United States Patent 11,492,591 (UNIVERSAL DONOR STEM CELLS AND RELATED METHODS) - sequence listing, part 9

SEQ ID NO: 265776 - DNA, 20 bp, Artificial
  CRISPR gRNA sequence
agttagacaggacatattca

SEQ ID NO: 265777 - DNA, 20 bp, Artificial
  CRISPR gRNA sequence
gacaggacatattcagcaaa

SEQ ID NO: 265778 - DNA, 20 bp, Artificial
  CRISPR gRNA sequence
agcaaaccactggactctag

SEQ ID NO: 265779 - DNA, 20 bp, Artificial
  CRISPR gRNA sequence
gactctagatgccacagctt

SEQ ID NO: 265780 - DNA, 20 bp, Artificial
  CRISPR gRNA sequence
tagatgccacagcttttctt

SEQ ID NO: 265781 - DNA, 20 bp, Artificial
  CRISPR gRNA sequence
gatgccacagcttttcttcc

SEQ ID NO: 265782 - DNA, 20 bp, Artificial
  CRISPR gRNA sequence
ttcttccttcctctctctcc

SEQ ID NO: 265783 - DNA, 20 bp, Artificial
  CRISPR gRNA sequence
tcttccttcctctctctccc

SEQ ID NO: 265784 - DNA, 20 bp, Artificial
  CRISPR gRNA sequence
cttccttcctctctctccct

SEQ ID NO: 265785 - DNA, 20 bp, Artificial
  CRISPR gRNA sequence
ttccttcctctctctccctt

SEQ ID NO: 265786 - DNA, 20 bp, Artificial
  CRISPR gRNA sequence
ccttcctctctctcccttcc

SEQ ID NO: 265787 - DNA, 20 bp, Artificial
  CRISPR gRNA sequence
cttcctctctctcccttccc

SEQ ID NO: 265788 - DNA, 20 bp, Artificial
  CRISPR gRNA sequence
cctctctctcccttccctct

SEQ ID NO: 265789 - DNA, 20 bp, Artificial
  CRISPR gRNA sequence
ctctctctcccttccctctc

SEQ ID NO: 265790 - DNA, 20 bp, Artificial
  CRISPR gRNA sequence
tctctcccttccctctctcc

SEQ ID NO: 265791 - DNA, 20 bp, Artificial
  CRISPR gRNA sequence
tctcccttccctctctccac

SEQ ID NO: 265792 - DNA, 20 bp, Artificial
  CRISPR gRNA sequence
tcccttccctctctccacct

SEQ ID NO: 265793 - DNA, 20 bp, Artificial
  CRISPR gRNA sequence
ccttccctctctccacctca

SEQ ID NO: 265794 - DNA, 20 bp, Artificial
  CRISPR gRNA sequence
ccctctctccacctcactgt

SEQ ID NO: 265795 - DNA, 20 bp, Artificial
  CRISPR gRNA sequence
cctctctccacctcactgtg

SEQ ID NO: 265796 - DNA, 20 bp, Artificial
  CRISPR gRNA sequence
tctccacctcactgtgtgtg

SEQ ID NO: 265797 - DNA, 20 bp, Artificial
  CRISPR gRNA sequence
tccacctcactgtgtgtgct

SEQ ID NO: 265798 - DNA, 20 bp, Artificial
  CRISPR gRNA sequence
cacctcactgtgtgtgctgg

SEQ ID NO: 265799 - DNA, 20 bp, Artificial
  CRISPR gRNA sequence
actgtgtgtgctgggagagg

SEQ ID NO: 265800 - DNA, 20 bp, Artificial
  CRISPR gRNA sequence
tgtgtgctgggagagggagt

SEQ ID NO: 265801 - DNA, 20 bp, Artificial
  CRISPR gRNA sequence
ggagagggagtcaaactggg

SEQ ID NO: 265802 - DNA, 20 bp, Artificial
  CRISPR gRNA sequence
gggagccatctggggtttct

SEQ ID NO: 265803 - DNA, 20 bp, Artificial
  CRISPR gRNA sequence
gggtttctctccagcccacc

SEQ ID NO: 265804 - DNA, 20 bp, Artificial
  CRISPR gRNA sequence
ctctccagcccacccacact

SEQ ID NO: 265805 - DNA, 20 bp, Artificial
  CRISPR gRNA sequence
tctccagcccacccacactc

SEQ ID NO: 265806 - DNA, 20 bp, Artificial
  CRISPR gRNA sequence
tccagcccacccacactccc

SEQ ID NO: 265807 - DNA, 20 bp, Artificial
  CRISPR gRNA sequence
cagcccacccacactccctt

SEQ ID NO: 265808 - DNA, 20 bp, Artificial
  CRISPR gRNA sequence
cctttttttgtctccacaaa

SEQ ID NO: 265809 - DNA, 20 bp, Artificial
  CRISPR gRNA sequence
tttttgtctccacaaagaag

SEQ ID NO: 265810 - DNA, 20 bp, Artificial
  CRISPR gRNA sequence
ttttgtctccacaaagaagt

SEQ ID NO: 265811 - DNA, 20 bp, Artificial
  CRISPR gRNA sequence
tttgtctccacaaagaagtc

SEQ ID NO: 265812 - DNA, 20 bp, Artificial
  CRISPR gRNA sequence
ttgtctccacaaagaagtcc

SEQ ID NO: 265813 - DNA, 20 bp, Artificial
  CRISPR gRNA sequence
tgtctccacaaagaagtcct

SEQ ID NO: 265814 - DNA, 20 bp, Artificial
  CRISPR gRNA sequence
gtctccacaaagaagtccta

SEQ ID NO: 265815 - DNA, 20 bp, Artificial
  CRISPR gRNA sequence
tctccacaaagaagtcctat

SEQ ID NO: 265816 - DNA, 20 bp, Artificial
  CRISPR gRNA sequence
cacaaagaagtcctattctc

SEQ ID NO: 265817 - DNA, 20 bp, Artificial
  CRISPR gRNA sequence
ttctcattcccatctttttc

SEQ ID NO: 265818 - DNA, 20 bp, Artificial
  CRISPR gRNA sequence
tcattcccatctttttcttt

SEQ ID NO: 265819 - DNA, 20 bp, Artificial
  CRISPR gRNA sequence
attcccatctttttctttaa

SEQ ID NO: 265820 - DNA, 20 bp, Artificial
  CRISPR gRNA sequence
ccatctttttctttaaatca

SEQ ID NO: 265821 - DNA, 20 bp, Artificial
  CRISPR gRNA sequence
tttctttaaatcagctcaca

SEQ ID NO: 265822 - DNA, 20 bp, Artificial
  CRISPR gRNA sequence
ttctttaaatcagctcacaa

SEQ ID NO: 265823 - DNA, 20 bp, Artificial
  CRISPR gRNA sequence
tctttaaatcagctcacaaa

SEQ ID NO: 265824 - DNA, 20 bp, Artificial
  CRISPR gRNA sequence
ctttaaatcagctcacaaag

SEQ ID NO: 265825 - DNA, 20 bp, Artificial
  CRISPR gRNA sequence
tttaaatcagctcacaaagg

SEQ ID NO: 265826 - DNA, 20 bp, Artificial
  CRISPR gRNA sequence
taaatcagctcacaaaggca

SEQ ID NO: 265827 - DNA, 20 bp, Artificial
  CRISPR gRNA sequence
aaatcagctcacaaaggcag

SEQ ID NO: 265828 - DNA, 20 bp, Artificial
  CRISPR gRNA sequence
aatcagctcacaaaggcaga

SEQ ID NO: 265829 - DNA, 20 bp, Artificial
  CRISPR gRNA sequence
acaaaggcagatcaggaaga

SEQ ID NO: 265830 - DNA, 20 bp, Artificial
  CRISPR gRNA sequence
gaatgtgcattaaaacagaa

SEQ ID NO: 265831 - DNA, 20 bp, Artificial
  CRISPR gRNA sequence
aatgtgcattaaaacagaat

SEQ ID NO: 265832 - DNA, 20 bp, Artificial
  CRISPR gRNA sequence
aaacagaatccaaataatta

SEQ ID NO: 265833 - DNA, 20 bp, Artificial
  CRISPR gRNA sequence
gcaatagaaacacaattccc

SEQ ID NO: 265834 - DNA, 20 bp, Artificial
  CRISPR gRNA sequence
ccagggcggtgagcaagcag

SEQ ID NO: 265835 - DNA, 20 bp, Artificial
  CRISPR gRNA sequence
acctgcactcactctctgaa

SEQ ID NO: 265836 - DNA, 20 bp, Artificial
  CRISPR gRNA sequence
cactcactctctgaaaagga

SEQ ID NO: 265837 - DNA, 20 bp, Artificial
  CRISPR gRNA sequence
actctctgaaaaggaggaga

SEQ ID NO: 265838 - DNA, 20 bp, Artificial
  CRISPR gRNA sequence
tctgaaaaggaggagagatg

SEQ ID NO: 265839 - DNA, 20 bp, Artificial
  CRISPR gRNA sequence
tgaaaaggaggagagatgca

SEQ ID NO: 265840 - DNA, 20 bp, Artificial
  CRISPR gRNA sequence
aaaaggaggagagatgcagg

SEQ ID NO: 265841 - DNA, 20 bp, Artificial
  CRISPR gRNA sequence
cttgctggagttggttgctc

SEQ ID NO: 265842 - DNA, 20 bp, Artificial
  CRISPR gRNA sequence
gctggagttggttgctcttc

SEQ ID NO: 265843 - DNA, 20 bp, Artificial
  CRISPR gRNA sequence
ctggagttggttgctcttcc

SEQ ID NO: 265844 - DNA, 20 bp, Artificial
  CRISPR gRNA sequence
gagttggttgctcttccaat

SEQ ID NO: 265845 - DNA, 20 bp, Artificial
  CRISPR gRNA sequence
gttgctcttccaattagaac

SEQ ID NO: 265846 - DNA, 20 bp, Artificial
  CRISPR gRNA sequence
ctcttccaattagaactgac

SEQ ID NO: 265847 - DNA, 20 bp, Artificial
  CRISPR gRNA sequence
ttccaattagaactgaccta

SEQ ID NO: 265848 - DNA, 20 bp, Artificial
  CRISPR gRNA sequence
ccaattagaactgacctaat

SEQ ID NO: 265849 - DNA, 20 bp, Artificial
  CRISPR gRNA sequence
caattagaactgacctaatg

SEQ ID NO: 265850 - DNA, 20 bp, Artificial
  CRISPR gRNA sequence
gaactgacctaatgactcct

SEQ ID NO: 265851 - DNA, 20 bp, Artificial
  CRISPR gRNA sequence
acctaatgactccttctaag

SEQ ID NO: 265852 - DNA, 20 bp, Artificial
  CRISPR gRNA sequence
atgactccttctaagtaaaa

SEQ ID NO: 265853 - DNA, 20 bp, Artificial
  CRISPR gRNA sequence
cttctaagtaaaaaaaggaa

SEQ ID NO: 265854 - DNA, 20 bp, Artificial
  CRISPR gRNA sequence
ctaagtaaaaaaaggaaaca

SEQ ID NO: 265855 - DNA, 20 bp, Artificial
  CRISPR gRNA sequence
taagtaaaaaaaggaaacaa

SEQ ID NO: 265856 - DNA, 20 bp, Artificial
  CRISPR gRNA sequence
agtaaaaaaaggaaacaaac

SEQ ID NO: 265857 - DNA, 20 bp, Artificial
  CRISPR gRNA sequence
gatgtttgtattaagacagg

SEQ ID NO: 265858 - DNA, 20 bp, Artificial
  CRISPR gRNA sequence
gtattaagacaggtcgaact

SEQ ID NO: 265859 - DNA, 20 bp, Artificial
  CRISPR gRNA sequence
tattaagacaggtcgaactt

SEQ ID NO: 265860 - DNA, 20 bp, Artificial
  CRISPR gRNA sequence
agacaggtcgaactttttga

SEQ ID NO: 265861 - DNA, 20 bp, Artificial
  CRISPR gRNA sequence
tttgattctttgcatgttta

SEQ ID NO: 265862 - DNA, 20 bp, Artificial
  CRISPR gRNA sequence
ttgattctttgcatgtttat

SEQ ID NO: 265863 - DNA, 20 bp, Artificial
  CRISPR gRNA sequence
tgattctttgcatgtttatt

SEQ ID NO: 265864 - DNA, 20 bp, Artificial
  CRISPR gRNA sequence
gattctttgcatgtttattt

SEQ ID NO: 265865 - DNA, 20 bp, Artificial
  CRISPR gRNA sequence
attctttgcatgtttatttt

SEQ ID NO: 265866 - DNA, 20 bp, Artificial
  CRISPR gRNA sequence
tttgcatgtttatttttcag

SEQ ID NO: 265867 - DNA, 20 bp, Artificial
  CRISPR gRNA sequence
tgcatgtttatttttcagtg

SEQ ID NO: 265868 - DNA, 20 bp, Artificial
  CRISPR gRNA sequence
gcatgtttatttttcagtgc

SEQ ID NO: 265869 - DNA, 20 bp, Artificial
  CRISPR gRNA sequence
catgtttatttttcagtgct

SEQ ID NO: 265870 - DNA, 20 bp, Artificial
  CRISPR gRNA sequence
atttttcagtgcttttgcaa

SEQ ID NO: 265871 - DNA, 20 bp, Artificial
  CRISPR gRNA sequence
tttttcagtgcttttgcaaa

SEQ ID NO: 265872 - DNA, 20 bp, Artificial
  CRISPR gRNA sequence
ttcagtgcttttgcaaaata

SEQ ID NO: 265873 - DNA, 20 bp, Artificial
  CRISPR gRNA sequence
tcagtgcttttgcaaaatat

SEQ ID NO: 265874 - DNA, 20 bp, Artificial
  CRISPR gRNA sequence
cagtgcttttgcaaaatatt

SEQ ID NO: 265875 - DNA, 20 bp, Artificial
  CRISPR gRNA sequence
agtgcttttgcaaaatattt

SEQ ID NO: 265876 - DNA, 20 bp, Artificial
  CRISPR gRNA sequence
ttgcaaaatatttgtggaac

SEQ ID NO: 265877 - DNA, 20 bp, Artificial
  CRISPR gRNA sequence
tgcaaaatatttgtggaaca

SEQ ID NO: 265878 - DNA, 20 bp, Artificial
  CRISPR gRNA sequence
gcaaaatatttgtggaacaa

SEQ ID NO: 265879 - DNA, 20 bp, Artificial
  CRISPR gRNA sequence
caaaatatttgtggaacaaa

SEQ ID NO: 265880 - DNA, 20 bp, Artificial
  CRISPR gRNA sequence
gtggaacaaataataggtga

SEQ ID NO: 265881 - DNA, 20 bp, Artificial
  CRISPR gRNA sequence
tggaacaaataataggtgaa

SEQ ID NO: 265882 - DNA, 20 bp, Artificial
  CRISPR gRNA sequence
aagttgttgacacaggtttc

SEQ ID NO: 265883 - DNA, 20 bp, Artificial
  CRISPR gRNA sequence
ttgacacaggtttccaaaaa

SEQ ID NO: 265884 - DNA, 20 bp, Artificial
  CRISPR gRNA sequence
acacaggtttccaaaaagga

SEQ ID NO: 265885 - DNA, 20 bp, Artificial
  CRISPR gRNA sequence
ccaaaaaggatttaatgaga

SEQ ID NO: 265886 - DNA, 20 bp, Artificial
  CRISPR gRNA sequence
caaaaaggatttaatgagat

SEQ ID NO: 265887 - DNA, 20 bp, Artificial
  CRISPR gRNA sequence
aatgagatggtagtcaaacc

SEQ ID NO: 265888 - DNA, 20 bp, Artificial
  CRISPR gRNA sequence
atgagatggtagtcaaacct

SEQ ID NO: 265889 - DNA, 20 bp, Artificial
  CRISPR gRNA sequence
gctgctgataacaacaatac

SEQ ID NO: 265890 - DNA, 20 bp, Artificial
  CRISPR gRNA sequence
ctgataacaacaatacagcc

SEQ ID NO: 265891 - DNA, 20 bp, Artificial
  CRISPR gRNA sequence
ataacaacaatacagccgaa

SEQ ID NO: 265892 - DNA, 20 bp, Artificial
  CRISPR gRNA sequence
tcactccacaattattttat

SEQ ID NO: 265893 - DNA, 20 bp, Artificial
  CRISPR gRNA sequence
cactccacaattattttatg

SEQ ID NO: 265894 - DNA, 20 bp, Artificial
  CRISPR gRNA sequence
actccacaattattttatga

SEQ ID NO: 265895 - DNA, 20 bp, Artificial
  CRISPR gRNA sequence
cacaattattttatgagagt

SEQ ID NO: 265896 - DNA, 20 bp, Artificial
  CRISPR gRNA sequence
ttttatgagagtctattagt

SEQ ID NO: 265897 - DNA, 20 bp, Artificial
  CRISPR gRNA sequence
tatgagagtctattagtcat

SEQ ID NO: 265898 - DNA, 20 bp, Artificial
  CRISPR gRNA sequence
atgagagtctattagtcata

SEQ ID NO: 265899 - DNA, 20 bp, Artificial
  CRISPR gRNA sequence
tgagagtctattagtcatac

SEQ ID NO: 265900 - DNA, 20 bp, Artificial
  CRISPR gRNA sequence
ttagtcatactgtgttatgt

SEQ ID NO: 265901 - DNA, 20 bp, Artificial
  CRISPR gRNA sequence
gtcatactgtgttatgtaaa

SEQ ID NO: 265902 - DNA, 20 bp, Artificial
  CRISPR gRNA sequence
tgttatgtaaagaagcataa

SEQ ID NO: 265903 - DNA, 20 bp, Artificial
  CRISPR gRNA sequence
tgtaaagaagcataacatgt

SEQ ID NO: 265904 - DNA, 20 bp, Artificial
  CRISPR gRNA sequence
tctgtcaagagacttggaaa

SEQ ID NO: 265905 - DNA, 20 bp, Artificial
  CRISPR gRNA sequence
ctgtcaagagacttggaaac

SEQ ID NO: 265906 - DNA, 20 bp, Artificial
  CRISPR gRNA sequence
tgtcaagagacttggaaacc

SEQ ID NO: 265907 - DNA, 20 bp, Artificial
  CRISPR gRNA sequence
tcaagagacttggaaaccag

SEQ ID NO: 265908 - DNA, 20 bp, Artificial
  CRISPR gRNA sequence
ggaaaccaggggcctaaggg

SEQ ID NO: 265909 - DNA, 20 bp, Artificial
  CRISPR gRNA sequence
gaaaccaggggcctaaggga

SEQ ID NO: 265910 - DNA, 20 bp, Artificial
  CRISPR gRNA sequence
agggaaatgcacatgaatcc

SEQ ID NO: 265911 - DNA, 20 bp, Artificial
  CRISPR gRNA sequence
agcaaattgaagcatgtgaa

SEQ ID NO: 265912 - DNA, 20 bp, Artificial
  CRISPR gRNA sequence
aagcatgtgaaacaagagtt

SEQ ID NO: 265913 - DNA, 20 bp, Artificial
  CRISPR gRNA sequence
tttaaaaggtagaactcaaa

SEQ ID NO: 265914 - DNA, 20 bp, Artificial
  CRISPR gRNA sequence
aaaaggtagaactcaaatgt

SEQ ID NO: 265915 - DNA, 20 bp, Artificial
  CRISPR gRNA sequence
aaaggtagaactcaaatgtc

SEQ ID NO: 265916 - DNA, 20 bp, Artificial
  CRISPR gRNA sequence
aaatgtcaagtgagcgatac

SEQ ID NO: 265917 - DNA, 20 bp, Artificial
  CRISPR gRNA sequence
tgagacctgagaagggagtg

SEQ ID NO: 265918 - DNA, 20 bp, Artificial
  CRISPR gRNA sequence
gagacctgagaagggagtgg

SEQ ID NO: 265919 - DNA, 20 bp, Artificial
  CRISPR gRNA sequence
agacctgagaagggagtggt

SEQ ID NO: 265920 - DNA, 20 bp, Artificial
  CRISPR gRNA sequence
agaagggagtggtgctctgt

SEQ ID NO: 265921 - DNA, 20 bp, Artificial
  CRISPR gRNA sequence
tgtgccaaggagttagtaga

SEQ ID NO: 265922 - DNA, 20 bp, Artificial
  CRISPR gRNA sequence
tgccaaggagttagtagaca

SEQ ID NO: 265923 - DNA, 20 bp, Artificial
  CRISPR gRNA sequence
gtagacaaggcatggaggta

SEQ ID NO: 265924 - DNA, 20 bp, Artificial
  CRISPR gRNA sequence
acagtctgttcttgggatgt

SEQ ID NO: 265925 - DNA, 20 bp, Artificial
  CRISPR gRNA sequence
ttcttgggatgttggcttaa

SEQ ID NO: 265926 - DNA, 20 bp, Artificial
  CRISPR gRNA sequence
ttgggatgttggcttaaatg

SEQ ID NO: 265927 - DNA, 20 bp, Artificial
  CRISPR gRNA sequence
gggatgttggcttaaatggt

SEQ ID NO: 265928 - DNA, 20 bp, Artificial
  CRISPR gRNA sequence
ggatgttggcttaaatggtc

SEQ ID NO: 265929 - DNA, 20 bp, Artificial
  CRISPR gRNA sequence
gcttaaatggtctaattagg

SEQ ID NO: 265930 - DNA, 20 bp, Artificial
  CRISPR gRNA sequence
aaatggtctaattaggaggg

SEQ ID NO: 265931 - DNA, 20 bp, Artificial
  CRISPR gRNA sequence
aatggtctaattaggagggc

SEQ ID NO: 265932 - DNA, 20 bp, Artificial
  CRISPR gRNA sequence
attaggagggcttcggtttg

SEQ ID NO: 265933 - DNA, 20 bp, Artificial
  CRISPR gRNA sequence
ggagggcttcggtttgagga

SEQ ID NO: 265934 - DNA, 20 bp, Artificial
  CRISPR gRNA sequence
cggtttgaggaaatgaggtt

SEQ ID NO: 265935 - DNA, 20 bp, Artificial
  CRISPR gRNA sequence
ggtttgaggaaatgaggttg

SEQ ID NO: 265936 - DNA, 20 bp, Artificial
  CRISPR gRNA sequence
gaggaaatgaggttggaaaa

SEQ ID NO: 265937 - DNA, 20 bp, Artificial
  CRISPR gRNA sequence
aggaaatgaggttggaaaaa

SEQ ID NO: 265938 - DNA, 20 bp, Artificial
  CRISPR gRNA sequence
gaaaaacctgtggaggccga

SEQ ID NO: 265939 - DNA, 20 bp, Artificial
  CRISPR gRNA sequence
tggaggccgatttgaggata

SEQ ID NO: 265940 - DNA, 20 bp, Artificial
  CRISPR gRNA sequence
gaggataagaagttagtttt

SEQ ID NO: 265941 - DNA, 20 bp, Artificial
  CRISPR gRNA sequence
aggataagaagttagttttc

SEQ ID NO: 265942 - DNA, 20 bp, Artificial
  CRISPR gRNA sequence
gttttcctctgttaggccac

SEQ ID NO: 265943 - DNA, 20 bp, Artificial
  CRISPR gRNA sequence
tcctctgttaggccactggt

SEQ ID NO: 265944 - DNA, 20 bp, Artificial
  CRISPR gRNA sequence
cctctgttaggccactggtt

SEQ ID NO: 265945 - DNA, 20 bp, Artificial
  CRISPR gRNA sequence
ctctgttaggccactggttc

SEQ ID NO: 265946 - DNA, 20 bp, Artificial
  CRISPR gRNA sequence
tgttaggccactggttctca

SEQ ID NO: 265947 - DNA, 20 bp, Artificial
  CRISPR gRNA sequence
ttaggccactggttctcaaa

SEQ ID NO: 265948 - DNA, 20 bp, Artificial
  CRISPR gRNA sequence
ggccactggttctcaaattt

SEQ ID NO: 265949 - DNA, 20 bp, Artificial
  CRISPR gRNA sequence
gttctcaaatttgactgcca

SEQ ID NO: 265950 - DNA, 20 bp, Artificial
  CRISPR gRNA sequence
tcaaatttgactgccatcta

SEQ ID NO: 265951 - DNA, 20 bp, Artificial
  CRISPR gRNA sequence
aaatttgactgccatctaga

SEQ ID NO: 265952 - DNA, 20 bp, Artificial
  CRISPR gRNA sequence
gactgccatctagaattact

SEQ ID NO: 265953 - DNA, 20 bp, Artificial
  CRISPR gRNA sequence
actgccatctagaattacta

SEQ ID NO: 265954 - DNA, 20 bp, Artificial
  CRISPR gRNA sequence
ccatctagaattactagaga

SEQ ID NO: 265955 - DNA, 20 bp, Artificial
  CRISPR gRNA sequence
gaattactagagaaacttaa

SEQ ID NO: 265956 - DNA, 20 bp, Artificial
  CRISPR gRNA sequence
ctagagaaacttaaaaaata

SEQ ID NO: 265957 - DNA, 20 bp, Artificial
  CRISPR gRNA sequence
gagaaacttaaaaaatatga

SEQ ID NO: 265958 - DNA, 20 bp, Artificial
  CRISPR gRNA sequence
aaaaaatatgaatggatgcc

SEQ ID NO: 265959 - DNA, 20 bp, Artificial
  CRISPR gRNA sequence
aaaaatatgaatggatgcct

SEQ ID NO: 265960 - DNA, 20 bp, Artificial
  CRISPR gRNA sequence
ggtcctatacctagagattc

SEQ ID NO: 265961 - DNA, 20 bp, Artificial
  CRISPR gRNA sequence
tacctagagattctgattta

SEQ ID NO: 265962 - DNA, 20 bp, Artificial
  CRISPR gRNA sequence
gagattctgatttaattggc

SEQ ID NO: 265963 - DNA, 20 bp, Artificial
  CRISPR gRNA sequence
tgatttaattggccttggaa

SEQ ID NO: 265964 - DNA, 20 bp, Artificial
  CRISPR gRNA sequence
atttaattggccttggaaaa

SEQ ID NO: 265965 - DNA, 20 bp, Artificial
  CRISPR gRNA sequence
aattggccttggaaaaccaa

SEQ ID NO: 265966 - DNA, 20 bp, Artificial
  CRISPR gRNA sequence
attggccttggaaaaccaaa

SEQ ID NO: 265967 - DNA, 20 bp, Artificial
  CRISPR gRNA sequence
gccttggaaaaccaaaggct

SEQ ID NO: 265968 - DNA, 20 bp, Artificial
  CRISPR gRNA sequence
ggaaaaccaaaggcttttag

SEQ ID NO: 265969 - DNA, 20 bp, Artificial
  CRISPR gRNA sequence
gaaaaccaaaggcttttaga

SEQ ID NO: 265970 - DNA, 20 bp, Artificial
  CRISPR gRNA sequence
ttagatttttccaggtgatt

SEQ ID NO: 265971 - DNA, 20 bp, Artificial
  CRISPR gRNA sequence
tagatttttccaggtgattc

SEQ ID NO: 265972 - DNA, 20 bp, Artificial
  CRISPR gRNA sequence
agatttttccaggtgattct

SEQ ID NO: 265973 - DNA, 20 bp, Artificial
  CRISPR gRNA sequence
gatttttccaggtgattcta

SEQ ID NO: 265974 - DNA, 20 bp, Artificial
  CRISPR gRNA sequence
ttccaggtgattctaaatat

SEQ ID NO: 265975 - DNA, 20 bp, Artificial
  CRISPR gRNA sequence
tccaggtgattctaaatatg

SEQ ID NO: 265976 - DNA, 20 bp, Artificial
  CRISPR gRNA sequence
ccaggtgattctaaatatgt

SEQ ID NO: 265977 - DNA, 20 bp, Artificial
  CRISPR gRNA sequence
caggtgattctaaatatgtt

SEQ ID NO: 265978 - DNA, 20 bp, Artificial
  CRISPR gRNA sequence
taaatatgttgtcaggtgaa

SEQ ID NO: 265979 - DNA, 20 bp, Artificial
  CRISPR gRNA sequence
aatatgttgtcaggtgaatt

SEQ ID NO: 265980 - DNA, 20 bp, Artificial
  CRISPR gRNA sequence
tcaggtgaattccactaggc

SEQ ID NO: 265981 - DNA, 20 bp, Artificial
  CRISPR gRNA sequence
cactaggccatagtggcttt

SEQ ID NO: 265982 - DNA, 20 bp, Artificial
  CRISPR gRNA sequence
ggccatagtggctttcaacc

SEQ ID NO: 265983 - DNA, 20 bp, Artificial
  CRISPR gRNA sequence
tcaacccaattgaatattag

SEQ ID NO: 265984 - DNA, 20 bp, Artificial
  CRISPR gRNA sequence
caacccaattgaatattaga

SEQ ID NO: 265985 - DNA, 20 bp, Artificial
  CRISPR gRNA sequence
aacccaattgaatattagaa

SEQ ID NO: 265986 - DNA, 20 bp, Artificial
  CRISPR gRNA sequence
aatattagaatcaagtgggg

SEQ ID NO: 265987 - DNA, 20 bp, Artificial
  CRISPR gRNA sequence
gaatcaagtgggggaacttt

SEQ ID NO: 265988 - DNA, 20 bp, Artificial
  CRISPR gRNA sequence
ttaagataatatgaaagaca

SEQ ID NO: 265989 - DNA, 20 bp, Artificial
  CRISPR gRNA sequence
taagataatatgaaagacaa

SEQ ID NO: 265990 - DNA, 20 bp, Artificial
  CRISPR gRNA sequence
aagataatatgaaagacaat

SEQ ID NO: 265991 - DNA, 20 bp, Artificial
  CRISPR gRNA sequence
agataatatgaaagacaatc

SEQ ID NO: 265992 - DNA, 20 bp, Artificial
  CRISPR gRNA sequence
acaaatcacatatctgataa

SEQ ID NO: 265993 - DNA, 20 bp, Artificial
  CRISPR gRNA sequence
caaatcacatatctgataag

SEQ ID NO: 265994 - DNA, 20 bp, Artificial
  CRISPR gRNA sequence
ataagaaacttgtatcaagg

SEQ ID NO: 265995 - DNA, 20 bp, Artificial
  CRISPR gRNA sequence
gtatcaaggctgaggcaggc

SEQ ID NO: 265996 - DNA, 20 bp, Artificial
  CRISPR gRNA sequence
tatcaaggctgaggcaggca

SEQ ID NO: 265997 - DNA, 20 bp, Artificial
  CRISPR gRNA sequence
aggcaggcagatcatctgag

SEQ ID NO: 265998 - DNA, 20 bp, Artificial
  CRISPR gRNA sequence
aggtcaggagtttgagacca

SEQ ID NO: 265999 - DNA, 20 bp, Artificial
  CRISPR gRNA sequence
gagaccagcctggcccacat

SEQ ID NO: 266000 - DNA, 20 bp, Artificial
  CRISPR gRNA sequence
agaccagcctggcccacatg

SEQ ID NO: 266001 - DNA, 20 bp, Artificial
  CRISPR gRNA sequence
gcccacatggagaaacccca

SEQ ID NO: 266002 - DNA, 20 bp, Artificial
  CRISPR gRNA sequence
tactaaaaatataaaaatta

SEQ ID NO: 266003 - DNA, 20 bp, Artificial
  CRISPR gRNA sequence
ctaaaaatataaaaattagc

SEQ ID NO: 266004 - DNA, 20 bp, Artificial
  CRISPR gRNA sequence
aaaatataaaaattagctgg

SEQ ID NO: 266005 - DNA, 20 bp, Artificial
  CRISPR gRNA sequence
gctgggggtggtggtggtca

SEQ ID NO: 266006 - DNA, 20 bp, Artificial
  CRISPR gRNA sequence
ggggtggtggtggtcacctc

SEQ ID NO: 266007 - DNA, 20 bp, Artificial
  CRISPR gRNA sequence
caattccagctactcgggag

SEQ ID NO: 266008 - DNA, 20 bp, Artificial
  CRISPR gRNA sequence
cagctactcgggaggctgag

SEQ ID NO: 266009 - DNA, 20 bp, Artificial
  CRISPR gRNA sequence
ctcgggaggctgaggcagga

SEQ ID NO: 266010 - DNA, 20 bp, Artificial
  CRISPR gRNA sequence
gggaggctgaggcaggagga

SEQ ID NO: 266011 - DNA, 20 bp, Artificial
  CRISPR gRNA sequence
aggcaggaggattgcttgat

SEQ ID NO: 266012 - DNA, 20 bp, Artificial
  CRISPR gRNA sequence
cttgattctgggtggcagag

SEQ ID NO: 266013 - DNA, 20 bp, Artificial
  CRISPR gRNA sequence
gattctgggtggcagaggct

SEQ ID NO: 266014 - DNA, 20 bp, Artificial
  CRISPR gRNA sequence
attctgggtggcagaggctg

SEQ ID NO: 266015 - DNA, 20 bp, Artificial
  CRISPR gRNA sequence
tgggtggcagaggctgcagt

SEQ ID NO: 266016 - DNA, 20 bp, Artificial
  CRISPR gRNA sequence
ggtggcagaggctgcagtga

SEQ ID NO: 266017 - DNA, 20 bp, Artificial
  CRISPR gRNA sequence
cagtgagccaagatcatgcc

SEQ ID NO: 266018 - DNA, 20 bp, Artificial
  CRISPR gRNA sequence
cactccagcctgggtgacag

SEQ ID NO: 266019 - DNA, 20 bp, Artificial
  CRISPR gRNA sequence
cagcctgggtgacagagtga

SEQ ID NO: 266020 - DNA, 20 bp, Artificial
  CRISPR gRNA sequence
ggtgacagagtgagactctg

SEQ ID NO: 266021 - DNA, 20 bp, Artificial
  CRISPR gRNA sequence
tgtaaaaataaaaaaaaaaa

SEQ ID NO: 266022 - DNA, 20 bp, Artificial
  CRISPR gRNA sequence
taaaaataaaaaaaaaaaag

SEQ ID NO: 266023 - DNA, 20 bp, Artificial
  CRISPR gRNA sequence
caataattcaataataaaaa

SEQ ID NO: 266024 - DNA, 20 bp, Artificial
  CRISPR gRNA sequence
aataataaaaagataaatag

SEQ ID NO: 266025 - DNA, 20 bp, Artificial
  CRISPR gRNA sequence
accagttaataaatgggcaa

SEQ ID NO: 266026 - DNA, 20 bp, Artificial
  CRISPR gRNA sequence
ataaatgggcaaatgatctg

SEQ ID NO: 266027 - DNA, 20 bp, Artificial
  CRISPR gRNA sequence
aatagagagttctctaaaaa

SEQ ID NO: 266028 - DNA, 20 bp, Artificial
  CRISPR gRNA sequence
tctaaaaagaatagaccaat

SEQ ID NO: 266029 - DNA, 20 bp, Artificial
  CRISPR gRNA sequence
taaaaagaatagaccaatgg

SEQ ID NO: 266030 - DNA, 20 bp, Artificial
  CRISPR gRNA sequence
aaaagaatagaccaatggct

SEQ ID NO: 266031 - DNA, 20 bp, Artificial
  CRISPR gRNA sequence
ataagcacatgaaaagatgc

SEQ ID NO: 266032 - DNA, 20 bp, Artificial
  CRISPR gRNA sequence
agcatcattagttattagag

SEQ ID NO: 266033 - DNA, 20 bp, Artificial
  CRISPR gRNA sequence
gcatcattagttattagaga

SEQ ID NO: 266034 - DNA, 20 bp, Artificial
  CRISPR gRNA sequence
gttattagagaaatagcaaa

SEQ ID NO: 266035 - DNA, 20 bp, Artificial
  CRISPR gRNA sequence
ttagagaaatagcaaatcaa

SEQ ID NO: 266036 - DNA, 20 bp, Artificial
  CRISPR gRNA sequence
gagaaatagcaaatcaaacc

SEQ ID NO: 266037 - DNA, 20 bp, Artificial
  CRISPR gRNA sequence
cacgtccaccaggatggcta

SEQ ID NO: 266038 - DNA, 20 bp, Artificial
  CRISPR gRNA sequence
acgtccaccaggatggctat

SEQ ID NO: 266039 - DNA, 20 bp, Artificial
  CRISPR gRNA sequence
taatagaaaagatgaacaat

SEQ ID NO: 266040 - DNA, 20 bp, Artificial
  CRISPR gRNA sequence
gagccctcattcactgctgg

SEQ ID NO: 266041 - DNA, 20 bp, Artificial
  CRISPR gRNA sequence
attcactgctggtgagaatg

SEQ ID NO: 266042 - DNA, 20 bp, Artificial
  CRISPR gRNA sequence
actgctggtgagaatgtaca

SEQ ID NO: 266043 - DNA, 20 bp, Artificial
  CRISPR gRNA sequence
ctggtgagaatgtacaatgg

SEQ ID NO: 266044 - DNA, 20 bp, Artificial
  CRISPR gRNA sequence
gtgagaatgtacaatggtgc

SEQ ID NO: 266045 - DNA, 20 bp, Artificial
  CRISPR gRNA sequence
ctttggcaacagtttgacga

SEQ ID NO: 266046 - DNA, 20 bp, Artificial
  CRISPR gRNA sequence
tggcaacagtttgacgattc

SEQ ID NO: 266047 - DNA, 20 bp, Artificial
  CRISPR gRNA sequence
ggcaacagtttgacgattcc

SEQ ID NO: 266048 - DNA, 20 bp, Artificial
  CRISPR gRNA sequence
gcaacagtttgacgattcct

SEQ ID NO: 266049 - DNA, 20 bp, Artificial
  CRISPR gRNA sequence
gacgattcctcaaaaagtta

SEQ ID NO: 266050 - DNA, 20 bp, Artificial
  CRISPR gRNA sequence
acgattcctcaaaaagttaa

SEQ ID NO: 266051 - DNA, 20 bp, Artificial
  CRISPR gRNA sequence
ctcaaaaagttaaacataga

SEQ ID NO: 266052 - DNA, 20 bp, Artificial
  CRISPR gRNA sequence
aaaaagttaaacatagagtt

SEQ ID NO: 266053 - DNA, 20 bp, Artificial
  CRISPR gRNA sequence
aacatagagttaccatatga

SEQ ID NO: 266054 - DNA, 20 bp, Artificial
  CRISPR gRNA sequence
ccatatgacccagcaatttt

SEQ ID NO: 266055 - DNA, 20 bp, Artificial
  CRISPR gRNA sequence
tactgctggcaaatacctaa

SEQ ID NO: 266056 - DNA, 20 bp, Artificial
  CRISPR gRNA sequence
actgctggcaaatacctaag

SEQ ID NO: 266057 - DNA, 20 bp, Artificial
  CRISPR gRNA sequence
ctgctggcaaatacctaaga

SEQ ID NO: 266058 - DNA, 20 bp, Artificial
  CRISPR gRNA sequence
ctggcaaatacctaagagag

SEQ ID NO: 266059 - DNA, 20 bp, Artificial
  CRISPR gRNA sequence
gcaaatacctaagagagttg

SEQ ID NO: 266060 - DNA, 20 bp, Artificial
  CRISPR gRNA sequence
agagagttgaaaacatacgt

SEQ ID NO: 266061 - DNA, 20 bp, Artificial
  CRISPR gRNA sequence
aaaacatacgtccacacaaa

SEQ ID NO: 266062 - DNA, 20 bp, Artificial
  CRISPR gRNA sequence
tatgcaaatgctcatagtag

SEQ ID NO: 266063 - DNA, 20 bp, Artificial
  CRISPR gRNA sequence
atagtagcattattcataat

SEQ ID NO: 266064 - DNA, 20 bp, Artificial
  CRISPR gRNA sequence
ttcataatagccaaaaagtg

SEQ ID NO: 266065 - DNA, 20 bp, Artificial
  CRISPR gRNA sequence
ataatagccaaaaagtgatg

SEQ ID NO: 266066 - DNA, 20 bp, Artificial
  CRISPR gRNA sequence
tttggccatgaagagtgaag

SEQ ID NO: 266067 - DNA, 20 bp, Artificial
  CRISPR gRNA sequence
ggccatgaagagtgaagttc

SEQ ID NO: 266068 - DNA, 20 bp, Artificial
  CRISPR gRNA sequence
gccatgaagagtgaagttct

SEQ ID NO: 266069 - DNA, 20 bp, Artificial
  CRISPR gRNA sequence
tggtgcatgcaacaacatgg

SEQ ID NO: 266070 - DNA, 20 bp, Artificial
  CRISPR gRNA sequence
gtgcatgcaacaacatggat

SEQ ID NO: 266071 - DNA, 20 bp, Artificial
  CRISPR gRNA sequence
gaaacatggatgaaacttga

SEQ ID NO: 266072 - DNA, 20 bp, Artificial
  CRISPR gRNA sequence
aaacatggatgaaacttgaa

SEQ ID NO: 266073 - DNA, 20 bp, Artificial
  CRISPR gRNA sequence
gaaaacattatgctaagtga

SEQ ID NO: 266074 - DNA, 20 bp, Artificial
  CRISPR gRNA sequence
aaaacattatgctaagtgaa

SEQ ID NO: 266075 - DNA, 20 bp, Artificial
  CRISPR gRNA sequence
tgctaagtgaaagaaacgag

SEQ ID NO: 266076 - DNA, 20 bp, Artificial
  CRISPR gRNA sequence
agtgaaagaaacgagacaca

SEQ ID NO: 266077 - DNA, 20 bp, Artificial
  CRISPR gRNA sequence
tacttataaaaaaagtccag

SEQ ID NO: 266078 - DNA, 20 bp, Artificial
  CRISPR gRNA sequence
cttataaaaaaagtccagaa

SEQ ID NO: 266079 - DNA, 20 bp, Artificial
  CRISPR gRNA sequence
ataaaaaaagtccagaatag

SEQ ID NO: 266080 - DNA, 20 bp, Artificial
  CRISPR gRNA sequence
taaaaaaagtccagaatagg

SEQ ID NO: 266081 - DNA, 20 bp, Artificial
  CRISPR gRNA sequence
atagggccaaagtagatcag

SEQ ID NO: 266082 - DNA, 20 bp, Artificial
  CRISPR gRNA sequence
ccagggatttaagggaggga

SEQ ID NO: 266083 - DNA, 20 bp, Artificial
  CRISPR gRNA sequence
cagggatttaagggagggag

SEQ ID NO: 266084 - DNA, 20 bp, Artificial
  CRISPR gRNA sequence
aagggagggaggaagcaggg

SEQ ID NO: 266085 - DNA, 20 bp, Artificial
  CRISPR gRNA sequence
agggagggaggaagcagggt

SEQ ID NO: 266086 - DNA, 20 bp, Artificial
  CRISPR gRNA sequence
ctttatggagtaatgaaaat

SEQ ID NO: 266087 - DNA, 20 bp, Artificial
  CRISPR gRNA sequence
tttatggagtaatgaaaatg

SEQ ID NO: 266088 - DNA, 20 bp, Artificial
  CRISPR gRNA sequence
tatggagtaatgaaaatgtt

SEQ ID NO: 266089 - DNA, 20 bp, Artificial
  CRISPR gRNA sequence
atggagtaatgaaaatgttc

SEQ ID NO: 266090 - DNA, 20 bp, Artificial
  CRISPR gRNA sequence
tggagtaatgaaaatgttct

SEQ ID NO: 266091 - DNA, 20 bp, Artificial
  CRISPR gRNA sequence
tggaatcagatagtggtgat

SEQ ID NO: 266092 - DNA, 20 bp, Artificial
  CRISPR gRNA sequence
gaatcagatagtggtgattc

SEQ ID NO: 266093 - DNA, 20 bp, Artificial
  CRISPR gRNA sequence
attcataactttgtgaatat

SEQ ID NO: 266094 - DNA, 20 bp, Artificial
  CRISPR gRNA sequence
ataactttgtgaatatacta

SEQ ID NO: 266095 - DNA, 20 bp, Artificial
  CRISPR gRNA sequence
tgtgaatatactaaaaaatc

SEQ ID NO: 266096 - DNA, 20 bp, Artificial
  CRISPR gRNA sequence
gtgaatatactaaaaaatct

SEQ ID NO: 266097 - DNA, 20 bp, Artificial
  CRISPR gRNA sequence
tgaatatactaaaaaatctc

SEQ ID NO: 266098 - DNA, 20 bp, Artificial
  CRISPR gRNA sequence
aaaaatctctgaattttaca

SEQ ID NO: 266099 - DNA, 20 bp, Artificial
  CRISPR gRNA sequence
tgaattttacactttaaaac

SEQ ID NO: 266100 - DNA, 20 bp, Artificial
  CRISPR gRNA sequence
aattttacactttaaaacag

SEQ ID NO: 266101 - DNA, 20 bp, Artificial
  CRISPR gRNA sequence
tacactttaaaacagcaaac

SEQ ID NO: 266102 - DNA, 20 bp, Artificial
  CRISPR gRNA sequence
acactttaaaacagcaaact

SEQ ID NO: 266103 - DNA, 20 bp, Artificial
  CRISPR gRNA sequence
cactttaaaacagcaaactt

SEQ ID NO: 266104 - DNA, 20 bp, Artificial
  CRISPR gRNA sequence
taaaacagcaaactttatag

SEQ ID NO: 266105 - DNA, 20 bp, Artificial
  CRISPR gRNA sequence
aaaacagcaaactttatagt

SEQ ID NO: 266106 - DNA, 20 bp, Artificial
  CRISPR gRNA sequence
aaacagcaaactttatagta

SEQ ID NO: 266107 - DNA, 20 bp, Artificial
  CRISPR gRNA sequence
tatagtacctgaattatatc

SEQ ID NO: 266108 - DNA, 20 bp, Artificial
  CRISPR gRNA sequence
atagtacctgaattatatct

SEQ ID NO: 266109 - DNA, 20 bp, Artificial
  CRISPR gRNA sequence
tagtacctgaattatatctc

SEQ ID NO: 266110 - DNA, 20 bp, Artificial
  CRISPR gRNA sequence
aattatatctcaataaagtt

SEQ ID NO: 266111 - DNA, 20 bp, Artificial
  CRISPR gRNA sequence
tatctcaataaagttattat

SEQ ID NO: 266112 - DNA, 20 bp, Artificial
  CRISPR gRNA sequence
aataaagttattatctaaaa

SEQ ID NO: 266113 - DNA, 20 bp, Artificial
  CRISPR gRNA sequence
ttatctaaaataaagaaaaa

SEQ ID NO: 266114 - DNA, 20 bp, Artificial
  CRISPR gRNA sequence
tctaaaataaagaaaaaaaa

SEQ ID NO: 266115 - DNA, 20 bp, Artificial
  CRISPR gRNA sequence
aaataaagaaaaaaaactta

SEQ ID NO: 266116 - DNA, 20 bp, Artificial
  CRISPR gRNA sequence
agtatcaatccttcccccca

SEQ ID NO: 266117 - DNA, 20 bp, Artificial
  CRISPR gRNA sequence
gtatcaatccttccccccag

SEQ ID NO: 266118 - DNA, 20 bp, Artificial
  CRISPR gRNA sequence
ccccccagcctagaccaatt

SEQ ID NO: 266119 - DNA, 20 bp, Artificial
  CRISPR gRNA sequence
cccccagcctagaccaatta

SEQ ID NO: 266120 - DNA, 20 bp, Artificial
  CRISPR gRNA sequence
gaccaattaaatcagaattt

SEQ ID NO: 266121 - DNA, 20 bp, Artificial
  CRISPR gRNA sequence
aatcagaatttccggaagtg

SEQ ID NO: 266122 - DNA, 20 bp, Artificial
  CRISPR gRNA sequence
ccggaagtgggaggacttgg

SEQ ID NO: 266123 - DNA, 20 bp, Artificial
  CRISPR gRNA sequence
cggaagtgggaggacttggg

SEQ ID NO: 266124 - DNA, 20 bp, Artificial
  CRISPR gRNA sequence
gggcacagatattttttcat

SEQ ID NO: 266125 - DNA, 20 bp, Artificial
  CRISPR gRNA sequence
ggcacagatattttttcatt

SEQ ID NO: 266126 - DNA, 20 bp, Artificial
  CRISPR gRNA sequence
tttcattttaaagttcttga

SEQ ID NO: 266127 - DNA, 20 bp, Artificial
  CRISPR gRNA sequence
ttcattttaaagttcttgat

SEQ ID NO: 266128 - DNA, 20 bp, Artificial
  CRISPR gRNA sequence
tcattttaaagttcttgata

SEQ ID NO: 266129 - DNA, 20 bp, Artificial
  CRISPR gRNA sequence
cattttaaagttcttgatat

SEQ ID NO: 266130 - DNA, 20 bp, Artificial
  CRISPR gRNA sequence
attttaaagttcttgatata

SEQ ID NO: 266131 - DNA, 20 bp, Artificial
  CRISPR gRNA sequence
taaagttcttgatataaagc

SEQ ID NO: 266132 - DNA, 20 bp, Artificial
  CRISPR gRNA sequence
aaagttcttgatataaagcc

SEQ ID NO: 266133 - DNA, 20 bp, Artificial
  CRISPR gRNA sequence
aagttcttgatataaagcca

SEQ ID NO: 266134 - DNA, 20 bp, Artificial
  CRISPR gRNA sequence
ttgatataaagccagcaatg

SEQ ID NO: 266135 - DNA, 20 bp, Artificial
  CRISPR gRNA sequence
gatataaagccagcaatgat

SEQ ID NO: 266136 - DNA, 20 bp, Artificial
  CRISPR gRNA sequence
atataaagccagcaatgatt

SEQ ID NO: 266137 - DNA, 20 bp, Artificial
  CRISPR gRNA sequence
tttaaaaagaattttgtaga

SEQ ID NO: 266138 - DNA, 20 bp, Artificial
  CRISPR gRNA sequence
ttaaaaagaattttgtagag

SEQ ID NO: 266139 - DNA, 20 bp, Artificial
  CRISPR gRNA sequence
taaaaagaattttgtagaga

SEQ ID NO: 266140 - DNA, 20 bp, Artificial
  CRISPR gRNA sequence
aaaaagaattttgtagagat

SEQ ID NO: 266141 - DNA, 20 bp, Artificial
  CRISPR gRNA sequence
aaaagaattttgtagagatg

SEQ ID NO: 266142 - DNA, 20 bp, Artificial
  CRISPR gRNA sequence
tgtagagatgggttctttct

SEQ ID NO: 266143 - DNA, 20 bp, Artificial
  CRISPR gRNA sequence
gtagagatgggttctttcta

SEQ ID NO: 266144 - DNA, 20 bp, Artificial
  CRISPR gRNA sequence
tagagatgggttctttctat

SEQ ID NO: 266145 - DNA, 20 bp, Artificial
  CRISPR gRNA sequence
tttctatgttgcccaggctg

SEQ ID NO: 266146 - DNA, 20 bp, Artificial
  CRISPR gRNA sequence
tctatgttgcccaggctggt

SEQ ID NO: 266147 - DNA, 20 bp, Artificial
  CRISPR gRNA sequence
ctatgttgcccaggctggtc

SEQ ID NO: 266148 - DNA, 20 bp, Artificial
  CRISPR gRNA sequence
tatgttgcccaggctggtct

SEQ ID NO: 266149 - DNA, 20 bp, Artificial
  CRISPR gRNA sequence
tgttgcccaggctggtcttg

SEQ ID NO: 266150 - DNA, 20 bp, Artificial
  CRISPR gRNA sequence
cccaggctggtcttgaactc

SEQ ID NO: 266151 - DNA, 20 bp, Artificial
  CRISPR gRNA sequence
gtcttgaactcctgggctca

SEQ ID NO: 266152 - DNA, 20 bp, Artificial
  CRISPR gRNA sequence
gaactcctgggctcaagcat

SEQ ID NO: 266153 - DNA, 20 bp, Artificial
  CRISPR gRNA sequence
aactcctgggctcaagcatt

SEQ ID NO: 266154 - DNA, 20 bp, Artificial
  CRISPR gRNA sequence
ctgggctcaagcattcatcc

SEQ ID NO: 266155 - DNA, 20 bp, Artificial
  CRISPR gRNA sequence
ggctcaagcattcatcccgc

SEQ ID NO: 266156 - DNA, 20 bp, Artificial
  CRISPR gRNA sequence
aagcattcatcccgccttgg

SEQ ID NO: 266157 - DNA, 20 bp, Artificial
  CRISPR gRNA sequence
atcccgccttggcctcccaa

SEQ ID NO: 266158 - DNA, 20 bp, Artificial
  CRISPR gRNA sequence
ggcctcccaaagtgctagga

SEQ ID NO: 266159 - DNA, 20 bp, Artificial
  CRISPR gRNA sequence
gcctcccaaagtgctaggat

SEQ ID NO: 266160 - DNA, 20 bp, Artificial
  CRISPR gRNA sequence
ccaaagtgctaggatcacaa

SEQ ID NO: 266161 - DNA, 20 bp, Artificial
  CRISPR gRNA sequence
ggatcacaaaggtgtgagcc

SEQ ID NO: 266162 - DNA, 20 bp, Artificial
  CRISPR gRNA sequence
ttgattatataggagacaaa

SEQ ID NO: 266163 - DNA, 20 bp, Artificial
  CRISPR gRNA sequence
attatataggagacaaaaag

SEQ ID NO: 266164 - DNA, 20 bp, Artificial
  CRISPR gRNA sequence
tataggagacaaaaagctac

SEQ ID NO: 266165 - DNA, 20 bp, Artificial
  CRISPR gRNA sequence
ctattaatttagttctatgc

SEQ ID NO: 266166 - DNA, 20 bp, Artificial
  CRISPR gRNA sequence
ttaatttagttctatgccat

SEQ ID NO: 266167 - DNA, 20 bp, Artificial
  CRISPR gRNA sequence
atttagttctatgccatttc

SEQ ID NO: 266168 - DNA, 20 bp, Artificial
  CRISPR gRNA sequence
agttctatgccatttccttc

SEQ ID NO: 266169 - DNA, 20 bp, Artificial
  CRISPR gRNA sequence
gttctatgccatttccttct

SEQ ID NO: 266170 - DNA, 20 bp, Artificial
  CRISPR gRNA sequence
tatgccatttccttcttacc

SEQ ID NO: 266171 - DNA, 20 bp, Artificial
  CRISPR gRNA sequence
tgccatttccttcttaccaa

SEQ ID NO: 266172 - DNA, 20 bp, Artificial
  CRISPR gRNA sequence
ccttcttaccaaaaccaaaa

SEQ ID NO: 266173 - DNA, 20 bp, Artificial
  CRISPR gRNA sequence
cttcttaccaaaaccaaaac

SEQ ID NO: 266174 - DNA, 20 bp, Artificial
  CRISPR gRNA sequence
cttaccaaaaccaaaacaaa

SEQ ID NO: 266175 - DNA, 20 bp, Artificial
  CRISPR gRNA sequence
ttaccaaaaccaaaacaaaa

SEQ ID NO: 266176 - DNA, 20 bp, Artificial
  CRISPR gRNA sequence
accaaaaccaaaacaaaaca

SEQ ID NO: 266177 - DNA, 20 bp, Artificial
  CRISPR gRNA sequence
ccaaaaccaaaacaaaacac

SEQ ID NO: 266178 - DNA, 20 bp, Artificial
  CRISPR gRNA sequence
tgtatatgaattcaaattca

SEQ ID NO: 266179 - DNA, 20 bp, Artificial
  CRISPR gRNA sequence
aaattcagttaaattgtaaa

SEQ ID NO: 266180 - DNA, 20 bp, Artificial
  CRISPR gRNA sequence
agttaaattgtaaatttcat

SEQ ID NO: 266181 - DNA, 20 bp, Artificial
  CRISPR gRNA sequence
aattgtaaatttcatttaaa

SEQ ID NO: 266182 - DNA, 20 bp, Artificial
  CRISPR gRNA sequence
taaatttcatttaaaaatga

SEQ ID NO: 266183 - DNA, 20 bp, Artificial
  CRISPR gRNA sequence
catttaaaaatgaatctgat

SEQ ID NO: 266184 - DNA, 20 bp, Artificial
  CRISPR gRNA sequence
atttaaaaatgaatctgatt

SEQ ID NO: 266185 - DNA, 20 bp, Artificial
  CRISPR gRNA sequence
aaaaatgaatctgattttat

SEQ ID NO: 266186 - DNA, 20 bp, Artificial
  CRISPR gRNA sequence
aaaatgaatctgattttatt

SEQ ID NO: 266187 - DNA, 20 bp, Artificial
  CRISPR gRNA sequence
attttatttggctcttcagt

SEQ ID NO: 266188 - DNA, 20 bp, Artificial
  CRISPR gRNA sequence
tatttggctcttcagtgtgg

SEQ ID NO: 266189 - DNA, 20 bp, Artificial
  CRISPR gRNA sequence
atttggctcttcagtgtggg

SEQ ID NO: 266190 - DNA, 20 bp, Artificial
  CRISPR gRNA sequence
tttggctcttcagtgtgggt

SEQ ID NO: 266191 - DNA, 20 bp, Artificial
  CRISPR gRNA sequence
ggctcttcagtgtgggtata

SEQ ID NO: 266192 - DNA, 20 bp, Artificial
  CRISPR gRNA sequence
gctcttcagtgtgggtatac

SEQ ID NO: 266193 - DNA, 20 bp, Artificial
  CRISPR gRNA sequence
ttcagtgtgggtatacggga

SEQ ID NO: 266194 - DNA, 20 bp, Artificial
  CRISPR gRNA sequence
cagtgtgggtatacgggatg

SEQ ID NO: 266195 - DNA, 20 bp, Artificial
  CRISPR gRNA sequence
agtgtgggtatacgggatgt

SEQ ID NO: 266196 - DNA, 20 bp, Artificial
  CRISPR gRNA sequence
cttcaaataaacttaaaaga

SEQ ID NO: 266197 - DNA, 20 bp, Artificial
  CRISPR gRNA sequence
caaataaacttaaaagaaat

SEQ ID NO: 266198 - DNA, 20 bp, Artificial
  CRISPR gRNA sequence
aaataaacttaaaagaaatg

SEQ ID NO: 266199 - DNA, 20 bp, Artificial
  CRISPR gRNA sequence
aaaagaaatgcaagtaggta

SEQ ID NO: 266200 - DNA, 20 bp, Artificial
  CRISPR gRNA sequence
aaagaaatgcaagtaggtaa

SEQ ID NO: 266201 - DNA, 20 bp, Artificial
  CRISPR gRNA sequence
ttaacataccccaaaacaag

SEQ ID NO: 266202 - DNA, 20 bp, Artificial
  CRISPR gRNA sequence
acataccccaaaacaagagc

SEQ ID NO: 266203 - DNA, 20 bp, Artificial
  CRISPR gRNA sequence
ttgtttgcattgaaatttga

SEQ ID NO: 266204 - DNA, 20 bp, Artificial
  CRISPR gRNA sequence
tgtttgcattgaaatttgaa

SEQ ID NO: 266205 - DNA, 20 bp, Artificial
  CRISPR gRNA sequence
gtttgcattgaaatttgaat

SEQ ID NO: 266206 - DNA, 20 bp, Artificial
  CRISPR gRNA sequence
tttgcattgaaatttgaatc

SEQ ID NO: 266207 - DNA, 20 bp, Artificial
  CRISPR gRNA sequence
gcattgaaatttgaatcaaa

SEQ ID NO: 266208 - DNA, 20 bp, Artificial
  CRISPR gRNA sequence
cattgaaatttgaatcaaag

SEQ ID NO: 266209 - DNA, 20 bp, Artificial
  CRISPR gRNA sequence
aaatttgaatcaaagacaca

SEQ ID NO: 266210 - DNA, 20 bp, Artificial
  CRISPR gRNA sequence
gaatcaaagacacaaagtgg

SEQ ID NO: 266211 - DNA, 20 bp, Artificial
  CRISPR gRNA sequence
aatcaaagacacaaagtggt

SEQ ID NO: 266212 - DNA, 20 bp, Artificial
  CRISPR gRNA sequence
gttgttttagaaaaattctt

SEQ ID NO: 266213 - DNA, 20 bp, Artificial
  CRISPR gRNA sequence
ttgttttagaaaaattcttg

SEQ ID NO: 266214 - DNA, 20 bp, Artificial
  CRISPR gRNA sequence
ttttagaaaaattcttgagg

SEQ ID NO: 266215 - DNA, 20 bp, Artificial
  CRISPR gRNA sequence
tagaaaaattcttgagggcc

SEQ ID NO: 266216 - DNA, 20 bp, Artificial
  CRISPR gRNA sequence
agaaaaattcttgagggcca

SEQ ID NO: 266217 - DNA, 20 bp, Artificial
  CRISPR gRNA sequence
gaaaaattcttgagggccag

SEQ ID NO: 266218 - DNA, 20 bp, Artificial
  CRISPR gRNA sequence
ttgagggccaggcgcagtgg

SEQ ID NO: 266219 - DNA, 20 bp, Artificial
  CRISPR gRNA sequence
gagggccaggcgcagtggct

SEQ ID NO: 266220 - DNA, 20 bp, Artificial
  CRISPR gRNA sequence
agggccaggcgcagtggctc

SEQ ID NO: 266221 - DNA, 20 bp, Artificial
  CRISPR gRNA sequence
acacctgtaatcccagcact

SEQ ID NO: 266222 - DNA, 20 bp, Artificial
  CRISPR gRNA sequence
taatcccagcactttgggag

SEQ ID NO: 266223 - DNA, 20 bp, Artificial
  CRISPR gRNA sequence
tgggaggccgaggcggtgga

SEQ ID NO: 266224 - DNA, 20 bp, Artificial
  CRISPR gRNA sequence
gggaggccgaggcggtggat

SEQ ID NO: 266225 - DNA, 20 bp, Artificial
  CRISPR gRNA sequence
ggaggccgaggcggtggatc

SEQ ID NO: 266226 - DNA, 20 bp, Artificial
  CRISPR gRNA sequence
aggttgggagttcgagacaa

SEQ ID NO: 266227 - DNA, 20 bp, Artificial
  CRISPR gRNA sequence
ggagttcgagacaagcctga

SEQ ID NO: 266228 - DNA, 20 bp, Artificial
  CRISPR gRNA sequence
gagacaagcctgaccaacat

SEQ ID NO: 266229 - DNA, 20 bp, Artificial
  CRISPR gRNA sequence
accaacatggagaaaccccg

SEQ ID NO: 266230 - DNA, 20 bp, Artificial
  CRISPR gRNA sequence
tactaaaaatagaaaattag

SEQ ID NO: 266231 - DNA, 20 bp, Artificial
  CRISPR gRNA sequence
ctaaaaatagaaaattagcc

SEQ ID NO: 266232 - DNA, 20 bp, Artificial
  CRISPR gRNA sequence
aaaatagaaaattagccggg

SEQ ID NO: 266233 - DNA, 20 bp, Artificial
  CRISPR gRNA sequence
gccgggcatggtggtgcata

SEQ ID NO: 266234 - DNA, 20 bp, Artificial
  CRISPR gRNA sequence
ttaatcccagctactcggga

SEQ ID NO: 266235 - DNA, 20 bp, Artificial
  CRISPR gRNA sequence
atcccagctactcgggaggc

SEQ ID NO: 266236 - DNA, 20 bp, Artificial
  CRISPR gRNA sequence
ctcgggaggctgaggcagga

SEQ ID NO: 266237 - DNA, 20 bp, Artificial
  CRISPR gRNA sequence
gggaggctgaggcaggagaa

SEQ ID NO: 266238 - DNA, 20 bp, Artificial
  CRISPR gRNA sequence
aggcaggagaatcacctgaa

SEQ ID NO: 266239 - DNA, 20 bp, Artificial
  CRISPR gRNA sequence
aacccagagggcggaggttg

SEQ ID NO: 266240 - DNA, 20 bp, Artificial
  CRISPR gRNA sequence
cagtcagctgagatcgcacc

SEQ ID NO: 266241 - DNA, 20 bp, Artificial
  CRISPR gRNA sequence
agatcgcaccattgcactcc

SEQ ID NO: 266242 - DNA, 20 bp, Artificial
  CRISPR gRNA sequence
cactccagcctgggcaacaa

SEQ ID NO: 266243 - DNA, 20 bp, Artificial
  CRISPR gRNA sequence
cagcctgggcaacaagagcg

SEQ ID NO: 266244 - DNA, 20 bp, Artificial
  CRISPR gRNA sequence
ggcaacaagagcgaaactcc

SEQ ID NO: 266245 - DNA, 20 bp, Artificial
  CRISPR gRNA sequence
cgtctccagaaaaaaaaaaa

SEQ ID NO: 266246 - DNA, 20 bp, Artificial
  CRISPR gRNA sequence
cagaaaaaaaaaaaaaaaga

SEQ ID NO: 266247 - DNA, 20 bp, Artificial
  CRISPR gRNA sequence
tggaaggtgtcttggttgca

SEQ ID NO: 266248 - DNA, 20 bp, Artificial
  CRISPR gRNA sequence
ggaaggtgtcttggttgcaa

SEQ ID NO: 266249 - DNA, 20 bp, Artificial
  CRISPR gRNA sequence
gaaggtgtcttggttgcaaa

SEQ ID NO: 266250 - DNA, 20 bp, Artificial
  CRISPR gRNA sequence
ggttgcaaagttgattccca

SEQ ID NO: 266251 - DNA, 20 bp, Artificial
  CRISPR gRNA sequence
gttgcaaagttgattcccag

SEQ ID NO: 266252 - DNA, 20 bp, Artificial
  CRISPR gRNA sequence
caaagttgattcccagtttc

SEQ ID NO: 266253 - DNA, 20 bp, Artificial
  CRISPR gRNA sequence
attcccagtttctcagtgct

SEQ ID NO: 266254 - DNA, 20 bp, Artificial
  CRISPR gRNA sequence
ccagtttctcagtgcttcag

SEQ ID NO: 266255 - DNA, 20 bp, Artificial
  CRISPR gRNA sequence
ctcagtgcttcagtggtcta

SEQ ID NO: 266256 - DNA, 20 bp, Artificial
  CRISPR gRNA sequence
tcagtgcttcagtggtctat

SEQ ID NO: 266257 - DNA, 20 bp, Artificial
  CRISPR gRNA sequence
agtgcttcagtggtctattt

SEQ ID NO: 266258 - DNA, 20 bp, Artificial
  CRISPR gRNA sequence
cagtggtctatttctcaggt

SEQ ID NO: 266259 - DNA, 20 bp, Artificial
  CRISPR gRNA sequence
agtggtctatttctcaggtg

SEQ ID NO: 266260 - DNA, 20 bp, Artificial
  CRISPR gRNA sequence
tttctcaggtggtcatagcc

SEQ ID NO: 266261 - DNA, 20 bp, Artificial
  CRISPR gRNA sequence
ctcaggtggtcatagccaac

SEQ ID NO: 266262 - DNA, 20 bp, Artificial
  CRISPR gRNA sequence
tcaggtggtcatagccaact

SEQ ID NO: 266263 - DNA, 20 bp, Artificial
  CRISPR gRNA sequence
aggtggtcatagccaacttg

SEQ ID NO: 266264 - DNA, 20 bp, Artificial
  CRISPR gRNA sequence
gggttttagttctggctttg

SEQ ID NO: 266265 - DNA, 20 bp, Artificial
  CRISPR gRNA sequence
ggttttagttctggctttgc

SEQ ID NO: 266266 - DNA, 20 bp, Artificial
  CRISPR gRNA sequence
tagttctggctttgctcacc

SEQ ID NO: 266267 - DNA, 20 bp, Artificial
  CRISPR gRNA sequence
agttctggctttgctcacca

SEQ ID NO: 266268 - DNA, 20 bp, Artificial
  CRISPR gRNA sequence
gttctggctttgctcaccat

SEQ ID NO: 266269 - DNA, 20 bp, Artificial
  CRISPR gRNA sequence
tggctttgctcaccatttgt

SEQ ID NO: 266270 - DNA, 20 bp, Artificial
  CRISPR gRNA sequence
gctttgctcaccatttgttt

SEQ ID NO: 266271 - DNA, 20 bp, Artificial
  CRISPR gRNA sequence
tgctcaccatttgtttggtg

SEQ ID NO: 266272 - DNA, 20 bp, Artificial
  CRISPR gRNA sequence
gctcaccatttgtttggtga

SEQ ID NO: 266273 - DNA, 20 bp, Artificial
  CRISPR gRNA sequence
ctcaccatttgtttggtgac

SEQ ID NO: 266274 - DNA, 20 bp, Artificial
  CRISPR gRNA sequence
accatttgtttggtgacttc

SEQ ID NO: 266275 - DNA, 20 bp, Artificial
  CRISPR gRNA sequence
gtttggtgacttcagacaaa

SEQ ID NO: 266276 - DNA, 20 bp, Artificial
  CRISPR gRNA sequence
tttggtgacttcagacaaac

SEQ ID NO: 266277 - DNA, 20 bp, Artificial
  CRISPR gRNA sequence
ggtgacttcagacaaaccag

SEQ ID NO: 266278 - DNA, 20 bp, Artificial
  CRISPR gRNA sequence
gtgacttcagacaaaccagc

SEQ ID NO: 266279 - DNA, 20 bp, Artificial
  CRISPR gRNA sequence
cagacaaaccagctaatgtt

SEQ ID NO: 266280 - DNA, 20 bp, Artificial
  CRISPR gRNA sequence
agacaaaccagctaatgttt

SEQ ID NO: 266281 - DNA, 20 bp, Artificial
  CRISPR gRNA sequence
atgtttctaggccttataca

SEQ ID NO: 266282 - DNA, 20 bp, Artificial
  CRISPR gRNA sequence
ctaggccttatacaatcatt

SEQ ID NO: 266283 - DNA, 20 bp, Artificial
  CRISPR gRNA sequence
taggccttatacaatcatta

SEQ ID NO: 266284 - DNA, 20 bp, Artificial
  CRISPR gRNA sequence
ggccttatacaatcattaga

SEQ ID NO: 266285 - DNA, 20 bp, Artificial
  CRISPR gRNA sequence
atacaatcattagaaaagaa

SEQ ID NO: 266286 - DNA, 20 bp, Artificial
  CRISPR gRNA sequence
tacaatcattagaaaagaaa

SEQ ID NO: 266287 - DNA, 20 bp, Artificial
  CRISPR gRNA sequence
gaaaagaaaaaaaaaaagaa

SEQ ID NO: 266288 - DNA, 20 bp, Artificial
  CRISPR gRNA sequence
tcctgtgccaacaatgagga

SEQ ID NO: 266289 - DNA, 20 bp, Artificial
  CRISPR gRNA sequence
tgccaacaatgaggatacca

SEQ ID NO: 266290 - DNA, 20 bp, Artificial
  CRISPR gRNA sequence
tcttcacttatggagttgat

SEQ ID NO: 266291 - DNA, 20 bp, Artificial
  CRISPR gRNA sequence
ttcacttatggagttgataa

SEQ ID NO: 266292 - DNA, 20 bp, Artificial
  CRISPR gRNA sequence
cacttatggagttgataaac

SEQ ID NO: 266293 - DNA, 20 bp, Artificial
  CRISPR gRNA sequence
acttatggagttgataaact

SEQ ID NO: 266294 - DNA, 20 bp, Artificial
  CRISPR gRNA sequence
atggagttgataaactagtt

SEQ ID NO: 266295 - DNA, 20 bp, Artificial
  CRISPR gRNA sequence
tggagttgataaactagttt

SEQ ID NO: 266296 - DNA, 20 bp, Artificial
  CRISPR gRNA sequence
ataaactagtttcaggttct

SEQ ID NO: 266297 - DNA, 20 bp, Artificial
  CRISPR gRNA sequence
gtttcaggttctttgctttt

SEQ ID NO: 266298 - DNA, 20 bp, Artificial
  CRISPR gRNA sequence
caggttctttgcttttaaag

SEQ ID NO: 266299 - DNA, 20 bp, Artificial
  CRISPR gRNA sequence
aggttctttgcttttaaaga

SEQ ID NO: 266300 - DNA, 20 bp, Artificial
  CRISPR gRNA sequence
tttgcttttaaagattgaac

SEQ ID NO: 266301 - DNA, 20 bp, Artificial
  CRISPR gRNA sequence
tgcttttaaagattgaacta

SEQ ID NO: 266302 - DNA, 20 bp, Artificial
  CRISPR gRNA sequence
gcttttaaagattgaactaa

SEQ ID NO: 266303 - DNA, 20 bp, Artificial
  CRISPR gRNA sequence
cttttaaagattgaactaaa

SEQ ID NO: 266304 - DNA, 20 bp, Artificial
  CRISPR gRNA sequence
ttaaagattgaactaaatgc

SEQ ID NO: 266305 - DNA, 20 bp, Artificial
  CRISPR gRNA sequence
taaagattgaactaaatgct

SEQ ID NO: 266306 - DNA, 20 bp, Artificial
  CRISPR gRNA sequence
aaagattgaactaaatgctc

SEQ ID NO: 266307 - DNA, 20 bp, Artificial
  CRISPR gRNA sequence
aagattgaactaaatgctct

SEQ ID NO: 266308 - DNA, 20 bp, Artificial
  CRISPR gRNA sequence
aactaaatgctctccagatt

SEQ ID NO: 266309 - DNA, 20 bp, Artificial
  CRISPR gRNA sequence
aatgctctccagattctttg

SEQ ID NO: 266310 - DNA, 20 bp, Artificial
  CRISPR gRNA sequence
tccagattctttgatctttt

SEQ ID NO: 266311 - DNA, 20 bp, Artificial
  CRISPR gRNA sequence
cagattctttgatcttttat

SEQ ID NO: 266312 - DNA, 20 bp, Artificial
  CRISPR gRNA sequence
tttgatcttttattgggata

SEQ ID NO: 266313 - DNA, 20 bp, Artificial
  CRISPR gRNA sequence
tgatcttttattgggatagc

SEQ ID NO: 266314 - DNA, 20 bp, Artificial
  CRISPR gRNA sequence
gatcttttattgggatagca

SEQ ID NO: 266315 - DNA, 20 bp, Artificial
  CRISPR gRNA sequence
atcttttattgggatagcag

SEQ ID NO: 266316 - DNA, 20 bp, Artificial
  CRISPR gRNA sequence
ttattgggatagcagtaaag

SEQ ID NO: 266317 - DNA, 20 bp, Artificial
  CRISPR gRNA sequence
tattgggatagcagtaaagg

SEQ ID NO: 266318 - DNA, 20 bp, Artificial
  CRISPR gRNA sequence
attgggatagcagtaaaggt

SEQ ID NO: 266319 - DNA, 20 bp, Artificial
  CRISPR gRNA sequence
ttgggatagcagtaaaggta

SEQ ID NO: 266320 - DNA, 20 bp, Artificial
  CRISPR gRNA sequence
ggatagcagtaaaggtagat

SEQ ID NO: 266321 - DNA, 20 bp, Artificial
  CRISPR gRNA sequence
ccctctggagtctttcacct

SEQ ID NO: 266322 - DNA, 20 bp, Artificial
  CRISPR gRNA sequence
tggagtctttcacctttcat

SEQ ID NO: 266323 - DNA, 20 bp, Artificial
  CRISPR gRNA sequence
gagtctttcacctttcatga

SEQ ID NO: 266324 - DNA, 20 bp, Artificial
  CRISPR gRNA sequence
tcacctttcatgatataagg

SEQ ID NO: 266325 - DNA, 20 bp, Artificial
  CRISPR gRNA sequence
cacctttcatgatataaggg

SEQ ID NO: 266326 - DNA, 20 bp, Artificial
  CRISPR gRNA sequence
acctttcatgatataaggga

SEQ ID NO: 266327 - DNA, 20 bp, Artificial
  CRISPR gRNA sequence
tcatgatataagggaataga

SEQ ID NO: 266328 - DNA, 20 bp, Artificial
  CRISPR gRNA sequence
catgatataagggaatagat

SEQ ID NO: 266329 - DNA, 20 bp, Artificial
  CRISPR gRNA sequence
atgatataagggaatagatc

SEQ ID NO: 266330 - DNA, 20 bp, Artificial
  CRISPR gRNA sequence
tgaatttcttggggaggcta

SEQ ID NO: 266331 - DNA, 20 bp, Artificial
  CRISPR gRNA sequence
cttggggaggctattctctg

SEQ ID NO: 266332 - DNA, 20 bp, Artificial
  CRISPR gRNA sequence
ttggggaggctattctctga

SEQ ID NO: 266333 - DNA, 20 bp, Artificial
  CRISPR gRNA sequence
ggggaggctattctctgaat

SEQ ID NO: 266334 - DNA, 20 bp, Artificial
  CRISPR gRNA sequence
gggaggctattctctgaatt

SEQ ID NO: 266335 - DNA, 20 bp, Artificial
  CRISPR gRNA sequence
ttctctgaatttggtgcaga

SEQ ID NO: 266336 - DNA, 20 bp, Artificial
  CRISPR gRNA sequence
tctgaatttggtgcagaaaa

SEQ ID NO: 266337 - DNA, 20 bp, Artificial
  CRISPR gRNA sequence
tgaatttggtgcagaaaaca

SEQ ID NO: 266338 - DNA, 20 bp, Artificial
  CRISPR gRNA sequence
aatttggtgcagaaaacaca

SEQ ID NO: 266339 - DNA, 20 bp, Artificial
  CRISPR gRNA sequence
ggtgcagaaaacacattaaa

SEQ ID NO: 266340 - DNA, 20 bp, Artificial
  CRISPR gRNA sequence
gtgcagaaaacacattaaag

SEQ ID NO: 266341 - DNA, 20 bp, Artificial
  CRISPR gRNA sequence
aagcaaactcttgggttata

SEQ ID NO: 266342 - DNA, 20 bp, Artificial
  CRISPR gRNA sequence
ttgggttatattttttctta

SEQ ID NO: 266343 - DNA, 20 bp, Artificial
  CRISPR gRNA sequence
gggttatattttttcttatc

SEQ ID NO: 266344 - DNA, 20 bp, Artificial
  CRISPR gRNA sequence
ggttatattttttcttatct

SEQ ID NO: 266345 - DNA, 20 bp, Artificial
  CRISPR gRNA sequence
tattttttcttatctcttca

SEQ ID NO: 266346 - DNA, 20 bp, Artificial
  CRISPR gRNA sequence
tttcttatctcttcatccca

SEQ ID NO: 266347 - DNA, 20 bp, Artificial
  CRISPR gRNA sequence
ttcttatctcttcatcccac

SEQ ID NO: 266348 - DNA, 20 bp, Artificial
  CRISPR gRNA sequence
tcttatctcttcatcccact

SEQ ID NO: 266349 - DNA, 20 bp, Artificial
  CRISPR gRNA sequence
cttatctcttcatcccactc

SEQ ID NO: 266350 - DNA, 20 bp, Artificial
  CRISPR gRNA sequence
ttatctcttcatcccactct

SEQ ID NO: 266351 - DNA, 20 bp, Artificial
  CRISPR gRNA sequence
atctcttcatcccactcttg

SEQ ID NO: 266352 - DNA, 20 bp, Artificial
  CRISPR gRNA sequence
tctcttcatcccactcttgc

SEQ ID NO: 266353 - DNA, 20 bp, Artificial
  CRISPR gRNA sequence
ttcatcccactcttgcaatg

SEQ ID NO: 266354 - DNA, 20 bp, Artificial
  CRISPR gRNA sequence
catcccactcttgcaatggg

SEQ ID NO: 266355 - DNA, 20 bp, Artificial
  CRISPR gRNA sequence
atcccactcttgcaatgggc

SEQ ID NO: 266356 - DNA, 20 bp, Artificial
  CRISPR gRNA sequence
ttgcaatgggcaataaacaa

SEQ ID NO: 266357 - DNA, 20 bp, Artificial
  CRISPR gRNA sequence
gcaatgggcaataaacaaag

SEQ ID NO: 266358 - DNA, 20 bp, Artificial
  CRISPR gRNA sequence
caatgggcaataaacaaagt

SEQ ID NO: 266359 - DNA, 20 bp, Artificial
  CRISPR gRNA sequence
caaaatattttaattccttt

SEQ ID NO: 266360 - DNA, 20 bp, Artificial
  CRISPR gRNA sequence
aaaatattttaattccttta

SEQ ID NO: 266361 - DNA, 20 bp, Artificial
  CRISPR gRNA sequence
taattcctttacaaaaacct

SEQ ID NO: 266362 - DNA, 20 bp, Artificial
  CRISPR gRNA sequence
aattcctttacaaaaacctg

SEQ ID NO: 266363 - DNA, 20 bp, Artificial
  CRISPR gRNA sequence
attcctttacaaaaacctgt

SEQ ID NO: 266364 - DNA, 20 bp, Artificial
  CRISPR gRNA sequence
ctttacaaaaacctgtatca

SEQ ID NO: 266365 - DNA, 20 bp, Artificial
  CRISPR gRNA sequence
tacaaaaacctgtatcacaa

SEQ ID NO: 266366 - DNA, 20 bp, Artificial
  CRISPR gRNA sequence
acaaaaacctgtatcacaac

SEQ ID NO: 266367 - DNA, 20 bp, Artificial
  CRISPR gRNA sequence
caaaaacctgtatcacaact

SEQ ID NO: 266368 - DNA, 20 bp, Artificial
  CRISPR gRNA sequence
tatcacaacttaaaaacaaa

SEQ ID NO: 266369 - DNA, 20 bp, Artificial
  CRISPR gRNA sequence
aaaaacaaatctatttgtag

SEQ ID NO: 266370 - DNA, 20 bp, Artificial
  CRISPR gRNA sequence
aaaacaaatctatttgtagg

SEQ ID NO: 266371 - DNA, 20 bp, Artificial
  CRISPR gRNA sequence
tttgtaggttgggcatggtg

SEQ ID NO: 266372 - DNA, 20 bp, Artificial
  CRISPR gRNA sequence
gtaggttgggcatggtggct

SEQ ID NO: 266373 - DNA, 20 bp, Artificial
  CRISPR gRNA sequence
taggttgggcatggtggctc

SEQ ID NO: 266374 - DNA, 20 bp, Artificial
  CRISPR gRNA sequence
ggcatggtggctcatgcttg

SEQ ID NO: 266375 - DNA, 20 bp, Artificial
  CRISPR gRNA sequence
atgcttgtaatcccagcact

SEQ ID NO: 266376 - DNA, 20 bp, Artificial
  CRISPR gRNA sequence
gtaatcccagcactttggga

SEQ ID NO: 266377 - DNA, 20 bp, Artificial
  CRISPR gRNA sequence
taatcccagcactttgggag

SEQ ID NO: 266378 - DNA, 20 bp, Artificial
  CRISPR gRNA sequence
tgggaggccaaggtggtcag

SEQ ID NO: 266379 - DNA, 20 bp, Artificial
  CRISPR gRNA sequence
gggaggccaaggtggtcaga

SEQ ID NO: 266380 - DNA, 20 bp, Artificial
  CRISPR gRNA sequence
ggaggccaaggtggtcagat

SEQ ID NO: 266381 - DNA, 20 bp, Artificial
  CRISPR gRNA sequence
gaggccaggagtttgagacc

SEQ ID NO: 266382 - DNA, 20 bp, Artificial
  CRISPR gRNA sequence
aggccaggagtttgagacca

SEQ ID NO: 266383 - DNA, 20 bp, Artificial
  CRISPR gRNA sequence
gagaccaggctagccaacat

SEQ ID NO: 266384 - DNA, 20 bp, Artificial
  CRISPR gRNA sequence
agaccaggctagccaacatg

SEQ ID NO: 266385 - DNA, 20 bp, Artificial
  CRISPR gRNA sequence
gccaacatggtgaaaccccg

SEQ ID NO: 266386 - DNA, 20 bp, Artificial
  CRISPR gRNA sequence
tactaaaaaaatagaaaaat

SEQ ID NO: 266387 - DNA, 20 bp, Artificial
  CRISPR gRNA sequence
aaaaaatagaaaaattagct

SEQ ID NO: 266388 - DNA, 20 bp, Artificial
  CRISPR gRNA sequence
gctgggcgtggtggtgcata

SEQ ID NO: 266389 - DNA, 20 bp, Artificial
  CRISPR gRNA sequence
ggcgtggtggtgcatacctg

SEQ ID NO: 266390 - DNA, 20 bp, Artificial
  CRISPR gRNA sequence
taatcccagctacttaagag

SEQ ID NO: 266391 - DNA, 20 bp, Artificial
  CRISPR gRNA sequence
cttaagagactgaggcagga

SEQ ID NO: 266392 - DNA, 20 bp, Artificial
  CRISPR gRNA sequence
aagagactgaggcaggagaa

SEQ ID NO: 266393 - DNA, 20 bp, Artificial
  CRISPR gRNA sequence
agagactgaggcaggagaat

SEQ ID NO: 266394 - DNA, 20 bp, Artificial
  CRISPR gRNA sequence
aggcaggagaattgtttgaa

SEQ ID NO: 266395 - DNA, 20 bp, Artificial
  CRISPR gRNA sequence
tttgaactcggtgggtggag

SEQ ID NO: 266396 - DNA, 20 bp, Artificial
  CRISPR gRNA sequence
gaactcggtgggtggaggtt

SEQ ID NO: 266397 - DNA, 20 bp, Artificial
  CRISPR gRNA sequence
aactcggtgggtggaggttg

SEQ ID NO: 266398 - DNA, 20 bp, Artificial
  CRISPR gRNA sequence
ggtgggtggaggttgcagtg

SEQ ID NO: 266399 - DNA, 20 bp, Artificial
  CRISPR gRNA sequence
cagtgagctgagattgcacc

SEQ ID NO: 266400 - DNA, 20 bp, Artificial
  CRISPR gRNA sequence
agattgcaccactgcacttc

SEQ ID NO: 266401 - DNA, 20 bp, Artificial
  CRISPR gRNA sequence
caccactgcacttcagcctg

SEQ ID NO: 266402 - DNA, 20 bp, Artificial
  CRISPR gRNA sequence
cacttcagcctgggcaacag

SEQ ID NO: 266403 - DNA, 20 bp, Artificial
  CRISPR gRNA sequence
cagcctgggcaacagagcaa

SEQ ID NO: 266404 - DNA, 20 bp, Artificial
  CRISPR gRNA sequence
agcctgggcaacagagcaag

SEQ ID NO: 266405 - DNA, 20 bp, Artificial
  CRISPR gRNA sequence
ggcaacagagcaagactctg

SEQ ID NO: 266406 - DNA, 20 bp, Artificial
  CRISPR gRNA sequence
tgtctcaaaaacaaacaaac

SEQ ID NO: 266407 - DNA, 20 bp, Artificial
  CRISPR gRNA sequence
tctcaaaaacaaacaaacaa

SEQ ID NO: 266408 - DNA, 20 bp, Artificial
  CRISPR gRNA sequence
aaaaacaaacaaacaaagaa

SEQ ID NO: 266409 - DNA, 20 bp, Artificial
  CRISPR gRNA sequence
tttttgtgtctgtgtcaggc

SEQ ID NO: 266410 - DNA, 20 bp, Artificial
  CRISPR gRNA sequence
ttgtgtctgtgtcaggcact

SEQ ID NO: 266411 - DNA, 20 bp, Artificial
  CRISPR gRNA sequence
tgtgtctgtgtcaggcacta

SEQ ID NO: 266412 - DNA, 20 bp, Artificial
  CRISPR gRNA sequence
gtgtctgtgtcaggcactaa

SEQ ID NO: 266413 - DNA, 20 bp, Artificial
  CRISPR gRNA sequence
tgtctgtgtcaggcactaaa

SEQ ID NO: 266414 - DNA, 20 bp, Artificial
  CRISPR gRNA sequence
tgtcaggcactaaagccacc

SEQ ID NO: 266415 - DNA, 20 bp, Artificial
  CRISPR gRNA sequence
aagccacctccaaatatatc

SEQ ID NO: 266416 - DNA, 20 bp, Artificial
  CRISPR gRNA sequence
caaatatatcactcagtcag

SEQ ID NO: 266417 - DNA, 20 bp, Artificial
  CRISPR gRNA sequence
agtcaggaaattggcccaat

SEQ ID NO: 266418 - DNA, 20 bp, Artificial
  CRISPR gRNA sequence
gcccaatgcatgattaatat

SEQ ID NO: 266419 - DNA, 20 bp, Artificial
  CRISPR gRNA sequence
atattaatgtctcaggaata

SEQ ID NO: 266420 - DNA, 20 bp, Artificial
  CRISPR gRNA sequence
atgtctcaggaatatagatt

SEQ ID NO: 266421 - DNA, 20 bp, Artificial
  CRISPR gRNA sequence
aggaatatagatttaaaaat

SEQ ID NO: 266422 - DNA, 20 bp, Artificial
  CRISPR gRNA sequence
aaaaattgtgagtgcctagc

SEQ ID NO: 266423 - DNA, 20 bp, Artificial
  CRISPR gRNA sequence
aaaattgtgagtgcctagct

SEQ ID NO: 266424 - DNA, 20 bp, Artificial
  CRISPR gRNA sequence
tgagtgcctagctgtggtgc

SEQ ID NO: 266425 - DNA, 20 bp, Artificial
  CRISPR gRNA sequence
gctgtggtgctcaatgctaa

SEQ ID NO: 266426 - DNA, 20 bp, Artificial
  CRISPR gRNA sequence
tggtgctcaatgctaacaga

SEQ ID NO: 266427 - DNA, 20 bp, Artificial
  CRISPR gRNA sequence
aatgctaacagaaagccatg

SEQ ID NO: 266428 - DNA, 20 bp, Artificial
  CRISPR gRNA sequence
acagaaagccatgtactgcc

SEQ ID NO: 266429 - DNA, 20 bp, Artificial
  CRISPR gRNA sequence
ccttctgggtgaaaacatgc

SEQ ID NO: 266430 - DNA, 20 bp, Artificial
  CRISPR gRNA sequence
ctgggtgaaaacatgctcca

SEQ ID NO: 266431 - DNA, 20 bp, Artificial
  CRISPR gRNA sequence
tgggtgaaaacatgctccat

SEQ ID NO: 266432 - DNA, 20 bp, Artificial
  CRISPR gRNA sequence
ggtgaaaacatgctccattg

SEQ ID NO: 266433 - DNA, 20 bp, Artificial
  CRISPR gRNA sequence
cattgttccattcaaaagag

SEQ ID NO: 266434 - DNA, 20 bp, Artificial
  CRISPR gRNA sequence
ttccattcaaaagaggatga

SEQ ID NO: 266435 - DNA, 20 bp, Artificial
  CRISPR gRNA sequence
cattcaaaagaggatgaaaa

SEQ ID NO: 266436 - DNA, 20 bp, Artificial
  CRISPR gRNA sequence
aaaagaggatgaaaataata

SEQ ID NO: 266437 - DNA, 20 bp, Artificial
  CRISPR gRNA sequence
aaatgttaacttttgaactc

SEQ ID NO: 266438 - DNA, 20 bp, Artificial
  CRISPR gRNA sequence
acttttgaactctcagtata

SEQ ID NO: 266439 - DNA, 20 bp, Artificial
  CRISPR gRNA sequence
ttgaactctcagtataatta

SEQ ID NO: 266440 - DNA, 20 bp, Artificial
  CRISPR gRNA sequence
tgaactctcagtataattat

SEQ ID NO: 266441 - DNA, 20 bp, Artificial
  CRISPR gRNA sequence
gaactctcagtataattatc

SEQ ID NO: 266442 - DNA, 20 bp, Artificial
  CRISPR gRNA sequence
aactctcagtataattatcc

SEQ ID NO: 266443 - DNA, 20 bp, Artificial
  CRISPR gRNA sequence
tcagtataattatcccctga

SEQ ID NO: 266444 - DNA, 20 bp, Artificial
  CRISPR gRNA sequence
agtataattatcccctgaag

SEQ ID NO: 266445 - DNA, 20 bp, Artificial
  CRISPR gRNA sequence
tcccctgaagaggtcctaca

SEQ ID NO: 266446 - DNA, 20 bp, Artificial
  CRISPR gRNA sequence
aagaggtcctacatcttctg

SEQ ID NO: 266447 - DNA, 20 bp, Artificial
  CRISPR gRNA sequence
catcttctgccaagagaaaa

SEQ ID NO: 266448 - DNA, 20 bp, Artificial
  CRISPR gRNA sequence
ctgccaagagaaaacctttg

SEQ ID NO: 266449 - DNA, 20 bp, Artificial
  CRISPR gRNA sequence
tgccaagagaaaacctttgc

SEQ ID NO: 266450 - DNA, 20 bp, Artificial
  CRISPR gRNA sequence
ccaagagaaaacctttgctg

SEQ ID NO: 266451 - DNA, 20 bp, Artificial
  CRISPR gRNA sequence
tgctggagatctgttcattt

SEQ ID NO: 266452 - DNA, 20 bp, Artificial
  CRISPR gRNA sequence
gctggagatctgttcattta

SEQ ID NO: 266453 - DNA, 20 bp, Artificial
  CRISPR gRNA sequence
ctggagatctgttcatttag

SEQ ID NO: 266454 - DNA, 20 bp, Artificial
  CRISPR gRNA sequence
gagatctgttcatttagtta

SEQ ID NO: 266455 - DNA, 20 bp, Artificial
  CRISPR gRNA sequence
ttcatttagttaattaatat

SEQ ID NO: 266456 - DNA, 20 bp, Artificial
  CRISPR gRNA sequence
atttagttaattaatatatt

SEQ ID NO: 266457 - DNA, 20 bp, Artificial
  CRISPR gRNA sequence
agttaattaatatattttgc

SEQ ID NO: 266458 - DNA, 20 bp, Artificial
  CRISPR gRNA sequence
gttaattaatatattttgct

SEQ ID NO: 266459 - DNA, 20 bp, Artificial
  CRISPR gRNA sequence
attaatatattttgctctca

SEQ ID NO: 266460 - DNA, 20 bp, Artificial
  CRISPR gRNA sequence
atatattttgctctcaggaa

SEQ ID NO: 266461 - DNA, 20 bp, Artificial
  CRISPR gRNA sequence
tgctctcaggaagaaaaatt

SEQ ID NO: 266462 - DNA, 20 bp, Artificial
  CRISPR gRNA sequence
gctctcaggaagaaaaatta

SEQ ID NO: 266463 - DNA, 20 bp, Artificial
  CRISPR gRNA sequence
ctctcaggaagaaaaattat

SEQ ID NO: 266464 - DNA, 20 bp, Artificial
  CRISPR gRNA sequence
tcaggaagaaaaattatcct

SEQ ID NO: 266465 - DNA, 20 bp, Artificial
  CRISPR gRNA sequence
aggaagaaaaattatcctta

SEQ ID NO: 266466 - DNA, 20 bp, Artificial
  CRISPR gRNA sequence
tccttatattcttgttctaa

SEQ ID NO: 266467 - DNA, 20 bp, Artificial
  CRISPR gRNA sequence
atattcttgttctaagcaaa

SEQ ID NO: 266468 - DNA, 20 bp, Artificial
  CRISPR gRNA sequence
tattcttgttctaagcaaat

SEQ ID NO: 266469 - DNA, 20 bp, Artificial
  CRISPR gRNA sequence
ttgttctaagcaaatgattt

SEQ ID NO: 266470 - DNA, 20 bp, Artificial
  CRISPR gRNA sequence
gttctaagcaaatgattttt

SEQ ID NO: 266471 - DNA, 20 bp, Artificial
  CRISPR gRNA sequence
ttctaagcaaatgatttttt

SEQ ID NO: 266472 - DNA, 20 bp, Artificial
  CRISPR gRNA sequence
taagcaaatgattttttttt

SEQ ID NO: 266473 - DNA, 20 bp, Artificial
  CRISPR gRNA sequence
agcaaatgatttttttttcc

SEQ ID NO: 266474 - DNA, 20 bp, Artificial
  CRISPR gRNA sequence
ttttttcccccaggaaacaa

SEQ ID NO: 266475 - DNA, 20 bp, Artificial
  CRISPR gRNA sequence
tttttcccccaggaaacaag

SEQ ID NO: 266476 - DNA, 20 bp, Artificial
  CRISPR gRNA sequence
ttttcccccaggaaacaaga

SEQ ID NO: 266477 - DNA, 20 bp, Artificial
  CRISPR gRNA sequence
tttcccccaggaaacaagat

SEQ ID NO: 266478 - DNA, 20 bp, Artificial
  CRISPR gRNA sequence
ttcccccaggaaacaagatt

SEQ ID NO: 266479 - DNA, 20 bp, Artificial
  CRISPR gRNA sequence
tcccccaggaaacaagattt

SEQ ID NO: 266480 - DNA, 20 bp, Artificial
  CRISPR gRNA sequence
cccccaggaaacaagatttt

SEQ ID NO: 266481 - DNA, 20 bp, Artificial
  CRISPR gRNA sequence
ccccaggaaacaagattttg

SEQ ID NO: 266482 - DNA, 20 bp, Artificial
  CRISPR gRNA sequence
tggtgaagcagtcgcccatg

SEQ ID NO: 266483 - DNA, 20 bp, Artificial
  CRISPR gRNA sequence
ggtgaagcagtcgcccatgc

SEQ ID NO: 266484 - DNA, 20 bp, Artificial
  CRISPR gRNA sequence
gtgaagcagtcgcccatgct

SEQ ID NO: 266485 - DNA, 20 bp, Artificial
  CRISPR gRNA sequence
gtagcgtacgacaatgcggt

SEQ ID NO: 266486 - DNA, 20 bp, Artificial
  CRISPR gRNA sequence
tagcgtacgacaatgcggtc

SEQ ID NO: 266487 - DNA, 20 bp, Artificial
  CRISPR gRNA sequence
agctgcaagtattcctacaa

SEQ ID NO: 266488 - DNA, 20 bp, Artificial
  CRISPR gRNA sequence
gctgcaagtattcctacaat

SEQ ID NO: 266489 - DNA, 20 bp, Artificial
  CRISPR gRNA sequence
caagtattcctacaatctct

SEQ ID NO: 266490 - DNA, 20 bp, Artificial
  CRISPR gRNA sequence
ctacaatctcttctcaaggg

SEQ ID NO: 266491 - DNA, 20 bp, Artificial
  CRISPR gRNA sequence
caatctcttctcaagggagt

SEQ ID NO: 266492 - DNA, 20 bp, Artificial
  CRISPR gRNA sequence
ttctcaagggagttccgggc

SEQ ID NO: 266493 - DNA, 20 bp, Artificial
  CRISPR gRNA sequence
ctcaagggagttccgggcat

SEQ ID NO: 266494 - DNA, 20 bp, Artificial
  CRISPR gRNA sequence
tcaagggagttccgggcatc

SEQ ID NO: 266495 - DNA, 20 bp, Artificial
  CRISPR gRNA sequence
aagggagttccgggcatccc

SEQ ID NO: 266496 - DNA, 20 bp, Artificial
  CRISPR gRNA sequence
cgggcatcccttcacaaagg

SEQ ID NO: 266497 - DNA, 20 bp, Artificial
  CRISPR gRNA sequence
cacaaaggactggatagtgc

SEQ ID NO: 266498 - DNA, 20 bp, Artificial
  CRISPR gRNA sequence
acaaaggactggatagtgct

SEQ ID NO: 266499 - DNA, 20 bp, Artificial
  CRISPR gRNA sequence
gatagtgctgtggaagtctg

SEQ ID NO: 266500 - DNA, 20 bp, Artificial
  CRISPR gRNA sequence
tggaagtctgtgttgtatat

SEQ ID NO: 266501 - DNA, 20 bp, Artificial
  CRISPR gRNA sequence
tgttgtatatgggaattact

SEQ ID NO: 266502 - DNA, 20 bp, Artificial
  CRISPR gRNA sequence
tatatgggaattactcccag

SEQ ID NO: 266503 - DNA, 20 bp, Artificial
  CRISPR gRNA sequence
ctcccagcagcttcaggttt

SEQ ID NO: 266504 - DNA, 20 bp, Artificial
  CRISPR gRNA sequence
ccagcagcttcaggtttact

SEQ ID NO: 266505 - DNA, 20 bp, Artificial
  CRISPR gRNA sequence
caggtttactcaaaaacggg

SEQ ID NO: 266506 - DNA, 20 bp, Artificial
  CRISPR gRNA sequence
aggtttactcaaaaacgggg

SEQ ID NO: 266507 - DNA, 20 bp, Artificial
  CRISPR gRNA sequence
actcaaaaacggggttcaac

SEQ ID NO: 266508 - DNA, 20 bp, Artificial
  CRISPR gRNA sequence
ctcaaaaacggggttcaact

SEQ ID NO: 266509 - DNA, 20 bp, Artificial
  CRISPR gRNA sequence
aaaaacggggttcaactgtg

SEQ ID NO: 266510 - DNA, 20 bp, Artificial
  CRISPR gRNA sequence
aactgtgatgggaaattggg

SEQ ID NO: 266511 - DNA, 20 bp, Artificial
  CRISPR gRNA sequence
tgatgggaaattgggcaatg

SEQ ID NO: 266512 - DNA, 20 bp, Artificial
  CRISPR gRNA sequence
ggcaatgaatcagtgacatt

SEQ ID NO: 266513 - DNA, 20 bp, Artificial
  CRISPR gRNA sequence
tacctccagaatttgtatgt

SEQ ID NO: 266514 - DNA, 20 bp, Artificial
  CRISPR gRNA sequence
cctccagaatttgtatgtta

SEQ ID NO: 266515 - DNA, 20 bp, Artificial
  CRISPR gRNA sequence
cagaatttgtatgttaacca

SEQ ID NO: 266516 - DNA, 20 bp, Artificial
  CRISPR gRNA sequence
gtatgttaaccaaacagata

SEQ ID NO: 266517 - DNA, 20 bp, Artificial
  CRISPR gRNA sequence
tatgttaaccaaacagatat

SEQ ID NO: 266518 - DNA, 20 bp, Artificial
  CRISPR gRNA sequence
accaaacagatatttacttc

SEQ ID NO: 266519 - DNA, 20 bp, Artificial
  CRISPR gRNA sequence
acttctgcaaaattgaagtt

SEQ ID NO: 266520 - DNA, 20 bp, Artificial
  CRISPR gRNA sequence
cttctgcaaaattgaagtta

SEQ ID NO: 266521 - DNA, 20 bp, Artificial
  CRISPR gRNA sequence
ctgcaaaattgaagttatgt

SEQ ID NO: 266522 - DNA, 20 bp, Artificial
  CRISPR gRNA sequence
tgcaaaattgaagttatgta

SEQ ID NO: 266523 - DNA, 20 bp, Artificial
  CRISPR gRNA sequence
caaaattgaagttatgtatc

SEQ ID NO: 266524 - DNA, 20 bp, Artificial
  CRISPR gRNA sequence
aagttatgtatcctcctcct

SEQ ID NO: 266525 - DNA, 20 bp, Artificial
  CRISPR gRNA sequence
tgtatcctcctccttaccta

SEQ ID NO: 266526 - DNA, 20 bp, Artificial
  CRISPR gRNA sequence
ctccttacctagacaatgag

SEQ ID NO: 266527 - DNA, 20 bp, Artificial
  CRISPR gRNA sequence
cttacctagacaatgagaag

SEQ ID NO: 266528 - DNA, 20 bp, Artificial
  CRISPR gRNA sequence
acctagacaatgagaagagc

SEQ ID NO: 266529 - DNA, 20 bp, Artificial
  CRISPR gRNA sequence
cctagacaatgagaagagca

SEQ ID NO: 266530 - DNA, 20 bp, Artificial
  CRISPR gRNA sequence
gacaatgagaagagcaatgg

SEQ ID NO: 266531 - DNA, 20 bp, Artificial
  CRISPR gRNA sequence
tccatgtgaaaggtaacata

SEQ ID NO: 266532 - DNA, 20 bp, Artificial
  CRISPR gRNA sequence
taccagtgtaccaccctaaa

SEQ ID NO: 266533 - DNA, 20 bp, Artificial
  CRISPR gRNA sequence
accagtgtaccaccctaaag

SEQ ID NO: 266534 - DNA, 20 bp, Artificial
  CRISPR gRNA sequence
ccagtgtaccaccctaaagt

SEQ ID NO: 266535 - DNA, 20 bp, Artificial
  CRISPR gRNA sequence
aagtaatggttttcaaatgc

SEQ ID NO: 266536 - DNA, 20 bp, Artificial
  CRISPR gRNA sequence
tcaaatgcagtcctgaaaac

SEQ ID NO: 266537 - DNA, 20 bp, Artificial
  CRISPR gRNA sequence
caaatgcagtcctgaaaact

SEQ ID NO: 266538 - DNA, 20 bp, Artificial
  CRISPR gRNA sequence
aaatgcagtcctgaaaactg

SEQ ID NO: 266539 - DNA, 20 bp, Artificial
  CRISPR gRNA sequence
aaaactgggttgtggtcagt

SEQ ID NO: 266540 - DNA, 20 bp, Artificial
  CRISPR gRNA sequence
ggttgtggtcagtggtgggg

SEQ ID NO: 266541 - DNA, 20 bp, Artificial
  CRISPR gRNA sequence
tggtcagtggtggggttgaa

SEQ ID NO: 266542 - DNA, 20 bp, Artificial
  CRISPR gRNA sequence
aataaggcctaagtgatttg

SEQ ID NO: 266543 - DNA, 20 bp, Artificial
  CRISPR gRNA sequence
agtgatttgatactaacaaa

SEQ ID NO: 266544 - DNA, 20 bp, Artificial
  CRISPR gRNA sequence
gatactaacaaagacaaata

SEQ ID NO: 266545 - DNA, 20 bp, Artificial
  CRISPR gRNA sequence
atactaacaaagacaaataa

SEQ ID NO: 266546 - DNA, 20 bp, Artificial
  CRISPR gRNA sequence
acaaagacaaataatgtttt

SEQ ID NO: 266547 - DNA, 20 bp, Artificial
  CRISPR gRNA sequence
tcagaaaaatttttcccttt

SEQ ID NO: 266548 - DNA, 20 bp, Artificial
  CRISPR gRNA sequence
cagaaaaatttttcccttta

SEQ ID NO: 266549 - DNA, 20 bp, Artificial
  CRISPR gRNA sequence
agaaaaatttttccctttac

SEQ ID NO: 266550 - DNA, 20 bp, Artificial
  CRISPR gRNA sequence
ttccctttactgtagaggag

SEQ ID NO: 266551 - DNA, 20 bp, Artificial
  CRISPR gRNA sequence
tccctttactgtagaggaga

SEQ ID NO: 266552 - DNA, 20 bp, Artificial
  CRISPR gRNA sequence
ccctttactgtagaggagat

SEQ ID NO: 266553 - DNA, 20 bp, Artificial
  CRISPR gRNA sequence
cctttactgtagaggagatt

SEQ ID NO: 266554 - DNA, 20 bp, Artificial
  CRISPR gRNA sequence
tactgtagaggagattcaag

SEQ ID NO: 266555 - DNA, 20 bp, Artificial
  CRISPR gRNA sequence
actgtagaggagattcaagg

SEQ ID NO: 266556 - DNA, 20 bp, Artificial
  CRISPR gRNA sequence
ctgtagaggagattcaaggt

SEQ ID NO: 266557 - DNA, 20 bp, Artificial
  CRISPR gRNA sequence
tagaggagattcaaggttat

SEQ ID NO: 266558 - DNA, 20 bp, Artificial
  CRISPR gRNA sequence
aaggttatattttgaatatc

SEQ ID NO: 266559 - DNA, 20 bp, Artificial
  CRISPR gRNA sequence
tattttgaatatctttattt

SEQ ID NO: 266560 - DNA, 20 bp, Artificial
  CRISPR gRNA sequence
tgaatatctttattttcctt

SEQ ID NO: 266561 - DNA, 20 bp, Artificial
  CRISPR gRNA sequence
gaatatctttattttccttt

SEQ ID NO: 266562 - DNA, 20 bp, Artificial
  CRISPR gRNA sequence
aatatctttattttcctttg

SEQ ID NO: 266563 - DNA, 20 bp, Artificial
  CRISPR gRNA sequence
tattttcctttgctgacatt

SEQ ID NO: 266564 - DNA, 20 bp, Artificial
  CRISPR gRNA sequence
attttcctttgctgacattg

SEQ ID NO: 266565 - DNA, 20 bp, Artificial
  CRISPR gRNA sequence
ttttcctttgctgacattga

SEQ ID NO: 266566 - DNA, 20 bp, Artificial
  CRISPR gRNA sequence
tcctttgctgacattgagcg

SEQ ID NO: 266567 - DNA, 20 bp, Artificial
  CRISPR gRNA sequence
cctttgctgacattgagcgg

SEQ ID NO: 266568 - DNA, 20 bp, Artificial
  CRISPR gRNA sequence
ctttgctgacattgagcggg

SEQ ID NO: 266569 - DNA, 20 bp, Artificial
  CRISPR gRNA sequence
tgctgacattgagcgggaga

SEQ ID NO: 266570 - DNA, 20 bp, Artificial
  CRISPR gRNA sequence
gctgacattgagcgggagag

SEQ ID NO: 266571 - DNA, 20 bp, Artificial
  CRISPR gRNA sequence
ctgacattgagcgggagagt

SEQ ID NO: 266572 - DNA, 20 bp, Artificial
  CRISPR gRNA sequence
acattgagcgggagagtaag

SEQ ID NO: 266573 - DNA, 20 bp, Artificial
  CRISPR gRNA sequence
agcgggagagtaagtgatga

SEQ ID NO: 266574 - DNA, 20 bp, Artificial
  CRISPR gRNA sequence
ccgcatgtgggaacagatca

SEQ ID NO: 266575 - DNA, 20 bp, Artificial
  CRISPR gRNA sequence
ttctccattccagtggatca

SEQ ID NO: 266576 - DNA, 20 bp, Artificial
  CRISPR gRNA sequence
tctccattccagtggatcat

SEQ ID NO: 266577 - DNA, 20 bp, Artificial
  CRISPR gRNA sequence
ctccattccagtggatcatg

SEQ ID NO: 266578 - DNA, 20 bp, Artificial
  CRISPR gRNA sequence
tccattccagtggatcatgg

SEQ ID NO: 266579 - DNA, 20 bp, Artificial
  CRISPR gRNA sequence
cattccagtggatcatggca

SEQ ID NO: 266580 - DNA, 20 bp, Artificial
  CRISPR gRNA sequence
cagtggatcatggcagaaaa

SEQ ID NO: 266581 - DNA, 20 bp, Artificial
  CRISPR gRNA sequence
ccattaaaatgtaagcccag

SEQ ID NO: 266582 - DNA, 20 bp, Artificial
  CRISPR gRNA sequence
aaatgtaagcccaggtgccc

SEQ ID NO: 266583 - DNA, 20 bp, Artificial
  CRISPR gRNA sequence
aagtaacagctgggtctaat

SEQ ID NO: 266584 - DNA, 20 bp, Artificial
  CRISPR gRNA sequence
ggtctaatgggttaagactc

SEQ ID NO: 266585 - DNA, 20 bp, Artificial
  CRISPR gRNA sequence
atgggttaagactcaggaag

SEQ ID NO: 266586 - DNA, 20 bp, Artificial
  CRISPR gRNA sequence
agactcaggaagactcactt

SEQ ID NO: 266587 - DNA, 20 bp, Artificial
  CRISPR gRNA sequence
aggaagactcacttctattt

SEQ ID NO: 266588 - DNA, 20 bp, Artificial
  CRISPR gRNA sequence
acttctatttctaattaatt

SEQ ID NO: 266589 - DNA, 20 bp, Artificial
  CRISPR gRNA sequence
ctatttctaattaattcttt

SEQ ID NO: 266590 - DNA, 20 bp, Artificial
  CRISPR gRNA sequence
tatttctaattaattctttt

SEQ ID NO: 266591 - DNA, 20 bp, Artificial
  CRISPR gRNA sequence
tttctaattaattctttttt

SEQ ID NO: 266592 - DNA, 20 bp, Artificial
  CRISPR gRNA sequence
ctaattaattctttttttgt

SEQ ID NO: 266593 - DNA, 20 bp, Artificial
  CRISPR gRNA sequence
taattaattctttttttgtg

SEQ ID NO: 266594 - DNA, 20 bp, Artificial
  CRISPR gRNA sequence
attaattctttttttgtgct

SEQ ID NO: 266595 - DNA, 20 bp, Artificial
  CRISPR gRNA sequence
attctttttttgtgctccat

SEQ ID NO: 266596 - DNA, 20 bp, Artificial
  CRISPR gRNA sequence
tttttttgtgctccataatc

SEQ ID NO: 266597 - DNA, 20 bp, Artificial
  CRISPR gRNA sequence
tttttgtgctccataatctt

SEQ ID NO: 266598 - DNA, 20 bp, Artificial
  CRISPR gRNA sequence
ttttgtgctccataatcttc

SEQ ID NO: 266599 - DNA, 20 bp, Artificial
  CRISPR gRNA sequence
tttgtgctccataatcttcc

SEQ ID NO: 266600 - DNA, 20 bp, Artificial
  CRISPR gRNA sequence
ttgtgctccataatcttcct

SEQ ID NO: 266601 - DNA, 20 bp, Artificial
  CRISPR gRNA sequence
tgtgctccataatcttcctc

SEQ ID NO: 266602 - DNA, 20 bp, Artificial
  CRISPR gRNA sequence
gtgctccataatcttcctct

SEQ ID NO: 266603 - DNA, 20 bp, Artificial
  CRISPR gRNA sequence
tgctccataatcttcctctg

SEQ ID NO: 266604 - DNA, 20 bp, Artificial
  CRISPR gRNA sequence
cataatcttcctctgtaaaa

SEQ ID NO: 266605 - DNA, 20 bp, Artificial
  CRISPR gRNA sequence
cctctgtaaaagtacctttc

SEQ ID NO: 266606 - DNA, 20 bp, Artificial
  CRISPR gRNA sequence
ctctgtaaaagtacctttcc

SEQ ID NO: 266607 - DNA, 20 bp, Artificial
  CRISPR gRNA sequence
tgtaaaagtacctttccatt

SEQ ID NO: 266608 - DNA, 20 bp, Artificial
  CRISPR gRNA sequence
taaaagtacctttccatttt

SEQ ID NO: 266609 - DNA, 20 bp, Artificial
  CRISPR gRNA sequence
tccattttctttttccttcc

SEQ ID NO: 266610 - DNA, 20 bp, Artificial
  CRISPR gRNA sequence
ccattttctttttccttcct

SEQ ID NO: 266611 - DNA, 20 bp, Artificial
  CRISPR gRNA sequence
cattttctttttccttcctt

SEQ ID NO: 266612 - DNA, 20 bp, Artificial
  CRISPR gRNA sequence
tctttttccttccttccttc

SEQ ID NO: 266613 - DNA, 20 bp, Artificial
  CRISPR gRNA sequence
ctttttccttccttccttcc

SEQ ID NO: 266614 - DNA, 20 bp, Artificial
  CRISPR gRNA sequence
tttttccttccttccttcct

SEQ ID NO: 266615 - DNA, 20 bp, Artificial
  CRISPR gRNA sequence
tttccttccttccttccttc

SEQ ID NO: 266616 - DNA, 20 bp, Artificial
  CRISPR gRNA sequence
ttccttccttccttccttcc

SEQ ID NO: 266617 - DNA, 20 bp, Artificial
  CRISPR gRNA sequence
tccttccttccttccttcct

SEQ ID NO: 266618 - DNA, 20 bp, Artificial
  CRISPR gRNA sequence
ccttccttccttccttcctt

SEQ ID NO: 266619 - DNA, 20 bp, Artificial
  CRISPR gRNA sequence
cttccttccttccttccttc

SEQ ID NO: 266620 - DNA, 20 bp, Artificial
  CRISPR gRNA sequence
ccttccttccttccttcctt

SEQ ID NO: 266621 - DNA, 20 bp, Artificial
  CRISPR gRNA sequence
cttccttccttccttccttc

SEQ ID NO: 266622 - DNA, 20 bp, Artificial
  CRISPR gRNA sequence
ccttccttccttccttcctt

SEQ ID NO: 266623 - DNA, 20 bp, Artificial
  CRISPR gRNA sequence
cttccttccttccttccttc

SEQ ID NO: 266624 - DNA, 20 bp, Artificial
  CRISPR gRNA sequence
ccttccttccttccttcctt

SEQ ID NO: 266625 - DNA, 20 bp, Artificial
  CRISPR gRNA sequence
cttccttccttccttccttc

SEQ ID NO: 266626 - DNA, 20 bp, Artificial
  CRISPR gRNA sequence
ccttccttccttccttcctt

SEQ ID NO: 266627 - DNA, 20 bp, Artificial
  CRISPR gRNA sequence
cttccttccttccttccttt

SEQ ID NO: 266628 - DNA, 20 bp, Artificial
  CRISPR gRNA sequence
ccttccttccttccttttct

SEQ ID NO: 266629 - DNA, 20 bp, Artificial
  CRISPR gRNA sequence
cttccttccttccttttctt

SEQ ID NO: 266630 - DNA, 20 bp, Artificial
  CRISPR gRNA sequence
ccttccttccttttcttttc

SEQ ID NO: 266631 - DNA, 20 bp, Artificial
  CRISPR gRNA sequence
cttccttccttttcttttct

SEQ ID NO: 266632 - DNA, 20 bp, Artificial
  CRISPR gRNA sequence
ccttccttttcttttctttt

SEQ ID NO: 266633 - DNA, 20 bp, Artificial
  CRISPR gRNA sequence
cttccttttcttttcttttt

SEQ ID NO: 266634 - DNA, 20 bp, Artificial
  CRISPR gRNA sequence
ccttttcttttctttttctt

SEQ ID NO: 266635 - DNA, 20 bp, Artificial
  CRISPR gRNA sequence
cttttcttttctttttcttt

SEQ ID NO: 266636 - DNA, 20 bp, Artificial
  CRISPR gRNA sequence
ttcttttctttttctttttc

SEQ ID NO: 266637 - DNA, 20 bp, Artificial
  CRISPR gRNA sequence
tcttttctttttctttttct

SEQ ID NO: 266638 - DNA, 20 bp, Artificial
  CRISPR gRNA sequence
cttttctttttctttttctt

SEQ ID NO: 266639 - DNA, 20 bp, Artificial
  CRISPR gRNA sequence
ttttctttttctttttcttt

SEQ ID NO: 266640 - DNA, 20 bp, Artificial
  CRISPR gRNA sequence
ttctttttctttttcttttt

SEQ ID NO: 266641 - DNA, 20 bp, Artificial
  CRISPR gRNA sequence
tctttttctttttctttttt

SEQ ID NO: 266642 - DNA, 20 bp, Artificial
  CRISPR gRNA sequence
ctttttctttttcttttttt

SEQ ID NO: 266643 - DNA, 20 bp, Artificial
  CRISPR gRNA sequence
tttttctttttctttttttt

SEQ ID NO: 266644 - DNA, 20 bp, Artificial
  CRISPR gRNA sequence
tttctttttctttttttttg

SEQ ID NO: 266645 - DNA, 20 bp, Artificial
  CRISPR gRNA sequence
ttctttttctttttttttga

SEQ ID NO: 266646 - DNA, 20 bp, Artificial
  CRISPR gRNA sequence
tctttttctttttttttgag

SEQ ID NO: 266647 - DNA, 20 bp, Artificial
  CRISPR gRNA sequence
ctttttctttttttttgaga

SEQ ID NO: 266648 - DNA, 20 bp, Artificial
  CRISPR gRNA sequence
tttttctttttttttgagac

SEQ ID NO: 266649 - DNA, 20 bp, Artificial
  CRISPR gRNA sequence
tttctttttttttgagacgg

SEQ ID NO: 266650 - DNA, 20 bp, Artificial
  CRISPR gRNA sequence
ttctttttttttgagacgga

SEQ ID NO: 266651 - DNA, 20 bp, Artificial
  CRISPR gRNA sequence
tctttttttttgagacggac

SEQ ID NO: 266652 - DNA, 20 bp, Artificial
  CRISPR gRNA sequence
ctttttttttgagacggact

SEQ ID NO: 266653 - DNA, 20 bp, Artificial
  CRISPR gRNA sequence
tttttttttgagacggactc

SEQ ID NO: 266654 - DNA, 20 bp, Artificial
  CRISPR gRNA sequence
tttttttgagacggactctc

SEQ ID NO: 266655 - DNA, 20 bp, Artificial
  CRISPR gRNA sequence
ttttttgagacggactctcg

SEQ ID NO: 266656 - DNA, 20 bp, Artificial
  CRISPR gRNA sequence
tttttgagacggactctcgc

SEQ ID NO: 266657 - DNA, 20 bp, Artificial
  CRISPR gRNA sequence
ttttgagacggactctcgct

SEQ ID NO: 266658 - DNA, 20 bp, Artificial
  CRISPR gRNA sequence
tttgagacggactctcgctc

SEQ ID NO: 266659 - DNA, 20 bp, Artificial
  CRISPR gRNA sequence
ttgagacggactctcgctct

SEQ ID NO: 266660 - DNA, 20 bp, Artificial
  CRISPR gRNA sequence
tgagacggactctcgctctg

SEQ ID NO: 266661 - DNA, 20 bp, Artificial
  CRISPR gRNA sequence
gagacggactctcgctctgt

SEQ ID NO: 266662 - DNA, 20 bp, Artificial
  CRISPR gRNA sequence
agacggactctcgctctgtc

SEQ ID NO: 266663 - DNA, 20 bp, Artificial
  CRISPR gRNA sequence
tcgctctgtcgcccaggctg

SEQ ID NO: 266664 - DNA, 20 bp, Artificial
  CRISPR gRNA sequence
gctctgtcgcccaggctgga

SEQ ID NO: 266665 - DNA, 20 bp, Artificial
  CRISPR gRNA sequence
tgtcgcccaggctggagtgc

SEQ ID NO: 266666 - DNA, 20 bp, Artificial
  CRISPR gRNA sequence
tcgcccaggctggagtgcag

SEQ ID NO: 266667 - DNA, 20 bp, Artificial
  CRISPR gRNA sequence
gagtgcagtggcgggatctc

SEQ ID NO: 266668 - DNA, 20 bp, Artificial
  CRISPR gRNA sequence
agttcactgcaagctctgcc

SEQ ID NO: 266669 - DNA, 20 bp, Artificial
  CRISPR gRNA sequence
actgcaagctctgcctcccg

SEQ ID NO: 266670 - DNA, 20 bp, Artificial
  CRISPR gRNA sequence
caagctctgcctcccgggtt

SEQ ID NO: 266671 - DNA, 20 bp, Artificial
  CRISPR gRNA sequence
tgcctcccgggttcacgtca

SEQ ID NO: 266672 - DNA, 20 bp, Artificial
  CRISPR gRNA sequence
cctcccgggttcacgtcatt

SEQ ID NO: 266673 - DNA, 20 bp, Artificial
  CRISPR gRNA sequence
ccgggttcacgtcattctcc

SEQ ID NO: 266674 - DNA, 20 bp, Artificial
  CRISPR gRNA sequence
acgtcattctcctgcctcag

SEQ ID NO: 266675 - DNA, 20 bp, Artificial
  CRISPR gRNA sequence
tcctgcctcagcctcccgat

SEQ ID NO: 266676 - DNA, 20 bp, Artificial
  CRISPR gRNA sequence
ctgcctcagcctcccgatca

SEQ ID NO: 266677 - DNA, 20 bp, Artificial
  CRISPR gRNA sequence
cctcagcctcccgatcagct

SEQ ID NO: 266678 - DNA, 20 bp, Artificial
  CRISPR gRNA sequence
agcctcccgatcagctggga

SEQ ID NO: 266679 - DNA, 20 bp, Artificial
  CRISPR gRNA sequence
ccgatcagctgggactacag

SEQ ID NO: 266680 - DNA, 20 bp, Artificial
  CRISPR gRNA sequence
ggactacagggcccgccacc

SEQ ID NO: 266681 - DNA, 20 bp, Artificial
  CRISPR gRNA sequence
cagggcccgccaccacgcct

SEQ ID NO: 266682 - DNA, 20 bp, Artificial
  CRISPR gRNA sequence
gcttattttttgtatattta

SEQ ID NO: 266683 - DNA, 20 bp, Artificial
  CRISPR gRNA sequence
attttttgtatatttattta

SEQ ID NO: 266684 - DNA, 20 bp, Artificial
  CRISPR gRNA sequence
ttttttgtatatttatttat

SEQ ID NO: 266685 - DNA, 20 bp, Artificial
  CRISPR gRNA sequence
tttgtatatttatttattta

SEQ ID NO: 266686 - DNA, 20 bp, Artificial
  CRISPR gRNA sequence
ttgtatatttatttatttat

SEQ ID NO: 266687 - DNA, 20 bp, Artificial
  CRISPR gRNA sequence
tgtatatttatttatttatt

SEQ ID NO: 266688 - DNA, 20 bp, Artificial
  CRISPR gRNA sequence
gtatatttatttatttattt

SEQ ID NO: 266689 - DNA, 20 bp, Artificial
  CRISPR gRNA sequence
tatatttatttatttattta

SEQ ID NO: 266690 - DNA, 20 bp, Artificial
  CRISPR gRNA sequence
atttatttatttattttaat

SEQ ID NO: 266691 - DNA, 20 bp, Artificial
  CRISPR gRNA sequence
tttatttatttattttaatt

SEQ ID NO: 266692 - DNA, 20 bp, Artificial
  CRISPR gRNA sequence
atttatttattttaattaat

SEQ ID NO: 266693 - DNA, 20 bp, Artificial
  CRISPR gRNA sequence
tttatttattttaattaatt

SEQ ID NO: 266694 - DNA, 20 bp, Artificial
  CRISPR gRNA sequence
atttattttaattaattaat

SEQ ID NO: 266695 - DNA, 20 bp, Artificial
  CRISPR gRNA sequence
tttattttaattaattaatt

SEQ ID NO: 266696 - DNA, 20 bp, Artificial
  CRISPR gRNA sequence
attttaattaattaattttt

SEQ ID NO: 266697 - DNA, 20 bp, Artificial
  CRISPR gRNA sequence
ttttaattaattaatttttt

SEQ ID NO: 266698 - DNA, 20 bp, Artificial
  CRISPR gRNA sequence
taattaattaattttttttt

SEQ ID NO: 266699 - DNA, 20 bp, Artificial
  CRISPR gRNA sequence
aattaattaatttttttttt

SEQ ID NO: 266700 - DNA, 20 bp, Artificial
  CRISPR gRNA sequence
attaattaattttttttttt

SEQ ID NO: 266701 - DNA, 20 bp, Artificial
  CRISPR gRNA sequence
attaatttttttttttgaga

SEQ ID NO: 266702 - DNA, 20 bp, Artificial
  CRISPR gRNA sequence
atttttttttttgagaggga

SEQ ID NO: 266703 - DNA, 20 bp, Artificial
  CRISPR gRNA sequence
ttttttttgagagggagtct

SEQ ID NO: 266704 - DNA, 20 bp, Artificial
  CRISPR gRNA sequence
tttttttgagagggagtctt

SEQ ID NO: 266705 - DNA, 20 bp, Artificial
  CRISPR gRNA sequence
ttttttgagagggagtcttg

SEQ ID NO: 266706 - DNA, 20 bp, Artificial
  CRISPR gRNA sequence
tttttgagagggagtcttgc

SEQ ID NO: 266707 - DNA, 20 bp, Artificial
  CRISPR gRNA sequence
ttttgagagggagtcttgct

SEQ ID NO: 266708 - DNA, 20 bp, Artificial
  CRISPR gRNA sequence
tttgagagggagtcttgctc

SEQ ID NO: 266709 - DNA, 20 bp, Artificial
  CRISPR gRNA sequence
ttgagagggagtcttgctct

SEQ ID NO: 266710 - DNA, 20 bp, Artificial
  CRISPR gRNA sequence
tgagagggagtcttgctctg

SEQ ID NO: 266711 - DNA, 20 bp, Artificial
  CRISPR gRNA sequence
gagagggagtcttgctctgt

SEQ ID NO: 266712 - DNA, 20 bp, Artificial
  CRISPR gRNA sequence
agagggagtcttgctctgtc

SEQ ID NO: 266713 - DNA, 20 bp, Artificial
  CRISPR gRNA sequence
gctctgtcgcccaggctgga

SEQ ID NO: 266714 - DNA, 20 bp, Artificial
  CRISPR gRNA sequence
ctctgtcgcccaggctggaa

SEQ ID NO: 266715 - DNA, 20 bp, Artificial
  CRISPR gRNA sequence
tgtcgcccaggctggaatgc

SEQ ID NO: 266716 - DNA, 20 bp, Artificial
  CRISPR gRNA sequence
tcgcccaggctggaatgcgg

SEQ ID NO: 266717 - DNA, 20 bp, Artificial
  CRISPR gRNA sequence
gaatgcggtggcgcgatctc

SEQ ID NO: 266718 - DNA, 20 bp, Artificial
  CRISPR gRNA sequence
ggctcactgcaagctccgcc

SEQ ID NO: 266719 - DNA, 20 bp, Artificial
  CRISPR gRNA sequence
actgcaagctccgcctccca

SEQ ID NO: 266720 - DNA, 20 bp, Artificial
  CRISPR gRNA sequence
caagctccgcctcccaggtt

SEQ ID NO: 266721 - DNA, 20 bp, Artificial
  CRISPR gRNA sequence
cgcctcccaggttcatgcca

SEQ ID NO: 266722 - DNA, 20 bp, Artificial
  CRISPR gRNA sequence
ccaggttcatgccattctcc

SEQ ID NO: 266723 - DNA, 20 bp, Artificial
  CRISPR gRNA sequence
atgccattctcctgcctcag

SEQ ID NO: 266724 - DNA, 20 bp, Artificial
  CRISPR gRNA sequence
tcctgcctcagcctcctgag

SEQ ID NO: 266725 - DNA, 20 bp, Artificial
  CRISPR gRNA sequence
ctgcctcagcctcctgagta

SEQ ID NO: 266726 - DNA, 20 bp, Artificial
  CRISPR gRNA sequence
cctcagcctcctgagtagct

SEQ ID NO: 266727 - DNA, 20 bp, Artificial
  CRISPR gRNA sequence
agcctcctgagtagctggga

SEQ ID NO: 266728 - DNA, 20 bp, Artificial
  CRISPR gRNA sequence
ctgagtagctgggactacag

SEQ ID NO: 266729 - DNA, 20 bp, Artificial
  CRISPR gRNA sequence
agtagctgggactacaggta

SEQ ID NO: 266730 - DNA, 20 bp, Artificial
  CRISPR gRNA sequence
ggactacaggtacctgccac

SEQ ID NO: 266731 - DNA, 20 bp, Artificial
  CRISPR gRNA sequence
caggtacctgccaccatgcc

SEQ ID NO: 266732 - DNA, 20 bp, Artificial
  CRISPR gRNA sequence
ccaccatgcccggctaattt

SEQ ID NO: 266733 - DNA, 20 bp, Artificial
  CRISPR gRNA sequence
attttttgtatttttagtag

SEQ ID NO: 266734 - DNA, 20 bp, Artificial
  CRISPR gRNA sequence
tttgtatttttagtagacag

SEQ ID NO: 266735 - DNA, 20 bp, Artificial
  CRISPR gRNA sequence
ttgtatttttagtagacagg

SEQ ID NO: 266736 - DNA, 20 bp, Artificial
  CRISPR gRNA sequence
tgtatttttagtagacaggg

SEQ ID NO: 266737 - DNA, 20 bp, Artificial
  CRISPR gRNA sequence
gtatttttagtagacagggt

SEQ ID NO: 266738 - DNA, 20 bp, Artificial
  CRISPR gRNA sequence
tatttttagtagacagggtt

SEQ ID NO: 266739 - DNA, 20 bp, Artificial
  CRISPR gRNA sequence
ttagtagacagggtttcacc

SEQ ID NO: 266740 - DNA, 20 bp, Artificial
  CRISPR gRNA sequence
tagtagacagggtttcacct

SEQ ID NO: 266741 - DNA, 20 bp, Artificial
  CRISPR gRNA sequence
agtagacagggtttcacctt

SEQ ID NO: 266742 - DNA, 20 bp, Artificial
  CRISPR gRNA sequence
gtagacagggtttcaccttg

SEQ ID NO: 266743 - DNA, 20 bp, Artificial
  CRISPR gRNA sequence
caccttgttagccaggatgg

SEQ ID NO: 266744 - DNA, 20 bp, Artificial
  CRISPR gRNA sequence
accttgttagccaggatggt

SEQ ID NO: 266745 - DNA, 20 bp, Artificial
  CRISPR gRNA sequence
gttagccaggatggtctcga

SEQ ID NO: 266746 - DNA, 20 bp, Artificial
  CRISPR gRNA sequence
ttagccaggatggtctcgat

SEQ ID NO: 266747 - DNA, 20 bp, Artificial
  CRISPR gRNA sequence
gccaggatggtctcgatttc

SEQ ID NO: 266748 - DNA, 20 bp, Artificial
  CRISPR gRNA sequence
gatttcctgacctcgtgacc

SEQ ID NO: 266749 - DNA, 20 bp, Artificial
  CRISPR gRNA sequence
cctgacctcgtgacccgccc

SEQ ID NO: 266750 - DNA, 20 bp, Artificial
  CRISPR gRNA sequence
ctgacctcgtgacccgcccg

SEQ ID NO: 266751 - DNA, 20 bp, Artificial
  CRISPR gRNA sequence
acctcgtgacccgcccgtgt

SEQ ID NO: 266752 - DNA, 20 bp, Artificial
  CRISPR gRNA sequence
gtgacccgcccgtgttggcc

SEQ ID NO: 266753 - DNA, 20 bp, Artificial
  CRISPR gRNA sequence
gcctcccaaagtgctgggat

SEQ ID NO: 266754 - DNA, 20 bp, Artificial
  CRISPR gRNA sequence
ccaaagtgctgggattacag

SEQ ID NO: 266755 - DNA, 20 bp, Artificial
  CRISPR gRNA sequence
ggattacaggcgtgagccac

SEQ ID NO: 266756 - DNA, 20 bp, Artificial
  CRISPR gRNA sequence
caggcgtgagccaccgcgcc

SEQ ID NO: 266757 - DNA, 20 bp, Artificial
  CRISPR gRNA sequence
tttgtacttttagtagagac

SEQ ID NO: 266758 - DNA, 20 bp, Artificial
  CRISPR gRNA sequence
ttgtacttttagtagagacg

SEQ ID NO: 266759 - DNA, 20 bp, Artificial
  CRISPR gRNA sequence
tgtacttttagtagagacgg

SEQ ID NO: 266760 - DNA, 20 bp, Artificial
  CRISPR gRNA sequence
gtacttttagtagagacggg

SEQ ID NO: 266761 - DNA, 20 bp, Artificial
  CRISPR gRNA sequence
tacttttagtagagacgggg

SEQ ID NO: 266762 - DNA, 20 bp, Artificial
  CRISPR gRNA sequence
ttagtagagacggggtttca

SEQ ID NO: 266763 - DNA, 20 bp, Artificial
  CRISPR gRNA sequence
tagtagagacggggtttcac

SEQ ID NO: 266764 - DNA, 20 bp, Artificial
  CRISPR gRNA sequence
agtagagacggggtttcacc

SEQ ID NO: 266765 - DNA, 20 bp, Artificial
  CRISPR gRNA sequence
gtagagacggggtttcaccg

SEQ ID NO: 266766 - DNA, 20 bp, Artificial
  CRISPR gRNA sequence
caccgtgttagcaaggatgg

SEQ ID NO: 266767 - DNA, 20 bp, Artificial
  CRISPR gRNA sequence
accgtgttagcaaggatggt

SEQ ID NO: 266768 - DNA, 20 bp, Artificial
  CRISPR gRNA sequence
gcaaggatggtctcaatctc

SEQ ID NO: 266769 - DNA, 20 bp, Artificial
  CRISPR gRNA sequence
aatctcctgacctcgtgatc

SEQ ID NO: 266770 - DNA, 20 bp, Artificial
  CRISPR gRNA sequence
ctgacctcgtgatctgccca

SEQ ID NO: 266771 - DNA, 20 bp, Artificial
  CRISPR gRNA sequence
acctcgtgatctgcccacct

SEQ ID NO: 266772 - DNA, 20 bp, Artificial
  CRISPR gRNA sequence
gtgatctgcccacctgggcc

SEQ ID NO: 266773 - DNA, 20 bp, Artificial
  CRISPR gRNA sequence
cccacctgggcctcccaaag

SEQ ID NO: 266774 - DNA, 20 bp, Artificial
  CRISPR gRNA sequence
ggcctcccaaagtgctgtga

SEQ ID NO: 266775 - DNA, 20 bp, Artificial
  CRISPR gRNA sequence
ccaaagtgctgtgattacag

SEQ ID NO: 266776 - DNA, 20 bp, Artificial
  CRISPR gRNA sequence
tgattacaggcgtaagccac

SEQ ID NO: 266777 - DNA, 20 bp, Artificial
  CRISPR gRNA sequence
caggcgtaagccaccgcgcc

SEQ ID NO: 266778 - DNA, 20 bp, Artificial
  CRISPR gRNA sequence
tccattttctaaaatataca

SEQ ID NO: 266779 - DNA, 20 bp, Artificial
  CRISPR gRNA sequence
ccattttctaaaatatacaa

SEQ ID NO: 266780 - DNA, 20 bp, Artificial
  CRISPR gRNA sequence
cattttctaaaatatacaaa

SEQ ID NO: 266781 - DNA, 20 bp, Artificial
  CRISPR gRNA sequence
tctaaaatatacaaagaatg

SEQ ID NO: 266782 - DNA, 20 bp, Artificial
  CRISPR gRNA sequence
ctaaaatatacaaagaatgc

SEQ ID NO: 266783 - DNA, 20 bp, Artificial
  CRISPR gRNA sequence
taaaatatacaaagaatgct

SEQ ID NO: 266784 - DNA, 20 bp, Artificial
  CRISPR gRNA sequence
aaatatacaaagaatgctgg

SEQ ID NO: 266785 - DNA, 20 bp, Artificial
  CRISPR gRNA sequence
gactagaaaccgggggacat

SEQ ID NO: 266786 - DNA, 20 bp, Artificial
  CRISPR gRNA sequence
gaaaccgggggacataaaat

SEQ ID NO: 266787 - DNA, 20 bp, Artificial
  CRISPR gRNA sequence
gctattaatcaactgtgtga

SEQ ID NO: 266788 - DNA, 20 bp, Artificial
  CRISPR gRNA sequence
ctattaatcaactgtgtgat

SEQ ID NO: 266789 - DNA, 20 bp, Artificial
  CRISPR gRNA sequence
ttaatcaactgtgtgatctt

SEQ ID NO: 266790 - DNA, 20 bp, Artificial
  CRISPR gRNA sequence
atcaactgtgtgatcttgga

SEQ ID NO: 266791 - DNA, 20 bp, Artificial
  CRISPR gRNA sequence
tgtgatcttggataagtcac

SEQ ID NO: 266792 - DNA, 20 bp, Artificial
  CRISPR gRNA sequence
ggataagtcacctaactttt

SEQ ID NO: 266793 - DNA, 20 bp, Artificial
  CRISPR gRNA sequence
gataagtcacctaacttttt

SEQ ID NO: 266794 - DNA, 20 bp, Artificial
  CRISPR gRNA sequence
actttttcatagtcaaaaac

SEQ ID NO: 266795 - DNA, 20 bp, Artificial
  CRISPR gRNA sequence
tttcatagtcaaaaactcag

SEQ ID NO: 266796 - DNA, 20 bp, Artificial
  CRISPR gRNA sequence
ttcatagtcaaaaactcagt

SEQ ID NO: 266797 - DNA, 20 bp, Artificial
  CRISPR gRNA sequence
tcatagtcaaaaactcagta

SEQ ID NO: 266798 - DNA, 20 bp, Artificial
  CRISPR gRNA sequence
catagtcaaaaactcagtac

SEQ ID NO: 266799 - DNA, 20 bp, Artificial
  CRISPR gRNA sequence
atagtcaaaaactcagtaca

SEQ ID NO: 266800 - DNA, 20 bp, Artificial
  CRISPR gRNA sequence
agtacaactgttaagcagta

SEQ ID NO: 266801 - DNA, 20 bp, Artificial
  CRISPR gRNA sequence
ttaagcagtatttgtgaatt

SEQ ID NO: 266802 - DNA, 20 bp, Artificial
  CRISPR gRNA sequence
agcagtatttgtgaattagt

SEQ ID NO: 266803 - DNA, 20 bp, Artificial
  CRISPR gRNA sequence
gtgaattagtgaaaataagt

SEQ ID NO: 266804 - DNA, 20 bp, Artificial
  CRISPR gRNA sequence
tgaattagtgaaaataagtc

SEQ ID NO: 266805 - DNA, 20 bp, Artificial
  CRISPR gRNA sequence
gtgaaaataagtctactgaa

SEQ ID NO: 266806 - DNA, 20 bp, Artificial
  CRISPR gRNA sequence
ctgaacttttgttgatgtta

SEQ ID NO: 266807 - DNA, 20 bp, Artificial
  CRISPR gRNA sequence
aacttttgttgatgttatgt

SEQ ID NO: 266808 - DNA, 20 bp, Artificial
  CRISPR gRNA sequence
ttgttgatgttatgttctgc

SEQ ID NO: 266809 - DNA, 20 bp, Artificial
  CRISPR gRNA sequence
tgttgatgttatgttctgcc

SEQ ID NO: 266810 - DNA, 20 bp, Artificial
  CRISPR gRNA sequence
gttgatgttatgttctgcct

SEQ ID NO: 266811 - DNA, 20 bp, Artificial
  CRISPR gRNA sequence
ttgatgttatgttctgccta

SEQ ID NO: 266812 - DNA, 20 bp, Artificial
  CRISPR gRNA sequence
atgttatgttctgcctaaat

SEQ ID NO: 266813 - DNA, 20 bp, Artificial
  CRISPR gRNA sequence
tgttctgcctaaatgttagg

SEQ ID NO: 266814 - DNA, 20 bp, Artificial
  CRISPR gRNA sequence
tgcctaaatgttagggagaa

SEQ ID NO: 266815 - DNA, 20 bp, Artificial
  CRISPR gRNA sequence
cctaaatgttagggagaaaa

SEQ ID NO: 266816 - DNA, 20 bp, Artificial
  CRISPR gRNA sequence
aatgttagggagaaaaatca

SEQ ID NO: 266817 - DNA, 20 bp, Artificial
  CRISPR gRNA sequence
gggagaaaaatcatgattcc

SEQ ID NO: 266818 - DNA, 20 bp, Artificial
  CRISPR gRNA sequence
cccaactcagaagaatacag

SEQ ID NO: 266819 - DNA, 20 bp, Artificial
  CRISPR gRNA sequence
agaagaatacagtattggta

SEQ ID NO: 266820 - DNA, 20 bp, Artificial
  CRISPR gRNA sequence
gtagcaacaagtaaagtttg

SEQ ID NO: 266821 - DNA, 20 bp, Artificial
  CRISPR gRNA sequence
gattttttggtatactttgt

SEQ ID NO: 266822 - DNA, 20 bp, Artificial
  CRISPR gRNA sequence
attttttggtatactttgtg

SEQ ID NO: 266823 - DNA, 20 bp, Artificial
  CRISPR gRNA sequence
tttggtatactttgtggata

SEQ ID NO: 266824 - DNA, 20 bp, Artificial
  CRISPR gRNA sequence
ttggtatactttgtggatat

SEQ ID NO: 266825 - DNA, 20 bp, Artificial
  CRISPR gRNA sequence
tggtatactttgtggatata

SEQ ID NO: 266826 - DNA, 20 bp, Artificial
  CRISPR gRNA sequence
ggtatactttgtggatatat

SEQ ID NO: 266827 - DNA, 20 bp, Artificial
  CRISPR gRNA sequence
gtatactttgtggatatatc

SEQ ID NO: 266828 - DNA, 20 bp, Artificial
  CRISPR gRNA sequence
tgtggatatatcatagcttt

SEQ ID NO: 266829 - DNA, 20 bp, Artificial
  CRISPR gRNA sequence
gtggatatatcatagctttt

SEQ ID NO: 266830 - DNA, 20 bp, Artificial
  CRISPR gRNA sequence
tggatatatcatagcttttc

SEQ ID NO: 266831 - DNA, 20 bp, Artificial
  CRISPR gRNA sequence
ttcatttttgtggaatgata

SEQ ID NO: 266832 - DNA, 20 bp, Artificial
  CRISPR gRNA sequence
tcatttttgtggaatgataa

SEQ ID NO: 266833 - DNA, 20 bp, Artificial
  CRISPR gRNA sequence
catttttgtggaatgataat

SEQ ID NO: 266834 - DNA, 20 bp, Artificial
  CRISPR gRNA sequence
atttttgtggaatgataata

SEQ ID NO: 266835 - DNA, 20 bp, Artificial
  CRISPR gRNA sequence
ttgtggaatgataataagaa

SEQ ID NO: 266836 - DNA, 20 bp, Artificial
  CRISPR gRNA sequence
tgtggaatgataataagaaa

SEQ ID NO: 266837 - DNA, 20 bp, Artificial
  CRISPR gRNA sequence
gtggaatgataataagaaac

SEQ ID NO: 266838 - DNA, 20 bp, Artificial
  CRISPR gRNA sequence
tggaatgataataagaaaca

SEQ ID NO: 266839 - DNA, 20 bp, Artificial
  CRISPR gRNA sequence
agttttgtactgaatcctag

SEQ ID NO: 266840 - DNA, 20 bp, Artificial
  CRISPR gRNA sequence
tgtactgaatcctagcataa

SEQ ID NO: 266841 - DNA, 20 bp, Artificial
  CRISPR gRNA sequence
gtactgaatcctagcataat

SEQ ID NO: 266842 - DNA, 20 bp, Artificial
  CRISPR gRNA sequence
tactgaatcctagcataatg

SEQ ID NO: 266843 - DNA, 20 bp, Artificial
  CRISPR gRNA sequence
aatcctagcataatgccaat

SEQ ID NO: 266844 - DNA, 20 bp, Artificial
  CRISPR gRNA sequence
gcataatgccaatgaatggt

SEQ ID NO: 266845 - DNA, 20 bp, Artificial
  CRISPR gRNA sequence
ttcttcaatgctggaacaga

SEQ ID NO: 266846 - DNA, 20 bp, Artificial
  CRISPR gRNA sequence
tcttcaatgctggaacagag

SEQ ID NO: 266847 - DNA, 20 bp, Artificial
  CRISPR gRNA sequence
cttcaatgctggaacagagc

SEQ ID NO: 266848 - DNA, 20 bp, Artificial
  CRISPR gRNA sequence
ttcaatgctggaacagagcc

SEQ ID NO: 266849 - DNA, 20 bp, Artificial
  CRISPR gRNA sequence
caatgctggaacagagccat

SEQ ID NO: 266850 - DNA, 20 bp, Artificial
  CRISPR gRNA sequence
aatgctggaacagagccatg

SEQ ID NO: 266851 - DNA, 20 bp, Artificial
  CRISPR gRNA sequence
gaacagagccatgctgatga

SEQ ID NO: 266852 - DNA, 20 bp, Artificial
  CRISPR gRNA sequence
atgaaaaataggatactaaa

SEQ ID NO: 266853 - DNA, 20 bp, Artificial
  CRISPR gRNA sequence
aataaggaaagaattgttaa

SEQ ID NO: 266854 - DNA, 20 bp, Artificial
  CRISPR gRNA sequence
ttaatgtggcagataagctt

SEQ ID NO: 266855 - DNA, 20 bp, Artificial
  CRISPR gRNA sequence
atgtggcagataagcttttg

SEQ ID NO: 266856 - DNA, 20 bp, Artificial
  CRISPR gRNA sequence
ttgtgttctggcaaaataga

SEQ ID NO: 266857 - DNA, 20 bp, Artificial
  CRISPR gRNA sequence
tgtgttctggcaaaatagag

SEQ ID NO: 266858 - DNA, 20 bp, Artificial
  CRISPR gRNA sequence
gtgttctggcaaaatagaga

SEQ ID NO: 266859 - DNA, 20 bp, Artificial
  CRISPR gRNA sequence
tgttctggcaaaatagagac

SEQ ID NO: 266860 - DNA, 20 bp, Artificial
  CRISPR gRNA sequence
tggcaaaatagagacaatta

SEQ ID NO: 266861 - DNA, 20 bp, Artificial
  CRISPR gRNA sequence
gcaaaatagagacaattaat

SEQ ID NO: 266862 - DNA, 20 bp, Artificial
  CRISPR gRNA sequence
atgtgtgaatattttgtttg

SEQ ID NO: 266863 - DNA, 20 bp, Artificial
  CRISPR gRNA sequence
tgtttgctgagtcctattta

SEQ ID NO: 266864 - DNA, 20 bp, Artificial
  CRISPR gRNA sequence
gtttgctgagtcctatttag

SEQ ID NO: 266865 - DNA, 20 bp, Artificial
  CRISPR gRNA sequence
tttgctgagtcctatttaga

SEQ ID NO: 266866 - DNA, 20 bp, Artificial
  CRISPR gRNA sequence
gctgagtcctatttagattt

SEQ ID NO: 266867 - DNA, 20 bp, Artificial
  CRISPR gRNA sequence
ctgagtcctatttagatttc

SEQ ID NO: 266868 - DNA, 20 bp, Artificial
  CRISPR gRNA sequence
agtcctatttagatttctaa

SEQ ID NO: 266869 - DNA, 20 bp, Artificial
  CRISPR gRNA sequence
tttagatttctaatatctgt

SEQ ID NO: 266870 - DNA, 20 bp, Artificial
  CRISPR gRNA sequence
agatttctaatatctgtaat

SEQ ID NO: 266871 - DNA, 20 bp, Artificial
  CRISPR gRNA sequence
gatttctaatatctgtaata

SEQ ID NO: 266872 - DNA, 20 bp, Artificial
  CRISPR gRNA sequence
ctaatatctgtaatatccaa

SEQ ID NO: 266873 - DNA, 20 bp, Artificial
  CRISPR gRNA sequence
taatatctgtaatatccaaa

SEQ ID NO: 266874 - DNA, 20 bp, Artificial
  CRISPR gRNA sequence
atatctgtaatatccaaaca

SEQ ID NO: 266875 - DNA, 20 bp, Artificial
  CRISPR gRNA sequence
taatatccaaacagaatatt

SEQ ID NO: 266876 - DNA, 20 bp, Artificial
  CRISPR gRNA sequence
taattgtatcaagtcaaagg

SEQ ID NO: 266877 - DNA, 20 bp, Artificial
  CRISPR gRNA sequence
aattgtatcaagtcaaaggt

SEQ ID NO: 266878 - DNA, 20 bp, Artificial
  CRISPR gRNA sequence
attgtatcaagtcaaaggtt

SEQ ID NO: 266879 - DNA, 20 bp, Artificial
  CRISPR gRNA sequence
tatcaagtcaaaggttaaaa

SEQ ID NO: 266880 - DNA, 20 bp, Artificial
  CRISPR gRNA sequence
aaaaattatgctattttgct

SEQ ID NO: 266881 - DNA, 20 bp, Artificial
  CRISPR gRNA sequence
tgctattttgcttgtagcta

SEQ ID NO: 266882 - DNA, 20 bp, Artificial
  CRISPR gRNA sequence
ttttgcttgtagctaagagt

SEQ ID NO: 266883 - DNA, 20 bp, Artificial
  CRISPR gRNA sequence
tgcttgtagctaagagtgaa

SEQ ID NO: 266884 - DNA, 20 bp, Artificial
  CRISPR gRNA sequence
gcttgtagctaagagtgaaa

SEQ ID NO: 266885 - DNA, 20 bp, Artificial
  CRISPR gRNA sequence
cttgtagctaagagtgaaat

SEQ ID NO: 266886 - DNA, 20 bp, Artificial
  CRISPR gRNA sequence
gtagctaagagtgaaatatt

SEQ ID NO: 266887 - DNA, 20 bp, Artificial
  CRISPR gRNA sequence
tagctaagagtgaaatattt

SEQ ID NO: 266888 - DNA, 20 bp, Artificial
  CRISPR gRNA sequence
agagtgaaatattttttcct

SEQ ID NO: 266889 - DNA, 20 bp, Artificial
  CRISPR gRNA sequence
tttcctatatgaaaggcatg

SEQ ID NO: 266890 - DNA, 20 bp, Artificial
  CRISPR gRNA sequence
ttcctatatgaaaggcatgc

SEQ ID NO: 266891 - DNA, 20 bp, Artificial
  CRISPR gRNA sequence
tcctatatgaaaggcatgct

SEQ ID NO: 266892 - DNA, 20 bp, Artificial
  CRISPR gRNA sequence
cctatatgaaaggcatgcta

SEQ ID NO: 266893 - DNA, 20 bp, Artificial
  CRISPR gRNA sequence
ctatatgaaaggcatgctac

SEQ ID NO: 266894 - DNA, 20 bp, Artificial
  CRISPR gRNA sequence
tatgaaaggcatgctacttt

SEQ ID NO: 266895 - DNA, 20 bp, Artificial
  CRISPR gRNA sequence
ctttaggatagtattttata

SEQ ID NO: 266896 - DNA, 20 bp, Artificial
  CRISPR gRNA sequence
taggatagtattttatatat

SEQ ID NO: 266897 - DNA, 20 bp, Artificial
  CRISPR gRNA sequence
aggatagtattttatatata

SEQ ID NO: 266898 - DNA, 20 bp, Artificial
  CRISPR gRNA sequence
ggatagtattttatatatat

SEQ ID NO: 266899 - DNA, 20 bp, Artificial
  CRISPR gRNA sequence
tatatatatgtatacacaca

SEQ ID NO: 266900 - DNA, 20 bp, Artificial
  CRISPR gRNA sequence
atatatatgtatacacacat

SEQ ID NO: 266901 - DNA, 20 bp, Artificial
  CRISPR gRNA sequence
tatatatgtatacacacata

SEQ ID NO: 266902 - DNA, 20 bp, Artificial
  CRISPR gRNA sequence
atgttagaactgagaaggac

SEQ ID NO: 266903 - DNA, 20 bp, Artificial
  CRISPR gRNA sequence
tgttagaactgagaaggaca

SEQ ID NO: 266904 - DNA, 20 bp, Artificial
  CRISPR gRNA sequence
gaactgagaaggacaccaat

SEQ ID NO: 266905 - DNA, 20 bp, Artificial
  CRISPR gRNA sequence
agaaggacaccaatgatcct

SEQ ID NO: 266906 - DNA, 20 bp, Artificial
  CRISPR gRNA sequence
tacttagtaattttcaatcc

SEQ ID NO: 266907 - DNA, 20 bp, Artificial
  CRISPR gRNA sequence
agtaattttcaatcctatct

SEQ ID NO: 266908 - DNA, 20 bp, Artificial
  CRISPR gRNA sequence
gtaattttcaatcctatctg

SEQ ID NO: 266909 - DNA, 20 bp, Artificial
  CRISPR gRNA sequence
tcaatcctatctgtatatta

SEQ ID NO: 266910 - DNA, 20 bp, Artificial
  CRISPR gRNA sequence
caatcctatctgtatattat

SEQ ID NO: 266911 - DNA, 20 bp, Artificial
  CRISPR gRNA sequence
aatcctatctgtatattata

SEQ ID NO: 266912 - DNA, 20 bp, Artificial
  CRISPR gRNA sequence
tctgtatattataaatctga

SEQ ID NO: 266913 - DNA, 20 bp, Artificial
  CRISPR gRNA sequence
tatattataaatctgagtag

SEQ ID NO: 266914 - DNA, 20 bp, Artificial
  CRISPR gRNA sequence
taaatctgagtaggttttaa

SEQ ID NO: 266915 - DNA, 20 bp, Artificial
  CRISPR gRNA sequence
agtaggttttaaaagaaata

SEQ ID NO: 266916 - DNA, 20 bp, Artificial
  CRISPR gRNA sequence
taaaagaaataccaatgcct

SEQ ID NO: 266917 - DNA, 20 bp, Artificial
  CRISPR gRNA sequence
aaaagaaataccaatgccta

SEQ ID NO: 266918 - DNA, 20 bp, Artificial
  CRISPR gRNA sequence
aaagaaataccaatgcctag

SEQ ID NO: 266919 - DNA, 20 bp, Artificial
  CRISPR gRNA sequence
gttccagccctgagattctg

SEQ ID NO: 266920 - DNA, 20 bp, Artificial
  CRISPR gRNA sequence
cagccctgagattctgatgt

SEQ ID NO: 266921 - DNA, 20 bp, Artificial
  CRISPR gRNA sequence
agattctgatgtaattgata

SEQ ID NO: 266922 - DNA, 20 bp, Artificial
  CRISPR gRNA sequence
tgatgtaattgatatgggtt

SEQ ID NO: 266923 - DNA, 20 bp, Artificial
  CRISPR gRNA sequence
atgtaattgatatgggttga

SEQ ID NO: 266924 - DNA, 20 bp, Artificial
  CRISPR gRNA sequence
atatgggttgaggaaggggt

SEQ ID NO: 266925 - DNA, 20 bp, Artificial
  CRISPR gRNA sequence
aggaaggggtgctggacatc

SEQ ID NO: 266926 - DNA, 20 bp, Artificial
  CRISPR gRNA sequence
gacatcagtatattttcaaa

SEQ ID NO: 266927 - DNA, 20 bp, Artificial
  CRISPR gRNA sequence
tcaaactttctcggataatt

SEQ ID NO: 266928 - DNA, 20 bp, Artificial
  CRISPR gRNA sequence
caaactttctcggataattt

SEQ ID NO: 266929 - DNA, 20 bp, Artificial
  CRISPR gRNA sequence
aaactttctcggataattta

SEQ ID NO: 266930 - DNA, 20 bp, Artificial
  CRISPR gRNA sequence
tctcggataatttattgtgc

SEQ ID NO: 266931 - DNA, 20 bp, Artificial
  CRISPR gRNA sequence
ctcggataatttattgtgca

SEQ ID NO: 266932 - DNA, 20 bp, Artificial
  CRISPR gRNA sequence
tcggataatttattgtgcag

SEQ ID NO: 266933 - DNA, 20 bp, Artificial
  CRISPR gRNA sequence
ggataatttattgtgcagct

SEQ ID NO: 266934 - DNA, 20 bp, Artificial
  CRISPR gRNA sequence
attgtgcagctaggatggaa

SEQ ID NO: 266935 - DNA, 20 bp, Artificial
  CRISPR gRNA sequence
ttgtgcagctaggatggaaa

SEQ ID NO: 266936 - DNA, 20 bp, Artificial
  CRISPR gRNA sequence
tgcagctaggatggaaaatc

SEQ ID NO: 266937 - DNA, 20 bp, Artificial
  CRISPR gRNA sequence
ggatggaaaatcaatggact

SEQ ID NO: 266938 - DNA, 20 bp, Artificial
  CRISPR gRNA sequence
gaggatttttggtatgcttt

SEQ ID NO: 266939 - DNA, 20 bp, Artificial
  CRISPR gRNA sequence
ttggtatgctttctagttct

SEQ ID NO: 266940 - DNA, 20 bp, Artificial
  CRISPR gRNA sequence
tggtatgctttctagttcta

SEQ ID NO: 266941 - DNA, 20 bp, Artificial
  CRISPR gRNA sequence
ggtatgctttctagttctaa

SEQ ID NO: 266942 - DNA, 20 bp, Artificial
  CRISPR gRNA sequence
gtatgctttctagttctaat

SEQ ID NO: 266943 - DNA, 20 bp, Artificial
  CRISPR gRNA sequence
tctagttctaattttctcta

SEQ ID NO: 266944 - DNA, 20 bp, Artificial
  CRISPR gRNA sequence
ctagttctaattttctctaa

SEQ ID NO: 266945 - DNA, 20 bp, Artificial
  CRISPR gRNA sequence
tagttctaattttctctaat

SEQ ID NO: 266946 - DNA, 20 bp, Artificial
  CRISPR gRNA sequence
gttctaattttctctaattt

SEQ ID NO: 266947 - DNA, 20 bp, Artificial
  CRISPR gRNA sequence
taattttctctaattttgaa

SEQ ID NO: 266948 - DNA, 20 bp, Artificial
  CRISPR gRNA sequence
attttctctaattttgaata

SEQ ID NO: 266949 - DNA, 20 bp, Artificial
  CRISPR gRNA sequence
tctctaattttgaatagaat

SEQ ID NO: 266950 - DNA, 20 bp, Artificial
  CRISPR gRNA sequence
ctctaattttgaatagaatt

SEQ ID NO: 266951 - DNA, 20 bp, Artificial
  CRISPR gRNA sequence
tctaattttgaatagaattc

SEQ ID NO: 266952 - DNA, 20 bp, Artificial
  CRISPR gRNA sequence
taattttgaatagaattcta

SEQ ID NO: 266953 - DNA, 20 bp, Artificial
  CRISPR gRNA sequence
attttgaatagaattctata

SEQ ID NO: 266954 - DNA, 20 bp, Artificial
  CRISPR gRNA sequence
tgaatagaattctataggtt

SEQ ID NO: 266955 - DNA, 20 bp, Artificial
  CRISPR gRNA sequence
gaatagaattctataggttc

SEQ ID NO: 266956 - DNA, 20 bp, Artificial
  CRISPR gRNA sequence
aatagaattctataggttcc

SEQ ID NO: 266957 - DNA, 20 bp, Artificial
  CRISPR gRNA sequence
tataggttccttctcatccc

SEQ ID NO: 266958 - DNA, 20 bp, Artificial
  CRISPR gRNA sequence
taggttccttctcatcccct

SEQ ID NO: 266959 - DNA, 20 bp, Artificial
  CRISPR gRNA sequence
cttctcatccccttttgatt

SEQ ID NO: 266960 - DNA, 20 bp, Artificial
  CRISPR gRNA sequence
ctcatccccttttgattcct

SEQ ID NO: 266961 - DNA, 20 bp, Artificial
  CRISPR gRNA sequence
tcatccccttttgattccta

SEQ ID NO: 266962 - DNA, 20 bp, Artificial
  CRISPR gRNA sequence
atccccttttgattcctaaa

SEQ ID NO: 266963 - DNA, 20 bp, Artificial
  CRISPR gRNA sequence
ttgattcctaaagatacaaa

SEQ ID NO: 266964 - DNA, 20 bp, Artificial
  CRISPR gRNA sequence
tgattcctaaagatacaaag

SEQ ID NO: 266965 - DNA, 20 bp, Artificial
  CRISPR gRNA sequence
gattcctaaagatacaaagt

SEQ ID NO: 266966 - DNA, 20 bp, Artificial
  CRISPR gRNA sequence
attcctaaagatacaaagtg

SEQ ID NO: 266967 - DNA, 20 bp, Artificial
  CRISPR gRNA sequence
ctaaagatacaaagtgattt

SEQ ID NO: 266968 - DNA, 20 bp, Artificial
  CRISPR gRNA sequence
aagatacaaagtgatttgtt

SEQ ID NO: 266969 - DNA, 20 bp, Artificial
  CRISPR gRNA sequence
gtttgtcattatataatcta

SEQ ID NO: 266970 - DNA, 20 bp, Artificial
  CRISPR gRNA sequence
tttgtcattatataatctat

SEQ ID NO: 266971 - DNA, 20 bp, Artificial
  CRISPR gRNA sequence
gtcattatataatctatgag

SEQ ID NO: 266972 - DNA, 20 bp, Artificial
  CRISPR gRNA sequence
tcattatataatctatgaga

SEQ ID NO: 266973 - DNA, 20 bp, Artificial
  CRISPR gRNA sequence
tataatctatgagacagggt

SEQ ID NO: 266974 - DNA, 20 bp, Artificial
  CRISPR gRNA sequence
tgagacagggttggaactag

SEQ ID NO: 266975 - DNA, 20 bp, Artificial
  CRISPR gRNA sequence
gaactagaaatttatcctct

SEQ ID NO: 266976 - DNA, 20 bp, Artificial
  CRISPR gRNA sequence
gaaatttatcctctgattag

SEQ ID NO: 266977 - DNA, 20 bp, Artificial
  CRISPR gRNA sequence
atcctctgattagcagtcca

SEQ ID NO: 266978 - DNA, 20 bp, Artificial
  CRISPR gRNA sequence
tcctctgattagcagtccag

SEQ ID NO: 266979 - DNA, 20 bp, Artificial
  CRISPR gRNA sequence
tgattagcagtccagtgttc

SEQ ID NO: 266980 - DNA, 20 bp, Artificial
  CRISPR gRNA sequence
attagcagtccagtgttctg

SEQ ID NO: 266981 - DNA, 20 bp, Artificial
  CRISPR gRNA sequence
gcagtccagtgttctgactg

SEQ ID NO: 266982 - DNA, 20 bp, Artificial
  CRISPR gRNA sequence
tgactgccatattaggctga

SEQ ID NO: 266983 - DNA, 20 bp, Artificial
  CRISPR gRNA sequence
actgccatattaggctgatg

SEQ ID NO: 266984 - DNA, 20 bp, Artificial
  CRISPR gRNA sequence
ccatattaggctgatgattt

SEQ ID NO: 266985 - DNA, 20 bp, Artificial
  CRISPR gRNA sequence
ggctgatgattttcttaagg

SEQ ID NO: 266986 - DNA, 20 bp, Artificial
  CRISPR gRNA sequence
atgattttcttaaggcttga

SEQ ID NO: 266987 - DNA, 20 bp, Artificial
  CRISPR gRNA sequence
tcttaaggcttgaaaacatg

SEQ ID NO: 266988 - DNA, 20 bp, Artificial
  CRISPR gRNA sequence
cttaaggcttgaaaacatgc

SEQ ID NO: 266989 - DNA, 20 bp, Artificial
  CRISPR gRNA sequence
ttaaggcttgaaaacatgca

SEQ ID NO: 266990 - DNA, 20 bp, Artificial
  CRISPR gRNA sequence
aaggcttgaaaacatgcata

SEQ ID NO: 266991 - DNA, 20 bp, Artificial
  CRISPR gRNA sequence
aggcttgaaaacatgcatat

SEQ ID NO: 266992 - DNA, 20 bp, Artificial
  CRISPR gRNA sequence
gaaaacatgcatattattta

SEQ ID NO: 266993 - DNA, 20 bp, Artificial
  CRISPR gRNA sequence
aaaacatgcatattatttaa

SEQ ID NO: 266994 - DNA, 20 bp, Artificial
  CRISPR gRNA sequence
tttaacttattccaaggatg

SEQ ID NO: 266995 - DNA, 20 bp, Artificial
  CRISPR gRNA sequence
aacttattccaaggatgcag

SEQ ID NO: 266996 - DNA, 20 bp, Artificial
  CRISPR gRNA sequence
acttattccaaggatgcagt

SEQ ID NO: 266997 - DNA, 20 bp, Artificial
  CRISPR gRNA sequence
attccaaggatgcagtttag

SEQ ID NO: 266998 - DNA, 20 bp, Artificial
  CRISPR gRNA sequence
ttccaaggatgcagtttagg

SEQ ID NO: 266999 - DNA, 20 bp, Artificial
  CRISPR gRNA sequence
caaggatgcagtttagggtc

SEQ ID NO: 267000 - DNA, 20 bp, Artificial
  CRISPR gRNA sequence
agggtctagattaactatct

SEQ ID NO: 267001 - DNA, 20 bp, Artificial
  CRISPR gRNA sequence
gggtctagattaactatctt

SEQ ID NO: 267002 - DNA, 20 bp, Artificial
  CRISPR gRNA sequence
gattaactatcttctgatgg

SEQ ID NO: 267003 - DNA, 20 bp, Artificial
  CRISPR gRNA sequence
actatcttctgatgggagaa

SEQ ID NO: 267004 - DNA, 20 bp, Artificial
  CRISPR gRNA sequence
tcttctgatgggagaaacgg

SEQ ID NO: 267005 - DNA, 20 bp, Artificial
  CRISPR gRNA sequence
ctgatgggagaaacggataa

SEQ ID NO: 267006 - DNA, 20 bp, Artificial
  CRISPR gRNA sequence
tgatgggagaaacggataaa

SEQ ID NO: 267007 - DNA, 20 bp, Artificial
  CRISPR gRNA sequence
atgggagaaacggataaagt

SEQ ID NO: 267008 - DNA, 20 bp, Artificial
  CRISPR gRNA sequence
ggttaaggccattggaagtc

SEQ ID NO: 267009 - DNA, 20 bp, Artificial
  CRISPR gRNA sequence
aggccattggaagtcaccgt

SEQ ID NO: 267010 - DNA, 20 bp, Artificial
  CRISPR gRNA sequence
gaagtcaccgttttgaatca

SEQ ID NO: 267011 - DNA, 20 bp, Artificial
  CRISPR gRNA sequence
tgaatcacacagtagaatcc

SEQ ID NO: 267012 - DNA, 20 bp, Artificial
  CRISPR gRNA sequence
gaatcacacagtagaatcca

SEQ ID NO: 267013 - DNA, 20 bp, Artificial
  CRISPR gRNA sequence
aatcacacagtagaatccac

SEQ ID NO: 267014 - DNA, 20 bp, Artificial
  CRISPR gRNA sequence
ccagtgtaccatcctaacgt

SEQ ID NO: 267015 - DNA, 20 bp, Artificial
  CRISPR gRNA sequence
acgtaatggctttcaactgt

SEQ ID NO: 267016 - DNA, 20 bp, Artificial
  CRISPR gRNA sequence
tcaactgtggtcgtgaaaac

SEQ ID NO: 267017 - DNA, 20 bp, Artificial
  CRISPR gRNA sequence
caactgtggtcgtgaaaact

SEQ ID NO: 267018 - DNA, 20 bp, Artificial
  CRISPR gRNA sequence
aactgtggtcgtgaaaactg

SEQ ID NO: 267019 - DNA, 20 bp, Artificial
  CRISPR gRNA sequence
tggtcgtgaaaactgaccag

SEQ ID NO: 267020 - DNA, 20 bp, Artificial
  CRISPR gRNA sequence
accagatcatggtcagtggt

SEQ ID NO: 267021 - DNA, 20 bp, Artificial
  CRISPR gRNA sequence
ggtaagtctcaaagaggaaa

SEQ ID NO: 267022 - DNA, 20 bp, Artificial
  CRISPR gRNA sequence
aaagaggaaatctattcact

SEQ ID NO: 267023 - DNA, 20 bp, Artificial
  CRISPR gRNA sequence
ttcactctaagctggtgata

SEQ ID NO: 267024 - DNA, 20 bp, Artificial
  CRISPR gRNA sequence
actctaagctggtgatatgt

SEQ ID NO: 267025 - DNA, 20 bp, Artificial
  CRISPR gRNA sequence
taagctggtgatatgtttaa

SEQ ID NO: 267026 - DNA, 20 bp, Artificial
  CRISPR gRNA sequence
agctggtgatatgtttaata

SEQ ID NO: 267027 - DNA, 20 bp, Artificial
  CRISPR gRNA sequence
gtgatatgtttaatattttt

SEQ ID NO: 267028 - DNA, 20 bp, Artificial
  CRISPR gRNA sequence
aatatttttatttctttcac

SEQ ID NO: 267029 - DNA, 20 bp, Artificial
  CRISPR gRNA sequence
atatttttatttctttcaca

SEQ ID NO: 267030 - DNA, 20 bp, Artificial
  CRISPR gRNA sequence
ttatttctttcacatttttc

SEQ ID NO: 267031 - DNA, 20 bp, Artificial
  CRISPR gRNA sequence
tatttctttcacatttttct

SEQ ID NO: 267032 - DNA, 20 bp, Artificial
  CRISPR gRNA sequence
atttctttcacatttttctc

SEQ ID NO: 267033 - DNA, 20 bp, Artificial
  CRISPR gRNA sequence
tttctttcacatttttctct

SEQ ID NO: 267034 - DNA, 20 bp, Artificial
  CRISPR gRNA sequence
ctttcacatttttctctgat

SEQ ID NO: 267035 - DNA, 20 bp, Artificial
  CRISPR gRNA sequence
tttcacatttttctctgatg

SEQ ID NO: 267036 - DNA, 20 bp, Artificial
  CRISPR gRNA sequence
tcacatttttctctgatgtt

SEQ ID NO: 267037 - DNA, 20 bp, Artificial
  CRISPR gRNA sequence
cacatttttctctgatgttc

SEQ ID NO: 267038 - DNA, 20 bp, Artificial
  CRISPR gRNA sequence
acatttttctctgatgttca

SEQ ID NO: 267039 - DNA, 20 bp, Artificial
  CRISPR gRNA sequence
ttctctgatgttcacaagga

SEQ ID NO: 267040 - DNA, 20 bp, Artificial
  CRISPR gRNA sequence
tctctgatgttcacaaggaa

SEQ ID NO: 267041 - DNA, 20 bp, Artificial
  CRISPR gRNA sequence
ctctgatgttcacaaggaag

SEQ ID NO: 267042 - DNA, 20 bp, Artificial
  CRISPR gRNA sequence
tctgatgttcacaaggaagg

SEQ ID NO: 267043 - DNA, 20 bp, Artificial
  CRISPR gRNA sequence
tgatgttcacaaggaaggaa

SEQ ID NO: 267044 - DNA, 20 bp, Artificial
  CRISPR gRNA sequence
atgttcacaaggaaggaaat

SEQ ID NO: 267045 - DNA, 20 bp, Artificial
  CRISPR gRNA sequence
acaaggaaggaaatgcactc

SEQ ID NO: 267046 - DNA, 20 bp, Artificial
  CRISPR gRNA sequence
aattgctattcctgtatcat

SEQ ID NO: 267047 - DNA, 20 bp, Artificial
  CRISPR gRNA sequence
ctattcctgtatcatttaat

SEQ ID NO: 267048 - DNA, 20 bp, Artificial
  CRISPR gRNA sequence
ttcctgtatcatttaatcca

SEQ ID NO: 267049 - DNA, 20 bp, Artificial
  CRISPR gRNA sequence
ctgtatcatttaatccactc

SEQ ID NO: 267050 - DNA, 20 bp, Artificial
  CRISPR gRNA sequence
tatcatttaatccactctat

SEQ ID NO: 267051 - DNA, 20 bp, Artificial
  CRISPR gRNA sequence
aatccactctattttgtttt

SEQ ID NO: 267052 - DNA, 20 bp, Artificial
  CRISPR gRNA sequence
atccactctattttgttttt

SEQ ID NO: 267053 - DNA, 20 bp, Artificial
  CRISPR gRNA sequence
tattttgtttttcagggaaa

SEQ ID NO: 267054 - DNA, 20 bp, Artificial
  CRISPR gRNA sequence
ttttgtttttcagggaaaca

SEQ ID NO: 267055 - DNA, 20 bp, Artificial
  CRISPR gRNA sequence
tgtttttcagggaaacacct

SEQ ID NO: 267056 - DNA, 20 bp, Artificial
  CRISPR gRNA sequence
gtttttcagggaaacacctt

SEQ ID NO: 267057 - DNA, 20 bp, Artificial
  CRISPR gRNA sequence
tttttcagggaaacaccttt

SEQ ID NO: 267058 - DNA, 20 bp, Artificial
  CRISPR gRNA sequence
ttcagggaaacacctttgtc

SEQ ID NO: 267059 - DNA, 20 bp, Artificial
  CRISPR gRNA sequence
tcagggaaacacctttgtcc

SEQ ID NO: 267060 - DNA, 20 bp, Artificial
  CRISPR gRNA sequence
cagggaaacacctttgtcca

SEQ ID NO: 267061 - DNA, 20 bp, Artificial
  CRISPR gRNA sequence
agggaaacacctttgtccaa

SEQ ID NO: 267062 - DNA, 20 bp, Artificial
  CRISPR gRNA sequence
tgtccaagtcccctatttcc

SEQ ID NO: 267063 - DNA, 20 bp, Artificial
  CRISPR gRNA sequence
gtccaagtcccctatttccc

SEQ ID NO: 267064 - DNA, 20 bp, Artificial
  CRISPR gRNA sequence
tccaagtcccctatttcccg

SEQ ID NO: 267065 - DNA, 20 bp, Artificial
  CRISPR gRNA sequence
tttcccggaccttctaagcc

SEQ ID NO: 267066 - DNA, 20 bp, Artificial
  CRISPR gRNA sequence
cccggaccttctaagccctt

SEQ ID NO: 267067 - DNA, 20 bp, Artificial
  CRISPR gRNA sequence
ccggaccttctaagcccttt

SEQ ID NO: 267068 - DNA, 20 bp, Artificial
  CRISPR gRNA sequence
ctaagcccttttgggtgctg

SEQ ID NO: 267069 - DNA, 20 bp, Artificial
  CRISPR gRNA sequence
taagcccttttgggtgctgg

SEQ ID NO: 267070 - DNA, 20 bp, Artificial
  CRISPR gRNA sequence
agcccttttgggtgctggtg

SEQ ID NO: 267071 - DNA, 20 bp, Artificial
  CRISPR gRNA sequence
ttgggtgctggtggtggttg

SEQ ID NO: 267072 - DNA, 20 bp, Artificial
  CRISPR gRNA sequence
tgggtgctggtggtggttgg

SEQ ID NO: 267073 - DNA, 20 bp, Artificial
  CRISPR gRNA sequence
gggtgctggtggtggttggt

SEQ ID NO: 267074 - DNA, 20 bp, Artificial
  CRISPR gRNA sequence
ggtgctggtggtggttggtg

SEQ ID NO: 267075 - DNA, 20 bp, Artificial
  CRISPR gRNA sequence
gtggtggttggtggagtcct

SEQ ID NO: 267076 - DNA, 20 bp, Artificial
  CRISPR gRNA sequence
gtggagtcctggcttgctat

SEQ ID NO: 267077 - DNA, 20 bp, Artificial
  CRISPR gRNA sequence
gcttgctatagcttgctagt

SEQ ID NO: 267078 - DNA, 20 bp, Artificial
  CRISPR gRNA sequence
gctatagcttgctagtaaca

SEQ ID NO: 267079 - DNA, 20 bp, Artificial
  CRISPR gRNA sequence
ctatagcttgctagtaacag

SEQ ID NO: 267080 - DNA, 20 bp, Artificial
  CRISPR gRNA sequence
tagcttgctagtaacagtgg

SEQ ID NO: 267081 - DNA, 20 bp, Artificial
  CRISPR gRNA sequence
gctagtaacagtggccttta

SEQ ID NO: 267082 - DNA, 20 bp, Artificial
  CRISPR gRNA sequence
ctagtaacagtggcctttat

SEQ ID NO: 267083 - DNA, 20 bp, Artificial
  CRISPR gRNA sequence
gtaacagtggcctttattat

SEQ ID NO: 267084 - DNA, 20 bp, Artificial
  CRISPR gRNA sequence
tattattttctgggtaagag

SEQ ID NO: 267085 - DNA, 20 bp, Artificial
  CRISPR gRNA sequence
attattttctgggtaagaga

SEQ ID NO: 267086 - DNA, 20 bp, Artificial
  CRISPR gRNA sequence
ttattttctgggtaagagaa

SEQ ID NO: 267087 - DNA, 20 bp, Artificial
  CRISPR gRNA sequence
ttttctgggtaagagaagca

SEQ ID NO: 267088 - DNA, 20 bp, Artificial
  CRISPR gRNA sequence
tctgggtaagagaagcagca

SEQ ID NO: 267089 - DNA, 20 bp, Artificial
  CRISPR gRNA sequence
ctgggtaagagaagcagcac

SEQ ID NO: 267090 - DNA, 20 bp, Artificial
  CRISPR gRNA sequence
tgggtaagagaagcagcact

SEQ ID NO: 267091 - DNA, 20 bp, Artificial
  CRISPR gRNA sequence
ggtaagagaagcagcactgc

SEQ ID NO: 267092 - DNA, 20 bp, Artificial
  CRISPR gRNA sequence
cttttatgtaacttttccac

SEQ ID NO: 267093 - DNA, 20 bp, Artificial
  CRISPR gRNA sequence
ttatgtaacttttccactgc

SEQ ID NO: 267094 - DNA, 20 bp, Artificial
  CRISPR gRNA sequence
tatgtaacttttccactgca

SEQ ID NO: 267095 - DNA, 20 bp, Artificial
  CRISPR gRNA sequence
atgtaacttttccactgcac

SEQ ID NO: 267096 - DNA, 20 bp, Artificial
  CRISPR gRNA sequence
tgtaacttttccactgcaca

SEQ ID NO: 267097 - DNA, 20 bp, Artificial
  CRISPR gRNA sequence
ttccactgcacatgaaatct

SEQ ID NO: 267098 - DNA, 20 bp, Artificial
  CRISPR gRNA sequence
tccactgcacatgaaatctg

SEQ ID NO: 267099 - DNA, 20 bp, Artificial
  CRISPR gRNA sequence
ccactgcacatgaaatctga

SEQ ID NO: 267100 - DNA, 20 bp, Artificial
  CRISPR gRNA sequence
cactgcacatgaaatctgaa

SEQ ID NO: 267101 - DNA, 20 bp, Artificial
  CRISPR gRNA sequence
cacatgaaatctgaacacat

SEQ ID NO: 267102 - DNA, 20 bp, Artificial
  CRISPR gRNA sequence
aacacattcaagaattttgc

SEQ ID NO: 267103 - DNA, 20 bp, Artificial
  CRISPR gRNA sequence
aagaattttgcctatgtggt

SEQ ID NO: 267104 - DNA, 20 bp, Artificial
  CRISPR gRNA sequence
tgcctatgtggtttattttc

SEQ ID NO: 267105 - DNA, 20 bp, Artificial
  CRISPR gRNA sequence
gcctatgtggtttattttct

SEQ ID NO: 267106 - DNA, 20 bp, Artificial
  CRISPR gRNA sequence
cctatgtggtttattttctg

SEQ ID NO: 267107 - DNA, 20 bp, Artificial
  CRISPR gRNA sequence
tgtggtttattttctgttta

SEQ ID NO: 267108 - DNA, 20 bp, Artificial
  CRISPR gRNA sequence
attttctgtttaatatagga

SEQ ID NO: 267109 - DNA, 20 bp, Artificial
  CRISPR gRNA sequence
ttttctgtttaatataggat

SEQ ID NO: 267110 - DNA, 20 bp, Artificial
  CRISPR gRNA sequence
tctgtttaatataggatgat

SEQ ID NO: 267111 - DNA, 20 bp, Artificial
  CRISPR gRNA sequence
ctgtttaatataggatgatg

SEQ ID NO: 267112 - DNA, 20 bp, Artificial
  CRISPR gRNA sequence
tgtttaatataggatgatga

SEQ ID NO: 267113 - DNA, 20 bp, Artificial
  CRISPR gRNA sequence
tttaatataggatgatgatt

SEQ ID NO: 267114 - DNA, 20 bp, Artificial
  CRISPR gRNA sequence
aatataggatgatgattttc

SEQ ID NO: 267115 - DNA, 20 bp, Artificial
  CRISPR gRNA sequence
atataggatgatgattttct

SEQ ID NO: 267116 - DNA, 20 bp, Artificial
  CRISPR gRNA sequence
tcttttccccatgcttgagt

SEQ ID NO: 267117 - DNA, 20 bp, Artificial
  CRISPR gRNA sequence
cttttccccatgcttgagta

SEQ ID NO: 267118 - DNA, 20 bp, Artificial
  CRISPR gRNA sequence
ttttccccatgcttgagtag

SEQ ID NO: 267119 - DNA, 20 bp, Artificial
  CRISPR gRNA sequence
ttccccatgcttgagtaggt

SEQ ID NO: 267120 - DNA, 20 bp, Artificial
  CRISPR gRNA sequence
tccccatgcttgagtaggtt

SEQ ID NO: 267121 - DNA, 20 bp, Artificial
  CRISPR gRNA sequence
ccccatgcttgagtaggttc

SEQ ID NO: 267122 - DNA, 20 bp, Artificial
  CRISPR gRNA sequence
cccatgcttgagtaggttct

SEQ ID NO: 267123 - DNA, 20 bp, Artificial
  CRISPR gRNA sequence
gagtaggttctcttttagct

SEQ ID NO: 267124 - DNA, 20 bp, Artificial
  CRISPR gRNA sequence
agtaggttctcttttagctt

SEQ ID NO: 267125 - DNA, 20 bp, Artificial
  CRISPR gRNA sequence
tcttttagcttgttcaactc

SEQ ID NO: 267126 - DNA, 20 bp, Artificial
  CRISPR gRNA sequence
ttttagcttgttcaactcta

SEQ ID NO: 267127 - DNA, 20 bp, Artificial
  CRISPR gRNA sequence
ttagcttgttcaactctatc

SEQ ID NO: 267128 - DNA, 20 bp, Artificial
  CRISPR gRNA sequence
tagcttgttcaactctatct

SEQ ID NO: 267129 - DNA, 20 bp, Artificial
  CRISPR gRNA sequence
agcttgttcaactctatctg

SEQ ID NO: 267130 - DNA, 20 bp, Artificial
  CRISPR gRNA sequence
gcttgttcaactctatctga

SEQ ID NO: 267131 - DNA, 20 bp, Artificial
  CRISPR gRNA sequence
gttcaactctatctgagata

SEQ ID NO: 267132 - DNA, 20 bp, Artificial
  CRISPR gRNA sequence
ttcaactctatctgagataa

SEQ ID NO: 267133 - DNA, 20 bp, Artificial
  CRISPR gRNA sequence
aactctatctgagataaaaa

SEQ ID NO: 267134 - DNA, 20 bp, Artificial
  CRISPR gRNA sequence
tatctgagataaaaatctga

SEQ ID NO: 267135 - DNA, 20 bp, Artificial
  CRISPR gRNA sequence
tctgagataaaaatctgata

SEQ ID NO: 267136 - DNA, 20 bp, Artificial
  CRISPR gRNA sequence
agataaaaatctgatatgag

SEQ ID NO: 267137 - DNA, 20 bp, Artificial
  CRISPR gRNA sequence
atatgagttagatttcccag

SEQ ID NO: 267138 - DNA, 20 bp, Artificial
  CRISPR gRNA sequence
gatttcccagaaggcattga

SEQ ID NO: 267139 - DNA, 20 bp, Artificial
  CRISPR gRNA sequence
cccagaaggcattgagtagg

SEQ ID NO: 267140 - DNA, 20 bp, Artificial
  CRISPR gRNA sequence
ccagaaggcattgagtaggt

SEQ ID NO: 267141 - DNA, 20 bp, Artificial
  CRISPR gRNA sequence
agtaggtggtgaggcaaaat

SEQ ID NO: 267142 - DNA, 20 bp, Artificial
  CRISPR gRNA sequence
aatgggtaaattagggtgga

SEQ ID NO: 267143 - DNA, 20 bp, Artificial
  CRISPR gRNA sequence
gggtggagggattaggagca

SEQ ID NO: 267144 - DNA, 20 bp, Artificial
  CRISPR gRNA sequence
ggagcagttgcctttcttct

SEQ ID NO: 267145 - DNA, 20 bp, Artificial
  CRISPR gRNA sequence
cctttcttctccccattttg

SEQ ID NO: 267146 - DNA, 20 bp, Artificial
  CRISPR gRNA sequence
tcttctccccattttgcaat

SEQ ID NO: 267147 - DNA, 20 bp, Artificial
  CRISPR gRNA sequence
cttctccccattttgcaata

SEQ ID NO: 267148 - DNA, 20 bp, Artificial
  CRISPR gRNA sequence
ttctccccattttgcaatat

SEQ ID NO: 267149 - DNA, 20 bp, Artificial
  CRISPR gRNA sequence
ctccccattttgcaatataa

SEQ ID NO: 267150 - DNA, 20 bp, Artificial
  CRISPR gRNA sequence
tccccattttgcaatataat

SEQ ID NO: 267151 - DNA, 20 bp, Artificial
  CRISPR gRNA sequence
cccattttgcaatataatta

SEQ ID NO: 267152 - DNA, 20 bp, Artificial
  CRISPR gRNA sequence
tgcaatataattatgacaca

SEQ ID NO: 267153 - DNA, 20 bp, Artificial
  CRISPR gRNA sequence
gcaatataattatgacacat

SEQ ID NO: 267154 - DNA, 20 bp, Artificial
  CRISPR gRNA sequence
caatataattatgacacata

SEQ ID NO: 267155 - DNA, 20 bp, Artificial
  CRISPR gRNA sequence
tgacacataaaacagtttta

SEQ ID NO: 267156 - DNA, 20 bp, Artificial
  CRISPR gRNA sequence
taatgcgtatatatgtataa

SEQ ID NO: 267157 - DNA, 20 bp, Artificial
  CRISPR gRNA sequence
aatgcgtatatatgtataaa

SEQ ID NO: 267158 - DNA, 20 bp, Artificial
  CRISPR gRNA sequence
atgcgtatatatgtataaac

SEQ ID NO: 267159 - DNA, 20 bp, Artificial
  CRISPR gRNA sequence
ggcaacttgggaagctaggc

SEQ ID NO: 267160 - DNA, 20 bp, Artificial
  CRISPR gRNA sequence
gggaagctaggcaactgaag

SEQ ID NO: 267161 - DNA, 20 bp, Artificial
  CRISPR gRNA sequence
ggaagctaggcaactgaagc

SEQ ID NO: 267162 - DNA, 20 bp, Artificial
  CRISPR gRNA sequence
ggcaactgaagccaatggac

SEQ ID NO: 267163 - DNA, 20 bp, Artificial
  CRISPR gRNA sequence
aagccaatggacaatgttgg

SEQ ID NO: 267164 - DNA, 20 bp, Artificial
  CRISPR gRNA sequence
gcttgatcaaaaatcatgag

SEQ ID NO: 267165 - DNA, 20 bp, Artificial
  CRISPR gRNA sequence
gatcaaaaatcatgagaaac

SEQ ID NO: 267166 - DNA, 20 bp, Artificial
  CRISPR gRNA sequence
atcaaaaatcatgagaaact

SEQ ID NO: 267167 - DNA, 20 bp, Artificial
  CRISPR gRNA sequence
ggctactgaaattgtgtatt

SEQ ID NO: 267168 - DNA, 20 bp, Artificial
  CRISPR gRNA sequence
gctactgaaattgtgtattc

SEQ ID NO: 267169 - DNA, 20 bp, Artificial
  CRISPR gRNA sequence
ctgaaattgtgtattcaaac

SEQ ID NO: 267170 - DNA, 20 bp, Artificial
  CRISPR gRNA sequence
aaattgtgtattcaaaccta

SEQ ID NO: 267171 - DNA, 20 bp, Artificial
  CRISPR gRNA sequence
tgtattcaaacctagcaaag

SEQ ID NO: 267172 - DNA, 20 bp, Artificial
  CRISPR gRNA sequence
aaacctagcaaagaaactag

SEQ ID NO: 267173 - DNA, 20 bp, Artificial
  CRISPR gRNA sequence
gcaaagaaactagatctgtt

SEQ ID NO: 267174 - DNA, 20 bp, Artificial
  CRISPR gRNA sequence
gatctgtttatctgagtcat

SEQ ID NO: 267175 - DNA, 20 bp, Artificial
  CRISPR gRNA sequence
tttatctgagtcatattttt

SEQ ID NO: 267176 - DNA, 20 bp, Artificial
  CRISPR gRNA sequence
atctgagtcatatttttttt

SEQ ID NO: 267177 - DNA, 20 bp, Artificial
  CRISPR gRNA sequence
tctgagtcatattttttttt

SEQ ID NO: 267178 - DNA, 20 bp, Artificial
  CRISPR gRNA sequence
agtcatatttttttttctcc

SEQ ID NO: 267179 - DNA, 20 bp, Artificial
  CRISPR gRNA sequence
ttttttctcctctgaagcag

SEQ ID NO: 267180 - DNA, 20 bp, Artificial
  CRISPR gRNA sequence
tttttctcctctgaagcagt

SEQ ID NO: 267181 - DNA, 20 bp, Artificial
  CRISPR gRNA sequence
ttttctcctctgaagcagtt

SEQ ID NO: 267182 - DNA, 20 bp, Artificial
  CRISPR gRNA sequence
tttctcctctgaagcagttg

SEQ ID NO: 267183 - DNA, 20 bp, Artificial
  CRISPR gRNA sequence
ttctcctctgaagcagttga

SEQ ID NO: 267184 - DNA, 20 bp, Artificial
  CRISPR gRNA sequence
tctcctctgaagcagttgaa

SEQ ID NO: 267185 - DNA, 20 bp, Artificial
  CRISPR gRNA sequence
ctcctctgaagcagttgaat

SEQ ID NO: 267186 - DNA, 20 bp, Artificial
  CRISPR gRNA sequence
tcctctgaagcagttgaatt

SEQ ID NO: 267187 - DNA, 20 bp, Artificial
  CRISPR gRNA sequence
ctctgaagcagttgaattgt

SEQ ID NO: 267188 - DNA, 20 bp, Artificial
  CRISPR gRNA sequence
tgaagcagttgaattgtgtg

SEQ ID NO: 267189 - DNA, 20 bp, Artificial
  CRISPR gRNA sequence
aagcagttgaattgtgtgag

SEQ ID NO: 267190 - DNA, 20 bp, Artificial
  CRISPR gRNA sequence
aattgtgtgaggccaagtat

SEQ ID NO: 267191 - DNA, 20 bp, Artificial
  CRISPR gRNA sequence
tgtgaggccaagtatggtgc

SEQ ID NO: 267192 - DNA, 20 bp, Artificial
  CRISPR gRNA sequence
tcattatgaaactataatgg

SEQ ID NO: 267193 - DNA, 20 bp, Artificial
  CRISPR gRNA sequence
tgaaactataatgggagtta

SEQ ID NO: 267194 - DNA, 20 bp, Artificial
  CRISPR gRNA sequence
taatgggagttagaattttc

SEQ ID NO: 267195 - DNA, 20 bp, Artificial
  CRISPR gRNA sequence
gaattttctgagctctcacc

SEQ ID NO: 267196 - DNA, 20 bp, Artificial
  CRISPR gRNA sequence
tctgagctctcaccactgaa

SEQ ID NO: 267197 - DNA, 20 bp, Artificial
  CRISPR gRNA sequence
ctgagctctcaccactgaat

SEQ ID NO: 267198 - DNA, 20 bp, Artificial
  CRISPR gRNA sequence
tgagctctcaccactgaatt

SEQ ID NO: 267199 - DNA, 20 bp, Artificial
  CRISPR gRNA sequence
agctctcaccactgaattga

SEQ ID NO: 267200 - DNA, 20 bp, Artificial
  CRISPR gRNA sequence
tcaccactgaattgaagtac

SEQ ID NO: 267201 - DNA, 20 bp, Artificial
  CRISPR gRNA sequence
accactgaattgaagtacta

SEQ ID NO: 267202 - DNA, 20 bp, Artificial
  CRISPR gRNA sequence
aattgaagtactaacttttg

SEQ ID NO: 267203 - DNA, 20 bp, Artificial
  CRISPR gRNA sequence
aagtactaacttttgcaaat

SEQ ID NO: 267204 - DNA, 20 bp, Artificial
  CRISPR gRNA sequence
acttttgcaaatgtttacgt

SEQ ID NO: 267205 - DNA, 20 bp, Artificial
  CRISPR gRNA sequence
ttgcaaatgtttacgtaata

SEQ ID NO: 267206 - DNA, 20 bp, Artificial
  CRISPR gRNA sequence
tgcaaatgtttacgtaataa

SEQ ID NO: 267207 - DNA, 20 bp, Artificial
  CRISPR gRNA sequence
gcaaatgtttacgtaataaa

SEQ ID NO: 267208 - DNA, 20 bp, Artificial
  CRISPR gRNA sequence
caaatgtttacgtaataaat

SEQ ID NO: 267209 - DNA, 20 bp, Artificial
  CRISPR gRNA sequence
acgtaataaatgtggtgtat

SEQ ID NO: 267210 - DNA, 20 bp, Artificial
  CRISPR gRNA sequence
cgtaataaatgtggtgtatt

SEQ ID NO: 267211 - DNA, 20 bp, Artificial
  CRISPR gRNA sequence
ttctttaccttcctcaacat

SEQ ID NO: 267212 - DNA, 20 bp, Artificial
  CRISPR gRNA sequence
tctttaccttcctcaacatt

SEQ ID NO: 267213 - DNA, 20 bp, Artificial
  CRISPR gRNA sequence
ctttaccttcctcaacattg

SEQ ID NO: 267214 - DNA, 20 bp, Artificial
  CRISPR gRNA sequence
tttaccttcctcaacattga

SEQ ID NO: 267215 - DNA, 20 bp, Artificial
  CRISPR gRNA sequence
taccttcctcaacattgaat

SEQ ID NO: 267216 - DNA, 20 bp, Artificial
  CRISPR gRNA sequence
accttcctcaacattgaatt

SEQ ID NO: 267217 - DNA, 20 bp, Artificial
  CRISPR gRNA sequence
ccttcctcaacattgaattt

SEQ ID NO: 267218 - DNA, 20 bp, Artificial
  CRISPR gRNA sequence
cctcaacattgaatttttgg

SEQ ID NO: 267219 - DNA, 20 bp, Artificial
  CRISPR gRNA sequence
ctcaacattgaatttttggc

SEQ ID NO: 267220 - DNA, 20 bp, Artificial
  CRISPR gRNA sequence
aacattgaatttttggcctg

SEQ ID NO: 267221 - DNA, 20 bp, Artificial
  CRISPR gRNA sequence
aatttttggcctgggtttga

SEQ ID NO: 267222 - DNA, 20 bp, Artificial
  CRISPR gRNA sequence
ttggcctgggtttgaacaca

SEQ ID NO: 267223 - DNA, 20 bp, Artificial
  CRISPR gRNA sequence
tggcctgggtttgaacacat

SEQ ID NO: 267224 - DNA, 20 bp, Artificial
  CRISPR gRNA sequence
ggcctgggtttgaacacatt

SEQ ID NO: 267225 - DNA, 20 bp, Artificial
  CRISPR gRNA sequence
gcctgggtttgaacacattt

SEQ ID NO: 267226 - DNA, 20 bp, Artificial
  CRISPR gRNA sequence
ggtttgaacacattttgatg

SEQ ID NO: 267227 - DNA, 20 bp, Artificial
  CRISPR gRNA sequence
gaacacattttgatgaacgc

SEQ ID NO: 267228 - DNA, 20 bp, Artificial
  CRISPR gRNA sequence
aacacattttgatgaacgca

SEQ ID NO: 267229 - DNA, 20 bp, Artificial
  CRISPR gRNA sequence
tgatgaacgcacctacagtt

SEQ ID NO: 267230 - DNA, 20 bp, Artificial
  CRISPR gRNA sequence
gatgaacgcacctacagtta

SEQ ID NO: 267231 - DNA, 20 bp, Artificial
  CRISPR gRNA sequence
atgaacgcacctacagttaa

SEQ ID NO: 267232 - DNA, 20 bp, Artificial
  CRISPR gRNA sequence
cagttaagaacgtacccctg

SEQ ID NO: 267233 - DNA, 20 bp, Artificial
  CRISPR gRNA sequence
agaacgtacccctgagtgac

SEQ ID NO: 267234 - DNA, 20 bp, Artificial
  CRISPR gRNA sequence
agtgacccttgttcttactc

SEQ ID NO: 267235 - DNA, 20 bp, Artificial
  CRISPR gRNA sequence
gttcttactcagaaacttct

SEQ ID NO: 267236 - DNA, 20 bp, Artificial
  CRISPR gRNA sequence
ttcttactcagaaacttctt

SEQ ID NO: 267237 - DNA, 20 bp, Artificial
  CRISPR gRNA sequence
ttactcagaaacttcttagg

SEQ ID NO: 267238 - DNA, 20 bp, Artificial
  CRISPR gRNA sequence
actcagaaacttcttaggta

SEQ ID NO: 267239 - DNA, 20 bp, Artificial
  CRISPR gRNA sequence
ctcagaaacttcttaggtac

SEQ ID NO: 267240 - DNA, 20 bp, Artificial
  CRISPR gRNA sequence
agaaacttcttaggtacata

SEQ ID NO: 267241 - DNA, 20 bp, Artificial
  CRISPR gRNA sequence
cttaggtacatagtatggta

SEQ ID NO: 267242 - DNA, 20 bp, Artificial
  CRISPR gRNA sequence
ttaggtacatagtatggtac

SEQ ID NO: 267243 - DNA, 20 bp, Artificial
  CRISPR gRNA sequence
aggtacatagtatggtacag

SEQ ID NO: 267244 - DNA, 20 bp, Artificial
  CRISPR gRNA sequence
ggtacatagtatggtacaga

SEQ ID NO: 267245 - DNA, 20 bp, Artificial
  CRISPR gRNA sequence
actccatgttgtctttgaat

SEQ ID NO: 267246 - DNA, 20 bp, Artificial
  CRISPR gRNA sequence
catgttgtctttgaattttt

SEQ ID NO: 267247 - DNA, 20 bp, Artificial
  CRISPR gRNA sequence
tctttgaatttttttctaga

SEQ ID NO: 267248 - DNA, 20 bp, Artificial
  CRISPR gRNA sequence
tgaatttttttctagaagtt

SEQ ID NO: 267249 - DNA, 20 bp, Artificial
  CRISPR gRNA sequence
gaatttttttctagaagtta

SEQ ID NO: 267250 - DNA, 20 bp, Artificial
  CRISPR gRNA sequence
aatttttttctagaagttac

SEQ ID NO: 267251 - DNA, 20 bp, Artificial
  CRISPR gRNA sequence
ttttctagaagttacatgca

SEQ ID NO: 267252 - DNA, 20 bp, Artificial
  CRISPR gRNA sequence
tttctagaagttacatgcat

SEQ ID NO: 267253 - DNA, 20 bp, Artificial
  CRISPR gRNA sequence
ttctagaagttacatgcatg

SEQ ID NO: 267254 - DNA, 20 bp, Artificial
  CRISPR gRNA sequence
tctagaagttacatgcatgg

SEQ ID NO: 267255 - DNA, 20 bp, Artificial
  CRISPR gRNA sequence
ctagaagttacatgcatgga

SEQ ID NO: 267256 - DNA, 20 bp, Artificial
  CRISPR gRNA sequence
tagaagttacatgcatggat

SEQ ID NO: 267257 - DNA, 20 bp, Artificial
  CRISPR gRNA sequence
gaagttacatgcatggatga

SEQ ID NO: 267258 - DNA, 20 bp, Artificial
  CRISPR gRNA sequence
catgcatggatgagtcattt

SEQ ID NO: 267259 - DNA, 20 bp, Artificial
  CRISPR gRNA sequence
cttcaatgagaaatgtattc

SEQ ID NO: 267260 - DNA, 20 bp, Artificial
  CRISPR gRNA sequence
ttcaatgagaaatgtattct

SEQ ID NO: 267261 - DNA, 20 bp, Artificial
  CRISPR gRNA sequence
caatgagaaatgtattctca

SEQ ID NO: 267262 - DNA, 20 bp, Artificial
  CRISPR gRNA sequence
aatgagaaatgtattctcaa

SEQ ID NO: 267263 - DNA, 20 bp, Artificial
  CRISPR gRNA sequence
tcaaacataaaagactattt

SEQ ID NO: 267264 - DNA, 20 bp, Artificial
  CRISPR gRNA sequence
aaacataaaagactatttct

SEQ ID NO: 267265 - DNA, 20 bp, Artificial
  CRISPR gRNA sequence
tttctcttgatagtctccaa

SEQ ID NO: 267266 - DNA, 20 bp, Artificial
  CRISPR gRNA sequence
ctcttgatagtctccaaaag

SEQ ID NO: 267267 - DNA, 20 bp, Artificial
  CRISPR gRNA sequence
tcttgatagtctccaaaaga

SEQ ID NO: 267268 - DNA, 20 bp, Artificial
  CRISPR gRNA sequence
ttgatagtctccaaaagact

SEQ ID NO: 267269 - DNA, 20 bp, Artificial
  CRISPR gRNA sequence
gatagtctccaaaagactat

SEQ ID NO: 267270 - DNA, 20 bp, Artificial
  CRISPR gRNA sequence
atagtctccaaaagactatt

SEQ ID NO: 267271 - DNA, 20 bp, Artificial
  CRISPR gRNA sequence
caaaagactatttctcttga

SEQ ID NO: 267272 - DNA, 20 bp, Artificial
  CRISPR gRNA sequence
tttctcttgatattctccat

SEQ ID NO: 267273 - DNA, 20 bp, Artificial
  CRISPR gRNA sequence
ctcttgatattctccatttg

SEQ ID NO: 267274 - DNA, 20 bp, Artificial
  CRISPR gRNA sequence
tcttgatattctccatttga

SEQ ID NO: 267275 - DNA, 20 bp, Artificial
  CRISPR gRNA sequence
ttgatattctccatttgata

SEQ ID NO: 267276 - DNA, 20 bp, Artificial
  CRISPR gRNA sequence
gatattctccatttgatatt

SEQ ID NO: 267277 - DNA, 20 bp, Artificial
  CRISPR gRNA sequence
atattctccatttgatatta

SEQ ID NO: 267278 - DNA, 20 bp, Artificial
  CRISPR gRNA sequence
tccatttgatattaagtaca

SEQ ID NO: 267279 - DNA, 20 bp, Artificial
  CRISPR gRNA sequence
catttgatattaagtacatt

SEQ ID NO: 267280 - DNA, 20 bp, Artificial
  CRISPR gRNA sequence
gatattaagtacatttggtg

SEQ ID NO: 267281 - DNA, 20 bp, Artificial
  CRISPR gRNA sequence
atattaagtacatttggtgc

SEQ ID NO: 267282 - DNA, 20 bp, Artificial
  CRISPR gRNA sequence
agtacatttggtgcttaatg

SEQ ID NO: 267283 - DNA, 20 bp, Artificial
  CRISPR gRNA sequence
ggtgcttaatgaatgcttat

SEQ ID NO: 267284 - DNA, 20 bp, Artificial
  CRISPR gRNA sequence
gtgcttaatgaatgcttatt

SEQ ID NO: 267285 - DNA, 20 bp, Artificial
  CRISPR gRNA sequence
aatgaatgcttattggattg

SEQ ID NO: 267286 - DNA, 20 bp, Artificial
  CRISPR gRNA sequence
atgaatgcttattggattga

SEQ ID NO: 267287 - DNA, 20 bp, Artificial
  CRISPR gRNA sequence
attggattgatgaattgata

SEQ ID NO: 267288 - DNA, 20 bp, Artificial
  CRISPR gRNA sequence
ttggattgatgaattgataa

SEQ ID NO: 267289 - DNA, 20 bp, Artificial
  CRISPR gRNA sequence
gattgatgaattgataacct

SEQ ID NO: 267290 - DNA, 20 bp, Artificial
  CRISPR gRNA sequence
atgaattgataacctccaga

SEQ ID NO: 267291 - DNA, 20 bp, Artificial
  CRISPR gRNA sequence
ataacctccagagaggtcaa

SEQ ID NO: 267292 - DNA, 20 bp, Artificial
  CRISPR gRNA sequence
cagagaggtcaaattaagga

SEQ ID NO: 267293 - DNA, 20 bp, Artificial
  CRISPR gRNA sequence
aggatttaaatgagtctgcc

SEQ ID NO: 267294 - DNA, 20 bp, Artificial
  CRISPR gRNA sequence
aaatgagtctgcctgaagta

SEQ ID NO: 267295 - DNA, 20 bp, Artificial
  CRISPR gRNA sequence
aatgagtctgcctgaagtat

SEQ ID NO: 267296 - DNA, 20 bp, Artificial
  CRISPR gRNA sequence
cctgaagtatgatactcatc

SEQ ID NO: 267297 - DNA, 20 bp, Artificial
  CRISPR gRNA sequence
aagtatgatactcatcttta

SEQ ID NO: 267298 - DNA, 20 bp, Artificial
  CRISPR gRNA sequence
atctttaaggcataatctgt

SEQ ID NO: 267299 - DNA, 20 bp, Artificial
  CRISPR gRNA sequence
taaggcataatctgtatatg

SEQ ID NO: 267300 - DNA, 20 bp, Artificial
  CRISPR gRNA sequence
aaggcataatctgtatatgt

SEQ ID NO: 267301 - DNA, 20 bp, Artificial
  CRISPR gRNA sequence
aggcataatctgtatatgta

SEQ ID NO: 267302 - DNA, 20 bp, Artificial
  CRISPR gRNA sequence
tatatgtacctaattcatag

SEQ ID NO: 267303 - DNA, 20 bp, Artificial
  CRISPR gRNA sequence
attcatagatgggtcagtga

SEQ ID NO: 267304 - DNA, 20 bp, Artificial
  CRISPR gRNA sequence
atagatgggtcagtgatttc

SEQ ID NO: 267305 - DNA, 20 bp, Artificial
  CRISPR gRNA sequence
ctgaaagccatatcatatga

SEQ ID NO: 267306 - DNA, 20 bp, Artificial
  CRISPR gRNA sequence
tgaaagccatatcatatgaa

SEQ ID NO: 267307 - DNA, 20 bp, Artificial
  CRISPR gRNA sequence
aaagccatatcatatgaagt

SEQ ID NO: 267308 - DNA, 20 bp, Artificial
  CRISPR gRNA sequence
tgtttactgtcagcttggtg

SEQ ID NO: 267309 - DNA, 20 bp, Artificial
  CRISPR gRNA sequence
tttactgtcagcttggtgac

SEQ ID NO: 267310 - DNA, 20 bp, Artificial
  CRISPR gRNA sequence
actgtcagcttggtgactgc

SEQ ID NO: 267311 - DNA, 20 bp, Artificial
  CRISPR gRNA sequence
ctgtcagcttggtgactgcg

SEQ ID NO: 267312 - DNA, 20 bp, Artificial
  CRISPR gRNA sequence
tcagcttggtgactgcgggt

SEQ ID NO: 267313 - DNA, 20 bp, Artificial
  CRISPR gRNA sequence
ggtgactgcgggtacagacc

SEQ ID NO: 267314 - DNA, 20 bp, Artificial
  CRISPR gRNA sequence
gtgactgcgggtacagacct

SEQ ID NO: 267315 - DNA, 20 bp, Artificial
  CRISPR gRNA sequence
cgggtacagacctggatcca

SEQ ID NO: 267316 - DNA, 20 bp, Artificial
  CRISPR gRNA sequence
gatccacagccatgccttcc

SEQ ID NO: 267317 - DNA, 20 bp, Artificial
  CRISPR gRNA sequence
cctattatccagtcttagat

SEQ ID NO: 267318 - DNA, 20 bp, Artificial
  CRISPR gRNA sequence
ctattatccagtcttagatt

SEQ ID NO: 267319 - DNA, 20 bp, Artificial
  CRISPR gRNA sequence
ttatccagtcttagattctt

SEQ ID NO: 267320 - DNA, 20 bp, Artificial
  CRISPR gRNA sequence
tccagtcttagattctttta

SEQ ID NO: 267321 - DNA, 20 bp, Artificial
  CRISPR gRNA sequence
agattcttttagactcttct

SEQ ID NO: 267322 - DNA, 20 bp, Artificial
  CRISPR gRNA sequence
gattcttttagactcttctt

SEQ ID NO: 267323 - DNA, 20 bp, Artificial
  CRISPR gRNA sequence
ttttagactcttcttggcct

SEQ ID NO: 267324 - DNA, 20 bp, Artificial
  CRISPR gRNA sequence
ttagactcttcttggcctat

SEQ ID NO: 267325 - DNA, 20 bp, Artificial
  CRISPR gRNA sequence
tagactcttcttggcctatt

SEQ ID NO: 267326 - DNA, 20 bp, Artificial
  CRISPR gRNA sequence
agactcttcttggcctattg

SEQ ID NO: 267327 - DNA, 20 bp, Artificial
  CRISPR gRNA sequence
gactcttcttggcctattgc

SEQ ID NO: 267328 - DNA, 20 bp, Artificial
  CRISPR gRNA sequence
ttcttggcctattgccaaag

SEQ ID NO: 267329 - DNA, 20 bp, Artificial
  CRISPR gRNA sequence
cttggcctattgccaaagct

SEQ ID NO: 267330 - DNA, 20 bp, Artificial
  CRISPR gRNA sequence
ttggcctattgccaaagctt

SEQ ID NO: 267331 - DNA, 20 bp, Artificial
  CRISPR gRNA sequence
ggcctattgccaaagcttac

SEQ ID NO: 267332 - DNA, 20 bp, Artificial
  CRISPR gRNA sequence
gcctattgccaaagcttacc

SEQ ID NO: 267333 - DNA, 20 bp, Artificial
  CRISPR gRNA sequence
ttgccaaagcttacctttca

SEQ ID NO: 267334 - DNA, 20 bp, Artificial
  CRISPR gRNA sequence
ccaaagcttacctttcagtt

SEQ ID NO: 267335 - DNA, 20 bp, Artificial
  CRISPR gRNA sequence
acctttcagttgttccccac

SEQ ID NO: 267336 - DNA, 20 bp, Artificial
  CRISPR gRNA sequence
cctttcagttgttccccaca

SEQ ID NO: 267337 - DNA, 20 bp, Artificial
  CRISPR gRNA sequence
tcagttgttccccacatgct

SEQ ID NO: 267338 - DNA, 20 bp, Artificial
  CRISPR gRNA sequence
cagttgttccccacatgctc

SEQ ID NO: 267339 - DNA, 20 bp, Artificial
  CRISPR gRNA sequence
agttgttccccacatgctcc

SEQ ID NO: 267340 - DNA, 20 bp, Artificial
  CRISPR gRNA sequence
ttccccacatgctccttgca

SEQ ID NO: 267341 - DNA, 20 bp, Artificial
  CRISPR gRNA sequence
cccacatgctccttgcagtt

SEQ ID NO: 267342 - DNA, 20 bp, Artificial
  CRISPR gRNA sequence
cttgcagttcagaagaccct

SEQ ID NO: 267343 - DNA, 20 bp, Artificial
  CRISPR gRNA sequence
gcagttcagaagaccctagg

SEQ ID NO: 267344 - DNA, 20 bp, Artificial
  CRISPR gRNA sequence
cagttcagaagaccctaggg

SEQ ID NO: 267345 - DNA, 20 bp, Artificial
  CRISPR gRNA sequence
agaagaccctagggctcaga

SEQ ID NO: 267346 - DNA, 20 bp, Artificial
  CRISPR gRNA sequence
gggctcagatggacatttgt

SEQ ID NO: 267347 - DNA, 20 bp, Artificial
  CRISPR gRNA sequence
agatggacatttgtcaggct

SEQ ID NO: 267348 - DNA, 20 bp, Artificial
  CRISPR gRNA sequence
gtcaggctgcctgttgctta

SEQ ID NO: 267349 - DNA, 20 bp, Artificial
  CRISPR gRNA sequence
tcaggctgcctgttgcttac

SEQ ID NO: 267350 - DNA, 20 bp, Artificial
  CRISPR gRNA sequence
cctgttgcttactctgtact

SEQ ID NO: 267351 - DNA, 20 bp, Artificial
  CRISPR gRNA sequence
ttgcttactctgtacttgcc

SEQ ID NO: 267352 - DNA, 20 bp, Artificial
  CRISPR gRNA sequence
cttactctgtacttgccgca

SEQ ID NO: 267353 - DNA, 20 bp, Artificial
  CRISPR gRNA sequence
actctgtacttgccgcaggg

SEQ ID NO: 267354 - DNA, 20 bp, Artificial
  CRISPR gRNA sequence
ctctgtacttgccgcagggt

SEQ ID NO: 267355 - DNA, 20 bp, Artificial
  CRISPR gRNA sequence
tgtacttgccgcagggtagg

SEQ ID NO: 267356 - DNA, 20 bp, Artificial
  CRISPR gRNA sequence
tacttgccgcagggtaggaa

SEQ ID NO: 267357 - DNA, 20 bp, Artificial
  CRISPR gRNA sequence
gccgcagggtaggaaacaaa

SEQ ID NO: 267358 - DNA, 20 bp, Artificial
  CRISPR gRNA sequence
ccgcagggtaggaaacaaag

SEQ ID NO: 267359 - DNA, 20 bp, Artificial
  CRISPR gRNA sequence
cttgttcctggaaattcttt

SEQ ID NO: 267360 - DNA, 20 bp, Artificial
  CRISPR gRNA sequence
gttcctggaaattctttata

SEQ ID NO: 267361 - DNA, 20 bp, Artificial
  CRISPR gRNA sequence
ttcctggaaattctttatac

SEQ ID NO: 267362 - DNA, 20 bp, Artificial
  CRISPR gRNA sequence
ctggaaattctttatactag

SEQ ID NO: 267363 - DNA, 20 bp, Artificial
  CRISPR gRNA sequence
gaaattctttatactaggta

SEQ ID NO: 267364 - DNA, 20 bp, Artificial
  CRISPR gRNA sequence
tttatactaggtatcatctt

SEQ ID NO: 267365 - DNA, 20 bp, Artificial
  CRISPR gRNA sequence
tatactaggtatcatcttaa

SEQ ID NO: 267366 - DNA, 20 bp, Artificial
  CRISPR gRNA sequence
atactaggtatcatcttaag

SEQ ID NO: 267367 - DNA, 20 bp, Artificial
  CRISPR gRNA sequence
tactaggtatcatcttaaga

SEQ ID NO: 267368 - DNA, 20 bp, Artificial
  CRISPR gRNA sequence
ggtatcatcttaagaatttg

SEQ ID NO: 267369 - DNA, 20 bp, Artificial
  CRISPR gRNA sequence
aagaatttgcctggcttgcc

SEQ ID NO: 267370 - DNA, 20 bp, Artificial
  CRISPR gRNA sequence
agaatttgcctggcttgcct

SEQ ID NO: 267371 - DNA, 20 bp, Artificial
  CRISPR gRNA sequence
gcctggcttgccttctgcaa

SEQ ID NO: 267372 - DNA, 20 bp, Artificial
  CRISPR gRNA sequence
cctggcttgccttctgcaag

SEQ ID NO: 267373 - DNA, 20 bp, Artificial
  CRISPR gRNA sequence
gcttgccttctgcaagttgc

SEQ ID NO: 267374 - DNA, 20 bp, Artificial
  CRISPR gRNA sequence
gccttctgcaagttgcccaa

SEQ ID NO: 267375 - DNA, 20 bp, Artificial
  CRISPR gRNA sequence
ccttctgcaagttgcccaac

SEQ ID NO: 267376 - DNA, 20 bp, Artificial
  CRISPR gRNA sequence
ctgcaagttgcccaaccctg

SEQ ID NO: 267377 - DNA, 20 bp, Artificial
  CRISPR gRNA sequence
tgcaagttgcccaaccctga

SEQ ID NO: 267378 - DNA, 20 bp, Artificial
  CRISPR gRNA sequence
caagttgcccaaccctgaag

SEQ ID NO: 267379 - DNA, 20 bp, Artificial
  CRISPR gRNA sequence
cccaaccctgaaggtggggc

SEQ ID NO: 267380 - DNA, 20 bp, Artificial
  CRISPR gRNA sequence
aaggtggggctttggtattg

SEQ ID NO: 267381 - DNA, 20 bp, Artificial
  CRISPR gRNA sequence
tggtattgtaaaatgttgcc

SEQ ID NO: 267382 - DNA, 20 bp, Artificial
  CRISPR gRNA sequence
ggtattgtaaaatgttgcct

SEQ ID NO: 267383 - DNA, 20 bp, Artificial
  CRISPR gRNA sequence
gtattgtaaaatgttgcctg

SEQ ID NO: 267384 - DNA, 20 bp, Artificial
  CRISPR gRNA sequence
taaaatgttgcctgaattct

SEQ ID NO: 267385 - DNA, 20 bp, Artificial
  CRISPR gRNA sequence
cctgaattctgcctctgatg

SEQ ID NO: 267386 - DNA, 20 bp, Artificial
  CRISPR gRNA sequence
aattctgcctctgatgttag

SEQ ID NO: 267387 - DNA, 20 bp, Artificial
  CRISPR gRNA sequence
tgcctctgatgttagttgac

SEQ ID NO: 267388 - DNA, 20 bp, Artificial
  CRISPR gRNA sequence
cctctgatgttagttgacta

SEQ ID NO: 267389 - DNA, 20 bp, Artificial
  CRISPR gRNA sequence
tgatgttagttgactacttt

SEQ ID NO: 267390 - DNA, 20 bp, Artificial
  CRISPR gRNA sequence
atgttagttgactactttca

SEQ ID NO: 267391 - DNA, 20 bp, Artificial
  CRISPR gRNA sequence
gttgactactttcacctttc

SEQ ID NO: 267392 - DNA, 20 bp, Artificial
  CRISPR gRNA sequence
actactttcacctttccaga

SEQ ID NO: 267393 - DNA, 20 bp, Artificial
  CRISPR gRNA sequence
ctttcacctttccagatctt

SEQ ID NO: 267394 - DNA, 20 bp, Artificial
  CRISPR gRNA sequence
tcacctttccagatcttggt

SEQ ID NO: 267395 - DNA, 20 bp, Artificial
  CRISPR gRNA sequence
cacctttccagatcttggta

SEQ ID NO: 267396 - DNA, 20 bp, Artificial
  CRISPR gRNA sequence
acctttccagatcttggtat

SEQ ID NO: 267397 - DNA, 20 bp, Artificial
  CRISPR gRNA sequence
tccagatcttggtatcttca

SEQ ID NO: 267398 - DNA, 20 bp, Artificial
  CRISPR gRNA sequence
ccagatcttggtatcttcat

SEQ ID NO: 267399 - DNA, 20 bp, Artificial
  CRISPR gRNA sequence
cagatcttggtatcttcatc

SEQ ID NO: 267400 - DNA, 20 bp, Artificial
  CRISPR gRNA sequence
ggtatcttcatccaacttac

SEQ ID NO: 267401 - DNA, 20 bp, Artificial
  CRISPR gRNA sequence
gtatcttcatccaacttacc

SEQ ID NO: 267402 - DNA, 20 bp, Artificial
  CRISPR gRNA sequence
catccaacttaccttctaac

SEQ ID NO: 267403 - DNA, 20 bp, Artificial
  CRISPR gRNA sequence
atccaacttaccttctaact

SEQ ID NO: 267404 - DNA, 20 bp, Artificial
  CRISPR gRNA sequence
accttctaactttgatcctc

SEQ ID NO: 267405 - DNA, 20 bp, Artificial
  CRISPR gRNA sequence
ccttctaactttgatcctct

SEQ ID NO: 267406 - DNA, 20 bp, Artificial
  CRISPR gRNA sequence
ctaactttgatcctctggtg

SEQ ID NO: 267407 - DNA, 20 bp, Artificial
  CRISPR gRNA sequence
taactttgatcctctggtgt

SEQ ID NO: 267408 - DNA, 20 bp, Artificial
  CRISPR gRNA sequence
actttgatcctctggtgttt

SEQ ID NO: 267409 - DNA, 20 bp, Artificial
  CRISPR gRNA sequence
tgatcctctggtgtttgctg

SEQ ID NO: 267410 - DNA, 20 bp, Artificial
  CRISPR gRNA sequence
gatcctctggtgtttgctga

SEQ ID NO: 267411 - DNA, 20 bp, Artificial
  CRISPR gRNA sequence
atcctctggtgtttgctgat

SEQ ID NO: 267412 - DNA, 20 bp, Artificial
  CRISPR gRNA sequence
tggtgtttgctgataatttt

SEQ ID NO: 267413 - DNA, 20 bp, Artificial
  CRISPR gRNA sequence
gtgtttgctgataattttcg

SEQ ID NO: 267414 - DNA, 20 bp, Artificial
  CRISPR gRNA sequence
gctgataattttcgagtttt

SEQ ID NO: 267415 - DNA, 20 bp, Artificial
  CRISPR gRNA sequence
ctgataattttcgagttttt

SEQ ID NO: 267416 - DNA, 20 bp, Artificial
  CRISPR gRNA sequence
ataattttcgagtttttaga

SEQ ID NO: 267417 - DNA, 20 bp, Artificial
  CRISPR gRNA sequence
tcgagtttttagaattctta

SEQ ID NO: 267418 - DNA, 20 bp, Artificial
  CRISPR gRNA sequence
cgagtttttagaattcttag

SEQ ID NO: 267419 - DNA, 20 bp, Artificial
  CRISPR gRNA sequence
gagtttttagaattcttagt

SEQ ID NO: 267420 - DNA, 20 bp, Artificial
  CRISPR gRNA sequence
ttagaattcttagttcttgt

SEQ ID NO: 267421 - DNA, 20 bp, Artificial
  CRISPR gRNA sequence
tagaattcttagttcttgtt

SEQ ID NO: 267422 - DNA, 20 bp, Artificial
  CRISPR gRNA sequence
agaattcttagttcttgttt

SEQ ID NO: 267423 - DNA, 20 bp, Artificial
  CRISPR gRNA sequence
gaattcttagttcttgtttc

SEQ ID NO: 267424 - DNA, 20 bp, Artificial
  CRISPR gRNA sequence
ttagttcttgtttcttctta

SEQ ID NO: 267425 - DNA, 20 bp, Artificial
  CRISPR gRNA sequence
agttcttgtttcttcttaat

SEQ ID NO: 267426 - DNA, 20 bp, Artificial
  CRISPR gRNA sequence
gttcttgtttcttcttaatc

SEQ ID NO: 267427 - DNA, 20 bp, Artificial
  CRISPR gRNA sequence
ttgtttcttcttaatctctg

SEQ ID NO: 267428 - DNA, 20 bp, Artificial
  CRISPR gRNA sequence
gtttcttcttaatctctggc

SEQ ID NO: 267429 - DNA, 20 bp, Artificial
  CRISPR gRNA sequence
tttcttcttaatctctggcc

SEQ ID NO: 267430 - DNA, 20 bp, Artificial
  CRISPR gRNA sequence
cttcttaatctctggccatt

SEQ ID NO: 267431 - DNA, 20 bp, Artificial
  CRISPR gRNA sequence
ttcttaatctctggccattg

SEQ ID NO: 267432 - DNA, 20 bp, Artificial
  CRISPR gRNA sequence
cttaatctctggccattggc

SEQ ID NO: 267433 - DNA, 20 bp, Artificial
  CRISPR gRNA sequence
ttaatctctggccattggct

SEQ ID NO: 267434 - DNA, 20 bp, Artificial
  CRISPR gRNA sequence
aatctctggccattggcttt

SEQ ID NO: 267435 - DNA, 20 bp, Artificial
  CRISPR gRNA sequence
atctctggccattggctttt

SEQ ID NO: 267436 - DNA, 20 bp, Artificial
  CRISPR gRNA sequence
tggccattggcttttatgcc

SEQ ID NO: 267437 - DNA, 20 bp, Artificial
  CRISPR gRNA sequence
gccattggcttttatgccta

SEQ ID NO: 267438 - DNA, 20 bp, Artificial
  CRISPR gRNA sequence
gcttttatgcctaccatatg

SEQ ID NO: 267439 - DNA, 20 bp, Artificial
  CRISPR gRNA sequence
ttatgcctaccatatggctt

SEQ ID NO: 267440 - DNA, 20 bp, Artificial
  CRISPR gRNA sequence
tatgcctaccatatggcttt

SEQ ID NO: 267441 - DNA, 20 bp, Artificial
  CRISPR gRNA sequence
atgcctaccatatggctttt

SEQ ID NO: 267442 - DNA, 20 bp, Artificial
  CRISPR gRNA sequence
tgcctaccatatggcttttc

SEQ ID NO: 267443 - DNA, 20 bp, Artificial
  CRISPR gRNA sequence
ccatatggcttttcaatcct

SEQ ID NO: 267444 - DNA, 20 bp, Artificial
  CRISPR gRNA sequence
ttcaatcctcttattgggaa

SEQ ID NO: 267445 - DNA, 20 bp, Artificial
  CRISPR gRNA sequence
tcaatcctcttattgggaat

SEQ ID NO: 267446 - DNA, 20 bp, Artificial
  CRISPR gRNA sequence
caatcctcttattgggaatc

SEQ ID NO: 267447 - DNA, 20 bp, Artificial
  CRISPR gRNA sequence
aatcctcttattgggaatct

SEQ ID NO: 267448 - DNA, 20 bp, Artificial
  CRISPR gRNA sequence
ttattgggaatctcaacttt

SEQ ID NO: 267449 - DNA, 20 bp, Artificial
  CRISPR gRNA sequence
attgggaatctcaactttct

SEQ ID NO: 267450 - DNA, 20 bp, Artificial
  CRISPR gRNA sequence
ttgggaatctcaactttcta

SEQ ID NO: 267451 - DNA, 20 bp, Artificial
  CRISPR gRNA sequence
ggaatctcaactttctaact

SEQ ID NO: 267452 - DNA, 20 bp, Artificial
  CRISPR gRNA sequence
aactttctaacttaaaggcc

SEQ ID NO: 267453 - DNA, 20 bp, Artificial
  CRISPR gRNA sequence
tctaacttaaaggccaggtg

SEQ ID NO: 267454 - DNA, 20 bp, Artificial
  CRISPR gRNA sequence
ctaacttaaaggccaggtgc

SEQ ID NO: 267455 - DNA, 20 bp, Artificial
  CRISPR gRNA sequence
taacttaaaggccaggtgca

SEQ ID NO: 267456 - DNA, 20 bp, Artificial
  CRISPR gRNA sequence
acttaaaggccaggtgcagt

SEQ ID NO: 267457 - DNA, 20 bp, Artificial
  CRISPR gRNA sequence
aaaggccaggtgcagtggcc

SEQ ID NO: 267458 - DNA, 20 bp, Artificial
  CRISPR gRNA sequence
aaggccaggtgcagtggccc

SEQ ID NO: 267459 - DNA, 20 bp, Artificial
  CRISPR gRNA sequence
tggatacccctccaggaaag

SEQ ID NO: 267460 - DNA, 20 bp, Artificial
  CRISPR gRNA sequence
ggatacccctccaggaaagg

SEQ ID NO: 267461 - DNA, 20 bp, Artificial
  CRISPR gRNA sequence
gatacccctccaggaaaggc

SEQ ID NO: 267462 - DNA, 20 bp, Artificial
  CRISPR gRNA sequence
caggaaaggcattcccctgt

SEQ ID NO: 267463 - DNA, 20 bp, Artificial
  CRISPR gRNA sequence
ccctgtgatatgctgaccta

SEQ ID NO: 267464 - DNA, 20 bp, Artificial
  CRISPR gRNA sequence
tgatatgctgacctaggtca

SEQ ID NO: 267465 - DNA, 20 bp, Artificial
  CRISPR gRNA sequence
acctaggtcaaagtaattta

SEQ ID NO: 267466 - DNA, 20 bp, Artificial
  CRISPR gRNA sequence
ggtcaaagtaatttactagc

SEQ ID NO: 267467 - DNA, 20 bp, Artificial
  CRISPR gRNA sequence
actagctctgcagaaagtag

SEQ ID NO: 267468 - DNA, 20 bp, Artificial
  CRISPR gRNA sequence
ctagctctgcagaaagtagt

SEQ ID NO: 267469 - DNA, 20 bp, Artificial
  CRISPR gRNA sequence
gctctgcagaaagtagtttt

SEQ ID NO: 267470 - DNA, 20 bp, Artificial
  CRISPR gRNA sequence
tgcagaaagtagttttggga

SEQ ID NO: 267471 - DNA, 20 bp, Artificial
  CRISPR gRNA sequence
cagaaagtagttttgggaat

SEQ ID NO: 267472 - DNA, 20 bp, Artificial
  CRISPR gRNA sequence
tgggaattactttaaccttc

SEQ ID NO: 267473 - DNA, 20 bp, Artificial
  CRISPR gRNA sequence
gggaattactttaaccttca

SEQ ID NO: 267474 - DNA, 20 bp, Artificial
  CRISPR gRNA sequence
ggaattactttaaccttcaa

SEQ ID NO: 267475 - DNA, 20 bp, Artificial
  CRISPR gRNA sequence
ctttaaccttcaatggccag

SEQ ID NO: 267476 - DNA, 20 bp, Artificial
  CRISPR gRNA sequence
taaccttcaatggccagagg

SEQ ID NO: 267477 - DNA, 20 bp, Artificial
  CRISPR gRNA sequence
aaccttcaatggccagagga

SEQ ID NO: 267478 - DNA, 20 bp, Artificial
  CRISPR gRNA sequence
accttcaatggccagaggac

SEQ ID NO: 267479 - DNA, 20 bp, Artificial
  CRISPR gRNA sequence
caatggccagaggacactgc

SEQ ID NO: 267480 - DNA, 20 bp, Artificial
  CRISPR gRNA sequence
aatggccagaggacactgct

SEQ ID NO: 267481 - DNA, 20 bp, Artificial
  CRISPR gRNA sequence
ctcattattgaaaacttatt

SEQ ID NO: 267482 - DNA, 20 bp, Artificial
  CRISPR gRNA sequence
attattgaaaacttattata

SEQ ID NO: 267483 - DNA, 20 bp, Artificial
  CRISPR gRNA sequence
ttgaaaacttattataaata

SEQ ID NO: 267484 - DNA, 20 bp, Artificial
  CRISPR gRNA sequence
aaaacttattataaatattc

SEQ ID NO: 267485 - DNA, 20 bp, Artificial
  CRISPR gRNA sequence
attataaatattcattagaa

SEQ ID NO: 267486 - DNA, 20 bp, Artificial
  CRISPR gRNA sequence
ttataaatattcattagaat

SEQ ID NO: 267487 - DNA, 20 bp, Artificial
  CRISPR gRNA sequence
taaatattcattagaatgtc

SEQ ID NO: 267488 - DNA, 20 bp, Artificial
  CRISPR gRNA sequence
attagaatgtcagttactat

SEQ ID NO: 267489 - DNA, 20 bp, Artificial
  CRISPR gRNA sequence
gaatgtcagttactataatg

SEQ ID NO: 267490 - DNA, 20 bp, Artificial
  CRISPR gRNA sequence
ctataatgagacatcaattt

SEQ ID NO: 267491 - DNA, 20 bp, Artificial
  CRISPR gRNA sequence
taatgagacatcaatttgtt

SEQ ID NO: 267492 - DNA, 20 bp, Artificial
  CRISPR gRNA sequence
gttgagtgacttgagtcacc

SEQ ID NO: 267493 - DNA, 20 bp, Artificial
  CRISPR gRNA sequence
ttgagtgacttgagtcaccc

SEQ ID NO: 267494 - DNA, 20 bp, Artificial
  CRISPR gRNA sequence
agtgacttgagtcacccaaa

SEQ ID NO: 267495 - DNA, 20 bp, Artificial
  CRISPR gRNA sequence
gagtcacccaaagggacaaa

SEQ ID NO: 267496 - DNA, 20 bp, Artificial
  CRISPR gRNA sequence
agtcacccaaagggacaaaa

SEQ ID NO: 267497 - DNA, 20 bp, Artificial
  CRISPR gRNA sequence
ctcactttcaatgaatttaa

SEQ ID NO: 267498 - DNA, 20 bp, Artificial
  CRISPR gRNA sequence
tcactttcaatgaatttaaa

SEQ ID NO: 267499 - DNA, 20 bp, Artificial
  CRISPR gRNA sequence
actttcaatgaatttaaacc

SEQ ID NO: 267500 - DNA, 20 bp, Artificial
  CRISPR gRNA sequence
tcaatgaatttaaaccgttc

SEQ ID NO: 267501 - DNA, 20 bp, Artificial
  CRISPR gRNA sequence
caatgaatttaaaccgttca

SEQ ID NO: 267502 - DNA, 20 bp, Artificial
  CRISPR gRNA sequence
aatgaatttaaaccgttcac

SEQ ID NO: 267503 - DNA, 20 bp, Artificial
  CRISPR gRNA sequence
aaaccgttcactttcaactc

SEQ ID NO: 267504 - DNA, 20 bp, Artificial
  CRISPR gRNA sequence
aaccgttcactttcaactca

SEQ ID NO: 267505 - DNA, 20 bp, Artificial
  CRISPR gRNA sequence
actttcaactcagacacatc

SEQ ID NO: 267506 - DNA, 20 bp, Artificial
  CRISPR gRNA sequence
tcaactcagacacatcatag

SEQ ID NO: 267507 - DNA, 20 bp, Artificial
  CRISPR gRNA sequence
caactcagacacatcataga

SEQ ID NO: 267508 - DNA, 20 bp, Artificial
  CRISPR gRNA sequence
aactcagacacatcatagac

SEQ ID NO: 267509 - DNA, 20 bp, Artificial
  CRISPR gRNA sequence
agacacatcatagacacact

SEQ ID NO: 267510 - DNA, 20 bp, Artificial
  CRISPR gRNA sequence
ggtttttccttggcagtact

SEQ ID NO: 267511 - DNA, 20 bp, Artificial
  CRISPR gRNA sequence
ttccttggcagtactactaa

SEQ ID NO: 267512 - DNA, 20 bp, Artificial
  CRISPR gRNA sequence
tccttggcagtactactaat

SEQ ID NO: 267513 - DNA, 20 bp, Artificial
  CRISPR gRNA sequence
ccttggcagtactactaatt

SEQ ID NO: 267514 - DNA, 20 bp, Artificial
  CRISPR gRNA sequence
cttggcagtactactaattc

SEQ ID NO: 267515 - DNA, 20 bp, Artificial
  CRISPR gRNA sequence
ggcagtactactaattccta

SEQ ID NO: 267516 - DNA, 20 bp, Artificial
  CRISPR gRNA sequence
gcagtactactaattcctag

SEQ ID NO: 267517 - DNA, 20 bp, Artificial
  CRISPR gRNA sequence
ctaattcctagtgagattca

SEQ ID NO: 267518 - DNA, 20 bp, Artificial
  CRISPR gRNA sequence
attcctagtgagattcatct

SEQ ID NO: 267519 - DNA, 20 bp, Artificial
  CRISPR gRNA sequence
ctagtgagattcatcttgct

SEQ ID NO: 267520 - DNA, 20 bp, Artificial
  CRISPR gRNA sequence
gtgagattcatcttgctttg

SEQ ID NO: 267521 - DNA, 20 bp, Artificial
  CRISPR gRNA sequence
atcttgctttgttttaaaaa

SEQ ID NO: 267522 - DNA, 20 bp, Artificial
  CRISPR gRNA sequence
gctttgttttaaaaaaattt

SEQ ID NO: 267523 - DNA, 20 bp, Artificial
  CRISPR gRNA sequence
ctttgttttaaaaaaatttt

SEQ ID NO: 267524 - DNA, 20 bp, Artificial
  CRISPR gRNA sequence
tgttttaaaaaaattttatt

SEQ ID NO: 267525 - DNA, 20 bp, Artificial
  CRISPR gRNA sequence
gttttaaaaaaattttattt

SEQ ID NO: 267526 - DNA, 20 bp, Artificial
  CRISPR gRNA sequence
ttttaaaaaaattttatttt

SEQ ID NO: 267527 - DNA, 20 bp, Artificial
  CRISPR gRNA sequence
taaaaaaattttatttttgt

SEQ ID NO: 267528 - DNA, 20 bp, Artificial
  CRISPR gRNA sequence
aaaaaaattttatttttgtt

SEQ ID NO: 267529 - DNA, 20 bp, Artificial
  CRISPR gRNA sequence
aaaaaattttatttttgttt

SEQ ID NO: 267530 - DNA, 20 bp, Artificial
  CRISPR gRNA sequence
tatttttgttttactttgtc

SEQ ID NO: 267531 - DNA, 20 bp, Artificial
  CRISPR gRNA sequence
atttttgttttactttgtct

SEQ ID NO: 267532 - DNA, 20 bp, Artificial
  CRISPR gRNA sequence
tttttgttttactttgtctt

SEQ ID NO: 267533 - DNA, 20 bp, Artificial
  CRISPR gRNA sequence
ttgttttactttgtcttaca

SEQ ID NO: 267534 - DNA, 20 bp, Artificial
  CRISPR gRNA sequence
tgttttactttgtcttacag

SEQ ID NO: 267535 - DNA, 20 bp, Artificial
  CRISPR gRNA sequence
gttttactttgtcttacaga

SEQ ID NO: 267536 - DNA, 20 bp, Artificial
  CRISPR gRNA sequence
ttttactttgtcttacagac

SEQ ID NO: 267537 - DNA, 20 bp, Artificial
  CRISPR gRNA sequence
tactttgtcttacagacccc

SEQ ID NO: 267538 - DNA, 20 bp, Artificial
  CRISPR gRNA sequence
actttgtcttacagaccccc

SEQ ID NO: 267539 - DNA, 20 bp, Artificial
  CRISPR gRNA sequence
ctttgtcttacagaccccct

SEQ ID NO: 267540 - DNA, 20 bp, Artificial
  CRISPR gRNA sequence
tgtcttacagaccccctgtg

SEQ ID NO: 267541 - DNA, 20 bp, Artificial
  CRISPR gRNA sequence
gtcttacagaccccctgtga

SEQ ID NO: 267542 - DNA, 20 bp, Artificial
  CRISPR gRNA sequence
tcttacagaccccctgtgaa

SEQ ID NO: 267543 - DNA, 20 bp, Artificial
  CRISPR gRNA sequence
acagaccccctgtgaattgg

SEQ ID NO: 267544 - DNA, 20 bp, Artificial
  CRISPR gRNA sequence
cagaccccctgtgaattggg

SEQ ID NO: 267545 - DNA, 20 bp, Artificial
  CRISPR gRNA sequence
tgaattgggcagtcctgtca

SEQ ID NO: 267546 - DNA, 20 bp, Artificial
  CRISPR gRNA sequence
ggcagtcctgtcatttgtgg

SEQ ID NO: 267547 - DNA, 20 bp, Artificial
  CRISPR gRNA sequence
tcatttgtggcctcttgtag

SEQ ID NO: 267548 - DNA, 20 bp, Artificial
  CRISPR gRNA sequence
gtggcctcttgtagtcaatt

SEQ ID NO: 267549 - DNA, 20 bp, Artificial
  CRISPR gRNA sequence
tggcctcttgtagtcaattc

SEQ ID NO: 267550 - DNA, 20 bp, Artificial
  CRISPR gRNA sequence
ttgtagtcaattcggttacc

SEQ ID NO: 267551 - DNA, 20 bp, Artificial
  CRISPR gRNA sequence
gtagtcaattcggttaccca

SEQ ID NO: 267552 - DNA, 20 bp, Artificial
  CRISPR gRNA sequence
tagtcaattcggttacccaa

SEQ ID NO: 267553 - DNA, 20 bp, Artificial
  CRISPR gRNA sequence
ggttacccaataaaaactac

SEQ ID NO: 267554 - DNA, 20 bp, Artificial
  CRISPR gRNA sequence
cccaataaaaactaccactt

SEQ ID NO: 267555 - DNA, 20 bp, Artificial
  CRISPR gRNA sequence
ccacttatctgcatctcaaa

SEQ ID NO: 267556 - DNA, 20 bp, Artificial
  CRISPR gRNA sequence
atctgcatctcaaacctggg

SEQ ID NO: 267557 - DNA, 20 bp, Artificial
  CRISPR gRNA sequence
tctgcatctcaaacctgggt

SEQ ID NO: 267558 - DNA, 20 bp, Artificial
  CRISPR gRNA sequence
catctcaaacctgggtcttt

SEQ ID NO: 267559 - DNA, 20 bp, Artificial
  CRISPR gRNA sequence
aaacctgggtctttgtactc

SEQ ID NO: 267560 - DNA, 20 bp, Artificial
  CRISPR gRNA sequence
ggtctttgtactctcttacc

SEQ ID NO: 267561 - DNA, 20 bp, Artificial
  CRISPR gRNA sequence
tgtactctcttaccaaaaga

SEQ ID NO: 267562 - DNA, 20 bp, Artificial
  CRISPR gRNA sequence
gtactctcttaccaaaagag

SEQ ID NO: 267563 - DNA, 20 bp, Artificial
  CRISPR gRNA sequence
tactctcttaccaaaagagt

SEQ ID NO: 267564 - DNA, 20 bp, Artificial
  CRISPR gRNA sequence
tcttaccaaaagagtataaa

SEQ ID NO: 267565 - DNA, 20 bp, Artificial
  CRISPR gRNA sequence
ttaccaaaagagtataaata

SEQ ID NO: 267566 - DNA, 20 bp, Artificial
  CRISPR gRNA sequence
accaaaagagtataaataca

SEQ ID NO: 267567 - DNA, 20 bp, Artificial
  CRISPR gRNA sequence
ccaaaagagtataaatacaa

SEQ ID NO: 267568 - DNA, 20 bp, Artificial
  CRISPR gRNA sequence
gtctatatttcgtagaataa

SEQ ID NO: 267569 - DNA, 20 bp, Artificial
  CRISPR gRNA sequence
tctatatttcgtagaataac

SEQ ID NO: 267570 - DNA, 20 bp, Artificial
  CRISPR gRNA sequence
tatttcgtagaataacatag

SEQ ID NO: 267571 - DNA, 20 bp, Artificial
  CRISPR gRNA sequence
cgtagaataacatagtattt

SEQ ID NO: 267572 - DNA, 20 bp, Artificial
  CRISPR gRNA sequence
gtagaataacatagtatttt

SEQ ID NO: 267573 - DNA, 20 bp, Artificial
  CRISPR gRNA sequence
ttactctgggctcatctttt

SEQ ID NO: 267574 - DNA, 20 bp, Artificial
  CRISPR gRNA sequence
tactctgggctcatcttttc

SEQ ID NO: 267575 - DNA, 20 bp, Artificial
  CRISPR gRNA sequence
actctgggctcatcttttcc

SEQ ID NO: 267576 - DNA, 20 bp, Artificial
  CRISPR gRNA sequence
ctctgggctcatcttttcct

SEQ ID NO: 267577 - DNA, 20 bp, Artificial
  CRISPR gRNA sequence
tgggctcatcttttcctgct

SEQ ID NO: 267578 - DNA, 20 bp, Artificial
  CRISPR gRNA sequence
ggctcatcttttcctgctgt

SEQ ID NO: 267579 - DNA, 20 bp, Artificial
  CRISPR gRNA sequence
atcttttcctgctgttggta

SEQ ID NO: 267580 - DNA, 20 bp, Artificial
  CRISPR gRNA sequence
ttcctgctgttggtatttaa

SEQ ID NO: 267581 - DNA, 20 bp, Artificial
  CRISPR gRNA sequence
tcctgctgttggtatttaag

SEQ ID NO: 267582 - DNA, 20 bp, Artificial
  CRISPR gRNA sequence
cctgctgttggtatttaagc

SEQ ID NO: 267583 - DNA, 20 bp, Artificial
  CRISPR gRNA sequence
ctgctgttggtatttaagca

SEQ ID NO: 267584 - DNA, 20 bp, Artificial
  CRISPR gRNA sequence
ctgttggtatttaagcaaca

SEQ ID NO: 267585 - DNA, 20 bp, Artificial
  CRISPR gRNA sequence
ttggtatttaagcaacaagt

SEQ ID NO: 267586 - DNA, 20 bp, Artificial
  CRISPR gRNA sequence
gtatttaagcaacaagtacc

SEQ ID NO: 267587 - DNA, 20 bp, Artificial
  CRISPR gRNA sequence
aagcaacaagtaccttgctg

SEQ ID NO: 267588 - DNA, 20 bp, Artificial
  CRISPR gRNA sequence
agcaacaagtaccttgctga

SEQ ID NO: 267589 - DNA, 20 bp, Artificial
  CRISPR gRNA sequence
gctgagttgggcatctaggc

SEQ ID NO: 267590 - DNA, 20 bp, Artificial
  CRISPR gRNA sequence
ctgagttgggcatctaggcc

SEQ ID NO: 267591 - DNA, 20 bp, Artificial
  CRISPR gRNA sequence
agttgggcatctaggccatt

SEQ ID NO: 267592 - DNA, 20 bp, Artificial
  CRISPR gRNA sequence
ggcatctaggccattatgga

SEQ ID NO: 267593 - DNA, 20 bp, Artificial
  CRISPR gRNA sequence
ggccattatggatccctgga

SEQ ID NO: 267594 - DNA, 20 bp, Artificial
  CRISPR gRNA sequence
tggatccctggagtttagct

SEQ ID NO: 267595 - DNA, 20 bp, Artificial
  CRISPR gRNA sequence
gagtttagctgtttcctggg

SEQ ID NO: 267596 - DNA, 20 bp, Artificial
  CRISPR gRNA sequence
agctgtttcctgggtaattt

SEQ ID NO: 267597 - DNA, 20 bp, Artificial
  CRISPR gRNA sequence
gctgtttcctgggtaatttt

SEQ ID NO: 267598 - DNA, 20 bp, Artificial
  CRISPR gRNA sequence
tttcctgggtaattttctga

SEQ ID NO: 267599 - DNA, 20 bp, Artificial
  CRISPR gRNA sequence
cctgggtaattttctgagat

SEQ ID NO: 267600 - DNA, 20 bp, Artificial
  CRISPR gRNA sequence
ctgggtaattttctgagatc

SEQ ID NO: 267601 - DNA, 20 bp, Artificial
  CRISPR gRNA sequence
ggtaattttctgagatccta

SEQ ID NO: 267602 - DNA, 20 bp, Artificial
  CRISPR gRNA sequence
tctgagatcctatttttggc

SEQ ID NO: 267603 - DNA, 20 bp, Artificial
  CRISPR gRNA sequence
ctgagatcctatttttggct

SEQ ID NO: 267604 - DNA, 20 bp, Artificial
  CRISPR gRNA sequence
tgagatcctatttttggctg

SEQ ID NO: 267605 - DNA, 20 bp, Artificial
  CRISPR gRNA sequence
agatcctatttttggctggt

SEQ ID NO: 267606 - DNA, 20 bp, Artificial
  CRISPR gRNA sequence
tttttggctggtctgcagcg

SEQ ID NO: 267607 - DNA, 20 bp, Artificial
  CRISPR gRNA sequence
ttggctggtctgcagcgtgc

SEQ ID NO: 267608 - DNA, 20 bp, Artificial
  CRISPR gRNA sequence
tggctggtctgcagcgtgcc

SEQ ID NO: 267609 - DNA, 20 bp, Artificial
  CRISPR gRNA sequence
ggctggtctgcagcgtgcct

SEQ ID NO: 267610 - DNA, 20 bp, Artificial
  CRISPR gRNA sequence
gctggtctgcagcgtgcctt

SEQ ID NO: 267611 - DNA, 20 bp, Artificial
  CRISPR gRNA sequence
gtctgcagcgtgccttgatg

SEQ ID NO: 267612 - DNA, 20 bp, Artificial
  CRISPR gRNA sequence
cagcgtgccttgatgtaagt

SEQ ID NO: 267613 - DNA, 20 bp, Artificial
  CRISPR gRNA sequence
gatgtaagttgctgttttcc

SEQ ID NO: 267614 - DNA, 20 bp, Artificial
  CRISPR gRNA sequence
atgtaagttgctgttttccg

SEQ ID NO: 267615 - DNA, 20 bp, Artificial
  CRISPR gRNA sequence
ctgttttccggaacttcctg

SEQ ID NO: 267616 - DNA, 20 bp, Artificial
  CRISPR gRNA sequence
ttttccggaacttcctgagg

SEQ ID NO: 267617 - DNA, 20 bp, Artificial
  CRISPR gRNA sequence
tccggaacttcctgagggcc

SEQ ID NO: 267618 - DNA, 20 bp, Artificial
  CRISPR gRNA sequence
ccggaacttcctgagggcct

SEQ ID NO: 267619 - DNA, 20 bp, Artificial
  CRISPR gRNA sequence
cggaacttcctgagggcctg

SEQ ID NO: 267620 - DNA, 20 bp, Artificial
  CRISPR gRNA sequence
cctgagggcctgatatgcta

SEQ ID NO: 267621 - DNA, 20 bp, Artificial
  CRISPR gRNA sequence
ctgagggcctgatatgctac

SEQ ID NO: 267622 - DNA, 20 bp, Artificial
  CRISPR gRNA sequence
agggcctgatatgctactgt

SEQ ID NO: 267623 - DNA, 20 bp, Artificial
  CRISPR gRNA sequence
atatgctactgtaggcagtt

SEQ ID NO: 267624 - DNA, 20 bp, Artificial
  CRISPR gRNA sequence
ctgtaggcagttctgggttg

SEQ ID NO: 267625 - DNA, 20 bp, Artificial
  CRISPR gRNA sequence
taggcagttctgggttgagt

SEQ ID NO: 267626 - DNA, 20 bp, Artificial
  CRISPR gRNA sequence
tgggttgagtgggtttctag

SEQ ID NO: 267627 - DNA, 20 bp, Artificial
  CRISPR gRNA sequence
ggttgagtgggtttctaggc

SEQ ID NO: 267628 - DNA, 20 bp, Artificial
  CRISPR gRNA sequence
agtgggtttctaggctgagc

SEQ ID NO: 267629 - DNA, 20 bp, Artificial
  CRISPR gRNA sequence
ctaggctgagcgggtttctg

SEQ ID NO: 267630 - DNA, 20 bp, Artificial
  CRISPR gRNA sequence
taggctgagcgggtttctgg

SEQ ID NO: 267631 - DNA, 20 bp, Artificial
  CRISPR gRNA sequence
ggctgagcgggtttctggga

SEQ ID NO: 267632 - DNA, 20 bp, Artificial
  CRISPR gRNA sequence
agcgggtttctgggagcagc

SEQ ID NO: 267633 - DNA, 20 bp, Artificial
  CRISPR gRNA sequence
ctgggagcagctgcagattc

SEQ ID NO: 267634 - DNA, 20 bp, Artificial
  CRISPR gRNA sequence
tgggagcagctgcagattct

SEQ ID NO: 267635 - DNA, 20 bp, Artificial
  CRISPR gRNA sequence
ggagcagctgcagattctat

SEQ ID NO: 267636 - DNA, 20 bp, Artificial
  CRISPR gRNA sequence
cagattctatctcagttctt

SEQ ID NO: 267637 - DNA, 20 bp, Artificial
  CRISPR gRNA sequence
tatctcagttcttgacctga

SEQ ID NO: 267638 - DNA, 20 bp, Artificial
  CRISPR gRNA sequence
tctcagttcttgacctgatg

SEQ ID NO: 267639 - DNA, 20 bp, Artificial
  CRISPR gRNA sequence
agttcttgacctgatgttga

SEQ ID NO: 267640 - DNA, 20 bp, Artificial
  CRISPR gRNA sequence
ttgacctgatgttgacattt

SEQ ID NO: 267641 - DNA, 20 bp, Artificial
  CRISPR gRNA sequence
gacctgatgttgacatttga

SEQ ID NO: 267642 - DNA, 20 bp, Artificial
  CRISPR gRNA sequence
acctgatgttgacatttgag

SEQ ID NO: 267643 - DNA, 20 bp, Artificial
  CRISPR gRNA sequence
atgttgacatttgagtaaat

SEQ ID NO: 267644 - DNA, 20 bp, Artificial
  CRISPR gRNA sequence
acatttgagtaaataaagag

SEQ ID NO: 267645 - DNA, 20 bp, Artificial
  CRISPR gRNA sequence
gagtaaataaagagctccct

SEQ ID NO: 267646 - DNA, 20 bp, Artificial
  CRISPR gRNA sequence
agtaaataaagagctccctt

SEQ ID NO: 267647 - DNA, 20 bp, Artificial
  CRISPR gRNA sequence
cctttggtcaagctgtcaca

SEQ ID NO: 267648 - DNA, 20 bp, Artificial
  CRISPR gRNA sequence
tggtcaagctgtcacaggcc

SEQ ID NO: 267649 - DNA, 20 bp, Artificial
  CRISPR gRNA sequence
ggtcaagctgtcacaggcca

SEQ ID NO: 267650 - DNA, 20 bp, Artificial
  CRISPR gRNA sequence
gtcaagctgtcacaggccag

SEQ ID NO: 267651 - DNA, 20 bp, Artificial
  CRISPR gRNA sequence
tcacaggccagcacctgtca

SEQ ID NO: 267652 - DNA, 20 bp, Artificial
  CRISPR gRNA sequence
tcactgtctttcaattctcc

SEQ ID NO: 267653 - DNA, 20 bp, Artificial
  CRISPR gRNA sequence
tctttcaattctccattcat

SEQ ID NO: 267654 - DNA, 20 bp, Artificial
  CRISPR gRNA sequence
tcaattctccattcatgcag

SEQ ID NO: 267655 - DNA, 20 bp, Artificial
  CRISPR gRNA sequence
caattctccattcatgcagc

SEQ ID NO: 267656 - DNA, 20 bp, Artificial
  CRISPR gRNA sequence
aattctccattcatgcagct

SEQ ID NO: 267657 - DNA, 20 bp, Artificial
  CRISPR gRNA sequence
tccattcatgcagctgtgct

SEQ ID NO: 267658 - DNA, 20 bp, Artificial
  CRISPR gRNA sequence
cattcatgcagctgtgctgg

SEQ ID NO: 267659 - DNA, 20 bp, Artificial
  CRISPR gRNA sequence
atgcagctgtgctggtaaag

SEQ ID NO: 267660 - DNA, 20 bp, Artificial
  CRISPR gRNA sequence
tgctggtaaagctgcccgtt

SEQ ID NO: 267661 - DNA, 20 bp, Artificial
  CRISPR gRNA sequence
gtaaagctgcccgttttcct

SEQ ID NO: 267662 - DNA, 20 bp, Artificial
  CRISPR gRNA sequence
cccgttttcctaaagaaatc

SEQ ID NO: 267663 - DNA, 20 bp, Artificial
  CRISPR gRNA sequence
tcctaaagaaatctttttaa

SEQ ID NO: 267664 - DNA, 20 bp, Artificial
  CRISPR gRNA sequence
cctaaagaaatctttttaaa

SEQ ID NO: 267665 - DNA, 20 bp, Artificial
  CRISPR gRNA sequence
ctaaagaaatctttttaaaa

SEQ ID NO: 267666 - DNA, 20 bp, Artificial
  CRISPR gRNA sequence
aagaaatctttttaaaaaac

SEQ ID NO: 267667 - DNA, 20 bp, Artificial
  CRISPR gRNA sequence
tttaaaaaacattatgttcc

SEQ ID NO: 267668 - DNA, 20 bp, Artificial
  CRISPR gRNA sequence
ttaaaaaacattatgttccc

SEQ ID NO: 267669 - DNA, 20 bp, Artificial
  CRISPR gRNA sequence
taaaaaacattatgttcccc

SEQ ID NO: 267670 - DNA, 20 bp, Artificial
  CRISPR gRNA sequence
aaaaaacattatgttcccca

SEQ ID NO: 267671 - DNA, 20 bp, Artificial
  CRISPR gRNA sequence
aaaaacattatgttccccac

SEQ ID NO: 267672 - DNA, 20 bp, Artificial
  CRISPR gRNA sequence
tgttccccactgcagatcat

SEQ ID NO: 267673 - DNA, 20 bp, Artificial
  CRISPR gRNA sequence
cccactgcagatcataatgt

SEQ ID NO: 267674 - DNA, 20 bp, Artificial
  CRISPR gRNA sequence
cagatcataatgtgaggaat

SEQ ID NO: 267675 - DNA, 20 bp, Artificial
  CRISPR gRNA sequence
ctttttataataatccagta

SEQ ID NO: 267676 - DNA, 20 bp, Artificial
  CRISPR gRNA sequence
tttataataatccagtagat

SEQ ID NO: 267677 - DNA, 20 bp, Artificial
  CRISPR gRNA sequence
ttataataatccagtagatt

SEQ ID NO: 267678 - DNA, 20 bp, Artificial
  CRISPR gRNA sequence
tataataatccagtagattc

SEQ ID NO: 267679 - DNA, 20 bp, Artificial
  CRISPR gRNA sequence
ataataatccagtagattct

SEQ ID NO: 267680 - DNA, 20 bp, Artificial
  CRISPR gRNA sequence
taataatccagtagattctt

SEQ ID NO: 267681 - DNA, 20 bp, Artificial
  CRISPR gRNA sequence
ttgaagaccacgtacttaag

SEQ ID NO: 267682 - DNA, 20 bp, Artificial
  CRISPR gRNA sequence
gaagaccacgtacttaagta

SEQ ID NO: 267683 - DNA, 20 bp, Artificial
  CRISPR gRNA sequence
aagaccacgtacttaagtag

SEQ ID NO: 267684 - DNA, 20 bp, Artificial
  CRISPR gRNA sequence
aagtagattaccttgcatat

SEQ ID NO: 267685 - DNA, 20 bp, Artificial
  CRISPR gRNA sequence
agtagattaccttgcatatg

SEQ ID NO: 267686 - DNA, 20 bp, Artificial
  CRISPR gRNA sequence
ccttgcatatgccctgtgta

SEQ ID NO: 267687 - DNA, 20 bp, Artificial
  CRISPR gRNA sequence
gcatatgccctgtgtattgc

SEQ ID NO: 267688 - DNA, 20 bp, Artificial
  CRISPR gRNA sequence
catatgccctgtgtattgct

SEQ ID NO: 267689 - DNA, 20 bp, Artificial
  CRISPR gRNA sequence
tgtattgctgctgttcccag

SEQ ID NO: 267690 - DNA, 20 bp, Artificial
  CRISPR gRNA sequence
ctgctgttcccaggaaacaa

SEQ ID NO: 267691 - DNA, 20 bp, Artificial
  CRISPR gRNA sequence
ctgttcccaggaaacaagtg

SEQ ID NO: 267692 - DNA, 20 bp, Artificial
  CRISPR gRNA sequence
ttcccaggaaacaagtgggt

SEQ ID NO: 267693 - DNA, 20 bp, Artificial
  CRISPR gRNA sequence
ccaggaaacaagtgggtaag

SEQ ID NO: 267694 - DNA, 20 bp, Artificial
  CRISPR gRNA sequence
gcatggggagaagggcaaag

SEQ ID NO: 267695 - DNA, 20 bp, Artificial
  CRISPR gRNA sequence
catatcattagctgacattc

SEQ ID NO: 267696 - DNA, 20 bp, Artificial
  CRISPR gRNA sequence
gctgacattcactgttgaag

SEQ ID NO: 267697 - DNA, 20 bp, Artificial
  CRISPR gRNA sequence
acattcactgttgaaggggt

SEQ ID NO: 267698 - DNA, 20 bp, Artificial
  CRISPR gRNA sequence
actgttgaaggggtggagat

SEQ ID NO: 267699 - DNA, 20 bp, Artificial
  CRISPR gRNA sequence
ttgaaggggtggagatgaca

SEQ ID NO: 267700 - DNA, 20 bp, Artificial
  CRISPR gRNA sequence
aaggggtggagatgacacag

SEQ ID NO: 267701 - DNA, 20 bp, Artificial
  CRISPR gRNA sequence
cctgcacacatatgcacaca

SEQ ID NO: 267702 - DNA, 20 bp, Artificial
  CRISPR gRNA sequence
ctgcacacatatgcacacat

SEQ ID NO: 267703 - DNA, 20 bp, Artificial
  CRISPR gRNA sequence
cacacatatgcacacatact

SEQ ID NO: 267704 - DNA, 20 bp, Artificial
  CRISPR gRNA sequence
aatgcacatgggtgctgtag

SEQ ID NO: 267705 - DNA, 20 bp, Artificial
  CRISPR gRNA sequence
taggttctgcgtggtgtttg

SEQ ID NO: 267706 - DNA, 20 bp, Artificial
  CRISPR gRNA sequence
tgcgtggtgtttgttcccag

SEQ ID NO: 267707 - DNA, 20 bp, Artificial
  CRISPR gRNA sequence
cgtggtgtttgttcccagcc

SEQ ID NO: 267708 - DNA, 20 bp, Artificial
  CRISPR gRNA sequence
gttcccagccatgcatctgt

SEQ ID NO: 267709 - DNA, 20 bp, Artificial
  CRISPR gRNA sequence
ttcccagccatgcatctgtc

SEQ ID NO: 267710 - DNA, 20 bp, Artificial
  CRISPR gRNA sequence
ccagccatgcatctgtcatt

SEQ ID NO: 267711 - DNA, 20 bp, Artificial
  CRISPR gRNA sequence
tcattttcatcccactgctg

SEQ ID NO: 267712 - DNA, 20 bp, Artificial
  CRISPR gRNA sequence
tcatcccactgctgtgttta

SEQ ID NO: 267713 - DNA, 20 bp, Artificial
  CRISPR gRNA sequence
catcccactgctgtgtttag

SEQ ID NO: 267714 - DNA, 20 bp, Artificial
  CRISPR gRNA sequence
atcccactgctgtgtttaga

SEQ ID NO: 267715 - DNA, 20 bp, Artificial
  CRISPR gRNA sequence
ctgtgtttagagttagggtg

SEQ ID NO: 267716 - DNA, 20 bp, Artificial
  CRISPR gRNA sequence
tgtttagagttagggtgata

SEQ ID NO: 267717 - DNA, 20 bp, Artificial
  CRISPR gRNA sequence
agagttagggtgataataag

SEQ ID NO: 267718 - DNA, 20 bp, Artificial
  CRISPR gRNA sequence
gagttagggtgataataagt

SEQ ID NO: 267719 - DNA, 20 bp, Artificial
  CRISPR gRNA sequence
gggtgataataagtaagtct

SEQ ID NO: 267720 - DNA, 20 bp, Artificial
  CRISPR gRNA sequence
ccatctgacaatcacttgag

SEQ ID NO: 267721 - DNA, 20 bp, Artificial
  CRISPR gRNA sequence
acaatcacttgaggataagc

SEQ ID NO: 267722 - DNA, 20 bp, Artificial
  CRISPR gRNA sequence
gaggataagcatgggagctg

SEQ ID NO: 267723 - DNA, 20 bp, Artificial
  CRISPR gRNA sequence
aggataagcatgggagctga

SEQ ID NO: 267724 - DNA, 20 bp, Artificial
  CRISPR gRNA sequence
actgcaacagacctttcatt

SEQ ID NO: 267725 - DNA, 20 bp, Artificial
  CRISPR gRNA sequence
caacagacctttcattattt

SEQ ID NO: 267726 - DNA, 20 bp, Artificial
  CRISPR gRNA sequence
tcattattttatgtgcaatg

SEQ ID NO: 267727 - DNA, 20 bp, Artificial
  CRISPR gRNA sequence
cattattttatgtgcaatgt

SEQ ID NO: 267728 - DNA, 20 bp, Artificial
  CRISPR gRNA sequence
attattttatgtgcaatgta

SEQ ID NO: 267729 - DNA, 20 bp, Artificial
  CRISPR gRNA sequence
ttttatgtgcaatgtaaaga

SEQ ID NO: 267730 - DNA, 20 bp, Artificial
  CRISPR gRNA sequence
tatgtgcaatgtaaagaacc

SEQ ID NO: 267731 - DNA, 20 bp, Artificial
  CRISPR gRNA sequence
atgtgcaatgtaaagaacct

SEQ ID NO: 267732 - DNA, 20 bp, Artificial
  CRISPR gRNA sequence
tgtgcaatgtaaagaacctg

SEQ ID NO: 267733 - DNA, 20 bp, Artificial
  CRISPR gRNA sequence
agaatcaagacacctttatt

SEQ ID NO: 267734 - DNA, 20 bp, Artificial
  CRISPR gRNA sequence
tattgctgtggcctctctac

SEQ ID NO: 267735 - DNA, 20 bp, Artificial
  CRISPR gRNA sequence
attgctgtggcctctctacc

SEQ ID NO: 267736 - DNA, 20 bp, Artificial
  CRISPR gRNA sequence
ttgctgtggcctctctacca

SEQ ID NO: 267737 - DNA, 20 bp, Artificial
  CRISPR gRNA sequence
ctgtggcctctctaccagct

SEQ ID NO: 267738 - DNA, 20 bp, Artificial
  CRISPR gRNA sequence
tggcctctctaccagctatg

SEQ ID NO: 267739 - DNA, 20 bp, Artificial
  CRISPR gRNA sequence
tctaccagctatgatttggt

SEQ ID NO: 267740 - DNA, 20 bp, Artificial
  CRISPR gRNA sequence
taccagctatgatttggttt

SEQ ID NO: 267741 - DNA, 20 bp, Artificial
  CRISPR gRNA sequence
ccagctatgatttggtttgg

SEQ ID NO: 267742 - DNA, 20 bp, Artificial
  CRISPR gRNA sequence
tgatttggtttgggtgtccg

SEQ ID NO: 267743 - DNA, 20 bp, Artificial
  CRISPR gRNA sequence
ggtttgggtgtccggaggca

SEQ ID NO: 267744 - DNA, 20 bp, Artificial
  CRISPR gRNA sequence
gtttgggtgtccggaggcag

SEQ ID NO: 267745 - DNA, 20 bp, Artificial
  CRISPR gRNA sequence
gggtgtccggaggcagaggc

SEQ ID NO: 267746 - DNA, 20 bp, Artificial
  CRISPR gRNA sequence
ggtgtccggaggcagaggct

SEQ ID NO: 267747 - DNA, 20 bp, Artificial
  CRISPR gRNA sequence
acacttggaggtttggcaaa

SEQ ID NO: 267748 - DNA, 20 bp, Artificial
  CRISPR gRNA sequence
ggaggtttggcaaagggagt

SEQ ID NO: 267749 - DNA, 20 bp, Artificial
  CRISPR gRNA sequence
gaggtttggcaaagggagtc

SEQ ID NO: 267750 - DNA, 20 bp, Artificial
  CRISPR gRNA sequence
ggcaaagggagtcctcaggg

SEQ ID NO: 267751 - DNA, 20 bp, Artificial
  CRISPR gRNA sequence
gcaaagggagtcctcagggt

SEQ ID NO: 267752 - DNA, 20 bp, Artificial
  CRISPR gRNA sequence
agggttggagtaagtactaa

SEQ ID NO: 267753 - DNA, 20 bp, Artificial
  CRISPR gRNA sequence
gagtaagtactaaaaatgct

SEQ ID NO: 267754 - DNA, 20 bp, Artificial
  CRISPR gRNA sequence
aaaatgcttcccaggttatc

SEQ ID NO: 267755 - DNA, 20 bp, Artificial
  CRISPR gRNA sequence
cccaggttatcagctgtttt

SEQ ID NO: 267756 - DNA, 20 bp, Artificial
  CRISPR gRNA sequence
ccaggttatcagctgttttc

SEQ ID NO: 267757 - DNA, 20 bp, Artificial
  CRISPR gRNA sequence
tcagctgttttctacactca

SEQ ID NO: 267758 - DNA, 20 bp, Artificial
  CRISPR gRNA sequence
ttttctacactcatctgggg

SEQ ID NO: 267759 - DNA, 20 bp, Artificial
  CRISPR gRNA sequence
tctacactcatctggggaca

SEQ ID NO: 267760 - DNA, 20 bp, Artificial
  CRISPR gRNA sequence
ctacactcatctggggacag

SEQ ID NO: 267761 - DNA, 20 bp, Artificial
  CRISPR gRNA sequence
tacactcatctggggacaga

SEQ ID NO: 267762 - DNA, 20 bp, Artificial
  CRISPR gRNA sequence
cactcatctggggacagaca

SEQ ID NO: 267763 - DNA, 20 bp, Artificial
  CRISPR gRNA sequence
atctggggacagacatttcc

SEQ ID NO: 267764 - DNA, 20 bp, Artificial
  CRISPR gRNA sequence
gggacagacatttcctcggc

SEQ ID NO: 267765 - DNA, 20 bp, Artificial
  CRISPR gRNA sequence
cctcggcctcacccctgccc

SEQ ID NO: 267766 - DNA, 20 bp, Artificial
  CRISPR gRNA sequence
ctcggcctcacccctgccct

SEQ ID NO: 267767 - DNA, 20 bp, Artificial
  CRISPR gRNA sequence
ggcctcacccctgccctgct

SEQ ID NO: 267768 - DNA, 20 bp, Artificial
  CRISPR gRNA sequence
acccctgccctgctgtgatc

SEQ ID NO: 267769 - DNA, 20 bp, Artificial
  CRISPR gRNA sequence
ccctgctgtgatcttgtgct

SEQ ID NO: 267770 - DNA, 20 bp, Artificial
  CRISPR gRNA sequence
ctgtgatcttgtgctcaaga

SEQ ID NO: 267771 - DNA, 20 bp, Artificial
  CRISPR gRNA sequence
tgatcttgtgctcaagacag

SEQ ID NO: 267772 - DNA, 20 bp, Artificial
  CRISPR gRNA sequence
gtgctcaagacagctctagt

SEQ ID NO: 267773 - DNA, 20 bp, Artificial
  CRISPR gRNA sequence
tgctcaagacagctctagtc

SEQ ID NO: 267774 - DNA, 20 bp, Artificial
  CRISPR gRNA sequence
aagacagctctagtctttca

SEQ ID NO: 267775 - DNA, 20 bp, Artificial
  CRISPR gRNA sequence
tagtctttcatttacagaaa

SEQ ID NO: 267776 - DNA, 20 bp, Artificial
  CRISPR gRNA sequence
gtctttcatttacagaaagg

SEQ ID NO: 267777 - DNA, 20 bp, Artificial
  CRISPR gRNA sequence
tcatttacagaaaggatgta

SEQ ID NO: 267778 - DNA, 20 bp, Artificial
  CRISPR gRNA sequence
catttacagaaaggatgtag

SEQ ID NO: 267779 - DNA, 20 bp, Artificial
  CRISPR gRNA sequence
atttacagaaaggatgtaga

SEQ ID NO: 267780 - DNA, 20 bp, Artificial
  CRISPR gRNA sequence
acagaaaggatgtagaacca

SEQ ID NO: 267781 - DNA, 20 bp, Artificial
  CRISPR gRNA sequence
cagaaaggatgtagaaccaa

SEQ ID NO: 267782 - DNA, 20 bp, Artificial
  CRISPR gRNA sequence
ttcattgcattgtaggatgt

SEQ ID NO: 267783 - DNA, 20 bp, Artificial
  CRISPR gRNA sequence
cattgcattgtaggatgttt

SEQ ID NO: 267784 - DNA, 20 bp, Artificial
  CRISPR gRNA sequence
attgcattgtaggatgttta

SEQ ID NO: 267785 - DNA, 20 bp, Artificial
  CRISPR gRNA sequence
cattgtaggatgtttagcag

SEQ ID NO: 267786 - DNA, 20 bp, Artificial
  CRISPR gRNA sequence
taggatgtttagcagcatct

SEQ ID NO: 267787 - DNA, 20 bp, Artificial
  CRISPR gRNA sequence
agcagcatctctgacctcta

SEQ ID NO: 267788 - DNA, 20 bp, Artificial
  CRISPR gRNA sequence
gcagcatctctgacctctac

SEQ ID NO: 267789 - DNA, 20 bp, Artificial
  CRISPR gRNA sequence
tgacctctacccagtagatg

SEQ ID NO: 267790 - DNA, 20 bp, Artificial
  CRISPR gRNA sequence
acctctacccagtagatgcc

SEQ ID NO: 267791 - DNA, 20 bp, Artificial
  CRISPR gRNA sequence
tacccagtagatgccagtag

SEQ ID NO: 267792 - DNA, 20 bp, Artificial
  CRISPR gRNA sequence
cccagtagatgccagtagca

SEQ ID NO: 267793 - DNA, 20 bp, Artificial
  CRISPR gRNA sequence
cccgttgtgatgatccaaaa

SEQ ID NO: 267794 - DNA, 20 bp, Artificial
  CRISPR gRNA sequence
tgatgatccaaaatgttttt

SEQ ID NO: 267795 - DNA, 20 bp, Artificial
  CRISPR gRNA sequence
ttagacttcactaaatgtct

SEQ ID NO: 267796 - DNA, 20 bp, Artificial
  CRISPR gRNA sequence
tagacttcactaaatgtctc

SEQ ID NO: 267797 - DNA, 20 bp, Artificial
  CRISPR gRNA sequence
agacttcactaaatgtctcc

SEQ ID NO: 267798 - DNA, 20 bp, Artificial
  CRISPR gRNA sequence
gacttcactaaatgtctcct

SEQ ID NO: 267799 - DNA, 20 bp, Artificial
  CRISPR gRNA sequence
cactaaatgtctcctgggac

SEQ ID NO: 267800 - DNA, 20 bp, Artificial
  CRISPR gRNA sequence
actaaatgtctcctgggaca

SEQ ID NO: 267801 - DNA, 20 bp, Artificial
  CRISPR gRNA sequence
aatgtctcctgggacaggga

SEQ ID NO: 267802 - DNA, 20 bp, Artificial
  CRISPR gRNA sequence
ctgggacagggattaaggga

SEQ ID NO: 267803 - DNA, 20 bp, Artificial
  CRISPR gRNA sequence
ggacagggattaagggagct

SEQ ID NO: 267804 - DNA, 20 bp, Artificial
  CRISPR gRNA sequence
agggagcttgaggtgtcaag

SEQ ID NO: 267805 - DNA, 20 bp, Artificial
  CRISPR gRNA sequence
gaggtgtcaaggatgaggtt

SEQ ID NO: 267806 - DNA, 20 bp, Artificial
  CRISPR gRNA sequence
aggtgtcaaggatgaggtta

SEQ ID NO: 267807 - DNA, 20 bp, Artificial
  CRISPR gRNA sequence
ggaggtctgtcttgggcagc

SEQ ID NO: 267808 - DNA, 20 bp, Artificial
  CRISPR gRNA sequence
tcttgggcagctgtatatat

SEQ ID NO: 267809 - DNA, 20 bp, Artificial
  CRISPR gRNA sequence
gggcagctgtatatatggta

SEQ ID NO: 267810 - DNA, 20 bp, Artificial
  CRISPR gRNA sequence
ggcagctgtatatatggtag

SEQ ID NO: 267811 - DNA, 20 bp, Artificial
  CRISPR gRNA sequence
tatatatggtagtgtcattc

SEQ ID NO: 267812 - DNA, 20 bp, Artificial
  CRISPR gRNA sequence
actcagatgagaaacactgg

SEQ ID NO: 267813 - DNA, 20 bp, Artificial
  CRISPR gRNA sequence
agatgagaaacactggtaaa

SEQ ID NO: 267814 - DNA, 20 bp, Artificial
  CRISPR gRNA sequence
gtaaaaaaaaaacagcattt

SEQ ID NO: 267815 - DNA, 20 bp, Artificial
  CRISPR gRNA sequence
gggggaaatcttgagtttta

SEQ ID NO: 267816 - DNA, 20 bp, Artificial
  CRISPR gRNA sequence
ggggaaatcttgagttttat

SEQ ID NO: 267817 - DNA, 20 bp, Artificial
  CRISPR gRNA sequence
gagttttattttagacatgt

SEQ ID NO: 267818 - DNA, 20 bp, Artificial
  CRISPR gRNA sequence
agttttattttagacatgtt

SEQ ID NO: 267819 - DNA, 20 bp, Artificial
  CRISPR gRNA sequence
tattttagacatgttgagtt

SEQ ID NO: 267820 - DNA, 20 bp, Artificial
  CRISPR gRNA sequence
attttagacatgttgagttt

SEQ ID NO: 267821 - DNA, 20 bp, Artificial
  CRISPR gRNA sequence
ttttagacatgttgagttta

SEQ ID NO: 267822 - DNA, 20 bp, Artificial
  CRISPR gRNA sequence
tagacatgttgagtttagag

SEQ ID NO: 267823 - DNA, 20 bp, Artificial
  CRISPR gRNA sequence
agacatgttgagtttagagt

SEQ ID NO: 267824 - DNA, 20 bp, Artificial
  CRISPR gRNA sequence
gacatgttgagtttagagtg

SEQ ID NO: 267825 - DNA, 20 bp, Artificial
  CRISPR gRNA sequence
agtttagagtggctttgagg

SEQ ID NO: 267826 - DNA, 20 bp, Artificial
  CRISPR gRNA sequence
agagtggctttgaggtttag

SEQ ID NO: 267827 - DNA, 20 bp, Artificial
  CRISPR gRNA sequence
gagtggctttgaggtttagt

SEQ ID NO: 267828 - DNA, 20 bp, Artificial
  CRISPR gRNA sequence
tgaggtttagtccagagata

SEQ ID NO: 267829 - DNA, 20 bp, Artificial
  CRISPR gRNA sequence
gaggtttagtccagagatat

SEQ ID NO: 267830 - DNA, 20 bp, Artificial
  CRISPR gRNA sequence
aggtttagtccagagatata

SEQ ID NO: 267831 - DNA, 20 bp, Artificial
  CRISPR gRNA sequence
agtccagagatataaatttg

SEQ ID NO: 267832 - DNA, 20 bp, Artificial
  CRISPR gRNA sequence
gtccagagatataaatttgg

SEQ ID NO: 267833 - DNA, 20 bp, Artificial
  CRISPR gRNA sequence
gggtgagtaggtggtaattg

SEQ ID NO: 267834 - DNA, 20 bp, Artificial
  CRISPR gRNA sequence
ggtgagtaggtggtaattga

SEQ ID NO: 267835 - DNA, 20 bp, Artificial
  CRISPR gRNA sequence
aagctgtgaatgtggataag

SEQ ID NO: 267836 - DNA, 20 bp, Artificial
  CRISPR gRNA sequence
tgaatgtggataagattgcc

SEQ ID NO: 267837 - DNA, 20 bp, Artificial
  CRISPR gRNA sequence
cctagggaaagaggatagag

SEQ ID NO: 267838 - DNA, 20 bp, Artificial
  CRISPR gRNA sequence
gggaaagaggatagagaaga

SEQ ID NO: 267839 - DNA, 20 bp, Artificial
  CRISPR gRNA sequence
ggaccaagcagtgagaaatt

SEQ ID NO: 267840 - DNA, 20 bp, Artificial
  CRISPR gRNA sequence
taacggctggttagagaagg

SEQ ID NO: 267841 - DNA, 20 bp, Artificial
  CRISPR gRNA sequence
acggctggttagagaaggat

SEQ ID NO: 267842 - DNA, 20 bp, Artificial
  CRISPR gRNA sequence
gttagagaaggatgagcttg

SEQ ID NO: 267843 - DNA, 20 bp, Artificial
  CRISPR gRNA sequence
gagaaggatgagcttgcaaa

SEQ ID NO: 267844 - DNA, 20 bp, Artificial
  CRISPR gRNA sequence
gcaaaggaggcagggaagga

SEQ ID NO: 267845 - DNA, 20 bp, Artificial
  CRISPR gRNA sequence
caaaggaggcagggaaggag

SEQ ID NO: 267846 - DNA, 20 bp, Artificial
  CRISPR gRNA sequence
ggatgtcatagatggcaaag

SEQ ID NO: 267847 - DNA, 20 bp, Artificial
  CRISPR gRNA sequence
tcaatagtatagaatactgc

SEQ ID NO: 267848 - DNA, 20 bp, Artificial
  CRISPR gRNA sequence
ctgagagttgaagaagatga

SEQ ID NO: 267849 - DNA, 20 bp, Artificial
  CRISPR gRNA sequence
agagttgaagaagatgagga

SEQ ID NO: 267850 - DNA, 20 bp, Artificial
  CRISPR gRNA sequence
aagaagatgaggacttaaaa

SEQ ID NO: 267851 - DNA, 20 bp, Artificial
  CRISPR gRNA sequence
aaaacatgttagctgtgttt

SEQ ID NO: 267852 - DNA, 20 bp, Artificial
  CRISPR gRNA sequence
aaacatgttagctgtgttta

SEQ ID NO: 267853 - DNA, 20 bp, Artificial
  CRISPR gRNA sequence
gctgtgtttagtaacatgga

SEQ ID NO: 267854 - DNA, 20 bp, Artificial
  CRISPR gRNA sequence
tgtttagtaacatggaagtc

SEQ ID NO: 267855 - DNA, 20 bp, Artificial
  CRISPR gRNA sequence
agtaacatggaagtcagcgt

SEQ ID NO: 267856 - DNA, 20 bp, Artificial
  CRISPR gRNA sequence
gtaacatggaagtcagcgtt

SEQ ID NO: 267857 - DNA, 20 bp, Artificial
  CRISPR gRNA sequence
ttcaaacctttctttagcac

SEQ ID NO: 267858 - DNA, 20 bp, Artificial
  CRISPR gRNA sequence
tcaaacctttctttagcact

SEQ ID NO: 267859 - DNA, 20 bp, Artificial
  CRISPR gRNA sequence
caaacctttctttagcactt

SEQ ID NO: 267860 - DNA, 20 bp, Artificial
  CRISPR gRNA sequence
aaacctttctttagcactta

SEQ ID NO: 267861 - DNA, 20 bp, Artificial
  CRISPR gRNA sequence
tctttagcacttactcatgc

SEQ ID NO: 267862 - DNA, 20 bp, Artificial
  CRISPR gRNA sequence
ctttagcacttactcatgcc

SEQ ID NO: 267863 - DNA, 20 bp, Artificial
  CRISPR gRNA sequence
tttagcacttactcatgccc

SEQ ID NO: 267864 - DNA, 20 bp, Artificial
  CRISPR gRNA sequence
tagcacttactcatgcccct

SEQ ID NO: 267865 - DNA, 20 bp, Artificial
  CRISPR gRNA sequence
agcacttactcatgcccctt

SEQ ID NO: 267866 - DNA, 20 bp, Artificial
  CRISPR gRNA sequence
gcacttactcatgccccttt

SEQ ID NO: 267867 - DNA, 20 bp, Artificial
  CRISPR gRNA sequence
actcatgcccctttgacaag

SEQ ID NO: 267868 - DNA, 20 bp, Artificial
  CRISPR gRNA sequence
ctcatgcccctttgacaagg

SEQ ID NO: 267869 - DNA, 20 bp, Artificial
  CRISPR gRNA sequence
atgcccctttgacaaggaag

SEQ ID NO: 267870 - DNA, 20 bp, Artificial
  CRISPR gRNA sequence
tgacaaggaaggtgtgaagt

SEQ ID NO: 267871 - DNA, 20 bp, Artificial
  CRISPR gRNA sequence
gacaaggaaggtgtgaagtg

SEQ ID NO: 267872 - DNA, 20 bp, Artificial
  CRISPR gRNA sequence
acaaggaaggtgtgaagtgc

SEQ ID NO: 267873 - DNA, 20 bp, Artificial
  CRISPR gRNA sequence
aggcaggagtgtatggaaac

SEQ ID NO: 267874 - DNA, 20 bp, Artificial
  CRISPR gRNA sequence
aaatcattcacttatttatt

SEQ ID NO: 267875 - DNA, 20 bp, Artificial
  CRISPR gRNA sequence
acttatttattcattcaggt

SEQ ID NO: 267876 - DNA, 20 bp, Artificial
  CRISPR gRNA sequence
atttattcattcaggtatca

SEQ ID NO: 267877 - DNA, 20 bp, Artificial
  CRISPR gRNA sequence
tttattcattcaggtatcat

SEQ ID NO: 267878 - DNA, 20 bp, Artificial
  CRISPR gRNA sequence
attcattcaggtatcatgtc

SEQ ID NO: 267879 - DNA, 20 bp, Artificial
  CRISPR gRNA sequence
ttcattcaggtatcatgtca

SEQ ID NO: 267880 - DNA, 20 bp, Artificial
  CRISPR gRNA sequence
attcaggtatcatgtcattc

SEQ ID NO: 267881 - DNA, 20 bp, Artificial
  CRISPR gRNA sequence
aggtatcatgtcattcatgt

SEQ ID NO: 267882 - DNA, 20 bp, Artificial
  CRISPR gRNA sequence
atgtacagcattatctactt

SEQ ID NO: 267883 - DNA, 20 bp, Artificial
  CRISPR gRNA sequence
tctacttaggtatcagcctg

SEQ ID NO: 267884 - DNA, 20 bp, Artificial
  CRISPR gRNA sequence
cttaggtatcagcctgtgtg

SEQ ID NO: 267885 - DNA, 20 bp, Artificial
  CRISPR gRNA sequence
aggtatcagcctgtgtgcca

SEQ ID NO: 267886 - DNA, 20 bp, Artificial
  CRISPR gRNA sequence
ggtatcagcctgtgtgccag

SEQ ID NO: 267887 - DNA, 20 bp, Artificial
  CRISPR gRNA sequence
tgtgccaggaactaggcact

SEQ ID NO: 267888 - DNA, 20 bp, Artificial
  CRISPR gRNA sequence
ggcacttttttcataataga

SEQ ID NO: 267889 - DNA, 20 bp, Artificial
  CRISPR gRNA sequence
ttttcataatagagaattct

SEQ ID NO: 267890 - DNA, 20 bp, Artificial
  CRISPR gRNA sequence
tttcataatagagaattctg

SEQ ID NO: 267891 - DNA, 20 bp, Artificial
  CRISPR gRNA sequence
ttcataatagagaattctga

SEQ ID NO: 267892 - DNA, 20 bp, Artificial
  CRISPR gRNA sequence
tcataatagagaattctgaa

SEQ ID NO: 267893 - DNA, 20 bp, Artificial
  CRISPR gRNA sequence
cataatagagaattctgaat

SEQ ID NO: 267894 - DNA, 20 bp, Artificial
  CRISPR gRNA sequence
ataatagagaattctgaatc

SEQ ID NO: 267895 - DNA, 20 bp, Artificial
  CRISPR gRNA sequence
tgaatccagaaatctgatgg

SEQ ID NO: 267896 - DNA, 20 bp, Artificial
  CRISPR gRNA sequence
aatccagaaatctgatggct

SEQ ID NO: 267897 - DNA, 20 bp, Artificial
  CRISPR gRNA sequence
atggctttctgtttttagat

SEQ ID NO: 267898 - DNA, 20 bp, Artificial
  CRISPR gRNA sequence
tctgtttttagatgttttct

SEQ ID NO: 267899 - DNA, 20 bp, Artificial
  CRISPR gRNA sequence
ctgtttttagatgttttctg

SEQ ID NO: 267900 - DNA, 20 bp, Artificial
  CRISPR gRNA sequence
tgtttttagatgttttctgg

SEQ ID NO: 267901 - DNA, 20 bp, Artificial
  CRISPR gRNA sequence
tttttagatgttttctgggt

SEQ ID NO: 267902 - DNA, 20 bp, Artificial
  CRISPR gRNA sequence
ttagatgttttctgggtcat

SEQ ID NO: 267903 - DNA, 20 bp, Artificial
  CRISPR gRNA sequence
tagatgttttctgggtcatt

SEQ ID NO: 267904 - DNA, 20 bp, Artificial
  CRISPR gRNA sequence
agatgttttctgggtcattt

SEQ ID NO: 267905 - DNA, 20 bp, Artificial
  CRISPR gRNA sequence
gatgttttctgggtcatttg

SEQ ID NO: 267906 - DNA, 20 bp, Artificial
  CRISPR gRNA sequence
tctgggtcatttgttaagaa

SEQ ID NO: 267907 - DNA, 20 bp, Artificial
  CRISPR gRNA sequence
ctgggtcatttgttaagaaa

SEQ ID NO: 267908 - DNA, 20 bp, Artificial
  CRISPR gRNA sequence
tgggtcatttgttaagaaat

SEQ ID NO: 267909 - DNA, 20 bp, Artificial
  CRISPR gRNA sequence
ggtcatttgttaagaaatgt

SEQ ID NO: 267910 - DNA, 20 bp, Artificial
  CRISPR gRNA sequence
gttaagaaatgtagaatttt

SEQ ID NO: 267911 - DNA, 20 bp, Artificial
  CRISPR gRNA sequence
ttaagaaatgtagaatttta

SEQ ID NO: 267912 - DNA, 20 bp, Artificial
  CRISPR gRNA sequence
agaaatgtagaattttacta

SEQ ID NO: 267913 - DNA, 20 bp, Artificial
  CRISPR gRNA sequence
tactatcacattgattcaga

SEQ ID NO: 267914 - DNA, 20 bp, Artificial
  CRISPR gRNA sequence
actatcacattgattcagaa

SEQ ID NO: 267915 - DNA, 20 bp, Artificial
  CRISPR gRNA sequence
ctatcacattgattcagaaa

SEQ ID NO: 267916 - DNA, 20 bp, Artificial
  CRISPR gRNA sequence
tcacattgattcagaaatga

SEQ ID NO: 267917 - DNA, 20 bp, Artificial
  CRISPR gRNA sequence
attcagaaatgatgttccta

SEQ ID NO: 267918 - DNA, 20 bp, Artificial
  CRISPR gRNA sequence
agaaatgatgttcctaaccc

SEQ ID NO: 267919 - DNA, 20 bp, Artificial
  CRISPR gRNA sequence
ctaacccttagtcaaaaatt

SEQ ID NO: 267920 - DNA, 20 bp, Artificial
  CRISPR gRNA sequence
acccttagtcaaaaattttg

SEQ ID NO: 267921 - DNA, 20 bp, Artificial
  CRISPR gRNA sequence
agtcaaaaattttgctaaga

SEQ ID NO: 267922 - DNA, 20 bp, Artificial
  CRISPR gRNA sequence
gtcaaaaattttgctaagat

SEQ ID NO: 267923 - DNA, 20 bp, Artificial
  CRISPR gRNA sequence
tgctaagattcatggtgggt

SEQ ID NO: 267924 - DNA, 20 bp, Artificial
  CRISPR gRNA sequence
gctaagattcatggtgggtg

SEQ ID NO: 267925 - DNA, 20 bp, Artificial
  CRISPR gRNA sequence
ctaagattcatggtgggtga

SEQ ID NO: 267926 - DNA, 20 bp, Artificial
  CRISPR gRNA sequence
agattcatggtgggtgaaac

SEQ ID NO: 267927 - DNA, 20 bp, Artificial
  CRISPR gRNA sequence
atggtgggtgaaactattgc

SEQ ID NO: 267928 - DNA, 20 bp, Artificial
  CRISPR gRNA sequence
ttgcccttacttccctcact

SEQ ID NO: 267929 - DNA, 20 bp, Artificial
  CRISPR gRNA sequence
cccttacttccctcacttct

SEQ ID NO: 267930 - DNA, 20 bp, Artificial
  CRISPR gRNA sequence
acttccctcacttctggtgg

SEQ ID NO: 267931 - DNA, 20 bp, Artificial
  CRISPR gRNA sequence
cttccctcacttctggtgga

SEQ ID NO: 267932 - DNA, 20 bp, Artificial
  CRISPR gRNA sequence
ccctcacttctggtggaaat

SEQ ID NO: 267933 - DNA, 20 bp, Artificial
  CRISPR gRNA sequence
cctcacttctggtggaaatt

SEQ ID NO: 267934 - DNA, 20 bp, Artificial
  CRISPR gRNA sequence
acttctggtggaaattcatc

SEQ ID NO: 267935 - DNA, 20 bp, Artificial
  CRISPR gRNA sequence
ctggtggaaattcatcctga

SEQ ID NO: 267936 - DNA, 20 bp, Artificial
  CRISPR gRNA sequence
tggtggaaattcatcctgat

SEQ ID NO: 267937 - DNA, 20 bp, Artificial
  CRISPR gRNA sequence
gtggaaattcatcctgatgg

SEQ ID NO: 267938 - DNA, 20 bp, Artificial
  CRISPR gRNA sequence
atcctgatggagccaagcct

SEQ ID NO: 267939 - DNA, 20 bp, Artificial
  CRISPR gRNA sequence
atggagccaagcctatgaaa

SEQ ID NO: 267940 - DNA, 20 bp, Artificial
  CRISPR gRNA sequence
tgaaagagagatgagtgtag

SEQ ID NO: 267941 - DNA, 20 bp, Artificial
  CRISPR gRNA sequence
gttgtctagaactgtaaatt

SEQ ID NO: 267942 - DNA, 20 bp, Artificial
  CRISPR gRNA sequence
tctagaactgtaaattgcca

SEQ ID NO: 267943 - DNA, 20 bp, Artificial
  CRISPR gRNA sequence
gaactgtaaattgccattag

SEQ ID NO: 267944 - DNA, 20 bp, Artificial
  CRISPR gRNA sequence
taaattgccattagtttgga

SEQ ID NO: 267945 - DNA, 20 bp, Artificial
  CRISPR gRNA sequence
ccattagtttggactccacc

SEQ ID NO: 267946 - DNA, 20 bp, Artificial
  CRISPR gRNA sequence
gtttggactccacctttaca

SEQ ID NO: 267947 - DNA, 20 bp, Artificial
  CRISPR gRNA sequence
ggactccacctttacaaatt

SEQ ID NO: 267948 - DNA, 20 bp, Artificial
  CRISPR gRNA sequence
gactccacctttacaaattt

SEQ ID NO: 267949 - DNA, 20 bp, Artificial
  CRISPR gRNA sequence
cacctttacaaatttgtgat

SEQ ID NO: 267950 - DNA, 20 bp, Artificial
  CRISPR gRNA sequence
tacaaatttgtgattattac

SEQ ID NO: 267951 - DNA, 20 bp, Artificial
  CRISPR gRNA sequence
acaaatttgtgattattaca

SEQ ID NO: 267952 - DNA, 20 bp, Artificial
  CRISPR gRNA sequence
caaatttgtgattattacag

SEQ ID NO: 267953 - DNA, 20 bp, Artificial
  CRISPR gRNA sequence
gtgattattacagactctgg

SEQ ID NO: 267954 - DNA, 20 bp, Artificial
  CRISPR gRNA sequence
tgattattacagactctgga

SEQ ID NO: 267955 - DNA, 20 bp, Artificial
  CRISPR gRNA sequence
ttacagactctggaggagtt

SEQ ID NO: 267956 - DNA, 20 bp, Artificial
  CRISPR gRNA sequence
cagactctggaggagttgaa

SEQ ID NO: 267957 - DNA, 20 bp, Artificial
  CRISPR gRNA sequence
tggaggagttgaaagtcctc

SEQ ID NO: 267958 - DNA, 20 bp, Artificial
  CRISPR gRNA sequence
gaggagttgaaagtcctctt

SEQ ID NO: 267959 - DNA, 20 bp, Artificial
  CRISPR gRNA sequence
aaagtcctcttcggttaatt

SEQ ID NO: 267960 - DNA, 20 bp, Artificial
  CRISPR gRNA sequence
ttcggttaattatggaaaaa

SEQ ID NO: 267961 - DNA, 20 bp, Artificial
  CRISPR gRNA sequence
cggttaattatggaaaaaca

SEQ ID NO: 267962 - DNA, 20 bp, Artificial
  CRISPR gRNA sequence
ggttaattatggaaaaacag

SEQ ID NO: 267963 - DNA, 20 bp, Artificial
  CRISPR gRNA sequence
attatggaaaaacagcttgt

SEQ ID NO: 267964 - DNA, 20 bp, Artificial
  CRISPR gRNA sequence
tggaaaaacagcttgttaag

SEQ ID NO: 267965 - DNA, 20 bp, Artificial
  CRISPR gRNA sequence
gttaagcaaatgctaatgta

SEQ ID NO: 267966 - DNA, 20 bp, Artificial
  CRISPR gRNA sequence
ttaagcaaatgctaatgtaa

SEQ ID NO: 267967 - DNA, 20 bp, Artificial
  CRISPR gRNA sequence
agcaaatgctaatgtaagaa

SEQ ID NO: 267968 - DNA, 20 bp, Artificial
  CRISPR gRNA sequence
atgtaagaagatcacaatgt

SEQ ID NO: 267969 - DNA, 20 bp, Artificial
  CRISPR gRNA sequence
aacctagtcaaaggaggaag

SEQ ID NO: 267970 - DNA, 20 bp, Artificial
  CRISPR gRNA sequence
acctagtcaaaggaggaagg

SEQ ID NO: 267971 - DNA, 20 bp, Artificial
  CRISPR gRNA sequence
gtcaaaggaggaagggcctt

SEQ ID NO: 267972 - DNA, 20 bp, Artificial
  CRISPR gRNA sequence
caagtgtatttacatatcaa

SEQ ID NO: 267973 - DNA, 20 bp, Artificial
  CRISPR gRNA sequence
aagtgtatttacatatcaac

SEQ ID NO: 267974 - DNA, 20 bp, Artificial
  CRISPR gRNA sequence
acatatcaacagtggatatg

SEQ ID NO: 267975 - DNA, 20 bp, Artificial
  CRISPR gRNA sequence
catatcaacagtggatatgt

SEQ ID NO: 267976 - DNA, 20 bp, Artificial
  CRISPR gRNA sequence
attagtgtgcatttttaatt

SEQ ID NO: 267977 - DNA, 20 bp, Artificial
  CRISPR gRNA sequence
gtgtgcatttttaattcagg

SEQ ID NO: 267978 - DNA, 20 bp, Artificial
  CRISPR gRNA sequence
ttaattcaggtcagatgaca

SEQ ID NO: 267979 - DNA, 20 bp, Artificial
  CRISPR gRNA sequence
taattcaggtcagatgacag

SEQ ID NO: 267980 - DNA, 20 bp, Artificial
  CRISPR gRNA sequence
aattcaggtcagatgacagc

SEQ ID NO: 267981 - DNA, 20 bp, Artificial
  CRISPR gRNA sequence
attcaggtcagatgacagca

SEQ ID NO: 267982 - DNA, 20 bp, Artificial
  CRISPR gRNA sequence
aggtcagatgacagcattga

SEQ ID NO: 267983 - DNA, 20 bp, Artificial
  CRISPR gRNA sequence
agagtaacagggatgcattt

SEQ ID NO: 267984 - DNA, 20 bp, Artificial
  CRISPR gRNA sequence
ctctaaaatactttctttga

SEQ ID NO: 267985 - DNA, 20 bp, Artificial
  CRISPR gRNA sequence
tctaaaatactttctttgag

SEQ ID NO: 267986 - DNA, 20 bp, Artificial
  CRISPR gRNA sequence
taaaatactttctttgagat

SEQ ID NO: 267987 - DNA, 20 bp, Artificial
  CRISPR gRNA sequence
aaatactttctttgagattt

SEQ ID NO: 267988 - DNA, 20 bp, Artificial
  CRISPR gRNA sequence
tctttgagatttttcaagtt

SEQ ID NO: 267989 - DNA, 20 bp, Artificial
  CRISPR gRNA sequence
ctttgagatttttcaagttc

SEQ ID NO: 267990 - DNA, 20 bp, Artificial
  CRISPR gRNA sequence
tttgagatttttcaagttca

SEQ ID NO: 267991 - DNA, 20 bp, Artificial
  CRISPR gRNA sequence
tgagatttttcaagttcaat

SEQ ID NO: 267992 - DNA, 20 bp, Artificial
  CRISPR gRNA sequence
gagatttttcaagttcaatg

SEQ ID NO: 267993 - DNA, 20 bp, Artificial
  CRISPR gRNA sequence
agatttttcaagttcaatgt

SEQ ID NO: 267994 - DNA, 20 bp, Artificial
  CRISPR gRNA sequence
ttcaagttcaatgtgaagag

SEQ ID NO: 267995 - DNA, 20 bp, Artificial
  CRISPR gRNA sequence
tcaagttcaatgtgaagagt

SEQ ID NO: 267996 - DNA, 20 bp, Artificial
  CRISPR gRNA sequence
caagttcaatgtgaagagtc

SEQ ID NO: 267997 - DNA, 20 bp, Artificial
  CRISPR gRNA sequence
aagttcaatgtgaagagtca

SEQ ID NO: 267998 - DNA, 20 bp, Artificial
  CRISPR gRNA sequence
aatgtgaagagtcagtagtt

SEQ ID NO: 267999 - DNA, 20 bp, Artificial
  CRISPR gRNA sequence
ggtgtgattagtcattaccc

SEQ ID NO: 268000 - DNA, 20 bp, Artificial
  CRISPR gRNA sequence
gtcattacccaagtccaagg

SEQ ID NO: 268001 - DNA, 20 bp, Artificial
  CRISPR gRNA sequence
cccaagtccaaggtgctcaa

SEQ ID NO: 268002 - DNA, 20 bp, Artificial
  CRISPR gRNA sequence
aaaaaaggttagtgttttag

SEQ ID NO: 268003 - DNA, 20 bp, Artificial
  CRISPR gRNA sequence
gtgttttagtgtctctgtca

SEQ ID NO: 268004 - DNA, 20 bp, Artificial
  CRISPR gRNA sequence
tagtgtctctgtcatttgac

SEQ ID NO: 268005 - DNA, 20 bp, Artificial
  CRISPR gRNA sequence
agtgtctctgtcatttgaca

SEQ ID NO: 268006 - DNA, 20 bp, Artificial
  CRISPR gRNA sequence
gtgtctctgtcatttgacag

SEQ ID NO: 268007 - DNA, 20 bp, Artificial
  CRISPR gRNA sequence
tgtcatttgacagttaatat

SEQ ID NO: 268008 - DNA, 20 bp, Artificial
  CRISPR gRNA sequence
tcatttgacagttaatatta

SEQ ID NO: 268009 - DNA, 20 bp, Artificial
  CRISPR gRNA sequence
gacagttaatattatgaata

SEQ ID NO: 268010 - DNA, 20 bp, Artificial
  CRISPR gRNA sequence
acagttaatattatgaatag

SEQ ID NO: 268011 - DNA, 20 bp, Artificial
  CRISPR gRNA sequence
atattatgaatagttgtgcc

SEQ ID NO: 268012 - DNA, 20 bp, Artificial
  CRISPR gRNA sequence
tgaatagttgtgcccacagt

SEQ ID NO: 268013 - DNA, 20 bp, Artificial
  CRISPR gRNA sequence
tgcccacagtcttagaactc

SEQ ID NO: 268014 - DNA, 20 bp, Artificial
  CRISPR gRNA sequence
agaactccttccatgacatt

SEQ ID NO: 268015 - DNA, 20 bp, Artificial
  CRISPR gRNA sequence
gaactccttccatgacattg

SEQ ID NO: 268016 - DNA, 20 bp, Artificial
  CRISPR gRNA sequence
cttccatgacattgtccctc

SEQ ID NO: 268017 - DNA, 20 bp, Artificial
  CRISPR gRNA sequence
ccatgacattgtccctccat

SEQ ID NO: 268018 - DNA, 20 bp, Artificial
  CRISPR gRNA sequence
catgacattgtccctccata

SEQ ID NO: 268019 - DNA, 20 bp, Artificial
  CRISPR gRNA sequence
tccctccatactgacacttc

SEQ ID NO: 268020 - DNA, 20 bp, Artificial
  CRISPR gRNA sequence
catactgacacttctctttc

SEQ ID NO: 268021 - DNA, 20 bp, Artificial
  CRISPR gRNA sequence
acacttctctttcctgcagg

SEQ ID NO: 268022 - DNA, 20 bp, Artificial
  CRISPR gRNA sequence
ctctttcctgcaggtgagga

SEQ ID NO: 268023 - DNA, 20 bp, Artificial
  CRISPR gRNA sequence
tctttcctgcaggtgaggag

SEQ ID NO: 268024 - DNA, 20 bp, Artificial
  CRISPR gRNA sequence
tttcctgcaggtgaggagta

SEQ ID NO: 268025 - DNA, 20 bp, Artificial
  CRISPR gRNA sequence
tcctgcaggtgaggagtaag

SEQ ID NO: 268026 - DNA, 20 bp, Artificial
  CRISPR gRNA sequence
cctgcaggtgaggagtaaga

SEQ ID NO: 268027 - DNA, 20 bp, Artificial
  CRISPR gRNA sequence
ctgcaggtgaggagtaagag

SEQ ID NO: 268028 - DNA, 20 bp, Artificial
  CRISPR gRNA sequence
caggtgaggagtaagaggag

SEQ ID NO: 268029 - DNA, 20 bp, Artificial
  CRISPR gRNA sequence
ctgcacagtgactacatgaa

SEQ ID NO: 268030 - DNA, 20 bp, Artificial
  CRISPR gRNA sequence
cacagtgactacatgaacat

SEQ ID NO: 268031 - DNA, 20 bp, Artificial
  CRISPR gRNA sequence
catgaacatgactccccgcc

SEQ ID NO: 268032 - DNA, 20 bp, Artificial
  CRISPR gRNA sequence
cccgccgccccgggcccacc

SEQ ID NO: 268033 - DNA, 20 bp, Artificial
  CRISPR gRNA sequence
ccagccctatgccccaccac

SEQ ID NO: 268034 - DNA, 20 bp, Artificial
  CRISPR gRNA sequence
tgccccaccacgcgacttcg

SEQ ID NO: 268035 - DNA, 20 bp, Artificial
  CRISPR gRNA sequence
cgcagcctatcgctcctgac

SEQ ID NO: 268036 - DNA, 20 bp, Artificial
  CRISPR gRNA sequence
gcagcctatcgctcctgaca

SEQ ID NO: 268037 - DNA, 20 bp, Artificial
  CRISPR gRNA sequence
tcgctcctgacacggacgcc

SEQ ID NO: 268038 - DNA, 20 bp, Artificial
  CRISPR gRNA sequence
ctgacacggacgcctatcca

SEQ ID NO: 268039 - DNA, 20 bp, Artificial
  CRISPR gRNA sequence
acacggacgcctatccagaa

SEQ ID NO: 268040 - DNA, 20 bp, Artificial
  CRISPR gRNA sequence
tccagaagccagccggctgg

SEQ ID NO: 268041 - DNA, 20 bp, Artificial
  CRISPR gRNA sequence
gcagcccccatctgctcaat

SEQ ID NO: 268042 - DNA, 20 bp, Artificial
  CRISPR gRNA sequence
ctcaatatcactgctctgga

SEQ ID NO: 268043 - DNA, 20 bp, Artificial
  CRISPR gRNA sequence
aatatcactgctctggatag

SEQ ID NO: 268044 - DNA, 20 bp, Artificial
  CRISPR gRNA sequence
ctctggataggaaatgaccg

SEQ ID NO: 268045 - DNA, 20 bp, Artificial
  CRISPR gRNA sequence
tggataggaaatgaccgcca

SEQ ID NO: 268046 - DNA, 20 bp, Artificial
  CRISPR gRNA sequence
gataggaaatgaccgccatc

SEQ ID NO: 268047 - DNA, 20 bp, Artificial
  CRISPR gRNA sequence
cagccggccacctcaggccc

SEQ ID NO: 268048 - DNA, 20 bp, Artificial
  CRISPR gRNA sequence
aggcccctgttgggccacca

SEQ ID NO: 268049 - DNA, 20 bp, Artificial
  CRISPR gRNA sequence
ttgggccaccaatgccaatt

SEQ ID NO: 268050 - DNA, 20 bp, Artificial
  CRISPR gRNA sequence
ggccaccaatgccaattttt

SEQ ID NO: 268051 - DNA, 20 bp, Artificial
  CRISPR gRNA sequence
ttctcgagtgactagaccaa

SEQ ID NO: 268052 - DNA, 20 bp, Artificial
  CRISPR gRNA sequence
tctcgagtgactagaccaaa

SEQ ID NO: 268053 - DNA, 20 bp, Artificial
  CRISPR gRNA sequence
ctcgagtgactagaccaaat

SEQ ID NO: 268054 - DNA, 20 bp, Artificial
  CRISPR gRNA sequence
tcgagtgactagaccaaata

SEQ ID NO: 268055 - DNA, 20 bp, Artificial
  CRISPR gRNA sequence
gagtgactagaccaaatatc

SEQ ID NO: 268056 - DNA, 20 bp, Artificial
  CRISPR gRNA sequence
gaccaaatatcaagatcatt

SEQ ID NO: 268057 - DNA, 20 bp, Artificial
  CRISPR gRNA sequence
tgagactctgaaatgaagta

SEQ ID NO: 268058 - DNA, 20 bp, Artificial
  CRISPR gRNA sequence
gagactctgaaatgaagtaa

SEQ ID NO: 268059 - DNA, 20 bp, Artificial
  CRISPR gRNA sequence
agactctgaaatgaagtaaa

SEQ ID NO: 268060 - DNA, 20 bp, Artificial
  CRISPR gRNA sequence
tgaaatgaagtaaaagagat

SEQ ID NO: 268061 - DNA, 20 bp, Artificial
  CRISPR gRNA sequence
aaatgaagtaaaagagattt

SEQ ID NO: 268062 - DNA, 20 bp, Artificial
  CRISPR gRNA sequence
cctgtgacaggccaagtctt

SEQ ID NO: 268063 - DNA, 20 bp, Artificial
  CRISPR gRNA sequence
ctgtgacaggccaagtctta

SEQ ID NO: 268064 - DNA, 20 bp, Artificial
  CRISPR gRNA sequence
tgacaggccaagtcttacag

SEQ ID NO: 268065 - DNA, 20 bp, Artificial
  CRISPR gRNA sequence
acagtgccatggcccacatt

SEQ ID NO: 268066 - DNA, 20 bp, Artificial
  CRISPR gRNA sequence
cagtgccatggcccacattc

SEQ ID NO: 268067 - DNA, 20 bp, Artificial
  CRISPR gRNA sequence
caacttaccatgtacttagt

SEQ ID NO: 268068 - DNA, 20 bp, Artificial
  CRISPR gRNA sequence
accatgtacttagtgacttg

SEQ ID NO: 268069 - DNA, 20 bp, Artificial
  CRISPR gRNA sequence
ccatgtacttagtgacttga

SEQ ID NO: 268070 - DNA, 20 bp, Artificial
  CRISPR gRNA sequence
agtgacttgactgagaagtt

SEQ ID NO: 268071 - DNA, 20 bp, Artificial
  CRISPR gRNA sequence
gtgacttgactgagaagtta

SEQ ID NO: 268072 - DNA, 20 bp, Artificial
  CRISPR gRNA sequence
gactgagaagttagggtaga

SEQ ID NO: 268073 - DNA, 20 bp, Artificial
  CRISPR gRNA sequence
actgagaagttagggtagaa

SEQ ID NO: 268074 - DNA, 20 bp, Artificial
  CRISPR gRNA sequence
agaagttagggtagaaaaca

SEQ ID NO: 268075 - DNA, 20 bp, Artificial
  CRISPR gRNA sequence
gggtagaaaacaaaaaggga

SEQ ID NO: 268076 - DNA, 20 bp, Artificial
  CRISPR gRNA sequence
tgggagcctcttccctttct

SEQ ID NO: 268077 - DNA, 20 bp, Artificial
  CRISPR gRNA sequence
ggagcctcttccctttctca

SEQ ID NO: 268078 - DNA, 20 bp, Artificial
  CRISPR gRNA sequence
ttccctttctcactcacctg

SEQ ID NO: 268079 - DNA, 20 bp, Artificial
  CRISPR gRNA sequence
ccctttctcactcacctgca

SEQ ID NO: 268080 - DNA, 20 bp, Artificial
  CRISPR gRNA sequence
cctttctcactcacctgcac

SEQ ID NO: 268081 - DNA, 20 bp, Artificial
  CRISPR gRNA sequence
tctcactcacctgcacatct

SEQ ID NO: 268082 - DNA, 20 bp, Artificial
  CRISPR gRNA sequence
ctcactcacctgcacatctc

SEQ ID NO: 268083 - DNA, 20 bp, Artificial
  CRISPR gRNA sequence
tcactcacctgcacatctca

SEQ ID NO: 268084 - DNA, 20 bp, Artificial
  CRISPR gRNA sequence
actcacctgcacatctcagt

SEQ ID NO: 268085 - DNA, 20 bp, Artificial
  CRISPR gRNA sequence
acctgcacatctcagtcaag

SEQ ID NO: 268086 - DNA, 20 bp, Artificial
  CRISPR gRNA sequence
cacatctcagtcaagcaaag

SEQ ID NO: 268087 - DNA, 20 bp, Artificial
  CRISPR gRNA sequence
agtcaagcaaagtgtggtat

SEQ ID NO: 268088 - DNA, 20 bp, Artificial
  CRISPR gRNA sequence
tagttgcagaagaaaggcta

SEQ ID NO: 268089 - DNA, 20 bp, Artificial
  CRISPR gRNA sequence
agttgcagaagaaaggctag

SEQ ID NO: 268090 - DNA, 20 bp, Artificial
  CRISPR gRNA sequence
gttgcagaagaaaggctagg

SEQ ID NO: 268091 - DNA, 20 bp, Artificial
  CRISPR gRNA sequence
cagaagaaaggctaggaaat

SEQ ID NO: 268092 - DNA, 20 bp, Artificial
  CRISPR gRNA sequence
ggaaatcattccttttggtt

SEQ ID NO: 268093 - DNA, 20 bp, Artificial
  CRISPR gRNA sequence
cttttggttaaatgggtgtt

SEQ ID NO: 268094 - DNA, 20 bp, Artificial
  CRISPR gRNA sequence
ttggttaaatgggtgtttaa

SEQ ID NO: 268095 - DNA, 20 bp, Artificial
  CRISPR gRNA sequence
tggttaaatgggtgtttaat

SEQ ID NO: 268096 - DNA, 20 bp, Artificial
  CRISPR gRNA sequence
ggttaaatgggtgtttaatc

SEQ ID NO: 268097 - DNA, 20 bp, Artificial
  CRISPR gRNA sequence
gttaaatgggtgtttaatct

SEQ ID NO: 268098 - DNA, 20 bp, Artificial
  CRISPR gRNA sequence
aatgggtgtttaatcttttg

SEQ ID NO: 268099 - DNA, 20 bp, Artificial
  CRISPR gRNA sequence
aatcttttggttagtgggtt

SEQ ID NO: 268100 - DNA, 20 bp, Artificial
  CRISPR gRNA sequence
atcttttggttagtgggtta

SEQ ID NO: 268101 - DNA, 20 bp, Artificial
  CRISPR gRNA sequence
ttggttagtgggttaaacgg

SEQ ID NO: 268102 - DNA, 20 bp, Artificial
  CRISPR gRNA sequence
tggttagtgggttaaacggg

SEQ ID NO: 268103 - DNA, 20 bp, Artificial
  CRISPR gRNA sequence
ggttagtgggttaaacgggg

SEQ ID NO: 268104 - DNA, 20 bp, Artificial
  CRISPR gRNA sequence
gttagtgggttaaacggggt

SEQ ID NO: 268105 - DNA, 20 bp, Artificial
  CRISPR gRNA sequence
gtgggttaaacggggtaagt

SEQ ID NO: 268106 - DNA, 20 bp, Artificial
  CRISPR gRNA sequence
aacggggtaagttagagtag

SEQ ID NO: 268107 - DNA, 20 bp, Artificial
  CRISPR gRNA sequence
gagtagggggagggatagga

SEQ ID NO: 268108 - DNA, 20 bp, Artificial
  CRISPR gRNA sequence
aaaaaccattaaaacactgt

SEQ ID NO: 268109 - DNA, 20 bp, Artificial
  CRISPR gRNA sequence
aaaaccattaaaacactgtc

SEQ ID NO: 268110 - DNA, 20 bp, Artificial
  CRISPR gRNA sequence
aaacactgtctcccactcat

SEQ ID NO: 268111 - DNA, 20 bp, Artificial
  CRISPR gRNA sequence
tctcccactcatgaaatgag

SEQ ID NO: 268112 - DNA, 20 bp, Artificial
  CRISPR gRNA sequence
ccactcatgaaatgagccac

SEQ ID NO: 268113 - DNA, 20 bp, Artificial
  CRISPR gRNA sequence
atgaaatgagccacgtagtt

SEQ ID NO: 268114 - DNA, 20 bp, Artificial
  CRISPR gRNA sequence
ctatttaatgctgttttcct

SEQ ID NO: 268115 - DNA, 20 bp, Artificial
  CRISPR gRNA sequence
tttaatgctgttttccttta

SEQ ID NO: 268116 - DNA, 20 bp, Artificial
  CRISPR gRNA sequence
aatgctgttttcctttagtt

SEQ ID NO: 268117 - DNA, 20 bp, Artificial
  CRISPR gRNA sequence
atgctgttttcctttagttt

SEQ ID NO: 268118 - DNA, 20 bp, Artificial
  CRISPR gRNA sequence
ttttcctttagtttagaaat

SEQ ID NO: 268119 - DNA, 20 bp, Artificial
  CRISPR gRNA sequence
tcctttagtttagaaataca

SEQ ID NO: 268120 - DNA, 20 bp, Artificial
  CRISPR gRNA sequence
cctttagtttagaaatacat

SEQ ID NO: 268121 - DNA, 20 bp, Artificial
  CRISPR gRNA sequence
ctttagtttagaaatacata

SEQ ID NO: 268122 - DNA, 20 bp, Artificial
  CRISPR gRNA sequence
tagtttagaaatacatagac

SEQ ID NO: 268123 - DNA, 20 bp, Artificial
  CRISPR gRNA sequence
agtttagaaatacatagaca

SEQ ID NO: 268124 - DNA, 20 bp, Artificial
  CRISPR gRNA sequence
gtttagaaatacatagacat

SEQ ID NO: 268125 - DNA, 20 bp, Artificial
  CRISPR gRNA sequence
agaaatacatagacattgtc

SEQ ID NO: 268126 - DNA, 20 bp, Artificial
  CRISPR gRNA sequence
gaaatacatagacattgtct

SEQ ID NO: 268127 - DNA, 20 bp, Artificial
  CRISPR gRNA sequence
tcttttatgaattctgatca

SEQ ID NO: 268128 - DNA, 20 bp, Artificial
  CRISPR gRNA sequence
ttatgaattctgatcatatt

SEQ ID NO: 268129 - DNA, 20 bp, Artificial
  CRISPR gRNA sequence
tatgaattctgatcatattt

SEQ ID NO: 268130 - DNA, 20 bp, Artificial
  CRISPR gRNA sequence
atgaattctgatcatattta

SEQ ID NO: 268131 - DNA, 20 bp, Artificial
  CRISPR gRNA sequence
tgaattctgatcatatttag

SEQ ID NO: 268132 - DNA, 20 bp, Artificial
  CRISPR gRNA sequence
tgatcatatttagtcatttt

SEQ ID NO: 268133 - DNA, 20 bp, Artificial
  CRISPR gRNA sequence
atcatatttagtcattttga

SEQ ID NO: 268134 - DNA, 20 bp, Artificial
  CRISPR gRNA sequence
agtcattttgaccaaatgag

SEQ ID NO: 268135 - DNA, 20 bp, Artificial
  CRISPR gRNA sequence
gtcattttgaccaaatgagg

SEQ ID NO: 268136 - DNA, 20 bp, Artificial
  CRISPR gRNA sequence
tgaccaaatgagggatttgg

SEQ ID NO: 268137 - DNA, 20 bp, Artificial
  CRISPR gRNA sequence
gaccaaatgagggatttggt

SEQ ID NO: 268138 - DNA, 20 bp, Artificial
  CRISPR gRNA sequence
accaaatgagggatttggtc

SEQ ID NO: 268139 - DNA, 20 bp, Artificial
  CRISPR gRNA sequence
ggtcaaatgagggattccct

SEQ ID NO: 268140 - DNA, 20 bp, Artificial
  CRISPR gRNA sequence
gtcaaatgagggattccctc

SEQ ID NO: 268141 - DNA, 20 bp, Artificial
  CRISPR gRNA sequence
cctcaaagcaatatcaggta

SEQ ID NO: 268142 - DNA, 20 bp, Artificial
  CRISPR gRNA sequence
aaagcaatatcaggtaaacc

SEQ ID NO: 268143 - DNA, 20 bp, Artificial
  CRISPR gRNA sequence
ctttcctcactccctgtcat

SEQ ID NO: 268144 - DNA, 20 bp, Artificial
  CRISPR gRNA sequence
tcctcactccctgtcatgag

SEQ ID NO: 268145 - DNA, 20 bp, Artificial
  CRISPR gRNA sequence
cctcactccctgtcatgaga

SEQ ID NO: 268146 - DNA, 20 bp, Artificial
  CRISPR gRNA sequence
ctcactccctgtcatgagac

SEQ ID NO: 268147 - DNA, 20 bp, Artificial
  CRISPR gRNA sequence
actccctgtcatgagacttc

SEQ ID NO: 268148 - DNA, 20 bp, Artificial
  CRISPR gRNA sequence
cctgtcatgagacttcagtg

SEQ ID NO: 268149 - DNA, 20 bp, Artificial
  CRISPR gRNA sequence
tcatgagacttcagtgttaa

SEQ ID NO: 268150 - DNA, 20 bp, Artificial
  CRISPR gRNA sequence
cagtgttaatgttcacaata

SEQ ID NO: 268151 - DNA, 20 bp, Artificial
  CRISPR gRNA sequence
agtgttaatgttcacaatat

SEQ ID NO: 268152 - DNA, 20 bp, Artificial
  CRISPR gRNA sequence
atgttcacaatatactttcg

SEQ ID NO: 268153 - DNA, 20 bp, Artificial
  CRISPR gRNA sequence
acaatatactttcgaaagaa

SEQ ID NO: 268154 - DNA, 20 bp, Artificial
  CRISPR gRNA sequence
tcgaaagaataaaatagttc

SEQ ID NO: 268155 - DNA, 20 bp, Artificial
  CRISPR gRNA sequence
cgaaagaataaaatagttct

SEQ ID NO: 268156 - DNA, 20 bp, Artificial
  CRISPR gRNA sequence
gaaagaataaaatagttctc

SEQ ID NO: 268157 - DNA, 20 bp, Artificial
  CRISPR gRNA sequence
tcctacatgaagaaagaata

SEQ ID NO: 268158 - DNA, 20 bp, Artificial
  CRISPR gRNA sequence
ctacatgaagaaagaatatg

SEQ ID NO: 268159 - DNA, 20 bp, Artificial
  CRISPR gRNA sequence
catgaagaaagaatatgtca

SEQ ID NO: 268160 - DNA, 20 bp, Artificial
  CRISPR gRNA sequence
tatgtcaaaattatttgagt

SEQ ID NO: 268161 - DNA, 20 bp, Artificial
  CRISPR gRNA sequence
atgtcaaaattatttgagta

SEQ ID NO: 268162 - DNA, 20 bp, Artificial
  CRISPR gRNA sequence
tgtcaaaattatttgagtac

SEQ ID NO: 268163 - DNA, 20 bp, Artificial
  CRISPR gRNA sequence
tttgagtactatgggacctg

SEQ ID NO: 268164 - DNA, 20 bp, Artificial
  CRISPR gRNA sequence
gagtactatgggacctggcg

SEQ ID NO: 268165 - DNA, 20 bp, Artificial
  CRISPR gRNA sequence
agtactatgggacctggcgc

SEQ ID NO: 268166 - DNA, 20 bp, Artificial
  CRISPR gRNA sequence
tgggacctggcgcagtggct

SEQ ID NO: 268167 - DNA, 20 bp, Artificial
  CRISPR gRNA sequence
gcgcagtggctcatgcttgt

SEQ ID NO: 268168 - DNA, 20 bp, Artificial
  CRISPR gRNA sequence
atgcttgtaatcccagcact

SEQ ID NO: 268169 - DNA, 20 bp, Artificial
  CRISPR gRNA sequence
gtaatcccagcactttggga

SEQ ID NO: 268170 - DNA, 20 bp, Artificial
  CRISPR gRNA sequence
taatcccagcactttgggag

SEQ ID NO: 268171 - DNA, 20 bp, Artificial
  CRISPR gRNA sequence
tgggaggccgaggtgggcag

SEQ ID NO: 268172 - DNA, 20 bp, Artificial
  CRISPR gRNA sequence
gggaggccgaggtgggcaga

SEQ ID NO: 268173 - DNA, 20 bp, Artificial
  CRISPR gRNA sequence
ggaggccgaggtgggcagat

SEQ ID NO: 268174 - DNA, 20 bp, Artificial
  CRISPR gRNA sequence
gagatcaggaccagcctggt

SEQ ID NO: 268175 - DNA, 20 bp, Artificial
  CRISPR gRNA sequence
agatcaggaccagcctggtc

SEQ ID NO: 268176 - DNA, 20 bp, Artificial
  CRISPR gRNA sequence
gtcaagatggtgaaactccg

SEQ ID NO: 268177 - DNA, 20 bp, Artificial
  CRISPR gRNA sequence
cgtctgtactaaaaatacaa

SEQ ID NO: 268178 - DNA, 20 bp, Artificial
  CRISPR gRNA sequence
tactaaaaatacaaaattta

SEQ ID NO: 268179 - DNA, 20 bp, Artificial
  CRISPR gRNA sequence
aaaatacaaaatttagcttg

SEQ ID NO: 268180 - DNA, 20 bp, Artificial
  CRISPR gRNA sequence
agcttggcctggtggcaggc

SEQ ID NO: 268181 - DNA, 20 bp, Artificial
  CRISPR gRNA sequence
gcttggcctggtggcaggca

SEQ ID NO: 268182 - DNA, 20 bp, Artificial
  CRISPR gRNA sequence
ggcctggtggcaggcacctg

SEQ ID NO: 268183 - DNA, 20 bp, Artificial
  CRISPR gRNA sequence
gcctggtggcaggcacctgt

SEQ ID NO: 268184 - DNA, 20 bp, Artificial
  CRISPR gRNA sequence
gtggcaggcacctgtaatcc

SEQ ID NO: 268185 - DNA, 20 bp, Artificial
  CRISPR gRNA sequence
taatcccagctgcccaagag

SEQ ID NO: 268186 - DNA, 20 bp, Artificial
  CRISPR gRNA sequence
cccaagaggctgaggcatga

SEQ ID NO: 268187 - DNA, 20 bp, Artificial
  CRISPR gRNA sequence
aggcatgagaatcgcttgaa

SEQ ID NO: 268188 - DNA, 20 bp, Artificial
  CRISPR gRNA sequence
gaacctggcaggcggaggtt

SEQ ID NO: 268189 - DNA, 20 bp, Artificial
  CRISPR gRNA sequence
aacctggcaggcggaggttg

SEQ ID NO: 268190 - DNA, 20 bp, Artificial
  CRISPR gRNA sequence
gcaggcggaggttgcagtga

SEQ ID NO: 268191 - DNA, 20 bp, Artificial
  CRISPR gRNA sequence
cagtgagccgagatagtgcc

SEQ ID NO: 268192 - DNA, 20 bp, Artificial
  CRISPR gRNA sequence
tccagcctgggcgacagagt

SEQ ID NO: 268193 - DNA, 20 bp, Artificial
  CRISPR gRNA sequence
cagcctgggcgacagagtga

SEQ ID NO: 268194 - DNA, 20 bp, Artificial
  CRISPR gRNA sequence
ggcgacagagtgagactcca

SEQ ID NO: 268195 - DNA, 20 bp, Artificial
  CRISPR gRNA sequence
catctcaaacaacaacaaca

SEQ ID NO: 268196 - DNA, 20 bp, Artificial
  CRISPR gRNA sequence
aaacaacaacaacaacaaca

SEQ ID NO: 268197 - DNA, 20 bp, Artificial
  CRISPR gRNA sequence
tttgagtactgtgaaggatt

SEQ ID NO: 268198 - DNA, 20 bp, Artificial
  CRISPR gRNA sequence
gagtactgtgaaggattatt

SEQ ID NO: 268199 - DNA, 20 bp, Artificial
  CRISPR gRNA sequence
agtactgtgaaggattattt

SEQ ID NO: 268200 - DNA, 20 bp, Artificial
  CRISPR gRNA sequence
tgaaggattatttgtctaac

SEQ ID NO: 268201 - DNA, 20 bp, Artificial
  CRISPR gRNA sequence
tttgtctaacagttcattcc

SEQ ID NO: 268202 - DNA, 20 bp, Artificial
  CRISPR gRNA sequence
gtctaacagttcattccaat

SEQ ID NO: 268203 - DNA, 20 bp, Artificial
  CRISPR gRNA sequence
tctaacagttcattccaatc

SEQ ID NO: 268204 - DNA, 20 bp, Artificial
  CRISPR gRNA sequence
acagttcattccaatcagac

SEQ ID NO: 268205 - DNA, 20 bp, Artificial
  CRISPR gRNA sequence
attccaatcagaccaggtag

SEQ ID NO: 268206 - DNA, 20 bp, Artificial
  CRISPR gRNA sequence
caatcagaccaggtaggagc

SEQ ID NO: 268207 - DNA, 20 bp, Artificial
  CRISPR gRNA sequence
tcctgtttcatatgtttcag

SEQ ID NO: 268208 - DNA, 20 bp, Artificial
  CRISPR gRNA sequence
cctgtttcatatgtttcagg

SEQ ID NO: 268209 - DNA, 20 bp, Artificial
  CRISPR gRNA sequence
ctgtttcatatgtttcaggg

SEQ ID NO: 268210 - DNA, 20 bp, Artificial
  CRISPR gRNA sequence
tttcatatgtttcagggttg

SEQ ID NO: 268211 - DNA, 20 bp, Artificial
  CRISPR gRNA sequence
catatgtttcagggttgcac

SEQ ID NO: 268212 - DNA, 20 bp, Artificial
  CRISPR gRNA sequence
atatgtttcagggttgcaca

SEQ ID NO: 268213 - DNA, 20 bp, Artificial
  CRISPR gRNA sequence
cagggttgcacagttggtct

SEQ ID NO: 268214 - DNA, 20 bp, Artificial
  CRISPR gRNA sequence
agggttgcacagttggtctc

SEQ ID NO: 268215 - DNA, 20 bp, Artificial
  CRISPR gRNA sequence
cacagttggtctctttaatg

SEQ ID NO: 268216 - DNA, 20 bp, Artificial
  CRISPR gRNA sequence
gtctctttaatgtcggtgtg

SEQ ID NO: 268217 - DNA, 20 bp, Artificial
  CRISPR gRNA sequence
tttaatgtcggtgtggagat

SEQ ID NO: 268218 - DNA, 20 bp, Artificial
  CRISPR gRNA sequence
taatgtcggtgtggagatcc

SEQ ID NO: 268219 - DNA, 20 bp, Artificial
  CRISPR gRNA sequence
aatgtcggtgtggagatcca

SEQ ID NO: 268220 - DNA, 20 bp, Artificial
  CRISPR gRNA sequence
atgtcggtgtggagatccaa

SEQ ID NO: 268221 - DNA, 20 bp, Artificial
  CRISPR gRNA sequence
tggaaagagcgtccatagga

SEQ ID NO: 268222 - DNA, 20 bp, Artificial
  CRISPR gRNA sequence
tgaaaaagggatgttagcat

SEQ ID NO: 268223 - DNA, 20 bp, Artificial
  CRISPR gRNA sequence
gcattcattagagtatgagg

SEQ ID NO: 268224 - DNA, 20 bp, Artificial
  CRISPR gRNA sequence
attagagtatgaggatgagt

SEQ ID NO: 268225 - DNA, 20 bp, Artificial
  CRISPR gRNA sequence
gagtatgaggatgagtccca

SEQ ID NO: 268226 - DNA, 20 bp, Artificial
  CRISPR gRNA sequence
tttggaaggaggacgaatag

SEQ ID NO: 268227 - DNA, 20 bp, Artificial
  CRISPR gRNA sequence
tggaaggaggacgaatagaa

SEQ ID NO: 268228 - DNA, 20 bp, Artificial
  CRISPR gRNA sequence
ggaaggaggacgaatagaat

SEQ ID NO: 268229 - DNA, 20 bp, Artificial
  CRISPR gRNA sequence
gaaggaggacgaatagaatg

SEQ ID NO: 268230 - DNA, 20 bp, Artificial
  CRISPR gRNA sequence
ttgccatgtgctgaggagat

SEQ ID NO: 268231 - DNA, 20 bp, Artificial
  CRISPR gRNA sequence
gccatgtgctgaggagatag

SEQ ID NO: 268232 - DNA, 20 bp, Artificial
  CRISPR gRNA sequence
ccatgtgctgaggagatagc

SEQ ID NO: 268233 - DNA, 20 bp, Artificial
  CRISPR gRNA sequence
aggagatagccagcattagg

SEQ ID NO: 268234 - DNA, 20 bp, Artificial
  CRISPR gRNA sequence
ggtgacaatcttccagaagt

SEQ ID NO: 268235 - DNA, 20 bp, Artificial
  CRISPR gRNA sequence
ccagaagtggtcaggcagaa

SEQ ID NO: 268236 - DNA, 20 bp, Artificial
  CRISPR gRNA sequence
cagaagtggtcaggcagaag

SEQ ID NO: 268237 - DNA, 20 bp, Artificial
  CRISPR gRNA sequence
gtgagagctcctttacaggg

SEQ ID NO: 268238 - DNA, 20 bp, Artificial
  CRISPR gRNA sequence
ctttacagggactttatgtg

SEQ ID NO: 268239 - DNA, 20 bp, Artificial
  CRISPR gRNA sequence
tacagggactttatgtggtt

SEQ ID NO: 268240 - DNA, 20 bp, Artificial
  CRISPR gRNA sequence
acagggactttatgtggttt

SEQ ID NO: 268241 - DNA, 20 bp, Artificial
  CRISPR gRNA sequence
cagggactttatgtggttta

SEQ ID NO: 268242 - DNA, 20 bp, Artificial
  CRISPR gRNA sequence
tatgtggtttagggctcaga

SEQ ID NO: 268243 - DNA, 20 bp, Artificial
  CRISPR gRNA sequence
atgtggtttagggctcagag

SEQ ID NO: 268244 - DNA, 20 bp, Artificial
  CRISPR gRNA sequence
tgtggtttagggctcagagc

SEQ ID NO: 268245 - DNA, 20 bp, Artificial
  CRISPR gRNA sequence
agggctcagagctccaaaac

SEQ ID NO: 268246 - DNA, 20 bp, Artificial
  CRISPR gRNA sequence
gggctcagagctccaaaact

SEQ ID NO: 268247 - DNA, 20 bp, Artificial
  CRISPR gRNA sequence
agagctccaaaactctgggc

SEQ ID NO: 268248 - DNA, 20 bp, Artificial
  CRISPR gRNA sequence
caaaactctgggctcagctg

SEQ ID NO: 268249 - DNA, 20 bp, Artificial
  CRISPR gRNA sequence
tgggctcagctgctcctgta

SEQ ID NO: 268250 - DNA, 20 bp, Artificial
  CRISPR gRNA sequence
ggctcagctgctcctgtacc

SEQ ID NO: 268251 - DNA, 20 bp, Artificial
  CRISPR gRNA sequence
agctgctcctgtaccttgga

SEQ ID NO: 268252 - DNA, 20 bp, Artificial
  CRISPR gRNA sequence
ctcctgtaccttggaggtcc

SEQ ID NO: 268253 - DNA, 20 bp, Artificial
  CRISPR gRNA sequence
ctgtaccttggaggtccatt

SEQ ID NO: 268254 - DNA, 20 bp, Artificial
  CRISPR gRNA sequence
taccttggaggtccattcac

SEQ ID NO: 268255 - DNA, 20 bp, Artificial
  CRISPR gRNA sequence
ggaggtccattcacatggga

SEQ ID NO: 268256 - DNA, 20 bp, Artificial
  CRISPR gRNA sequence
gaggtccattcacatgggaa

SEQ ID NO: 268257 - DNA, 20 bp, Artificial
  CRISPR gRNA sequence
acatgggaaagtattttgga

SEQ ID NO: 268258 - DNA, 20 bp, Artificial
  CRISPR gRNA sequence
tggaatgtgtcttttgaaga

SEQ ID NO: 268259 - DNA, 20 bp, Artificial
  CRISPR gRNA sequence
ggaatgtgtcttttgaagag

SEQ ID NO: 268260 - DNA, 20 bp, Artificial
  CRISPR gRNA sequence
gaatgtgtcttttgaagaga

SEQ ID NO: 268261 - DNA, 20 bp, Artificial
  CRISPR gRNA sequence
ttgaagagagcatcagagtt

SEQ ID NO: 268262 - DNA, 20 bp, Artificial
  CRISPR gRNA sequence
tgaagagagcatcagagttc

SEQ ID NO: 268263 - DNA, 20 bp, Artificial
  CRISPR gRNA sequence
gaagagagcatcagagttct

SEQ ID NO: 268264 - DNA, 20 bp, Artificial
  CRISPR gRNA sequence
aagagagcatcagagttctt

SEQ ID NO: 268265 - DNA, 20 bp, Artificial
  CRISPR gRNA sequence
ttaagggactgggtaaggcc

SEQ ID NO: 268266 - DNA, 20 bp, Artificial
  CRISPR gRNA sequence
aagggactgggtaaggcctg

SEQ ID NO: 268267 - DNA, 20 bp, Artificial
  CRISPR gRNA sequence
agggactgggtaaggcctga

SEQ ID NO: 268268 - DNA, 20 bp, Artificial
  CRISPR gRNA sequence
ggtaaggcctgaccctgaaa

SEQ ID NO: 268269 - DNA, 20 bp, Artificial
  CRISPR gRNA sequence
accctgaaatgaccatggat

SEQ ID NO: 268270 - DNA, 20 bp, Artificial
  CRISPR gRNA sequence
aaatgaccatggatattttt

SEQ ID NO: 268271 - DNA, 20 bp, Artificial
  CRISPR gRNA sequence
ttctacctacagtttgagtc

SEQ ID NO: 268272 - DNA, 20 bp, Artificial
  CRISPR gRNA sequence
tctacctacagtttgagtca

SEQ ID NO: 268273 - DNA, 20 bp, Artificial
  CRISPR gRNA sequence
ctacctacagtttgagtcaa

SEQ ID NO: 268274 - DNA, 20 bp, Artificial
  CRISPR gRNA sequence
tacctacagtttgagtcaac

SEQ ID NO: 268275 - DNA, 20 bp, Artificial
  CRISPR gRNA sequence
cctacagtttgagtcaacta

SEQ ID NO: 268276 - DNA, 20 bp, Artificial
  CRISPR gRNA sequence
cagtttgagtcaactagaat

SEQ ID NO: 268277 - DNA, 20 bp, Artificial
  CRISPR gRNA sequence
gagtcaactagaatatgcct

SEQ ID NO: 268278 - DNA, 20 bp, Artificial
  CRISPR gRNA sequence
agtcaactagaatatgcctg

SEQ ID NO: 268279 - DNA, 20 bp, Artificial
  CRISPR gRNA sequence
gaatatgcctggggaccttg

SEQ ID NO: 268280 - DNA, 20 bp, Artificial
  CRISPR gRNA sequence
gggaccttgaagaatggccc

SEQ ID NO: 268281 - DNA, 20 bp, Artificial
  CRISPR gRNA sequence
gaagaatggcccttcagtgg

SEQ ID NO: 268282 - DNA, 20 bp, Artificial
  CRISPR gRNA sequence
aagaatggcccttcagtggc

SEQ ID NO: 268283 - DNA, 20 bp, Artificial
  CRISPR gRNA sequence
cagtggccctcaccatttgt

SEQ ID NO: 268284 - DNA, 20 bp, Artificial
  CRISPR gRNA sequence
agtggccctcaccatttgtt

SEQ ID NO: 268285 - DNA, 20 bp, Artificial
  CRISPR gRNA sequence
accatttgttcatgcttcag

SEQ ID NO: 268286 - DNA, 20 bp, Artificial
  CRISPR gRNA sequence
gttcatgcttcagttaattc

SEQ ID NO: 268287 - DNA, 20 bp, Artificial
  CRISPR gRNA sequence
ttcatgcttcagttaattca

SEQ ID NO: 268288 - DNA, 20 bp, Artificial
  CRISPR gRNA sequence
atgcttcagttaattcaggt

SEQ ID NO: 268289 - DNA, 20 bp, Artificial
  CRISPR gRNA sequence
cagttaattcaggtgttgaa

SEQ ID NO: 268290 - DNA, 20 bp, Artificial
  CRISPR gRNA sequence
agttaattcaggtgttgaag

SEQ ID NO: 268291 - DNA, 20 bp, Artificial
  CRISPR gRNA sequence
attcaggtgttgaaggagct

SEQ ID NO: 268292 - DNA, 20 bp, Artificial
  CRISPR gRNA sequence
aggtgttgaaggagcttagg

SEQ ID NO: 268293 - DNA, 20 bp, Artificial
  CRISPR gRNA sequence
aaggagcttaggttttagag

SEQ ID NO: 268294 - DNA, 20 bp, Artificial
  CRISPR gRNA sequence
aggttttagaggcacgtaga

SEQ ID NO: 268295 - DNA, 20 bp, Artificial
  CRISPR gRNA sequence
ggttttagaggcacgtagac

SEQ ID NO: 268296 - DNA, 20 bp, Artificial
  CRISPR gRNA sequence
tagaggcacgtagacttggt

SEQ ID NO: 268297 - DNA, 20 bp, Artificial
  CRISPR gRNA sequence
agaggcacgtagacttggtt

SEQ ID NO: 268298 - DNA, 20 bp, Artificial
  CRISPR gRNA sequence
gaggcacgtagacttggttc

SEQ ID NO: 268299 - DNA, 20 bp, Artificial
  CRISPR gRNA sequence
ggttcaagtctcgttagtag

SEQ ID NO: 268300 - DNA, 20 bp, Artificial
  CRISPR gRNA sequence
gttcaagtctcgttagtagt

SEQ ID NO: 268301 - DNA, 20 bp, Artificial
  CRISPR gRNA sequence
aagtctcgttagtagttgaa

SEQ ID NO: 268302 - DNA, 20 bp, Artificial
  CRISPR gRNA sequence
gttagtagttgaatagcctc

SEQ ID NO: 268303 - DNA, 20 bp, Artificial
  CRISPR gRNA sequence
gtagttgaatagcctcaggc

SEQ ID NO: 268304 - DNA, 20 bp, Artificial
  CRISPR gRNA sequence
aatagcctcaggcaagtcac

SEQ ID NO: 268305 - DNA, 20 bp, Artificial
  CRISPR gRNA sequence
aggcaagtcactgcccacct

SEQ ID NO: 268306 - DNA, 20 bp, Artificial
  CRISPR gRNA sequence
cccacctaagatgatggttc

SEQ ID NO: 268307 - DNA, 20 bp, Artificial
  CRISPR gRNA sequence
agatgatggttcttcaacta

SEQ ID NO: 268308 - DNA, 20 bp, Artificial
  CRISPR gRNA sequence
ttcaactataaaatggagat

SEQ ID NO: 268309 - DNA, 20 bp, Artificial
  CRISPR gRNA sequence
caactataaaatggagataa

SEQ ID NO: 268310 - DNA, 20 bp, Artificial
  CRISPR gRNA sequence
aactataaaatggagataat

SEQ ID NO: 268311 - DNA, 20 bp, Artificial
  CRISPR gRNA sequence
taaaatggagataatggtta

SEQ ID NO: 268312 - DNA, 20 bp, Artificial
  CRISPR gRNA sequence
caaatgtctcttcctatagt

SEQ ID NO: 268313 - DNA, 20 bp, Artificial
  CRISPR gRNA sequence
ttcctatagtataatctcca

SEQ ID NO: 268314 - DNA, 20 bp, Artificial
  CRISPR gRNA sequence
cctatagtataatctccata

SEQ ID NO: 268315 - DNA, 20 bp, Artificial
  CRISPR gRNA sequence
ctatagtataatctccataa

SEQ ID NO: 268316 - DNA, 20 bp, Artificial
  CRISPR gRNA sequence
tagtataatctccataaggg

SEQ ID NO: 268317 - DNA, 20 bp, Artificial
  CRISPR gRNA sequence
cataagggcatggcccaagt

SEQ ID NO: 268318 - DNA, 20 bp, Artificial
  CRISPR gRNA sequence
tctttgactctgcctatccc

SEQ ID NO: 268319 - DNA, 20 bp, Artificial
  CRISPR gRNA sequence
tgactctgcctatccctgac

SEQ ID NO: 268320 - DNA, 20 bp, Artificial
  CRISPR gRNA sequence
gactctgcctatccctgaca

SEQ ID NO: 268321 - DNA, 20 bp, Artificial
  CRISPR gRNA sequence
actctgcctatccctgacat

SEQ ID NO: 268322 - DNA, 20 bp, Artificial
  CRISPR gRNA sequence
tgcctatccctgacatttag

SEQ ID NO: 268323 - DNA, 20 bp, Artificial
  CRISPR gRNA sequence
cctatccctgacatttagta

SEQ ID NO: 268324 - DNA, 20 bp, Artificial
  CRISPR gRNA sequence
tccctgacatttagtagcat

SEQ ID NO: 268325 - DNA, 20 bp, Artificial
  CRISPR gRNA sequence
acatttagtagcatgcccga

SEQ ID NO: 268326 - DNA, 20 bp, Artificial
  CRISPR gRNA sequence
agtagcatgcccgacataca

SEQ ID NO: 268327 - DNA, 20 bp, Artificial
  CRISPR gRNA sequence
gtagcatgcccgacatacaa

SEQ ID NO: 268328 - DNA, 20 bp, Artificial
  CRISPR gRNA sequence
gctattggtattattgccat

SEQ ID NO: 268329 - DNA, 20 bp, Artificial
  CRISPR gRNA sequence
ttggtattattgccatatag

SEQ ID NO: 268330 - DNA, 20 bp, Artificial
  CRISPR gRNA sequence
gtattattgccatatagata

SEQ ID NO: 268331 - DNA, 20 bp, Artificial
  CRISPR gRNA sequence
ttgccatatagataaattat

SEQ ID NO: 268332 - DNA, 20 bp, Artificial
  CRISPR gRNA sequence
ccatatagataaattatgta

SEQ ID NO: 268333 - DNA, 20 bp, Artificial
  CRISPR gRNA sequence
tgtataaaaattaaactggg

SEQ ID NO: 268334 - DNA, 20 bp, Artificial
  CRISPR gRNA sequence
aactgggcaatagcctaaga

SEQ ID NO: 268335 - DNA, 20 bp, Artificial
  CRISPR gRNA sequence
ggcaatagcctaagaagggg

SEQ ID NO: 268336 - DNA, 20 bp, Artificial
  CRISPR gRNA sequence
agaaggggggaatattgtaa

SEQ ID NO: 268337 - DNA, 20 bp, Artificial
  CRISPR gRNA sequence
taacacaaatttaaacccac

SEQ ID NO: 268338 - DNA, 20 bp, Artificial
  CRISPR gRNA sequence
aaacccactacgcagggatg

SEQ ID NO: 268339 - DNA, 20 bp, Artificial
  CRISPR gRNA sequence
aacccactacgcagggatga

SEQ ID NO: 268340 - DNA, 20 bp, Artificial
  CRISPR gRNA sequence
cgcagggatgaggtgctata

SEQ ID NO: 268341 - DNA, 20 bp, Artificial
  CRISPR gRNA sequence
taatatgaggaccttttaac

SEQ ID NO: 268342 - DNA, 20 bp, Artificial
  CRISPR gRNA sequence
ttaacttccatcattttcct

SEQ ID NO: 268343 - DNA, 20 bp, Artificial
  CRISPR gRNA sequence
taacttccatcattttcctg

SEQ ID NO: 268344 - DNA, 20 bp, Artificial
  CRISPR gRNA sequence
aacttccatcattttcctgt

SEQ ID NO: 268345 - DNA, 20 bp, Artificial
  CRISPR gRNA sequence
acttccatcattttcctgtt

SEQ ID NO: 268346 - DNA, 20 bp, Artificial
  CRISPR gRNA sequence
ccatcattttcctgtttctt

SEQ ID NO: 268347 - DNA, 20 bp, Artificial
  CRISPR gRNA sequence
catcattttcctgtttcttg

SEQ ID NO: 268348 - DNA, 20 bp, Artificial
  CRISPR gRNA sequence
tcctgtttcttgaaatagtt

SEQ ID NO: 268349 - DNA, 20 bp, Artificial
  CRISPR gRNA sequence
cctgtttcttgaaatagttt

SEQ ID NO: 268350 - DNA, 20 bp, Artificial
  CRISPR gRNA sequence
ctgtttcttgaaatagttta

SEQ ID NO: 268351 - DNA, 20 bp, Artificial
  CRISPR gRNA sequence
tttcttgaaatagtttatct

SEQ ID NO: 268352 - DNA, 20 bp, Artificial
  CRISPR gRNA sequence
cttgaaatagtttatcttgt

SEQ ID NO: 268353 - DNA, 20 bp, Artificial
  CRISPR gRNA sequence
ttgaaatagtttatcttgta

SEQ ID NO: 268354 - DNA, 20 bp, Artificial
  CRISPR gRNA sequence
gaaatagtttatcttgtaat

SEQ ID NO: 268355 - DNA, 20 bp, Artificial
  CRISPR gRNA sequence
aaatagtttatcttgtaatg

SEQ ID NO: 268356 - DNA, 20 bp, Artificial
  CRISPR gRNA sequence
atcttgtaatgaaatataag

SEQ ID NO: 268357 - DNA, 20 bp, Artificial
  CRISPR gRNA sequence
tcttgtaatgaaatataagg

SEQ ID NO: 268358 - DNA, 20 bp, Artificial
  CRISPR gRNA sequence
gtaatgaaatataaggcacc

SEQ ID NO: 268359 - DNA, 20 bp, Artificial
  CRISPR gRNA sequence
taatgaaatataaggcacct

SEQ ID NO: 268360 - DNA, 20 bp, Artificial
  CRISPR gRNA sequence
ccacttttatgtatagaaag

SEQ ID NO: 268361 - DNA, 20 bp, Artificial
  CRISPR gRNA sequence
ttatgtatagaaagaggtct

SEQ ID NO: 268362 - DNA, 20 bp, Artificial
  CRISPR gRNA sequence
tatgtatagaaagaggtctt

SEQ ID NO: 268363 - DNA, 20 bp, Artificial
  CRISPR gRNA sequence
atgtatagaaagaggtcttt

SEQ ID NO: 268364 - DNA, 20 bp, Artificial
  CRISPR gRNA sequence
tgtatagaaagaggtctttt

SEQ ID NO: 268365 - DNA, 20 bp, Artificial
  CRISPR gRNA sequence
ttaatttttttttaatgtga

SEQ ID NO: 268366 - DNA, 20 bp, Artificial
  CRISPR gRNA sequence
taatttttttttaatgtgag

SEQ ID NO: 268367 - DNA, 20 bp, Artificial
  CRISPR gRNA sequence
aatttttttttaatgtgaga

SEQ ID NO: 268368 - DNA, 20 bp, Artificial
  CRISPR gRNA sequence
atttttttttaatgtgagaa

SEQ ID NO: 268369 - DNA, 20 bp, Artificial
  CRISPR gRNA sequence
ttttttaatgtgagaaggaa

SEQ ID NO: 268370 - DNA, 20 bp, Artificial
  CRISPR gRNA sequence
tttttaatgtgagaaggaag

SEQ ID NO: 268371 - DNA, 20 bp, Artificial
  CRISPR gRNA sequence
ttttaatgtgagaaggaagg

SEQ ID NO: 268372 - DNA, 20 bp, Artificial
  CRISPR gRNA sequence
tttaatgtgagaaggaaggg

SEQ ID NO: 268373 - DNA, 20 bp, Artificial
  CRISPR gRNA sequence
ttaatgtgagaaggaaggga

SEQ ID NO: 268374 - DNA, 20 bp, Artificial
  CRISPR gRNA sequence
taatgtgagaaggaagggag

SEQ ID NO: 268375 - DNA, 20 bp, Artificial
  CRISPR gRNA sequence
aatgtgagaaggaagggagg

SEQ ID NO: 268376 - DNA, 20 bp, Artificial
  CRISPR gRNA sequence
atgtgagaaggaagggagga

SEQ ID NO: 268377 - DNA, 20 bp, Artificial
  CRISPR gRNA sequence
gagattccagatcgaaaata

SEQ ID NO: 268378 - DNA, 20 bp, Artificial
  CRISPR gRNA sequence
agattccagatcgaaaatac

SEQ ID NO: 268379 - DNA, 20 bp, Artificial
  CRISPR gRNA sequence
cagatcgaaaatactgtact

SEQ ID NO: 268380 - DNA, 20 bp, Artificial
  CRISPR gRNA sequence
tactttggttgatttttaag

SEQ ID NO: 268381 - DNA, 20 bp, Artificial
  CRISPR gRNA sequence
tggttgatttttaagtgggc

SEQ ID NO: 268382 - DNA, 20 bp, Artificial
  CRISPR gRNA sequence
ggttgatttttaagtgggct

SEQ ID NO: 268383 - DNA, 20 bp, Artificial
  CRISPR gRNA sequence
gttgatttttaagtgggctt

SEQ ID NO: 268384 - DNA, 20 bp, Artificial
  CRISPR gRNA sequence
atttttaagtgggcttccat

SEQ ID NO: 268385 - DNA, 20 bp, Artificial
  CRISPR gRNA sequence
ttaagtgggcttccattcca

SEQ ID NO: 268386 - DNA, 20 bp, Artificial
  CRISPR gRNA sequence
taagtgggcttccattccat

SEQ ID NO: 268387 - DNA, 20 bp, Artificial
  CRISPR gRNA sequence
aagtgggcttccattccatg

SEQ ID NO: 268388 - DNA, 20 bp, Artificial
  CRISPR gRNA sequence
agtgggcttccattccatgg

SEQ ID NO: 268389 - DNA, 20 bp, Artificial
  CRISPR gRNA sequence
ccattccatggatttaatca

SEQ ID NO: 268390 - DNA, 20 bp, Artificial
  CRISPR gRNA sequence
cattccatggatttaatcag

SEQ ID NO: 268391 - DNA, 20 bp, Artificial
  CRISPR gRNA sequence
catggatttaatcagtccca

SEQ ID NO: 268392 - DNA, 20 bp, Artificial
  CRISPR gRNA sequence
aatcagtcccaagaagatca

SEQ ID NO: 268393 - DNA, 20 bp, Artificial
  CRISPR gRNA sequence
atcagtcccaagaagatcaa

SEQ ID NO: 268394 - DNA, 20 bp, Artificial
  CRISPR gRNA sequence
agcagtacttgggtgctgaa

SEQ ID NO: 268395 - DNA, 20 bp, Artificial
  CRISPR gRNA sequence
gggtgctgaagaactgttgg

SEQ ID NO: 268396 - DNA, 20 bp, Artificial
  CRISPR gRNA sequence
ggtgctgaagaactgttgga

SEQ ID NO: 268397 - DNA, 20 bp, Artificial
  CRISPR gRNA sequence
aagaactgttggatttaccc

SEQ ID NO: 268398 - DNA, 20 bp, Artificial
  CRISPR gRNA sequence
ttggatttaccctggcacgt

SEQ ID NO: 268399 - DNA, 20 bp, Artificial
  CRISPR gRNA sequence
gatttaccctggcacgtgtg

SEQ ID NO: 268400 - DNA, 20 bp, Artificial
  CRISPR gRNA sequence
accctggcacgtgtgccact

SEQ ID NO: 268401 - DNA, 20 bp, Artificial
  CRISPR gRNA sequence
ccctggcacgtgtgccactt

SEQ ID NO: 268402 - DNA, 20 bp, Artificial
  CRISPR gRNA sequence
gcacgtgtgccacttgccag

SEQ ID NO: 268403 - DNA, 20 bp, Artificial
  CRISPR gRNA sequence
gccagcttcttgggcacaca

SEQ ID NO: 268404 - DNA, 20 bp, Artificial
  CRISPR gRNA sequence
ccagcttcttgggcacacag

SEQ ID NO: 268405 - DNA, 20 bp, Artificial
  CRISPR gRNA sequence
cttgggcacacagagttctt

SEQ ID NO: 268406 - DNA, 20 bp, Artificial
  CRISPR gRNA sequence
ttgggcacacagagttcttc

SEQ ID NO: 268407 - DNA, 20 bp, Artificial
  CRISPR gRNA sequence
gggcacacagagttcttcaa

SEQ ID NO: 268408 - DNA, 20 bp, Artificial
  CRISPR gRNA sequence
ggcacacagagttcttcaat

SEQ ID NO: 268409 - DNA, 20 bp, Artificial
  CRISPR gRNA sequence
ttcaatccaagttatcagat

SEQ ID NO: 268410 - DNA, 20 bp, Artificial
  CRISPR gRNA sequence
caatccaagttatcagattg

SEQ ID NO: 268411 - DNA, 20 bp, Artificial
  CRISPR gRNA sequence
aatccaagttatcagattgt

SEQ ID NO: 268412 - DNA, 20 bp, Artificial
  CRISPR gRNA sequence
tcagattgtatttgaaaatg

SEQ ID NO: 268413 - DNA, 20 bp, Artificial
  CRISPR gRNA sequence
tatttgaaaatgacagagct

SEQ ID NO: 268414 - DNA, 20 bp, Artificial
  CRISPR gRNA sequence
gaaaatgacagagctggaga

SEQ ID NO: 268415 - DNA, 20 bp, Artificial
  CRISPR gRNA sequence
aaaatgacagagctggagag

SEQ ID NO: 268416 - DNA, 20 bp, Artificial
  CRISPR gRNA sequence
gagagttttttgaaatggca

SEQ ID NO: 268417 - DNA, 20 bp, Artificial
  CRISPR gRNA sequence
tttgaaatggcagtggcaaa

SEQ ID NO: 268418 - DNA, 20 bp, Artificial
  CRISPR gRNA sequence
ttgaaatggcagtggcaaat

SEQ ID NO: 268419 - DNA, 20 bp, Artificial
  CRISPR gRNA sequence
tgaaatggcagtggcaaata

SEQ ID NO: 268420 - DNA, 20 bp, Artificial
  CRISPR gRNA sequence
gaaatggcagtggcaaataa

SEQ ID NO: 268421 - DNA, 20 bp, Artificial
  CRISPR gRNA sequence
aaatggcagtggcaaataaa

SEQ ID NO: 268422 - DNA, 20 bp, Artificial
  CRISPR gRNA sequence
ttttttaaatggaaagactt

SEQ ID NO: 268423 - DNA, 20 bp, Artificial
  CRISPR gRNA sequence
tttttaaatggaaagacttg

SEQ ID NO: 268424 - DNA, 20 bp, Artificial
  CRISPR gRNA sequence
ttttaaatggaaagacttga

SEQ ID NO: 268425 - DNA, 20 bp, Artificial
  CRISPR gRNA sequence
tttaaatggaaagacttgat

SEQ ID NO: 268426 - DNA, 20 bp, Artificial
  CRISPR gRNA sequence
ttaaatggaaagacttgatc

SEQ ID NO: 268427 - DNA, 20 bp, Artificial
  CRISPR gRNA sequence
taaatggaaagacttgatct

SEQ ID NO: 268428 - DNA, 20 bp, Artificial
  CRISPR gRNA sequence
aaatggaaagacttgatcta

SEQ ID NO: 268429 - DNA, 20 bp, Artificial
  CRISPR gRNA sequence
aatggaaagacttgatctat

SEQ ID NO: 268430 - DNA, 20 bp, Artificial
  CRISPR gRNA sequence
gatctatggtaataaatgat

SEQ ID NO: 268431 - DNA, 20 bp, Artificial
  CRISPR gRNA sequence
atctatggtaataaatgatt

SEQ ID NO: 268432 - DNA, 20 bp, Artificial
  CRISPR gRNA sequence
tggtaataaatgattttgtt

SEQ ID NO: 268433 - DNA, 20 bp, Artificial
  CRISPR gRNA sequence
tgttttctgactggaaaaat

SEQ ID NO: 268434 - DNA, 20 bp, Artificial
  CRISPR gRNA sequence
gttttctgactggaaaaata

SEQ ID NO: 268435 - DNA, 20 bp, Artificial
  CRISPR gRNA sequence
ttttctgactggaaaaatag

SEQ ID NO: 268436 - DNA, 20 bp, Artificial
  CRISPR gRNA sequence
tctgactggaaaaataggcc

SEQ ID NO: 268437 - DNA, 20 bp, Artificial
  CRISPR gRNA sequence
ctgactggaaaaataggcct

SEQ ID NO: 268438 - DNA, 20 bp, Artificial
  CRISPR gRNA sequence
tgactggaaaaataggccta

SEQ ID NO: 268439 - DNA, 20 bp, Artificial
  CRISPR gRNA sequence
actggaaaaataggcctact

SEQ ID NO: 268440 - DNA, 20 bp, Artificial
  CRISPR gRNA sequence
gaaaaataggcctactaaag

SEQ ID NO: 268441 - DNA, 20 bp, Artificial
  CRISPR gRNA sequence
ctaaagatgaatcacacttg

SEQ ID NO: 268442 - DNA, 20 bp, Artificial
  CRISPR gRNA sequence
aagatgaatcacacttgaga

SEQ ID NO: 268443 - DNA, 20 bp, Artificial
  CRISPR gRNA sequence
gagatgtttcttactcactc

SEQ ID NO: 268444 - DNA, 20 bp, Artificial
  CRISPR gRNA sequence
agatgtttcttactcactct

SEQ ID NO: 268445 - DNA, 20 bp, Artificial
  CRISPR gRNA sequence
cttactcactctgcacagaa

SEQ ID NO: 268446 - DNA, 20 bp, Artificial
  CRISPR gRNA sequence
ttactcactctgcacagaaa

SEQ ID NO: 268447 - DNA, 20 bp, Artificial
  CRISPR gRNA sequence
actcactctgcacagaaaca

SEQ ID NO: 268448 - DNA, 20 bp, Artificial
  CRISPR gRNA sequence
ctcactctgcacagaaacaa

SEQ ID NO: 268449 - DNA, 20 bp, Artificial
  CRISPR gRNA sequence
actctgcacagaaacaaaga

SEQ ID NO: 268450 - DNA, 20 bp, Artificial
  CRISPR gRNA sequence
tgcacagaaacaaagaagaa

SEQ ID NO: 268451 - DNA, 20 bp, Artificial
  CRISPR gRNA sequence
cacagaaacaaagaagaaat

SEQ ID NO: 268452 - DNA, 20 bp, Artificial
  CRISPR gRNA sequence
tacagggaagtccgttttca

SEQ ID NO: 268453 - DNA, 20 bp, Artificial
  CRISPR gRNA sequence
tcactattagtatgaaccaa

SEQ ID NO: 268454 - DNA, 20 bp, Artificial
  CRISPR gRNA sequence
cactattagtatgaaccaag

SEQ ID NO: 268455 - DNA, 20 bp, Artificial
  CRISPR gRNA sequence
actattagtatgaaccaaga

SEQ ID NO: 268456 - DNA, 20 bp, Artificial
  CRISPR gRNA sequence
ttagtatgaaccaagaaatg

SEQ ID NO: 268457 - DNA, 20 bp, Artificial
  CRISPR gRNA sequence
gtatgaaccaagaaatggtt

SEQ ID NO: 268458 - DNA, 20 bp, Artificial
  CRISPR gRNA sequence
aaaaacagtggtaggagcaa

SEQ ID NO: 268459 - DNA, 20 bp, Artificial
  CRISPR gRNA sequence
tcatagtttcagatatggta

SEQ ID NO: 268460 - DNA, 20 bp, Artificial
  CRISPR gRNA sequence
catagtttcagatatggtag

SEQ ID NO: 268461 - DNA, 20 bp, Artificial
  CRISPR gRNA sequence
atagtttcagatatggtagt

SEQ ID NO: 268462 - DNA, 20 bp, Artificial
  CRISPR gRNA sequence
cagatatggtagttatgaag

SEQ ID NO: 268463 - DNA, 20 bp, Artificial
  CRISPR gRNA sequence
agatatggtagttatgaaga

SEQ ID NO: 268464 - DNA, 20 bp, Artificial
  CRISPR gRNA sequence
tgaagaaaacaatgtcattt

SEQ ID NO: 268465 - DNA, 20 bp, Artificial
  CRISPR gRNA sequence
gctgctattattgtaagagt

SEQ ID NO: 268466 - DNA, 20 bp, Artificial
  CRISPR gRNA sequence
ctgctattattgtaagagtc

SEQ ID NO: 268467 - DNA, 20 bp, Artificial
  CRISPR gRNA sequence
ctattattgtaagagtctta

SEQ ID NO: 268468 - DNA, 20 bp, Artificial
  CRISPR gRNA sequence
ttattgtaagagtcttataa

SEQ ID NO: 268469 - DNA, 20 bp, Artificial
  CRISPR gRNA sequence
ttgtaagagtcttataatta

SEQ ID NO: 268470 - DNA, 20 bp, Artificial
  CRISPR gRNA sequence
taagagtcttataattaatg

SEQ ID NO: 268471 - DNA, 20 bp, Artificial
  CRISPR gRNA sequence
ataattaatggtactcctat

SEQ ID NO: 268472 - DNA, 20 bp, Artificial
  CRISPR gRNA sequence
taattaatggtactcctata

SEQ ID NO: 268473 - DNA, 20 bp, Artificial
  CRISPR gRNA sequence
atggtactcctataattttt

SEQ ID NO: 268474 - DNA, 20 bp, Artificial
  CRISPR gRNA sequence
ctataatttttgattgtgag

SEQ ID NO: 268475 - DNA, 20 bp, Artificial
  CRISPR gRNA sequence
taatttttgattgtgagctc

SEQ ID NO: 268476 - DNA, 20 bp, Artificial
  CRISPR gRNA sequence
ttgattgtgagctcacctat

SEQ ID NO: 268477 - DNA, 20 bp, Artificial
  CRISPR gRNA sequence
tgattgtgagctcacctatt

SEQ ID NO: 268478 - DNA, 20 bp, Artificial
  CRISPR gRNA sequence
gattgtgagctcacctattt

SEQ ID NO: 268479 - DNA, 20 bp, Artificial
  CRISPR gRNA sequence
attgtgagctcacctatttg

SEQ ID NO: 268480 - DNA, 20 bp, Artificial
  CRISPR gRNA sequence
tgagctcacctatttgggtt

SEQ ID NO: 268481 - DNA, 20 bp, Artificial
  CRISPR gRNA sequence
acctatttgggttaagcatg

SEQ ID NO: 268482 - DNA, 20 bp, Artificial
  CRISPR gRNA sequence
tttgggttaagcatgccaat

SEQ ID NO: 268483 - DNA, 20 bp, Artificial
  CRISPR gRNA sequence
gggttaagcatgccaattta

SEQ ID NO: 268484 - DNA, 20 bp, Artificial
  CRISPR gRNA sequence
ggttaagcatgccaatttaa

SEQ ID NO: 268485 - DNA, 20 bp, Artificial
  CRISPR gRNA sequence
agcatgccaatttaaagaga

SEQ ID NO: 268486 - DNA, 20 bp, Artificial
  CRISPR gRNA sequence
aaagagaccaagtgtatgta

SEQ ID NO: 268487 - DNA, 20 bp, Artificial
  CRISPR gRNA sequence
aagagaccaagtgtatgtac

SEQ ID NO: 268488 - DNA, 20 bp, Artificial
  CRISPR gRNA sequence
tgttctacatattcagtgat

SEQ ID NO: 268489 - DNA, 20 bp, Artificial
  CRISPR gRNA sequence
tacatattcagtgataaaat

SEQ ID NO: 268490 - DNA, 20 bp, Artificial
  CRISPR gRNA sequence
catattcagtgataaaatta

SEQ ID NO: 268491 - DNA, 20 bp, Artificial
  CRISPR gRNA sequence
agtgataaaattactaaact

SEQ ID NO: 268492 - DNA, 20 bp, Artificial
  CRISPR gRNA sequence
ctaaactactatatgtctgc

SEQ ID NO: 268493 - DNA, 20 bp, Artificial
  CRISPR gRNA sequence
aactactatatgtctgcttt

SEQ ID NO: 268494 - DNA, 20 bp, Artificial
  CRISPR gRNA sequence
ctatatgtctgctttaaatt

SEQ ID NO: 268495 - DNA, 20 bp, Artificial
  CRISPR gRNA sequence
tatgtctgctttaaatttgt

SEQ ID NO: 268496 - DNA, 20 bp, Artificial
  CRISPR gRNA sequence
ctttaaatttgtactttaat

SEQ ID NO: 268497 - DNA, 20 bp, Artificial
  CRISPR gRNA sequence
taaatttgtactttaatatt

SEQ ID NO: 268498 - DNA, 20 bp, Artificial
  CRISPR gRNA sequence
aaatttgtactttaatattg

SEQ ID NO: 268499 - DNA, 20 bp, Artificial
  CRISPR gRNA sequence
aatttgtactttaatattgt

SEQ ID NO: 268500 - DNA, 20 bp, Artificial
  CRISPR gRNA sequence
gtactttaatattgtctttt

SEQ ID NO: 268501 - DNA, 20 bp, Artificial
  CRISPR gRNA sequence
tactttaatattgtcttttg

SEQ ID NO: 268502 - DNA, 20 bp, Artificial
  CRISPR gRNA sequence
taatattgtcttttggtatt

SEQ ID NO: 268503 - DNA, 20 bp, Artificial
  CRISPR gRNA sequence
aatattgtcttttggtatta

SEQ ID NO: 268504 - DNA, 20 bp, Artificial
  CRISPR gRNA sequence
atattgtcttttggtattaa

SEQ ID NO: 268505 - DNA, 20 bp, Artificial
  CRISPR gRNA sequence
tcttttggtattaagaaaga

SEQ ID NO: 268506 - DNA, 20 bp, Artificial
  CRISPR gRNA sequence
ttggtattaagaaagatatg

SEQ ID NO: 268507 - DNA, 20 bp, Artificial
  CRISPR gRNA sequence
tggtattaagaaagatatgc

SEQ ID NO: 268508 - DNA, 20 bp, Artificial
  CRISPR gRNA sequence
ggtattaagaaagatatgct

SEQ ID NO: 268509 - DNA, 20 bp, Artificial
  CRISPR gRNA sequence
gtattaagaaagatatgctt

SEQ ID NO: 268510 - DNA, 20 bp, Artificial
  CRISPR gRNA sequence
agaaagatatgctttcagaa

SEQ ID NO: 268511 - DNA, 20 bp, Artificial
  CRISPR gRNA sequence
tcagaatagatatgcttcgc

SEQ ID NO: 268512 - DNA, 20 bp, Artificial
  CRISPR gRNA sequence
cagaatagatatgcttcgct

SEQ ID NO: 268513 - DNA, 20 bp, Artificial
  CRISPR gRNA sequence
agaatagatatgcttcgctt

SEQ ID NO: 268514 - DNA, 20 bp, Artificial
  CRISPR gRNA sequence
cgctttggcaaggaatttgg

SEQ ID NO: 268515 - DNA, 20 bp, Artificial
  CRISPR gRNA sequence
gctttggcaaggaatttgga

SEQ ID NO: 268516 - DNA, 20 bp, Artificial
  CRISPR gRNA sequence
tggcaaggaatttggataga

SEQ ID NO: 268517 - DNA, 20 bp, Artificial
  CRISPR gRNA sequence
ggcaaggaatttggatagaa

SEQ ID NO: 268518 - DNA, 20 bp, Artificial
  CRISPR gRNA sequence
gcaaggaatttggatagaac

SEQ ID NO: 268519 - DNA, 20 bp, Artificial
  CRISPR gRNA sequence
ggatagaacttgctatttaa

SEQ ID NO: 268520 - DNA, 20 bp, Artificial
  CRISPR gRNA sequence
gatagaacttgctatttaaa

SEQ ID NO: 268521 - DNA, 20 bp, Artificial
  CRISPR gRNA sequence
gctatttaaaagaggtgtgg

SEQ ID NO: 268522 - DNA, 20 bp, Artificial
  CRISPR gRNA sequence
ctatttaaaagaggtgtggg

SEQ ID NO: 268523 - DNA, 20 bp, Artificial
  CRISPR gRNA sequence
tttaaaagaggtgtggggta

SEQ ID NO: 268524 - DNA, 20 bp, Artificial
  CRISPR gRNA sequence
aaaagaggtgtggggtaaat

SEQ ID NO: 268525 - DNA, 20 bp, Artificial
  CRISPR gRNA sequence
aaagaggtgtggggtaaatc

SEQ ID NO: 268526 - DNA, 20 bp, Artificial
  CRISPR gRNA sequence
gtataaatctccagtttagc

SEQ ID NO: 268527 - DNA, 20 bp, Artificial
  CRISPR gRNA sequence
tataaatctccagtttagcc

SEQ ID NO: 268528 - DNA, 20 bp, Artificial
  CRISPR gRNA sequence
cagtttagccttttttgaaa

SEQ ID NO: 268529 - DNA, 20 bp, Artificial
  CRISPR gRNA sequence
agccttttttgaaaaagcta

SEQ ID NO: 268530 - DNA, 20 bp, Artificial
  CRISPR gRNA sequence
gccttttttgaaaaagctag

SEQ ID NO: 268531 - DNA, 20 bp, Artificial
  CRISPR gRNA sequence
ttttgaaaaagctagacttt

SEQ ID NO: 268532 - DNA, 20 bp, Artificial
  CRISPR gRNA sequence
tttgaaaaagctagactttc

SEQ ID NO: 268533 - DNA, 20 bp, Artificial
  CRISPR gRNA sequence
ttgaaaaagctagactttca

SEQ ID NO: 268534 - DNA, 20 bp, Artificial
  CRISPR gRNA sequence
tgaaaaagctagactttcaa

SEQ ID NO: 268535 - DNA, 20 bp, Artificial
  CRISPR gRNA sequence
gaaaaagctagactttcaaa

SEQ ID NO: 268536 - DNA, 20 bp, Artificial
  CRISPR gRNA sequence
aaaaagctagactttcaaat

SEQ ID NO: 268537 - DNA, 20 bp, Artificial
  CRISPR gRNA sequence
gactttcaaatactaatttc

SEQ ID NO: 268538 - DNA, 20 bp, Artificial
  CRISPR gRNA sequence
tcaaatactaatttcacttc

SEQ ID NO: 268539 - DNA, 20 bp, Artificial
  CRISPR gRNA sequence
caaatactaatttcacttca

SEQ ID NO: 268540 - DNA, 20 bp, Artificial
  CRISPR gRNA sequence
aaatactaatttcacttcaa

SEQ ID NO: 268541 - DNA, 20 bp, Artificial
  CRISPR gRNA sequence
atttcacttcaagcagggta

SEQ ID NO: 268542 - DNA, 20 bp, Artificial
  CRISPR gRNA sequence
cacttcaagcagggtacgtt

SEQ ID NO: 268543 - DNA, 20 bp, Artificial
  CRISPR gRNA sequence
acttcaagcagggtacgttt

SEQ ID NO: 268544 - DNA, 20 bp, Artificial
  CRISPR gRNA sequence
caagcagggtacgtttctgg

SEQ ID NO: 268545 - DNA, 20 bp, Artificial
  CRISPR gRNA sequence
aagcagggtacgtttctggt

SEQ ID NO: 268546 - DNA, 20 bp, Artificial
  CRISPR gRNA sequence
ctggtttgtttgcttgactt

SEQ ID NO: 268547 - DNA, 20 bp, Artificial
  CRISPR gRNA sequence
tggtttgtttgcttgacttc

SEQ ID NO: 268548 - DNA, 20 bp, Artificial
  CRISPR gRNA sequence
gtttgtttgcttgacttcag

SEQ ID NO: 268549 - DNA, 20 bp, Artificial
  CRISPR gRNA sequence
gtttgcttgacttcagtcac

SEQ ID NO: 268550 - DNA, 20 bp, Artificial
  CRISPR gRNA sequence
tttgcttgacttcagtcaca

SEQ ID NO: 268551 - DNA, 20 bp, Artificial
  CRISPR gRNA sequence
gcttgacttcagtcacaatt

SEQ ID NO: 268552 - DNA, 20 bp, Artificial
  CRISPR gRNA sequence
cttgacttcagtcacaattt

SEQ ID NO: 268553 - DNA, 20 bp, Artificial
  CRISPR gRNA sequence
gacttcagtcacaatttctt

SEQ ID NO: 268554 - DNA, 20 bp, Artificial
  CRISPR gRNA sequence
acttcagtcacaatttctta

SEQ ID NO: 268555 - DNA, 20 bp, Artificial
  CRISPR gRNA sequence
cagtcacaatttcttatcag

SEQ ID NO: 268556 - DNA, 20 bp, Artificial
  CRISPR gRNA sequence
agtcacaatttcttatcaga

SEQ ID NO: 268557 - DNA, 20 bp, Artificial
  CRISPR gRNA sequence
cttatcagaccaatggctga

SEQ ID NO: 268558 - DNA, 20 bp, Artificial
  CRISPR gRNA sequence
ttatcagaccaatggctgac

SEQ ID NO: 268559 - DNA, 20 bp, Artificial
  CRISPR gRNA sequence
atcagaccaatggctgacct

SEQ ID NO: 268560 - DNA, 20 bp, Artificial
  CRISPR gRNA sequence
tcagaccaatggctgacctc

SEQ ID NO: 268561 - DNA, 20 bp, Artificial
  CRISPR gRNA sequence
acctctttgagatgtcaggc

SEQ ID NO: 268562 - DNA, 20 bp, Artificial
  CRISPR gRNA sequence
tttgagatgtcaggctaggc

SEQ ID NO: 268563 - DNA, 20 bp, Artificial
  CRISPR gRNA sequence
tgagatgtcaggctaggctt

SEQ ID NO: 268564 - DNA, 20 bp, Artificial
  CRISPR gRNA sequence
gagatgtcaggctaggctta

SEQ ID NO: 268565 - DNA, 20 bp, Artificial
  CRISPR gRNA sequence
agatgtcaggctaggcttac

SEQ ID NO: 268566 - DNA, 20 bp, Artificial
  CRISPR gRNA sequence
ggcttacctatgtgttctgt

SEQ ID NO: 268567 - DNA, 20 bp, Artificial
  CRISPR gRNA sequence
acctatgtgttctgtgtcat

SEQ ID NO: 268568 - DNA, 20 bp, Artificial
  CRISPR gRNA sequence
cctatgtgttctgtgtcatg

SEQ ID NO: 268569 - DNA, 20 bp, Artificial
  CRISPR gRNA sequence
tgtgttctgtgtcatgtgaa

SEQ ID NO: 268570 - DNA, 20 bp, Artificial
  CRISPR gRNA sequence
tgtgtcatgtgaatgctgag

SEQ ID NO: 268571 - DNA, 20 bp, Artificial
  CRISPR gRNA sequence
tgtcatgtgaatgctgagaa

SEQ ID NO: 268572 - DNA, 20 bp, Artificial
  CRISPR gRNA sequence
agaagtttgacagagatcca

SEQ ID NO: 268573 - DNA, 20 bp, Artificial
  CRISPR gRNA sequence
gacagagatccaacttcagc

SEQ ID NO: 268574 - DNA, 20 bp, Artificial
  CRISPR gRNA sequence
acagagatccaacttcagcc

SEQ ID NO: 268575 - DNA, 20 bp, Artificial
  CRISPR gRNA sequence
cagccttgaccccatcagtc

SEQ ID NO: 268576 - DNA, 20 bp, Artificial
  CRISPR gRNA sequence
agccttgaccccatcagtcc

SEQ ID NO: 268577 - DNA, 20 bp, Artificial
  CRISPR gRNA sequence
gaccccatcagtccctcggg

SEQ ID NO: 268578 - DNA, 20 bp, Artificial
  CRISPR gRNA sequence
accccatcagtccctcgggt

SEQ ID NO: 268579 - DNA, 20 bp, Artificial
  CRISPR gRNA sequence
gggttaactaactgagccac

SEQ ID NO: 268580 - DNA, 20 bp, Artificial
  CRISPR gRNA sequence
actaactgagccaccggtcc

SEQ ID NO: 268581 - DNA, 20 bp, Artificial
  CRISPR gRNA sequence
actgagccaccggtcctcat

SEQ ID NO: 268582 - DNA, 20 bp, Artificial
  CRISPR gRNA sequence
agccaccggtcctcatggct

SEQ ID NO: 268583 - DNA, 20 bp, Artificial
  CRISPR gRNA sequence
atggctattttaatgagggt

SEQ ID NO: 268584 - DNA, 20 bp, Artificial
  CRISPR gRNA sequence
ttttaatgagggtattgatg

SEQ ID NO: 268585 - DNA, 20 bp, Artificial
  CRISPR gRNA sequence
taatgagggtattgatggtt

SEQ ID NO: 268586 - DNA, 20 bp, Artificial
  CRISPR gRNA sequence
aatgagggtattgatggtta

SEQ ID NO: 268587 - DNA, 20 bp, Artificial
  CRISPR gRNA sequence
atgagggtattgatggttaa

SEQ ID NO: 268588 - DNA, 20 bp, Artificial
  CRISPR gRNA sequence
atggttaaatgcatgtctga

SEQ ID NO: 268589 - DNA, 20 bp, Artificial
  CRISPR gRNA sequence
aatgcatgtctgatccctta

SEQ ID NO: 268590 - DNA, 20 bp, Artificial
  CRISPR gRNA sequence
atcccttatcccagccattt

SEQ ID NO: 268591 - DNA, 20 bp, Artificial
  CRISPR gRNA sequence
atcccagccatttgcactgc

SEQ ID NO: 268592 - DNA, 20 bp, Artificial
  CRISPR gRNA sequence
tcccagccatttgcactgcc

SEQ ID NO: 268593 - DNA, 20 bp, Artificial
  CRISPR gRNA sequence
gcactgccagctgggaacta

SEQ ID NO: 268594 - DNA, 20 bp, Artificial
  CRISPR gRNA sequence
cactgccagctgggaactat

SEQ ID NO: 268595 - DNA, 20 bp, Artificial
  CRISPR gRNA sequence
ccagctgggaactataccag

SEQ ID NO: 268596 - DNA, 20 bp, Artificial
  CRISPR gRNA sequence
ggaactataccagacctgga

SEQ ID NO: 268597 - DNA, 20 bp, Artificial
  CRISPR gRNA sequence
taccagacctggatactgat

SEQ ID NO: 268598 - DNA, 20 bp, Artificial
  CRISPR gRNA sequence
gatactgatcccaaagtgtt

SEQ ID NO: 268599 - DNA, 20 bp, Artificial
  CRISPR gRNA sequence
atcccaaagtgttaaattca

SEQ ID NO: 268600 - DNA, 20 bp, Artificial
  CRISPR gRNA sequence
aattcaactacatgctggag

SEQ ID NO: 268601 - DNA, 20 bp, Artificial
  CRISPR gRNA sequence
aactacatgctggagattag

SEQ ID NO: 268602 - DNA, 20 bp, Artificial
  CRISPR gRNA sequence
catgctggagattagagatg

SEQ ID NO: 268603 - DNA, 20 bp, Artificial
  CRISPR gRNA sequence
gagattagagatggtgccaa

SEQ ID NO: 268604 - DNA, 20 bp, Artificial
  CRISPR gRNA sequence
gagatggtgccaataaagga

SEQ ID NO: 268605 - DNA, 20 bp, Artificial
  CRISPR gRNA sequence
gattgctatagacttattaa

SEQ ID NO: 268606 - DNA, 20 bp, Artificial
  CRISPR gRNA sequence
attgctatagacttattaat

SEQ ID NO: 268607 - DNA, 20 bp, Artificial
  CRISPR gRNA sequence
ctatagacttattaataatc

SEQ ID NO: 268608 - DNA, 20 bp, Artificial
  CRISPR gRNA sequence
tagacttattaataatccag

SEQ ID NO: 268609 - DNA, 20 bp, Artificial
  CRISPR gRNA sequence
attaataatccaggtcaaag

SEQ ID NO: 268610 - DNA, 20 bp, Artificial
  CRISPR gRNA sequence
ttaataatccaggtcaaaga

SEQ ID NO: 268611 - DNA, 20 bp, Artificial
  CRISPR gRNA sequence
ataatccaggtcaaagagag

SEQ ID NO: 268612 - DNA, 20 bp, Artificial
  CRISPR gRNA sequence
tctcaagacctggggtgagg

SEQ ID NO: 268613 - DNA, 20 bp, Artificial
  CRISPR gRNA sequence
tcaagacctggggtgaggga

SEQ ID NO: 268614 - DNA, 20 bp, Artificial
  CRISPR gRNA sequence
aagacctggggtgagggagt

SEQ ID NO: 268615 - DNA, 20 bp, Artificial
  CRISPR gRNA sequence
gggtgagggagtctgtgtta

SEQ ID NO: 268616 - DNA, 20 bp, Artificial
  CRISPR gRNA sequence
tgttatctgcaaggccattt

SEQ ID NO: 268617 - DNA, 20 bp, Artificial
  CRISPR gRNA sequence
tctgcaaggccatttgaggc

SEQ ID NO: 268618 - DNA, 20 bp, Artificial
  CRISPR gRNA sequence
caaggccatttgaggctcag

SEQ ID NO: 268619 - DNA, 20 bp, Artificial
  CRISPR gRNA sequence
gaggctcagaaagtctctct

SEQ ID NO: 268620 - DNA, 20 bp, Artificial
  CRISPR gRNA sequence
aggctcagaaagtctctctt

SEQ ID NO: 268621 - DNA, 20 bp, Artificial
  CRISPR gRNA sequence
agaaagtctctctttcctat

SEQ ID NO: 268622 - DNA, 20 bp, Artificial
  CRISPR gRNA sequence
tctttcctatagatatatgc

SEQ ID NO: 268623 - DNA, 20 bp, Artificial
  CRISPR gRNA sequence
tttcctatagatatatgcat

SEQ ID NO: 268624 - DNA, 20 bp, Artificial
  CRISPR gRNA sequence
tcctatagatatatgcatac

SEQ ID NO: 268625 - DNA, 20 bp, Artificial
  CRISPR gRNA sequence
cctatagatatatgcatact

SEQ ID NO: 268626 - DNA, 20 bp, Artificial
  CRISPR gRNA sequence
ctatagatatatgcatactt

SEQ ID NO: 268627 - DNA, 20 bp, Artificial
  CRISPR gRNA sequence
tagatatatgcatactttct

SEQ ID NO: 268628 - DNA, 20 bp, Artificial
  CRISPR gRNA sequence
tctgacatataggaatgtat

SEQ ID NO: 268629 - DNA, 20 bp, Artificial
  CRISPR gRNA sequence
ctgacatataggaatgtatc

SEQ ID NO: 268630 - DNA, 20 bp, Artificial
  CRISPR gRNA sequence
tgacatataggaatgtatca

SEQ ID NO: 268631 - DNA, 20 bp, Artificial
  CRISPR gRNA sequence
acatataggaatgtatcagg

SEQ ID NO: 268632 - DNA, 20 bp, Artificial
  CRISPR gRNA sequence
aaccatcacaggcatgttcc

SEQ ID NO: 268633 - DNA, 20 bp, Artificial
  CRISPR gRNA sequence
ctacctcagggcctttacat

SEQ ID NO: 268634 - DNA, 20 bp, Artificial
  CRISPR gRNA sequence
cctcagggcctttacatgtc

SEQ ID NO: 268635 - DNA, 20 bp, Artificial
  CRISPR gRNA sequence
agggcctttacatgtcctgt

SEQ ID NO: 268636 - DNA, 20 bp, Artificial
  CRISPR gRNA sequence
tacatgtcctgtttactctg

SEQ ID NO: 268637 - DNA, 20 bp, Artificial
  CRISPR gRNA sequence
acatgtcctgtttactctgt

SEQ ID NO: 268638 - DNA, 20 bp, Artificial
  CRISPR gRNA sequence
catgtcctgtttactctgtc

SEQ ID NO: 268639 - DNA, 20 bp, Artificial
  CRISPR gRNA sequence
tttactctgtctagaatgtc

SEQ ID NO: 268640 - DNA, 20 bp, Artificial
  CRISPR gRNA sequence
actctgtctagaatgtcctt

SEQ ID NO: 268641 - DNA, 20 bp, Artificial
  CRISPR gRNA sequence
ctctgtctagaatgtccttc

SEQ ID NO: 268642 - DNA, 20 bp, Artificial
  CRISPR gRNA sequence
tgtctagaatgtccttctgt

SEQ ID NO: 268643 - DNA, 20 bp, Artificial
  CRISPR gRNA sequence
tctagaatgtccttctgtag

SEQ ID NO: 268644 - DNA, 20 bp, Artificial
  CRISPR gRNA sequence
gaatgtccttctgtagatga

SEQ ID NO: 268645 - DNA, 20 bp, Artificial
  CRISPR gRNA sequence
ctgtagatgacctggcttgc

SEQ ID NO: 268646 - DNA, 20 bp, Artificial
  CRISPR gRNA sequence
tgtagatgacctggcttgcc

SEQ ID NO: 268647 - DNA, 20 bp, Artificial
  CRISPR gRNA sequence
tagatgacctggcttgcctc

SEQ ID NO: 268648 - DNA, 20 bp, Artificial
  CRISPR gRNA sequence
gcttgcctcgtcacccttca

SEQ ID NO: 268649 - DNA, 20 bp, Artificial
  CRISPR gRNA sequence
gcctcgtcacccttcaggtc

SEQ ID NO: 268650 - DNA, 20 bp, Artificial
  CRISPR gRNA sequence
cctcgtcacccttcaggtcc

SEQ ID NO: 268651 - DNA, 20 bp, Artificial
  CRISPR gRNA sequence
gtcacccttcaggtccttgc

SEQ ID NO: 268652 - DNA, 20 bp, Artificial
  CRISPR gRNA sequence
caggtccttgctcaagtgtc

SEQ ID NO: 268653 - DNA, 20 bp, Artificial
  CRISPR gRNA sequence
aggtccttgctcaagtgtca

SEQ ID NO: 268654 - DNA, 20 bp, Artificial
  CRISPR gRNA sequence
gctcaagtgtcatcttctcc

SEQ ID NO: 268655 - DNA, 20 bp, Artificial
  CRISPR gRNA sequence
ctcaagtgtcatcttctccc

SEQ ID NO: 268656 - DNA, 20 bp, Artificial
  CRISPR gRNA sequence
aagtgtcatcttctccccta

SEQ ID NO: 268657 - DNA, 20 bp, Artificial
  CRISPR gRNA sequence
ctcccctagttaaactaccc

SEQ ID NO: 268658 - DNA, 20 bp, Artificial
  CRISPR gRNA sequence
tcccctagttaaactacccc

SEQ ID NO: 268659 - DNA, 20 bp, Artificial
  CRISPR gRNA sequence
ccctagttaaactaccccac

SEQ ID NO: 268660 - DNA, 20 bp, Artificial
  CRISPR gRNA sequence
gttaaactaccccacaccct

SEQ ID NO: 268661 - DNA, 20 bp, Artificial
  CRISPR gRNA sequence
aactaccccacaccctgtct

SEQ ID NO: 268662 - DNA, 20 bp, Artificial
  CRISPR gRNA sequence
ccccacaccctgtctgcttt

SEQ ID NO: 268663 - DNA, 20 bp, Artificial
  CRISPR gRNA sequence
tctgctttccttgcttattt

SEQ ID NO: 268664 - DNA, 20 bp, Artificial
  CRISPR gRNA sequence
ctttccttgcttatttttct

SEQ ID NO: 268665 - DNA, 20 bp, Artificial
  CRISPR gRNA sequence
tccttgcttatttttctcca

SEQ ID NO: 268666 - DNA, 20 bp, Artificial
  CRISPR gRNA sequence
ccttgcttatttttctccat

SEQ ID NO: 268667 - DNA, 20 bp, Artificial
  CRISPR gRNA sequence
cttgcttatttttctccata

SEQ ID NO: 268668 - DNA, 20 bp, Artificial
  CRISPR gRNA sequence
gcttatttttctccatagca

SEQ ID NO: 268669 - DNA, 20 bp, Artificial
  CRISPR gRNA sequence
cttatttttctccatagcat

SEQ ID NO: 268670 - DNA, 20 bp, Artificial
  CRISPR gRNA sequence
atttttctccatagcatttt

SEQ ID NO: 268671 - DNA, 20 bp, Artificial
  CRISPR gRNA sequence
tttttctccatagcatttta

SEQ ID NO: 268672 - DNA, 20 bp, Artificial
  CRISPR gRNA sequence
ttctccatagcattttacca

SEQ ID NO: 268673 - DNA, 20 bp, Artificial
  CRISPR gRNA sequence
tctccatagcattttaccat

SEQ ID NO: 268674 - DNA, 20 bp, Artificial
  CRISPR gRNA sequence
ctccatagcattttaccatc

SEQ ID NO: 268675 - DNA, 20 bp, Artificial
  CRISPR gRNA sequence
tccatagcattttaccatct

SEQ ID NO: 268676 - DNA, 20 bp, Artificial
  CRISPR gRNA sequence
catagcattttaccatctct

SEQ ID NO: 268677 - DNA, 20 bp, Artificial
  CRISPR gRNA sequence
taccatctcttacattagac

SEQ ID NO: 268678 - DNA, 20 bp, Artificial
  CRISPR gRNA sequence
accatctcttacattagaca

SEQ ID NO: 268679 - DNA, 20 bp, Artificial
  CRISPR gRNA sequence
ccatctcttacattagacat

SEQ ID NO: 268680 - DNA, 20 bp, Artificial
  CRISPR gRNA sequence
ttacattagacatttttctt

SEQ ID NO: 268681 - DNA, 20 bp, Artificial
  CRISPR gRNA sequence
acattagacatttttcttat

SEQ ID NO: 268682 - DNA, 20 bp, Artificial
  CRISPR gRNA sequence
cattagacatttttcttatt

SEQ ID NO: 268683 - DNA, 20 bp, Artificial
  CRISPR gRNA sequence
gacatttttcttatttattt

SEQ ID NO: 268684 - DNA, 20 bp, Artificial
  CRISPR gRNA sequence
ttcttatttatttgtagttt

SEQ ID NO: 268685 - DNA, 20 bp, Artificial
  CRISPR gRNA sequence
tcttatttatttgtagttta

SEQ ID NO: 268686 - DNA, 20 bp, Artificial
  CRISPR gRNA sequence
cttatttatttgtagtttat

SEQ ID NO: 268687 - DNA, 20 bp, Artificial
  CRISPR gRNA sequence
ttatttatttgtagtttata

SEQ ID NO: 268688 - DNA, 20 bp, Artificial
  CRISPR gRNA sequence
atttatttgtagtttataag

SEQ ID NO: 268689 - DNA, 20 bp, Artificial
  CRISPR gRNA sequence
tttatttgtagtttataagc

SEQ ID NO: 268690 - DNA, 20 bp, Artificial
  CRISPR gRNA sequence
atttgtagtttataagcttc

SEQ ID NO: 268691 - DNA, 20 bp, Artificial
  CRISPR gRNA sequence
tttgtagtttataagcttca

SEQ ID NO: 268692 - DNA, 20 bp, Artificial
  CRISPR gRNA sequence
gtagtttataagcttcatga

SEQ ID NO: 268693 - DNA, 20 bp, Artificial
  CRISPR gRNA sequence
tagtttataagcttcatgag

SEQ ID NO: 268694 - DNA, 20 bp, Artificial
  CRISPR gRNA sequence
ataagcttcatgaggcaagt

SEQ ID NO: 268695 - DNA, 20 bp, Artificial
  CRISPR gRNA sequence
taagcttcatgaggcaagta

SEQ ID NO: 268696 - DNA, 20 bp, Artificial
  CRISPR gRNA sequence
catgaggcaagtaactttgc

SEQ ID NO: 268697 - DNA, 20 bp, Artificial
  CRISPR gRNA sequence
atgaggcaagtaactttgct

SEQ ID NO: 268698 - DNA, 20 bp, Artificial
  CRISPR gRNA sequence
tgctttgtttcttgctgtat

SEQ ID NO: 268699 - DNA, 20 bp, Artificial
  CRISPR gRNA sequence
gctttgtttcttgctgtatc

SEQ ID NO: 268700 - DNA, 20 bp, Artificial
  CRISPR gRNA sequence
ctttgtttcttgctgtatct

SEQ ID NO: 268701 - DNA, 20 bp, Artificial
  CRISPR gRNA sequence
tgtttcttgctgtatctcca

SEQ ID NO: 268702 - DNA, 20 bp, Artificial
  CRISPR gRNA sequence
gtttcttgctgtatctccag

SEQ ID NO: 268703 - DNA, 20 bp, Artificial
  CRISPR gRNA sequence
tttcttgctgtatctccagt

SEQ ID NO: 268704 - DNA, 20 bp, Artificial
  CRISPR gRNA sequence
cttgctgtatctccagtgcc

SEQ ID NO: 268705 - DNA, 20 bp, Artificial
  CRISPR gRNA sequence
ttgctgtatctccagtgccc

SEQ ID NO: 268706 - DNA, 20 bp, Artificial
  CRISPR gRNA sequence
gctgtatctccagtgcccag

SEQ ID NO: 268707 - DNA, 20 bp, Artificial
  CRISPR gRNA sequence
ctgtatctccagtgcccaga

SEQ ID NO: 268708 - DNA, 20 bp, Artificial
  CRISPR gRNA sequence
tatctccagtgcccagagca

SEQ ID NO: 268709 - DNA, 20 bp, Artificial
  CRISPR gRNA sequence
cagtgcccagagcagtgcct

SEQ ID NO: 268710 - DNA, 20 bp, Artificial
  CRISPR gRNA sequence
gtatataataaatatttatt

SEQ ID NO: 268711 - DNA, 20 bp, Artificial
  CRISPR gRNA sequence
attgactgagtgaatgagtt

SEQ ID NO: 268712 - DNA, 20 bp, Artificial
  CRISPR gRNA sequence
ttgactgagtgaatgagttt

SEQ ID NO: 268713 - DNA, 20 bp, Artificial
  CRISPR gRNA sequence
actgagtgaatgagttttac

SEQ ID NO: 268714 - DNA, 20 bp, Artificial
  CRISPR gRNA sequence
agtgaatgagttttacatgg

SEQ ID NO: 268715 - DNA, 20 bp, Artificial
  CRISPR gRNA sequence
tacatggccttatgaattaa

SEQ ID NO: 268716 - DNA, 20 bp, Artificial
  CRISPR gRNA sequence
acatggccttatgaattaac

SEQ ID NO: 268717 - DNA, 20 bp, Artificial
  CRISPR gRNA sequence
catggccttatgaattaacg

SEQ ID NO: 268718 - DNA, 20 bp, Artificial
  CRISPR gRNA sequence
atgaattaacggtgagtcta

SEQ ID NO: 268719 - DNA, 20 bp, Artificial
  CRISPR gRNA sequence
tgaattaacggtgagtctaa

SEQ ID NO: 268720 - DNA, 20 bp, Artificial
  CRISPR gRNA sequence
acggtgagtctaaatgttat

SEQ ID NO: 268721 - DNA, 20 bp, Artificial
  CRISPR gRNA sequence
aatgttataatcatactttg

SEQ ID NO: 268722 - DNA, 20 bp, Artificial
  CRISPR gRNA sequence
taatcatactttgagaggga

SEQ ID NO: 268723 - DNA, 20 bp, Artificial
  CRISPR gRNA sequence
tgagagggagaaagccagtt

SEQ ID NO: 268724 - DNA, 20 bp, Artificial
  CRISPR gRNA sequence
gagagggagaaagccagttc

SEQ ID NO: 268725 - DNA, 20 bp, Artificial
  CRISPR gRNA sequence
agagggagaaagccagttct

SEQ ID NO: 268726 - DNA, 20 bp, Artificial
  CRISPR gRNA sequence
tattttctactttcctctta

SEQ ID NO: 268727 - DNA, 20 bp, Artificial
  CRISPR gRNA sequence
ttttctactttcctcttaag

SEQ ID NO: 268728 - DNA, 20 bp, Artificial
  CRISPR gRNA sequence
aagaggaaagtagaaaatag

SEQ ID NO: 268729 - DNA, 20 bp, Artificial
  CRISPR gRNA sequence
agaggaaagtagaaaataga

SEQ ID NO: 268730 - DNA, 20 bp, Artificial
  CRISPR gRNA sequence
gctttctccctctcaaagta

SEQ ID NO: 268731 - DNA, 20 bp, Artificial
  CRISPR gRNA sequence
tctccctctcaaagtatgat

SEQ ID NO: 268732 - DNA, 20 bp, Artificial
  CRISPR gRNA sequence
ctccctctcaaagtatgatt

SEQ ID NO: 268733 - DNA, 20 bp, Artificial
  CRISPR gRNA sequence
tccctctcaaagtatgatta

SEQ ID NO: 268734 - DNA, 20 bp, Artificial
  CRISPR gRNA sequence
cctctcaaagtatgattata

SEQ ID NO: 268735 - DNA, 20 bp, Artificial
  CRISPR gRNA sequence
tcaaagtatgattataacat

SEQ ID NO: 268736 - DNA, 20 bp, Artificial
  CRISPR gRNA sequence
aaagtatgattataacattt

SEQ ID NO: 268737 - DNA, 20 bp, Artificial
  CRISPR gRNA sequence
taacatttagactcaccgtt

SEQ ID NO: 268738 - DNA, 20 bp, Artificial
  CRISPR gRNA sequence
agactcaccgttaattcata

SEQ ID NO: 268739 - DNA, 20 bp, Artificial
  CRISPR gRNA sequence
gactcaccgttaattcataa

SEQ ID NO: 268740 - DNA, 20 bp, Artificial
  CRISPR gRNA sequence
accgttaattcataaggcca

SEQ ID NO: 268741 - DNA, 20 bp, Artificial
  CRISPR gRNA sequence
attcataaggccatgtaaaa

SEQ ID NO: 268742 - DNA, 20 bp, Artificial
  CRISPR gRNA sequence
ataaggccatgtaaaactca

SEQ ID NO: 268743 - DNA, 20 bp, Artificial
  CRISPR gRNA sequence
attcactcagtcaataaata

SEQ ID NO: 268744 - DNA, 20 bp, Artificial
  CRISPR gRNA sequence
actcagtcaataaatattta

SEQ ID NO: 268745 - DNA, 20 bp, Artificial
  CRISPR gRNA sequence
agtcaataaatatttattat

SEQ ID NO: 268746 - DNA, 20 bp, Artificial
  CRISPR gRNA sequence
attatataccaggcactgct

SEQ ID NO: 268747 - DNA, 20 bp, Artificial
  CRISPR gRNA sequence
ttatataccaggcactgctc

SEQ ID NO: 268748 - DNA, 20 bp, Artificial
  CRISPR gRNA sequence
tataccaggcactgctctgg

SEQ ID NO: 268749 - DNA, 20 bp, Artificial
  CRISPR gRNA sequence
ctctgggcactggagataca

SEQ ID NO: 268750 - DNA, 20 bp, Artificial
  CRISPR gRNA sequence
tgggcactggagatacagca

SEQ ID NO: 268751 - DNA, 20 bp, Artificial
  CRISPR gRNA sequence
ggcactggagatacagcaag

SEQ ID NO: 268752 - DNA, 20 bp, Artificial
  CRISPR gRNA sequence
gagatacagcaagaaacaaa

SEQ ID NO: 268753 - DNA, 20 bp, Artificial
  CRISPR gRNA sequence
cttgcctcatgaagcttata

SEQ ID NO: 268754 - DNA, 20 bp, Artificial
  CRISPR gRNA sequence
gcctcatgaagcttataaac

SEQ ID NO: 268755 - DNA, 20 bp, Artificial
  CRISPR gRNA sequence
cctcatgaagcttataaact

SEQ ID NO: 268756 - DNA, 20 bp, Artificial
  CRISPR gRNA sequence
atgaagcttataaactacaa

SEQ ID NO: 268757 - DNA, 20 bp, Artificial
  CRISPR gRNA sequence
ataaactacaaataaataag

SEQ ID NO: 268758 - DNA, 20 bp, Artificial
  CRISPR gRNA sequence
taaactacaaataaataaga

SEQ ID NO: 268759 - DNA, 20 bp, Artificial
  CRISPR gRNA sequence
caaataaataagaaaaatgt

SEQ ID NO: 268760 - DNA, 20 bp, Artificial
  CRISPR gRNA sequence
atgtaagagatggtaaaatg

SEQ ID NO: 268761 - DNA, 20 bp, Artificial
  CRISPR gRNA sequence
tggagaaaaataagcaagga

SEQ ID NO: 268762 - DNA, 20 bp, Artificial
  CRISPR gRNA sequence
aactaggggagaagatgaca

SEQ ID NO: 268763 - DNA, 20 bp, Artificial
  CRISPR gRNA sequence
actaggggagaagatgacac

SEQ ID NO: 268764 - DNA, 20 bp, Artificial
  CRISPR gRNA sequence
ggggagaagatgacacttga

SEQ ID NO: 268765 - DNA, 20 bp, Artificial
  CRISPR gRNA sequence
gagcaaggacctgaagggtg

SEQ ID NO: 268766 - DNA, 20 bp, Artificial
  CRISPR gRNA sequence
agcaaggacctgaagggtga

SEQ ID NO: 268767 - DNA, 20 bp, Artificial
  CRISPR gRNA sequence
aagggtgacgaggcaagcca

SEQ ID NO: 268768 - DNA, 20 bp, Artificial
  CRISPR gRNA sequence
cagaaggacattctagacag

SEQ ID NO: 268769 - DNA, 20 bp, Artificial
  CRISPR gRNA sequence
tagacagagtaaacaggaca

SEQ ID NO: 268770 - DNA, 20 bp, Artificial
  CRISPR gRNA sequence
gacagagtaaacaggacatg

SEQ ID NO: 268771 - DNA, 20 bp, Artificial
  CRISPR gRNA sequence
aggtaggaacatgcctgtga

SEQ ID NO: 268772 - DNA, 20 bp, Artificial
  CRISPR gRNA sequence
tgatggttgagtattcctga

SEQ ID NO: 268773 - DNA, 20 bp, Artificial
  CRISPR gRNA sequence
agtattcctgatacattcct

SEQ ID NO: 268774 - DNA, 20 bp, Artificial
  CRISPR gRNA sequence
ctgatacattcctatatgtc

SEQ ID NO: 268775 - DNA, 20 bp, Artificial
  CRISPR gRNA sequence
atacattcctatatgtcaga

SEQ ID NO: 268776 - DNA, 20 bp, Artificial
  CRISPR gRNA sequence
ctatatgtcagaaagtatgc

SEQ ID NO: 268777 - DNA, 20 bp, Artificial
  CRISPR gRNA sequence
tatgtcagaaagtatgcata

SEQ ID NO: 268778 - DNA, 20 bp, Artificial
  CRISPR gRNA sequence
taggaaagagagactttctg

SEQ ID NO: 268779 - DNA, 20 bp, Artificial
  CRISPR gRNA sequence
tctgagcctcaaatggcctt

SEQ ID NO: 268780 - DNA, 20 bp, Artificial
  CRISPR gRNA sequence
ctgagcctcaaatggccttg

SEQ ID NO: 268781 - DNA, 20 bp, Artificial
  CRISPR gRNA sequence
tgagcctcaaatggccttgc

SEQ ID NO: 268782 - DNA, 20 bp, Artificial
  CRISPR gRNA sequence
agcctcaaatggccttgcag

SEQ ID NO: 268783 - DNA, 20 bp, Artificial
  CRISPR gRNA sequence
aaatggccttgcagataaca

SEQ ID NO: 268784 - DNA, 20 bp, Artificial
  CRISPR gRNA sequence
gcagataacacagactccct

SEQ ID NO: 268785 - DNA, 20 bp, Artificial
  CRISPR gRNA sequence
cagataacacagactccctc

SEQ ID NO: 268786 - DNA, 20 bp, Artificial
  CRISPR gRNA sequence
cctcaccccaggtcttgaga

SEQ ID NO: 268787 - DNA, 20 bp, Artificial
  CRISPR gRNA sequence
accccaggtcttgagagagt

SEQ ID NO: 268788 - DNA, 20 bp, Artificial
  CRISPR gRNA sequence
gagagagtgtgtgtcactct

SEQ ID NO: 268789 - DNA, 20 bp, Artificial
  CRISPR gRNA sequence
agagagtgtgtgtcactctc

SEQ ID NO: 268790 - DNA, 20 bp, Artificial
  CRISPR gRNA sequence
tctttgacctggattattaa

SEQ ID NO: 268791 - DNA, 20 bp, Artificial
  CRISPR gRNA sequence
tttgacctggattattaata

SEQ ID NO: 268792 - DNA, 20 bp, Artificial
  CRISPR gRNA sequence
tgacctggattattaataag

SEQ ID NO: 268793 - DNA, 20 bp, Artificial
  CRISPR gRNA sequence
gacctggattattaataagt

SEQ ID NO: 268794 - DNA, 20 bp, Artificial
  CRISPR gRNA sequence
acctggattattaataagtc

SEQ ID NO: 268795 - DNA, 20 bp, Artificial
  CRISPR gRNA sequence
gattattaataagtctatag

SEQ ID NO: 268796 - DNA, 20 bp, Artificial
  CRISPR gRNA sequence
ttaataagtctatagcaatc

SEQ ID NO: 268797 - DNA, 20 bp, Artificial
  CRISPR gRNA sequence
ataagtctatagcaatcaag

SEQ ID NO: 268798 - DNA, 20 bp, Artificial
  CRISPR gRNA sequence
tagcaatcaagatcctggtt

SEQ ID NO: 268799 - DNA, 20 bp, Artificial
  CRISPR gRNA sequence
gttctgggtcctttattggc

SEQ ID NO: 268800 - DNA, 20 bp, Artificial
  CRISPR gRNA sequence
tgggtcctttattggcacca

SEQ ID NO: 268801 - DNA, 20 bp, Artificial
  CRISPR gRNA sequence
ggtcctttattggcaccatc

SEQ ID NO: 268802 - DNA, 20 bp, Artificial
  CRISPR gRNA sequence
tattggcaccatctctaatc

SEQ ID NO: 268803 - DNA, 20 bp, Artificial
  CRISPR gRNA sequence
attggcaccatctctaatct

SEQ ID NO: 268804 - DNA, 20 bp, Artificial
  CRISPR gRNA sequence
ttggcaccatctctaatctc

SEQ ID NO: 268805 - DNA, 20 bp, Artificial
  CRISPR gRNA sequence
gcaccatctctaatctccag

SEQ ID NO: 268806 - DNA, 20 bp, Artificial
  CRISPR gRNA sequence
taatctccagcatgtagttg

SEQ ID NO: 268807 - DNA, 20 bp, Artificial
  CRISPR gRNA sequence
atctccagcatgtagttgaa

SEQ ID NO: 268808 - DNA, 20 bp, Artificial
  CRISPR gRNA sequence
cagcatgtagttgaatttaa

SEQ ID NO: 268809 - DNA, 20 bp, Artificial
  CRISPR gRNA sequence
aatttaacactttgggatca

SEQ ID NO: 268810 - DNA, 20 bp, Artificial
  CRISPR gRNA sequence
aacactttgggatcagtatc

SEQ ID NO: 268811 - DNA, 20 bp, Artificial
  CRISPR gRNA sequence
acactttgggatcagtatcc

SEQ ID NO: 268812 - DNA, 20 bp, Artificial
  CRISPR gRNA sequence
tgggatcagtatccaggtct

SEQ ID NO: 268813 - DNA, 20 bp, Artificial
  CRISPR gRNA sequence
gggatcagtatccaggtctg

SEQ ID NO: 268814 - DNA, 20 bp, Artificial
  CRISPR gRNA sequence
ggatcagtatccaggtctgg

SEQ ID NO: 268815 - DNA, 20 bp, Artificial
  CRISPR gRNA sequence
gtatagttcccagctggcag

SEQ ID NO: 268816 - DNA, 20 bp, Artificial
  CRISPR gRNA sequence
ccagctggcagtgcaaatgg

SEQ ID NO: 268817 - DNA, 20 bp, Artificial
  CRISPR gRNA sequence
gcagtgcaaatggctgggat

SEQ ID NO: 268818 - DNA, 20 bp, Artificial
  CRISPR gRNA sequence
ggataagggatcagacatgc

SEQ ID NO: 268819 - DNA, 20 bp, Artificial
  CRISPR gRNA sequence
aaccatcaataccctcatta

SEQ ID NO: 268820 - DNA, 20 bp, Artificial
  CRISPR gRNA sequence
accatcaataccctcattaa

SEQ ID NO: 268821 - DNA, 20 bp, Artificial
  CRISPR gRNA sequence
attaaaatagccatgaggac

SEQ ID NO: 268822 - DNA, 20 bp, Artificial
  CRISPR gRNA sequence
aaatagccatgaggaccggt

SEQ ID NO: 268823 - DNA, 20 bp, Artificial
  CRISPR gRNA sequence
agttagttaacccgagggac

SEQ ID NO: 268824 - DNA, 20 bp, Artificial
  CRISPR gRNA sequence
gttaacccgagggactgatg

SEQ ID NO: 268825 - DNA, 20 bp, Artificial
  CRISPR gRNA sequence
acccgagggactgatggggt

SEQ ID NO: 268826 - DNA, 20 bp, Artificial
  CRISPR gRNA sequence
atggggtcaaggctgaagtt

SEQ ID NO: 268827 - DNA, 20 bp, Artificial
  CRISPR gRNA sequence
aagttggatctctgtcaaac

SEQ ID NO: 268828 - DNA, 20 bp, Artificial
  CRISPR gRNA sequence
gatctctgtcaaacttctca

SEQ ID NO: 268829 - DNA, 20 bp, Artificial
  CRISPR gRNA sequence
tgtcaaacttctcagcattc

SEQ ID NO: 268830 - DNA, 20 bp, Artificial
  CRISPR gRNA sequence
tcaaacttctcagcattcac

SEQ ID NO: 268831 - DNA, 20 bp, Artificial
  CRISPR gRNA sequence
ctcagcattcacatgacaca

SEQ ID NO: 268832 - DNA, 20 bp, Artificial
  CRISPR gRNA sequence
tcagcattcacatgacacag

SEQ ID NO: 268833 - DNA, 20 bp, Artificial
  CRISPR gRNA sequence
agcattcacatgacacagaa

SEQ ID NO: 268834 - DNA, 20 bp, Artificial
  CRISPR gRNA sequence
acatgacacagaacacatag

SEQ ID NO: 268835 - DNA, 20 bp, Artificial
  CRISPR gRNA sequence
gcctgacatctcaaagaggt

SEQ ID NO: 268836 - DNA, 20 bp, Artificial
  CRISPR gRNA sequence
acatctcaaagaggtcagcc

SEQ ID NO: 268837 - DNA, 20 bp, Artificial
  CRISPR gRNA sequence
aaagaggtcagccattggtc

SEQ ID NO: 268838 - DNA, 20 bp, Artificial
  CRISPR gRNA sequence
gtctgataagaaattgtgac

SEQ ID NO: 268839 - DNA, 20 bp, Artificial
  CRISPR gRNA sequence
ataagaaattgtgactgaag

SEQ ID NO: 268840 - DNA, 20 bp, Artificial
  CRISPR gRNA sequence
tgactgaagtcaagcaaaca

SEQ ID NO: 268841 - DNA, 20 bp, Artificial
  CRISPR gRNA sequence
aagtcaagcaaacaaaccag

SEQ ID NO: 268842 - DNA, 20 bp, Artificial
  CRISPR gRNA sequence
cttgaagtgaaattagtatt

SEQ ID NO: 268843 - DNA, 20 bp, Artificial
  CRISPR gRNA sequence
gaagtgaaattagtatttga

SEQ ID NO: 268844 - DNA, 20 bp, Artificial
  CRISPR gRNA sequence
aagtgaaattagtatttgaa

SEQ ID NO: 268845 - DNA, 20 bp, Artificial
  CRISPR gRNA sequence
gtatttgaaagtctagcttt

SEQ ID NO: 268846 - DNA, 20 bp, Artificial
  CRISPR gRNA sequence
gaaagtctagctttttcaaa

SEQ ID NO: 268847 - DNA, 20 bp, Artificial
  CRISPR gRNA sequence
aaagtctagctttttcaaaa

SEQ ID NO: 268848 - DNA, 20 bp, Artificial
  CRISPR gRNA sequence
gctttttcaaaaaaggctaa

SEQ ID NO: 268849 - DNA, 20 bp, Artificial
  CRISPR gRNA sequence
tttcaaaaaaggctaaactg

SEQ ID NO: 268850 - DNA, 20 bp, Artificial
  CRISPR gRNA sequence
ttcaaaaaaggctaaactgg

SEQ ID NO: 268851 - DNA, 20 bp, Artificial
  CRISPR gRNA sequence
tcaaaaaaggctaaactgga

SEQ ID NO: 268852 - DNA, 20 bp, Artificial
  CRISPR gRNA sequence
caaaaaaggctaaactggag

SEQ ID NO: 268853 - DNA, 20 bp, Artificial
  CRISPR gRNA sequence
aaaaaaggctaaactggaga

SEQ ID NO: 268854 - DNA, 20 bp, Artificial
  CRISPR gRNA sequence
aactggagatttatacaagg

SEQ ID NO: 268855 - DNA, 20 bp, Artificial
  CRISPR gRNA sequence
gagatttatacaaggattta

SEQ ID NO: 268856 - DNA, 20 bp, Artificial
  CRISPR gRNA sequence
atacaaggatttaccccaca

SEQ ID NO: 268857 - DNA, 20 bp, Artificial
  CRISPR gRNA sequence
tacaaggatttaccccacac

SEQ ID NO: 268858 - DNA, 20 bp, Artificial
  CRISPR gRNA sequence
accccacacctcttttaaat

SEQ ID NO: 268859 - DNA, 20 bp, Artificial
  CRISPR gRNA sequence
ccccacacctcttttaaata

SEQ ID NO: 268860 - DNA, 20 bp, Artificial
  CRISPR gRNA sequence
ttttaaatagcaagttctat

SEQ ID NO: 268861 - DNA, 20 bp, Artificial
  CRISPR gRNA sequence
ttaaatagcaagttctatcc

SEQ ID NO: 268862 - DNA, 20 bp, Artificial
  CRISPR gRNA sequence
taaatagcaagttctatcca

SEQ ID NO: 268863 - DNA, 20 bp, Artificial
  CRISPR gRNA sequence
aaatagcaagttctatccaa

SEQ ID NO: 268864 - DNA, 20 bp, Artificial
  CRISPR gRNA sequence
aatagcaagttctatccaaa

SEQ ID NO: 268865 - DNA, 20 bp, Artificial
  CRISPR gRNA sequence
tatccaaattccttgccaaa

SEQ ID NO: 268866 - DNA, 20 bp, Artificial
  CRISPR gRNA sequence
tccaaattccttgccaaagc

SEQ ID NO: 268867 - DNA, 20 bp, Artificial
  CRISPR gRNA sequence
cttgccaaagcgaagcatat

SEQ ID NO: 268868 - DNA, 20 bp, Artificial
  CRISPR gRNA sequence
gccaaagcgaagcatatcta

SEQ ID NO: 268869 - DNA, 20 bp, Artificial
  CRISPR gRNA sequence
ccaaagcgaagcatatctat

SEQ ID NO: 268870 - DNA, 20 bp, Artificial
  CRISPR gRNA sequence
ttctgaaagcatatctttct

SEQ ID NO: 268871 - DNA, 20 bp, Artificial
  CRISPR gRNA sequence
tgaaagcatatctttcttaa

SEQ ID NO: 268872 - DNA, 20 bp, Artificial
  CRISPR gRNA sequence
aaagcatatctttcttaata

SEQ ID NO: 268873 - DNA, 20 bp, Artificial
  CRISPR gRNA sequence
tcttaataccaaaagacaat

SEQ ID NO: 268874 - DNA, 20 bp, Artificial
  CRISPR gRNA sequence
cttaataccaaaagacaata

SEQ ID NO: 268875 - DNA, 20 bp, Artificial
  CRISPR gRNA sequence
ttaataccaaaagacaatat

SEQ ID NO: 268876 - DNA, 20 bp, Artificial
  CRISPR gRNA sequence
aataccaaaagacaatatta

SEQ ID NO: 268877 - DNA, 20 bp, Artificial
  CRISPR gRNA sequence
ataccaaaagacaatattaa

SEQ ID NO: 268878 - DNA, 20 bp, Artificial
  CRISPR gRNA sequence
aagtacaaatttaaagcaga

SEQ ID NO: 268879 - DNA, 20 bp, Artificial
  CRISPR gRNA sequence
aaagcagacatatagtagtt

SEQ ID NO: 268880 - DNA, 20 bp, Artificial
  CRISPR gRNA sequence
aagcagacatatagtagttt

SEQ ID NO: 268881 - DNA, 20 bp, Artificial
  CRISPR gRNA sequence
agtaattttatcactgaata

SEQ ID NO: 268882 - DNA, 20 bp, Artificial
  CRISPR gRNA sequence
gtaattttatcactgaatat

SEQ ID NO: 268883 - DNA, 20 bp, Artificial
  CRISPR gRNA sequence
tatcactgaatatgtagaac

SEQ ID NO: 268884 - DNA, 20 bp, Artificial
  CRISPR gRNA sequence
atcactgaatatgtagaaca

SEQ ID NO: 268885 - DNA, 20 bp, Artificial
  CRISPR gRNA sequence
tcactgaatatgtagaacat

SEQ ID NO: 268886 - DNA, 20 bp, Artificial
  CRISPR gRNA sequence
aatatgtagaacataatgta

SEQ ID NO: 268887 - DNA, 20 bp, Artificial
  CRISPR gRNA sequence
ggtctctttaaattggcatg

SEQ ID NO: 268888 - DNA, 20 bp, Artificial
  CRISPR gRNA sequence
gtctctttaaattggcatgc

SEQ ID NO: 268889 - DNA, 20 bp, Artificial
  CRISPR gRNA sequence
tttaaattggcatgcttaac

SEQ ID NO: 268890 - DNA, 20 bp, Artificial
  CRISPR gRNA sequence
taaattggcatgcttaaccc

SEQ ID NO: 268891 - DNA, 20 bp, Artificial
  CRISPR gRNA sequence
aaattggcatgcttaaccca

SEQ ID NO: 268892 - DNA, 20 bp, Artificial
  CRISPR gRNA sequence
aattggcatgcttaacccaa

SEQ ID NO: 268893 - DNA, 20 bp, Artificial
  CRISPR gRNA sequence
gcatgcttaacccaaatagg

SEQ ID NO: 268894 - DNA, 20 bp, Artificial
  CRISPR gRNA sequence
aacccaaataggtgagctca

SEQ ID NO: 268895 - DNA, 20 bp, Artificial
  CRISPR gRNA sequence
acccaaataggtgagctcac

SEQ ID NO: 268896 - DNA, 20 bp, Artificial
  CRISPR gRNA sequence
acaatcaaaaattataggag

SEQ ID NO: 268897 - DNA, 20 bp, Artificial
  CRISPR gRNA sequence
taggagtaccattaattata

SEQ ID NO: 268898 - DNA, 20 bp, Artificial
  CRISPR gRNA sequence
attataagactcttacaata

SEQ ID NO: 268899 - DNA, 20 bp, Artificial
  CRISPR gRNA sequence
taagactcttacaataatag

SEQ ID NO: 268900 - DNA, 20 bp, Artificial
  CRISPR gRNA sequence
ttacaataatagcagcaaat

SEQ ID NO: 268901 - DNA, 20 bp, Artificial
  CRISPR gRNA sequence
acaataatagcagcaaatga

SEQ ID NO: 268902 - DNA, 20 bp, Artificial
  CRISPR gRNA sequence
caataatagcagcaaatgac

SEQ ID NO: 268903 - DNA, 20 bp, Artificial
  CRISPR gRNA sequence
ttttcttcataactaccata

SEQ ID NO: 268904 - DNA, 20 bp, Artificial
  CRISPR gRNA sequence
tcttcataactaccatatct

SEQ ID NO: 268905 - DNA, 20 bp, Artificial
  CRISPR gRNA sequence
cttcataactaccatatctg

SEQ ID NO: 268906 - DNA, 20 bp, Artificial
  CRISPR gRNA sequence
ttcataactaccatatctga

SEQ ID NO: 268907 - DNA, 20 bp, Artificial
  CRISPR gRNA sequence
cataactaccatatctgaaa

SEQ ID NO: 268908 - DNA, 20 bp, Artificial
  CRISPR gRNA sequence
ataactaccatatctgaaac

SEQ ID NO: 268909 - DNA, 20 bp, Artificial
  CRISPR gRNA sequence
ccatatctgaaactatgaaa

SEQ ID NO: 268910 - DNA, 20 bp, Artificial
  CRISPR gRNA sequence
aaactatgaaagcattgctc

SEQ ID NO: 268911 - DNA, 20 bp, Artificial
  CRISPR gRNA sequence
tgaaagcattgctcctacca

SEQ ID NO: 268912 - DNA, 20 bp, Artificial
  CRISPR gRNA sequence
ctcctaccactgtttttgaa

SEQ ID NO: 268913 - DNA, 20 bp, Artificial
  CRISPR gRNA sequence
ctaccactgtttttgaacca

SEQ ID NO: 268914 - DNA, 20 bp, Artificial
  CRISPR gRNA sequence
ccactgtttttgaaccattt

SEQ ID NO: 268915 - DNA, 20 bp, Artificial
  CRISPR gRNA sequence
tttttgaaccatttcttggt

SEQ ID NO: 268916 - DNA, 20 bp, Artificial
  CRISPR gRNA sequence
ttgaaccatttcttggttca

SEQ ID NO: 268917 - DNA, 20 bp, Artificial
  CRISPR gRNA sequence
tgaaccatttcttggttcat

SEQ ID NO: 268918 - DNA, 20 bp, Artificial
  CRISPR gRNA sequence
gaaccatttcttggttcata

SEQ ID NO: 268919 - DNA, 20 bp, Artificial
  CRISPR gRNA sequence
aaccatttcttggttcatac

SEQ ID NO: 268920 - DNA, 20 bp, Artificial
  CRISPR gRNA sequence
cttggttcatactaatagtg

SEQ ID NO: 268921 - DNA, 20 bp, Artificial
  CRISPR gRNA sequence
ttggttcatactaatagtga

SEQ ID NO: 268922 - DNA, 20 bp, Artificial
  CRISPR gRNA sequence
ggttcatactaatagtgaaa

SEQ ID NO: 268923 - DNA, 20 bp, Artificial
  CRISPR gRNA sequence
gttcatactaatagtgaaaa

SEQ ID NO: 268924 - DNA, 20 bp, Artificial
  CRISPR gRNA sequence
atactaatagtgaaaacgga

SEQ ID NO: 268925 - DNA, 20 bp, Artificial
  CRISPR gRNA sequence
atagtgaaaacggacttccc

SEQ ID NO: 268926 - DNA, 20 bp, Artificial
  CRISPR gRNA sequence
ccctgtataacatttcttct

SEQ ID NO: 268927 - DNA, 20 bp, Artificial
  CRISPR gRNA sequence
cctgtataacatttcttctt

SEQ ID NO: 268928 - DNA, 20 bp, Artificial
  CRISPR gRNA sequence
tataacatttcttctttgtt

SEQ ID NO: 268929 - DNA, 20 bp, Artificial
  CRISPR gRNA sequence
cttctttgtttctgtgcaga

SEQ ID NO: 268930 - DNA, 20 bp, Artificial
  CRISPR gRNA sequence
ttctttgtttctgtgcagag

SEQ ID NO: 268931 - DNA, 20 bp, Artificial
  CRISPR gRNA sequence
ctttgtttctgtgcagagtg

SEQ ID NO: 268932 - DNA, 20 bp, Artificial
  CRISPR gRNA sequence
tttgtttctgtgcagagtga

SEQ ID NO: 268933 - DNA, 20 bp, Artificial
  CRISPR gRNA sequence
tgtttctgtgcagagtgagt

SEQ ID NO: 268934 - DNA, 20 bp, Artificial
  CRISPR gRNA sequence
gtttctgtgcagagtgagta

SEQ ID NO: 268935 - DNA, 20 bp, Artificial
  CRISPR gRNA sequence
tttctgtgcagagtgagtaa

SEQ ID NO: 268936 - DNA, 20 bp, Artificial
  CRISPR gRNA sequence
ctgtgcagagtgagtaagaa

SEQ ID NO: 268937 - DNA, 20 bp, Artificial
  CRISPR gRNA sequence
tgtgcagagtgagtaagaaa

SEQ ID NO: 268938 - DNA, 20 bp, Artificial
  CRISPR gRNA sequence
tgcagagtgagtaagaaaca

SEQ ID NO: 268939 - DNA, 20 bp, Artificial
  CRISPR gRNA sequence
aagtgtgattcatctttagt

SEQ ID NO: 268940 - DNA, 20 bp, Artificial
  CRISPR gRNA sequence
atctttagtaggcctatttt

SEQ ID NO: 268941 - DNA, 20 bp, Artificial
  CRISPR gRNA sequence
tagtaggcctatttttccag

SEQ ID NO: 268942 - DNA, 20 bp, Artificial
  CRISPR gRNA sequence
agtaggcctatttttccagt

SEQ ID NO: 268943 - DNA, 20 bp, Artificial
  CRISPR gRNA sequence
gtaggcctatttttccagtc

SEQ ID NO: 268944 - DNA, 20 bp, Artificial
  CRISPR gRNA sequence
tttttccagtcagaaaacaa

SEQ ID NO: 268945 - DNA, 20 bp, Artificial
  CRISPR gRNA sequence
ttccagtcagaaaacaaaat

SEQ ID NO: 268946 - DNA, 20 bp, Artificial
  CRISPR gRNA sequence
tccagtcagaaaacaaaatc

SEQ ID NO: 268947 - DNA, 20 bp, Artificial
  CRISPR gRNA sequence
ccagtcagaaaacaaaatca

SEQ ID NO: 268948 - DNA, 20 bp, Artificial
  CRISPR gRNA sequence
cagtcagaaaacaaaatcat

SEQ ID NO: 268949 - DNA, 20 bp, Artificial
  CRISPR gRNA sequence
attaccatagatcaagtctt

SEQ ID NO: 268950 - DNA, 20 bp, Artificial
  CRISPR gRNA sequence
ttaccatagatcaagtcttt

SEQ ID NO: 268951 - DNA, 20 bp, Artificial
  CRISPR gRNA sequence
ccatagatcaagtctttcca

SEQ ID NO: 268952 - DNA, 20 bp, Artificial
  CRISPR gRNA sequence
tccatttaaaaaaaagtatt

SEQ ID NO: 268953 - DNA, 20 bp, Artificial
  CRISPR gRNA sequence
ccatttaaaaaaaagtattt

SEQ ID NO: 268954 - DNA, 20 bp, Artificial
  CRISPR gRNA sequence
catttaaaaaaaagtattta

SEQ ID NO: 268955 - DNA, 20 bp, Artificial
  CRISPR gRNA sequence
aaaaaaaagtatttatttat

SEQ ID NO: 268956 - DNA, 20 bp, Artificial
  CRISPR gRNA sequence
aaaaaaagtatttatttatt

SEQ ID NO: 268957 - DNA, 20 bp, Artificial
  CRISPR gRNA sequence
atttatttgccactgccatt

SEQ ID NO: 268958 - DNA, 20 bp, Artificial
  CRISPR gRNA sequence
tttatttgccactgccattt

SEQ ID NO: 268959 - DNA, 20 bp, Artificial
  CRISPR gRNA sequence
atttgccactgccatttcaa

SEQ ID NO: 268960 - DNA, 20 bp, Artificial
  CRISPR gRNA sequence
tttgccactgccatttcaaa

SEQ ID NO: 268961 - DNA, 20 bp, Artificial
  CRISPR gRNA sequence
gccactgccatttcaaaaaa

SEQ ID NO: 268962 - DNA, 20 bp, Artificial
  CRISPR gRNA sequence
ccactgccatttcaaaaaac

SEQ ID NO: 268963 - DNA, 20 bp, Artificial
  CRISPR gRNA sequence
ccatttcaaaaaactctcca

SEQ ID NO: 268964 - DNA, 20 bp, Artificial
  CRISPR gRNA sequence
caaaaaactctccagctctg

SEQ ID NO: 268965 - DNA, 20 bp, Artificial
  CRISPR gRNA sequence
aaaaaactctccagctctgt

SEQ ID NO: 268966 - DNA, 20 bp, Artificial
  CRISPR gRNA sequence
tccagctctgtcattttcaa

SEQ ID NO: 268967 - DNA, 20 bp, Artificial
  CRISPR gRNA sequence
cagctctgtcattttcaaat

SEQ ID NO: 268968 - DNA, 20 bp, Artificial
  CRISPR gRNA sequence
tgtcattttcaaatacaatc

SEQ ID NO: 268969 - DNA, 20 bp, Artificial
  CRISPR gRNA sequence
tcattttcaaatacaatctg

SEQ ID NO: 268970 - DNA, 20 bp, Artificial
  CRISPR gRNA sequence
tcaaatacaatctgataact

SEQ ID NO: 268971 - DNA, 20 bp, Artificial
  CRISPR gRNA sequence
caaatacaatctgataactt

SEQ ID NO: 268972 - DNA, 20 bp, Artificial
  CRISPR gRNA sequence
aaatacaatctgataacttg

SEQ ID NO: 268973 - DNA, 20 bp, Artificial
  CRISPR gRNA sequence
ataacttggattgaagaact

SEQ ID NO: 268974 - DNA, 20 bp, Artificial
  CRISPR gRNA sequence
ggattgaagaactctgtgtg

SEQ ID NO: 268975 - DNA, 20 bp, Artificial
  CRISPR gRNA sequence
gattgaagaactctgtgtgc

SEQ ID NO: 268976 - DNA, 20 bp, Artificial
  CRISPR gRNA sequence
aagaactctgtgtgcccaag

SEQ ID NO: 268977 - DNA, 20 bp, Artificial
  CRISPR gRNA sequence
tgtgtgcccaagaagctggc

SEQ ID NO: 268978 - DNA, 20 bp, Artificial
  CRISPR gRNA sequence
tgtgcccaagaagctggcaa

SEQ ID NO: 268979 - DNA, 20 bp, Artificial
  CRISPR gRNA sequence
gcaagtggcacacgtgccag

SEQ ID NO: 268980 - DNA, 20 bp, Artificial
  CRISPR gRNA sequence
ttcagcacccaagtactgct

SEQ ID NO: 268981 - DNA, 20 bp, Artificial
  CRISPR gRNA sequence
cagcacccaagtactgctga

SEQ ID NO: 268982 - DNA, 20 bp, Artificial
  CRISPR gRNA sequence
agcacccaagtactgctgag

SEQ ID NO: 268983 - DNA, 20 bp, Artificial
  CRISPR gRNA sequence
ctgagtttgatcttcttggg

SEQ ID NO: 268984 - DNA, 20 bp, Artificial
  CRISPR gRNA sequence
agtttgatcttcttgggact

SEQ ID NO: 268985 - DNA, 20 bp, Artificial
  CRISPR gRNA sequence
gatcttcttgggactgatta

SEQ ID NO: 268986 - DNA, 20 bp, Artificial
  CRISPR gRNA sequence
atcttcttgggactgattaa

SEQ ID NO: 268987 - DNA, 20 bp, Artificial
  CRISPR gRNA sequence
cttgggactgattaaatcca

SEQ ID NO: 268988 - DNA, 20 bp, Artificial
  CRISPR gRNA sequence
ttgggactgattaaatccat

SEQ ID NO: 268989 - DNA, 20 bp, Artificial
  CRISPR gRNA sequence
gggactgattaaatccatgg

SEQ ID NO: 268990 - DNA, 20 bp, Artificial
  CRISPR gRNA sequence
ggactgattaaatccatgga

SEQ ID NO: 268991 - DNA, 20 bp, Artificial
  CRISPR gRNA sequence
attaaatccatggaatggaa

SEQ ID NO: 268992 - DNA, 20 bp, Artificial
  CRISPR gRNA sequence
aatccatggaatggaagccc

SEQ ID NO: 268993 - DNA, 20 bp, Artificial
  CRISPR gRNA sequence
aaaaatcaaccaaagtacag

SEQ ID NO: 268994 - DNA, 20 bp, Artificial
  CRISPR gRNA sequence
aaaatcaaccaaagtacagt

SEQ ID NO: 268995 - DNA, 20 bp, Artificial
  CRISPR gRNA sequence
tcgatctggaatctcaagat

SEQ ID NO: 268996 - DNA, 20 bp, Artificial
  CRISPR gRNA sequence
cgatctggaatctcaagatt

SEQ ID NO: 268997 - DNA, 20 bp, Artificial
  CRISPR gRNA sequence
gatctggaatctcaagattc

SEQ ID NO: 268998 - DNA, 20 bp, Artificial
  CRISPR gRNA sequence
gaatctcaagattcctactc

SEQ ID NO: 268999 - DNA, 20 bp, Artificial
  CRISPR gRNA sequence
aagattcctactcctccctt

SEQ ID NO: 269000 - DNA, 20 bp, Artificial
  CRISPR gRNA sequence
ctactcctcccttccttctc

SEQ ID NO: 269001 - DNA, 20 bp, Artificial
  CRISPR gRNA sequence
ctcctcccttccttctcaca

SEQ ID NO: 269002 - DNA, 20 bp, Artificial
  CRISPR gRNA sequence
ctcccttccttctcacatta

SEQ ID NO: 269003 - DNA, 20 bp, Artificial
  CRISPR gRNA sequence
ccttccttctcacattaaaa

SEQ ID NO: 269004 - DNA, 20 bp, Artificial
  CRISPR gRNA sequence
ccttctcacattaaaaaaaa

SEQ ID NO: 269005 - DNA, 20 bp, Artificial
  CRISPR gRNA sequence
cttctcacattaaaaaaaaa

SEQ ID NO: 269006 - DNA, 20 bp, Artificial
  CRISPR gRNA sequence
ctcacattaaaaaaaaatta

SEQ ID NO: 269007 - DNA, 20 bp, Artificial
  CRISPR gRNA sequence
tcacattaaaaaaaaattaa

SEQ ID NO: 269008 - DNA, 20 bp, Artificial
  CRISPR gRNA sequence
acattaaaaaaaaattaaaa

SEQ ID NO: 269009 - DNA, 20 bp, Artificial
  CRISPR gRNA sequence
aaaaaaaattaaaagacctc

SEQ ID NO: 269010 - DNA, 20 bp, Artificial
  CRISPR gRNA sequence
aaagacctctttctatacat

SEQ ID NO: 269011 - DNA, 20 bp, Artificial
  CRISPR gRNA sequence
tttctatacataaaagtggg

SEQ ID NO: 269012 - DNA, 20 bp, Artificial
  CRISPR gRNA sequence
tctatacataaaagtgggag

SEQ ID NO: 269013 - DNA, 20 bp, Artificial
  CRISPR gRNA sequence
ctatacataaaagtgggagg

SEQ ID NO: 269014 - DNA, 20 bp, Artificial
  CRISPR gRNA sequence
tatacataaaagtgggaggt

SEQ ID NO: 269015 - DNA, 20 bp, Artificial
  CRISPR gRNA sequence
tacataaaagtgggaggtgc

SEQ ID NO: 269016 - DNA, 20 bp, Artificial
  CRISPR gRNA sequence
atatttcattacaagataaa

SEQ ID NO: 269017 - DNA, 20 bp, Artificial
  CRISPR gRNA sequence
tatttcattacaagataaac

SEQ ID NO: 269018 - DNA, 20 bp, Artificial
  CRISPR gRNA sequence
cattacaagataaactattt

SEQ ID NO: 269019 - DNA, 20 bp, Artificial
  CRISPR gRNA sequence
attacaagataaactatttc

SEQ ID NO: 269020 - DNA, 20 bp, Artificial
  CRISPR gRNA sequence
caagataaactatttcaaga

SEQ ID NO: 269021 - DNA, 20 bp, Artificial
  CRISPR gRNA sequence
tttcaagaaacaggaaaatg

SEQ ID NO: 269022 - DNA, 20 bp, Artificial
  CRISPR gRNA sequence
caagaaacaggaaaatgatg

SEQ ID NO: 269023 - DNA, 20 bp, Artificial
  CRISPR gRNA sequence
aagaaacaggaaaatgatgg

SEQ ID NO: 269024 - DNA, 20 bp, Artificial
  CRISPR gRNA sequence
aaaggtcctcatattatagc

SEQ ID NO: 269025 - DNA, 20 bp, Artificial
  CRISPR gRNA sequence
atattatagcacctcatccc

SEQ ID NO: 269026 - DNA, 20 bp, Artificial
  CRISPR gRNA sequence
tagcacctcatccctgcgta

SEQ ID NO: 269027 - DNA, 20 bp, Artificial
  CRISPR gRNA sequence
atccctgcgtagtgggttta

SEQ ID NO: 269028 - DNA, 20 bp, Artificial
  CRISPR gRNA sequence
cgtagtgggtttaaatttgt

SEQ ID NO: 269029 - DNA, 20 bp, Artificial
  CRISPR gRNA sequence
aaatttgtgttacaatattc

SEQ ID NO: 269030 - DNA, 20 bp, Artificial
  CRISPR gRNA sequence
aatttgtgttacaatattcc

SEQ ID NO: 269031 - DNA, 20 bp, Artificial
  CRISPR gRNA sequence
gtgttacaatattcccccct

SEQ ID NO: 269032 - DNA, 20 bp, Artificial
  CRISPR gRNA sequence
tgttacaatattcccccctt

SEQ ID NO: 269033 - DNA, 20 bp, Artificial
  CRISPR gRNA sequence
caatattccccccttcttag

SEQ ID NO: 269034 - DNA, 20 bp, Artificial
  CRISPR gRNA sequence
cccccttcttaggctattgc

SEQ ID NO: 269035 - DNA, 20 bp, Artificial
  CRISPR gRNA sequence
cttaggctattgcccagttt

SEQ ID NO: 269036 - DNA, 20 bp, Artificial
  CRISPR gRNA sequence
ttaggctattgcccagttta

SEQ ID NO: 269037 - DNA, 20 bp, Artificial
  CRISPR gRNA sequence
aggctattgcccagtttaat

SEQ ID NO: 269038 - DNA, 20 bp, Artificial
  CRISPR gRNA sequence
ggctattgcccagtttaatt

SEQ ID NO: 269039 - DNA, 20 bp, Artificial
  CRISPR gRNA sequence
ttgcccagtttaatttttat

SEQ ID NO: 269040 - DNA, 20 bp, Artificial
  CRISPR gRNA sequence
cccagtttaatttttataca

SEQ ID NO: 269041 - DNA, 20 bp, Artificial
  CRISPR gRNA sequence
aatttttatacataatttat

SEQ ID NO: 269042 - DNA, 20 bp, Artificial
  CRISPR gRNA sequence
atttttatacataatttatc

SEQ ID NO: 269043 - DNA, 20 bp, Artificial
  CRISPR gRNA sequence
ttatacataatttatctata

SEQ ID NO: 269044 - DNA, 20 bp, Artificial
  CRISPR gRNA sequence
tatacataatttatctatat

SEQ ID NO: 269045 - DNA, 20 bp, Artificial
  CRISPR gRNA sequence
atacataatttatctatatg

SEQ ID NO: 269046 - DNA, 20 bp, Artificial
  CRISPR gRNA sequence
tacataatttatctatatgg

SEQ ID NO: 269047 - DNA, 20 bp, Artificial
  CRISPR gRNA sequence
atctatatggcaataatacc

SEQ ID NO: 269048 - DNA, 20 bp, Artificial
  CRISPR gRNA sequence
tctatatggcaataatacca

SEQ ID NO: 269049 - DNA, 20 bp, Artificial
  CRISPR gRNA sequence
tatggcaataataccaatag

SEQ ID NO: 269050 - DNA, 20 bp, Artificial
  CRISPR gRNA sequence
acattgtatgtcgggcatgc

SEQ ID NO: 269051 - DNA, 20 bp, Artificial
  CRISPR gRNA sequence
tatgtcgggcatgctactaa

SEQ ID NO: 269052 - DNA, 20 bp, Artificial
  CRISPR gRNA sequence
ctaaatgtcagggataggca

SEQ ID NO: 269053 - DNA, 20 bp, Artificial
  CRISPR gRNA sequence
aatgtcagggataggcagag

SEQ ID NO: 269054 - DNA, 20 bp, Artificial
  CRISPR gRNA sequence
gggccatgcccttatggaga

SEQ ID NO: 269055 - DNA, 20 bp, Artificial
  CRISPR gRNA sequence
ggccatgcccttatggagat

SEQ ID NO: 269056 - DNA, 20 bp, Artificial
  CRISPR gRNA sequence
atggagattatactatagga

SEQ ID NO: 269057 - DNA, 20 bp, Artificial
  CRISPR gRNA sequence
tggagattatactataggaa

SEQ ID NO: 269058 - DNA, 20 bp, Artificial
  CRISPR gRNA sequence
tactataggaagagacattt

SEQ ID NO: 269059 - DNA, 20 bp, Artificial
  CRISPR gRNA sequence
taggaagagacatttgtaac

SEQ ID NO: 269060 - DNA, 20 bp, Artificial
  CRISPR gRNA sequence
gtaaccattatctccatttt

SEQ ID NO: 269061 - DNA, 20 bp, Artificial
  CRISPR gRNA sequence
taaccattatctccatttta

SEQ ID NO: 269062 - DNA, 20 bp, Artificial
  CRISPR gRNA sequence
tctccattttatagttgaag

SEQ ID NO: 269063 - DNA, 20 bp, Artificial
  CRISPR gRNA sequence
cattttatagttgaagaacc

SEQ ID NO: 269064 - DNA, 20 bp, Artificial
  CRISPR gRNA sequence
tatagttgaagaaccatcat

SEQ ID NO: 269065 - DNA, 20 bp, Artificial
  CRISPR gRNA sequence
atagttgaagaaccatcatc

SEQ ID NO: 269066 - DNA, 20 bp, Artificial
  CRISPR gRNA sequence
tagttgaagaaccatcatct

SEQ ID NO: 269067 - DNA, 20 bp, Artificial
  CRISPR gRNA sequence
aagaaccatcatcttaggtg

SEQ ID NO: 269068 - DNA, 20 bp, Artificial
  CRISPR gRNA sequence
aggtgggcagtgacttgcct

SEQ ID NO: 269069 - DNA, 20 bp, Artificial
  CRISPR gRNA sequence
ggtgggcagtgacttgcctg

SEQ ID NO: 269070 - DNA, 20 bp, Artificial
  CRISPR gRNA sequence
gcctgaggctattcaactac

SEQ ID NO: 269071 - DNA, 20 bp, Artificial
  CRISPR gRNA sequence
cctgaggctattcaactact

SEQ ID NO: 269072 - DNA, 20 bp, Artificial
  CRISPR gRNA sequence
aggctattcaactactaacg

SEQ ID NO: 269073 - DNA, 20 bp, Artificial
  CRISPR gRNA sequence
ttcaactactaacgagactt

SEQ ID NO: 269074 - DNA, 20 bp, Artificial
  CRISPR gRNA sequence
aactactaacgagacttgaa

SEQ ID NO: 269075 - DNA, 20 bp, Artificial
  CRISPR gRNA sequence
ctaacgagacttgaaccaag

SEQ ID NO: 269076 - DNA, 20 bp, Artificial
  CRISPR gRNA sequence
acgagacttgaaccaagtct

SEQ ID NO: 269077 - DNA, 20 bp, Artificial
  CRISPR gRNA sequence
gaaccaagtctacgtgcctc

SEQ ID NO: 269078 - DNA, 20 bp, Artificial
  CRISPR gRNA sequence
aaccaagtctacgtgcctct

SEQ ID NO: 269079 - DNA, 20 bp, Artificial
  CRISPR gRNA sequence
cgtgcctctaaaacctaagc

SEQ ID NO: 269080 - DNA, 20 bp, Artificial
  CRISPR gRNA sequence
taaaacctaagctccttcaa

SEQ ID NO: 269081 - DNA, 20 bp, Artificial
  CRISPR gRNA sequence
aaacctaagctccttcaaca

SEQ ID NO: 269082 - DNA, 20 bp, Artificial
  CRISPR gRNA sequence
agctccttcaacacctgaat

SEQ ID NO: 269083 - DNA, 20 bp, Artificial
  CRISPR gRNA sequence
cttcaacacctgaattaact

SEQ ID NO: 269084 - DNA, 20 bp, Artificial
  CRISPR gRNA sequence
caacacctgaattaactgaa

SEQ ID NO: 269085 - DNA, 20 bp, Artificial
  CRISPR gRNA sequence
aacacctgaattaactgaag

SEQ ID NO: 269086 - DNA, 20 bp, Artificial
  CRISPR gRNA sequence
aattaactgaagcatgaaca

SEQ ID NO: 269087 - DNA, 20 bp, Artificial
  CRISPR gRNA sequence
actgaagcatgaacaaatgg

SEQ ID NO: 269088 - DNA, 20 bp, Artificial
  CRISPR gRNA sequence
aagcatgaacaaatggtgag

SEQ ID NO: 269089 - DNA, 20 bp, Artificial
  CRISPR gRNA sequence
aagggccattcttcaaggtc

SEQ ID NO: 269090 - DNA, 20 bp, Artificial
  CRISPR gRNA sequence
ttcaaggtccccaggcatat

SEQ ID NO: 269091 - DNA, 20 bp, Artificial
  CRISPR gRNA sequence
caaggtccccaggcatattc

SEQ ID NO: 269092 - DNA, 20 bp, Artificial
  CRISPR gRNA sequence
aaggtccccaggcatattct

SEQ ID NO: 269093 - DNA, 20 bp, Artificial
  CRISPR gRNA sequence
tagttgactcaaactgtagg

SEQ ID NO: 269094 - DNA, 20 bp, Artificial
  CRISPR gRNA sequence
gttgactcaaactgtaggta

SEQ ID NO: 269095 - DNA, 20 bp, Artificial
  CRISPR gRNA sequence
actcaaactgtaggtagaaa

SEQ ID NO: 269096 - DNA, 20 bp, Artificial
  CRISPR gRNA sequence
aaactgtaggtagaaaaata

SEQ ID NO: 269097 - DNA, 20 bp, Artificial
  CRISPR gRNA sequence
taggtagaaaaatatccatg

SEQ ID NO: 269098 - DNA, 20 bp, Artificial
  CRISPR gRNA sequence
cagggtcaggccttacccag

SEQ ID NO: 269099 - DNA, 20 bp, Artificial
  CRISPR gRNA sequence
agggtcaggccttacccagt

SEQ ID NO: 269100 - DNA, 20 bp, Artificial
  CRISPR gRNA sequence
acccagtcccttaagaactc

SEQ ID NO: 269101 - DNA, 20 bp, Artificial
  CRISPR gRNA sequence
cccagtcccttaagaactct

SEQ ID NO: 269102 - DNA, 20 bp, Artificial
  CRISPR gRNA sequence
aagaactctgatgctctctt

SEQ ID NO: 269103 - DNA, 20 bp, Artificial
  CRISPR gRNA sequence
agaactctgatgctctcttc

SEQ ID NO: 269104 - DNA, 20 bp, Artificial
  CRISPR gRNA sequence
tgatgctctcttcaaaagac

SEQ ID NO: 269105 - DNA, 20 bp, Artificial
  CRISPR gRNA sequence
atgctctcttcaaaagacac

SEQ ID NO: 269106 - DNA, 20 bp, Artificial
  CRISPR gRNA sequence
tcttcaaaagacacattcca

SEQ ID NO: 269107 - DNA, 20 bp, Artificial
  CRISPR gRNA sequence
ttcaaaagacacattccaaa

SEQ ID NO: 269108 - DNA, 20 bp, Artificial
  CRISPR gRNA sequence
caaaagacacattccaaaat

SEQ ID NO: 269109 - DNA, 20 bp, Artificial
  CRISPR gRNA sequence
aaaagacacattccaaaata

SEQ ID NO: 269110 - DNA, 20 bp, Artificial
  CRISPR gRNA sequence
caaaatactttcccatgtga

SEQ ID NO: 269111 - DNA, 20 bp, Artificial
  CRISPR gRNA sequence
tcccatgtgaatggacctcc

SEQ ID NO: 269112 - DNA, 20 bp, Artificial
  CRISPR gRNA sequence
cccatgtgaatggacctcca

SEQ ID NO: 269113 - DNA, 20 bp, Artificial
  CRISPR gRNA sequence
ccatgtgaatggacctccaa

SEQ ID NO: 269114 - DNA, 20 bp, Artificial
  CRISPR gRNA sequence
caaggtacaggagcagctga

SEQ ID NO: 269115 - DNA, 20 bp, Artificial
  CRISPR gRNA sequence
agcccagagttttggagctc

SEQ ID NO: 269116 - DNA, 20 bp, Artificial
  CRISPR gRNA sequence
tggagctctgagccctaaac

SEQ ID NO: 269117 - DNA, 20 bp, Artificial
  CRISPR gRNA sequence
ggagctctgagccctaaacc

SEQ ID NO: 269118 - DNA, 20 bp, Artificial
  CRISPR gRNA sequence
gagctctgagccctaaacca

SEQ ID NO: 269119 - DNA, 20 bp, Artificial
  CRISPR gRNA sequence
tgagccctaaaccacataaa

SEQ ID NO: 269120 - DNA, 20 bp, Artificial
  CRISPR gRNA sequence
agccctaaaccacataaagt

SEQ ID NO: 269121 - DNA, 20 bp, Artificial
  CRISPR gRNA sequence
aaccacataaagtccctgta

SEQ ID NO: 269122 - DNA, 20 bp, Artificial
  CRISPR gRNA sequence
taaaggagctctcaccaggg

SEQ ID NO: 269123 - DNA, 20 bp, Artificial
  CRISPR gRNA sequence
tcaccagggcaccttctgcc

SEQ ID NO: 269124 - DNA, 20 bp, Artificial
  CRISPR gRNA sequence
accagggcaccttctgcctg

SEQ ID NO: 269125 - DNA, 20 bp, Artificial
  CRISPR gRNA sequence
ctgcctgaccacttctggaa

SEQ ID NO: 269126 - DNA, 20 bp, Artificial
  CRISPR gRNA sequence
tgcctgaccacttctggaag

SEQ ID NO: 269127 - DNA, 20 bp, Artificial
  CRISPR gRNA sequence
cctgaccacttctggaagat

SEQ ID NO: 269128 - DNA, 20 bp, Artificial
  CRISPR gRNA sequence
accacttctggaagattgtc

SEQ ID NO: 269129 - DNA, 20 bp, Artificial
  CRISPR gRNA sequence
ctggaagattgtcacctaat

SEQ ID NO: 269130 - DNA, 20 bp, Artificial
  CRISPR gRNA sequence
tggaagattgtcacctaatg

SEQ ID NO: 269131 - DNA, 20 bp, Artificial
  CRISPR gRNA sequence
gaagattgtcacctaatgct

SEQ ID NO: 269132 - DNA, 20 bp, Artificial
  CRISPR gRNA sequence
tcacctaatgctggctatct

SEQ ID NO: 269133 - DNA, 20 bp, Artificial
  CRISPR gRNA sequence
atgctggctatctcctcagc

SEQ ID NO: 269134 - DNA, 20 bp, Artificial
  CRISPR gRNA sequence
gctatctcctcagcacatgg

SEQ ID NO: 269135 - DNA, 20 bp, Artificial
  CRISPR gRNA sequence
tctcctcagcacatggcaag

SEQ ID NO: 269136 - DNA, 20 bp, Artificial
  CRISPR gRNA sequence
ctcagcacatggcaagaatt

SEQ ID NO: 269137 - DNA, 20 bp, Artificial
  CRISPR gRNA sequence
agcacatggcaagaatttca

SEQ ID NO: 269138 - DNA, 20 bp, Artificial
  CRISPR gRNA sequence
cattactccattctattcgt

SEQ ID NO: 269139 - DNA, 20 bp, Artificial
  CRISPR gRNA sequence
attactccattctattcgtc

SEQ ID NO: 269140 - DNA, 20 bp, Artificial
  CRISPR gRNA sequence
ctccattctattcgtcctcc

SEQ ID NO: 269141 - DNA, 20 bp, Artificial
  CRISPR gRNA sequence
cattctattcgtcctccttc

SEQ ID NO: 269142 - DNA, 20 bp, Artificial
  CRISPR gRNA sequence
tattcgtcctccttccaaag

SEQ ID NO: 269143 - DNA, 20 bp, Artificial
  CRISPR gRNA sequence
ttcgtcctccttccaaagaa

SEQ ID NO: 269144 - DNA, 20 bp, Artificial
  CRISPR gRNA sequence
gtcctccttccaaagaacct

SEQ ID NO: 269145 - DNA, 20 bp, Artificial
  CRISPR gRNA sequence
cttccaaagaaccttcttgg

SEQ ID NO: 269146 - DNA, 20 bp, Artificial
  CRISPR gRNA sequence
ccaaagaaccttcttgggac

SEQ ID NO: 269147 - DNA, 20 bp, Artificial
  CRISPR gRNA sequence
caaagaaccttcttgggact

SEQ ID NO: 269148 - DNA, 20 bp, Artificial
  CRISPR gRNA sequence
cttgggactcatcctcatac

SEQ ID NO: 269149 - DNA, 20 bp, Artificial
  CRISPR gRNA sequence
ttgggactcatcctcatact

SEQ ID NO: 269150 - DNA, 20 bp, Artificial
  CRISPR gRNA sequence
gggactcatcctcatactct

SEQ ID NO: 269151 - DNA, 20 bp, Artificial
  CRISPR gRNA sequence
ggactcatcctcatactcta

SEQ ID NO: 269152 - DNA, 20 bp, Artificial
  CRISPR gRNA sequence
atcctcatactctaatgaat

SEQ ID NO: 269153 - DNA, 20 bp, Artificial
  CRISPR gRNA sequence
atactctaatgaatgctaac

SEQ ID NO: 269154 - DNA, 20 bp, Artificial
  CRISPR gRNA sequence
taatgaatgctaacatccct

SEQ ID NO: 269155 - DNA, 20 bp, Artificial
  CRISPR gRNA sequence
atgaatgctaacatcccttt

SEQ ID NO: 269156 - DNA, 20 bp, Artificial
  CRISPR gRNA sequence
acatccctttttcacagtat

SEQ ID NO: 269157 - DNA, 20 bp, Artificial
  CRISPR gRNA sequence
tttcacagtattctcacttc

SEQ ID NO: 269158 - DNA, 20 bp, Artificial
  CRISPR gRNA sequence
ttcacagtattctcacttct

SEQ ID NO: 269159 - DNA, 20 bp, Artificial
  CRISPR gRNA sequence
tcacagtattctcacttctc

SEQ ID NO: 269160 - DNA, 20 bp, Artificial
  CRISPR gRNA sequence
cacagtattctcacttctcc

SEQ ID NO: 269161 - DNA, 20 bp, Artificial
  CRISPR gRNA sequence
acagtattctcacttctcct

SEQ ID NO: 269162 - DNA, 20 bp, Artificial
  CRISPR gRNA sequence
tcacttctcctatggacgct

SEQ ID NO: 269163 - DNA, 20 bp, Artificial
  CRISPR gRNA sequence
acttctcctatggacgctct

SEQ ID NO: 269164 - DNA, 20 bp, Artificial
  CRISPR gRNA sequence
ctcctatggacgctctttcc

SEQ ID NO: 269165 - DNA, 20 bp, Artificial
  CRISPR gRNA sequence
tcctatggacgctctttcca

SEQ ID NO: 269166 - DNA, 20 bp, Artificial
  CRISPR gRNA sequence
ctatggacgctctttccaca

SEQ ID NO: 269167 - DNA, 20 bp, Artificial
  CRISPR gRNA sequence
tggacgctctttccacaacc

SEQ ID NO: 269168 - DNA, 20 bp, Artificial
  CRISPR gRNA sequence
tttccacaacccactttgga

SEQ ID NO: 269169 - DNA, 20 bp, Artificial
  CRISPR gRNA sequence
tccacaacccactttggatc

SEQ ID NO: 269170 - DNA, 20 bp, Artificial
  CRISPR gRNA sequence
ccacaacccactttggatct

SEQ ID NO: 269171 - DNA, 20 bp, Artificial
  CRISPR gRNA sequence
cacaacccactttggatctc

SEQ ID NO: 269172 - DNA, 20 bp, Artificial
  CRISPR gRNA sequence
tggatctccacaccgacatt

SEQ ID NO: 269173 - DNA, 20 bp, Artificial
  CRISPR gRNA sequence
ggatctccacaccgacatta

SEQ ID NO: 269174 - DNA, 20 bp, Artificial
  CRISPR gRNA sequence
gatctccacaccgacattaa

SEQ ID NO: 269175 - DNA, 20 bp, Artificial
  CRISPR gRNA sequence
cacaccgacattaaagagac

SEQ ID NO: 269176 - DNA, 20 bp, Artificial
  CRISPR gRNA sequence
aagagaccaactgtgcaacc

SEQ ID NO: 269177 - DNA, 20 bp, Artificial
  CRISPR gRNA sequence
tgcaaccctgaaacatatga

SEQ ID NO: 269178 - DNA, 20 bp, Artificial
  CRISPR gRNA sequence
aaacatatgaaacaggaaag

SEQ ID NO: 269179 - DNA, 20 bp, Artificial
  CRISPR gRNA sequence
ctacctggtctgattggaat

SEQ ID NO: 269180 - DNA, 20 bp, Artificial
  CRISPR gRNA sequence
cctggtctgattggaatgaa

SEQ ID NO: 269181 - DNA, 20 bp, Artificial
  CRISPR gRNA sequence
gtctgattggaatgaactgt

SEQ ID NO: 269182 - DNA, 20 bp, Artificial
  CRISPR gRNA sequence
attggaatgaactgttagac

SEQ ID NO: 269183 - DNA, 20 bp, Artificial
  CRISPR gRNA sequence
gaatgaactgttagacaaat

SEQ ID NO: 269184 - DNA, 20 bp, Artificial
  CRISPR gRNA sequence
ttagacaaataatccttcac

SEQ ID NO: 269185 - DNA, 20 bp, Artificial
  CRISPR gRNA sequence
gacaaataatccttcacagt

SEQ ID NO: 269186 - DNA, 20 bp, Artificial
  CRISPR gRNA sequence
cacagtactcaaataatttt

SEQ ID NO: 269187 - DNA, 20 bp, Artificial
  CRISPR gRNA sequence
acagtactcaaataattttg

SEQ ID NO: 269188 - DNA, 20 bp, Artificial
  CRISPR gRNA sequence
aaataattttgtggtttgtt

SEQ ID NO: 269189 - DNA, 20 bp, Artificial
  CRISPR gRNA sequence
tgtggtttgttgttgttgtt

SEQ ID NO: 269190 - DNA, 20 bp, Artificial
  CRISPR gRNA sequence
gtggtttgttgttgttgttg

SEQ ID NO: 269191 - DNA, 20 bp, Artificial
  CRISPR gRNA sequence
tggtttgttgttgttgttgt

SEQ ID NO: 269192 - DNA, 20 bp, Artificial
  CRISPR gRNA sequence
gttgttgttgttgttgttgt

SEQ ID NO: 269193 - DNA, 20 bp, Artificial
  CRISPR gRNA sequence
ttgttgttgttgttgttgtt

SEQ ID NO: 269194 - DNA, 20 bp, Artificial
  CRISPR gRNA sequence
ttgttgttgttgttgttgtt

SEQ ID NO: 269195 - DNA, 20 bp, Artificial
  CRISPR gRNA sequence
ttgttgttgttgttgttgtt

SEQ ID NO: 269196 - DNA, 20 bp, Artificial
  CRISPR gRNA sequence
ttgttgttgttgttgttgtt

SEQ ID NO: 269197 - DNA, 20 bp, Artificial
  CRISPR gRNA sequence
ttgttgttgttgttgtttga

SEQ ID NO: 269198 - DNA, 20 bp, Artificial
  CRISPR gRNA sequence
ttgttgttgttgtttgagat

SEQ ID NO: 269199 - DNA, 20 bp, Artificial
  CRISPR gRNA sequence
ttgttgttgtttgagatgga

SEQ ID NO: 269200 - DNA, 20 bp, Artificial
  CRISPR gRNA sequence
ttgttgtttgagatggagtc

SEQ ID NO: 269201 - DNA, 20 bp, Artificial
  CRISPR gRNA sequence
ttgtttgagatggagtctca

SEQ ID NO: 269202 - DNA, 20 bp, Artificial
  CRISPR gRNA sequence
tttgagatggagtctcactc

SEQ ID NO: 269203 - DNA, 20 bp, Artificial
  CRISPR gRNA sequence
gagatggagtctcactctgt

SEQ ID NO: 269204 - DNA, 20 bp, Artificial
  CRISPR gRNA sequence
agatggagtctcactctgtc

SEQ ID NO: 269205 - DNA, 20 bp, Artificial
  CRISPR gRNA sequence
actctgtcgcccaggctgga

SEQ ID NO: 269206 - DNA, 20 bp, Artificial
  CRISPR gRNA sequence
tgtcgcccaggctggagagc

SEQ ID NO: 269207 - DNA, 20 bp, Artificial
  CRISPR gRNA sequence
tcgcccaggctggagagctg

SEQ ID NO: 269208 - DNA, 20 bp, Artificial
  CRISPR gRNA sequence
gagagctgtggcactatctc

SEQ ID NO: 269209 - DNA, 20 bp, Artificial
  CRISPR gRNA sequence
tggcactatctcggctcact

SEQ ID NO: 269210 - DNA, 20 bp, Artificial
  CRISPR gRNA sequence
tctcggctcactgcaacctc

SEQ ID NO: 269211 - DNA, 20 bp, Artificial
  CRISPR gRNA sequence
ggctcactgcaacctccgcc

SEQ ID NO: 269212 - DNA, 20 bp, Artificial
  CRISPR gRNA sequence
actgcaacctccgcctgcca

SEQ ID NO: 269213 - DNA, 20 bp, Artificial
  CRISPR gRNA sequence
caacctccgcctgccaggtt

SEQ ID NO: 269214 - DNA, 20 bp, Artificial
  CRISPR gRNA sequence
cgcctgccaggttcaagcga

SEQ ID NO: 269215 - DNA, 20 bp, Artificial
  CRISPR gRNA sequence
ccaggttcaagcgattctca

SEQ ID NO: 269216 - DNA, 20 bp, Artificial
  CRISPR gRNA sequence
aagcgattctcatgcctcag

SEQ ID NO: 269217 - DNA, 20 bp, Artificial
  CRISPR gRNA sequence
tcatgcctcagcctcttggg

SEQ ID NO: 269218 - DNA, 20 bp, Artificial
  CRISPR gRNA sequence
atgcctcagcctcttgggca

SEQ ID NO: 269219 - DNA, 20 bp, Artificial
  CRISPR gRNA sequence
agcctcttgggcagctggga

SEQ ID NO: 269220 - DNA, 20 bp, Artificial
  CRISPR gRNA sequence
ttgggcagctgggattacag

SEQ ID NO: 269221 - DNA, 20 bp, Artificial
  CRISPR gRNA sequence
gggcagctgggattacaggt

SEQ ID NO: 269222 - DNA, 20 bp, Artificial
  CRISPR gRNA sequence
ggcagctgggattacaggtg

SEQ ID NO: 269223 - DNA, 20 bp, Artificial
  CRISPR gRNA sequence
ggattacaggtgcctgccac

SEQ ID NO: 269224 - DNA, 20 bp, Artificial
  CRISPR gRNA sequence
caggtgcctgccaccaggcc

SEQ ID NO: 269225 - DNA, 20 bp, Artificial
  CRISPR gRNA sequence
ccaccaggccaagctaaatt

SEQ ID NO: 269226 - DNA, 20 bp, Artificial
  CRISPR gRNA sequence
aattttgtatttttagtaca

SEQ ID NO: 269227 - DNA, 20 bp, Artificial
  CRISPR gRNA sequence
tgtatttttagtacagacgg

SEQ ID NO: 269228 - DNA, 20 bp, Artificial
  CRISPR gRNA sequence
gtatttttagtacagacgga

SEQ ID NO: 269229 - DNA, 20 bp, Artificial
  CRISPR gRNA sequence
tatttttagtacagacggag

SEQ ID NO: 269230 - DNA, 20 bp, Artificial
  CRISPR gRNA sequence
ttagtacagacggagtttca

SEQ ID NO: 269231 - DNA, 20 bp, Artificial
  CRISPR gRNA sequence
tagtacagacggagtttcac

SEQ ID NO: 269232 - DNA, 20 bp, Artificial
  CRISPR gRNA sequence
agtacagacggagtttcacc

SEQ ID NO: 269233 - DNA, 20 bp, Artificial
  CRISPR gRNA sequence
gtacagacggagtttcacca

SEQ ID NO: 269234 - DNA, 20 bp, Artificial
  CRISPR gRNA sequence
caccatcttgaccaggctgg

SEQ ID NO: 269235 - DNA, 20 bp, Artificial
  CRISPR gRNA sequence
accatcttgaccaggctggt

SEQ ID NO: 269236 - DNA, 20 bp, Artificial
  CRISPR gRNA sequence
gaccaggctggtcctgatct

SEQ ID NO: 269237 - DNA, 20 bp, Artificial
  CRISPR gRNA sequence
accaggctggtcctgatctc

SEQ ID NO: 269238 - DNA, 20 bp, Artificial
  CRISPR gRNA sequence
gtcctgatctcaagtgatct

SEQ ID NO: 269239 - DNA, 20 bp, Artificial
  CRISPR gRNA sequence
atctcaagtgatctgcccac

SEQ ID NO: 269240 - DNA, 20 bp, Artificial
  CRISPR gRNA sequence
aagtgatctgcccacctcgg

SEQ ID NO: 269241 - DNA, 20 bp, Artificial
  CRISPR gRNA sequence
cccacctcggcctcccaaag

SEQ ID NO: 269242 - DNA, 20 bp, Artificial
  CRISPR gRNA sequence
ggcctcccaaagtgctggga

SEQ ID NO: 269243 - DNA, 20 bp, Artificial
  CRISPR gRNA sequence
ccaaagtgctgggattacaa

SEQ ID NO: 269244 - DNA, 20 bp, Artificial
  CRISPR gRNA sequence
ggattacaagcatgagccac

SEQ ID NO: 269245 - DNA, 20 bp, Artificial
  CRISPR gRNA sequence
caagcatgagccactgcgcc

SEQ ID NO: 269246 - DNA, 20 bp, Artificial
  CRISPR gRNA sequence
cgccaggtcccatagtactc

SEQ ID NO: 269247 - DNA, 20 bp, Artificial
  CRISPR gRNA sequence
aaataattttgacataaagt

SEQ ID NO: 269248 - DNA, 20 bp, Artificial
  CRISPR gRNA sequence
tgacataaagtgaccttatt

SEQ ID NO: 269249 - DNA, 20 bp, Artificial
  CRISPR gRNA sequence
gacataaagtgaccttattt

SEQ ID NO: 269250 - DNA, 20 bp, Artificial
  CRISPR gRNA sequence
acataaagtgaccttatttc

SEQ ID NO: 269251 - DNA, 20 bp, Artificial
  CRISPR gRNA sequence
atttcctgacatattctttc

SEQ ID NO: 269252 - DNA, 20 bp, Artificial
  CRISPR gRNA sequence
tttcctgacatattctttct

SEQ ID NO: 269253 - DNA, 20 bp, Artificial
  CRISPR gRNA sequence
cctgacatattctttcttca

SEQ ID NO: 269254 - DNA, 20 bp, Artificial
  CRISPR gRNA sequence
ctgacatattctttcttcat

SEQ ID NO: 269255 - DNA, 20 bp, Artificial
  CRISPR gRNA sequence
acatattctttcttcatgta

SEQ ID NO: 269256 - DNA, 20 bp, Artificial
  CRISPR gRNA sequence
tttcttcatgtaggagaact

SEQ ID NO: 269257 - DNA, 20 bp, Artificial
  CRISPR gRNA sequence
tcttcatgtaggagaactat

SEQ ID NO: 269258 - DNA, 20 bp, Artificial
  CRISPR gRNA sequence
cttcatgtaggagaactatt

SEQ ID NO: 269259 - DNA, 20 bp, Artificial
  CRISPR gRNA sequence
ttcatgtaggagaactattt

SEQ ID NO: 269260 - DNA, 20 bp, Artificial
  CRISPR gRNA sequence
catgtaggagaactatttta

SEQ ID NO: 269261 - DNA, 20 bp, Artificial
  CRISPR gRNA sequence
atgtaggagaactattttat

SEQ ID NO: 269262 - DNA, 20 bp, Artificial
  CRISPR gRNA sequence
ttttattctttcgaaagtat

SEQ ID NO: 269263 - DNA, 20 bp, Artificial
  CRISPR gRNA sequence
tattctttcgaaagtatatt

SEQ ID NO: 269264 - DNA, 20 bp, Artificial
  CRISPR gRNA sequence
attctttcgaaagtatattg

SEQ ID NO: 269265 - DNA, 20 bp, Artificial
  CRISPR gRNA sequence
ttctttcgaaagtatattgt

SEQ ID NO: 269266 - DNA, 20 bp, Artificial
  CRISPR gRNA sequence
tttcgaaagtatattgtgaa

SEQ ID NO: 269267 - DNA, 20 bp, Artificial
  CRISPR gRNA sequence
tcgaaagtatattgtgaaca

SEQ ID NO: 269268 - DNA, 20 bp, Artificial
  CRISPR gRNA sequence
cgaaagtatattgtgaacat

SEQ ID NO: 269269 - DNA, 20 bp, Artificial
  CRISPR gRNA sequence
gaaagtatattgtgaacatt

SEQ ID NO: 269270 - DNA, 20 bp, Artificial
  CRISPR gRNA sequence
tgaacattaacactgaagtc

SEQ ID NO: 269271 - DNA, 20 bp, Artificial
  CRISPR gRNA sequence
acactgaagtctcatgacag

SEQ ID NO: 269272 - DNA, 20 bp, Artificial
  CRISPR gRNA sequence
aagtctcatgacagggagtg

SEQ ID NO: 269273 - DNA, 20 bp, Artificial
  CRISPR gRNA sequence
atgacagggagtgaggaaag

SEQ ID NO: 269274 - DNA, 20 bp, Artificial
  CRISPR gRNA sequence
ggtttacctgatattgcttt

SEQ ID NO: 269275 - DNA, 20 bp, Artificial
  CRISPR gRNA sequence
gtttacctgatattgctttg

SEQ ID NO: 269276 - DNA, 20 bp, Artificial
  CRISPR gRNA sequence
acctgatattgctttgaggg

SEQ ID NO: 269277 - DNA, 20 bp, Artificial
  CRISPR gRNA sequence
cctgatattgctttgaggga

SEQ ID NO: 269278 - DNA, 20 bp, Artificial
  CRISPR gRNA sequence
atattgctttgagggaatcc

SEQ ID NO: 269279 - DNA, 20 bp, Artificial
  CRISPR gRNA sequence
ctttgagggaatccctcatt

SEQ ID NO: 269280 - DNA, 20 bp, Artificial
  CRISPR gRNA sequence
tgagggaatccctcatttga

SEQ ID NO: 269281 - DNA, 20 bp, Artificial
  CRISPR gRNA sequence
gagggaatccctcatttgac

SEQ ID NO: 269282 - DNA, 20 bp, Artificial
  CRISPR gRNA sequence
agggaatccctcatttgacc

SEQ ID NO: 269283 - DNA, 20 bp, Artificial
  CRISPR gRNA sequence
atttgaccaaatccctcatt

SEQ ID NO: 269284 - DNA, 20 bp, Artificial
  CRISPR gRNA sequence
gaccaaatccctcatttggt

SEQ ID NO: 269285 - DNA, 20 bp, Artificial
  CRISPR gRNA sequence
accaaatccctcatttggtc

SEQ ID NO: 269286 - DNA, 20 bp, Artificial
  CRISPR gRNA sequence
atttggtcaaaatgactaaa

SEQ ID NO: 269287 - DNA, 20 bp, Artificial
  CRISPR gRNA sequence
ggtcaaaatgactaaatatg

SEQ ID NO: 269288 - DNA, 20 bp, Artificial
  CRISPR gRNA sequence
gtcaaaatgactaaatatga

SEQ ID NO: 269289 - DNA, 20 bp, Artificial
  CRISPR gRNA sequence
aatatgatcagaattcataa

SEQ ID NO: 269290 - DNA, 20 bp, Artificial
  CRISPR gRNA sequence
ataaaagacaatgtctatgt

SEQ ID NO: 269291 - DNA, 20 bp, Artificial
  CRISPR gRNA sequence
tgtatttctaaactaaagga

SEQ ID NO: 269292 - DNA, 20 bp, Artificial
  CRISPR gRNA sequence
ctaaactaaaggaaaacagc

SEQ ID NO: 269293 - DNA, 20 bp, Artificial
  CRISPR gRNA sequence
taaactaaaggaaaacagca

SEQ ID NO: 269294 - DNA, 20 bp, Artificial
  CRISPR gRNA sequence
aactaaaggaaaacagcatt

SEQ ID NO: 269295 - DNA, 20 bp, Artificial
  CRISPR gRNA sequence
aaggaaaacagcattaaata

SEQ ID NO: 269296 - DNA, 20 bp, Artificial
  CRISPR gRNA sequence
aataggaactacgtggctca

SEQ ID NO: 269297 - DNA, 20 bp, Artificial
  CRISPR gRNA sequence
cgtggctcatttcatgagtg

SEQ ID NO: 269298 - DNA, 20 bp, Artificial
  CRISPR gRNA sequence
atttcatgagtgggagacag

SEQ ID NO: 269299 - DNA, 20 bp, Artificial
  CRISPR gRNA sequence
catgagtgggagacagtgtt

SEQ ID NO: 269300 - DNA, 20 bp, Artificial
  CRISPR gRNA sequence
atgagtgggagacagtgttt

SEQ ID NO: 269301 - DNA, 20 bp, Artificial
  CRISPR gRNA sequence
taatggtttttaaatatgtc

SEQ ID NO: 269302 - DNA, 20 bp, Artificial
  CRISPR gRNA sequence
aatggtttttaaatatgtct

SEQ ID NO: 269303 - DNA, 20 bp, Artificial
  CRISPR gRNA sequence
atggtttttaaatatgtctt

SEQ ID NO: 269304 - DNA, 20 bp, Artificial
  CRISPR gRNA sequence
ttaaatatgtcttcctatcc

SEQ ID NO: 269305 - DNA, 20 bp, Artificial
  CRISPR gRNA sequence
taaatatgtcttcctatccc

SEQ ID NO: 269306 - DNA, 20 bp, Artificial
  CRISPR gRNA sequence
aaatatgtcttcctatccct

SEQ ID NO: 269307 - DNA, 20 bp, Artificial
  CRISPR gRNA sequence
aatatgtcttcctatccctc

SEQ ID NO: 269308 - DNA, 20 bp, Artificial
  CRISPR gRNA sequence
cctatccctccccctactct

SEQ ID NO: 269309 - DNA, 20 bp, Artificial
  CRISPR gRNA sequence
ctatccctccccctactcta

SEQ ID NO: 269310 - DNA, 20 bp, Artificial
  CRISPR gRNA sequence
tccctccccctactctaact

SEQ ID NO: 269311 - DNA, 20 bp, Artificial
  CRISPR gRNA sequence
cccctactctaacttacccc

SEQ ID NO: 269312 - DNA, 20 bp, Artificial
  CRISPR gRNA sequence
ctctaacttaccccgtttaa

SEQ ID NO: 269313 - DNA, 20 bp, Artificial
  CRISPR gRNA sequence
taacttaccccgtttaaccc

SEQ ID NO: 269314 - DNA, 20 bp, Artificial
  CRISPR gRNA sequence
acttaccccgtttaacccac

SEQ ID NO: 269315 - DNA, 20 bp, Artificial
  CRISPR gRNA sequence
accccgtttaacccactaac

SEQ ID NO: 269316 - DNA, 20 bp, Artificial
  CRISPR gRNA sequence
ccccgtttaacccactaacc

SEQ ID NO: 269317 - DNA, 20 bp, Artificial
  CRISPR gRNA sequence
aacccactaaccaaaagatt

SEQ ID NO: 269318 - DNA, 20 bp, Artificial
  CRISPR gRNA sequence
acccactaaccaaaagatta

SEQ ID NO: 269319 - DNA, 20 bp, Artificial
  CRISPR gRNA sequence
accaaaagattaaacaccca

SEQ ID NO: 269320 - DNA, 20 bp, Artificial
  CRISPR gRNA sequence
aacacccatttaaccaaaag

SEQ ID NO: 269321 - DNA, 20 bp, Artificial
  CRISPR gRNA sequence
aaccaaaaggaatgatttcc

SEQ ID NO: 269322 - DNA, 20 bp, Artificial
  CRISPR gRNA sequence
accaaaaggaatgatttcct

SEQ ID NO: 269323 - DNA, 20 bp, Artificial
  CRISPR gRNA sequence
cctagcctttcttctgcaac

SEQ ID NO: 269324 - DNA, 20 bp, Artificial
  CRISPR gRNA sequence
ctagcctttcttctgcaact

SEQ ID NO: 269325 - DNA, 20 bp, Artificial
  CRISPR gRNA sequence
gcctttcttctgcaactaaa

SEQ ID NO: 269326 - DNA, 20 bp, Artificial
  CRISPR gRNA sequence
tcttctgcaactaaaatgtc

SEQ ID NO: 269327 - DNA, 20 bp, Artificial
  CRISPR gRNA sequence
cttctgcaactaaaatgtct

SEQ ID NO: 269328 - DNA, 20 bp, Artificial
  CRISPR gRNA sequence
ttctgcaactaaaatgtctg

SEQ ID NO: 269329 - DNA, 20 bp, Artificial
  CRISPR gRNA sequence
ctgcaactaaaatgtctgtg

SEQ ID NO: 269330 - DNA, 20 bp, Artificial
  CRISPR gRNA sequence
tgcaactaaaatgtctgtgg

SEQ ID NO: 269331 - DNA, 20 bp, Artificial
  CRISPR gRNA sequence
caactaaaatgtctgtggat

SEQ ID NO: 269332 - DNA, 20 bp, Artificial
  CRISPR gRNA sequence
aaatgtctgtggataccaca

SEQ ID NO: 269333 - DNA, 20 bp, Artificial
  CRISPR gRNA sequence
tggataccacactttgcttg

SEQ ID NO: 269334 - DNA, 20 bp, Artificial
  CRISPR gRNA sequence
tgcttgactgagatgtgcag

SEQ ID NO: 269335 - DNA, 20 bp, Artificial
  CRISPR gRNA sequence
gcttgactgagatgtgcagg

SEQ ID NO: 269336 - DNA, 20 bp, Artificial
  CRISPR gRNA sequence
cttgactgagatgtgcaggt

SEQ ID NO: 269337 - DNA, 20 bp, Artificial
  CRISPR gRNA sequence
gactgagatgtgcaggtgag

SEQ ID NO: 269338 - DNA, 20 bp, Artificial
  CRISPR gRNA sequence
actgagatgtgcaggtgagt

SEQ ID NO: 269339 - DNA, 20 bp, Artificial
  CRISPR gRNA sequence
agatgtgcaggtgagtgaga

SEQ ID NO: 269340 - DNA, 20 bp, Artificial
  CRISPR gRNA sequence
ccagaatccactcccttttt

SEQ ID NO: 269341 - DNA, 20 bp, Artificial
  CRISPR gRNA sequence
cctttttgttttctacccta

SEQ ID NO: 269342 - DNA, 20 bp, Artificial
  CRISPR gRNA sequence
tttgttttctaccctaactt

SEQ ID NO: 269343 - DNA, 20 bp, Artificial
  CRISPR gRNA sequence
ttgttttctaccctaacttc

SEQ ID NO: 269344 - DNA, 20 bp, Artificial
  CRISPR gRNA sequence
tgttttctaccctaacttct

SEQ ID NO: 269345 - DNA, 20 bp, Artificial
  CRISPR gRNA sequence
gttttctaccctaacttctc

SEQ ID NO: 269346 - DNA, 20 bp, Artificial
  CRISPR gRNA sequence
ttttctaccctaacttctca

SEQ ID NO: 269347 - DNA, 20 bp, Artificial
  CRISPR gRNA sequence
tctaccctaacttctcagtc

SEQ ID NO: 269348 - DNA, 20 bp, Artificial
  CRISPR gRNA sequence
ctaccctaacttctcagtca

SEQ ID NO: 269349 - DNA, 20 bp, Artificial
  CRISPR gRNA sequence
taccctaacttctcagtcaa

SEQ ID NO: 269350 - DNA, 20 bp, Artificial
  CRISPR gRNA sequence
ccctaacttctcagtcaagt

SEQ ID NO: 269351 - DNA, 20 bp, Artificial
  CRISPR gRNA sequence
acttctcagtcaagtcacta

SEQ ID NO: 269352 - DNA, 20 bp, Artificial
  CRISPR gRNA sequence
ctcagtcaagtcactaagta

SEQ ID NO: 269353 - DNA, 20 bp, Artificial
  CRISPR gRNA sequence
tcagtcaagtcactaagtac

SEQ ID NO: 269354 - DNA, 20 bp, Artificial
  CRISPR gRNA sequence
agtcaagtcactaagtacat

SEQ ID NO: 269355 - DNA, 20 bp, Artificial
  CRISPR gRNA sequence
agtacatggtaagttggaat

SEQ ID NO: 269356 - DNA, 20 bp, Artificial
  CRISPR gRNA sequence
gaatgtgggccatggcactg

SEQ ID NO: 269357 - DNA, 20 bp, Artificial
  CRISPR gRNA sequence
taagacttggcctgtcacag

SEQ ID NO: 269358 - DNA, 20 bp, Artificial
  CRISPR gRNA sequence
ggcctgtcacaggaaatctc

SEQ ID NO: 269359 - DNA, 20 bp, Artificial
  CRISPR gRNA sequence
gcctgtcacaggaaatctct

SEQ ID NO: 269360 - DNA, 20 bp, Artificial
  CRISPR gRNA sequence
tcacaggaaatctcttttac

SEQ ID NO: 269361 - DNA, 20 bp, Artificial
  CRISPR gRNA sequence
ttttacttcatttcagagtc

SEQ ID NO: 269362 - DNA, 20 bp, Artificial
  CRISPR gRNA sequence
ttacttcatttcagagtctc

SEQ ID NO: 269363 - DNA, 20 bp, Artificial
  CRISPR gRNA sequence
tacttcatttcagagtctca

SEQ ID NO: 269364 - DNA, 20 bp, Artificial
  CRISPR gRNA sequence
acttcatttcagagtctcaa

SEQ ID NO: 269365 - DNA, 20 bp, Artificial
  CRISPR gRNA sequence
cttcatttcagagtctcaaa

SEQ ID NO: 269366 - DNA, 20 bp, Artificial
  CRISPR gRNA sequence
catttcagagtctcaaaatg

SEQ ID NO: 269367 - DNA, 20 bp, Artificial
  CRISPR gRNA sequence
atttcagagtctcaaaatga

SEQ ID NO: 269368 - DNA, 20 bp, Artificial
  CRISPR gRNA sequence
cagagtctcaaaatgatctt

SEQ ID NO: 269369 - DNA, 20 bp, Artificial
  CRISPR gRNA sequence
agagtctcaaaatgatcttg

SEQ ID NO: 269370 - DNA, 20 bp, Artificial
  CRISPR gRNA sequence
aaaatgatcttgatatttgg

SEQ ID NO: 269371 - DNA, 20 bp, Artificial
  CRISPR gRNA sequence
gatatttggtctagtcactc

SEQ ID NO: 269372 - DNA, 20 bp, Artificial
  CRISPR gRNA sequence
atatttggtctagtcactcg

SEQ ID NO: 269373 - DNA, 20 bp, Artificial
  CRISPR gRNA sequence
ggtctagtcactcgagaaaa

SEQ ID NO: 269374 - DNA, 20 bp, Artificial
  CRISPR gRNA sequence
gtctagtcactcgagaaaaa

SEQ ID NO: 269375 - DNA, 20 bp, Artificial
  CRISPR gRNA sequence
gtcactcgagaaaaattggc

SEQ ID NO: 269376 - DNA, 20 bp, Artificial
  CRISPR gRNA sequence
gagaaaaattggcattggtg

SEQ ID NO: 269377 - DNA, 20 bp, Artificial
  CRISPR gRNA sequence
gcattggtggcccaacaggg

SEQ ID NO: 269378 - DNA, 20 bp, Artificial
  CRISPR gRNA sequence
gtggcccaacaggggcctga

SEQ ID NO: 269379 - DNA, 20 bp, Artificial
  CRISPR gRNA sequence
aggtggccggctggagatgg

SEQ ID NO: 269380 - DNA, 20 bp, Artificial
  CRISPR gRNA sequence
gagatggcggtcatttccta

SEQ ID NO: 269381 - DNA, 20 bp, Artificial
  CRISPR gRNA sequence
cctatccagagcagtgatat

SEQ ID NO: 269382 - DNA, 20 bp, Artificial
  CRISPR gRNA sequence
ctatccagagcagtgatatt

SEQ ID NO: 269383 - DNA, 20 bp, Artificial
  CRISPR gRNA sequence
tccagagcagtgatattgag

SEQ ID NO: 269384 - DNA, 20 bp, Artificial
  CRISPR gRNA sequence
agcagatgggggctgccagc

SEQ ID NO: 269385 - DNA, 20 bp, Artificial
  CRISPR gRNA sequence
ccagccggctggcttctgga

SEQ ID NO: 269386 - DNA, 20 bp, Artificial
  CRISPR gRNA sequence
gcttctggataggcgtccgt

SEQ ID NO: 269387 - DNA, 20 bp, Artificial
  CRISPR gRNA sequence
ctggataggcgtccgtgtca

SEQ ID NO: 269388 - DNA, 20 bp, Artificial
  CRISPR gRNA sequence
tggataggcgtccgtgtcag

SEQ ID NO: 269389 - DNA, 20 bp, Artificial
  CRISPR gRNA sequence
gataggcgtccgtgtcagga

SEQ ID NO: 269390 - DNA, 20 bp, Artificial
  CRISPR gRNA sequence
cgaagtcgcgtggtggggca

SEQ ID NO: 269391 - DNA, 20 bp, Artificial
  CRISPR gRNA sequence
gtaatgcttgcgggtgggcc

SEQ ID NO: 269392 - DNA, 20 bp, Artificial
  CRISPR gRNA sequence
gcgggtgggcccggggcggc

SEQ ID NO: 269393 - DNA, 20 bp, Artificial
  CRISPR gRNA sequence
cgggtgggcccggggcggcg

SEQ ID NO: 269394 - DNA, 20 bp, Artificial
  CRISPR gRNA sequence
atgtagtcactgtgcaggag

SEQ ID NO: 269395 - DNA, 20 bp, Artificial
  CRISPR gRNA sequence
tgcaggagcctgctcctctt

SEQ ID NO: 269396 - DNA, 20 bp, Artificial
  CRISPR gRNA sequence
ctcctcttactcctcacctg

SEQ ID NO: 269397 - DNA, 20 bp, Artificial
  CRISPR gRNA sequence
ctcttactcctcacctgcag

SEQ ID NO: 269398 - DNA, 20 bp, Artificial
  CRISPR gRNA sequence
ttactcctcacctgcaggaa

SEQ ID NO: 269399 - DNA, 20 bp, Artificial
  CRISPR gRNA sequence
actcctcacctgcaggaaag

SEQ ID NO: 269400 - DNA, 20 bp, Artificial
  CRISPR gRNA sequence
ctcctcacctgcaggaaaga

SEQ ID NO: 269401 - DNA, 20 bp, Artificial
  CRISPR gRNA sequence
ctcacctgcaggaaagagaa

SEQ ID NO: 269402 - DNA, 20 bp, Artificial
  CRISPR gRNA sequence
acctgcaggaaagagaagtg

SEQ ID NO: 269403 - DNA, 20 bp, Artificial
  CRISPR gRNA sequence
caggaaagagaagtgtcagt

SEQ ID NO: 269404 - DNA, 20 bp, Artificial
  CRISPR gRNA sequence
taagactgtgggcacaacta

SEQ ID NO: 269405 - DNA, 20 bp, Artificial
  CRISPR gRNA sequence
agactgtgggcacaactatt

SEQ ID NO: 269406 - DNA, 20 bp, Artificial
  CRISPR gRNA sequence
tgggcacaactattcataat

SEQ ID NO: 269407 - DNA, 20 bp, Artificial
  CRISPR gRNA sequence
ttcataatattaactgtcaa

SEQ ID NO: 269408 - DNA, 20 bp, Artificial
  CRISPR gRNA sequence
ataatattaactgtcaaatg

SEQ ID NO: 269409 - DNA, 20 bp, Artificial
  CRISPR gRNA sequence
actgtcaaatgacagagaca

SEQ ID NO: 269410 - DNA, 20 bp, Artificial
  CRISPR gRNA sequence
tcaaatgacagagacactaa

SEQ ID NO: 269411 - DNA, 20 bp, Artificial
  CRISPR gRNA sequence
aaacactaaccttttttgag

SEQ ID NO: 269412 - DNA, 20 bp, Artificial
  CRISPR gRNA sequence
accttttttgagcaccttgg

SEQ ID NO: 269413 - DNA, 20 bp, Artificial
  CRISPR gRNA sequence
ttttgagcaccttggacttg

SEQ ID NO: 269414 - DNA, 20 bp, Artificial
  CRISPR gRNA sequence
tttgagcaccttggacttgg

SEQ ID NO: 269415 - DNA, 20 bp, Artificial
  CRISPR gRNA sequence
ttgagcaccttggacttggg

SEQ ID NO: 269416 - DNA, 20 bp, Artificial
  CRISPR gRNA sequence
tgagcaccttggacttgggt

SEQ ID NO: 269417 - DNA, 20 bp, Artificial
  CRISPR gRNA sequence
gagcaccttggacttgggta

SEQ ID NO: 269418 - DNA, 20 bp, Artificial
  CRISPR gRNA sequence
agcaccttggacttgggtaa

SEQ ID NO: 269419 - DNA, 20 bp, Artificial
  CRISPR gRNA sequence
ggacttgggtaatgactaat

SEQ ID NO: 269420 - DNA, 20 bp, Artificial
  CRISPR gRNA sequence
gacttgggtaatgactaatc

SEQ ID NO: 269421 - DNA, 20 bp, Artificial
  CRISPR gRNA sequence
gggtaatgactaatcacacc

SEQ ID NO: 269422 - DNA, 20 bp, Artificial
  CRISPR gRNA sequence
ggtaatgactaatcacaccc

SEQ ID NO: 269423 - DNA, 20 bp, Artificial
  CRISPR gRNA sequence
atcacacccaactactgact

SEQ ID NO: 269424 - DNA, 20 bp, Artificial
  CRISPR gRNA sequence
ctgactcttcacattgaact

SEQ ID NO: 269425 - DNA, 20 bp, Artificial
  CRISPR gRNA sequence
actcttcacattgaacttga

SEQ ID NO: 269426 - DNA, 20 bp, Artificial
  CRISPR gRNA sequence
ttcacattgaacttgaaaaa

SEQ ID NO: 269427 - DNA, 20 bp, Artificial
  CRISPR gRNA sequence
cacattgaacttgaaaaatc

SEQ ID NO: 269428 - DNA, 20 bp, Artificial
  CRISPR gRNA sequence
acattgaacttgaaaaatct

SEQ ID NO: 269429 - DNA, 20 bp, Artificial
  CRISPR gRNA sequence
aacttgaaaaatctcaaaga

SEQ ID NO: 269430 - DNA, 20 bp, Artificial
  CRISPR gRNA sequence
gaaaaatctcaaagaaagta

SEQ ID NO: 269431 - DNA, 20 bp, Artificial
  CRISPR gRNA sequence
aaaaatctcaaagaaagtat

SEQ ID NO: 269432 - DNA, 20 bp, Artificial
  CRISPR gRNA sequence
aaagaaagtattttagagaa

SEQ ID NO: 269433 - DNA, 20 bp, Artificial
  CRISPR gRNA sequence
tagagaaatgcatccctgtt

SEQ ID NO: 269434 - DNA, 20 bp, Artificial
  CRISPR gRNA sequence
agagaaatgcatccctgtta

SEQ ID NO: 269435 - DNA, 20 bp, Artificial
  CRISPR gRNA sequence
gagaaatgcatccctgttac

SEQ ID NO: 269436 - DNA, 20 bp, Artificial
  CRISPR gRNA sequence
ttactctcaatgctgtcatc

SEQ ID NO: 269437 - DNA, 20 bp, Artificial
  CRISPR gRNA sequence
ctctcaatgctgtcatctga

SEQ ID NO: 269438 - DNA, 20 bp, Artificial
  CRISPR gRNA sequence
tcaatgctgtcatctgacct

SEQ ID NO: 269439 - DNA, 20 bp, Artificial
  CRISPR gRNA sequence
aatgctgtcatctgacctga

SEQ ID NO: 269440 - DNA, 20 bp, Artificial
  CRISPR gRNA sequence
tcatctgacctgaattaaaa

SEQ ID NO: 269441 - DNA, 20 bp, Artificial
  CRISPR gRNA sequence
acctgaattaaaaatgcaca

SEQ ID NO: 269442 - DNA, 20 bp, Artificial
  CRISPR gRNA sequence
aattaaaaatgcacactaat

SEQ ID NO: 269443 - DNA, 20 bp, Artificial
  CRISPR gRNA sequence
aaaatgcacactaattaaca

SEQ ID NO: 269444 - DNA, 20 bp, Artificial
  CRISPR gRNA sequence
attaacatatccactgttga

SEQ ID NO: 269445 - DNA, 20 bp, Artificial
  CRISPR gRNA sequence
acatatccactgttgatatg

SEQ ID NO: 269446 - DNA, 20 bp, Artificial
  CRISPR gRNA sequence
ttgatatgtaaatacacttg

SEQ ID NO: 269447 - DNA, 20 bp, Artificial
  CRISPR gRNA sequence
atatgtaaatacacttgaag

SEQ ID NO: 269448 - DNA, 20 bp, Artificial
  CRISPR gRNA sequence
gaaggcccttcctcctttga

SEQ ID NO: 269449 - DNA, 20 bp, Artificial
  CRISPR gRNA sequence
aaggcccttcctcctttgac

SEQ ID NO: 269450 - DNA, 20 bp, Artificial
  CRISPR gRNA sequence
cctcctttgactaggttaag

SEQ ID NO: 269451 - DNA, 20 bp, Artificial
  CRISPR gRNA sequence
ctcctttgactaggttaagc

SEQ ID NO: 269452 - DNA, 20 bp, Artificial
  CRISPR gRNA sequence
ctttgactaggttaagccta

SEQ ID NO: 269453 - DNA, 20 bp, Artificial
  CRISPR gRNA sequence
tgactaggttaagcctaccc

SEQ ID NO: 269454 - DNA, 20 bp, Artificial
  CRISPR gRNA sequence
gactaggttaagcctaccca

SEQ ID NO: 269455 - DNA, 20 bp, Artificial
  CRISPR gRNA sequence
actaggttaagcctacccac

SEQ ID NO: 269456 - DNA, 20 bp, Artificial
  CRISPR gRNA sequence
ggttaagcctacccacattg

SEQ ID NO: 269457 - DNA, 20 bp, Artificial
  CRISPR gRNA sequence
agcctacccacattgtgatc

SEQ ID NO: 269458 - DNA, 20 bp, Artificial
  CRISPR gRNA sequence
cccacattgtgatcttctta

SEQ ID NO: 269459 - DNA, 20 bp, Artificial
  CRISPR gRNA sequence
tgatcttcttacattagcat

SEQ ID NO: 269460 - DNA, 20 bp, Artificial
  CRISPR gRNA sequence
cttacattagcatttgctta

SEQ ID NO: 269461 - DNA, 20 bp, Artificial
  CRISPR gRNA sequence
ttacattagcatttgcttaa

SEQ ID NO: 269462 - DNA, 20 bp, Artificial
  CRISPR gRNA sequence
acattagcatttgcttaaca

SEQ ID NO: 269463 - DNA, 20 bp, Artificial
  CRISPR gRNA sequence
cattagcatttgcttaacaa

SEQ ID NO: 269464 - DNA, 20 bp, Artificial
  CRISPR gRNA sequence
gcatttgcttaacaagctgt

SEQ ID NO: 269465 - DNA, 20 bp, Artificial
  CRISPR gRNA sequence
gcttaacaagctgtttttcc

SEQ ID NO: 269466 - DNA, 20 bp, Artificial
  CRISPR gRNA sequence
cttaacaagctgtttttcca

SEQ ID NO: 269467 - DNA, 20 bp, Artificial
  CRISPR gRNA sequence
aacaagctgtttttccataa

SEQ ID NO: 269468 - DNA, 20 bp, Artificial
  CRISPR gRNA sequence
acaagctgtttttccataat

SEQ ID NO: 269469 - DNA, 20 bp, Artificial
  CRISPR gRNA sequence
tttttccataattaaccgaa

SEQ ID NO: 269470 - DNA, 20 bp, Artificial
  CRISPR gRNA sequence
ttccataattaaccgaagag

SEQ ID NO: 269471 - DNA, 20 bp, Artificial
  CRISPR gRNA sequence
tccataattaaccgaagagg

SEQ ID NO: 269472 - DNA, 20 bp, Artificial
  CRISPR gRNA sequence
ccataattaaccgaagagga

SEQ ID NO: 269473 - DNA, 20 bp, Artificial
  CRISPR gRNA sequence
cataattaaccgaagaggac

SEQ ID NO: 269474 - DNA, 20 bp, Artificial
  CRISPR gRNA sequence
accgaagaggactttcaact

SEQ ID NO: 269475 - DNA, 20 bp, Artificial
  CRISPR gRNA sequence
tcaactcctccagagtctgt

SEQ ID NO: 269476 - DNA, 20 bp, Artificial
  CRISPR gRNA sequence
caactcctccagagtctgta

SEQ ID NO: 269477 - DNA, 20 bp, Artificial
  CRISPR gRNA sequence
aactcctccagagtctgtaa

SEQ ID NO: 269478 - DNA, 20 bp, Artificial
  CRISPR gRNA sequence
ctccagagtctgtaataatc

SEQ ID NO: 269479 - DNA, 20 bp, Artificial
  CRISPR gRNA sequence
cagagtctgtaataatcaca

SEQ ID NO: 269480 - DNA, 20 bp, Artificial
  CRISPR gRNA sequence
taataatcacaaatttgtaa

SEQ ID NO: 269481 - DNA, 20 bp, Artificial
  CRISPR gRNA sequence
gtaaaggtggagtccaaact

SEQ ID NO: 269482 - DNA, 20 bp, Artificial
  CRISPR gRNA sequence
taaaggtggagtccaaacta

SEQ ID NO: 269483 - DNA, 20 bp, Artificial
  CRISPR gRNA sequence
atggcaatttacagttctag

SEQ ID NO: 269484 - DNA, 20 bp, Artificial
  CRISPR gRNA sequence
acagttctagacaactagta

SEQ ID NO: 269485 - DNA, 20 bp, Artificial
  CRISPR gRNA sequence
cagttctagacaactagtac

SEQ ID NO: 269486 - DNA, 20 bp, Artificial
  CRISPR gRNA sequence
tagacaactagtacattcct

SEQ ID NO: 269487 - DNA, 20 bp, Artificial
  CRISPR gRNA sequence
gacaactagtacattcctat

SEQ ID NO: 269488 - DNA, 20 bp, Artificial
  CRISPR gRNA sequence
gtacattcctatgtctttat

SEQ ID NO: 269489 - DNA, 20 bp, Artificial
  CRISPR gRNA sequence
ctatgtctttatgggtatgt

SEQ ID NO: 269490 - DNA, 20 bp, Artificial
  CRISPR gRNA sequence
tgtctttatgggtatgtatt

SEQ ID NO: 269491 - DNA, 20 bp, Artificial
  CRISPR gRNA sequence
tatgggtatgtatttctaca

SEQ ID NO: 269492 - DNA, 20 bp, Artificial
  CRISPR gRNA sequence
atgggtatgtatttctacac

SEQ ID NO: 269493 - DNA, 20 bp, Artificial
  CRISPR gRNA sequence
tgggtatgtatttctacact

SEQ ID NO: 269494 - DNA, 20 bp, Artificial
  CRISPR gRNA sequence
ctacactcatctctctttca

SEQ ID NO: 269495 - DNA, 20 bp, Artificial
  CRISPR gRNA sequence
tacactcatctctctttcat

SEQ ID NO: 269496 - DNA, 20 bp, Artificial
  CRISPR gRNA sequence
cactcatctctctttcatag

SEQ ID NO: 269497 - DNA, 20 bp, Artificial
  CRISPR gRNA sequence
atctctctttcataggcttg

SEQ ID NO: 269498 - DNA, 20 bp, Artificial
  CRISPR gRNA sequence
tctttcataggcttggctcc

SEQ ID NO: 269499 - DNA, 20 bp, Artificial
  CRISPR gRNA sequence
tttcataggcttggctccat

SEQ ID NO: 269500 - DNA, 20 bp, Artificial
  CRISPR gRNA sequence
tcataggcttggctccatca

SEQ ID NO: 269501 - DNA, 20 bp, Artificial
  CRISPR gRNA sequence
cataggcttggctccatcag

SEQ ID NO: 269502 - DNA, 20 bp, Artificial
  CRISPR gRNA sequence
ataggcttggctccatcagg

SEQ ID NO: 269503 - DNA, 20 bp, Artificial
  CRISPR gRNA sequence
ggctccatcaggatgaattt

SEQ ID NO: 269504 - DNA, 20 bp, Artificial
  CRISPR gRNA sequence
gctccatcaggatgaatttc

SEQ ID NO: 269505 - DNA, 20 bp, Artificial
  CRISPR gRNA sequence
catcaggatgaatttccacc

SEQ ID NO: 269506 - DNA, 20 bp, Artificial
  CRISPR gRNA sequence
ccaccagaagtgagggaagt

SEQ ID NO: 269507 - DNA, 20 bp, Artificial
  CRISPR gRNA sequence
caccagaagtgagggaagta

SEQ ID NO: 269508 - DNA, 20 bp, Artificial
  CRISPR gRNA sequence
cacccaccatgaatcttagc

SEQ ID NO: 269509 - DNA, 20 bp, Artificial
  CRISPR gRNA sequence
acccaccatgaatcttagca

SEQ ID NO: 269510 - DNA, 20 bp, Artificial
  CRISPR gRNA sequence
agcaaaatttttgactaagg

SEQ ID NO: 269511 - DNA, 20 bp, Artificial
  CRISPR gRNA sequence
gcaaaatttttgactaaggg

SEQ ID NO: 269512 - DNA, 20 bp, Artificial
  CRISPR gRNA sequence
ttgactaagggttaggaaca

SEQ ID NO: 269513 - DNA, 20 bp, Artificial
  CRISPR gRNA sequence
tgactaagggttaggaacat

SEQ ID NO: 269514 - DNA, 20 bp, Artificial
  CRISPR gRNA sequence
gactaagggttaggaacatc

SEQ ID NO: 269515 - DNA, 20 bp, Artificial
  CRISPR gRNA sequence
actaagggttaggaacatca

SEQ ID NO: 269516 - DNA, 20 bp, Artificial
  CRISPR gRNA sequence
agggttaggaacatcatttc

SEQ ID NO: 269517 - DNA, 20 bp, Artificial
  CRISPR gRNA sequence
ggaacatcatttctgaatca

SEQ ID NO: 269518 - DNA, 20 bp, Artificial
  CRISPR gRNA sequence
ctgaatcaatgtgatagtaa

SEQ ID NO: 269519 - DNA, 20 bp, Artificial
  CRISPR gRNA sequence
tgaatcaatgtgatagtaaa

SEQ ID NO: 269520 - DNA, 20 bp, Artificial
  CRISPR gRNA sequence
aatcaatgtgatagtaaaat

SEQ ID NO: 269521 - DNA, 20 bp, Artificial
  CRISPR gRNA sequence
tacatttcttaacaaatgac

SEQ ID NO: 269522 - DNA, 20 bp, Artificial
  CRISPR gRNA sequence
catttcttaacaaatgaccc

SEQ ID NO: 269523 - DNA, 20 bp, Artificial
  CRISPR gRNA sequence
cttaacaaatgacccagaaa

SEQ ID NO: 269524 - DNA, 20 bp, Artificial
  CRISPR gRNA sequence
ttaacaaatgacccagaaaa

SEQ ID NO: 269525 - DNA, 20 bp, Artificial
  CRISPR gRNA sequence
aacaaatgacccagaaaaca

SEQ ID NO: 269526 - DNA, 20 bp, Artificial
  CRISPR gRNA sequence
acaaatgacccagaaaacat

SEQ ID NO: 269527 - DNA, 20 bp, Artificial
  CRISPR gRNA sequence
aaaacagaaagccatcagat

SEQ ID NO: 269528 - DNA, 20 bp, Artificial
  CRISPR gRNA sequence
ctggattcagaattctctat

SEQ ID NO: 269529 - DNA, 20 bp, Artificial
  CRISPR gRNA sequence
tggattcagaattctctatt

SEQ ID NO: 269530 - DNA, 20 bp, Artificial
  CRISPR gRNA sequence
gattcagaattctctattat

SEQ ID NO: 269531 - DNA, 20 bp, Artificial
  CRISPR gRNA sequence
agaattctctattatgaaaa

SEQ ID NO: 269532 - DNA, 20 bp, Artificial
  CRISPR gRNA sequence
tctattatgaaaaaagtgcc

SEQ ID NO: 269533 - DNA, 20 bp, Artificial
  CRISPR gRNA sequence
tattatgaaaaaagtgccta

SEQ ID NO: 269534 - DNA, 20 bp, Artificial
  CRISPR gRNA sequence
ttatgaaaaaagtgcctagt

SEQ ID NO: 269535 - DNA, 20 bp, Artificial
  CRISPR gRNA sequence
tgaaaaaagtgcctagttcc

SEQ ID NO: 269536 - DNA, 20 bp, Artificial
  CRISPR gRNA sequence
gttcctggcacacaggctga

SEQ ID NO: 269537 - DNA, 20 bp, Artificial
  CRISPR gRNA sequence
ctggcacacaggctgatacc

SEQ ID NO: 269538 - DNA, 20 bp, Artificial
  CRISPR gRNA sequence
gcacacaggctgatacctaa

SEQ ID NO: 269539 - DNA, 20 bp, Artificial
  CRISPR gRNA sequence
atacctaagtagataatgct

SEQ ID NO: 269540 - DNA, 20 bp, Artificial
  CRISPR gRNA sequence
agtagataatgctgtacatg

SEQ ID NO: 269541 - DNA, 20 bp, Artificial
  CRISPR gRNA sequence
tacatgaatgacatgatacc

SEQ ID NO: 269542 - DNA, 20 bp, Artificial
  CRISPR gRNA sequence
aatgaataaataagtgaatg

SEQ ID NO: 269543 - DNA, 20 bp, Artificial
  CRISPR gRNA sequence
cagccctggttttgtttcca

SEQ ID NO: 269544 - DNA, 20 bp, Artificial
  CRISPR gRNA sequence
agccctggttttgtttccat

SEQ ID NO: 269545 - DNA, 20 bp, Artificial
  CRISPR gRNA sequence
gttttgtttccatacactcc

SEQ ID NO: 269546 - DNA, 20 bp, Artificial
  CRISPR gRNA sequence
tgtttccatacactcctgcc

SEQ ID NO: 269547 - DNA, 20 bp, Artificial
  CRISPR gRNA sequence
gtttccatacactcctgcct

SEQ ID NO: 269548 - DNA, 20 bp, Artificial
  CRISPR gRNA sequence
tttccatacactcctgcctg

SEQ ID NO: 269549 - DNA, 20 bp, Artificial
  CRISPR gRNA sequence
ccatacactcctgcctgagc

SEQ ID NO: 269550 - DNA, 20 bp, Artificial
  CRISPR gRNA sequence
catacactcctgcctgagca

SEQ ID NO: 269551 - DNA, 20 bp, Artificial
  CRISPR gRNA sequence
ctgcctgagcacttcacacc

SEQ ID NO: 269552 - DNA, 20 bp, Artificial
  CRISPR gRNA sequence
cctgagcacttcacaccttc

SEQ ID NO: 269553 - DNA, 20 bp, Artificial
  CRISPR gRNA sequence
agcacttcacaccttccttg

SEQ ID NO: 269554 - DNA, 20 bp, Artificial
  CRISPR gRNA sequence
cacaccttccttgtcaaagg

SEQ ID NO: 269555 - DNA, 20 bp, Artificial
  CRISPR gRNA sequence
acaccttccttgtcaaaggg

SEQ ID NO: 269556 - DNA, 20 bp, Artificial
  CRISPR gRNA sequence
ccttgtcaaaggggcatgag

SEQ ID NO: 269557 - DNA, 20 bp, Artificial
  CRISPR gRNA sequence
cttgtcaaaggggcatgagt

SEQ ID NO: 269558 - DNA, 20 bp, Artificial
  CRISPR gRNA sequence
gtcaaaggggcatgagtaag

SEQ ID NO: 269559 - DNA, 20 bp, Artificial
  CRISPR gRNA sequence
tcaaaggggcatgagtaagt

SEQ ID NO: 269560 - DNA, 20 bp, Artificial
  CRISPR gRNA sequence
aagaaaggtttgaaaaacgc

SEQ ID NO: 269561 - DNA, 20 bp, Artificial
  CRISPR gRNA sequence
gaaaaacgctgacttccatg

SEQ ID NO: 269562 - DNA, 20 bp, Artificial
  CRISPR gRNA sequence
aaaaacgctgacttccatgt

SEQ ID NO: 269563 - DNA, 20 bp, Artificial
  CRISPR gRNA sequence
acttccatgttactaaacac

SEQ ID NO: 269564 - DNA, 20 bp, Artificial
  CRISPR gRNA sequence
ccatgttactaaacacagct

SEQ ID NO: 269565 - DNA, 20 bp, Artificial
  CRISPR gRNA sequence
catgttactaaacacagcta

SEQ ID NO: 269566 - DNA, 20 bp, Artificial
  CRISPR gRNA sequence
ctaaacacagctaacatgtt

SEQ ID NO: 269567 - DNA, 20 bp, Artificial
  CRISPR gRNA sequence
aacacagctaacatgtttta

SEQ ID NO: 269568 - DNA, 20 bp, Artificial
  CRISPR gRNA sequence
acatgttttaagtcctcatc

SEQ ID NO: 269569 - DNA, 20 bp, Artificial
  CRISPR gRNA sequence
taagtcctcatcttcttcaa

SEQ ID NO: 269570 - DNA, 20 bp, Artificial
  CRISPR gRNA sequence
aagtcctcatcttcttcaac

SEQ ID NO: 269571 - DNA, 20 bp, Artificial
  CRISPR gRNA sequence
agtcctcatcttcttcaact

SEQ ID NO: 269572 - DNA, 20 bp, Artificial
  CRISPR gRNA sequence
atcttcttcaactctcagca

SEQ ID NO: 269573 - DNA, 20 bp, Artificial
  CRISPR gRNA sequence
cttcaactctcagcagtatt

SEQ ID NO: 269574 - DNA, 20 bp, Artificial
  CRISPR gRNA sequence
ttcaactctcagcagtattc

SEQ ID NO: 269575 - DNA, 20 bp, Artificial
  CRISPR gRNA sequence
caactctcagcagtattcta

SEQ ID NO: 269576 - DNA, 20 bp, Artificial
  CRISPR gRNA sequence
aactctcagcagtattctat

SEQ ID NO: 269577 - DNA, 20 bp, Artificial
  CRISPR gRNA sequence
tcagcagtattctatactat

SEQ ID NO: 269578 - DNA, 20 bp, Artificial
  CRISPR gRNA sequence
agcagtattctatactattg

SEQ ID NO: 269579 - DNA, 20 bp, Artificial
  CRISPR gRNA sequence
tatactattgataactctct

SEQ ID NO: 269580 - DNA, 20 bp, Artificial
  CRISPR gRNA sequence
tactattgataactctcttc

SEQ ID NO: 269581 - DNA, 20 bp, Artificial
  CRISPR gRNA sequence
ttgataactctcttcttttt

SEQ ID NO: 269582 - DNA, 20 bp, Artificial
  CRISPR gRNA sequence
ataactctcttctttttgtg

SEQ ID NO: 269583 - DNA, 20 bp, Artificial
  CRISPR gRNA sequence
tcttctttttgtgatactat

SEQ ID NO: 269584 - DNA, 20 bp, Artificial
  CRISPR gRNA sequence
ttctttttgtgatactattt

SEQ ID NO: 269585 - DNA, 20 bp, Artificial
  CRISPR gRNA sequence
ctttttgtgatactatttct

SEQ ID NO: 269586 - DNA, 20 bp, Artificial
  CRISPR gRNA sequence
tttttgtgatactatttctc

SEQ ID NO: 269587 - DNA, 20 bp, Artificial
  CRISPR gRNA sequence
tttgtgatactatttctctt

SEQ ID NO: 269588 - DNA, 20 bp, Artificial
  CRISPR gRNA sequence
ttgtgatactatttctcttt

SEQ ID NO: 269589 - DNA, 20 bp, Artificial
  CRISPR gRNA sequence
tgtgatactatttctctttg

SEQ ID NO: 269590 - DNA, 20 bp, Artificial
  CRISPR gRNA sequence
gtgatactatttctctttgc

SEQ ID NO: 269591 - DNA, 20 bp, Artificial
  CRISPR gRNA sequence
tgatactatttctctttgcc

SEQ ID NO: 269592 - DNA, 20 bp, Artificial
  CRISPR gRNA sequence
tttctctttgccatctatga

SEQ ID NO: 269593 - DNA, 20 bp, Artificial
  CRISPR gRNA sequence
ctctttgccatctatgacat

SEQ ID NO: 269594 - DNA, 20 bp, Artificial
  CRISPR gRNA sequence
tctttgccatctatgacatc

SEQ ID NO: 269595 - DNA, 20 bp, Artificial
  CRISPR gRNA sequence
tttgccatctatgacatccc

SEQ ID NO: 269596 - DNA, 20 bp, Artificial
  CRISPR gRNA sequence
tgccatctatgacatcccag

SEQ ID NO: 269597 - DNA, 20 bp, Artificial
  CRISPR gRNA sequence
gccatctatgacatcccagt

SEQ ID NO: 269598 - DNA, 20 bp, Artificial
  CRISPR gRNA sequence
ccatctatgacatcccagtt

SEQ ID NO: 269599 - DNA, 20 bp, Artificial
  CRISPR gRNA sequence
tgacatcccagtttttatcc

SEQ ID NO: 269600 - DNA, 20 bp, Artificial
  CRISPR gRNA sequence
ttatcctacctgtcttgtca

SEQ ID NO: 269601 - DNA, 20 bp, Artificial
  CRISPR gRNA sequence
tatcctacctgtcttgtcac

SEQ ID NO: 269602 - DNA, 20 bp, Artificial
  CRISPR gRNA sequence
atcctacctgtcttgtcact

SEQ ID NO: 269603 - DNA, 20 bp, Artificial
  CRISPR gRNA sequence
tcctacctgtcttgtcactc

SEQ ID NO: 269604 - DNA, 20 bp, Artificial
  CRISPR gRNA sequence
cctgtcttgtcactccttcc

SEQ ID NO: 269605 - DNA, 20 bp, Artificial
  CRISPR gRNA sequence
tcttgtcactccttccctgc

SEQ ID NO: 269606 - DNA, 20 bp, Artificial
  CRISPR gRNA sequence
gtcactccttccctgcctcc

SEQ ID NO: 269607 - DNA, 20 bp, Artificial
  CRISPR gRNA sequence
tcactccttccctgcctcct

SEQ ID NO: 269608 - DNA, 20 bp, Artificial
  CRISPR gRNA sequence
cttccctgcctcctttgcaa

SEQ ID NO: 269609 - DNA, 20 bp, Artificial
  CRISPR gRNA sequence
ccctgcctcctttgcaagct

SEQ ID NO: 269610 - DNA, 20 bp, Artificial
  CRISPR gRNA sequence
cctgcctcctttgcaagctc

SEQ ID NO: 269611 - DNA, 20 bp, Artificial
  CRISPR gRNA sequence
cctcctttgcaagctcatcc

SEQ ID NO: 269612 - DNA, 20 bp, Artificial
  CRISPR gRNA sequence
ctttgcaagctcatccttct

SEQ ID NO: 269613 - DNA, 20 bp, Artificial
  CRISPR gRNA sequence
tgcaagctcatccttctcta

SEQ ID NO: 269614 - DNA, 20 bp, Artificial
  CRISPR gRNA sequence
gcaagctcatccttctctaa

SEQ ID NO: 269615 - DNA, 20 bp, Artificial
  CRISPR gRNA sequence
caagctcatccttctctaac

SEQ ID NO: 269616 - DNA, 20 bp, Artificial
  CRISPR gRNA sequence
atccttctctaaccagccgt

SEQ ID NO: 269617 - DNA, 20 bp, Artificial
  CRISPR gRNA sequence
ctctaaccagccgttagaat

SEQ ID NO: 269618 - DNA, 20 bp, Artificial
  CRISPR gRNA sequence
tctaaccagccgttagaatt

SEQ ID NO: 269619 - DNA, 20 bp, Artificial
  CRISPR gRNA sequence
taaccagccgttagaatttc

SEQ ID NO: 269620 - DNA, 20 bp, Artificial
  CRISPR gRNA sequence
accagccgttagaatttctc

SEQ ID NO: 269621 - DNA, 20 bp, Artificial
  CRISPR gRNA sequence
gaatttctcactgcttggtc

SEQ ID NO: 269622 - DNA, 20 bp, Artificial
  CRISPR gRNA sequence
ctcactgcttggtcctaggc

SEQ ID NO: 269623 - DNA, 20 bp, Artificial
  CRISPR gRNA sequence
tcactgcttggtcctaggcc

SEQ ID NO: 269624 - DNA, 20 bp, Artificial
  CRISPR gRNA sequence
actgcttggtcctaggcctt

SEQ ID NO: 269625 - DNA, 20 bp, Artificial
  CRISPR gRNA sequence
cttggtcctaggccttcttc

SEQ ID NO: 269626 - DNA, 20 bp, Artificial
  CRISPR gRNA sequence
ggtcctaggccttcttctct

SEQ ID NO: 269627 - DNA, 20 bp, Artificial
  CRISPR gRNA sequence
gtcctaggccttcttctcta

SEQ ID NO: 269628 - DNA, 20 bp, Artificial
  CRISPR gRNA sequence
ggccttcttctctatcctct

SEQ ID NO: 269629 - DNA, 20 bp, Artificial
  CRISPR gRNA sequence
cttctctatcctctttccct

SEQ ID NO: 269630 - DNA, 20 bp, Artificial
  CRISPR gRNA sequence
ttctctatcctctttcccta

SEQ ID NO: 269631 - DNA, 20 bp, Artificial
  CRISPR gRNA sequence
ctctatcctctttccctagg

SEQ ID NO: 269632 - DNA, 20 bp, Artificial
  CRISPR gRNA sequence
tctatcctctttccctaggc

SEQ ID NO: 269633 - DNA, 20 bp, Artificial
  CRISPR gRNA sequence
tatcctctttccctaggcaa

SEQ ID NO: 269634 - DNA, 20 bp, Artificial
  CRISPR gRNA sequence
tcctctttccctaggcaatc

SEQ ID NO: 269635 - DNA, 20 bp, Artificial
  CRISPR gRNA sequence
tttccctaggcaatcttatc

SEQ ID NO: 269636 - DNA, 20 bp, Artificial
  CRISPR gRNA sequence
tccctaggcaatcttatcca

SEQ ID NO: 269637 - DNA, 20 bp, Artificial
  CRISPR gRNA sequence
ccctaggcaatcttatccac

SEQ ID NO: 269638 - DNA, 20 bp, Artificial
  CRISPR gRNA sequence
cctaggcaatcttatccaca

SEQ ID NO: 269639 - DNA, 20 bp, Artificial
  CRISPR gRNA sequence
ggcaatcttatccacattca

SEQ ID NO: 269640 - DNA, 20 bp, Artificial
  CRISPR gRNA sequence
atccacattcacagcttcaa

SEQ ID NO: 269641 - DNA, 20 bp, Artificial
  CRISPR gRNA sequence
tccacattcacagcttcaat

SEQ ID NO: 269642 - DNA, 20 bp, Artificial
  CRISPR gRNA sequence
acagcttcaattaccaccta

SEQ ID NO: 269643 - DNA, 20 bp, Artificial
  CRISPR gRNA sequence
caattaccacctactcaccc

SEQ ID NO: 269644 - DNA, 20 bp, Artificial
  CRISPR gRNA sequence
aattaccacctactcaccca

SEQ ID NO: 269645 - DNA, 20 bp, Artificial
  CRISPR gRNA sequence
ccacctactcacccaaattt

SEQ ID NO: 269646 - DNA, 20 bp, Artificial
  CRISPR gRNA sequence
ctcacccaaatttatatctc

SEQ ID NO: 269647 - DNA, 20 bp, Artificial
  CRISPR gRNA sequence
acccaaatttatatctctgg

SEQ ID NO: 269648 - DNA, 20 bp, Artificial
  CRISPR gRNA sequence
atatctctggactaaacctc

SEQ ID NO: 269649 - DNA, 20 bp, Artificial
  CRISPR gRNA sequence
tatctctggactaaacctca

SEQ ID NO: 269650 - DNA, 20 bp, Artificial
  CRISPR gRNA sequence
tggactaaacctcaaagcca

SEQ ID NO: 269651 - DNA, 20 bp, Artificial
  CRISPR gRNA sequence
gactaaacctcaaagccact

SEQ ID NO: 269652 - DNA, 20 bp, Artificial
  CRISPR gRNA sequence
aacctcaaagccactctaaa

SEQ ID NO: 269653 - DNA, 20 bp, Artificial
  CRISPR gRNA sequence
aaagccactctaaactcaac

SEQ ID NO: 269654 - DNA, 20 bp, Artificial
  CRISPR gRNA sequence
taaactcaacatgtctaaaa

SEQ ID NO: 269655 - DNA, 20 bp, Artificial
  CRISPR gRNA sequence
aactcaacatgtctaaaata

SEQ ID NO: 269656 - DNA, 20 bp, Artificial
  CRISPR gRNA sequence
aacatgtctaaaataaaact

SEQ ID NO: 269657 - DNA, 20 bp, Artificial
  CRISPR gRNA sequence
aaataaaactcaagatttcc

SEQ ID NO: 269658 - DNA, 20 bp, Artificial
  CRISPR gRNA sequence
aagatttcccccaaatgctg

SEQ ID NO: 269659 - DNA, 20 bp, Artificial
  CRISPR gRNA sequence
cccccaaatgctgttttttt

SEQ ID NO: 269660 - DNA, 20 bp, Artificial
  CRISPR gRNA sequence
ccccaaatgctgtttttttt

SEQ ID NO: 269661 - DNA, 20 bp, Artificial
  CRISPR gRNA sequence
ttttttttttaccagtgttt

SEQ ID NO: 269662 - DNA, 20 bp, Artificial
  CRISPR gRNA sequence
tttttttaccagtgtttctc

SEQ ID NO: 269663 - DNA, 20 bp, Artificial
  CRISPR gRNA sequence
ttttttaccagtgtttctca

SEQ ID NO: 269664 - DNA, 20 bp, Artificial
  CRISPR gRNA sequence
tttttaccagtgtttctcat

SEQ ID NO: 269665 - DNA, 20 bp, Artificial
  CRISPR gRNA sequence
ttttaccagtgtttctcatc

SEQ ID NO: 269666 - DNA, 20 bp, Artificial
  CRISPR gRNA sequence
tttaccagtgtttctcatct

SEQ ID NO: 269667 - DNA, 20 bp, Artificial
  CRISPR gRNA sequence
ttaccagtgtttctcatctg

SEQ ID NO: 269668 - DNA, 20 bp, Artificial
  CRISPR gRNA sequence
taccagtgtttctcatctga

SEQ ID NO: 269669 - DNA, 20 bp, Artificial
  CRISPR gRNA sequence
accagtgtttctcatctgag

SEQ ID NO: 269670 - DNA, 20 bp, Artificial
  CRISPR gRNA sequence
ccagtgtttctcatctgagt

SEQ ID NO: 269671 - DNA, 20 bp, Artificial
  CRISPR gRNA sequence
ctcatctgagtgaatgacac

SEQ ID NO: 269672 - DNA, 20 bp, Artificial
  CRISPR gRNA sequence
tcatctgagtgaatgacact

SEQ ID NO: 269673 - DNA, 20 bp, Artificial
  CRISPR gRNA sequence
atctgagtgaatgacactac

SEQ ID NO: 269674 - DNA, 20 bp, Artificial
  CRISPR gRNA sequence
agtgaatgacactaccatat

SEQ ID NO: 269675 - DNA, 20 bp, Artificial
  CRISPR gRNA sequence
ccatatatacagctgcccaa

SEQ ID NO: 269676 - DNA, 20 bp, Artificial
  CRISPR gRNA sequence
cccaagacagacctcctaac

SEQ ID NO: 269677 - DNA, 20 bp, Artificial
  CRISPR gRNA sequence
ctaacctcatccttgacacc

SEQ ID NO: 269678 - DNA, 20 bp, Artificial
  CRISPR gRNA sequence
acctcatccttgacacctca

SEQ ID NO: 269679 - DNA, 20 bp, Artificial
  CRISPR gRNA sequence
atccttgacacctcaagctc

SEQ ID NO: 269680 - DNA, 20 bp, Artificial
  CRISPR gRNA sequence
gacacctcaagctcccttaa

SEQ ID NO: 269681 - DNA, 20 bp, Artificial
  CRISPR gRNA sequence
acacctcaagctcccttaat

SEQ ID NO: 269682 - DNA, 20 bp, Artificial
  CRISPR gRNA sequence
aagctcccttaatccctgtc

SEQ ID NO: 269683 - DNA, 20 bp, Artificial
  CRISPR gRNA sequence
ccttaatccctgtcccagga

SEQ ID NO: 269684 - DNA, 20 bp, Artificial
  CRISPR gRNA sequence
aatccctgtcccaggagaca

SEQ ID NO: 269685 - DNA, 20 bp, Artificial
  CRISPR gRNA sequence
atccctgtcccaggagacat

SEQ ID NO: 269686 - DNA, 20 bp, Artificial
  CRISPR gRNA sequence
tcccaggagacatttagtga

SEQ ID NO: 269687 - DNA, 20 bp, Artificial
  CRISPR gRNA sequence
agtgaagtctaaaaacattt

SEQ ID NO: 269688 - DNA, 20 bp, Artificial
  CRISPR gRNA sequence
gtgaagtctaaaaacatttt

SEQ ID NO: 269689 - DNA, 20 bp, Artificial
  CRISPR gRNA sequence
aaaacattttggatcatcac

SEQ ID NO: 269690 - DNA, 20 bp, Artificial
  CRISPR gRNA sequence
tggatcatcacaacggggag

SEQ ID NO: 269691 - DNA, 20 bp, Artificial
  CRISPR gRNA sequence
ggatcatcacaacggggagg

SEQ ID NO: 269692 - DNA, 20 bp, Artificial
  CRISPR gRNA sequence
gatcatcacaacggggaggg

SEQ ID NO: 269693 - DNA, 20 bp, Artificial
  CRISPR gRNA sequence
ctggcatctactgggtagag

SEQ ID NO: 269694 - DNA, 20 bp, Artificial
  CRISPR gRNA sequence
gcatctactgggtagaggtc

SEQ ID NO: 269695 - DNA, 20 bp, Artificial
  CRISPR gRNA sequence
ctgggtagaggtcagagatg

SEQ ID NO: 269696 - DNA, 20 bp, Artificial
  CRISPR gRNA sequence
ggtagaggtcagagatgctg

SEQ ID NO: 269697 - DNA, 20 bp, Artificial
  CRISPR gRNA sequence
ctaaacatcctacaatgcaa

SEQ ID NO: 269698 - DNA, 20 bp, Artificial
  CRISPR gRNA sequence
aacatcctacaatgcaatga

SEQ ID NO: 269699 - DNA, 20 bp, Artificial
  CRISPR gRNA sequence
caatgcaatgaagaattgtt

SEQ ID NO: 269700 - DNA, 20 bp, Artificial
  CRISPR gRNA sequence
ttttggttctacatcctttc

SEQ ID NO: 269701 - DNA, 20 bp, Artificial
  CRISPR gRNA sequence
tggttctacatcctttctgt

SEQ ID NO: 269702 - DNA, 20 bp, Artificial
  CRISPR gRNA sequence
ggttctacatcctttctgta

SEQ ID NO: 269703 - DNA, 20 bp, Artificial
  CRISPR gRNA sequence
gttctacatcctttctgtaa

SEQ ID NO: 269704 - DNA, 20 bp, Artificial
  CRISPR gRNA sequence
tacatcctttctgtaaatga

SEQ ID NO: 269705 - DNA, 20 bp, Artificial
  CRISPR gRNA sequence
catcctttctgtaaatgaaa

SEQ ID NO: 269706 - DNA, 20 bp, Artificial
  CRISPR gRNA sequence
tctgtaaatgaaagactaga

SEQ ID NO: 269707 - DNA, 20 bp, Artificial
  CRISPR gRNA sequence
ctgtaaatgaaagactagag

SEQ ID NO: 269708 - DNA, 20 bp, Artificial
  CRISPR gRNA sequence
tgtaaatgaaagactagagc

SEQ ID NO: 269709 - DNA, 20 bp, Artificial
  CRISPR gRNA sequence
taaatgaaagactagagctg

SEQ ID NO: 269710 - DNA, 20 bp, Artificial
  CRISPR gRNA sequence
gagctgtcttgagcacaaga

SEQ ID NO: 269711 - DNA, 20 bp, Artificial
  CRISPR gRNA sequence
tcttgagcacaagatcacag

SEQ ID NO: 269712 - DNA, 20 bp, Artificial
  CRISPR gRNA sequence
gagcacaagatcacagcagg

SEQ ID NO: 269713 - DNA, 20 bp, Artificial
  CRISPR gRNA sequence
agcacaagatcacagcaggg

SEQ ID NO: 269714 - DNA, 20 bp, Artificial
  CRISPR gRNA sequence
tccccagatgagtgtagaaa

SEQ ID NO: 269715 - DNA, 20 bp, Artificial
  CRISPR gRNA sequence
ataacctgggaagcattttt

SEQ ID NO: 269716 - DNA, 20 bp, Artificial
  CRISPR gRNA sequence
ggaagcatttttagtactta

SEQ ID NO: 269717 - DNA, 20 bp, Artificial
  CRISPR gRNA sequence
ttagtacttactccaaccct

SEQ ID NO: 269718 - DNA, 20 bp, Artificial
  CRISPR gRNA sequence
tagtacttactccaaccctg

SEQ ID NO: 269719 - DNA, 20 bp, Artificial
  CRISPR gRNA sequence
agtacttactccaaccctga

SEQ ID NO: 269720 - DNA, 20 bp, Artificial
  CRISPR gRNA sequence
gtacttactccaaccctgag

SEQ ID NO: 269721 - DNA, 20 bp, Artificial
  CRISPR gRNA sequence
actccaaccctgaggactcc

SEQ ID NO: 269722 - DNA, 20 bp, Artificial
  CRISPR gRNA sequence
ctccaaccctgaggactccc

SEQ ID NO: 269723 - DNA, 20 bp, Artificial
  CRISPR gRNA sequence
caaccctgaggactcccttt

SEQ ID NO: 269724 - DNA, 20 bp, Artificial
  CRISPR gRNA sequence
aggactccctttgccaaacc

SEQ ID NO: 269725 - DNA, 20 bp, Artificial
  CRISPR gRNA sequence
cctttgccaaacctccaagt

SEQ ID NO: 269726 - DNA, 20 bp, Artificial
  CRISPR gRNA sequence
tgccaaacctccaagtgtca

SEQ ID NO: 269727 - DNA, 20 bp, Artificial
  CRISPR gRNA sequence
gccaaacctccaagtgtcag

SEQ ID NO: 269728 - DNA, 20 bp, Artificial
  CRISPR gRNA sequence
ccaaacctccaagtgtcagc

SEQ ID NO: 269729 - DNA, 20 bp, Artificial
  CRISPR gRNA sequence
caagtgtcagcctctgcctc

SEQ ID NO: 269730 - DNA, 20 bp, Artificial
  CRISPR gRNA sequence
tgcctccggacacccaaacc

SEQ ID NO: 269731 - DNA, 20 bp, Artificial
  CRISPR gRNA sequence
cctccggacacccaaaccaa

SEQ ID NO: 269732 - DNA, 20 bp, Artificial
  CRISPR gRNA sequence
cggacacccaaaccaaatca

SEQ ID NO: 269733 - DNA, 20 bp, Artificial
  CRISPR gRNA sequence
gtagagaggccacagcaata

SEQ ID NO: 269734 - DNA, 20 bp, Artificial
  CRISPR gRNA sequence
gattctcaggttctttacat

SEQ ID NO: 269735 - DNA, 20 bp, Artificial
  CRISPR gRNA sequence
attctcaggttctttacatt

SEQ ID NO: 269736 - DNA, 20 bp, Artificial
  CRISPR gRNA sequence
tcaggttctttacattgcac

SEQ ID NO: 269737 - DNA, 20 bp, Artificial
  CRISPR gRNA sequence
aggttctttacattgcacat

SEQ ID NO: 269738 - DNA, 20 bp, Artificial
  CRISPR gRNA sequence
tttacattgcacataaaata

SEQ ID NO: 269739 - DNA, 20 bp, Artificial
  CRISPR gRNA sequence
tacattgcacataaaataat

SEQ ID NO: 269740 - DNA, 20 bp, Artificial
  CRISPR gRNA sequence
acattgcacataaaataatg

SEQ ID NO: 269741 - DNA, 20 bp, Artificial
  CRISPR gRNA sequence
cattgcacataaaataatga

SEQ ID NO: 269742 - DNA, 20 bp, Artificial
  CRISPR gRNA sequence
cacataaaataatgaaaggt

SEQ ID NO: 269743 - DNA, 20 bp, Artificial
  CRISPR gRNA sequence
ttgcagtcagctcccatgct

SEQ ID NO: 269744 - DNA, 20 bp, Artificial
  CRISPR gRNA sequence
cagtcagctcccatgcttat

SEQ ID NO: 269745 - DNA, 20 bp, Artificial
  CRISPR gRNA sequence
ccatgcttatcctcaagtga

SEQ ID NO: 269746 - DNA, 20 bp, Artificial
  CRISPR gRNA sequence
atcctcaagtgattgtcaga

SEQ ID NO: 269747 - DNA, 20 bp, Artificial
  CRISPR gRNA sequence
tcctcaagtgattgtcagat

SEQ ID NO: 269748 - DNA, 20 bp, Artificial
  CRISPR gRNA sequence
aagtgattgtcagatggcag

SEQ ID NO: 269749 - DNA, 20 bp, Artificial
  CRISPR gRNA sequence
tcagatggcagacttactta

SEQ ID NO: 269750 - DNA, 20 bp, Artificial
  CRISPR gRNA sequence
acttattatcaccctaactc

SEQ ID NO: 269751 - DNA, 20 bp, Artificial
  CRISPR gRNA sequence
cttattatcaccctaactct

SEQ ID NO: 269752 - DNA, 20 bp, Artificial
  CRISPR gRNA sequence
attatcaccctaactctaaa

SEQ ID NO: 269753 - DNA, 20 bp, Artificial
  CRISPR gRNA sequence
ttatcaccctaactctaaac

SEQ ID NO: 269754 - DNA, 20 bp, Artificial
  CRISPR gRNA sequence
tcaccctaactctaaacaca

SEQ ID NO: 269755 - DNA, 20 bp, Artificial
  CRISPR gRNA sequence
actctaaacacagcagtggg

SEQ ID NO: 269756 - DNA, 20 bp, Artificial
  CRISPR gRNA sequence
taaacacagcagtgggatga

SEQ ID NO: 269757 - DNA, 20 bp, Artificial
  CRISPR gRNA sequence
aacacagcagtgggatgaaa

SEQ ID NO: 269758 - DNA, 20 bp, Artificial
  CRISPR gRNA sequence
ggaacaaacaccacgcagaa

SEQ ID NO: 269759 - DNA, 20 bp, Artificial
  CRISPR gRNA sequence
cagcacccatgtgcattgag

SEQ ID NO: 269760 - DNA, 20 bp, Artificial
  CRISPR gRNA sequence
agtatgtgtgcatatgtgtg

SEQ ID NO: 269761 - DNA, 20 bp, Artificial
  CRISPR gRNA sequence
ccctatgtgtctgtgtcatc

SEQ ID NO: 269762 - DNA, 20 bp, Artificial
  CRISPR gRNA sequence
tgtgtctgtgtcatctccac

SEQ ID NO: 269763 - DNA, 20 bp, Artificial
  CRISPR gRNA sequence
tgtcatctccaccccttcaa

SEQ ID NO: 269764 - DNA, 20 bp, Artificial
  CRISPR gRNA sequence
caccccttcaacagtgaatg

SEQ ID NO: 269765 - DNA, 20 bp, Artificial
  CRISPR gRNA sequence
caacagtgaatgtcagctaa

SEQ ID NO: 269766 - DNA, 20 bp, Artificial
  CRISPR gRNA sequence
aacagtgaatgtcagctaat

SEQ ID NO: 269767 - DNA, 20 bp, Artificial
  CRISPR gRNA sequence
atgatatgtaatttctggac

SEQ ID NO: 269768 - DNA, 20 bp, Artificial
  CRISPR gRNA sequence
ctggaccattcctcctttgc

SEQ ID NO: 269769 - DNA, 20 bp, Artificial
  CRISPR gRNA sequence
tggaccattcctcctttgcc

SEQ ID NO: 269770 - DNA, 20 bp, Artificial
  CRISPR gRNA sequence
gaccattcctcctttgccct

SEQ ID NO: 269771 - DNA, 20 bp, Artificial
  CRISPR gRNA sequence
ctcctttgcccttctcccca

SEQ ID NO: 269772 - DNA, 20 bp, Artificial
  CRISPR gRNA sequence
ctttgcccttctccccatgc

SEQ ID NO: 269773 - DNA, 20 bp, Artificial
  CRISPR gRNA sequence
tgcccttctccccatgccag

SEQ ID NO: 269774 - DNA, 20 bp, Artificial
  CRISPR gRNA sequence
gcccttctccccatgccagc

SEQ ID NO: 269775 - DNA, 20 bp, Artificial
  CRISPR gRNA sequence
cccttctccccatgccagcc

SEQ ID NO: 269776 - DNA, 20 bp, Artificial
  CRISPR gRNA sequence
ctccccatgccagccttacc

SEQ ID NO: 269777 - DNA, 20 bp, Artificial
  CRISPR gRNA sequence
tccccatgccagccttaccc

SEQ ID NO: 269778 - DNA, 20 bp, Artificial
  CRISPR gRNA sequence
cccatgccagccttacccac

SEQ ID NO: 269779 - DNA, 20 bp, Artificial
  CRISPR gRNA sequence
acccacttgtttcctgggaa

SEQ ID NO: 269780 - DNA, 20 bp, Artificial
  CRISPR gRNA sequence
cccacttgtttcctgggaac

SEQ ID NO: 269781 - DNA, 20 bp, Artificial
  CRISPR gRNA sequence
gtttcctgggaacagcagca

SEQ ID NO: 269782 - DNA, 20 bp, Artificial
  CRISPR gRNA sequence
tttcctgggaacagcagcaa

SEQ ID NO: 269783 - DNA, 20 bp, Artificial
  CRISPR gRNA sequence
cctgggaacagcagcaatac

SEQ ID NO: 269784 - DNA, 20 bp, Artificial
  CRISPR gRNA sequence
ctgggaacagcagcaataca

SEQ ID NO: 269785 - DNA, 20 bp, Artificial
  CRISPR gRNA sequence
ggaacagcagcaatacacag

SEQ ID NO: 269786 - DNA, 20 bp, Artificial
  CRISPR gRNA sequence
cttaagtacgtggtcttcaa

SEQ ID NO: 269787 - DNA, 20 bp, Artificial
  CRISPR gRNA sequence
aagtacgtggtcttcaagaa

SEQ ID NO: 269788 - DNA, 20 bp, Artificial
  CRISPR gRNA sequence
agtacgtggtcttcaagaat

SEQ ID NO: 269789 - DNA, 20 bp, Artificial
  CRISPR gRNA sequence
caagaatctactggattatt

SEQ ID NO: 269790 - DNA, 20 bp, Artificial
  CRISPR gRNA sequence
aagaatctactggattatta

SEQ ID NO: 269791 - DNA, 20 bp, Artificial
  CRISPR gRNA sequence
ctggattattataaaaagca

SEQ ID NO: 269792 - DNA, 20 bp, Artificial
  CRISPR gRNA sequence
gattattataaaaagcagac

SEQ ID NO: 269793 - DNA, 20 bp, Artificial
  CRISPR gRNA sequence
ttataaaaagcagacactac

SEQ ID NO: 269794 - DNA, 20 bp, Artificial
  CRISPR gRNA sequence
taaaaagcagacactacctg

SEQ ID NO: 269795 - DNA, 20 bp, Artificial
  CRISPR gRNA sequence
cctgtacacacactatctac

SEQ ID NO: 269796 - DNA, 20 bp, Artificial
  CRISPR gRNA sequence
tacacacactatctacattc

SEQ ID NO: 269797 - DNA, 20 bp, Artificial
  CRISPR gRNA sequence
tctacattcctcacattatg

SEQ ID NO: 269798 - DNA, 20 bp, Artificial
  CRISPR gRNA sequence
cattcctcacattatgatct

SEQ ID NO: 269799 - DNA, 20 bp, Artificial
  CRISPR gRNA sequence
ctcacattatgatctgcagt

SEQ ID NO: 269800 - DNA, 20 bp, Artificial
  CRISPR gRNA sequence
acattatgatctgcagtggg

SEQ ID NO: 269801 - DNA, 20 bp, Artificial
  CRISPR gRNA sequence
tgatctgcagtggggaacat

SEQ ID NO: 269802 - DNA, 20 bp, Artificial
  CRISPR gRNA sequence
cagtggggaacataatgttt

SEQ ID NO: 269803 - DNA, 20 bp, Artificial
  CRISPR gRNA sequence
tttaaaaagatttctttagg

SEQ ID NO: 269804 - DNA, 20 bp, Artificial
  CRISPR gRNA sequence
ttaaaaagatttctttagga

SEQ ID NO: 269805 - DNA, 20 bp, Artificial
  CRISPR gRNA sequence
taaaaagatttctttaggaa

SEQ ID NO: 269806 - DNA, 20 bp, Artificial
  CRISPR gRNA sequence
aaaaagatttctttaggaaa

SEQ ID NO: 269807 - DNA, 20 bp, Artificial
  CRISPR gRNA sequence
aaaagatttctttaggaaaa

SEQ ID NO: 269808 - DNA, 20 bp, Artificial
  CRISPR gRNA sequence
ctttaggaaaacgggcagct

SEQ ID NO: 269809 - DNA, 20 bp, Artificial
  CRISPR gRNA sequence
tttaggaaaacgggcagctt

SEQ ID NO: 269810 - DNA, 20 bp, Artificial
  CRISPR gRNA sequence
taggaaaacgggcagcttta

SEQ ID NO: 269811 - DNA, 20 bp, Artificial
  CRISPR gRNA sequence
aggaaaacgggcagctttac

SEQ ID NO: 269812 - DNA, 20 bp, Artificial
  CRISPR gRNA sequence
ggaaaacgggcagctttacc

SEQ ID NO: 269813 - DNA, 20 bp, Artificial
  CRISPR gRNA sequence
taccagcacagctgcatgaa

SEQ ID NO: 269814 - DNA, 20 bp, Artificial
  CRISPR gRNA sequence
accagcacagctgcatgaat

SEQ ID NO: 269815 - DNA, 20 bp, Artificial
  CRISPR gRNA sequence
ccagcacagctgcatgaatg

SEQ ID NO: 269816 - DNA, 20 bp, Artificial
  CRISPR gRNA sequence
catgaatggagaattgaaag

SEQ ID NO: 269817 - DNA, 20 bp, Artificial
  CRISPR gRNA sequence
aaagacagtgacaggtgctg

SEQ ID NO: 269818 - DNA, 20 bp, Artificial
  CRISPR gRNA sequence
gcctgtgacagcttgaccaa

SEQ ID NO: 269819 - DNA, 20 bp, Artificial
  CRISPR gRNA sequence
tgacagcttgaccaaaggga

SEQ ID NO: 269820 - DNA, 20 bp, Artificial
  CRISPR gRNA sequence
gaccaaagggagctctttat

SEQ ID NO: 269821 - DNA, 20 bp, Artificial
  CRISPR gRNA sequence
accaaagggagctctttatt

SEQ ID NO: 269822 - DNA, 20 bp, Artificial
  CRISPR gRNA sequence
tttatttactcaaatgtcaa

SEQ ID NO: 269823 - DNA, 20 bp, Artificial
  CRISPR gRNA sequence
tatttactcaaatgtcaaca

SEQ ID NO: 269824 - DNA, 20 bp, Artificial
  CRISPR gRNA sequence
atttactcaaatgtcaacat

SEQ ID NO: 269825 - DNA, 20 bp, Artificial
  CRISPR gRNA sequence
tttactcaaatgtcaacatc

SEQ ID NO: 269826 - DNA, 20 bp, Artificial
  CRISPR gRNA sequence
actcaaatgtcaacatcagg

SEQ ID NO: 269827 - DNA, 20 bp, Artificial
  CRISPR gRNA sequence
ctcaaatgtcaacatcaggt

SEQ ID NO: 269828 - DNA, 20 bp, Artificial
  CRISPR gRNA sequence
aaatgtcaacatcaggtcaa

SEQ ID NO: 269829 - DNA, 20 bp, Artificial
  CRISPR gRNA sequence
agatagaatctgcagctgct

SEQ ID NO: 269830 - DNA, 20 bp, Artificial
  CRISPR gRNA sequence
cagctgctcccagaaacccg

SEQ ID NO: 269831 - DNA, 20 bp, Artificial
  CRISPR gRNA sequence
ctcccagaaacccgctcagc

SEQ ID NO: 269832 - DNA, 20 bp, Artificial
  CRISPR gRNA sequence
ccagaaacccgctcagccta

SEQ ID NO: 269833 - DNA, 20 bp, Artificial
  CRISPR gRNA sequence
agcctagaaacccactcaac

SEQ ID NO: 269834 - DNA, 20 bp, Artificial
  CRISPR gRNA sequence
gaaacccactcaacccagaa

SEQ ID NO: 269835 - DNA, 20 bp, Artificial
  CRISPR gRNA sequence
aacccagaactgcctacagt

SEQ ID NO: 269836 - DNA, 20 bp, Artificial
  CRISPR gRNA sequence
cctacagtagcatatcaggc

SEQ ID NO: 269837 - DNA, 20 bp, Artificial
  CRISPR gRNA sequence
cagtagcatatcaggccctc

SEQ ID NO: 269838 - DNA, 20 bp, Artificial
  CRISPR gRNA sequence
aggaagttccggaaaacagc

SEQ ID NO: 269839 - DNA, 20 bp, Artificial
  CRISPR gRNA sequence
cggaaaacagcaacttacat

SEQ ID NO: 269840 - DNA, 20 bp, Artificial
  CRISPR gRNA sequence
acatcaaggcacgctgcaga

SEQ ID NO: 269841 - DNA, 20 bp, Artificial
  CRISPR gRNA sequence
catcaaggcacgctgcagac

SEQ ID NO: 269842 - DNA, 20 bp, Artificial
  CRISPR gRNA sequence
cagaccagccaaaaatagga

SEQ ID NO: 269843 - DNA, 20 bp, Artificial
  CRISPR gRNA sequence
agaaaattacccaggaaaca

SEQ ID NO: 269844 - DNA, 20 bp, Artificial
  CRISPR gRNA sequence
cccaggaaacagctaaactc

SEQ ID NO: 269845 - DNA, 20 bp, Artificial
  CRISPR gRNA sequence
aactccagggatccataatg

SEQ ID NO: 269846 - DNA, 20 bp, Artificial
  CRISPR gRNA sequence
cagggatccataatggccta

SEQ ID NO: 269847 - DNA, 20 bp, Artificial
  CRISPR gRNA sequence
gatgcccaactcagcaaggt

SEQ ID NO: 269848 - DNA, 20 bp, Artificial
  CRISPR gRNA sequence
agcaaggtacttgttgctta

SEQ ID NO: 269849 - DNA, 20 bp, Artificial
  CRISPR gRNA sequence
gttgcttaaataccaacagc

SEQ ID NO: 269850 - DNA, 20 bp, Artificial
  CRISPR gRNA sequence
ttgcttaaataccaacagca

SEQ ID NO: 269851 - DNA, 20 bp, Artificial
  CRISPR gRNA sequence
cttaaataccaacagcagga

SEQ ID NO: 269852 - DNA, 20 bp, Artificial
  CRISPR gRNA sequence
aaataccaacagcaggaaaa

SEQ ID NO: 269853 - DNA, 20 bp, Artificial
  CRISPR gRNA sequence
aataccaacagcaggaaaag

SEQ ID NO: 269854 - DNA, 20 bp, Artificial
  CRISPR gRNA sequence
tgttattctacgaaatatag

SEQ ID NO: 269855 - DNA, 20 bp, Artificial
  CRISPR gRNA sequence
ttctacgaaatatagacaaa

SEQ ID NO: 269856 - DNA, 20 bp, Artificial
  CRISPR gRNA sequence
tacgaaatatagacaaactt

SEQ ID NO: 269857 - DNA, 20 bp, Artificial
  CRISPR gRNA sequence
cgaaatatagacaaacttgt

SEQ ID NO: 269858 - DNA, 20 bp, Artificial
  CRISPR gRNA sequence
gtatttatactcttttggta

SEQ ID NO: 269859 - DNA, 20 bp, Artificial
  CRISPR gRNA sequence
tatttatactcttttggtaa

SEQ ID NO: 269860 - DNA, 20 bp, Artificial
  CRISPR gRNA sequence
atactcttttggtaagagag

SEQ ID NO: 269861 - DNA, 20 bp, Artificial
  CRISPR gRNA sequence
tactcttttggtaagagagt

SEQ ID NO: 269862 - DNA, 20 bp, Artificial
  CRISPR gRNA sequence
ttttggtaagagagtacaaa

SEQ ID NO: 269863 - DNA, 20 bp, Artificial
  CRISPR gRNA sequence
ttggtaagagagtacaaaga

SEQ ID NO: 269864 - DNA, 20 bp, Artificial
  CRISPR gRNA sequence
tggtaagagagtacaaagac

SEQ ID NO: 269865 - DNA, 20 bp, Artificial
  CRISPR gRNA sequence
ggtaagagagtacaaagacc

SEQ ID NO: 269866 - DNA, 20 bp, Artificial
  CRISPR gRNA sequence
gtaagagagtacaaagaccc

SEQ ID NO: 269867 - DNA, 20 bp, Artificial
  CRISPR gRNA sequence
gagatgcagataagtggtag

SEQ ID NO: 269868 - DNA, 20 bp, Artificial
  CRISPR gRNA sequence
agatgcagataagtggtagt

SEQ ID NO: 269869 - DNA, 20 bp, Artificial
  CRISPR gRNA sequence
ttattgggtaaccgaattga

SEQ ID NO: 269870 - DNA, 20 bp, Artificial
  CRISPR gRNA sequence
tattgggtaaccgaattgac

SEQ ID NO: 269871 - DNA, 20 bp, Artificial
  CRISPR gRNA sequence
attgggtaaccgaattgact

SEQ ID NO: 269872 - DNA, 20 bp, Artificial
  CRISPR gRNA sequence
ttgggtaaccgaattgacta

SEQ ID NO: 269873 - DNA, 20 bp, Artificial
  CRISPR gRNA sequence
ggtaaccgaattgactacaa

SEQ ID NO: 269874 - DNA, 20 bp, Artificial
  CRISPR gRNA sequence
actacaagaggccacaaatg

SEQ ID NO: 269875 - DNA, 20 bp, Artificial
  CRISPR gRNA sequence
caagaggccacaaatgacag

SEQ ID NO: 269876 - DNA, 20 bp, Artificial
  CRISPR gRNA sequence
cccaattcacagggggtctg

SEQ ID NO: 269877 - DNA, 20 bp, Artificial
  CRISPR gRNA sequence
acagggggtctgtaagacaa

SEQ ID NO: 269878 - DNA, 20 bp, Artificial
  CRISPR gRNA sequence
taagacaaagtaaaacaaaa

SEQ ID NO: 269879 - DNA, 20 bp, Artificial
  CRISPR gRNA sequence
ttttaaaacaaagcaagatg

SEQ ID NO: 269880 - DNA, 20 bp, Artificial
  CRISPR gRNA sequence
tttaaaacaaagcaagatga

SEQ ID NO: 269881 - DNA, 20 bp, Artificial
  CRISPR gRNA sequence
ttaaaacaaagcaagatgaa

SEQ ID NO: 269882 - DNA, 20 bp, Artificial
  CRISPR gRNA sequence
taaaacaaagcaagatgaat

SEQ ID NO: 269883 - DNA, 20 bp, Artificial
  CRISPR gRNA sequence
aaaacaaagcaagatgaatc

SEQ ID NO: 269884 - DNA, 20 bp, Artificial
  CRISPR gRNA sequence
aaacaaagcaagatgaatct

SEQ ID NO: 269885 - DNA, 20 bp, Artificial
  CRISPR gRNA sequence
actaggaattagtagtactg

SEQ ID NO: 269886 - DNA, 20 bp, Artificial
  CRISPR gRNA sequence
ggaattagtagtactgccaa

SEQ ID NO: 269887 - DNA, 20 bp, Artificial
  CRISPR gRNA sequence
gtagtactgccaaggaaaaa

SEQ ID NO: 269888 - DNA, 20 bp, Artificial
  CRISPR gRNA sequence
ccaaggaaaaacccagtgtg

SEQ ID NO: 269889 - DNA, 20 bp, Artificial
  CRISPR gRNA sequence
tgatgtgtctgagttgaaag

SEQ ID NO: 269890 - DNA, 20 bp, Artificial
  CRISPR gRNA sequence
agttgaaagtgaacggttta

SEQ ID NO: 269891 - DNA, 20 bp, Artificial
  CRISPR gRNA sequence
aaagtgaacggtttaaattc

SEQ ID NO: 269892 - DNA, 20 bp, Artificial
  CRISPR gRNA sequence
aaattcattgaaagtgagaa

SEQ ID NO: 269893 - DNA, 20 bp, Artificial
  CRISPR gRNA sequence
aattcattgaaagtgagaag

SEQ ID NO: 269894 - DNA, 20 bp, Artificial
  CRISPR gRNA sequence
attgaaagtgagaagctgct

SEQ ID NO: 269895 - DNA, 20 bp, Artificial
  CRISPR gRNA sequence
aaagtgagaagctgcttttg

SEQ ID NO: 269896 - DNA, 20 bp, Artificial
  CRISPR gRNA sequence
cttttgtccctttgggtgac

SEQ ID NO: 269897 - DNA, 20 bp, Artificial
  CRISPR gRNA sequence
ttgtccctttgggtgactca

SEQ ID NO: 269898 - DNA, 20 bp, Artificial
  CRISPR gRNA sequence
tgtccctttgggtgactcaa

SEQ ID NO: 269899 - DNA, 20 bp, Artificial
  CRISPR gRNA sequence
gtccctttgggtgactcaag

SEQ ID NO: 269900 - DNA, 20 bp, Artificial
  CRISPR gRNA sequence
tccctttgggtgactcaagt

SEQ ID NO: 269901 - DNA, 20 bp, Artificial
  CRISPR gRNA sequence
tgggtgactcaagtcactca

SEQ ID NO: 269902 - DNA, 20 bp, Artificial
  CRISPR gRNA sequence
gggtgactcaagtcactcaa

SEQ ID NO: 269903 - DNA, 20 bp, Artificial
  CRISPR gRNA sequence
ggtgactcaagtcactcaac

SEQ ID NO: 269904 - DNA, 20 bp, Artificial
  CRISPR gRNA sequence
aagtcactcaacaaattgat

SEQ ID NO: 269905 - DNA, 20 bp, Artificial
  CRISPR gRNA sequence
aacaaattgatgtctcatta

SEQ ID NO: 269906 - DNA, 20 bp, Artificial
  CRISPR gRNA sequence
atgtctcattatagtaactg

SEQ ID NO: 269907 - DNA, 20 bp, Artificial
  CRISPR gRNA sequence
attatagtaactgacattct

SEQ ID NO: 269908 - DNA, 20 bp, Artificial
  CRISPR gRNA sequence
tagtaactgacattctaatg

SEQ ID NO: 269909 - DNA, 20 bp, Artificial
  CRISPR gRNA sequence
acattctaatgaatatttat

SEQ ID NO: 269910 - DNA, 20 bp, Artificial
  CRISPR gRNA sequence
taatgaatatttataataag

SEQ ID NO: 269911 - DNA, 20 bp, Artificial
  CRISPR gRNA sequence
atgaatatttataataagtt

SEQ ID NO: 269912 - DNA, 20 bp, Artificial
  CRISPR gRNA sequence
ataataagttttcaataatg

SEQ ID NO: 269913 - DNA, 20 bp, Artificial
  CRISPR gRNA sequence
taataagttttcaataatga

SEQ ID NO: 269914 - DNA, 20 bp, Artificial
  CRISPR gRNA sequence
tcaataatgagcagtgtcct

SEQ ID NO: 269915 - DNA, 20 bp, Artificial
  CRISPR gRNA sequence
caataatgagcagtgtcctc

SEQ ID NO: 269916 - DNA, 20 bp, Artificial
  CRISPR gRNA sequence
aataatgagcagtgtcctct

SEQ ID NO: 269917 - DNA, 20 bp, Artificial
  CRISPR gRNA sequence
tggccattgaaggttaaagt

SEQ ID NO: 269918 - DNA, 20 bp, Artificial
  CRISPR gRNA sequence
gccattgaaggttaaagtaa

SEQ ID NO: 269919 - DNA, 20 bp, Artificial
  CRISPR gRNA sequence
aaggttaaagtaattcccaa

SEQ ID NO: 269920 - DNA, 20 bp, Artificial
  CRISPR gRNA sequence
aagtaattcccaaaactact

SEQ ID NO: 269921 - DNA, 20 bp, Artificial
  CRISPR gRNA sequence
ccaaaactactttctgcaga

SEQ ID NO: 269922 - DNA, 20 bp, Artificial
  CRISPR gRNA sequence
ctttctgcagagctagtaaa

SEQ ID NO: 269923 - DNA, 20 bp, Artificial
  CRISPR gRNA sequence
tctgcagagctagtaaatta

SEQ ID NO: 269924 - DNA, 20 bp, Artificial
  CRISPR gRNA sequence
ctgcagagctagtaaattac

SEQ ID NO: 269925 - DNA, 20 bp, Artificial
  CRISPR gRNA sequence
tgcagagctagtaaattact

SEQ ID NO: 269926 - DNA, 20 bp, Artificial
  CRISPR gRNA sequence
cagagctagtaaattacttt

SEQ ID NO: 269927 - DNA, 20 bp, Artificial
  CRISPR gRNA sequence
gtaaattactttgacctagg

SEQ ID NO: 269928 - DNA, 20 bp, Artificial
  CRISPR gRNA sequence
ctttgacctaggtcagcata

SEQ ID NO: 269929 - DNA, 20 bp, Artificial
  CRISPR gRNA sequence
tgacctaggtcagcatatca

SEQ ID NO: 269930 - DNA, 20 bp, Artificial
  CRISPR gRNA sequence
gacctaggtcagcatatcac

SEQ ID NO: 269931 - DNA, 20 bp, Artificial
  CRISPR gRNA sequence
acctaggtcagcatatcaca

SEQ ID NO: 269932 - DNA, 20 bp, Artificial
  CRISPR gRNA sequence
ggtcagcatatcacagggga

SEQ ID NO: 269933 - DNA, 20 bp, Artificial
  CRISPR gRNA sequence
tcctggaggggtatccaaag

SEQ ID NO: 269934 - DNA, 20 bp, Artificial
  CRISPR gRNA sequence
cctggaggggtatccaaagg

SEQ ID NO: 269935 - DNA, 20 bp, Artificial
  CRISPR gRNA sequence
ctggaggggtatccaaaggg

SEQ ID NO: 269936 - DNA, 20 bp, Artificial
  CRISPR gRNA sequence
gaggggtatccaaagggcca

SEQ ID NO: 269937 - DNA, 20 bp, Artificial
  CRISPR gRNA sequence
cacctggcctttaagttaga

SEQ ID NO: 269938 - DNA, 20 bp, Artificial
  CRISPR gRNA sequence
gcctttaagttagaaagttg

SEQ ID NO: 269939 - DNA, 20 bp, Artificial
  CRISPR gRNA sequence
taagttagaaagttgagatt

SEQ ID NO: 269940 - DNA, 20 bp, Artificial
  CRISPR gRNA sequence
aagttagaaagttgagattc

SEQ ID NO: 269941 - DNA, 20 bp, Artificial
  CRISPR gRNA sequence
agttagaaagttgagattcc

SEQ ID NO: 269942 - DNA, 20 bp, Artificial
  CRISPR gRNA sequence
gaaagttgagattcccaata

SEQ ID NO: 269943 - DNA, 20 bp, Artificial
  CRISPR gRNA sequence
agattcccaataagaggatt

SEQ ID NO: 269944 - DNA, 20 bp, Artificial
  CRISPR gRNA sequence
ccaataagaggattgaaaag

SEQ ID NO: 269945 - DNA, 20 bp, Artificial
  CRISPR gRNA sequence
aaaagccatatggtaggcat

SEQ ID NO: 269946 - DNA, 20 bp, Artificial
  CRISPR gRNA sequence
agaagaaacaagaactaaga

SEQ ID NO: 269947 - DNA, 20 bp, Artificial
  CRISPR gRNA sequence
agaattctaaaaactcgaaa

SEQ ID NO: 269948 - DNA, 20 bp, Artificial
  CRISPR gRNA sequence
taaaaactcgaaaattatca

SEQ ID NO: 269949 - DNA, 20 bp, Artificial
  CRISPR gRNA sequence
aaaactcgaaaattatcagc

SEQ ID NO: 269950 - DNA, 20 bp, Artificial
  CRISPR gRNA sequence
gaaaattatcagcaaacacc

SEQ ID NO: 269951 - DNA, 20 bp, Artificial
  CRISPR gRNA sequence
tcagcaaacaccagaggatc

SEQ ID NO: 269952 - DNA, 20 bp, Artificial
  CRISPR gRNA sequence
gaaggtaagttggatgaaga

SEQ ID NO: 269953 - DNA, 20 bp, Artificial
  CRISPR gRNA sequence
gatgaagataccaagatctg

SEQ ID NO: 269954 - DNA, 20 bp, Artificial
  CRISPR gRNA sequence
gaaaggtgaaagtagtcaac

SEQ ID NO: 269955 - DNA, 20 bp, Artificial
  CRISPR gRNA sequence
acatcagaggcagaattcag

SEQ ID NO: 269956 - DNA, 20 bp, Artificial
  CRISPR gRNA sequence
aggcaacattttacaatacc

SEQ ID NO: 269957 - DNA, 20 bp, Artificial
  CRISPR gRNA sequence
tacaataccaaagccccacc

SEQ ID NO: 269958 - DNA, 20 bp, Artificial
  CRISPR gRNA sequence
acaataccaaagccccacct

SEQ ID NO: 269959 - DNA, 20 bp, Artificial
  CRISPR gRNA sequence
caataccaaagccccacctt

SEQ ID NO: 269960 - DNA, 20 bp, Artificial
  CRISPR gRNA sequence
cagggttgggcaacttgcag

SEQ ID NO: 269961 - DNA, 20 bp, Artificial
  CRISPR gRNA sequence
agggttgggcaacttgcaga

SEQ ID NO: 269962 - DNA, 20 bp, Artificial
  CRISPR gRNA sequence
ggcaacttgcagaaggcaag

SEQ ID NO: 269963 - DNA, 20 bp, Artificial
  CRISPR gRNA sequence
gcagaaggcaagccaggcaa

SEQ ID NO: 269964 - DNA, 20 bp, Artificial
  CRISPR gRNA sequence
cagaaggcaagccaggcaaa

SEQ ID NO: 269965 - DNA, 20 bp, Artificial
  CRISPR gRNA sequence
ttaagatgatacctagtata

SEQ ID NO: 269966 - DNA, 20 bp, Artificial
  CRISPR gRNA sequence
aagatgatacctagtataaa

SEQ ID NO: 269967 - DNA, 20 bp, Artificial
  CRISPR gRNA sequence
agatgatacctagtataaag

SEQ ID NO: 269968 - DNA, 20 bp, Artificial
  CRISPR gRNA sequence
gtataaagaatttccaggaa

SEQ ID NO: 269969 - DNA, 20 bp, Artificial
  CRISPR gRNA sequence
ccaggaacaagcaaccactt

SEQ ID NO: 269970 - DNA, 20 bp, Artificial
  CRISPR gRNA sequence
caggaacaagcaaccacttt

SEQ ID NO: 269971 - DNA, 20 bp, Artificial
  CRISPR gRNA sequence
tgtttcctaccctgcggcaa

SEQ ID NO: 269972 - DNA, 20 bp, Artificial
  CRISPR gRNA sequence
gtttcctaccctgcggcaag

SEQ ID NO: 269973 - DNA, 20 bp, Artificial
  CRISPR gRNA sequence
tttcctaccctgcggcaagt

SEQ ID NO: 269974 - DNA, 20 bp, Artificial
  CRISPR gRNA sequence
cctaccctgcggcaagtaca

SEQ ID NO: 269975 - DNA, 20 bp, Artificial
  CRISPR gRNA sequence
ctaccctgcggcaagtacag

SEQ ID NO: 269976 - DNA, 20 bp, Artificial
  CRISPR gRNA sequence
ccctgcggcaagtacagagt

SEQ ID NO: 269977 - DNA, 20 bp, Artificial
  CRISPR gRNA sequence
cggcaagtacagagtaagca

SEQ ID NO: 269978 - DNA, 20 bp, Artificial
  CRISPR gRNA sequence
acaaatgtccatctgagccc

SEQ ID NO: 269979 - DNA, 20 bp, Artificial
  CRISPR gRNA sequence
agccctagggtcttctgaac

SEQ ID NO: 269980 - DNA, 20 bp, Artificial
  CRISPR gRNA sequence
gggtcttctgaactgcaagg

SEQ ID NO: 269981 - DNA, 20 bp, Artificial
  CRISPR gRNA sequence
ctgaactgcaaggagcatgt

SEQ ID NO: 269982 - DNA, 20 bp, Artificial
  CRISPR gRNA sequence
tgaactgcaaggagcatgtg

SEQ ID NO: 269983 - DNA, 20 bp, Artificial
  CRISPR gRNA sequence
aactgcaaggagcatgtggg

SEQ ID NO: 269984 - DNA, 20 bp, Artificial
  CRISPR gRNA sequence
caaggagcatgtggggaaca

SEQ ID NO: 269985 - DNA, 20 bp, Artificial
  CRISPR gRNA sequence
aaaggtaagctttggcaata

SEQ ID NO: 269986 - DNA, 20 bp, Artificial
  CRISPR gRNA sequence
tggcaataggccaagaagag

SEQ ID NO: 269987 - DNA, 20 bp, Artificial
  CRISPR gRNA sequence
ggcaataggccaagaagagt

SEQ ID NO: 269988 - DNA, 20 bp, Artificial
  CRISPR gRNA sequence
gcaataggccaagaagagtc

SEQ ID NO: 269989 - DNA, 20 bp, Artificial
  CRISPR gRNA sequence
aaagaatctaagactggata

SEQ ID NO: 269990 - DNA, 20 bp, Artificial
  CRISPR gRNA sequence
agactggataataggaaggc

SEQ ID NO: 269991 - DNA, 20 bp, Artificial
  CRISPR gRNA sequence
gataataggaaggcatggct

SEQ ID NO: 269992 - DNA, 20 bp, Artificial
  CRISPR gRNA sequence
tggatccaggtctgtacccg

SEQ ID NO: 269993 - DNA, 20 bp, Artificial
  CRISPR gRNA sequence
tacccgcagtcaccaagctg

SEQ ID NO: 269994 - DNA, 20 bp, Artificial
  CRISPR gRNA sequence
acagtaaacagaatgacttc

SEQ ID NO: 269995 - DNA, 20 bp, Artificial
  CRISPR gRNA sequence
catatgatatggctttcaga

SEQ ID NO: 269996 - DNA, 20 bp, Artificial
  CRISPR gRNA sequence
atatgatatggctttcagaa

SEQ ID NO: 269997 - DNA, 20 bp, Artificial
  CRISPR gRNA sequence
tcagaaatcactgacccatc

SEQ ID NO: 269998 - DNA, 20 bp, Artificial
  CRISPR gRNA sequence
cagaaatcactgacccatct

SEQ ID NO: 269999 - DNA, 20 bp, Artificial
  CRISPR gRNA sequence
agaaatcactgacccatcta

SEQ ID NO: 270000 - DNA, 20 bp, Artificial
  CRISPR gRNA sequence
acccatctatgaattaggta

SEQ ID NO: 270001 - DNA, 20 bp, Artificial
  CRISPR gRNA sequence
tgaattaggtacatatacag

SEQ ID NO: 270002 - DNA, 20 bp, Artificial
  CRISPR gRNA sequence
ggtacatatacagattatgc

SEQ ID NO: 270003 - DNA, 20 bp, Artificial
  CRISPR gRNA sequence
tgccttaaagatgagtatca

SEQ ID NO: 270004 - DNA, 20 bp, Artificial
  CRISPR gRNA sequence
aaagatgagtatcatacttc

SEQ ID NO: 270005 - DNA, 20 bp, Artificial
  CRISPR gRNA sequence
aagatgagtatcatacttca

SEQ ID NO: 270006 - DNA, 20 bp, Artificial
  CRISPR gRNA sequence
caggcagactcatttaaatc

SEQ ID NO: 270007 - DNA, 20 bp, Artificial
  CRISPR gRNA sequence
aggcagactcatttaaatcc

SEQ ID NO: 270008 - DNA, 20 bp, Artificial
  CRISPR gRNA sequence
atttaaatccttaatttgac

SEQ ID NO: 270009 - DNA, 20 bp, Artificial
  CRISPR gRNA sequence
aaatccttaatttgacctct

SEQ ID NO: 270010 - DNA, 20 bp, Artificial
  CRISPR gRNA sequence
aatccttaatttgacctctc

SEQ ID NO: 270011 - DNA, 20 bp, Artificial
  CRISPR gRNA sequence
aatttgacctctctggaggt

SEQ ID NO: 270012 - DNA, 20 bp, Artificial
  CRISPR gRNA sequence
atttgacctctctggaggtt

SEQ ID NO: 270013 - DNA, 20 bp, Artificial
  CRISPR gRNA sequence
gacctctctggaggttatca

SEQ ID NO: 270014 - DNA, 20 bp, Artificial
  CRISPR gRNA sequence
acctctctggaggttatcaa

SEQ ID NO: 270015 - DNA, 20 bp, Artificial
  CRISPR gRNA sequence
tctggaggttatcaattcat

SEQ ID NO: 270016 - DNA, 20 bp, Artificial
  CRISPR gRNA sequence
tggaggttatcaattcatca

SEQ ID NO: 270017 - DNA, 20 bp, Artificial
  CRISPR gRNA sequence
gaggttatcaattcatcaat

SEQ ID NO: 270018 - DNA, 20 bp, Artificial
  CRISPR gRNA sequence
tcaattcatcaatccaataa

SEQ ID NO: 270019 - DNA, 20 bp, Artificial
  CRISPR gRNA sequence
atcaatccaataagcattca

SEQ ID NO: 270020 - DNA, 20 bp, Artificial
  CRISPR gRNA sequence
attaagcaccaaatgtactt

SEQ ID NO: 270021 - DNA, 20 bp, Artificial
  CRISPR gRNA sequence
agcaccaaatgtacttaata

SEQ ID NO: 270022 - DNA, 20 bp, Artificial
  CRISPR gRNA sequence
aatatcaaatggagaatatc

SEQ ID NO: 270023 - DNA, 20 bp, Artificial
  CRISPR gRNA sequence
atatcaaatggagaatatca

SEQ ID NO: 270024 - DNA, 20 bp, Artificial
  CRISPR gRNA sequence
ttggagactatcaagagaaa

SEQ ID NO: 270025 - DNA, 20 bp, Artificial
  CRISPR gRNA sequence
tggagactatcaagagaaat

SEQ ID NO: 270026 - DNA, 20 bp, Artificial
  CRISPR gRNA sequence
ggagactatcaagagaaata

SEQ ID NO: 270027 - DNA, 20 bp, Artificial
  CRISPR gRNA sequence
gagactatcaagagaaatag

SEQ ID NO: 270028 - DNA, 20 bp, Artificial
  CRISPR gRNA sequence
tcaagagaaatagtctttta

SEQ ID NO: 270029 - DNA, 20 bp, Artificial
  CRISPR gRNA sequence
ttatgtttgagaatacattt

SEQ ID NO: 270030 - DNA, 20 bp, Artificial
  CRISPR gRNA sequence
tatgtttgagaatacatttc

SEQ ID NO: 270031 - DNA, 20 bp, Artificial
  CRISPR gRNA sequence
atgtttgagaatacatttct

SEQ ID NO: 270032 - DNA, 20 bp, Artificial
  CRISPR gRNA sequence
tgtttgagaatacatttctc

SEQ ID NO: 270033 - DNA, 20 bp, Artificial
  CRISPR gRNA sequence
gagaatacatttctcattga

SEQ ID NO: 270034 - DNA, 20 bp, Artificial
  CRISPR gRNA sequence
agaatacatttctcattgaa

SEQ ID NO: 270035 - DNA, 20 bp, Artificial
  CRISPR gRNA sequence
ctcattgaagaaatgactca

SEQ ID NO: 270036 - DNA, 20 bp, Artificial
  CRISPR gRNA sequence
tcattgaagaaatgactcat

SEQ ID NO: 270037 - DNA, 20 bp, Artificial
  CRISPR gRNA sequence
attgaagaaatgactcatcc

SEQ ID NO: 270038 - DNA, 20 bp, Artificial
  CRISPR gRNA sequence
aagaaatgactcatccatgc

SEQ ID NO: 270039 - DNA, 20 bp, Artificial
  CRISPR gRNA sequence
atccatgcatgtaacttcta

SEQ ID NO: 270040 - DNA, 20 bp, Artificial
  CRISPR gRNA sequence
ctagaaaaaaattcaaagac

SEQ ID NO: 270041 - DNA, 20 bp, Artificial
  CRISPR gRNA sequence
tagaaaaaaattcaaagaca

SEQ ID NO: 270042 - DNA, 20 bp, Artificial
  CRISPR gRNA sequence
gaaaaaaattcaaagacaac

SEQ ID NO: 270043 - DNA, 20 bp, Artificial
  CRISPR gRNA sequence
aaagacaacatggagtcaat

SEQ ID NO: 270044 - DNA, 20 bp, Artificial
  CRISPR gRNA sequence
tgtaccatactatgtaccta

SEQ ID NO: 270045 - DNA, 20 bp, Artificial
  CRISPR gRNA sequence
taccatactatgtacctaag

SEQ ID NO: 270046 - DNA, 20 bp, Artificial
  CRISPR gRNA sequence
tgtacctaagaagtttctga

SEQ ID NO: 270047 - DNA, 20 bp, Artificial
  CRISPR gRNA sequence
agaagtttctgagtaagaac

SEQ ID NO: 270048 - DNA, 20 bp, Artificial
  CRISPR gRNA sequence
ctgagtaagaacaagggtca

SEQ ID NO: 270049 - DNA, 20 bp, Artificial
  CRISPR gRNA sequence
tgagtaagaacaagggtcac

SEQ ID NO: 270050 - DNA, 20 bp, Artificial
  CRISPR gRNA sequence
agtaagaacaagggtcactc

SEQ ID NO: 270051 - DNA, 20 bp, Artificial
  CRISPR gRNA sequence
aggggtacgttcttaactgt

SEQ ID NO: 270052 - DNA, 20 bp, Artificial
  CRISPR gRNA sequence
ttaactgtaggtgcgttcat

SEQ ID NO: 270053 - DNA, 20 bp, Artificial
  CRISPR gRNA sequence
aactgtaggtgcgttcatca

SEQ ID NO: 270054 - DNA, 20 bp, Artificial
  CRISPR gRNA sequence
actgtaggtgcgttcatcaa

SEQ ID NO: 270055 - DNA, 20 bp, Artificial
  CRISPR gRNA sequence
taggtgcgttcatcaaaatg

SEQ ID NO: 270056 - DNA, 20 bp, Artificial
  CRISPR gRNA sequence
atcaaaatgtgttcaaaccc

SEQ ID NO: 270057 - DNA, 20 bp, Artificial
  CRISPR gRNA sequence
aaacccaggccaaaaattca

SEQ ID NO: 270058 - DNA, 20 bp, Artificial
  CRISPR gRNA sequence
aatgttgaggaaggtaaaga

SEQ ID NO: 270059 - DNA, 20 bp, Artificial
  CRISPR gRNA sequence
aggaaggtaaagaaaaatac

SEQ ID NO: 270060 - DNA, 20 bp, Artificial
  CRISPR gRNA sequence
attacgtaaacatttgcaaa

SEQ ID NO: 270061 - DNA, 20 bp, Artificial
  CRISPR gRNA sequence
ttacgtaaacatttgcaaaa

SEQ ID NO: 270062 - DNA, 20 bp, Artificial
  CRISPR gRNA sequence
cgtaaacatttgcaaaagtt

SEQ ID NO: 270063 - DNA, 20 bp, Artificial
  CRISPR gRNA sequence
gcaaaagttagtacttcaat

SEQ ID NO: 270064 - DNA, 20 bp, Artificial
  CRISPR gRNA sequence
caaaagttagtacttcaatt

SEQ ID NO: 270065 - DNA, 20 bp, Artificial
  CRISPR gRNA sequence
gtacttcaattcagtggtga

SEQ ID NO: 270066 - DNA, 20 bp, Artificial
  CRISPR gRNA sequence
caattcagtggtgagagctc

SEQ ID NO: 270067 - DNA, 20 bp, Artificial
  CRISPR gRNA sequence
aattcagtggtgagagctca

SEQ ID NO: 270068 - DNA, 20 bp, Artificial
  CRISPR gRNA sequence
agtggtgagagctcagaaaa

SEQ ID NO: 270069 - DNA, 20 bp, Artificial
  CRISPR gRNA sequence
agaaaattctaactcccatt

SEQ ID NO: 270070 - DNA, 20 bp, Artificial
  CRISPR gRNA sequence
taactcccattatagtttca

SEQ ID NO: 270071 - DNA, 20 bp, Artificial
  CRISPR gRNA sequence
actcccattatagtttcata

SEQ ID NO: 270072 - DNA, 20 bp, Artificial
  CRISPR gRNA sequence
ccattatagtttcataatga

SEQ ID NO: 270073 - DNA, 20 bp, Artificial
  CRISPR gRNA sequence
tagtttcataatgacagcac

SEQ ID NO: 270074 - DNA, 20 bp, Artificial
  CRISPR gRNA sequence
cataatgacagcaccatact

SEQ ID NO: 270075 - DNA, 20 bp, Artificial
  CRISPR gRNA sequence
ataatgacagcaccatactt

SEQ ID NO: 270076 - DNA, 20 bp, Artificial
  CRISPR gRNA sequence
ggcctcacacaattcaactg

SEQ ID NO: 270077 - DNA, 20 bp, Artificial
  CRISPR gRNA sequence
gcctcacacaattcaactgc

SEQ ID NO: 270078 - DNA, 20 bp, Artificial
  CRISPR gRNA sequence
acacaattcaactgcttcag

SEQ ID NO: 270079 - DNA, 20 bp, Artificial
  CRISPR gRNA sequence
aactgcttcagaggagaaaa

SEQ ID NO: 270080 - DNA, 20 bp, Artificial
  CRISPR gRNA sequence
cttcagaggagaaaaaaaaa

SEQ ID NO: 270081 - DNA, 20 bp, Artificial
  CRISPR gRNA sequence
cagaggagaaaaaaaaatat

SEQ ID NO: 270082 - DNA, 20 bp, Artificial
  CRISPR gRNA sequence
agaggagaaaaaaaaatatg

SEQ ID NO: 270083 - DNA, 20 bp, Artificial
  CRISPR gRNA sequence
agataaacagatctagtttc

SEQ ID NO: 270084 - DNA, 20 bp, Artificial
  CRISPR gRNA sequence
gtttctttgctaggtttgaa

SEQ ID NO: 270085 - DNA, 20 bp, Artificial
  CRISPR gRNA sequence
ctttgctaggtttgaataca

SEQ ID NO: 270086 - DNA, 20 bp, Artificial
  CRISPR gRNA sequence
tttgctaggtttgaatacac

SEQ ID NO: 270087 - DNA, 20 bp, Artificial
  CRISPR gRNA sequence
tgctaggtttgaatacacaa

SEQ ID NO: 270088 - DNA, 20 bp, Artificial
  CRISPR gRNA sequence
gctaggtttgaatacacaat

SEQ ID NO: 270089 - DNA, 20 bp, Artificial
  CRISPR gRNA sequence
ctaggtttgaatacacaatt

SEQ ID NO: 270090 - DNA, 20 bp, Artificial
  CRISPR gRNA sequence
ggtttgaatacacaatttca

SEQ ID NO: 270091 - DNA, 20 bp, Artificial
  CRISPR gRNA sequence
gaatacacaatttcagtagc

SEQ ID NO: 270092 - DNA, 20 bp, Artificial
  CRISPR gRNA sequence
aatacacaatttcagtagcc

SEQ ID NO: 270093 - DNA, 20 bp, Artificial
  CRISPR gRNA sequence
cagtagccaagtttctcatg

SEQ ID NO: 270094 - DNA, 20 bp, Artificial
  CRISPR gRNA sequence
agtagccaagtttctcatga

SEQ ID NO: 270095 - DNA, 20 bp, Artificial
  CRISPR gRNA sequence
ctcatgatttttgatcaagc

SEQ ID NO: 270096 - DNA, 20 bp, Artificial
  CRISPR gRNA sequence
tcatgatttttgatcaagcc

SEQ ID NO: 270097 - DNA, 20 bp, Artificial
  CRISPR gRNA sequence
atgatttttgatcaagccaa

SEQ ID NO: 270098 - DNA, 20 bp, Artificial
  CRISPR gRNA sequence
ttgatcaagccaacattgtc

SEQ ID NO: 270099 - DNA, 20 bp, Artificial
  CRISPR gRNA sequence
tgatcaagccaacattgtcc

SEQ ID NO: 270100 - DNA, 20 bp, Artificial
  CRISPR gRNA sequence
gatcaagccaacattgtcca

SEQ ID NO: 270101 - DNA, 20 bp, Artificial
  CRISPR gRNA sequence
atcaagccaacattgtccat

SEQ ID NO: 270102 - DNA, 20 bp, Artificial
  CRISPR gRNA sequence
tccattggcttcagttgcct

SEQ ID NO: 270103 - DNA, 20 bp, Artificial
  CRISPR gRNA sequence
gcttcagttgcctagcttcc

SEQ ID NO: 270104 - DNA, 20 bp, Artificial
  CRISPR gRNA sequence
cagttgcctagcttcccaag

SEQ ID NO: 270105 - DNA, 20 bp, Artificial
  CRISPR gRNA sequence
agttgcctagcttcccaagt

SEQ ID NO: 270106 - DNA, 20 bp, Artificial
  CRISPR gRNA sequence
cctagcttcccaagttgcct

SEQ ID NO: 270107 - DNA, 20 bp, Artificial
  CRISPR gRNA sequence
gcttcccaagttgcctaggt

SEQ ID NO: 270108 - DNA, 20 bp, Artificial
  CRISPR gRNA sequence
cccaagttgcctaggtgttt

SEQ ID NO: 270109 - DNA, 20 bp, Artificial
  CRISPR gRNA sequence
ccaagttgcctaggtgttta

SEQ ID NO: 270110 - DNA, 20 bp, Artificial
  CRISPR gRNA sequence
cctaggtgtttatacatata

SEQ ID NO: 270111 - DNA, 20 bp, Artificial
  CRISPR gRNA sequence
ggtgtttatacatatatacg

SEQ ID NO: 270112 - DNA, 20 bp, Artificial
  CRISPR gRNA sequence
atacatatatacgcattaaa

SEQ ID NO: 270113 - DNA, 20 bp, Artificial
  CRISPR gRNA sequence
tacatatatacgcattaaaa

SEQ ID NO: 270114 - DNA, 20 bp, Artificial
  CRISPR gRNA sequence
aaactgttttatgtgtcata

SEQ ID NO: 270115 - DNA, 20 bp, Artificial
  CRISPR gRNA sequence
ttttatgtgtcataattata

SEQ ID NO: 270116 - DNA, 20 bp, Artificial
  CRISPR gRNA sequence
tatgtgtcataattatattg

SEQ ID NO: 270117 - DNA, 20 bp, Artificial
  CRISPR gRNA sequence
atgtgtcataattatattgc

SEQ ID NO: 270118 - DNA, 20 bp, Artificial
  CRISPR gRNA sequence
tgtgtcataattatattgca

SEQ ID NO: 270119 - DNA, 20 bp, Artificial
  CRISPR gRNA sequence
tattgcaaaatggggagaag

SEQ ID NO: 270120 - DNA, 20 bp, Artificial
  CRISPR gRNA sequence
caaaatggggagaagaaagg

SEQ ID NO: 270121 - DNA, 20 bp, Artificial
  CRISPR gRNA sequence
ctcctaatccctccacccta

SEQ ID NO: 270122 - DNA, 20 bp, Artificial
  CRISPR gRNA sequence
ctaatccctccaccctaatt

SEQ ID NO: 270123 - DNA, 20 bp, Artificial
  CRISPR gRNA sequence
atccctccaccctaatttac

SEQ ID NO: 270124 - DNA, 20 bp, Artificial
  CRISPR gRNA sequence
caccctaatttacccattta

SEQ ID NO: 270125 - DNA, 20 bp, Artificial
  CRISPR gRNA sequence
atttacccatttagcttctt

SEQ ID NO: 270126 - DNA, 20 bp, Artificial
  CRISPR gRNA sequence
acccatttagcttcttattt

SEQ ID NO: 270127 - DNA, 20 bp, Artificial
  CRISPR gRNA sequence
cccatttagcttcttatttt

SEQ ID NO: 270128 - DNA, 20 bp, Artificial
  CRISPR gRNA sequence
agcttcttattttgcctcac

SEQ ID NO: 270129 - DNA, 20 bp, Artificial
  CRISPR gRNA sequence
gcttcttattttgcctcacc

SEQ ID NO: 270130 - DNA, 20 bp, Artificial
  CRISPR gRNA sequence
cttattttgcctcaccacct

SEQ ID NO: 270131 - DNA, 20 bp, Artificial
  CRISPR gRNA sequence
ttattttgcctcaccaccta

SEQ ID NO: 270132 - DNA, 20 bp, Artificial
  CRISPR gRNA sequence
attttgcctcaccacctact

SEQ ID NO: 270133 - DNA, 20 bp, Artificial
  CRISPR gRNA sequence
ttttgcctcaccacctactc

SEQ ID NO: 270134 - DNA, 20 bp, Artificial
  CRISPR gRNA sequence
tgcctcaccacctactcaat

SEQ ID NO: 270135 - DNA, 20 bp, Artificial
  CRISPR gRNA sequence
gcctcaccacctactcaatg

SEQ ID NO: 270136 - DNA, 20 bp, Artificial
  CRISPR gRNA sequence
cctcaccacctactcaatgc

SEQ ID NO: 270137 - DNA, 20 bp, Artificial
  CRISPR gRNA sequence
accacctactcaatgccttc

SEQ ID NO: 270138 - DNA, 20 bp, Artificial
  CRISPR gRNA sequence
ctcaatgccttctgggaaat

SEQ ID NO: 270139 - DNA, 20 bp, Artificial
  CRISPR gRNA sequence
aatgccttctgggaaatcta

SEQ ID NO: 270140 - DNA, 20 bp, Artificial
  CRISPR gRNA sequence
ctgggaaatctaactcatat

SEQ ID NO: 270141 - DNA, 20 bp, Artificial
  CRISPR gRNA sequence
tgggaaatctaactcatatc

SEQ ID NO: 270142 - DNA, 20 bp, Artificial
  CRISPR gRNA sequence
ggaaatctaactcatatcag

SEQ ID NO: 270143 - DNA, 20 bp, Artificial
  CRISPR gRNA sequence
actcatatcagatttttatc

SEQ ID NO: 270144 - DNA, 20 bp, Artificial
  CRISPR gRNA sequence
atatcagatttttatctcag

SEQ ID NO: 270145 - DNA, 20 bp, Artificial
  CRISPR gRNA sequence
ttatctcagatagagttgaa

SEQ ID NO: 270146 - DNA, 20 bp, Artificial
  CRISPR gRNA sequence
tatctcagatagagttgaac

SEQ ID NO: 270147 - DNA, 20 bp, Artificial
  CRISPR gRNA sequence
atctcagatagagttgaaca

SEQ ID NO: 270148 - DNA, 20 bp, Artificial
  CRISPR gRNA sequence
tctcagatagagttgaacaa

SEQ ID NO: 270149 - DNA, 20 bp, Artificial
  CRISPR gRNA sequence
agatagagttgaacaagcta

SEQ ID NO: 270150 - DNA, 20 bp, Artificial
  CRISPR gRNA sequence
aacaagctaaaagagaacct

SEQ ID NO: 270151 - DNA, 20 bp, Artificial
  CRISPR gRNA sequence
aaagagaacctactcaagca

SEQ ID NO: 270152 - DNA, 20 bp, Artificial
  CRISPR gRNA sequence
ctcaagcatggggaaaagaa

SEQ ID NO: 270153 - DNA, 20 bp, Artificial
  CRISPR gRNA sequence
aagcatggggaaaagaaaat

SEQ ID NO: 270154 - DNA, 20 bp, Artificial
  CRISPR gRNA sequence
tattaaacagaaaataaacc

SEQ ID NO: 270155 - DNA, 20 bp, Artificial
  CRISPR gRNA sequence
aacagaaaataaaccacata

SEQ ID NO: 270156 - DNA, 20 bp, Artificial
  CRISPR gRNA sequence
ttgaatgtgttcagatttca

SEQ ID NO: 270157 - DNA, 20 bp, Artificial
  CRISPR gRNA sequence
gaatgtgttcagatttcatg

SEQ ID NO: 270158 - DNA, 20 bp, Artificial
  CRISPR gRNA sequence
aatgtgttcagatttcatgt

SEQ ID NO: 270159 - DNA, 20 bp, Artificial
  CRISPR gRNA sequence
agatttcatgtgcagtggaa

SEQ ID NO: 270160 - DNA, 20 bp, Artificial
  CRISPR gRNA sequence
catgtgcagtggaaaagtta

SEQ ID NO: 270161 - DNA, 20 bp, Artificial
  CRISPR gRNA sequence
atgtgcagtggaaaagttac

SEQ ID NO: 270162 - DNA, 20 bp, Artificial
  CRISPR gRNA sequence
cataaaagcagtgctgcttc

SEQ ID NO: 270163 - DNA, 20 bp, Artificial
  CRISPR gRNA sequence
cttctcttacccagaaaata

SEQ ID NO: 270164 - DNA, 20 bp, Artificial
  CRISPR gRNA sequence
ctcttacccagaaaataata

SEQ ID NO: 270165 - DNA, 20 bp, Artificial
  CRISPR gRNA sequence
tcttacccagaaaataataa

SEQ ID NO: 270166 - DNA, 20 bp, Artificial
  CRISPR gRNA sequence
ttacccagaaaataataaag

SEQ ID NO: 270167 - DNA, 20 bp, Artificial
  CRISPR gRNA sequence
acccagaaaataataaaggc

SEQ ID NO: 270168 - DNA, 20 bp, Artificial
  CRISPR gRNA sequence
cccagaaaataataaaggcc

SEQ ID NO: 270169 - DNA, 20 bp, Artificial
  CRISPR gRNA sequence
ttactagcaagctatagcaa

SEQ ID NO: 270170 - DNA, 20 bp, Artificial
  CRISPR gRNA sequence
ctagcaagctatagcaagcc

SEQ ID NO: 270171 - DNA, 20 bp, Artificial
  CRISPR gRNA sequence
gcaagctatagcaagccagg

SEQ ID NO: 270172 - DNA, 20 bp, Artificial
  CRISPR gRNA sequence
tagcaagccaggactccacc

SEQ ID NO: 270173 - DNA, 20 bp, Artificial
  CRISPR gRNA sequence
caccaaccaccaccagcacc

SEQ ID NO: 270174 - DNA, 20 bp, Artificial
  CRISPR gRNA sequence
agaaggtccgggaaataggg

SEQ ID NO: 270175 - DNA, 20 bp, Artificial
  CRISPR gRNA sequence
gaaggtccgggaaatagggg

SEQ ID NO: 270176 - DNA, 20 bp, Artificial
  CRISPR gRNA sequence
ggacaaaggtgtttccctga

SEQ ID NO: 270177 - DNA, 20 bp, Artificial
  CRISPR gRNA sequence
gacaaaggtgtttccctgaa

SEQ ID NO: 270178 - DNA, 20 bp, Artificial
  CRISPR gRNA sequence
ccctgaaaaacaaaatagag

SEQ ID NO: 270179 - DNA, 20 bp, Artificial
  CRISPR gRNA sequence
cctgaaaaacaaaatagagt

SEQ ID NO: 270180 - DNA, 20 bp, Artificial
  CRISPR gRNA sequence
aaaaacaaaatagagtggat

SEQ ID NO: 270181 - DNA, 20 bp, Artificial
  CRISPR gRNA sequence
aatgatacaggaatagcaat

SEQ ID NO: 270182 - DNA, 20 bp, Artificial
  CRISPR gRNA sequence
agtgcatttccttccttgtg

SEQ ID NO: 270183 - DNA, 20 bp, Artificial
  CRISPR gRNA sequence
ccttccttgtgaacatcaga

SEQ ID NO: 270184 - DNA, 20 bp, Artificial
  CRISPR gRNA sequence
cttccttgtgaacatcagag

SEQ ID NO: 270185 - DNA, 20 bp, Artificial
  CRISPR gRNA sequence
ccttgtgaacatcagagaaa

SEQ ID NO: 270186 - DNA, 20 bp, Artificial
  CRISPR gRNA sequence
cttgtgaacatcagagaaaa

SEQ ID NO: 270187 - DNA, 20 bp, Artificial
  CRISPR gRNA sequence
gtgaacatcagagaaaaatg

SEQ ID NO: 270188 - DNA, 20 bp, Artificial
  CRISPR gRNA sequence
tgaacatcagagaaaaatgt

SEQ ID NO: 270189 - DNA, 20 bp, Artificial
  CRISPR gRNA sequence
aacatatcaccagcttagag

SEQ ID NO: 270190 - DNA, 20 bp, Artificial
  CRISPR gRNA sequence
agagtgaatagatttcctct

SEQ ID NO: 270191 - DNA, 20 bp, Artificial
  CRISPR gRNA sequence
gagtgaatagatttcctctt

SEQ ID NO: 270192 - DNA, 20 bp, Artificial
  CRISPR gRNA sequence
cctctttgagacttacccaa

SEQ ID NO: 270193 - DNA, 20 bp, Artificial
  CRISPR gRNA sequence
ctctttgagacttacccaac

SEQ ID NO: 270194 - DNA, 20 bp, Artificial
  CRISPR gRNA sequence
tttgagacttacccaacccc

SEQ ID NO: 270195 - DNA, 20 bp, Artificial
  CRISPR gRNA sequence
tgagacttacccaaccccac

SEQ ID NO: 270196 - DNA, 20 bp, Artificial
  CRISPR gRNA sequence
gagacttacccaaccccacc

SEQ ID NO: 270197 - DNA, 20 bp, Artificial
  CRISPR gRNA sequence
agacttacccaaccccacca

SEQ ID NO: 270198 - DNA, 20 bp, Artificial
  CRISPR gRNA sequence
acccaaccccaccactgacc

SEQ ID NO: 270199 - DNA, 20 bp, Artificial
  CRISPR gRNA sequence
cccaaccccaccactgacca

SEQ ID NO: 270200 - DNA, 20 bp, Artificial
  CRISPR gRNA sequence
accatgatctggtcagtttt

SEQ ID NO: 270201 - DNA, 20 bp, Artificial
  CRISPR gRNA sequence
gtcagttttcacgaccacag

SEQ ID NO: 270202 - DNA, 20 bp, Artificial
  CRISPR gRNA sequence
tcacgaccacagttgaaagc

SEQ ID NO: 270203 - DNA, 20 bp, Artificial
  CRISPR gRNA sequence
cacgaccacagttgaaagcc

SEQ ID NO: 270204 - DNA, 20 bp, Artificial
  CRISPR gRNA sequence
acgaccacagttgaaagcca

SEQ ID NO: 270205 - DNA, 20 bp, Artificial
  CRISPR gRNA sequence
aaagccattacgttaggatg

SEQ ID NO: 270206 - DNA, 20 bp, Artificial
  CRISPR gRNA sequence
cgttaggatggtacactggt

SEQ ID NO: 270207 - DNA, 20 bp, Artificial
  CRISPR gRNA sequence
ggatggtacactggtagact

SEQ ID NO: 270208 - DNA, 20 bp, Artificial
  CRISPR gRNA sequence
gtagacttgtattcacttga

SEQ ID NO: 270209 - DNA, 20 bp, Artificial
  CRISPR gRNA sequence
gtattcacttgactttgtgg

SEQ ID NO: 270210 - DNA, 20 bp, Artificial
  CRISPR gRNA sequence
tattcacttgactttgtgga

SEQ ID NO: 270211 - DNA, 20 bp, Artificial
  CRISPR gRNA sequence
acttgactttgtggattcta

SEQ ID NO: 270212 - DNA, 20 bp, Artificial
  CRISPR gRNA sequence
gactttgtggattctactgt

SEQ ID NO: 270213 - DNA, 20 bp, Artificial
  CRISPR gRNA sequence
actttgtggattctactgtg

SEQ ID NO: 270214 - DNA, 20 bp, Artificial
  CRISPR gRNA sequence
tgtggattctactgtgtgat

SEQ ID NO: 270215 - DNA, 20 bp, Artificial
  CRISPR gRNA sequence
gtggattctactgtgtgatt

SEQ ID NO: 270216 - DNA, 20 bp, Artificial
  CRISPR gRNA sequence
tggattctactgtgtgattc

SEQ ID NO: 270217 - DNA, 20 bp, Artificial
  CRISPR gRNA sequence
tactgtgtgattcaaaacgg

SEQ ID NO: 270218 - DNA, 20 bp, Artificial
  CRISPR gRNA sequence
ctgtgtgattcaaaacggtg

SEQ ID NO: 270219 - DNA, 20 bp, Artificial
  CRISPR gRNA sequence
tgtgattcaaaacggtgact

SEQ ID NO: 270220 - DNA, 20 bp, Artificial
  CRISPR gRNA sequence
aaaacggtgacttccaatgg

SEQ ID NO: 270221 - DNA, 20 bp, Artificial
  CRISPR gRNA sequence
ccaatggccttaacctaact

SEQ ID NO: 270222 - DNA, 20 bp, Artificial
  CRISPR gRNA sequence
caatggccttaacctaactt

SEQ ID NO: 270223 - DNA, 20 bp, Artificial
  CRISPR gRNA sequence
aacctaactttatccgtttc

SEQ ID NO: 270224 - DNA, 20 bp, Artificial
  CRISPR gRNA sequence
acctaactttatccgtttct

SEQ ID NO: 270225 - DNA, 20 bp, Artificial
  CRISPR gRNA sequence
actttatccgtttctcccat

SEQ ID NO: 270226 - DNA, 20 bp, Artificial
  CRISPR gRNA sequence
tatccgtttctcccatcaga

SEQ ID NO: 270227 - DNA, 20 bp, Artificial
  CRISPR gRNA sequence
atccgtttctcccatcagaa

SEQ ID NO: 270228 - DNA, 20 bp, Artificial
  CRISPR gRNA sequence
tccgtttctcccatcagaag

SEQ ID NO: 270229 - DNA, 20 bp, Artificial
  CRISPR gRNA sequence
ctcccatcagaagatagtta

SEQ ID NO: 270230 - DNA, 20 bp, Artificial
  CRISPR gRNA sequence
tcccatcagaagatagttaa

SEQ ID NO: 270231 - DNA, 20 bp, Artificial
  CRISPR gRNA sequence
ccatcagaagatagttaatc

SEQ ID NO: 270232 - DNA, 20 bp, Artificial
  CRISPR gRNA sequence
atctagaccctaaactgcat

SEQ ID NO: 270233 - DNA, 20 bp, Artificial
  CRISPR gRNA sequence
gaccctaaactgcatccttg

SEQ ID NO: 270234 - DNA, 20 bp, Artificial
  CRISPR gRNA sequence
aactgcatccttggaataag

SEQ ID NO: 270235 - DNA, 20 bp, Artificial
  CRISPR gRNA sequence
catccttggaataagttaaa

SEQ ID NO: 270236 - DNA, 20 bp, Artificial
  CRISPR gRNA sequence
ggaataagttaaataatatg

SEQ ID NO: 270237 - DNA, 20 bp, Artificial
  CRISPR gRNA sequence
gaataagttaaataatatgc

SEQ ID NO: 270238 - DNA, 20 bp, Artificial
  CRISPR gRNA sequence
aataatatgcatgttttcaa

SEQ ID NO: 270239 - DNA, 20 bp, Artificial
  CRISPR gRNA sequence
tcaagccttaagaaaatcat

SEQ ID NO: 270240 - DNA, 20 bp, Artificial
  CRISPR gRNA sequence
caagccttaagaaaatcatc

SEQ ID NO: 270241 - DNA, 20 bp, Artificial
  CRISPR gRNA sequence
aagccttaagaaaatcatca

SEQ ID NO: 270242 - DNA, 20 bp, Artificial
  CRISPR gRNA sequence
aagaaaatcatcagcctaat

SEQ ID NO: 270243 - DNA, 20 bp, Artificial
  CRISPR gRNA sequence
agaaaatcatcagcctaata

SEQ ID NO: 270244 - DNA, 20 bp, Artificial
  CRISPR gRNA sequence
atatggcagtcagaacactg

SEQ ID NO: 270245 - DNA, 20 bp, Artificial
  CRISPR gRNA sequence
gactgctaatcagaggataa

SEQ ID NO: 270246 - DNA, 20 bp, Artificial
  CRISPR gRNA sequence
ctaatcagaggataaatttc

SEQ ID NO: 270247 - DNA, 20 bp, Artificial
  CRISPR gRNA sequence
atcagaggataaatttctag

SEQ ID NO: 270248 - DNA, 20 bp, Artificial
  CRISPR gRNA sequence
ctagttccaaccctgtctca

SEQ ID NO: 270249 - DNA, 20 bp, Artificial
  CRISPR gRNA sequence
tagttccaaccctgtctcat

SEQ ID NO: 270250 - DNA, 20 bp, Artificial
  CRISPR gRNA sequence
gttccaaccctgtctcatag

SEQ ID NO: 270251 - DNA, 20 bp, Artificial
  CRISPR gRNA sequence
caaccctgtctcatagatta

SEQ ID NO: 270252 - DNA, 20 bp, Artificial
  CRISPR gRNA sequence
tctcatagattatataatga

SEQ ID NO: 270253 - DNA, 20 bp, Artificial
  CRISPR gRNA sequence
atagattatataatgacaaa

SEQ ID NO: 270254 - DNA, 20 bp, Artificial
  CRISPR gRNA sequence
tataatgacaaacaaatcac

SEQ ID NO: 270255 - DNA, 20 bp, Artificial
  CRISPR gRNA sequence
tgtatctttaggaatcaaaa

SEQ ID NO: 270256 - DNA, 20 bp, Artificial
  CRISPR gRNA sequence
gtatctttaggaatcaaaag

SEQ ID NO: 270257 - DNA, 20 bp, Artificial
  CRISPR gRNA sequence
tatctttaggaatcaaaagg

SEQ ID NO: 270258 - DNA, 20 bp, Artificial
  CRISPR gRNA sequence
taggaatcaaaaggggatga

SEQ ID NO: 270259 - DNA, 20 bp, Artificial
  CRISPR gRNA sequence
aggaatcaaaaggggatgag

SEQ ID NO: 270260 - DNA, 20 bp, Artificial
  CRISPR gRNA sequence
ggaatcaaaaggggatgaga

SEQ ID NO: 270261 - DNA, 20 bp, Artificial
  CRISPR gRNA sequence
tagaattctattcaaaatta

SEQ ID NO: 270262 - DNA, 20 bp, Artificial
  CRISPR gRNA sequence
tattcaaaattagagaaaat

SEQ ID NO: 270263 - DNA, 20 bp, Artificial
  CRISPR gRNA sequence
ttcaaaattagagaaaatta

SEQ ID NO: 270264 - DNA, 20 bp, Artificial
  CRISPR gRNA sequence
aaaattagagaaaattagaa

SEQ ID NO: 270265 - DNA, 20 bp, Artificial
  CRISPR gRNA sequence
gagaaaattagaactagaaa

SEQ ID NO: 270266 - DNA, 20 bp, Artificial
  CRISPR gRNA sequence
gaactagaaagcataccaaa

SEQ ID NO: 270267 - DNA, 20 bp, Artificial
  CRISPR gRNA sequence
gaaagcataccaaaaatcct

SEQ ID NO: 270268 - DNA, 20 bp, Artificial
  CRISPR gRNA sequence
tagtccattgattttccatc

SEQ ID NO: 270269 - DNA, 20 bp, Artificial
  CRISPR gRNA sequence
gtccattgattttccatcct

SEQ ID NO: 270270 - DNA, 20 bp, Artificial
  CRISPR gRNA sequence
attttccatcctagctgcac

SEQ ID NO: 270271 - DNA, 20 bp, Artificial
  CRISPR gRNA sequence
tccatcctagctgcacaata

SEQ ID NO: 270272 - DNA, 20 bp, Artificial
  CRISPR gRNA sequence
ccatcctagctgcacaataa

SEQ ID NO: 270273 - DNA, 20 bp, Artificial
  CRISPR gRNA sequence
catcctagctgcacaataaa

SEQ ID NO: 270274 - DNA, 20 bp, Artificial
  CRISPR gRNA sequence
gctgcacaataaattatccg

SEQ ID NO: 270275 - DNA, 20 bp, Artificial
  CRISPR gRNA sequence
cacaataaattatccgagaa

SEQ ID NO: 270276 - DNA, 20 bp, Artificial
  CRISPR gRNA sequence
tccgagaaagtttgaaaata

SEQ ID NO: 270277 - DNA, 20 bp, Artificial
  CRISPR gRNA sequence
gaaaatatactgatgtccag

SEQ ID NO: 270278 - DNA, 20 bp, Artificial
  CRISPR gRNA sequence
aaaatatactgatgtccagc

SEQ ID NO: 270279 - DNA, 20 bp, Artificial
  CRISPR gRNA sequence
atgtccagcaccccttcctc

SEQ ID NO: 270280 - DNA, 20 bp, Artificial
  CRISPR gRNA sequence
cctcaacccatatcaattac

SEQ ID NO: 270281 - DNA, 20 bp, Artificial
  CRISPR gRNA sequence
ctcaacccatatcaattaca

SEQ ID NO: 270282 - DNA, 20 bp, Artificial
  CRISPR gRNA sequence
aacccatatcaattacatca

SEQ ID NO: 270283 - DNA, 20 bp, Artificial
  CRISPR gRNA sequence
catcagaatctcagggctgg

SEQ ID NO: 270284 - DNA, 20 bp, Artificial
  CRISPR gRNA sequence
agggctggaactaggcattg

SEQ ID NO: 270285 - DNA, 20 bp, Artificial
  CRISPR gRNA sequence
gaactaggcattggtatttc

SEQ ID NO: 270286 - DNA, 20 bp, Artificial
  CRISPR gRNA sequence
ggcattggtatttcttttaa

SEQ ID NO: 270287 - DNA, 20 bp, Artificial
  CRISPR gRNA sequence
gtatttcttttaaaacctac

SEQ ID NO: 270288 - DNA, 20 bp, Artificial
  CRISPR gRNA sequence
cttttaaaacctactcagat

SEQ ID NO: 270289 - DNA, 20 bp, Artificial
  CRISPR gRNA sequence
ttttaaaacctactcagatt

SEQ ID NO: 270290 - DNA, 20 bp, Artificial
  CRISPR gRNA sequence
ttaaaacctactcagattta

SEQ ID NO: 270291 - DNA, 20 bp, Artificial
  CRISPR gRNA sequence
taaaacctactcagatttat

SEQ ID NO: 270292 - DNA, 20 bp, Artificial
  CRISPR gRNA sequence
aaaacctactcagatttata

SEQ ID NO: 270293 - DNA, 20 bp, Artificial
  CRISPR gRNA sequence
aaacctactcagatttataa

SEQ ID NO: 270294 - DNA, 20 bp, Artificial
  CRISPR gRNA sequence
ctcagatttataatatacag

SEQ ID NO: 270295 - DNA, 20 bp, Artificial
  CRISPR gRNA sequence
agatttataatatacagata

SEQ ID NO: 270296 - DNA, 20 bp, Artificial
  CRISPR gRNA sequence
ataatatacagataggattg

SEQ ID NO: 270297 - DNA, 20 bp, Artificial
  CRISPR gRNA sequence
taatatacagataggattga

SEQ ID NO: 270298 - DNA, 20 bp, Artificial
  CRISPR gRNA sequence
aaaattactaagtacaggat

SEQ ID NO: 270299 - DNA, 20 bp, Artificial
  CRISPR gRNA sequence
ctaagtacaggatcattggt

SEQ ID NO: 270300 - DNA, 20 bp, Artificial
  CRISPR gRNA sequence
agtacaggatcattggtgtc

SEQ ID NO: 270301 - DNA, 20 bp, Artificial
  CRISPR gRNA sequence
gtgtccttctcagttctaac

SEQ ID NO: 270302 - DNA, 20 bp, Artificial
  CRISPR gRNA sequence
ctcagttctaacataaatga

SEQ ID NO: 270303 - DNA, 20 bp, Artificial
  CRISPR gRNA sequence
tcagttctaacataaatgat

SEQ ID NO: 270304 - DNA, 20 bp, Artificial
  CRISPR gRNA sequence
agttctaacataaatgatat

SEQ ID NO: 270305 - DNA, 20 bp, Artificial
  CRISPR gRNA sequence
taacataaatgatatgtgta

SEQ ID NO: 270306 - DNA, 20 bp, Artificial
  CRISPR gRNA sequence
acataaatgatatgtgtata

SEQ ID NO: 270307 - DNA, 20 bp, Artificial
  CRISPR gRNA sequence
tcctaaagtagcatgccttt

SEQ ID NO: 270308 - DNA, 20 bp, Artificial
  CRISPR gRNA sequence
aagtagcatgcctttcatat

SEQ ID NO: 270309 - DNA, 20 bp, Artificial
  CRISPR gRNA sequence
tcatataggaaaaaatattt

SEQ ID NO: 270310 - DNA, 20 bp, Artificial
  CRISPR gRNA sequence
catataggaaaaaatatttc

SEQ ID NO: 270311 - DNA, 20 bp, Artificial
  CRISPR gRNA sequence
atataggaaaaaatatttca

SEQ ID NO: 270312 - DNA, 20 bp, Artificial
  CRISPR gRNA sequence
cactcttagctacaagcaaa

SEQ ID NO: 270313 - DNA, 20 bp, Artificial
  CRISPR gRNA sequence
actcttagctacaagcaaaa

SEQ ID NO: 270314 - DNA, 20 bp, Artificial
  CRISPR gRNA sequence
ttagctacaagcaaaatagc

SEQ ID NO: 270315 - DNA, 20 bp, Artificial
  CRISPR gRNA sequence
agctacaagcaaaatagcat

SEQ ID NO: 270316 - DNA, 20 bp, Artificial
  CRISPR gRNA sequence
gctacaagcaaaatagcata

SEQ ID NO: 270317 - DNA, 20 bp, Artificial
  CRISPR gRNA sequence
caagcaaaatagcataattt

SEQ ID NO: 270318 - DNA, 20 bp, Artificial
  CRISPR gRNA sequence
tttaacctttgacttgatac

SEQ ID NO: 270319 - DNA, 20 bp, Artificial
  CRISPR gRNA sequence
ttaacctttgacttgataca

SEQ ID NO: 270320 - DNA, 20 bp, Artificial
  CRISPR gRNA sequence
taacctttgacttgatacaa

SEQ ID NO: 270321 - DNA, 20 bp, Artificial
  CRISPR gRNA sequence
aacctttgacttgatacaat

SEQ ID NO: 270322 - DNA, 20 bp, Artificial
  CRISPR gRNA sequence
acctttgacttgatacaatt

SEQ ID NO: 270323 - DNA, 20 bp, Artificial
  CRISPR gRNA sequence
tgacttgatacaattaaaat

SEQ ID NO: 270324 - DNA, 20 bp, Artificial
  CRISPR gRNA sequence
gacttgatacaattaaaata

SEQ ID NO: 270325 - DNA, 20 bp, Artificial
  CRISPR gRNA sequence
acttgatacaattaaaatat

SEQ ID NO: 270326 - DNA, 20 bp, Artificial
  CRISPR gRNA sequence
gatacaattaaaatattctg

SEQ ID NO: 270327 - DNA, 20 bp, Artificial
  CRISPR gRNA sequence
atacaattaaaatattctgt

SEQ ID NO: 270328 - DNA, 20 bp, Artificial
  CRISPR gRNA sequence
aaatattctgtttggatatt

SEQ ID NO: 270329 - DNA, 20 bp, Artificial
  CRISPR gRNA sequence
tgtttggatattacagatat

SEQ ID NO: 270330 - DNA, 20 bp, Artificial
  CRISPR gRNA sequence
tttggatattacagatatta

SEQ ID NO: 270331 - DNA, 20 bp, Artificial
  CRISPR gRNA sequence
ggatattacagatattagaa

SEQ ID NO: 270332 - DNA, 20 bp, Artificial
  CRISPR gRNA sequence
gatattacagatattagaaa

SEQ ID NO: 270333 - DNA, 20 bp, Artificial
  CRISPR gRNA sequence
cagatattagaaatctaaat

SEQ ID NO: 270334 - DNA, 20 bp, Artificial
  CRISPR gRNA sequence
gaaatctaaataggactcag

SEQ ID NO: 270335 - DNA, 20 bp, Artificial
  CRISPR gRNA sequence
aataggactcagcaaacaaa

SEQ ID NO: 270336 - DNA, 20 bp, Artificial
  CRISPR gRNA sequence
agcaaacaaaatattcacac

SEQ ID NO: 270337 - DNA, 20 bp, Artificial
  CRISPR gRNA sequence
acacattaattgtctctatt

SEQ ID NO: 270338 - DNA, 20 bp, Artificial
  CRISPR gRNA sequence
attgtctctattttgccaga

SEQ ID NO: 270339 - DNA, 20 bp, Artificial
  CRISPR gRNA sequence
tctctattttgccagaacac

SEQ ID NO: 270340 - DNA, 20 bp, Artificial
  CRISPR gRNA sequence
tattttgccagaacacaaaa

SEQ ID NO: 270341 - DNA, 20 bp, Artificial
  CRISPR gRNA sequence
ttttgccagaacacaaaagc

SEQ ID NO: 270342 - DNA, 20 bp, Artificial
  CRISPR gRNA sequence
tgccagaacacaaaagctta

SEQ ID NO: 270343 - DNA, 20 bp, Artificial
  CRISPR gRNA sequence
gccagaacacaaaagcttat

SEQ ID NO: 270344 - DNA, 20 bp, Artificial
  CRISPR gRNA sequence
ccagaacacaaaagcttatc

SEQ ID NO: 270345 - DNA, 20 bp, Artificial
  CRISPR gRNA sequence
atctgccacattaacaattc

SEQ ID NO: 270346 - DNA, 20 bp, Artificial
  CRISPR gRNA sequence
tctgccacattaacaattct

SEQ ID NO: 270347 - DNA, 20 bp, Artificial
  CRISPR gRNA sequence
ccacattaacaattctttcc

SEQ ID NO: 270348 - DNA, 20 bp, Artificial
  CRISPR gRNA sequence
acaattctttccttatttag

SEQ ID NO: 270349 - DNA, 20 bp, Artificial
  CRISPR gRNA sequence
tttccttatttagtatccta

SEQ ID NO: 270350 - DNA, 20 bp, Artificial
  CRISPR gRNA sequence
tccttatttagtatcctatt

SEQ ID NO: 270351 - DNA, 20 bp, Artificial
  CRISPR gRNA sequence
ccttatttagtatcctattt

SEQ ID NO: 270352 - DNA, 20 bp, Artificial
  CRISPR gRNA sequence
cttatttagtatcctatttt

SEQ ID NO: 270353 - DNA, 20 bp, Artificial
  CRISPR gRNA sequence
atttagtatcctatttttca

SEQ ID NO: 270354 - DNA, 20 bp, Artificial
  CRISPR gRNA sequence
tttagtatcctatttttcat

SEQ ID NO: 270355 - DNA, 20 bp, Artificial
  CRISPR gRNA sequence
agtatcctatttttcatcag

SEQ ID NO: 270356 - DNA, 20 bp, Artificial
  CRISPR gRNA sequence
gtatcctatttttcatcagc

SEQ ID NO: 270357 - DNA, 20 bp, Artificial
  CRISPR gRNA sequence
tttttcatcagcatggctct

SEQ ID NO: 270358 - DNA, 20 bp, Artificial
  CRISPR gRNA sequence
ttcatcagcatggctctgtt

SEQ ID NO: 270359 - DNA, 20 bp, Artificial
  CRISPR gRNA sequence
tcatcagcatggctctgttc

SEQ ID NO: 270360 - DNA, 20 bp, Artificial
  CRISPR gRNA sequence
catcagcatggctctgttcc

SEQ ID NO: 270361 - DNA, 20 bp, Artificial
  CRISPR gRNA sequence
atcagcatggctctgttcca

SEQ ID NO: 270362 - DNA, 20 bp, Artificial
  CRISPR gRNA sequence
tgttccagcattgaagaaaa

SEQ ID NO: 270363 - DNA, 20 bp, Artificial
  CRISPR gRNA sequence
ttccagcattgaagaaaaac

SEQ ID NO: 270364 - DNA, 20 bp, Artificial
  CRISPR gRNA sequence
cagcattgaagaaaaaccat

SEQ ID NO: 270365 - DNA, 20 bp, Artificial
  CRISPR gRNA sequence
aagaaaaaccattcattggc

SEQ ID NO: 270366 - DNA, 20 bp, Artificial
  CRISPR gRNA sequence
attggcattatgctaggatt

SEQ ID NO: 270367 - DNA, 20 bp, Artificial
  CRISPR gRNA sequence
gcattatgctaggattcagt

SEQ ID NO: 270368 - DNA, 20 bp, Artificial
  CRISPR gRNA sequence
tgctaggattcagtacaaaa

SEQ ID NO: 270369 - DNA, 20 bp, Artificial
  CRISPR gRNA sequence
ggattcagtacaaaactgaa

SEQ ID NO: 270370 - DNA, 20 bp, Artificial
  CRISPR gRNA sequence
agtacaaaactgaacatatg

SEQ ID NO: 270371 - DNA, 20 bp, Artificial
  CRISPR gRNA sequence
aacatatgtgtttcttatta

SEQ ID NO: 270372 - DNA, 20 bp, Artificial
  CRISPR gRNA sequence
cttattatcattccacaaaa

SEQ ID NO: 270373 - DNA, 20 bp, Artificial
  CRISPR gRNA sequence
ttattatcattccacaaaaa

SEQ ID NO: 270374 - DNA, 20 bp, Artificial
  CRISPR gRNA sequence
attatcattccacaaaaatg

SEQ ID NO: 270375 - DNA, 20 bp, Artificial
  CRISPR gRNA sequence
ttatcattccacaaaaatga

SEQ ID NO: 270376 - DNA, 20 bp, Artificial
  CRISPR gRNA sequence
tcattccacaaaaatgaaaa

SEQ ID NO: 270377 - DNA, 20 bp, Artificial
  CRISPR gRNA sequence
cacaaaaatgaaaagctatg

SEQ ID NO: 270378 - DNA, 20 bp, Artificial
  CRISPR gRNA sequence
tgatatatccacaaagtata

SEQ ID NO: 270379 - DNA, 20 bp, Artificial
  CRISPR gRNA sequence
tacttgttgctaccaatact

SEQ ID NO: 270380 - DNA, 20 bp, Artificial
  CRISPR gRNA sequence
acttgttgctaccaatactg

SEQ ID NO: 270381 - DNA, 20 bp, Artificial
  CRISPR gRNA sequence
cttgttgctaccaatactgt

SEQ ID NO: 270382 - DNA, 20 bp, Artificial
  CRISPR gRNA sequence
gttgctaccaatactgtatt

SEQ ID NO: 270383 - DNA, 20 bp, Artificial
  CRISPR gRNA sequence
ttgctaccaatactgtattc

SEQ ID NO: 270384 - DNA, 20 bp, Artificial
  CRISPR gRNA sequence
ctaccaatactgtattcttc

SEQ ID NO: 270385 - DNA, 20 bp, Artificial
  CRISPR gRNA sequence
ccaatactgtattcttctga

SEQ ID NO: 270386 - DNA, 20 bp, Artificial
  CRISPR gRNA sequence
tattcttctgagttggggaa

SEQ ID NO: 270387 - DNA, 20 bp, Artificial
  CRISPR gRNA sequence
ttctgagttggggaatcatg

SEQ ID NO: 270388 - DNA, 20 bp, Artificial
  CRISPR gRNA sequence
ctgagttggggaatcatgat

SEQ ID NO: 270389 - DNA, 20 bp, Artificial
  CRISPR gRNA sequence
tgagttggggaatcatgatt

SEQ ID NO: 270390 - DNA, 20 bp, Artificial
  CRISPR gRNA sequence
agttggggaatcatgatttt

SEQ ID NO: 270391 - DNA, 20 bp, Artificial
  CRISPR gRNA sequence
gggaatcatgatttttctcc

SEQ ID NO: 270392 - DNA, 20 bp, Artificial
  CRISPR gRNA sequence
ttctccctaacatttaggca

SEQ ID NO: 270393 - DNA, 20 bp, Artificial
  CRISPR gRNA sequence
tctccctaacatttaggcag

SEQ ID NO: 270394 - DNA, 20 bp, Artificial
  CRISPR gRNA sequence
ctccctaacatttaggcaga

SEQ ID NO: 270395 - DNA, 20 bp, Artificial
  CRISPR gRNA sequence
tccctaacatttaggcagaa

SEQ ID NO: 270396 - DNA, 20 bp, Artificial
  CRISPR gRNA sequence
cctaacatttaggcagaaca

SEQ ID NO: 270397 - DNA, 20 bp, Artificial
  CRISPR gRNA sequence
acatttaggcagaacataac

SEQ ID NO: 270398 - DNA, 20 bp, Artificial
  CRISPR gRNA sequence
aggcagaacataacatcaac

SEQ ID NO: 270399 - DNA, 20 bp, Artificial
  CRISPR gRNA sequence
ggcagaacataacatcaaca

SEQ ID NO: 270400 - DNA, 20 bp, Artificial
  CRISPR gRNA sequence
agtagacttattttcactaa

SEQ ID NO: 270401 - DNA, 20 bp, Artificial
  CRISPR gRNA sequence
attttcactaattcacaaat

SEQ ID NO: 270402 - DNA, 20 bp, Artificial
  CRISPR gRNA sequence
ttttcactaattcacaaata

SEQ ID NO: 270403 - DNA, 20 bp, Artificial
  CRISPR gRNA sequence
tcactaattcacaaatactg

SEQ ID NO: 270404 - DNA, 20 bp, Artificial
  CRISPR gRNA sequence
cactaattcacaaatactgc

SEQ ID NO: 270405 - DNA, 20 bp, Artificial
  CRISPR gRNA sequence
actaattcacaaatactgct

SEQ ID NO: 270406 - DNA, 20 bp, Artificial
  CRISPR gRNA sequence
attcacaaatactgcttaac

SEQ ID NO: 270407 - DNA, 20 bp, Artificial
  CRISPR gRNA sequence
acaaatactgcttaacagtt

SEQ ID NO: 270408 - DNA, 20 bp, Artificial
  CRISPR gRNA sequence
cttaacagttgtactgagtt

SEQ ID NO: 270409 - DNA, 20 bp, Artificial
  CRISPR gRNA sequence
aacagttgtactgagttttt

SEQ ID NO: 270410 - DNA, 20 bp, Artificial
  CRISPR gRNA sequence
acagttgtactgagtttttg

SEQ ID NO: 270411 - DNA, 20 bp, Artificial
  CRISPR gRNA sequence
tactgagtttttgactatga

SEQ ID NO: 270412 - DNA, 20 bp, Artificial
  CRISPR gRNA sequence
agtttttgactatgaaaaag

SEQ ID NO: 270413 - DNA, 20 bp, Artificial
  CRISPR gRNA sequence
ttgactatgaaaaagttagg

SEQ ID NO: 270414 - DNA, 20 bp, Artificial
  CRISPR gRNA sequence
tgactatgaaaaagttaggt

SEQ ID NO: 270415 - DNA, 20 bp, Artificial
  CRISPR gRNA sequence
gactatgaaaaagttaggtg

SEQ ID NO: 270416 - DNA, 20 bp, Artificial
  CRISPR gRNA sequence
actatgaaaaagttaggtga

SEQ ID NO: 270417 - DNA, 20 bp, Artificial
  CRISPR gRNA sequence
tgaaaaagttaggtgactta

SEQ ID NO: 270418 - DNA, 20 bp, Artificial
  CRISPR gRNA sequence
ggtgacttatccaagatcac

SEQ ID NO: 270419 - DNA, 20 bp, Artificial
  CRISPR gRNA sequence
atccaagatcacacagttga

SEQ ID NO: 270420 - DNA, 20 bp, Artificial
  CRISPR gRNA sequence
tccaagatcacacagttgat

SEQ ID NO: 270421 - DNA, 20 bp, Artificial
  CRISPR gRNA sequence
attaatagcaaattttatgt

SEQ ID NO: 270422 - DNA, 20 bp, Artificial
  CRISPR gRNA sequence
atagcaaattttatgtcccc

SEQ ID NO: 270423 - DNA, 20 bp, Artificial
  CRISPR gRNA sequence
tatgtcccccggtttctagt

SEQ ID NO: 270424 - DNA, 20 bp, Artificial
  CRISPR gRNA sequence
atgtcccccggtttctagtc

SEQ ID NO: 270425 - DNA, 20 bp, Artificial
  CRISPR gRNA sequence
tgtcccccggtttctagtcc

SEQ ID NO: 270426 - DNA, 20 bp, Artificial
  CRISPR gRNA sequence
ctagtccagcattctttgta

SEQ ID NO: 270427 - DNA, 20 bp, Artificial
  CRISPR gRNA sequence
tagtccagcattctttgtat

SEQ ID NO: 270428 - DNA, 20 bp, Artificial
  CRISPR gRNA sequence
gtccagcattctttgtatat

SEQ ID NO: 270429 - DNA, 20 bp, Artificial
  CRISPR gRNA sequence
tttgtatattttagaaaatg

SEQ ID NO: 270430 - DNA, 20 bp, Artificial
  CRISPR gRNA sequence
tgtatattttagaaaatgga

SEQ ID NO: 270431 - DNA, 20 bp, Artificial
  CRISPR gRNA sequence
gtatattttagaaaatggaa

SEQ ID NO: 270432 - DNA, 20 bp, Artificial
  CRISPR gRNA sequence
tatattttagaaaatggaaa

SEQ ID NO: 270433 - DNA, 20 bp, Artificial
  CRISPR gRNA sequence
tagaaaatggaaaggtacgg

SEQ ID NO: 270434 - DNA, 20 bp, Artificial
  CRISPR gRNA sequence
agaaaatggaaaggtacggg

SEQ ID NO: 270435 - DNA, 20 bp, Artificial
  CRISPR gRNA sequence
gaaaatggaaaggtacgggc

SEQ ID NO: 270436 - DNA, 20 bp, Artificial
  CRISPR gRNA sequence
ggcgcggtggcttacgcctg

SEQ ID NO: 270437 - DNA, 20 bp, Artificial
  CRISPR gRNA sequence
acgcctgtaatcacagcact

SEQ ID NO: 270438 - DNA, 20 bp, Artificial
  CRISPR gRNA sequence
cgcctgtaatcacagcactt

SEQ ID NO: 270439 - DNA, 20 bp, Artificial
  CRISPR gRNA sequence
taatcacagcactttgggag

SEQ ID NO: 270440 - DNA, 20 bp, Artificial
  CRISPR gRNA sequence
tgggaggcccaggtgggcag

SEQ ID NO: 270441 - DNA, 20 bp, Artificial
  CRISPR gRNA sequence
gggaggcccaggtgggcaga

SEQ ID NO: 270442 - DNA, 20 bp, Artificial
  CRISPR gRNA sequence
ggaggcccaggtgggcagat

SEQ ID NO: 270443 - DNA, 20 bp, Artificial
  CRISPR gRNA sequence
agaccatccttgctaacacg

SEQ ID NO: 270444 - DNA, 20 bp, Artificial
  CRISPR gRNA sequence
gctaacacggtgaaaccccg

SEQ ID NO: 270445 - DNA, 20 bp, Artificial
  CRISPR gRNA sequence
ctaacacggtgaaaccccgt

SEQ ID NO: 270446 - DNA, 20 bp, Artificial
  CRISPR gRNA sequence
acacggtgaaaccccgtctc

SEQ ID NO: 270447 - DNA, 20 bp, Artificial
  CRISPR gRNA sequence
tactaaaagtacaaaaaatg

SEQ ID NO: 270448 - DNA, 20 bp, Artificial
  CRISPR gRNA sequence
ctaaaagtacaaaaaatggc

SEQ ID NO: 270449 - DNA, 20 bp, Artificial
  CRISPR gRNA sequence
aaagtacaaaaaatggctgg

SEQ ID NO: 270450 - DNA, 20 bp, Artificial
  CRISPR gRNA sequence
ggcgcggtggctcacgcctg

SEQ ID NO: 270451 - DNA, 20 bp, Artificial
  CRISPR gRNA sequence
acgcctgtaatcccagcact

SEQ ID NO: 270452 - DNA, 20 bp, Artificial
  CRISPR gRNA sequence
taatcccagcactttgggag

SEQ ID NO: 270453 - DNA, 20 bp, Artificial
  CRISPR gRNA sequence
tgggaggccaacacgggcgg

SEQ ID NO: 270454 - DNA, 20 bp, Artificial
  CRISPR gRNA sequence
gggaggccaacacgggcggg

SEQ ID NO: 270455 - DNA, 20 bp, Artificial
  CRISPR gRNA sequence
ggaggccaacacgggcgggt

SEQ ID NO: 270456 - DNA, 20 bp, Artificial
  CRISPR gRNA sequence
gctaacaaggtgaaaccctg

SEQ ID NO: 270457 - DNA, 20 bp, Artificial
  CRISPR gRNA sequence
acaaggtgaaaccctgtcta

SEQ ID NO: 270458 - DNA, 20 bp, Artificial
  CRISPR gRNA sequence
tctactaaaaatacaaaaaa

SEQ ID NO: 270459 - DNA, 20 bp, Artificial
  CRISPR gRNA sequence
ctaaaaatacaaaaaattag

SEQ ID NO: 270460 - DNA, 20 bp, Artificial
  CRISPR gRNA sequence
aaaatacaaaaaattagccg

SEQ ID NO: 270461 - DNA, 20 bp, Artificial
  CRISPR gRNA sequence
gccgggcatggtggcaggta

SEQ ID NO: 270462 - DNA, 20 bp, Artificial
  CRISPR gRNA sequence
tagtcccagctactcaggag

SEQ ID NO: 270463 - DNA, 20 bp, Artificial
  CRISPR gRNA sequence
ctcaggaggctgaggcagga

SEQ ID NO: 270464 - DNA, 20 bp, Artificial
  CRISPR gRNA sequence
aggaggctgaggcaggagaa

SEQ ID NO: 270465 - DNA, 20 bp, Artificial
  CRISPR gRNA sequence
aggcaggagaatggcatgaa

SEQ ID NO: 270466 - DNA, 20 bp, Artificial
  CRISPR gRNA sequence
ggaggcggagcttgcagtga

SEQ ID NO: 270467 - DNA, 20 bp, Artificial
  CRISPR gRNA sequence
gcagtgagccgagatcgcgc

SEQ ID NO: 270468 - DNA, 20 bp, Artificial
  CRISPR gRNA sequence
cagtgagccgagatcgcgcc

SEQ ID NO: 270469 - DNA, 20 bp, Artificial
  CRISPR gRNA sequence
cagcctgggcgacagagcaa

SEQ ID NO: 270470 - DNA, 20 bp, Artificial
  CRISPR gRNA sequence
ggcgacagagcaagactccc

SEQ ID NO: 270471 - DNA, 20 bp, Artificial
  CRISPR gRNA sequence
cctctcaaaaaaaaaaatta

SEQ ID NO: 270472 - DNA, 20 bp, Artificial
  CRISPR gRNA sequence
tcaaaaaaaaaaattaatta

SEQ ID NO: 270473 - DNA, 20 bp, Artificial
  CRISPR gRNA sequence
aaaaaaaaaaattaattaat

SEQ ID NO: 270474 - DNA, 20 bp, Artificial
  CRISPR gRNA sequence
attaattaaaataaataaat

SEQ ID NO: 270475 - DNA, 20 bp, Artificial
  CRISPR gRNA sequence
attaaaataaataaataaat

SEQ ID NO: 270476 - DNA, 20 bp, Artificial
  CRISPR gRNA sequence
aaataaataaataaataaat

SEQ ID NO: 270477 - DNA, 20 bp, Artificial
  CRISPR gRNA sequence
tagtcccagctgatcgggag

SEQ ID NO: 270478 - DNA, 20 bp, Artificial
  CRISPR gRNA sequence
atcgggaggctgaggcagga

SEQ ID NO: 270479 - DNA, 20 bp, Artificial
  CRISPR gRNA sequence
aggcaggagaatgacgtgaa

SEQ ID NO: 270480 - DNA, 20 bp, Artificial
  CRISPR gRNA sequence
gcagtgaactgagatcccgc

SEQ ID NO: 270481 - DNA, 20 bp, Artificial
  CRISPR gRNA sequence
cagtgaactgagatcccgcc

SEQ ID NO: 270482 - DNA, 20 bp, Artificial
  CRISPR gRNA sequence
agatcccgccactgcactcc

SEQ ID NO: 270483 - DNA, 20 bp, Artificial
  CRISPR gRNA sequence
cactccagcctgggcgacag

SEQ ID NO: 270484 - DNA, 20 bp, Artificial
  CRISPR gRNA sequence
cagcctgggcgacagagcga

SEQ ID NO: 270485 - DNA, 20 bp, Artificial
  CRISPR gRNA sequence
ggcgacagagcgagagtccg

SEQ ID NO: 270486 - DNA, 20 bp, Artificial
  CRISPR gRNA sequence
aaaaaaaaagaaaaagaaaa

SEQ ID NO: 270487 - DNA, 20 bp, Artificial
  CRISPR gRNA sequence
ttacagaggaagattatgga

SEQ ID NO: 270488 - DNA, 20 bp, Artificial
  CRISPR gRNA sequence
tacagaggaagattatggag

SEQ ID NO: 270489 - DNA, 20 bp, Artificial
  CRISPR gRNA sequence
acagaggaagattatggagc

SEQ ID NO: 270490 - DNA, 20 bp, Artificial
  CRISPR gRNA sequence
cagaggaagattatggagca

SEQ ID NO: 270491 - DNA, 20 bp, Artificial
  CRISPR gRNA sequence
tggagcacaaaaaaagaatt

SEQ ID NO: 270492 - DNA, 20 bp, Artificial
  CRISPR gRNA sequence
attagaaatagaagtgagtc

SEQ ID NO: 270493 - DNA, 20 bp, Artificial
  CRISPR gRNA sequence
gaaatagaagtgagtcttcc

SEQ ID NO: 270494 - DNA, 20 bp, Artificial
  CRISPR gRNA sequence
cctgagtcttaacccattag

SEQ ID NO: 270495 - DNA, 20 bp, Artificial
  CRISPR gRNA sequence
ctgagtcttaacccattaga

SEQ ID NO: 270496 - DNA, 20 bp, Artificial
  CRISPR gRNA sequence
agtcttaacccattagaccc

SEQ ID NO: 270497 - DNA, 20 bp, Artificial
  CRISPR gRNA sequence
aacccattagacccagctgt

SEQ ID NO: 270498 - DNA, 20 bp, Artificial
  CRISPR gRNA sequence
acccattagacccagctgtt

SEQ ID NO: 270499 - DNA, 20 bp, Artificial
  CRISPR gRNA sequence
gacccagctgttacttgagg

SEQ ID NO: 270500 - DNA, 20 bp, Artificial
  CRISPR gRNA sequence
ttacttgagggcacctgggc

SEQ ID NO: 270501 - DNA, 20 bp, Artificial
  CRISPR gRNA sequence
cttgagggcacctgggctta

SEQ ID NO: 270502 - DNA, 20 bp, Artificial
  CRISPR gRNA sequence
gagggcacctgggcttacat

SEQ ID NO: 270503 - DNA, 20 bp, Artificial
  CRISPR gRNA sequence
agggcacctgggcttacatt

SEQ ID NO: 270504 - DNA, 20 bp, Artificial
  CRISPR gRNA sequence
ggcttacattttaatggtaa

SEQ ID NO: 270505 - DNA, 20 bp, Artificial
  CRISPR gRNA sequence
acattttaatggtaacctct

SEQ ID NO: 270506 - DNA, 20 bp, Artificial
  CRISPR gRNA sequence
cattttaatggtaacctctt

SEQ ID NO: 270507 - DNA, 20 bp, Artificial
  CRISPR gRNA sequence
taatggtaacctcttttctg

SEQ ID NO: 270508 - DNA, 20 bp, Artificial
  CRISPR gRNA sequence
aatggtaacctcttttctgc

SEQ ID NO: 270509 - DNA, 20 bp, Artificial
  CRISPR gRNA sequence
atggtaacctcttttctgcc

SEQ ID NO: 270510 - DNA, 20 bp, Artificial
  CRISPR gRNA sequence
ttttctgccatgatccactg

SEQ ID NO: 270511 - DNA, 20 bp, Artificial
  CRISPR gRNA sequence
ttctgccatgatccactgga

SEQ ID NO: 270512 - DNA, 20 bp, Artificial
  CRISPR gRNA sequence
tctgccatgatccactggaa

SEQ ID NO: 270513 - DNA, 20 bp, Artificial
  CRISPR gRNA sequence
ctgccatgatccactggaat

SEQ ID NO: 270514 - DNA, 20 bp, Artificial
  CRISPR gRNA sequence
tgccatgatccactggaatg

SEQ ID NO: 270515 - DNA, 20 bp, Artificial
  CRISPR gRNA sequence
ccatgatccactggaatgga

SEQ ID NO: 270516 - DNA, 20 bp, Artificial
  CRISPR gRNA sequence
gaatggagaaaaatgatctg

SEQ ID NO: 270517 - DNA, 20 bp, Artificial
  CRISPR gRNA sequence
ttcccacatgcggtaacttc

SEQ ID NO: 270518 - DNA, 20 bp, Artificial
  CRISPR gRNA sequence
ccacatgcggtaacttcatc

SEQ ID NO: 270519 - DNA, 20 bp, Artificial
  CRISPR gRNA sequence
catcacttactctcccgctc

SEQ ID NO: 270520 - DNA, 20 bp, Artificial
  CRISPR gRNA sequence
atcacttactctcccgctca

SEQ ID NO: 270521 - DNA, 20 bp, Artificial
  CRISPR gRNA sequence
actctcccgctcaatgtcag

SEQ ID NO: 270522 - DNA, 20 bp, Artificial
  CRISPR gRNA sequence
ctctcccgctcaatgtcagc

SEQ ID NO: 270523 - DNA, 20 bp, Artificial
  CRISPR gRNA sequence
tcccgctcaatgtcagcaaa

SEQ ID NO: 270524 - DNA, 20 bp, Artificial
  CRISPR gRNA sequence
ccgctcaatgtcagcaaagg

SEQ ID NO: 270525 - DNA, 20 bp, Artificial
  CRISPR gRNA sequence
aatgtcagcaaaggaaaata

SEQ ID NO: 270526 - DNA, 20 bp, Artificial
  CRISPR gRNA sequence
aaaatataaccttgaatctc

SEQ ID NO: 270527 - DNA, 20 bp, Artificial
  CRISPR gRNA sequence
gaatctcctctacagtaaag

SEQ ID NO: 270528 - DNA, 20 bp, Artificial
  CRISPR gRNA sequence
aatctcctctacagtaaagg

SEQ ID NO: 270529 - DNA, 20 bp, Artificial
  CRISPR gRNA sequence
ctctacagtaaagggaaaaa

SEQ ID NO: 270530 - DNA, 20 bp, Artificial
  CRISPR gRNA sequence
tacagtaaagggaaaaattt

SEQ ID NO: 270531 - DNA, 20 bp, Artificial
  CRISPR gRNA sequence
cagtaaagggaaaaattttt

SEQ ID NO: 270532 - DNA, 20 bp, Artificial
  CRISPR gRNA sequence
ttctgaaaacattatttgtc

SEQ ID NO: 270533 - DNA, 20 bp, Artificial
  CRISPR gRNA sequence
tctgaaaacattatttgtct

SEQ ID NO: 270534 - DNA, 20 bp, Artificial
  CRISPR gRNA sequence
ctgaaaacattatttgtctt

SEQ ID NO: 270535 - DNA, 20 bp, Artificial
  CRISPR gRNA sequence
tgaaaacattatttgtcttt

SEQ ID NO: 270536 - DNA, 20 bp, Artificial
  CRISPR gRNA sequence
aaaacattatttgtctttgt

SEQ ID NO: 270537 - DNA, 20 bp, Artificial
  CRISPR gRNA sequence
tttgtctttgttagtatcaa

SEQ ID NO: 270538 - DNA, 20 bp, Artificial
  CRISPR gRNA sequence
gtctttgttagtatcaaatc

SEQ ID NO: 270539 - DNA, 20 bp, Artificial
  CRISPR gRNA sequence
tctttgttagtatcaaatca

SEQ ID NO: 270540 - DNA, 20 bp, Artificial
  CRISPR gRNA sequence
tgttagtatcaaatcactta

SEQ ID NO: 270541 - DNA, 20 bp, Artificial
  CRISPR gRNA sequence
gttagtatcaaatcacttag

SEQ ID NO: 270542 - DNA, 20 bp, Artificial
  CRISPR gRNA sequence
ttagtatcaaatcacttagg

SEQ ID NO: 270543 - DNA, 20 bp, Artificial
  CRISPR gRNA sequence
gtatcaaatcacttaggcct

SEQ ID NO: 270544 - DNA, 20 bp, Artificial
  CRISPR gRNA sequence
aggccttattcaaccccacc

SEQ ID NO: 270545 - DNA, 20 bp, Artificial
  CRISPR gRNA sequence
ggccttattcaaccccacca

SEQ ID NO: 270546 - DNA, 20 bp, Artificial
  CRISPR gRNA sequence
attcaaccccaccactgacc

SEQ ID NO: 270547 - DNA, 20 bp, Artificial
  CRISPR gRNA sequence
ttcaaccccaccactgacca

SEQ ID NO: 270548 - DNA, 20 bp, Artificial
  CRISPR gRNA sequence
aaccccaccactgaccacaa

SEQ ID NO: 270549 - DNA, 20 bp, Artificial
  CRISPR gRNA sequence
accacaacccagttttcagg

SEQ ID NO: 270550 - DNA, 20 bp, Artificial
  CRISPR gRNA sequence
tcaggactgcatttgaaaac

SEQ ID NO: 270551 - DNA, 20 bp, Artificial
  CRISPR gRNA sequence
caggactgcatttgaaaacc

SEQ ID NO: 270552 - DNA, 20 bp, Artificial
  CRISPR gRNA sequence
aggactgcatttgaaaacca

SEQ ID NO: 270553 - DNA, 20 bp, Artificial
  CRISPR gRNA sequence
catttgaaaaccattacttt

SEQ ID NO: 270554 - DNA, 20 bp, Artificial
  CRISPR gRNA sequence
gaaaaccattactttagggt

SEQ ID NO: 270555 - DNA, 20 bp, Artificial
  CRISPR gRNA sequence
aaaaccattactttagggtg

SEQ ID NO: 270556 - DNA, 20 bp, Artificial
  CRISPR gRNA sequence
ctttagggtggtacactggt

SEQ ID NO: 270557 - DNA, 20 bp, Artificial
  CRISPR gRNA sequence
tagggtggtacactggtaaa

SEQ ID NO: 270558 - DNA, 20 bp, Artificial
  CRISPR gRNA sequence
agggtggtacactggtaaag

SEQ ID NO: 270559 - DNA, 20 bp, Artificial
  CRISPR gRNA sequence
gggtggtacactggtaaagt

SEQ ID NO: 270560 - DNA, 20 bp, Artificial
  CRISPR gRNA sequence
gtaaagttgtatgttacctt

SEQ ID NO: 270561 - DNA, 20 bp, Artificial
  CRISPR gRNA sequence
tatgttacctttcacatgga

SEQ ID NO: 270562 - DNA, 20 bp, Artificial
  CRISPR gRNA sequence
cctttcacatggataatggt

SEQ ID NO: 270563 - DNA, 20 bp, Artificial
  CRISPR gRNA sequence
tcacatggataatggttcca

SEQ ID NO: 270564 - DNA, 20 bp, Artificial
  CRISPR gRNA sequence
cacatggataatggttccat

SEQ ID NO: 270565 - DNA, 20 bp, Artificial
  CRISPR gRNA sequence
acatggataatggttccatt

SEQ ID NO: 270566 - DNA, 20 bp, Artificial
  CRISPR gRNA sequence
cattgctcttctcattgtct

SEQ ID NO: 270567 - DNA, 20 bp, Artificial
  CRISPR gRNA sequence
ctcttctcattgtctaggta

SEQ ID NO: 270568 - DNA, 20 bp, Artificial
  CRISPR gRNA sequence
ttctcattgtctaggtaagg

SEQ ID NO: 270569 - DNA, 20 bp, Artificial
  CRISPR gRNA sequence
ctcattgtctaggtaaggag

SEQ ID NO: 270570 - DNA, 20 bp, Artificial
  CRISPR gRNA sequence
tcattgtctaggtaaggagg

SEQ ID NO: 270571 - DNA, 20 bp, Artificial
  CRISPR gRNA sequence
attgtctaggtaaggaggag

SEQ ID NO: 270572 - DNA, 20 bp, Artificial
  CRISPR gRNA sequence
tctaggtaaggaggaggata

SEQ ID NO: 270573 - DNA, 20 bp, Artificial
  CRISPR gRNA sequence
ggtaaggaggaggatacata

SEQ ID NO: 270574 - DNA, 20 bp, Artificial
  CRISPR gRNA sequence
caattttgcagaagtaaata

SEQ ID NO: 270575 - DNA, 20 bp, Artificial
  CRISPR gRNA sequence
aattttgcagaagtaaatat

SEQ ID NO: 270576 - DNA, 20 bp, Artificial
  CRISPR gRNA sequence
tgcagaagtaaatatctgtt

SEQ ID NO: 270577 - DNA, 20 bp, Artificial
  CRISPR gRNA sequence
gcagaagtaaatatctgttt

SEQ ID NO: 270578 - DNA, 20 bp, Artificial
  CRISPR gRNA sequence
cagaagtaaatatctgtttg

SEQ ID NO: 270579 - DNA, 20 bp, Artificial
  CRISPR gRNA sequence
tttggttaacatacaaattc

SEQ ID NO: 270580 - DNA, 20 bp, Artificial
  CRISPR gRNA sequence
ggttaacatacaaattctgg

SEQ ID NO: 270581 - DNA, 20 bp, Artificial
  CRISPR gRNA sequence
gttaacatacaaattctgga

SEQ ID NO: 270582 - DNA, 20 bp, Artificial
  CRISPR gRNA sequence
acatacaaattctggaggta

SEQ ID NO: 270583 - DNA, 20 bp, Artificial
  CRISPR gRNA sequence
tggaggtagaatgtcactga

SEQ ID NO: 270584 - DNA, 20 bp, Artificial
  CRISPR gRNA sequence
gaggtagaatgtcactgatt

SEQ ID NO: 270585 - DNA, 20 bp, Artificial
  CRISPR gRNA sequence
attcattgcccaatttccca

SEQ ID NO: 270586 - DNA, 20 bp, Artificial
  CRISPR gRNA sequence
attgcccaatttcccatcac

SEQ ID NO: 270587 - DNA, 20 bp, Artificial
  CRISPR gRNA sequence
cccaatttcccatcacagtt

SEQ ID NO: 270588 - DNA, 20 bp, Artificial
  CRISPR gRNA sequence
cccatcacagttgaaccccg

SEQ ID NO: 270589 - DNA, 20 bp, Artificial
  CRISPR gRNA sequence
ccatcacagttgaaccccgt

SEQ ID NO: 270590 - DNA, 20 bp, Artificial
  CRISPR gRNA sequence
aaccccgtttttgagtaaac

SEQ ID NO: 270591 - DNA, 20 bp, Artificial
  CRISPR gRNA sequence
ttgagtaaacctgaagctgc

SEQ ID NO: 270592 - DNA, 20 bp, Artificial
  CRISPR gRNA sequence
tgagtaaacctgaagctgct

SEQ ID NO: 270593 - DNA, 20 bp, Artificial
  CRISPR gRNA sequence
gagtaaacctgaagctgctg

SEQ ID NO: 270594 - DNA, 20 bp, Artificial
  CRISPR gRNA sequence
agtaaacctgaagctgctgg

SEQ ID NO: 270595 - DNA, 20 bp, Artificial
  CRISPR gRNA sequence
aagctgctgggagtaattcc

SEQ ID NO: 270596 - DNA, 20 bp, Artificial
  CRISPR gRNA sequence
ctgggagtaattcccatata

SEQ ID NO: 270597 - DNA, 20 bp, Artificial
  CRISPR gRNA sequence
ggagtaattcccatatacaa

SEQ ID NO: 270598 - DNA, 20 bp, Artificial
  CRISPR gRNA sequence
ccatatacaacacagacttc

SEQ ID NO: 270599 - DNA, 20 bp, Artificial
  CRISPR gRNA sequence
ccacagcactatccagtcct

SEQ ID NO: 270600 - DNA, 20 bp, Artificial
  CRISPR gRNA sequence
cacagcactatccagtcctt

SEQ ID NO: 270601 - DNA, 20 bp, Artificial
  CRISPR gRNA sequence
tccagtcctttgtgaaggga

SEQ ID NO: 270602 - DNA, 20 bp, Artificial
  CRISPR gRNA sequence
tgtgaagggatgcccggaac

SEQ ID NO: 270603 - DNA, 20 bp, Artificial
  CRISPR gRNA sequence
gtgaagggatgcccggaact

SEQ ID NO: 270604 - DNA, 20 bp, Artificial
  CRISPR gRNA sequence
tgaagggatgcccggaactc

SEQ ID NO: 270605 - DNA, 20 bp, Artificial
  CRISPR gRNA sequence
ccttgagaagagattgtagg

SEQ ID NO: 270606 - DNA, 20 bp, Artificial
  CRISPR gRNA sequence
gagaagagattgtaggaata

SEQ ID NO: 270607 - DNA, 20 bp, Artificial
  CRISPR gRNA sequence
agaagagattgtaggaatac

SEQ ID NO: 270608 - DNA, 20 bp, Artificial
  CRISPR gRNA sequence
taggaatacttgcagctaag

SEQ ID NO: 270609 - DNA, 20 bp, Artificial
  CRISPR gRNA sequence
gcagctaaggttgaccgcat

SEQ ID NO: 270610 - DNA, 20 bp, Artificial
  CRISPR gRNA sequence
cagctaaggttgaccgcatt

SEQ ID NO: 270611 - DNA, 20 bp, Artificial
  CRISPR gRNA sequence
aggttgaccgcattgtcgta

SEQ ID NO: 270612 - DNA, 20 bp, Artificial
  CRISPR gRNA sequence
accgcattgtcgtacgctac

SEQ ID NO: 270613 - DNA, 20 bp, Artificial
  CRISPR gRNA sequence
tcgtacgctacaagcatggg

SEQ ID NO: 270614 - DNA, 20 bp, Artificial
  CRISPR gRNA sequence
caagcatgggcgactgcttc

SEQ ID NO: 270615 - DNA, 20 bp, Artificial
  CRISPR gRNA sequence
cttcaccaaaatcttgtttc

SEQ ID NO: 270616 - DNA, 20 bp, Artificial
  CRISPR gRNA sequence
caccaaaatcttgtttcctg

SEQ ID NO: 270617 - DNA, 20 bp, Artificial
  CRISPR gRNA sequence
accaaaatcttgtttcctgg

SEQ ID NO: 270618 - DNA, 20 bp, Artificial
  CRISPR gRNA sequence
gtttcctgggggaaaaaaaa

SEQ ID NO: 270619 - DNA, 20 bp, Artificial
  CRISPR gRNA sequence
tttcctgggggaaaaaaaaa

SEQ ID NO: 270620 - DNA, 20 bp, Artificial
  CRISPR gRNA sequence
cctgggggaaaaaaaaatca

SEQ ID NO: 270621 - DNA, 20 bp, Artificial
  CRISPR gRNA sequence
ctgggggaaaaaaaaatcat

SEQ ID NO: 270622 - DNA, 20 bp, Artificial
  CRISPR gRNA sequence
ggggaaaaaaaaatcatttg

SEQ ID NO: 270623 - DNA, 20 bp, Artificial
  CRISPR gRNA sequence
gcttagaacaagaatataag

SEQ ID NO: 270624 - DNA, 20 bp, Artificial
  CRISPR gRNA sequence
cttagaacaagaatataagg

SEQ ID NO: 270625 - DNA, 20 bp, Artificial
  CRISPR gRNA sequence
agaacaagaatataaggata

SEQ ID NO: 270626 - DNA, 20 bp, Artificial
  CRISPR gRNA sequence
gaacaagaatataaggataa

SEQ ID NO: 270627 - DNA, 20 bp, Artificial
  CRISPR gRNA sequence
ttcttcctgagagcaaaata

SEQ ID NO: 270628 - DNA, 20 bp, Artificial
  CRISPR gRNA sequence
tcttcctgagagcaaaatat

SEQ ID NO: 270629 - DNA, 20 bp, Artificial
  CRISPR gRNA sequence
cttcctgagagcaaaatata

SEQ ID NO: 270630 - DNA, 20 bp, Artificial
  CRISPR gRNA sequence
ttcctgagagcaaaatatat

SEQ ID NO: 270631 - DNA, 20 bp, Artificial
  CRISPR gRNA sequence
cctgagagcaaaatatatta

SEQ ID NO: 270632 - DNA, 20 bp, Artificial
  CRISPR gRNA sequence
ctgagagcaaaatatattaa

SEQ ID NO: 270633 - DNA, 20 bp, Artificial
  CRISPR gRNA sequence
agagcaaaatatattaatta

SEQ ID NO: 270634 - DNA, 20 bp, Artificial
  CRISPR gRNA sequence
attaactaaatgaacagatc

SEQ ID NO: 270635 - DNA, 20 bp, Artificial
  CRISPR gRNA sequence
actaaatgaacagatctcca

SEQ ID NO: 270636 - DNA, 20 bp, Artificial
  CRISPR gRNA sequence
aatgaacagatctccagcaa

SEQ ID NO: 270637 - DNA, 20 bp, Artificial
  CRISPR gRNA sequence
cagcaaaggttttctcttgg

SEQ ID NO: 270638 - DNA, 20 bp, Artificial
  CRISPR gRNA sequence
tctcttggcagaagatgtag

SEQ ID NO: 270639 - DNA, 20 bp, Artificial
  CRISPR gRNA sequence
ctcttggcagaagatgtagg

SEQ ID NO: 270640 - DNA, 20 bp, Artificial
  CRISPR gRNA sequence
tcttggcagaagatgtagga

SEQ ID NO: 270641 - DNA, 20 bp, Artificial
  CRISPR gRNA sequence
ttggcagaagatgtaggacc

SEQ ID NO: 270642 - DNA, 20 bp, Artificial
  CRISPR gRNA sequence
ggcagaagatgtaggacctc

SEQ ID NO: 270643 - DNA, 20 bp, Artificial
  CRISPR gRNA sequence
gcagaagatgtaggacctct

SEQ ID NO: 270644 - DNA, 20 bp, Artificial
  CRISPR gRNA sequence
ttcaggggataattatactg

SEQ ID NO: 270645 - DNA, 20 bp, Artificial
  CRISPR gRNA sequence
caggggataattatactgag

SEQ ID NO: 270646 - DNA, 20 bp, Artificial
  CRISPR gRNA sequence
aggggataattatactgaga

SEQ ID NO: 270647 - DNA, 20 bp, Artificial
  CRISPR gRNA sequence
tactgagagttcaaaagtta

SEQ ID NO: 270648 - DNA, 20 bp, Artificial
  CRISPR gRNA sequence
agagttcaaaagttaacatt

SEQ ID NO: 270649 - DNA, 20 bp, Artificial
  CRISPR gRNA sequence
aaaagttaacatttcaatat

SEQ ID NO: 270650 - DNA, 20 bp, Artificial
  CRISPR gRNA sequence
acatttcaatattattttca

SEQ ID NO: 270651 - DNA, 20 bp, Artificial
  CRISPR gRNA sequence
caatattattttcatcctct

SEQ ID NO: 270652 - DNA, 20 bp, Artificial
  CRISPR gRNA sequence
aatattattttcatcctctt

SEQ ID NO: 270653 - DNA, 20 bp, Artificial
  CRISPR gRNA sequence
ttttcatcctcttttgaatg

SEQ ID NO: 270654 - DNA, 20 bp, Artificial
  CRISPR gRNA sequence
tcatcctcttttgaatggaa

SEQ ID NO: 270655 - DNA, 20 bp, Artificial
  CRISPR gRNA sequence
catcctcttttgaatggaac

SEQ ID NO: 270656 - DNA, 20 bp, Artificial
  CRISPR gRNA sequence
atcctcttttgaatggaaca

SEQ ID NO: 270657 - DNA, 20 bp, Artificial
  CRISPR gRNA sequence
ttttgaatggaacaatggag

SEQ ID NO: 270658 - DNA, 20 bp, Artificial
  CRISPR gRNA sequence
ttgaatggaacaatggagca

SEQ ID NO: 270659 - DNA, 20 bp, Artificial
  CRISPR gRNA sequence
tgaatggaacaatggagcat

SEQ ID NO: 270660 - DNA, 20 bp, Artificial
  CRISPR gRNA sequence
gaatggaacaatggagcatg

SEQ ID NO: 270661 - DNA, 20 bp, Artificial
  CRISPR gRNA sequence
aatggaacaatggagcatgt

SEQ ID NO: 270662 - DNA, 20 bp, Artificial
  CRISPR gRNA sequence
tcacccagaaggcagtacat

SEQ ID NO: 270663 - DNA, 20 bp, Artificial
  CRISPR gRNA sequence
cacccagaaggcagtacatg

SEQ ID NO: 270664 - DNA, 20 bp, Artificial
  CRISPR gRNA sequence
acccagaaggcagtacatgg

SEQ ID NO: 270665 - DNA, 20 bp, Artificial
  CRISPR gRNA sequence
tctgttagcattgagcacca

SEQ ID NO: 270666 - DNA, 20 bp, Artificial
  CRISPR gRNA sequence
ctgttagcattgagcaccac

SEQ ID NO: 270667 - DNA, 20 bp, Artificial
  CRISPR gRNA sequence
tgttagcattgagcaccaca

SEQ ID NO: 270668 - DNA, 20 bp, Artificial
  CRISPR gRNA sequence
ttagcattgagcaccacagc

SEQ ID NO: 270669 - DNA, 20 bp, Artificial
  CRISPR gRNA sequence
gcattgagcaccacagctag

SEQ ID NO: 270670 - DNA, 20 bp, Artificial
  CRISPR gRNA sequence
agcaccacagctaggcactc

SEQ ID NO: 270671 - DNA, 20 bp, Artificial
  CRISPR gRNA sequence
ggcactcacaatttttaaat

SEQ ID NO: 270672 - DNA, 20 bp, Artificial
  CRISPR gRNA sequence
acaatttttaaatctatatt

SEQ ID NO: 270673 - DNA, 20 bp, Artificial
  CRISPR gRNA sequence
ttaaatctatattcctgaga

SEQ ID NO: 270674 - DNA, 20 bp, Artificial
  CRISPR gRNA sequence
taaatctatattcctgagac

SEQ ID NO: 270675 - DNA, 20 bp, Artificial
  CRISPR gRNA sequence
aaatctatattcctgagaca

SEQ ID NO: 270676 - DNA, 20 bp, Artificial
  CRISPR gRNA sequence
aatctatattcctgagacat

SEQ ID NO: 270677 - DNA, 20 bp, Artificial
  CRISPR gRNA sequence
tattcctgagacattaatat

SEQ ID NO: 270678 - DNA, 20 bp, Artificial
  CRISPR gRNA sequence
ctgagacattaatattaatc

SEQ ID NO: 270679 - DNA, 20 bp, Artificial
  CRISPR gRNA sequence
agacattaatattaatcatg

SEQ ID NO: 270680 - DNA, 20 bp, Artificial
  CRISPR gRNA sequence
atattaatcatgcattgggc

SEQ ID NO: 270681 - DNA, 20 bp, Artificial
  CRISPR gRNA sequence
atcatgcattgggccaattt

SEQ ID NO: 270682 - DNA, 20 bp, Artificial
  CRISPR gRNA sequence
ggccaatttcctgactgagt

SEQ ID NO: 270683 - DNA, 20 bp, Artificial
  CRISPR gRNA sequence
cctgactgagtgatatattt

SEQ ID NO: 270684 - DNA, 20 bp, Artificial
  CRISPR gRNA sequence
ctgactgagtgatatatttg

SEQ ID NO: 270685 - DNA, 20 bp, Artificial
  CRISPR gRNA sequence
actgagtgatatatttggag

SEQ ID NO: 270686 - DNA, 20 bp, Artificial
  CRISPR gRNA sequence
agtgatatatttggaggtgg

SEQ ID NO: 270687 - DNA, 20 bp, Artificial
  CRISPR gRNA sequence
ggaggtggctttagtgcctg

SEQ ID NO: 270688 - DNA, 20 bp, Artificial
  CRISPR gRNA sequence
gaggtggctttagtgcctga

SEQ ID NO: 270689 - DNA, 20 bp, Artificial
  CRISPR gRNA sequence
tagtgcctgacacagacaca

SEQ ID NO: 270690 - DNA, 20 bp, Artificial
  CRISPR gRNA sequence
agtgcctgacacagacacaa

SEQ ID NO: 270691 - DNA, 20 bp, Artificial
  CRISPR gRNA sequence
gtgcctgacacagacacaaa

SEQ ID NO: 270692 - DNA, 20 bp, Artificial
  CRISPR gRNA sequence
acacagacacaaaaatagat

SEQ ID NO: 270693 - DNA, 20 bp, Artificial
  CRISPR gRNA sequence
tttctttgtttgtttgtttt

SEQ ID NO: 270694 - DNA, 20 bp, Artificial
  CRISPR gRNA sequence
ctttgtttgtttgtttttga

SEQ ID NO: 270695 - DNA, 20 bp, Artificial
  CRISPR gRNA sequence
tttgtttgtttgtttttgag

SEQ ID NO: 270696 - DNA, 20 bp, Artificial
  CRISPR gRNA sequence
tgtttgtttgtttttgagac

SEQ ID NO: 270697 - DNA, 20 bp, Artificial
  CRISPR gRNA sequence
gtttgtttgtttttgagaca

SEQ ID NO: 270698 - DNA, 20 bp, Artificial
  CRISPR gRNA sequence
tttgtttgtttttgagacag

SEQ ID NO: 270699 - DNA, 20 bp, Artificial
  CRISPR gRNA sequence
gtttgtttttgagacagagt

SEQ ID NO: 270700 - DNA, 20 bp, Artificial
  CRISPR gRNA sequence
tttgtttttgagacagagtc

SEQ ID NO: 270701 - DNA, 20 bp, Artificial
  CRISPR gRNA sequence
gtttttgagacagagtcttg

SEQ ID NO: 270702 - DNA, 20 bp, Artificial
  CRISPR gRNA sequence
tttttgagacagagtcttgc

SEQ ID NO: 270703 - DNA, 20 bp, Artificial
  CRISPR gRNA sequence
ttgagacagagtcttgctct

SEQ ID NO: 270704 - DNA, 20 bp, Artificial
  CRISPR gRNA sequence
tgagacagagtcttgctctg

SEQ ID NO: 270705 - DNA, 20 bp, Artificial
  CRISPR gRNA sequence
gagacagagtcttgctctgt

SEQ ID NO: 270706 - DNA, 20 bp, Artificial
  CRISPR gRNA sequence
agacagagtcttgctctgtt

SEQ ID NO: 270707 - DNA, 20 bp, Artificial
  CRISPR gRNA sequence
gctctgttgcccaggctgaa

SEQ ID NO: 270708 - DNA, 20 bp, Artificial
  CRISPR gRNA sequence
ctctgttgcccaggctgaag

SEQ ID NO: 270709 - DNA, 20 bp, Artificial
  CRISPR gRNA sequence
tgttgcccaggctgaagtgc

SEQ ID NO: 270710 - DNA, 20 bp, Artificial
  CRISPR gRNA sequence
ttgcccaggctgaagtgcag

SEQ ID NO: 270711 - DNA, 20 bp, Artificial
  CRISPR gRNA sequence
cccaggctgaagtgcagtgg

SEQ ID NO: 270712 - DNA, 20 bp, Artificial
  CRISPR gRNA sequence
aagtgcagtggtgcaatctc

SEQ ID NO: 270713 - DNA, 20 bp, Artificial
  CRISPR gRNA sequence
agctcactgcaacctccacc

SEQ ID NO: 270714 - DNA, 20 bp, Artificial
  CRISPR gRNA sequence
actgcaacctccacccaccg

SEQ ID NO: 270715 - DNA, 20 bp, Artificial
  CRISPR gRNA sequence
caacctccacccaccgagtt

SEQ ID NO: 270716 - DNA, 20 bp, Artificial
  CRISPR gRNA sequence
cacccaccgagttcaaacaa

SEQ ID NO: 270717 - DNA, 20 bp, Artificial
  CRISPR gRNA sequence
aaacaattctcctgcctcag

SEQ ID NO: 270718 - DNA, 20 bp, Artificial
  CRISPR gRNA sequence
tcctgcctcagtctcttaag

SEQ ID NO: 270719 - DNA, 20 bp, Artificial
  CRISPR gRNA sequence
ctgcctcagtctcttaagta

SEQ ID NO: 270720 - DNA, 20 bp, Artificial
  CRISPR gRNA sequence
cctcagtctcttaagtagct

SEQ ID NO: 270721 - DNA, 20 bp, Artificial
  CRISPR gRNA sequence
agtctcttaagtagctggga

SEQ ID NO: 270722 - DNA, 20 bp, Artificial
  CRISPR gRNA sequence
ttaagtagctgggattacag

SEQ ID NO: 270723 - DNA, 20 bp, Artificial
  CRISPR gRNA sequence
aagtagctgggattacaggt

SEQ ID NO: 270724 - DNA, 20 bp, Artificial
  CRISPR gRNA sequence
agtagctgggattacaggta

SEQ ID NO: 270725 - DNA, 20 bp, Artificial
  CRISPR gRNA sequence
ggattacaggtatgcaccac

SEQ ID NO: 270726 - DNA, 20 bp, Artificial
  CRISPR gRNA sequence
caggtatgcaccaccacgcc

SEQ ID NO: 270727 - DNA, 20 bp, Artificial
  CRISPR gRNA sequence
atttttctatttttttagta

SEQ ID NO: 270728 - DNA, 20 bp, Artificial
  CRISPR gRNA sequence
ttctatttttttagtataga

SEQ ID NO: 270729 - DNA, 20 bp, Artificial
  CRISPR gRNA sequence
tctatttttttagtatagac

SEQ ID NO: 270730 - DNA, 20 bp, Artificial
  CRISPR gRNA sequence
ctatttttttagtatagacg

SEQ ID NO: 270731 - DNA, 20 bp, Artificial
  CRISPR gRNA sequence
tatttttttagtatagacgg

SEQ ID NO: 270732 - DNA, 20 bp, Artificial
  CRISPR gRNA sequence
tttttttagtatagacgggg

SEQ ID NO: 270733 - DNA, 20 bp, Artificial
  CRISPR gRNA sequence
ttttagtatagacggggttt

SEQ ID NO: 270734 - DNA, 20 bp, Artificial
  CRISPR gRNA sequence
tttagtatagacggggtttc

SEQ ID NO: 270735 - DNA, 20 bp, Artificial
  CRISPR gRNA sequence
ttagtatagacggggtttca

SEQ ID NO: 270736 - DNA, 20 bp, Artificial
  CRISPR gRNA sequence
tagtatagacggggtttcac

SEQ ID NO: 270737 - DNA, 20 bp, Artificial
  CRISPR gRNA sequence
agtatagacggggtttcacc

SEQ ID NO: 270738 - DNA, 20 bp, Artificial
  CRISPR gRNA sequence
gtatagacggggtttcacca

SEQ ID NO: 270739 - DNA, 20 bp, Artificial
  CRISPR gRNA sequence
caccatgttggctagcctgg

SEQ ID NO: 270740 - DNA, 20 bp, Artificial
  CRISPR gRNA sequence
accatgttggctagcctggt

SEQ ID NO: 270741 - DNA, 20 bp, Artificial
  CRISPR gRNA sequence
gctagcctggtctcaaactc

SEQ ID NO: 270742 - DNA, 20 bp, Artificial
  CRISPR gRNA sequence
gcctggtctcaaactcctgg

SEQ ID NO: 270743 - DNA, 20 bp, Artificial
  CRISPR gRNA sequence
gtctcaaactcctggcctca

SEQ ID NO: 270744 - DNA, 20 bp, Artificial
  CRISPR gRNA sequence
aaactcctggcctcaagtga

SEQ ID NO: 270745 - DNA, 20 bp, Artificial
  CRISPR gRNA sequence
ctggcctcaagtgatctgac

SEQ ID NO: 270746 - DNA, 20 bp, Artificial
  CRISPR gRNA sequence
gcctcaagtgatctgaccac

SEQ ID NO: 270747 - DNA, 20 bp, Artificial
  CRISPR gRNA sequence
aagtgatctgaccaccttgg

SEQ ID NO: 270748 - DNA, 20 bp, Artificial
  CRISPR gRNA sequence
accaccttggcctcccaaag

SEQ ID NO: 270749 - DNA, 20 bp, Artificial
  CRISPR gRNA sequence
ggcctcccaaagtgctggga

SEQ ID NO: 270750 - DNA, 20 bp, Artificial
  CRISPR gRNA sequence
gcctcccaaagtgctgggat

SEQ ID NO: 270751 - DNA, 20 bp, Artificial
  CRISPR gRNA sequence
ccaaagtgctgggattacaa

SEQ ID NO: 270752 - DNA, 20 bp, Artificial
  CRISPR gRNA sequence
ggattacaagcatgagccac

SEQ ID NO: 270753 - DNA, 20 bp, Artificial
  CRISPR gRNA sequence
caagcatgagccaccatgcc

SEQ ID NO: 270754 - DNA, 20 bp, Artificial
  CRISPR gRNA sequence
caaatagatttgtttttaag

SEQ ID NO: 270755 - DNA, 20 bp, Artificial
  CRISPR gRNA sequence
gtttttaagttgtgatacag

SEQ ID NO: 270756 - DNA, 20 bp, Artificial
  CRISPR gRNA sequence
tttttaagttgtgatacagg

SEQ ID NO: 270757 - DNA, 20 bp, Artificial
  CRISPR gRNA sequence
ttaagttgtgatacaggttt

SEQ ID NO: 270758 - DNA, 20 bp, Artificial
  CRISPR gRNA sequence
taagttgtgatacaggtttt

SEQ ID NO: 270759 - DNA, 20 bp, Artificial
  CRISPR gRNA sequence
aagttgtgatacaggttttt

SEQ ID NO: 270760 - DNA, 20 bp, Artificial
  CRISPR gRNA sequence
agttgtgatacaggtttttg

SEQ ID NO: 270761 - DNA, 20 bp, Artificial
  CRISPR gRNA sequence
tgatacaggtttttgtaaag

SEQ ID NO: 270762 - DNA, 20 bp, Artificial
  CRISPR gRNA sequence
ttgtaaaggaattaaaatat

SEQ ID NO: 270763 - DNA, 20 bp, Artificial
  CRISPR gRNA sequence
tgtaaaggaattaaaatatt

SEQ ID NO: 270764 - DNA, 20 bp, Artificial
  CRISPR gRNA sequence
gtaaaggaattaaaatattt

SEQ ID NO: 270765 - DNA, 20 bp, Artificial
  CRISPR gRNA sequence
taaaggaattaaaatatttt

SEQ ID NO: 270766 - DNA, 20 bp, Artificial
  CRISPR gRNA sequence
aaatattttgaaacattttt

SEQ ID NO: 270767 - DNA, 20 bp, Artificial
  CRISPR gRNA sequence
tgaaacatttttactttgtt

SEQ ID NO: 270768 - DNA, 20 bp, Artificial
  CRISPR gRNA sequence
gaaacatttttactttgttt

SEQ ID NO: 270769 - DNA, 20 bp, Artificial
  CRISPR gRNA sequence
aaacatttttactttgttta

SEQ ID NO: 270770 - DNA, 20 bp, Artificial
  CRISPR gRNA sequence
ttactttgtttattgcccat

SEQ ID NO: 270771 - DNA, 20 bp, Artificial
  CRISPR gRNA sequence
tactttgtttattgcccatt

SEQ ID NO: 270772 - DNA, 20 bp, Artificial
  CRISPR gRNA sequence
actttgtttattgcccattg

SEQ ID NO: 270773 - DNA, 20 bp, Artificial
  CRISPR gRNA sequence
ctttgtttattgcccattgc

SEQ ID NO: 270774 - DNA, 20 bp, Artificial
  CRISPR gRNA sequence
tgtttattgcccattgcaag

SEQ ID NO: 270775 - DNA, 20 bp, Artificial
  CRISPR gRNA sequence
gtttattgcccattgcaaga

SEQ ID NO: 270776 - DNA, 20 bp, Artificial
  CRISPR gRNA sequence
tttattgcccattgcaagag

SEQ ID NO: 270777 - DNA, 20 bp, Artificial
  CRISPR gRNA sequence
attgcccattgcaagagtgg

SEQ ID NO: 270778 - DNA, 20 bp, Artificial
  CRISPR gRNA sequence
ttgcccattgcaagagtggg

SEQ ID NO: 270779 - DNA, 20 bp, Artificial
  CRISPR gRNA sequence
cccattgcaagagtgggatg

SEQ ID NO: 270780 - DNA, 20 bp, Artificial
  CRISPR gRNA sequence
caagagtgggatgaagagat

SEQ ID NO: 270781 - DNA, 20 bp, Artificial
  CRISPR gRNA sequence
gctttaatgtgttttctgca

SEQ ID NO: 270782 - DNA, 20 bp, Artificial
  CRISPR gRNA sequence
ctttaatgtgttttctgcac

SEQ ID NO: 270783 - DNA, 20 bp, Artificial
  CRISPR gRNA sequence
taatgtgttttctgcaccaa

SEQ ID NO: 270784 - DNA, 20 bp, Artificial
  CRISPR gRNA sequence
aatgtgttttctgcaccaaa

SEQ ID NO: 270785 - DNA, 20 bp, Artificial
  CRISPR gRNA sequence
atgtgttttctgcaccaaat

SEQ ID NO: 270786 - DNA, 20 bp, Artificial
  CRISPR gRNA sequence
tctgcaccaaattcagagaa

SEQ ID NO: 270787 - DNA, 20 bp, Artificial
  CRISPR gRNA sequence
ctgcaccaaattcagagaat

SEQ ID NO: 270788 - DNA, 20 bp, Artificial
  CRISPR gRNA sequence
tgcaccaaattcagagaata

SEQ ID NO: 270789 - DNA, 20 bp, Artificial
  CRISPR gRNA sequence
caccaaattcagagaatagc

SEQ ID NO: 270790 - DNA, 20 bp, Artificial
  CRISPR gRNA sequence
agagaatagcctccccaaga

SEQ ID NO: 270791 - DNA, 20 bp, Artificial
  CRISPR gRNA sequence
cccaagaaattcatagatct

SEQ ID NO: 270792 - DNA, 20 bp, Artificial
  CRISPR gRNA sequence
atagatctattcccttatat

SEQ ID NO: 270793 - DNA, 20 bp, Artificial
  CRISPR gRNA sequence
ttcccttatatcatgaaagg

SEQ ID NO: 270794 - DNA, 20 bp, Artificial
  CRISPR gRNA sequence
ccttatatcatgaaaggtga

SEQ ID NO: 270795 - DNA, 20 bp, Artificial
  CRISPR gRNA sequence
atatcatgaaaggtgaaaga

SEQ ID NO: 270796 - DNA, 20 bp, Artificial
  CRISPR gRNA sequence
tatcatgaaaggtgaaagac

SEQ ID NO: 270797 - DNA, 20 bp, Artificial
  CRISPR gRNA sequence
cagaggggagttatctctct

SEQ ID NO: 270798 - DNA, 20 bp, Artificial
  CRISPR gRNA sequence
tctctctggtccatcatcta

SEQ ID NO: 270799 - DNA, 20 bp, Artificial
  CRISPR gRNA sequence
tctggtccatcatctacctt

SEQ ID NO: 270800 - DNA, 20 bp, Artificial
  CRISPR gRNA sequence
tggtccatcatctaccttta

SEQ ID NO: 270801 - DNA, 20 bp, Artificial
  CRISPR gRNA sequence
gtccatcatctacctttact

SEQ ID NO: 270802 - DNA, 20 bp, Artificial
  CRISPR gRNA sequence
cctttactgctatcccaata

SEQ ID NO: 270803 - DNA, 20 bp, Artificial
  CRISPR gRNA sequence
tactgctatcccaataaaag

SEQ ID NO: 270804 - DNA, 20 bp, Artificial
  CRISPR gRNA sequence
actgctatcccaataaaaga

SEQ ID NO: 270805 - DNA, 20 bp, Artificial
  CRISPR gRNA sequence
ctgctatcccaataaaagat

SEQ ID NO: 270806 - DNA, 20 bp, Artificial
  CRISPR gRNA sequence
ctatcccaataaaagatcaa

SEQ ID NO: 270807 - DNA, 20 bp, Artificial
  CRISPR gRNA sequence
tcccaataaaagatcaaaga

SEQ ID NO: 270808 - DNA, 20 bp, Artificial
  CRISPR gRNA sequence
gagagcatttagttcaatct

SEQ ID NO: 270809 - DNA, 20 bp, Artificial
  CRISPR gRNA sequence
agttcaatctttaaaagcaa

SEQ ID NO: 270810 - DNA, 20 bp, Artificial
  CRISPR gRNA sequence
gttcaatctttaaaagcaaa

SEQ ID NO: 270811 - DNA, 20 bp, Artificial
  CRISPR gRNA sequence
aatctttaaaagcaaagaac

SEQ ID NO: 270812 - DNA, 20 bp, Artificial
  CRISPR gRNA sequence
taaaagcaaagaacctgaaa

SEQ ID NO: 270813 - DNA, 20 bp, Artificial
  CRISPR gRNA sequence
aaaagcaaagaacctgaaac

SEQ ID NO: 270814 - DNA, 20 bp, Artificial
  CRISPR gRNA sequence
aaagcaaagaacctgaaact

SEQ ID NO: 270815 - DNA, 20 bp, Artificial
  CRISPR gRNA sequence
aaactagtttatcaactcca

SEQ ID NO: 270816 - DNA, 20 bp, Artificial
  CRISPR gRNA sequence
gtttatcaactccataagtg

SEQ ID NO: 270817 - DNA, 20 bp, Artificial
  CRISPR gRNA sequence
atcaactccataagtgaaga

SEQ ID NO: 270818 - DNA, 20 bp, Artificial
  CRISPR gRNA sequence
tcaactccataagtgaagag

SEQ ID NO: 270819 - DNA, 20 bp, Artificial
  CRISPR gRNA sequence
cataagtgaagagaacacat

SEQ ID NO: 270820 - DNA, 20 bp, Artificial
  CRISPR gRNA sequence
atctcatttcccatggtatc

SEQ ID NO: 270821 - DNA, 20 bp, Artificial
  CRISPR gRNA sequence
atttcccatggtatcctcat

SEQ ID NO: 270822 - DNA, 20 bp, Artificial
  CRISPR gRNA sequence
cccatggtatcctcattgtt

SEQ ID NO: 270823 - DNA, 20 bp, Artificial
  CRISPR gRNA sequence
ccatggtatcctcattgttg

SEQ ID NO: 270824 - DNA, 20 bp, Artificial
  CRISPR gRNA sequence
attgttggcacaggacaata

SEQ ID NO: 270825 - DNA, 20 bp, Artificial
  CRISPR gRNA sequence
ttggcacaggacaatattat

SEQ ID NO: 270826 - DNA, 20 bp, Artificial
  CRISPR gRNA sequence
gcacaggacaatattatttc

SEQ ID NO: 270827 - DNA, 20 bp, Artificial
  CRISPR gRNA sequence
tttctttttttttttctttt

SEQ ID NO: 270828 - DNA, 20 bp, Artificial
  CRISPR gRNA sequence
ctttttttttttcttttcta

SEQ ID NO: 270829 - DNA, 20 bp, Artificial
  CRISPR gRNA sequence
tttttttttttcttttctaa

SEQ ID NO: 270830 - DNA, 20 bp, Artificial
  CRISPR gRNA sequence
tttttttttcttttctaatg

SEQ ID NO: 270831 - DNA, 20 bp, Artificial
  CRISPR gRNA sequence
ttttttttcttttctaatga

SEQ ID NO: 270832 - DNA, 20 bp, Artificial
  CRISPR gRNA sequence
tttttttcttttctaatgat

SEQ ID NO: 270833 - DNA, 20 bp, Artificial
  CRISPR gRNA sequence
ttttttcttttctaatgatt

SEQ ID NO: 270834 - DNA, 20 bp, Artificial
  CRISPR gRNA sequence
tttttcttttctaatgattg

SEQ ID NO: 270835 - DNA, 20 bp, Artificial
  CRISPR gRNA sequence
ttttcttttctaatgattgt

SEQ ID NO: 270836 - DNA, 20 bp, Artificial
  CRISPR gRNA sequence
tttcttttctaatgattgta

SEQ ID NO: 270837 - DNA, 20 bp, Artificial
  CRISPR gRNA sequence
ttcttttctaatgattgtat

SEQ ID NO: 270838 - DNA, 20 bp, Artificial
  CRISPR gRNA sequence
tcttttctaatgattgtata

SEQ ID NO: 270839 - DNA, 20 bp, Artificial
  CRISPR gRNA sequence
cttttctaatgattgtataa

SEQ ID NO: 270840 - DNA, 20 bp, Artificial
  CRISPR gRNA sequence
ttttctaatgattgtataag

SEQ ID NO: 270841 - DNA, 20 bp, Artificial
  CRISPR gRNA sequence
ttctaatgattgtataaggc

SEQ ID NO: 270842 - DNA, 20 bp, Artificial
  CRISPR gRNA sequence
tctaatgattgtataaggcc

SEQ ID NO: 270843 - DNA, 20 bp, Artificial
  CRISPR gRNA sequence
ctaatgattgtataaggcct

SEQ ID NO: 270844 - DNA, 20 bp, Artificial
  CRISPR gRNA sequence
taatgattgtataaggccta

SEQ ID NO: 270845 - DNA, 20 bp, Artificial
  CRISPR gRNA sequence
atgattgtataaggcctaga

SEQ ID NO: 270846 - DNA, 20 bp, Artificial
  CRISPR gRNA sequence
tataaggcctagaaacatta

SEQ ID NO: 270847 - DNA, 20 bp, Artificial
  CRISPR gRNA sequence
gaaacattagctggtttgtc

SEQ ID NO: 270848 - DNA, 20 bp, Artificial
  CRISPR gRNA sequence
gctggtttgtctgaagtcac

SEQ ID NO: 270849 - DNA, 20 bp, Artificial
  CRISPR gRNA sequence
gtttgtctgaagtcaccaaa

SEQ ID NO: 270850 - DNA, 20 bp, Artificial
  CRISPR gRNA sequence
gtctgaagtcaccaaacaaa

SEQ ID NO: 270851 - DNA, 20 bp, Artificial
  CRISPR gRNA sequence
tctgaagtcaccaaacaaat

SEQ ID NO: 270852 - DNA, 20 bp, Artificial
  CRISPR gRNA sequence
aagtcaccaaacaaatggtg

SEQ ID NO: 270853 - DNA, 20 bp, Artificial
  CRISPR gRNA sequence
aaacccaagttggctatgac

SEQ ID NO: 270854 - DNA, 20 bp, Artificial
  CRISPR gRNA sequence
gctatgaccacctgagaaat

SEQ ID NO: 270855 - DNA, 20 bp, Artificial
  CRISPR gRNA sequence
tgaccacctgagaaatagac

SEQ ID NO: 270856 - DNA, 20 bp, Artificial
  CRISPR gRNA sequence
agaaatagaccactgaagca

SEQ ID NO: 270857 - DNA, 20 bp, Artificial
  CRISPR gRNA sequence
aagcactgagaaactgggaa

SEQ ID NO: 270858 - DNA, 20 bp, Artificial
  CRISPR gRNA sequence
agaaactgggaatcaacttt

SEQ ID NO: 270859 - DNA, 20 bp, Artificial
  CRISPR gRNA sequence
ggaatcaactttgcaaccaa

SEQ ID NO: 270860 - DNA, 20 bp, Artificial
  CRISPR gRNA sequence
tgcaaccaagacaccttcca

SEQ ID NO: 270861 - DNA, 20 bp, Artificial
  CRISPR gRNA sequence
gcaaccaagacaccttccaa

SEQ ID NO: 270862 - DNA, 20 bp, Artificial
  CRISPR gRNA sequence
caaccaagacaccttccaaa

SEQ ID NO: 270863 - DNA, 20 bp, Artificial
  CRISPR gRNA sequence
ccaaaatttttctttttttt

SEQ ID NO: 270864 - DNA, 20 bp, Artificial
  CRISPR gRNA sequence
caaaatttttcttttttttt

SEQ ID NO: 270865 - DNA, 20 bp, Artificial
  CRISPR gRNA sequence
ttctttttttttttttttct

SEQ ID NO: 270866 - DNA, 20 bp, Artificial
  CRISPR gRNA sequence
tctttttttttttttttctg

SEQ ID NO: 270867 - DNA, 20 bp, Artificial
  CRISPR gRNA sequence
ctttttttttttttttctgg

SEQ ID NO: 270868 - DNA, 20 bp, Artificial
  CRISPR gRNA sequence
tttttttttttttttctgga

SEQ ID NO: 270869 - DNA, 20 bp, Artificial
  CRISPR gRNA sequence
tttttttttttttctggaga

SEQ ID NO: 270870 - DNA, 20 bp, Artificial
  CRISPR gRNA sequence
ttttttttttttctggagac

SEQ ID NO: 270871 - DNA, 20 bp, Artificial
  CRISPR gRNA sequence
tttttttttttctggagacg

SEQ ID NO: 270872 - DNA, 20 bp, Artificial
  CRISPR gRNA sequence
ttttttttttctggagacgg

SEQ ID NO: 270873 - DNA, 20 bp, Artificial
  CRISPR gRNA sequence
tttttttttctggagacgga

SEQ ID NO: 270874 - DNA, 20 bp, Artificial
  CRISPR gRNA sequence
ttttttttctggagacggag

SEQ ID NO: 270875 - DNA, 20 bp, Artificial
  CRISPR gRNA sequence
tttttttctggagacggagt

SEQ ID NO: 270876 - DNA, 20 bp, Artificial
  CRISPR gRNA sequence
ttttttctggagacggagtt

SEQ ID NO: 270877 - DNA, 20 bp, Artificial
  CRISPR gRNA sequence
tttttctggagacggagttt

SEQ ID NO: 270878 - DNA, 20 bp, Artificial
  CRISPR gRNA sequence
ttttctggagacggagtttc

SEQ ID NO: 270879 - DNA, 20 bp, Artificial
  CRISPR gRNA sequence
tttctggagacggagtttcg

SEQ ID NO: 270880 - DNA, 20 bp, Artificial
  CRISPR gRNA sequence
ttctggagacggagtttcgc

SEQ ID NO: 270881 - DNA, 20 bp, Artificial
  CRISPR gRNA sequence
tctggagacggagtttcgct

SEQ ID NO: 270882 - DNA, 20 bp, Artificial
  CRISPR gRNA sequence
ctggagacggagtttcgctc

SEQ ID NO: 270883 - DNA, 20 bp, Artificial
  CRISPR gRNA sequence
tggagacggagtttcgctct

SEQ ID NO: 270884 - DNA, 20 bp, Artificial
  CRISPR gRNA sequence
gagacggagtttcgctcttg

SEQ ID NO: 270885 - DNA, 20 bp, Artificial
  CRISPR gRNA sequence
cgctcttgttgcccaggctg

SEQ ID NO: 270886 - DNA, 20 bp, Artificial
  CRISPR gRNA sequence
gctcttgttgcccaggctgg

SEQ ID NO: 270887 - DNA, 20 bp, Artificial
  CRISPR gRNA sequence
ttgttgcccaggctggagtg

SEQ ID NO: 270888 - DNA, 20 bp, Artificial
  CRISPR gRNA sequence
gttgcccaggctggagtgca

SEQ ID NO: 270889 - DNA, 20 bp, Artificial
  CRISPR gRNA sequence
ttgcccaggctggagtgcaa

SEQ ID NO: 270890 - DNA, 20 bp, Artificial
  CRISPR gRNA sequence
cccaggctggagtgcaatgg

SEQ ID NO: 270891 - DNA, 20 bp, Artificial
  CRISPR gRNA sequence
gagtgcaatggtgcgatctc

SEQ ID NO: 270892 - DNA, 20 bp, Artificial
  CRISPR gRNA sequence
agctgactgcaacctccgcc

SEQ ID NO: 270893 - DNA, 20 bp, Artificial
  CRISPR gRNA sequence
actgcaacctccgccctctg

SEQ ID NO: 270894 - DNA, 20 bp, Artificial
  CRISPR gRNA sequence
caacctccgccctctgggtt

SEQ ID NO: 270895 - DNA, 20 bp, Artificial
  CRISPR gRNA sequence
cgccctctgggttcaggtga

SEQ ID NO: 270896 - DNA, 20 bp, Artificial
  CRISPR gRNA sequence
tgggttcaggtgattctcct

SEQ ID NO: 270897 - DNA, 20 bp, Artificial
  CRISPR gRNA sequence
ggttcaggtgattctcctgc

SEQ ID NO: 270898 - DNA, 20 bp, Artificial
  CRISPR gRNA sequence
aggtgattctcctgcctcag

SEQ ID NO: 270899 - DNA, 20 bp, Artificial
  CRISPR gRNA sequence
tcctgcctcagcctcccgag

SEQ ID NO: 270900 - DNA, 20 bp, Artificial
  CRISPR gRNA sequence
ctgcctcagcctcccgagta

SEQ ID NO: 270901 - DNA, 20 bp, Artificial
  CRISPR gRNA sequence
cctcagcctcccgagtagct

SEQ ID NO: 270902 - DNA, 20 bp, Artificial
  CRISPR gRNA sequence
agcctcccgagtagctggga

SEQ ID NO: 270903 - DNA, 20 bp, Artificial
  CRISPR gRNA sequence
ccgagtagctgggattaaca

SEQ ID NO: 270904 - DNA, 20 bp, Artificial
  CRISPR gRNA sequence
ggattaacaggtatgcacca

SEQ ID NO: 270905 - DNA, 20 bp, Artificial
  CRISPR gRNA sequence
acaggtatgcaccaccatgc

SEQ ID NO: 270906 - DNA, 20 bp, Artificial
  CRISPR gRNA sequence
attttctatttttagtagag

SEQ ID NO: 270907 - DNA, 20 bp, Artificial
  CRISPR gRNA sequence
tctatttttagtagagacgg

SEQ ID NO: 270908 - DNA, 20 bp, Artificial
  CRISPR gRNA sequence
ctatttttagtagagacggg

SEQ ID NO: 270909 - DNA, 20 bp, Artificial
  CRISPR gRNA sequence
tatttttagtagagacgggg

SEQ ID NO: 270910 - DNA, 20 bp, Artificial
  CRISPR gRNA sequence
tttttagtagagacggggtt

SEQ ID NO: 270911 - DNA, 20 bp, Artificial
  CRISPR gRNA sequence
ttagtagagacggggtttct

SEQ ID NO: 270912 - DNA, 20 bp, Artificial
  CRISPR gRNA sequence
tagtagagacggggtttctc

SEQ ID NO: 270913 - DNA, 20 bp, Artificial
  CRISPR gRNA sequence
agtagagacggggtttctcc

SEQ ID NO: 270914 - DNA, 20 bp, Artificial
  CRISPR gRNA sequence
gtagagacggggtttctcca

SEQ ID NO: 270915 - DNA, 20 bp, Artificial
  CRISPR gRNA sequence
ctccatgttggtcaggcttg

SEQ ID NO: 270916 - DNA, 20 bp, Artificial
  CRISPR gRNA sequence
tccatgttggtcaggcttgt

SEQ ID NO: 270917 - DNA, 20 bp, Artificial
  CRISPR gRNA sequence
catgttggtcaggcttgtct

SEQ ID NO: 270918 - DNA, 20 bp, Artificial
  CRISPR gRNA sequence
gtcaggcttgtctcgaactc

SEQ ID NO: 270919 - DNA, 20 bp, Artificial
  CRISPR gRNA sequence
gtctcgaactcccaacctca

SEQ ID NO: 270920 - DNA, 20 bp, Artificial
  CRISPR gRNA sequence
tctcgaactcccaacctcag

SEQ ID NO: 270921 - DNA, 20 bp, Artificial
  CRISPR gRNA sequence
gaactcccaacctcaggtga

SEQ ID NO: 270922 - DNA, 20 bp, Artificial
  CRISPR gRNA sequence
ccaacctcaggtgatccacc

SEQ ID NO: 270923 - DNA, 20 bp, Artificial
  CRISPR gRNA sequence
aggtgatccaccgcctcggc

SEQ ID NO: 270924 - DNA, 20 bp, Artificial
  CRISPR gRNA sequence
ggcctcccaaagtgctggga

SEQ ID NO: 270925 - DNA, 20 bp, Artificial
  CRISPR gRNA sequence
ccaaagtgctgggattacag

SEQ ID NO: 270926 - DNA, 20 bp, Artificial
  CRISPR gRNA sequence
ggattacaggtgtgagccac

SEQ ID NO: 270927 - DNA, 20 bp, Artificial
  CRISPR gRNA sequence
caggtgtgagccactgcgcc

SEQ ID NO: 270928 - DNA, 20 bp, Artificial
  CRISPR gRNA sequence
cgcctggccctcaagaattt

SEQ ID NO: 270929 - DNA, 20 bp, Artificial
  CRISPR gRNA sequence
gccctcaagaatttttctaa

SEQ ID NO: 270930 - DNA, 20 bp, Artificial
  CRISPR gRNA sequence
aagaatttttctaaaacaac

SEQ ID NO: 270931 - DNA, 20 bp, Artificial
  CRISPR gRNA sequence
ttctaaaacaacaaaccact

SEQ ID NO: 270932 - DNA, 20 bp, Artificial
  CRISPR gRNA sequence
tctaaaacaacaaaccactt

SEQ ID NO: 270933 - DNA, 20 bp, Artificial
  CRISPR gRNA sequence
ctaaaacaacaaaccacttt

SEQ ID NO: 270934 - DNA, 20 bp, Artificial
  CRISPR gRNA sequence
taaaacaacaaaccactttg

SEQ ID NO: 270935 - DNA, 20 bp, Artificial
  CRISPR gRNA sequence
aaacaacaaaccactttgtg

SEQ ID NO: 270936 - DNA, 20 bp, Artificial
  CRISPR gRNA sequence
tgtgtctttgattcaaattt

SEQ ID NO: 270937 - DNA, 20 bp, Artificial
  CRISPR gRNA sequence
gtgtctttgattcaaatttc

SEQ ID NO: 270938 - DNA, 20 bp, Artificial
  CRISPR gRNA sequence
tgtctttgattcaaatttca

SEQ ID NO: 270939 - DNA, 20 bp, Artificial
  CRISPR gRNA sequence
tgattcaaatttcaatgcaa

SEQ ID NO: 270940 - DNA, 20 bp, Artificial
  CRISPR gRNA sequence
gattcaaatttcaatgcaaa

SEQ ID NO: 270941 - DNA, 20 bp, Artificial
  CRISPR gRNA sequence
attcaaatttcaatgcaaac

SEQ ID NO: 270942 - DNA, 20 bp, Artificial
  CRISPR gRNA sequence
aaatttcaatgcaaacaaaa

SEQ ID NO: 270943 - DNA, 20 bp, Artificial
  CRISPR gRNA sequence
caatgcaaacaaaagcattt

SEQ ID NO: 270944 - DNA, 20 bp, Artificial
  CRISPR gRNA sequence
aatgcaaacaaaagcatttt

SEQ ID NO: 270945 - DNA, 20 bp, Artificial
  CRISPR gRNA sequence
ttttgctcttgttttggggt

SEQ ID NO: 270946 - DNA, 20 bp, Artificial
  CRISPR gRNA sequence
tttgctcttgttttggggta

SEQ ID NO: 270947 - DNA, 20 bp, Artificial
  CRISPR gRNA sequence
ttgctcttgttttggggtat

SEQ ID NO: 270948 - DNA, 20 bp, Artificial
  CRISPR gRNA sequence
tgctcttgttttggggtatg

SEQ ID NO: 270949 - DNA, 20 bp, Artificial
  CRISPR gRNA sequence
gctcttgttttggggtatgt

SEQ ID NO: 270950 - DNA, 20 bp, Artificial
  CRISPR gRNA sequence
ctcttgttttggggtatgtt

SEQ ID NO: 270951 - DNA, 20 bp, Artificial
  CRISPR gRNA sequence
ttgttttggggtatgttaat

SEQ ID NO: 270952 - DNA, 20 bp, Artificial
  CRISPR gRNA sequence
gttttggggtatgttaataa

SEQ ID NO: 270953 - DNA, 20 bp, Artificial
  CRISPR gRNA sequence
ttttggggtatgttaataat

SEQ ID NO: 270954 - DNA, 20 bp, Artificial
  CRISPR gRNA sequence
tggggtatgttaataattat

SEQ ID NO: 270955 - DNA, 20 bp, Artificial
  CRISPR gRNA sequence
ggggtatgttaataattatt

SEQ ID NO: 270956 - DNA, 20 bp, Artificial
  CRISPR gRNA sequence
gggtatgttaataattattt

SEQ ID NO: 270957 - DNA, 20 bp, Artificial
  CRISPR gRNA sequence
ataattatttacctacttgc

SEQ ID NO: 270958 - DNA, 20 bp, Artificial
  CRISPR gRNA sequence
tttacctacttgcatttctt

SEQ ID NO: 270959 - DNA, 20 bp, Artificial
  CRISPR gRNA sequence
acctacttgcatttctttta

SEQ ID NO: 270960 - DNA, 20 bp, Artificial
  CRISPR gRNA sequence
cctacttgcatttcttttaa

SEQ ID NO: 270961 - DNA, 20 bp, Artificial
  CRISPR gRNA sequence
cttgcatttcttttaagttt

SEQ ID NO: 270962 - DNA, 20 bp, Artificial
  CRISPR gRNA sequence
gcatttcttttaagtttatt

SEQ ID NO: 270963 - DNA, 20 bp, Artificial
  CRISPR gRNA sequence
catttcttttaagtttattt

SEQ ID NO: 270964 - DNA, 20 bp, Artificial
  CRISPR gRNA sequence
cttttaagtttatttgaagc

SEQ ID NO: 270965 - DNA, 20 bp, Artificial
  CRISPR gRNA sequence
ttttaagtttatttgaagca

SEQ ID NO: 270966 - DNA, 20 bp, Artificial
  CRISPR gRNA sequence
ttaagtttatttgaagcaac

SEQ ID NO: 270967 - DNA, 20 bp, Artificial
  CRISPR gRNA sequence
taagtttatttgaagcaaca

SEQ ID NO: 270968 - DNA, 20 bp, Artificial
  CRISPR gRNA sequence
aagtttatttgaagcaacat

SEQ ID NO: 270969 - DNA, 20 bp, Artificial
  CRISPR gRNA sequence
agtttatttgaagcaacatc

SEQ ID NO: 270970 - DNA, 20 bp, Artificial
  CRISPR gRNA sequence
atttgaagcaacatcccgta

SEQ ID NO: 270971 - DNA, 20 bp, Artificial
  CRISPR gRNA sequence
tttgaagcaacatcccgtat

SEQ ID NO: 270972 - DNA, 20 bp, Artificial
  CRISPR gRNA sequence
gaagcaacatcccgtatacc

SEQ ID NO: 270973 - DNA, 20 bp, Artificial
  CRISPR gRNA sequence
aagcaacatcccgtataccc

SEQ ID NO: 270974 - DNA, 20 bp, Artificial
  CRISPR gRNA sequence
aagagccaaataaaatcaga

SEQ ID NO: 270975 - DNA, 20 bp, Artificial
  CRISPR gRNA sequence
atttttaaatgaaatttaca

SEQ ID NO: 270976 - DNA, 20 bp, Artificial
  CRISPR gRNA sequence
ttaaatgaaatttacaattt

SEQ ID NO: 270977 - DNA, 20 bp, Artificial
  CRISPR gRNA sequence
taaatgaaatttacaattta

SEQ ID NO: 270978 - DNA, 20 bp, Artificial
  CRISPR gRNA sequence
aaatgaaatttacaatttaa

SEQ ID NO: 270979 - DNA, 20 bp, Artificial
  CRISPR gRNA sequence
aatgaaatttacaatttaac

SEQ ID NO: 270980 - DNA, 20 bp, Artificial
  CRISPR gRNA sequence
acaatttaactgaatttgaa

SEQ ID NO: 270981 - DNA, 20 bp, Artificial
  CRISPR gRNA sequence
caatttaactgaatttgaat

SEQ ID NO: 270982 - DNA, 20 bp, Artificial
  CRISPR gRNA sequence
aactgaatttgaattcatat

SEQ ID NO: 270983 - DNA, 20 bp, Artificial
  CRISPR gRNA sequence
actgaatttgaattcatata

SEQ ID NO: 270984 - DNA, 20 bp, Artificial
  CRISPR gRNA sequence
aatttgaattcatatacaca

SEQ ID NO: 270985 - DNA, 20 bp, Artificial
  CRISPR gRNA sequence
gaattcatatacacaggtgt

SEQ ID NO: 270986 - DNA, 20 bp, Artificial
  CRISPR gRNA sequence
aattcatatacacaggtgtt

SEQ ID NO: 270987 - DNA, 20 bp, Artificial
  CRISPR gRNA sequence
atatacacaggtgttttgtt

SEQ ID NO: 270988 - DNA, 20 bp, Artificial
  CRISPR gRNA sequence
tgttttggttttggtaagaa

SEQ ID NO: 270989 - DNA, 20 bp, Artificial
  CRISPR gRNA sequence
gttttggttttggtaagaag

SEQ ID NO: 270990 - DNA, 20 bp, Artificial
  CRISPR gRNA sequence
ttttggttttggtaagaagg

SEQ ID NO: 270991 - DNA, 20 bp, Artificial
  CRISPR gRNA sequence
tggttttggtaagaaggaaa

SEQ ID NO: 270992 - DNA, 20 bp, Artificial
  CRISPR gRNA sequence
ggttttggtaagaaggaaat

SEQ ID NO: 270993 - DNA, 20 bp, Artificial
  CRISPR gRNA sequence
gttttggtaagaaggaaatg

SEQ ID NO: 270994 - DNA, 20 bp, Artificial
  CRISPR gRNA sequence
tggtaagaaggaaatggcat

SEQ ID NO: 270995 - DNA, 20 bp, Artificial
  CRISPR gRNA sequence
ggtaagaaggaaatggcata

SEQ ID NO: 270996 - DNA, 20 bp, Artificial
  CRISPR gRNA sequence
gtaagaaggaaatggcatag

SEQ ID NO: 270997 - DNA, 20 bp, Artificial
  CRISPR gRNA sequence
aattaatagtagctttttgt

SEQ ID NO: 270998 - DNA, 20 bp, Artificial
  CRISPR gRNA sequence
atagtagctttttgtctcct

SEQ ID NO: 270999 - DNA, 20 bp, Artificial
  CRISPR gRNA sequence
tttgtctcctatataatcaa

SEQ ID NO: 271000 - DNA, 20 bp, Artificial
  CRISPR gRNA sequence
ttgtctcctatataatcaat

SEQ ID NO: 271001 - DNA, 20 bp, Artificial
  CRISPR gRNA sequence
tgtctcctatataatcaata

SEQ ID NO: 271002 - DNA, 20 bp, Artificial
  CRISPR gRNA sequence
gtctcctatataatcaataa

SEQ ID NO: 271003 - DNA, 20 bp, Artificial
  CRISPR gRNA sequence
tctcctatataatcaataat

SEQ ID NO: 271004 - DNA, 20 bp, Artificial
  CRISPR gRNA sequence
ctatataatcaataatgctg

SEQ ID NO: 271005 - DNA, 20 bp, Artificial
  CRISPR gRNA sequence
tataatcaataatgctggct

SEQ ID NO: 271006 - DNA, 20 bp, Artificial
  CRISPR gRNA sequence
gctggggatgatggctcaca

SEQ ID NO: 271007 - DNA, 20 bp, Artificial
  CRISPR gRNA sequence
gggatgatggctcacacctt

SEQ ID NO: 271008 - DNA, 20 bp, Artificial
  CRISPR gRNA sequence
acacctttgtgatcctagca

SEQ ID NO: 271009 - DNA, 20 bp, Artificial
  CRISPR gRNA sequence
tgtgatcctagcactttggg

SEQ ID NO: 271010 - DNA, 20 bp, Artificial
  CRISPR gRNA sequence
gtgatcctagcactttggga

SEQ ID NO: 271011 - DNA, 20 bp, Artificial
  CRISPR gRNA sequence
tgatcctagcactttgggag

SEQ ID NO: 271012 - DNA, 20 bp, Artificial
  CRISPR gRNA sequence
gcactttgggaggccaaggc

SEQ ID NO: 271013 - DNA, 20 bp, Artificial
  CRISPR gRNA sequence
tgggaggccaaggcgggatg

SEQ ID NO: 271014 - DNA, 20 bp, Artificial
  CRISPR gRNA sequence
gggaggccaaggcgggatga

SEQ ID NO: 271015 - DNA, 20 bp, Artificial
  CRISPR gRNA sequence
ggaggccaaggcgggatgaa

SEQ ID NO: 271016 - DNA, 20 bp, Artificial
  CRISPR gRNA sequence
gagcccaggagttcaagacc

SEQ ID NO: 271017 - DNA, 20 bp, Artificial
  CRISPR gRNA sequence
agcccaggagttcaagacca

SEQ ID NO: 271018 - DNA, 20 bp, Artificial
  CRISPR gRNA sequence
aagaccagcctgggcaacat

SEQ ID NO: 271019 - DNA, 20 bp, Artificial
  CRISPR gRNA sequence
ggcaacatagaaagaaccca

SEQ ID NO: 271020 - DNA, 20 bp, Artificial
  CRISPR gRNA sequence
tacaaaattctttttaaaaa

SEQ ID NO: 271021 - DNA, 20 bp, Artificial
  CRISPR gRNA sequence
caaaattctttttaaaaaat

SEQ ID NO: 271022 - DNA, 20 bp, Artificial
  CRISPR gRNA sequence
tttttaaaaaatcattgctg

SEQ ID NO: 271023 - DNA, 20 bp, Artificial
  CRISPR gRNA sequence
tttaaaaaatcattgctggc

SEQ ID NO: 271024 - DNA, 20 bp, Artificial
  CRISPR gRNA sequence
ttaaaaaatcattgctggct

SEQ ID NO: 271025 - DNA, 20 bp, Artificial
  CRISPR gRNA sequence
taaaaaatcattgctggctt

SEQ ID NO: 271026 - DNA, 20 bp, Artificial
  CRISPR gRNA sequence
aaaaaatcattgctggcttt

SEQ ID NO: 271027 - DNA, 20 bp, Artificial
  CRISPR gRNA sequence
aaaaatcattgctggcttta

SEQ ID NO: 271028 - DNA, 20 bp, Artificial
  CRISPR gRNA sequence
ctggctttatatcaagaact

SEQ ID NO: 271029 - DNA, 20 bp, Artificial
  CRISPR gRNA sequence
gctttatatcaagaacttta

SEQ ID NO: 271030 - DNA, 20 bp, Artificial
  CRISPR gRNA sequence
tatatcaagaactttaaaat

SEQ ID NO: 271031 - DNA, 20 bp, Artificial
  CRISPR gRNA sequence
atatcaagaactttaaaatg

SEQ ID NO: 271032 - DNA, 20 bp, Artificial
  CRISPR gRNA sequence
tatcaagaactttaaaatga

SEQ ID NO: 271033 - DNA, 20 bp, Artificial
  CRISPR gRNA sequence
taaaatgaaaaaatatctgt

SEQ ID NO: 271034 - DNA, 20 bp, Artificial
  CRISPR gRNA sequence
aaaatgaaaaaatatctgtg

SEQ ID NO: 271035 - DNA, 20 bp, Artificial
  CRISPR gRNA sequence
aaatgaaaaaatatctgtgc

SEQ ID NO: 271036 - DNA, 20 bp, Artificial
  CRISPR gRNA sequence
tgcccaagtcctcccacttc

SEQ ID NO: 271037 - DNA, 20 bp, Artificial
  CRISPR gRNA sequence
ccacttccggaaattctgat

SEQ ID NO: 271038 - DNA, 20 bp, Artificial
  CRISPR gRNA sequence
ccggaaattctgatttaatt

SEQ ID NO: 271039 - DNA, 20 bp, Artificial
  CRISPR gRNA sequence
cggaaattctgatttaattg

SEQ ID NO: 271040 - DNA, 20 bp, Artificial
  CRISPR gRNA sequence
tgatttaattggtctaggct

SEQ ID NO: 271041 - DNA, 20 bp, Artificial
  CRISPR gRNA sequence
atttaattggtctaggctgg

SEQ ID NO: 271042 - DNA, 20 bp, Artificial
  CRISPR gRNA sequence
aattggtctaggctgggggg

SEQ ID NO: 271043 - DNA, 20 bp, Artificial
  CRISPR gRNA sequence
attggtctaggctgggggga

SEQ ID NO: 271044 - DNA, 20 bp, Artificial
  CRISPR gRNA sequence
gtctaggctggggggaagga

SEQ ID NO: 271045 - DNA, 20 bp, Artificial
  CRISPR gRNA sequence
ggctggggggaaggattgat

SEQ ID NO: 271046 - DNA, 20 bp, Artificial
  CRISPR gRNA sequence
gggggaaggattgatactaa

SEQ ID NO: 271047 - DNA, 20 bp, Artificial
  CRISPR gRNA sequence
atactaagttttttttcttt

SEQ ID NO: 271048 - DNA, 20 bp, Artificial
  CRISPR gRNA sequence
agttttttttctttatttta

SEQ ID NO: 271049 - DNA, 20 bp, Artificial
  CRISPR gRNA sequence
tttttctttattttagataa

SEQ ID NO: 271050 - DNA, 20 bp, Artificial
  CRISPR gRNA sequence
ttttctttattttagataat

SEQ ID NO: 271051 - DNA, 20 bp, Artificial
  CRISPR gRNA sequence
tttctttattttagataata

SEQ ID NO: 271052 - DNA, 20 bp, Artificial
  CRISPR gRNA sequence
ttctttattttagataataa

SEQ ID NO: 271053 - DNA, 20 bp, Artificial
  CRISPR gRNA sequence
tctttattttagataataac

SEQ ID NO: 271054 - DNA, 20 bp, Artificial
  CRISPR gRNA sequence
ctttattttagataataact

SEQ ID NO: 271055 - DNA, 20 bp, Artificial
  CRISPR gRNA sequence
tttattttagataataactt

SEQ ID NO: 271056 - DNA, 20 bp, Artificial
  CRISPR gRNA sequence
tattttagataataacttta

SEQ ID NO: 271057 - DNA, 20 bp, Artificial
  CRISPR gRNA sequence
attttagataataactttat

SEQ ID NO: 271058 - DNA, 20 bp, Artificial
  CRISPR gRNA sequence
ttttagataataactttatt

SEQ ID NO: 271059 - DNA, 20 bp, Artificial
  CRISPR gRNA sequence
tagataataactttattgag

SEQ ID NO: 271060 - DNA, 20 bp, Artificial
  CRISPR gRNA sequence
agataataactttattgaga

SEQ ID NO: 271061 - DNA, 20 bp, Artificial
  CRISPR gRNA sequence
gataataactttattgagat

SEQ ID NO: 271062 - DNA, 20 bp, Artificial
  CRISPR gRNA sequence
tattgagatataattcaggt

SEQ ID NO: 271063 - DNA, 20 bp, Artificial
  CRISPR gRNA sequence
attgagatataattcaggta

SEQ ID NO: 271064 - DNA, 20 bp, Artificial
  CRISPR gRNA sequence
ttgagatataattcaggtac

SEQ ID NO: 271065 - DNA, 20 bp, Artificial
  CRISPR gRNA sequence
agatataattcaggtactat

SEQ ID NO: 271066 - DNA, 20 bp, Artificial
  CRISPR gRNA sequence
aggtactataaagtttgctg

SEQ ID NO: 271067 - DNA, 20 bp, Artificial
  CRISPR gRNA sequence
taaagtttgctgttttaaag

SEQ ID NO: 271068 - DNA, 20 bp, Artificial
  CRISPR gRNA sequence
gctgttttaaagtgtaaaat

SEQ ID NO: 271069 - DNA, 20 bp, Artificial
  CRISPR gRNA sequence
ctgttttaaagtgtaaaatt

SEQ ID NO: 271070 - DNA, 20 bp, Artificial
  CRISPR gRNA sequence
ttttaaagtgtaaaattcag

SEQ ID NO: 271071 - DNA, 20 bp, Artificial
  CRISPR gRNA sequence
taaagtgtaaaattcagaga

SEQ ID NO: 271072 - DNA, 20 bp, Artificial
  CRISPR gRNA sequence
aaagtgtaaaattcagagat

SEQ ID NO: 271073 - DNA, 20 bp, Artificial
  CRISPR gRNA sequence
aagtgtaaaattcagagatt

SEQ ID NO: 271074 - DNA, 20 bp, Artificial
  CRISPR gRNA sequence
agagattttttagtatattc

SEQ ID NO: 271075 - DNA, 20 bp, Artificial
  CRISPR gRNA sequence
tttagtatattcacaaagtt

SEQ ID NO: 271076 - DNA, 20 bp, Artificial
  CRISPR gRNA sequence
ttagtatattcacaaagtta

SEQ ID NO: 271077 - DNA, 20 bp, Artificial
  CRISPR gRNA sequence
tagtatattcacaaagttat

SEQ ID NO: 271078 - DNA, 20 bp, Artificial
  CRISPR gRNA sequence
agtatattcacaaagttatg

SEQ ID NO: 271079 - DNA, 20 bp, Artificial
  CRISPR gRNA sequence
gtatattcacaaagttatga

SEQ ID NO: 271080 - DNA, 20 bp, Artificial
  CRISPR gRNA sequence
acaaagttatgaatgaatca

SEQ ID NO: 271081 - DNA, 20 bp, Artificial
  CRISPR gRNA sequence
tgaatgaatcaccactatct

SEQ ID NO: 271082 - DNA, 20 bp, Artificial
  CRISPR gRNA sequence
tctgattccagaacattttc

SEQ ID NO: 271083 - DNA, 20 bp, Artificial
  CRISPR gRNA sequence
attccagaacattttcatta

SEQ ID NO: 271084 - DNA, 20 bp, Artificial
  CRISPR gRNA sequence
cagaacattttcattactcc

SEQ ID NO: 271085 - DNA, 20 bp, Artificial
  CRISPR gRNA sequence
tcattactccataaagaaat

SEQ ID NO: 271086 - DNA, 20 bp, Artificial
  CRISPR gRNA sequence
cattactccataaagaaata

SEQ ID NO: 271087 - DNA, 20 bp, Artificial
  CRISPR gRNA sequence
attactccataaagaaatac

SEQ ID NO: 271088 - DNA, 20 bp, Artificial
  CRISPR gRNA sequence
ctccataaagaaataccata

SEQ ID NO: 271089 - DNA, 20 bp, Artificial
  CRISPR gRNA sequence
cataaagaaataccataccc

SEQ ID NO: 271090 - DNA, 20 bp, Artificial
  CRISPR gRNA sequence
accatcaccctgcttcctcc

SEQ ID NO: 271091 - DNA, 20 bp, Artificial
  CRISPR gRNA sequence
ccatcaccctgcttcctccc

SEQ ID NO: 271092 - DNA, 20 bp, Artificial
  CRISPR gRNA sequence
cttcctccctcccttaaatc

SEQ ID NO: 271093 - DNA, 20 bp, Artificial
  CRISPR gRNA sequence
cctccctcccttaaatccct

SEQ ID NO: 271094 - DNA, 20 bp, Artificial
  CRISPR gRNA sequence
ctccctcccttaaatccctg

SEQ ID NO: 271095 - DNA, 20 bp, Artificial
  CRISPR gRNA sequence
cctcccttaaatccctggaa

SEQ ID NO: 271096 - DNA, 20 bp, Artificial
  CRISPR gRNA sequence
ccttaaatccctggaaacca

SEQ ID NO: 271097 - DNA, 20 bp, Artificial
  CRISPR gRNA sequence
aaatccctggaaaccactga

SEQ ID NO: 271098 - DNA, 20 bp, Artificial
  CRISPR gRNA sequence
aatccctggaaaccactgat

SEQ ID NO: 271099 - DNA, 20 bp, Artificial
  CRISPR gRNA sequence
gaaaccactgatctactttg

SEQ ID NO: 271100 - DNA, 20 bp, Artificial
  CRISPR gRNA sequence
atctactttggccctatgaa

SEQ ID NO: 271101 - DNA, 20 bp, Artificial
  CRISPR gRNA sequence
ctttggccctatgaatttgc

SEQ ID NO: 271102 - DNA, 20 bp, Artificial
  CRISPR gRNA sequence
tggccctatgaatttgccta

SEQ ID NO: 271103 - DNA, 20 bp, Artificial
  CRISPR gRNA sequence
ggccctatgaatttgcctat

SEQ ID NO: 271104 - DNA, 20 bp, Artificial
  CRISPR gRNA sequence
gccctatgaatttgcctatt

SEQ ID NO: 271105 - DNA, 20 bp, Artificial
  CRISPR gRNA sequence
tgaatttgcctattctggac

SEQ ID NO: 271106 - DNA, 20 bp, Artificial
  CRISPR gRNA sequence
gcctattctggacttttttt

SEQ ID NO: 271107 - DNA, 20 bp, Artificial
  CRISPR gRNA sequence
cctattctggacttttttta

SEQ ID NO: 271108 - DNA, 20 bp, Artificial
  CRISPR gRNA sequence
ttctggactttttttataag

SEQ ID NO: 271109 - DNA, 20 bp, Artificial
  CRISPR gRNA sequence
tggactttttttataagtag

SEQ ID NO: 271110 - DNA, 20 bp, Artificial
  CRISPR gRNA sequence
gactttttttataagtagaa

SEQ ID NO: 271111 - DNA, 20 bp, Artificial
  CRISPR gRNA sequence
tttttataagtagaatcata

SEQ ID NO: 271112 - DNA, 20 bp, Artificial
  CRISPR gRNA sequence
ttttataagtagaatcatac

SEQ ID NO: 271113 - DNA, 20 bp, Artificial
  CRISPR gRNA sequence
tttataagtagaatcatacg

SEQ ID NO: 271114 - DNA, 20 bp, Artificial
  CRISPR gRNA sequence
ttataagtagaatcatacga

SEQ ID NO: 271115 - DNA, 20 bp, Artificial
  CRISPR gRNA sequence
tataagtagaatcatacgat

SEQ ID NO: 271116 - DNA, 20 bp, Artificial
  CRISPR gRNA sequence
ataagtagaatcatacgata

SEQ ID NO: 271117 - DNA, 20 bp, Artificial
  CRISPR gRNA sequence
taagtagaatcatacgatat

SEQ ID NO: 271118 - DNA, 20 bp, Artificial
  CRISPR gRNA sequence
tttgtgtctcgtttctttca

SEQ ID NO: 271119 - DNA, 20 bp, Artificial
  CRISPR gRNA sequence
ttgtgtctcgtttctttcac

SEQ ID NO: 271120 - DNA, 20 bp, Artificial
  CRISPR gRNA sequence
tgtgtctcgtttctttcact

SEQ ID NO: 271121 - DNA, 20 bp, Artificial
  CRISPR gRNA sequence
gtgtctcgtttctttcactt

SEQ ID NO: 271122 - DNA, 20 bp, Artificial
  CRISPR gRNA sequence
tgtctcgtttctttcactta

SEQ ID NO: 271123 - DNA, 20 bp, Artificial
  CRISPR gRNA sequence
gtttctttcacttagcataa

SEQ ID NO: 271124 - DNA, 20 bp, Artificial
  CRISPR gRNA sequence
ctttcacttagcataatgtt

SEQ ID NO: 271125 - DNA, 20 bp, Artificial
  CRISPR gRNA sequence
tttcacttagcataatgttt

SEQ ID NO: 271126 - DNA, 20 bp, Artificial
  CRISPR gRNA sequence
tcacttagcataatgttttc

SEQ ID NO: 271127 - DNA, 20 bp, Artificial
  CRISPR gRNA sequence
cacttagcataatgttttca

SEQ ID NO: 271128 - DNA, 20 bp, Artificial
  CRISPR gRNA sequence
acttagcataatgttttcaa

SEQ ID NO: 271129 - DNA, 20 bp, Artificial
  CRISPR gRNA sequence
agcataatgttttcaagttt

SEQ ID NO: 271130 - DNA, 20 bp, Artificial
  CRISPR gRNA sequence
gcataatgttttcaagtttc

SEQ ID NO: 271131 - DNA, 20 bp, Artificial
  CRISPR gRNA sequence
tcaagtttcatccatgtttc

SEQ ID NO: 271132 - DNA, 20 bp, Artificial
  CRISPR gRNA sequence
caagtttcatccatgtttca

SEQ ID NO: 271133 - DNA, 20 bp, Artificial
  CRISPR gRNA sequence
aagtttcatccatgtttcaa

SEQ ID NO: 271134 - DNA, 20 bp, Artificial
  CRISPR gRNA sequence
catccatgtttcaagtttca

SEQ ID NO: 271135 - DNA, 20 bp, Artificial
  CRISPR gRNA sequence
atccatgtttcaagtttcat

SEQ ID NO: 271136 - DNA, 20 bp, Artificial
  CRISPR gRNA sequence
caagtttcatccatgttgtt

SEQ ID NO: 271137 - DNA, 20 bp, Artificial
  CRISPR gRNA sequence
aagtttcatccatgttgttg

SEQ ID NO: 271138 - DNA, 20 bp, Artificial
  CRISPR gRNA sequence
catccatgttgttgcatgca

SEQ ID NO: 271139 - DNA, 20 bp, Artificial
  CRISPR gRNA sequence
atccatgttgttgcatgcac

SEQ ID NO: 271140 - DNA, 20 bp, Artificial
  CRISPR gRNA sequence
ttgcatgcaccagaacttca

SEQ ID NO: 271141 - DNA, 20 bp, Artificial
  CRISPR gRNA sequence
catgcaccagaacttcactc

SEQ ID NO: 271142 - DNA, 20 bp, Artificial
  CRISPR gRNA sequence
cactcttcatggccaaataa

SEQ ID NO: 271143 - DNA, 20 bp, Artificial
  CRISPR gRNA sequence
actcttcatggccaaataat

SEQ ID NO: 271144 - DNA, 20 bp, Artificial
  CRISPR gRNA sequence
ttcatggccaaataatattc

SEQ ID NO: 271145 - DNA, 20 bp, Artificial
  CRISPR gRNA sequence
catggccaaataatattcca

SEQ ID NO: 271146 - DNA, 20 bp, Artificial
  CRISPR gRNA sequence
atggccaaataatattccat

SEQ ID NO: 271147 - DNA, 20 bp, Artificial
  CRISPR gRNA sequence
cattgtatggctatactaca

SEQ ID NO: 271148 - DNA, 20 bp, Artificial
  CRISPR gRNA sequence
tatggctatactacattttg

SEQ ID NO: 271149 - DNA, 20 bp, Artificial
  CRISPR gRNA sequence
tactacattttgtttttcta

SEQ ID NO: 271150 - DNA, 20 bp, Artificial
  CRISPR gRNA sequence
cattttgtttttctattcat

SEQ ID NO: 271151 - DNA, 20 bp, Artificial
  CRISPR gRNA sequence
tgtttttctattcatcactt

SEQ ID NO: 271152 - DNA, 20 bp, Artificial
  CRISPR gRNA sequence
gtttttctattcatcacttt

SEQ ID NO: 271153 - DNA, 20 bp, Artificial
  CRISPR gRNA sequence
tttttctattcatcactttt

SEQ ID NO: 271154 - DNA, 20 bp, Artificial
  CRISPR gRNA sequence
ttctattcatcactttttgg

SEQ ID NO: 271155 - DNA, 20 bp, Artificial
  CRISPR gRNA sequence
tctattcatcactttttggc

SEQ ID NO: 271156 - DNA, 20 bp, Artificial
  CRISPR gRNA sequence
ctattcatcactttttggct

SEQ ID NO: 271157 - DNA, 20 bp, Artificial
  CRISPR gRNA sequence
tattcatcactttttggcta

SEQ ID NO: 271158 - DNA, 20 bp, Artificial
  CRISPR gRNA sequence
ttcatcactttttggctatt

SEQ ID NO: 271159 - DNA, 20 bp, Artificial
  CRISPR gRNA sequence
atcactttttggctattatg

SEQ ID NO: 271160 - DNA, 20 bp, Artificial
  CRISPR gRNA sequence
tttggctattatgaataatg

SEQ ID NO: 271161 - DNA, 20 bp, Artificial
  CRISPR gRNA sequence
ttggctattatgaataatgc

SEQ ID NO: 271162 - DNA, 20 bp, Artificial
  CRISPR gRNA sequence
tggctattatgaataatgct

SEQ ID NO: 271163 - DNA, 20 bp, Artificial
  CRISPR gRNA sequence
ggctattatgaataatgcta

SEQ ID NO: 271164 - DNA, 20 bp, Artificial
  CRISPR gRNA sequence
gctattatgaataatgctac

SEQ ID NO: 271165 - DNA, 20 bp, Artificial
  CRISPR gRNA sequence
ttatgaataatgctactatg

SEQ ID NO: 271166 - DNA, 20 bp, Artificial
  CRISPR gRNA sequence
tgaataatgctactatgagc

SEQ ID NO: 271167 - DNA, 20 bp, Artificial
  CRISPR gRNA sequence
ctatgagcatttgcatacag

SEQ ID NO: 271168 - DNA, 20 bp, Artificial
  CRISPR gRNA sequence
tgagcatttgcatacagatt

SEQ ID NO: 271169 - DNA, 20 bp, Artificial
  CRISPR gRNA sequence
gcatacagatttttgtgtgg

SEQ ID NO: 271170 - DNA, 20 bp, Artificial
  CRISPR gRNA sequence
catacagatttttgtgtgga

SEQ ID NO: 271171 - DNA, 20 bp, Artificial
  CRISPR gRNA sequence
ttgtgtggacgtatgttttc

SEQ ID NO: 271172 - DNA, 20 bp, Artificial
  CRISPR gRNA sequence
tgtgtggacgtatgttttca

SEQ ID NO: 271173 - DNA, 20 bp, Artificial
  CRISPR gRNA sequence
gtgtggacgtatgttttcaa

SEQ ID NO: 271174 - DNA, 20 bp, Artificial
  CRISPR gRNA sequence
tgtggacgtatgttttcaac

SEQ ID NO: 271175 - DNA, 20 bp, Artificial
  CRISPR gRNA sequence
tcaactctcttaggtatttg

SEQ ID NO: 271176 - DNA, 20 bp, Artificial
  CRISPR gRNA sequence
caactctcttaggtatttgc

SEQ ID NO: 271177 - DNA, 20 bp, Artificial
  CRISPR gRNA sequence
aactctcttaggtatttgcc

SEQ ID NO: 271178 - DNA, 20 bp, Artificial
  CRISPR gRNA sequence
tcttaggtatttgccagcag

SEQ ID NO: 271179 - DNA, 20 bp, Artificial
  CRISPR gRNA sequence
ttaggtatttgccagcagta

SEQ ID NO: 271180 - DNA, 20 bp, Artificial
  CRISPR gRNA sequence
aggtatttgccagcagtaaa

SEQ ID NO: 271181 - DNA, 20 bp, Artificial
  CRISPR gRNA sequence
ggtatttgccagcagtaaaa

SEQ ID NO: 271182 - DNA, 20 bp, Artificial
  CRISPR gRNA sequence
gccagcagtaaaattgctgg

SEQ ID NO: 271183 - DNA, 20 bp, Artificial
  CRISPR gRNA sequence
ccagcagtaaaattgctggg

SEQ ID NO: 271184 - DNA, 20 bp, Artificial
  CRISPR gRNA sequence
ctgggtcatatggtaactct

SEQ ID NO: 271185 - DNA, 20 bp, Artificial
  CRISPR gRNA sequence
ggtcatatggtaactctatg

SEQ ID NO: 271186 - DNA, 20 bp, Artificial
  CRISPR gRNA sequence
tatgtttaactttttgagga

SEQ ID NO: 271187 - DNA, 20 bp, Artificial
  CRISPR gRNA sequence
tgtttaactttttgaggaat

SEQ ID NO: 271188 - DNA, 20 bp, Artificial
  CRISPR gRNA sequence
aactttttgaggaatcgtca

SEQ ID NO: 271189 - DNA, 20 bp, Artificial
  CRISPR gRNA sequence
actttttgaggaatcgtcaa

SEQ ID NO: 271190 - DNA, 20 bp, Artificial
  CRISPR gRNA sequence
tttgaggaatcgtcaaactg

SEQ ID NO: 271191 - DNA, 20 bp, Artificial
  CRISPR gRNA sequence
ttgaggaatcgtcaaactgt

SEQ ID NO: 271192 - DNA, 20 bp, Artificial
  CRISPR gRNA sequence
tgaggaatcgtcaaactgtt

SEQ ID NO: 271193 - DNA, 20 bp, Artificial
  CRISPR gRNA sequence
gaggaatcgtcaaactgttg

SEQ ID NO: 271194 - DNA, 20 bp, Artificial
  CRISPR gRNA sequence
aggaatcgtcaaactgttgc

SEQ ID NO: 271195 - DNA, 20 bp, Artificial
  CRISPR gRNA sequence
ttgccaaagcaactgcacca

SEQ ID NO: 271196 - DNA, 20 bp, Artificial
  CRISPR gRNA sequence
ccaaagcaactgcaccattg

SEQ ID NO: 271197 - DNA, 20 bp, Artificial
  CRISPR gRNA sequence
caccattgtacattctcacc

SEQ ID NO: 271198 - DNA, 20 bp, Artificial
  CRISPR gRNA sequence
tacattctcaccagcagtga

SEQ ID NO: 271199 - DNA, 20 bp, Artificial
  CRISPR gRNA sequence
tcaccagcagtgaatgaggg

SEQ ID NO: 271200 - DNA, 20 bp, Artificial
  CRISPR gRNA sequence
accagcagtgaatgagggct

SEQ ID NO: 271201 - DNA, 20 bp, Artificial
  CRISPR gRNA sequence
caatttatcctcacccttgc

SEQ ID NO: 271202 - DNA, 20 bp, Artificial
  CRISPR gRNA sequence
atcctcacccttgccgacac

SEQ ID NO: 271203 - DNA, 20 bp, Artificial
  CRISPR gRNA sequence
tcctcacccttgccgacact

SEQ ID NO: 271204 - DNA, 20 bp, Artificial
  CRISPR gRNA sequence
acccttgccgacacttgtta

SEQ ID NO: 271205 - DNA, 20 bp, Artificial
  CRISPR gRNA sequence
gccgacacttgttattgttc

SEQ ID NO: 271206 - DNA, 20 bp, Artificial
  CRISPR gRNA sequence
ccgacacttgttattgttca

SEQ ID NO: 271207 - DNA, 20 bp, Artificial
  CRISPR gRNA sequence
gttattgttcatcttttcta

SEQ ID NO: 271208 - DNA, 20 bp, Artificial
  CRISPR gRNA sequence
ttattgttcatcttttctat

SEQ ID NO: 271209 - DNA, 20 bp, Artificial
  CRISPR gRNA sequence
ttgttcatcttttctattat

SEQ ID NO: 271210 - DNA, 20 bp, Artificial
  CRISPR gRNA sequence
ttcatcttttctattatagc

SEQ ID NO: 271211 - DNA, 20 bp, Artificial
  CRISPR gRNA sequence
atcttttctattatagccat

SEQ ID NO: 271212 - DNA, 20 bp, Artificial
  CRISPR gRNA sequence
ttctattatagccatcctgg

SEQ ID NO: 271213 - DNA, 20 bp, Artificial
  CRISPR gRNA sequence
tctattatagccatcctggt

SEQ ID NO: 271214 - DNA, 20 bp, Artificial
  CRISPR gRNA sequence
ctattatagccatcctggtg

SEQ ID NO: 271215 - DNA, 20 bp, Artificial
  CRISPR gRNA sequence
tattatagccatcctggtgg

SEQ ID NO: 271216 - DNA, 20 bp, Artificial
  CRISPR gRNA sequence
ttatagccatcctggtggac

SEQ ID NO: 271217 - DNA, 20 bp, Artificial
  CRISPR gRNA sequence
tagccatcctggtggacgtg

SEQ ID NO: 271218 - DNA, 20 bp, Artificial
  CRISPR gRNA sequence
gtggacgtgaagtgatatct

SEQ ID NO: 271219 - DNA, 20 bp, Artificial
  CRISPR gRNA sequence
atcatggtttgatttgctat

SEQ ID NO: 271220 - DNA, 20 bp, Artificial
  CRISPR gRNA sequence
gatttgctatttctctaata

SEQ ID NO: 271221 - DNA, 20 bp, Artificial
  CRISPR gRNA sequence
atttgctatttctctaataa

SEQ ID NO: 271222 - DNA, 20 bp, Artificial
  CRISPR gRNA sequence
gctatttctctaataactaa

SEQ ID NO: 271223 - DNA, 20 bp, Artificial
  CRISPR gRNA sequence
ctatttctctaataactaat

SEQ ID NO: 271224 - DNA, 20 bp, Artificial
  CRISPR gRNA sequence
tttctctaataactaatgat

SEQ ID NO: 271225 - DNA, 20 bp, Artificial
  CRISPR gRNA sequence
ctctaataactaatgatgct

SEQ ID NO: 271226 - DNA, 20 bp, Artificial
  CRISPR gRNA sequence
tctaataactaatgatgcta

SEQ ID NO: 271227 - DNA, 20 bp, Artificial
  CRISPR gRNA sequence
taataactaatgatgctaag

SEQ ID NO: 271228 - DNA, 20 bp, Artificial
  CRISPR gRNA sequence
ataactaatgatgctaagca

SEQ ID NO: 271229 - DNA, 20 bp, Artificial
  CRISPR gRNA sequence
atgatgctaagcatcttttc

SEQ ID NO: 271230 - DNA, 20 bp, Artificial
  CRISPR gRNA sequence
agcatcttttcatgtgctta

SEQ ID NO: 271231 - DNA, 20 bp, Artificial
  CRISPR gRNA sequence
ttcatgtgcttattagccat

SEQ ID NO: 271232 - DNA, 20 bp, Artificial
  CRISPR gRNA sequence
tcatgtgcttattagccatt

SEQ ID NO: 271233 - DNA, 20 bp, Artificial
  CRISPR gRNA sequence
catgtgcttattagccattg

SEQ ID NO: 271234 - DNA, 20 bp, Artificial
  CRISPR gRNA sequence
atgtgcttattagccattgg

SEQ ID NO: 271235 - DNA, 20 bp, Artificial
  CRISPR gRNA sequence
attagccattggtctattct

SEQ ID NO: 271236 - DNA, 20 bp, Artificial
  CRISPR gRNA sequence
ttagccattggtctattctt

SEQ ID NO: 271237 - DNA, 20 bp, Artificial
  CRISPR gRNA sequence
gccattggtctattcttttt

SEQ ID NO: 271238 - DNA, 20 bp, Artificial
  CRISPR gRNA sequence
gtctattctttttagagaac

SEQ ID NO: 271239 - DNA, 20 bp, Artificial
  CRISPR gRNA sequence
ttctttttagagaactctct

SEQ ID NO: 271240 - DNA, 20 bp, Artificial
  CRISPR gRNA sequence
tttttagagaactctctatt

SEQ ID NO: 271241 - DNA, 20 bp, Artificial
  CRISPR gRNA sequence
tttagagaactctctattca

SEQ ID NO: 271242 - DNA, 20 bp, Artificial
  CRISPR gRNA sequence
ttagagaactctctattcag

SEQ ID NO: 271243 - DNA, 20 bp, Artificial
  CRISPR gRNA sequence
tagagaactctctattcaga

SEQ ID NO: 271244 - DNA, 20 bp, Artificial
  CRISPR gRNA sequence
agagaactctctattcagat

SEQ ID NO: 271245 - DNA, 20 bp, Artificial
  CRISPR gRNA sequence
gagaactctctattcagatc

SEQ ID NO: 271246 - DNA, 20 bp, Artificial
  CRISPR gRNA sequence
tctattcagatcatttgccc

SEQ ID NO: 271247 - DNA, 20 bp, Artificial
  CRISPR gRNA sequence
tattcagatcatttgcccat

SEQ ID NO: 271248 - DNA, 20 bp, Artificial
  CRISPR gRNA sequence
ttcagatcatttgcccattt

SEQ ID NO: 271249 - DNA, 20 bp, Artificial
  CRISPR gRNA sequence
agatcatttgcccatttatt

SEQ ID NO: 271250 - DNA, 20 bp, Artificial
  CRISPR gRNA sequence
gcccatttattaactggtta

SEQ ID NO: 271251 - DNA, 20 bp, Artificial
  CRISPR gRNA sequence
cccatttattaactggttag

SEQ ID NO: 271252 - DNA, 20 bp, Artificial
  CRISPR gRNA sequence
attaactggttaggctattt

SEQ ID NO: 271253 - DNA, 20 bp, Artificial
  CRISPR gRNA sequence
ttaactggttaggctattta

SEQ ID NO: 271254 - DNA, 20 bp, Artificial
  CRISPR gRNA sequence
actggttaggctatttatct

SEQ ID NO: 271255 - DNA, 20 bp, Artificial
  CRISPR gRNA sequence
gttaggctatttatcttttt

SEQ ID NO: 271256 - DNA, 20 bp, Artificial
  CRISPR gRNA sequence
ggctatttatctttttatta

SEQ ID NO: 271257 - DNA, 20 bp, Artificial
  CRISPR gRNA sequence
tttatctttttattattgaa

SEQ ID NO: 271258 - DNA, 20 bp, Artificial
  CRISPR gRNA sequence
atctttttattattgaatta

SEQ ID NO: 271259 - DNA, 20 bp, Artificial
  CRISPR gRNA sequence
tctttttattattgaattat

SEQ ID NO: 271260 - DNA, 20 bp, Artificial
  CRISPR gRNA sequence
tttattattgaattattgga

SEQ ID NO: 271261 - DNA, 20 bp, Artificial
  CRISPR gRNA sequence
ttattattgaattattggag

SEQ ID NO: 271262 - DNA, 20 bp, Artificial
  CRISPR gRNA sequence
tattattgaattattggagt

SEQ ID NO: 271263 - DNA, 20 bp, Artificial
  CRISPR gRNA sequence
attattgaattattggagtt

SEQ ID NO: 271264 - DNA, 20 bp, Artificial
  CRISPR gRNA sequence
ttattgaattattggagttc

SEQ ID NO: 271265 - DNA, 20 bp, Artificial
  CRISPR gRNA sequence
ttgaattattggagttctgt

SEQ ID NO: 271266 - DNA, 20 bp, Artificial
  CRISPR gRNA sequence
aattattggagttctgtatg

SEQ ID NO: 271267 - DNA, 20 bp, Artificial
  CRISPR gRNA sequence
ttggagttctgtatgcattt

SEQ ID NO: 271268 - DNA, 20 bp, Artificial
  CRISPR gRNA sequence
gagttctgtatgcatttttt

SEQ ID NO: 271269 - DNA, 20 bp, Artificial
  CRISPR gRNA sequence
tgtatgcattttttatactt

SEQ ID NO: 271270 - DNA, 20 bp, Artificial
  CRISPR gRNA sequence
tatgcattttttatactttt

SEQ ID NO: 271271 - DNA, 20 bp, Artificial
  CRISPR gRNA sequence
tttatactttttttttttta

SEQ ID NO: 271272 - DNA, 20 bp, Artificial
  CRISPR gRNA sequence
ttatacttttttttttttat

SEQ ID NO: 271273 - DNA, 20 bp, Artificial
  CRISPR gRNA sequence
tatacttttttttttttatt

SEQ ID NO: 271274 - DNA, 20 bp, Artificial
  CRISPR gRNA sequence
atacttttttttttttattt

SEQ ID NO: 271275 - DNA, 20 bp, Artificial
  CRISPR gRNA sequence
tacttttttttttttatttt

SEQ ID NO: 271276 - DNA, 20 bp, Artificial
  CRISPR gRNA sequence
ttttttttttatttttacag

SEQ ID NO: 271277 - DNA, 20 bp, Artificial
  CRISPR gRNA sequence
tttttttttatttttacaga

SEQ ID NO: 271278 - DNA, 20 bp, Artificial
  CRISPR gRNA sequence
ttttttttatttttacagag

SEQ ID NO: 271279 - DNA, 20 bp, Artificial
  CRISPR gRNA sequence
tttttttatttttacagagt

SEQ ID NO: 271280 - DNA, 20 bp, Artificial
  CRISPR gRNA sequence
ttttttatttttacagagtc

SEQ ID NO: 271281 - DNA, 20 bp, Artificial
  CRISPR gRNA sequence
tttttatttttacagagtct

SEQ ID NO: 271282 - DNA, 20 bp, Artificial
  CRISPR gRNA sequence
ttttatttttacagagtctc

SEQ ID NO: 271283 - DNA, 20 bp, Artificial
  CRISPR gRNA sequence
tttatttttacagagtctca

SEQ ID NO: 271284 - DNA, 20 bp, Artificial
  CRISPR gRNA sequence
ttatttttacagagtctcac

SEQ ID NO: 271285 - DNA, 20 bp, Artificial
  CRISPR gRNA sequence
tatttttacagagtctcact

SEQ ID NO: 271286 - DNA, 20 bp, Artificial
  CRISPR gRNA sequence
atttttacagagtctcactc

SEQ ID NO: 271287 - DNA, 20 bp, Artificial
  CRISPR gRNA sequence
tttttacagagtctcactct

SEQ ID NO: 271288 - DNA, 20 bp, Artificial
  CRISPR gRNA sequence
ttacagagtctcactctgtc

SEQ ID NO: 271289 - DNA, 20 bp, Artificial
  CRISPR gRNA sequence
tacagagtctcactctgtca

SEQ ID NO: 271290 - DNA, 20 bp, Artificial
  CRISPR gRNA sequence
acagagtctcactctgtcac

SEQ ID NO: 271291 - DNA, 20 bp, Artificial
  CRISPR gRNA sequence
cagagtctcactctgtcacc

SEQ ID NO: 271292 - DNA, 20 bp, Artificial
  CRISPR gRNA sequence
actctgtcacccaggctgga

SEQ ID NO: 271293 - DNA, 20 bp, Artificial
  CRISPR gRNA sequence
tgtcacccaggctggagtgc

SEQ ID NO: 271294 - DNA, 20 bp, Artificial
  CRISPR gRNA sequence
tcacccaggctggagtgcag

SEQ ID NO: 271295 - DNA, 20 bp, Artificial
  CRISPR gRNA sequence
gagtgcagtggcatgatctt

SEQ ID NO: 271296 - DNA, 20 bp, Artificial
  CRISPR gRNA sequence
ggctcactgcagcctctgcc

SEQ ID NO: 271297 - DNA, 20 bp, Artificial
  CRISPR gRNA sequence
gctcactgcagcctctgcca

SEQ ID NO: 271298 - DNA, 20 bp, Artificial
  CRISPR gRNA sequence
actgcagcctctgccaccca

SEQ ID NO: 271299 - DNA, 20 bp, Artificial
  CRISPR gRNA sequence
cagcctctgccacccagaat

SEQ ID NO: 271300 - DNA, 20 bp, Artificial
  CRISPR gRNA sequence
tgccacccagaatcaagcaa

SEQ ID NO: 271301 - DNA, 20 bp, Artificial
  CRISPR gRNA sequence
ccacccagaatcaagcaatc

SEQ ID NO: 271302 - DNA, 20 bp, Artificial
  CRISPR gRNA sequence
ctgcctcagcctcccgagta

SEQ ID NO: 271303 - DNA, 20 bp, Artificial
  CRISPR gRNA sequence
cctcagcctcccgagtagct

SEQ ID NO: 271304 - DNA, 20 bp, Artificial
  CRISPR gRNA sequence
agcctcccgagtagctggaa

SEQ ID NO: 271305 - DNA, 20 bp, Artificial
  CRISPR gRNA sequence
ccgagtagctggaattggag

SEQ ID NO: 271306 - DNA, 20 bp, Artificial
  CRISPR gRNA sequence
gaattggaggtgaccaccac

SEQ ID NO: 271307 - DNA, 20 bp, Artificial
  CRISPR gRNA sequence
gaggtgaccaccaccacccc

SEQ ID NO: 271308 - DNA, 20 bp, Artificial
  CRISPR gRNA sequence
atttttatatttttagtaga

SEQ ID NO: 271309 - DNA, 20 bp, Artificial
  CRISPR gRNA sequence
ttatatttttagtagagatg

SEQ ID NO: 271310 - DNA, 20 bp, Artificial
  CRISPR gRNA sequence
tatatttttagtagagatgg

SEQ ID NO: 271311 - DNA, 20 bp, Artificial
  CRISPR gRNA sequence
atatttttagtagagatggg

SEQ ID NO: 271312 - DNA, 20 bp, Artificial
  CRISPR gRNA sequence
tatttttagtagagatgggg

SEQ ID NO: 271313 - DNA, 20 bp, Artificial
  CRISPR gRNA sequence
ttagtagagatggggtttct

SEQ ID NO: 271314 - DNA, 20 bp, Artificial
  CRISPR gRNA sequence
tagtagagatggggtttctc

SEQ ID NO: 271315 - DNA, 20 bp, Artificial
  CRISPR gRNA sequence
agtagagatggggtttctcc

SEQ ID NO: 271316 - DNA, 20 bp, Artificial
  CRISPR gRNA sequence
gtagagatggggtttctcca

SEQ ID NO: 271317 - DNA, 20 bp, Artificial
  CRISPR gRNA sequence
ctccatgtgggccaggctgg

SEQ ID NO: 271318 - DNA, 20 bp, Artificial
  CRISPR gRNA sequence
tccatgtgggccaggctggt

SEQ ID NO: 271319 - DNA, 20 bp, Artificial
  CRISPR gRNA sequence
catgtgggccaggctggtct

SEQ ID NO: 271320 - DNA, 20 bp, Artificial
  CRISPR gRNA sequence
gtctcaaactcctgacctca

SEQ ID NO: 271321 - DNA, 20 bp, Artificial
  CRISPR gRNA sequence
aaactcctgacctcagatga

SEQ ID NO: 271322 - DNA, 20 bp, Artificial
  CRISPR gRNA sequence
ctgacctcagatgatctgcc

SEQ ID NO: 271323 - DNA, 20 bp, Artificial
  CRISPR gRNA sequence
acctcagatgatctgcctgc

SEQ ID NO: 271324 - DNA, 20 bp, Artificial
  CRISPR gRNA sequence
agatgatctgcctgcctcag

SEQ ID NO: 271325 - DNA, 20 bp, Artificial
  CRISPR gRNA sequence
cctgcctcagccttgataca

SEQ ID NO: 271326 - DNA, 20 bp, Artificial
  CRISPR gRNA sequence
cctcagccttgatacaagtt

SEQ ID NO: 271327 - DNA, 20 bp, Artificial
  CRISPR gRNA sequence
agccttgatacaagtttctt

SEQ ID NO: 271328 - DNA, 20 bp, Artificial
  CRISPR gRNA sequence
gatacaagtttcttatcaga

SEQ ID NO: 271329 - DNA, 20 bp, Artificial
  CRISPR gRNA sequence
atacaagtttcttatcagat

SEQ ID NO: 271330 - DNA, 20 bp, Artificial
  CRISPR gRNA sequence
cttatcagatatgtgatttg

SEQ ID NO: 271331 - DNA, 20 bp, Artificial
  CRISPR gRNA sequence
ttatcagatatgtgatttgt

SEQ ID NO: 271332 - DNA, 20 bp, Artificial
  CRISPR gRNA sequence
atcagatatgtgatttgtaa

SEQ ID NO: 271333 - DNA, 20 bp, Artificial
  CRISPR gRNA sequence
tcagatatgtgatttgtaaa

SEQ ID NO: 271334 - DNA, 20 bp, Artificial
  CRISPR gRNA sequence
gtaaatgttttctctcattc

SEQ ID NO: 271335 - DNA, 20 bp, Artificial
  CRISPR gRNA sequence
taaatgttttctctcattct

SEQ ID NO: 271336 - DNA, 20 bp, Artificial
  CRISPR gRNA sequence
tctctcattctgtggattgt

SEQ ID NO: 271337 - DNA, 20 bp, Artificial
  CRISPR gRNA sequence
ctctcattctgtggattgtc

SEQ ID NO: 271338 - DNA, 20 bp, Artificial
  CRISPR gRNA sequence
tctcattctgtggattgtct

SEQ ID NO: 271339 - DNA, 20 bp, Artificial
  CRISPR gRNA sequence
tcattctgtggattgtcttt

SEQ ID NO: 271340 - DNA, 20 bp, Artificial
  CRISPR gRNA sequence
attctgtggattgtctttca

SEQ ID NO: 271341 - DNA, 20 bp, Artificial
  CRISPR gRNA sequence
tgtggattgtctttcatatt

SEQ ID NO: 271342 - DNA, 20 bp, Artificial
  CRISPR gRNA sequence
tggattgtctttcatattat

SEQ ID NO: 271343 - DNA, 20 bp, Artificial
  CRISPR gRNA sequence
tctttcatattatcttaaaa

SEQ ID NO: 271344 - DNA, 20 bp, Artificial
  CRISPR gRNA sequence
tcatattatcttaaaagttc

SEQ ID NO: 271345 - DNA, 20 bp, Artificial
  CRISPR gRNA sequence
catattatcttaaaagttcc

SEQ ID NO: 271346 - DNA, 20 bp, Artificial
  CRISPR gRNA sequence
atattatcttaaaagttccc

SEQ ID NO: 271347 - DNA, 20 bp, Artificial
  CRISPR gRNA sequence
tcttaaaagttcccccactt

SEQ ID NO: 271348 - DNA, 20 bp, Artificial
  CRISPR gRNA sequence
aaaagttcccccacttgatt

SEQ ID NO: 271349 - DNA, 20 bp, Artificial
  CRISPR gRNA sequence
aaagttcccccacttgattc

SEQ ID NO: 271350 - DNA, 20 bp, Artificial
  CRISPR gRNA sequence
ccccacttgattctaatatt

SEQ ID NO: 271351 - DNA, 20 bp, Artificial
  CRISPR gRNA sequence
gattctaatattcaattggg

SEQ ID NO: 271352 - DNA, 20 bp, Artificial
  CRISPR gRNA sequence
attctaatattcaattgggt

SEQ ID NO: 271353 - DNA, 20 bp, Artificial
  CRISPR gRNA sequence
taatattcaattgggttgaa

SEQ ID NO: 271354 - DNA, 20 bp, Artificial
  CRISPR gRNA sequence
atattcaattgggttgaaag

SEQ ID NO: 271355 - DNA, 20 bp, Artificial
  CRISPR gRNA sequence
aattgggttgaaagccacta

SEQ ID NO: 271356 - DNA, 20 bp, Artificial
  CRISPR gRNA sequence
ggttgaaagccactatggcc

SEQ ID NO: 271357 - DNA, 20 bp, Artificial
  CRISPR gRNA sequence
aaagccactatggcctagtg

SEQ ID NO: 271358 - DNA, 20 bp, Artificial
  CRISPR gRNA sequence
tggcctagtggaattcacct

SEQ ID NO: 271359 - DNA, 20 bp, Artificial
  CRISPR gRNA sequence
gtggaattcacctgacaaca

SEQ ID NO: 271360 - DNA, 20 bp, Artificial
  CRISPR gRNA sequence
acctgacaacatatttagaa

SEQ ID NO: 271361 - DNA, 20 bp, Artificial
  CRISPR gRNA sequence
acaacatatttagaatcacc

SEQ ID NO: 271362 - DNA, 20 bp, Artificial
  CRISPR gRNA sequence
agaatcacctggaaaaatct

SEQ ID NO: 271363 - DNA, 20 bp, Artificial
  CRISPR gRNA sequence
gaatcacctggaaaaatcta

SEQ ID NO: 271364 - DNA, 20 bp, Artificial
  CRISPR gRNA sequence
gaaaaatctaaaagcctttg

SEQ ID NO: 271365 - DNA, 20 bp, Artificial
  CRISPR gRNA sequence
aaagcctttggttttccaag

SEQ ID NO: 271366 - DNA, 20 bp, Artificial
  CRISPR gRNA sequence
tggttttccaaggccaatta

SEQ ID NO: 271367 - DNA, 20 bp, Artificial
  CRISPR gRNA sequence
ggttttccaaggccaattaa

SEQ ID NO: 271368 - DNA, 20 bp, Artificial
  CRISPR gRNA sequence
gttttccaaggccaattaaa

SEQ ID NO: 271369 - DNA, 20 bp, Artificial
  CRISPR gRNA sequence
tccaaggccaattaaatcag

SEQ ID NO: 271370 - DNA, 20 bp, Artificial
  CRISPR gRNA sequence
ccaaggccaattaaatcaga

SEQ ID NO: 271371 - DNA, 20 bp, Artificial
  CRISPR gRNA sequence
caaggccaattaaatcagaa

SEQ ID NO: 271372 - DNA, 20 bp, Artificial
  CRISPR gRNA sequence
aatcagaatctctaggtata

SEQ ID NO: 271373 - DNA, 20 bp, Artificial
  CRISPR gRNA sequence
taggtataggacccaggcat

SEQ ID NO: 271374 - DNA, 20 bp, Artificial
  CRISPR gRNA sequence
ggtataggacccaggcatcc

SEQ ID NO: 271375 - DNA, 20 bp, Artificial
  CRISPR gRNA sequence
atattttttaagtttctcta

SEQ ID NO: 271376 - DNA, 20 bp, Artificial
  CRISPR gRNA sequence
tttaagtttctctagtaatt

SEQ ID NO: 271377 - DNA, 20 bp, Artificial
  CRISPR gRNA sequence
ttaagtttctctagtaattc

SEQ ID NO: 271378 - DNA, 20 bp, Artificial
  CRISPR gRNA sequence
taagtttctctagtaattct

SEQ ID NO: 271379 - DNA, 20 bp, Artificial
  CRISPR gRNA sequence
aagtttctctagtaattcta

SEQ ID NO: 271380 - DNA, 20 bp, Artificial
  CRISPR gRNA sequence
agtttctctagtaattctag

SEQ ID NO: 271381 - DNA, 20 bp, Artificial
  CRISPR gRNA sequence
ctctagtaattctagatggc

SEQ ID NO: 271382 - DNA, 20 bp, Artificial
  CRISPR gRNA sequence
tctagtaattctagatggca

SEQ ID NO: 271383 - DNA, 20 bp, Artificial
  CRISPR gRNA sequence
tagtaattctagatggcagt

SEQ ID NO: 271384 - DNA, 20 bp, Artificial
  CRISPR gRNA sequence
gtaattctagatggcagtca

SEQ ID NO: 271385 - DNA, 20 bp, Artificial
  CRISPR gRNA sequence
tagatggcagtcaaatttga

SEQ ID NO: 271386 - DNA, 20 bp, Artificial
  CRISPR gRNA sequence
gatggcagtcaaatttgaga

SEQ ID NO: 271387 - DNA, 20 bp, Artificial
  CRISPR gRNA sequence
gagaaccagtggcctaacag

SEQ ID NO: 271388 - DNA, 20 bp, Artificial
  CRISPR gRNA sequence
agaaccagtggcctaacaga

SEQ ID NO: 271389 - DNA, 20 bp, Artificial
  CRISPR gRNA sequence
acagaggaaaactaacttct

SEQ ID NO: 271390 - DNA, 20 bp, Artificial
  CRISPR gRNA sequence
acttcttatcctcaaatcgg

SEQ ID NO: 271391 - DNA, 20 bp, Artificial
  CRISPR gRNA sequence
cttatcctcaaatcggcctc

SEQ ID NO: 271392 - DNA, 20 bp, Artificial
  CRISPR gRNA sequence
ttatcctcaaatcggcctcc

SEQ ID NO: 271393 - DNA, 20 bp, Artificial
  CRISPR gRNA sequence
atcctcaaatcggcctccac

SEQ ID NO: 271394 - DNA, 20 bp, Artificial
  CRISPR gRNA sequence
tcctcaaatcggcctccaca

SEQ ID NO: 271395 - DNA, 20 bp, Artificial
  CRISPR gRNA sequence
aaatcggcctccacaggttt

SEQ ID NO: 271396 - DNA, 20 bp, Artificial
  CRISPR gRNA sequence
cacaggtttttccaacctca

SEQ ID NO: 271397 - DNA, 20 bp, Artificial
  CRISPR gRNA sequence
ttccaacctcatttcctcaa

SEQ ID NO: 271398 - DNA, 20 bp, Artificial
  CRISPR gRNA sequence
tccaacctcatttcctcaaa

SEQ ID NO: 271399 - DNA, 20 bp, Artificial
  CRISPR gRNA sequence
ccaacctcatttcctcaaac

SEQ ID NO: 271400 - DNA, 20 bp, Artificial
  CRISPR gRNA sequence
caacctcatttcctcaaacc

SEQ ID NO: 271401 - DNA, 20 bp, Artificial
  CRISPR gRNA sequence
atttcctcaaaccgaagccc

SEQ ID NO: 271402 - DNA, 20 bp, Artificial
  CRISPR gRNA sequence
cctcaaaccgaagccctcct

SEQ ID NO: 271403 - DNA, 20 bp, Artificial
  CRISPR gRNA sequence
ctcaaaccgaagccctccta

SEQ ID NO: 271404 - DNA, 20 bp, Artificial
  CRISPR gRNA sequence
aaaccgaagccctcctaatt

SEQ ID NO: 271405 - DNA, 20 bp, Artificial
  CRISPR gRNA sequence
ctaattagaccatttaagcc

SEQ ID NO: 271406 - DNA, 20 bp, Artificial
  CRISPR gRNA sequence
attagaccatttaagccaac

SEQ ID NO: 271407 - DNA, 20 bp, Artificial
  CRISPR gRNA sequence
gaccatttaagccaacatcc

SEQ ID NO: 271408 - DNA, 20 bp, Artificial
  CRISPR gRNA sequence
aagccaacatcccaagaaca

SEQ ID NO: 271409 - DNA, 20 bp, Artificial
  CRISPR gRNA sequence
agccaacatcccaagaacag

SEQ ID NO: 271410 - DNA, 20 bp, Artificial
  CRISPR gRNA sequence
tgagcattcctacctccatg

SEQ ID NO: 271411 - DNA, 20 bp, Artificial
  CRISPR gRNA sequence
ctacctccatgccttgtcta

SEQ ID NO: 271412 - DNA, 20 bp, Artificial
  CRISPR gRNA sequence
cctccatgccttgtctacta

SEQ ID NO: 271413 - DNA, 20 bp, Artificial
  CRISPR gRNA sequence
catgccttgtctactaactc

SEQ ID NO: 271414 - DNA, 20 bp, Artificial
  CRISPR gRNA sequence
gtctactaactccttggcac

SEQ ID NO: 271415 - DNA, 20 bp, Artificial
  CRISPR gRNA sequence
tctactaactccttggcaca

SEQ ID NO: 271416 - DNA, 20 bp, Artificial
  CRISPR gRNA sequence
ctaactccttggcacagagc

SEQ ID NO: 271417 - DNA, 20 bp, Artificial
  CRISPR gRNA sequence
actccttggcacagagcacc

SEQ ID NO: 271418 - DNA, 20 bp, Artificial
  CRISPR gRNA sequence
cttggcacagagcaccactc

SEQ ID NO: 271419 - DNA, 20 bp, Artificial
  CRISPR gRNA sequence
ggcacagagcaccactccct

SEQ ID NO: 271420 - DNA, 20 bp, Artificial
  CRISPR gRNA sequence
gcacagagcaccactccctt

SEQ ID NO: 271421 - DNA, 20 bp, Artificial
  CRISPR gRNA sequence
ccttctcaggtctcaaaatg

SEQ ID NO: 271422 - DNA, 20 bp, Artificial
  CRISPR gRNA sequence
ctcaggtctcaaaatgatta

SEQ ID NO: 271423 - DNA, 20 bp, Artificial
  CRISPR gRNA sequence
tcaggtctcaaaatgattac

SEQ ID NO: 271424 - DNA, 20 bp, Artificial
  CRISPR gRNA sequence
aggtctcaaaatgattacta

SEQ ID NO: 271425 - DNA, 20 bp, Artificial
  CRISPR gRNA sequence
aaaatgattactatctgtat

SEQ ID NO: 271426 - DNA, 20 bp, Artificial
  CRISPR gRNA sequence
ctatctgtatcgctcacttg

SEQ ID NO: 271427 - DNA, 20 bp, Artificial
  CRISPR gRNA sequence
tctgtatcgctcacttgaca

SEQ ID NO: 271428 - DNA, 20 bp, Artificial
  CRISPR gRNA sequence
tatcgctcacttgacatttg

SEQ ID NO: 271429 - DNA, 20 bp, Artificial
  CRISPR gRNA sequence
acttgacatttgagttctac

SEQ ID NO: 271430 - DNA, 20 bp, Artificial
  CRISPR gRNA sequence
gacatttgagttctaccttt

SEQ ID NO: 271431 - DNA, 20 bp, Artificial
  CRISPR gRNA sequence
acatttgagttctacctttt

SEQ ID NO: 271432 - DNA, 20 bp, Artificial
  CRISPR gRNA sequence
gagttctaccttttaaacaa

SEQ ID NO: 271433 - DNA, 20 bp, Artificial
  CRISPR gRNA sequence
agttctaccttttaaacaac

SEQ ID NO: 271434 - DNA, 20 bp, Artificial
  CRISPR gRNA sequence
taccttttaaacaactcttg

SEQ ID NO: 271435 - DNA, 20 bp, Artificial
  CRISPR gRNA sequence
ccttttaaacaactcttgtt

SEQ ID NO: 271436 - DNA, 20 bp, Artificial
  CRISPR gRNA sequence
ttaaacaactcttgtttcac

SEQ ID NO: 271437 - DNA, 20 bp, Artificial
  CRISPR gRNA sequence
taaacaactcttgtttcaca

SEQ ID NO: 271438 - DNA, 20 bp, Artificial
  CRISPR gRNA sequence
aaacaactcttgtttcacat

SEQ ID NO: 271439 - DNA, 20 bp, Artificial
  CRISPR gRNA sequence
aacaactcttgtttcacatg

SEQ ID NO: 271440 - DNA, 20 bp, Artificial
  CRISPR gRNA sequence
ttgtttcacatgcttcaatt

SEQ ID NO: 271441 - DNA, 20 bp, Artificial
  CRISPR gRNA sequence
gtttcacatgcttcaatttg

SEQ ID NO: 271442 - DNA, 20 bp, Artificial
  CRISPR gRNA sequence
tttcacatgcttcaatttgc

SEQ ID NO: 271443 - DNA, 20 bp, Artificial
  CRISPR gRNA sequence
cacatgcttcaatttgctta

SEQ ID NO: 271444 - DNA, 20 bp, Artificial
  CRISPR gRNA sequence
acatgcttcaatttgcttag

SEQ ID NO: 271445 - DNA, 20 bp, Artificial
  CRISPR gRNA sequence
caatttgcttagctttggat

SEQ ID NO: 271446 - DNA, 20 bp, Artificial
  CRISPR gRNA sequence
aatttgcttagctttggatt

SEQ ID NO: 271447 - DNA, 20 bp, Artificial
  CRISPR gRNA sequence
gcttagctttggattcatgt

SEQ ID NO: 271448 - DNA, 20 bp, Artificial
  CRISPR gRNA sequence
cttagctttggattcatgtg

SEQ ID NO: 271449 - DNA, 20 bp, Artificial
  CRISPR gRNA sequence
agctttggattcatgtgcat

SEQ ID NO: 271450 - DNA, 20 bp, Artificial
  CRISPR gRNA sequence
gctttggattcatgtgcatt

SEQ ID NO: 271451 - DNA, 20 bp, Artificial
  CRISPR gRNA sequence
tggattcatgtgcatttccc

SEQ ID NO: 271452 - DNA, 20 bp, Artificial
  CRISPR gRNA sequence
ggattcatgtgcatttccct

SEQ ID NO: 271453 - DNA, 20 bp, Artificial
  CRISPR gRNA sequence
gattcatgtgcatttccctt

SEQ ID NO: 271454 - DNA, 20 bp, Artificial
  CRISPR gRNA sequence
atgtgcatttcccttaggcc

SEQ ID NO: 271455 - DNA, 20 bp, Artificial
  CRISPR gRNA sequence
cccttaggcccctggtttcc

SEQ ID NO: 271456 - DNA, 20 bp, Artificial
  CRISPR gRNA sequence
ccttaggcccctggtttcca

SEQ ID NO: 271457 - DNA, 20 bp, Artificial
  CRISPR gRNA sequence
aggcccctggtttccaagtc

SEQ ID NO: 271458 - DNA, 20 bp, Artificial
  CRISPR gRNA sequence
ggcccctggtttccaagtct

SEQ ID NO: 271459 - DNA, 20 bp, Artificial
  CRISPR gRNA sequence
gtttccaagtctcttgacag

SEQ ID NO: 271460 - DNA, 20 bp, Artificial
  CRISPR gRNA sequence
ccaagtctcttgacagaaag

SEQ ID NO: 271461 - DNA, 20 bp, Artificial
  CRISPR gRNA sequence
caagtctcttgacagaaagg

SEQ ID NO: 271462 - DNA, 20 bp, Artificial
  CRISPR gRNA sequence
ttgacagaaaggaccacatg

SEQ ID NO: 271463 - DNA, 20 bp, Artificial
  CRISPR gRNA sequence
gacagaaaggaccacatgtt

SEQ ID NO: 271464 - DNA, 20 bp, Artificial
  CRISPR gRNA sequence
acagaaaggaccacatgtta

SEQ ID NO: 271465 - DNA, 20 bp, Artificial
  CRISPR gRNA sequence
tgcttctttacataacacag

SEQ ID NO: 271466 - DNA, 20 bp, Artificial
  CRISPR gRNA sequence
ctttacataacacagtatga

SEQ ID NO: 271467 - DNA, 20 bp, Artificial
  CRISPR gRNA sequence
tttacataacacagtatgac

SEQ ID NO: 271468 - DNA, 20 bp, Artificial
  CRISPR gRNA sequence
tacataacacagtatgacta

SEQ ID NO: 271469 - DNA, 20 bp, Artificial
  CRISPR gRNA sequence
acataacacagtatgactaa

SEQ ID NO: 271470 - DNA, 20 bp, Artificial
  CRISPR gRNA sequence
cataacacagtatgactaat

SEQ ID NO: 271471 - DNA, 20 bp, Artificial
  CRISPR gRNA sequence
atagactctcataaaataat

SEQ ID NO: 271472 - DNA, 20 bp, Artificial
  CRISPR gRNA sequence
tcataaaataattgtggagt

SEQ ID NO: 271473 - DNA, 20 bp, Artificial
  CRISPR gRNA sequence
ataaaataattgtggagtga

SEQ ID NO: 271474 - DNA, 20 bp, Artificial
  CRISPR gRNA sequence
tggagtgaaagatggtgatt

SEQ ID NO: 271475 - DNA, 20 bp, Artificial
  CRISPR gRNA sequence
ggctgtattgttgttatcag

SEQ ID NO: 271476 - DNA, 20 bp, Artificial
  CRISPR gRNA sequence
tattgttgttatcagcagct

SEQ ID NO: 271477 - DNA, 20 bp, Artificial
  CRISPR gRNA sequence
ttgttatcagcagctaggtt

SEQ ID NO: 271478 - DNA, 20 bp, Artificial
  CRISPR gRNA sequence
ttatcagcagctaggtttga

SEQ ID NO: 271479 - DNA, 20 bp, Artificial
  CRISPR gRNA sequence
tcagcagctaggtttgacta

SEQ ID NO: 271480 - DNA, 20 bp, Artificial
  CRISPR gRNA sequence
ggtttgactaccatctcatt

SEQ ID NO: 271481 - DNA, 20 bp, Artificial
  CRISPR gRNA sequence
gactaccatctcattaaatc

SEQ ID NO: 271482 - DNA, 20 bp, Artificial
  CRISPR gRNA sequence
actaccatctcattaaatcc

SEQ ID NO: 271483 - DNA, 20 bp, Artificial
  CRISPR gRNA sequence
ccatctcattaaatcctttt

SEQ ID NO: 271484 - DNA, 20 bp, Artificial
  CRISPR gRNA sequence
attaaatcctttttggaaac

SEQ ID NO: 271485 - DNA, 20 bp, Artificial
  CRISPR gRNA sequence
aatcctttttggaaacctgt

SEQ ID NO: 271486 - DNA, 20 bp, Artificial
  CRISPR gRNA sequence
tttggaaacctgtgtcaaca

SEQ ID NO: 271487 - DNA, 20 bp, Artificial
  CRISPR gRNA sequence
ttggaaacctgtgtcaacaa

SEQ ID NO: 271488 - DNA, 20 bp, Artificial
  CRISPR gRNA sequence
tggaaacctgtgtcaacaac

SEQ ID NO: 271489 - DNA, 20 bp, Artificial
  CRISPR gRNA sequence
ggaaacctgtgtcaacaact

SEQ ID NO: 271490 - DNA, 20 bp, Artificial
  CRISPR gRNA sequence
gaaacctgtgtcaacaactt

SEQ ID NO: 271491 - DNA, 20 bp, Artificial
  CRISPR gRNA sequence
tgtcaacaactttaacttca

SEQ ID NO: 271492 - DNA, 20 bp, Artificial
  CRISPR gRNA sequence
taacttcacctattatttgt

SEQ ID NO: 271493 - DNA, 20 bp, Artificial
  CRISPR gRNA sequence
aacttcacctattatttgtt

SEQ ID NO: 271494 - DNA, 20 bp, Artificial
  CRISPR gRNA sequence
acttcacctattatttgttc

SEQ ID NO: 271495 - DNA, 20 bp, Artificial
  CRISPR gRNA sequence
cacctattatttgttccaca

SEQ ID NO: 271496 - DNA, 20 bp, Artificial
  CRISPR gRNA sequence
acctattatttgttccacaa

SEQ ID NO: 271497 - DNA, 20 bp, Artificial
  CRISPR gRNA sequence
ttatttgttccacaaatatt

SEQ ID NO: 271498 - DNA, 20 bp, Artificial
  CRISPR gRNA sequence
tttgttccacaaatattttg

SEQ ID NO: 271499 - DNA, 20 bp, Artificial
  CRISPR gRNA sequence
gttccacaaatattttgcaa

SEQ ID NO: 271500 - DNA, 20 bp, Artificial
  CRISPR gRNA sequence
ttccacaaatattttgcaaa

SEQ ID NO: 271501 - DNA, 20 bp, Artificial
  CRISPR gRNA sequence
cacaaatattttgcaaaagc

SEQ ID NO: 271502 - DNA, 20 bp, Artificial
  CRISPR gRNA sequence
tgcaaaagcactgaaaaata

SEQ ID NO: 271503 - DNA, 20 bp, Artificial
  CRISPR gRNA sequence
gcaaaagcactgaaaaataa

SEQ ID NO: 271504 - DNA, 20 bp, Artificial
  CRISPR gRNA sequence
caaaagcactgaaaaataaa

SEQ ID NO: 271505 - DNA, 20 bp, Artificial
  CRISPR gRNA sequence
aaaaataaacatgcaaagaa

SEQ ID NO: 271506 - DNA, 20 bp, Artificial
  CRISPR gRNA sequence
gacctgtcttaatacaaaca

SEQ ID NO: 271507 - DNA, 20 bp, Artificial
  CRISPR gRNA sequence
tcttaatacaaacatccaat

SEQ ID NO: 271508 - DNA, 20 bp, Artificial
  CRISPR gRNA sequence
aatacaaacatccaatttgt

SEQ ID NO: 271509 - DNA, 20 bp, Artificial
  CRISPR gRNA sequence
atacaaacatccaatttgtt

SEQ ID NO: 271510 - DNA, 20 bp, Artificial
  CRISPR gRNA sequence
gtttttttgtttttgattta

SEQ ID NO: 271511 - DNA, 20 bp, Artificial
  CRISPR gRNA sequence
tttttttgtttttgatttat

SEQ ID NO: 271512 - DNA, 20 bp, Artificial
  CRISPR gRNA sequence
ttttgtttttgatttatttt

SEQ ID NO: 271513 - DNA, 20 bp, Artificial
  CRISPR gRNA sequence
tttgtttttgatttattttg

SEQ ID NO: 271514 - DNA, 20 bp, Artificial
  CRISPR gRNA sequence
ttgtttttgatttattttgt

SEQ ID NO: 271515 - DNA, 20 bp, Artificial
  CRISPR gRNA sequence
tgtttttgatttattttgtt

SEQ ID NO: 271516 - DNA, 20 bp, Artificial
  CRISPR gRNA sequence
gtttttgatttattttgttt

SEQ ID NO: 271517 - DNA, 20 bp, Artificial
  CRISPR gRNA sequence
tttttgatttattttgtttg

SEQ ID NO: 271518 - DNA, 20 bp, Artificial
  CRISPR gRNA sequence
ttgatttattttgtttgttt

SEQ ID NO: 271519 - DNA, 20 bp, Artificial
  CRISPR gRNA sequence
tgatttattttgtttgtttc

SEQ ID NO: 271520 - DNA, 20 bp, Artificial
  CRISPR gRNA sequence
gatttattttgtttgtttcc

SEQ ID NO: 271521 - DNA, 20 bp, Artificial
  CRISPR gRNA sequence
atttattttgtttgtttcct

SEQ ID NO: 271522 - DNA, 20 bp, Artificial
  CRISPR gRNA sequence
attttgtttgtttccttttt

SEQ ID NO: 271523 - DNA, 20 bp, Artificial
  CRISPR gRNA sequence
ttttgtttgtttcctttttt

SEQ ID NO: 271524 - DNA, 20 bp, Artificial
  CRISPR gRNA sequence
tgtttgtttcctttttttac

SEQ ID NO: 271525 - DNA, 20 bp, Artificial
  CRISPR gRNA sequence
gtttgtttcctttttttact

SEQ ID NO: 271526 - DNA, 20 bp, Artificial
  CRISPR gRNA sequence
tttgtttcctttttttactt

SEQ ID NO: 271527 - DNA, 20 bp, Artificial
  CRISPR gRNA sequence
gtttcctttttttacttaga

SEQ ID NO: 271528 - DNA, 20 bp, Artificial
  CRISPR gRNA sequence
tttcctttttttacttagaa

SEQ ID NO: 271529 - DNA, 20 bp, Artificial
  CRISPR gRNA sequence
cctttttttacttagaagga

SEQ ID NO: 271530 - DNA, 20 bp, Artificial
  CRISPR gRNA sequence
ctttttttacttagaaggag

SEQ ID NO: 271531 - DNA, 20 bp, Artificial
  CRISPR gRNA sequence
tttttacttagaaggagtca

SEQ ID NO: 271532 - DNA, 20 bp, Artificial
  CRISPR gRNA sequence
ttttacttagaaggagtcat

SEQ ID NO: 271533 - DNA, 20 bp, Artificial
  CRISPR gRNA sequence
tttacttagaaggagtcatt

SEQ ID NO: 271534 - DNA, 20 bp, Artificial
  CRISPR gRNA sequence
ttacttagaaggagtcatta

SEQ ID NO: 271535 - DNA, 20 bp, Artificial
  CRISPR gRNA sequence
tacttagaaggagtcattag

SEQ ID NO: 271536 - DNA, 20 bp, Artificial
  CRISPR gRNA sequence
acttagaaggagtcattagg

SEQ ID NO: 271537 - DNA, 20 bp, Artificial
  CRISPR gRNA sequence
cttagaaggagtcattaggt

SEQ ID NO: 271538 - DNA, 20 bp, Artificial
  CRISPR gRNA sequence
agaaggagtcattaggtcag

SEQ ID NO: 271539 - DNA, 20 bp, Artificial
  CRISPR gRNA sequence
gaaggagtcattaggtcagt

SEQ ID NO: 271540 - DNA, 20 bp, Artificial
  CRISPR gRNA sequence
ggtcagttctaattggaaga

SEQ ID NO: 271541 - DNA, 20 bp, Artificial
  CRISPR gRNA sequence
taattggaagagcaaccaac

SEQ ID NO: 271542 - DNA, 20 bp, Artificial
  CRISPR gRNA sequence
attggaagagcaaccaactc

SEQ ID NO: 271543 - DNA, 20 bp, Artificial
  CRISPR gRNA sequence
gaagagcaaccaactccagc

SEQ ID NO: 271544 - DNA, 20 bp, Artificial
  CRISPR gRNA sequence
cagcaagcaatgcctgcatc

SEQ ID NO: 271545 - DNA, 20 bp, Artificial
  CRISPR gRNA sequence
catctctcctccttttcaga

SEQ ID NO: 271546 - DNA, 20 bp, Artificial
  CRISPR gRNA sequence
tcctccttttcagagagtga

SEQ ID NO: 271547 - DNA, 20 bp, Artificial
  CRISPR gRNA sequence
ctccttttcagagagtgagt

SEQ ID NO: 271548 - DNA, 20 bp, Artificial
  CRISPR gRNA sequence
cttttcagagagtgagtgca

SEQ ID NO: 271549 - DNA, 20 bp, Artificial
  CRISPR gRNA sequence
ttcagagagtgagtgcaggt

SEQ ID NO: 271550 - DNA, 20 bp, Artificial
  CRISPR gRNA sequence
tcagagagtgagtgcaggtt

SEQ ID NO: 271551 - DNA, 20 bp, Artificial
  CRISPR gRNA sequence
cagagagtgagtgcaggtta

SEQ ID NO: 271552 - DNA, 20 bp, Artificial
  CRISPR gRNA sequence
agagagtgagtgcaggttag

SEQ ID NO: 271553 - DNA, 20 bp, Artificial
  CRISPR gRNA sequence
ggcatttgtattctgcttgc

SEQ ID NO: 271554 - DNA, 20 bp, Artificial
  CRISPR gRNA sequence
gtattctgcttgctcaccgc

SEQ ID NO: 271555 - DNA, 20 bp, Artificial
  CRISPR gRNA sequence
tattctgcttgctcaccgcc

SEQ ID NO: 271556 - DNA, 20 bp, Artificial
  CRISPR gRNA sequence
tgcttgctcaccgccctggg

SEQ ID NO: 271557 - DNA, 20 bp, Artificial
  CRISPR gRNA sequence
cttgctcaccgccctgggaa

SEQ ID NO: 271558 - DNA, 20 bp, Artificial
  CRISPR gRNA sequence
gctcaccgccctgggaattg

SEQ ID NO: 271559 - DNA, 20 bp, Artificial
  CRISPR gRNA sequence
ctcaccgccctgggaattgt

SEQ ID NO: 271560 - DNA, 20 bp, Artificial
  CRISPR gRNA sequence
accgccctgggaattgtgtt

SEQ ID NO: 271561 - DNA, 20 bp, Artificial
  CRISPR gRNA sequence
ggaattgtgtttctattgct

SEQ ID NO: 271562 - DNA, 20 bp, Artificial
  CRISPR gRNA sequence
tgtttctattgctaattatt

SEQ ID NO: 271563 - DNA, 20 bp, Artificial
  CRISPR gRNA sequence
ctattgctaattatttggat

SEQ ID NO: 271564 - DNA, 20 bp, Artificial
  CRISPR gRNA sequence
tattgctaattatttggatt

SEQ ID NO: 271565 - DNA, 20 bp, Artificial
  CRISPR gRNA sequence
ttgctaattatttggattct

SEQ ID NO: 271566 - DNA, 20 bp, Artificial
  CRISPR gRNA sequence
ctaattatttggattctgtt

SEQ ID NO: 271567 - DNA, 20 bp, Artificial
  CRISPR gRNA sequence
attatttggattctgtttta

SEQ ID NO: 271568 - DNA, 20 bp, Artificial
  CRISPR gRNA sequence
tttggattctgttttaatgc

SEQ ID NO: 271569 - DNA, 20 bp, Artificial
  CRISPR gRNA sequence
ggattctgttttaatgcaca

SEQ ID NO: 271570 - DNA, 20 bp, Artificial
  CRISPR gRNA sequence
gattctgttttaatgcacat

SEQ ID NO: 271571 - DNA, 20 bp, Artificial
  CRISPR gRNA sequence
tgttttaatgcacattcaaa

SEQ ID NO: 271572 - DNA, 20 bp, Artificial
  CRISPR gRNA sequence
ttttaatgcacattcaaatt

SEQ ID NO: 271573 - DNA, 20 bp, Artificial
  CRISPR gRNA sequence
taatgcacattcaaattctt

SEQ ID NO: 271574 - DNA, 20 bp, Artificial
  CRISPR gRNA sequence
aatgcacattcaaattcttc

SEQ ID NO: 271575 - DNA, 20 bp, Artificial
  CRISPR gRNA sequence
atgcacattcaaattcttcc

SEQ ID NO: 271576 - DNA, 20 bp, Artificial
  CRISPR gRNA sequence
aaattcttcctgatctgcct

SEQ ID NO: 271577 - DNA, 20 bp, Artificial
  CRISPR gRNA sequence
ttcctgatctgcctttgtga

SEQ ID NO: 271578 - DNA, 20 bp, Artificial
  CRISPR gRNA sequence
cctgatctgcctttgtgagc

SEQ ID NO: 271579 - DNA, 20 bp, Artificial
  CRISPR gRNA sequence
ctgatctgcctttgtgagct

SEQ ID NO: 271580 - DNA, 20 bp, Artificial
  CRISPR gRNA sequence
atctgcctttgtgagctgat

SEQ ID NO: 271581 - DNA, 20 bp, Artificial
  CRISPR gRNA sequence
cctttgtgagctgatttaaa

SEQ ID NO: 271582 - DNA, 20 bp, Artificial
  CRISPR gRNA sequence
tgtgagctgatttaaagaaa

SEQ ID NO: 271583 - DNA, 20 bp, Artificial
  CRISPR gRNA sequence
gtgagctgatttaaagaaaa

SEQ ID NO: 271584 - DNA, 20 bp, Artificial
  CRISPR gRNA sequence
tgagctgatttaaagaaaaa

SEQ ID NO: 271585 - DNA, 20 bp, Artificial
  CRISPR gRNA sequence
atttaaagaaaaagatggga

SEQ ID NO: 271586 - DNA, 20 bp, Artificial
  CRISPR gRNA sequence
aaagaaaaagatgggaatga

SEQ ID NO: 271587 - DNA, 20 bp, Artificial
  CRISPR gRNA sequence
aagaaaaagatgggaatgag

SEQ ID NO: 271588 - DNA, 20 bp, Artificial
  CRISPR gRNA sequence
ctttgtggagacaaaaaaag

SEQ ID NO: 271589 - DNA, 20 bp, Artificial
  CRISPR gRNA sequence
tttgtggagacaaaaaaagg

SEQ ID NO: 271590 - DNA, 20 bp, Artificial
  CRISPR gRNA sequence
tgtggagacaaaaaaaggga

SEQ ID NO: 271591 - DNA, 20 bp, Artificial
  CRISPR gRNA sequence
gtggagacaaaaaaagggag

SEQ ID NO: 271592 - DNA, 20 bp, Artificial
  CRISPR gRNA sequence
tggagacaaaaaaagggagt

SEQ ID NO: 271593 - DNA, 20 bp, Artificial
  CRISPR gRNA sequence
gagagaaaccccagatggct

SEQ ID NO: 271594 - DNA, 20 bp, Artificial
  CRISPR gRNA sequence
cccagtttgactccctctcc

SEQ ID NO: 271595 - DNA, 20 bp, Artificial
  CRISPR gRNA sequence
gactccctctcccagcacac

SEQ ID NO: 271596 - DNA, 20 bp, Artificial
  CRISPR gRNA sequence
actccctctcccagcacaca

SEQ ID NO: 271597 - DNA, 20 bp, Artificial
  CRISPR gRNA sequence
cctctcccagcacacacagt

SEQ ID NO: 271598 - DNA, 20 bp, Artificial
  CRISPR gRNA sequence
tcccagcacacacagtgagg

SEQ ID NO: 271599 - DNA, 20 bp, Artificial
  CRISPR gRNA sequence
ccagcacacacagtgaggtg

SEQ ID NO: 271600 - DNA, 20 bp, Artificial
  CRISPR gRNA sequence
tggcatctagagtccagtgg

SEQ ID NO: 271601 - DNA, 20 bp, Artificial
  CRISPR gRNA sequence
gagtccagtggtttgctgaa

SEQ ID NO: 271602 - DNA, 20 bp, Artificial
  CRISPR gRNA sequence
gctgaatatgtcctgtctaa

SEQ ID NO: 271603 - DNA, 20 bp, Artificial
  CRISPR gRNA sequence
ctgaatatgtcctgtctaac

SEQ ID NO: 271604 - DNA, 20 bp, Artificial
  CRISPR gRNA sequence
aatatgtcctgtctaactca

SEQ ID NO: 271605 - DNA, 20 bp, Artificial
  CRISPR gRNA sequence
tctaactcagggtgtgacat

SEQ ID NO: 271606 - DNA, 20 bp, Artificial
  CRISPR gRNA sequence
actcagggtgtgacatgttc

SEQ ID NO: 271607 - DNA, 20 bp, Artificial
  CRISPR gRNA sequence
agggtgtgacatgttcctaa

SEQ ID NO: 271608 - DNA, 20 bp, Artificial
  CRISPR gRNA sequence
ctaagatgcacatgggagag

SEQ ID NO: 271609 - DNA, 20 bp, Artificial
  CRISPR gRNA sequence
agatgcacatgggagagaag

SEQ ID NO: 271610 - DNA, 20 bp, Artificial
  CRISPR gRNA sequence
atttcccaaaaatgaatgcc

SEQ ID NO: 271611 - DNA, 20 bp, Artificial
  CRISPR gRNA sequence
cccaaaaatgaatgccactc

SEQ ID NO: 271612 - DNA, 20 bp, Artificial
  CRISPR gRNA sequence
ccaaaaatgaatgccactca

SEQ ID NO: 271613 - DNA, 20 bp, Artificial
  CRISPR gRNA sequence
aattcccgtcctacggcagc

SEQ ID NO: 271614 - DNA, 20 bp, Artificial
  CRISPR gRNA sequence
ccgtcctacggcagctcatg

SEQ ID NO: 271615 - DNA, 20 bp, Artificial
  CRISPR gRNA sequence
cggcagctcatgatctgatg

SEQ ID NO: 271616 - DNA, 20 bp, Artificial
  CRISPR gRNA sequence
atgatctgatggggaagaaa

SEQ ID NO: 271617 - DNA, 20 bp, Artificial
  CRISPR gRNA sequence
atggggaagaaagatataaa

SEQ ID NO: 271618 - DNA, 20 bp, Artificial
  CRISPR gRNA sequence
ctttaaacatagtgacacag

SEQ ID NO: 271619 - DNA, 20 bp, Artificial
  CRISPR gRNA sequence
taaacatagtgacacagtga

SEQ ID NO: 271620 - DNA, 20 bp, Artificial
  CRISPR gRNA sequence
aaacatagtgacacagtgat

SEQ ID NO: 271621 - DNA, 20 bp, Artificial
  CRISPR gRNA sequence
aacatagtgacacagtgatc

SEQ ID NO: 271622 - DNA, 20 bp, Artificial
  CRISPR gRNA sequence
cacaaaacttccgggggcaa

SEQ ID NO: 271623 - DNA, 20 bp, Artificial
  CRISPR gRNA sequence
ccgggggcaacagggaaacc

SEQ ID NO: 271624 - DNA, 20 bp, Artificial
  CRISPR gRNA sequence
cgggggcaacagggaaacca

SEQ ID NO: 271625 - DNA, 20 bp, Artificial
  CRISPR gRNA sequence
aggatctcaggagatgacgg

SEQ ID NO: 271626 - DNA, 20 bp, Artificial
  CRISPR gRNA sequence
aggagatgacggctgacctg

SEQ ID NO: 271627 - DNA, 20 bp, Artificial
  CRISPR gRNA sequence
acctgagtcctgaaggagta

SEQ ID NO: 271628 - DNA, 20 bp, Artificial
  CRISPR gRNA sequence
agtcctgaaggagtatgcat

SEQ ID NO: 271629 - DNA, 20 bp, Artificial
  CRISPR gRNA sequence
aaggagtatgcatacatgga

SEQ ID NO: 271630 - DNA, 20 bp, Artificial
  CRISPR gRNA sequence
gaccaacttttactaagtaa

SEQ ID NO: 271631 - DNA, 20 bp, Artificial
  CRISPR gRNA sequence
accaacttttactaagtaaa

SEQ ID NO: 271632 - DNA, 20 bp, Artificial
  CRISPR gRNA sequence
ttactaagtaaaagttagcc

SEQ ID NO: 271633 - DNA, 20 bp, Artificial
  CRISPR gRNA sequence
tactaagtaaaagttagcct

SEQ ID NO: 271634 - DNA, 20 bp, Artificial
  CRISPR gRNA sequence
actaagtaaaagttagcctg

SEQ ID NO: 271635 - DNA, 20 bp, Artificial
  CRISPR gRNA sequence
ctaagtaaaagttagcctgg

SEQ ID NO: 271636 - DNA, 20 bp, Artificial
  CRISPR gRNA sequence
agtaaaagttagcctggcta

SEQ ID NO: 271637 - DNA, 20 bp, Artificial
  CRISPR gRNA sequence
gcctggctaagacgtgtctt

SEQ ID NO: 271638 - DNA, 20 bp, Artificial
  CRISPR gRNA sequence
gctaagacgtgtctttgtgt

SEQ ID NO: 271639 - DNA, 20 bp, Artificial
  CRISPR gRNA sequence
agacgtgtctttgtgttggg

SEQ ID NO: 271640 - DNA, 20 bp, Artificial
  CRISPR gRNA sequence
tgtgttggggactggggtga

SEQ ID NO: 271641 - DNA, 20 bp, Artificial
  CRISPR gRNA sequence
gtgttggggactggggtgag

SEQ ID NO: 271642 - DNA, 20 bp, Artificial
  CRISPR gRNA sequence
tgttggggactggggtgagg

SEQ ID NO: 271643 - DNA, 20 bp, Artificial
  CRISPR gRNA sequence
gggactggggtgaggtggga

SEQ ID NO: 271644 - DNA, 20 bp, Artificial
  CRISPR gRNA sequence
gggtgaggtgggagagtgtg

SEQ ID NO: 271645 - DNA, 20 bp, Artificial
  CRISPR gRNA sequence
gggctggggtgagttagggg

SEQ ID NO: 271646 - DNA, 20 bp, Artificial
  CRISPR gRNA sequence
ggctggggtgagttagggga

SEQ ID NO: 271647 - DNA, 20 bp, Artificial
  CRISPR gRNA sequence
gggtgagttaggggactgtg

SEQ ID NO: 271648 - DNA, 20 bp, Artificial
  CRISPR gRNA sequence
ggggactgtggggaggataa

SEQ ID NO: 271649 - DNA, 20 bp, Artificial
  CRISPR gRNA sequence
tggggaggataagacaaaga

SEQ ID NO: 271650 - DNA, 20 bp, Artificial
  CRISPR gRNA sequence
ggcaagggagatgaggaggg

SEQ ID NO: 271651 - DNA, 20 bp, Artificial
  CRISPR gRNA sequence
ggggaattacagctaccttc

SEQ ID NO: 271652 - DNA, 20 bp, Artificial
  CRISPR gRNA sequence
gggaattacagctaccttct

SEQ ID NO: 271653 - DNA, 20 bp, Artificial
  CRISPR gRNA sequence
cagctaccttctttttgctg

SEQ ID NO: 271654 - DNA, 20 bp, Artificial
  CRISPR gRNA sequence
ccttctttttgctgggccat

SEQ ID NO: 271655 - DNA, 20 bp, Artificial
  CRISPR gRNA sequence
ctttttgctgggccatgagt

SEQ ID NO: 271656 - DNA, 20 bp, Artificial
  CRISPR gRNA sequence
tttttgctgggccatgagtt

SEQ ID NO: 271657 - DNA, 20 bp, Artificial
  CRISPR gRNA sequence
tttgctgggccatgagttac

SEQ ID NO: 271658 - DNA, 20 bp, Artificial
  CRISPR gRNA sequence
ttgctgggccatgagttaca

SEQ ID NO: 271659 - DNA, 20 bp, Artificial
  CRISPR gRNA sequence
tgctgggccatgagttacaa

SEQ ID NO: 271660 - DNA, 20 bp, Artificial
  CRISPR gRNA sequence
gctgggccatgagttacaaa

SEQ ID NO: 271661 - DNA, 20 bp, Artificial
  CRISPR gRNA sequence
ctgggccatgagttacaaaa

SEQ ID NO: 271662 - DNA, 20 bp, Artificial
  CRISPR gRNA sequence
ggccatgagttacaaaagac

SEQ ID NO: 271663 - DNA, 20 bp, Artificial
  CRISPR gRNA sequence
caaaagacaagattgtcaga

SEQ ID NO: 271664 - DNA, 20 bp, Artificial
  CRISPR gRNA sequence
tcagagcaagcatagttcac

SEQ ID NO: 271665 - DNA, 20 bp, Artificial
  CRISPR gRNA sequence
actccattagagagcttggg

SEQ ID NO: 271666 - DNA, 20 bp, Artificial
  CRISPR gRNA sequence
cattagagagcttgggctct

SEQ ID NO: 271667 - DNA, 20 bp, Artificial
  CRISPR gRNA sequence
gagagcttgggctctcttct

SEQ ID NO: 271668 - DNA, 20 bp, Artificial
  CRISPR gRNA sequence
gggctctcttctgaaggtga

SEQ ID NO: 271669 - DNA, 20 bp, Artificial
  CRISPR gRNA sequence
ggctctcttctgaaggtgat

SEQ ID NO: 271670 - DNA, 20 bp, Artificial
  CRISPR gRNA sequence
tcttctgaaggtgatgaaga

SEQ ID NO: 271671 - DNA, 20 bp, Artificial
  CRISPR gRNA sequence
ttctgaaggtgatgaagatc

SEQ ID NO: 271672 - DNA, 20 bp, Artificial
  CRISPR gRNA sequence
ctgaaggtgatgaagatcta

SEQ ID NO: 271673 - DNA, 20 bp, Artificial
  CRISPR gRNA sequence
tgaaggtgatgaagatctac

SEQ ID NO: 271674 - DNA, 20 bp, Artificial
  CRISPR gRNA sequence
aaggtgatgaagatctactg

SEQ ID NO: 271675 - DNA, 20 bp, Artificial
  CRISPR gRNA sequence
ctgaaggcttttatgcagaa

SEQ ID NO: 271676 - DNA, 20 bp, Artificial
  CRISPR gRNA sequence
aaggcttttatgcagaaaag

SEQ ID NO: 271677 - DNA, 20 bp, Artificial
  CRISPR gRNA sequence
ttatgcagaaaagtgctaag

SEQ ID NO: 271678 - DNA, 20 bp, Artificial
  CRISPR gRNA sequence
tatgcagaaaagtgctaaga

SEQ ID NO: 271679 - DNA, 20 bp, Artificial
  CRISPR gRNA sequence
atgcagaaaagtgctaagat

SEQ ID NO: 271680 - DNA, 20 bp, Artificial
  CRISPR gRNA sequence
tgcagaaaagtgctaagatt

SEQ ID NO: 271681 - DNA, 20 bp, Artificial
  CRISPR gRNA sequence
agattttgctggaaaagagc

SEQ ID NO: 271682 - DNA, 20 bp, Artificial
  CRISPR gRNA sequence
tgctggaaaagagcttgaaa

SEQ ID NO: 271683 - DNA, 20 bp, Artificial
  CRISPR gRNA sequence
gctggaaaagagcttgaaaa

SEQ ID NO: 271684 - DNA, 20 bp, Artificial
  CRISPR gRNA sequence
ctggaaaagagcttgaaaac

SEQ ID NO: 271685 - DNA, 20 bp, Artificial
  CRISPR gRNA sequence
gaaaagagcttgaaaactat

SEQ ID NO: 271686 - DNA, 20 bp, Artificial
  CRISPR gRNA sequence
gaaaactatttgttttcgat

SEQ ID NO: 271687 - DNA, 20 bp, Artificial
  CRISPR gRNA sequence
aaaactatttgttttcgata

SEQ ID NO: 271688 - DNA, 20 bp, Artificial
  CRISPR gRNA sequence
tttgttttcgataaggccat

SEQ ID NO: 271689 - DNA, 20 bp, Artificial
  CRISPR gRNA sequence
gttttcgataaggccatttg

SEQ ID NO: 271690 - DNA, 20 bp, Artificial
  CRISPR gRNA sequence
ttttcgataaggccatttga

SEQ ID NO: 271691 - DNA, 20 bp, Artificial
  CRISPR gRNA sequence
tcgataaggccatttgagga

SEQ ID NO: 271692 - DNA, 20 bp, Artificial
  CRISPR gRNA sequence
cgataaggccatttgaggaa

SEQ ID NO: 271693 - DNA, 20 bp, Artificial
  CRISPR gRNA sequence
gataaggccatttgaggaaa

SEQ ID NO: 271694 - DNA, 20 bp, Artificial
  CRISPR gRNA sequence
gaggaaaagccatccaattt

SEQ ID NO: 271695 - DNA, 20 bp, Artificial
  CRISPR gRNA sequence
aggaaaagccatccaattta

SEQ ID NO: 271696 - DNA, 20 bp, Artificial
  CRISPR gRNA sequence
attgctcatgtttactttcc

SEQ ID NO: 271697 - DNA, 20 bp, Artificial
  CRISPR gRNA sequence
ttgctcatgtttactttcct

SEQ ID NO: 271698 - DNA, 20 bp, Artificial
  CRISPR gRNA sequence
ctcatgtttactttcctccc

SEQ ID NO: 271699 - DNA, 20 bp, Artificial
  CRISPR gRNA sequence
atgtttactttcctccctct

SEQ ID NO: 271700 - DNA, 20 bp, Artificial
  CRISPR gRNA sequence
actttcctccctcttctttg

SEQ ID NO: 271701 - DNA, 20 bp, Artificial
  CRISPR gRNA sequence
ctttcctccctcttctttgt

SEQ ID NO: 271702 - DNA, 20 bp, Artificial
  CRISPR gRNA sequence
tcctccctcttctttgtcaa

SEQ ID NO: 271703 - DNA, 20 bp, Artificial
  CRISPR gRNA sequence
cctccctcttctttgtcaac

SEQ ID NO: 271704 - DNA, 20 bp, Artificial
  CRISPR gRNA sequence
ctccctcttctttgtcaaca

SEQ ID NO: 271705 - DNA, 20 bp, Artificial
  CRISPR gRNA sequence
cctcttctttgtcaacatag

SEQ ID NO: 271706 - DNA, 20 bp, Artificial
  CRISPR gRNA sequence
ttctttgtcaacatagatca

SEQ ID NO: 271707 - DNA, 20 bp, Artificial
  CRISPR gRNA sequence
ctttgtcaacatagatcatt

SEQ ID NO: 271708 - DNA, 20 bp, Artificial
  CRISPR gRNA sequence
tttgtcaacatagatcattt

SEQ ID NO: 271709 - DNA, 20 bp, Artificial
  CRISPR gRNA sequence
tgtcaacatagatcattttt

SEQ ID NO: 271710 - DNA, 20 bp, Artificial
  CRISPR gRNA sequence
gtcaacatagatcattttta

SEQ ID NO: 271711 - DNA, 20 bp, Artificial
  CRISPR gRNA sequence
tcaacatagatcatttttaa

SEQ ID NO: 271712 - DNA, 20 bp, Artificial
  CRISPR gRNA sequence
ttaaattagctggctctcaa

SEQ ID NO: 271713 - DNA, 20 bp, Artificial
  CRISPR gRNA sequence
taaattagctggctctcaaa

SEQ ID NO: 271714 - DNA, 20 bp, Artificial
  CRISPR gRNA sequence
aaattagctggctctcaaac

SEQ ID NO: 271715 - DNA, 20 bp, Artificial
  CRISPR gRNA sequence
aattagctggctctcaaaca

SEQ ID NO: 271716 - DNA, 20 bp, Artificial
  CRISPR gRNA sequence
gctggctctcaaacacagat

SEQ ID NO: 271717 - DNA, 20 bp, Artificial
  CRISPR gRNA sequence
gctctcaaacacagatactg

SEQ ID NO: 271718 - DNA, 20 bp, Artificial
  CRISPR gRNA sequence
tcaaacacagatactgtgct

SEQ ID NO: 271719 - DNA, 20 bp, Artificial
  CRISPR gRNA sequence
aaacacagatactgtgcttg

SEQ ID NO: 271720 - DNA, 20 bp, Artificial
  CRISPR gRNA sequence
tgcttgaaatcgtttgctta

SEQ ID NO: 271721 - DNA, 20 bp, Artificial
  CRISPR gRNA sequence
gaaatcgtttgcttactatg

SEQ ID NO: 271722 - DNA, 20 bp, Artificial
  CRISPR gRNA sequence
aaatcgtttgcttactatgt

SEQ ID NO: 271723 - DNA, 20 bp, Artificial
  CRISPR gRNA sequence
gcttactatgtgttaacatg

SEQ ID NO: 271724 - DNA, 20 bp, Artificial
  CRISPR gRNA sequence
cttactatgtgttaacatgt

SEQ ID NO: 271725 - DNA, 20 bp, Artificial
  CRISPR gRNA sequence
actatgtgttaacatgtagc

SEQ ID NO: 271726 - DNA, 20 bp, Artificial
  CRISPR gRNA sequence
ctatgtgttaacatgtagct

SEQ ID NO: 271727 - DNA, 20 bp, Artificial
  CRISPR gRNA sequence
tgtgttaacatgtagctaac

SEQ ID NO: 271728 - DNA, 20 bp, Artificial
  CRISPR gRNA sequence
acatgtagctaacagcctcc

SEQ ID NO: 271729 - DNA, 20 bp, Artificial
  CRISPR gRNA sequence
acagcctcctagtttagagt

SEQ ID NO: 271730 - DNA, 20 bp, Artificial
  CRISPR gRNA sequence
ctagtttagagttcaagctg

SEQ ID NO: 271731 - DNA, 20 bp, Artificial
  CRISPR gRNA sequence
gtttagagttcaagctgagt

SEQ ID NO: 271732 - DNA, 20 bp, Artificial
  CRISPR gRNA sequence
agagttcaagctgagttcaa

SEQ ID NO: 271733 - DNA, 20 bp, Artificial
  CRISPR gRNA sequence
gagttcaagctgagttcaag

SEQ ID NO: 271734 - DNA, 20 bp, Artificial
  CRISPR gRNA sequence
aagctgagttcaaggttggc

SEQ ID NO: 271735 - DNA, 20 bp, Artificial
  CRISPR gRNA sequence
agttcaaggttggctgataa

SEQ ID NO: 271736 - DNA, 20 bp, Artificial
  CRISPR gRNA sequence
aaggttggctgataaaatct

SEQ ID NO: 271737 - DNA, 20 bp, Artificial
  CRISPR gRNA sequence
gctgataaaatctcgtttct

SEQ ID NO: 271738 - DNA, 20 bp, Artificial
  CRISPR gRNA sequence
ataaaatctcgtttctcaat

SEQ ID NO: 271739 - DNA, 20 bp, Artificial
  CRISPR gRNA sequence
gtttctcaatatttatatcc

SEQ ID NO: 271740 - DNA, 20 bp, Artificial
  CRISPR gRNA sequence
ctcaatatttatatcctcat

SEQ ID NO: 271741 - DNA, 20 bp, Artificial
  CRISPR gRNA sequence
tcaatatttatatcctcata

SEQ ID NO: 271742 - DNA, 20 bp, Artificial
  CRISPR gRNA sequence
aatatttatatcctcatagc

SEQ ID NO: 271743 - DNA, 20 bp, Artificial
  CRISPR gRNA sequence
atatcctcatagcatttggt

SEQ ID NO: 271744 - DNA, 20 bp, Artificial
  CRISPR gRNA sequence
tatcctcatagcatttggtc

SEQ ID NO: 271745 - DNA, 20 bp, Artificial
  CRISPR gRNA sequence
atagcatttggtcccacctt

SEQ ID NO: 271746 - DNA, 20 bp, Artificial
  CRISPR gRNA sequence
ggtcccaccttggttcatgt

SEQ ID NO: 271747 - DNA, 20 bp, Artificial
  CRISPR gRNA sequence
gtcccaccttggttcatgtc

SEQ ID NO: 271748 - DNA, 20 bp, Artificial
  CRISPR gRNA sequence
ggttcatgtcaataattcag

SEQ ID NO: 271749 - DNA, 20 bp, Artificial
  CRISPR gRNA sequence
gttcatgtcaataattcaga

SEQ ID NO: 271750 - DNA, 20 bp, Artificial
  CRISPR gRNA sequence
atgtcaataattcagagaag

SEQ ID NO: 271751 - DNA, 20 bp, Artificial
  CRISPR gRNA sequence
agagaagcctaaataggaaa

SEQ ID NO: 271752 - DNA, 20 bp, Artificial
  CRISPR gRNA sequence
aataggaaactatctcacag

SEQ ID NO: 271753 - DNA, 20 bp, Artificial
  CRISPR gRNA sequence
tctcacaggacctcaaaatc

SEQ ID NO: 271754 - DNA, 20 bp, Artificial
  CRISPR gRNA sequence
acaggacctcaaaatctcta

SEQ ID NO: 271755 - DNA, 20 bp, Artificial
  CRISPR gRNA sequence
aaaatctctatatgctttgc

SEQ ID NO: 271756 - DNA, 20 bp, Artificial
  CRISPR gRNA sequence
tatatgctttgcaagacagt

SEQ ID NO: 271757 - DNA, 20 bp, Artificial
  CRISPR gRNA sequence
tatgctttgcaagacagtaa

SEQ ID NO: 271758 - DNA, 20 bp, Artificial
  CRISPR gRNA sequence
tgcaagacagtaaatgagag

SEQ ID NO: 271759 - DNA, 20 bp, Artificial
  CRISPR gRNA sequence
gcaagacagtaaatgagaga

SEQ ID NO: 271760 - DNA, 20 bp, Artificial
  CRISPR gRNA sequence
caagacagtaaatgagagaa

SEQ ID NO: 271761 - DNA, 20 bp, Artificial
  CRISPR gRNA sequence
acttttggtgctagaaaaag

SEQ ID NO: 271762 - DNA, 20 bp, Artificial
  CRISPR gRNA sequence
cttttggtgctagaaaaaga

SEQ ID NO: 271763 - DNA, 20 bp, Artificial
  CRISPR gRNA sequence
ttggtgctagaaaaagataa

SEQ ID NO: 271764 - DNA, 20 bp, Artificial
  CRISPR gRNA sequence
tggtgctagaaaaagataac

SEQ ID NO: 271765 - DNA, 20 bp, Artificial
  CRISPR gRNA sequence
ggtgctagaaaaagataacc

SEQ ID NO: 271766 - DNA, 20 bp, Artificial
  CRISPR gRNA sequence
gtgctagaaaaagataacca

SEQ ID NO: 271767 - DNA, 20 bp, Artificial
  CRISPR gRNA sequence
gaaaaagataaccagtgact

SEQ ID NO: 271768 - DNA, 20 bp, Artificial
  CRISPR gRNA sequence
taagtgatactgaatatgtg

SEQ ID NO: 271769 - DNA, 20 bp, Artificial
  CRISPR gRNA sequence
agtgatactgaatatgtgtg

SEQ ID NO: 271770 - DNA, 20 bp, Artificial
  CRISPR gRNA sequence
aatatgtgtgatcattgtga

SEQ ID NO: 271771 - DNA, 20 bp, Artificial
  CRISPR gRNA sequence
tgactttgagtaaacacaat

SEQ ID NO: 271772 - DNA, 20 bp, Artificial
  CRISPR gRNA sequence
tgagtaaacacaataattct

SEQ ID NO: 271773 - DNA, 20 bp, Artificial
  CRISPR gRNA sequence
gagtaaacacaataattctg

SEQ ID NO: 271774 - DNA, 20 bp, Artificial
  CRISPR gRNA sequence
agtaaacacaataattctga

SEQ ID NO: 271775 - DNA, 20 bp, Artificial
  CRISPR gRNA sequence
tgatttctcttattttcttt

SEQ ID NO: 271776 - DNA, 20 bp, Artificial
  CRISPR gRNA sequence
atttctcttattttctttta

SEQ ID NO: 271777 - DNA, 20 bp, Artificial
  CRISPR gRNA sequence
ctcttattttcttttaaaat

SEQ ID NO: 271778 - DNA, 20 bp, Artificial
  CRISPR gRNA sequence
tcttattttcttttaaaatg

SEQ ID NO: 271779 - DNA, 20 bp, Artificial
  CRISPR gRNA sequence
ttattttcttttaaaatggg

SEQ ID NO: 271780 - DNA, 20 bp, Artificial
  CRISPR gRNA sequence
attttcttttaaaatggggc

SEQ ID NO: 271781 - DNA, 20 bp, Artificial
  CRISPR gRNA sequence
ttttcttttaaaatggggca

SEQ ID NO: 271782 - DNA, 20 bp, Artificial
  CRISPR gRNA sequence
tcttttaaaatggggcatgt

SEQ ID NO: 271783 - DNA, 20 bp, Artificial
  CRISPR gRNA sequence
cttttaaaatggggcatgtg

SEQ ID NO: 271784 - DNA, 20 bp, Artificial
  CRISPR gRNA sequence
ttttaaaatggggcatgtgt

SEQ ID NO: 271785 - DNA, 20 bp, Artificial
  CRISPR gRNA sequence
ttaaaatggggcatgtgtaa

SEQ ID NO: 271786 - DNA, 20 bp, Artificial
  CRISPR gRNA sequence
taaaatggggcatgtgtaaa

SEQ ID NO: 271787 - DNA, 20 bp, Artificial
  CRISPR gRNA sequence
aaaatggggcatgtgtaaaa

SEQ ID NO: 271788 - DNA, 20 bp, Artificial
  CRISPR gRNA sequence
aaatggggcatgtgtaaaaa

SEQ ID NO: 271789 - DNA, 20 bp, Artificial
  CRISPR gRNA sequence
gctctatgaagtaaaaacat

SEQ ID NO: 271790 - DNA, 20 bp, Artificial
  CRISPR gRNA sequence
ctctatgaagtaaaaacatg

SEQ ID NO: 271791 - DNA, 20 bp, Artificial
  CRISPR gRNA sequence
tatgaagtaaaaacatggag

SEQ ID NO: 271792 - DNA, 20 bp, Artificial
  CRISPR gRNA sequence
tgaagtaaaaacatggagaa

SEQ ID NO: 271793 - DNA, 20 bp, Artificial
  CRISPR gRNA sequence
ataatcagaatatcagatga

SEQ ID NO: 271794 - DNA, 20 bp, Artificial
  CRISPR gRNA sequence
ggctttgatatgtattttcg

SEQ ID NO: 271795 - DNA, 20 bp, Artificial
  CRISPR gRNA sequence
gctttgatatgtattttcgg

SEQ ID NO: 271796 - DNA, 20 bp, Artificial
  CRISPR gRNA sequence
tgatatgtattttcggtctc

SEQ ID NO: 271797 - DNA, 20 bp, Artificial
  CRISPR gRNA sequence
gatatgtattttcggtctct

SEQ ID NO: 271798 - DNA, 20 bp, Artificial
  CRISPR gRNA sequence
atatgtattttcggtctctg

SEQ ID NO: 271799 - DNA, 20 bp, Artificial
  CRISPR gRNA sequence
tcggtctctgagtttctgaa

SEQ ID NO: 271800 - DNA, 20 bp, Artificial
  CRISPR gRNA sequence
cggtctctgagtttctgaaa

SEQ ID NO: 271801 - DNA, 20 bp, Artificial
  CRISPR gRNA sequence
ggtctctgagtttctgaaaa

SEQ ID NO: 271802 - DNA, 20 bp, Artificial
  CRISPR gRNA sequence
tgagtttctgaaaatccaca

SEQ ID NO: 271803 - DNA, 20 bp, Artificial
  CRISPR gRNA sequence
agtttctgaaaatccacagt

SEQ ID NO: 271804 - DNA, 20 bp, Artificial
  CRISPR gRNA sequence
ctgaaaatccacagtacttc

SEQ ID NO: 271805 - DNA, 20 bp, Artificial
  CRISPR gRNA sequence
tgaaaatccacagtacttca

SEQ ID NO: 271806 - DNA, 20 bp, Artificial
  CRISPR gRNA sequence
aaaatccacagtacttcaaa

SEQ ID NO: 271807 - DNA, 20 bp, Artificial
  CRISPR gRNA sequence
caaataatgtaaggacatat

SEQ ID NO: 271808 - DNA, 20 bp, Artificial
  CRISPR gRNA sequence
aaataatgtaaggacatatt

SEQ ID NO: 271809 - DNA, 20 bp, Artificial
  CRISPR gRNA sequence
caaatgtaaggacatatcta

SEQ ID NO: 271810 - DNA, 20 bp, Artificial
  CRISPR gRNA sequence
gactcagaagaaacccaaat

SEQ ID NO: 271811 - DNA, 20 bp, Artificial
  CRISPR gRNA sequence
agaagaaacccaaatatgta

SEQ ID NO: 271812 - DNA, 20 bp, Artificial
  CRISPR gRNA sequence
cctcgtcctaacttgtgttt

SEQ ID NO: 271813 - DNA, 20 bp, Artificial
  CRISPR gRNA sequence
gtcctaacttgtgtttgatt

SEQ ID NO: 271814 - DNA, 20 bp, Artificial
  CRISPR gRNA sequence
acttgtgtttgatttctttt

SEQ ID NO: 271815 - DNA, 20 bp, Artificial
  CRISPR gRNA sequence
gtgtttgatttctttttgct

SEQ ID NO: 271816 - DNA, 20 bp, Artificial
  CRISPR gRNA sequence
tgtttgatttctttttgctt

SEQ ID NO: 271817 - DNA, 20 bp, Artificial
  CRISPR gRNA sequence
gatttctttttgctttccag

SEQ ID NO: 271818 - DNA, 20 bp, Artificial
  CRISPR gRNA sequence
atttctttttgctttccagt

SEQ ID NO: 271819 - DNA, 20 bp, Artificial
  CRISPR gRNA sequence
ctttttgctttccagttcat

SEQ ID NO: 271820 - DNA, 20 bp, Artificial
  CRISPR gRNA sequence
tttttgctttccagttcatg

SEQ ID NO: 271821 - DNA, 20 bp, Artificial
  CRISPR gRNA sequence
tttgctttccagttcatgct

SEQ ID NO: 271822 - DNA, 20 bp, Artificial
  CRISPR gRNA sequence
ttgctttccagttcatgcta

SEQ ID NO: 271823 - DNA, 20 bp, Artificial
  CRISPR gRNA sequence
tgctttccagttcatgctag

SEQ ID NO: 271824 - DNA, 20 bp, Artificial
  CRISPR gRNA sequence
gctttccagttcatgctagg

SEQ ID NO: 271825 - DNA, 20 bp, Artificial
  CRISPR gRNA sequence
ctttccagttcatgctagga

SEQ ID NO: 271826 - DNA, 20 bp, Artificial
  CRISPR gRNA sequence
tccagttcatgctaggagtg

SEQ ID NO: 271827 - DNA, 20 bp, Artificial
  CRISPR gRNA sequence
ccagttcatgctaggagtgg

SEQ ID NO: 271828 - DNA, 20 bp, Artificial
  CRISPR gRNA sequence
cagttcatgctaggagtgga

SEQ ID NO: 271829 - DNA, 20 bp, Artificial
  CRISPR gRNA sequence
atgctaggagtggaaggcat

SEQ ID NO: 271830 - DNA, 20 bp, Artificial
  CRISPR gRNA sequence
ggagtggaaggcattcttct

SEQ ID NO: 271831 - DNA, 20 bp, Artificial
  CRISPR gRNA sequence
ttcttaggctacttgggtat

SEQ ID NO: 271832 - DNA, 20 bp, Artificial
  CRISPR gRNA sequence
cttaggctacttgggtatca

SEQ ID NO: 271833 - DNA, 20 bp, Artificial
  CRISPR gRNA sequence
ttaggctacttgggtatcag

SEQ ID NO: 271834 - DNA, 20 bp, Artificial
  CRISPR gRNA sequence
aggctacttgggtatcagga

SEQ ID NO: 271835 - DNA, 20 bp, Artificial
  CRISPR gRNA sequence
ggctacttgggtatcaggag

SEQ ID NO: 271836 - DNA, 20 bp, Artificial
  CRISPR gRNA sequence
cttgggtatcaggagaccca

SEQ ID NO: 271837 - DNA, 20 bp, Artificial
  CRISPR gRNA sequence
gggtatcaggagacccagcc

SEQ ID NO: 271838 - DNA, 20 bp, Artificial
  CRISPR gRNA sequence
ggtatcaggagacccagccc

SEQ ID NO: 271839 - DNA, 20 bp, Artificial
  CRISPR gRNA sequence
tccctgtgaatatttgattt

SEQ ID NO: 271840 - DNA, 20 bp, Artificial
  CRISPR gRNA sequence
ccctgtgaatatttgatttt

SEQ ID NO: 271841 - DNA, 20 bp, Artificial
  CRISPR gRNA sequence
cctgtgaatatttgatttta

SEQ ID NO: 271842 - DNA, 20 bp, Artificial
  CRISPR gRNA sequence
tgaatatttgattttacttc

SEQ ID NO: 271843 - DNA, 20 bp, Artificial
  CRISPR gRNA sequence
gattttacttcttgtgagtg

SEQ ID NO: 271844 - DNA, 20 bp, Artificial
  CRISPR gRNA sequence
attttacttcttgtgagtgt

SEQ ID NO: 271845 - DNA, 20 bp, Artificial
  CRISPR gRNA sequence
tacttcttgtgagtgttcag

SEQ ID NO: 271846 - DNA, 20 bp, Artificial
  CRISPR gRNA sequence
acttcttgtgagtgttcagg

SEQ ID NO: 271847 - DNA, 20 bp, Artificial
  CRISPR gRNA sequence
cttcttgtgagtgttcaggt

SEQ ID NO: 271848 - DNA, 20 bp, Artificial
  CRISPR gRNA sequence
cttgtgagtgttcaggtaag

SEQ ID NO: 271849 - DNA, 20 bp, Artificial
  CRISPR gRNA sequence
ttgtgagtgttcaggtaagg

SEQ ID NO: 271850 - DNA, 20 bp, Artificial
  CRISPR gRNA sequence
gtgagtgttcaggtaaggtc

SEQ ID NO: 271851 - DNA, 20 bp, Artificial
  CRISPR gRNA sequence
tgagtgttcaggtaaggtct

SEQ ID NO: 271852 - DNA, 20 bp, Artificial
  CRISPR gRNA sequence
aggtaaggtctacctaggtc

SEQ ID NO: 271853 - DNA, 20 bp, Artificial
  CRISPR gRNA sequence
cctaggtcaaacctactagg

SEQ ID NO: 271854 - DNA, 20 bp, Artificial
  CRISPR gRNA sequence
ggtcaaacctactaggttaa

SEQ ID NO: 271855 - DNA, 20 bp, Artificial
  CRISPR gRNA sequence
ctaggttaaaagaaacattg

SEQ ID NO: 271856 - DNA, 20 bp, Artificial
  CRISPR gRNA sequence
ggttaaaagaaacattgtca

SEQ ID NO: 271857 - DNA, 20 bp, Artificial
  CRISPR gRNA sequence
aaagaaacattgtcaaccca

SEQ ID NO: 271858 - DNA, 20 bp, Artificial
  CRISPR gRNA sequence
tcaacccatccattttcttt

SEQ ID NO: 271859 - DNA, 20 bp, Artificial
  CRISPR gRNA sequence
tctttgcttacgttatcaaa

SEQ ID NO: 271860 - DNA, 20 bp, Artificial
  CRISPR gRNA sequence
ctttgcttacgttatcaaaa

SEQ ID NO: 271861 - DNA, 20 bp, Artificial
  CRISPR gRNA sequence
tttgcttacgttatcaaaag

SEQ ID NO: 271862 - DNA, 20 bp, Artificial
  CRISPR gRNA sequence
tgcttacgttatcaaaagat

SEQ ID NO: 271863 - DNA, 20 bp, Artificial
  CRISPR gRNA sequence
gcttacgttatcaaaagatt

SEQ ID NO: 271864 - DNA, 20 bp, Artificial
  CRISPR gRNA sequence
cttacgttatcaaaagattg

SEQ ID NO: 271865 - DNA, 20 bp, Artificial
  CRISPR gRNA sequence
acgttatcaaaagattggtc

SEQ ID NO: 271866 - DNA, 20 bp, Artificial
  CRISPR gRNA sequence
cgttatcaaaagattggtct

SEQ ID NO: 271867 - DNA, 20 bp, Artificial
  CRISPR gRNA sequence
tcaaaagattggtctgactg

SEQ ID NO: 271868 - DNA, 20 bp, Artificial
  CRISPR gRNA sequence
gtctgactgacatttctcta

SEQ ID NO: 271869 - DNA, 20 bp, Artificial
  CRISPR gRNA sequence
actgacatttctctaactga

SEQ ID NO: 271870 - DNA, 20 bp, Artificial
  CRISPR gRNA sequence
acatttctctaactgaattg

SEQ ID NO: 271871 - DNA, 20 bp, Artificial
  CRISPR gRNA sequence
ctctaactgaattgacaagt

SEQ ID NO: 271872 - DNA, 20 bp, Artificial
  CRISPR gRNA sequence
tctaactgaattgacaagtt

SEQ ID NO: 271873 - DNA, 20 bp, Artificial
  CRISPR gRNA sequence
taactgaattgacaagttgt

SEQ ID NO: 271874 - DNA, 20 bp, Artificial
  CRISPR gRNA sequence
actgaattgacaagttgttt

SEQ ID NO: 271875 - DNA, 20 bp, Artificial
  CRISPR gRNA sequence
aattgacaagttgttttgaa

SEQ ID NO: 271876 - DNA, 20 bp, Artificial
  CRISPR gRNA sequence
acaagttgttttgaaggtga

SEQ ID NO: 271877 - DNA, 20 bp, Artificial
  CRISPR gRNA sequence
ttttgaaggtgaatttagtg

SEQ ID NO: 271878 - DNA, 20 bp, Artificial
  CRISPR gRNA sequence
tgaaggtgaatttagtgctt

SEQ ID NO: 271879 - DNA, 20 bp, Artificial
  CRISPR gRNA sequence
gaaggtgaatttagtgcttt

SEQ ID NO: 271880 - DNA, 20 bp, Artificial
  CRISPR gRNA sequence
aaggtgaatttagtgctttg

SEQ ID NO: 271881 - DNA, 20 bp, Artificial
  CRISPR gRNA sequence
agtgctttgcttttcaaagc

SEQ ID NO: 271882 - DNA, 20 bp, Artificial
  CRISPR gRNA sequence
gtgctttgcttttcaaagcc

SEQ ID NO: 271883 - DNA, 20 bp, Artificial
  CRISPR gRNA sequence
tgcttttcaaagcctttcct

SEQ ID NO: 271884 - DNA, 20 bp, Artificial
  CRISPR gRNA sequence
gcttttcaaagcctttccta

SEQ ID NO: 271885 - DNA, 20 bp, Artificial
  CRISPR gRNA sequence
cttttcaaagcctttcctag

SEQ ID NO: 271886 - DNA, 20 bp, Artificial
  CRISPR gRNA sequence
ttcaaagcctttcctagcag

SEQ ID NO: 271887 - DNA, 20 bp, Artificial
  CRISPR gRNA sequence
tcaaagcctttcctagcagc

SEQ ID NO: 271888 - DNA, 20 bp, Artificial
  CRISPR gRNA sequence
caaagcctttcctagcagct

SEQ ID NO: 271889 - DNA, 20 bp, Artificial
  CRISPR gRNA sequence
aaagcctttcctagcagcta

SEQ ID NO: 271890 - DNA, 20 bp, Artificial
  CRISPR gRNA sequence
tcctagcagctaaaccagct

SEQ ID NO: 271891 - DNA, 20 bp, Artificial
  CRISPR gRNA sequence
cctagcagctaaaccagcta

SEQ ID NO: 271892 - DNA, 20 bp, Artificial
  CRISPR gRNA sequence
ctagcagctaaaccagctaa

SEQ ID NO: 271893 - DNA, 20 bp, Artificial
  CRISPR gRNA sequence
gcagctaaaccagctaaagg

SEQ ID NO: 271894 - DNA, 20 bp, Artificial
  CRISPR gRNA sequence
aaccagctaaaggtgtggag

SEQ ID NO: 271895 - DNA, 20 bp, Artificial
  CRISPR gRNA sequence
aaggtgtggagacaggaagc

SEQ ID NO: 271896 - DNA, 20 bp, Artificial
  CRISPR gRNA sequence
acctcaaacctctttccctc

SEQ ID NO: 271897 - DNA, 20 bp, Artificial
  CRISPR gRNA sequence
aaacctctttccctcacagc

SEQ ID NO: 271898 - DNA, 20 bp, Artificial
  CRISPR gRNA sequence
tttccctcacagctcctgct

SEQ ID NO: 271899 - DNA, 20 bp, Artificial
  CRISPR gRNA sequence
tccctcacagctcctgctta

SEQ ID NO: 271900 - DNA, 20 bp, Artificial
  CRISPR gRNA sequence
ccctcacagctcctgcttaa

SEQ ID NO: 271901 - DNA, 20 bp, Artificial
  CRISPR gRNA sequence
cctcacagctcctgcttaac

SEQ ID NO: 271902 - DNA, 20 bp, Artificial
  CRISPR gRNA sequence
acagctcctgcttaacaaca

SEQ ID NO: 271903 - DNA, 20 bp, Artificial
  CRISPR gRNA sequence
ctgcttaacaacaggcaaca

SEQ ID NO: 271904 - DNA, 20 bp, Artificial
  CRISPR gRNA sequence
cttaacaacaggcaacatga

SEQ ID NO: 271905 - DNA, 20 bp, Artificial
  CRISPR gRNA sequence
aacaacaggcaacatgaaga

SEQ ID NO: 271906 - DNA, 20 bp, Artificial
  CRISPR gRNA sequence
acaacaggcaacatgaagag

SEQ ID NO: 271907 - DNA, 20 bp, Artificial
  CRISPR gRNA sequence
gaggtgagaaggtacttatc

SEQ ID NO: 271908 - DNA, 20 bp, Artificial
  CRISPR gRNA sequence
atctgctgcttgtgagcaag

SEQ ID NO: 271909 - DNA, 20 bp, Artificial
  CRISPR gRNA sequence
tctgctgcttgtgagcaagg

SEQ ID NO: 271910 - DNA, 20 bp, Artificial
  CRISPR gRNA sequence
ctgcttgtgagcaaggtact

SEQ ID NO: 271911 - DNA, 20 bp, Artificial
  CRISPR gRNA sequence
cttgtgagcaaggtactgag

SEQ ID NO: 271912 - DNA, 20 bp, Artificial
  CRISPR gRNA sequence
gtgagcaaggtactgagagc

SEQ ID NO: 271913 - DNA, 20 bp, Artificial
  CRISPR gRNA sequence
tgagcaaggtactgagagct

SEQ ID NO: 271914 - DNA, 20 bp, Artificial
  CRISPR gRNA sequence
agagctaaaagatttcccac

SEQ ID NO: 271915 - DNA, 20 bp, Artificial
  CRISPR gRNA sequence
aaagatttcccacagataat

SEQ ID NO: 271916 - DNA, 20 bp, Artificial
  CRISPR gRNA sequence
cccacagataatctgtgaat

SEQ ID NO: 271917 - DNA, 20 bp, Artificial
  CRISPR gRNA sequence
ccacagataatctgtgaatc

SEQ ID NO: 271918 - DNA, 20 bp, Artificial
  CRISPR gRNA sequence
tgaatcttgtgaaacagccg

SEQ ID NO: 271919 - DNA, 20 bp, Artificial
  CRISPR gRNA sequence
gtgaaacagccgacttcagg

SEQ ID NO: 271920 - DNA, 20 bp, Artificial
  CRISPR gRNA sequence
tgaaacagccgacttcagga

SEQ ID NO: 271921 - DNA, 20 bp, Artificial
  CRISPR gRNA sequence
caggaaaattgaaagttgct

SEQ ID NO: 271922 - DNA, 20 bp, Artificial
  CRISPR gRNA sequence
aggaaaattgaaagttgctt

SEQ ID NO: 271923 - DNA, 20 bp, Artificial
  CRISPR gRNA sequence
aaagttgcttgaacttccat

SEQ ID NO: 271924 - DNA, 20 bp, Artificial
  CRISPR gRNA sequence
cttgaacttccatgagaatg

SEQ ID NO: 271925 - DNA, 20 bp, Artificial
  CRISPR gRNA sequence
gaacttccatgagaatggca

SEQ ID NO: 271926 - DNA, 20 bp, Artificial
  CRISPR gRNA sequence
aacttccatgagaatggcag

SEQ ID NO: 271927 - DNA, 20 bp, Artificial
  CRISPR gRNA sequence
ccatgagaatggcagtgggt

SEQ ID NO: 271928 - DNA, 20 bp, Artificial
  CRISPR gRNA sequence
catgagaatggcagtgggtg

SEQ ID NO: 271929 - DNA, 20 bp, Artificial
  CRISPR gRNA sequence
ggttacaaaaaaaaacaact

SEQ ID NO: 271930 - DNA, 20 bp, Artificial
  CRISPR gRNA sequence
gttacaaaaaaaaacaactc

SEQ ID NO: 271931 - DNA, 20 bp, Artificial
  CRISPR gRNA sequence
caaaaaaaaacaactcttgc

SEQ ID NO: 271932 - DNA, 20 bp, Artificial
  CRISPR gRNA sequence
ttgccgtttacacctattat

SEQ ID NO: 271933 - DNA, 20 bp, Artificial
  CRISPR gRNA sequence
gccgtttacacctattataa

SEQ ID NO: 271934 - DNA, 20 bp, Artificial
  CRISPR gRNA sequence
ccgtttacacctattataaa

SEQ ID NO: 271935 - DNA, 20 bp, Artificial
  CRISPR gRNA sequence
acacctattataaacgggtc

SEQ ID NO: 271936 - DNA, 20 bp, Artificial
  CRISPR gRNA sequence
cacctattataaacgggtca

SEQ ID NO: 271937 - DNA, 20 bp, Artificial
  CRISPR gRNA sequence
ttataaacgggtcaattacc

SEQ ID NO: 271938 - DNA, 20 bp, Artificial
  CRISPR gRNA sequence
taaacgggtcaattaccata

SEQ ID NO: 271939 - DNA, 20 bp, Artificial
  CRISPR gRNA sequence
ccatatttagtaatgaggtc

SEQ ID NO: 271940 - DNA, 20 bp, Artificial
  CRISPR gRNA sequence
agtaatgaggtcaaccctct

SEQ ID NO: 271941 - DNA, 20 bp, Artificial
  CRISPR gRNA sequence
gtaatgaggtcaaccctctg

SEQ ID NO: 271942 - DNA, 20 bp, Artificial
  CRISPR gRNA sequence
tgcataggtggggtggtaac

SEQ ID NO: 271943 - DNA, 20 bp, Artificial
  CRISPR gRNA sequence
cataggtggggtggtaacca

SEQ ID NO: 271944 - DNA, 20 bp, Artificial
  CRISPR gRNA sequence
taaggtgtggctcccagcat

SEQ ID NO: 271945 - DNA, 20 bp, Artificial
  CRISPR gRNA sequence
aggtgtggctcccagcatca

SEQ ID NO: 271946 - DNA, 20 bp, Artificial
  CRISPR gRNA sequence
ccagcatcaaagaaccctga

SEQ ID NO: 271947 - DNA, 20 bp, Artificial
  CRISPR gRNA sequence
accttaaaaggaccctccca

SEQ ID NO: 271948 - DNA, 20 bp, Artificial
  CRISPR gRNA sequence
aaaaggaccctcccaccagc

SEQ ID NO: 271949 - DNA, 20 bp, Artificial
  CRISPR gRNA sequence
aaaggaccctcccaccagct

SEQ ID NO: 271950 - DNA, 20 bp, Artificial
  CRISPR gRNA sequence
ccaccagctcagttaatgct

SEQ ID NO: 271951 - DNA, 20 bp, Artificial
  CRISPR gRNA sequence
agttaatgcttagatttcca

SEQ ID NO: 271952 - DNA, 20 bp, Artificial
  CRISPR gRNA sequence
atgcttagatttccaaagaa

SEQ ID NO: 271953 - DNA, 20 bp, Artificial
  CRISPR gRNA sequence
agatttccaaagaaaatgaa

SEQ ID NO: 271954 - DNA, 20 bp, Artificial
  CRISPR gRNA sequence
gatttccaaagaaaatgaag

SEQ ID NO: 271955 - DNA, 20 bp, Artificial
  CRISPR gRNA sequence
ccaaagaaaatgaagcccaa

SEQ ID NO: 271956 - DNA, 20 bp, Artificial
  CRISPR gRNA sequence
caaagaaaatgaagcccaaa

SEQ ID NO: 271957 - DNA, 20 bp, Artificial
  CRISPR gRNA sequence
gcttaatttagtatctatgg

SEQ ID NO: 271958 - DNA, 20 bp, Artificial
  CRISPR gRNA sequence
aatttagtatctatggctta

SEQ ID NO: 271959 - DNA, 20 bp, Artificial
  CRISPR gRNA sequence
atttagtatctatggcttac

SEQ ID NO: 271960 - DNA, 20 bp, Artificial
  CRISPR gRNA sequence
agtatctatggcttacattc

SEQ ID NO: 271961 - DNA, 20 bp, Artificial
  CRISPR gRNA sequence
gtatctatggcttacattca

SEQ ID NO: 271962 - DNA, 20 bp, Artificial
  CRISPR gRNA sequence
tggcttacattcacagggct

SEQ ID NO: 271963 - DNA, 20 bp, Artificial
  CRISPR gRNA sequence
acattcacagggctataaaa

SEQ ID NO: 271964 - DNA, 20 bp, Artificial
  CRISPR gRNA sequence
cattcacagggctataaaat

SEQ ID NO: 271965 - DNA, 20 bp, Artificial
  CRISPR gRNA sequence
acagggctataaaatgctgt

SEQ ID NO: 271966 - DNA, 20 bp, Artificial
  CRISPR gRNA sequence
taaaatgctgtctcttatct

SEQ ID NO: 271967 - DNA, 20 bp, Artificial
  CRISPR gRNA sequence
tctcttatctcatctgaact

SEQ ID NO: 271968 - DNA, 20 bp, Artificial
  CRISPR gRNA sequence
ttatctcatctgaactctat

SEQ ID NO: 271969 - DNA, 20 bp, Artificial
  CRISPR gRNA sequence
atctcatctgaactctatat

SEQ ID NO: 271970 - DNA, 20 bp, Artificial
  CRISPR gRNA sequence
tctcatctgaactctatatt

SEQ ID NO: 271971 - DNA, 20 bp, Artificial
  CRISPR gRNA sequence
atctgaactctatattcaac

SEQ ID NO: 271972 - DNA, 20 bp, Artificial
  CRISPR gRNA sequence
aactctatattcaactgtga

SEQ ID NO: 271973 - DNA, 20 bp, Artificial
  CRISPR gRNA sequence
tatattcaactgtgaagtaa

SEQ ID NO: 271974 - DNA, 20 bp, Artificial
  CRISPR gRNA sequence
tattcaactgtgaagtaaat

SEQ ID NO: 271975 - DNA, 20 bp, Artificial
  CRISPR gRNA sequence
aactgtgaagtaaataggca

SEQ ID NO: 271976 - DNA, 20 bp, Artificial
  CRISPR gRNA sequence
tgaagtaaataggcaggaca

SEQ ID NO: 271977 - DNA, 20 bp, Artificial
  CRISPR gRNA sequence
tatgcccatcttacacatgg

SEQ ID NO: 271978 - DNA, 20 bp, Artificial
  CRISPR gRNA sequence
atgcccatcttacacatggg

SEQ ID NO: 271979 - DNA, 20 bp, Artificial
  CRISPR gRNA sequence
tgcccatcttacacatgggg

SEQ ID NO: 271980 - DNA, 20 bp, Artificial
  CRISPR gRNA sequence
acacatggggaaactgaggt

SEQ ID NO: 271981 - DNA, 20 bp, Artificial
  CRISPR gRNA sequence
cacatggggaaactgaggtc

SEQ ID NO: 271982 - DNA, 20 bp, Artificial
  CRISPR gRNA sequence
aggtcaaagaggtagatgag

SEQ ID NO: 271983 - DNA, 20 bp, Artificial
  CRISPR gRNA sequence
tccaaggttacaggaaacat

SEQ ID NO: 271984 - DNA, 20 bp, Artificial
  CRISPR gRNA sequence
caggaaacataagtgatcct

SEQ ID NO: 271985 - DNA, 20 bp, Artificial
  CRISPR gRNA sequence
gaaatttaagctcataactt

SEQ ID NO: 271986 - DNA, 20 bp, Artificial
  CRISPR gRNA sequence
aaatttaagctcataactta

SEQ ID NO: 271987 - DNA, 20 bp, Artificial
  CRISPR gRNA sequence
aagctcataacttatgactt

SEQ ID NO: 271988 - DNA, 20 bp, Artificial
  CRISPR gRNA sequence
agctcataacttatgacttc

SEQ ID NO: 271989 - DNA, 20 bp, Artificial
  CRISPR gRNA sequence
ataacttatgacttctaatc

SEQ ID NO: 271990 - DNA, 20 bp, Artificial
  CRISPR gRNA sequence
atgacttctaatctattgtt

SEQ ID NO: 271991 - DNA, 20 bp, Artificial
  CRISPR gRNA sequence
tgacttctaatctattgttc

SEQ ID NO: 271992 - DNA, 20 bp, Artificial
  CRISPR gRNA sequence
ctaatctattgttcatttcc

SEQ ID NO: 271993 - DNA, 20 bp, Artificial
  CRISPR gRNA sequence
taatctattgttcatttcct

SEQ ID NO: 271994 - DNA, 20 bp, Artificial
  CRISPR gRNA sequence
atctattgttcatttccttc

SEQ ID NO: 271995 - DNA, 20 bp, Artificial
  CRISPR gRNA sequence
ttgttcatttccttctgcca

SEQ ID NO: 271996 - DNA, 20 bp, Artificial
  CRISPR gRNA sequence
ttcatttccttctgccatgt

SEQ ID NO: 271997 - DNA, 20 bp, Artificial
  CRISPR gRNA sequence
atttccttctgccatgttgc

SEQ ID NO: 271998 - DNA, 20 bp, Artificial
  CRISPR gRNA sequence
ccttctgccatgttgcatca

SEQ ID NO: 271999 - DNA, 20 bp, Artificial
  CRISPR gRNA sequence
cttctgccatgttgcatcaa

SEQ ID NO: 272000 - DNA, 20 bp, Artificial
  CRISPR gRNA sequence
ctgccatgttgcatcaaaat

SEQ ID NO: 272001 - DNA, 20 bp, Artificial
  CRISPR gRNA sequence
tgccatgttgcatcaaaatt

SEQ ID NO: 272002 - DNA, 20 bp, Artificial
  CRISPR gRNA sequence
ccatgttgcatcaaaatttc

SEQ ID NO: 272003 - DNA, 20 bp, Artificial
  CRISPR gRNA sequence
catcaaaatttcaacacaat

SEQ ID NO: 272004 - DNA, 20 bp, Artificial
  CRISPR gRNA sequence
caacacaattgcagtgattg

SEQ ID NO: 272005 - DNA, 20 bp, Artificial
  CRISPR gRNA sequence
aacacaattgcagtgattgg

SEQ ID NO: 272006 - DNA, 20 bp, Artificial
  CRISPR gRNA sequence
cagtgattggttctagatcc

SEQ ID NO: 272007 - DNA, 20 bp, Artificial
  CRISPR gRNA sequence
gttctagatcctctcaaagt

SEQ ID NO: 272008 - DNA, 20 bp, Artificial
  CRISPR gRNA sequence
tagatcctctcaaagttgga

SEQ ID NO: 272009 - DNA, 20 bp, Artificial
  CRISPR gRNA sequence
gatcctctcaaagttggact

SEQ ID NO: 272010 - DNA, 20 bp, Artificial
  CRISPR gRNA sequence
tcaaagttggacttgatagg

SEQ ID NO: 272011 - DNA, 20 bp, Artificial
  CRISPR gRNA sequence
aaagttggacttgataggga

SEQ ID NO: 272012 - DNA, 20 bp, Artificial
  CRISPR gRNA sequence
gacttgatagggaggatggt

SEQ ID NO: 272013 - DNA, 20 bp, Artificial
  CRISPR gRNA sequence
gatagggaggatggtaccag

SEQ ID NO: 272014 - DNA, 20 bp, Artificial
  CRISPR gRNA sequence
atagggaggatggtaccaga

SEQ ID NO: 272015 - DNA, 20 bp, Artificial
  CRISPR gRNA sequence
gagtgagggttagggaggag

SEQ ID NO: 272016 - DNA, 20 bp, Artificial
  CRISPR gRNA sequence
gggaggagattaccattaag

SEQ ID NO: 272017 - DNA, 20 bp, Artificial
  CRISPR gRNA sequence
ccattaagtaggggagtgaa

SEQ ID NO: 272018 - DNA, 20 bp, Artificial
  CRISPR gRNA sequence
agtaggggagtgaatggaat

SEQ ID NO: 272019 - DNA, 20 bp, Artificial
  CRISPR gRNA sequence
cattttccccactattttat

SEQ ID NO: 272020 - DNA, 20 bp, Artificial
  CRISPR gRNA sequence
attttccccactattttatt

SEQ ID NO: 272021 - DNA, 20 bp, Artificial
  CRISPR gRNA sequence
tccccactattttattagag

SEQ ID NO: 272022 - DNA, 20 bp, Artificial
  CRISPR gRNA sequence
ccccactattttattagagt

SEQ ID NO: 272023 - DNA, 20 bp, Artificial
  CRISPR gRNA sequence
cccactattttattagagtc

SEQ ID NO: 272024 - DNA, 20 bp, Artificial
  CRISPR gRNA sequence
ttttattagagtcttatcct

SEQ ID NO: 272025 - DNA, 20 bp, Artificial
  CRISPR gRNA sequence
tattagagtcttatcctgca

SEQ ID NO: 272026 - DNA, 20 bp, Artificial
  CRISPR gRNA sequence
attagagtcttatcctgcaa

SEQ ID NO: 272027 - DNA, 20 bp, Artificial
  CRISPR gRNA sequence
ttagagtcttatcctgcaaa

SEQ ID NO: 272028 - DNA, 20 bp, Artificial
  CRISPR gRNA sequence
gagtcttatcctgcaaaaaa

SEQ ID NO: 272029 - DNA, 20 bp, Artificial
  CRISPR gRNA sequence
atcctgcaaaaaaccacact

SEQ ID NO: 272030 - DNA, 20 bp, Artificial
  CRISPR gRNA sequence
tcctgcaaaaaaccacactc

SEQ ID NO: 272031 - DNA, 20 bp, Artificial
  CRISPR gRNA sequence
caaaaaaccacactcaactg

SEQ ID NO: 272032 - DNA, 20 bp, Artificial
  CRISPR gRNA sequence
aactggaagggaacttggag

SEQ ID NO: 272033 - DNA, 20 bp, Artificial
  CRISPR gRNA sequence
gaagggaacttggagatgat

SEQ ID NO: 272034 - DNA, 20 bp, Artificial
  CRISPR gRNA sequence
ggagatgatctatgccaatt

SEQ ID NO: 272035 - DNA, 20 bp, Artificial
  CRISPR gRNA sequence
gagatgatctatgccaattc

SEQ ID NO: 272036 - DNA, 20 bp, Artificial
  CRISPR gRNA sequence
tgccaattccttattttaaa

SEQ ID NO: 272037 - DNA, 20 bp, Artificial
  CRISPR gRNA sequence
cttattttaaagaagaggct

SEQ ID NO: 272038 - DNA, 20 bp, Artificial
  CRISPR gRNA sequence
attttaaagaagaggctatt

SEQ ID NO: 272039 - DNA, 20 bp, Artificial
  CRISPR gRNA sequence
ttttaaagaagaggctattg

SEQ ID NO: 272040 - DNA, 20 bp, Artificial
  CRISPR gRNA sequence
taaagaagaggctattgggg

SEQ ID NO: 272041 - DNA, 20 bp, Artificial
  CRISPR gRNA sequence
aaagaagaggctattggggg

SEQ ID NO: 272042 - DNA, 20 bp, Artificial
  CRISPR gRNA sequence
aagaagaggctattgggggg

SEQ ID NO: 272043 - DNA, 20 bp, Artificial
  CRISPR gRNA sequence
ttggggggaaaaaaagagaa

SEQ ID NO: 272044 - DNA, 20 bp, Artificial
  CRISPR gRNA sequence
gggggaaaaaaagagaagaa

SEQ ID NO: 272045 - DNA, 20 bp, Artificial
  CRISPR gRNA sequence
ttcaaacaaggtcacacaaa

SEQ ID NO: 272046 - DNA, 20 bp, Artificial
  CRISPR gRNA sequence
tcaaacaaggtcacacaaat

SEQ ID NO: 272047 - DNA, 20 bp, Artificial
  CRISPR gRNA sequence
caaacaaggtcacacaaata

SEQ ID NO: 272048 - DNA, 20 bp, Artificial
  CRISPR gRNA sequence
aaacaaggtcacacaaataa

SEQ ID NO: 272049 - DNA, 20 bp, Artificial
  CRISPR gRNA sequence
agatgtaatttatttattta

SEQ ID NO: 272050 - DNA, 20 bp, Artificial
  CRISPR gRNA sequence
atttatttagacatctagga

SEQ ID NO: 272051 - DNA, 20 bp, Artificial
  CRISPR gRNA sequence
tttatttagacatctaggag

SEQ ID NO: 272052 - DNA, 20 bp, Artificial
  CRISPR gRNA sequence
atttagacatctaggagtaa

SEQ ID NO: 272053 - DNA, 20 bp, Artificial
  CRISPR gRNA sequence
tttagacatctaggagtaat

SEQ ID NO: 272054 - DNA, 20 bp, Artificial
  CRISPR gRNA sequence
agacatctaggagtaatgtt

SEQ ID NO: 272055 - DNA, 20 bp, Artificial
  CRISPR gRNA sequence
gacatctaggagtaatgttt

SEQ ID NO: 272056 - DNA, 20 bp, Artificial
  CRISPR gRNA sequence
ggagtaatgttttaaatcat

SEQ ID NO: 272057 - DNA, 20 bp, Artificial
  CRISPR gRNA sequence
taaatcataaatggacagaa

SEQ ID NO: 272058 - DNA, 20 bp, Artificial
  CRISPR gRNA sequence
aaatcataaatggacagaaa

SEQ ID NO: 272059 - DNA, 20 bp, Artificial
  CRISPR gRNA sequence
aatcataaatggacagaaaa

SEQ ID NO: 272060 - DNA, 20 bp, Artificial
  CRISPR gRNA sequence
tgttcattcagcaagactga

SEQ ID NO: 272061 - DNA, 20 bp, Artificial
  CRISPR gRNA sequence
gttcattcagcaagactgaa

SEQ ID NO: 272062 - DNA, 20 bp, Artificial
  CRISPR gRNA sequence
ttcattcagcaagactgaat

SEQ ID NO: 272063 - DNA, 20 bp, Artificial
  CRISPR gRNA sequence
attcagcaagactgaattta

SEQ ID NO: 272064 - DNA, 20 bp, Artificial
  CRISPR gRNA sequence
agcaagactgaatttatttc

SEQ ID NO: 272065 - DNA, 20 bp, Artificial
  CRISPR gRNA sequence
aatttatttcatgctcatat

SEQ ID NO: 272066 - DNA, 20 bp, Artificial
  CRISPR gRNA sequence
atttcatgctcatatctaga

SEQ ID NO: 272067 - DNA, 20 bp, Artificial
  CRISPR gRNA sequence
tttcatgctcatatctagaa

SEQ ID NO: 272068 - DNA, 20 bp, Artificial
  CRISPR gRNA sequence
catgctcatatctagaaaaa

SEQ ID NO: 272069 - DNA, 20 bp, Artificial
  CRISPR gRNA sequence
atgctcatatctagaaaaaa

SEQ ID NO: 272070 - DNA, 20 bp, Artificial
  CRISPR gRNA sequence
atatctagaaaaaaatacat

SEQ ID NO: 272071 - DNA, 20 bp, Artificial
  CRISPR gRNA sequence
gaaaaaaatacatttccaaa

SEQ ID NO: 272072 - DNA, 20 bp, Artificial
  CRISPR gRNA sequence
ccaaattttttgcctctaat

SEQ ID NO: 272073 - DNA, 20 bp, Artificial
  CRISPR gRNA sequence
caaattttttgcctctaatg

SEQ ID NO: 272074 - DNA, 20 bp, Artificial
  CRISPR gRNA sequence
tttgcctctaatgcacatat

SEQ ID NO: 272075 - DNA, 20 bp, Artificial
  CRISPR gRNA sequence
ttgcctctaatgcacatata

SEQ ID NO: 272076 - DNA, 20 bp, Artificial
  CRISPR gRNA sequence
tgcctctaatgcacatatac

SEQ ID NO: 272077 - DNA, 20 bp, Artificial
  CRISPR gRNA sequence
gcctctaatgcacatataca

SEQ ID NO: 272078 - DNA, 20 bp, Artificial
  CRISPR gRNA sequence
cctctaatgcacatatacaa

SEQ ID NO: 272079 - DNA, 20 bp, Artificial
  CRISPR gRNA sequence
taatgcacatatacaaaaca

SEQ ID NO: 272080 - DNA, 20 bp, Artificial
  CRISPR gRNA sequence
atgcacatatacaaaacatt

SEQ ID NO: 272081 - DNA, 20 bp, Artificial
  CRISPR gRNA sequence
tgcttacaattttgaagatt

SEQ ID NO: 272082 - DNA, 20 bp, Artificial
  CRISPR gRNA sequence
gcttacaattttgaagattt

SEQ ID NO: 272083 - DNA, 20 bp, Artificial
  CRISPR gRNA sequence
cttacaattttgaagatttc

SEQ ID NO: 272084 - DNA, 20 bp, Artificial
  CRISPR gRNA sequence
acaattttgaagatttcctg

SEQ ID NO: 272085 - DNA, 20 bp, Artificial
  CRISPR gRNA sequence
caattttgaagatttcctga

SEQ ID NO: 272086 - DNA, 20 bp, Artificial
  CRISPR gRNA sequence
tgaagatttcctgaaggtca

SEQ ID NO: 272087 - DNA, 20 bp, Artificial
  CRISPR gRNA sequence
gaagatttcctgaaggtcat

SEQ ID NO: 272088 - DNA, 20 bp, Artificial
  CRISPR gRNA sequence
aagatttcctgaaggtcata

SEQ ID NO: 272089 - DNA, 20 bp, Artificial
  CRISPR gRNA sequence
cctgaaggtcatagatggat

SEQ ID NO: 272090 - DNA, 20 bp, Artificial
  CRISPR gRNA sequence
ctgaaggtcatagatggatc

SEQ ID NO: 272091 - DNA, 20 bp, Artificial
  CRISPR gRNA sequence
aaggtcatagatggatccca

SEQ ID NO: 272092 - DNA, 20 bp, Artificial
  CRISPR gRNA sequence
acagacagtatgatcacatc

SEQ ID NO: 272093 - DNA, 20 bp, Artificial
  CRISPR gRNA sequence
cagacagtatgatcacatca

SEQ ID NO: 272094 - DNA, 20 bp, Artificial
  CRISPR gRNA sequence
ataaattatttctgatgcac

SEQ ID NO: 272095 - DNA, 20 bp, Artificial
  CRISPR gRNA sequence
taaattatttctgatgcaca

SEQ ID NO: 272096 - DNA, 20 bp, Artificial
  CRISPR gRNA sequence
tttctgatgcacaagtaata

SEQ ID NO: 272097 - DNA, 20 bp, Artificial
  CRISPR gRNA sequence
ctgatgcacaagtaataatt

SEQ ID NO: 272098 - DNA, 20 bp, Artificial
  CRISPR gRNA sequence
tgatgcacaagtaataatta

SEQ ID NO: 272099 - DNA, 20 bp, Artificial
  CRISPR gRNA sequence
atgcacaagtaataattata

SEQ ID NO: 272100 - DNA, 20 bp, Artificial
  CRISPR gRNA sequence
taccattgagatcttccatt

SEQ ID NO: 272101 - DNA, 20 bp, Artificial
  CRISPR gRNA sequence
agatcttccattctagctta

SEQ ID NO: 272102 - DNA, 20 bp, Artificial
  CRISPR gRNA sequence
ccattctagcttacccaagt

SEQ ID NO: 272103 - DNA, 20 bp, Artificial
  CRISPR gRNA sequence
cattctagcttacccaagta

SEQ ID NO: 272104 - DNA, 20 bp, Artificial
  CRISPR gRNA sequence
tagcttacccaagtatacaa

SEQ ID NO: 272105 - DNA, 20 bp, Artificial
  CRISPR gRNA sequence
gcttacccaagtatacaaaa

SEQ ID NO: 272106 - DNA, 20 bp, Artificial
  CRISPR gRNA sequence
acccaagtatacaaaaggga

SEQ ID NO: 272107 - DNA, 20 bp, Artificial
  CRISPR gRNA sequence
cccaagtatacaaaagggat

SEQ ID NO: 272108 - DNA, 20 bp, Artificial
  CRISPR gRNA sequence
aacatagacatgagtcaaca

SEQ ID NO: 272109 - DNA, 20 bp, Artificial
  CRISPR gRNA sequence
cagtctgaacttcactagga

SEQ ID NO: 272110 - DNA, 20 bp, Artificial
  CRISPR gRNA sequence
agtctgaacttcactaggaa

SEQ ID NO: 272111 - DNA, 20 bp, Artificial
  CRISPR gRNA sequence
aacttcactaggaaaatcct

SEQ ID NO: 272112 - DNA, 20 bp, Artificial
  CRISPR gRNA sequence
cactaggaaaatccttaact

SEQ ID NO: 272113 - DNA, 20 bp, Artificial
  CRISPR gRNA sequence
actaggaaaatccttaactt

SEQ ID NO: 272114 - DNA, 20 bp, Artificial
  CRISPR gRNA sequence
ggaaaatccttaacttcagg

SEQ ID NO: 272115 - DNA, 20 bp, Artificial
  CRISPR gRNA sequence
aacttcagggcttttgtgaa

SEQ ID NO: 272116 - DNA, 20 bp, Artificial
  CRISPR gRNA sequence
acttcagggcttttgtgaat

SEQ ID NO: 272117 - DNA, 20 bp, Artificial
  CRISPR gRNA sequence
cagggcttttgtgaattaca

SEQ ID NO: 272118 - DNA, 20 bp, Artificial
  CRISPR gRNA sequence
agggcttttgtgaattacat

SEQ ID NO: 272119 - DNA, 20 bp, Artificial
  CRISPR gRNA sequence
ttgtgaattacatttgtttg

SEQ ID NO: 272120 - DNA, 20 bp, Artificial
  CRISPR gRNA sequence
tgtgaattacatttgtttgt

SEQ ID NO: 272121 - DNA, 20 bp, Artificial
  CRISPR gRNA sequence
gtgaattacatttgtttgtc

SEQ ID NO: 272122 - DNA, 20 bp, Artificial
  CRISPR gRNA sequence
tgaattacatttgtttgtca

SEQ ID NO: 272123 - DNA, 20 bp, Artificial
  CRISPR gRNA sequence
catttgtttgtcatagtttt

SEQ ID NO: 272124 - DNA, 20 bp, Artificial
  CRISPR gRNA sequence
gtttgtcatagtttttcctt

SEQ ID NO: 272125 - DNA, 20 bp, Artificial
  CRISPR gRNA sequence
tttgtcatagtttttccttt

SEQ ID NO: 272126 - DNA, 20 bp, Artificial
  CRISPR gRNA sequence
gtcatagtttttccttttct

SEQ ID NO: 272127 - DNA, 20 bp, Artificial
  CRISPR gRNA sequence
tcatagtttttccttttctt

SEQ ID NO: 272128 - DNA, 20 bp, Artificial
  CRISPR gRNA sequence
ttccttttctttatcgtagc

SEQ ID NO: 272129 - DNA, 20 bp, Artificial
  CRISPR gRNA sequence
tccttttctttatcgtagca

SEQ ID NO: 272130 - DNA, 20 bp, Artificial
  CRISPR gRNA sequence
ccttttctttatcgtagcac

SEQ ID NO: 272131 - DNA, 20 bp, Artificial
  CRISPR gRNA sequence
cttttctttatcgtagcacc

SEQ ID NO: 272132 - DNA, 20 bp, Artificial
  CRISPR gRNA sequence
ttctttatcgtagcaccata

SEQ ID NO: 272133 - DNA, 20 bp, Artificial
  CRISPR gRNA sequence
tctttatcgtagcaccatag

SEQ ID NO: 272134 - DNA, 20 bp, Artificial
  CRISPR gRNA sequence
ctttatcgtagcaccataga

SEQ ID NO: 272135 - DNA, 20 bp, Artificial
  CRISPR gRNA sequence
tttatcgtagcaccatagag

SEQ ID NO: 272136 - DNA, 20 bp, Artificial
  CRISPR gRNA sequence
tatcgtagcaccatagagaa

SEQ ID NO: 272137 - DNA, 20 bp, Artificial
  CRISPR gRNA sequence
atcgtagcaccatagagaaa

SEQ ID NO: 272138 - DNA, 20 bp, Artificial
  CRISPR gRNA sequence
tcgtagcaccatagagaaat

SEQ ID NO: 272139 - DNA, 20 bp, Artificial
  CRISPR gRNA sequence
ggaagctaaagaagcagtta

SEQ ID NO: 272140 - DNA, 20 bp, Artificial
  CRISPR gRNA sequence
aagaagcagttagagagctg

SEQ ID NO: 272141 - DNA, 20 bp, Artificial
  CRISPR gRNA sequence
gagagctggaatacatgatt

SEQ ID NO: 272142 - DNA, 20 bp, Artificial
  CRISPR gRNA sequence
gaatacatgattaattagca

SEQ ID NO: 272143 - DNA, 20 bp, Artificial
  CRISPR gRNA sequence
attagcaaaatgtgattttc

SEQ ID NO: 272144 - DNA, 20 bp, Artificial
  CRISPR gRNA sequence
gcaaaatgtgattttcctcc

SEQ ID NO: 272145 - DNA, 20 bp, Artificial
  CRISPR gRNA sequence
tcctccagaatctttaagaa

SEQ ID NO: 272146 - DNA, 20 bp, Artificial
  CRISPR gRNA sequence
cctccagaatctttaagaac

SEQ ID NO: 272147 - DNA, 20 bp, Artificial
  CRISPR gRNA sequence
ctccagaatctttaagaact

SEQ ID NO: 272148 - DNA, 20 bp, Artificial
  CRISPR gRNA sequence
cagaatctttaagaacttta

SEQ ID NO: 272149 - DNA, 20 bp, Artificial
  CRISPR gRNA sequence
taagaactttatcaggttcc

SEQ ID NO: 272150 - DNA, 20 bp, Artificial
  CRISPR gRNA sequence
aagaactttatcaggttcca

SEQ ID NO: 272151 - DNA, 20 bp, Artificial
  CRISPR gRNA sequence
agaactttatcaggttccat

SEQ ID NO: 272152 - DNA, 20 bp, Artificial
  CRISPR gRNA sequence
tatcaggttccatttatgca

SEQ ID NO: 272153 - DNA, 20 bp, Artificial
  CRISPR gRNA sequence
atcaggttccatttatgcac

SEQ ID NO: 272154 - DNA, 20 bp, Artificial
  CRISPR gRNA sequence
tcaggttccatttatgcaca

SEQ ID NO: 272155 - DNA, 20 bp, Artificial
  CRISPR gRNA sequence
catttatgcacatcatagtc

SEQ ID NO: 272156 - DNA, 20 bp, Artificial
  CRISPR gRNA sequence
atgcacatcatagtctgact

SEQ ID NO: 272157 - DNA, 20 bp, Artificial
  CRISPR gRNA sequence
tgcacatcatagtctgactt

SEQ ID NO: 272158 - DNA, 20 bp, Artificial
  CRISPR gRNA sequence
actttcttttgcagttgaaa

SEQ ID NO: 272159 - DNA, 20 bp, Artificial
  CRISPR gRNA sequence
tcttttgcagttgaaaaatc

SEQ ID NO: 272160 - DNA, 20 bp, Artificial
  CRISPR gRNA sequence
cttttgcagttgaaaaatca

SEQ ID NO: 272161 - DNA, 20 bp, Artificial
  CRISPR gRNA sequence
ttttgcagttgaaaaatcag

SEQ ID NO: 272162 - DNA, 20 bp, Artificial
  CRISPR gRNA sequence
ttgcagttgaaaaatcaggt

SEQ ID NO: 272163 - DNA, 20 bp, Artificial
  CRISPR gRNA sequence
tgcagttgaaaaatcaggtt

SEQ ID NO: 272164 - DNA, 20 bp, Artificial
  CRISPR gRNA sequence
gcagttgaaaaatcaggttg

SEQ ID NO: 272165 - DNA, 20 bp, Artificial
  CRISPR gRNA sequence
cagttgaaaaatcaggttgt

SEQ ID NO: 272166 - DNA, 20 bp, Artificial
  CRISPR gRNA sequence
aaaaatcaggttgtaagatt

SEQ ID NO: 272167 - DNA, 20 bp, Artificial
  CRISPR gRNA sequence
taagattctaattatcttgt

SEQ ID NO: 272168 - DNA, 20 bp, Artificial
  CRISPR gRNA sequence
taattatcttgtttcctttt

SEQ ID NO: 272169 - DNA, 20 bp, Artificial
  CRISPR gRNA sequence
attatcttgtttccttttaa

SEQ ID NO: 272170 - DNA, 20 bp, Artificial
  CRISPR gRNA sequence
tcttgtttccttttaaaaat

SEQ ID NO: 272171 - DNA, 20 bp, Artificial
  CRISPR gRNA sequence
gtttccttttaaaaattcgg

SEQ ID NO: 272172 - DNA, 20 bp, Artificial
  CRISPR gRNA sequence
tttccttttaaaaattcgga

SEQ ID NO: 272173 - DNA, 20 bp, Artificial
  CRISPR gRNA sequence
ccttttaaaaattcggactg

SEQ ID NO: 272174 - DNA, 20 bp, Artificial
  CRISPR gRNA sequence
cttttaaaaattcggactga

SEQ ID NO: 272175 - DNA, 20 bp, Artificial
  CRISPR gRNA sequence
ttaaaaattcggactgaaca

SEQ ID NO: 272176 - DNA, 20 bp, Artificial
  CRISPR gRNA sequence
taaaaattcggactgaacag

SEQ ID NO: 272177 - DNA, 20 bp, Artificial
  CRISPR gRNA sequence
aaaaattcggactgaacaga

SEQ ID NO: 272178 - DNA, 20 bp, Artificial
  CRISPR gRNA sequence
aaaattcggactgaacagaa

SEQ ID NO: 272179 - DNA, 20 bp, Artificial
  CRISPR gRNA sequence
ggactgaacagaatttcaca

SEQ ID NO: 272180 - DNA, 20 bp, Artificial
  CRISPR gRNA sequence
aacagaatttcacatgttag

SEQ ID NO: 272181 - DNA, 20 bp, Artificial
  CRISPR gRNA sequence
cacatgttaggtaggaacca

SEQ ID NO: 272182 - DNA, 20 bp, Artificial
  CRISPR gRNA sequence
acatgttaggtaggaaccaa

SEQ ID NO: 272183 - DNA, 20 bp, Artificial
  CRISPR gRNA sequence
ggtaggaaccaaaaacaatg

SEQ ID NO: 272184 - DNA, 20 bp, Artificial
  CRISPR gRNA sequence
ctactttcagccattttgcc

SEQ ID NO: 272185 - DNA, 20 bp, Artificial
  CRISPR gRNA sequence
tactttcagccattttgccc

SEQ ID NO: 272186 - DNA, 20 bp, Artificial
  CRISPR gRNA sequence
ctttcagccattttgccctg

SEQ ID NO: 272187 - DNA, 20 bp, Artificial
  CRISPR gRNA sequence
tcagccattttgccctgtga

SEQ ID NO: 272188 - DNA, 20 bp, Artificial
  CRISPR gRNA sequence
cagccattttgccctgtgat

SEQ ID NO: 272189 - DNA, 20 bp, Artificial
  CRISPR gRNA sequence
agccattttgccctgtgata

SEQ ID NO: 272190 - DNA, 20 bp, Artificial
  CRISPR gRNA sequence
tgccctgtgatatttgtgag

SEQ ID NO: 272191 - DNA, 20 bp, Artificial
  CRISPR gRNA sequence
gccctgtgatatttgtgagc

SEQ ID NO: 272192 - DNA, 20 bp, Artificial
  CRISPR gRNA sequence
ccctgtgatatttgtgagca

SEQ ID NO: 272193 - DNA, 20 bp, Artificial
  CRISPR gRNA sequence
tgatatttgtgagcacactg

SEQ ID NO: 272194 - DNA, 20 bp, Artificial
  CRISPR gRNA sequence
gtgagcacactgtgaaggtg

SEQ ID NO: 272195 - DNA, 20 bp, Artificial
  CRISPR gRNA sequence
tgagcacactgtgaaggtga

SEQ ID NO: 272196 - DNA, 20 bp, Artificial
  CRISPR gRNA sequence
tgaaggtgatgctgatttcc

SEQ ID NO: 272197 - DNA, 20 bp, Artificial
  CRISPR gRNA sequence
atttccctggcatagaagag

SEQ ID NO: 272198 - DNA, 20 bp, Artificial
  CRISPR gRNA sequence
ccctggcatagaagagcacc

SEQ ID NO: 272199 - DNA, 20 bp, Artificial
  CRISPR gRNA sequence
cctggcatagaagagcacct

SEQ ID NO: 272200 - DNA, 20 bp, Artificial
  CRISPR gRNA sequence
gcatagaagagcacctccct

SEQ ID NO: 272201 - DNA, 20 bp, Artificial
  CRISPR gRNA sequence
cctcctgaccacagagctag

SEQ ID NO: 272202 - DNA, 20 bp, Artificial
  CRISPR gRNA sequence
ctgaccacagagctagttaa

SEQ ID NO: 272203 - DNA, 20 bp, Artificial
  CRISPR gRNA sequence
accacagagctagttaagtt

SEQ ID NO: 272204 - DNA, 20 bp, Artificial
  CRISPR gRNA sequence
gttaagttactgtaactttc

SEQ ID NO: 272205 - DNA, 20 bp, Artificial
  CRISPR gRNA sequence
agttactgtaactttcctct

SEQ ID NO: 272206 - DNA, 20 bp, Artificial
  CRISPR gRNA sequence
ctgtaactttcctctgagta

SEQ ID NO: 272207 - DNA, 20 bp, Artificial
  CRISPR gRNA sequence
taactttcctctgagtatat

SEQ ID NO: 272208 - DNA, 20 bp, Artificial
  CRISPR gRNA sequence
tcctctgagtatatttcctg

SEQ ID NO: 272209 - DNA, 20 bp, Artificial
  CRISPR gRNA sequence
cctctgagtatatttcctgt

SEQ ID NO: 272210 - DNA, 20 bp, Artificial
  CRISPR gRNA sequence
ctctgagtatatttcctgtt

SEQ ID NO: 272211 - DNA, 20 bp, Artificial
  CRISPR gRNA sequence
tgagtatatttcctgttcag

SEQ ID NO: 272212 - DNA, 20 bp, Artificial
  CRISPR gRNA sequence
agtatatttcctgttcaggc

SEQ ID NO: 272213 - DNA, 20 bp, Artificial
  CRISPR gRNA sequence
cctgttcaggcccaggatgc

SEQ ID NO: 272214 - DNA, 20 bp, Artificial
  CRISPR gRNA sequence
ctgttcaggcccaggatgcc

SEQ ID NO: 272215 - DNA, 20 bp, Artificial
  CRISPR gRNA sequence
ttcaggcccaggatgccctt

SEQ ID NO: 272216 - DNA, 20 bp, Artificial
  CRISPR gRNA sequence
aggcccaggatgcccttcaa

SEQ ID NO: 272217 - DNA, 20 bp, Artificial
  CRISPR gRNA sequence
caacacgtgaccatctgacc

SEQ ID NO: 272218 - DNA, 20 bp, Artificial
  CRISPR gRNA sequence
aacacgtgaccatctgacca

SEQ ID NO: 272219 - DNA, 20 bp, Artificial
  CRISPR gRNA sequence
accactggctccttttcagg

SEQ ID NO: 272220 - DNA, 20 bp, Artificial
  CRISPR gRNA sequence
gctccttttcaggctctgta

SEQ ID NO: 272221 - DNA, 20 bp, Artificial
  CRISPR gRNA sequence
cttttcaggctctgtaaggg

SEQ ID NO: 272222 - DNA, 20 bp, Artificial
  CRISPR gRNA sequence
ttcaggctctgtaaggggta

SEQ ID NO: 272223 - DNA, 20 bp, Artificial
  CRISPR gRNA sequence
tcaggctctgtaaggggtag

SEQ ID NO: 272224 - DNA, 20 bp, Artificial
  CRISPR gRNA sequence
caggctctgtaaggggtagg

SEQ ID NO: 272225 - DNA, 20 bp, Artificial
  CRISPR gRNA sequence
aggctctgtaaggggtaggc

SEQ ID NO: 272226 - DNA, 20 bp, Artificial
  CRISPR gRNA sequence
tgtaaggggtaggctccccc

SEQ ID NO: 272227 - DNA, 20 bp, Artificial
  CRISPR gRNA sequence
taaggggtaggctcccccac

SEQ ID NO: 272228 - DNA, 20 bp, Artificial
  CRISPR gRNA sequence
ccccacaagacaacccggtg

SEQ ID NO: 272229 - DNA, 20 bp, Artificial
  CRISPR gRNA sequence
ctcaggaaactgtgagacaa

SEQ ID NO: 272230 - DNA, 20 bp, Artificial
  CRISPR gRNA sequence
aggaaactgtgagacaaacc

SEQ ID NO: 272231 - DNA, 20 bp, Artificial
  CRISPR gRNA sequence
tgagacaaaccgtgctccct

SEQ ID NO: 272232 - DNA, 20 bp, Artificial
  CRISPR gRNA sequence
cctgagaagaaagggggact

SEQ ID NO: 272233 - DNA, 20 bp, Artificial
  CRISPR gRNA sequence
agaagaaagggggactcaac

SEQ ID NO: 272234 - DNA, 20 bp, Artificial
  CRISPR gRNA sequence
aacagtctatggctctgata

SEQ ID NO: 272235 - DNA, 20 bp, Artificial
  CRISPR gRNA sequence
tggctctgataaccttagct

SEQ ID NO: 272236 - DNA, 20 bp, Artificial
  CRISPR gRNA sequence
tgataaccttagctggtggc

SEQ ID NO: 272237 - DNA, 20 bp, Artificial
  CRISPR gRNA sequence
ataaccttagctggtggcct

SEQ ID NO: 272238 - DNA, 20 bp, Artificial
  CRISPR gRNA sequence
agctggtggcctggcttcct

SEQ ID NO: 272239 - DNA, 20 bp, Artificial
  CRISPR gRNA sequence
gctggtggcctggcttcctt

SEQ ID NO: 272240 - DNA, 20 bp, Artificial
  CRISPR gRNA sequence
gtggcctggcttccttctga

SEQ ID NO: 272241 - DNA, 20 bp, Artificial
  CRISPR gRNA sequence
gcttccttctgataagagaa

SEQ ID NO: 272242 - DNA, 20 bp, Artificial
  CRISPR gRNA sequence
ccttctgataagagaaagag

SEQ ID NO: 272243 - DNA, 20 bp, Artificial
  CRISPR gRNA sequence
cttctgataagagaaagaga

SEQ ID NO: 272244 - DNA, 20 bp, Artificial
  CRISPR gRNA sequence
ctgataagagaaagagaagt

SEQ ID NO: 272245 - DNA, 20 bp, Artificial
  CRISPR gRNA sequence
tgataagagaaagagaagta

SEQ ID NO: 272246 - DNA, 20 bp, Artificial
  CRISPR gRNA sequence
ataagagaaagagaagtaca

SEQ ID NO: 272247 - DNA, 20 bp, Artificial
  CRISPR gRNA sequence
accagactgtagcacctttc

SEQ ID NO: 272248 - DNA, 20 bp, Artificial
  CRISPR gRNA sequence
tagcacctttcaccatcctc

SEQ ID NO: 272249 - DNA, 20 bp, Artificial
  CRISPR gRNA sequence
tcaccatcctctctgagctg

SEQ ID NO: 272250 - DNA, 20 bp, Artificial
  CRISPR gRNA sequence
caccatcctctctgagctgc

SEQ ID NO: 272251 - DNA, 20 bp, Artificial
  CRISPR gRNA sequence
accatcctctctgagctgca

SEQ ID NO: 272252 - DNA, 20 bp, Artificial
  CRISPR gRNA sequence
tctgagctgcaatgaagata

SEQ ID NO: 272253 - DNA, 20 bp, Artificial
  CRISPR gRNA sequence
tgagctgcaatgaagataaa

SEQ ID NO: 272254 - DNA, 20 bp, Artificial
  CRISPR gRNA sequence
agctgcaatgaagataaaaa

SEQ ID NO: 272255 - DNA, 20 bp, Artificial
  CRISPR gRNA sequence
caatgaagataaaaacaaag

SEQ ID NO: 272256 - DNA, 20 bp, Artificial
  CRISPR gRNA sequence
ttcatgacctaccatgcttt

SEQ ID NO: 272257 - DNA, 20 bp, Artificial
  CRISPR gRNA sequence
atgacctaccatgctttgaa

SEQ ID NO: 272258 - DNA, 20 bp, Artificial
  CRISPR gRNA sequence
ccatgctttgaatggaccca

SEQ ID NO: 272259 - DNA, 20 bp, Artificial
  CRISPR gRNA sequence
tgaatggacccagcctctct

SEQ ID NO: 272260 - DNA, 20 bp, Artificial
  CRISPR gRNA sequence
gaatggacccagcctctctc

SEQ ID NO: 272261 - DNA, 20 bp, Artificial
  CRISPR gRNA sequence
aatggacccagcctctctct

SEQ ID NO: 272262 - DNA, 20 bp, Artificial
  CRISPR gRNA sequence
tctctcccagaaattcatgt

SEQ ID NO: 272263 - DNA, 20 bp, Artificial
  CRISPR gRNA sequence
tctcccagaaattcatgtta

SEQ ID NO: 272264 - DNA, 20 bp, Artificial
  CRISPR gRNA sequence
tcccagaaattcatgttaaa

SEQ ID NO: 272265 - DNA, 20 bp, Artificial
  CRISPR gRNA sequence
ccagaaattcatgttaaaat

SEQ ID NO: 272266 - DNA, 20 bp, Artificial
  CRISPR gRNA sequence
atgttaaaatgaaaaaatgg

SEQ ID NO: 272267 - DNA, 20 bp, Artificial
  CRISPR gRNA sequence
aaatgaaaaaatggtaataa

SEQ ID NO: 272268 - DNA, 20 bp, Artificial
  CRISPR gRNA sequence
tggtttaaaaataattctgt

SEQ ID NO: 272269 - DNA, 20 bp, Artificial
  CRISPR gRNA sequence
aaaaataattctgtggtcat

SEQ ID NO: 272270 - DNA, 20 bp, Artificial
  CRISPR gRNA sequence
aaaataattctgtggtcatt

SEQ ID NO: 272271 - DNA, 20 bp, Artificial
  CRISPR gRNA sequence
tgtggtcatttcatctagtt

SEQ ID NO: 272272 - DNA, 20 bp, Artificial
  CRISPR gRNA sequence
tggtcatttcatctagtttt

SEQ ID NO: 272273 - DNA, 20 bp, Artificial
  CRISPR gRNA sequence
catctagttttctgttgact

SEQ ID NO: 272274 - DNA, 20 bp, Artificial
  CRISPR gRNA sequence
atctagttttctgttgactg

SEQ ID NO: 272275 - DNA, 20 bp, Artificial
  CRISPR gRNA sequence
gttttctgttgactgttatc

SEQ ID NO: 272276 - DNA, 20 bp, Artificial
  CRISPR gRNA sequence
tctgttgactgttatcttga

SEQ ID NO: 272277 - DNA, 20 bp, Artificial
  CRISPR gRNA sequence
ctgttgactgttatcttgaa

SEQ ID NO: 272278 - DNA, 20 bp, Artificial
  CRISPR gRNA sequence
tgttgactgttatcttgaaa

SEQ ID NO: 272279 - DNA, 20 bp, Artificial
  CRISPR gRNA sequence
ttgactgttatcttgaaagt

SEQ ID NO: 272280 - DNA, 20 bp, Artificial
  CRISPR gRNA sequence
actgttatcttgaaagtctt

SEQ ID NO: 272281 - DNA, 20 bp, Artificial
  CRISPR gRNA sequence
ttatcttgaaagtcttccca

SEQ ID NO: 272282 - DNA, 20 bp, Artificial
  CRISPR gRNA sequence
tcttgaaagtcttcccattt

SEQ ID NO: 272283 - DNA, 20 bp, Artificial
  CRISPR gRNA sequence
gaaagtcttcccattttcac

SEQ ID NO: 272284 - DNA, 20 bp, Artificial
  CRISPR gRNA sequence
aaagtcttcccattttcaca

SEQ ID NO: 272285 - DNA, 20 bp, Artificial
  CRISPR gRNA sequence
cccattttcacaagaaatga

SEQ ID NO: 272286 - DNA, 20 bp, Artificial
  CRISPR gRNA sequence
ccattttcacaagaaatgaa

SEQ ID NO: 272287 - DNA, 20 bp, Artificial
  CRISPR gRNA sequence
tcacaagaaatgaagattta

SEQ ID NO: 272288 - DNA, 20 bp, Artificial
  CRISPR gRNA sequence
cacaagaaatgaagatttaa

SEQ ID NO: 272289 - DNA, 20 bp, Artificial
  CRISPR gRNA sequence
acaagaaatgaagatttaag

SEQ ID NO: 272290 - DNA, 20 bp, Artificial
  CRISPR gRNA sequence
aaggaaaatctcttcacaca

SEQ ID NO: 272291 - DNA, 20 bp, Artificial
  CRISPR gRNA sequence
aggaaaatctcttcacacag

SEQ ID NO: 272292 - DNA, 20 bp, Artificial
  CRISPR gRNA sequence
ttcacacagaaaaagggggc

SEQ ID NO: 272293 - DNA, 20 bp, Artificial
  CRISPR gRNA sequence
cacacagaaaaagggggctt

SEQ ID NO: 272294 - DNA, 20 bp, Artificial
  CRISPR gRNA sequence
acacagaaaaagggggcttt

SEQ ID NO: 272295 - DNA, 20 bp, Artificial
  CRISPR gRNA sequence
tgaataagcttgataaacat

SEQ ID NO: 272296 - DNA, 20 bp, Artificial
  CRISPR gRNA sequence
gaataagcttgataaacatg

SEQ ID NO: 272297 - DNA, 20 bp, Artificial
  CRISPR gRNA sequence
aataagcttgataaacatgc

SEQ ID NO: 272298 - DNA, 20 bp, Artificial
  CRISPR gRNA sequence
gataaacatgcatatacagt

SEQ ID NO: 272299 - DNA, 20 bp, Artificial
  CRISPR gRNA sequence
ataaacatgcatatacagtg

SEQ ID NO: 272300 - DNA, 20 bp, Artificial
  CRISPR gRNA sequence
tggatccatggggtgttggt

SEQ ID NO: 272301 - DNA, 20 bp, Artificial
  CRISPR gRNA sequence
gatccatggggtgttggttc

SEQ ID NO: 272302 - DNA, 20 bp, Artificial
  CRISPR gRNA sequence
gttccaggacccctgcagat

SEQ ID NO: 272303 - DNA, 20 bp, Artificial
  CRISPR gRNA sequence
caggacccctgcagatacca

SEQ ID NO: 272304 - DNA, 20 bp, Artificial
  CRISPR gRNA sequence
cagataccaaaatccatgga

SEQ ID NO: 272305 - DNA, 20 bp, Artificial
  CRISPR gRNA sequence
aagtcatgcaattgttggtc

SEQ ID NO: 272306 - DNA, 20 bp, Artificial
  CRISPR gRNA sequence
ttggtcctctgtatccatag

SEQ ID NO: 272307 - DNA, 20 bp, Artificial
  CRISPR gRNA sequence
gtcctctgtatccatagatt

SEQ ID NO: 272308 - DNA, 20 bp, Artificial
  CRISPR gRNA sequence
tgtatccatagattctgcat

SEQ ID NO: 272309 - DNA, 20 bp, Artificial
  CRISPR gRNA sequence
tatccatagattctgcatcc

SEQ ID NO: 272310 - DNA, 20 bp, Artificial
  CRISPR gRNA sequence
tgcatcccacaaatactgtt

SEQ ID NO: 272311 - DNA, 20 bp, Artificial
  CRISPR gRNA sequence
catcccacaaatactgtttt

SEQ ID NO: 272312 - DNA, 20 bp, Artificial
  CRISPR gRNA sequence
tttttgatccatggttcatt

SEQ ID NO: 272313 - DNA, 20 bp, Artificial
  CRISPR gRNA sequence
ttgatccatggttcattgaa

SEQ ID NO: 272314 - DNA, 20 bp, Artificial
  CRISPR gRNA sequence
tgatccatggttcattgaat

SEQ ID NO: 272315 - DNA, 20 bp, Artificial
  CRISPR gRNA sequence
gatccatggttcattgaatc

SEQ ID NO: 272316 - DNA, 20 bp, Artificial
  CRISPR gRNA sequence
atccatggttcattgaatcc

SEQ ID NO: 272317 - DNA, 20 bp, Artificial
  CRISPR gRNA sequence
attgaatccaaagatgcata

SEQ ID NO: 272318 - DNA, 20 bp, Artificial
  CRISPR gRNA sequence
aatccaaagatgcataaccc

SEQ ID NO: 272319 - DNA, 20 bp, Artificial
  CRISPR gRNA sequence
tatgttgtctcattccagat

SEQ ID NO: 272320 - DNA, 20 bp, Artificial
  CRISPR gRNA sequence
tctcattccagatcccaaat

SEQ ID NO: 272321 - DNA, 20 bp, Artificial
  CRISPR gRNA sequence
attccagatcccaaatgaaa

SEQ ID NO: 272322 - DNA, 20 bp, Artificial
  CRISPR gRNA sequence
cagatcccaaatgaaaacag

SEQ ID NO: 272323 - DNA, 20 bp, Artificial
  CRISPR gRNA sequence
ggcaagagtaggaaggttat

SEQ ID NO: 272324 - DNA, 20 bp, Artificial
  CRISPR gRNA sequence
tttatgaaaggactgttggc

SEQ ID NO: 272325 - DNA, 20 bp, Artificial
  CRISPR gRNA sequence
atgaaaggactgttggcaaa

SEQ ID NO: 272326 - DNA, 20 bp, Artificial
  CRISPR gRNA sequence
tgaaaggactgttggcaaag

SEQ ID NO: 272327 - DNA, 20 bp, Artificial
  CRISPR gRNA sequence
ttggcaaaggtgtggcaaga

SEQ ID NO: 272328 - DNA, 20 bp, Artificial
  CRISPR gRNA sequence
gcaaaggtgtggcaagagca

SEQ ID NO: 272329 - DNA, 20 bp, Artificial
  CRISPR gRNA sequence
tgacttgcagcagcagaatt

SEQ ID NO: 272330 - DNA, 20 bp, Artificial
  CRISPR gRNA sequence
gcagcagcagaattatgacc

SEQ ID NO: 272331 - DNA, 20 bp, Artificial
  CRISPR gRNA sequence
cagcagcagaattatgacca

SEQ ID NO: 272332 - DNA, 20 bp, Artificial
  CRISPR gRNA sequence
tgaccacccttaggtcgaaa

SEQ ID NO: 272333 - DNA, 20 bp, Artificial
  CRISPR gRNA sequence
aggtcgaaagagaccagggg

SEQ ID NO: 272334 - DNA, 20 bp, Artificial
  CRISPR gRNA sequence
ggtcgaaagagaccagggga

SEQ ID NO: 272335 - DNA, 20 bp, Artificial
  CRISPR gRNA sequence
ccagaaccagaaggcaagag

SEQ ID NO: 272336 - DNA, 20 bp, Artificial
  CRISPR gRNA sequence
tgtagtggaggccaccatga

SEQ ID NO: 272337 - DNA, 20 bp, Artificial
  CRISPR gRNA sequence
ccatcaagagaagcagacca

SEQ ID NO: 272338 - DNA, 20 bp, Artificial
  CRISPR gRNA sequence
catcaagagaagcagaccaa

SEQ ID NO: 272339 - DNA, 20 bp, Artificial
  CRISPR gRNA sequence
tggccaagattgtgtatatc

SEQ ID NO: 272340 - DNA, 20 bp, Artificial
  CRISPR gRNA sequence
ggccaagattgtgtatatca

SEQ ID NO: 272341 - DNA, 20 bp, Artificial
  CRISPR gRNA sequence
gccaagattgtgtatatcac

SEQ ID NO: 272342 - DNA, 20 bp, Artificial
  CRISPR gRNA sequence
tgtatatcacaactatcagt

SEQ ID NO: 272343 - DNA, 20 bp, Artificial
  CRISPR gRNA sequence
tcagttataccaagcacatt

SEQ ID NO: 272344 - DNA, 20 bp, Artificial
  CRISPR gRNA sequence
taccaagcacattaactgtt

SEQ ID NO: 272345 - DNA, 20 bp, Artificial
  CRISPR gRNA sequence
actgttcttgacagaaagta

SEQ ID NO: 272346 - DNA, 20 bp, Artificial
  CRISPR gRNA sequence
ttcttgacagaaagtatggt

SEQ ID NO: 272347 - DNA, 20 bp, Artificial
  CRISPR gRNA sequence
ttgacagaaagtatggtttt

SEQ ID NO: 272348 - DNA, 20 bp, Artificial
  CRISPR gRNA sequence
gacagaaagtatggttttaa

SEQ ID NO: 272349 - DNA, 20 bp, Artificial
  CRISPR gRNA sequence
acagaaagtatggttttaaa

SEQ ID NO: 272350 - DNA, 20 bp, Artificial
  CRISPR gRNA sequence
taaaacaaaatctaaagagg

SEQ ID NO: 272351 - DNA, 20 bp, Artificial
  CRISPR gRNA sequence
aaaacaaaatctaaagaggt

SEQ ID NO: 272352 - DNA, 20 bp, Artificial
  CRISPR gRNA sequence
aaacaaaatctaaagaggtt

SEQ ID NO: 272353 - DNA, 20 bp, Artificial
  CRISPR gRNA sequence
aagaggttttagtttgaaca

SEQ ID NO: 272354 - DNA, 20 bp, Artificial
  CRISPR gRNA sequence
tagtttgaacaaggacaaat

SEQ ID NO: 272355 - DNA, 20 bp, Artificial
  CRISPR gRNA sequence
agtttgaacaaggacaaatg

SEQ ID NO: 272356 - DNA, 20 bp, Artificial
  CRISPR gRNA sequence
gtttgaacaaggacaaatga

SEQ ID NO: 272357 - DNA, 20 bp, Artificial
  CRISPR gRNA sequence
gaacaaggacaaatgattat

SEQ ID NO: 272358 - DNA, 20 bp, Artificial
  CRISPR gRNA sequence
aacaaggacaaatgattata

SEQ ID NO: 272359 - DNA, 20 bp, Artificial
  CRISPR gRNA sequence
taggtaacaatataaataga

SEQ ID NO: 272360 - DNA, 20 bp, Artificial
  CRISPR gRNA sequence
attaataaatttactaaagg

SEQ ID NO: 272361 - DNA, 20 bp, Artificial
  CRISPR gRNA sequence
ataaatttactaaaggcctg

SEQ ID NO: 272362 - DNA, 20 bp, Artificial
  CRISPR gRNA sequence
actaaaggcctggcacagtg

SEQ ID NO: 272363 - DNA, 20 bp, Artificial
  CRISPR gRNA sequence
ctaaaggcctggcacagtgg

SEQ ID NO: 272364 - DNA, 20 bp, Artificial
  CRISPR gRNA sequence
aaggcctggcacagtggatt

SEQ ID NO: 272365 - DNA, 20 bp, Artificial
  CRISPR gRNA sequence
gcacagtggattacacctgt

SEQ ID NO: 272366 - DNA, 20 bp, Artificial
  CRISPR gRNA sequence
cacctgtactcctagcactt

SEQ ID NO: 272367 - DNA, 20 bp, Artificial
  CRISPR gRNA sequence
tactcctagcactttgggag

SEQ ID NO: 272368 - DNA, 20 bp, Artificial
  CRISPR gRNA sequence
ctagcactttgggaggatga

SEQ ID NO: 272369 - DNA, 20 bp, Artificial
  CRISPR gRNA sequence
gcactttgggaggatgacac

SEQ ID NO: 272370 - DNA, 20 bp, Artificial
  CRISPR gRNA sequence
tgggaggatgacacaggtgg

SEQ ID NO: 272371 - DNA, 20 bp, Artificial
  CRISPR gRNA sequence
gggaggatgacacaggtgga

SEQ ID NO: 272372 - DNA, 20 bp, Artificial
  CRISPR gRNA sequence
ggaggatgacacaggtggat

SEQ ID NO: 272373 - DNA, 20 bp, Artificial
  CRISPR gRNA sequence
gaacccaggagatggaaacc

SEQ ID NO: 272374 - DNA, 20 bp, Artificial
  CRISPR gRNA sequence
aacccaggagatggaaacca

SEQ ID NO: 272375 - DNA, 20 bp, Artificial
  CRISPR gRNA sequence
ggcaacatggcgagacccca

SEQ ID NO: 272376 - DNA, 20 bp, Artificial
  CRISPR gRNA sequence
ctacaaaaaatacaaaaatt

SEQ ID NO: 272377 - DNA, 20 bp, Artificial
  CRISPR gRNA sequence
tacaaaaaatacaaaaatta

SEQ ID NO: 272378 - DNA, 20 bp, Artificial
  CRISPR gRNA sequence
caaaaaatacaaaaattagc

SEQ ID NO: 272379 - DNA, 20 bp, Artificial
  CRISPR gRNA sequence
gctgggtgtgggggtacctg

SEQ ID NO: 272380 - DNA, 20 bp, Artificial
  CRISPR gRNA sequence
ggtgtgggggtacctggctg

SEQ ID NO: 272381 - DNA, 20 bp, Artificial
  CRISPR gRNA sequence
gctgtggtggcatgtgcctg

SEQ ID NO: 272382 - DNA, 20 bp, Artificial
  CRISPR gRNA sequence
tggtggcatgtgcctgtagt

SEQ ID NO: 272383 - DNA, 20 bp, Artificial
  CRISPR gRNA sequence
tagtcccagctccttgggag

SEQ ID NO: 272384 - DNA, 20 bp, Artificial
  CRISPR gRNA sequence
cttgggaggctgaggtggga

SEQ ID NO: 272385 - DNA, 20 bp, Artificial
  CRISPR gRNA sequence
gggaggctgaggtgggagga

SEQ ID NO: 272386 - DNA, 20 bp, Artificial
  CRISPR gRNA sequence
ggaggctgaggtgggaggat

SEQ ID NO: 272387 - DNA, 20 bp, Artificial
  CRISPR gRNA sequence
aggtgggaggatcacttgag

SEQ ID NO: 272388 - DNA, 20 bp, Artificial
  CRISPR gRNA sequence
gagcccaggaggtcaaggct

SEQ ID NO: 272389 - DNA, 20 bp, Artificial
  CRISPR gRNA sequence
agcccaggaggtcaaggctg

SEQ ID NO: 272390 - DNA, 20 bp, Artificial
  CRISPR gRNA sequence
cagtgagtggtgattgtacc

SEQ ID NO: 272391 - DNA, 20 bp, Artificial
  CRISPR gRNA sequence
taccactgcactccagcctg

SEQ ID NO: 272392 - DNA, 20 bp, Artificial
  CRISPR gRNA sequence
cactccagcctgagcaacaa

SEQ ID NO: 272393 - DNA, 20 bp, Artificial
  CRISPR gRNA sequence
cagcctgagcaacaaagtga

SEQ ID NO: 272394 - DNA, 20 bp, Artificial
  CRISPR gRNA sequence
agcaacaaagtgagacccca

SEQ ID NO: 272395 - DNA, 20 bp, Artificial
  CRISPR gRNA sequence
aaataaataaataatttagt

SEQ ID NO: 272396 - DNA, 20 bp, Artificial
  CRISPR gRNA sequence
agtaaagaagttgcttttgg

SEQ ID NO: 272397 - DNA, 20 bp, Artificial
  CRISPR gRNA sequence
gtaaagaagttgcttttggt

SEQ ID NO: 272398 - DNA, 20 bp, Artificial
  CRISPR gRNA sequence
cttttggtcagcactaatct

SEQ ID NO: 272399 - DNA, 20 bp, Artificial
  CRISPR gRNA sequence
ttggtcagcactaatctaag

SEQ ID NO: 272400 - DNA, 20 bp, Artificial
  CRISPR gRNA sequence
tggtcagcactaatctaagc

SEQ ID NO: 272401 - DNA, 20 bp, Artificial
  CRISPR gRNA sequence
ggtcagcactaatctaagcc

SEQ ID NO: 272402 - DNA, 20 bp, Artificial
  CRISPR gRNA sequence
gtcagcactaatctaagccc

SEQ ID NO: 272403 - DNA, 20 bp, Artificial
  CRISPR gRNA sequence
atctaagccccacctttaac

SEQ ID NO: 272404 - DNA, 20 bp, Artificial
  CRISPR gRNA sequence
agccccacctttaaccttta

SEQ ID NO: 272405 - DNA, 20 bp, Artificial
  CRISPR gRNA sequence
taacctttatttgtgttcct

SEQ ID NO: 272406 - DNA, 20 bp, Artificial
  CRISPR gRNA sequence
aacctttatttgtgttccta

SEQ ID NO: 272407 - DNA, 20 bp, Artificial
  CRISPR gRNA sequence
acctttatttgtgttcctac

SEQ ID NO: 272408 - DNA, 20 bp, Artificial
  CRISPR gRNA sequence
tatttgtgttcctacacagg

SEQ ID NO: 272409 - DNA, 20 bp, Artificial
  CRISPR gRNA sequence
atttgtgttcctacacaggc

SEQ ID NO: 272410 - DNA, 20 bp, Artificial
  CRISPR gRNA sequence
tttgtgttcctacacaggca

SEQ ID NO: 272411 - DNA, 20 bp, Artificial
  CRISPR gRNA sequence
gtgttcctacacaggcagac

SEQ ID NO: 272412 - DNA, 20 bp, Artificial
  CRISPR gRNA sequence
tgttcctacacaggcagaca

SEQ ID NO: 272413 - DNA, 20 bp, Artificial
  CRISPR gRNA sequence
ctacacaggcagacactata

SEQ ID NO: 272414 - DNA, 20 bp, Artificial
  CRISPR gRNA sequence
cacaggcagacactataatg

SEQ ID NO: 272415 - DNA, 20 bp, Artificial
  CRISPR gRNA sequence
taatgtagaggacacttgtt

SEQ ID NO: 272416 - DNA, 20 bp, Artificial
  CRISPR gRNA sequence
gttcttgtcctcttaaaaaa

SEQ ID NO: 272417 - DNA, 20 bp, Artificial
  CRISPR gRNA sequence
ttcttgtcctcttaaaaaaa

SEQ ID NO: 272418 - DNA, 20 bp, Artificial
  CRISPR gRNA sequence
ttgtcctcttaaaaaaatta

SEQ ID NO: 272419 - DNA, 20 bp, Artificial
  CRISPR gRNA sequence
gtcctcttaaaaaaattatt

SEQ ID NO: 272420 - DNA, 20 bp, Artificial
  CRISPR gRNA sequence
tcctcttaaaaaaattattg

SEQ ID NO: 272421 - DNA, 20 bp, Artificial
  CRISPR gRNA sequence
ttaaaaaaattattgtgcta

SEQ ID NO: 272422 - DNA, 20 bp, Artificial
  CRISPR gRNA sequence
aaaaaaattattgtgctaca

SEQ ID NO: 272423 - DNA, 20 bp, Artificial
  CRISPR gRNA sequence
aaaaaattattgtgctacat

SEQ ID NO: 272424 - DNA, 20 bp, Artificial
  CRISPR gRNA sequence
ttgtgctacatgtaactgtc

SEQ ID NO: 272425 - DNA, 20 bp, Artificial
  CRISPR gRNA sequence
tgctacatgtaactgtcaga

SEQ ID NO: 272426 - DNA, 20 bp, Artificial
  CRISPR gRNA sequence
catgtaactgtcagaaagta

SEQ ID NO: 272427 - DNA, 20 bp, Artificial
  CRISPR gRNA sequence
tcagaaagtaagtcaaaggt

SEQ ID NO: 272428 - DNA, 20 bp, Artificial
  CRISPR gRNA sequence
agtagcaaaaagtcccatat

SEQ ID NO: 272429 - DNA, 20 bp, Artificial
  CRISPR gRNA sequence
aggcattcatttttgagagg

SEQ ID NO: 272430 - DNA, 20 bp, Artificial
  CRISPR gRNA sequence
atttttgagagggaaaagtt

SEQ ID NO: 272431 - DNA, 20 bp, Artificial
  CRISPR gRNA sequence
ttgagagggaaaagttatca

SEQ ID NO: 272432 - DNA, 20 bp, Artificial
  CRISPR gRNA sequence
tgagagggaaaagttatcaa

SEQ ID NO: 272433 - DNA, 20 bp, Artificial
  CRISPR gRNA sequence
gagagggaaaagttatcaaa

SEQ ID NO: 272434 - DNA, 20 bp, Artificial
  CRISPR gRNA sequence
agagggaaaagttatcaaaa

SEQ ID NO: 272435 - DNA, 20 bp, Artificial
  CRISPR gRNA sequence
tcaaaaacaatcaatgagta

SEQ ID NO: 272436 - DNA, 20 bp, Artificial
  CRISPR gRNA sequence
tctgagaagaaattttgatg

SEQ ID NO: 272437 - DNA, 20 bp, Artificial
  CRISPR gRNA sequence
ctgagaagaaattttgatgt

SEQ ID NO: 272438 - DNA, 20 bp, Artificial
  CRISPR gRNA sequence
tgagaagaaattttgatgtg

SEQ ID NO: 272439 - DNA, 20 bp, Artificial
  CRISPR gRNA sequence
agaagaaattttgatgtgtc

SEQ ID NO: 272440 - DNA, 20 bp, Artificial
  CRISPR gRNA sequence
tgatgtgtcacagaatcgtc

SEQ ID NO: 272441 - DNA, 20 bp, Artificial
  CRISPR gRNA sequence
gatgtgtcacagaatcgtcc

SEQ ID NO: 272442 - DNA, 20 bp, Artificial
  CRISPR gRNA sequence
atgtgtcacagaatcgtcct

SEQ ID NO: 272443 - DNA, 20 bp, Artificial
  CRISPR gRNA sequence
tggtattctgacttctgctg

SEQ ID NO: 272444 - DNA, 20 bp, Artificial
  CRISPR gRNA sequence
ggtattctgacttctgctgt

SEQ ID NO: 272445 - DNA, 20 bp, Artificial
  CRISPR gRNA sequence
gtattctgacttctgctgtg

SEQ ID NO: 272446 - DNA, 20 bp, Artificial
  CRISPR gRNA sequence
tgacttctgctgtgacagcg

SEQ ID NO: 272447 - DNA, 20 bp, Artificial
  CRISPR gRNA sequence
acttctgctgtgacagcgtc

SEQ ID NO: 272448 - DNA, 20 bp, Artificial
  CRISPR gRNA sequence
ctgctgtgacagcgtcattc

SEQ ID NO: 272449 - DNA, 20 bp, Artificial
  CRISPR gRNA sequence
tgctgtgacagcgtcattca

SEQ ID NO: 272450 - DNA, 20 bp, Artificial
  CRISPR gRNA sequence
ctgtgacagcgtcattcatt

SEQ ID NO: 272451 - DNA, 20 bp, Artificial
  CRISPR gRNA sequence
tgacagcgtcattcattcat

SEQ ID NO: 272452 - DNA, 20 bp, Artificial
  CRISPR gRNA sequence
attcatttattcatcaaata

SEQ ID NO: 272453 - DNA, 20 bp, Artificial
  CRISPR gRNA sequence
atttattcatcaaataaata

SEQ ID NO: 272454 - DNA, 20 bp, Artificial
  CRISPR gRNA sequence
attcatcaaataaataaggg

SEQ ID NO: 272455 - DNA, 20 bp, Artificial
  CRISPR gRNA sequence
ttcatcaaataaataaggga

SEQ ID NO: 272456 - DNA, 20 bp, Artificial
  CRISPR gRNA sequence
atcaaataaataagggactt

SEQ ID NO: 272457 - DNA, 20 bp, Artificial
  CRISPR gRNA sequence
aatgtacttgattcttagga

SEQ ID NO: 272458 - DNA, 20 bp, Artificial
  CRISPR gRNA sequence
atgtacttgattcttaggag

SEQ ID NO: 272459 - DNA, 20 bp, Artificial
  CRISPR gRNA sequence
gattcttaggagatgggaag

SEQ ID NO: 272460 - DNA, 20 bp, Artificial
  CRISPR gRNA sequence
attcttaggagatgggaaga

SEQ ID NO: 272461 - DNA, 20 bp, Artificial
  CRISPR gRNA sequence
ttaggagatgggaagatgta

SEQ ID NO: 272462 - DNA, 20 bp, Artificial
  CRISPR gRNA sequence
aggagatgggaagatgtaaa

SEQ ID NO: 272463 - DNA, 20 bp, Artificial
  CRISPR gRNA sequence
ggagatgggaagatgtaaaa

SEQ ID NO: 272464 - DNA, 20 bp, Artificial
  CRISPR gRNA sequence
tttcattctaggagaaatcc

SEQ ID NO: 272465 - DNA, 20 bp, Artificial
  CRISPR gRNA sequence
cattctaggagaaatccgaa

SEQ ID NO: 272466 - DNA, 20 bp, Artificial
  CRISPR gRNA sequence
attctaggagaaatccgaag

SEQ ID NO: 272467 - DNA, 20 bp, Artificial
  CRISPR gRNA sequence
taggagaaatccgaaggcag

SEQ ID NO: 272468 - DNA, 20 bp, Artificial
  CRISPR gRNA sequence
ggagaaatccgaaggcaggt

SEQ ID NO: 272469 - DNA, 20 bp, Artificial
  CRISPR gRNA sequence
ctctccgaagccatccgtgg

SEQ ID NO: 272470 - DNA, 20 bp, Artificial
  CRISPR gRNA sequence
tccgaagccatccgtggtac

SEQ ID NO: 272471 - DNA, 20 bp, Artificial
  CRISPR gRNA sequence
cgaagccatccgtggtacat

SEQ ID NO: 272472 - DNA, 20 bp, Artificial
  CRISPR gRNA sequence
taaagggtcattgacaggca

SEQ ID NO: 272473 - DNA, 20 bp, Artificial
  CRISPR gRNA sequence
aaagggtcattgacaggcac

SEQ ID NO: 272474 - DNA, 20 bp, Artificial
  CRISPR gRNA sequence
aagggtcattgacaggcacg

SEQ ID NO: 272475 - DNA, 20 bp, Artificial
  CRISPR gRNA sequence
acaggcacgcgaaagaagcc

SEQ ID NO: 272476 - DNA, 20 bp, Artificial
  CRISPR gRNA sequence
gtttccagacaggatgattc

SEQ ID NO: 272477 - DNA, 20 bp, Artificial
  CRISPR gRNA sequence
tttccagacaggatgattct

SEQ ID NO: 272478 - DNA, 20 bp, Artificial
  CRISPR gRNA sequence
ccagacaggatgattctgga

SEQ ID NO: 272479 - DNA, 20 bp, Artificial
  CRISPR gRNA sequence
cagacaggatgattctggag

SEQ ID NO: 272480 - DNA, 20 bp, Artificial
  CRISPR gRNA sequence
tggaggcttttgtagagact

SEQ ID NO: 272481 - DNA, 20 bp, Artificial
  CRISPR gRNA sequence
gaggcttttgtagagacttc

SEQ ID NO: 272482 - DNA, 20 bp, Artificial
  CRISPR gRNA sequence
ttgtagagacttcacattta

SEQ ID NO: 272483 - DNA, 20 bp, Artificial
  CRISPR gRNA sequence
tgtagagacttcacatttag

SEQ ID NO: 272484 - DNA, 20 bp, Artificial
  CRISPR gRNA sequence
gtagagacttcacatttagc

SEQ ID NO: 272485 - DNA, 20 bp, Artificial
  CRISPR gRNA sequence
tagagacttcacatttagct

SEQ ID NO: 272486 - DNA, 20 bp, Artificial
  CRISPR gRNA sequence
cacatttagctgggccataa

SEQ ID NO: 272487 - DNA, 20 bp, Artificial
  CRISPR gRNA sequence
acatttagctgggccataag

SEQ ID NO: 272488 - DNA, 20 bp, Artificial
  CRISPR gRNA sequence
agctgggccataaggtctgg

SEQ ID NO: 272489 - DNA, 20 bp, Artificial
  CRISPR gRNA sequence
gctgggccataaggtctggg

SEQ ID NO: 272490 - DNA, 20 bp, Artificial
  CRISPR gRNA sequence
ggccataaggtctggggcaa

SEQ ID NO: 272491 - DNA, 20 bp, Artificial
  CRISPR gRNA sequence
gggcaaatttagacaggcta

SEQ ID NO: 272492 - DNA, 20 bp, Artificial
  CRISPR gRNA sequence
agacaggctaagatcatgga

SEQ ID NO: 272493 - DNA, 20 bp, Artificial
  CRISPR gRNA sequence
gacaggctaagatcatggaa

SEQ ID NO: 272494 - DNA, 20 bp, Artificial
  CRISPR gRNA sequence
agatcatggaaatgacctta

SEQ ID NO: 272495 - DNA, 20 bp, Artificial
  CRISPR gRNA sequence
agtgtgagagtttattggga

SEQ ID NO: 272496 - DNA, 20 bp, Artificial
  CRISPR gRNA sequence
gtgtgagagtttattgggaa

SEQ ID NO: 272497 - DNA, 20 bp, Artificial
  CRISPR gRNA sequence
attgggaactggcagagtat

SEQ ID NO: 272498 - DNA, 20 bp, Artificial
  CRISPR gRNA sequence
ttgggaactggcagagtatt

SEQ ID NO: 272499 - DNA, 20 bp, Artificial
  CRISPR gRNA sequence
ggaactggcagagtattcca

SEQ ID NO: 272500 - DNA, 20 bp, Artificial
  CRISPR gRNA sequence
gcagagtattccatttatgt

SEQ ID NO: 272501 - DNA, 20 bp, Artificial
  CRISPR gRNA sequence
catttatgtaggatggaaac

SEQ ID NO: 272502 - DNA, 20 bp, Artificial
  CRISPR gRNA sequence
atgtaggatggaaacaggtg

SEQ ID NO: 272503 - DNA, 20 bp, Artificial
  CRISPR gRNA sequence
tgtaggatggaaacaggtga

SEQ ID NO: 272504 - DNA, 20 bp, Artificial
  CRISPR gRNA sequence
taccagaaaggccatgggag

SEQ ID NO: 272505 - DNA, 20 bp, Artificial
  CRISPR gRNA sequence
accagaaaggccatgggaga

SEQ ID NO: 272506 - DNA, 20 bp, Artificial
  CRISPR gRNA sequence
ccagaaaggccatgggagat

SEQ ID NO: 272507 - DNA, 20 bp, Artificial
  CRISPR gRNA sequence
aagatgtctgagttgagaat

SEQ ID NO: 272508 - DNA, 20 bp, Artificial
  CRISPR gRNA sequence
agttgagaatgttgtggtac

SEQ ID NO: 272509 - DNA, 20 bp, Artificial
  CRISPR gRNA sequence
agaatgttgtggtacatgct

SEQ ID NO: 272510 - DNA, 20 bp, Artificial
  CRISPR gRNA sequence
tggtacatgctgctttggga

SEQ ID NO: 272511 - DNA, 20 bp, Artificial
  CRISPR gRNA sequence
ctttgggaaggttagcacag

SEQ ID NO: 272512 - DNA, 20 bp, Artificial
  CRISPR gRNA sequence
tgggaaggttagcacagcct

SEQ ID NO: 272513 - DNA, 20 bp, Artificial
  CRISPR gRNA sequence
gggaaggttagcacagcctt

SEQ ID NO: 272514 - DNA, 20 bp, Artificial
  CRISPR gRNA sequence
ggaaggttagcacagccttg

SEQ ID NO: 272515 - DNA, 20 bp, Artificial
  CRISPR gRNA sequence
gcacagccttgaggagtgca

SEQ ID NO: 272516 - DNA, 20 bp, Artificial
  CRISPR gRNA sequence
gaggagtgcagcaagcaatc

SEQ ID NO: 272517 - DNA, 20 bp, Artificial
  CRISPR gRNA sequence
aggagtgcagcaagcaatct

SEQ ID NO: 272518 - DNA, 20 bp, Artificial
  CRISPR gRNA sequence
gactgcccttggcttggagc

SEQ ID NO: 272519 - DNA, 20 bp, Artificial
  CRISPR gRNA sequence
actgcccttggcttggagca

SEQ ID NO: 272520 - DNA, 20 bp, Artificial
  CRISPR gRNA sequence
cccttggcttggagcaaggg

SEQ ID NO: 272521 - DNA, 20 bp, Artificial
  CRISPR gRNA sequence
ggcttggagcaagggaagaa

SEQ ID NO: 272522 - DNA, 20 bp, Artificial
  CRISPR gRNA sequence
gcttggagcaagggaagaac

SEQ ID NO: 272523 - DNA, 20 bp, Artificial
  CRISPR gRNA sequence
ggagcaagggaagaactgag

SEQ ID NO: 272524 - DNA, 20 bp, Artificial
  CRISPR gRNA sequence
gagcaagggaagaactgagg

SEQ ID NO: 272525 - DNA, 20 bp, Artificial
  CRISPR gRNA sequence
aggcagagaccaatcaggag

SEQ ID NO: 272526 - DNA, 20 bp, Artificial
  CRISPR gRNA sequence
atgcaatagcactgatgtga

SEQ ID NO: 272527 - DNA, 20 bp, Artificial
  CRISPR gRNA sequence
atgtgagttcataaggcctg

SEQ ID NO: 272528 - DNA, 20 bp, Artificial
  CRISPR gRNA sequence
ataaggcctgagctgtggag

SEQ ID NO: 272529 - DNA, 20 bp, Artificial
  CRISPR gRNA sequence
agctgtggaggtggcagctg

SEQ ID NO: 272530 - DNA, 20 bp, Artificial
  CRISPR gRNA sequence
tggaggtggcagctggtatg

SEQ ID NO: 272531 - DNA, 20 bp, Artificial
  CRISPR gRNA sequence
gtatgaaagggtcaaacaag

SEQ ID NO: 272532 - DNA, 20 bp, Artificial
  CRISPR gRNA sequence
gtgctcagttttacagactg

SEQ ID NO: 272533 - DNA, 20 bp, Artificial
  CRISPR gRNA sequence
agttttacagactgatggtg

SEQ ID NO: 272534 - DNA, 20 bp, Artificial
  CRISPR gRNA sequence
tacagactgatggtgaacag

SEQ ID NO: 272535 - DNA, 20 bp, Artificial
  CRISPR gRNA sequence
acagactgatggtgaacagg

SEQ ID NO: 272536 - DNA, 20 bp, Artificial
  CRISPR gRNA sequence
cagactgatggtgaacagga

SEQ ID NO: 272537 - DNA, 20 bp, Artificial
  CRISPR gRNA sequence
atggtgaacaggaatggaaa

SEQ ID NO: 272538 - DNA, 20 bp, Artificial
  CRISPR gRNA sequence
acgcactgggtaagggtatg

SEQ ID NO: 272539 - DNA, 20 bp, Artificial
  CRISPR gRNA sequence
ggtaagggtatgagtggagg

SEQ ID NO: 272540 - DNA, 20 bp, Artificial
  CRISPR gRNA sequence
acaaaatgaggtaagttaag

SEQ ID NO: 272541 - DNA, 20 bp, Artificial
  CRISPR gRNA sequence
agaggaaatttgttcatcct

SEQ ID NO: 272542 - DNA, 20 bp, Artificial
  CRISPR gRNA sequence
gttcatcctggaggaaagat

SEQ ID NO: 272543 - DNA, 20 bp, Artificial
  CRISPR gRNA sequence
ttcatcctggaggaaagatc

SEQ ID NO: 272544 - DNA, 20 bp, Artificial
  CRISPR gRNA sequence
atcctggaggaaagatccag

SEQ ID NO: 272545 - DNA, 20 bp, Artificial
  CRISPR gRNA sequence
gaggaaagatccagaaggag

SEQ ID NO: 272546 - DNA, 20 bp, Artificial
  CRISPR gRNA sequence
gaagtataggactagagttc

SEQ ID NO: 272547 - DNA, 20 bp, Artificial
  CRISPR gRNA sequence
gagttcgaggaagccagttg

SEQ ID NO: 272548 - DNA, 20 bp, Artificial
  CRISPR gRNA sequence
gaggaagccagttggggata

SEQ ID NO: 272549 - DNA, 20 bp, Artificial
  CRISPR gRNA sequence
gggatagaaatgtacattag

SEQ ID NO: 272550 - DNA, 20 bp, Artificial
  CRISPR gRNA sequence
ggaagttcatatgtattagg

SEQ ID NO: 272551 - DNA, 20 bp, Artificial
  CRISPR gRNA sequence
atatgtattaggatgacagt

SEQ ID NO: 272552 - DNA, 20 bp, Artificial
  CRISPR gRNA sequence
ggatgacagttaatattaaa

SEQ ID NO: 272553 - DNA, 20 bp, Artificial
  CRISPR gRNA sequence
atattaaaattgctaaaaac

SEQ ID NO: 272554 - DNA, 20 bp, Artificial
  CRISPR gRNA sequence
aaattgctaaaaaccatcac

SEQ ID NO: 272555 - DNA, 20 bp, Artificial
  CRISPR gRNA sequence
ctaaaaaccatcacctgtgc

SEQ ID NO: 272556 - DNA, 20 bp, Artificial
  CRISPR gRNA sequence
aaaaccatcacctgtgctgt

SEQ ID NO: 272557 - DNA, 20 bp, Artificial
  CRISPR gRNA sequence
tgctgtaacccatccctacc

SEQ ID NO: 272558 - DNA, 20 bp, Artificial
  CRISPR gRNA sequence
taacccatccctaccactca

SEQ ID NO: 272559 - DNA, 20 bp, Artificial
  CRISPR gRNA sequence
ccactcagagacaccacaca

SEQ ID NO: 272560 - DNA, 20 bp, Artificial
  CRISPR gRNA sequence
agagacaccacacagcaatg

SEQ ID NO: 272561 - DNA, 20 bp, Artificial
  CRISPR gRNA sequence
tgggaccaaaacttcctaac

SEQ ID NO: 272562 - DNA, 20 bp, Artificial
  CRISPR gRNA sequence
ggaccaaaacttcctaaccc

SEQ ID NO: 272563 - DNA, 20 bp, Artificial
  CRISPR gRNA sequence
cctaacccaaagcaacataa

SEQ ID NO: 272564 - DNA, 20 bp, Artificial
  CRISPR gRNA sequence
ctaacccaaagcaacataaa

SEQ ID NO: 272565 - DNA, 20 bp, Artificial
  CRISPR gRNA sequence
acccaaagcaacataaactc

SEQ ID NO: 272566 - DNA, 20 bp, Artificial
  CRISPR gRNA sequence
agatgcagtgtgacccaatc

SEQ ID NO: 272567 - DNA, 20 bp, Artificial
  CRISPR gRNA sequence
ccgttcacaggtcaggtctg

SEQ ID NO: 272568 - DNA, 20 bp, Artificial
  CRISPR gRNA sequence
acaggtcaggtctgcaattt

SEQ ID NO: 272569 - DNA, 20 bp, Artificial
  CRISPR gRNA sequence
caattttcctctgatctcct

SEQ ID NO: 272570 - DNA, 20 bp, Artificial
  CRISPR gRNA sequence
tcctctgatctcctaatgtt

SEQ ID NO: 272571 - DNA, 20 bp, Artificial
  CRISPR gRNA sequence
cctctgatctcctaatgtta

SEQ ID NO: 272572 - DNA, 20 bp, Artificial
  CRISPR gRNA sequence
ctctgatctcctaatgttag

SEQ ID NO: 272573 - DNA, 20 bp, Artificial
  CRISPR gRNA sequence
tgatctcctaatgttagaaa

SEQ ID NO: 272574 - DNA, 20 bp, Artificial
  CRISPR gRNA sequence
atctcctaatgttagaaaga

SEQ ID NO: 272575 - DNA, 20 bp, Artificial
  CRISPR gRNA sequence
ctaatgttagaaagacaatc

SEQ ID NO: 272576 - DNA, 20 bp, Artificial
  CRISPR gRNA sequence
atgttagaaagacaatctaa

SEQ ID NO: 272577 - DNA, 20 bp, Artificial
  CRISPR gRNA sequence
gaaagacaatctaaggggac

SEQ ID NO: 272578 - DNA, 20 bp, Artificial
  CRISPR gRNA sequence
aggggacaacatagcaagag

SEQ ID NO: 272579 - DNA, 20 bp, Artificial
  CRISPR gRNA sequence
aacttacatgaaagtggaac

SEQ ID NO: 272580 - DNA, 20 bp, Artificial
  CRISPR gRNA sequence
acttacatgaaagtggaacc

SEQ ID NO: 272581 - DNA, 20 bp, Artificial
  CRISPR gRNA sequence
acatgaaagtggaacccata

SEQ ID NO: 272582 - DNA, 20 bp, Artificial
  CRISPR gRNA sequence
catgaaagtggaacccatac

SEQ ID NO: 272583 - DNA, 20 bp, Artificial
  CRISPR gRNA sequence
cccaaaatcaaatctcacta

SEQ ID NO: 272584 - DNA, 20 bp, Artificial
  CRISPR gRNA sequence
actattctaaaaggttgcct

SEQ ID NO: 272585 - DNA, 20 bp, Artificial
  CRISPR gRNA sequence
ttctaaaaggttgcctgtag

SEQ ID NO: 272586 - DNA, 20 bp, Artificial
  CRISPR gRNA sequence
taaaaggttgcctgtagtct

SEQ ID NO: 272587 - DNA, 20 bp, Artificial
  CRISPR gRNA sequence
aaaggttgcctgtagtctaa

SEQ ID NO: 272588 - DNA, 20 bp, Artificial
  CRISPR gRNA sequence
cctgtagtctaaataggagg

SEQ ID NO: 272589 - DNA, 20 bp, Artificial
  CRISPR gRNA sequence
tagtctaaataggaggtaac

SEQ ID NO: 272590 - DNA, 20 bp, Artificial
  CRISPR gRNA sequence
aataggaggtaaccagggaa

SEQ ID NO: 272591 - DNA, 20 bp, Artificial
  CRISPR gRNA sequence
tagctttctgtacatatata

SEQ ID NO: 272592 - DNA, 20 bp, Artificial
  CRISPR gRNA sequence
tctgtacatatatattatta

SEQ ID NO: 272593 - DNA, 20 bp, Artificial
  CRISPR gRNA sequence
ctgtacatatatattattat

SEQ ID NO: 272594 - DNA, 20 bp, Artificial
  CRISPR gRNA sequence
tgtacatatatattattata

SEQ ID NO: 272595 - DNA, 20 bp, Artificial
  CRISPR gRNA sequence
tacatatatattattatagt

SEQ ID NO: 272596 - DNA, 20 bp, Artificial
  CRISPR gRNA sequence
ttatagtaattcagttaacg

SEQ ID NO: 272597 - DNA, 20 bp, Artificial
  CRISPR gRNA sequence
tagtaattcagttaacggat

SEQ ID NO: 272598 - DNA, 20 bp, Artificial
  CRISPR gRNA sequence
agttaacggatcaaaagaaa

SEQ ID NO: 272599 - DNA, 20 bp, Artificial
  CRISPR gRNA sequence
acggatcaaaagaaaaccca

SEQ ID NO: 272600 - DNA, 20 bp, Artificial
  CRISPR gRNA sequence
ctctattaatttattatttt

SEQ ID NO: 272601 - DNA, 20 bp, Artificial
  CRISPR gRNA sequence
tattaatttattattttcta

SEQ ID NO: 272602 - DNA, 20 bp, Artificial
  CRISPR gRNA sequence
ttaatttattattttctaaa

SEQ ID NO: 272603 - DNA, 20 bp, Artificial
  CRISPR gRNA sequence
atttattattttctaaatat

SEQ ID NO: 272604 - DNA, 20 bp, Artificial
  CRISPR gRNA sequence
attattttctaaatatatgt

SEQ ID NO: 272605 - DNA, 20 bp, Artificial
  CRISPR gRNA sequence
ttattttctaaatatatgtt

SEQ ID NO: 272606 - DNA, 20 bp, Artificial
  CRISPR gRNA sequence
ttttctaaatatatgtttta

SEQ ID NO: 272607 - DNA, 20 bp, Artificial
  CRISPR gRNA sequence
tctaaatatatgttttaatc

SEQ ID NO: 272608 - DNA, 20 bp, Artificial
  CRISPR gRNA sequence
ctaaatatatgttttaatct

SEQ ID NO: 272609 - DNA, 20 bp, Artificial
  CRISPR gRNA sequence
taaatatatgttttaatcta

SEQ ID NO: 272610 - DNA, 20 bp, Artificial
  CRISPR gRNA sequence
aatatatgttttaatctagt

SEQ ID NO: 272611 - DNA, 20 bp, Artificial
  CRISPR gRNA sequence
taatctagtaaccaaatttg

SEQ ID NO: 272612 - DNA, 20 bp, Artificial
  CRISPR gRNA sequence
aatctagtaaccaaatttga

SEQ ID NO: 272613 - DNA, 20 bp, Artificial
  CRISPR gRNA sequence
atctagtaaccaaatttgag

SEQ ID NO: 272614 - DNA, 20 bp, Artificial
  CRISPR gRNA sequence
gtaaccaaatttgagagcca

SEQ ID NO: 272615 - DNA, 20 bp, Artificial
  CRISPR gRNA sequence
gagagccatattttcctcct

SEQ ID NO: 272616 - DNA, 20 bp, Artificial
  CRISPR gRNA sequence
agagccatattttcctcctg

SEQ ID NO: 272617 - DNA, 20 bp, Artificial
  CRISPR gRNA sequence
tcctcctgagccacaattat

SEQ ID NO: 272618 - DNA, 20 bp, Artificial
  CRISPR gRNA sequence
cctcctgagccacaattatc

SEQ ID NO: 272619 - DNA, 20 bp, Artificial
  CRISPR gRNA sequence
ctcctgagccacaattatcc

SEQ ID NO: 272620 - DNA, 20 bp, Artificial
  CRISPR gRNA sequence
ctgagccacaattatcctga

SEQ ID NO: 272621 - DNA, 20 bp, Artificial
  CRISPR gRNA sequence
agccacaattatcctgatcc

SEQ ID NO: 272622 - DNA, 20 bp, Artificial
  CRISPR gRNA sequence
tcctgatccctcattcaaaa

SEQ ID NO: 272623 - DNA, 20 bp, Artificial
  CRISPR gRNA sequence
atccctcattcaaaacaact

SEQ ID NO: 272624 - DNA, 20 bp, Artificial
  CRISPR gRNA sequence
attcaaaacaactctgtgat

SEQ ID NO: 272625 - DNA, 20 bp, Artificial
  CRISPR gRNA sequence
aaaacaactctgtgatgaag

SEQ ID NO: 272626 - DNA, 20 bp, Artificial
  CRISPR gRNA sequence
tgtgatgaagacaacagtac

SEQ ID NO: 272627 - DNA, 20 bp, Artificial
  CRISPR gRNA sequence
tgatgaagacaacagtacat

SEQ ID NO: 272628 - DNA, 20 bp, Artificial
  CRISPR gRNA sequence
ttcctgtctgttccattctg

SEQ ID NO: 272629 - DNA, 20 bp, Artificial
  CRISPR gRNA sequence
tcctgtctgttccattctgc

SEQ ID NO: 272630 - DNA, 20 bp, Artificial
  CRISPR gRNA sequence
cctgtctgttccattctgcc

SEQ ID NO: 272631 - DNA, 20 bp, Artificial
  CRISPR gRNA sequence
ctgtctgttccattctgcct

SEQ ID NO: 272632 - DNA, 20 bp, Artificial
  CRISPR gRNA sequence
tctgttccattctgcctaaa

SEQ ID NO: 272633 - DNA, 20 bp, Artificial
  CRISPR gRNA sequence
ttccattctgcctaaatcac

SEQ ID NO: 272634 - DNA, 20 bp, Artificial
  CRISPR gRNA sequence
cattctgcctaaatcacata

SEQ ID NO: 272635 - DNA, 20 bp, Artificial
  CRISPR gRNA sequence
tgcctaaatcacatacctct

SEQ ID NO: 272636 - DNA, 20 bp, Artificial
  CRISPR gRNA sequence
cctaaatcacatacctctga

SEQ ID NO: 272637 - DNA, 20 bp, Artificial
  CRISPR gRNA sequence
aatcacatacctctgaagaa

SEQ ID NO: 272638 - DNA, 20 bp, Artificial
  CRISPR gRNA sequence
tgaagaatctgctcaggatc

SEQ ID NO: 272639 - DNA, 20 bp, Artificial
  CRISPR gRNA sequence
aagaatctgctcaggatcac

SEQ ID NO: 272640 - DNA, 20 bp, Artificial
  CRISPR gRNA sequence
ctcaggatcaccttgtcata

SEQ ID NO: 272641 - DNA, 20 bp, Artificial
  CRISPR gRNA sequence
aggatcaccttgtcatatac

SEQ ID NO: 272642 - DNA, 20 bp, Artificial
  CRISPR gRNA sequence
gtcatatacagaacctccag

SEQ ID NO: 272643 - DNA, 20 bp, Artificial
  CRISPR gRNA sequence
tcatatacagaacctccagg

SEQ ID NO: 272644 - DNA, 20 bp, Artificial
  CRISPR gRNA sequence
caggtaaatgtcatggccca

SEQ ID NO: 272645 - DNA, 20 bp, Artificial
  CRISPR gRNA sequence
aaataattactgtgttggac

SEQ ID NO: 272646 - DNA, 20 bp, Artificial
  CRISPR gRNA sequence
aataattactgtgttggacc

SEQ ID NO: 272647 - DNA, 20 bp, Artificial
  CRISPR gRNA sequence
ctgtgttggaccttaacatt

SEQ ID NO: 272648 - DNA, 20 bp, Artificial
  CRISPR gRNA sequence
tgttggaccttaacattgca

SEQ ID NO: 272649 - DNA, 20 bp, Artificial
  CRISPR gRNA sequence
gaccttaacattgcatagga

SEQ ID NO: 272650 - DNA, 20 bp, Artificial
  CRISPR gRNA sequence
aacattgcataggaaaacag

SEQ ID NO: 272651 - DNA, 20 bp, Artificial
  CRISPR gRNA sequence
acattgcataggaaaacagg

SEQ ID NO: 272652 - DNA, 20 bp, Artificial
  CRISPR gRNA sequence
cataggaaaacaggagatag

SEQ ID NO: 272653 - DNA, 20 bp, Artificial
  CRISPR gRNA sequence
ccccctcaaagtccagcagt

SEQ ID NO: 272654 - DNA, 20 bp, Artificial
  CRISPR gRNA sequence
aaagtccagcagtcatttct

SEQ ID NO: 272655 - DNA, 20 bp, Artificial
  CRISPR gRNA sequence
ctaagcacattagcagcatt

SEQ ID NO: 272656 - DNA, 20 bp, Artificial
  CRISPR gRNA sequence
taagcacattagcagcattt

SEQ ID NO: 272657 - DNA, 20 bp, Artificial
  CRISPR gRNA sequence
agcacattagcagcatttag

SEQ ID NO: 272658 - DNA, 20 bp, Artificial
  CRISPR gRNA sequence
gcagcatttaggatcctggt

SEQ ID NO: 272659 - DNA, 20 bp, Artificial
  CRISPR gRNA sequence
aggatcctggttagcaatcc

SEQ ID NO: 272660 - DNA, 20 bp, Artificial
  CRISPR gRNA sequence
ggatcctggttagcaatccc

SEQ ID NO: 272661 - DNA, 20 bp, Artificial
  CRISPR gRNA sequence
gttagcaatccctgcaaggg

SEQ ID NO: 272662 - DNA, 20 bp, Artificial
  CRISPR gRNA sequence
gcaatccctgcaagggattt

SEQ ID NO: 272663 - DNA, 20 bp, Artificial
  CRISPR gRNA sequence
caagggatttcagagatggc

SEQ ID NO: 272664 - DNA, 20 bp, Artificial
  CRISPR gRNA sequence
cagagatggctggtttctaa

SEQ ID NO: 272665 - DNA, 20 bp, Artificial
  CRISPR gRNA sequence
agagatggctggtttctaat

SEQ ID NO: 272666 - DNA, 20 bp, Artificial
  CRISPR gRNA sequence
gtttctaatttcttgtattt

SEQ ID NO: 272667 - DNA, 20 bp, Artificial
  CRISPR gRNA sequence
ctaatttcttgtatttgctc

SEQ ID NO: 272668 - DNA, 20 bp, Artificial
  CRISPR gRNA sequence
taatttcttgtatttgctct

SEQ ID NO: 272669 - DNA, 20 bp, Artificial
  CRISPR gRNA sequence
atttcttgtatttgctctat

SEQ ID NO: 272670 - DNA, 20 bp, Artificial
  CRISPR gRNA sequence
cttgtatttgctctatcagg

SEQ ID NO: 272671 - DNA, 20 bp, Artificial
  CRISPR gRNA sequence
ttgtatttgctctatcaggt

SEQ ID NO: 272672 - DNA, 20 bp, Artificial
  CRISPR gRNA sequence
gtatttgctctatcaggtca

SEQ ID NO: 272673 - DNA, 20 bp, Artificial
  CRISPR gRNA sequence
tatttgctctatcaggtcat

SEQ ID NO: 272674 - DNA, 20 bp, Artificial
  CRISPR gRNA sequence
gctctatcaggtcataagag

SEQ ID NO: 272675 - DNA, 20 bp, Artificial
  CRISPR gRNA sequence
ctctatcaggtcataagagc

SEQ ID NO: 272676 - DNA, 20 bp, Artificial
  CRISPR gRNA sequence
tatcaggtcataagagcatc

SEQ ID NO: 272677 - DNA, 20 bp, Artificial
  CRISPR gRNA sequence
tcaggtcataagagcatcca

SEQ ID NO: 272678 - DNA, 20 bp, Artificial
  CRISPR gRNA sequence
agctgccttgttagacccga

SEQ ID NO: 272679 - DNA, 20 bp, Artificial
  CRISPR gRNA sequence
ccttgttagacccgacaaaa

SEQ ID NO: 272680 - DNA, 20 bp, Artificial
  CRISPR gRNA sequence
gttagacccgacaaaagtta

SEQ ID NO: 272681 - DNA, 20 bp, Artificial
  CRISPR gRNA sequence
ttagacccgacaaaagttag

SEQ ID NO: 272682 - DNA, 20 bp, Artificial
  CRISPR gRNA sequence
gacccgacaaaagttagctt

SEQ ID NO: 272683 - DNA, 20 bp, Artificial
  CRISPR gRNA sequence
gctttttaaaaaattccact

SEQ ID NO: 272684 - DNA, 20 bp, Artificial
  CRISPR gRNA sequence
tttaaaaaattccacttcag

SEQ ID NO: 272685 - DNA, 20 bp, Artificial
  CRISPR gRNA sequence
ttaaaaaattccacttcaga

SEQ ID NO: 272686 - DNA, 20 bp, Artificial
  CRISPR gRNA sequence
taaaaaattccacttcagaa

SEQ ID NO: 272687 - DNA, 20 bp, Artificial
  CRISPR gRNA sequence
aaaaaattccacttcagaag

SEQ ID NO: 272688 - DNA, 20 bp, Artificial
  CRISPR gRNA sequence
aaaaattccacttcagaagc

SEQ ID NO: 272689 - DNA, 20 bp, Artificial
  CRISPR gRNA sequence
cacttcagaagcacttttaa

SEQ ID NO: 272690 - DNA, 20 bp, Artificial
  CRISPR gRNA sequence
cagaagcacttttaagccag

SEQ ID NO: 272691 - DNA, 20 bp, Artificial
  CRISPR gRNA sequence
agaagcacttttaagccaga

SEQ ID NO: 272692 - DNA, 20 bp, Artificial
  CRISPR gRNA sequence
ttaagccagaaagtagacct

SEQ ID NO: 272693 - DNA, 20 bp, Artificial
  CRISPR gRNA sequence
taagccagaaagtagacctg

SEQ ID NO: 272694 - DNA, 20 bp, Artificial
  CRISPR gRNA sequence
aagccagaaagtagacctga

SEQ ID NO: 272695 - DNA, 20 bp, Artificial
  CRISPR gRNA sequence
agccagaaagtagacctgag

SEQ ID NO: 272696 - DNA, 20 bp, Artificial
  CRISPR gRNA sequence
agatatcctccagcccaaac

SEQ ID NO: 272697 - DNA, 20 bp, Artificial
  CRISPR gRNA sequence
cagcccaaactcttcatgta

SEQ ID NO: 272698 - DNA, 20 bp, Artificial
  CRISPR gRNA sequence
ttcatgtatcagatgaagaa

SEQ ID NO: 272699 - DNA, 20 bp, Artificial
  CRISPR gRNA sequence
catgtatcagatgaagaaac

SEQ ID NO: 272700 - DNA, 20 bp, Artificial
  CRISPR gRNA sequence
atgtatcagatgaagaaacc

SEQ ID NO: 272701 - DNA, 20 bp, Artificial
  CRISPR gRNA sequence
gaaaagttctgtcacagtat

SEQ ID NO: 272702 - DNA, 20 bp, Artificial
  CRISPR gRNA sequence
tgtcacagtatgatagacta

SEQ ID NO: 272703 - DNA, 20 bp, Artificial
  CRISPR gRNA sequence
tcacagtatgatagactaat

SEQ ID NO: 272704 - DNA, 20 bp, Artificial
  CRISPR gRNA sequence
atactcctaatcacatcccc

SEQ ID NO: 272705 - DNA, 20 bp, Artificial
  CRISPR gRNA sequence
ctaatcacatcccccacctt

SEQ ID NO: 272706 - DNA, 20 bp, Artificial
  CRISPR gRNA sequence
atcacatcccccaccttgag

SEQ ID NO: 272707 - DNA, 20 bp, Artificial
  CRISPR gRNA sequence
gagaaatccttgggattagc

SEQ ID NO: 272708 - DNA, 20 bp, Artificial
  CRISPR gRNA sequence
agaaatccttgggattagct

SEQ ID NO: 272709 - DNA, 20 bp, Artificial
  CRISPR gRNA sequence
gggattagcttttgagtttg

SEQ ID NO: 272710 - DNA, 20 bp, Artificial
  CRISPR gRNA sequence
ggattagcttttgagtttga

SEQ ID NO: 272711 - DNA, 20 bp, Artificial
  CRISPR gRNA sequence
gcttttgagtttgaaaaaag

SEQ ID NO: 272712 - DNA, 20 bp, Artificial
  CRISPR gRNA sequence
ttgagtttgaaaaaagagag

SEQ ID NO: 272713 - DNA, 20 bp, Artificial
  CRISPR gRNA sequence
tgagtttgaaaaaagagagg

SEQ ID NO: 272714 - DNA, 20 bp, Artificial
  CRISPR gRNA sequence
gagtttgaaaaaagagaggg

SEQ ID NO: 272715 - DNA, 20 bp, Artificial
  CRISPR gRNA sequence
agtttgaaaaaagagagggc

SEQ ID NO: 272716 - DNA, 20 bp, Artificial
  CRISPR gRNA sequence
gaaaaaagagagggcaaaag

SEQ ID NO: 272717 - DNA, 20 bp, Artificial
  CRISPR gRNA sequence
aaaaaagagagggcaaaaga

SEQ ID NO: 272718 - DNA, 20 bp, Artificial
  CRISPR gRNA sequence
gcctccccaagccaaggtca

SEQ ID NO: 272719 - DNA, 20 bp, Artificial
  CRISPR gRNA sequence
cccaagccaaggtcaagcaa

SEQ ID NO: 272720 - DNA, 20 bp, Artificial
  CRISPR gRNA sequence
gttccaaaacacacagggaa

SEQ ID NO: 272721 - DNA, 20 bp, Artificial
  CRISPR gRNA sequence
ttccaaaacacacagggaaa

SEQ ID NO: 272722 - DNA, 20 bp, Artificial
  CRISPR gRNA sequence
caaaacacacagggaaatgc

SEQ ID NO: 272723 - DNA, 20 bp, Artificial
  CRISPR gRNA sequence
agattaacatccctgactgg

SEQ ID NO: 272724 - DNA, 20 bp, Artificial
  CRISPR gRNA sequence
acatccctgactggaaacta

SEQ ID NO: 272725 - DNA, 20 bp, Artificial
  CRISPR gRNA sequence
actggaaactagagtcccgc

SEQ ID NO: 272726 - DNA, 20 bp, Artificial
  CRISPR gRNA sequence
gaaactagagtcccgcccat

SEQ ID NO: 272727 - DNA, 20 bp, Artificial
  CRISPR gRNA sequence
gagtcccgcccataatgttg

SEQ ID NO: 272728 - DNA, 20 bp, Artificial
  CRISPR gRNA sequence
ggcagggttggtttgaaccc

SEQ ID NO: 272729 - DNA, 20 bp, Artificial
  CRISPR gRNA sequence
gtttgaaccctgtgaccctg

SEQ ID NO: 272730 - DNA, 20 bp, Artificial
  CRISPR gRNA sequence
gaaccctgtgaccctgtgat

SEQ ID NO: 272731 - DNA, 20 bp, Artificial
  CRISPR gRNA sequence
aaccctgtgaccctgtgatc

SEQ ID NO: 272732 - DNA, 20 bp, Artificial
  CRISPR gRNA sequence
tgaccctgtgatctcagccg

SEQ ID NO: 272733 - DNA, 20 bp, Artificial
  CRISPR gRNA sequence
tgatctcagccgtgagctga

SEQ ID NO: 272734 - DNA, 20 bp, Artificial
  CRISPR gRNA sequence
agccgtgagctgaggtcaag

SEQ ID NO: 272735 - DNA, 20 bp, Artificial
  CRISPR gRNA sequence
aggtcaagcctagccatagt

SEQ ID NO: 272736 - DNA, 20 bp, Artificial
  CRISPR gRNA sequence
gccatagtgtgcattgttga

SEQ ID NO: 272737 - DNA, 20 bp, Artificial
  CRISPR gRNA sequence
ttgaggactcaagcaagaat

SEQ ID NO: 272738 - DNA, 20 bp, Artificial
  CRISPR gRNA sequence
aggactcaagcaagaattta

SEQ ID NO: 272739 - DNA, 20 bp, Artificial
  CRISPR gRNA sequence
aagcaagaatttaaagtaca

SEQ ID NO: 272740 - DNA, 20 bp, Artificial
  CRISPR gRNA sequence
aaagtacacatgggcaaagt

SEQ ID NO: 272741 - DNA, 20 bp, Artificial
  CRISPR gRNA sequence
aagtacacatgggcaaagtc

SEQ ID NO: 272742 - DNA, 20 bp, Artificial
  CRISPR gRNA sequence
cagagagaaggcatgtatta

SEQ ID NO: 272743 - DNA, 20 bp, Artificial
  CRISPR gRNA sequence
agagagaaggcatgtattac

SEQ ID NO: 272744 - DNA, 20 bp, Artificial
  CRISPR gRNA sequence
cccagtagcccttgttgata

SEQ ID NO: 272745 - DNA, 20 bp, Artificial
  CRISPR gRNA sequence
gttgatataggtttaacatc

SEQ ID NO: 272746 - DNA, 20 bp, Artificial
  CRISPR gRNA sequence
ttgatataggtttaacatca

SEQ ID NO: 272747 - DNA, 20 bp, Artificial
  CRISPR gRNA sequence
atataggtttaacatcatga

SEQ ID NO: 272748 - DNA, 20 bp, Artificial
  CRISPR gRNA sequence
aacatcatgacctactctga

SEQ ID NO: 272749 - DNA, 20 bp, Artificial
  CRISPR gRNA sequence
acatcatgacctactctgag

SEQ ID NO: 272750 - DNA, 20 bp, Artificial
  CRISPR gRNA sequence
ctctgagagatttgtttgtt

SEQ ID NO: 272751 - DNA, 20 bp, Artificial
  CRISPR gRNA sequence
tgagagatttgtttgttttt

SEQ ID NO: 272752 - DNA, 20 bp, Artificial
  CRISPR gRNA sequence
agagatttgtttgtttttaa

SEQ ID NO: 272753 - DNA, 20 bp, Artificial
  CRISPR gRNA sequence
gtttgtttttaacctcaggt

SEQ ID NO: 272754 - DNA, 20 bp, Artificial
  CRISPR gRNA sequence
tttgtttttaacctcaggtt

SEQ ID NO: 272755 - DNA, 20 bp, Artificial
  CRISPR gRNA sequence
gtttttaacctcaggttcac

SEQ ID NO: 272756 - DNA, 20 bp, Artificial
  CRISPR gRNA sequence
tttttaacctcaggttcacc

SEQ ID NO: 272757 - DNA, 20 bp, Artificial
  CRISPR gRNA sequence
ttaacctcaggttcaccagt

SEQ ID NO: 272758 - DNA, 20 bp, Artificial
  CRISPR gRNA sequence
taacctcaggttcaccagta

SEQ ID NO: 272759 - DNA, 20 bp, Artificial
  CRISPR gRNA sequence
aacctcaggttcaccagtat

SEQ ID NO: 272760 - DNA, 20 bp, Artificial
  CRISPR gRNA sequence
acctcaggttcaccagtata

SEQ ID NO: 272761 - DNA, 20 bp, Artificial
  CRISPR gRNA sequence
aggttcaccagtatagaatc

SEQ ID NO: 272762 - DNA, 20 bp, Artificial
  CRISPR gRNA sequence
accagtatagaatcactcat

SEQ ID NO: 272763 - DNA, 20 bp, Artificial
  CRISPR gRNA sequence
atctaccatagcttcattct

SEQ ID NO: 272764 - DNA, 20 bp, Artificial
  CRISPR gRNA sequence
ccatagcttcattctaactt

SEQ ID NO: 272765 - DNA, 20 bp, Artificial
  CRISPR gRNA sequence
cattctaacttatctctacc

SEQ ID NO: 272766 - DNA, 20 bp, Artificial
  CRISPR gRNA sequence
attctaacttatctctaccc

SEQ ID NO: 272767 - DNA, 20 bp, Artificial
  CRISPR gRNA sequence
taacttatctctacccctat

SEQ ID NO: 272768 - DNA, 20 bp, Artificial
  CRISPR gRNA sequence
acttatctctacccctataa

SEQ ID NO: 272769 - DNA, 20 bp, Artificial
  CRISPR gRNA sequence
atctctacccctataagtct

SEQ ID NO: 272770 - DNA, 20 bp, Artificial
  CRISPR gRNA sequence
tctctacccctataagtctc

SEQ ID NO: 272771 - DNA, 20 bp, Artificial
  CRISPR gRNA sequence
tacccctataagtctcttct

SEQ ID NO: 272772 - DNA, 20 bp, Artificial
  CRISPR gRNA sequence
cccctataagtctcttctct

SEQ ID NO: 272773 - DNA, 20 bp, Artificial
  CRISPR gRNA sequence
taagtctcttctcttcctcc

SEQ ID NO: 272774 - DNA, 20 bp, Artificial
  CRISPR gRNA sequence
ttctcttcctccctatcttc

SEQ ID NO: 272775 - DNA, 20 bp, Artificial
  CRISPR gRNA sequence
ctcttcctccctatcttctt

SEQ ID NO: 272776 - DNA, 20 bp, Artificial
  CRISPR gRNA sequence
tcttcctccctatcttctta

SEQ ID NO: 272777 - DNA, 20 bp, Artificial
  CRISPR gRNA sequence
ttcctccctatcttcttaga

SEQ ID NO: 272778 - DNA, 20 bp, Artificial
  CRISPR gRNA sequence
cctccctatcttcttagaga

SEQ ID NO: 272779 - DNA, 20 bp, Artificial
  CRISPR gRNA sequence
ctccctatcttcttagagat

SEQ ID NO: 272780 - DNA, 20 bp, Artificial
  CRISPR gRNA sequence
cctatcttcttagagatttg

SEQ ID NO: 272781 - DNA, 20 bp, Artificial
  CRISPR gRNA sequence
tcttcttagagatttgtcct

SEQ ID NO: 272782 - DNA, 20 bp, Artificial
  CRISPR gRNA sequence
cttagagatttgtcctcctc

SEQ ID NO: 272783 - DNA, 20 bp, Artificial
  CRISPR gRNA sequence
ttagagatttgtcctcctct

SEQ ID NO: 272784 - DNA, 20 bp, Artificial
  CRISPR gRNA sequence
agagatttgtcctcctctct

SEQ ID NO: 272785 - DNA, 20 bp, Artificial
  CRISPR gRNA sequence
gagatttgtcctcctctctc

SEQ ID NO: 272786 - DNA, 20 bp, Artificial
  CRISPR gRNA sequence
gtcctcctctctctaataca

SEQ ID NO: 272787 - DNA, 20 bp, Artificial
  CRISPR gRNA sequence
tcctcctctctctaatacac

SEQ ID NO: 272788 - DNA, 20 bp, Artificial
  CRISPR gRNA sequence
ctctctctaatacactcatc

SEQ ID NO: 272789 - DNA, 20 bp, Artificial
  CRISPR gRNA sequence
tctctaatacactcatctcc

SEQ ID NO: 272790 - DNA, 20 bp, Artificial
  CRISPR gRNA sequence
tctaatacactcatctccta

SEQ ID NO: 272791 - DNA, 20 bp, Artificial
  CRISPR gRNA sequence
taatacactcatctcctatg

SEQ ID NO: 272792 - DNA, 20 bp, Artificial
  CRISPR gRNA sequence
atacactcatctcctatgca

SEQ ID NO: 272793 - DNA, 20 bp, Artificial
  CRISPR gRNA sequence
atctcctatgcaacaaatct

SEQ ID NO: 272794 - DNA, 20 bp, Artificial
  CRISPR gRNA sequence
ctatgcaacaaatctccctc

SEQ ID NO: 272795 - DNA, 20 bp, Artificial
  CRISPR gRNA sequence
tgcaacaaatctccctccct

SEQ ID NO: 272796 - DNA, 20 bp, Artificial
  CRISPR gRNA sequence
cctccctatctccttgagaa

SEQ ID NO: 272797 - DNA, 20 bp, Artificial
  CRISPR gRNA sequence
cctatctccttgagaaaact

SEQ ID NO: 272798 - DNA, 20 bp, Artificial
  CRISPR gRNA sequence
tctccttgagaaaactatcc

SEQ ID NO: 272799 - DNA, 20 bp, Artificial
  CRISPR gRNA sequence
cttgagaaaactatccccac

SEQ ID NO: 272800 - DNA, 20 bp, Artificial
  CRISPR gRNA sequence
gagaaaactatccccaccct

SEQ ID NO: 272801 - DNA, 20 bp, Artificial
  CRISPR gRNA sequence
agaaaactatccccaccctc

SEQ ID NO: 272802 - DNA, 20 bp, Artificial
  CRISPR gRNA sequence
tccccaccctctttttttcc

SEQ ID NO: 272803 - DNA, 20 bp, Artificial
  CRISPR gRNA sequence
tttttttcctctccctcctc

SEQ ID NO: 272804 - DNA, 20 bp, Artificial
  CRISPR gRNA sequence
tttttcctctccctcctcct

SEQ ID NO: 272805 - DNA, 20 bp, Artificial
  CRISPR gRNA sequence
ttttcctctccctcctcctc

SEQ ID NO: 272806 - DNA, 20 bp, Artificial
  CRISPR gRNA sequence
tttcctctccctcctcctcc

SEQ ID NO: 272807 - DNA, 20 bp, Artificial
  CRISPR gRNA sequence
ttcctctccctcctcctcct

SEQ ID NO: 272808 - DNA, 20 bp, Artificial
  CRISPR gRNA sequence
tcctctccctcctcctcctt

SEQ ID NO: 272809 - DNA, 20 bp, Artificial
  CRISPR gRNA sequence
cctctccctcctcctccttt

SEQ ID NO: 272810 - DNA, 20 bp, Artificial
  CRISPR gRNA sequence
ctctccctcctcctcctttc

SEQ ID NO: 272811 - DNA, 20 bp, Artificial
  CRISPR gRNA sequence
tccctcctcctcctttcttt

SEQ ID NO: 272812 - DNA, 20 bp, Artificial
  CRISPR gRNA sequence
cctcctcctcctttctttcc

SEQ ID NO: 272813 - DNA, 20 bp, Artificial
  CRISPR gRNA sequence
ctcctcctttctttcctaat

SEQ ID NO: 272814 - DNA, 20 bp, Artificial
  CRISPR gRNA sequence
ctcctttctttcctaataat

SEQ ID NO: 272815 - DNA, 20 bp, Artificial
  CRISPR gRNA sequence
ctttctttcctaataatacc

SEQ ID NO: 272816 - DNA, 20 bp, Artificial
  CRISPR gRNA sequence
tctttcctaataataccctt

SEQ ID NO: 272817 - DNA, 20 bp, Artificial
  CRISPR gRNA sequence
ctttcctaataatacccttc

SEQ ID NO: 272818 - DNA, 20 bp, Artificial
  CRISPR gRNA sequence
tttcctaataatacccttct

SEQ ID NO: 272819 - DNA, 20 bp, Artificial
  CRISPR gRNA sequence
tcctaataatacccttctct

SEQ ID NO: 272820 - DNA, 20 bp, Artificial
  CRISPR gRNA sequence
cctaataatacccttctcta

SEQ ID NO: 272821 - DNA, 20 bp, Artificial
  CRISPR gRNA sequence
ctaataatacccttctctac

SEQ ID NO: 272822 - DNA, 20 bp, Artificial
  CRISPR gRNA sequence
ataatacccttctctaccct

SEQ ID NO: 272823 - DNA, 20 bp, Artificial
  CRISPR gRNA sequence
ctctaccctcaagccctgca

SEQ ID NO: 272824 - DNA, 20 bp, Artificial
  CRISPR gRNA sequence
tctaccctcaagccctgcaa

SEQ ID NO: 272825 - DNA, 20 bp, Artificial
  CRISPR gRNA sequence
taccctcaagccctgcaatg

SEQ ID NO: 272826 - DNA, 20 bp, Artificial
  CRISPR gRNA sequence
ccctcaagccctgcaatgct

SEQ ID NO: 272827 - DNA, 20 bp, Artificial
  CRISPR gRNA sequence
aagccctgcaatgctacaca

SEQ ID NO: 272828 - DNA, 20 bp, Artificial
  CRISPR gRNA sequence
caatgctacacacacacaca

SEQ ID NO: 272829 - DNA, 20 bp, Artificial
  CRISPR gRNA sequence
cacacacacacacacactct

SEQ ID NO: 272830 - DNA, 20 bp, Artificial
  CRISPR gRNA sequence
tctctctctgtctctctctc

SEQ ID NO: 272831 - DNA, 20 bp, Artificial
  CRISPR gRNA sequence
tctctctgtctctctctctc

SEQ ID NO: 272832 - DNA, 20 bp, Artificial
  CRISPR gRNA sequence
tctctgtctctctctctctc

SEQ ID NO: 272833 - DNA, 20 bp, Artificial
  CRISPR gRNA sequence
tctgtctctctctctctctc

SEQ ID NO: 272834 - DNA, 20 bp, Artificial
  CRISPR gRNA sequence
tgtctctctctctctctctc

SEQ ID NO: 272835 - DNA, 20 bp, Artificial
  CRISPR gRNA sequence
tctctctctctctctctctc

SEQ ID NO: 272836 - DNA, 20 bp, Artificial
  CRISPR gRNA sequence
tctctctctctctctctctc

SEQ ID NO: 272837 - DNA, 20 bp, Artificial
  CRISPR gRNA sequence
tctctctctctctctctccc

SEQ ID NO: 272838 - DNA, 20 bp, Artificial
  CRISPR gRNA sequence
tctctctctctctctccctc

SEQ ID NO: 272839 - DNA, 20 bp, Artificial
  CRISPR gRNA sequence
tctctctctctctccctctc

SEQ ID NO: 272840 - DNA, 20 bp, Artificial
  CRISPR gRNA sequence
tctctctctctccctctctc

SEQ ID NO: 272841 - DNA, 20 bp, Artificial
  CRISPR gRNA sequence
tctctctctccctctctctc

SEQ ID NO: 272842 - DNA, 20 bp, Artificial
  CRISPR gRNA sequence
tctctctccctctctctctc

SEQ ID NO: 272843 - DNA, 20 bp, Artificial
  CRISPR gRNA sequence
tctctccctctctctctctc

SEQ ID NO: 272844 - DNA, 20 bp, Artificial
  CRISPR gRNA sequence
tctccctctctctctctctc

SEQ ID NO: 272845 - DNA, 20 bp, Artificial
  CRISPR gRNA sequence
tccctctctctctctctctc

SEQ ID NO: 272846 - DNA, 20 bp, Artificial
  CRISPR gRNA sequence
cctctctctctctctctcag

SEQ ID NO: 272847 - DNA, 20 bp, Artificial
  CRISPR gRNA sequence
tctctctctctctcaggtcc

SEQ ID NO: 272848 - DNA, 20 bp, Artificial
  CRISPR gRNA sequence
tctctctctctcaggtccag

SEQ ID NO: 272849 - DNA, 20 bp, Artificial
  CRISPR gRNA sequence
tctctctctcaggtccagca

SEQ ID NO: 272850 - DNA, 20 bp, Artificial
  CRISPR gRNA sequence
tctctctcaggtccagcact

SEQ ID NO: 272851 - DNA, 20 bp, Artificial
  CRISPR gRNA sequence
tctctcaggtccagcacttg

SEQ ID NO: 272852 - DNA, 20 bp, Artificial
  CRISPR gRNA sequence
tctcaggtccagcacttggc

SEQ ID NO: 272853 - DNA, 20 bp, Artificial
  CRISPR gRNA sequence
tcaggtccagcacttggctc

SEQ ID NO: 272854 - DNA, 20 bp, Artificial
  CRISPR gRNA sequence
aggtccagcacttggctcct

SEQ ID NO: 272855 - DNA, 20 bp, Artificial
  CRISPR gRNA sequence
ggctccttccacatgtcaaa

SEQ ID NO: 272856 - DNA, 20 bp, Artificial
  CRISPR gRNA sequence
gctccttccacatgtcaaac

SEQ ID NO: 272857 - DNA, 20 bp, Artificial
  CRISPR gRNA sequence
cttccacatgtcaaacatac

SEQ ID NO: 272858 - DNA, 20 bp, Artificial
  CRISPR gRNA sequence
ccacatgtcaaacatactta

SEQ ID NO: 272859 - DNA, 20 bp, Artificial
  CRISPR gRNA sequence
cacatgtcaaacatacttaa

SEQ ID NO: 272860 - DNA, 20 bp, Artificial
  CRISPR gRNA sequence
aagtcactcagccatttgca

SEQ ID NO: 272861 - DNA, 20 bp, Artificial
  CRISPR gRNA sequence
agtcactcagccatttgcaa

SEQ ID NO: 272862 - DNA, 20 bp, Artificial
  CRISPR gRNA sequence
agccatttgcaaacatttat

SEQ ID NO: 272863 - DNA, 20 bp, Artificial
  CRISPR gRNA sequence
gcaaacatttattattacat

SEQ ID NO: 272864 - DNA, 20 bp, Artificial
  CRISPR gRNA sequence
caaacatttattattacatg

SEQ ID NO: 272865 - DNA, 20 bp, Artificial
  CRISPR gRNA sequence
attattacatgcacaaaata

SEQ ID NO: 272866 - DNA, 20 bp, Artificial
  CRISPR gRNA sequence
ttattacatgcacaaaatac

SEQ ID NO: 272867 - DNA, 20 bp, Artificial
  CRISPR gRNA sequence
ttacatgcacaaaataccat

SEQ ID NO: 272868 - DNA, 20 bp, Artificial
  CRISPR gRNA sequence
catgcacaaaataccatggt

SEQ ID NO: 272869 - DNA, 20 bp, Artificial
  CRISPR gRNA sequence
taggtgatataagttcctaa

SEQ ID NO: 272870 - DNA, 20 bp, Artificial
  CRISPR gRNA sequence
aggtgatataagttcctaat

SEQ ID NO: 272871 - DNA, 20 bp, Artificial
  CRISPR gRNA sequence
ggtgatataagttcctaatt

SEQ ID NO: 272872 - DNA, 20 bp, Artificial
  CRISPR gRNA sequence
ctaattgtctttaccttatc

SEQ ID NO: 272873 - DNA, 20 bp, Artificial
  CRISPR gRNA sequence
attgtctttaccttatctat

SEQ ID NO: 272874 - DNA, 20 bp, Artificial
  CRISPR gRNA sequence
tctttaccttatctatttcc

SEQ ID NO: 272875 - DNA, 20 bp, Artificial
  CRISPR gRNA sequence
taccttatctatttcctctc

SEQ ID NO: 272876 - DNA, 20 bp, Artificial
  CRISPR gRNA sequence
accttatctatttcctctcc

SEQ ID NO: 272877 - DNA, 20 bp, Artificial
  CRISPR gRNA sequence
ccttatctatttcctctcct

SEQ ID NO: 272878 - DNA, 20 bp, Artificial
  CRISPR gRNA sequence
atctatttcctctccttttc

SEQ ID NO: 272879 - DNA, 20 bp, Artificial
  CRISPR gRNA sequence
tctatttcctctccttttca

SEQ ID NO: 272880 - DNA, 20 bp, Artificial
  CRISPR gRNA sequence
tttcctctccttttcactgt

SEQ ID NO: 272881 - DNA, 20 bp, Artificial
  CRISPR gRNA sequence
cctctccttttcactgtctc

SEQ ID NO: 272882 - DNA, 20 bp, Artificial
  CRISPR gRNA sequence
ctctccttttcactgtctct

SEQ ID NO: 272883 - DNA, 20 bp, Artificial
  CRISPR gRNA sequence
tccttttcactgtctctgtt

SEQ ID NO: 272884 - DNA, 20 bp, Artificial
  CRISPR gRNA sequence
cttttcactgtctctgtttt

SEQ ID NO: 272885 - DNA, 20 bp, Artificial
  CRISPR gRNA sequence
ttcactgtctctgttttgtc

SEQ ID NO: 272886 - DNA, 20 bp, Artificial
  CRISPR gRNA sequence
tcactgtctctgttttgtcc

SEQ ID NO: 272887 - DNA, 20 bp, Artificial
  CRISPR gRNA sequence
cactgtctctgttttgtccc

SEQ ID NO: 272888 - DNA, 20 bp, Artificial
  CRISPR gRNA sequence
actgtctctgttttgtcccc

SEQ ID NO: 272889 - DNA, 20 bp, Artificial
  CRISPR gRNA sequence
tctctgttttgtccccctcc

SEQ ID NO: 272890 - DNA, 20 bp, Artificial
  CRISPR gRNA sequence
tgttttgtccccctccactt

SEQ ID NO: 272891 - DNA, 20 bp, Artificial
  CRISPR gRNA sequence
ttttgtccccctccactttt

SEQ ID NO: 272892 - DNA, 20 bp, Artificial
  CRISPR gRNA sequence
tgtccccctccactttttct

SEQ ID NO: 272893 - DNA, 20 bp, Artificial
  CRISPR gRNA sequence
gtccccctccactttttctt

SEQ ID NO: 272894 - DNA, 20 bp, Artificial
  CRISPR gRNA sequence
tccccctccactttttctta

SEQ ID NO: 272895 - DNA, 20 bp, Artificial
  CRISPR gRNA sequence
cactttttcttaatcctgtg

SEQ ID NO: 272896 - DNA, 20 bp, Artificial
  CRISPR gRNA sequence
tttcttaatcctgtgaagtc

SEQ ID NO: 272897 - DNA, 20 bp, Artificial
  CRISPR gRNA sequence
ttcttaatcctgtgaagtct

SEQ ID NO: 272898 - DNA, 20 bp, Artificial
  CRISPR gRNA sequence
tcttaatcctgtgaagtctt

SEQ ID NO: 272899 - DNA, 20 bp, Artificial
  CRISPR gRNA sequence
cttaatcctgtgaagtctta

SEQ ID NO: 272900 - DNA, 20 bp, Artificial
  CRISPR gRNA sequence
ttaatcctgtgaagtcttat

SEQ ID NO: 272901 - DNA, 20 bp, Artificial
  CRISPR gRNA sequence
aatcctgtgaagtcttatct

SEQ ID NO: 272902 - DNA, 20 bp, Artificial
  CRISPR gRNA sequence
atcctgtgaagtcttatctt

SEQ ID NO: 272903 - DNA, 20 bp, Artificial
  CRISPR gRNA sequence
tgaagtcttatcttccttct

SEQ ID NO: 272904 - DNA, 20 bp, Artificial
  CRISPR gRNA sequence
atcttccttctccatgtctc

SEQ ID NO: 272905 - DNA, 20 bp, Artificial
  CRISPR gRNA sequence
tcttccttctccatgtctct

SEQ ID NO: 272906 - DNA, 20 bp, Artificial
  CRISPR gRNA sequence
ccttctccatgtctctgcct

SEQ ID NO: 272907 - DNA, 20 bp, Artificial
  CRISPR gRNA sequence
cttctccatgtctctgccta

SEQ ID NO: 272908 - DNA, 20 bp, Artificial
  CRISPR gRNA sequence
ctccatgtctctgcctaaac

SEQ ID NO: 272909 - DNA, 20 bp, Artificial
  CRISPR gRNA sequence
tccatgtctctgcctaaact

SEQ ID NO: 272910 - DNA, 20 bp, Artificial
  CRISPR gRNA sequence
catgtctctgcctaaactca

SEQ ID NO: 272911 - DNA, 20 bp, Artificial
  CRISPR gRNA sequence
tgcctaaactcaaaagtccc

SEQ ID NO: 272912 - DNA, 20 bp, Artificial
  CRISPR gRNA sequence
cctaaactcaaaagtcccag

SEQ ID NO: 272913 - DNA, 20 bp, Artificial
  CRISPR gRNA sequence
aactcaaaagtcccaggtgg

SEQ ID NO: 272914 - DNA, 20 bp, Artificial
  CRISPR gRNA sequence
aaaagtcccaggtggcgttt

SEQ ID NO: 272915 - DNA, 20 bp, Artificial
  CRISPR gRNA sequence
cagccaaatcccaagccatt

SEQ ID NO: 272916 - DNA, 20 bp, Artificial
  CRISPR gRNA sequence
agccaaatcccaagccatta

SEQ ID NO: 272917 - DNA, 20 bp, Artificial
  CRISPR gRNA sequence
ttcactcctttccctcttat

SEQ ID NO: 272918 - DNA, 20 bp, Artificial
  CRISPR gRNA sequence
actcctttccctcttatgtt

SEQ ID NO: 272919 - DNA, 20 bp, Artificial
  CRISPR gRNA sequence
ctttccctcttatgtttaat

SEQ ID NO: 272920 - DNA, 20 bp, Artificial
  CRISPR gRNA sequence
tccctcttatgtttaatgct

SEQ ID NO: 272921 - DNA, 20 bp, Artificial
  CRISPR gRNA sequence
ccctcttatgtttaatgcta

SEQ ID NO: 272922 - DNA, 20 bp, Artificial
  CRISPR gRNA sequence
cctcttatgtttaatgctat

SEQ ID NO: 272923 - DNA, 20 bp, Artificial
  CRISPR gRNA sequence
ttatgtttaatgctattaac

SEQ ID NO: 272924 - DNA, 20 bp, Artificial
  CRISPR gRNA sequence
atgtttaatgctattaacca

SEQ ID NO: 272925 - DNA, 20 bp, Artificial
  CRISPR gRNA sequence
tgtttaatgctattaaccac

SEQ ID NO: 272926 - DNA, 20 bp, Artificial
  CRISPR gRNA sequence
aatgctattaaccactatct

SEQ ID NO: 272927 - DNA, 20 bp, Artificial
  CRISPR gRNA sequence
atgctattaaccactatctt

SEQ ID NO: 272928 - DNA, 20 bp, Artificial
  CRISPR gRNA sequence
ttaaccactatctttttgaa

SEQ ID NO: 272929 - DNA, 20 bp, Artificial
  CRISPR gRNA sequence
accactatctttttgaaact

SEQ ID NO: 272930 - DNA, 20 bp, Artificial
  CRISPR gRNA sequence
tctttttgaaactctttccc

SEQ ID NO: 272931 - DNA, 20 bp, Artificial
  CRISPR gRNA sequence
tttgaaactctttccctcat

SEQ ID NO: 272932 - DNA, 20 bp, Artificial
  CRISPR gRNA sequence
ttgaaactctttccctcatt

SEQ ID NO: 272933 - DNA, 20 bp, Artificial
  CRISPR gRNA sequence
tgaaactctttccctcattg

SEQ ID NO: 272934 - DNA, 20 bp, Artificial
  CRISPR gRNA sequence
gaaactctttccctcattgg

SEQ ID NO: 272935 - DNA, 20 bp, Artificial
  CRISPR gRNA sequence
aaactctttccctcattggc

SEQ ID NO: 272936 - DNA, 20 bp, Artificial
  CRISPR gRNA sequence
tttccctcattggcttagtg

SEQ ID NO: 272937 - DNA, 20 bp, Artificial
  CRISPR gRNA sequence
tccctcattggcttagtggc

SEQ ID NO: 272938 - DNA, 20 bp, Artificial
  CRISPR gRNA sequence
ccctcattggcttagtggca

SEQ ID NO: 272939 - DNA, 20 bp, Artificial
  CRISPR gRNA sequence
cctcattggcttagtggcat

SEQ ID NO: 272940 - DNA, 20 bp, Artificial
  CRISPR gRNA sequence
attggcttagtggcattcca

SEQ ID NO: 272941 - DNA, 20 bp, Artificial
  CRISPR gRNA sequence
gcttagtggcattccactag

SEQ ID NO: 272942 - DNA, 20 bp, Artificial
  CRISPR gRNA sequence
agtggcattccactagcctc

SEQ ID NO: 272943 - DNA, 20 bp, Artificial
  CRISPR gRNA sequence
gtggcattccactagcctca

SEQ ID NO: 272944 - DNA, 20 bp, Artificial
  CRISPR gRNA sequence
cactagcctcactgtgtccc

SEQ ID NO: 272945 - DNA, 20 bp, Artificial
  CRISPR gRNA sequence
gcctcactgtgtccccctgc

SEQ ID NO: 272946 - DNA, 20 bp, Artificial
  CRISPR gRNA sequence
actgtgtccccctgcctctc

SEQ ID NO: 272947 - DNA, 20 bp, Artificial
  CRISPR gRNA sequence
tgtccccctgcctctctcac

SEQ ID NO: 272948 - DNA, 20 bp, Artificial
  CRISPR gRNA sequence
cctctctcaccactttcttt

SEQ ID NO: 272949 - DNA, 20 bp, Artificial
  CRISPR gRNA sequence
tctcaccactttctttgtct

SEQ ID NO: 272950 - DNA, 20 bp, Artificial
  CRISPR gRNA sequence
tcaccactttctttgtctcc

SEQ ID NO: 272951 - DNA, 20 bp, Artificial
  CRISPR gRNA sequence
accactttctttgtctcctt

SEQ ID NO: 272952 - DNA, 20 bp, Artificial
  CRISPR gRNA sequence
tctttgtctccttcactagc

SEQ ID NO: 272953 - DNA, 20 bp, Artificial
  CRISPR gRNA sequence
ctttgtctccttcactagct

SEQ ID NO: 272954 - DNA, 20 bp, Artificial
  CRISPR gRNA sequence
tttgtctccttcactagcta

SEQ ID NO: 272955 - DNA, 20 bp, Artificial
  CRISPR gRNA sequence
tgtctccttcactagctaac

SEQ ID NO: 272956 - DNA, 20 bp, Artificial
  CRISPR gRNA sequence
gtctccttcactagctaacc

SEQ ID NO: 272957 - DNA, 20 bp, Artificial
  CRISPR gRNA sequence
tctccttcactagctaacca

SEQ ID NO: 272958 - DNA, 20 bp, Artificial
  CRISPR gRNA sequence
cttcactagctaaccatcct

SEQ ID NO: 272959 - DNA, 20 bp, Artificial
  CRISPR gRNA sequence
cactagctaaccatcctttt

SEQ ID NO: 272960 - DNA, 20 bp, Artificial
  CRISPR gRNA sequence
actagctaaccatccttttc

SEQ ID NO: 272961 - DNA, 20 bp, Artificial
  CRISPR gRNA sequence
gctaaccatccttttcagct

SEQ ID NO: 272962 - DNA, 20 bp, Artificial
  CRISPR gRNA sequence
accatccttttcagctgact

SEQ ID NO: 272963 - DNA, 20 bp, Artificial
  CRISPR gRNA sequence
ttcagctgactcccatcaga

SEQ ID NO: 272964 - DNA, 20 bp, Artificial
  CRISPR gRNA sequence
tcagctgactcccatcagag

SEQ ID NO: 272965 - DNA, 20 bp, Artificial
  CRISPR gRNA sequence
cagctgactcccatcagagc

SEQ ID NO: 272966 - DNA, 20 bp, Artificial
  CRISPR gRNA sequence
agctgactcccatcagagcc

SEQ ID NO: 272967 - DNA, 20 bp, Artificial
  CRISPR gRNA sequence
actcccatcagagccagtta

SEQ ID NO: 272968 - DNA, 20 bp, Artificial
  CRISPR gRNA sequence
ccatcagagccagttagttt

SEQ ID NO: 272969 - DNA, 20 bp, Artificial
  CRISPR gRNA sequence
gtttccagattcagctccac

SEQ ID NO: 272970 - DNA, 20 bp, Artificial
  CRISPR gRNA sequence
ccagattcagctccactctc

SEQ ID NO: 272971 - DNA, 20 bp, Artificial
  CRISPR gRNA sequence
cagattcagctccactctct

SEQ ID NO: 272972 - DNA, 20 bp, Artificial
  CRISPR gRNA sequence
agctccactctctgtttttc

SEQ ID NO: 272973 - DNA, 20 bp, Artificial
  CRISPR gRNA sequence
cactctctgtttttctacag

SEQ ID NO: 272974 - DNA, 20 bp, Artificial
  CRISPR gRNA sequence
tctgtttttctacagttatg

SEQ ID NO: 272975 - DNA, 20 bp, Artificial
  CRISPR gRNA sequence
tgtttttctacagttatgcc

SEQ ID NO: 272976 - DNA, 20 bp, Artificial
  CRISPR gRNA sequence
tttttctacagttatgccct

SEQ ID NO: 272977 - DNA, 20 bp, Artificial
  CRISPR gRNA sequence
ttctacagttatgccctctc

SEQ ID NO: 272978 - DNA, 20 bp, Artificial
  CRISPR gRNA sequence
tctacagttatgccctctcc

SEQ ID NO: 272979 - DNA, 20 bp, Artificial
  CRISPR gRNA sequence
ctacagttatgccctctcct

SEQ ID NO: 272980 - DNA, 20 bp, Artificial
  CRISPR gRNA sequence
tacagttatgccctctcctt

SEQ ID NO: 272981 - DNA, 20 bp, Artificial
  CRISPR gRNA sequence
cagttatgccctctcctttc

SEQ ID NO: 272982 - DNA, 20 bp, Artificial
  CRISPR gRNA sequence
tgccctctcctttcgactag

SEQ ID NO: 272983 - DNA, 20 bp, Artificial
  CRISPR gRNA sequence
tcctttcgactagccatcca

SEQ ID NO: 272984 - DNA, 20 bp, Artificial
  CRISPR gRNA sequence
ctttcgactagccatccatt

SEQ ID NO: 272985 - DNA, 20 bp, Artificial
  CRISPR gRNA sequence
tcgactagccatccattccc

SEQ ID NO: 272986 - DNA, 20 bp, Artificial
  CRISPR gRNA sequence
cgactagccatccattccca

SEQ ID NO: 272987 - DNA, 20 bp, Artificial
  CRISPR gRNA sequence
gactagccatccattcccat

SEQ ID NO: 272988 - DNA, 20 bp, Artificial
  CRISPR gRNA sequence
gccatccattcccataactc

SEQ ID NO: 272989 - DNA, 20 bp, Artificial
  CRISPR gRNA sequence
ccataactccagcttcattc

SEQ ID NO: 272990 - DNA, 20 bp, Artificial
  CRISPR gRNA sequence
cagcttcattccaaagataa

SEQ ID NO: 272991 - DNA, 20 bp, Artificial
  CRISPR gRNA sequence
cattccaaagataaggattc

SEQ ID NO: 272992 - DNA, 20 bp, Artificial
  CRISPR gRNA sequence
attccaaagataaggattct

SEQ ID NO: 272993 - DNA, 20 bp, Artificial
  CRISPR gRNA sequence
caaagataaggattctgaaa

SEQ ID NO: 272994 - DNA, 20 bp, Artificial
  CRISPR gRNA sequence
tgaaatattttcttcttacc

SEQ ID NO: 272995 - DNA, 20 bp, Artificial
  CRISPR gRNA sequence
aaatattttcttcttaccca

SEQ ID NO: 272996 - DNA, 20 bp, Artificial
  CRISPR gRNA sequence
tcttcttacccaggccatta

SEQ ID NO: 272997 - DNA, 20 bp, Artificial
  CRISPR gRNA sequence
cttcttacccaggccattac

SEQ ID NO: 272998 - DNA, 20 bp, Artificial
  CRISPR gRNA sequence
ttcttacccaggccattact

SEQ ID NO: 272999 - DNA, 20 bp, Artificial
  CRISPR gRNA sequence
cttacccaggccattacttc

SEQ ID NO: 273000 - DNA, 20 bp, Artificial
  CRISPR gRNA sequence
ttacccaggccattacttca

SEQ ID NO: 273001 - DNA, 20 bp, Artificial
  CRISPR gRNA sequence
acccaggccattacttcaaa

SEQ ID NO: 273002 - DNA, 20 bp, Artificial
  CRISPR gRNA sequence
cccaggccattacttcaaaa

SEQ ID NO: 273003 - DNA, 20 bp, Artificial
  CRISPR gRNA sequence
cttcaaaatgacttgaaaat

SEQ ID NO: 273004 - DNA, 20 bp, Artificial
  CRISPR gRNA sequence
caaaatgacttgaaaataaa

SEQ ID NO: 273005 - DNA, 20 bp, Artificial
  CRISPR gRNA sequence
aaaatgacttgaaaataaag

SEQ ID NO: 273006 - DNA, 20 bp, Artificial
  CRISPR gRNA sequence
gaaaataaagtttgaatttc

SEQ ID NO: 273007 - DNA, 20 bp, Artificial
  CRISPR gRNA sequence
aaaataaagtttgaatttct

SEQ ID NO: 273008 - DNA, 20 bp, Artificial
  CRISPR gRNA sequence
gaatttctgttaccagtatt

SEQ ID NO: 273009 - DNA, 20 bp, Artificial
  CRISPR gRNA sequence
aatttctgttaccagtattc

SEQ ID NO: 273010 - DNA, 20 bp, Artificial
  CRISPR gRNA sequence
ctgttaccagtattctatcc

SEQ ID NO: 273011 - DNA, 20 bp, Artificial
  CRISPR gRNA sequence
tgttaccagtattctatcct

SEQ ID NO: 273012 - DNA, 20 bp, Artificial
  CRISPR gRNA sequence
ttaccagtattctatccttt

SEQ ID NO: 273013 - DNA, 20 bp, Artificial
  CRISPR gRNA sequence
ccagtattctatcctttgct

SEQ ID NO: 273014 - DNA, 20 bp, Artificial
  CRISPR gRNA sequence
tatcctttgcttagctggat

SEQ ID NO: 273015 - DNA, 20 bp, Artificial
  CRISPR gRNA sequence
tcctttgcttagctggattc

SEQ ID NO: 273016 - DNA, 20 bp, Artificial
  CRISPR gRNA sequence
tgcttagctggattctccgc

SEQ ID NO: 273017 - DNA, 20 bp, Artificial
  CRISPR gRNA sequence
gcttagctggattctccgct

SEQ ID NO: 273018 - DNA, 20 bp, Artificial
  CRISPR gRNA sequence
cttagctggattctccgctg

SEQ ID NO: 273019 - DNA, 20 bp, Artificial
  CRISPR gRNA sequence
agctggattctccgctgctt

SEQ ID NO: 273020 - DNA, 20 bp, Artificial
  CRISPR gRNA sequence
gctggattctccgctgcttc

SEQ ID NO: 273021 - DNA, 20 bp, Artificial
  CRISPR gRNA sequence
gattctccgctgcttcacca

SEQ ID NO: 273022 - DNA, 20 bp, Artificial
  CRISPR gRNA sequence
tccgctgcttcaccataacc

SEQ ID NO: 273023 - DNA, 20 bp, Artificial
  CRISPR gRNA sequence
cgctgcttcaccataacctc

SEQ ID NO: 273024 - DNA, 20 bp, Artificial
  CRISPR gRNA sequence
cttcaccataacctcacaca

SEQ ID NO: 273025 - DNA, 20 bp, Artificial
  CRISPR gRNA sequence
caccataacctcacacattc

SEQ ID NO: 273026 - DNA, 20 bp, Artificial
  CRISPR gRNA sequence
accataacctcacacattca

SEQ ID NO: 273027 - DNA, 20 bp, Artificial
  CRISPR gRNA sequence
acacattcagagttgccatc

SEQ ID NO: 273028 - DNA, 20 bp, Artificial
  CRISPR gRNA sequence
agagttgccatctgttctga

SEQ ID NO: 273029 - DNA, 20 bp, Artificial
  CRISPR gRNA sequence
ccatctgttctgagaacatg

SEQ ID NO: 273030 - DNA, 20 bp, Artificial
  CRISPR gRNA sequence
ttctgagaacatgaaacagt

SEQ ID NO: 273031 - DNA, 20 bp, Artificial
  CRISPR gRNA sequence
tgagaacatgaaacagtatt

SEQ ID NO: 273032 - DNA, 20 bp, Artificial
  CRISPR gRNA sequence
agaacatgaaacagtattcc

SEQ ID NO: 273033 - DNA, 20 bp, Artificial
  CRISPR gRNA sequence
ctggtttaatttctttatta

SEQ ID NO: 273034 - DNA, 20 bp, Artificial
  CRISPR gRNA sequence
gtttaatttctttattaatc

SEQ ID NO: 273035 - DNA, 20 bp, Artificial
  CRISPR gRNA sequence
aatttctttattaatccacc

SEQ ID NO: 273036 - DNA, 20 bp, Artificial
  CRISPR gRNA sequence
atttctttattaatccacct

SEQ ID NO: 273037 - DNA, 20 bp, Artificial
  CRISPR gRNA sequence
ctttattaatccaccttttc

SEQ ID NO: 273038 - DNA, 20 bp, Artificial
  CRISPR gRNA sequence
tttattaatccaccttttcc

SEQ ID NO: 273039 - DNA, 20 bp, Artificial
  CRISPR gRNA sequence
tattaatccaccttttcctt

SEQ ID NO: 273040 - DNA, 20 bp, Artificial
  CRISPR gRNA sequence
attaatccaccttttccttc

SEQ ID NO: 273041 - DNA, 20 bp, Artificial
  CRISPR gRNA sequence
ttaatccaccttttccttcc

SEQ ID NO: 273042 - DNA, 20 bp, Artificial
  CRISPR gRNA sequence
atccaccttttccttcctga

SEQ ID NO: 273043 - DNA, 20 bp, Artificial
  CRISPR gRNA sequence
ttccttcctgagacaacaca

SEQ ID NO: 273044 - DNA, 20 bp, Artificial
  CRISPR gRNA sequence
tccttcctgagacaacacag

SEQ ID NO: 273045 - DNA, 20 bp, Artificial
  CRISPR gRNA sequence
ccttcctgagacaacacagc

SEQ ID NO: 273046 - DNA, 20 bp, Artificial
  CRISPR gRNA sequence
cttcctgagacaacacagca

SEQ ID NO: 273047 - DNA, 20 bp, Artificial
  CRISPR gRNA sequence
cctgagacaacacagcattg

SEQ ID NO: 273048 - DNA, 20 bp, Artificial
  CRISPR gRNA sequence
ctgagacaacacagcattgg

SEQ ID NO: 273049 - DNA, 20 bp, Artificial
  CRISPR gRNA sequence
agacaacacagcattggtaa

SEQ ID NO: 273050 - DNA, 20 bp, Artificial
  CRISPR gRNA sequence
gtaagaacatgaaccccaga

SEQ ID NO: 273051 - DNA, 20 bp, Artificial
  CRISPR gRNA sequence
gatttacatacttagtagct

SEQ ID NO: 273052 - DNA, 20 bp, Artificial
  CRISPR gRNA sequence
acatacttagtagctttgtg

SEQ ID NO: 273053 - DNA, 20 bp, Artificial
  CRISPR gRNA sequence
catacttagtagctttgtga

SEQ ID NO: 273054 - DNA, 20 bp, Artificial
  CRISPR gRNA sequence
agtagctttgtgaccataag

SEQ ID NO: 273055 - DNA, 20 bp, Artificial
  CRISPR gRNA sequence
gtagctttgtgaccataagc

SEQ ID NO: 273056 - DNA, 20 bp, Artificial
  CRISPR gRNA sequence
tgtgaccataagcaagatgc

SEQ ID NO: 273057 - DNA, 20 bp, Artificial
  CRISPR gRNA sequence
gtgaccataagcaagatgct

SEQ ID NO: 273058 - DNA, 20 bp, Artificial
  CRISPR gRNA sequence
tgaccataagcaagatgctc

SEQ ID NO: 273059 - DNA, 20 bp, Artificial
  CRISPR gRNA sequence
tacccactctgtgcttcagt

SEQ ID NO: 273060 - DNA, 20 bp, Artificial
  CRISPR gRNA sequence
cccactctgtgcttcagttt

SEQ ID NO: 273061 - DNA, 20 bp, Artificial
  CRISPR gRNA sequence
tgtgcttcagtttccccatc

SEQ ID NO: 273062 - DNA, 20 bp, Artificial
  CRISPR gRNA sequence
tgcttcagtttccccatcta

SEQ ID NO: 273063 - DNA, 20 bp, Artificial
  CRISPR gRNA sequence
cagtttccccatctatgaaa

SEQ ID NO: 273064 - DNA, 20 bp, Artificial
  CRISPR gRNA sequence
agtttccccatctatgaaat

SEQ ID NO: 273065 - DNA, 20 bp, Artificial
  CRISPR gRNA sequence
ccccatctatgaaatagtat

SEQ ID NO: 273066 - DNA, 20 bp, Artificial
  CRISPR gRNA sequence
cccatctatgaaatagtata

SEQ ID NO: 273067 - DNA, 20 bp, Artificial
  CRISPR gRNA sequence
tgaaatagtataatcatagc

SEQ ID NO: 273068 - DNA, 20 bp, Artificial
  CRISPR gRNA sequence
cctcataggacttggagatt

SEQ ID NO: 273069 - DNA, 20 bp, Artificial
  CRISPR gRNA sequence
ataggacttggagattagat

SEQ ID NO: 273070 - DNA, 20 bp, Artificial
  CRISPR gRNA sequence
ggagattagatgacttaata

SEQ ID NO: 273071 - DNA, 20 bp, Artificial
  CRISPR gRNA sequence
gagattagatgacttaatac

SEQ ID NO: 273072 - DNA, 20 bp, Artificial
  CRISPR gRNA sequence
gatgacttaatacagggaaa

SEQ ID NO: 273073 - DNA, 20 bp, Artificial
  CRISPR gRNA sequence
aatacagggaaagccaggca

SEQ ID NO: 273074 - DNA, 20 bp, Artificial
  CRISPR gRNA sequence
atacagggaaagccaggcag

SEQ ID NO: 273075 - DNA, 20 bp, Artificial
  CRISPR gRNA sequence
cctggcacattataagtgca

SEQ ID NO: 273076 - DNA, 20 bp, Artificial
  CRISPR gRNA sequence
gcacattataagtgcaaaat

SEQ ID NO: 273077 - DNA, 20 bp, Artificial
  CRISPR gRNA sequence
taagtgcaaaataaatgtta

SEQ ID NO: 273078 - DNA, 20 bp, Artificial
  CRISPR gRNA sequence
gctagcaattattattaata

SEQ ID NO: 273079 - DNA, 20 bp, Artificial
  CRISPR gRNA sequence
gcaattattattaataacaa

SEQ ID NO: 273080 - DNA, 20 bp, Artificial
  CRISPR gRNA sequence
ttattaataacaacgttcat

SEQ ID NO: 273081 - DNA, 20 bp, Artificial
  CRISPR gRNA sequence
ttaataacaacgttcattca

SEQ ID NO: 273082 - DNA, 20 bp, Artificial
  CRISPR gRNA sequence
ataacaacgttcattcaaat

SEQ ID NO: 273083 - DNA, 20 bp, Artificial
  CRISPR gRNA sequence
attcaaatcttgtctactgt

SEQ ID NO: 273084 - DNA, 20 bp, Artificial
  CRISPR gRNA sequence
aaatcttgtctactgtccag

SEQ ID NO: 273085 - DNA, 20 bp, Artificial
  CRISPR gRNA sequence
gtctactgtccagtctaatt

SEQ ID NO: 273086 - DNA, 20 bp, Artificial
  CRISPR gRNA sequence
tctactgtccagtctaattc

SEQ ID NO: 273087 - DNA, 20 bp, Artificial
  CRISPR gRNA sequence
ctgtccagtctaattcccaa

SEQ ID NO: 273088 - DNA, 20 bp, Artificial
  CRISPR gRNA sequence
tccagtctaattcccaactc

SEQ ID NO: 273089 - DNA, 20 bp, Artificial
  CRISPR gRNA sequence
attcccaactctccataaag

SEQ ID NO: 273090 - DNA, 20 bp, Artificial
  CRISPR gRNA sequence
ccaactctccataaaggctt

SEQ ID NO: 273091 - DNA, 20 bp, Artificial
  CRISPR gRNA sequence
tccataaaggcttacctttc

SEQ ID NO: 273092 - DNA, 20 bp, Artificial
  CRISPR gRNA sequence
cataaaggcttacctttcta

SEQ ID NO: 273093 - DNA, 20 bp, Artificial
  CRISPR gRNA sequence
acctttctacattaatctta

SEQ ID NO: 273094 - DNA, 20 bp, Artificial
  CRISPR gRNA sequence
cctttctacattaatcttac

SEQ ID NO: 273095 - DNA, 20 bp, Artificial
  CRISPR gRNA sequence
tctacattaatcttacgagt

SEQ ID NO: 273096 - DNA, 20 bp, Artificial
  CRISPR gRNA sequence
ctacattaatcttacgagta

SEQ ID NO: 273097 - DNA, 20 bp, Artificial
  CRISPR gRNA sequence
tacattaatcttacgagtat

SEQ ID NO: 273098 - DNA, 20 bp, Artificial
  CRISPR gRNA sequence
cattaatcttacgagtattt

SEQ ID NO: 273099 - DNA, 20 bp, Artificial
  CRISPR gRNA sequence
atcttacgagtatttatttt

SEQ ID NO: 273100 - DNA, 20 bp, Artificial
  CRISPR gRNA sequence
acgagtatttattttatgct

SEQ ID NO: 273101 - DNA, 20 bp, Artificial
  CRISPR gRNA sequence
cgagtatttattttatgctt

SEQ ID NO: 273102 - DNA, 20 bp, Artificial
  CRISPR gRNA sequence
attttatgcttcctcatttt

SEQ ID NO: 273103 - DNA, 20 bp, Artificial
  CRISPR gRNA sequence
ttttatgcttcctcattttg

SEQ ID NO: 273104 - DNA, 20 bp, Artificial
  CRISPR gRNA sequence
tatgcttcctcattttgtta

SEQ ID NO: 273105 - DNA, 20 bp, Artificial
  CRISPR gRNA sequence
atgcttcctcattttgttac

SEQ ID NO: 273106 - DNA, 20 bp, Artificial
  CRISPR gRNA sequence
tgcttcctcattttgttact

SEQ ID NO: 273107 - DNA, 20 bp, Artificial
  CRISPR gRNA sequence
cctcattttgttactaattc

SEQ ID NO: 273108 - DNA, 20 bp, Artificial
  CRISPR gRNA sequence
ctcattttgttactaattca

SEQ ID NO: 273109 - DNA, 20 bp, Artificial
  CRISPR gRNA sequence
attttgttactaattcattc

SEQ ID NO: 273110 - DNA, 20 bp, Artificial
  CRISPR gRNA sequence
tgttactaattcattcattt

SEQ ID NO: 273111 - DNA, 20 bp, Artificial
  CRISPR gRNA sequence
gttactaattcattcatttc

SEQ ID NO: 273112 - DNA, 20 bp, Artificial
  CRISPR gRNA sequence
ttactaattcattcatttct

SEQ ID NO: 273113 - DNA, 20 bp, Artificial
  CRISPR gRNA sequence
ctaattcattcatttctttc

SEQ ID NO: 273114 - DNA, 20 bp, Artificial
  CRISPR gRNA sequence
attcattcatttctttcttc

SEQ ID NO: 273115 - DNA, 20 bp, Artificial
  CRISPR gRNA sequence
attcatttctttcttcaaca

SEQ ID NO: 273116 - DNA, 20 bp, Artificial
  CRISPR gRNA sequence
atttctttcttcaacaaata

SEQ ID NO: 273117 - DNA, 20 bp, Artificial
  CRISPR gRNA sequence
ctttcttcaacaaatattta

SEQ ID NO: 273118 - DNA, 20 bp, Artificial
  CRISPR gRNA sequence
tttcttcaacaaatatttat

SEQ ID NO: 273119 - DNA, 20 bp, Artificial
  CRISPR gRNA sequence
tcttcaacaaatatttattg

SEQ ID NO: 273120 - DNA, 20 bp, Artificial
  CRISPR gRNA sequence
cttcaacaaatatttattga

SEQ ID NO: 273121 - DNA, 20 bp, Artificial
  CRISPR gRNA sequence
ttcaacaaatatttattgag

SEQ ID NO: 273122 - DNA, 20 bp, Artificial
  CRISPR gRNA sequence
caacaaatatttattgagta

SEQ ID NO: 273123 - DNA, 20 bp, Artificial
  CRISPR gRNA sequence
aacaaatatttattgagtaa

SEQ ID NO: 273124 - DNA, 20 bp, Artificial
  CRISPR gRNA sequence
attgagtaactatatgctta

SEQ ID NO: 273125 - DNA, 20 bp, Artificial
  CRISPR gRNA sequence
ttgagtaactatatgcttac

SEQ ID NO: 273126 - DNA, 20 bp, Artificial
  CRISPR gRNA sequence
agtaactatatgcttacagc

SEQ ID NO: 273127 - DNA, 20 bp, Artificial
  CRISPR gRNA sequence
tatgcttacagcattgtgcc

SEQ ID NO: 273128 - DNA, 20 bp, Artificial
  CRISPR gRNA sequence
acagcattgtgcctaataca

SEQ ID NO: 273129 - DNA, 20 bp, Artificial
  CRISPR gRNA sequence
cagcattgtgcctaatacag

SEQ ID NO: 273130 - DNA, 20 bp, Artificial
  CRISPR gRNA sequence
tgcctaatacagaggttaga

SEQ ID NO: 273131 - DNA, 20 bp, Artificial
  CRISPR gRNA sequence
atacagaggttagaaggatg

SEQ ID NO: 273132 - DNA, 20 bp, Artificial
  CRISPR gRNA sequence
gaaggatgaataagacatga

SEQ ID NO: 273133 - DNA, 20 bp, Artificial
  CRISPR gRNA sequence
tgccctcaaggagttcatag

SEQ ID NO: 273134 - DNA, 20 bp, Artificial
  CRISPR gRNA sequence
ccctcaaggagttcatagtc

SEQ ID NO: 273135 - DNA, 20 bp, Artificial
  CRISPR gRNA sequence
aaggagttcatagtctagtg

SEQ ID NO: 273136 - DNA, 20 bp, Artificial
  CRISPR gRNA sequence
atagtctagtggaaaagaaa

SEQ ID NO: 273137 - DNA, 20 bp, Artificial
  CRISPR gRNA sequence
gtggaaaagaaaataaatgt

SEQ ID NO: 273138 - DNA, 20 bp, Artificial
  CRISPR gRNA sequence
ggagaaacttgagagggaag

SEQ ID NO: 273139 - DNA, 20 bp, Artificial
  CRISPR gRNA sequence
gagaaacttgagagggaagg

SEQ ID NO: 273140 - DNA, 20 bp, Artificial
  CRISPR gRNA sequence
gagagggaaggaagtccctc

SEQ ID NO: 273141 - DNA, 20 bp, Artificial
  CRISPR gRNA sequence
agagggaaggaagtccctct

SEQ ID NO: 273142 - DNA, 20 bp, Artificial
  CRISPR gRNA sequence
tctttgccatttggggtctc

SEQ ID NO: 273143 - DNA, 20 bp, Artificial
  CRISPR gRNA sequence
tttgccatttggggtctcag

SEQ ID NO: 273144 - DNA, 20 bp, Artificial
  CRISPR gRNA sequence
tgccatttggggtctcagag

SEQ ID NO: 273145 - DNA, 20 bp, Artificial
  CRISPR gRNA sequence
gccatttggggtctcagaga

SEQ ID NO: 273146 - DNA, 20 bp, Artificial
  CRISPR gRNA sequence
ccatttggggtctcagagaa

SEQ ID NO: 273147 - DNA, 20 bp, Artificial
  CRISPR gRNA sequence
ggggtctcagagaaggcttc

SEQ ID NO: 273148 - DNA, 20 bp, Artificial
  CRISPR gRNA sequence
gggtctcagagaaggcttct

SEQ ID NO: 273149 - DNA, 20 bp, Artificial
  CRISPR gRNA sequence
agagaaggcttcttcaggtg

SEQ ID NO: 273150 - DNA, 20 bp, Artificial
  CRISPR gRNA sequence
cttcaggtgagaggtgtaga

SEQ ID NO: 273151 - DNA, 20 bp, Artificial
  CRISPR gRNA sequence
ttcaggtgagaggtgtagag

SEQ ID NO: 273152 - DNA, 20 bp, Artificial
  CRISPR gRNA sequence
caggtgagaggtgtagagga

SEQ ID NO: 273153 - DNA, 20 bp, Artificial
  CRISPR gRNA sequence
aggtgagaggtgtagaggac

SEQ ID NO: 273154 - DNA, 20 bp, Artificial
  CRISPR gRNA sequence
cagattataaaaataatgta

SEQ ID NO: 273155 - DNA, 20 bp, Artificial
  CRISPR gRNA sequence
agattataaaaataatgtag

SEQ ID NO: 273156 - DNA, 20 bp, Artificial
  CRISPR gRNA sequence
taaaaataatgtaggcaaac

SEQ ID NO: 273157 - DNA, 20 bp, Artificial
  CRISPR gRNA sequence
tagtcatcaaatagcatggt

SEQ ID NO: 273158 - DNA, 20 bp, Artificial
  CRISPR gRNA sequence
agtcatcaaatagcatggtg

SEQ ID NO: 273159 - DNA, 20 bp, Artificial
  CRISPR gRNA sequence
gtcatcaaatagcatggtga

SEQ ID NO: 273160 - DNA, 20 bp, Artificial
  CRISPR gRNA sequence
ccaagtgttatttatctgtt

SEQ ID NO: 273161 - DNA, 20 bp, Artificial
  CRISPR gRNA sequence
tttatctgtttccagatgtt

SEQ ID NO: 273162 - DNA, 20 bp, Artificial
  CRISPR gRNA sequence
atctgtttccagatgttaca

SEQ ID NO: 273163 - DNA, 20 bp, Artificial
  CRISPR gRNA sequence
tctgtttccagatgttacat

SEQ ID NO: 273164 - DNA, 20 bp, Artificial
  CRISPR gRNA sequence
tttccagatgttacatcctc

SEQ ID NO: 273165 - DNA, 20 bp, Artificial
  CRISPR gRNA sequence
ccagatgttacatcctccta

SEQ ID NO: 273166 - DNA, 20 bp, Artificial
  CRISPR gRNA sequence
cagatgttacatcctcctat

SEQ ID NO: 273167 - DNA, 20 bp, Artificial
  CRISPR gRNA sequence
catcctcctattatatataa

SEQ ID NO: 273168 - DNA, 20 bp, Artificial
  CRISPR gRNA sequence
ctattatatataacctactc

SEQ ID NO: 273169 - DNA, 20 bp, Artificial
  CRISPR gRNA sequence
ttatatataacctactcaac

SEQ ID NO: 273170 - DNA, 20 bp, Artificial
  CRISPR gRNA sequence
tatataacctactcaactaa

SEQ ID NO: 273171 - DNA, 20 bp, Artificial
  CRISPR gRNA sequence
ctcaactaaatcataggggc

SEQ ID NO: 273172 - DNA, 20 bp, Artificial
  CRISPR gRNA sequence
aactaaatcataggggctgt

SEQ ID NO: 273173 - DNA, 20 bp, Artificial
  CRISPR gRNA sequence
aatcataggggctgtaaaag

SEQ ID NO: 273174 - DNA, 20 bp, Artificial
  CRISPR gRNA sequence
taaaagcagagagaactcag

SEQ ID NO: 273175 - DNA, 20 bp, Artificial
  CRISPR gRNA sequence
agttaactacctaattactt

SEQ ID NO: 273176 - DNA, 20 bp, Artificial
  CRISPR gRNA sequence
actacctaattacttgtact

SEQ ID NO: 273177 - DNA, 20 bp, Artificial
  CRISPR gRNA sequence
cctaattacttgtactacac

SEQ ID NO: 273178 - DNA, 20 bp, Artificial
  CRISPR gRNA sequence
attacttgtactacacaata

SEQ ID NO: 273179 - DNA, 20 bp, Artificial
  CRISPR gRNA sequence
cttgtactacacaatacttg

SEQ ID NO: 273180 - DNA, 20 bp, Artificial
  CRISPR gRNA sequence
gtactacacaatacttgtgt

SEQ ID NO: 273181 - DNA, 20 bp, Artificial
  CRISPR gRNA sequence
tactacacaatacttgtgta

SEQ ID NO: 273182 - DNA, 20 bp, Artificial
  CRISPR gRNA sequence
cacaatacttgtgtactgat

SEQ ID NO: 273183 - DNA, 20 bp, Artificial
  CRISPR gRNA sequence
gtgtactgattttatatttc

SEQ ID NO: 273184 - DNA, 20 bp, Artificial
  CRISPR gRNA sequence
tgtactgattttatatttct

SEQ ID NO: 273185 - DNA, 20 bp, Artificial
  CRISPR gRNA sequence
attttatatttctttttttt

SEQ ID NO: 273186 - DNA, 20 bp, Artificial
  CRISPR gRNA sequence
tatatttcttttttttgttg

SEQ ID NO: 273187 - DNA, 20 bp, Artificial
  CRISPR gRNA sequence
atatttcttttttttgttgt

SEQ ID NO: 273188 - DNA, 20 bp, Artificial
  CRISPR gRNA sequence
tatttcttttttttgttgtt

SEQ ID NO: 273189 - DNA, 20 bp, Artificial
  CRISPR gRNA sequence
cttttttttgttgttgttga

SEQ ID NO: 273190 - DNA, 20 bp, Artificial
  CRISPR gRNA sequence
ttttttttgttgttgttgag

SEQ ID NO: 273191 - DNA, 20 bp, Artificial
  CRISPR gRNA sequence
ttttttgttgttgttgagac

SEQ ID NO: 273192 - DNA, 20 bp, Artificial
  CRISPR gRNA sequence
tttttgttgttgttgagacg

SEQ ID NO: 273193 - DNA, 20 bp, Artificial
  CRISPR gRNA sequence
ttttgttgttgttgagacgg

SEQ ID NO: 273194 - DNA, 20 bp, Artificial
  CRISPR gRNA sequence
tttgttgttgttgagacgga

SEQ ID NO: 273195 - DNA, 20 bp, Artificial
  CRISPR gRNA sequence
ttgttgttgttgagacggaa

SEQ ID NO: 273196 - DNA, 20 bp, Artificial
  CRISPR gRNA sequence
tgttgttgttgagacggaat

SEQ ID NO: 273197 - DNA, 20 bp, Artificial
  CRISPR gRNA sequence
gttgttgttgagacggaatc

SEQ ID NO: 273198 - DNA, 20 bp, Artificial
  CRISPR gRNA sequence
ttgttgttgagacggaatct

SEQ ID NO: 273199 - DNA, 20 bp, Artificial
  CRISPR gRNA sequence
ttgttgagacggaatctcgc

SEQ ID NO: 273200 - DNA, 20 bp, Artificial
  CRISPR gRNA sequence
ttgagacggaatctcgctct

SEQ ID NO: 273201 - DNA, 20 bp, Artificial
  CRISPR gRNA sequence
agacggaatctcgctctgtc

SEQ ID NO: 273202 - DNA, 20 bp, Artificial
  CRISPR gRNA sequence
gctctgtcacccaggctgga

SEQ ID NO: 273203 - DNA, 20 bp, Artificial
  CRISPR gRNA sequence
tgtcacccaggctggagtgc

SEQ ID NO: 273204 - DNA, 20 bp, Artificial
  CRISPR gRNA sequence
tcacccaggctggagtgcat

SEQ ID NO: 273205 - DNA, 20 bp, Artificial
  CRISPR gRNA sequence
gagtgcattgacacaatctc

SEQ ID NO: 273206 - DNA, 20 bp, Artificial
  CRISPR gRNA sequence
acacaatctctgctcactgc

SEQ ID NO: 273207 - DNA, 20 bp, Artificial
  CRISPR gRNA sequence
tgctcactgcaacctctgcc

SEQ ID NO: 273208 - DNA, 20 bp, Artificial
  CRISPR gRNA sequence
ctcactgcaacctctgcctc

SEQ ID NO: 273209 - DNA, 20 bp, Artificial
  CRISPR gRNA sequence
actgcaacctctgcctccta

SEQ ID NO: 273210 - DNA, 20 bp, Artificial
  CRISPR gRNA sequence
caacctctgcctcctaggtt

SEQ ID NO: 273211 - DNA, 20 bp, Artificial
  CRISPR gRNA sequence
tgcctcctaggttcaagcaa

SEQ ID NO: 273212 - DNA, 20 bp, Artificial
  CRISPR gRNA sequence
cctcctaggttcaagcaatt

SEQ ID NO: 273213 - DNA, 20 bp, Artificial
  CRISPR gRNA sequence
ctaggttcaagcaattctcc

SEQ ID NO: 273214 - DNA, 20 bp, Artificial
  CRISPR gRNA sequence
ggttcaagcaattctcctac

SEQ ID NO: 273215 - DNA, 20 bp, Artificial
  CRISPR gRNA sequence
aagcaattctcctacctcag

SEQ ID NO: 273216 - DNA, 20 bp, Artificial
  CRISPR gRNA sequence
tcctacctcagcctccccag

SEQ ID NO: 273217 - DNA, 20 bp, Artificial
  CRISPR gRNA sequence
ctacctcagcctccccagta

SEQ ID NO: 273218 - DNA, 20 bp, Artificial
  CRISPR gRNA sequence
cctcagcctccccagtagct

SEQ ID NO: 273219 - DNA, 20 bp, Artificial
  CRISPR gRNA sequence
agcctccccagtagctggga

SEQ ID NO: 273220 - DNA, 20 bp, Artificial
  CRISPR gRNA sequence
cccagtagctgggactacag

SEQ ID NO: 273221 - DNA, 20 bp, Artificial
  CRISPR gRNA sequence
ggactacaggtgtgtaccac

SEQ ID NO: 273222 - DNA, 20 bp, Artificial
  CRISPR gRNA sequence
caggtgtgtaccaccacgcc

SEQ ID NO: 273223 - DNA, 20 bp, Artificial
  CRISPR gRNA sequence
gctaatttttgtatttttag

SEQ ID NO: 273224 - DNA, 20 bp, Artificial
  CRISPR gRNA sequence
atttttgtatttttagtaga

SEQ ID NO: 273225 - DNA, 20 bp, Artificial
  CRISPR gRNA sequence
ttgtatttttagtagagatg

SEQ ID NO: 273226 - DNA, 20 bp, Artificial
  CRISPR gRNA sequence
tgtatttttagtagagatgg

SEQ ID NO: 273227 - DNA, 20 bp, Artificial
  CRISPR gRNA sequence
gtatttttagtagagatggg

SEQ ID NO: 273228 - DNA, 20 bp, Artificial
  CRISPR gRNA sequence
tatttttagtagagatgggg

SEQ ID NO: 273229 - DNA, 20 bp, Artificial
  CRISPR gRNA sequence
ttagtagagatggggtttca

SEQ ID NO: 273230 - DNA, 20 bp, Artificial
  CRISPR gRNA sequence
tagtagagatggggtttcac

SEQ ID NO: 273231 - DNA, 20 bp, Artificial
  CRISPR gRNA sequence
agtagagatggggtttcacc

SEQ ID NO: 273232 - DNA, 20 bp, Artificial
  CRISPR gRNA sequence
gtagagatggggtttcacca

SEQ ID NO: 273233 - DNA, 20 bp, Artificial
  CRISPR gRNA sequence
caccatattggccagactgg

SEQ ID NO: 273234 - DNA, 20 bp, Artificial
  CRISPR gRNA sequence
accatattggccagactggt

SEQ ID NO: 273235 - DNA, 20 bp, Artificial
  CRISPR gRNA sequence
gccagactggtctcaaactt

SEQ ID NO: 273236 - DNA, 20 bp, Artificial
  CRISPR gRNA sequence
gtctcaaacttctgacctca

SEQ ID NO: 273237 - DNA, 20 bp, Artificial
  CRISPR gRNA sequence
aaacttctgacctcaggtga

SEQ ID NO: 273238 - DNA, 20 bp, Artificial
  CRISPR gRNA sequence
ctgacctcaggtgatctgcc

SEQ ID NO: 273239 - DNA, 20 bp, Artificial
  CRISPR gRNA sequence
tgacctcaggtgatctgcct

SEQ ID NO: 273240 - DNA, 20 bp, Artificial
  CRISPR gRNA sequence
acctcaggtgatctgcctgc

SEQ ID NO: 273241 - DNA, 20 bp, Artificial
  CRISPR gRNA sequence
aggtgatctgcctgccttgg

SEQ ID NO: 273242 - DNA, 20 bp, Artificial
  CRISPR gRNA sequence
cctgccttggtctcccaaag

SEQ ID NO: 273243 - DNA, 20 bp, Artificial
  CRISPR gRNA sequence
ccttggtctcccaaagtgct

SEQ ID NO: 273244 - DNA, 20 bp, Artificial
  CRISPR gRNA sequence
ggtctcccaaagtgctgggg

SEQ ID NO: 273245 - DNA, 20 bp, Artificial
  CRISPR gRNA sequence
gtctcccaaagtgctggggt

SEQ ID NO: 273246 - DNA, 20 bp, Artificial
  CRISPR gRNA sequence
ccaaagtgctggggttacag

SEQ ID NO: 273247 - DNA, 20 bp, Artificial
  CRISPR gRNA sequence
gggttacaggtgtgaggcac

SEQ ID NO: 273248 - DNA, 20 bp, Artificial
  CRISPR gRNA sequence
caggtgtgaggcaccatatc

SEQ ID NO: 273249 - DNA, 20 bp, Artificial
  CRISPR gRNA sequence
tatttctttttatattctct

SEQ ID NO: 273250 - DNA, 20 bp, Artificial
  CRISPR gRNA sequence
ctttttatattctctgaaac

SEQ ID NO: 273251 - DNA, 20 bp, Artificial
  CRISPR gRNA sequence
tttttatattctctgaaact

SEQ ID NO: 273252 - DNA, 20 bp, Artificial
  CRISPR gRNA sequence
tttatattctctgaaactct

SEQ ID NO: 273253 - DNA, 20 bp, Artificial
  CRISPR gRNA sequence
ttatattctctgaaactctg

SEQ ID NO: 273254 - DNA, 20 bp, Artificial
  CRISPR gRNA sequence
tatattctctgaaactctga

SEQ ID NO: 273255 - DNA, 20 bp, Artificial
  CRISPR gRNA sequence
atattctctgaaactctgat

SEQ ID NO: 273256 - DNA, 20 bp, Artificial
  CRISPR gRNA sequence
tattctctgaaactctgatg

SEQ ID NO: 273257 - DNA, 20 bp, Artificial
  CRISPR gRNA sequence
tctgaaactctgatggagat

SEQ ID NO: 273258 - DNA, 20 bp, Artificial
  CRISPR gRNA sequence
tgaaactctgatggagatta

SEQ ID NO: 273259 - DNA, 20 bp, Artificial
  CRISPR gRNA sequence
aaactctgatggagattaaa

SEQ ID NO: 273260 - DNA, 20 bp, Artificial
  CRISPR gRNA sequence
tgatggagattaaaatatga

SEQ ID NO: 273261 - DNA, 20 bp, Artificial
  CRISPR gRNA sequence
atggagattaaaatatgaga

SEQ ID NO: 273262 - DNA, 20 bp, Artificial
  CRISPR gRNA sequence
aaatatgagaggtttaataa

SEQ ID NO: 273263 - DNA, 20 bp, Artificial
  CRISPR gRNA sequence
aataaatatttgttaagttg

SEQ ID NO: 273264 - DNA, 20 bp, Artificial
  CRISPR gRNA sequence
ataaatatttgttaagttga

SEQ ID NO: 273265 - DNA, 20 bp, Artificial
  CRISPR gRNA sequence
gttaagttgagatacacttc

SEQ ID NO: 273266 - DNA, 20 bp, Artificial
  CRISPR gRNA sequence
ttaagttgagatacacttcc

SEQ ID NO: 273267 - DNA, 20 bp, Artificial
  CRISPR gRNA sequence
agttgagatacacttccatc

SEQ ID NO: 273268 - DNA, 20 bp, Artificial
  CRISPR gRNA sequence
agatacacttccatcagaac

SEQ ID NO: 273269 - DNA, 20 bp, Artificial
  CRISPR gRNA sequence
ccatcagaactcctcttcca

SEQ ID NO: 273270 - DNA, 20 bp, Artificial
  CRISPR gRNA sequence
catcagaactcctcttccaa

SEQ ID NO: 273271 - DNA, 20 bp, Artificial
  CRISPR gRNA sequence
ctcttccaagaccacaataa

SEQ ID NO: 273272 - DNA, 20 bp, Artificial
  CRISPR gRNA sequence
ttccaagaccacaataaagg

SEQ ID NO: 273273 - DNA, 20 bp, Artificial
  CRISPR gRNA sequence
ccaagaccacaataaaggct

SEQ ID NO: 273274 - DNA, 20 bp, Artificial
  CRISPR gRNA sequence
caagaccacaataaaggctg

SEQ ID NO: 273275 - DNA, 20 bp, Artificial
  CRISPR gRNA sequence
aagtatccagaagcttcttc

SEQ ID NO: 273276 - DNA, 20 bp, Artificial
  CRISPR gRNA sequence
cttcgaggaggtggatcttt

SEQ ID NO: 273277 - DNA, 20 bp, Artificial
  CRISPR gRNA sequence
ttcgaggaggtggatctttc

SEQ ID NO: 273278 - DNA, 20 bp, Artificial
  CRISPR gRNA sequence
cgaggaggtggatctttcac

SEQ ID NO: 273279 - DNA, 20 bp, Artificial
  CRISPR gRNA sequence
gaggaggtggatctttcacg

SEQ ID NO: 273280 - DNA, 20 bp, Artificial
  CRISPR gRNA sequence
tcacgaaaagtctaacatga

SEQ ID NO: 273281 - DNA, 20 bp, Artificial
  CRISPR gRNA sequence
cacgaaaagtctaacatgaa

SEQ ID NO: 273282 - DNA, 20 bp, Artificial
  CRISPR gRNA sequence
acgaaaagtctaacatgaaa

SEQ ID NO: 273283 - DNA, 20 bp, Artificial
  CRISPR gRNA sequence
acatgaaagacaagtagatt

SEQ ID NO: 273284 - DNA, 20 bp, Artificial
  CRISPR gRNA sequence
catggtggattgtgagccaa

SEQ ID NO: 273285 - DNA, 20 bp, Artificial
  CRISPR gRNA sequence
tgagccaatgaggtgattca

SEQ ID NO: 273286 - DNA, 20 bp, Artificial
  CRISPR gRNA sequence
agatattgcagaaaggggct

SEQ ID NO: 273287 - DNA, 20 bp, Artificial
  CRISPR gRNA sequence
cagaaaggggctcacaatta

SEQ ID NO: 273288 - DNA, 20 bp, Artificial
  CRISPR gRNA sequence
acaattagatcagaggccaa

SEQ ID NO: 273289 - DNA, 20 bp, Artificial
  CRISPR gRNA sequence
gatcagaggccaaagtgaac

SEQ ID NO: 273290 - DNA, 20 bp, Artificial
  CRISPR gRNA sequence
tgagtgagtaattctgaatg

SEQ ID NO: 273291 - DNA, 20 bp, Artificial
  CRISPR gRNA sequence
tgaatgataccatcaggaac

SEQ ID NO: 273292 - DNA, 20 bp, Artificial
  CRISPR gRNA sequence
aatgataccatcaggaacca

SEQ ID NO: 273293 - DNA, 20 bp, Artificial
  CRISPR gRNA sequence
acctggttatattgtcagcc

SEQ ID NO: 273294 - DNA, 20 bp, Artificial
  CRISPR gRNA sequence
gttatattgtcagccacaat

SEQ ID NO: 273295 - DNA, 20 bp, Artificial
  CRISPR gRNA sequence
tattgtcagccacaataccc

SEQ ID NO: 273296 - DNA, 20 bp, Artificial
  CRISPR gRNA sequence
tcagccacaatacccaagat

SEQ ID NO: 273297 - DNA, 20 bp, Artificial
  CRISPR gRNA sequence
aaagttaagtaagaacttct

SEQ ID NO: 273298 - DNA, 20 bp, Artificial
  CRISPR gRNA sequence
agtaagaacttctccaccac

SEQ ID NO: 273299 - DNA, 20 bp, Artificial
  CRISPR gRNA sequence
ctccaccaccttgcaggttc

SEQ ID NO: 273300 - DNA, 20 bp, Artificial
  CRISPR gRNA sequence
tccaccaccttgcaggttct

SEQ ID NO: 273301 - DNA, 20 bp, Artificial
  CRISPR gRNA sequence
caccaccttgcaggttctct

SEQ ID NO: 273302 - DNA, 20 bp, Artificial
  CRISPR gRNA sequence
gcaggttctcttccagcaat

SEQ ID NO: 273303 - DNA, 20 bp, Artificial
  CRISPR gRNA sequence
caggttctcttccagcaatg

SEQ ID NO: 273304 - DNA, 20 bp, Artificial
  CRISPR gRNA sequence
tcttccagcaatgaaaacag

SEQ ID NO: 273305 - DNA, 20 bp, Artificial
  CRISPR gRNA sequence
ttccagcaatgaaaacagaa

SEQ ID NO: 273306 - DNA, 20 bp, Artificial
  CRISPR gRNA sequence
ccagcaatgaaaacagaagc

SEQ ID NO: 273307 - DNA, 20 bp, Artificial
  CRISPR gRNA sequence
cagcaatgaaaacagaagca

SEQ ID NO: 273308 - DNA, 20 bp, Artificial
  CRISPR gRNA sequence
catggtgacacgagactaaa

SEQ ID NO: 273309 - DNA, 20 bp, Artificial
  CRISPR gRNA sequence
aataaacatgcctttgaaat

SEQ ID NO: 273310 - DNA, 20 bp, Artificial
  CRISPR gRNA sequence
tgaaattaacattgaaatag

SEQ ID NO: 273311 - DNA, 20 bp, Artificial
  CRISPR gRNA sequence
gaaattaacattgaaatagt

SEQ ID NO: 273312 - DNA, 20 bp, Artificial
  CRISPR gRNA sequence
aaattaacattgaaatagtg

SEQ ID NO: 273313 - DNA, 20 bp, Artificial
  CRISPR gRNA sequence
acattgaaatagtgagaagt

SEQ ID NO: 273314 - DNA, 20 bp, Artificial
  CRISPR gRNA sequence
aaatagtgagaagtctaaac

SEQ ID NO: 273315 - DNA, 20 bp, Artificial
  CRISPR gRNA sequence
aactcttttttccaagcctc

SEQ ID NO: 273316 - DNA, 20 bp, Artificial
  CRISPR gRNA sequence
ttttttccaagcctctacca

SEQ ID NO: 273317 - DNA, 20 bp, Artificial
  CRISPR gRNA sequence
ttttccaagcctctaccaaa

SEQ ID NO: 273318 - DNA, 20 bp, Artificial
  CRISPR gRNA sequence
tttccaagcctctaccaaat

SEQ ID NO: 273319 - DNA, 20 bp, Artificial
  CRISPR gRNA sequence
ttccaagcctctaccaaatg

SEQ ID NO: 273320 - DNA, 20 bp, Artificial
  CRISPR gRNA sequence
tccaagcctctaccaaatga

SEQ ID NO: 273321 - DNA, 20 bp, Artificial
  CRISPR gRNA sequence
ccaagcctctaccaaatgac

SEQ ID NO: 273322 - DNA, 20 bp, Artificial
  CRISPR gRNA sequence
caagcctctaccaaatgact

SEQ ID NO: 273323 - DNA, 20 bp, Artificial
  CRISPR gRNA sequence
taccaaatgactgagtagtt

SEQ ID NO: 273324 - DNA, 20 bp, Artificial
  CRISPR gRNA sequence
ccaaatgactgagtagttct

SEQ ID NO: 273325 - DNA, 20 bp, Artificial
  CRISPR gRNA sequence
agtagttcttgatcctatcc

SEQ ID NO: 273326 - DNA, 20 bp, Artificial
  CRISPR gRNA sequence
ttgatcctatccagtgcact

SEQ ID NO: 273327 - DNA, 20 bp, Artificial
  CRISPR gRNA sequence
gatcctatccagtgcacttc

SEQ ID NO: 273328 - DNA, 20 bp, Artificial
  CRISPR gRNA sequence
atcctatccagtgcacttct

SEQ ID NO: 273329 - DNA, 20 bp, Artificial
  CRISPR gRNA sequence
tccagtgcacttctcttcta

SEQ ID NO: 273330 - DNA, 20 bp, Artificial
  CRISPR gRNA sequence
ctcttctagtgtttggagtc

SEQ ID NO: 273331 - DNA, 20 bp, Artificial
  CRISPR gRNA sequence
tcttctagtgtttggagtcc

SEQ ID NO: 273332 - DNA, 20 bp, Artificial
  CRISPR gRNA sequence
ttctagtgtttggagtcctc

SEQ ID NO: 273333 - DNA, 20 bp, Artificial
  CRISPR gRNA sequence
ctagtgtttggagtcctcaa

SEQ ID NO: 273334 - DNA, 20 bp, Artificial
  CRISPR gRNA sequence
tagtgtttggagtcctcaaa

SEQ ID NO: 273335 - DNA, 20 bp, Artificial
  CRISPR gRNA sequence
gtgtttggagtcctcaaaat

SEQ ID NO: 273336 - DNA, 20 bp, Artificial
  CRISPR gRNA sequence
ggagtcctcaaaatgagatt

SEQ ID NO: 273337 - DNA, 20 bp, Artificial
  CRISPR gRNA sequence
gagtcctcaaaatgagatta

SEQ ID NO: 273338 - DNA, 20 bp, Artificial
  CRISPR gRNA sequence
aaaatgagattaacaaggaa

SEQ ID NO: 273339 - DNA, 20 bp, Artificial
  CRISPR gRNA sequence
acaaggaaaaagttagacac

SEQ ID NO: 273340 - DNA, 20 bp, Artificial
  CRISPR gRNA sequence
gacacttgcatgcaaccacc

SEQ ID NO: 273341 - DNA, 20 bp, Artificial
  CRISPR gRNA sequence
gcatgcaaccacctttctgt

SEQ ID NO: 273342 - DNA, 20 bp, Artificial
  CRISPR gRNA sequence
catgcaaccacctttctgtg

SEQ ID NO: 273343 - DNA, 20 bp, Artificial
  CRISPR gRNA sequence
tctgtggggcctgggttacc

SEQ ID NO: 273344 - DNA, 20 bp, Artificial
  CRISPR gRNA sequence
ctgtggggcctgggttacct

SEQ ID NO: 273345 - DNA, 20 bp, Artificial
  CRISPR gRNA sequence
tgtggggcctgggttacctt

SEQ ID NO: 273346 - DNA, 20 bp, Artificial
  CRISPR gRNA sequence
tggggcctgggttaccttcc

SEQ ID NO: 273347 - DNA, 20 bp, Artificial
  CRISPR gRNA sequence
ggttaccttccccccagctt

SEQ ID NO: 273348 - DNA, 20 bp, Artificial
  CRISPR gRNA sequence
ccttccccccagcttcaggc

SEQ ID NO: 273349 - DNA, 20 bp, Artificial
  CRISPR gRNA sequence
ccccccagcttcaggcacca

SEQ ID NO: 273350 - DNA, 20 bp, Artificial
  CRISPR gRNA sequence
cccccagcttcaggcaccaa

SEQ ID NO: 273351 - DNA, 20 bp, Artificial
  CRISPR gRNA sequence
caggcaccaattctcatgct

SEQ ID NO: 273352 - DNA, 20 bp, Artificial
  CRISPR gRNA sequence
aggcaccaattctcatgcta

SEQ ID NO: 273353 - DNA, 20 bp, Artificial
  CRISPR gRNA sequence
tcatgctataattatcaggc

SEQ ID NO: 273354 - DNA, 20 bp, Artificial
  CRISPR gRNA sequence
atgctataattatcaggctc

SEQ ID NO: 273355 - DNA, 20 bp, Artificial
  CRISPR gRNA sequence
taattatcaggctcaaagct

SEQ ID NO: 273356 - DNA, 20 bp, Artificial
  CRISPR gRNA sequence
tcaggctcaaagctctgagt

SEQ ID NO: 273357 - DNA, 20 bp, Artificial
  CRISPR gRNA sequence
aaagctctgagtgaattgtc

SEQ ID NO: 273358 - DNA, 20 bp, Artificial
  CRISPR gRNA sequence
tgagtgaattgtcttggttt

SEQ ID NO: 273359 - DNA, 20 bp, Artificial
  CRISPR gRNA sequence
agtgaattgtcttggttttt

SEQ ID NO: 273360 - DNA, 20 bp, Artificial
  CRISPR gRNA sequence
tcttggtttttttggttttg

SEQ ID NO: 273361 - DNA, 20 bp, Artificial
  CRISPR gRNA sequence
ggtttttttggttttgggtt

SEQ ID NO: 273362 - DNA, 20 bp, Artificial
  CRISPR gRNA sequence
gtttttttggttttgggttt

SEQ ID NO: 273363 - DNA, 20 bp, Artificial
  CRISPR gRNA sequence
ttttggttttgggtttttgg

SEQ ID NO: 273364 - DNA, 20 bp, Artificial
  CRISPR gRNA sequence
tttggttttgggtttttggt

SEQ ID NO: 273365 - DNA, 20 bp, Artificial
  CRISPR gRNA sequence
ttggttttgggtttttggtg

SEQ ID NO: 273366 - DNA, 20 bp, Artificial
  CRISPR gRNA sequence
tggttttgggtttttggtgc

SEQ ID NO: 273367 - DNA, 20 bp, Artificial
  CRISPR gRNA sequence
ggttttgggtttttggtgct

SEQ ID NO: 273368 - DNA, 20 bp, Artificial
  CRISPR gRNA sequence
gttttgggtttttggtgcta

SEQ ID NO: 273369 - DNA, 20 bp, Artificial
  CRISPR gRNA sequence
tgggtttttggtgctaacac

SEQ ID NO: 273370 - DNA, 20 bp, Artificial
  CRISPR gRNA sequence
gggtttttggtgctaacacc

SEQ ID NO: 273371 - DNA, 20 bp, Artificial
  CRISPR gRNA sequence
ggtttttggtgctaacaccc

SEQ ID NO: 273372 - DNA, 20 bp, Artificial
  CRISPR gRNA sequence
ttggtgctaacaccctgtca

SEQ ID NO: 273373 - DNA, 20 bp, Artificial
  CRISPR gRNA sequence
tggtgctaacaccctgtcat

SEQ ID NO: 273374 - DNA, 20 bp, Artificial
  CRISPR gRNA sequence
ggtgctaacaccctgtcatt

SEQ ID NO: 273375 - DNA, 20 bp, Artificial
  CRISPR gRNA sequence
gtgctaacaccctgtcattg

SEQ ID NO: 273376 - DNA, 20 bp, Artificial
  CRISPR gRNA sequence
acaccctgtcattggccaaa

SEQ ID NO: 273377 - DNA, 20 bp, Artificial
  CRISPR gRNA sequence
tcattggccaaaaacggcca

SEQ ID NO: 273378 - DNA, 20 bp, Artificial
  CRISPR gRNA sequence
gccaaaaacggccaaataaa

SEQ ID NO: 273379 - DNA, 20 bp, Artificial
  CRISPR gRNA sequence
aacacagcttaaccagagag

SEQ ID NO: 273380 - DNA, 20 bp, Artificial
  CRISPR gRNA sequence
acacagcttaaccagagagc

SEQ ID NO: 273381 - DNA, 20 bp, Artificial
  CRISPR gRNA sequence
aaccagagagccattcagtc

SEQ ID NO: 273382 - DNA, 20 bp, Artificial
  CRISPR gRNA sequence
accagagagccattcagtca

SEQ ID NO: 273383 - DNA, 20 bp, Artificial
  CRISPR gRNA sequence
agtcagtcacaaaaccaccc

SEQ ID NO: 273384 - DNA, 20 bp, Artificial
  CRISPR gRNA sequence
ttccagatgctcagctcaac

SEQ ID NO: 273385 - DNA, 20 bp, Artificial
  CRISPR gRNA sequence
tccagatgctcagctcaact

SEQ ID NO: 273386 - DNA, 20 bp, Artificial
  CRISPR gRNA sequence
ccagatgctcagctcaacta

SEQ ID NO: 273387 - DNA, 20 bp, Artificial
  CRISPR gRNA sequence
cagatgctcagctcaactat

SEQ ID NO: 273388 - DNA, 20 bp, Artificial
  CRISPR gRNA sequence
agctcaactatgtactgaga

SEQ ID NO: 273389 - DNA, 20 bp, Artificial
  CRISPR gRNA sequence
aactatgtactgagaagaaa

SEQ ID NO: 273390 - DNA, 20 bp, Artificial
  CRISPR gRNA sequence
tgtactgagaagaaaagttc

SEQ ID NO: 273391 - DNA, 20 bp, Artificial
  CRISPR gRNA sequence
agaagaaaagttccagcctc

SEQ ID NO: 273392 - DNA, 20 bp, Artificial
  CRISPR gRNA sequence
cagcctctgtgaagttccat

SEQ ID NO: 273393 - DNA, 20 bp, Artificial
  CRISPR gRNA sequence
tgtgaagttccataaataat

SEQ ID NO: 273394 - DNA, 20 bp, Artificial
  CRISPR gRNA sequence
tgaagttccataaataataa

SEQ ID NO: 273395 - DNA, 20 bp, Artificial
  CRISPR gRNA sequence
cataaataataaatttcttg

SEQ ID NO: 273396 - DNA, 20 bp, Artificial
  CRISPR gRNA sequence
cttgaagaaaaaggcaaaca

SEQ ID NO: 273397 - DNA, 20 bp, Artificial
  CRISPR gRNA sequence
ttgaagaaaaaggcaaacaa

SEQ ID NO: 273398 - DNA, 20 bp, Artificial
  CRISPR gRNA sequence
gaagaaaaaggcaaacaaaa

SEQ ID NO: 273399 - DNA, 20 bp, Artificial
  CRISPR gRNA sequence
aagaaaaaggcaaacaaaaa

SEQ ID NO: 273400 - DNA, 20 bp, Artificial
  CRISPR gRNA sequence
aaccaacatgagaaagagaa

SEQ ID NO: 273401 - DNA, 20 bp, Artificial
  CRISPR gRNA sequence
accaacatgagaaagagaag

SEQ ID NO: 273402 - DNA, 20 bp, Artificial
  CRISPR gRNA sequence
tatcccttgccatgacctgc

SEQ ID NO: 273403 - DNA, 20 bp, Artificial
  CRISPR gRNA sequence
tcccttgccatgacctgctg

SEQ ID NO: 273404 - DNA, 20 bp, Artificial
  CRISPR gRNA sequence
gccatgacctgctgggaaac

SEQ ID NO: 273405 - DNA, 20 bp, Artificial
  CRISPR gRNA sequence
ccatgacctgctgggaaaca

SEQ ID NO: 273406 - DNA, 20 bp, Artificial
  CRISPR gRNA sequence
ctgggaaacaattgtgcttt

SEQ ID NO: 273407 - DNA, 20 bp, Artificial
  CRISPR gRNA sequence
ggaaacaattgtgctttgaa

SEQ ID NO: 273408 - DNA, 20 bp, Artificial
  CRISPR gRNA sequence
tgctttgaaggagtgtccgt

SEQ ID NO: 273409 - DNA, 20 bp, Artificial
  CRISPR gRNA sequence
tgaaggagtgtccgtcctct

SEQ ID NO: 273410 - DNA, 20 bp, Artificial
  CRISPR gRNA sequence
gaaggagtgtccgtcctctg

SEQ ID NO: 273411 - DNA, 20 bp, Artificial
  CRISPR gRNA sequence
aaggagtgtccgtcctctga

SEQ ID NO: 273412 - DNA, 20 bp, Artificial
  CRISPR gRNA sequence
tgatttttagacaaccaagt

SEQ ID NO: 273413 - DNA, 20 bp, Artificial
  CRISPR gRNA sequence
atttttagacaaccaagtct

SEQ ID NO: 273414 - DNA, 20 bp, Artificial
  CRISPR gRNA sequence
ttagacaaccaagtctgaca

SEQ ID NO: 273415 - DNA, 20 bp, Artificial
  CRISPR gRNA sequence
tagacaaccaagtctgacat

SEQ ID NO: 273416 - DNA, 20 bp, Artificial
  CRISPR gRNA sequence
agacaaccaagtctgacatg

SEQ ID NO: 273417 - DNA, 20 bp, Artificial
  CRISPR gRNA sequence
gacaaccaagtctgacatga

SEQ ID NO: 273418 - DNA, 20 bp, Artificial
  CRISPR gRNA sequence
acatgaattgcgtatcctca

SEQ ID NO: 273419 - DNA, 20 bp, Artificial
  CRISPR gRNA sequence
cgtatcctcatcaatgccta

SEQ ID NO: 273420 - DNA, 20 bp, Artificial
  CRISPR gRNA sequence
atcaatgcctacactagtta

SEQ ID NO: 273421 - DNA, 20 bp, Artificial
  CRISPR gRNA sequence
cactagttaataaagggctt

SEQ ID NO: 273422 - DNA, 20 bp, Artificial
  CRISPR gRNA sequence
gttaataaagggcttttgtg

SEQ ID NO: 273423 - DNA, 20 bp, Artificial
  CRISPR gRNA sequence
ataaagggcttttgtgttag

SEQ ID NO: 273424 - DNA, 20 bp, Artificial
  CRISPR gRNA sequence
ttgtgttagagatgataaac

SEQ ID NO: 273425 - DNA, 20 bp, Artificial
  CRISPR gRNA sequence
tgtgttagagatgataaacc

SEQ ID NO: 273426 - DNA, 20 bp, Artificial
  CRISPR gRNA sequence
gtgttagagatgataaacca

SEQ ID NO: 273427 - DNA, 20 bp, Artificial
  CRISPR gRNA sequence
tgttagagatgataaaccac

SEQ ID NO: 273428 - DNA, 20 bp, Artificial
  CRISPR gRNA sequence
gagatgataaaccacaacaa

SEQ ID NO: 273429 - DNA, 20 bp, Artificial
  CRISPR gRNA sequence
tcttctgggatgttggtggc

SEQ ID NO: 273430 - DNA, 20 bp, Artificial
  CRISPR gRNA sequence
cttctgggatgttggtggca

SEQ ID NO: 273431 - DNA, 20 bp, Artificial
  CRISPR gRNA sequence
ttctgggatgttggtggcat

SEQ ID NO: 273432 - DNA, 20 bp, Artificial
  CRISPR gRNA sequence
ctgggatgttggtggcataa

SEQ ID NO: 273433 - DNA, 20 bp, Artificial
  CRISPR gRNA sequence
tgggatgttggtggcataaa

SEQ ID NO: 273434 - DNA, 20 bp, Artificial
  CRISPR gRNA sequence
ggatgttggtggcataaaaa

SEQ ID NO: 273435 - DNA, 20 bp, Artificial
  CRISPR gRNA sequence
gtggcataaaaattttcctt

SEQ ID NO: 273436 - DNA, 20 bp, Artificial
  CRISPR gRNA sequence
tccttttgtaaatgtcagca

SEQ ID NO: 273437 - DNA, 20 bp, Artificial
  CRISPR gRNA sequence
ccttttgtaaatgtcagcac

SEQ ID NO: 273438 - DNA, 20 bp, Artificial
  CRISPR gRNA sequence
cttttgtaaatgtcagcaca

SEQ ID NO: 273439 - DNA, 20 bp, Artificial
  CRISPR gRNA sequence
ttgtaaatgtcagcacactg

SEQ ID NO: 273440 - DNA, 20 bp, Artificial
  CRISPR gRNA sequence
tgtaaatgtcagcacactgc

SEQ ID NO: 273441 - DNA, 20 bp, Artificial
  CRISPR gRNA sequence
gtaaatgtcagcacactgct

SEQ ID NO: 273442 - DNA, 20 bp, Artificial
  CRISPR gRNA sequence
taaatgtcagcacactgctt

SEQ ID NO: 273443 - DNA, 20 bp, Artificial
  CRISPR gRNA sequence
cttgcaggaaatacttggag

SEQ ID NO: 273444 - DNA, 20 bp, Artificial
  CRISPR gRNA sequence
gcaggaaatacttggaggaa

SEQ ID NO: 273445 - DNA, 20 bp, Artificial
  CRISPR gRNA sequence
caggaaatacttggaggaag

SEQ ID NO: 273446 - DNA, 20 bp, Artificial
  CRISPR gRNA sequence
ggaggaagatatccacacaa

SEQ ID NO: 273447 - DNA, 20 bp, Artificial
  CRISPR gRNA sequence
gaggaagatatccacacaag

SEQ ID NO: 273448 - DNA, 20 bp, Artificial
  CRISPR gRNA sequence
ctccacccttgaaaaaaggc

SEQ ID NO: 273449 - DNA, 20 bp, Artificial
  CRISPR gRNA sequence
tccacccttgaaaaaaggca

SEQ ID NO: 273450 - DNA, 20 bp, Artificial
  CRISPR gRNA sequence
cacccttgaaaaaaggcata

SEQ ID NO: 273451 - DNA, 20 bp, Artificial
  CRISPR gRNA sequence
gaaaaaaggcataagacgtt

SEQ ID NO: 273452 - DNA, 20 bp, Artificial
  CRISPR gRNA sequence
aaaaaaggcataagacgtta

SEQ ID NO: 273453 - DNA, 20 bp, Artificial
  CRISPR gRNA sequence
aaaaggaggagggtctatgt

SEQ ID NO: 273454 - DNA, 20 bp, Artificial
  CRISPR gRNA sequence
tgtcttaaagaaggggaggc

SEQ ID NO: 273455 - DNA, 20 bp, Artificial
  CRISPR gRNA sequence
aaagaaggggaggcagcgag

SEQ ID NO: 273456 - DNA, 20 bp, Artificial
  CRISPR gRNA sequence
aagaaggggaggcagcgaga

SEQ ID NO: 273457 - DNA, 20 bp, Artificial
  CRISPR gRNA sequence
tccccacccatagtaaaagt

SEQ ID NO: 273458 - DNA, 20 bp, Artificial
  CRISPR gRNA sequence
cccacccatagtaaaagttt

SEQ ID NO: 273459 - DNA, 20 bp, Artificial
  CRISPR gRNA sequence
gaatgtgagagctttggagt

SEQ ID NO: 273460 - DNA, 20 bp, Artificial
  CRISPR gRNA sequence
aatgtgagagctttggagtt

SEQ ID NO: 273461 - DNA, 20 bp, Artificial
  CRISPR gRNA sequence
tggagttacaatcacagatt

SEQ ID NO: 273462 - DNA, 20 bp, Artificial
  CRISPR gRNA sequence
ggagttacaatcacagattc

SEQ ID NO: 273463 - DNA, 20 bp, Artificial
  CRISPR gRNA sequence
gagttacaatcacagattca

SEQ ID NO: 273464 - DNA, 20 bp, Artificial
  CRISPR gRNA sequence
caatcacagattcatttcta

SEQ ID NO: 273465 - DNA, 20 bp, Artificial
  CRISPR gRNA sequence
atttctatttctaatctatc

SEQ ID NO: 273466 - DNA, 20 bp, Artificial
  CRISPR gRNA sequence
ctatttctaatctatctgtg

SEQ ID NO: 273467 - DNA, 20 bp, Artificial
  CRISPR gRNA sequence
tatttctaatctatctgtgg

SEQ ID NO: 273468 - DNA, 20 bp, Artificial
  CRISPR gRNA sequence
tttctaatctatctgtggca

SEQ ID NO: 273469 - DNA, 20 bp, Artificial
  CRISPR gRNA sequence
ctaatctatctgtggcaatg

SEQ ID NO: 273470 - DNA, 20 bp, Artificial
  CRISPR gRNA sequence
taatctatctgtggcaatga

SEQ ID NO: 273471 - DNA, 20 bp, Artificial
  CRISPR gRNA sequence
atctatctgtggcaatgact

SEQ ID NO: 273472 - DNA, 20 bp, Artificial
  CRISPR gRNA sequence
tctgtggcaatgactcattc

SEQ ID NO: 273473 - DNA, 20 bp, Artificial
  CRISPR gRNA sequence
tggcaatgactcattccatt

SEQ ID NO: 273474 - DNA, 20 bp, Artificial
  CRISPR gRNA sequence
attccatttcctggtattga

SEQ ID NO: 273475 - DNA, 20 bp, Artificial
  CRISPR gRNA sequence
catttcctggtattgatata

SEQ ID NO: 273476 - DNA, 20 bp, Artificial
  CRISPR gRNA sequence
cctggtattgatatattgat

SEQ ID NO: 273477 - DNA, 20 bp, Artificial
  CRISPR gRNA sequence
ctggtattgatatattgata

SEQ ID NO: 273478 - DNA, 20 bp, Artificial
  CRISPR gRNA sequence
gtattgatatattgatatta

SEQ ID NO: 273479 - DNA, 20 bp, Artificial
  CRISPR gRNA sequence
atatattgatattaattttg

SEQ ID NO: 273480 - DNA, 20 bp, Artificial
  CRISPR gRNA sequence
atattaattttgcagtcctt

SEQ ID NO: 273481 - DNA, 20 bp, Artificial
  CRISPR gRNA sequence
attttgcagtccttgctgta

SEQ ID NO: 273482 - DNA, 20 bp, Artificial
  CRISPR gRNA sequence
tgcagtccttgctgtaaacg

SEQ ID NO: 273483 - DNA, 20 bp, Artificial
  CRISPR gRNA sequence
gcagtccttgctgtaaacgt

SEQ ID NO: 273484 - DNA, 20 bp, Artificial
  CRISPR gRNA sequence
cagtccttgctgtaaacgtc

SEQ ID NO: 273485 - DNA, 20 bp, Artificial
  CRISPR gRNA sequence
gctgtaaacgtccttgctgg

SEQ ID NO: 273486 - DNA, 20 bp, Artificial
  CRISPR gRNA sequence
ctgtaaacgtccttgctgga

SEQ ID NO: 273487 - DNA, 20 bp, Artificial
  CRISPR gRNA sequence
taaacgtccttgctggatgg

SEQ ID NO: 273488 - DNA, 20 bp, Artificial
  CRISPR gRNA sequence
gctggatggttgccttaaaa

SEQ ID NO: 273489 - DNA, 20 bp, Artificial
  CRISPR gRNA sequence
ctggatggttgccttaaaaa

SEQ ID NO: 273490 - DNA, 20 bp, Artificial
  CRISPR gRNA sequence
gatggttgccttaaaaaaca

SEQ ID NO: 273491 - DNA, 20 bp, Artificial
  CRISPR gRNA sequence
ccttaaaaaacacaatgtgt

SEQ ID NO: 273492 - DNA, 20 bp, Artificial
  CRISPR gRNA sequence
aaaaaacacaatgtgttaac

SEQ ID NO: 273493 - DNA, 20 bp, Artificial
  CRISPR gRNA sequence
aaaaacacaatgtgttaact

SEQ ID NO: 273494 - DNA, 20 bp, Artificial
  CRISPR gRNA sequence
actagggcacggtagtagag

SEQ ID NO: 273495 - DNA, 20 bp, Artificial
  CRISPR gRNA sequence
gggcacggtagtagagtaaa

SEQ ID NO: 273496 - DNA, 20 bp, Artificial
  CRISPR gRNA sequence
aagcaatgcctatacttttg

SEQ ID NO: 273497 - DNA, 20 bp, Artificial
  CRISPR gRNA sequence
agcaatgcctatacttttga

SEQ ID NO: 273498 - DNA, 20 bp, Artificial
  CRISPR gRNA sequence
tacttttgaaatatccatca

SEQ ID NO: 273499 - DNA, 20 bp, Artificial
  CRISPR gRNA sequence
ttgaaatatccatcaaattt

SEQ ID NO: 273500 - DNA, 20 bp, Artificial
  CRISPR gRNA sequence
tgaaatatccatcaaattta

SEQ ID NO: 273501 - DNA, 20 bp, Artificial
  CRISPR gRNA sequence
gaaatatccatcaaatttac

SEQ ID NO: 273502 - DNA, 20 bp, Artificial
  CRISPR gRNA sequence
aaatatccatcaaatttact

SEQ ID NO: 273503 - DNA, 20 bp, Artificial
  CRISPR gRNA sequence
acttgaaatgacaaaaacat

SEQ ID NO: 273504 - DNA, 20 bp, Artificial
  CRISPR gRNA sequence
cttgaaatgacaaaaacatc

SEQ ID NO: 273505 - DNA, 20 bp, Artificial
  CRISPR gRNA sequence
gaaatgacaaaaacatccag

SEQ ID NO: 273506 - DNA, 20 bp, Artificial
  CRISPR gRNA sequence
aaatgacaaaaacatccagt

SEQ ID NO: 273507 - DNA, 20 bp, Artificial
  CRISPR gRNA sequence
cttttaacagaaaaactggc

SEQ ID NO: 273508 - DNA, 20 bp, Artificial
  CRISPR gRNA sequence
ttttaacagaaaaactggcc

SEQ ID NO: 273509 - DNA, 20 bp, Artificial
  CRISPR gRNA sequence
ttaacagaaaaactggccac

SEQ ID NO: 273510 - DNA, 20 bp, Artificial
  CRISPR gRNA sequence
taacagaaaaactggccaca

SEQ ID NO: 273511 - DNA, 20 bp, Artificial
  CRISPR gRNA sequence
aacagaaaaactggccacag

SEQ ID NO: 273512 - DNA, 20 bp, Artificial
  CRISPR gRNA sequence
acagaaaaactggccacagc

SEQ ID NO: 273513 - DNA, 20 bp, Artificial
  CRISPR gRNA sequence
gccacagcatattggaagtc

SEQ ID NO: 273514 - DNA, 20 bp, Artificial
  CRISPR gRNA sequence
gaagtcatgtaaatacggca

SEQ ID NO: 273515 - DNA, 20 bp, Artificial
  CRISPR gRNA sequence
ttgattttttgacattcatc

SEQ ID NO: 273516 - DNA, 20 bp, Artificial
  CRISPR gRNA sequence
attttttgacattcatcttt

SEQ ID NO: 273517 - DNA, 20 bp, Artificial
  CRISPR gRNA sequence
tttgacattcatcttttcac

SEQ ID NO: 273518 - DNA, 20 bp, Artificial
  CRISPR gRNA sequence
ttgacattcatcttttcacc

SEQ ID NO: 273519 - DNA, 20 bp, Artificial
  CRISPR gRNA sequence
tgacattcatcttttcacct

SEQ ID NO: 273520 - DNA, 20 bp, Artificial
  CRISPR gRNA sequence
gacattcatcttttcacctt

SEQ ID NO: 273521 - DNA, 20 bp, Artificial
  CRISPR gRNA sequence
acattcatcttttcacctta

SEQ ID NO: 273522 - DNA, 20 bp, Artificial
  CRISPR gRNA sequence
atcttttcaccttactttcc

SEQ ID NO: 273523 - DNA, 20 bp, Artificial
  CRISPR gRNA sequence
ttcaccttactttcccaagc

SEQ ID NO: 273524 - DNA, 20 bp, Artificial
  CRISPR gRNA sequence
tcaccttactttcccaagcc

SEQ ID NO: 273525 - DNA, 20 bp, Artificial
  CRISPR gRNA sequence
caccttactttcccaagccc

SEQ ID NO: 273526 - DNA, 20 bp, Artificial
  CRISPR gRNA sequence
accttactttcccaagccca

SEQ ID NO: 273527 - DNA, 20 bp, Artificial
  CRISPR gRNA sequence
actttcccaagcccagtctc

SEQ ID NO: 273528 - DNA, 20 bp, Artificial
  CRISPR gRNA sequence
ctttcccaagcccagtctca

SEQ ID NO: 273529 - DNA, 20 bp, Artificial
  CRISPR gRNA sequence
tcccaagcccagtctcagag

SEQ ID NO: 273530 - DNA, 20 bp, Artificial
  CRISPR gRNA sequence
cccaagcccagtctcagagc

SEQ ID NO: 273531 - DNA, 20 bp, Artificial
  CRISPR gRNA sequence
ccaagcccagtctcagagca

SEQ ID NO: 273532 - DNA, 20 bp, Artificial
  CRISPR gRNA sequence
agagcaacacttaactgtga

SEQ ID NO: 273533 - DNA, 20 bp, Artificial
  CRISPR gRNA sequence
aactgtgagaaacaaattac

SEQ ID NO: 273534 - DNA, 20 bp, Artificial
  CRISPR gRNA sequence
actgtgagaaacaaattact

SEQ ID NO: 273535 - DNA, 20 bp, Artificial
  CRISPR gRNA sequence
tgagaaacaaattacttctt

SEQ ID NO: 273536 - DNA, 20 bp, Artificial
  CRISPR gRNA sequence
cttctttccgtatacaacca

SEQ ID NO: 273537 - DNA, 20 bp, Artificial
  CRISPR gRNA sequence
ctttccgtatacaaccagct

SEQ ID NO: 273538 - DNA, 20 bp, Artificial
  CRISPR gRNA sequence
tttccgtatacaaccagctc

SEQ ID NO: 273539 - DNA, 20 bp, Artificial
  CRISPR gRNA sequence
tccgtatacaaccagctcag

SEQ ID NO: 273540 - DNA, 20 bp, Artificial
  CRISPR gRNA sequence
ccgtatacaaccagctcagg

SEQ ID NO: 273541 - DNA, 20 bp, Artificial
  CRISPR gRNA sequence
cgtatacaaccagctcaggg

SEQ ID NO: 273542 - DNA, 20 bp, Artificial
  CRISPR gRNA sequence
aggggagtcattggctgaag

SEQ ID NO: 273543 - DNA, 20 bp, Artificial
  CRISPR gRNA sequence
gctgaagactagagtacaaa

SEQ ID NO: 273544 - DNA, 20 bp, Artificial
  CRISPR gRNA sequence
aagactagagtacaaataaa

SEQ ID NO: 273545 - DNA, 20 bp, Artificial
  CRISPR gRNA sequence
gagtacaaataaaattttta

SEQ ID NO: 273546 - DNA, 20 bp, Artificial
  CRISPR gRNA sequence
ttaattgctttgctgatgac

SEQ ID NO: 273547 - DNA, 20 bp, Artificial
  CRISPR gRNA sequence
taattgctttgctgatgact

SEQ ID NO: 273548 - DNA, 20 bp, Artificial
  CRISPR gRNA sequence
aattgctttgctgatgactt

SEQ ID NO: 273549 - DNA, 20 bp, Artificial
  CRISPR gRNA sequence
attgctttgctgatgacttt

SEQ ID NO: 273550 - DNA, 20 bp, Artificial
  CRISPR gRNA sequence
ctttgctgatgactttttat

SEQ ID NO: 273551 - DNA, 20 bp, Artificial
  CRISPR gRNA sequence
tgctgatgactttttattaa

SEQ ID NO: 273552 - DNA, 20 bp, Artificial
  CRISPR gRNA sequence
gctgatgactttttattaaa

SEQ ID NO: 273553 - DNA, 20 bp, Artificial
  CRISPR gRNA sequence
ctgatgactttttattaaat

SEQ ID NO: 273554 - DNA, 20 bp, Artificial
  CRISPR gRNA sequence
atgactttttattaaatgtc

SEQ ID NO: 273555 - DNA, 20 bp, Artificial
  CRISPR gRNA sequence
tttattaaatgtcagttatt

SEQ ID NO: 273556 - DNA, 20 bp, Artificial
  CRISPR gRNA sequence
ttattaaatgtcagttattt

SEQ ID NO: 273557 - DNA, 20 bp, Artificial
  CRISPR gRNA sequence
tattaaatgtcagttatttt

SEQ ID NO: 273558 - DNA, 20 bp, Artificial
  CRISPR gRNA sequence
attaaatgtcagttattttc

SEQ ID NO: 273559 - DNA, 20 bp, Artificial
  CRISPR gRNA sequence
ttaaatgtcagttattttcc

SEQ ID NO: 273560 - DNA, 20 bp, Artificial
  CRISPR gRNA sequence
aatgtcagttattttcctgc

SEQ ID NO: 273561 - DNA, 20 bp, Artificial
  CRISPR gRNA sequence
ttttcctgctttccatgcct

SEQ ID NO: 273562 - DNA, 20 bp, Artificial
  CRISPR gRNA sequence
tcctgctttccatgcctctc

SEQ ID NO: 273563 - DNA, 20 bp, Artificial
  CRISPR gRNA sequence
cctgctttccatgcctctct

SEQ ID NO: 273564 - DNA, 20 bp, Artificial
  CRISPR gRNA sequence
ctgctttccatgcctctctc

SEQ ID NO: 273565 - DNA, 20 bp, Artificial
  CRISPR gRNA sequence
ctttccatgcctctctcaga

SEQ ID NO: 273566 - DNA, 20 bp, Artificial
  CRISPR gRNA sequence
tccatgcctctctcagaaaa

SEQ ID NO: 273567 - DNA, 20 bp, Artificial
  CRISPR gRNA sequence
ccatgcctctctcagaaaaa

SEQ ID NO: 273568 - DNA, 20 bp, Artificial
  CRISPR gRNA sequence
catgcctctctcagaaaaat

SEQ ID NO: 273569 - DNA, 20 bp, Artificial
  CRISPR gRNA sequence
tctcagaaaaataagcgcta

SEQ ID NO: 273570 - DNA, 20 bp, Artificial
  CRISPR gRNA sequence
tcagaaaaataagcgctaag

SEQ ID NO: 273571 - DNA, 20 bp, Artificial
  CRISPR gRNA sequence
agaaaaataagcgctaaggg

SEQ ID NO: 273572 - DNA, 20 bp, Artificial
  CRISPR gRNA sequence
agggaaggcgctggagaaat

SEQ ID NO: 273573 - DNA, 20 bp, Artificial
  CRISPR gRNA sequence
gagaaattagctttgtccaa

SEQ ID NO: 273574 - DNA, 20 bp, Artificial
  CRISPR gRNA sequence
gctttgtccaaactggccat

SEQ ID NO: 273575 - DNA, 20 bp, Artificial
  CRISPR gRNA sequence
tgtccaaactggccattttg

SEQ ID NO: 273576 - DNA, 20 bp, Artificial
  CRISPR gRNA sequence
gtccaaactggccattttga

SEQ ID NO: 273577 - DNA, 20 bp, Artificial
  CRISPR gRNA sequence
tccaaactggccattttgac

SEQ ID NO: 273578 - DNA, 20 bp, Artificial
  CRISPR gRNA sequence
gccattttgacagttttttg

SEQ ID NO: 273579 - DNA, 20 bp, Artificial
  CRISPR gRNA sequence
tgacagttttttgcccaagt

SEQ ID NO: 273580 - DNA, 20 bp, Artificial
  CRISPR gRNA sequence
gacagttttttgcccaagtt

SEQ ID NO: 273581 - DNA, 20 bp, Artificial
  CRISPR gRNA sequence
acagttttttgcccaagttt

SEQ ID NO: 273582 - DNA, 20 bp, Artificial
  CRISPR gRNA sequence
tttgcccaagttttggagaa

SEQ ID NO: 273583 - DNA, 20 bp, Artificial
  CRISPR gRNA sequence
ttgcccaagttttggagaag

SEQ ID NO: 273584 - DNA, 20 bp, Artificial
  CRISPR gRNA sequence
tgcccaagttttggagaagt

SEQ ID NO: 273585 - DNA, 20 bp, Artificial
  CRISPR gRNA sequence
gcccaagttttggagaagtg

SEQ ID NO: 273586 - DNA, 20 bp, Artificial
  CRISPR gRNA sequence
cccaagttttggagaagtga

SEQ ID NO: 273587 - DNA, 20 bp, Artificial
  CRISPR gRNA sequence
tggagaagtgaaaaggaatg

SEQ ID NO: 273588 - DNA, 20 bp, Artificial
  CRISPR gRNA sequence
ggagaagtgaaaaggaatga

SEQ ID NO: 273589 - DNA, 20 bp, Artificial
  CRISPR gRNA sequence
gagaagtgaaaaggaatgat

SEQ ID NO: 273590 - DNA, 20 bp, Artificial
  CRISPR gRNA sequence
atggaaaaataagtggtaat

SEQ ID NO: 273591 - DNA, 20 bp, Artificial
  CRISPR gRNA sequence
atttttctcttcacactgga

SEQ ID NO: 273592 - DNA, 20 bp, Artificial
  CRISPR gRNA sequence
ttctcttcacactggatgat

SEQ ID NO: 273593 - DNA, 20 bp, Artificial
  CRISPR gRNA sequence
tctcttcacactggatgatt

SEQ ID NO: 273594 - DNA, 20 bp, Artificial
  CRISPR gRNA sequence
ctcttcacactggatgatta

SEQ ID NO: 273595 - DNA, 20 bp, Artificial
  CRISPR gRNA sequence
tcttcacactggatgattag

SEQ ID NO: 273596 - DNA, 20 bp, Artificial
  CRISPR gRNA sequence
ttcacactggatgattaggc

SEQ ID NO: 273597 - DNA, 20 bp, Artificial
  CRISPR gRNA sequence
cacactggatgattaggctt

SEQ ID NO: 273598 - DNA, 20 bp, Artificial
  CRISPR gRNA sequence
acactggatgattaggcttg

SEQ ID NO: 273599 - DNA, 20 bp, Artificial
  CRISPR gRNA sequence
gatgattaggcttgctaaaa

SEQ ID NO: 273600 - DNA, 20 bp, Artificial
  CRISPR gRNA sequence
ggcttgctaaaaaatagcaa

SEQ ID NO: 273601 - DNA, 20 bp, Artificial
  CRISPR gRNA sequence
gctaaaaaatagcaaatatg

SEQ ID NO: 273602 - DNA, 20 bp, Artificial
  CRISPR gRNA sequence
ctaaaaaatagcaaatatgg

SEQ ID NO: 273603 - DNA, 20 bp, Artificial
  CRISPR gRNA sequence
aaaaatagcaaatatggcct

SEQ ID NO: 273604 - DNA, 20 bp, Artificial
  CRISPR gRNA sequence
aaacatgtgaccaatgtcaa

SEQ ID NO: 273605 - DNA, 20 bp, Artificial
  CRISPR gRNA sequence
tgtgcataccatccttctat

SEQ ID NO: 273606 - DNA, 20 bp, Artificial
  CRISPR gRNA sequence
gtgcataccatccttctatc

SEQ ID NO: 273607 - DNA, 20 bp, Artificial
  CRISPR gRNA sequence
tgcataccatccttctatca

SEQ ID NO: 273608 - DNA, 20 bp, Artificial
  CRISPR gRNA sequence
ctatcatcaatcccagagca

SEQ ID NO: 273609 - DNA, 20 bp, Artificial
  CRISPR gRNA sequence
tatcatcaatcccagagcat

SEQ ID NO: 273610 - DNA, 20 bp, Artificial
  CRISPR gRNA sequence
tcatcaatcccagagcattt

SEQ ID NO: 273611 - DNA, 20 bp, Artificial
  CRISPR gRNA sequence
ccctcttaaggctctgtagt

SEQ ID NO: 273612 - DNA, 20 bp, Artificial
  CRISPR gRNA sequence
cctcttaaggctctgtagtt

SEQ ID NO: 273613 - DNA, 20 bp, Artificial
  CRISPR gRNA sequence
ttaaggctctgtagttctgg

SEQ ID NO: 273614 - DNA, 20 bp, Artificial
  CRISPR gRNA sequence
aaggctctgtagttctgggc

SEQ ID NO: 273615 - DNA, 20 bp, Artificial
  CRISPR gRNA sequence
aggctctgtagttctgggct

SEQ ID NO: 273616 - DNA, 20 bp, Artificial
  CRISPR gRNA sequence
tgtagttctgggctggactc

SEQ ID NO: 273617 - DNA, 20 bp, Artificial
  CRISPR gRNA sequence
tagttctgggctggactcct

SEQ ID NO: 273618 - DNA, 20 bp, Artificial
  CRISPR gRNA sequence
tgggctggactcctatccca

SEQ ID NO: 273619 - DNA, 20 bp, Artificial
  CRISPR gRNA sequence
ggctggactcctatcccaaa

SEQ ID NO: 273620 - DNA, 20 bp, Artificial
  CRISPR gRNA sequence
gactcctatcccaaagtcca

SEQ ID NO: 273621 - DNA, 20 bp, Artificial
  CRISPR gRNA sequence
ctatcccaaagtccagcaaa

SEQ ID NO: 273622 - DNA, 20 bp, Artificial
  CRISPR gRNA sequence
tcccaaagtccagcaaaata

SEQ ID NO: 273623 - DNA, 20 bp, Artificial
  CRISPR gRNA sequence
tctgtggatctcagttgcac

SEQ ID NO: 273624 - DNA, 20 bp, Artificial
  CRISPR gRNA sequence
tgtggatctcagttgcacaa

SEQ ID NO: 273625 - DNA, 20 bp, Artificial
  CRISPR gRNA sequence
tggatctcagttgcacaatt

SEQ ID NO: 273626 - DNA, 20 bp, Artificial
  CRISPR gRNA sequence
agttgcacaattatccgagt

SEQ ID NO: 273627 - DNA, 20 bp, Artificial
  CRISPR gRNA sequence
cacaattatccgagtctagt

SEQ ID NO: 273628 - DNA, 20 bp, Artificial
  CRISPR gRNA sequence
tccgagtctagtagaaaaca

SEQ ID NO: 273629 - DNA, 20 bp, Artificial
  CRISPR gRNA sequence
gtagaaaacatgcaaagggc

SEQ ID NO: 273630 - DNA, 20 bp, Artificial
  CRISPR gRNA sequence
atctaagttaaggtttcctc

SEQ ID NO: 273631 - DNA, 20 bp, Artificial
  CRISPR gRNA sequence
tctaagttaaggtttcctca

SEQ ID NO: 273632 - DNA, 20 bp, Artificial
  CRISPR gRNA sequence
agttaaggtttcctcactct

SEQ ID NO: 273633 - DNA, 20 bp, Artificial
  CRISPR gRNA sequence
aggtttcctcactcttccta

SEQ ID NO: 273634 - DNA, 20 bp, Artificial
  CRISPR gRNA sequence
cctcactcttcctaaatcac

SEQ ID NO: 273635 - DNA, 20 bp, Artificial
  CRISPR gRNA sequence
ctcactcttcctaaatcaca

SEQ ID NO: 273636 - DNA, 20 bp, Artificial
  CRISPR gRNA sequence
actcttcctaaatcacactt

SEQ ID NO: 273637 - DNA, 20 bp, Artificial
  CRISPR gRNA sequence
ttcctaaatcacacttcttt

SEQ ID NO: 273638 - DNA, 20 bp, Artificial
  CRISPR gRNA sequence
cctaaatcacacttctttaa

SEQ ID NO: 273639 - DNA, 20 bp, Artificial
  CRISPR gRNA sequence
ctaaatcacacttctttaac

SEQ ID NO: 273640 - DNA, 20 bp, Artificial
  CRISPR gRNA sequence
aatcacacttctttaactta

SEQ ID NO: 273641 - DNA, 20 bp, Artificial
  CRISPR gRNA sequence
ctttaacttagccataaata

SEQ ID NO: 273642 - DNA, 20 bp, Artificial
  CRISPR gRNA sequence
tttaacttagccataaatat

SEQ ID NO: 273643 - DNA, 20 bp, Artificial
  CRISPR gRNA sequence
taacttagccataaatatct

SEQ ID NO: 273644 - DNA, 20 bp, Artificial
  CRISPR gRNA sequence
aacttagccataaatatctc

SEQ ID NO: 273645 - DNA, 20 bp, Artificial
  CRISPR gRNA sequence
acttagccataaatatctct

SEQ ID NO: 273646 - DNA, 20 bp, Artificial
  CRISPR gRNA sequence
agccataaatatctctctac

SEQ ID NO: 273647 - DNA, 20 bp, Artificial
  CRISPR gRNA sequence
gccataaatatctctctaca

SEQ ID NO: 273648 - DNA, 20 bp, Artificial
  CRISPR gRNA sequence
tctacactgtcatccaactc

SEQ ID NO: 273649 - DNA, 20 bp, Artificial
  CRISPR gRNA sequence
tacactgtcatccaactcat

SEQ ID NO: 273650 - DNA, 20 bp, Artificial
  CRISPR gRNA sequence
cactgtcatccaactcataa

SEQ ID NO: 273651 - DNA, 20 bp, Artificial
  CRISPR gRNA sequence
tcatccaactcataaggaat

SEQ ID NO: 273652 - DNA, 20 bp, Artificial
  CRISPR gRNA sequence
ataaggaatcaggttagact

SEQ ID NO: 273653 - DNA, 20 bp, Artificial
  CRISPR gRNA sequence
gacttaacctttatagaata

SEQ ID NO: 273654 - DNA, 20 bp, Artificial
  CRISPR gRNA sequence
aacctttatagaataaatat

SEQ ID NO: 273655 - DNA, 20 bp, Artificial
  CRISPR gRNA sequence
acctttatagaataaatatt

SEQ ID NO: 273656 - DNA, 20 bp, Artificial
  CRISPR gRNA sequence
tatagaataaatattttaag

SEQ ID NO: 273657 - DNA, 20 bp, Artificial
  CRISPR gRNA sequence
atagaataaatattttaagc

SEQ ID NO: 273658 - DNA, 20 bp, Artificial
  CRISPR gRNA sequence
tagaataaatattttaagct

SEQ ID NO: 273659 - DNA, 20 bp, Artificial
  CRISPR gRNA sequence
taagctatgctgtaaacaaa

SEQ ID NO: 273660 - DNA, 20 bp, Artificial
  CRISPR gRNA sequence
aagctatgctgtaaacaaat

SEQ ID NO: 273661 - DNA, 20 bp, Artificial
  CRISPR gRNA sequence
agctatgctgtaaacaaata

SEQ ID NO: 273662 - DNA, 20 bp, Artificial
  CRISPR gRNA sequence
tgctgtaaacaaataagtta

SEQ ID NO: 273663 - DNA, 20 bp, Artificial
  CRISPR gRNA sequence
taaacaaataagttacatta

SEQ ID NO: 273664 - DNA, 20 bp, Artificial
  CRISPR gRNA sequence
cattattaaattaatggaaa

SEQ ID NO: 273665 - DNA, 20 bp, Artificial
  CRISPR gRNA sequence
ttaaattaatggaaaaaaga

SEQ ID NO: 273666 - DNA, 20 bp, Artificial
  CRISPR gRNA sequence
aattaatggaaaaaagaact

SEQ ID NO: 273667 - DNA, 20 bp, Artificial
  CRISPR gRNA sequence
atggaaaaaagaactattct

SEQ ID NO: 273668 - DNA, 20 bp, Artificial
  CRISPR gRNA sequence
ttcttcatatacatacatac

SEQ ID NO: 273669 - DNA, 20 bp, Artificial
  CRISPR gRNA sequence
ttcatatacatacatacaca

SEQ ID NO: 273670 - DNA, 20 bp, Artificial
  CRISPR gRNA sequence
catatacatacatacacaca

SEQ ID NO: 273671 - DNA, 20 bp, Artificial
  CRISPR gRNA sequence
atatacatacatacacacac

SEQ ID NO: 273672 - DNA, 20 bp, Artificial
  CRISPR gRNA sequence
ttaaattaatggaaaaaaga

SEQ ID NO: 273673 - DNA, 20 bp, Artificial
  CRISPR gRNA sequence
aattaatggaaaaaagaact

SEQ ID NO: 273674 - DNA, 20 bp, Artificial
  CRISPR gRNA sequence
atggaaaaaagaactattct

SEQ ID NO: 273675 - DNA, 20 bp, Artificial
  CRISPR gRNA sequence
ttcttcatatacatacatac

SEQ ID NO: 273676 - DNA, 20 bp, Artificial
  CRISPR gRNA sequence
ttcatatacatacatacaca

SEQ ID NO: 273677 - DNA, 20 bp, Artificial
  CRISPR gRNA sequence
catatacatacatacacaca

SEQ ID NO: 273678 - DNA, 20 bp, Artificial
  CRISPR gRNA sequence
atatacatacatacacacac

SEQ ID NO: 273679 - DNA, 20 bp, Artificial
  CRISPR gRNA sequence
aacacaggcataacagtggt

SEQ ID NO: 273680 - DNA, 20 bp, Artificial
  CRISPR gRNA sequence
ctcagacctaggaaggacag

SEQ ID NO: 273681 - DNA, 20 bp, Artificial
  CRISPR gRNA sequence
tcagacctaggaaggacagt

SEQ ID NO: 273682 - DNA, 20 bp, Artificial
  CRISPR gRNA sequence
agacctaggaaggacagtta

SEQ ID NO: 273683 - DNA, 20 bp, Artificial
  CRISPR gRNA sequence
ggaaggacagttacactttg

SEQ ID NO: 273684 - DNA, 20 bp, Artificial
  CRISPR gRNA sequence
cactttgaccagagaatttc

SEQ ID NO: 273685 - DNA, 20 bp, Artificial
  CRISPR gRNA sequence
tgaccagagaatttccctat

SEQ ID NO: 273686 - DNA, 20 bp, Artificial
  CRISPR gRNA sequence
gaccagagaatttccctatc

SEQ ID NO: 273687 - DNA, 20 bp, Artificial
  CRISPR gRNA sequence
accagagaatttccctatct

SEQ ID NO: 273688 - DNA, 20 bp, Artificial
  CRISPR gRNA sequence
ccctatctataatttcttaa

SEQ ID NO: 273689 - DNA, 20 bp, Artificial
  CRISPR gRNA sequence
cctatctataatttcttaat

SEQ ID NO: 273690 - DNA, 20 bp, Artificial
  CRISPR gRNA sequence
tctataatttcttaatggaa

SEQ ID NO: 273691 - DNA, 20 bp, Artificial
  CRISPR gRNA sequence
taatttcttaatggaaggtg

SEQ ID NO: 273692 - DNA, 20 bp, Artificial
  CRISPR gRNA sequence
cttaatggaaggtgtgtaca

SEQ ID NO: 273693 - DNA, 20 bp, Artificial
  CRISPR gRNA sequence
ttaatggaaggtgtgtacag

SEQ ID NO: 273694 - DNA, 20 bp, Artificial
  CRISPR gRNA sequence
aatggaaggtgtgtacagag

SEQ ID NO: 273695 - DNA, 20 bp, Artificial
  CRISPR gRNA sequence
atggaaggtgtgtacagaga

SEQ ID NO: 273696 - DNA, 20 bp, Artificial
  CRISPR gRNA sequence
tgcactatttgattagaatg

SEQ ID NO: 273697 - DNA, 20 bp, Artificial
  CRISPR gRNA sequence
gcactatttgattagaatgc

SEQ ID NO: 273698 - DNA, 20 bp, Artificial
  CRISPR gRNA sequence
cactatttgattagaatgca

SEQ ID NO: 273699 - DNA, 20 bp, Artificial
  CRISPR gRNA sequence
tttgattagaatgcagcata

SEQ ID NO: 273700 - DNA, 20 bp, Artificial
  CRISPR gRNA sequence
gattagaatgcagcataatt

SEQ ID NO: 273701 - DNA, 20 bp, Artificial
  CRISPR gRNA sequence
attagaatgcagcataattt

SEQ ID NO: 273702 - DNA, 20 bp, Artificial
  CRISPR gRNA sequence
gaatgcagcataattttttt

SEQ ID NO: 273703 - DNA, 20 bp, Artificial
  CRISPR gRNA sequence
ttttttttttttgagactgt

SEQ ID NO: 273704 - DNA, 20 bp, Artificial
  CRISPR gRNA sequence
tttttttttttgagactgtt

SEQ ID NO: 273705 - DNA, 20 bp, Artificial
  CRISPR gRNA sequence
ttttttttttgagactgttt

SEQ ID NO: 273706 - DNA, 20 bp, Artificial
  CRISPR gRNA sequence
tttttttttgagactgtttc

SEQ ID NO: 273707 - DNA, 20 bp, Artificial
  CRISPR gRNA sequence
ttttttttgagactgtttcc

SEQ ID NO: 273708 - DNA, 20 bp, Artificial
  CRISPR gRNA sequence
tttttttgagactgtttccc

SEQ ID NO: 273709 - DNA, 20 bp, Artificial
  CRISPR gRNA sequence
ttttttgagactgtttccca

SEQ ID NO: 273710 - DNA, 20 bp, Artificial
  CRISPR gRNA sequence
tttttgagactgtttcccag

SEQ ID NO: 273711 - DNA, 20 bp, Artificial
  CRISPR gRNA sequence
ttttgagactgtttcccagg

SEQ ID NO: 273712 - DNA, 20 bp, Artificial
  CRISPR gRNA sequence
tttgagactgtttcccaggc

SEQ ID NO: 273713 - DNA, 20 bp, Artificial
  CRISPR gRNA sequence
ttgagactgtttcccaggct

SEQ ID NO: 273714 - DNA, 20 bp, Artificial
  CRISPR gRNA sequence
tgagactgtttcccaggctg

SEQ ID NO: 273715 - DNA, 20 bp, Artificial
  CRISPR gRNA sequence
gagactgtttcccaggctgg

SEQ ID NO: 273716 - DNA, 20 bp, Artificial
  CRISPR gRNA sequence
agactgtttcccaggctgga

SEQ ID NO: 273717 - DNA, 20 bp, Artificial
  CRISPR gRNA sequence
tttcccaggctggagtgcag

SEQ ID NO: 273718 - DNA, 20 bp, Artificial
  CRISPR gRNA sequence
cccaggctggagtgcagggg

SEQ ID NO: 273719 - DNA, 20 bp, Artificial
  CRISPR gRNA sequence
ccaggctggagtgcaggggt

SEQ ID NO: 273720 - DNA, 20 bp, Artificial
  CRISPR gRNA sequence
gagtgcaggggtgcaatcta

SEQ ID NO: 273721 - DNA, 20 bp, Artificial
  CRISPR gRNA sequence
agttcacagcaacctccgcg

SEQ ID NO: 273722 - DNA, 20 bp, Artificial
  CRISPR gRNA sequence
acagcaacctccgcgtcccg

SEQ ID NO: 273723 - DNA, 20 bp, Artificial
  CRISPR gRNA sequence
cgcgtcccgggtttaagcaa

SEQ ID NO: 273724 - DNA, 20 bp, Artificial
  CRISPR gRNA sequence
aagcaattctcctgcctaag

SEQ ID NO: 273725 - DNA, 20 bp, Artificial
  CRISPR gRNA sequence
agcaattctcctgcctaagc

SEQ ID NO: 273726 - DNA, 20 bp, Artificial
  CRISPR gRNA sequence
tcctgcctaagcctcacaag

SEQ ID NO: 273727 - DNA, 20 bp, Artificial
  CRISPR gRNA sequence
ctgcctaagcctcacaagta

SEQ ID NO: 273728 - DNA, 20 bp, Artificial
  CRISPR gRNA sequence
cctaagcctcacaagtagct

SEQ ID NO: 273729 - DNA, 20 bp, Artificial
  CRISPR gRNA sequence
agcctcacaagtagctggga

SEQ ID NO: 273730 - DNA, 20 bp, Artificial
  CRISPR gRNA sequence
acaagtagctgggattacag

SEQ ID NO: 273731 - DNA, 20 bp, Artificial
  CRISPR gRNA sequence
ggattacaggcgcatgccac

SEQ ID NO: 273732 - DNA, 20 bp, Artificial
  CRISPR gRNA sequence
caggcgcatgccaccacacc

SEQ ID NO: 273733 - DNA, 20 bp, Artificial
  CRISPR gRNA sequence
ctaatttttttgtattttta

SEQ ID NO: 273734 - DNA, 20 bp, Artificial
  CRISPR gRNA sequence
atttttttgtatttttagta

SEQ ID NO: 273735 - DNA, 20 bp, Artificial
  CRISPR gRNA sequence
ttttgtatttttagtagaga

SEQ ID NO: 273736 - DNA, 20 bp, Artificial
  CRISPR gRNA sequence
tttgtatttttagtagagat

SEQ ID NO: 273737 - DNA, 20 bp, Artificial
  CRISPR gRNA sequence
ttgtatttttagtagagatg

SEQ ID NO: 273738 - DNA, 20 bp, Artificial
  CRISPR gRNA sequence
tgtatttttagtagagatgg

SEQ ID NO: 273739 - DNA, 20 bp, Artificial
  CRISPR gRNA sequence
gtatttttagtagagatggg

SEQ ID NO: 273740 - DNA, 20 bp, Artificial
  CRISPR gRNA sequence
tatttttagtagagatggga

SEQ ID NO: 273741 - DNA, 20 bp, Artificial
  CRISPR gRNA sequence
ttagtagagatgggatttca

SEQ ID NO: 273742 - DNA, 20 bp, Artificial
  CRISPR gRNA sequence
tagtagagatgggatttcac

SEQ ID NO: 273743 - DNA, 20 bp, Artificial
  CRISPR gRNA sequence
agtagagatgggatttcacc

SEQ ID NO: 273744 - DNA, 20 bp, Artificial
  CRISPR gRNA sequence
gtagagatgggatttcacca

SEQ ID NO: 273745 - DNA, 20 bp, Artificial
  CRISPR gRNA sequence
caccatgttagcccgacggg

SEQ ID NO: 273746 - DNA, 20 bp, Artificial
  CRISPR gRNA sequence
accatgttagcccgacgggt

SEQ ID NO: 273747 - DNA, 20 bp, Artificial
  CRISPR gRNA sequence
gcccgacgggtctccaactc

SEQ ID NO: 273748 - DNA, 20 bp, Artificial
  CRISPR gRNA sequence
caactcctgacctcaagtga

SEQ ID NO: 273749 - DNA, 20 bp, Artificial
  CRISPR gRNA sequence
ctgacctcaagtgatccacc

SEQ ID NO: 273750 - DNA, 20 bp, Artificial
  CRISPR gRNA sequence
acctcaagtgatccacccgc

SEQ ID NO: 273751 - DNA, 20 bp, Artificial
  CRISPR gRNA sequence
aagtgatccacccgcctcag

SEQ ID NO: 273752 - DNA, 20 bp, Artificial
  CRISPR gRNA sequence
agcgtcccacgattacaggc

SEQ ID NO: 273753 - DNA, 20 bp, Artificial
  CRISPR gRNA sequence
caggcgtgagccaccacacc

SEQ ID NO: 273754 - DNA, 20 bp, Artificial
  CRISPR gRNA sequence
tttatgtggtcattcttttc

SEQ ID NO: 273755 - DNA, 20 bp, Artificial
  CRISPR gRNA sequence
ttatgtggtcattcttttct

SEQ ID NO: 273756 - DNA, 20 bp, Artificial
  CRISPR gRNA sequence
tatgtggtcattcttttctt

SEQ ID NO: 273757 - DNA, 20 bp, Artificial
  CRISPR gRNA sequence
atgtggtcattcttttcttg

SEQ ID NO: 273758 - DNA, 20 bp, Artificial
  CRISPR gRNA sequence
tgtggtcattcttttcttgc

SEQ ID NO: 273759 - DNA, 20 bp, Artificial
  CRISPR gRNA sequence
ttttcttgctcgtaagtttt

SEQ ID NO: 273760 - DNA, 20 bp, Artificial
  CRISPR gRNA sequence
ttcttgctcgtaagttttct

SEQ ID NO: 273761 - DNA, 20 bp, Artificial
  CRISPR gRNA sequence
tcttgctcgtaagttttctt

SEQ ID NO: 273762 - DNA, 20 bp, Artificial
  CRISPR gRNA sequence
cttgctcgtaagttttctta

SEQ ID NO: 273763 - DNA, 20 bp, Artificial
  CRISPR gRNA sequence
ttgctcgtaagttttcttac

SEQ ID NO: 273764 - DNA, 20 bp, Artificial
  CRISPR gRNA sequence
gctcgtaagttttcttactg

SEQ ID NO: 273765 - DNA, 20 bp, Artificial
  CRISPR gRNA sequence
ctcgtaagttttcttactgg

SEQ ID NO: 273766 - DNA, 20 bp, Artificial
  CRISPR gRNA sequence
gtaagttttcttactggaaa

SEQ ID NO: 273767 - DNA, 20 bp, Artificial
  CRISPR gRNA sequence
tcttactggaaaagactgta

SEQ ID NO: 273768 - DNA, 20 bp, Artificial
  CRISPR gRNA sequence
cttactggaaaagactgtaa

SEQ ID NO: 273769 - DNA, 20 bp, Artificial
  CRISPR gRNA sequence
ttactggaaaagactgtaaa

SEQ ID NO: 273770 - DNA, 20 bp, Artificial
  CRISPR gRNA sequence
actggaaaagactgtaaaag

SEQ ID NO: 273771 - DNA, 20 bp, Artificial
  CRISPR gRNA sequence
ctggaaaagactgtaaaagt

SEQ ID NO: 273772 - DNA, 20 bp, Artificial
  CRISPR gRNA sequence
gaaaagactgtaaaagtgtc

SEQ ID NO: 273773 - DNA, 20 bp, Artificial
  CRISPR gRNA sequence
taaaagtgtccccttcactc

SEQ ID NO: 273774 - DNA, 20 bp, Artificial
  CRISPR gRNA sequence
cactcccatctctttccttc

SEQ ID NO: 273775 - DNA, 20 bp, Artificial
  CRISPR gRNA sequence
actcccatctctttccttct

SEQ ID NO: 273776 - DNA, 20 bp, Artificial
  CRISPR gRNA sequence
ccatctctttccttcttcat

SEQ ID NO: 273777 - DNA, 20 bp, Artificial
  CRISPR gRNA sequence
tttccttcttcattagatag

SEQ ID NO: 273778 - DNA, 20 bp, Artificial
  CRISPR gRNA sequence
tccttcttcattagatagcc

SEQ ID NO: 273779 - DNA, 20 bp, Artificial
  CRISPR gRNA sequence
ccttcttcattagatagcca

SEQ ID NO: 273780 - DNA, 20 bp, Artificial
  CRISPR gRNA sequence
cttcttcattagatagccac

SEQ ID NO: 273781 - DNA, 20 bp, Artificial
  CRISPR gRNA sequence
cttcattagatagccactca

SEQ ID NO: 273782 - DNA, 20 bp, Artificial
  CRISPR gRNA sequence
ttcattagatagccactcag

SEQ ID NO: 273783 - DNA, 20 bp, Artificial
  CRISPR gRNA sequence
cattagatagccactcagta

SEQ ID NO: 273784 - DNA, 20 bp, Artificial
  CRISPR gRNA sequence
attagatagccactcagtat

SEQ ID NO: 273785 - DNA, 20 bp, Artificial
  CRISPR gRNA sequence
gatagccactcagtatcaaa

SEQ ID NO: 273786 - DNA, 20 bp, Artificial
  CRISPR gRNA sequence
agtatcaaatgctaaaagtt

SEQ ID NO: 273787 - DNA, 20 bp, Artificial
  CRISPR gRNA sequence
aaagttactagaaaagtgaa

SEQ ID NO: 273788 - DNA, 20 bp, Artificial
  CRISPR gRNA sequence
ctagaaaagtgaattggcat

SEQ ID NO: 273789 - DNA, 20 bp, Artificial
  CRISPR gRNA sequence
gaaaagtgaattggcatttg

SEQ ID NO: 273790 - DNA, 20 bp, Artificial
  CRISPR gRNA sequence
gcatttgaaaagtaaatata

SEQ ID NO: 273791 - DNA, 20 bp, Artificial
  CRISPR gRNA sequence
gaaaagtaaatatatgtcaa

SEQ ID NO: 273792 - DNA, 20 bp, Artificial
  CRISPR gRNA sequence
aaaagtaaatatatgtcaaa

SEQ ID NO: 273793 - DNA, 20 bp, Artificial
  CRISPR gRNA sequence
tgtgtgtgaactctccaacc

SEQ ID NO: 273794 - DNA, 20 bp, Artificial
  CRISPR gRNA sequence
tccaaccacttatctagcta

SEQ ID NO: 273795 - DNA, 20 bp, Artificial
  CRISPR gRNA sequence
caaccacttatctagctagt

SEQ ID NO: 273796 - DNA, 20 bp, Artificial
  CRISPR gRNA sequence
atctagctagtcccctttta

SEQ ID NO: 273797 - DNA, 20 bp, Artificial
  CRISPR gRNA sequence
tctagctagtccccttttaa

SEQ ID NO: 273798 - DNA, 20 bp, Artificial
  CRISPR gRNA sequence
gctagtccccttttaataaa

SEQ ID NO: 273799 - DNA, 20 bp, Artificial
  CRISPR gRNA sequence
gtccccttttaataaatgtt

SEQ ID NO: 273800 - DNA, 20 bp, Artificial
  CRISPR gRNA sequence
ttaataaatgttctaaagaa

SEQ ID NO: 273801 - DNA, 20 bp, Artificial
  CRISPR gRNA sequence
taataaatgttctaaagaaa

SEQ ID NO: 273802 - DNA, 20 bp, Artificial
  CRISPR gRNA sequence
aataaatgttctaaagaaaa

SEQ ID NO: 273803 - DNA, 20 bp, Artificial
  CRISPR gRNA sequence
ataaatgttctaaagaaaac

SEQ ID NO: 273804 - DNA, 20 bp, Artificial
  CRISPR gRNA sequence
taaagaaaacatacaaagtt

SEQ ID NO: 273805 - DNA, 20 bp, Artificial
  CRISPR gRNA sequence
aagaaaacatacaaagtttt

SEQ ID NO: 273806 - DNA, 20 bp, Artificial
  CRISPR gRNA sequence
tgagtcttaccaaaaactct

SEQ ID NO: 273807 - DNA, 20 bp, Artificial
  CRISPR gRNA sequence
gagtcttaccaaaaactctt

SEQ ID NO: 273808 - DNA, 20 bp, Artificial
  CRISPR gRNA sequence
agtcttaccaaaaactcttc

SEQ ID NO: 273809 - DNA, 20 bp, Artificial
  CRISPR gRNA sequence
accaaaaactcttcaaaaga

SEQ ID NO: 273810 - DNA, 20 bp, Artificial
  CRISPR gRNA sequence
ccaaaaactcttcaaaagag

SEQ ID NO: 273811 - DNA, 20 bp, Artificial
  CRISPR gRNA sequence
ttcaaaagagagtgaataag

SEQ ID NO: 273812 - DNA, 20 bp, Artificial
  CRISPR gRNA sequence
caaaagagagtgaataagtt

SEQ ID NO: 273813 - DNA, 20 bp, Artificial
  CRISPR gRNA sequence
aaaagagagtgaataagttg

SEQ ID NO: 273814 - DNA, 20 bp, Artificial
  CRISPR gRNA sequence
atgacagataggtgtccaca

SEQ ID NO: 273815 - DNA, 20 bp, Artificial
  CRISPR gRNA sequence
agtgtacaattaccaatttt

SEQ ID NO: 273816 - DNA, 20 bp, Artificial
  CRISPR gRNA sequence
gtgtacaattaccaatttta

SEQ ID NO: 273817 - DNA, 20 bp, Artificial
  CRISPR gRNA sequence
ccaattttaaatagttttca

SEQ ID NO: 273818 - DNA, 20 bp, Artificial
  CRISPR gRNA sequence
taaatagttttcagtcaggg

SEQ ID NO: 273819 - DNA, 20 bp, Artificial
  CRISPR gRNA sequence
aaatagttttcagtcagggt

SEQ ID NO: 273820 - DNA, 20 bp, Artificial
  CRISPR gRNA sequence
aatagttttcagtcagggta

SEQ ID NO: 273821 - DNA, 20 bp, Artificial
  CRISPR gRNA sequence
tcagtcagggtaggcttccc

SEQ ID NO: 273822 - DNA, 20 bp, Artificial
  CRISPR gRNA sequence
cagtcagggtaggcttccct

SEQ ID NO: 273823 - DNA, 20 bp, Artificial
  CRISPR gRNA sequence
agtcagggtaggcttccctt

SEQ ID NO: 273824 - DNA, 20 bp, Artificial
  CRISPR gRNA sequence
cccttgactgtctaacaaat

SEQ ID NO: 273825 - DNA, 20 bp, Artificial
  CRISPR gRNA sequence
ccttgactgtctaacaaatt

SEQ ID NO: 273826 - DNA, 20 bp, Artificial
  CRISPR gRNA sequence
gactgtctaacaaattaagt

SEQ ID NO: 273827 - DNA, 20 bp, Artificial
  CRISPR gRNA sequence
actgtctaacaaattaagta

SEQ ID NO: 273828 - DNA, 20 bp, Artificial
  CRISPR gRNA sequence
tctaacaaattaagtaattt

SEQ ID NO: 273829 - DNA, 20 bp, Artificial
  CRISPR gRNA sequence
acaaattaagtaattttaaa

SEQ ID NO: 273830 - DNA, 20 bp, Artificial
  CRISPR gRNA sequence
agtaattttaaatattcttt

SEQ ID NO: 273831 - DNA, 20 bp, Artificial
  CRISPR gRNA sequence
taaatattctttaagtttga

SEQ ID NO: 273832 - DNA, 20 bp, Artificial
  CRISPR gRNA sequence
aaatattctttaagtttgag

SEQ ID NO: 273833 - DNA, 20 bp, Artificial
  CRISPR gRNA sequence
aatattctttaagtttgaga

SEQ ID NO: 273834 - DNA, 20 bp, Artificial
  CRISPR gRNA sequence
tttaagtttgagagatctct

SEQ ID NO: 273835 - DNA, 20 bp, Artificial
  CRISPR gRNA sequence
taagtttgagagatctctta

SEQ ID NO: 273836 - DNA, 20 bp, Artificial
  CRISPR gRNA sequence
aagtttgagagatctcttaa

SEQ ID NO: 273837 - DNA, 20 bp, Artificial
  CRISPR gRNA sequence
agtttgagagatctcttaaa

SEQ ID NO: 273838 - DNA, 20 bp, Artificial
  CRISPR gRNA sequence
gagagatctcttaaaaataa

SEQ ID NO: 273839 - DNA, 20 bp, Artificial
  CRISPR gRNA sequence
agagatctcttaaaaataag

SEQ ID NO: 273840 - DNA, 20 bp, Artificial
  CRISPR gRNA sequence
ttaaaaataaggtttgacct

SEQ ID NO: 273841 - DNA, 20 bp, Artificial
  CRISPR gRNA sequence
aaaaataaggtttgaccttt

SEQ ID NO: 273842 - DNA, 20 bp, Artificial
  CRISPR gRNA sequence
aaaataaggtttgacctttt

SEQ ID NO: 273843 - DNA, 20 bp, Artificial
  CRISPR gRNA sequence
gacctttttaaaataaatgt

SEQ ID NO: 273844 - DNA, 20 bp, Artificial
  CRISPR gRNA sequence
acctttttaaaataaatgtt

SEQ ID NO: 273845 - DNA, 20 bp, Artificial
  CRISPR gRNA sequence
tttaaaataaatgttaaaga

SEQ ID NO: 273846 - DNA, 20 bp, Artificial
  CRISPR gRNA sequence
ttaaaataaatgttaaagat

SEQ ID NO: 273847 - DNA, 20 bp, Artificial
  CRISPR gRNA sequence
taaaataaatgttaaagatt

SEQ ID NO: 273848 - DNA, 20 bp, Artificial
  CRISPR gRNA sequence
aaaataaatgttaaagattc

SEQ ID NO: 273849 - DNA, 20 bp, Artificial
  CRISPR gRNA sequence
aaataaatgttaaagattct

SEQ ID NO: 273850 - DNA, 20 bp, Artificial
  CRISPR gRNA sequence
aagattcttgtagaatatat

SEQ ID NO: 273851 - DNA, 20 bp, Artificial
  CRISPR gRNA sequence
ttgtagaatatatttggtag

SEQ ID NO: 273852 - DNA, 20 bp, Artificial
  CRISPR gRNA sequence
gtagaatatatttggtagct

SEQ ID NO: 273853 - DNA, 20 bp, Artificial
  CRISPR gRNA sequence
tagaatatatttggtagctg

SEQ ID NO: 273854 - DNA, 20 bp, Artificial
  CRISPR gRNA sequence
ggtagctgtaaacgcttggt

SEQ ID NO: 273855 - DNA, 20 bp, Artificial
  CRISPR gRNA sequence
gtagctgtaaacgcttggta

SEQ ID NO: 273856 - DNA, 20 bp, Artificial
  CRISPR gRNA sequence
taaacgcttggtaccagatc

SEQ ID NO: 273857 - DNA, 20 bp, Artificial
  CRISPR gRNA sequence
ggtaccagatctcattgcca

SEQ ID NO: 273858 - DNA, 20 bp, Artificial
  CRISPR gRNA sequence
gtaccagatctcattgccaa

SEQ ID NO: 273859 - DNA, 20 bp, Artificial
  CRISPR gRNA sequence
attgccaactcatgtctttc

SEQ ID NO: 273860 - DNA, 20 bp, Artificial
  CRISPR gRNA sequence
ccaactcatgtctttcatta

SEQ ID NO: 273861 - DNA, 20 bp, Artificial
  CRISPR gRNA sequence
atgtctttcattatatcaac

SEQ ID NO: 273862 - DNA, 20 bp, Artificial
  CRISPR gRNA sequence
tcattatatcaacacgtttt

SEQ ID NO: 273863 - DNA, 20 bp, Artificial
  CRISPR gRNA sequence
cattatatcaacacgtttta

SEQ ID NO: 273864 - DNA, 20 bp, Artificial
  CRISPR gRNA sequence
attatatcaacacgttttat

SEQ ID NO: 273865 - DNA, 20 bp, Artificial
  CRISPR gRNA sequence
tatcaacacgttttataaat

SEQ ID NO: 273866 - DNA, 20 bp, Artificial
  CRISPR gRNA sequence
tataaatatacacaatttgt

SEQ ID NO: 273867 - DNA, 20 bp, Artificial
  CRISPR gRNA sequence
ataaatatacacaatttgtg

SEQ ID NO: 273868 - DNA, 20 bp, Artificial
  CRISPR gRNA sequence
taaatatacacaatttgtgc

SEQ ID NO: 273869 - DNA, 20 bp, Artificial
  CRISPR gRNA sequence
gtgctcactggtacgtcaga

SEQ ID NO: 273870 - DNA, 20 bp, Artificial
  CRISPR gRNA sequence
tgctcactggtacgtcagac

SEQ ID NO: 273871 - DNA, 20 bp, Artificial
  CRISPR gRNA sequence
actggtacgtcagaccataa

SEQ ID NO: 273872 - DNA, 20 bp, Artificial
  CRISPR gRNA sequence
gtacgtcagaccataaaata

SEQ ID NO: 273873 - DNA, 20 bp, Artificial
  CRISPR gRNA sequence
ctgtacctctgcagattggg

SEQ ID NO: 273874 - DNA, 20 bp, Artificial
  CRISPR gRNA sequence
tacctctgcagattgggaaa

SEQ ID NO: 273875 - DNA, 20 bp, Artificial
  CRISPR gRNA sequence
tgcagattgggaaattatac

SEQ ID NO: 273876 - DNA, 20 bp, Artificial
  CRISPR gRNA sequence
cagattgggaaattatactc

SEQ ID NO: 273877 - DNA, 20 bp, Artificial
  CRISPR gRNA sequence
ggaaattatactctttgggc

SEQ ID NO: 273878 - DNA, 20 bp, Artificial
  CRISPR gRNA sequence
tactctttgggctatgtaca

SEQ ID NO: 273879 - DNA, 20 bp, Artificial
  CRISPR gRNA sequence
tttgggctatgtacacttaa

SEQ ID NO: 273880 - DNA, 20 bp, Artificial
  CRISPR gRNA sequence
tgggctatgtacacttaatg

SEQ ID NO: 273881 - DNA, 20 bp, Artificial
  CRISPR gRNA sequence
gggctatgtacacttaatgt

SEQ ID NO: 273882 - DNA, 20 bp, Artificial
  CRISPR gRNA sequence
ggctatgtacacttaatgtt

SEQ ID NO: 273883 - DNA, 20 bp, Artificial
  CRISPR gRNA sequence
tgtacacttaatgtttaaga

SEQ ID NO: 273884 - DNA, 20 bp, Artificial
  CRISPR gRNA sequence
aatgtttaagaataacaaca

SEQ ID NO: 273885 - DNA, 20 bp, Artificial
  CRISPR gRNA sequence
atgtttaagaataacaacaa

SEQ ID NO: 273886 - DNA, 20 bp, Artificial
  CRISPR gRNA sequence
aagaataacaacaaataatg

SEQ ID NO: 273887 - DNA, 20 bp, Artificial
  CRISPR gRNA sequence
agaataacaacaaataatgc

SEQ ID NO: 273888 - DNA, 20 bp, Artificial
  CRISPR gRNA sequence
tgtactgccaaaataagaaa

SEQ ID NO: 273889 - DNA, 20 bp, Artificial
  CRISPR gRNA sequence
tactgccaaaataagaaaga

SEQ ID NO: 273890 - DNA, 20 bp, Artificial
  CRISPR gRNA sequence
ccaaaataagaaagaaaatt

SEQ ID NO: 273891 - DNA, 20 bp, Artificial
  CRISPR gRNA sequence
aggatactggcttttcaatg

SEQ ID NO: 273892 - DNA, 20 bp, Artificial
  CRISPR gRNA sequence
gcttttcaatgtatctttca

SEQ ID NO: 273893 - DNA, 20 bp, Artificial
  CRISPR gRNA sequence
ttcaatgtatctttcaggga

SEQ ID NO: 273894 - DNA, 20 bp, Artificial
  CRISPR gRNA sequence
tcaatgtatctttcagggaa

SEQ ID NO: 273895 - DNA, 20 bp, Artificial
  CRISPR gRNA sequence
caatgtatctttcagggaaa

SEQ ID NO: 273896 - DNA, 20 bp, Artificial
  CRISPR gRNA sequence
aatgtatctttcagggaaaa

SEQ ID NO: 273897 - DNA, 20 bp, Artificial
  CRISPR gRNA sequence
tcagggaaaaataactgtcc

SEQ ID NO: 273898 - DNA, 20 bp, Artificial
  CRISPR gRNA sequence
cagggaaaaataactgtcct

SEQ ID NO: 273899 - DNA, 20 bp, Artificial
  CRISPR gRNA sequence
agggaaaaataactgtcctt

SEQ ID NO: 273900 - DNA, 20 bp, Artificial
  CRISPR gRNA sequence
tccttatttaagcatgactg

SEQ ID NO: 273901 - DNA, 20 bp, Artificial
  CRISPR gRNA sequence
atttaagcatgactgttgac

SEQ ID NO: 273902 - DNA, 20 bp, Artificial
  CRISPR gRNA sequence
tttaagcatgactgttgacc

SEQ ID NO: 273903 - DNA, 20 bp, Artificial
  CRISPR gRNA sequence
aagcatgactgttgacccct

SEQ ID NO: 273904 - DNA, 20 bp, Artificial
  CRISPR gRNA sequence
agcatgactgttgaccccta

SEQ ID NO: 273905 - DNA, 20 bp, Artificial
  CRISPR gRNA sequence
ttgacccctatcagtccagt

SEQ ID NO: 273906 - DNA, 20 bp, Artificial
  CRISPR gRNA sequence
acccctatcagtccagtttt

SEQ ID NO: 273907 - DNA, 20 bp, Artificial
  CRISPR gRNA sequence
tcagtccagtttttgaacca

SEQ ID NO: 273908 - DNA, 20 bp, Artificial
  CRISPR gRNA sequence
ttgaaccaagcgggggcctt

SEQ ID NO: 273909 - DNA, 20 bp, Artificial
  CRISPR gRNA sequence
tgaaccaagcgggggccttt

SEQ ID NO: 273910 - DNA, 20 bp, Artificial
  CRISPR gRNA sequence
gaaccaagcgggggcctttt

SEQ ID NO: 273911 - DNA, 20 bp, Artificial
  CRISPR gRNA sequence
aaccaagcgggggccttttt

SEQ ID NO: 273912 - DNA, 20 bp, Artificial
  CRISPR gRNA sequence
tttctaactctgagaacacg

SEQ ID NO: 273913 - DNA, 20 bp, Artificial
  CRISPR gRNA sequence
ttctaactctgagaacacgt

SEQ ID NO: 273914 - DNA, 20 bp, Artificial
  CRISPR gRNA sequence
tctaactctgagaacacgtt

SEQ ID NO: 273915 - DNA, 20 bp, Artificial
  CRISPR gRNA sequence
ctaactctgagaacacgttg

SEQ ID NO: 273916 - DNA, 20 bp, Artificial
  CRISPR gRNA sequence
taactctgagaacacgttga

SEQ ID NO: 273917 - DNA, 20 bp, Artificial
  CRISPR gRNA sequence
actctgagaacacgttgaat

SEQ ID NO: 273918 - DNA, 20 bp, Artificial
  CRISPR gRNA sequence
tgagaacacgttgaatgagc

SEQ ID NO: 273919 - DNA, 20 bp, Artificial
  CRISPR gRNA sequence
agaacacgttgaatgagcat

SEQ ID NO: 273920 - DNA, 20 bp, Artificial
  CRISPR gRNA sequence
aatgagcatcttactccagc

SEQ ID NO: 273921 - DNA, 20 bp, Artificial
  CRISPR gRNA sequence
actccagcccacccaagtaa

SEQ ID NO: 273922 - DNA, 20 bp, Artificial
  CRISPR gRNA sequence
ctccagcccacccaagtaac

SEQ ID NO: 273923 - DNA, 20 bp, Artificial
  CRISPR gRNA sequence
cagcccacccaagtaacaaa

SEQ ID NO: 273924 - DNA, 20 bp, Artificial
  CRISPR gRNA sequence
tttctgttaggaattgtgct

SEQ ID NO: 273925 - DNA, 20 bp, Artificial
  CRISPR gRNA sequence
tctgttaggaattgtgcttg

SEQ ID NO: 273926 - DNA, 20 bp, Artificial
  CRISPR gRNA sequence
ctgttaggaattgtgcttgt

SEQ ID NO: 273927 - DNA, 20 bp, Artificial
  CRISPR gRNA sequence
tgttaggaattgtgcttgtg

SEQ ID NO: 273928 - DNA, 20 bp, Artificial
  CRISPR gRNA sequence
ttaggaattgtgcttgtgat

SEQ ID NO: 273929 - DNA, 20 bp, Artificial
  CRISPR gRNA sequence
ggaattgtgcttgtgatttt

SEQ ID NO: 273930 - DNA, 20 bp, Artificial
  CRISPR gRNA sequence
tgcttgtgattttccgaagt

SEQ ID NO: 273931 - DNA, 20 bp, Artificial
  CRISPR gRNA sequence
gtgattttccgaagttaatt

SEQ ID NO: 273932 - DNA, 20 bp, Artificial
  CRISPR gRNA sequence
tgattttccgaagttaattt

SEQ ID NO: 273933 - DNA, 20 bp, Artificial
  CRISPR gRNA sequence
tccgaagttaatttaaccct

SEQ ID NO: 273934 - DNA, 20 bp, Artificial
  CRISPR gRNA sequence
ccgaagttaatttaaccctg

SEQ ID NO: 273935 - DNA, 20 bp, Artificial
  CRISPR gRNA sequence
cgaagttaatttaaccctgg

SEQ ID NO: 273936 - DNA, 20 bp, Artificial
  CRISPR gRNA sequence
atttaaccctggatttacct

SEQ ID NO: 273937 - DNA, 20 bp, Artificial
  CRISPR gRNA sequence
aaccctggatttacctgagt

SEQ ID NO: 273938 - DNA, 20 bp, Artificial
  CRISPR gRNA sequence
accctggatttacctgagtc

SEQ ID NO: 273939 - DNA, 20 bp, Artificial
  CRISPR gRNA sequence
gatttacctgagtccatgaa

SEQ ID NO: 273940 - DNA, 20 bp, Artificial
  CRISPR gRNA sequence
acctgagtccatgaaattac

SEQ ID NO: 273941 - DNA, 20 bp, Artificial
  CRISPR gRNA sequence
cctgagtccatgaaattaca

SEQ ID NO: 273942 - DNA, 20 bp, Artificial
  CRISPR gRNA sequence
agtccatgaaattacaaatc

SEQ ID NO: 273943 - DNA, 20 bp, Artificial
  CRISPR gRNA sequence
caaatcacaccatgttagat

SEQ ID NO: 273944 - DNA, 20 bp, Artificial
  CRISPR gRNA sequence
gatggaatagcataataatc

SEQ ID NO: 273945 - DNA, 20 bp, Artificial
  CRISPR gRNA sequence
gagtcagactaaggtggttc

SEQ ID NO: 273946 - DNA, 20 bp, Artificial
  CRISPR gRNA sequence
aggtggttcagaccctgcct

SEQ ID NO: 273947 - DNA, 20 bp, Artificial
  CRISPR gRNA sequence
agaccctgcctcctatagct

SEQ ID NO: 273948 - DNA, 20 bp, Artificial
  CRISPR gRNA sequence
cctcctatagctgccacctg

SEQ ID NO: 273949 - DNA, 20 bp, Artificial
  CRISPR gRNA sequence
ctatagctgccacctgtaca

SEQ ID NO: 273950 - DNA, 20 bp, Artificial
  CRISPR gRNA sequence
tagctgccacctgtacatcc

SEQ ID NO: 273951 - DNA, 20 bp, Artificial
  CRISPR gRNA sequence
ccacctgtacatccttgggc

SEQ ID NO: 273952 - DNA, 20 bp, Artificial
  CRISPR gRNA sequence
tacatccttgggcaaatccc

SEQ ID NO: 273953 - DNA, 20 bp, Artificial
  CRISPR gRNA sequence
gggcaaatcccttaatgtgc

SEQ ID NO: 273954 - DNA, 20 bp, Artificial
  CRISPR gRNA sequence
ggcaaatcccttaatgtgcc

SEQ ID NO: 273955 - DNA, 20 bp, Artificial
  CRISPR gRNA sequence
aatgtgcctacccctcagtc

SEQ ID NO: 273956 - DNA, 20 bp, Artificial
  CRISPR gRNA sequence
atgtgcctacccctcagtct

SEQ ID NO: 273957 - DNA, 20 bp, Artificial
  CRISPR gRNA sequence
cccctcagtctcttcatctg

SEQ ID NO: 273958 - DNA, 20 bp, Artificial
  CRISPR gRNA sequence
agtctcttcatctgaaatga

SEQ ID NO: 273959 - DNA, 20 bp, Artificial
  CRISPR gRNA sequence
ttcatctgaaatgaagttaa

SEQ ID NO: 273960 - DNA, 20 bp, Artificial
  CRISPR gRNA sequence
catctgaaatgaagttaact

SEQ ID NO: 273961 - DNA, 20 bp, Artificial
  CRISPR gRNA sequence
atctgaaatgaagttaactg

SEQ ID NO: 273962 - DNA, 20 bp, Artificial
  CRISPR gRNA sequence
aaatgaagttaactgtaata

SEQ ID NO: 273963 - DNA, 20 bp, Artificial
  CRISPR gRNA sequence
actgtaatacctaccttcta

SEQ ID NO: 273964 - DNA, 20 bp, Artificial
  CRISPR gRNA sequence
taatacctaccttctagtta

SEQ ID NO: 273965 - DNA, 20 bp, Artificial
  CRISPR gRNA sequence
ccttctagttacgagaactg

SEQ ID NO: 273966 - DNA, 20 bp, Artificial
  CRISPR gRNA sequence
ctagttacgagaactgtgtg

SEQ ID NO: 273967 - DNA, 20 bp, Artificial
  CRISPR gRNA sequence
tagttacgagaactgtgtgc

SEQ ID NO: 273968 - DNA, 20 bp, Artificial
  CRISPR gRNA sequence
gttacgagaactgtgtgctg

SEQ ID NO: 273969 - DNA, 20 bp, Artificial
  CRISPR gRNA sequence
cgagaactgtgtgctgctca

SEQ ID NO: 273970 - DNA, 20 bp, Artificial
  CRISPR gRNA sequence
tgtgctgctcaaagtgctag

SEQ ID NO: 273971 - DNA, 20 bp, Artificial
  CRISPR gRNA sequence
ctcaaagtgctagatgtatt

SEQ ID NO: 273972 - DNA, 20 bp, Artificial
  CRISPR gRNA sequence
aaagtgctagatgtattatc

SEQ ID NO: 273973 - DNA, 20 bp, Artificial
  CRISPR gRNA sequence
gatgtattatcctcctcatc

SEQ ID NO: 273974 - DNA, 20 bp, Artificial
  CRISPR gRNA sequence
tcctcctcatcatcgtcatt

SEQ ID NO: 273975 - DNA, 20 bp, Artificial
  CRISPR gRNA sequence
ctcatcatcgtcattgggaa

SEQ ID NO: 273976 - DNA, 20 bp, Artificial
  CRISPR gRNA sequence
atcatcgtcattgggaactt

SEQ ID NO: 273977 - DNA, 20 bp, Artificial
  CRISPR gRNA sequence
ggaacttaaagaattttaat

SEQ ID NO: 273978 - DNA, 20 bp, Artificial
  CRISPR gRNA sequence
aaagaattttaatctaagaa

SEQ ID NO: 273979 - DNA, 20 bp, Artificial
  CRISPR gRNA sequence
aagaattttaatctaagaaa

SEQ ID NO: 273980 - DNA, 20 bp, Artificial
  CRISPR gRNA sequence
taatctaagaaaatacattt

SEQ ID NO: 273981 - DNA, 20 bp, Artificial
  CRISPR gRNA sequence
aatctaagaaaatacatttt

SEQ ID NO: 273982 - DNA, 20 bp, Artificial
  CRISPR gRNA sequence
atctaagaaaatacattttg

SEQ ID NO: 273983 - DNA, 20 bp, Artificial
  CRISPR gRNA sequence
agaaaatacattttggccga

SEQ ID NO: 273984 - DNA, 20 bp, Artificial
  CRISPR gRNA sequence
tggccgattgtaaaagaaaa

SEQ ID NO: 273985 - DNA, 20 bp, Artificial
  CRISPR gRNA sequence
ggccgattgtaaaagaaaac

SEQ ID NO: 273986 - DNA, 20 bp, Artificial
  CRISPR gRNA sequence
gccgattgtaaaagaaaact

SEQ ID NO: 273987 - DNA, 20 bp, Artificial
  CRISPR gRNA sequence
taaaagaaaactaatttatt

SEQ ID NO: 273988 - DNA, 20 bp, Artificial
  CRISPR gRNA sequence
atttattaatattggtgttg

SEQ ID NO: 273989 - DNA, 20 bp, Artificial
  CRISPR gRNA sequence
attaatattggtgttgtagc

SEQ ID NO: 273990 - DNA, 20 bp, Artificial
  CRISPR gRNA sequence
ttaatattggtgttgtagca

SEQ ID NO: 273991 - DNA, 20 bp, Artificial
  CRISPR gRNA sequence
atattggtgttgtagcagct

SEQ ID NO: 273992 - DNA, 20 bp, Artificial
  CRISPR gRNA sequence
gtgttgtagcagcttctgtg

SEQ ID NO: 273993 - DNA, 20 bp, Artificial
  CRISPR gRNA sequence
tagcagcttctgtggtgact

SEQ ID NO: 273994 - DNA, 20 bp, Artificial
  CRISPR gRNA sequence
ctgtggtgactccagaattc

SEQ ID NO: 273995 - DNA, 20 bp, Artificial
  CRISPR gRNA sequence
tgtggtgactccagaattca

SEQ ID NO: 273996 - DNA, 20 bp, Artificial
  CRISPR gRNA sequence
tggtgactccagaattcatg

SEQ ID NO: 273997 - DNA, 20 bp, Artificial
  CRISPR gRNA sequence
cagaattcatgttggaactc

SEQ ID NO: 273998 - DNA, 20 bp, Artificial
  CRISPR gRNA sequence
atgttggaactcattcaatt

SEQ ID NO: 273999 - DNA, 20 bp, Artificial
  CRISPR gRNA sequence
gaactcattcaattcaggta

SEQ ID NO: 274000 - DNA, 20 bp, Artificial
  CRISPR gRNA sequence
attcaattcaggtagataga

SEQ ID NO: 274001 - DNA, 20 bp, Artificial
  CRISPR gRNA sequence
aattcaggtagatagagtaa

SEQ ID NO: 274002 - DNA, 20 bp, Artificial
  CRISPR gRNA sequence
aggtagatagagtaattaca

SEQ ID NO: 274003 - DNA, 20 bp, Artificial
  CRISPR gRNA sequence
cagttcacatttatcttgaa

SEQ ID NO: 274004 - DNA, 20 bp, Artificial
  CRISPR gRNA sequence
acatttatcttgaagcctga

SEQ ID NO: 274005 - DNA, 20 bp, Artificial
  CRISPR gRNA sequence
atcttgaagcctgactgagc

SEQ ID NO: 274006 - DNA, 20 bp, Artificial
  CRISPR gRNA sequence
tcttgaagcctgactgagct

SEQ ID NO: 274007 - DNA, 20 bp, Artificial
  CRISPR gRNA sequence
gaagcctgactgagctaagc

SEQ ID NO: 274008 - DNA, 20 bp, Artificial
  CRISPR gRNA sequence
aagcctgactgagctaagcc

SEQ ID NO: 274009 - DNA, 20 bp, Artificial
  CRISPR gRNA sequence
actgagctaagcccttcgca

SEQ ID NO: 274010 - DNA, 20 bp, Artificial
  CRISPR gRNA sequence
agctaagcccttcgcatgga

SEQ ID NO: 274011 - DNA, 20 bp, Artificial
  CRISPR gRNA sequence
agcccttcgcatggattatt

SEQ ID NO: 274012 - DNA, 20 bp, Artificial
  CRISPR gRNA sequence
cgcatggattatttcatttt

SEQ ID NO: 274013 - DNA, 20 bp, Artificial
  CRISPR gRNA sequence
gcatggattatttcatttta

SEQ ID NO: 274014 - DNA, 20 bp, Artificial
  CRISPR gRNA sequence
tttcattttacctcacaatg

SEQ ID NO: 274015 - DNA, 20 bp, Artificial
  CRISPR gRNA sequence
cattttacctcacaatgacc

SEQ ID NO: 274016 - DNA, 20 bp, Artificial
  CRISPR gRNA sequence
attttacctcacaatgacct

SEQ ID NO: 274017 - DNA, 20 bp, Artificial
  CRISPR gRNA sequence
tacctcacaatgaccttgag

SEQ ID NO: 274018 - DNA, 20 bp, Artificial
  CRISPR gRNA sequence
acctcacaatgaccttgagg

SEQ ID NO: 274019 - DNA, 20 bp, Artificial
  CRISPR gRNA sequence
cctcacaatgaccttgaggt

SEQ ID NO: 274020 - DNA, 20 bp, Artificial
  CRISPR gRNA sequence
acaatgaccttgaggtgagg

SEQ ID NO: 274021 - DNA, 20 bp, Artificial
  CRISPR gRNA sequence
gaggtgaggtttattattat

SEQ ID NO: 274022 - DNA, 20 bp, Artificial
  CRISPR gRNA sequence
aggtgaggtttattattatt

SEQ ID NO: 274023 - DNA, 20 bp, Artificial
  CRISPR gRNA sequence
attattattcccactttaca

SEQ ID NO: 274024 - DNA, 20 bp, Artificial
  CRISPR gRNA sequence
ttattattcccactttacag

SEQ ID NO: 274025 - DNA, 20 bp, Artificial
  CRISPR gRNA sequence
ttattcccactttacagtta

SEQ ID NO: 274026 - DNA, 20 bp, Artificial
  CRISPR gRNA sequence
ttcccactttacagttaagg

SEQ ID NO: 274027 - DNA, 20 bp, Artificial
  CRISPR gRNA sequence
ccactttacagttaaggaaa

SEQ ID NO: 274028 - DNA, 20 bp, Artificial
  CRISPR gRNA sequence
tacagttaaggaaactgagg

SEQ ID NO: 274029 - DNA, 20 bp, Artificial
  CRISPR gRNA sequence
acagttaaggaaactgaggt

SEQ ID NO: 274030 - DNA, 20 bp, Artificial
  CRISPR gRNA sequence
cagttaaggaaactgaggtt

SEQ ID NO: 274031 - DNA, 20 bp, Artificial
  CRISPR gRNA sequence
aggaaactgaggtttggaga

SEQ ID NO: 274032 - DNA, 20 bp, Artificial
  CRISPR gRNA sequence
aggtttggagagtttaaata

SEQ ID NO: 274033 - DNA, 20 bp, Artificial
  CRISPR gRNA sequence
ggagagtttaaataatagct

SEQ ID NO: 274034 - DNA, 20 bp, Artificial
  CRISPR gRNA sequence
gagagtttaaataatagcta

SEQ ID NO: 274035 - DNA, 20 bp, Artificial
  CRISPR gRNA sequence
aaataatagctaagcctaag

SEQ ID NO: 274036 - DNA, 20 bp, Artificial
  CRISPR gRNA sequence
aataatagctaagcctaagc

SEQ ID NO: 274037 - DNA, 20 bp, Artificial
  CRISPR gRNA sequence
agcctaagcttacctagtga

SEQ ID NO: 274038 - DNA, 20 bp, Artificial
  CRISPR gRNA sequence
agcttacctagtgagaattg

SEQ ID NO: 274039 - DNA, 20 bp, Artificial
  CRISPR gRNA sequence
acctagtgagaattggacct

SEQ ID NO: 274040 - DNA, 20 bp, Artificial
  CRISPR gRNA sequence
cctagtgagaattggacctg

SEQ ID NO: 274041 - DNA, 20 bp, Artificial
  CRISPR gRNA sequence
gtgagaattggacctgtgtt

SEQ ID NO: 274042 - DNA, 20 bp, Artificial
  CRISPR gRNA sequence
gacctgtgttaggaacatag

SEQ ID NO: 274043 - DNA, 20 bp, Artificial
  CRISPR gRNA sequence
tgttaggaacataggcaacc

SEQ ID NO: 274044 - DNA, 20 bp, Artificial
  CRISPR gRNA sequence
ggaacataggcaacctaaat

SEQ ID NO: 274045 - DNA, 20 bp, Artificial
  CRISPR gRNA sequence
aattcagagcttccagagcc

SEQ ID NO: 274046 - DNA, 20 bp, Artificial
  CRISPR gRNA sequence
agagcttccagagccaatct

SEQ ID NO: 274047 - DNA, 20 bp, Artificial
  CRISPR gRNA sequence
ccagagccaatctacttaca

SEQ ID NO: 274048 - DNA, 20 bp, Artificial
  CRISPR gRNA sequence
cagagccaatctacttacag

SEQ ID NO: 274049 - DNA, 20 bp, Artificial
  CRISPR gRNA sequence
cttacagcagctttcttaaa

SEQ ID NO: 274050 - DNA, 20 bp, Artificial
  CRISPR gRNA sequence
acagcagctttcttaaatta

SEQ ID NO: 274051 - DNA, 20 bp, Artificial
  CRISPR gRNA sequence
cagcagctttcttaaattaa

SEQ ID NO: 274052 - DNA, 20 bp, Artificial
  CRISPR gRNA sequence
tcttaaattaaaaaaaaaaa

SEQ ID NO: 274053 - DNA, 20 bp, Artificial
  CRISPR gRNA sequence
cttaaattaaaaaaaaaaag

SEQ ID NO: 274054 - DNA, 20 bp, Artificial
  CRISPR gRNA sequence
ttaaattaaaaaaaaaaaga

SEQ ID NO: 274055 - DNA, 20 bp, Artificial
  CRISPR gRNA sequence
aaattaaaaaaaaaaagaaa

SEQ ID NO: 274056 - DNA, 20 bp, Artificial
  CRISPR gRNA sequence
aattaaaaaaaaaaagaaag

SEQ ID NO: 274057 - DNA, 20 bp, Artificial
  CRISPR gRNA sequence
aaaaaaaaaagaaagaaaga

SEQ ID NO: 274058 - DNA, 20 bp, Artificial
  CRISPR gRNA sequence
aaaattattggccgggcatg

SEQ ID NO: 274059 - DNA, 20 bp, Artificial
  CRISPR gRNA sequence
ttggccgggcatggtagctc

SEQ ID NO: 274060 - DNA, 20 bp, Artificial
  CRISPR gRNA sequence
gccgggcatggtagctcatg

SEQ ID NO: 274061 - DNA, 20 bp, Artificial
  CRISPR gRNA sequence
atgcctgtaaccctagcact

SEQ ID NO: 274062 - DNA, 20 bp, Artificial
  CRISPR gRNA sequence
taaccctagcactttgggag

SEQ ID NO: 274063 - DNA, 20 bp, Artificial
  CRISPR gRNA sequence
gcactttgggaggcagaggc

SEQ ID NO: 274064 - DNA, 20 bp, Artificial
  CRISPR gRNA sequence
tgggaggcagaggcaggtgg

SEQ ID NO: 274065 - DNA, 20 bp, Artificial
  CRISPR gRNA sequence
gggaggcagaggcaggtgga

SEQ ID NO: 274066 - DNA, 20 bp, Artificial
  CRISPR gRNA sequence
ggaggcagaggcaggtggat

SEQ ID NO: 274067 - DNA, 20 bp, Artificial
  CRISPR gRNA sequence
cttgagctcagaagtttgag

SEQ ID NO: 274068 - DNA, 20 bp, Artificial
  CRISPR gRNA sequence
gagctcagaagtttgagacc

SEQ ID NO: 274069 - DNA, 20 bp, Artificial
  CRISPR gRNA sequence
agctcagaagtttgagacca

SEQ ID NO: 274070 - DNA, 20 bp, Artificial
  CRISPR gRNA sequence
agaagtttgagaccagcctg

SEQ ID NO: 274071 - DNA, 20 bp, Artificial
  CRISPR gRNA sequence
gagaccagcctgggcaacat

SEQ ID NO: 274072 - DNA, 20 bp, Artificial
  CRISPR gRNA sequence
agaccagcctgggcaacata

SEQ ID NO: 274073 - DNA, 20 bp, Artificial
  CRISPR gRNA sequence
ggcaacatagtgaaacccca

SEQ ID NO: 274074 - DNA, 20 bp, Artificial
  CRISPR gRNA sequence
aatttaaaataataataata

SEQ ID NO: 274075 - DNA, 20 bp, Artificial
  CRISPR gRNA sequence
aaaataataataataataat

SEQ ID NO: 274076 - DNA, 20 bp, Artificial
  CRISPR gRNA sequence
aaataataataataataata

SEQ ID NO: 274077 - DNA, 20 bp, Artificial
  CRISPR gRNA sequence
ttgggacactatcaactaat

SEQ ID NO: 274078 - DNA, 20 bp, Artificial
  CRISPR gRNA sequence
gggacactatcaactaatag

SEQ ID NO: 274079 - DNA, 20 bp, Artificial
  CRISPR gRNA sequence
ggacactatcaactaatagc

SEQ ID NO: 274080 - DNA, 20 bp, Artificial
  CRISPR gRNA sequence
tcaactaatagctagagaaa

SEQ ID NO: 274081 - DNA, 20 bp, Artificial
  CRISPR gRNA sequence
atagctagagaaactaatag

SEQ ID NO: 274082 - DNA, 20 bp, Artificial
  CRISPR gRNA sequence
gagaaactaatagcttagaa

SEQ ID NO: 274083 - DNA, 20 bp, Artificial
  CRISPR gRNA sequence
atagcttagaaaatttattt

SEQ ID NO: 274084 - DNA, 20 bp, Artificial
  CRISPR gRNA sequence
agaaaatttatttccaaggg

SEQ ID NO: 274085 - DNA, 20 bp, Artificial
  CRISPR gRNA sequence
gaaaatttatttccaaggga

SEQ ID NO: 274086 - DNA, 20 bp, Artificial
  CRISPR gRNA sequence
atttccaagggacttttgtt

SEQ ID NO: 274087 - DNA, 20 bp, Artificial
  CRISPR gRNA sequence
tttccaagggacttttgtta

SEQ ID NO: 274088 - DNA, 20 bp, Artificial
  CRISPR gRNA sequence
ccaagggacttttgttaaga

SEQ ID NO: 274089 - DNA, 20 bp, Artificial
  CRISPR gRNA sequence
caagggacttttgttaagat

SEQ ID NO: 274090 - DNA, 20 bp, Artificial
  CRISPR gRNA sequence
ttgttaagatactatattgt

SEQ ID NO: 274091 - DNA, 20 bp, Artificial
  CRISPR gRNA sequence
tgttaagatactatattgta

SEQ ID NO: 274092 - DNA, 20 bp, Artificial
  CRISPR gRNA sequence
gttaagatactatattgtag

SEQ ID NO: 274093 - DNA, 20 bp, Artificial
  CRISPR gRNA sequence
ttaagatactatattgtagt

SEQ ID NO: 274094 - DNA, 20 bp, Artificial
  CRISPR gRNA sequence
agatactatattgtagtctg

SEQ ID NO: 274095 - DNA, 20 bp, Artificial
  CRISPR gRNA sequence
tattgtagtctgagaatcaa

SEQ ID NO: 274096 - DNA, 20 bp, Artificial
  CRISPR gRNA sequence
tagtctgagaatcaatgatt

SEQ ID NO: 274097 - DNA, 20 bp, Artificial
  CRISPR gRNA sequence
agaatcaatgattttcaaaa

SEQ ID NO: 274098 - DNA, 20 bp, Artificial
  CRISPR gRNA sequence
tcaaaataacacattgccct

SEQ ID NO: 274099 - DNA, 20 bp, Artificial
  CRISPR gRNA sequence
caaaataacacattgcccta

SEQ ID NO: 274100 - DNA, 20 bp, Artificial
  CRISPR gRNA sequence
aaaataacacattgccctat

SEQ ID NO: 274101 - DNA, 20 bp, Artificial
  CRISPR gRNA sequence
ccctattacagcaaaactac

SEQ ID NO: 274102 - DNA, 20 bp, Artificial
  CRISPR gRNA sequence
ttacagcaaaactacacttc

SEQ ID NO: 274103 - DNA, 20 bp, Artificial
  CRISPR gRNA sequence
cagcaaaactacacttcaaa

SEQ ID NO: 274104 - DNA, 20 bp, Artificial
  CRISPR gRNA sequence
cacttcaaatgttcaaattt

SEQ ID NO: 274105 - DNA, 20 bp, Artificial
  CRISPR gRNA sequence
caaatgttcaaatttcacac

SEQ ID NO: 274106 - DNA, 20 bp, Artificial
  CRISPR gRNA sequence
aaatgttcaaatttcacaca

SEQ ID NO: 274107 - DNA, 20 bp, Artificial
  CRISPR gRNA sequence
aaatttcacacattgttaga

SEQ ID NO: 274108 - DNA, 20 bp, Artificial
  CRISPR gRNA sequence
cacacattgttagaaattta

SEQ ID NO: 274109 - DNA, 20 bp, Artificial
  CRISPR gRNA sequence
acacattgttagaaatttaa

SEQ ID NO: 274110 - DNA, 20 bp, Artificial
  CRISPR gRNA sequence
ttagaaatttaaaataaact

SEQ ID NO: 274111 - DNA, 20 bp, Artificial
  CRISPR gRNA sequence
gaaatttaaaataaactaag

SEQ ID NO: 274112 - DNA, 20 bp, Artificial
  CRISPR gRNA sequence
aaaataaactaagccaattg

SEQ ID NO: 274113 - DNA, 20 bp, Artificial
  CRISPR gRNA sequence
aaataaactaagccaattgg

SEQ ID NO: 274114 - DNA, 20 bp, Artificial
  CRISPR gRNA sequence
agccaattggaagacctcaa

SEQ ID NO: 274115 - DNA, 20 bp, Artificial
  CRISPR gRNA sequence
gaagacctcaaaaaatattt

SEQ ID NO: 274116 - DNA, 20 bp, Artificial
  CRISPR gRNA sequence
aaaaaatatttacagaaaga

SEQ ID NO: 274117 - DNA, 20 bp, Artificial
  CRISPR gRNA sequence
acagaaagaaagacattaac

SEQ ID NO: 274118 - DNA, 20 bp, Artificial
  CRISPR gRNA sequence
cagaaagaaagacattaaca

SEQ ID NO: 274119 - DNA, 20 bp, Artificial
  CRISPR gRNA sequence
acattgtttacctgttactt

SEQ ID NO: 274120 - DNA, 20 bp, Artificial
  CRISPR gRNA sequence
tttacctgttacttgaattg

SEQ ID NO: 274121 - DNA, 20 bp, Artificial
  CRISPR gRNA sequence
acctgttacttgaattgaag

SEQ ID NO: 274122 - DNA, 20 bp, Artificial
  CRISPR gRNA sequence
cctgttacttgaattgaagg

SEQ ID NO: 274123 - DNA, 20 bp, Artificial
  CRISPR gRNA sequence
ttacttgaattgaagggaat

SEQ ID NO: 274124 - DNA, 20 bp, Artificial
  CRISPR gRNA sequence
cttgaattgaagggaataag

SEQ ID NO: 274125 - DNA, 20 bp, Artificial
  CRISPR gRNA sequence
gaattgaagggaataagttg

SEQ ID NO: 274126 - DNA, 20 bp, Artificial
  CRISPR gRNA sequence
aattgaagggaataagttga

SEQ ID NO: 274127 - DNA, 20 bp, Artificial
  CRISPR gRNA sequence
aagggaataagttgagagcc

SEQ ID NO: 274128 - DNA, 20 bp, Artificial
  CRISPR gRNA sequence
agagccaagagcagcctgag

SEQ ID NO: 274129 - DNA, 20 bp, Artificial
  CRISPR gRNA sequence
agcatctttgtcctgacgat

SEQ ID NO: 274130 - DNA, 20 bp, Artificial
  CRISPR gRNA sequence
tgtcctgacgatgggctagg

SEQ ID NO: 274131 - DNA, 20 bp, Artificial
  CRISPR gRNA sequence
gtcctgacgatgggctaggg

SEQ ID NO: 274132 - DNA, 20 bp, Artificial
  CRISPR gRNA sequence
tcctgacgatgggctagggt

SEQ ID NO: 274133 - DNA, 20 bp, Artificial
  CRISPR gRNA sequence
acgatgggctagggttccag

SEQ ID NO: 274134 - DNA, 20 bp, Artificial
  CRISPR gRNA sequence
gggttccagcccctcctccc

SEQ ID NO: 274135 - DNA, 20 bp, Artificial
  CRISPR gRNA sequence
cagcccctcctccccgagga

SEQ ID NO: 274136 - DNA, 20 bp, Artificial
  CRISPR gRNA sequence
ctccccgaggaacccgaagt

SEQ ID NO: 274137 - DNA, 20 bp, Artificial
  CRISPR gRNA sequence
cccgaggaacccgaagtgtg

SEQ ID NO: 274138 - DNA, 20 bp, Artificial
  CRISPR gRNA sequence
aaagacgcacctgccaaggc

SEQ ID NO: 274139 - DNA, 20 bp, Artificial
  CRISPR gRNA sequence
ccaaggcctgagagtctccg

SEQ ID NO: 274140 - DNA, 20 bp, Artificial
  CRISPR gRNA sequence
agagtctccgtcatccacgg

SEQ ID NO: 274141 - DNA, 20 bp, Artificial
  CRISPR gRNA sequence
cgtcatccacggccaccacc

SEQ ID NO: 274142 - DNA, 20 bp, Artificial
  CRISPR gRNA sequence
tgctgtaatagggcaactca

SEQ ID NO: 274143 - DNA, 20 bp, Artificial
  CRISPR gRNA sequence
gctgtaatagggcaactcaa

SEQ ID NO: 274144 - DNA, 20 bp, Artificial
  CRISPR gRNA sequence
ctgtaatagggcaactcaaa

SEQ ID NO: 274145 - DNA, 20 bp, Artificial
  CRISPR gRNA sequence
taatagggcaactcaaacca

SEQ ID NO: 274146 - DNA, 20 bp, Artificial
  CRISPR gRNA sequence
aaaccacaaggcatcctgac

SEQ ID NO: 274147 - DNA, 20 bp, Artificial
  CRISPR gRNA sequence
actgcagcatttcacacagg

SEQ ID NO: 274148 - DNA, 20 bp, Artificial
  CRISPR gRNA sequence
cagcatttcacacaggatat

SEQ ID NO: 274149 - DNA, 20 bp, Artificial
  CRISPR gRNA sequence
cacacaggatataacgttgt

SEQ ID NO: 274150 - DNA, 20 bp, Artificial
  CRISPR gRNA sequence
acacaggatataacgttgtt

SEQ ID NO: 274151 - DNA, 20 bp, Artificial
  CRISPR gRNA sequence
ttttgatgactttagacttt

SEQ ID NO: 274152 - DNA, 20 bp, Artificial
  CRISPR gRNA sequence
tgatgactttagacttttac

SEQ ID NO: 274153 - DNA, 20 bp, Artificial
  CRISPR gRNA sequence
gatgactttagacttttact

SEQ ID NO: 274154 - DNA, 20 bp, Artificial
  CRISPR gRNA sequence
atgactttagacttttactt

SEQ ID NO: 274155 - DNA, 20 bp, Artificial
  CRISPR gRNA sequence
tagacttttacttctatttt

SEQ ID NO: 274156 - DNA, 20 bp, Artificial
  CRISPR gRNA sequence
agacttttacttctattttt

SEQ ID NO: 274157 - DNA, 20 bp, Artificial
  CRISPR gRNA sequence
gacttttacttctattttta

SEQ ID NO: 274158 - DNA, 20 bp, Artificial
  CRISPR gRNA sequence
ttacttctatttttaaagac

SEQ ID NO: 274159 - DNA, 20 bp, Artificial
  CRISPR gRNA sequence
tacttctatttttaaagact

SEQ ID NO: 274160 - DNA, 20 bp, Artificial
  CRISPR gRNA sequence
acttctatttttaaagactt

SEQ ID NO: 274161 - DNA, 20 bp, Artificial
  CRISPR gRNA sequence
cttctatttttaaagacttt

SEQ ID NO: 274162 - DNA, 20 bp, Artificial
  CRISPR gRNA sequence
ctatttttaaagactttttt

SEQ ID NO: 274163 - DNA, 20 bp, Artificial
  CRISPR gRNA sequence
tatttttaaagacttttttt

SEQ ID NO: 274164 - DNA, 20 bp, Artificial
  CRISPR gRNA sequence
tttttaaagacttttttttt

SEQ ID NO: 274165 - DNA, 20 bp, Artificial
  CRISPR gRNA sequence
ttaaagactttttttttgtc

SEQ ID NO: 274166 - DNA, 20 bp, Artificial
  CRISPR gRNA sequence
taaagactttttttttgtca

SEQ ID NO: 274167 - DNA, 20 bp, Artificial
  CRISPR gRNA sequence
aaagactttttttttgtcac

SEQ ID NO: 274168 - DNA, 20 bp, Artificial
  CRISPR gRNA sequence
aagactttttttttgtcact

SEQ ID NO: 274169 - DNA, 20 bp, Artificial
  CRISPR gRNA sequence
tttttttgtcactgaaaaat

SEQ ID NO: 274170 - DNA, 20 bp, Artificial
  CRISPR gRNA sequence
ttttttgtcactgaaaaata

SEQ ID NO: 274171 - DNA, 20 bp, Artificial
  CRISPR gRNA sequence
tttttgtcactgaaaaatag

SEQ ID NO: 274172 - DNA, 20 bp, Artificial
  CRISPR gRNA sequence
ttttgtcactgaaaaatagt

SEQ ID NO: 274173 - DNA, 20 bp, Artificial
  CRISPR gRNA sequence
tttgtcactgaaaaatagtc

SEQ ID NO: 274174 - DNA, 20 bp, Artificial
  CRISPR gRNA sequence
ttgtcactgaaaaatagtcg

SEQ ID NO: 274175 - DNA, 20 bp, Artificial
  CRISPR gRNA sequence
tgtcactgaaaaatagtcgg

SEQ ID NO: 274176 - DNA, 20 bp, Artificial
  CRISPR gRNA sequence
gtcactgaaaaatagtcggt

SEQ ID NO: 274177 - DNA, 20 bp, Artificial
  CRISPR gRNA sequence
tcactgaaaaatagtcggtc

SEQ ID NO: 274178 - DNA, 20 bp, Artificial
  CRISPR gRNA sequence
aaaaatagtcggtcactaca

SEQ ID NO: 274179 - DNA, 20 bp, Artificial
  CRISPR gRNA sequence
catgatgggcttatgggaat

SEQ ID NO: 274180 - DNA, 20 bp, Artificial
  CRISPR gRNA sequence
atgggaattattctttattg

SEQ ID NO: 274181 - DNA, 20 bp, Artificial
  CRISPR gRNA sequence
tgggaattattctttattga

SEQ ID NO: 274182 - DNA, 20 bp, Artificial
  CRISPR gRNA sequence
aatttaagtgctggtacctg

SEQ ID NO: 274183 - DNA, 20 bp, Artificial
  CRISPR gRNA sequence
ttaagtgctggtacctgtgg

SEQ ID NO: 274184 - DNA, 20 bp, Artificial
  CRISPR gRNA sequence
agtgctggtacctgtggtgg

SEQ ID NO: 274185 - DNA, 20 bp, Artificial
  CRISPR gRNA sequence
gctggtacctgtggtggcag

SEQ ID NO: 274186 - DNA, 20 bp, Artificial
  CRISPR gRNA sequence
tttttcttttctttttaact

SEQ ID NO: 274187 - DNA, 20 bp, Artificial
  CRISPR gRNA sequence
cttttctttttaactaagaa

SEQ ID NO: 274188 - DNA, 20 bp, Artificial
  CRISPR gRNA sequence
ttttctttttaactaagaat

SEQ ID NO: 274189 - DNA, 20 bp, Artificial
  CRISPR gRNA sequence
tttctttttaactaagaatg

SEQ ID NO: 274190 - DNA, 20 bp, Artificial
  CRISPR gRNA sequence
catgaatatatccacccacc

SEQ ID NO: 274191 - DNA, 20 bp, Artificial
  CRISPR gRNA sequence
tatccacccacctagatttt

SEQ ID NO: 274192 - DNA, 20 bp, Artificial
  CRISPR gRNA sequence
ccacccacctagattttaag

SEQ ID NO: 274193 - DNA, 20 bp, Artificial
  CRISPR gRNA sequence
gtaaataaaacatttcgcaa

SEQ ID NO: 274194 - DNA, 20 bp, Artificial
  CRISPR gRNA sequence
aaacatttcgcaaaagatta

SEQ ID NO: 274195 - DNA, 20 bp, Artificial
  CRISPR gRNA sequence
aagattaaagttgaatttta

SEQ ID NO: 274196 - DNA, 20 bp, Artificial
  CRISPR gRNA sequence
ttacagttcgtatattcatg

SEQ ID NO: 274197 - DNA, 20 bp, Artificial
  CRISPR gRNA sequence
atattcatgtggtcctttga

SEQ ID NO: 274198 - DNA, 20 bp, Artificial
  CRISPR gRNA sequence
tattcatgtggtcctttgaa

SEQ ID NO: 274199 - DNA, 20 bp, Artificial
  CRISPR gRNA sequence
attcatgtggtcctttgaaa

SEQ ID NO: 274200 - DNA, 20 bp, Artificial
  CRISPR gRNA sequence
ggtcctttgaaagggtattc

SEQ ID NO: 274201 - DNA, 20 bp, Artificial
  CRISPR gRNA sequence
aagggtattctagaaatcac

SEQ ID NO: 274202 - DNA, 20 bp, Artificial
  CRISPR gRNA sequence
gtattctagaaatcactgga

SEQ ID NO: 274203 - DNA, 20 bp, Artificial
  CRISPR gRNA sequence
attctagaaatcactggaaa

SEQ ID NO: 274204 - DNA, 20 bp, Artificial
  CRISPR gRNA sequence
ttctagaaatcactggaaag

SEQ ID NO: 274205 - DNA, 20 bp, Artificial
  CRISPR gRNA sequence
ctagaaatcactggaaagag

SEQ ID NO: 274206 - DNA, 20 bp, Artificial
  CRISPR gRNA sequence
agaaatcactggaaagagga

SEQ ID NO: 274207 - DNA, 20 bp, Artificial
  CRISPR gRNA sequence
gaaatcactggaaagaggag

SEQ ID NO: 274208 - DNA, 20 bp, Artificial
  CRISPR gRNA sequence
tcactggaaagaggagagga

SEQ ID NO: 274209 - DNA, 20 bp, Artificial
  CRISPR gRNA sequence
gaaagaggagaggaaagaac

SEQ ID NO: 274210 - DNA, 20 bp, Artificial
  CRISPR gRNA sequence
aaagaggagaggaaagaacc

SEQ ID NO: 274211 - DNA, 20 bp, Artificial
  CRISPR gRNA sequence
gaggagaggaaagaaccagg

SEQ ID NO: 274212 - DNA, 20 bp, Artificial
  CRISPR gRNA sequence
aggagaggaaagaaccaggt

SEQ ID NO: 274213 - DNA, 20 bp, Artificial
  CRISPR gRNA sequence
gaaagaaccaggtaggcaaa

SEQ ID NO: 274214 - DNA, 20 bp, Artificial
  CRISPR gRNA sequence
caaatggtctgtgaaaccct

SEQ ID NO: 274215 - DNA, 20 bp, Artificial
  CRISPR gRNA sequence
aaatggtctgtgaaaccctt

SEQ ID NO: 274216 - DNA, 20 bp, Artificial
  CRISPR gRNA sequence
tctgtgaaacccttgggtcc

SEQ ID NO: 274217 - DNA, 20 bp, Artificial
  CRISPR gRNA sequence
gtgaaacccttgggtcctgg

SEQ ID NO: 274218 - DNA, 20 bp, Artificial
  CRISPR gRNA sequence
aaacccttgggtcctggaag

SEQ ID NO: 274219 - DNA, 20 bp, Artificial
  CRISPR gRNA sequence
ttgggtcctggaagcagtgt

SEQ ID NO: 274220 - DNA, 20 bp, Artificial
  CRISPR gRNA sequence
gcagtgtgagtgtaaatgtg

SEQ ID NO: 274221 - DNA, 20 bp, Artificial
  CRISPR gRNA sequence
gagtgtaaatgtgtagtgtt

SEQ ID NO: 274222 - DNA, 20 bp, Artificial
  CRISPR gRNA sequence
tggtttcatctaaataaaca

SEQ ID NO: 274223 - DNA, 20 bp, Artificial
  CRISPR gRNA sequence
taaaatacaaattcaacaaa

SEQ ID NO: 274224 - DNA, 20 bp, Artificial
  CRISPR gRNA sequence
aatacaaattcaacaaaaag

SEQ ID NO: 274225 - DNA, 20 bp, Artificial
  CRISPR gRNA sequence
aaattcaacaaaaagtagat

SEQ ID NO: 274226 - DNA, 20 bp, Artificial
  CRISPR gRNA sequence
aaagtagatcagcattatta

SEQ ID NO: 274227 - DNA, 20 bp, Artificial
  CRISPR gRNA sequence
gatcagcattattaaagaaa

SEQ ID NO: 274228 - DNA, 20 bp, Artificial
  CRISPR gRNA sequence
ttcaactttgtttcttccct

SEQ ID NO: 274229 - DNA, 20 bp, Artificial
  CRISPR gRNA sequence
ttcccttagtattgctgaca

SEQ ID NO: 274230 - DNA, 20 bp, Artificial
  CRISPR gRNA sequence
tgctgacaaagtatctgctg

SEQ ID NO: 274231 - DNA, 20 bp, Artificial
  CRISPR gRNA sequence
aaagtatctgctgtagaata

SEQ ID NO: 274232 - DNA, 20 bp, Artificial
  CRISPR gRNA sequence
aagtatctgctgtagaatac

SEQ ID NO: 274233 - DNA, 20 bp, Artificial
  CRISPR gRNA sequence
tgtagaatacaggaattact

SEQ ID NO: 274234 - DNA, 20 bp, Artificial
  CRISPR gRNA sequence
aatacaggaattacttagaa

SEQ ID NO: 274235 - DNA, 20 bp, Artificial
  CRISPR gRNA sequence
aattacttagaatagaaaca

SEQ ID NO: 274236 - DNA, 20 bp, Artificial
  CRISPR gRNA sequence
tcatcacaactgttactaaa

SEQ ID NO: 274237 - DNA, 20 bp, Artificial
  CRISPR gRNA sequence
acaactgttactaaatggaa

SEQ ID NO: 274238 - DNA, 20 bp, Artificial
  CRISPR gRNA sequence
tgttactaaatggaaaagaa

SEQ ID NO: 274239 - DNA, 20 bp, Artificial
  CRISPR gRNA sequence
tggaaaagaaaagaattatt

SEQ ID NO: 274240 - DNA, 20 bp, Artificial
  CRISPR gRNA sequence
aagaaaagaattattgagtt

SEQ ID NO: 274241 - DNA, 20 bp, Artificial
  CRISPR gRNA sequence
gttaagtattcctgtcaata

SEQ ID NO: 274242 - DNA, 20 bp, Artificial
  CRISPR gRNA sequence
ttaagtattcctgtcaatac

SEQ ID NO: 274243 - DNA, 20 bp, Artificial
  CRISPR gRNA sequence
gtcaatacgggaaacactgc

SEQ ID NO: 274244 - DNA, 20 bp, Artificial
  CRISPR gRNA sequence
acactgctagtaccttatgt

SEQ ID NO: 274245 - DNA, 20 bp, Artificial
  CRISPR gRNA sequence
ctagtaccttatgttggtgt

SEQ ID NO: 274246 - DNA, 20 bp, Artificial
  CRISPR gRNA sequence
agacctctctgccctacact

SEQ ID NO: 274247 - DNA, 20 bp, Artificial
  CRISPR gRNA sequence
tctgccctacactgagaata

SEQ ID NO: 274248 - DNA, 20 bp, Artificial
  CRISPR gRNA sequence
actgagaatatagttttaca

SEQ ID NO: 274249 - DNA, 20 bp, Artificial
  CRISPR gRNA sequence
ctgagaatatagttttacac

SEQ ID NO: 274250 - DNA, 20 bp, Artificial
  CRISPR gRNA sequence
gagaatatagttttacacag

SEQ ID NO: 274251 - DNA, 20 bp, Artificial
  CRISPR gRNA sequence
atatagttttacacaggagc

SEQ ID NO: 274252 - DNA, 20 bp, Artificial
  CRISPR gRNA sequence
tatagttttacacaggagca

SEQ ID NO: 274253 - DNA, 20 bp, Artificial
  CRISPR gRNA sequence
acacaggagcaaggtttgtg

SEQ ID NO: 274254 - DNA, 20 bp, Artificial
  CRISPR gRNA sequence
caggagcaaggtttgtgaag

SEQ ID NO: 274255 - DNA, 20 bp, Artificial
  CRISPR gRNA sequence
gcaaggtttgtgaagcagca

SEQ ID NO: 274256 - DNA, 20 bp, Artificial
  CRISPR gRNA sequence
ggtttgtgaagcagcatagt

SEQ ID NO: 274257 - DNA, 20 bp, Artificial
  CRISPR gRNA sequence
gtttgtgaagcagcatagtg

SEQ ID NO: 274258 - DNA, 20 bp, Artificial
  CRISPR gRNA sequence
tgtgaagcagcatagtgagg

SEQ ID NO: 274259 - DNA, 20 bp, Artificial
  CRISPR gRNA sequence
gcagcatagtgaggtagcta

SEQ ID NO: 274260 - DNA, 20 bp, Artificial
  CRISPR gRNA sequence
tagtgaggtagctaaagcca

SEQ ID NO: 274261 - DNA, 20 bp, Artificial
  CRISPR gRNA sequence
agtgaggtagctaaagccat

SEQ ID NO: 274262 - DNA, 20 bp, Artificial
  CRISPR gRNA sequence
aggtagctaaagccatgggc

SEQ ID NO: 274263 - DNA, 20 bp, Artificial
  CRISPR gRNA sequence
aaagccatgggctggctcta

SEQ ID NO: 274264 - DNA, 20 bp, Artificial
  CRISPR gRNA sequence
aagccatgggctggctctaa

SEQ ID NO: 274265 - DNA, 20 bp, Artificial
  CRISPR gRNA sequence
gctctaaaggctttaaatcc

SEQ ID NO: 274266 - DNA, 20 bp, Artificial
  CRISPR gRNA sequence
ggctttaaatcccagccatg

SEQ ID NO: 274267 - DNA, 20 bp, Artificial
  CRISPR gRNA sequence
taaatcccagccatgtggct

SEQ ID NO: 274268 - DNA, 20 bp, Artificial
  CRISPR gRNA sequence
ccatgtggcttagctgccat

SEQ ID NO: 274269 - DNA, 20 bp, Artificial
  CRISPR gRNA sequence
ctgccatgagatgtgcattt

SEQ ID NO: 274270 - DNA, 20 bp, Artificial
  CRISPR gRNA sequence
cttcttttgctgttcaactc

SEQ ID NO: 274271 - DNA, 20 bp, Artificial
  CRISPR gRNA sequence
gctgttcaactccagatttt

SEQ ID NO: 274272 - DNA, 20 bp, Artificial
  CRISPR gRNA sequence
agatgataatgtgattatcc

SEQ ID NO: 274273 - DNA, 20 bp, Artificial
  CRISPR gRNA sequence
taatgtgattatcccagctt

SEQ ID NO: 274274 - DNA, 20 bp, Artificial
  CRISPR gRNA sequence
gcttaagttgcgtccacttc

SEQ ID NO: 274275 - DNA, 20 bp, Artificial
  CRISPR gRNA sequence
agttgcgtccacttctggtc

SEQ ID NO: 274276 - DNA, 20 bp, Artificial
  CRISPR gRNA sequence
acttctggtctagtgaattg

SEQ ID NO: 274277 - DNA, 20 bp, Artificial
  CRISPR gRNA sequence
tctggtctagtgaattgtgg

SEQ ID NO: 274278 - DNA, 20 bp, Artificial
  CRISPR gRNA sequence
ctggtctagtgaattgtgga

SEQ ID NO: 274279 - DNA, 20 bp, Artificial
  CRISPR gRNA sequence
gtctagtgaattgtggaagg

SEQ ID NO: 274280 - DNA, 20 bp, Artificial
  CRISPR gRNA sequence
tgaattgtggaaggcagttt

SEQ ID NO: 274281 - DNA, 20 bp, Artificial
  CRISPR gRNA sequence
aattgtggaaggcagtttta

SEQ ID NO: 274282 - DNA, 20 bp, Artificial
  CRISPR gRNA sequence
gtggaaggcagttttagaga

SEQ ID NO: 274283 - DNA, 20 bp, Artificial
  CRISPR gRNA sequence
tggaaggcagttttagagaa

SEQ ID NO: 274284 - DNA, 20 bp, Artificial
  CRISPR gRNA sequence
gaaggcagttttagagaaag

SEQ ID NO: 274285 - DNA, 20 bp, Artificial
  CRISPR gRNA sequence
gttttagagaaaggagtcat

SEQ ID NO: 274286 - DNA, 20 bp, Artificial
  CRISPR gRNA sequence
ggagtcatgagtaacatgaa

SEQ ID NO: 274287 - DNA, 20 bp, Artificial
  CRISPR gRNA sequence
gtcatgagtaacatgaacag

SEQ ID NO: 274288 - DNA, 20 bp, Artificial
  CRISPR gRNA sequence
tgagtaacatgaacagcagt

SEQ ID NO: 274289 - DNA, 20 bp, Artificial
  CRISPR gRNA sequence
agcagttggctatgtctttc

SEQ ID NO: 274290 - DNA, 20 bp, Artificial
  CRISPR gRNA sequence
ttccagttctctgctgatgt

SEQ ID NO: 274291 - DNA, 20 bp, Artificial
  CRISPR gRNA sequence
agttctctgctgatgtcaga

SEQ ID NO: 274292 - DNA, 20 bp, Artificial
  CRISPR gRNA sequence
ctgctgatgtcagaaagacc

SEQ ID NO: 274293 - DNA, 20 bp, Artificial
  CRISPR gRNA sequence
cagaaagacccagaaatacc

SEQ ID NO: 274294 - DNA, 20 bp, Artificial
  CRISPR gRNA sequence
agaaagacccagaaatacca

SEQ ID NO: 274295 - DNA, 20 bp, Artificial
  CRISPR gRNA sequence
aaagacccagaaataccaag

SEQ ID NO: 274296 - DNA, 20 bp, Artificial
  CRISPR gRNA sequence
ccagaaataccaaggagaaa

SEQ ID NO: 274297 - DNA, 20 bp, Artificial
  CRISPR gRNA sequence
ccaaggagaaaaagccatct

SEQ ID NO: 274298 - DNA, 20 bp, Artificial
  CRISPR gRNA sequence
caaggagaaaaagccatctt

SEQ ID NO: 274299 - DNA, 20 bp, Artificial
  CRISPR gRNA sequence
aaggagaaaaagccatctta

SEQ ID NO: 274300 - DNA, 20 bp, Artificial
  CRISPR gRNA sequence
aaaagccatcttagggatct

SEQ ID NO: 274301 - DNA, 20 bp, Artificial
  CRISPR gRNA sequence
aaagccatcttagggatcta

SEQ ID NO: 274302 - DNA, 20 bp, Artificial
  CRISPR gRNA sequence
agccatcttagggatctaag

SEQ ID NO: 274303 - DNA, 20 bp, Artificial
  CRISPR gRNA sequence
gccatcttagggatctaagg

SEQ ID NO: 274304 - DNA, 20 bp, Artificial
  CRISPR gRNA sequence
agggatctaaggaggcccta

SEQ ID NO: 274305 - DNA, 20 bp, Artificial
  CRISPR gRNA sequence
atctaaggaggccctatgga

SEQ ID NO: 274306 - DNA, 20 bp, Artificial
  CRISPR gRNA sequence
cctatggaaagttactacct

SEQ ID NO: 274307 - DNA, 20 bp, Artificial
  CRISPR gRNA sequence
gttactaccttagacatttg

SEQ ID NO: 274308 - DNA, 20 bp, Artificial
  CRISPR gRNA sequence
ctaccttagacatttgaaga

SEQ ID NO: 274309 - DNA, 20 bp, Artificial
  CRISPR gRNA sequence
tttgaagatagcttactgct

SEQ ID NO: 274310 - DNA, 20 bp, Artificial
  CRISPR gRNA sequence
acaacgatctcattttaaat

SEQ ID NO: 274311 - DNA, 20 bp, Artificial
  CRISPR gRNA sequence
ctcataaatattttacaaat

SEQ ID NO: 274312 - DNA, 20 bp, Artificial
  CRISPR gRNA sequence
tcataaatattttacaaatg

SEQ ID NO: 274313 - DNA, 20 bp, Artificial
  CRISPR gRNA sequence
ttttacaaatgaggtcaaac

SEQ ID NO: 274314 - DNA, 20 bp, Artificial
  CRISPR gRNA sequence
aatgaggtcaaactagcata

SEQ ID NO: 274315 - DNA, 20 bp, Artificial
  CRISPR gRNA sequence
aactagcataaagccattta

SEQ ID NO: 274316 - DNA, 20 bp, Artificial
  CRISPR gRNA sequence
ctagcataaagccatttaaa

SEQ ID NO: 274317 - DNA, 20 bp, Artificial
  CRISPR gRNA sequence
aagccatttaaagagattat

SEQ ID NO: 274318 - DNA, 20 bp, Artificial
  CRISPR gRNA sequence
attatcagtccaatatgaac

SEQ ID NO: 274319 - DNA, 20 bp, Artificial
  CRISPR gRNA sequence
cagtccaatatgaaccagtt

SEQ ID NO: 274320 - DNA, 20 bp, Artificial
  CRISPR gRNA sequence
atatgaaccagttaagtctt

SEQ ID NO: 274321 - DNA, 20 bp, Artificial
  CRISPR gRNA sequence
aaatcattcgtcttacatgt

SEQ ID NO: 274322 - DNA, 20 bp, Artificial
  CRISPR gRNA sequence
atcattcgtcttacatgtca

SEQ ID NO: 274323 - DNA, 20 bp, Artificial
  CRISPR gRNA sequence
tcattcgtcttacatgtcag

SEQ ID NO: 274324 - DNA, 20 bp, Artificial
  CRISPR gRNA sequence
tcttacatgtcagaggaaat

SEQ ID NO: 274325 - DNA, 20 bp, Artificial
  CRISPR gRNA sequence
atgtcagaggaaattagttt

SEQ ID NO: 274326 - DNA, 20 bp, Artificial
  CRISPR gRNA sequence
cagaggaaattagttttgga

SEQ ID NO: 274327 - DNA, 20 bp, Artificial
  CRISPR gRNA sequence
ctcctttctgctgtacctca

SEQ ID NO: 274328 - DNA, 20 bp, Artificial
  CRISPR gRNA sequence
tcctttctgctgtacctcat

SEQ ID NO: 274329 - DNA, 20 bp, Artificial
  CRISPR gRNA sequence
cctttctgctgtacctcatg

SEQ ID NO: 274330 - DNA, 20 bp, Artificial
  CRISPR gRNA sequence
ctttctgctgtacctcatgg

SEQ ID NO: 274331 - DNA, 20 bp, Artificial
  CRISPR gRNA sequence
ttctgctgtacctcatgggg

SEQ ID NO: 274332 - DNA, 20 bp, Artificial
  CRISPR gRNA sequence
gctgtacctcatgggggagt

SEQ ID NO: 274333 - DNA, 20 bp, Artificial
  CRISPR gRNA sequence
tgtacctcatgggggagtga

SEQ ID NO: 274334 - DNA, 20 bp, Artificial
  CRISPR gRNA sequence
tacctcatgggggagtgaga

SEQ ID NO: 274335 - DNA, 20 bp, Artificial
  CRISPR gRNA sequence
ctcatgggggagtgagagag

SEQ ID NO: 274336 - DNA, 20 bp, Artificial
  CRISPR gRNA sequence
ggggagtgagagagcagcaa

SEQ ID NO: 274337 - DNA, 20 bp, Artificial
  CRISPR gRNA sequence
ggagtgagagagcagcaata

SEQ ID NO: 274338 - DNA, 20 bp, Artificial
  CRISPR gRNA sequence
agagaacacaatgaaaaaaa

SEQ ID NO: 274339 - DNA, 20 bp, Artificial
  CRISPR gRNA sequence
caatgaaaaaaatggaatac

SEQ ID NO: 274340 - DNA, 20 bp, Artificial
  CRISPR gRNA sequence
aatgaaaaaaatggaatact

SEQ ID NO: 274341 - DNA, 20 bp, Artificial
  CRISPR gRNA sequence
aacaccaataatatttccat

SEQ ID NO: 274342 - DNA, 20 bp, Artificial
  CRISPR gRNA sequence
atatttccattagtctccta

SEQ ID NO: 274343 - DNA, 20 bp, Artificial
  CRISPR gRNA sequence
atacttcctatgcattacat

SEQ ID NO: 274344 - DNA, 20 bp, Artificial
  CRISPR gRNA sequence
tacttcctatgcattacatt

SEQ ID NO: 274345 - DNA, 20 bp, Artificial
  CRISPR gRNA sequence
ttacattgggcttttgtaaa

SEQ ID NO: 274346 - DNA, 20 bp, Artificial
  CRISPR gRNA sequence
cattgggcttttgtaaacag

SEQ ID NO: 274347 - DNA, 20 bp, Artificial
  CRISPR gRNA sequence
aaaatcttctactctgacat

SEQ ID NO: 274348 - DNA, 20 bp, Artificial
  CRISPR gRNA sequence
aaatcttctactctgacatt

SEQ ID NO: 274349 - DNA, 20 bp, Artificial
  CRISPR gRNA sequence
ctactctgacattaggaaat

SEQ ID NO: 274350 - DNA, 20 bp, Artificial
  CRISPR gRNA sequence
tctgacattaggaaatcaga

SEQ ID NO: 274351 - DNA, 20 bp, Artificial
  CRISPR gRNA sequence
aggaaatcagatagtctctg

SEQ ID NO: 274352 - DNA, 20 bp, Artificial
  CRISPR gRNA sequence
ctctgaagttgacctgttat

SEQ ID NO: 274353 - DNA, 20 bp, Artificial
  CRISPR gRNA sequence
tattggacaaattctacttc

SEQ ID NO: 274354 - DNA, 20 bp, Artificial
  CRISPR gRNA sequence
tggacaaattctacttccag

SEQ ID NO: 274355 - DNA, 20 bp, Artificial
  CRISPR gRNA sequence
tgacatatatatgtatatac

SEQ ID NO: 274356 - DNA, 20 bp, Artificial
  CRISPR gRNA sequence
tatatgtatataccagttaa

SEQ ID NO: 274357 - DNA, 20 bp, Artificial
  CRISPR gRNA sequence
atatgtatataccagttaac

SEQ ID NO: 274358 - DNA, 20 bp, Artificial
  CRISPR gRNA sequence
atataccagttaacaggcca

SEQ ID NO: 274359 - DNA, 20 bp, Artificial
  CRISPR gRNA sequence
aggccacagtcaaactgata

SEQ ID NO: 274360 - DNA, 20 bp, Artificial
  CRISPR gRNA sequence
ggccacagtcaaactgataa

SEQ ID NO: 274361 - DNA, 20 bp, Artificial
  CRISPR gRNA sequence
gccacagtcaaactgataaa

SEQ ID NO: 274362 - DNA, 20 bp, Artificial
  CRISPR gRNA sequence
cagtcaaactgataaaggga

SEQ ID NO: 274363 - DNA, 20 bp, Artificial
  CRISPR gRNA sequence
gtcaaactgataaagggaaa

SEQ ID NO: 274364 - DNA, 20 bp, Artificial
  CRISPR gRNA sequence
ctgataaagggaaagagcac

SEQ ID NO: 274365 - DNA, 20 bp, Artificial
  CRISPR gRNA sequence
gataaagggaaagagcacca

SEQ ID NO: 274366 - DNA, 20 bp, Artificial
  CRISPR gRNA sequence
aagggaaagagcaccagagt

SEQ ID NO: 274367 - DNA, 20 bp, Artificial
  CRISPR gRNA sequence
agggaaagagcaccagagtt

SEQ ID NO: 274368 - DNA, 20 bp, Artificial
  CRISPR gRNA sequence
agcaccagagttaggaaatc

SEQ ID NO: 274369 - DNA, 20 bp, Artificial
  CRISPR gRNA sequence
gcaccagagttaggaaatct

SEQ ID NO: 274370 - DNA, 20 bp, Artificial
  CRISPR gRNA sequence
gagttaggaaatctgggttc

SEQ ID NO: 274371 - DNA, 20 bp, Artificial
  CRISPR gRNA sequence
ggaaatctgggttctggcgc

SEQ ID NO: 274372 - DNA, 20 bp, Artificial
  CRISPR gRNA sequence
tggcgctggcctttataatt

SEQ ID NO: 274373 - DNA, 20 bp, Artificial
  CRISPR gRNA sequence
ggcgctggcctttataattc

SEQ ID NO: 274374 - DNA, 20 bp, Artificial
  CRISPR gRNA sequence
tataattcgggtcacctccc

SEQ ID NO: 274375 - DNA, 20 bp, Artificial
  CRISPR gRNA sequence
ataattcgggtcacctccct

SEQ ID NO: 274376 - DNA, 20 bp, Artificial
  CRISPR gRNA sequence
cgggtcacctccctgggcct

SEQ ID NO: 274377 - DNA, 20 bp, Artificial
  CRISPR gRNA sequence
gcctttgtcattaataacac

SEQ ID NO: 274378 - DNA, 20 bp, Artificial
  CRISPR gRNA sequence
aataacactggtattctcta

SEQ ID NO: 274379 - DNA, 20 bp, Artificial
  CRISPR gRNA sequence
gtattctctaaagtcccttc

SEQ ID NO: 274380 - DNA, 20 bp, Artificial
  CRISPR gRNA sequence
taaagtcccttccagaactc

SEQ ID NO: 274381 - DNA, 20 bp, Artificial
  CRISPR gRNA sequence
catttcaaaacaccttgatc

SEQ ID NO: 274382 - DNA, 20 bp, Artificial
  CRISPR gRNA sequence
atttcaaaacaccttgatca

SEQ ID NO: 274383 - DNA, 20 bp, Artificial
  CRISPR gRNA sequence
aacaccttgatcaaggtcac

SEQ ID NO: 274384 - DNA, 20 bp, Artificial
  CRISPR gRNA sequence
caccttgatcaaggtcacca

SEQ ID NO: 274385 - DNA, 20 bp, Artificial
  CRISPR gRNA sequence
ctgtgcccaccatattcctc

SEQ ID NO: 274386 - DNA, 20 bp, Artificial
  CRISPR gRNA sequence
tcctctagacacttcctgca

SEQ ID NO: 274387 - DNA, 20 bp, Artificial
  CRISPR gRNA sequence
cacttcctgcaaagcaactg

SEQ ID NO: 274388 - DNA, 20 bp, Artificial
  CRISPR gRNA sequence
cctgcaaagcaactgaagtg

SEQ ID NO: 274389 - DNA, 20 bp, Artificial
  CRISPR gRNA sequence
gcaaagcaactgaagtgaag

SEQ ID NO: 274390 - DNA, 20 bp, Artificial
  CRISPR gRNA sequence
actgaagtgaagaagcacct

SEQ ID NO: 274391 - DNA, 20 bp, Artificial
  CRISPR gRNA sequence
tgaagtgaagaagcacctaa

SEQ ID NO: 274392 - DNA, 20 bp, Artificial
  CRISPR gRNA sequence
agtgaagaagcacctaagag

SEQ ID NO: 274393 - DNA, 20 bp, Artificial
  CRISPR gRNA sequence
cacctaagagcagatacgta

SEQ ID NO: 274394 - DNA, 20 bp, Artificial
  CRISPR gRNA sequence
acctaagagcagatacgtaa

SEQ ID NO: 274395 - DNA, 20 bp, Artificial
  CRISPR gRNA sequence
cctaagagcagatacgtaaa

SEQ ID NO: 274396 - DNA, 20 bp, Artificial
  CRISPR gRNA sequence
agagcagatacgtaaagggc

SEQ ID NO: 274397 - DNA, 20 bp, Artificial
  CRISPR gRNA sequence
gagcagatacgtaaagggca

SEQ ID NO: 274398 - DNA, 20 bp, Artificial
  CRISPR gRNA sequence
cagatacgtaaagggcaagg

SEQ ID NO: 274399 - DNA, 20 bp, Artificial
  CRISPR gRNA sequence
agatacgtaaagggcaaggt

SEQ ID NO: 274400 - DNA, 20 bp, Artificial
  CRISPR gRNA sequence
gatacgtaaagggcaaggtg

SEQ ID NO: 274401 - DNA, 20 bp, Artificial
  CRISPR gRNA sequence
tggggtaatcttgtccatct

SEQ ID NO: 274402 - DNA, 20 bp, Artificial
  CRISPR gRNA sequence
ggggtaatcttgtccatctg

SEQ ID NO: 274403 - DNA, 20 bp, Artificial
  CRISPR gRNA sequence
gtaatcttgtccatctgagg

SEQ ID NO: 274404 - DNA, 20 bp, Artificial
  CRISPR gRNA sequence
tgtccatctgaggaagttcc

SEQ ID NO: 274405 - DNA, 20 bp, Artificial
  CRISPR gRNA sequence
ccatctgaggaagttcccag

SEQ ID NO: 274406 - DNA, 20 bp, Artificial
  CRISPR gRNA sequence
atctgaggaagttcccagaa

SEQ ID NO: 274407 - DNA, 20 bp, Artificial
  CRISPR gRNA sequence
tctgaggaagttcccagaag

SEQ ID NO: 274408 - DNA, 20 bp, Artificial
  CRISPR gRNA sequence
cagaagaggtcaattgcaaa

SEQ ID NO: 274409 - DNA, 20 bp, Artificial
  CRISPR gRNA sequence
gaagaggtcaattgcaaatg

SEQ ID NO: 274410 - DNA, 20 bp, Artificial
  CRISPR gRNA sequence
aagaggtcaattgcaaatgg

SEQ ID NO: 274411 - DNA, 20 bp, Artificial
  CRISPR gRNA sequence
aggtcaattgcaaatggagg

SEQ ID NO: 274412 - DNA, 20 bp, Artificial
  CRISPR gRNA sequence
ggtcaattgcaaatggaggt

SEQ ID NO: 274413 - DNA, 20 bp, Artificial
  CRISPR gRNA sequence
tgcaaatggaggtgggacct

SEQ ID NO: 274414 - DNA, 20 bp, Artificial
  CRISPR gRNA sequence
aggtgggacctgagaaaaca

SEQ ID NO: 274415 - DNA, 20 bp, Artificial
  CRISPR gRNA sequence
gattacatcaaaccctatat

SEQ ID NO: 274416 - DNA, 20 bp, Artificial
  CRISPR gRNA sequence
catcaaaccctatattggca

SEQ ID NO: 274417 - DNA, 20 bp, Artificial
  CRISPR gRNA sequence
atcaaaccctatattggcaa

SEQ ID NO: 274418 - DNA, 20 bp, Artificial
  CRISPR gRNA sequence
caaaccctatattggcaaag

SEQ ID NO: 274419 - DNA, 20 bp, Artificial
  CRISPR gRNA sequence
aaaccctatattggcaaagg

SEQ ID NO: 274420 - DNA, 20 bp, Artificial
  CRISPR gRNA sequence
tatatatatattttaaatat

SEQ ID NO: 274421 - DNA, 20 bp, Artificial
  CRISPR gRNA sequence
ttaatttacattttaatctc

SEQ ID NO: 274422 - DNA, 20 bp, Artificial
  CRISPR gRNA sequence
tacattttaatctcaagatc

SEQ ID NO: 274423 - DNA, 20 bp, Artificial
  CRISPR gRNA sequence
acattttaatctcaagatca

SEQ ID NO: 274424 - DNA, 20 bp, Artificial
  CRISPR gRNA sequence
cattttaatctcaagatcaa

SEQ ID NO: 274425 - DNA, 20 bp, Artificial
  CRISPR gRNA sequence
ctcaagatcaagggtattcc

SEQ ID NO: 274426 - DNA, 20 bp, Artificial
  CRISPR gRNA sequence
gggtattcccagcttgtaca

SEQ ID NO: 274427 - DNA, 20 bp, Artificial
  CRISPR gRNA sequence
cttgtacacagtaaccttga

SEQ ID NO: 274428 - DNA, 20 bp, Artificial
  CRISPR gRNA sequence
cacagtaaccttgatagctg

SEQ ID NO: 274429 - DNA, 20 bp, Artificial
  CRISPR gRNA sequence
cttgatagctgaagaatatg

SEQ ID NO: 274430 - DNA, 20 bp, Artificial
  CRISPR gRNA sequence
ttgatagctgaagaatatga

SEQ ID NO: 274431 - DNA, 20 bp, Artificial
  CRISPR gRNA sequence
tgatagctgaagaatatgaa

SEQ ID NO: 274432 - DNA, 20 bp, Artificial
  CRISPR gRNA sequence
agctgaagaatatgaaggga

SEQ ID NO: 274433 - DNA, 20 bp, Artificial
  CRISPR gRNA sequence
tgaagggaaagctgaattat

SEQ ID NO: 274434 - DNA, 20 bp, Artificial
  CRISPR gRNA sequence
aagggaaagctgaattatga

SEQ ID NO: 274435 - DNA, 20 bp, Artificial
  CRISPR gRNA sequence
gagagaacttaaaactactc

SEQ ID NO: 274436 - DNA, 20 bp, Artificial
  CRISPR gRNA sequence
ttgtcacatgaaatatcgat

SEQ ID NO: 274437 - DNA, 20 bp, Artificial
  CRISPR gRNA sequence
tgtcacatgaaatatcgatc

SEQ ID NO: 274438 - DNA, 20 bp, Artificial
  CRISPR gRNA sequence
atatcgatcaggcaaatgtt

SEQ ID NO: 274439 - DNA, 20 bp, Artificial
  CRISPR gRNA sequence
ggcaaatgtttagttattac

SEQ ID NO: 274440 - DNA, 20 bp, Artificial
  CRISPR gRNA sequence
aaacgaccaaatgcttgatc

SEQ ID NO: 274441 - DNA, 20 bp, Artificial
  CRISPR gRNA sequence
tcaagccactcttctatgtg

SEQ ID NO: 274442 - DNA, 20 bp, Artificial
  CRISPR gRNA sequence
caagccactcttctatgtgt

SEQ ID NO: 274443 - DNA, 20 bp, Artificial
  CRISPR gRNA sequence
aagccactcttctatgtgtg

SEQ ID NO: 274444 - DNA, 20 bp, Artificial
  CRISPR gRNA sequence
tcttctatgtgtggggctct

SEQ ID NO: 274445 - DNA, 20 bp, Artificial
  CRISPR gRNA sequence
cttctatgtgtggggctctc

SEQ ID NO: 274446 - DNA, 20 bp, Artificial
  CRISPR gRNA sequence
atgtgtggggctctcaggca

SEQ ID NO: 274447 - DNA, 20 bp, Artificial
  CRISPR gRNA sequence
tttctcaataaacctacata

SEQ ID NO: 274448 - DNA, 20 bp, Artificial
  CRISPR gRNA sequence
caataaacctacatacagtc

SEQ ID NO: 274449 - DNA, 20 bp, Artificial
  CRISPR gRNA sequence
aacctacatacagtccagta

SEQ ID NO: 274450 - DNA, 20 bp, Artificial
  CRISPR gRNA sequence
acctacatacagtccagtaa

SEQ ID NO: 274451 - DNA, 20 bp, Artificial
  CRISPR gRNA sequence
acatacagtccagtaaagga

SEQ ID NO: 274452 - DNA, 20 bp, Artificial
  CRISPR gRNA sequence
tacagtccagtaaaggatag

SEQ ID NO: 274453 - DNA, 20 bp, Artificial
  CRISPR gRNA sequence
acagtccagtaaaggataga

SEQ ID NO: 274454 - DNA, 20 bp, Artificial
  CRISPR gRNA sequence
gtccagtaaaggatagaagg

SEQ ID NO: 274455 - DNA, 20 bp, Artificial
  CRISPR gRNA sequence
taaaggatagaaggaagatg

SEQ ID NO: 274456 - DNA, 20 bp, Artificial
  CRISPR gRNA sequence
acatgaaaatcaacctatgc

SEQ ID NO: 274457 - DNA, 20 bp, Artificial
  CRISPR gRNA sequence
tgaaaatcaacctatgctgg

SEQ ID NO: 274458 - DNA, 20 bp, Artificial
  CRISPR gRNA sequence
tcaacctatgctggtggtat

SEQ ID NO: 274459 - DNA, 20 bp, Artificial
  CRISPR gRNA sequence
tggtggtatgagatgtgcta

SEQ ID NO: 274460 - DNA, 20 bp, Artificial
  CRISPR gRNA sequence
gtggtatgagatgtgctata

SEQ ID NO: 274461 - DNA, 20 bp, Artificial
  CRISPR gRNA sequence
tggtatgagatgtgctatag

SEQ ID NO: 274462 - DNA, 20 bp, Artificial
  CRISPR gRNA sequence
tatgagatgtgctatagagg

SEQ ID NO: 274463 - DNA, 20 bp, Artificial
  CRISPR gRNA sequence
ctatagaggtggaactgctt

SEQ ID NO: 274464 - DNA, 20 bp, Artificial
  CRISPR gRNA sequence
agaggtggaactgcttgagc

SEQ ID NO: 274465 - DNA, 20 bp, Artificial
  CRISPR gRNA sequence
tggaactgcttgagctagac

SEQ ID NO: 274466 - DNA, 20 bp, Artificial
  CRISPR gRNA sequence
tgagctagacaagatgacca

SEQ ID NO: 274467 - DNA, 20 bp, Artificial
  CRISPR gRNA sequence
gctagacaagatgaccacag

SEQ ID NO: 274468 - DNA, 20 bp, Artificial
  CRISPR gRNA sequence
ctagacaagatgaccacaga

SEQ ID NO: 274469 - DNA, 20 bp, Artificial
  CRISPR gRNA sequence
tgaccacagaaggccttgtg

SEQ ID NO: 274470 - DNA, 20 bp, Artificial
  CRISPR gRNA sequence
ccacagaaggccttgtgtag

SEQ ID NO: 274471 - DNA, 20 bp, Artificial
  CRISPR gRNA sequence
gaaggccttgtgtagaagat

SEQ ID NO: 274472 - DNA, 20 bp, Artificial
  CRISPR gRNA sequence
aaggccttgtgtagaagatt

SEQ ID NO: 274473 - DNA, 20 bp, Artificial
  CRISPR gRNA sequence
tgtgtagaagattgggtaca

SEQ ID NO: 274474 - DNA, 20 bp, Artificial
  CRISPR gRNA sequence
gggtacacggcttcattttg

SEQ ID NO: 274475 - DNA, 20 bp, Artificial
  CRISPR gRNA sequence
acggcttcattttgaagtat

SEQ ID NO: 274476 - DNA, 20 bp, Artificial
  CRISPR gRNA sequence
gcttcattttgaagtatcag

SEQ ID NO: 274477 - DNA, 20 bp, Artificial
  CRISPR gRNA sequence
ttttgaagtatcagcagact

SEQ ID NO: 274478 - DNA, 20 bp, Artificial
  CRISPR gRNA sequence
tgaagtatcagcagactgag

SEQ ID NO: 274479 - DNA, 20 bp, Artificial
  CRISPR gRNA sequence
agtatcagcagactgagcag

SEQ ID NO: 274480 - DNA, 20 bp, Artificial
  CRISPR gRNA sequence
agactgagcagaagactttt

SEQ ID NO: 274481 - DNA, 20 bp, Artificial
  CRISPR gRNA sequence
tgagcagaagactttttaga

SEQ ID NO: 274482 - DNA, 20 bp, Artificial
  CRISPR gRNA sequence
cagaagactttttagataga

SEQ ID NO: 274483 - DNA, 20 bp, Artificial
  CRISPR gRNA sequence
gactttttagatagaaagtc

SEQ ID NO: 274484 - DNA, 20 bp, Artificial
  CRISPR gRNA sequence
atagaaagtcaagaaaattg

SEQ ID NO: 274485 - DNA, 20 bp, Artificial
  CRISPR gRNA sequence
aagaaaattgtagataatga

SEQ ID NO: 274486 - DNA, 20 bp, Artificial
  CRISPR gRNA sequence
ttgtagataatgacagaact

SEQ ID NO: 274487 - DNA, 20 bp, Artificial
  CRISPR gRNA sequence
agataatgacagaactgagc

SEQ ID NO: 274488 - DNA, 20 bp, Artificial
  CRISPR gRNA sequence
ataatgacagaactgagcca

SEQ ID NO: 274489 - DNA, 20 bp, Artificial
  CRISPR gRNA sequence
actgagccagagcaacatcc

SEQ ID NO: 274490 - DNA, 20 bp, Artificial
  CRISPR gRNA sequence
gccagagcaacatcctggaa

SEQ ID NO: 274491 - DNA, 20 bp, Artificial
  CRISPR gRNA sequence
catcctggaaaagacattct

SEQ ID NO: 274492 - DNA, 20 bp, Artificial
  CRISPR gRNA sequence
atcctggaaaagacattctg

SEQ ID NO: 274493 - DNA, 20 bp, Artificial
  CRISPR gRNA sequence
cctggaaaagacattctgag

SEQ ID NO: 274494 - DNA, 20 bp, Artificial
  CRISPR gRNA sequence
gaaaagacattctgaggagt

SEQ ID NO: 274495 - DNA, 20 bp, Artificial
  CRISPR gRNA sequence
agacattctgaggagtgagc

SEQ ID NO: 274496 - DNA, 20 bp, Artificial
  CRISPR gRNA sequence
ctgaggagtgagcaagcatt

SEQ ID NO: 274497 - DNA, 20 bp, Artificial
  CRISPR gRNA sequence
aggagtgagcaagcattcag

SEQ ID NO: 274498 - DNA, 20 bp, Artificial
  CRISPR gRNA sequence
attcagtggaaatgaaaaaa

SEQ ID NO: 274499 - DNA, 20 bp, Artificial
  CRISPR gRNA sequence
ttcagtggaaatgaaaaaac

SEQ ID NO: 274500 - DNA, 20 bp, Artificial
  CRISPR gRNA sequence
gtggaaatgaaaaaacagga

SEQ ID NO: 274501 - DNA, 20 bp, Artificial
  CRISPR gRNA sequence
tggaaatgaaaaaacaggat

SEQ ID NO: 274502 - DNA, 20 bp, Artificial
  CRISPR gRNA sequence
aaatgaaaaaacaggatagg

SEQ ID NO: 274503 - DNA, 20 bp, Artificial
  CRISPR gRNA sequence
aaaaaacaggataggaagtt

SEQ ID NO: 274504 - DNA, 20 bp, Artificial
  CRISPR gRNA sequence
aggaagttgagacactgcct

SEQ ID NO: 274505 - DNA, 20 bp, Artificial
  CRISPR gRNA sequence
ggaagttgagacactgcctt

SEQ ID NO: 274506 - DNA, 20 bp, Artificial
  CRISPR gRNA sequence
gaagttgagacactgccttg

SEQ ID NO: 274507 - DNA, 20 bp, Artificial
  CRISPR gRNA sequence
aagttgagacactgccttgg

SEQ ID NO: 274508 - DNA, 20 bp, Artificial
  CRISPR gRNA sequence
gccttgggggaaaatatgtg

SEQ ID NO: 274509 - DNA, 20 bp, Artificial
  CRISPR gRNA sequence
ccttgggggaaaatatgtgt

SEQ ID NO: 274510 - DNA, 20 bp, Artificial
  CRISPR gRNA sequence
ggaaaatatgtgtaggctgc

SEQ ID NO: 274511 - DNA, 20 bp, Artificial
  CRISPR gRNA sequence
gaaaatatgtgtaggctgcc

SEQ ID NO: 274512 - DNA, 20 bp, Artificial
  CRISPR gRNA sequence
atgtgtaggctgccaggttg

SEQ ID NO: 274513 - DNA, 20 bp, Artificial
  CRISPR gRNA sequence
tgtgtaggctgccaggttgt

SEQ ID NO: 274514 - DNA, 20 bp, Artificial
  CRISPR gRNA sequence
gtgtaggctgccaggttgta

SEQ ID NO: 274515 - DNA, 20 bp, Artificial
  CRISPR gRNA sequence
aggctgccaggttgtaggga

SEQ ID NO: 274516 - DNA, 20 bp, Artificial
  CRISPR gRNA sequence
ggctgccaggttgtagggaa

SEQ ID NO: 274517 - DNA, 20 bp, Artificial
  CRISPR gRNA sequence
ctgccaggttgtagggaaag

SEQ ID NO: 274518 - DNA, 20 bp, Artificial
  CRISPR gRNA sequence
aggagcctgaacttgatgtc

SEQ ID NO: 274519 - DNA, 20 bp, Artificial
  CRISPR gRNA sequence
ttgatgtccagtttgaatct

SEQ ID NO: 274520 - DNA, 20 bp, Artificial
  CRISPR gRNA sequence
catctgtatgaccgtacctc

SEQ ID NO: 274521 - DNA, 20 bp, Artificial
  CRISPR gRNA sequence
caagcaaatctcttaacctc

SEQ ID NO: 274522 - DNA, 20 bp, Artificial
  CRISPR gRNA sequence
aagcaaatctcttaacctct

SEQ ID NO: 274523 - DNA, 20 bp, Artificial
  CRISPR gRNA sequence
gcaaatctcttaacctctgg

SEQ ID NO: 274524 - DNA, 20 bp, Artificial
  CRISPR gRNA sequence
tcttaacctctgggagcctc

SEQ ID NO: 274525 - DNA, 20 bp, Artificial
  CRISPR gRNA sequence
ctggtttctctcccataaca

SEQ ID NO: 274526 - DNA, 20 bp, Artificial
  CRISPR gRNA sequence
tctctcccataacatggaaa

SEQ ID NO: 274527 - DNA, 20 bp, Artificial
  CRISPR gRNA sequence
atggaaatagatcttgctca

SEQ ID NO: 274528 - DNA, 20 bp, Artificial
  CRISPR gRNA sequence
ggaaatagatcttgctcata

SEQ ID NO: 274529 - DNA, 20 bp, Artificial
  CRISPR gRNA sequence
ttgctcatagagatttttat

SEQ ID NO: 274530 - DNA, 20 bp, Artificial
  CRISPR gRNA sequence
atagagatttttataagact

SEQ ID NO: 274531 - DNA, 20 bp, Artificial
  CRISPR gRNA sequence
tttataagactaagatgaaa

SEQ ID NO: 274532 - DNA, 20 bp, Artificial
  CRISPR gRNA sequence
tgcaaaacaacctgttgtat

SEQ ID NO: 274533 - DNA, 20 bp, Artificial
  CRISPR gRNA sequence
acaacctgttgtataagcgt

SEQ ID NO: 274534 - DNA, 20 bp, Artificial
  CRISPR gRNA sequence
caacctgttgtataagcgtc

SEQ ID NO: 274535 - DNA, 20 bp, Artificial
  CRISPR gRNA sequence
ttatatttccccctcctgcc

SEQ ID NO: 274536 - DNA, 20 bp, Artificial
  CRISPR gRNA sequence
tatatttccccctcctgccc

SEQ ID NO: 274537 - DNA, 20 bp, Artificial
  CRISPR gRNA sequence
cttgctttcctttattttta

SEQ ID NO: 274538 - DNA, 20 bp, Artificial
  CRISPR gRNA sequence
tatttttaaagataattttg

SEQ ID NO: 274539 - DNA, 20 bp, Artificial
  CRISPR gRNA sequence
ttgtagactaattcctatac

SEQ ID NO: 274540 - DNA, 20 bp, Artificial
  CRISPR gRNA sequence
ggtgttactctaaccttcac

SEQ ID NO: 274541 - DNA, 20 bp, Artificial
  CRISPR gRNA sequence
actctaaccttcacaagtca

SEQ ID NO: 274542 - DNA, 20 bp, Artificial
  CRISPR gRNA sequence
caagtcaaagctgaactgtt

SEQ ID NO: 274543 - DNA, 20 bp, Artificial
  CRISPR gRNA sequence
aagtcaaagctgaactgttt

SEQ ID NO: 274544 - DNA, 20 bp, Artificial
  CRISPR gRNA sequence
agtcaaagctgaactgttta

SEQ ID NO: 274545 - DNA, 20 bp, Artificial
  CRISPR gRNA sequence
tcaaagctgaactgtttagg

SEQ ID NO: 274546 - DNA, 20 bp, Artificial
  CRISPR gRNA sequence
caaagctgaactgtttaggg

SEQ ID NO: 274547 - DNA, 20 bp, Artificial
  CRISPR gRNA sequence
tagggaggcttataactacc

SEQ ID NO: 274548 - DNA, 20 bp, Artificial
  CRISPR gRNA sequence
agggaggcttataactacct

SEQ ID NO: 274549 - DNA, 20 bp, Artificial
  CRISPR gRNA sequence
aactacctgggacctgatat

SEQ ID NO: 274550 - DNA, 20 bp, Artificial
  CRISPR gRNA sequence
gggacctgatatcagtctct

SEQ ID NO: 274551 - DNA, 20 bp, Artificial
  CRISPR gRNA sequence
tggattctaatgtcccatgt

SEQ ID NO: 274552 - DNA, 20 bp, Artificial
  CRISPR gRNA sequence
ttctcttgcatgaaaatacc

SEQ ID NO: 274553 - DNA, 20 bp, Artificial
  CRISPR gRNA sequence
tctcttgcatgaaaatacct

SEQ ID NO: 274554 - DNA, 20 bp, Artificial
  CRISPR gRNA sequence
ctcttgcatgaaaatacctg

SEQ ID NO: 274555 - DNA, 20 bp, Artificial
  CRISPR gRNA sequence
tggggatttgtgactcacta

SEQ ID NO: 274556 - DNA, 20 bp, Artificial
  CRISPR gRNA sequence
gatttgtgactcactaaagc

SEQ ID NO: 274557 - DNA, 20 bp, Artificial
  CRISPR gRNA sequence
cactaaagctagtgctgtgt

SEQ ID NO: 274558 - DNA, 20 bp, Artificial
  CRISPR gRNA sequence
actaaagctagtgctgtgtt

SEQ ID NO: 274559 - DNA, 20 bp, Artificial
  CRISPR gRNA sequence
gctgtgttaggctctcttaa

SEQ ID NO: 274560 - DNA, 20 bp, Artificial
  CRISPR gRNA sequence
ctgtgttaggctctcttaac

SEQ ID NO: 274561 - DNA, 20 bp, Artificial
  CRISPR gRNA sequence
gttaggctctcttaacagga

SEQ ID NO: 274562 - DNA, 20 bp, Artificial
  CRISPR gRNA sequence
tcttaacaggatggacattc

SEQ ID NO: 274563 - DNA, 20 bp, Artificial
  CRISPR gRNA sequence
aggatggacattccagaccc

SEQ ID NO: 274564 - DNA, 20 bp, Artificial
  CRISPR gRNA sequence
aataattatctcattgtatg

SEQ ID NO: 274565 - DNA, 20 bp, Artificial
  CRISPR gRNA sequence
taattatctcattgtatgta

SEQ ID NO: 274566 - DNA, 20 bp, Artificial
  CRISPR gRNA sequence
tcattgtatgtagagtcatt

SEQ ID NO: 274567 - DNA, 20 bp, Artificial
  CRISPR gRNA sequence
agtcattaagaccaaatcta

SEQ ID NO: 274568 - DNA, 20 bp, Artificial
  CRISPR gRNA sequence
taagaccaaatctaaagtct

SEQ ID NO: 274569 - DNA, 20 bp, Artificial
  CRISPR gRNA sequence
aagaccaaatctaaagtctt

SEQ ID NO: 274570 - DNA, 20 bp, Artificial
  CRISPR gRNA sequence
tccgtttaccccattcatgt

SEQ ID NO: 274571 - DNA, 20 bp, Artificial
  CRISPR gRNA sequence
ccgtttaccccattcatgtg

SEQ ID NO: 274572 - DNA, 20 bp, Artificial
  CRISPR gRNA sequence
accccattcatgtgaggcac

SEQ ID NO: 274573 - DNA, 20 bp, Artificial
  CRISPR gRNA sequence
cactggaaaccatgccatgt

SEQ ID NO: 274574 - DNA, 20 bp, Artificial
  CRISPR gRNA sequence
actggaaaccatgccatgtg

SEQ ID NO: 274575 - DNA, 20 bp, Artificial
  CRISPR gRNA sequence
gccatgtgaggaacaattga

SEQ ID NO: 274576 - DNA, 20 bp, Artificial
  CRISPR gRNA sequence
aggaacaattgacagaactc

SEQ ID NO: 274577 - DNA, 20 bp, Artificial
  CRISPR gRNA sequence
ggaacaattgacagaactca

SEQ ID NO: 274578 - DNA, 20 bp, Artificial
  CRISPR gRNA sequence
gaacaattgacagaactcaa

SEQ ID NO: 274579 - DNA, 20 bp, Artificial
  CRISPR gRNA sequence
tgacagaactcaagggtatt

SEQ ID NO: 274580 - DNA, 20 bp, Artificial
  CRISPR gRNA sequence
actcaagggtatttagactg

SEQ ID NO: 274581 - DNA, 20 bp, Artificial
  CRISPR gRNA sequence
tcaagggtatttagactgaa

SEQ ID NO: 274582 - DNA, 20 bp, Artificial
  CRISPR gRNA sequence
ggtatttagactgaagagat

SEQ ID NO: 274583 - DNA, 20 bp, Artificial
  CRISPR gRNA sequence
tttagactgaagagatcagc

SEQ ID NO: 274584 - DNA, 20 bp, Artificial
  CRISPR gRNA sequence
tgaagagatcagctggaatg

SEQ ID NO: 274585 - DNA, 20 bp, Artificial
  CRISPR gRNA sequence
gagatcagctggaatgtgga

SEQ ID NO: 274586 - DNA, 20 bp, Artificial
  CRISPR gRNA sequence
ctggaatgtggaaagttaaa

SEQ ID NO: 274587 - DNA, 20 bp, Artificial
  CRISPR gRNA sequence
tggaaagttaaaaagctttg

SEQ ID NO: 274588 - DNA, 20 bp, Artificial
  CRISPR gRNA sequence
aagctttgaagctttttctg

SEQ ID NO: 274589 - DNA, 20 bp, Artificial
  CRISPR gRNA sequence
agctttgaagctttttctgt

SEQ ID NO: 274590 - DNA, 20 bp, Artificial
  CRISPR gRNA sequence
tttgaagctttttctgtagg

SEQ ID NO: 274591 - DNA, 20 bp, Artificial
  CRISPR gRNA sequence
gaagctttttctgtaggcag

SEQ ID NO: 274592 - DNA, 20 bp, Artificial
  CRISPR gRNA sequence
aagctttttctgtaggcagt

SEQ ID NO: 274593 - DNA, 20 bp, Artificial
  CRISPR gRNA sequence
agctttttctgtaggcagtg

SEQ ID NO: 274594 - DNA, 20 bp, Artificial
  CRISPR gRNA sequence
taggcagtggggtctcttct

SEQ ID NO: 274595 - DNA, 20 bp, Artificial
  CRISPR gRNA sequence
ggggtctcttctgagttttt

SEQ ID NO: 274596 - DNA, 20 bp, Artificial
  CRISPR gRNA sequence
gtctcttctgagtttttgag

SEQ ID NO: 274597 - DNA, 20 bp, Artificial
  CRISPR gRNA sequence
tctcttctgagtttttgagt

SEQ ID NO: 274598 - DNA, 20 bp, Artificial
  CRISPR gRNA sequence
tgagtgggaaaatgacatga

SEQ ID NO: 274599 - DNA, 20 bp, Artificial
  CRISPR gRNA sequence
agtgggaaaatgacatgaca

SEQ ID NO: 274600 - DNA, 20 bp, Artificial
  CRISPR gRNA sequence
gagtaattctttgtgaaatt

SEQ ID NO: 274601 - DNA, 20 bp, Artificial
  CRISPR gRNA sequence
aatttggctccatgattcgt

SEQ ID NO: 274602 - DNA, 20 bp, Artificial
  CRISPR gRNA sequence
ttggctccatgattcgtcag

SEQ ID NO: 274603 - DNA, 20 bp, Artificial
  CRISPR gRNA sequence
tggctccatgattcgtcagt

SEQ ID NO: 274604 - DNA, 20 bp, Artificial
  CRISPR gRNA sequence
ccatgattcgtcagtaggat

SEQ ID NO: 274605 - DNA, 20 bp, Artificial
  CRISPR gRNA sequence
cgtcagtaggatgagtctgt

SEQ ID NO: 274606 - DNA, 20 bp, Artificial
  CRISPR gRNA sequence
agtaggatgagtctgttagt

SEQ ID NO: 274607 - DNA, 20 bp, Artificial
  CRISPR gRNA sequence
taggatgagtctgttagtaa

SEQ ID NO: 274608 - DNA, 20 bp, Artificial
  CRISPR gRNA sequence
aggatgagtctgttagtaag

SEQ ID NO: 274609 - DNA, 20 bp, Artificial
  CRISPR gRNA sequence
atgagtctgttagtaagagg

SEQ ID NO: 274610 - DNA, 20 bp, Artificial
  CRISPR gRNA sequence
gagtctgttagtaagaggca

SEQ ID NO: 274611 - DNA, 20 bp, Artificial
  CRISPR gRNA sequence
aatgttaccgtgttaataca

SEQ ID NO: 274612 - DNA, 20 bp, Artificial
  CRISPR gRNA sequence
aacccatgtccatcaatact

SEQ ID NO: 274613 - DNA, 20 bp, Artificial
  CRISPR gRNA sequence
cccatgtccatcaatactga

SEQ ID NO: 274614 - DNA, 20 bp, Artificial
  CRISPR gRNA sequence
tgtccatcaatactgagaga

SEQ ID NO: 274615 - DNA, 20 bp, Artificial
  CRISPR gRNA sequence
tccatcaatactgagagata

SEQ ID NO: 274616 - DNA, 20 bp, Artificial
  CRISPR gRNA sequence
ccatcaatactgagagatag

SEQ ID NO: 274617 - DNA, 20 bp, Artificial
  CRISPR gRNA sequence
catcaatactgagagataga

SEQ ID NO: 274618 - DNA, 20 bp, Artificial
  CRISPR gRNA sequence
tagagggaaaaatgaatgat

SEQ ID NO: 274619 - DNA, 20 bp, Artificial
  CRISPR gRNA sequence
gaaaaatgaatgatcagaat

SEQ ID NO: 274620 - DNA, 20 bp, Artificial
  CRISPR gRNA sequence
aaatgaatgatcagaataag

SEQ ID NO: 274621 - DNA, 20 bp, Artificial
  CRISPR gRNA sequence
atcagaataagaagttacca

SEQ ID NO: 274622 - DNA, 20 bp, Artificial
  CRISPR gRNA sequence
tcagaataagaagttaccac

SEQ ID NO: 274623 - DNA, 20 bp, Artificial
  CRISPR gRNA sequence
aagttaccacaggaatattc

SEQ ID NO: 274624 - DNA, 20 bp, Artificial
  CRISPR gRNA sequence
tattcaagatgaactcaaat

SEQ ID NO: 274625 - DNA, 20 bp, Artificial
  CRISPR gRNA sequence
gaactcaaattagtgtttaa

SEQ ID NO: 274626 - DNA, 20 bp, Artificial
  CRISPR gRNA sequence
gtgtttaatagataatgaat

SEQ ID NO: 274627 - DNA, 20 bp, Artificial
  CRISPR gRNA sequence
tagataatgaattggctgac

SEQ ID NO: 274628 - DNA, 20 bp, Artificial
  CRISPR gRNA sequence
attggctgacaagacaattc

SEQ ID NO: 274629 - DNA, 20 bp, Artificial
  CRISPR gRNA sequence
gctgacaagacaattcaaga

SEQ ID NO: 274630 - DNA, 20 bp, Artificial
  CRISPR gRNA sequence
gacaagacaattcaagatgg

SEQ ID NO: 274631 - DNA, 20 bp, Artificial
  CRISPR gRNA sequence
gacaattcaagatggcagaa

SEQ ID NO: 274632 - DNA, 20 bp, Artificial
  CRISPR gRNA sequence
aagatggcagaatggaaaca

SEQ ID NO: 274633 - DNA, 20 bp, Artificial
  CRISPR gRNA sequence
gcagaatggaaacatggcaa

SEQ ID NO: 274634 - DNA, 20 bp, Artificial
  CRISPR gRNA sequence
gaatggaaacatggcaaaag

SEQ ID NO: 274635 - DNA, 20 bp, Artificial
  CRISPR gRNA sequence
atggaaacatggcaaaagaa

SEQ ID NO: 274636 - DNA, 20 bp, Artificial
  CRISPR gRNA sequence
tggaaacatggcaaaagaag

SEQ ID NO: 274637 - DNA, 20 bp, Artificial
  CRISPR gRNA sequence
gcaaaagaagaggttacatt

SEQ ID NO: 274638 - DNA, 20 bp, Artificial
  CRISPR gRNA sequence
tacattaagcaaattgcata

SEQ ID NO: 274639 - DNA, 20 bp, Artificial
  CRISPR gRNA sequence
acattaagcaaattgcatat

SEQ ID NO: 274640 - DNA, 20 bp, Artificial
  CRISPR gRNA sequence
cattaagcaaattgcatatg

SEQ ID NO: 274641 - DNA, 20 bp, Artificial
  CRISPR gRNA sequence
ttaagcaaattgcatatggg

SEQ ID NO: 274642 - DNA, 20 bp, Artificial
  CRISPR gRNA sequence
gcaaattgcatatggggaga

SEQ ID NO: 274643 - DNA, 20 bp, Artificial
  CRISPR gRNA sequence
caaattgcatatggggagaa

SEQ ID NO: 274644 - DNA, 20 bp, Artificial
  CRISPR gRNA sequence
aattgcatatggggagaaag

SEQ ID NO: 274645 - DNA, 20 bp, Artificial
  CRISPR gRNA sequence
ttgcatatggggagaaagga

SEQ ID NO: 274646 - DNA, 20 bp, Artificial
  CRISPR gRNA sequence
tgcatatggggagaaaggag

SEQ ID NO: 274647 - DNA, 20 bp, Artificial
  CRISPR gRNA sequence
gcatatggggagaaaggaga

SEQ ID NO: 274648 - DNA, 20 bp, Artificial
  CRISPR gRNA sequence
gggagaaaggagagggatgc

SEQ ID NO: 274649 - DNA, 20 bp, Artificial
  CRISPR gRNA sequence
ccagccatcttgtaactgtt

SEQ ID NO: 274650 - DNA, 20 bp, Artificial
  CRISPR gRNA sequence
aactgttcagcttaatctga

SEQ ID NO: 274651 - DNA, 20 bp, Artificial
  CRISPR gRNA sequence
ctgttcagcttaatctgaaa

SEQ ID NO: 274652 - DNA, 20 bp, Artificial
  CRISPR gRNA sequence
tgttcagcttaatctgaaag

SEQ ID NO: 274653 - DNA, 20 bp, Artificial
  CRISPR gRNA sequence
ttaatctgaaagaggttttt

SEQ ID NO: 274654 - DNA, 20 bp, Artificial
  CRISPR gRNA sequence
atctgaaagaggtttttaag

SEQ ID NO: 274655 - DNA, 20 bp, Artificial
  CRISPR gRNA sequence
tctgaaagaggtttttaaga

SEQ ID NO: 274656 - DNA, 20 bp, Artificial
  CRISPR gRNA sequence
aaagaggtttttaagaaggt

SEQ ID NO: 274657 - DNA, 20 bp, Artificial
  CRISPR gRNA sequence
aagaggtttttaagaaggtg

SEQ ID NO: 274658 - DNA, 20 bp, Artificial
  CRISPR gRNA sequence
aggtttttaagaaggtgagg

SEQ ID NO: 274659 - DNA, 20 bp, Artificial
  CRISPR gRNA sequence
tttttaagaaggtgaggtag

SEQ ID NO: 274660 - DNA, 20 bp, Artificial
  CRISPR gRNA sequence
ttttaagaaggtgaggtagt

SEQ ID NO: 274661 - DNA, 20 bp, Artificial
  CRISPR gRNA sequence
aggtgaggtagtgggtaaaa

SEQ ID NO: 274662 - DNA, 20 bp, Artificial
  CRISPR gRNA sequence
taaaacagcttaaatttgtt

SEQ ID NO: 274663 - DNA, 20 bp, Artificial
  CRISPR gRNA sequence
aaaacagcttaaatttgtta

SEQ ID NO: 274664 - DNA, 20 bp, Artificial
  CRISPR gRNA sequence
aaacagcttaaatttgttaa

SEQ ID NO: 274665 - DNA, 20 bp, Artificial
  CRISPR gRNA sequence
cagcttaaatttgttaaggg

SEQ ID NO: 274666 - DNA, 20 bp, Artificial
  CRISPR gRNA sequence
tccccacgatccatgtatcc

SEQ ID NO: 274667 - DNA, 20 bp, Artificial
  CRISPR gRNA sequence
ccacgatccatgtatcccag

SEQ ID NO: 274668 - DNA, 20 bp, Artificial
  CRISPR gRNA sequence
acgatccatgtatcccagaa

SEQ ID NO: 274669 - DNA, 20 bp, Artificial
  CRISPR gRNA sequence
atgtatcccagaagagatga

SEQ ID NO: 274670 - DNA, 20 bp, Artificial
  CRISPR gRNA sequence
gtatcccagaagagatgacg

SEQ ID NO: 274671 - DNA, 20 bp, Artificial
  CRISPR gRNA sequence
tatcccagaagagatgacgg

SEQ ID NO: 274672 - DNA, 20 bp, Artificial
  CRISPR gRNA sequence
gagatgacggaggctacctt

SEQ ID NO: 274673 - DNA, 20 bp, Artificial
  CRISPR gRNA sequence
aggctaccttcagatctttt

SEQ ID NO: 274674 - DNA, 20 bp, Artificial
  CRISPR gRNA sequence
ttttcagccccttgcttctg

SEQ ID NO: 274675 - DNA, 20 bp, Artificial
  CRISPR gRNA sequence
cttctgcggacactgttata

SEQ ID NO: 274676 - DNA, 20 bp, Artificial
  CRISPR gRNA sequence
ttctgcggacactgttatac

SEQ ID NO: 274677 - DNA, 20 bp, Artificial
  CRISPR gRNA sequence
tctgcggacactgttataca

SEQ ID NO: 274678 - DNA, 20 bp, Artificial
  CRISPR gRNA sequence
ctccttctctctctgcatct

SEQ ID NO: 274679 - DNA, 20 bp, Artificial
  CRISPR gRNA sequence
tccttctctctctgcatctt

SEQ ID NO: 274680 - DNA, 20 bp, Artificial
  CRISPR gRNA sequence
ccttctctctctgcatcttg

SEQ ID NO: 274681 - DNA, 20 bp, Artificial
  CRISPR gRNA sequence
tctctctgcatcttggggca

SEQ ID NO: 274682 - DNA, 20 bp, Artificial
  CRISPR gRNA sequence
tgcatcttggggcaaagcct

SEQ ID NO: 274683 - DNA, 20 bp, Artificial
  CRISPR gRNA sequence
catcttggggcaaagccttg

SEQ ID NO: 274684 - DNA, 20 bp, Artificial
  CRISPR gRNA sequence
tggggcaaagccttggagac

SEQ ID NO: 274685 - DNA, 20 bp, Artificial
  CRISPR gRNA sequence
gaacaaacaataaaaatgat

SEQ ID NO: 274686 - DNA, 20 bp, Artificial
  CRISPR gRNA sequence
aaacaataaaaatgataagt

SEQ ID NO: 274687 - DNA, 20 bp, Artificial
  CRISPR gRNA sequence
ccatatgttaatatttactt

SEQ ID NO: 274688 - DNA, 20 bp, Artificial
  CRISPR gRNA sequence
atgttaatatttactttagc

SEQ ID NO: 274689 - DNA, 20 bp, Artificial
  CRISPR gRNA sequence
tgttaatatttactttagca

SEQ ID NO: 274690 - DNA, 20 bp, Artificial
  CRISPR gRNA sequence
tatttactttagcaaggctt

SEQ ID NO: 274691 - DNA, 20 bp, Artificial
  CRISPR gRNA sequence
actttagcaaggcttcagac

SEQ ID NO: 274692 - DNA, 20 bp, Artificial
  CRISPR gRNA sequence
agcaaggcttcagactggct

SEQ ID NO: 274693 - DNA, 20 bp, Artificial
  CRISPR gRNA sequence
gcttcagactggcttagaac

SEQ ID NO: 274694 - DNA, 20 bp, Artificial
  CRISPR gRNA sequence
ttcagactggcttagaactg

SEQ ID NO: 274695 - DNA, 20 bp, Artificial
  CRISPR gRNA sequence
agactggcttagaactggag

SEQ ID NO: 274696 - DNA, 20 bp, Artificial
  CRISPR gRNA sequence
tggagcagttgttcttatac

SEQ ID NO: 274697 - DNA, 20 bp, Artificial
  CRISPR gRNA sequence
ggagcagttgttcttatacc

SEQ ID NO: 274698 - DNA, 20 bp, Artificial
  CRISPR gRNA sequence
gagcagttgttcttatacca

SEQ ID NO: 274699 - DNA, 20 bp, Artificial
  CRISPR gRNA sequence
agcagttgttcttataccag

SEQ ID NO: 274700 - DNA, 20 bp, Artificial
  CRISPR gRNA sequence
tccctctttacctctttgcc

SEQ ID NO: 274701 - DNA, 20 bp, Artificial
  CRISPR gRNA sequence
ccctctttacctctttgcca

SEQ ID NO: 274702 - DNA, 20 bp, Artificial
  CRISPR gRNA sequence
cctctttacctctttgccaa

SEQ ID NO: 274703 - DNA, 20 bp, Artificial
  CRISPR gRNA sequence
ctctttacctctttgccaag

SEQ ID NO: 274704 - DNA, 20 bp, Artificial
  CRISPR gRNA sequence
ctctttgccaaggggacatt

SEQ ID NO: 274705 - DNA, 20 bp, Artificial
  CRISPR gRNA sequence
aggggacatttggcaatgct

SEQ ID NO: 274706 - DNA, 20 bp, Artificial
  CRISPR gRNA sequence
ggggacatttggcaatgctt

SEQ ID NO: 274707 - DNA, 20 bp, Artificial
  CRISPR gRNA sequence
gggacatttggcaatgcttg

SEQ ID NO: 274708 - DNA, 20 bp, Artificial
  CRISPR gRNA sequence
gatatttttgattgtcgcaa

SEQ ID NO: 274709 - DNA, 20 bp, Artificial
  CRISPR gRNA sequence
atatttttgattgtcgcaac

SEQ ID NO: 274710 - DNA, 20 bp, Artificial
  CRISPR gRNA sequence
ttttgattgtcgcaacgggc

SEQ ID NO: 274711 - DNA, 20 bp, Artificial
  CRISPR gRNA sequence
tttgattgtcgcaacgggca

SEQ ID NO: 274712 - DNA, 20 bp, Artificial
  CRISPR gRNA sequence
ttgattgtcgcaacgggcaa

SEQ ID NO: 274713 - DNA, 20 bp, Artificial
  CRISPR gRNA sequence
tgattgtcgcaacgggcaag

SEQ ID NO: 274714 - DNA, 20 bp, Artificial
  CRISPR gRNA sequence
caacgggcaaggggtgctac

SEQ ID NO: 274715 - DNA, 20 bp, Artificial
  CRISPR gRNA sequence
caaggggtgctactggcatg

SEQ ID NO: 274716 - DNA, 20 bp, Artificial
  CRISPR gRNA sequence
gggtgctactggcatgtagt

SEQ ID NO: 274717 - DNA, 20 bp, Artificial
  CRISPR gRNA sequence
tgctactggcatgtagtgag

SEQ ID NO: 274718 - DNA, 20 bp, Artificial
  CRISPR gRNA sequence
ctactggcatgtagtgagta

SEQ ID NO: 274719 - DNA, 20 bp, Artificial
  CRISPR gRNA sequence
tactggcatgtagtgagtag

SEQ ID NO: 274720 - DNA, 20 bp, Artificial
  CRISPR gRNA sequence
gcatgtagtgagtagaggct

SEQ ID NO: 274721 - DNA, 20 bp, Artificial
  CRISPR gRNA sequence
catgtagtgagtagaggcta

SEQ ID NO: 274722 - DNA, 20 bp, Artificial
  CRISPR gRNA sequence
gtagtgagtagaggctaagg

SEQ ID NO: 274723 - DNA, 20 bp, Artificial
  CRISPR gRNA sequence
ggaagctgctaaacatccta

SEQ ID NO: 274724 - DNA, 20 bp, Artificial
  CRISPR gRNA sequence
gctaaacatcctacagtgca

SEQ ID NO: 274725 - DNA, 20 bp, Artificial
  CRISPR gRNA sequence
acatcctacagtgcacagaa

SEQ ID NO: 274726 - DNA, 20 bp, Artificial
  CRISPR gRNA sequence
cagaacagcactccaaaaca

SEQ ID NO: 274727 - DNA, 20 bp, Artificial
  CRISPR gRNA sequence
cccaaaatgccaataatgtt

SEQ ID NO: 274728 - DNA, 20 bp, Artificial
  CRISPR gRNA sequence
ccaaaatgccaataatgttg

SEQ ID NO: 274729 - DNA, 20 bp, Artificial
  CRISPR gRNA sequence
atgccaataatgttgaggat

SEQ ID NO: 274730 - DNA, 20 bp, Artificial
  CRISPR gRNA sequence
gccaataatgttgaggatga

SEQ ID NO: 274731 - DNA, 20 bp, Artificial
  CRISPR gRNA sequence
ggatgagagcccctgaatta

SEQ ID NO: 274732 - DNA, 20 bp, Artificial
  CRISPR gRNA sequence
gatgagagcccctgaattaa

SEQ ID NO: 274733 - DNA, 20 bp, Artificial
  CRISPR gRNA sequence
atgagagcccctgaattaaa

SEQ ID NO: 274734 - DNA, 20 bp, Artificial
  CRISPR gRNA sequence
tgagagcccctgaattaaag

SEQ ID NO: 274735 - DNA, 20 bp, Artificial
  CRISPR gRNA sequence
ctgaattaaaggggtaacac

SEQ ID NO: 274736 - DNA, 20 bp, Artificial
  CRISPR gRNA sequence
attaaaggggtaacactgga

SEQ ID NO: 274737 - DNA, 20 bp, Artificial
  CRISPR gRNA sequence
aaggggtaacactggatagt

SEQ ID NO: 274738 - DNA, 20 bp, Artificial
  CRISPR gRNA sequence
taacactggatagttggtat

SEQ ID NO: 274739 - DNA, 20 bp, Artificial
  CRISPR gRNA sequence
ttggtattagaaacatcctt

SEQ ID NO: 274740 - DNA, 20 bp, Artificial
  CRISPR gRNA sequence
agaaacatccttgagcccac

SEQ ID NO: 274741 - DNA, 20 bp, Artificial
  CRISPR gRNA sequence
agacctctttatcctaccct

SEQ ID NO: 274742 - DNA, 20 bp, Artificial
  CRISPR gRNA sequence
gacctctttatcctaccctt

SEQ ID NO: 274743 - DNA, 20 bp, Artificial
  CRISPR gRNA sequence
ctttatcctacccttgggat

SEQ ID NO: 274744 - DNA, 20 bp, Artificial
  CRISPR gRNA sequence
cccttgggataagttgttaa

SEQ ID NO: 274745 - DNA, 20 bp, Artificial
  CRISPR gRNA sequence
ttaacagcacatactctcta

SEQ ID NO: 274746 - DNA, 20 bp, Artificial
  CRISPR gRNA sequence
tactctctaaagaattcact

SEQ ID NO: 274747 - DNA, 20 bp, Artificial
  CRISPR gRNA sequence
ctaaagaattcactgagctt

SEQ ID NO: 274748 - DNA, 20 bp, Artificial
  CRISPR gRNA sequence
taaagaattcactgagcttt

SEQ ID NO: 274749 - DNA, 20 bp, Artificial
  CRISPR gRNA sequence
cactgagctttgggtttttt

SEQ ID NO: 274750 - DNA, 20 bp, Artificial
  CRISPR gRNA sequence
tttgggtttttttggtgcta

SEQ ID NO: 274751 - DNA, 20 bp, Artificial
  CRISPR gRNA sequence
gtttttttggtgctaaagcc

SEQ ID NO: 274752 - DNA, 20 bp, Artificial
  CRISPR gRNA sequence
tttttttggtgctaaagcct

SEQ ID NO: 274753 - DNA, 20 bp, Artificial
  CRISPR gRNA sequence
gtgctaaagcctgggaaaat

SEQ ID NO: 274754 - DNA, 20 bp, Artificial
  CRISPR gRNA sequence
ctaaagcctgggaaaatcag

SEQ ID NO: 274755 - DNA, 20 bp, Artificial
  CRISPR gRNA sequence
atcttccgattttatttgat

SEQ ID NO: 274756 - DNA, 20 bp, Artificial
  CRISPR gRNA sequence
gtgtacatgatttctactca

SEQ ID NO: 274757 - DNA, 20 bp, Artificial
  CRISPR gRNA sequence
tacatgatttctactcaaag

SEQ ID NO: 274758 - DNA, 20 bp, Artificial
  CRISPR gRNA sequence
acatgatttctactcaaaga

SEQ ID NO: 274759 - DNA, 20 bp, Artificial
  CRISPR gRNA sequence
catgatttctactcaaagaa

SEQ ID NO: 274760 - DNA, 20 bp, Artificial
  CRISPR gRNA sequence
atttctactcaaagaagggt

SEQ ID NO: 274761 - DNA, 20 bp, Artificial
  CRISPR gRNA sequence
gaagggttggtaccccttca

SEQ ID NO: 274762 - DNA, 20 bp, Artificial
  CRISPR gRNA sequence
gtaccccttcatagtgatta

SEQ ID NO: 274763 - DNA, 20 bp, Artificial
  CRISPR gRNA sequence
tagtgattatggccttattt

SEQ ID NO: 274764 - DNA, 20 bp, Artificial
  CRISPR gRNA sequence
tatggccttatttcggacca

SEQ ID NO: 274765 - DNA, 20 bp, Artificial
  CRISPR gRNA sequence
cttatttcggaccatagaac

SEQ ID NO: 274766 - DNA, 20 bp, Artificial
  CRISPR gRNA sequence
atttcggaccatagaactag

SEQ ID NO: 274767 - DNA, 20 bp, Artificial
  CRISPR gRNA sequence
agttcctcttcatttaatca

SEQ ID NO: 274768 - DNA, 20 bp, Artificial
  CRISPR gRNA sequence
ttcctcttcatttaatcata

SEQ ID NO: 274769 - DNA, 20 bp, Artificial
  CRISPR gRNA sequence
ttcatttaatcatagagatt

SEQ ID NO: 274770 - DNA, 20 bp, Artificial
  CRISPR gRNA sequence
tcatttaatcatagagattg

SEQ ID NO: 274771 - DNA, 20 bp, Artificial
  CRISPR gRNA sequence
catttaatcatagagattga

SEQ ID NO: 274772 - DNA, 20 bp, Artificial
  CRISPR gRNA sequence
ttaatcatagagattgaggg

SEQ ID NO: 274773 - DNA, 20 bp, Artificial
  CRISPR gRNA sequence
cagcatatgtctaacaccca

SEQ ID NO: 274774 - DNA, 20 bp, Artificial
  CRISPR gRNA sequence
acacccaaagtgtaaattca

SEQ ID NO: 274775 - DNA, 20 bp, Artificial
  CRISPR gRNA sequence
cacccaaagtgtaaattcat

SEQ ID NO: 274776 - DNA, 20 bp, Artificial
  CRISPR gRNA sequence
acccaaagtgtaaattcata

SEQ ID NO: 274777 - DNA, 20 bp, Artificial
  CRISPR gRNA sequence
attcatagggtaaaatatct

SEQ ID NO: 274778 - DNA, 20 bp, Artificial
  CRISPR gRNA sequence
ttagaaatctcttctttcat

SEQ ID NO: 274779 - DNA, 20 bp, Artificial
  CRISPR gRNA sequence
tcatccaaaaatgtattcta

SEQ ID NO: 274780 - DNA, 20 bp, Artificial
  CRISPR gRNA sequence
aaaatgtattctaaagaact

SEQ ID NO: 274781 - DNA, 20 bp, Artificial
  CRISPR gRNA sequence
attctaaagaactgagaaaa

SEQ ID NO: 274782 - DNA, 20 bp, Artificial
  CRISPR gRNA sequence
ctgagaaaatggacattttc

SEQ ID NO: 274783 - DNA, 20 bp, Artificial
  CRISPR gRNA sequence
tttccagacacctatgtgtg

SEQ ID NO: 274784 - DNA, 20 bp, Artificial
  CRISPR gRNA sequence
ctatgtgtgtggcactctac

SEQ ID NO: 274785 - DNA, 20 bp, Artificial
  CRISPR gRNA sequence
tatgtgtgtggcactctact

SEQ ID NO: 274786 - DNA, 20 bp, Artificial
  CRISPR gRNA sequence
tgtggcactctactaggcac

SEQ ID NO: 274787 - DNA, 20 bp, Artificial
  CRISPR gRNA sequence
tactaggcactggaattcca

SEQ ID NO: 274788 - DNA, 20 bp, Artificial
  CRISPR gRNA sequence
ggcactggaattccaaagac

SEQ ID NO: 274789 - DNA, 20 bp, Artificial
  CRISPR gRNA sequence
actggaattccaaagacaag

SEQ ID NO: 274790 - DNA, 20 bp, Artificial
  CRISPR gRNA sequence
attccaaagacaagaagtcc

SEQ ID NO: 274791 - DNA, 20 bp, Artificial
  CRISPR gRNA sequence
gacaagaagtcccagcactt

SEQ ID NO: 274792 - DNA, 20 bp, Artificial
  CRISPR gRNA sequence
acaagaagtcccagcacttt

SEQ ID NO: 274793 - DNA, 20 bp, Artificial
  CRISPR gRNA sequence
agaagtcccagcactttggg

SEQ ID NO: 274794 - DNA, 20 bp, Artificial
  CRISPR gRNA sequence
tcccagcactttgggaagcc

SEQ ID NO: 274795 - DNA, 20 bp, Artificial
  CRISPR gRNA sequence
cccagcactttgggaagcca

SEQ ID NO: 274796 - DNA, 20 bp, Artificial
  CRISPR gRNA sequence
agcactttgggaagccaagg

SEQ ID NO: 274797 - DNA, 20 bp, Artificial
  CRISPR gRNA sequence
gcactttgggaagccaaggc

SEQ ID NO: 274798 - DNA, 20 bp, Artificial
  CRISPR gRNA sequence
ctttgggaagccaaggcagg

SEQ ID NO: 274799 - DNA, 20 bp, Artificial
  CRISPR gRNA sequence
agccaaggcaggcggatcac

SEQ ID NO: 274800 - DNA, 20 bp, Artificial
  CRISPR gRNA sequence
gccaaggcaggcggatcacg

SEQ ID NO: 274801 - DNA, 20 bp, Artificial
  CRISPR gRNA sequence
aggcaggcggatcacgaggt

SEQ ID NO: 274802 - DNA, 20 bp, Artificial
  CRISPR gRNA sequence
ggcaggcggatcacgaggtc

SEQ ID NO: 274803 - DNA, 20 bp, Artificial
  CRISPR gRNA sequence
caggcggatcacgaggtcag

SEQ ID NO: 274804 - DNA, 20 bp, Artificial
  CRISPR gRNA sequence
gatcacgaggtcaggagatc

SEQ ID NO: 274805 - DNA, 20 bp, Artificial
  CRISPR gRNA sequence
tcaggagatcaagaccatcc

SEQ ID NO: 274806 - DNA, 20 bp, Artificial
  CRISPR gRNA sequence
caagaccatcctggccaaca

SEQ ID NO: 274807 - DNA, 20 bp, Artificial
  CRISPR gRNA sequence
ctaaaaatacaaaaaaaaat

SEQ ID NO: 274808 - DNA, 20 bp, Artificial
  CRISPR gRNA sequence
aaatacaaaaaaaaattagt

SEQ ID NO: 274809 - DNA, 20 bp, Artificial
  CRISPR gRNA sequence
aatacaaaaaaaaattagtc

SEQ ID NO: 274810 - DNA, 20 bp, Artificial
  CRISPR gRNA sequence
aaaaaaaaattagtcaggcg

SEQ ID NO: 274811 - DNA, 20 bp, Artificial
  CRISPR gRNA sequence
aaaaaattagtcaggcgtgg

SEQ ID NO: 274812 - DNA, 20 bp, Artificial
  CRISPR gRNA sequence
ggcgtggcagcacgcacctg

SEQ ID NO: 274813 - DNA, 20 bp, Artificial
  CRISPR gRNA sequence
gcagcacgcacctgtagtcc

SEQ ID NO: 274814 - DNA, 20 bp, Artificial
  CRISPR gRNA sequence
cacctgtagtcccagctact

SEQ ID NO: 274815 - DNA, 20 bp, Artificial
  CRISPR gRNA sequence
acctgtagtcccagctactc

SEQ ID NO: 274816 - DNA, 20 bp, Artificial
  CRISPR gRNA sequence
ctgtagtcccagctactcag

SEQ ID NO: 274817 - DNA, 20 bp, Artificial
  CRISPR gRNA sequence
tgtagtcccagctactcagg

SEQ ID NO: 274818 - DNA, 20 bp, Artificial
  CRISPR gRNA sequence
tcccagctactcaggaggct

SEQ ID NO: 274819 - DNA, 20 bp, Artificial
  CRISPR gRNA sequence
cccagctactcaggaggctg

SEQ ID NO: 274820 - DNA, 20 bp, Artificial
  CRISPR gRNA sequence
gctactcaggaggctgaggc

SEQ ID NO: 274821 - DNA, 20 bp, Artificial
  CRISPR gRNA sequence
gccggataattgcttgaacc

SEQ ID NO: 274822 - DNA, 20 bp, Artificial
  CRISPR gRNA sequence
ccggataattgcttgaacct

SEQ ID NO: 274823 - DNA, 20 bp, Artificial
  CRISPR gRNA sequence
ggataattgcttgaacctgg

SEQ ID NO: 274824 - DNA, 20 bp, Artificial
  CRISPR gRNA sequence
gataattgcttgaacctggg

SEQ ID NO: 274825 - DNA, 20 bp, Artificial
  CRISPR gRNA sequence
aattgcttgaacctgggagg

SEQ ID NO: 274826 - DNA, 20 bp, Artificial
  CRISPR gRNA sequence
ttgcttgaacctgggaggcg

SEQ ID NO: 274827 - DNA, 20 bp, Artificial
  CRISPR gRNA sequence
tgcttgaacctgggaggcgg

SEQ ID NO: 274828 - DNA, 20 bp, Artificial
  CRISPR gRNA sequence
gaacctgggaggcggaggtg

SEQ ID NO: 274829 - DNA, 20 bp, Artificial
  CRISPR gRNA sequence
ctgggaggcggaggtgcagt

SEQ ID NO: 274830 - DNA, 20 bp, Artificial
  CRISPR gRNA sequence
aggcggaggtgcagtgagct

SEQ ID NO: 274831 - DNA, 20 bp, Artificial
  CRISPR gRNA sequence
gaggtgcagtgagctgagat

SEQ ID NO: 274832 - DNA, 20 bp, Artificial
  CRISPR gRNA sequence
aggtgcagtgagctgagatc

SEQ ID NO: 274833 - DNA, 20 bp, Artificial
  CRISPR gRNA sequence
ggtgcagtgagctgagatcg

SEQ ID NO: 274834 - DNA, 20 bp, Artificial
  CRISPR gRNA sequence
tgagatcggggcatacactc

SEQ ID NO: 274835 - DNA, 20 bp, Artificial
  CRISPR gRNA sequence
tcggggcatacactccagcc

SEQ ID NO: 274836 - DNA, 20 bp, Artificial
  CRISPR gRNA sequence
cggggcatacactccagcct

SEQ ID NO: 274837 - DNA, 20 bp, Artificial
  CRISPR gRNA sequence
ggcatacactccagcctggg

SEQ ID NO: 274838 - DNA, 20 bp, Artificial
  CRISPR gRNA sequence
atacactccagcctgggtgg

SEQ ID NO: 274839 - DNA, 20 bp, Artificial
  CRISPR gRNA sequence
acactccagcctgggtggca

SEQ ID NO: 274840 - DNA, 20 bp, Artificial
  CRISPR gRNA sequence
tccagcctgggtggcagagt

SEQ ID NO: 274841 - DNA, 20 bp, Artificial
  CRISPR gRNA sequence
actccatctcaaaaaaaaaa

SEQ ID NO: 274842 - DNA, 20 bp, Artificial
  CRISPR gRNA sequence
ctcaaaaaaaaaaaagaact

SEQ ID NO: 274843 - DNA, 20 bp, Artificial
  CRISPR gRNA sequence
aaaaaaaaagaactaagaat

SEQ ID NO: 274844 - DNA, 20 bp, Artificial
  CRISPR gRNA sequence
taagaattggtttgtgtttt

SEQ ID NO: 274845 - DNA, 20 bp, Artificial
  CRISPR gRNA sequence
aattggtttgtgttttgaga

SEQ ID NO: 274846 - DNA, 20 bp, Artificial
  CRISPR gRNA sequence
ttggtttgtgttttgagatg

SEQ ID NO: 274847 - DNA, 20 bp, Artificial
  CRISPR gRNA sequence
tggagtctcactctgtcacc

SEQ ID NO: 274848 - DNA, 20 bp, Artificial
  CRISPR gRNA sequence
ggagtctcactctgtcaccc

SEQ ID NO: 274849 - DNA, 20 bp, Artificial
  CRISPR gRNA sequence
tctcactctgtcacccaggc

SEQ ID NO: 274850 - DNA, 20 bp, Artificial
  CRISPR gRNA sequence
tcactctgtcacccaggctg

SEQ ID NO: 274851 - DNA, 20 bp, Artificial
  CRISPR gRNA sequence
tcacccaggctggagtgcaa

SEQ ID NO: 274852 - DNA, 20 bp, Artificial
  CRISPR gRNA sequence
ggagtgcaatggcatgatct

SEQ ID NO: 274853 - DNA, 20 bp, Artificial
  CRISPR gRNA sequence
ggcatgatcttggctcactg

SEQ ID NO: 274854 - DNA, 20 bp, Artificial
  CRISPR gRNA sequence
tcactgcagtctccgcctcc

SEQ ID NO: 274855 - DNA, 20 bp, Artificial
  CRISPR gRNA sequence
cactgcagtctccgcctcct

SEQ ID NO: 274856 - DNA, 20 bp, Artificial
  CRISPR gRNA sequence
gtctccgcctcctgggttcc

SEQ ID NO: 274857 - DNA, 20 bp, Artificial
  CRISPR gRNA sequence
tctccgcctcctgggttcct

SEQ ID NO: 274858 - DNA, 20 bp, Artificial
  CRISPR gRNA sequence
cctcctgggttcctgggttc

SEQ ID NO: 274859 - DNA, 20 bp, Artificial
  CRISPR gRNA sequence
ttcaagcaattctcctgctt

SEQ ID NO: 274860 - DNA, 20 bp, Artificial
  CRISPR gRNA sequence
ttctcctgcttcagcctcct

SEQ ID NO: 274861 - DNA, 20 bp, Artificial
  CRISPR gRNA sequence
tcctgcttcagcctcctgag

SEQ ID NO: 274862 - DNA, 20 bp, Artificial
  CRISPR gRNA sequence
gcttcagcctcctgagtagc

SEQ ID NO: 274863 - DNA, 20 bp, Artificial
  CRISPR gRNA sequence
cttcagcctcctgagtagct

SEQ ID NO: 274864 - DNA, 20 bp, Artificial
  CRISPR gRNA sequence
ctcctgagtagctaggacta

SEQ ID NO: 274865 - DNA, 20 bp, Artificial
  CRISPR gRNA sequence
tcctgagtagctaggactac

SEQ ID NO: 274866 - DNA, 20 bp, Artificial
  CRISPR gRNA sequence
caggtgcacgccaccatgcc

SEQ ID NO: 274867 - DNA, 20 bp, Artificial
  CRISPR gRNA sequence
ctggctaatttttgtatttt

SEQ ID NO: 274868 - DNA, 20 bp, Artificial
  CRISPR gRNA sequence
gctaatttttgtatttttag

SEQ ID NO: 274869 - DNA, 20 bp, Artificial
  CRISPR gRNA sequence
taatttttgtatttttagta

SEQ ID NO: 274870 - DNA, 20 bp, Artificial
  CRISPR gRNA sequence
ttttgtatttttagtagaga

SEQ ID NO: 274871 - DNA, 20 bp, Artificial
  CRISPR gRNA sequence
ttgtatttttagtagagaca

SEQ ID NO: 274872 - DNA, 20 bp, Artificial
  CRISPR gRNA sequence
gagacagagtttcaccatgt

SEQ ID NO: 274873 - DNA, 20 bp, Artificial
  CRISPR gRNA sequence
cagagtttcaccatgttggc

SEQ ID NO: 274874 - DNA, 20 bp, Artificial
  CRISPR gRNA sequence
agagtttcaccatgttggcc

SEQ ID NO: 274875 - DNA, 20 bp, Artificial
  CRISPR gRNA sequence
tttcaccatgttggccaggc

SEQ ID NO: 274876 - DNA, 20 bp, Artificial
  CRISPR gRNA sequence
ggtctcgaactcctgacctt

SEQ ID NO: 274877 - DNA, 20 bp, Artificial
  CRISPR gRNA sequence
cttaagtgatccacctgcct

SEQ ID NO: 274878 - DNA, 20 bp, Artificial
  CRISPR gRNA sequence
ccacctgccttggcctccca

SEQ ID NO: 274879 - DNA, 20 bp, Artificial
  CRISPR gRNA sequence
gccttggcctcccaaagtgc

SEQ ID NO: 274880 - DNA, 20 bp, Artificial
  CRISPR gRNA sequence
ccttggcctcccaaagtgct

SEQ ID NO: 274881 - DNA, 20 bp, Artificial
  CRISPR gRNA sequence
ctcccaaagtgctgggatta

SEQ ID NO: 274882 - DNA, 20 bp, Artificial
  CRISPR gRNA sequence
tcccaaagtgctgggattac

SEQ ID NO: 274883 - DNA, 20 bp, Artificial
  CRISPR gRNA sequence
agtgctgggattacaggcat

SEQ ID NO: 274884 - DNA, 20 bp, Artificial
  CRISPR gRNA sequence
caggcatgagccaccccacc

SEQ ID NO: 274885 - DNA, 20 bp, Artificial
  CRISPR gRNA sequence
tgagccaccccacccagccc

SEQ ID NO: 274886 - DNA, 20 bp, Artificial
  CRISPR gRNA sequence
ccccacccagcccaagaact

SEQ ID NO: 274887 - DNA, 20 bp, Artificial
  CRISPR gRNA sequence
ccagcccaagaactgagaat

SEQ ID NO: 274888 - DNA, 20 bp, Artificial
  CRISPR gRNA sequence
cccaagaactgagaattggt

SEQ ID NO: 274889 - DNA, 20 bp, Artificial
  CRISPR gRNA sequence
agaattggtgagatcacctg

SEQ ID NO: 274890 - DNA, 20 bp, Artificial
  CRISPR gRNA sequence
tgagatcacctgtagccatg

SEQ ID NO: 274891 - DNA, 20 bp, Artificial
  CRISPR gRNA sequence
atgtagtttctcaactgtat

SEQ ID NO: 274892 - DNA, 20 bp, Artificial
  CRISPR gRNA sequence
agtgcatcttgccctcctcc

SEQ ID NO: 274893 - DNA, 20 bp, Artificial
  CRISPR gRNA sequence
tcctccaagaaaatgattct

SEQ ID NO: 274894 - DNA, 20 bp, Artificial
  CRISPR gRNA sequence
ctctaactccaaatcaaaat

SEQ ID NO: 274895 - DNA, 20 bp, Artificial
  CRISPR gRNA sequence
ccaaatcaaaattagaatat

SEQ ID NO: 274896 - DNA, 20 bp, Artificial
  CRISPR gRNA sequence
aatcaaaattagaatatcag

SEQ ID NO: 274897 - DNA, 20 bp, Artificial
  CRISPR gRNA sequence
atcaaaattagaatatcagc

SEQ ID NO: 274898 - DNA, 20 bp, Artificial
  CRISPR gRNA sequence
aaattagaatatcagcagga

SEQ ID NO: 274899 - DNA, 20 bp, Artificial
  CRISPR gRNA sequence
ttagaatatcagcaggatgg

SEQ ID NO: 274900 - DNA, 20 bp, Artificial
  CRISPR gRNA sequence
tatcagcaggatggtggcca

SEQ ID NO: 274901 - DNA, 20 bp, Artificial
  CRISPR gRNA sequence
cagcaggatggtggccatgg

SEQ ID NO: 274902 - DNA, 20 bp, Artificial
  CRISPR gRNA sequence
aggatggtggccatggaagt

SEQ ID NO: 274903 - DNA, 20 bp, Artificial
  CRISPR gRNA sequence
catggaagttggaattcact

SEQ ID NO: 274904 - DNA, 20 bp, Artificial
  CRISPR gRNA sequence
atggaagttggaattcacta

SEQ ID NO: 274905 - DNA, 20 bp, Artificial
  CRISPR gRNA sequence
ggaagttggaattcactaag

SEQ ID NO: 274906 - DNA, 20 bp, Artificial
  CRISPR gRNA sequence
aactcacctgccaaatcgac

SEQ ID NO: 274907 - DNA, 20 bp, Artificial
  CRISPR gRNA sequence
actagcccttaaaaaaaaat

SEQ ID NO: 274908 - DNA, 20 bp, Artificial
  CRISPR gRNA sequence
aaaaaaattagaatatcatt

SEQ ID NO: 274909 - DNA, 20 bp, Artificial
  CRISPR gRNA sequence
attagaatatcatttagcat

SEQ ID NO: 274910 - DNA, 20 bp, Artificial
  CRISPR gRNA sequence
catcagaaacgttttcaaat

SEQ ID NO: 274911 - DNA, 20 bp, Artificial
  CRISPR gRNA sequence
agaaacgttttcaaattagt

SEQ ID NO: 274912 - DNA, 20 bp, Artificial
  CRISPR gRNA sequence
tcaaattagttagcaaaccc

SEQ ID NO: 274913 - DNA, 20 bp, Artificial
  CRISPR gRNA sequence
ccagtctccaaaaatatata

SEQ ID NO: 274914 - DNA, 20 bp, Artificial
  CRISPR gRNA sequence
tctccaaaaatatataaagt

SEQ ID NO: 274915 - DNA, 20 bp, Artificial
  CRISPR gRNA sequence
ctccaaaaatatataaagtc

SEQ ID NO: 274916 - DNA, 20 bp, Artificial
  CRISPR gRNA sequence
tccaaaaatatataaagtca

SEQ ID NO: 274917 - DNA, 20 bp, Artificial
  CRISPR gRNA sequence
aaagtcagggaaaaaataaa

SEQ ID NO: 274918 - DNA, 20 bp, Artificial
  CRISPR gRNA sequence
aaaaaataaacagactaaac

SEQ ID NO: 274919 - DNA, 20 bp, Artificial
  CRISPR gRNA sequence
actaaactagaatgtgtctt

SEQ ID NO: 274920 - DNA, 20 bp, Artificial
  CRISPR gRNA sequence
ctaaactagaatgtgtcttg

SEQ ID NO: 274921 - DNA, 20 bp, Artificial
  CRISPR gRNA sequence
taaactagaatgtgtcttga

SEQ ID NO: 274922 - DNA, 20 bp, Artificial
  CRISPR gRNA sequence
actagaatgtgtcttgaggg

SEQ ID NO: 274923 - DNA, 20 bp, Artificial
  CRISPR gRNA sequence
acttcttgtcattgtaattc

SEQ ID NO: 274924 - DNA, 20 bp, Artificial
  CRISPR gRNA sequence
gtcattgtaattccagtgcc

SEQ ID NO: 274925 - DNA, 20 bp, Artificial
  CRISPR gRNA sequence
attgtaattccagtgcctag

SEQ ID NO: 274926 - DNA, 20 bp, Artificial
  CRISPR gRNA sequence
tgtaattccagtgcctagta

SEQ ID NO: 274927 - DNA, 20 bp, Artificial
  CRISPR gRNA sequence
ctagtagagtgccacacacg

SEQ ID NO: 274928 - DNA, 20 bp, Artificial
  CRISPR gRNA sequence
tagtagagtgccacacacgt

SEQ ID NO: 274929 - DNA, 20 bp, Artificial
  CRISPR gRNA sequence
gtagagtgccacacacgtag

SEQ ID NO: 274930 - DNA, 20 bp, Artificial
  CRISPR gRNA sequence
tagagtgccacacacgtagg

SEQ ID NO: 274931 - DNA, 20 bp, Artificial
  CRISPR gRNA sequence
ccacacacgtaggaggtgtc

SEQ ID NO: 274932 - DNA, 20 bp, Artificial
  CRISPR gRNA sequence
ggaggtgtccggaaaatgtc

SEQ ID NO: 274933 - DNA, 20 bp, Artificial
  CRISPR gRNA sequence
gaaaatgtccagtgaatgaa

SEQ ID NO: 274934 - DNA, 20 bp, Artificial
  CRISPR gRNA sequence
gtgaatgaacagaacttgtt

SEQ ID NO: 274935 - DNA, 20 bp, Artificial
  CRISPR gRNA sequence
tgaacagaacttgttgagac

SEQ ID NO: 274936 - DNA, 20 bp, Artificial
  CRISPR gRNA sequence
agaacttgttgagacaagta

SEQ ID NO: 274937 - DNA, 20 bp, Artificial
  CRISPR gRNA sequence
gaacttgttgagacaagtaa

SEQ ID NO: 274938 - DNA, 20 bp, Artificial
  CRISPR gRNA sequence
acttgttgagacaagtaaag

SEQ ID NO: 274939 - DNA, 20 bp, Artificial
  CRISPR gRNA sequence
aggagatgctcatgtttcca

SEQ ID NO: 274940 - DNA, 20 bp, Artificial
  CRISPR gRNA sequence
ggagatgctcatgtttccat

SEQ ID NO: 274941 - DNA, 20 bp, Artificial
  CRISPR gRNA sequence
cataggcttgctgtaaacat

SEQ ID NO: 274942 - DNA, 20 bp, Artificial
  CRISPR gRNA sequence
aggcttgctgtaaacatgag

SEQ ID NO: 274943 - DNA, 20 bp, Artificial
  CRISPR gRNA sequence
ctgtaaacatgagaagcgaa

SEQ ID NO: 274944 - DNA, 20 bp, Artificial
  CRISPR gRNA sequence
tgtaaacatgagaagcgaat

SEQ ID NO: 274945 - DNA, 20 bp, Artificial
  CRISPR gRNA sequence
aagcgaataggctaaaacct

SEQ ID NO: 274946 - DNA, 20 bp, Artificial
  CRISPR gRNA sequence
gcgaataggctaaaacctca

SEQ ID NO: 274947 - DNA, 20 bp, Artificial
  CRISPR gRNA sequence
gaataggctaaaacctcaga

SEQ ID NO: 274948 - DNA, 20 bp, Artificial
  CRISPR gRNA sequence
ctcagagagatgccgaacca

SEQ ID NO: 274949 - DNA, 20 bp, Artificial
  CRISPR gRNA sequence
gatgccgaaccatggtaata

SEQ ID NO: 274950 - DNA, 20 bp, Artificial
  CRISPR gRNA sequence
ggtaataaagtttgatcttc

SEQ ID NO: 274951 - DNA, 20 bp, Artificial
  CRISPR gRNA sequence
aagtttgatcttccagaatt

SEQ ID NO: 274952 - DNA, 20 bp, Artificial
  CRISPR gRNA sequence
tgatcttccagaattgagat

SEQ ID NO: 274953 - DNA, 20 bp, Artificial
  CRISPR gRNA sequence
gatcttccagaattgagatc

SEQ ID NO: 274954 - DNA, 20 bp, Artificial
  CRISPR gRNA sequence
cagaattgagatcaggatga

SEQ ID NO: 274955 - DNA, 20 bp, Artificial
  CRISPR gRNA sequence
agatcaggatgatggtatga

SEQ ID NO: 274956 - DNA, 20 bp, Artificial
  CRISPR gRNA sequence
tgatggtatgatagtactta

SEQ ID NO: 274957 - DNA, 20 bp, Artificial
  CRISPR gRNA sequence
tggtatgatagtacttacag

SEQ ID NO: 274958 - DNA, 20 bp, Artificial
  CRISPR gRNA sequence
ggtatgatagtacttacagt

SEQ ID NO: 274959 - DNA, 20 bp, Artificial
  CRISPR gRNA sequence
tgatagtacttacagtaggt

SEQ ID NO: 274960 - DNA, 20 bp, Artificial
  CRISPR gRNA sequence
gatagtacttacagtaggtc

SEQ ID NO: 274961 - DNA, 20 bp, Artificial
  CRISPR gRNA sequence
agtacttacagtaggtcagg

SEQ ID NO: 274962 - DNA, 20 bp, Artificial
  CRISPR gRNA sequence
tcacaaaaattccatttact

SEQ ID NO: 274963 - DNA, 20 bp, Artificial
  CRISPR gRNA sequence
aaattccatttactgagatt

SEQ ID NO: 274964 - DNA, 20 bp, Artificial
  CRISPR gRNA sequence
aattccatttactgagatta

SEQ ID NO: 274965 - DNA, 20 bp, Artificial
  CRISPR gRNA sequence
atttactgagattaaggtaa

SEQ ID NO: 274966 - DNA, 20 bp, Artificial
  CRISPR gRNA sequence
ctgagattaaggtaatggcc

SEQ ID NO: 274967 - DNA, 20 bp, Artificial
  CRISPR gRNA sequence
tgagattaaggtaatggccc

SEQ ID NO: 274968 - DNA, 20 bp, Artificial
  CRISPR gRNA sequence
attaaggtaatggcccagga

SEQ ID NO: 274969 - DNA, 20 bp, Artificial
  CRISPR gRNA sequence
ttaaggtaatggcccaggat

SEQ ID NO: 274970 - DNA, 20 bp, Artificial
  CRISPR gRNA sequence
aaggtaatggcccaggatgg

SEQ ID NO: 274971 - DNA, 20 bp, Artificial
  CRISPR gRNA sequence
gtaatggcccaggatgggag

SEQ ID NO: 274972 - DNA, 20 bp, Artificial
  CRISPR gRNA sequence
taatggcccaggatgggagc

SEQ ID NO: 274973 - DNA, 20 bp, Artificial
  CRISPR gRNA sequence
ccaggatgggagcaggttat

SEQ ID NO: 274974 - DNA, 20 bp, Artificial
  CRISPR gRNA sequence
caggatgggagcaggttatc

SEQ ID NO: 274975 - DNA, 20 bp, Artificial
  CRISPR gRNA sequence
atcaggaaaatgctcttgct

SEQ ID NO: 274976 - DNA, 20 bp, Artificial
  CRISPR gRNA sequence
aaaatgctcttgcttggcta

SEQ ID NO: 274977 - DNA, 20 bp, Artificial
  CRISPR gRNA sequence
aatgctcttgcttggctatg

SEQ ID NO: 274978 - DNA, 20 bp, Artificial
  CRISPR gRNA sequence
atgctcttgcttggctatgg

SEQ ID NO: 274979 - DNA, 20 bp, Artificial
  CRISPR gRNA sequence
tgctcttgcttggctatgga

SEQ ID NO: 274980 - DNA, 20 bp, Artificial
  CRISPR gRNA sequence
ttgcttggctatggagggaa

SEQ ID NO: 274981 - DNA, 20 bp, Artificial
  CRISPR gRNA sequence
tggagggaaaagaataatgt

SEQ ID NO: 274982 - DNA, 20 bp, Artificial
  CRISPR gRNA sequence
cttttctattgatgcaactg

SEQ ID NO: 274983 - DNA, 20 bp, Artificial
  CRISPR gRNA sequence
tttctattgatgcaactgtg

SEQ ID NO: 274984 - DNA, 20 bp, Artificial
  CRISPR gRNA sequence
actgtggagtattctttgcc

SEQ ID NO: 274985 - DNA, 20 bp, Artificial
  CRISPR gRNA sequence
tggagtattctttgcctggt

SEQ ID NO: 274986 - DNA, 20 bp, Artificial
  CRISPR gRNA sequence
tctttgcctggtcagctctc

SEQ ID NO: 274987 - DNA, 20 bp, Artificial
  CRISPR gRNA sequence
ctggtcagctctccagtatg

SEQ ID NO: 274988 - DNA, 20 bp, Artificial
  CRISPR gRNA sequence
gctctccagtatgcagctgc

SEQ ID NO: 274989 - DNA, 20 bp, Artificial
  CRISPR gRNA sequence
ttcttgcataattcttcaat

SEQ ID NO: 274990 - DNA, 20 bp, Artificial
  CRISPR gRNA sequence
tcttgcataattcttcaatc

SEQ ID NO: 274991 - DNA, 20 bp, Artificial
  CRISPR gRNA sequence
ttcaatcaggcacatacttg

SEQ ID NO: 274992 - DNA, 20 bp, Artificial
  CRISPR gRNA sequence
tcaatcaggcacatacttgt

SEQ ID NO: 274993 - DNA, 20 bp, Artificial
  CRISPR gRNA sequence
acatacttgtgggcaactaa

SEQ ID NO: 274994 - DNA, 20 bp, Artificial
  CRISPR gRNA sequence
acttgtgggcaactaatagt

SEQ ID NO: 274995 - DNA, 20 bp, Artificial
  CRISPR gRNA sequence
agtcagatgtcacatattaa

SEQ ID NO: 274996 - DNA, 20 bp, Artificial
  CRISPR gRNA sequence
gtcacatattaaaagtgaaa

SEQ ID NO: 274997 - DNA, 20 bp, Artificial
  CRISPR gRNA sequence
tttgaatgtctgcatttact

SEQ ID NO: 274998 - DNA, 20 bp, Artificial
  CRISPR gRNA sequence
atgtctgcatttactgagtt

SEQ ID NO: 274999 - DNA, 20 bp, Artificial
  CRISPR gRNA sequence
ttactgagttaagttgacat

SEQ ID NO: 275000 - DNA, 20 bp, Artificial
  CRISPR gRNA sequence
tactgagttaagttgacata

SEQ ID NO: 275001 - DNA, 20 bp, Artificial
  CRISPR gRNA sequence
tgagttaagttgacataagg

SEQ ID NO: 275002 - DNA, 20 bp, Artificial
  CRISPR gRNA sequence
gttgacataaggaagattct

SEQ ID NO: 275003 - DNA, 20 bp, Artificial
  CRISPR gRNA sequence
ttgacataaggaagattcta

SEQ ID NO: 275004 - DNA, 20 bp, Artificial
  CRISPR gRNA sequence
attctaaggaaatcttttac

SEQ ID NO: 275005 - DNA, 20 bp, Artificial
  CRISPR gRNA sequence
atcttttacaagccatcttg

SEQ ID NO: 275006 - DNA, 20 bp, Artificial
  CRISPR gRNA sequence
cttgcagtatctcactttta

SEQ ID NO: 275007 - DNA, 20 bp, Artificial
  CRISPR gRNA sequence
aactatgtgttactactaac

SEQ ID NO: 275008 - DNA, 20 bp, Artificial
  CRISPR gRNA sequence
aactggttgatgttgtgttc

SEQ ID NO: 275009 - DNA, 20 bp, Artificial
  CRISPR gRNA sequence
actggttgatgttgtgttct

SEQ ID NO: 275010 - DNA, 20 bp, Artificial
  CRISPR gRNA sequence
atactttatttttccttctc

SEQ ID NO: 275011 - DNA, 20 bp, Artificial
  CRISPR gRNA sequence
tcacacacacccttacctca

SEQ ID NO: 275012 - DNA, 20 bp, Artificial
  CRISPR gRNA sequence
cacacacccttacctcacag

SEQ ID NO: 275013 - DNA, 20 bp, Artificial
  CRISPR gRNA sequence
acctcacagtagctgcccta

SEQ ID NO: 275014 - DNA, 20 bp, Artificial
  CRISPR gRNA sequence
cagtagctgccctaaagcta

SEQ ID NO: 275015 - DNA, 20 bp, Artificial
  CRISPR gRNA sequence
agtagctgccctaaagctac

SEQ ID NO: 275016 - DNA, 20 bp, Artificial
  CRISPR gRNA sequence
tagctgccctaaagctacag

SEQ ID NO: 275017 - DNA, 20 bp, Artificial
  CRISPR gRNA sequence
agccactttgcattcacttt

SEQ ID NO: 275018 - DNA, 20 bp, Artificial
  CRISPR gRNA sequence
tttgcattcactttcggata

SEQ ID NO: 275019 - DNA, 20 bp, Artificial
  CRISPR gRNA sequence
ttgcattcactttcggatac

SEQ ID NO: 275020 - DNA, 20 bp, Artificial
  CRISPR gRNA sequence
gatacaggtttttcaccctc

SEQ ID NO: 275021 - DNA, 20 bp, Artificial
  CRISPR gRNA sequence
gtttttcaccctctagctac

SEQ ID NO: 275022 - DNA, 20 bp, Artificial
  CRISPR gRNA sequence
ccctctagctactggaaaca

SEQ ID NO: 275023 - DNA, 20 bp, Artificial
  CRISPR gRNA sequence
agctactggaaacacagaac

SEQ ID NO: 275024 - DNA, 20 bp, Artificial
  CRISPR gRNA sequence
ctggaaacacagaacaagtc

SEQ ID NO: 275025 - DNA, 20 bp, Artificial
  CRISPR gRNA sequence
aacacagaacaagtctggca

SEQ ID NO: 275026 - DNA, 20 bp, Artificial
  CRISPR gRNA sequence
aacaagtctggcaaagaact

SEQ ID NO: 275027 - DNA, 20 bp, Artificial
  CRISPR gRNA sequence
gtctggcaaagaactaagtg

SEQ ID NO: 275028 - DNA, 20 bp, Artificial
  CRISPR gRNA sequence
caaagaactaagtgtggata

SEQ ID NO: 275029 - DNA, 20 bp, Artificial
  CRISPR gRNA sequence
aactaagtgtggatatggct

SEQ ID NO: 275030 - DNA, 20 bp, Artificial
  CRISPR gRNA sequence
gtgtggatatggcttggtat

SEQ ID NO: 275031 - DNA, 20 bp, Artificial
  CRISPR gRNA sequence
tgtggatatggcttggtatt

SEQ ID NO: 275032 - DNA, 20 bp, Artificial
  CRISPR gRNA sequence
ggatatggcttggtattagg

SEQ ID NO: 275033 - DNA, 20 bp, Artificial
  CRISPR gRNA sequence
gatatggcttggtattaggt

SEQ ID NO: 275034 - DNA, 20 bp, Artificial
  CRISPR gRNA sequence
ggtattaggtgggaccatcc

SEQ ID NO: 275035 - DNA, 20 bp, Artificial
  CRISPR gRNA sequence
attaggtgggaccatcctag

SEQ ID NO: 275036 - DNA, 20 bp, Artificial
  CRISPR gRNA sequence
taggtgggaccatcctagaa

SEQ ID NO: 275037 - DNA, 20 bp, Artificial
  CRISPR gRNA sequence
ggtgggaccatcctagaaga

SEQ ID NO: 275038 - DNA, 20 bp, Artificial
  CRISPR gRNA sequence
catcctagaagagagcactg

SEQ ID NO: 275039 - DNA, 20 bp, Artificial
  CRISPR gRNA sequence
atcctagaagagagcactga

SEQ ID NO: 275040 - DNA, 20 bp, Artificial
  CRISPR gRNA sequence
aagagagcactgaaggttat

SEQ ID NO: 275041 - DNA, 20 bp, Artificial
  CRISPR gRNA sequence
gcactgaaggttatcagctg

SEQ ID NO: 275042 - DNA, 20 bp, Artificial
  CRISPR gRNA sequence
aaggttatcagctgtagttt

SEQ ID NO: 275043 - DNA, 20 bp, Artificial
  CRISPR gRNA sequence
cagctgtagtttcagtccca

SEQ ID NO: 275044 - DNA, 20 bp, Artificial
  CRISPR gRNA sequence
gctgtagtttcagtcccaca

SEQ ID NO: 275045 - DNA, 20 bp, Artificial
  CRISPR gRNA sequence
tgtagtttcagtcccacaga

SEQ ID NO: 275046 - DNA, 20 bp, Artificial
  CRISPR gRNA sequence
ttcagtcccacagagagcac

SEQ ID NO: 275047 - DNA, 20 bp, Artificial
  CRISPR gRNA sequence
agtcccacagagagcacaag

SEQ ID NO: 275048 - DNA, 20 bp, Artificial
  CRISPR gRNA sequence
agagagcacaagaagtacac

SEQ ID NO: 275049 - DNA, 20 bp, Artificial
  CRISPR gRNA sequence
gagagcacaagaagtacaca

SEQ ID NO: 275050 - DNA, 20 bp, Artificial
  CRISPR gRNA sequence
caagaagtacacaaggaaat

SEQ ID NO: 275051 - DNA, 20 bp, Artificial
  CRISPR gRNA sequence
aagaagtacacaaggaaatg

SEQ ID NO: 275052 - DNA, 20 bp, Artificial
  CRISPR gRNA sequence
agaagtacacaaggaaatga

SEQ ID NO: 275053 - DNA, 20 bp, Artificial
  CRISPR gRNA sequence
agtacacaaggaaatgaggg

SEQ ID NO: 275054 - DNA, 20 bp, Artificial
  CRISPR gRNA sequence
gtacacaaggaaatgagggt

SEQ ID NO: 275055 - DNA, 20 bp, Artificial
  CRISPR gRNA sequence
tacacaaggaaatgagggtg

SEQ ID NO: 275056 - DNA, 20 bp, Artificial
  CRISPR gRNA sequence
cacaaggaaatgagggtggg

SEQ ID NO: 275057 - DNA, 20 bp, Artificial
  CRISPR gRNA sequence
acaaggaaatgagggtgggg

SEQ ID NO: 275058 - DNA, 20 bp, Artificial
  CRISPR gRNA sequence
aaggaaatgagggtggggag

SEQ ID NO: 275059 - DNA, 20 bp, Artificial
  CRISPR gRNA sequence
aaatgagggtggggaggaga

SEQ ID NO: 275060 - DNA, 20 bp, Artificial
  CRISPR gRNA sequence
aatgagggtggggaggagaa

SEQ ID NO: 275061 - DNA, 20 bp, Artificial
  CRISPR gRNA sequence
ggtggggaggagaaaggtgt

SEQ ID NO: 275062 - DNA, 20 bp, Artificial
  CRISPR gRNA sequence
ggggaggagaaaggtgttgg

SEQ ID NO: 275063 - DNA, 20 bp, Artificial
  CRISPR gRNA sequence
gagaaaggtgttggtggata

SEQ ID NO: 275064 - DNA, 20 bp, Artificial
  CRISPR gRNA sequence
tgttggtggatatggtgctg

SEQ ID NO: 275065 - DNA, 20 bp, Artificial
  CRISPR gRNA sequence
gttggtggatatggtgctgc

SEQ ID NO: 275066 - DNA, 20 bp, Artificial
  CRISPR gRNA sequence
gtgctgcgggtccatccctc

SEQ ID NO: 275067 - DNA, 20 bp, Artificial
  CRISPR gRNA sequence
gcgggtccatccctccagat

SEQ ID NO: 275068 - DNA, 20 bp, Artificial
  CRISPR gRNA sequence
cgggtccatccctccagatc

SEQ ID NO: 275069 - DNA, 20 bp, Artificial
  CRISPR gRNA sequence
ggtccatccctccagatcag

SEQ ID NO: 275070 - DNA, 20 bp, Artificial
  CRISPR gRNA sequence
ccatccctccagatcaggag

SEQ ID NO: 275071 - DNA, 20 bp, Artificial
  CRISPR gRNA sequence
tccctccagatcaggagcag

SEQ ID NO: 275072 - DNA, 20 bp, Artificial
  CRISPR gRNA sequence
cagatcaggagcagcagctg

SEQ ID NO: 275073 - DNA, 20 bp, Artificial
  CRISPR gRNA sequence
cagctgcagtatttattctt

SEQ ID NO: 275074 - DNA, 20 bp, Artificial
  CRISPR gRNA sequence
atttattcttcagctgcttt

SEQ ID NO: 275075 - DNA, 20 bp, Artificial
  CRISPR gRNA sequence
tttattcttcagctgctttg

SEQ ID NO: 275076 - DNA, 20 bp, Artificial
  CRISPR gRNA sequence
cagctgctttgaggaatcat

SEQ ID NO: 275077 - DNA, 20 bp, Artificial
  CRISPR gRNA sequence
gaggaatcattagcaacatc

SEQ ID NO: 275078 - DNA, 20 bp, Artificial
  CRISPR gRNA sequence
attagcaacatctggaaaaa

SEQ ID NO: 275079 - DNA, 20 bp, Artificial
  CRISPR gRNA sequence
agcaacatctggaaaaacgg

SEQ ID NO: 275080 - DNA, 20 bp, Artificial
  CRISPR gRNA sequence
gcaacatctggaaaaacggc

SEQ ID NO: 275081 - DNA, 20 bp, Artificial
  CRISPR gRNA sequence
caacatctggaaaaacggca

SEQ ID NO: 275082 - DNA, 20 bp, Artificial
  CRISPR gRNA sequence
aacggcagggacacaaatta

SEQ ID NO: 275083 - DNA, 20 bp, Artificial
  CRISPR gRNA sequence
ggcagggacacaaattatag

SEQ ID NO: 275084 - DNA, 20 bp, Artificial
  CRISPR gRNA sequence
aattatagcagctcattttc

SEQ ID NO: 275085 - DNA, 20 bp, Artificial
  CRISPR gRNA sequence
attttctggtttctctgaaa

SEQ ID NO: 275086 - DNA, 20 bp, Artificial
  CRISPR gRNA sequence
tactttttttcttcatgctg

SEQ ID NO: 275087 - DNA, 20 bp, Artificial
  CRISPR gRNA sequence
aagttttatttaaaacataa

SEQ ID NO: 275088 - DNA, 20 bp, Artificial
  CRISPR gRNA sequence
gaaatgttcccccaaaatgc

SEQ ID NO: 275089 - DNA, 20 bp, Artificial
  CRISPR gRNA sequence
ccccaaaatgctagtgaata

SEQ ID NO: 275090 - DNA, 20 bp, Artificial
  CRISPR gRNA sequence
aatgctagtgaataaagcaa

SEQ ID NO: 275091 - DNA, 20 bp, Artificial
  CRISPR gRNA sequence
atgctagtgaataaagcaaa

SEQ ID NO: 275092 - DNA, 20 bp, Artificial
  CRISPR gRNA sequence
taaagcaaaaggatacgaca

SEQ ID NO: 275093 - DNA, 20 bp, Artificial
  CRISPR gRNA sequence
acacagtgctctctcactat

SEQ ID NO: 275094 - DNA, 20 bp, Artificial
  CRISPR gRNA sequence
agtgctctctcactatgagt

SEQ ID NO: 275095 - DNA, 20 bp, Artificial
  CRISPR gRNA sequence
ctctctcactatgagttagc

SEQ ID NO: 275096 - DNA, 20 bp, Artificial
  CRISPR gRNA sequence
atgagttagccagcctatcc

SEQ ID NO: 275097 - DNA, 20 bp, Artificial
  CRISPR gRNA sequence
ttagccagcctatccaagta

SEQ ID NO: 275098 - DNA, 20 bp, Artificial
  CRISPR gRNA sequence
tagccagcctatccaagtac

SEQ ID NO: 275099 - DNA, 20 bp, Artificial
  CRISPR gRNA sequence
agccagcctatccaagtaca

SEQ ID NO: 275100 - DNA, 20 bp, Artificial
  CRISPR gRNA sequence
tccaagtacagggtaatata

SEQ ID NO: 275101 - DNA, 20 bp, Artificial
  CRISPR gRNA sequence
taatatacagtactcaatgc

SEQ ID NO: 275102 - DNA, 20 bp, Artificial
  CRISPR gRNA sequence
tatacagtactcaatgctgg

SEQ ID NO: 275103 - DNA, 20 bp, Artificial
  CRISPR gRNA sequence
tcaatgctggtagaatttca

SEQ ID NO: 275104 - DNA, 20 bp, Artificial
  CRISPR gRNA sequence
atgctggtagaatttcacag

SEQ ID NO: 275105 - DNA, 20 bp, Artificial
  CRISPR gRNA sequence
ggtagaatttcacagtagtt

SEQ ID NO: 275106 - DNA, 20 bp, Artificial
  CRISPR gRNA sequence
ttcacagtagtttagtgtta

SEQ ID NO: 275107 - DNA, 20 bp, Artificial
  CRISPR gRNA sequence
tgttaaagattatctgtgcc

SEQ ID NO: 275108 - DNA, 20 bp, Artificial
  CRISPR gRNA sequence
ttatctgtgcctagattatg

SEQ ID NO: 275109 - DNA, 20 bp, Artificial
  CRISPR gRNA sequence
atctgtgcctagattatgaa

SEQ ID NO: 275110 - DNA, 20 bp, Artificial
  CRISPR gRNA sequence
gattctcaatgtgtgatgct

SEQ ID NO: 275111 - DNA, 20 bp, Artificial
  CRISPR gRNA sequence
caatgtgtgatgcttagttc

SEQ ID NO: 275112 - DNA, 20 bp, Artificial
  CRISPR gRNA sequence
aatgtgtgatgcttagttct

SEQ ID NO: 275113 - DNA, 20 bp, Artificial
  CRISPR gRNA sequence
gttctgggtttacaccttac

SEQ ID NO: 275114 - DNA, 20 bp, Artificial
  CRISPR gRNA sequence
ttctgggtttacaccttact

SEQ ID NO: 275115 - DNA, 20 bp, Artificial
  CRISPR gRNA sequence
acaccttactgggcatgaac

SEQ ID NO: 275116 - DNA, 20 bp, Artificial
  CRISPR gRNA sequence
accttactgggcatgaacaa

SEQ ID NO: 275117 - DNA, 20 bp, Artificial
  CRISPR gRNA sequence
gaacaagagcccctgctcct

SEQ ID NO: 275118 - DNA, 20 bp, Artificial
  CRISPR gRNA sequence
gagcccctgctccttggcca

SEQ ID NO: 275119 - DNA, 20 bp, Artificial
  CRISPR gRNA sequence
ttggccatagccaaatccct

SEQ ID NO: 275120 - DNA, 20 bp, Artificial
  CRISPR gRNA sequence
tggccatagccaaatccctt

SEQ ID NO: 275121 - DNA, 20 bp, Artificial
  CRISPR gRNA sequence
agccaaatcccttgggccca

SEQ ID NO: 275122 - DNA, 20 bp, Artificial
  CRISPR gRNA sequence
tgggcccaaagttctttgca

SEQ ID NO: 275123 - DNA, 20 bp, Artificial
  CRISPR gRNA sequence
tttgcatagcaccattacaa

SEQ ID NO: 275124 - DNA, 20 bp, Artificial
  CRISPR gRNA sequence
atagatttcaccttcttttt

SEQ ID NO: 275125 - DNA, 20 bp, Artificial
  CRISPR gRNA sequence
atttcaccttctttttcagt

SEQ ID NO: 275126 - DNA, 20 bp, Artificial
  CRISPR gRNA sequence
ttcaccttctttttcagtca

SEQ ID NO: 275127 - DNA, 20 bp, Artificial
  CRISPR gRNA sequence
tcagtcagagttgttgattc

SEQ ID NO: 275128 - DNA, 20 bp, Artificial
  CRISPR gRNA sequence
tcttcccacactttgcacat

SEQ ID NO: 275129 - DNA, 20 bp, Artificial
  CRISPR gRNA sequence
cacactttgcacatcagaaa

SEQ ID NO: 275130 - DNA, 20 bp, Artificial
  CRISPR gRNA sequence
atcagaaacagtttttgtgc

SEQ ID NO: 275131 - DNA, 20 bp, Artificial
  CRISPR gRNA sequence
tcagaaacagtttttgtgcc

SEQ ID NO: 275132 - DNA, 20 bp, Artificial
  CRISPR gRNA sequence
cagaaacagtttttgtgcca

SEQ ID NO: 275133 - DNA, 20 bp, Artificial
  CRISPR gRNA sequence
gtttttgtgccagggctttc

SEQ ID NO: 275134 - DNA, 20 bp, Artificial
  CRISPR gRNA sequence
tccagctccaattatcttct

SEQ ID NO: 275135 - DNA, 20 bp, Artificial
  CRISPR gRNA sequence
agctccaattatcttctcgg

SEQ ID NO: 275136 - DNA, 20 bp, Artificial
  CRISPR gRNA sequence
tatcttctcggcagcatata

SEQ ID NO: 275137 - DNA, 20 bp, Artificial
  CRISPR gRNA sequence
atatacagaatccccacatc

SEQ ID NO: 275138 - DNA, 20 bp, Artificial
  CRISPR gRNA sequence
cccacatctggaacatttct

SEQ ID NO: 275139 - DNA, 20 bp, Artificial
  CRISPR gRNA sequence
ctcagcacctccatatttct

SEQ ID NO: 275140 - DNA, 20 bp, Artificial
  CRISPR gRNA sequence
tccatatttctgagcaaatt

SEQ ID NO: 275141 - DNA, 20 bp, Artificial
  CRISPR gRNA sequence
atatttctgagcaaatttag

SEQ ID NO: 275142 - DNA, 20 bp, Artificial
  CRISPR gRNA sequence
tgagcaaatttagaagcatt

SEQ ID NO: 275143 - DNA, 20 bp, Artificial
  CRISPR gRNA sequence
agaagcatttggatttcttg

SEQ ID NO: 275144 - DNA, 20 bp, Artificial
  CRISPR gRNA sequence
gaagcatttggatttcttgt

SEQ ID NO: 275145 - DNA, 20 bp, Artificial
  CRISPR gRNA sequence
tggatttcttgtaggcctgt

SEQ ID NO: 275146 - DNA, 20 bp, Artificial
  CRISPR gRNA sequence
ggatttcttgtaggcctgtg

SEQ ID NO: 275147 - DNA, 20 bp, Artificial
  CRISPR gRNA sequence
ctgtgaggctgaacactctc

SEQ ID NO: 275148 - DNA, 20 bp, Artificial
  CRISPR gRNA sequence
acactctctggcttgatgcc

SEQ ID NO: 275149 - DNA, 20 bp, Artificial
  CRISPR gRNA sequence
gcccagcctctcgccatgtt

SEQ ID NO: 275150 - DNA, 20 bp, Artificial
  CRISPR gRNA sequence
tctcgccatgttaagcgtgc

SEQ ID NO: 275151 - DNA, 20 bp, Artificial
  CRISPR gRNA sequence
tgttaagcgtgccagcaccc

SEQ ID NO: 275152 - DNA, 20 bp, Artificial
  CRISPR gRNA sequence
cagcaccctggccataacca

SEQ ID NO: 275153 - DNA, 20 bp, Artificial
  CRISPR gRNA sequence
ttgtcccatatttctttcca

SEQ ID NO: 275154 - DNA, 20 bp, Artificial
  CRISPR gRNA sequence
tcccatatttctttccatag

SEQ ID NO: 275155 - DNA, 20 bp, Artificial
  CRISPR gRNA sequence
cccatatttctttccatagt

SEQ ID NO: 275156 - DNA, 20 bp, Artificial
  CRISPR gRNA sequence
tctttccatagtaggatttg

SEQ ID NO: 275157 - DNA, 20 bp, Artificial
  CRISPR gRNA sequence
ttccatagtaggatttgcag

SEQ ID NO: 275158 - DNA, 20 bp, Artificial
  CRISPR gRNA sequence
aatttttcctgcaaaccatt

SEQ ID NO: 275159 - DNA, 20 bp, Artificial
  CRISPR gRNA sequence
tttcctgcaaaccattgagt

SEQ ID NO: 275160 - DNA, 20 bp, Artificial
  CRISPR gRNA sequence
tcctgcaaaccattgagtcg

SEQ ID NO: 275161 - DNA, 20 bp, Artificial
  CRISPR gRNA sequence
cctgcaaaccattgagtcgg

SEQ ID NO: 275162 - DNA, 20 bp, Artificial
  CRISPR gRNA sequence
gcaaaccattgagtcggagg

SEQ ID NO: 275163 - DNA, 20 bp, Artificial
  CRISPR gRNA sequence
caaaccattgagtcggaggc

SEQ ID NO: 275164 - DNA, 20 bp, Artificial
  CRISPR gRNA sequence
aaccattgagtcggaggcag

SEQ ID NO: 275165 - DNA, 20 bp, Artificial
  CRISPR gRNA sequence
ggaggcaggagcatgcacca

SEQ ID NO: 275166 - DNA, 20 bp, Artificial
  CRISPR gRNA sequence
gaggcaggagcatgcaccac

SEQ ID NO: 275167 - DNA, 20 bp, Artificial
  CRISPR gRNA sequence
gcaggagcatgcaccacagg

SEQ ID NO: 275168 - DNA, 20 bp, Artificial
  CRISPR gRNA sequence
aggagcatgcaccacaggcg

SEQ ID NO: 275169 - DNA, 20 bp, Artificial
  CRISPR gRNA sequence
gcatgcaccacaggcggagc

SEQ ID NO: 275170 - DNA, 20 bp, Artificial
  CRISPR gRNA sequence
gcaccacaggcggagctagc

SEQ ID NO: 275171 - DNA, 20 bp, Artificial
  CRISPR gRNA sequence
caccacaggcggagctagca

SEQ ID NO: 275172 - DNA, 20 bp, Artificial
  CRISPR gRNA sequence
acaggcggagctagcaaggc

SEQ ID NO: 275173 - DNA, 20 bp, Artificial
  CRISPR gRNA sequence
caggcggagctagcaaggct

SEQ ID NO: 275174 - DNA, 20 bp, Artificial
  CRISPR gRNA sequence
cggagctagcaaggctgggc

SEQ ID NO: 275175 - DNA, 20 bp, Artificial
  CRISPR gRNA sequence
gagctagcaaggctgggctg

SEQ ID NO: 275176 - DNA, 20 bp, Artificial
  CRISPR gRNA sequence
gctagcaaggctgggctgga

SEQ ID NO: 275177 - DNA, 20 bp, Artificial
  CRISPR gRNA sequence
tagcaaggctgggctggaga

SEQ ID NO: 275178 - DNA, 20 bp, Artificial
  CRISPR gRNA sequence
agcaaggctgggctggagag

SEQ ID NO: 275179 - DNA, 20 bp, Artificial
  CRISPR gRNA sequence
gcaaggctgggctggagaga

SEQ ID NO: 275180 - DNA, 20 bp, Artificial
  CRISPR gRNA sequence
gctgggctggagagagggtc

SEQ ID NO: 275181 - DNA, 20 bp, Artificial
  CRISPR gRNA sequence
ctgggctggagagagggtcc

SEQ ID NO: 275182 - DNA, 20 bp, Artificial
  CRISPR gRNA sequence
tgggctggagagagggtcca

SEQ ID NO: 275183 - DNA, 20 bp, Artificial
  CRISPR gRNA sequence
ggctggagagagggtccagg

SEQ ID NO: 275184 - DNA, 20 bp, Artificial
  CRISPR gRNA sequence
agagagggtccagggagtcc

SEQ ID NO: 275185 - DNA, 20 bp, Artificial
  CRISPR gRNA sequence
acttttctgattaccaaacc

SEQ ID NO: 275186 - DNA, 20 bp, Artificial
  CRISPR gRNA sequence
tttctgattaccaaacccag

SEQ ID NO: 275187 - DNA, 20 bp, Artificial
  CRISPR gRNA sequence
tgattaccaaacccagtggt

SEQ ID NO: 275188 - DNA, 20 bp, Artificial
  CRISPR gRNA sequence
atttatttatttatttattt

SEQ ID NO: 275189 - DNA, 20 bp, Artificial
  CRISPR gRNA sequence
atttatttatttatttaaga

SEQ ID NO: 275190 - DNA, 20 bp, Artificial
  CRISPR gRNA sequence
cggactttcactgtgtttcc

SEQ ID NO: 275191 - DNA, 20 bp, Artificial
  CRISPR gRNA sequence
ggactttcactgtgtttccc

SEQ ID NO: 275192 - DNA, 20 bp, Artificial
  CRISPR gRNA sequence
tttcactgtgtttcccaggc

SEQ ID NO: 275193 - DNA, 20 bp, Artificial
  CRISPR gRNA sequence
ttcactgtgtttcccaggcc

SEQ ID NO: 275194 - DNA, 20 bp, Artificial
  CRISPR gRNA sequence
ctgtgtttcccaggccaggc

SEQ ID NO: 275195 - DNA, 20 bp, Artificial
  CRISPR gRNA sequence
gtgtttcccaggccaggctg

SEQ ID NO: 275196 - DNA, 20 bp, Artificial
  CRISPR gRNA sequence
tcccaggccaggctggagtg

SEQ ID NO: 275197 - DNA, 20 bp, Artificial
  CRISPR gRNA sequence
ggagtgcagtgatgtgatct

SEQ ID NO: 275198 - DNA, 20 bp, Artificial
  CRISPR gRNA sequence
cactgcaatctctgcctccc

SEQ ID NO: 275199 - DNA, 20 bp, Artificial
  CRISPR gRNA sequence
aatctctgcctcccgagttc

SEQ ID NO: 275200 - DNA, 20 bp, Artificial
  CRISPR gRNA sequence
atctctgcctcccgagttca

SEQ ID NO: 275201 - DNA, 20 bp, Artificial
  CRISPR gRNA sequence
ttcaaggaattctcctgcct

SEQ ID NO: 275202 - DNA, 20 bp, Artificial
  CRISPR gRNA sequence
ttctcctgcctcagcctccc

SEQ ID NO: 275203 - DNA, 20 bp, Artificial
  CRISPR gRNA sequence
tcctgcctcagcctcccgag

SEQ ID NO: 275204 - DNA, 20 bp, Artificial
  CRISPR gRNA sequence
gcctcagcctcccgagtagc

SEQ ID NO: 275205 - DNA, 20 bp, Artificial
  CRISPR gRNA sequence
cctcagcctcccgagtagct

SEQ ID NO: 275206 - DNA, 20 bp, Artificial
  CRISPR gRNA sequence
ctcccgagtagctgggatta

SEQ ID NO: 275207 - DNA, 20 bp, Artificial
  CRISPR gRNA sequence
tcccgagtagctgggattac

SEQ ID NO: 275208 - DNA, 20 bp, Artificial
  CRISPR gRNA sequence
cccgagtagctgggattaca

SEQ ID NO: 275209 - DNA, 20 bp, Artificial
  CRISPR gRNA sequence
ccgagtagctgggattacag

SEQ ID NO: 275210 - DNA, 20 bp, Artificial
  CRISPR gRNA sequence
caggggcgtgccaccacacc

SEQ ID NO: 275211 - DNA, 20 bp, Artificial
  CRISPR gRNA sequence
ccagctaatttttgtatttt

SEQ ID NO: 275212 - DNA, 20 bp, Artificial
  CRISPR gRNA sequence
gctaatttttgtattttcag

SEQ ID NO: 275213 - DNA, 20 bp, Artificial
  CRISPR gRNA sequence
taatttttgtattttcagta

SEQ ID NO: 275214 - DNA, 20 bp, Artificial
  CRISPR gRNA sequence
ttttgtattttcagtagaga

SEQ ID NO: 275215 - DNA, 20 bp, Artificial
  CRISPR gRNA sequence
tttgtattttcagtagagat

SEQ ID NO: 275216 - DNA, 20 bp, Artificial
  CRISPR gRNA sequence
ttgtattttcagtagagatg

SEQ ID NO: 275217 - DNA, 20 bp, Artificial
  CRISPR gRNA sequence
gagatggggtttccccatgt

SEQ ID NO: 275218 - DNA, 20 bp, Artificial
  CRISPR gRNA sequence
tggggtttccccatgttggc

SEQ ID NO: 275219 - DNA, 20 bp, Artificial
  CRISPR gRNA sequence
tttccccatgttggccagac

SEQ ID NO: 275220 - DNA, 20 bp, Artificial
  CRISPR gRNA sequence
tggtctcgaactcctgacct

SEQ ID NO: 275221 - DNA, 20 bp, Artificial
  CRISPR gRNA sequence
ggtctcgaactcctgacctc

SEQ ID NO: 275222 - DNA, 20 bp, Artificial
  CRISPR gRNA sequence
ctcaggtgattctcctgtct

SEQ ID NO: 275223 - DNA, 20 bp, Artificial
  CRISPR gRNA sequence
tctcctgtcttggcctccca

SEQ ID NO: 275224 - DNA, 20 bp, Artificial
  CRISPR gRNA sequence
gtcttggcctcccacagtgc

SEQ ID NO: 275225 - DNA, 20 bp, Artificial
  CRISPR gRNA sequence
tcttggcctcccacagtgct

SEQ ID NO: 275226 - DNA, 20 bp, Artificial
  CRISPR gRNA sequence
ctcccacagtgctgggatta

SEQ ID NO: 275227 - DNA, 20 bp, Artificial
  CRISPR gRNA sequence
tcccacagtgctgggattac

SEQ ID NO: 275228 - DNA, 20 bp, Artificial
  CRISPR gRNA sequence
agtgctgggattacaggcat

SEQ ID NO: 275229 - DNA, 20 bp, Artificial
  CRISPR gRNA sequence
caggcatgagccactgcgcc

SEQ ID NO: 275230 - DNA, 20 bp, Artificial
  CRISPR gRNA sequence
atgagccactgcgcctggcc

SEQ ID NO: 275231 - DNA, 20 bp, Artificial
  CRISPR gRNA sequence
agttttattcttttgcttat

SEQ ID NO: 275232 - DNA, 20 bp, Artificial
  CRISPR gRNA sequence
ttgcttattggacttctcat

SEQ ID NO: 275233 - DNA, 20 bp, Artificial
  CRISPR gRNA sequence
ttggacttctcatcagcatt

SEQ ID NO: 275234 - DNA, 20 bp, Artificial
  CRISPR gRNA sequence
acttctcatcagcatttagc

SEQ ID NO: 275235 - DNA, 20 bp, Artificial
  CRISPR gRNA sequence
ctcatcagcatttagccagt

SEQ ID NO: 275236 - DNA, 20 bp, Artificial
  CRISPR gRNA sequence
agttggaatcttctccttct

SEQ ID NO: 275237 - DNA, 20 bp, Artificial
  CRISPR gRNA sequence
gttgcactccgttttctctg

SEQ ID NO: 275238 - DNA, 20 bp, Artificial
  CRISPR gRNA sequence
ttgcactccgttttctctga

SEQ ID NO: 275239 - DNA, 20 bp, Artificial
  CRISPR gRNA sequence
tctaattattgttgttccca

SEQ ID NO: 275240 - DNA, 20 bp, Artificial
  CRISPR gRNA sequence
tgttcccatggttctgtttg

SEQ ID NO: 275241 - DNA, 20 bp, Artificial
  CRISPR gRNA sequence
tggtcccattttgcccttac

SEQ ID NO: 275242 - DNA, 20 bp, Artificial
  CRISPR gRNA sequence
cattttgcccttactggccc

SEQ ID NO: 275243 - DNA, 20 bp, Artificial
  CRISPR gRNA sequence
cttactggccccagtcttcc

SEQ ID NO: 275244 - DNA, 20 bp, Artificial
  CRISPR gRNA sequence
ttactggccccagtcttcct

SEQ ID NO: 275245 - DNA, 20 bp, Artificial
  CRISPR gRNA sequence
gggtaatatcctccacacct

SEQ ID NO: 275246 - DNA, 20 bp, Artificial
  CRISPR gRNA sequence
tgagatttgaaatgccatct

SEQ ID NO: 275247 - DNA, 20 bp, Artificial
  CRISPR gRNA sequence
gagatttgaaatgccatctg

SEQ ID NO: 275248 - DNA, 20 bp, Artificial
  CRISPR gRNA sequence
tttgaaatgccatctgaggc

SEQ ID NO: 275249 - DNA, 20 bp, Artificial
  CRISPR gRNA sequence
ttgaaatgccatctgaggct

SEQ ID NO: 275250 - DNA, 20 bp, Artificial
  CRISPR gRNA sequence
atgccatctgaggctgggca

SEQ ID NO: 275251 - DNA, 20 bp, Artificial
  CRISPR gRNA sequence
ccatctgaggctgggcacag

SEQ ID NO: 275252 - DNA, 20 bp, Artificial
  CRISPR gRNA sequence
gtggctcacacctgtaattc

SEQ ID NO: 275253 - DNA, 20 bp, Artificial
  CRISPR gRNA sequence
cacctgtaattctggcactt

SEQ ID NO: 275254 - DNA, 20 bp, Artificial
  CRISPR gRNA sequence
acctgtaattctggcacttt

SEQ ID NO: 275255 - DNA, 20 bp, Artificial
  CRISPR gRNA sequence
ctgtaattctggcactttgg

SEQ ID NO: 275256 - DNA, 20 bp, Artificial
  CRISPR gRNA sequence
tgtaattctggcactttggg

SEQ ID NO: 275257 - DNA, 20 bp, Artificial
  CRISPR gRNA sequence
ttctggcactttgggaggcc

SEQ ID NO: 275258 - DNA, 20 bp, Artificial
  CRISPR gRNA sequence
tctggcactttgggaggcca

SEQ ID NO: 275259 - DNA, 20 bp, Artificial
  CRISPR gRNA sequence
ggcactttgggaggccaagg

SEQ ID NO: 275260 - DNA, 20 bp, Artificial
  CRISPR gRNA sequence
gcactttgggaggccaaggt

SEQ ID NO: 275261 - DNA, 20 bp, Artificial
  CRISPR gRNA sequence
ctttgggaggccaaggtggg

SEQ ID NO: 275262 - DNA, 20 bp, Artificial
  CRISPR gRNA sequence
ccaaggtgggcagatcacct

SEQ ID NO: 275263 - DNA, 20 bp, Artificial
  CRISPR gRNA sequence
caaggtgggcagatcacctg

SEQ ID NO: 275264 - DNA, 20 bp, Artificial
  CRISPR gRNA sequence
gtgggcagatcacctgaggt

SEQ ID NO: 275265 - DNA, 20 bp, Artificial
  CRISPR gRNA sequence
tgggcagatcacctgaggtc

SEQ ID NO: 275266 - DNA, 20 bp, Artificial
  CRISPR gRNA sequence
ggcagatcacctgaggtcag

SEQ ID NO: 275267 - DNA, 20 bp, Artificial
  CRISPR gRNA sequence
tcacctgaggtcaggagttc

SEQ ID NO: 275268 - DNA, 20 bp, Artificial
  CRISPR gRNA sequence
tgaggtcaggagttcgagac

SEQ ID NO: 275269 - DNA, 20 bp, Artificial
  CRISPR gRNA sequence
tcaggagttcgagaccagcc

SEQ ID NO: 275270 - DNA, 20 bp, Artificial
  CRISPR gRNA sequence
cgagaccagcctggccaaca

SEQ ID NO: 275271 - DNA, 20 bp, Artificial
  CRISPR gRNA sequence
tgaaaccctgtctctactaa

SEQ ID NO: 275272 - DNA, 20 bp, Artificial
  CRISPR gRNA sequence
ctaaaagtacaaaaaattat

SEQ ID NO: 275273 - DNA, 20 bp, Artificial
  CRISPR gRNA sequence
aaagtacaaaaaattatcgg

SEQ ID NO: 275274 - DNA, 20 bp, Artificial
  CRISPR gRNA sequence
tacaaaaaattatcggtggc

SEQ ID NO: 275275 - DNA, 20 bp, Artificial
  CRISPR gRNA sequence
tcggtggcgagtaccaatcc

SEQ ID NO: 275276 - DNA, 20 bp, Artificial
  CRISPR gRNA sequence
cggtggcgagtaccaatccc

SEQ ID NO: 275277 - DNA, 20 bp, Artificial
  CRISPR gRNA sequence
gagtaccaatcccaggtact

SEQ ID NO: 275278 - DNA, 20 bp, Artificial
  CRISPR gRNA sequence
agtaccaatcccaggtactc

SEQ ID NO: 275279 - DNA, 20 bp, Artificial
  CRISPR gRNA sequence
taccaatcccaggtactcag

SEQ ID NO: 275280 - DNA, 20 bp, Artificial
  CRISPR gRNA sequence
accaatcccaggtactcagg

SEQ ID NO: 275281 - DNA, 20 bp, Artificial
  CRISPR gRNA sequence
cccaggtactcaggaggctg

SEQ ID NO: 275282 - DNA, 20 bp, Artificial
  CRISPR gRNA sequence
ggtactcaggaggctgaagc

SEQ ID NO: 275283 - DNA, 20 bp, Artificial
  CRISPR gRNA sequence
tactcaggaggctgaagcaa

SEQ ID NO: 275284 - DNA, 20 bp, Artificial
  CRISPR gRNA sequence
agcaagagaattgcttgaac

SEQ ID NO: 275285 - DNA, 20 bp, Artificial
  CRISPR gRNA sequence
gcaagagaattgcttgaacc

SEQ ID NO: 275286 - DNA, 20 bp, Artificial
  CRISPR gRNA sequence
caagagaattgcttgaacca

SEQ ID NO: 275287 - DNA, 20 bp, Artificial
  CRISPR gRNA sequence
agagaattgcttgaaccagg

SEQ ID NO: 275288 - DNA, 20 bp, Artificial
  CRISPR gRNA sequence
aattgcttgaaccagggaga

SEQ ID NO: 275289 - DNA, 20 bp, Artificial
  CRISPR gRNA sequence
ttgcttgaaccagggagaca

SEQ ID NO: 275290 - DNA, 20 bp, Artificial
  CRISPR gRNA sequence
tgcttgaaccagggagacag

SEQ ID NO: 275291 - DNA, 20 bp, Artificial
  CRISPR gRNA sequence
agggagacagaggttgcaat

SEQ ID NO: 275292 - DNA, 20 bp, Artificial
  CRISPR gRNA sequence
gacagaggttgcaatgagcc

SEQ ID NO: 275293 - DNA, 20 bp, Artificial
  CRISPR gRNA sequence
aatgagccaagattgcactc

SEQ ID NO: 275294 - DNA, 20 bp, Artificial
  CRISPR gRNA sequence
gccaagattgcactccagcc

SEQ ID NO: 275295 - DNA, 20 bp, Artificial
  CRISPR gRNA sequence
ccaagattgcactccagcct

SEQ ID NO: 275296 - DNA, 20 bp, Artificial
  CRISPR gRNA sequence
ttgcactccagcctgggtga

SEQ ID NO: 275297 - DNA, 20 bp, Artificial
  CRISPR gRNA sequence
gcactccagcctgggtgaca

SEQ ID NO: 275298 - DNA, 20 bp, Artificial
  CRISPR gRNA sequence
tccagcctgggtgacagagt

SEQ ID NO: 275299 - DNA, 20 bp, Artificial
  CRISPR gRNA sequence
gacagagtgagaatctatct

SEQ ID NO: 275300 - DNA, 20 bp, Artificial
  CRISPR gRNA sequence
gtgagaatctatctcagaaa

SEQ ID NO: 275301 - DNA, 20 bp, Artificial
  CRISPR gRNA sequence
atctatctcagaaaaagaca

SEQ ID NO: 275302 - DNA, 20 bp, Artificial
  CRISPR gRNA sequence
agacaaagaaaaaaaaaaaa

SEQ ID NO: 275303 - DNA, 20 bp, Artificial
  CRISPR gRNA sequence
caaagaaaaaaaaaaaaaag

SEQ ID NO: 275304 - DNA, 20 bp, Artificial
  CRISPR gRNA sequence
tgatttctaaatttgtatat

SEQ ID NO: 275305 - DNA, 20 bp, Artificial
  CRISPR gRNA sequence
ttctaaatttgtatattgga

SEQ ID NO: 275306 - DNA, 20 bp, Artificial
  CRISPR gRNA sequence
tttgtatattggatggatgc

SEQ ID NO: 275307 - DNA, 20 bp, Artificial
  CRISPR gRNA sequence
gctttccaaatcatatctac

SEQ ID NO: 275308 - DNA, 20 bp, Artificial
  CRISPR gRNA sequence
ccagctgtattctcccattt

SEQ ID NO: 275309 - DNA, 20 bp, Artificial
  CRISPR gRNA sequence
cagtgaataacaataccatt

SEQ ID NO: 275310 - DNA, 20 bp, Artificial
  CRISPR gRNA sequence
taccatttagttacccaaat

SEQ ID NO: 275311 - DNA, 20 bp, Artificial
  CRISPR gRNA sequence
ccatttagttacccaaataa

SEQ ID NO: 275312 - DNA, 20 bp, Artificial
  CRISPR gRNA sequence
tagttacccaaataagagtg

SEQ ID NO: 275313 - DNA, 20 bp, Artificial
  CRISPR gRNA sequence
ttttctttgtgctcacttcc

SEQ ID NO: 275314 - DNA, 20 bp, Artificial
  CRISPR gRNA sequence
tctttgtgctcacttcccag

SEQ ID NO: 275315 - DNA, 20 bp, Artificial
  CRISPR gRNA sequence
ctttgtgctcacttcccagt

SEQ ID NO: 275316 - DNA, 20 bp, Artificial
  CRISPR gRNA sequence
tgtattttctgttctatatt

SEQ ID NO: 275317 - DNA, 20 bp, Artificial
  CRISPR gRNA sequence
ttctatattcagaatatctc

SEQ ID NO: 275318 - DNA, 20 bp, Artificial
  CRISPR gRNA sequence
gctttttcccaaatctcttg

SEQ ID NO: 275319 - DNA, 20 bp, Artificial
  CRISPR gRNA sequence
atctcttgcagcaactgcct

SEQ ID NO: 275320 - DNA, 20 bp, Artificial
  CRISPR gRNA sequence
ttgcagcaactgccttagct

SEQ ID NO: 275321 - DNA, 20 bp, Artificial
  CRISPR gRNA sequence
gatttttctcatctcccacc

SEQ ID NO: 275322 - DNA, 20 bp, Artificial
  CRISPR gRNA sequence
ttttctcatctcccacctag

SEQ ID NO: 275323 - DNA, 20 bp, Artificial
  CRISPR gRNA sequence
ccacctagtagcctgcaaac

SEQ ID NO: 275324 - DNA, 20 bp, Artificial
  CRISPR gRNA sequence
gcaaaccggtctctttgcct

SEQ ID NO: 275325 - DNA, 20 bp, Artificial
  CRISPR gRNA sequence
caaaccggtctctttgcctc

SEQ ID NO: 275326 - DNA, 20 bp, Artificial
  CRISPR gRNA sequence
tctctttgcctcaggtttcc

SEQ ID NO: 275327 - DNA, 20 bp, Artificial
  CRISPR gRNA sequence
ctctttgcctcaggtttcct

SEQ ID NO: 275328 - DNA, 20 bp, Artificial
  CRISPR gRNA sequence
actcctgcacattgctgtca

SEQ ID NO: 275329 - DNA, 20 bp, Artificial
  CRISPR gRNA sequence
ctgaaacacctatttaatca

SEQ ID NO: 275330 - DNA, 20 bp, Artificial
  CRISPR gRNA sequence
catagtgtacctaccactta

SEQ ID NO: 275331 - DNA, 20 bp, Artificial
  CRISPR gRNA sequence
gtgtacctaccacttaaaga

SEQ ID NO: 275332 - DNA, 20 bp, Artificial
  CRISPR gRNA sequence
tgtacctaccacttaaagac

SEQ ID NO: 275333 - DNA, 20 bp, Artificial
  CRISPR gRNA sequence
cctaccacttaaagacagga

SEQ ID NO: 275334 - DNA, 20 bp, Artificial
  CRISPR gRNA sequence
ccacttaaagacaggatagt

SEQ ID NO: 275335 - DNA, 20 bp, Artificial
  CRISPR gRNA sequence
ttcttttttctctaaaacac

SEQ ID NO: 275336 - DNA, 20 bp, Artificial
  CRISPR gRNA sequence
ctctaaaacaccagattgaa

SEQ ID NO: 275337 - DNA, 20 bp, Artificial
  CRISPR gRNA sequence
ctaaaacaccagattgaatg

SEQ ID NO: 275338 - DNA, 20 bp, Artificial
  CRISPR gRNA sequence
ccagattgaatggagacatc

SEQ ID NO: 275339 - DNA, 20 bp, Artificial
  CRISPR gRNA sequence
tggagacatcaagtgattac

SEQ ID NO: 275340 - DNA, 20 bp, Artificial
  CRISPR gRNA sequence
gagacatcaagtgattacca

SEQ ID NO: 275341 - DNA, 20 bp, Artificial
  CRISPR gRNA sequence
attaccagagttgacctcta

SEQ ID NO: 275342 - DNA, 20 bp, Artificial
  CRISPR gRNA sequence
cagagttgacctctacagat

SEQ ID NO: 275343 - DNA, 20 bp, Artificial
  CRISPR gRNA sequence
agaatgacacaaaaaataac

SEQ ID NO: 275344 - DNA, 20 bp, Artificial
  CRISPR gRNA sequence
acaagccattgctgttatcc

SEQ ID NO: 275345 - DNA, 20 bp, Artificial
  CRISPR gRNA sequence
caagccattgctgttatcct

SEQ ID NO: 275346 - DNA, 20 bp, Artificial
  CRISPR gRNA sequence
agccattgctgttatcctgg

SEQ ID NO: 275347 - DNA, 20 bp, Artificial
  CRISPR gRNA sequence
ttgctgttatcctgggagtc

SEQ ID NO: 275348 - DNA, 20 bp, Artificial
  CRISPR gRNA sequence
ctgttatcctgggagtctag

SEQ ID NO: 275349 - DNA, 20 bp, Artificial
  CRISPR gRNA sequence
ctgggagtctagaagtttca

SEQ ID NO: 275350 - DNA, 20 bp, Artificial
  CRISPR gRNA sequence
tgggagtctagaagtttcac

SEQ ID NO: 275351 - DNA, 20 bp, Artificial
  CRISPR gRNA sequence
tctagaagtttcacaggctt

SEQ ID NO: 275352 - DNA, 20 bp, Artificial
  CRISPR gRNA sequence
cacaggcttcagctcattcc

SEQ ID NO: 275353 - DNA, 20 bp, Artificial
  CRISPR gRNA sequence
tccactccacacccatccac

SEQ ID NO: 275354 - DNA, 20 bp, Artificial
  CRISPR gRNA sequence
tccacaagcctcattcaacc

SEQ ID NO: 275355 - DNA, 20 bp, Artificial
  CRISPR gRNA sequence
cacaagcctcattcaaccta

SEQ ID NO: 275356 - DNA, 20 bp, Artificial
  CRISPR gRNA sequence
caagcctcattcaacctaga

SEQ ID NO: 275357 - DNA, 20 bp, Artificial
  CRISPR gRNA sequence
agcctcattcaacctagaga

SEQ ID NO: 275358 - DNA, 20 bp, Artificial
  CRISPR gRNA sequence
cctagagagagtatgtgtgt

SEQ ID NO: 275359 - DNA, 20 bp, Artificial
  CRISPR gRNA sequence
ctagagagagtatgtgtgtg

SEQ ID NO: 275360 - DNA, 20 bp, Artificial
  CRISPR gRNA sequence
tagagagagtatgtgtgtga

SEQ ID NO: 275361 - DNA, 20 bp, Artificial
  CRISPR gRNA sequence
gagagtatgtgtgtgaggga

SEQ ID NO: 275362 - DNA, 20 bp, Artificial
  CRISPR gRNA sequence
gagtatgtgtgtgagggaaa

SEQ ID NO: 275363 - DNA, 20 bp, Artificial
  CRISPR gRNA sequence
agtatgtgtgtgagggaaag

SEQ ID NO: 275364 - DNA, 20 bp, Artificial
  CRISPR gRNA sequence
gtatgtgtgtgagggaaaga

SEQ ID NO: 275365 - DNA, 20 bp, Artificial
  CRISPR gRNA sequence
atgtgtgtgagggaaagagg

SEQ ID NO: 275366 - DNA, 20 bp, Artificial
  CRISPR gRNA sequence
tgtgtgtgagggaaagaggg

SEQ ID NO: 275367 - DNA, 20 bp, Artificial
  CRISPR gRNA sequence
tgagggaaagagggaggcct

SEQ ID NO: 275368 - DNA, 20 bp, Artificial
  CRISPR gRNA sequence
gggaaagagggaggcctcag

SEQ ID NO: 275369 - DNA, 20 bp, Artificial
  CRISPR gRNA sequence
aaagagggaggcctcagtag

SEQ ID NO: 275370 - DNA, 20 bp, Artificial
  CRISPR gRNA sequence
agggaggcctcagtagcagc

SEQ ID NO: 275371 - DNA, 20 bp, Artificial
  CRISPR gRNA sequence
aggcctcagtagcagcaagc

SEQ ID NO: 275372 - DNA, 20 bp, Artificial
  CRISPR gRNA sequence
ggcctcagtagcagcaagcc

SEQ ID NO: 275373 - DNA, 20 bp, Artificial
  CRISPR gRNA sequence
aggtctattgtgacacctgt

SEQ ID NO: 275374 - DNA, 20 bp, Artificial
  CRISPR gRNA sequence
tgtgacacctgttagaaacc

SEQ ID NO: 275375 - DNA, 20 bp, Artificial
  CRISPR gRNA sequence
agaaacctggtaacatccca

SEQ ID NO: 275376 - DNA, 20 bp, Artificial
  CRISPR gRNA sequence
gaaacctggtaacatcccac

SEQ ID NO: 275377 - DNA, 20 bp, Artificial
  CRISPR gRNA sequence
aaacctggtaacatcccaca

SEQ ID NO: 275378 - DNA, 20 bp, Artificial
  CRISPR gRNA sequence
aacctggtaacatcccacag

SEQ ID NO: 275379 - DNA, 20 bp, Artificial
  CRISPR gRNA sequence
ctggtaacatcccacagggg

SEQ ID NO: 275380 - DNA, 20 bp, Artificial
  CRISPR gRNA sequence
acatcccacaggggcagacc

SEQ ID NO: 275381 - DNA, 20 bp, Artificial
  CRISPR gRNA sequence
caggggcagacccagaatcc

SEQ ID NO: 275382 - DNA, 20 bp, Artificial
  CRISPR gRNA sequence
aggggcagacccagaatcca

SEQ ID NO: 275383 - DNA, 20 bp, Artificial
  CRISPR gRNA sequence
cagacccagaatccaaggta

SEQ ID NO: 275384 - DNA, 20 bp, Artificial
  CRISPR gRNA sequence
gacccagaatccaaggtaca

SEQ ID NO: 275385 - DNA, 20 bp, Artificial
  CRISPR gRNA sequence
ccagaatccaaggtacagag

SEQ ID NO: 275386 - DNA, 20 bp, Artificial
  CRISPR gRNA sequence
tccaaggtacagagcggtgt

SEQ ID NO: 275387 - DNA, 20 bp, Artificial
  CRISPR gRNA sequence
ccaaggtacagagcggtgtg

SEQ ID NO: 275388 - DNA, 20 bp, Artificial
  CRISPR gRNA sequence
caaggtacagagcggtgtga

SEQ ID NO: 275389 - DNA, 20 bp, Artificial
  CRISPR gRNA sequence
tgtgagggcatctgcacatg

SEQ ID NO: 275390 - DNA, 20 bp, Artificial
  CRISPR gRNA sequence
catctgcacatgtagcttat

SEQ ID NO: 275391 - DNA, 20 bp, Artificial
  CRISPR gRNA sequence
tgtagcttattagataccat

SEQ ID NO: 275392 - DNA, 20 bp, Artificial
  CRISPR gRNA sequence
taccatgagtatgactctct

SEQ ID NO: 275393 - DNA, 20 bp, Artificial
  CRISPR gRNA sequence
ctctcagatgtatctccttc

SEQ ID NO: 275394 - DNA, 20 bp, Artificial
  CRISPR gRNA sequence
gtatctccttccagtttatc

SEQ ID NO: 275395 - DNA, 20 bp, Artificial
  CRISPR gRNA sequence
tatctccttccagtttatca

SEQ ID NO: 275396 - DNA, 20 bp, Artificial
  CRISPR gRNA sequence
atctccttccagtttatcaa

SEQ ID NO: 275397 - DNA, 20 bp, Artificial
  CRISPR gRNA sequence
ttatcaagggaaaacaaatt

SEQ ID NO: 275398 - DNA, 20 bp, Artificial
  CRISPR gRNA sequence
caagggaaaacaaatttggt

SEQ ID NO: 275399 - DNA, 20 bp, Artificial
  CRISPR gRNA sequence
tttggtgagactacactaaa

SEQ ID NO: 275400 - DNA, 20 bp, Artificial
  CRISPR gRNA sequence
atccgcttaattaatacatt

SEQ ID NO: 275401 - DNA, 20 bp, Artificial
  CRISPR gRNA sequence
tccgcttaattaatacattt

SEQ ID NO: 275402 - DNA, 20 bp, Artificial
  CRISPR gRNA sequence
ctttttttttttttccaaat

SEQ ID NO: 275403 - DNA, 20 bp, Artificial
  CRISPR gRNA sequence
aaatcagttatttactgata

SEQ ID NO: 275404 - DNA, 20 bp, Artificial
  CRISPR gRNA sequence
agttatttactgatatggtt

SEQ ID NO: 275405 - DNA, 20 bp, Artificial
  CRISPR gRNA sequence
atcttgaattataactccca

SEQ ID NO: 275406 - DNA, 20 bp, Artificial
  CRISPR gRNA sequence
cccacagttgccacatgtca

SEQ ID NO: 275407 - DNA, 20 bp, Artificial
  CRISPR gRNA sequence
ccacagttgccacatgtcat

SEQ ID NO: 275408 - DNA, 20 bp, Artificial
  CRISPR gRNA sequence
acagttgccacatgtcatgg

SEQ ID NO: 275409 - DNA, 20 bp, Artificial
  CRISPR gRNA sequence
cagttgccacatgtcatggg

SEQ ID NO: 275410 - DNA, 20 bp, Artificial
  CRISPR gRNA sequence
cacatgtcatgggaggaacc

SEQ ID NO: 275411 - DNA, 20 bp, Artificial
  CRISPR gRNA sequence
atgtcatgggaggaacccag

SEQ ID NO: 275412 - DNA, 20 bp, Artificial
  CRISPR gRNA sequence
tgtcatgggaggaacccagt

SEQ ID NO: 275413 - DNA, 20 bp, Artificial
  CRISPR gRNA sequence
tcatgggaggaacccagtgg

SEQ ID NO: 275414 - DNA, 20 bp, Artificial
  CRISPR gRNA sequence
catgggaggaacccagtggg

SEQ ID NO: 275415 - DNA, 20 bp, Artificial
  CRISPR gRNA sequence
agtgggaggtgactgaatta

SEQ ID NO: 275416 - DNA, 20 bp, Artificial
  CRISPR gRNA sequence
gtgggaggtgactgaattat

SEQ ID NO: 275417 - DNA, 20 bp, Artificial
  CRISPR gRNA sequence
tgggaggtgactgaattatg

SEQ ID NO: 275418 - DNA, 20 bp, Artificial
  CRISPR gRNA sequence
gggaggtgactgaattatgg

SEQ ID NO: 275419 - DNA, 20 bp, Artificial
  CRISPR gRNA sequence
ggtgactgaattatgggggc

SEQ ID NO: 275420 - DNA, 20 bp, Artificial
  CRISPR gRNA sequence
ttcctgcactgtccttgtga

SEQ ID NO: 275421 - DNA, 20 bp, Artificial
  CRISPR gRNA sequence
ctgtccttgtgatagttaat

SEQ ID NO: 275422 - DNA, 20 bp, Artificial
  CRISPR gRNA sequence
tgatagttaatgagtctcac

SEQ ID NO: 275423 - DNA, 20 bp, Artificial
  CRISPR gRNA sequence
atgagtctcacgagatctga

SEQ ID NO: 275424 - DNA, 20 bp, Artificial
  CRISPR gRNA sequence
gagatctgatagtttaaaaa

SEQ ID NO: 275425 - DNA, 20 bp, Artificial
  CRISPR gRNA sequence
agatctgatagtttaaaaac

SEQ ID NO: 275426 - DNA, 20 bp, Artificial
  CRISPR gRNA sequence
atctgatagtttaaaaacag

SEQ ID NO: 275427 - DNA, 20 bp, Artificial
  CRISPR gRNA sequence
aacaggagtttccttataac

SEQ ID NO: 275428 - DNA, 20 bp, Artificial
  CRISPR gRNA sequence
cttataacaagctctctttt

SEQ ID NO: 275429 - DNA, 20 bp, Artificial
  CRISPR gRNA sequence
ttggctgctgccatccacat

SEQ ID NO: 275430 - DNA, 20 bp, Artificial
  CRISPR gRNA sequence
tgccttctgccatgatttgt

SEQ ID NO: 275431 - DNA, 20 bp, Artificial
  CRISPR gRNA sequence
gccttctgccatgatttgtg

SEQ ID NO: 275432 - DNA, 20 bp, Artificial
  CRISPR gRNA sequence
catgatttgtgaggcctccc

SEQ ID NO: 275433 - DNA, 20 bp, Artificial
  CRISPR gRNA sequence
gtgaggcctccccagccacg

SEQ ID NO: 275434 - DNA, 20 bp, Artificial
  CRISPR gRNA sequence
ccccagccacgtggaactgt

SEQ ID NO: 275435 - DNA, 20 bp, Artificial
  CRISPR gRNA sequence
attaaacctctttattttgt

SEQ ID NO: 275436 - DNA, 20 bp, Artificial
  CRISPR gRNA sequence
tctttattttgtaagttgcc

SEQ ID NO: 275437 - DNA, 20 bp, Artificial
  CRISPR gRNA sequence
ttttgtaagttgcccagtct

SEQ ID NO: 275438 - DNA, 20 bp, Artificial
  CRISPR gRNA sequence
tttgtaagttgcccagtctc

SEQ ID NO: 275439 - DNA, 20 bp, Artificial
  CRISPR gRNA sequence
agtctcgggtatgtctttat

SEQ ID NO: 275440 - DNA, 20 bp, Artificial
  CRISPR gRNA sequence
ctcgggtatgtctttatcag

SEQ ID NO: 275441 - DNA, 20 bp, Artificial
  CRISPR gRNA sequence
gtctttatcagcagcatgaa

SEQ ID NO: 275442 - DNA, 20 bp, Artificial
  CRISPR gRNA sequence
tctttatcagcagcatgaaa

SEQ ID NO: 275443 - DNA, 20 bp, Artificial
  CRISPR gRNA sequence
ctttatcagcagcatgaaaa

SEQ ID NO: 275444 - DNA, 20 bp, Artificial
  CRISPR gRNA sequence
actaatacattttcacctca

SEQ ID NO: 275445 - DNA, 20 bp, Artificial
  CRISPR gRNA sequence
tacacttaatgtatatttgt

SEQ ID NO: 275446 - DNA, 20 bp, Artificial
  CRISPR gRNA sequence
ttaatgtatatttgttagtg

SEQ ID NO: 275447 - DNA, 20 bp, Artificial
  CRISPR gRNA sequence
tgtatatttgttagtgcagt

SEQ ID NO: 275448 - DNA, 20 bp, Artificial
  CRISPR gRNA sequence
tgcttttgaatcttattcta

SEQ ID NO: 275449 - DNA, 20 bp, Artificial
  CRISPR gRNA sequence
tattctaaagaatccccaca

SEQ ID NO: 275450 - DNA, 20 bp, Artificial
  CRISPR gRNA sequence
ccccacacagtccaattaat

SEQ ID NO: 275451 - DNA, 20 bp, Artificial
  CRISPR gRNA sequence
cagtccaattaatgagattt

SEQ ID NO: 275452 - DNA, 20 bp, Artificial
  CRISPR gRNA sequence
tttgagacatttatacccta

SEQ ID NO: 275453 - DNA, 20 bp, Artificial
  CRISPR gRNA sequence
atttataccctaaagctctc

SEQ ID NO: 275454 - DNA, 20 bp, Artificial
  CRISPR gRNA sequence
cctaaagctctccagccaca

SEQ ID NO: 275455 - DNA, 20 bp, Artificial
  CRISPR gRNA sequence
gccacaaagacaaaaacctt

SEQ ID NO: 275456 - DNA, 20 bp, Artificial
  CRISPR gRNA sequence
caaagacaaaaaccttaagt

SEQ ID NO: 275457 - DNA, 20 bp, Artificial
  CRISPR gRNA sequence
aaccttaagttagcaaacta

SEQ ID NO: 275458 - DNA, 20 bp, Artificial
  CRISPR gRNA sequence
agttagcaaactatagcaca

SEQ ID NO: 275459 - DNA, 20 bp, Artificial
  CRISPR gRNA sequence
gttagcaaactatagcacat

SEQ ID NO: 275460 - DNA, 20 bp, Artificial
  CRISPR gRNA sequence
tttttaaaaatgaaattttg

SEQ ID NO: 275461 - DNA, 20 bp, Artificial
  CRISPR gRNA sequence
taaaaatgaaattttgtggc

SEQ ID NO: 275462 - DNA, 20 bp, Artificial
  CRISPR gRNA sequence
aaaaatgaaattttgtggct

SEQ ID NO: 275463 - DNA, 20 bp, Artificial
  CRISPR gRNA sequence
tgaaattttgtggctgggtg

SEQ ID NO: 275464 - DNA, 20 bp, Artificial
  CRISPR gRNA sequence
aattttgtggctgggtgtag

SEQ ID NO: 275465 - DNA, 20 bp, Artificial
  CRISPR gRNA sequence
gtggctcacacctgtaatca

SEQ ID NO: 275466 - DNA, 20 bp, Artificial
  CRISPR gRNA sequence
acctgtaatcacagcgcttt

SEQ ID NO: 275467 - DNA, 20 bp, Artificial
  CRISPR gRNA sequence
ctgtaatcacagcgctttga

SEQ ID NO: 275468 - DNA, 20 bp, Artificial
  CRISPR gRNA sequence
tgtaatcacagcgctttgag

SEQ ID NO: 275469 - DNA, 20 bp, Artificial
  CRISPR gRNA sequence
tcacagcgctttgagaggct

SEQ ID NO: 275470 - DNA, 20 bp, Artificial
  CRISPR gRNA sequence
cacagcgctttgagaggctg

SEQ ID NO: 275471 - DNA, 20 bp, Artificial
  CRISPR gRNA sequence
agcgctttgagaggctgagg

SEQ ID NO: 275472 - DNA, 20 bp, Artificial
  CRISPR gRNA sequence
ctttgagaggctgaggcaga

SEQ ID NO: 275473 - DNA, 20 bp, Artificial
  CRISPR gRNA sequence
ctgaggcagatggatcacct

SEQ ID NO: 275474 - DNA, 20 bp, Artificial
  CRISPR gRNA sequence
gcagatggatcacctgagat

SEQ ID NO: 275475 - DNA, 20 bp, Artificial
  CRISPR gRNA sequence
cagatggatcacctgagatc

SEQ ID NO: 275476 - DNA, 20 bp, Artificial
  CRISPR gRNA sequence
gatggatcacctgagatcag

SEQ ID NO: 275477 - DNA, 20 bp, Artificial
  CRISPR gRNA sequence
tcacctgagatcaggagttc

SEQ ID NO: 275478 - DNA, 20 bp, Artificial
  CRISPR gRNA sequence
tgagatcaggagttcgagac

SEQ ID NO: 275479 - DNA, 20 bp, Artificial
  CRISPR gRNA sequence
cgagaccagcctgaccaaca

SEQ ID NO: 275480 - DNA, 20 bp, Artificial
  CRISPR gRNA sequence
ggtgaaaccccatctccact

SEQ ID NO: 275481 - DNA, 20 bp, Artificial
  CRISPR gRNA sequence
cactaagaaaatacataaat

SEQ ID NO: 275482 - DNA, 20 bp, Artificial
  CRISPR gRNA sequence
aagaaaatacataaattagc

SEQ ID NO: 275483 - DNA, 20 bp, Artificial
  CRISPR gRNA sequence
atacataaattagccagttg

SEQ ID NO: 275484 - DNA, 20 bp, Artificial
  CRISPR gRNA sequence
acataaattagccagttgtg

SEQ ID NO: 275485 - DNA, 20 bp, Artificial
  CRISPR gRNA sequence
cataaattagccagttgtgg

SEQ ID NO: 275486 - DNA, 20 bp, Artificial
  CRISPR gRNA sequence
aaattagccagttgtggagg

SEQ ID NO: 275487 - DNA, 20 bp, Artificial
  CRISPR gRNA sequence
aattagccagttgtggaggc

SEQ ID NO: 275488 - DNA, 20 bp, Artificial
  CRISPR gRNA sequence
gaggcaggcacctgtaatcc

SEQ ID NO: 275489 - DNA, 20 bp, Artificial
  CRISPR gRNA sequence
cacctgtaatcccagctact

SEQ ID NO: 275490 - DNA, 20 bp, Artificial
  CRISPR gRNA sequence
acctgtaatcccagctactt

SEQ ID NO: 275491 - DNA, 20 bp, Artificial
  CRISPR gRNA sequence
ctgtaatcccagctacttgg

SEQ ID NO: 275492 - DNA, 20 bp, Artificial
  CRISPR gRNA sequence
tgtaatcccagctacttggg

SEQ ID NO: 275493 - DNA, 20 bp, Artificial
  CRISPR gRNA sequence
tcccagctacttgggaggct

SEQ ID NO: 275494 - DNA, 20 bp, Artificial
  CRISPR gRNA sequence
cccagctacttgggaggctg

SEQ ID NO: 275495 - DNA, 20 bp, Artificial
  CRISPR gRNA sequence
agctacttgggaggctgagg

SEQ ID NO: 275496 - DNA, 20 bp, Artificial
  CRISPR gRNA sequence
gctacttgggaggctgaggc

SEQ ID NO: 275497 - DNA, 20 bp, Artificial
  CRISPR gRNA sequence
tacttgggaggctgaggcag

SEQ ID NO: 275498 - DNA, 20 bp, Artificial
  CRISPR gRNA sequence
gcaggagaatcgtttgaacc

SEQ ID NO: 275499 - DNA, 20 bp, Artificial
  CRISPR gRNA sequence
caggagaatcgtttgaacct

SEQ ID NO: 275500 - DNA, 20 bp, Artificial
  CRISPR gRNA sequence
ggagaatcgtttgaacctgg

SEQ ID NO: 275501 - DNA, 20 bp, Artificial
  CRISPR gRNA sequence
gagaatcgtttgaacctggg

SEQ ID NO: 275502 - DNA, 20 bp, Artificial
  CRISPR gRNA sequence
aatcgtttgaacctgggagg

SEQ ID NO: 275503 - DNA, 20 bp, Artificial
  CRISPR gRNA sequence
tcgtttgaacctgggaggca

SEQ ID NO: 275504 - DNA, 20 bp, Artificial
  CRISPR gRNA sequence
cgtttgaacctgggaggcag

SEQ ID NO: 275505 - DNA, 20 bp, Artificial
  CRISPR gRNA sequence
aacctgggaggcagaggttg

SEQ ID NO: 275506 - DNA, 20 bp, Artificial
  CRISPR gRNA sequence
tgggaggcagaggttgcagt

SEQ ID NO: 275507 - DNA, 20 bp, Artificial
  CRISPR gRNA sequence
ggcagaggttgcagtgagcc

SEQ ID NO: 275508 - DNA, 20 bp, Artificial
  CRISPR gRNA sequence
gagaccacaccattgcactc

SEQ ID NO: 275509 - DNA, 20 bp, Artificial
  CRISPR gRNA sequence
cacaccattgcactccagcc

SEQ ID NO: 275510 - DNA, 20 bp, Artificial
  CRISPR gRNA sequence
acaccattgcactccagcct

SEQ ID NO: 275511 - DNA, 20 bp, Artificial
  CRISPR gRNA sequence
tgcactccagcctgggcaac

SEQ ID NO: 275512 - DNA, 20 bp, Artificial
  CRISPR gRNA sequence
cactccagcctgggcaacaa

SEQ ID NO: 275513 - DNA, 20 bp, Artificial
  CRISPR gRNA sequence
tctgtctcaaaaaaaaaaaa

SEQ ID NO: 275514 - DNA, 20 bp, Artificial
  CRISPR gRNA sequence
tcaaaaaaaaaaaaaagaaa

SEQ ID NO: 275515 - DNA, 20 bp, Artificial
  CRISPR gRNA sequence
aaaaagaaaaagaaaaaaaa

SEQ ID NO: 275516 - DNA, 20 bp, Artificial
  CRISPR gRNA sequence
aaaaaaaagaaaaattttgt

SEQ ID NO: 275517 - DNA, 20 bp, Artificial
  CRISPR gRNA sequence
agaaaaattttgttggaaca

SEQ ID NO: 275518 - DNA, 20 bp, Artificial
  CRISPR gRNA sequence
attcatttatgtcttgtctg

SEQ ID NO: 275519 - DNA, 20 bp, Artificial
  CRISPR gRNA sequence
ggctgcttttgtgctacaac

SEQ ID NO: 275520 - DNA, 20 bp, Artificial
  CRISPR gRNA sequence
tgcttttgtgctacaaccag

SEQ ID NO: 275521 - DNA, 20 bp, Artificial
  CRISPR gRNA sequence
gtgctacaaccagcagaatt

SEQ ID NO: 275522 - DNA, 20 bp, Artificial
  CRISPR gRNA sequence
gcagaattgagttgttgcaa

SEQ ID NO: 275523 - DNA, 20 bp, Artificial
  CRISPR gRNA sequence
agaattgagttgttgcaaca

SEQ ID NO: 275524 - DNA, 20 bp, Artificial
  CRISPR gRNA sequence
caacagagactgtgactgca

SEQ ID NO: 275525 - DNA, 20 bp, Artificial
  CRISPR gRNA sequence
agcttaaaatatttactatc

SEQ ID NO: 275526 - DNA, 20 bp, Artificial
  CRISPR gRNA sequence
atttactatctggctctatt

SEQ ID NO: 275527 - DNA, 20 bp, Artificial
  CRISPR gRNA sequence
aaatttgccaacccctgtct

SEQ ID NO: 275528 - DNA, 20 bp, Artificial
  CRISPR gRNA sequence
tccaaatcaaaatgcaatcc

SEQ ID NO: 275529 - DNA, 20 bp, Artificial
  CRISPR gRNA sequence
aatcaaaatgcaatccaagc

SEQ ID NO: 275530 - DNA, 20 bp, Artificial
  CRISPR gRNA sequence
agtattactgatttaataat

SEQ ID NO: 275531 - DNA, 20 bp, Artificial
  CRISPR gRNA sequence
tactgttttctgccttcaat

SEQ ID NO: 275532 - DNA, 20 bp, Artificial
  CRISPR gRNA sequence
caatcagaataatgtaaaat

SEQ ID NO: 275533 - DNA, 20 bp, Artificial
  CRISPR gRNA sequence
tggttaaataatgctataac

SEQ ID NO: 275534 - DNA, 20 bp, Artificial
  CRISPR gRNA sequence
taaataatgctataacaaga

SEQ ID NO: 275535 - DNA, 20 bp, Artificial
  CRISPR gRNA sequence
ctataacaagaaagtaaaaa

SEQ ID NO: 275536 - DNA, 20 bp, Artificial
  CRISPR gRNA sequence
ataacaagaaagtaaaaata

SEQ ID NO: 275537 - DNA, 20 bp, Artificial
  CRISPR gRNA sequence
cttaataaactatatgattg

SEQ ID NO: 275538 - DNA, 20 bp, Artificial
  CRISPR gRNA sequence
aaaatttttacaacacataa

SEQ ID NO: 275539 - DNA, 20 bp, Artificial
  CRISPR gRNA sequence
acaacacataaaagatgact

SEQ ID NO: 275540 - DNA, 20 bp, Artificial
  CRISPR gRNA sequence
acataaaagatgactgagac

SEQ ID NO: 275541 - DNA, 20 bp, Artificial
  CRISPR gRNA sequence
aaaagatgactgagactggt

SEQ ID NO: 275542 - DNA, 20 bp, Artificial
  CRISPR gRNA sequence
atgactgagactggtaagtt

SEQ ID NO: 275543 - DNA, 20 bp, Artificial
  CRISPR gRNA sequence
gactgagactggtaagtttg

SEQ ID NO: 275544 - DNA, 20 bp, Artificial
  CRISPR gRNA sequence
tggtaagtttggagtatcaa

SEQ ID NO: 275545 - DNA, 20 bp, Artificial
  CRISPR gRNA sequence
gagtatcaatagtcatgtca

SEQ ID NO: 275546 - DNA, 20 bp, Artificial
  CRISPR gRNA sequence
tcaatagtcatgtcaaagtt

SEQ ID NO: 275547 - DNA, 20 bp, Artificial
  CRISPR gRNA sequence
tatatttgaactaattttcc

SEQ ID NO: 275548 - DNA, 20 bp, Artificial
  CRISPR gRNA sequence
atatttgaactaattttccc

SEQ ID NO: 275549 - DNA, 20 bp, Artificial
  CRISPR gRNA sequence
ccaggaaattttgtctcatt

SEQ ID NO: 275550 - DNA, 20 bp, Artificial
  CRISPR gRNA sequence
caggaaattttgtctcattg

SEQ ID NO: 275551 - DNA, 20 bp, Artificial
  CRISPR gRNA sequence
ttgtctcattgaggaaaata

SEQ ID NO: 275552 - DNA, 20 bp, Artificial
  CRISPR gRNA sequence
ggaaaataaagaatctgctg

SEQ ID NO: 275553 - DNA, 20 bp, Artificial
  CRISPR gRNA sequence
aataaagaatctgctgtagc

SEQ ID NO: 275554 - DNA, 20 bp, Artificial
  CRISPR gRNA sequence
ataaagaatctgctgtagcc

SEQ ID NO: 275555 - DNA, 20 bp, Artificial
  CRISPR gRNA sequence
gaatctgctgtagccgggca

SEQ ID NO: 275556 - DNA, 20 bp, Artificial
  CRISPR gRNA sequence
tctgctgtagccgggcatgg

SEQ ID NO: 275557 - DNA, 20 bp, Artificial
  CRISPR gRNA sequence
tgcctgtaatctccacactt

SEQ ID NO: 275558 - DNA, 20 bp, Artificial
  CRISPR gRNA sequence
gcctgtaatctccacacttt

SEQ ID NO: 275559 - DNA, 20 bp, Artificial
  CRISPR gRNA sequence
ctgtaatctccacactttgg

SEQ ID NO: 275560 - DNA, 20 bp, Artificial
  CRISPR gRNA sequence
tgtaatctccacactttggg

SEQ ID NO: 275561 - DNA, 20 bp, Artificial
  CRISPR gRNA sequence
tctccacactttgggaggct

SEQ ID NO: 275562 - DNA, 20 bp, Artificial
  CRISPR gRNA sequence
ctccacactttgggaggctg

SEQ ID NO: 275563 - DNA, 20 bp, Artificial
  CRISPR gRNA sequence
cacactttgggaggctgagg

SEQ ID NO: 275564 - DNA, 20 bp, Artificial
  CRISPR gRNA sequence
acactttgggaggctgaggc

SEQ ID NO: 275565 - DNA, 20 bp, Artificial
  CRISPR gRNA sequence
ctttgggaggctgaggcggg

SEQ ID NO: 275566 - DNA, 20 bp, Artificial
  CRISPR gRNA sequence
ctgaggcgggcagatcacct

SEQ ID NO: 275567 - DNA, 20 bp, Artificial
  CRISPR gRNA sequence
tgaggcgggcagatcaccta

SEQ ID NO: 275568 - DNA, 20 bp, Artificial
  CRISPR gRNA sequence
cgggcagatcacctaaggtc

SEQ ID NO: 275569 - DNA, 20 bp, Artificial
  CRISPR gRNA sequence
ggcagatcacctaaggtcga

SEQ ID NO: 275570 - DNA, 20 bp, Artificial
  CRISPR gRNA sequence
tcacctaaggtcgagagttc

SEQ ID NO: 275571 - DNA, 20 bp, Artificial
  CRISPR gRNA sequence
taaggtcgagagttcaagac

SEQ ID NO: 275572 - DNA, 20 bp, Artificial
  CRISPR gRNA sequence
caagaccagcctgaccaacg

SEQ ID NO: 275573 - DNA, 20 bp, Artificial
  CRISPR gRNA sequence
atacaaaaattatctgtgtg

SEQ ID NO: 275574 - DNA, 20 bp, Artificial
  CRISPR gRNA sequence
caaaaattatctgtgtgtgg

SEQ ID NO: 275575 - DNA, 20 bp, Artificial
  CRISPR gRNA sequence
aattatctgtgtgtggtggc

SEQ ID NO: 275576 - DNA, 20 bp, Artificial
  CRISPR gRNA sequence
tgtgtggtggctggcacctg

SEQ ID NO: 275577 - DNA, 20 bp, Artificial
  CRISPR gRNA sequence
gtggctggcacctgtagtcc

SEQ ID NO: 275578 - DNA, 20 bp, Artificial
  CRISPR gRNA sequence
cacctgtagtcccagctaca

SEQ ID NO: 275579 - DNA, 20 bp, Artificial
  CRISPR gRNA sequence
acctgtagtcccagctacac

SEQ ID NO: 275580 - DNA, 20 bp, Artificial
  CRISPR gRNA sequence
ctgtagtcccagctacacag

SEQ ID NO: 275581 - DNA, 20 bp, Artificial
  CRISPR gRNA sequence
tgtagtcccagctacacagg

SEQ ID NO: 275582 - DNA, 20 bp, Artificial
  CRISPR gRNA sequence
tcccagctacacaggaggct

SEQ ID NO: 275583 - DNA, 20 bp, Artificial
  CRISPR gRNA sequence
agctacacaggaggctgaga

SEQ ID NO: 275584 - DNA, 20 bp, Artificial
  CRISPR gRNA sequence
gctacacaggaggctgagac

SEQ ID NO: 275585 - DNA, 20 bp, Artificial
  CRISPR gRNA sequence
tacacaggaggctgagacag

SEQ ID NO: 275586 - DNA, 20 bp, Artificial
  CRISPR gRNA sequence
acaggagaattgcttcaacc

SEQ ID NO: 275587 - DNA, 20 bp, Artificial
  CRISPR gRNA sequence
caggagaattgcttcaacct

SEQ ID NO: 275588 - DNA, 20 bp, Artificial
  CRISPR gRNA sequence
ggagaattgcttcaacctgg

SEQ ID NO: 275589 - DNA, 20 bp, Artificial
  CRISPR gRNA sequence
gagaattgcttcaacctggg

SEQ ID NO: 275590 - DNA, 20 bp, Artificial
  CRISPR gRNA sequence
aattgcttcaacctgggagg

SEQ ID NO: 275591 - DNA, 20 bp, Artificial
  CRISPR gRNA sequence
ttgcttcaacctgggaggcg

SEQ ID NO: 275592 - DNA, 20 bp, Artificial
  CRISPR gRNA sequence
tgcttcaacctgggaggcgg

SEQ ID NO: 275593 - DNA, 20 bp, Artificial
  CRISPR gRNA sequence
aacctgggaggcggaggtta

SEQ ID NO: 275594 - DNA, 20 bp, Artificial
  CRISPR gRNA sequence
tgggaggcggaggttacagt

SEQ ID NO: 275595 - DNA, 20 bp, Artificial
  CRISPR gRNA sequence
ggcggaggttacagtgagcc

SEQ ID NO: 275596 - DNA, 20 bp, Artificial
  CRISPR gRNA sequence
aagatcacgccactgcactc

SEQ ID NO: 275597 - DNA, 20 bp, Artificial
  CRISPR gRNA sequence
cacgccactgcactccagcc

SEQ ID NO: 275598 - DNA, 20 bp, Artificial
  CRISPR gRNA sequence
acgccactgcactccagcct

SEQ ID NO: 275599 - DNA, 20 bp, Artificial
  CRISPR gRNA sequence
ctgcactccagcctgggtga

SEQ ID NO: 275600 - DNA, 20 bp, Artificial
  CRISPR gRNA sequence
gcactccagcctgggtgaca

SEQ ID NO: 275601 - DNA, 20 bp, Artificial
  CRISPR gRNA sequence
tccagcctgggtgacagagc

SEQ ID NO: 275602 - DNA, 20 bp, Artificial
  CRISPR gRNA sequence
aaaatctgctgtaacactga

SEQ ID NO: 275603 - DNA, 20 bp, Artificial
  CRISPR gRNA sequence
tgctgtaacactgaaagatc

SEQ ID NO: 275604 - DNA, 20 bp, Artificial
  CRISPR gRNA sequence
ctgtaacactgaaagatcta

SEQ ID NO: 275605 - DNA, 20 bp, Artificial
  CRISPR gRNA sequence
atctagagtaaatcatacac

SEQ ID NO: 275606 - DNA, 20 bp, Artificial
  CRISPR gRNA sequence
catacactagcatgaattac

SEQ ID NO: 275607 - DNA, 20 bp, Artificial
  CRISPR gRNA sequence
attatccacttcgcaactac

SEQ ID NO: 275608 - DNA, 20 bp, Artificial
  CRISPR gRNA sequence
ccacttcgcaactacaagta

SEQ ID NO: 275609 - DNA, 20 bp, Artificial
  CRISPR gRNA sequence
caactacaagtaaagacatg

SEQ ID NO: 275610 - DNA, 20 bp, Artificial
  CRISPR gRNA sequence
aagtaaagacatgaagaatt

SEQ ID NO: 275611 - DNA, 20 bp, Artificial
  CRISPR gRNA sequence
aagaattaagacatgccata

SEQ ID NO: 275612 - DNA, 20 bp, Artificial
  CRISPR gRNA sequence
tgcaactgtattatcaaact

SEQ ID NO: 275613 - DNA, 20 bp, Artificial
  CRISPR gRNA sequence
gtgttttgtttcttactata

SEQ ID NO: 275614 - DNA, 20 bp, Artificial
  CRISPR gRNA sequence
acagtcacaaaacctatcct

SEQ ID NO: 275615 - DNA, 20 bp, Artificial
  CRISPR gRNA sequence
cagtcacaaaacctatcctt

SEQ ID NO: 275616 - DNA, 20 bp, Artificial
  CRISPR gRNA sequence
gtcacaaaacctatccttgg

SEQ ID NO: 275617 - DNA, 20 bp, Artificial
  CRISPR gRNA sequence
acaaaacctatccttgggag

SEQ ID NO: 275618 - DNA, 20 bp, Artificial
  CRISPR gRNA sequence
caaaacctatccttgggagt

SEQ ID NO: 275619 - DNA, 20 bp, Artificial
  CRISPR gRNA sequence
aaaacctatccttgggagtg

SEQ ID NO: 275620 - DNA, 20 bp, Artificial
  CRISPR gRNA sequence
cctatccttgggagtggggc

SEQ ID NO: 275621 - DNA, 20 bp, Artificial
  CRISPR gRNA sequence
ctatccttgggagtggggct

SEQ ID NO: 275622 - DNA, 20 bp, Artificial
  CRISPR gRNA sequence
tatccttgggagtggggcta

SEQ ID NO: 275623 - DNA, 20 bp, Artificial
  CRISPR gRNA sequence
atccttgggagtggggctag

SEQ ID NO: 275624 - DNA, 20 bp, Artificial
  CRISPR gRNA sequence
cttgggagtggggctagggg

SEQ ID NO: 275625 - DNA, 20 bp, Artificial
  CRISPR gRNA sequence
ttgggagtggggctaggggt

SEQ ID NO: 275626 - DNA, 20 bp, Artificial
  CRISPR gRNA sequence
tgggagtggggctaggggta

SEQ ID NO: 275627 - DNA, 20 bp, Artificial
  CRISPR gRNA sequence
ggagtggggctaggggtagg

SEQ ID NO: 275628 - DNA, 20 bp, Artificial
  CRISPR gRNA sequence
agtggggctaggggtaggga

SEQ ID NO: 275629 - DNA, 20 bp, Artificial
  CRISPR gRNA sequence
tggggctaggggtagggaga

SEQ ID NO: 275630 - DNA, 20 bp, Artificial
  CRISPR gRNA sequence
ggggtagggagagagacctg

SEQ ID NO: 275631 - DNA, 20 bp, Artificial
  CRISPR gRNA sequence
cctgtggtcctctgtatgat

SEQ ID NO: 275632 - DNA, 20 bp, Artificial
  CRISPR gRNA sequence
atcagccgtacaatttaaac

SEQ ID NO: 275633 - DNA, 20 bp, Artificial
  CRISPR gRNA sequence
taaacaagtattaatatttt

SEQ ID NO: 275634 - DNA, 20 bp, Artificial
  CRISPR gRNA sequence
tattaatattttgagcatct

SEQ ID NO: 275635 - DNA, 20 bp, Artificial
  CRISPR gRNA sequence
agcatctcagttcaccttgt

SEQ ID NO: 275636 - DNA, 20 bp, Artificial
  CRISPR gRNA sequence
ttcaccttgtaagccatctt

SEQ ID NO: 275637 - DNA, 20 bp, Artificial
  CRISPR gRNA sequence
taagccatcttaagccatta

SEQ ID NO: 275638 - DNA, 20 bp, Artificial
  CRISPR gRNA sequence
aagccatcttaagccattat

SEQ ID NO: 275639 - DNA, 20 bp, Artificial
  CRISPR gRNA sequence
tcttaagccattataggcct

SEQ ID NO: 275640 - DNA, 20 bp, Artificial
  CRISPR gRNA sequence
tttcaaatgatttcacctct

SEQ ID NO: 275641 - DNA, 20 bp, Artificial
  CRISPR gRNA sequence
ttcaaatgatttcacctctt

SEQ ID NO: 275642 - DNA, 20 bp, Artificial
  CRISPR gRNA sequence
tcaaatgatttcacctcttg

SEQ ID NO: 275643 - DNA, 20 bp, Artificial
  CRISPR gRNA sequence
atgatttcacctcttgggga

SEQ ID NO: 275644 - DNA, 20 bp, Artificial
  CRISPR gRNA sequence
gatttcacctcttggggaaa

SEQ ID NO: 275645 - DNA, 20 bp, Artificial
  CRISPR gRNA sequence
ttggggaaagagaattctct

SEQ ID NO: 275646 - DNA, 20 bp, Artificial
  CRISPR gRNA sequence
gaattctctgagtttactac

SEQ ID NO: 275647 - DNA, 20 bp, Artificial
  CRISPR gRNA sequence
ttctctgagtttactaccag

SEQ ID NO: 275648 - DNA, 20 bp, Artificial
  CRISPR gRNA sequence
tctctgagtttactaccagt

SEQ ID NO: 275649 - DNA, 20 bp, Artificial
  CRISPR gRNA sequence
ctctgagtttactaccagta

SEQ ID NO: 275650 - DNA, 20 bp, Artificial
  CRISPR gRNA sequence
gctccaaaatgacctctttt

SEQ ID NO: 275651 - DNA, 20 bp, Artificial
  CRISPR gRNA sequence
ctccaaaatgacctcttttc

SEQ ID NO: 275652 - DNA, 20 bp, Artificial
  CRISPR gRNA sequence
tcttttcaggcgttgtcttc

SEQ ID NO: 275653 - DNA, 20 bp, Artificial
  CRISPR gRNA sequence
cttttcaggcgttgtcttca

SEQ ID NO: 275654 - DNA, 20 bp, Artificial
  CRISPR gRNA sequence
tttcaggcgttgtcttcaag

SEQ ID NO: 275655 - DNA, 20 bp, Artificial
  CRISPR gRNA sequence
agtttgtcactcacctttcc

SEQ ID NO: 275656 - DNA, 20 bp, Artificial
  CRISPR gRNA sequence
tcactcacctttcccagact

SEQ ID NO: 275657 - DNA, 20 bp, Artificial
  CRISPR gRNA sequence
cacctttcccagacttggtt

SEQ ID NO: 275658 - DNA, 20 bp, Artificial
  CRISPR gRNA sequence
agacttggttcagaatgaac

SEQ ID NO: 275659 - DNA, 20 bp, Artificial
  CRISPR gRNA sequence
cttggttcagaatgaaccag

SEQ ID NO: 275660 - DNA, 20 bp, Artificial
  CRISPR gRNA sequence
atgaaccagtagttcttaaa

SEQ ID NO: 275661 - DNA, 20 bp, Artificial
  CRISPR gRNA sequence
gcccacaaaaaaaaattgtt

SEQ ID NO: 275662 - DNA, 20 bp, Artificial
  CRISPR gRNA sequence
aaaaaaattgtttggcacca

SEQ ID NO: 275663 - DNA, 20 bp, Artificial
  CRISPR gRNA sequence
tttggcaccatggaaccgtg

SEQ ID NO: 275664 - DNA, 20 bp, Artificial
  CRISPR gRNA sequence
ttggcaccatggaaccgtgt

SEQ ID NO: 275665 - DNA, 20 bp, Artificial
  CRISPR gRNA sequence
gcaccatggaaccgtgtggg

SEQ ID NO: 275666 - DNA, 20 bp, Artificial
  CRISPR gRNA sequence
gtgtgggtggcatgccctaa

SEQ ID NO: 275667 - DNA, 20 bp, Artificial
  CRISPR gRNA sequence
gggtggcatgccctaaaaga

SEQ ID NO: 275668 - DNA, 20 bp, Artificial
  CRISPR gRNA sequence
aaagaaagcaccaaatccct

SEQ ID NO: 275669 - DNA, 20 bp, Artificial
  CRISPR gRNA sequence
aagaaagcaccaaatcccta

SEQ ID NO: 275670 - DNA, 20 bp, Artificial
  CRISPR gRNA sequence
agaaagcaccaaatccctaa

SEQ ID NO: 275671 - DNA, 20 bp, Artificial
  CRISPR gRNA sequence
aagcaccaaatccctaaggg

SEQ ID NO: 275672 - DNA, 20 bp, Artificial
  CRISPR gRNA sequence
aatccctaagggcagttcca

SEQ ID NO: 275673 - DNA, 20 bp, Artificial
  CRISPR gRNA sequence
atccctaagggcagttccaa

SEQ ID NO: 275674 - DNA, 20 bp, Artificial
  CRISPR gRNA sequence
tccctaagggcagttccaaa

SEQ ID NO: 275675 - DNA, 20 bp, Artificial
  CRISPR gRNA sequence
tattgttacaaaaacttttt

SEQ ID NO: 275676 - DNA, 20 bp, Artificial
  CRISPR gRNA sequence
tttttaagatgaatgcttga

SEQ ID NO: 275677 - DNA, 20 bp, Artificial
  CRISPR gRNA sequence
gatgaatgcttgatggataa

SEQ ID NO: 275678 - DNA, 20 bp, Artificial
  CRISPR gRNA sequence
gcttgatggataatggtttt

SEQ ID NO: 275679 - DNA, 20 bp, Artificial
  CRISPR gRNA sequence
tttttagtatatataaattt

SEQ ID NO: 275680 - DNA, 20 bp, Artificial
  CRISPR gRNA sequence
aattttagaatatttattac

SEQ ID NO: 275681 - DNA, 20 bp, Artificial
  CRISPR gRNA sequence
aatatttattacaagaaaat

SEQ ID NO: 275682 - DNA, 20 bp, Artificial
  CRISPR gRNA sequence
atatttattacaagaaaata

SEQ ID NO: 275683 - DNA, 20 bp, Artificial
  CRISPR gRNA sequence
ttattacaagaaaataaggc

SEQ ID NO: 275684 - DNA, 20 bp, Artificial
  CRISPR gRNA sequence
tattacaagaaaataaggcc

SEQ ID NO: 275685 - DNA, 20 bp, Artificial
  CRISPR gRNA sequence
caagaaaataaggccgggtg

SEQ ID NO: 275686 - DNA, 20 bp, Artificial
  CRISPR gRNA sequence
gaaaataaggccgggtgcag

SEQ ID NO: 275687 - DNA, 20 bp, Artificial
  CRISPR gRNA sequence
gtggctcacacctgtaatcc

SEQ ID NO: 275688 - DNA, 20 bp, Artificial
  CRISPR gRNA sequence
cacctgtaatcccagcactt

SEQ ID NO: 275689 - DNA, 20 bp, Artificial
  CRISPR gRNA sequence
acctgtaatcccagcacttt

SEQ ID NO: 275690 - DNA, 20 bp, Artificial
  CRISPR gRNA sequence
ctgtaatcccagcactttgg

SEQ ID NO: 275691 - DNA, 20 bp, Artificial
  CRISPR gRNA sequence
tgtaatcccagcactttggg

SEQ ID NO: 275692 - DNA, 20 bp, Artificial
  CRISPR gRNA sequence
tcccagcactttgggaggct

SEQ ID NO: 275693 - DNA, 20 bp, Artificial
  CRISPR gRNA sequence
cccagcactttgggaggctg

SEQ ID NO: 275694 - DNA, 20 bp, Artificial
  CRISPR gRNA sequence
agcactttgggaggctgagg

SEQ ID NO: 275695 - DNA, 20 bp, Artificial
  CRISPR gRNA sequence
gcactttgggaggctgaggc

SEQ ID NO: 275696 - DNA, 20 bp, Artificial
  CRISPR gRNA sequence
ctttgggaggctgaggcggg

SEQ ID NO: 275697 - DNA, 20 bp, Artificial
  CRISPR gRNA sequence
ggctgaggcgggcggatcac

SEQ ID NO: 275698 - DNA, 20 bp, Artificial
  CRISPR gRNA sequence
gctgaggcgggcggatcacg

SEQ ID NO: 275699 - DNA, 20 bp, Artificial
  CRISPR gRNA sequence
aggcgggcggatcacgaggt

SEQ ID NO: 275700 - DNA, 20 bp, Artificial
  CRISPR gRNA sequence
ggcgggcggatcacgaggtc

SEQ ID NO: 275701 - DNA, 20 bp, Artificial
  CRISPR gRNA sequence
cgggcggatcacgaggtcag

SEQ ID NO: 275702 - DNA, 20 bp, Artificial
  CRISPR gRNA sequence
gatcacgaggtcaggagttc

SEQ ID NO: 275703 - DNA, 20 bp, Artificial
  CRISPR gRNA sequence
cgaggtcaggagttcgagac

SEQ ID NO: 275704 - DNA, 20 bp, Artificial
  CRISPR gRNA sequence
cgagaccagcctgaccaaca

SEQ ID NO: 275705 - DNA, 20 bp, Artificial
  CRISPR gRNA sequence
gtgaaaccccatctccacta

SEQ ID NO: 275706 - DNA, 20 bp, Artificial
  CRISPR gRNA sequence
aaccccatctccactaaaga

SEQ ID NO: 275707 - DNA, 20 bp, Artificial
  CRISPR gRNA sequence
ccactaaagatagaaaaaat

SEQ ID NO: 275708 - DNA, 20 bp, Artificial
  CRISPR gRNA sequence
aaagatagaaaaaattagcc

SEQ ID NO: 275709 - DNA, 20 bp, Artificial
  CRISPR gRNA sequence
aagatagaaaaaattagccg

SEQ ID NO: 275710 - DNA, 20 bp, Artificial
  CRISPR gRNA sequence
agatagaaaaaattagccga

SEQ ID NO: 275711 - DNA, 20 bp, Artificial
  CRISPR gRNA sequence
tagaaaaaattagccgaggg

SEQ ID NO: 275712 - DNA, 20 bp, Artificial
  CRISPR gRNA sequence
aaaaaattagccgagggtgg

SEQ ID NO: 275713 - DNA, 20 bp, Artificial
  CRISPR gRNA sequence
aattagccgagggtggtggc

SEQ ID NO: 275714 - DNA, 20 bp, Artificial
  CRISPR gRNA sequence
gtggctggcgcctgtaatcc

SEQ ID NO: 275715 - DNA, 20 bp, Artificial
  CRISPR gRNA sequence
cgcctgtaatcccagctatt

SEQ ID NO: 275716 - DNA, 20 bp, Artificial
  CRISPR gRNA sequence
gcctgtaatcccagctattc

SEQ ID NO: 275717 - DNA, 20 bp, Artificial
  CRISPR gRNA sequence
ctgtaatcccagctattcgg

SEQ ID NO: 275718 - DNA, 20 bp, Artificial
  CRISPR gRNA sequence
tgtaatcccagctattcggg

SEQ ID NO: 275719 - DNA, 20 bp, Artificial
  CRISPR gRNA sequence
tcccagctattcgggaggct

SEQ ID NO: 275720 - DNA, 20 bp, Artificial
  CRISPR gRNA sequence
cccagctattcgggaggctg

SEQ ID NO: 275721 - DNA, 20 bp, Artificial
  CRISPR gRNA sequence
agctattcgggaggctgagg

SEQ ID NO: 275722 - DNA, 20 bp, Artificial
  CRISPR gRNA sequence
tattcgggaggctgaggcag

SEQ ID NO: 275723 - DNA, 20 bp, Artificial
  CRISPR gRNA sequence
gcagaagaattgcttgaacc

SEQ ID NO: 275724 - DNA, 20 bp, Artificial
  CRISPR gRNA sequence
gaagaattgcttgaacctgg

SEQ ID NO: 275725 - DNA, 20 bp, Artificial
  CRISPR gRNA sequence
aagaattgcttgaacctgga

SEQ ID NO: 275726 - DNA, 20 bp, Artificial
  CRISPR gRNA sequence
aattgcttgaacctggaagg

SEQ ID NO: 275727 - DNA, 20 bp, Artificial
  CRISPR gRNA sequence
ttgcttgaacctggaaggtg

SEQ ID NO: 275728 - DNA, 20 bp, Artificial
  CRISPR gRNA sequence
tgcttgaacctggaaggtgg

SEQ ID NO: 275729 - DNA, 20 bp, Artificial
  CRISPR gRNA sequence
aacctggaaggtggaggttg

SEQ ID NO: 275730 - DNA, 20 bp, Artificial
  CRISPR gRNA sequence
tggaaggtggaggttgcagt

SEQ ID NO: 275731 - DNA, 20 bp, Artificial
  CRISPR gRNA sequence
ggtggaggttgcagtgagct

SEQ ID NO: 275732 - DNA, 20 bp, Artificial
  CRISPR gRNA sequence
gagattgtgccactgcactc

SEQ ID NO: 275733 - DNA, 20 bp, Artificial
  CRISPR gRNA sequence
tgtgccactgcactccagcc

SEQ ID NO: 275734 - DNA, 20 bp, Artificial
  CRISPR gRNA sequence
gtgccactgcactccagcct

SEQ ID NO: 275735 - DNA, 20 bp, Artificial
  CRISPR gRNA sequence
ctgcactccagcctgggcaa

SEQ ID NO: 275736 - DNA, 20 bp, Artificial
  CRISPR gRNA sequence
tgcactccagcctgggcaac

SEQ ID NO: 275737 - DNA, 20 bp, Artificial
  CRISPR gRNA sequence
gcactccagcctgggcaaca

SEQ ID NO: 275738 - DNA, 20 bp, Artificial
  CRISPR gRNA sequence
tccagcctgggcaacagggc

SEQ ID NO: 275739 - DNA, 20 bp, Artificial
  CRISPR gRNA sequence
aaaataaataaataaataaa

SEQ ID NO: 275740 - DNA, 20 bp, Artificial
  CRISPR gRNA sequence
taaataaataaaaagaaaat

SEQ ID NO: 275741 - DNA, 20 bp, Artificial
  CRISPR gRNA sequence
taacattatcacaccttgca

SEQ ID NO: 275742 - DNA, 20 bp, Artificial
  CRISPR gRNA sequence
attattttatttatttcttt

SEQ ID NO: 275743 - DNA, 20 bp, Artificial
  CRISPR gRNA sequence
tattttatttatttctttta

SEQ ID NO: 275744 - DNA, 20 bp, Artificial
  CRISPR gRNA sequence
ttatttatttcttttagaga

SEQ ID NO: 275745 - DNA, 20 bp, Artificial
  CRISPR gRNA sequence
tatttatttcttttagagac

SEQ ID NO: 275746 - DNA, 20 bp, Artificial
  CRISPR gRNA sequence
atttatttcttttagagaca

SEQ ID NO: 275747 - DNA, 20 bp, Artificial
  CRISPR gRNA sequence
cagggtctcactctgttgcc

SEQ ID NO: 275748 - DNA, 20 bp, Artificial
  CRISPR gRNA sequence
agggtctcactctgttgccc

SEQ ID NO: 275749 - DNA, 20 bp, Artificial
  CRISPR gRNA sequence
tctcactctgttgcccaggc

SEQ ID NO: 275750 - DNA, 20 bp, Artificial
  CRISPR gRNA sequence
tcactctgttgcccaggctg

SEQ ID NO: 275751 - DNA, 20 bp, Artificial
  CRISPR gRNA sequence
ctgttgcccaggctggagtc

SEQ ID NO: 275752 - DNA, 20 bp, Artificial
  CRISPR gRNA sequence
ttgcccaggctggagtctag

SEQ ID NO: 275753 - DNA, 20 bp, Artificial
  CRISPR gRNA sequence
ggagtctagtggcatgatca

SEQ ID NO: 275754 - DNA, 20 bp, Artificial
  CRISPR gRNA sequence
tcactgcaactttgaacacc

SEQ ID NO: 275755 - DNA, 20 bp, Artificial
  CRISPR gRNA sequence
cactgcaactttgaacacct

SEQ ID NO: 275756 - DNA, 20 bp, Artificial
  CRISPR gRNA sequence
aactttgaacacctgggctc

SEQ ID NO: 275757 - DNA, 20 bp, Artificial
  CRISPR gRNA sequence
ttgaacacctgggctcaagt

SEQ ID NO: 275758 - DNA, 20 bp, Artificial
  CRISPR gRNA sequence
gccacccaccttaccctccc

SEQ ID NO: 275759 - DNA, 20 bp, Artificial
  CRISPR gRNA sequence
accttaccctcccaagtacc

SEQ ID NO: 275760 - DNA, 20 bp, Artificial
  CRISPR gRNA sequence
ccttaccctcccaagtacct

SEQ ID NO: 275761 - DNA, 20 bp, Artificial
  CRISPR gRNA sequence
gactacacatgtgtgtcacc

SEQ ID NO: 275762 - DNA, 20 bp, Artificial
  CRISPR gRNA sequence
cacatgtgtgtcaccaagcc

SEQ ID NO: 275763 - DNA, 20 bp, Artificial
  CRISPR gRNA sequence
ctaattttttaaatgttctg

SEQ ID NO: 275764 - DNA, 20 bp, Artificial
  CRISPR gRNA sequence
aattttttaaatgttctgta

SEQ ID NO: 275765 - DNA, 20 bp, Artificial
  CRISPR gRNA sequence
ttttaaatgttctgtagagt

SEQ ID NO: 275766 - DNA, 20 bp, Artificial
  CRISPR gRNA sequence
ttaaatgttctgtagagtca

SEQ ID NO: 275767 - DNA, 20 bp, Artificial
  CRISPR gRNA sequence
agtcagagtctcatgcttcc

SEQ ID NO: 275768 - DNA, 20 bp, Artificial
  CRISPR gRNA sequence
agagtctcatgcttcccagc

SEQ ID NO: 275769 - DNA, 20 bp, Artificial
  CRISPR gRNA sequence
cccagctggtcttgaactcc

SEQ ID NO: 275770 - DNA, 20 bp, Artificial
  CRISPR gRNA sequence
ccagctggtcttgaactcct

SEQ ID NO: 275771 - DNA, 20 bp, Artificial
  CRISPR gRNA sequence
ggtcttgaactcctgggctc

SEQ ID NO: 275772 - DNA, 20 bp, Artificial
  CRISPR gRNA sequence
ctcaagtgatcctcccactt

SEQ ID NO: 275773 - DNA, 20 bp, Artificial
  CRISPR gRNA sequence
cctcccacttcagcctccca

SEQ ID NO: 275774 - DNA, 20 bp, Artificial
  CRISPR gRNA sequence
acttcagcctcccaaagtgc

SEQ ID NO: 275775 - DNA, 20 bp, Artificial
  CRISPR gRNA sequence
cttcagcctcccaaagtgct

SEQ ID NO: 275776 - DNA, 20 bp, Artificial
  CRISPR gRNA sequence
ctcccaaagtgctgggatta

SEQ ID NO: 275777 - DNA, 20 bp, Artificial
  CRISPR gRNA sequence
tcccaaagtgctgggattac

SEQ ID NO: 275778 - DNA, 20 bp, Artificial
  CRISPR gRNA sequence
agtgctgggattacaggcat

SEQ ID NO: 275779 - DNA, 20 bp, Artificial
  CRISPR gRNA sequence
caggcatgagccactgtgcc

SEQ ID NO: 275780 - DNA, 20 bp, Artificial
  CRISPR gRNA sequence
agccactgtgcccagtctca

SEQ ID NO: 275781 - DNA, 20 bp, Artificial
  CRISPR gRNA sequence
agtctcacagtgactttaat

SEQ ID NO: 275782 - DNA, 20 bp, Artificial
  CRISPR gRNA sequence
gtgactttaataagtcataa

SEQ ID NO: 275783 - DNA, 20 bp, Artificial
  CRISPR gRNA sequence
cgacaattctaaaatgtatc

SEQ ID NO: 275784 - DNA, 20 bp, Artificial
  CRISPR gRNA sequence
attctaaaatgtatctggct

SEQ ID NO: 275785 - DNA, 20 bp, Artificial
  CRISPR gRNA sequence
aaatgtatctggctgagtta

SEQ ID NO: 275786 - DNA, 20 bp, Artificial
  CRISPR gRNA sequence
gtgccatgtaacattttcaa

SEQ ID NO: 275787 - DNA, 20 bp, Artificial
  CRISPR gRNA sequence
atggcattctgcatatatga

SEQ ID NO: 275788 - DNA, 20 bp, Artificial
  CRISPR gRNA sequence
gcattctgcatatatgatgg

SEQ ID NO: 275789 - DNA, 20 bp, Artificial
  CRISPR gRNA sequence
ttcctatgtttacatacgct

SEQ ID NO: 275790 - DNA, 20 bp, Artificial
  CRISPR gRNA sequence
gttacaactgcctatgtgtt

SEQ ID NO: 275791 - DNA, 20 bp, Artificial
  CRISPR gRNA sequence
aactgcctatgtgttcagta

SEQ ID NO: 275792 - DNA, 20 bp, Artificial
  CRISPR gRNA sequence
cagtatggtaacatgctgta

SEQ ID NO: 275793 - DNA, 20 bp, Artificial
  CRISPR gRNA sequence
agtatggtaacatgctgtac

SEQ ID NO: 275794 - DNA, 20 bp, Artificial
  CRISPR gRNA sequence
taacatgctgtacaggtgtg

SEQ ID NO: 275795 - DNA, 20 bp, Artificial
  CRISPR gRNA sequence
gctgtacaggtgtgtagcct

SEQ ID NO: 275796 - DNA, 20 bp, Artificial
  CRISPR gRNA sequence
tgtacaggtgtgtagcctca

SEQ ID NO: 275797 - DNA, 20 bp, Artificial
  CRISPR gRNA sequence
ggtgtgtagcctcagagcac

SEQ ID NO: 275798 - DNA, 20 bp, Artificial
  CRISPR gRNA sequence
gtgtgtagcctcagagcact

SEQ ID NO: 275799 - DNA, 20 bp, Artificial
  CRISPR gRNA sequence
gagcactgggctgtaccatg

SEQ ID NO: 275800 - DNA, 20 bp, Artificial
  CRISPR gRNA sequence
ctgggctgtaccatgtagcc

SEQ ID NO: 275801 - DNA, 20 bp, Artificial
  CRISPR gRNA sequence
tgggctgtaccatgtagcct

SEQ ID NO: 275802 - DNA, 20 bp, Artificial
  CRISPR gRNA sequence
taccatgtagcctaggtgtg

SEQ ID NO: 275803 - DNA, 20 bp, Artificial
  CRISPR gRNA sequence
catgtagcctaggtgtgcag

SEQ ID NO: 275804 - DNA, 20 bp, Artificial
  CRISPR gRNA sequence
atgtagcctaggtgtgcagt

SEQ ID NO: 275805 - DNA, 20 bp, Artificial
  CRISPR gRNA sequence
gtgcagtaggctgtaccatc

SEQ ID NO: 275806 - DNA, 20 bp, Artificial
  CRISPR gRNA sequence
tgcagtaggctgtaccatct

SEQ ID NO: 275807 - DNA, 20 bp, Artificial
  CRISPR gRNA sequence
tgtaaatacactctgatgtt

SEQ ID NO: 275808 - DNA, 20 bp, Artificial
  CRISPR gRNA sequence
ctctgatgttcagacaatga

SEQ ID NO: 275809 - DNA, 20 bp, Artificial
  CRISPR gRNA sequence
acacgactatattgtctttt

SEQ ID NO: 275810 - DNA, 20 bp, Artificial
  CRISPR gRNA sequence
ttgtctttttagattcgata

SEQ ID NO: 275811 - DNA, 20 bp, Artificial
  CRISPR gRNA sequence
tctttttagattcgatatag

SEQ ID NO: 275812 - DNA, 20 bp, Artificial
  CRISPR gRNA sequence
tcgatatagtagaaactccc

SEQ ID NO: 275813 - DNA, 20 bp, Artificial
  CRISPR gRNA sequence
aatgtcacttacttgtattc

SEQ ID NO: 275814 - DNA, 20 bp, Artificial
  CRISPR gRNA sequence
acttacttgtattccagttg

SEQ ID NO: 275815 - DNA, 20 bp, Artificial
  CRISPR gRNA sequence
cttacttgtattccagttga

SEQ ID NO: 275816 - DNA, 20 bp, Artificial
  CRISPR gRNA sequence
cttaaatgtccatacttgat

SEQ ID NO: 275817 - DNA, 20 bp, Artificial
  CRISPR gRNA sequence
catacttgatgagacacatg

SEQ ID NO: 275818 - DNA, 20 bp, Artificial
  CRISPR gRNA sequence
tgatgagacacatgaagctg

SEQ ID NO: 275819 - DNA, 20 bp, Artificial
  CRISPR gRNA sequence
gagacacatgaagctgtggt

SEQ ID NO: 275820 - DNA, 20 bp, Artificial
  CRISPR gRNA sequence
ttggttgtcatattgaaatc

SEQ ID NO: 275821 - DNA, 20 bp, Artificial
  CRISPR gRNA sequence
gaaatccagtttgctgctaa

SEQ ID NO: 275822 - DNA, 20 bp, Artificial
  CRISPR gRNA sequence
ccagtttgctgctaacagca

SEQ ID NO: 275823 - DNA, 20 bp, Artificial
  CRISPR gRNA sequence
agtttgctgctaacagcata

SEQ ID NO: 275824 - DNA, 20 bp, Artificial
  CRISPR gRNA sequence
gctgctaacagcatagagct

SEQ ID NO: 275825 - DNA, 20 bp, Artificial
  CRISPR gRNA sequence
aacagcatagagctcagttt

SEQ ID NO: 275826 - DNA, 20 bp, Artificial
  CRISPR gRNA sequence
acagcatagagctcagtttc

SEQ ID NO: 275827 - DNA, 20 bp, Artificial
  CRISPR gRNA sequence
agagctcagtttcaggatct

SEQ ID NO: 275828 - DNA, 20 bp, Artificial
  CRISPR gRNA sequence
gagctcagtttcaggatctt

SEQ ID NO: 275829 - DNA, 20 bp, Artificial
  CRISPR gRNA sequence
ttgggaaactgttgtgttga

SEQ ID NO: 275830 - DNA, 20 bp, Artificial
  CRISPR gRNA sequence
attcttctccattttccaac

SEQ ID NO: 275831 - DNA, 20 bp, Artificial
  CRISPR gRNA sequence
ttcttctccattttccaacc

SEQ ID NO: 275832 - DNA, 20 bp, Artificial
  CRISPR gRNA sequence
cttctccattttccaaccag

SEQ ID NO: 275833 - DNA, 20 bp, Artificial
  CRISPR gRNA sequence
tctccattttccaaccagga

SEQ ID NO: 275834 - DNA, 20 bp, Artificial
  CRISPR gRNA sequence
ctccattttccaaccaggag

SEQ ID NO: 275835 - DNA, 20 bp, Artificial
  CRISPR gRNA sequence
attttccaaccaggagaggt

SEQ ID NO: 275836 - DNA, 20 bp, Artificial
  CRISPR gRNA sequence
ttttccaaccaggagaggtg

SEQ ID NO: 275837 - DNA, 20 bp, Artificial
  CRISPR gRNA sequence
aaccaggagaggtgaggctc

SEQ ID NO: 275838 - DNA, 20 bp, Artificial
  CRISPR gRNA sequence
gtgaggctctggaaaacctc

SEQ ID NO: 275839 - DNA, 20 bp, Artificial
  CRISPR gRNA sequence
gaggctctggaaaacctcca

SEQ ID NO: 275840 - DNA, 20 bp, Artificial
  CRISPR gRNA sequence
aggctctggaaaacctccag

SEQ ID NO: 275841 - DNA, 20 bp, Artificial
  CRISPR gRNA sequence
ctggaaaacctccagaggtt

SEQ ID NO: 275842 - DNA, 20 bp, Artificial
  CRISPR gRNA sequence
gcaaattatccttctaatat

SEQ ID NO: 275843 - DNA, 20 bp, Artificial
  CRISPR gRNA sequence
aattatccttctaatattag

SEQ ID NO: 275844 - DNA, 20 bp, Artificial
  CRISPR gRNA sequence
atccttctaatattagaagt

SEQ ID NO: 275845 - DNA, 20 bp, Artificial
  CRISPR gRNA sequence
tattagaagttggaatttca

SEQ ID NO: 275846 - DNA, 20 bp, Artificial
  CRISPR gRNA sequence
agaagttggaatttcaaagt

SEQ ID NO: 275847 - DNA, 20 bp, Artificial
  CRISPR gRNA sequence
aatttcaaagtcagatatac

SEQ ID NO: 275848 - DNA, 20 bp, Artificial
  CRISPR gRNA sequence
atttcaaagtcagatatact

SEQ ID NO: 275849 - DNA, 20 bp, Artificial
  CRISPR gRNA sequence
aaagtcagatatactaggtg

SEQ ID NO: 275850 - DNA, 20 bp, Artificial
  CRISPR gRNA sequence
aagtcagatatactaggtgt

SEQ ID NO: 275851 - DNA, 20 bp, Artificial
  CRISPR gRNA sequence
agtcagatatactaggtgta

SEQ ID NO: 275852 - DNA, 20 bp, Artificial
  CRISPR gRNA sequence
cagatatactaggtgtaggg

SEQ ID NO: 275853 - DNA, 20 bp, Artificial
  CRISPR gRNA sequence
tatactaggtgtagggaagt

SEQ ID NO: 275854 - DNA, 20 bp, Artificial
  CRISPR gRNA sequence
aggtgtagggaagtcagcta

SEQ ID NO: 275855 - DNA, 20 bp, Artificial
  CRISPR gRNA sequence
gtagggaagtcagctaaaga

SEQ ID NO: 275856 - DNA, 20 bp, Artificial
  CRISPR gRNA sequence
aagtcagctaaagaaagaac

SEQ ID NO: 275857 - DNA, 20 bp, Artificial
  CRISPR gRNA sequence
caagaatatataattacgta

SEQ ID NO: 275858 - DNA, 20 bp, Artificial
  CRISPR gRNA sequence
tagttacaaacctatgtgtg

SEQ ID NO: 275859 - DNA, 20 bp, Artificial
  CRISPR gRNA sequence
gttacaaacctatgtgtgta

SEQ ID NO: 275860 - DNA, 20 bp, Artificial
  CRISPR gRNA sequence
ttacaaacctatgtgtgtag

SEQ ID NO: 275861 - DNA, 20 bp, Artificial
  CRISPR gRNA sequence
tttatttttaaataattttc

SEQ ID NO: 275862 - DNA, 20 bp, Artificial
  CRISPR gRNA sequence
aataattttctagctttaat

SEQ ID NO: 275863 - DNA, 20 bp, Artificial
  CRISPR gRNA sequence
agctttaataagaattgata

SEQ ID NO: 275864 - DNA, 20 bp, Artificial
  CRISPR gRNA sequence
gctttaataagaattgataa

SEQ ID NO: 275865 - DNA, 20 bp, Artificial
  CRISPR gRNA sequence
taataagaattgataaaggc

SEQ ID NO: 275866 - DNA, 20 bp, Artificial
  CRISPR gRNA sequence
aataagaattgataaaggcc

SEQ ID NO: 275867 - DNA, 20 bp, Artificial
  CRISPR gRNA sequence
gaattgataaaggccaggtg

SEQ ID NO: 275868 - DNA, 20 bp, Artificial
  CRISPR gRNA sequence
ttgataaaggccaggtgcag

SEQ ID NO: 275869 - DNA, 20 bp, Artificial
  CRISPR gRNA sequence
gtggctcactcctgtaatcc

SEQ ID NO: 275870 - DNA, 20 bp, Artificial
  CRISPR gRNA sequence
ctcctgtaatcccagcactt

SEQ ID NO: 275871 - DNA, 20 bp, Artificial
  CRISPR gRNA sequence
tcctgtaatcccagcacttt

SEQ ID NO: 275872 - DNA, 20 bp, Artificial
  CRISPR gRNA sequence
ctgtaatcccagcactttgg

SEQ ID NO: 275873 - DNA, 20 bp, Artificial
  CRISPR gRNA sequence
tgtaatcccagcactttggg

SEQ ID NO: 275874 - DNA, 20 bp, Artificial
  CRISPR gRNA sequence
tcccagcactttgggaggcc

SEQ ID NO: 275875 - DNA, 20 bp, Artificial
  CRISPR gRNA sequence
cccagcactttgggaggccg

SEQ ID NO: 275876 - DNA, 20 bp, Artificial
  CRISPR gRNA sequence
agcactttgggaggccgagg

SEQ ID NO: 275877 - DNA, 20 bp, Artificial
  CRISPR gRNA sequence
gcactttgggaggccgaggc

SEQ ID NO: 275878 - DNA, 20 bp, Artificial
  CRISPR gRNA sequence
ctttgggaggccgaggcagg

SEQ ID NO: 275879 - DNA, 20 bp, Artificial
  CRISPR gRNA sequence
ccgaggcaggtggaacacct

SEQ ID NO: 275880 - DNA, 20 bp, Artificial
  CRISPR gRNA sequence
cgaggcaggtggaacacctg

SEQ ID NO: 275881 - DNA, 20 bp, Artificial
  CRISPR gRNA sequence
gcaggtggaacacctgaggt

SEQ ID NO: 275882 - DNA, 20 bp, Artificial
  CRISPR gRNA sequence
caggtggaacacctgaggtc

SEQ ID NO: 275883 - DNA, 20 bp, Artificial
  CRISPR gRNA sequence
ggtggaacacctgaggtcag

SEQ ID NO: 275884 - DNA, 20 bp, Artificial
  CRISPR gRNA sequence
acacctgaggtcaggagttt

SEQ ID NO: 275885 - DNA, 20 bp, Artificial
  CRISPR gRNA sequence
tgaggtcaggagtttgagac

SEQ ID NO: 275886 - DNA, 20 bp, Artificial
  CRISPR gRNA sequence
tcaggagtttgagaccagcc

SEQ ID NO: 275887 - DNA, 20 bp, Artificial
  CRISPR gRNA sequence
tgagaccagcctggctaaca

SEQ ID NO: 275888 - DNA, 20 bp, Artificial
  CRISPR gRNA sequence
ccaaaaatacataaattaac

SEQ ID NO: 275889 - DNA, 20 bp, Artificial
  CRISPR gRNA sequence
caaaaatacataaattaacc

SEQ ID NO: 275890 - DNA, 20 bp, Artificial
  CRISPR gRNA sequence
atacataaattaaccaggcg

SEQ ID NO: 275891 - DNA, 20 bp, Artificial
  CRISPR gRNA sequence
cataaattaaccaggcgtgg

SEQ ID NO: 275892 - DNA, 20 bp, Artificial
  CRISPR gRNA sequence
aaattaaccaggcgtggtgg

SEQ ID NO: 275893 - DNA, 20 bp, Artificial
  CRISPR gRNA sequence
aattaaccaggcgtggtggc

SEQ ID NO: 275894 - DNA, 20 bp, Artificial
  CRISPR gRNA sequence
gtggcaggcgcctataatcc

SEQ ID NO: 275895 - DNA, 20 bp, Artificial
  CRISPR gRNA sequence
cgcctataatcccagctact

SEQ ID NO: 275896 - DNA, 20 bp, Artificial
  CRISPR gRNA sequence
gcctataatcccagctactc

SEQ ID NO: 275897 - DNA, 20 bp, Artificial
  CRISPR gRNA sequence
ctataatcccagctactcgg

SEQ ID NO: 275898 - DNA, 20 bp, Artificial
  CRISPR gRNA sequence
tataatcccagctactcggg

SEQ ID NO: 275899 - DNA, 20 bp, Artificial
  CRISPR gRNA sequence
tcccagctactcgggaggct

SEQ ID NO: 275900 - DNA, 20 bp, Artificial
  CRISPR gRNA sequence
cccagctactcgggaggcta

SEQ ID NO: 275901 - DNA, 20 bp, Artificial
  CRISPR gRNA sequence
gctactcgggaggctaaggc

SEQ ID NO: 275902 - DNA, 20 bp, Artificial
  CRISPR gRNA sequence
tactcgggaggctaaggcaa

SEQ ID NO: 275903 - DNA, 20 bp, Artificial
  CRISPR gRNA sequence
gggaggctaaggcaagagaa

SEQ ID NO: 275904 - DNA, 20 bp, Artificial
  CRISPR gRNA sequence
gcaagagaatggcttgaacc

SEQ ID NO: 275905 - DNA, 20 bp, Artificial
  CRISPR gRNA sequence
aagagaatggcttgaaccca

SEQ ID NO: 275906 - DNA, 20 bp, Artificial
  CRISPR gRNA sequence
agagaatggcttgaacccag

SEQ ID NO: 275907 - DNA, 20 bp, Artificial
  CRISPR gRNA sequence
gagaatggcttgaacccaga

SEQ ID NO: 275908 - DNA, 20 bp, Artificial
  CRISPR gRNA sequence
aatggcttgaacccagaggg

SEQ ID NO: 275909 - DNA, 20 bp, Artificial
  CRISPR gRNA sequence
tggcttgaacccagagggtg

SEQ ID NO: 275910 - DNA, 20 bp, Artificial
  CRISPR gRNA sequence
aacccagagggtggagattg

SEQ ID NO: 275911 - DNA, 20 bp, Artificial
  CRISPR gRNA sequence
cagagggtggagattgcagt

SEQ ID NO: 275912 - DNA, 20 bp, Artificial
  CRISPR gRNA sequence
ggtggagattgcagttagcc

SEQ ID NO: 275913 - DNA, 20 bp, Artificial
  CRISPR gRNA sequence
gagatcgtacgacttcactc

SEQ ID NO: 275914 - DNA, 20 bp, Artificial
  CRISPR gRNA sequence
cgtacgacttcactccagcc

SEQ ID NO: 275915 - DNA, 20 bp, Artificial
  CRISPR gRNA sequence
gtacgacttcactccagcct

SEQ ID NO: 275916 - DNA, 20 bp, Artificial
  CRISPR gRNA sequence
cttcactccagcctgggcaa

SEQ ID NO: 275917 - DNA, 20 bp, Artificial
  CRISPR gRNA sequence
tcactccagcctgggcaaaa

SEQ ID NO: 275918 - DNA, 20 bp, Artificial
  CRISPR gRNA sequence
tccagcctgggcaaaagagc

SEQ ID NO: 275919 - DNA, 20 bp, Artificial
  CRISPR gRNA sequence
ccagcctgggcaaaagagca

SEQ ID NO: 275920 - DNA, 20 bp, Artificial
  CRISPR gRNA sequence
caaaaacaacaaaacaaaac

SEQ ID NO: 275921 - DNA, 20 bp, Artificial
  CRISPR gRNA sequence
caaaacaagaatgataaaat

SEQ ID NO: 275922 - DNA, 20 bp, Artificial
  CRISPR gRNA sequence
aacttcccattactcattaa

SEQ ID NO: 275923 - DNA, 20 bp, Artificial
  CRISPR gRNA sequence
taatagttatgtataatcca

SEQ ID NO: 275924 - DNA, 20 bp, Artificial
  CRISPR gRNA sequence
agactaactttgatttgaat

SEQ ID NO: 275925 - DNA, 20 bp, Artificial
  CRISPR gRNA sequence
caattctttgccacttttga

SEQ ID NO: 275926 - DNA, 20 bp, Artificial
  CRISPR gRNA sequence
attctttgccacttttgatg

SEQ ID NO: 275927 - DNA, 20 bp, Artificial
  CRISPR gRNA sequence
tttgccacttttgatggaga

SEQ ID NO: 275928 - DNA, 20 bp, Artificial
  CRISPR gRNA sequence
ttgccacttttgatggagat

SEQ ID NO: 275929 - DNA, 20 bp, Artificial
  CRISPR gRNA sequence
gccacttttgatggagatag

SEQ ID NO: 275930 - DNA, 20 bp, Artificial
  CRISPR gRNA sequence
ccacttttgatggagatagg

SEQ ID NO: 275931 - DNA, 20 bp, Artificial
  CRISPR gRNA sequence
cacttttgatggagatagga

SEQ ID NO: 275932 - DNA, 20 bp, Artificial
  CRISPR gRNA sequence
agataggagggcacttatta

SEQ ID NO: 275933 - DNA, 20 bp, Artificial
  CRISPR gRNA sequence
aggagggcacttattacaga

SEQ ID NO: 275934 - DNA, 20 bp, Artificial
  CRISPR gRNA sequence
ggagggcacttattacagaa

SEQ ID NO: 275935 - DNA, 20 bp, Artificial
  CRISPR gRNA sequence
agggcacttattacagaaag

SEQ ID NO: 275936 - DNA, 20 bp, Artificial
  CRISPR gRNA sequence
gcacttattacagaaaggag

SEQ ID NO: 275937 - DNA, 20 bp, Artificial
  CRISPR gRNA sequence
cttattacagaaaggagaag

SEQ ID NO: 275938 - DNA, 20 bp, Artificial
  CRISPR gRNA sequence
ttattacagaaaggagaagt

SEQ ID NO: 275939 - DNA, 20 bp, Artificial
  CRISPR gRNA sequence
ttcgtgtgaataaatgttgc

SEQ ID NO: 275940 - DNA, 20 bp, Artificial
  CRISPR gRNA sequence
cgtgtgaataaatgttgcca

SEQ ID NO: 275941 - DNA, 20 bp, Artificial
  CRISPR gRNA sequence
gccagagtacttgcaattgt

SEQ ID NO: 275942 - DNA, 20 bp, Artificial
  CRISPR gRNA sequence
cagagtacttgcaattgtaa

SEQ ID NO: 275943 - DNA, 20 bp, Artificial
  CRISPR gRNA sequence
acttgcaattgtaagagatg

SEQ ID NO: 275944 - DNA, 20 bp, Artificial
  CRISPR gRNA sequence
ttgcaattgtaagagatgaa

SEQ ID NO: 275945 - DNA, 20 bp, Artificial
  CRISPR gRNA sequence
caattgtaagagatgaagag

SEQ ID NO: 275946 - DNA, 20 bp, Artificial
  CRISPR gRNA sequence
agagatgaagagaagaataa

SEQ ID NO: 275947 - DNA, 20 bp, Artificial
  CRISPR gRNA sequence
tttactgaactcttgtttgt

SEQ ID NO: 275948 - DNA, 20 bp, Artificial
  CRISPR gRNA sequence
ttactgaactcttgtttgtt

SEQ ID NO: 275949 - DNA, 20 bp, Artificial
  CRISPR gRNA sequence
gaactcttgtttgttaggtc

SEQ ID NO: 275950 - DNA, 20 bp, Artificial
  CRISPR gRNA sequence
cttacctcattttgtcctca

SEQ ID NO: 275951 - DNA, 20 bp, Artificial
  CRISPR gRNA sequence
ttttgtcctcacagaaaccc

SEQ ID NO: 275952 - DNA, 20 bp, Artificial
  CRISPR gRNA sequence
ttgtcctcacagaaacccta

SEQ ID NO: 275953 - DNA, 20 bp, Artificial
  CRISPR gRNA sequence
gtcctcacagaaaccctaga

SEQ ID NO: 275954 - DNA, 20 bp, Artificial
  CRISPR gRNA sequence
tcctcacagaaaccctagag

SEQ ID NO: 275955 - DNA, 20 bp, Artificial
  CRISPR gRNA sequence
tcacagaaaccctagagagg

SEQ ID NO: 275956 - DNA, 20 bp, Artificial
  CRISPR gRNA sequence
cacagaaaccctagagaggt

SEQ ID NO: 275957 - DNA, 20 bp, Artificial
  CRISPR gRNA sequence
aaccctagagaggtaggttg

SEQ ID NO: 275958 - DNA, 20 bp, Artificial
  CRISPR gRNA sequence
aggtaggttgtagatctaaa

SEQ ID NO: 275959 - DNA, 20 bp, Artificial
  CRISPR gRNA sequence
ggtaggttgtagatctaaaa

SEQ ID NO: 275960 - DNA, 20 bp, Artificial
  CRISPR gRNA sequence
ttgtagatctaaaaaggtca

SEQ ID NO: 275961 - DNA, 20 bp, Artificial
  CRISPR gRNA sequence
gatctaaaaaggtcaaagat

SEQ ID NO: 275962 - DNA, 20 bp, Artificial
  CRISPR gRNA sequence
taatataatttccattttat

SEQ ID NO: 275963 - DNA, 20 bp, Artificial
  CRISPR gRNA sequence
attttataagtaatcaaact

SEQ ID NO: 275964 - DNA, 20 bp, Artificial
  CRISPR gRNA sequence
ttttataagtaatcaaactg

SEQ ID NO: 275965 - DNA, 20 bp, Artificial
  CRISPR gRNA sequence
taagtaatcaaactgaggtt

SEQ ID NO: 275966 - DNA, 20 bp, Artificial
  CRISPR gRNA sequence
agtaatcaaactgaggttta

SEQ ID NO: 275967 - DNA, 20 bp, Artificial
  CRISPR gRNA sequence
ttagagaaattataactaac

SEQ ID NO: 275968 - DNA, 20 bp, Artificial
  CRISPR gRNA sequence
aaattataactaaccagtaa

SEQ ID NO: 275969 - DNA, 20 bp, Artificial
  CRISPR gRNA sequence
ttataactaaccagtaatgg

SEQ ID NO: 275970 - DNA, 20 bp, Artificial
  CRISPR gRNA sequence
aattcaaatctgtctgacac

SEQ ID NO: 275971 - DNA, 20 bp, Artificial
  CRISPR gRNA sequence
ttcaaatctgtctgacacca

SEQ ID NO: 275972 - DNA, 20 bp, Artificial
  CRISPR gRNA sequence
tcttttcttcctgatgcttg

SEQ ID NO: 275973 - DNA, 20 bp, Artificial
  CRISPR gRNA sequence
tcctgatgcttgaagtacgc

SEQ ID NO: 275974 - DNA, 20 bp, Artificial
  CRISPR gRNA sequence
tgatgcttgaagtacgcaag

SEQ ID NO: 275975 - DNA, 20 bp, Artificial
  CRISPR gRNA sequence
tctatttatttactaaacta

SEQ ID NO: 275976 - DNA, 20 bp, Artificial
  CRISPR gRNA sequence
gaaaacccaccatccaactt

SEQ ID NO: 275977 - DNA, 20 bp, Artificial
  CRISPR gRNA sequence
cttgagaccaaaaacactga

SEQ ID NO: 275978 - DNA, 20 bp, Artificial
  CRISPR gRNA sequence
caaaaacactgacagtaact

SEQ ID NO: 275979 - DNA, 20 bp, Artificial
  CRISPR gRNA sequence
aaaaacactgacagtaactt

SEQ ID NO: 275980 - DNA, 20 bp, Artificial
  CRISPR gRNA sequence
agtaacttaggtaaatctgc

SEQ ID NO: 275981 - DNA, 20 bp, Artificial
  CRISPR gRNA sequence
tccctctctttcccttacct

SEQ ID NO: 275982 - DNA, 20 bp, Artificial
  CRISPR gRNA sequence
ccctctctttcccttaccta

SEQ ID NO: 275983 - DNA, 20 bp, Artificial
  CRISPR gRNA sequence
ctatcactatcctaaatttg

SEQ ID NO: 275984 - DNA, 20 bp, Artificial
  CRISPR gRNA sequence
cactatcctaaatttgtggt

SEQ ID NO: 275985 - DNA, 20 bp, Artificial
  CRISPR gRNA sequence
agcatttccttgctttttaa

SEQ ID NO: 275986 - DNA, 20 bp, Artificial
  CRISPR gRNA sequence
gcatttccttgctttttaaa

SEQ ID NO: 275987 - DNA, 20 bp, Artificial
  CRISPR gRNA sequence
taaaaggtcgtcttttacat

SEQ ID NO: 275988 - DNA, 20 bp, Artificial
  CRISPR gRNA sequence
aaaaggtcgtcttttacatg

SEQ ID NO: 275989 - DNA, 20 bp, Artificial
  CRISPR gRNA sequence
aaaggtcgtcttttacatga

SEQ ID NO: 275990 - DNA, 20 bp, Artificial
  CRISPR gRNA sequence
aaggtcgtcttttacatgag

SEQ ID NO: 275991 - DNA, 20 bp, Artificial
  CRISPR gRNA sequence
gggcctacccctttgctctt

SEQ ID NO: 275992 - DNA, 20 bp, Artificial
  CRISPR gRNA sequence
tacccctttgctcttgagaa

SEQ ID NO: 275993 - DNA, 20 bp, Artificial
  CRISPR gRNA sequence
gtttctcatgtcctcctttc

SEQ ID NO: 275994 - DNA, 20 bp, Artificial
  CRISPR gRNA sequence
tcctttgaacattgactctt

SEQ ID NO: 275995 - DNA, 20 bp, Artificial
  CRISPR gRNA sequence
attgactcttaagtctgtta

SEQ ID NO: 275996 - DNA, 20 bp, Artificial
  CRISPR gRNA sequence
ttgactcttaagtctgttac

SEQ ID NO: 275997 - DNA, 20 bp, Artificial
  CRISPR gRNA sequence
ctcttaagtctgttacaggt

SEQ ID NO: 275998 - DNA, 20 bp, Artificial
  CRISPR gRNA sequence
tcttaagtctgttacaggta

SEQ ID NO: 275999 - DNA, 20 bp, Artificial
  CRISPR gRNA sequence
cttaagtctgttacaggtaa

SEQ ID NO: 276000 - DNA, 20 bp, Artificial
  CRISPR gRNA sequence
ttacaggtaagggctccatg

SEQ ID NO: 276001 - DNA, 20 bp, Artificial
  CRISPR gRNA sequence
ttgtgtttcccttttctttc

SEQ ID NO: 276002 - DNA, 20 bp, Artificial
  CRISPR gRNA sequence
acctaaactcaatacataaa

SEQ ID NO: 276003 - DNA, 20 bp, Artificial
  CRISPR gRNA sequence
ctaaactcaatacataaata

SEQ ID NO: 276004 - DNA, 20 bp, Artificial
  CRISPR gRNA sequence
aactcaatacataaatagag

SEQ ID NO: 276005 - DNA, 20 bp, Artificial
  CRISPR gRNA sequence
actcaatacataaatagaga

SEQ ID NO: 276006 - DNA, 20 bp, Artificial
  CRISPR gRNA sequence
agagaaggctttgcctaaca

SEQ ID NO: 276007 - DNA, 20 bp, Artificial
  CRISPR gRNA sequence
gcctaacatagaactttcgt

SEQ ID NO: 276008 - DNA, 20 bp, Artificial
  CRISPR gRNA sequence
aacatagaactttcgttgga

SEQ ID NO: 276009 - DNA, 20 bp, Artificial
  CRISPR gRNA sequence
acatagaactttcgttggaa

SEQ ID NO: 276010 - DNA, 20 bp, Artificial
  CRISPR gRNA sequence
catagaactttcgttggaaa

SEQ ID NO: 276011 - DNA, 20 bp, Artificial
  CRISPR gRNA sequence
aactttcgttggaaagggtc

SEQ ID NO: 276012 - DNA, 20 bp, Artificial
  CRISPR gRNA sequence
ttcgttggaaagggtctaga

SEQ ID NO: 276013 - DNA, 20 bp, Artificial
  CRISPR gRNA sequence
tcgttggaaagggtctagat

SEQ ID NO: 276014 - DNA, 20 bp, Artificial
  CRISPR gRNA sequence
cgttggaaagggtctagatg

SEQ ID NO: 276015 - DNA, 20 bp, Artificial
  CRISPR gRNA sequence
ttggaaagggtctagatggg

SEQ ID NO: 276016 - DNA, 20 bp, Artificial
  CRISPR gRNA sequence
ggaaagggtctagatgggga

SEQ ID NO: 276017 - DNA, 20 bp, Artificial
  CRISPR gRNA sequence
aaagggtctagatggggaga

SEQ ID NO: 276018 - DNA, 20 bp, Artificial
  CRISPR gRNA sequence
ggagagagaaaacataaatc

SEQ ID NO: 276019 - DNA, 20 bp, Artificial
  CRISPR gRNA sequence
gagaaaacataaatctggtc

SEQ ID NO: 276020 - DNA, 20 bp, Artificial
  CRISPR gRNA sequence
agaaaacataaatctggtca

SEQ ID NO: 276021 - DNA, 20 bp, Artificial
  CRISPR gRNA sequence
aaaacataaatctggtcaag

SEQ ID NO: 276022 - DNA, 20 bp, Artificial
  CRISPR gRNA sequence
aacataaatctggtcaagga

SEQ ID NO: 276023 - DNA, 20 bp, Artificial
  CRISPR gRNA sequence
acataaatctggtcaaggag

SEQ ID NO: 276024 - DNA, 20 bp, Artificial
  CRISPR gRNA sequence
ataaatctggtcaaggagag

SEQ ID NO: 276025 - DNA, 20 bp, Artificial
  CRISPR gRNA sequence
tggtcaaggagaggagatct

SEQ ID NO: 276026 - DNA, 20 bp, Artificial
  CRISPR gRNA sequence
gtcaaggagaggagatcttg

SEQ ID NO: 276027 - DNA, 20 bp, Artificial
  CRISPR gRNA sequence
aggagaggagatcttggaga

SEQ ID NO: 276028 - DNA, 20 bp, Artificial
  CRISPR gRNA sequence
ggagaggagatcttggagaa

SEQ ID NO: 276029 - DNA, 20 bp, Artificial
  CRISPR gRNA sequence
aaacctgtgacctgcctttt

SEQ ID NO: 276030 - DNA, 20 bp, Artificial
  CRISPR gRNA sequence
aacctgtgacctgccttttg

SEQ ID NO: 276031 - DNA, 20 bp, Artificial
  CRISPR gRNA sequence
acctgtgacctgccttttga

SEQ ID NO: 276032 - DNA, 20 bp, Artificial
  CRISPR gRNA sequence
cctgtgacctgccttttgag

SEQ ID NO: 276033 - DNA, 20 bp, Artificial
  CRISPR gRNA sequence
ctgtgacctgccttttgagg

SEQ ID NO: 276034 - DNA, 20 bp, Artificial
  CRISPR gRNA sequence
agggggcattgtgtgcgtgt

SEQ ID NO: 276035 - DNA, 20 bp, Artificial
  CRISPR gRNA sequence
gggcattgtgtgcgtgtgag

SEQ ID NO: 276036 - DNA, 20 bp, Artificial
  CRISPR gRNA sequence
ggcattgtgtgcgtgtgagt

SEQ ID NO: 276037 - DNA, 20 bp, Artificial
  CRISPR gRNA sequence
gcattgtgtgcgtgtgagtg

SEQ ID NO: 276038 - DNA, 20 bp, Artificial
  CRISPR gRNA sequence
cattgtgtgcgtgtgagtgg

SEQ ID NO: 276039 - DNA, 20 bp, Artificial
  CRISPR gRNA sequence
attgtgtgcgtgtgagtggg

SEQ ID NO: 276040 - DNA, 20 bp, Artificial
  CRISPR gRNA sequence
gtgtgcgtgtgagtgggggg

SEQ ID NO: 276041 - DNA, 20 bp, Artificial
  CRISPR gRNA sequence
tgtgcgtgtgagtggggggc

SEQ ID NO: 276042 - DNA, 20 bp, Artificial
  CRISPR gRNA sequence
ggggggcaggcattgaacta

SEQ ID NO: 276043 - DNA, 20 bp, Artificial
  CRISPR gRNA sequence
aggcattgaactatagtcat

SEQ ID NO: 276044 - DNA, 20 bp, Artificial
  CRISPR gRNA sequence
catgagcttttgcttctact

SEQ ID NO: 276045 - DNA, 20 bp, Artificial
  CRISPR gRNA sequence
cccaaaaaaacacccatgac

SEQ ID NO: 276046 - DNA, 20 bp, Artificial
  CRISPR gRNA sequence
ttaatttgcatatttatttc

SEQ ID NO: 276047 - DNA, 20 bp, Artificial
  CRISPR gRNA sequence
tttgcatatttatttctgga

SEQ ID NO: 276048 - DNA, 20 bp, Artificial
  CRISPR gRNA sequence
ttgcatatttatttctggat

SEQ ID NO: 276049 - DNA, 20 bp, Artificial
  CRISPR gRNA sequence
cctctttattctgtcctcat

SEQ ID NO: 276050 - DNA, 20 bp, Artificial
  CRISPR gRNA sequence
attctgtcctcatgagacca

SEQ ID NO: 276051 - DNA, 20 bp, Artificial
  CRISPR gRNA sequence
ttctgtcctcatgagaccat

SEQ ID NO: 276052 - DNA, 20 bp, Artificial
  CRISPR gRNA sequence
tcctcatgagaccatgggca

SEQ ID NO: 276053 - DNA, 20 bp, Artificial
  CRISPR gRNA sequence
atgggcaaagctctttattt

SEQ ID NO: 276054 - DNA, 20 bp, Artificial
  CRISPR gRNA sequence
tgggcaaagctctttatttt

SEQ ID NO: 276055 - DNA, 20 bp, Artificial
  CRISPR gRNA sequence
caaagctctttattttaggt

SEQ ID NO: 276056 - DNA, 20 bp, Artificial
  CRISPR gRNA sequence
agctctttattttaggtgag

SEQ ID NO: 276057 - DNA, 20 bp, Artificial
  CRISPR gRNA sequence
agaaaaactctgaaccacat

SEQ ID NO: 276058 - DNA, 20 bp, Artificial
  CRISPR gRNA sequence
gaattttttaattattttga

SEQ ID NO: 276059 - DNA, 20 bp, Artificial
  CRISPR gRNA sequence
ttttttaattattttgatag

SEQ ID NO: 276060 - DNA, 20 bp, Artificial
  CRISPR gRNA sequence
ttatttatttaatgtgcata

SEQ ID NO: 276061 - DNA, 20 bp, Artificial
  CRISPR gRNA sequence
tttatttaatgtgcatatgg

SEQ ID NO: 276062 - DNA, 20 bp, Artificial
  CRISPR gRNA sequence
gcatatggaagcctgaaaaa

SEQ ID NO: 276063 - DNA, 20 bp, Artificial
  CRISPR gRNA sequence
atggaagcctgaaaaataga

SEQ ID NO: 276064 - DNA, 20 bp, Artificial
  CRISPR gRNA sequence
ctgaaaaatagaaagctgta

SEQ ID NO: 276065 - DNA, 20 bp, Artificial
  CRISPR gRNA sequence
aatagaaagctgtatagact

SEQ ID NO: 276066 - DNA, 20 bp, Artificial
  CRISPR gRNA sequence
aaagctgtatagactgagtt

SEQ ID NO: 276067 - DNA, 20 bp, Artificial
  CRISPR gRNA sequence
gactgagtttagttgttaat

SEQ ID NO: 276068 - DNA, 20 bp, Artificial
  CRISPR gRNA sequence
agtttagttgttaattggtt

SEQ ID NO: 276069 - DNA, 20 bp, Artificial
  CRISPR gRNA sequence
gtttagttgttaattggttt

SEQ ID NO: 276070 - DNA, 20 bp, Artificial
  CRISPR gRNA sequence
ttagttgttaattggtttgg

SEQ ID NO: 276071 - DNA, 20 bp, Artificial
  CRISPR gRNA sequence
atgcataatttatgacttct

SEQ ID NO: 276072 - DNA, 20 bp, Artificial
  CRISPR gRNA sequence
tatttgtccgaattaattac

SEQ ID NO: 276073 - DNA, 20 bp, Artificial
  CRISPR gRNA sequence
atttgtccgaattaattact

SEQ ID NO: 276074 - DNA, 20 bp, Artificial
  CRISPR gRNA sequence
ccgaattaattactgggatg

SEQ ID NO: 276075 - DNA, 20 bp, Artificial
  CRISPR gRNA sequence
ttactgggatgaagctatgc

SEQ ID NO: 276076 - DNA, 20 bp, Artificial
  CRISPR gRNA sequence
aagctatgctagctttcaaa

SEQ ID NO: 276077 - DNA, 20 bp, Artificial
  CRISPR gRNA sequence
agctatgctagctttcaaac

SEQ ID NO: 276078 - DNA, 20 bp, Artificial
  CRISPR gRNA sequence
ctatgctagctttcaaacag

SEQ ID NO: 276079 - DNA, 20 bp, Artificial
  CRISPR gRNA sequence
ttcaaacaggagatgccttt

SEQ ID NO: 276080 - DNA, 20 bp, Artificial
  CRISPR gRNA sequence
tcagaaatttgtatattgtg

SEQ ID NO: 276081 - DNA, 20 bp, Artificial
  CRISPR gRNA sequence
tttgtatattgtgcagttgc

SEQ ID NO: 276082 - DNA, 20 bp, Artificial
  CRISPR gRNA sequence
tgccagaccaattaaatacc

SEQ ID NO: 276083 - DNA, 20 bp, Artificial
  CRISPR gRNA sequence
gttgaaattaaaaaaaaaaa

SEQ ID NO: 276084 - DNA, 20 bp, Artificial
  CRISPR gRNA sequence
gaaattaaaaaaaaaaaaag

SEQ ID NO: 276085 - DNA, 20 bp, Artificial
  CRISPR gRNA sequence
aaaaaaagtagtcttttact

SEQ ID NO: 276086 - DNA, 20 bp, Artificial
  CRISPR gRNA sequence
tatatccaaactacaacatt

SEQ ID NO: 276087 - DNA, 20 bp, Artificial
  CRISPR gRNA sequence
tactattttgatatgcctta

SEQ ID NO: 276088 - DNA, 20 bp, Artificial
  CRISPR gRNA sequence
actattttgatatgccttaa

SEQ ID NO: 276089 - DNA, 20 bp, Artificial
  CRISPR gRNA sequence
ctattttgatatgccttaaa

SEQ ID NO: 276090 - DNA, 20 bp, Artificial
  CRISPR gRNA sequence
tttgatatgccttaaaggga

SEQ ID NO: 276091 - DNA, 20 bp, Artificial
  CRISPR gRNA sequence
ttgatatgccttaaagggac

SEQ ID NO: 276092 - DNA, 20 bp, Artificial
  CRISPR gRNA sequence
atatgccttaaagggacagg

SEQ ID NO: 276093 - DNA, 20 bp, Artificial
  CRISPR gRNA sequence
tatgccttaaagggacagga

SEQ ID NO: 276094 - DNA, 20 bp, Artificial
  CRISPR gRNA sequence
aagggacaggaaggccttcc

SEQ ID NO: 276095 - DNA, 20 bp, Artificial
  CRISPR gRNA sequence
ggccttcctagcattcctcc

SEQ ID NO: 276096 - DNA, 20 bp, Artificial
  CRISPR gRNA sequence
agcattcctccaagaccctt

SEQ ID NO: 276097 - DNA, 20 bp, Artificial
  CRISPR gRNA sequence
gcattcctccaagacccttg

SEQ ID NO: 276098 - DNA, 20 bp, Artificial
  CRISPR gRNA sequence
tttatatatttgatccccat

SEQ ID NO: 276099 - DNA, 20 bp, Artificial
  CRISPR gRNA sequence
ttgatccccataagattctg

SEQ ID NO: 276100 - DNA, 20 bp, Artificial
  CRISPR gRNA sequence
ccataagattctgaagtaca

SEQ ID NO: 276101 - DNA, 20 bp, Artificial
  CRISPR gRNA sequence
agattctgaagtacaaagta

SEQ ID NO: 276102 - DNA, 20 bp, Artificial
  CRISPR gRNA sequence
gattctgaagtacaaagtac

SEQ ID NO: 276103 - DNA, 20 bp, Artificial
  CRISPR gRNA sequence
aaagtacaggaaaataaatg

SEQ ID NO: 276104 - DNA, 20 bp, Artificial
  CRISPR gRNA sequence
agtacaggaaaataaatgca

SEQ ID NO: 276105 - DNA, 20 bp, Artificial
  CRISPR gRNA sequence
gaaaataaatgcagagaaca

SEQ ID NO: 276106 - DNA, 20 bp, Artificial
  CRISPR gRNA sequence
aaaataaatgcagagaacat

SEQ ID NO: 276107 - DNA, 20 bp, Artificial
  CRISPR gRNA sequence
aataaatgcagagaacatag

SEQ ID NO: 276108 - DNA, 20 bp, Artificial
  CRISPR gRNA sequence
aatgcagagaacataggaga

SEQ ID NO: 276109 - DNA, 20 bp, Artificial
  CRISPR gRNA sequence
gaacataggagaaagatacc

SEQ ID NO: 276110 - DNA, 20 bp, Artificial
  CRISPR gRNA sequence
cataggagaaagatacctag

SEQ ID NO: 276111 - DNA, 20 bp, Artificial
  CRISPR gRNA sequence
gtcacttattcttacacata

SEQ ID NO: 276112 - DNA, 20 bp, Artificial
  CRISPR gRNA sequence
cacttattcttacacataaa

SEQ ID NO: 276113 - DNA, 20 bp, Artificial
  CRISPR gRNA sequence
attcttacacataaagagat

SEQ ID NO: 276114 - DNA, 20 bp, Artificial
  CRISPR gRNA sequence
acataaagagattagcttct

SEQ ID NO: 276115 - DNA, 20 bp, Artificial
  CRISPR gRNA sequence
ttagcttcttagcatgaatg

SEQ ID NO: 276116 - DNA, 20 bp, Artificial
  CRISPR gRNA sequence
tagcttcttagcatgaatgt

SEQ ID NO: 276117 - DNA, 20 bp, Artificial
  CRISPR gRNA sequence
agcttcttagcatgaatgta

SEQ ID NO: 276118 - DNA, 20 bp, Artificial
  CRISPR gRNA sequence
gtagggattcaatctcctca

SEQ ID NO: 276119 - DNA, 20 bp, Artificial
  CRISPR gRNA sequence
agggattcaatctcctcata

SEQ ID NO: 276120 - DNA, 20 bp, Artificial
  CRISPR gRNA sequence
attcaatctcctcatagagt

SEQ ID NO: 276121 - DNA, 20 bp, Artificial
  CRISPR gRNA sequence
catagagttagctttctttt

SEQ ID NO: 276122 - DNA, 20 bp, Artificial
  CRISPR gRNA sequence
agctttcttttcagaattct

SEQ ID NO: 276123 - DNA, 20 bp, Artificial
  CRISPR gRNA sequence
tttcagaattctgagcccca

SEQ ID NO: 276124 - DNA, 20 bp, Artificial
  CRISPR gRNA sequence
tcagaattctgagccccaca

SEQ ID NO: 276125 - DNA, 20 bp, Artificial
  CRISPR gRNA sequence
agccccacagagatgtcatg

SEQ ID NO: 276126 - DNA, 20 bp, Artificial
  CRISPR gRNA sequence
cagagatgtcatgtagcata

SEQ ID NO: 276127 - DNA, 20 bp, Artificial
  CRISPR gRNA sequence
atgtagcatatggtcatcaa

SEQ ID NO: 276128 - DNA, 20 bp, Artificial
  CRISPR gRNA sequence
tagcatatggtcatcaaaag

SEQ ID NO: 276129 - DNA, 20 bp, Artificial
  CRISPR gRNA sequence
agcatatggtcatcaaaagc

SEQ ID NO: 276130 - DNA, 20 bp, Artificial
  CRISPR gRNA sequence
tcaaaagcaggttttaaaac

SEQ ID NO: 276131 - DNA, 20 bp, Artificial
  CRISPR gRNA sequence
ccagttctgccttgtgaccc

SEQ ID NO: 276132 - DNA, 20 bp, Artificial
  CRISPR gRNA sequence
cagttctgccttgtgaccct

SEQ ID NO: 276133 - DNA, 20 bp, Artificial
  CRISPR gRNA sequence
gtcaataacttacccacctt

SEQ ID NO: 276134 - DNA, 20 bp, Artificial
  CRISPR gRNA sequence
aacttacccacctttagtct

SEQ ID NO: 276135 - DNA, 20 bp, Artificial
  CRISPR gRNA sequence
gtcttagtttgctcatctat

SEQ ID NO: 276136 - DNA, 20 bp, Artificial
  CRISPR gRNA sequence
tagtttgctcatctataaga

SEQ ID NO: 276137 - DNA, 20 bp, Artificial
  CRISPR gRNA sequence
agtttgctcatctataagat

SEQ ID NO: 276138 - DNA, 20 bp, Artificial
  CRISPR gRNA sequence
gtttgctcatctataagata

SEQ ID NO: 276139 - DNA, 20 bp, Artificial
  CRISPR gRNA sequence
aagatagggacactaatacc

SEQ ID NO: 276140 - DNA, 20 bp, Artificial
  CRISPR gRNA sequence
agatagggacactaataccc

SEQ ID NO: 276141 - DNA, 20 bp, Artificial
  CRISPR gRNA sequence
gatagggacactaataccca

SEQ ID NO: 276142 - DNA, 20 bp, Artificial
  CRISPR gRNA sequence
acactaatacccagggttgt

SEQ ID NO: 276143 - DNA, 20 bp, Artificial
  CRISPR gRNA sequence
gaattaaatgacatcgttca

SEQ ID NO: 276144 - DNA, 20 bp, Artificial
  CRISPR gRNA sequence
catcgttcatagaaatcact

SEQ ID NO: 276145 - DNA, 20 bp, Artificial
  CRISPR gRNA sequence
ttcatagaaatcacttagca

SEQ ID NO: 276146 - DNA, 20 bp, Artificial
  CRISPR gRNA sequence
catagaaatcacttagcaca

SEQ ID NO: 276147 - DNA, 20 bp, Artificial
  CRISPR gRNA sequence
ttagcacagagcctgacaca

SEQ ID NO: 276148 - DNA, 20 bp, Artificial
  CRISPR gRNA sequence
tagcacagagcctgacacac

SEQ ID NO: 276149 - DNA, 20 bp, Artificial
  CRISPR gRNA sequence
ctgacacacaggaaactaaa

SEQ ID NO: 276150 - DNA, 20 bp, Artificial
  CRISPR gRNA sequence
aatagtctcactctgttgcc

SEQ ID NO: 276151 - DNA, 20 bp, Artificial
  CRISPR gRNA sequence
atagtctcactctgttgccc

SEQ ID NO: 276152 - DNA, 20 bp, Artificial
  CRISPR gRNA sequence
tctcactctgttgcccaggc

SEQ ID NO: 276153 - DNA, 20 bp, Artificial
  CRISPR gRNA sequence
tcactctgttgcccaggctg

SEQ ID NO: 276154 - DNA, 20 bp, Artificial
  CRISPR gRNA sequence
ctgttgcccaggctggagtg

SEQ ID NO: 276155 - DNA, 20 bp, Artificial
  CRISPR gRNA sequence
ttgcccaggctggagtgcag

SEQ ID NO: 276156 - DNA, 20 bp, Artificial
  CRISPR gRNA sequence
ggagtgcagtggcaccatct

SEQ ID NO: 276157 - DNA, 20 bp, Artificial
  CRISPR gRNA sequence
tcttggcttactgcaacctc

SEQ ID NO: 276158 - DNA, 20 bp, Artificial
  CRISPR gRNA sequence
cttggcttactgcaacctcc

SEQ ID NO: 276159 - DNA, 20 bp, Artificial
  CRISPR gRNA sequence
ttactgcaacctccgggttc

SEQ ID NO: 276160 - DNA, 20 bp, Artificial
  CRISPR gRNA sequence
ttcaagtgattctcctgcct

SEQ ID NO: 276161 - DNA, 20 bp, Artificial
  CRISPR gRNA sequence
gattctcctgcctcagcctc

SEQ ID NO: 276162 - DNA, 20 bp, Artificial
  CRISPR gRNA sequence
ttctcctgcctcagcctcca

SEQ ID NO: 276163 - DNA, 20 bp, Artificial
  CRISPR gRNA sequence
tcctgcctcagcctccagag

SEQ ID NO: 276164 - DNA, 20 bp, Artificial
  CRISPR gRNA sequence
gcctcagcctccagagtagc

SEQ ID NO: 276165 - DNA, 20 bp, Artificial
  CRISPR gRNA sequence
cctcagcctccagagtagct

SEQ ID NO: 276166 - DNA, 20 bp, Artificial
  CRISPR gRNA sequence
ctccagagtagctgggacta

SEQ ID NO: 276167 - DNA, 20 bp, Artificial
  CRISPR gRNA sequence
tccagagtagctgggactac

SEQ ID NO: 276168 - DNA, 20 bp, Artificial
  CRISPR gRNA sequence
cagagtagctgggactacag

SEQ ID NO: 276169 - DNA, 20 bp, Artificial
  CRISPR gRNA sequence
ctaatttcttgtatttttaa

SEQ ID NO: 276170 - DNA, 20 bp, Artificial
  CRISPR gRNA sequence
aatttcttgtatttttaata

SEQ ID NO: 276171 - DNA, 20 bp, Artificial
  CRISPR gRNA sequence
tcttgtatttttaatagaga

SEQ ID NO: 276172 - DNA, 20 bp, Artificial
  CRISPR gRNA sequence
cttgtatttttaatagagat

SEQ ID NO: 276173 - DNA, 20 bp, Artificial
  CRISPR gRNA sequence
ttgtatttttaatagagatg

SEQ ID NO: 276174 - DNA, 20 bp, Artificial
  CRISPR gRNA sequence
gagatggggtttcactgtgt

SEQ ID NO: 276175 - DNA, 20 bp, Artificial
  CRISPR gRNA sequence
tggggtttcactgtgttagc

SEQ ID NO: 276176 - DNA, 20 bp, Artificial
  CRISPR gRNA sequence
ggggtttcactgtgttagcc

SEQ ID NO: 276177 - DNA, 20 bp, Artificial
  CRISPR gRNA sequence
tttcactgtgttagccagga

SEQ ID NO: 276178 - DNA, 20 bp, Artificial
  CRISPR gRNA sequence
tgtgttagccaggatggtct

SEQ ID NO: 276179 - DNA, 20 bp, Artificial
  CRISPR gRNA sequence
ctcctgacctcgtgatccac

SEQ ID NO: 276180 - DNA, 20 bp, Artificial
  CRISPR gRNA sequence
acctcgtgatccaccagcct

SEQ ID NO: 276181 - DNA, 20 bp, Artificial
  CRISPR gRNA sequence
ccaccagcctcggcctccca

SEQ ID NO: 276182 - DNA, 20 bp, Artificial
  CRISPR gRNA sequence
gcctcggcctcccaaagtgc

SEQ ID NO: 276183 - DNA, 20 bp, Artificial
  CRISPR gRNA sequence
cctcggcctcccaaagtgct

SEQ ID NO: 276184 - DNA, 20 bp, Artificial
  CRISPR gRNA sequence
ctcccaaagtgctgggatta

SEQ ID NO: 276185 - DNA, 20 bp, Artificial
  CRISPR gRNA sequence
tcccaaagtgctgggattac

SEQ ID NO: 276186 - DNA, 20 bp, Artificial
  CRISPR gRNA sequence
agtgctgggattacaggcgt

SEQ ID NO: 276187 - DNA, 20 bp, Artificial
  CRISPR gRNA sequence
caggcgtgagccaccacacc

SEQ ID NO: 276188 - DNA, 20 bp, Artificial
  CRISPR gRNA sequence
ccaccacacccagccaatga

SEQ ID NO: 276189 - DNA, 20 bp, Artificial
  CRISPR gRNA sequence
agccaatgatagctatattt

SEQ ID NO: 276190 - DNA, 20 bp, Artificial
  CRISPR gRNA sequence
caatgatagctatatttaag

SEQ ID NO: 276191 - DNA, 20 bp, Artificial
  CRISPR gRNA sequence
aatgatagctatatttaagt

SEQ ID NO: 276192 - DNA, 20 bp, Artificial
  CRISPR gRNA sequence
gtcttgaatttatcctctct

SEQ ID NO: 276193 - DNA, 20 bp, Artificial
  CRISPR gRNA sequence
tcttgaatttatcctctctt

SEQ ID NO: 276194 - DNA, 20 bp, Artificial
  CRISPR gRNA sequence
gaatttatcctctcttaggt

SEQ ID NO: 276195 - DNA, 20 bp, Artificial
  CRISPR gRNA sequence
gtaagccccctcatttaaat

SEQ ID NO: 276196 - DNA, 20 bp, Artificial
  CRISPR gRNA sequence
taagccccctcatttaaatc

SEQ ID NO: 276197 - DNA, 20 bp, Artificial
  CRISPR gRNA sequence
cctcatttaaatcaggttgc

SEQ ID NO: 276198 - DNA, 20 bp, Artificial
  CRISPR gRNA sequence
ctcatttaaatcaggttgcc

SEQ ID NO: 276199 - DNA, 20 bp, Artificial
  CRISPR gRNA sequence
ggttgccaggcaaacacttc

SEQ ID NO: 276200 - DNA, 20 bp, Artificial
  CRISPR gRNA sequence
gttgccaggcaaacacttcc

SEQ ID NO: 276201 - DNA, 20 bp, Artificial
  CRISPR gRNA sequence
acacttccaggaatgccttg

SEQ ID NO: 276202 - DNA, 20 bp, Artificial
  CRISPR gRNA sequence
cttgtggcacctacaataat

SEQ ID NO: 276203 - DNA, 20 bp, Artificial
  CRISPR gRNA sequence
ttgtggcacctacaataatg

SEQ ID NO: 276204 - DNA, 20 bp, Artificial
  CRISPR gRNA sequence
cacctacaataatgaggata

SEQ ID NO: 276205 - DNA, 20 bp, Artificial
  CRISPR gRNA sequence
acctacaataatgaggataa

SEQ ID NO: 276206 - DNA, 20 bp, Artificial
  CRISPR gRNA sequence
cctacaataatgaggataaa

SEQ ID NO: 276207 - DNA, 20 bp, Artificial
  CRISPR gRNA sequence
acaataatgaggataaaggg

SEQ ID NO: 276208 - DNA, 20 bp, Artificial
  CRISPR gRNA sequence
tgacaaatgatgataattgc

SEQ ID NO: 276209 - DNA, 20 bp, Artificial
  CRISPR gRNA sequence
gacaaatgatgataattgcc

SEQ ID NO: 276210 - DNA, 20 bp, Artificial
  CRISPR gRNA sequence
aatgatgataattgccagga

SEQ ID NO: 276211 - DNA, 20 bp, Artificial
  CRISPR gRNA sequence
tgatgataattgccaggaaa

SEQ ID NO: 276212 - DNA, 20 bp, Artificial
  CRISPR gRNA sequence
gatgataattgccaggaaag

SEQ ID NO: 276213 - DNA, 20 bp, Artificial
  CRISPR gRNA sequence
taattgccaggaaagaggaa

SEQ ID NO: 276214 - DNA, 20 bp, Artificial
  CRISPR gRNA sequence
tgccaggaaagaggaaaagt

SEQ ID NO: 276215 - DNA, 20 bp, Artificial
  CRISPR gRNA sequence
gaaagaggaaaagttggatt

SEQ ID NO: 276216 - DNA, 20 bp, Artificial
  CRISPR gRNA sequence
gaggaaaagttggatttggt

SEQ ID NO: 276217 - DNA, 20 bp, Artificial
  CRISPR gRNA sequence
ggaaaagttggatttggttg

SEQ ID NO: 276218 - DNA, 20 bp, Artificial
  CRISPR gRNA sequence
gaaaagttggatttggttgg

SEQ ID NO: 276219 - DNA, 20 bp, Artificial
  CRISPR gRNA sequence
gttggatttggttggaggtg

SEQ ID NO: 276220 - DNA, 20 bp, Artificial
  CRISPR gRNA sequence
atgaaccctgtccctaaatg

SEQ ID NO: 276221 - DNA, 20 bp, Artificial
  CRISPR gRNA sequence
atgaagtttgatatgttcct

SEQ ID NO: 276222 - DNA, 20 bp, Artificial
  CRISPR gRNA sequence
atatgttcctgagccacttt

SEQ ID NO: 276223 - DNA, 20 bp, Artificial
  CRISPR gRNA sequence
gttcctgagccacttttagt

SEQ ID NO: 276224 - DNA, 20 bp, Artificial
  CRISPR gRNA sequence
cacttattaatttatcctat

SEQ ID NO: 276225 - DNA, 20 bp, Artificial
  CRISPR gRNA sequence
tataagatcgactcatgaca

SEQ ID NO: 276226 - DNA, 20 bp, Artificial
  CRISPR gRNA sequence
ataagatcgactcatgacac

SEQ ID NO: 276227 - DNA, 20 bp, Artificial
  CRISPR gRNA sequence
agatcgactcatgacacagg

SEQ ID NO: 276228 - DNA, 20 bp, Artificial
  CRISPR gRNA sequence
tgacacaggcagctgatatc

SEQ ID NO: 276229 - DNA, 20 bp, Artificial
  CRISPR gRNA sequence
aatatgttttgtgttataac

SEQ ID NO: 276230 - DNA, 20 bp, Artificial
  CRISPR gRNA sequence
atatgttttgtgttataact

SEQ ID NO: 276231 - DNA, 20 bp, Artificial
  CRISPR gRNA sequence
atttctgtgctctgcttttc

SEQ ID NO: 276232 - DNA, 20 bp, Artificial
  CRISPR gRNA sequence
tttctgtgctctgcttttct

SEQ ID NO: 276233 - DNA, 20 bp, Artificial
  CRISPR gRNA sequence
cttttctgggaaataaacta

SEQ ID NO: 276234 - DNA, 20 bp, Artificial
  CRISPR gRNA sequence
ttttctgggaaataaactac

SEQ ID NO: 276235 - DNA, 20 bp, Artificial
  CRISPR gRNA sequence
tacaggaatgccactcatac

SEQ ID NO: 276236 - DNA, 20 bp, Artificial
  CRISPR gRNA sequence
acaggaatgccactcatacc

SEQ ID NO: 276237 - DNA, 20 bp, Artificial
  CRISPR gRNA sequence
actgtattaaaaatcttttc

SEQ ID NO: 276238 - DNA, 20 bp, Artificial
  CRISPR gRNA sequence
ctgtattaaaaatcttttca

SEQ ID NO: 276239 - DNA, 20 bp, Artificial
  CRISPR gRNA sequence
attaaaaatcttttcaaggc

SEQ ID NO: 276240 - DNA, 20 bp, Artificial
  CRISPR gRNA sequence
ttaaaaatcttttcaaggcc

SEQ ID NO: 276241 - DNA, 20 bp, Artificial
  CRISPR gRNA sequence
cttttcaaggccaggtgtgc

SEQ ID NO: 276242 - DNA, 20 bp, Artificial
  CRISPR gRNA sequence
ctggctcatgcctgtaatcc

SEQ ID NO: 276243 - DNA, 20 bp, Artificial
  CRISPR gRNA sequence
tgcctgtaatcctagcactt

SEQ ID NO: 276244 - DNA, 20 bp, Artificial
  CRISPR gRNA sequence
gcctgtaatcctagcacttt

SEQ ID NO: 276245 - DNA, 20 bp, Artificial
  CRISPR gRNA sequence
ctgtaatcctagcactttgg

SEQ ID NO: 276246 - DNA, 20 bp, Artificial
  CRISPR gRNA sequence
tgtaatcctagcactttggg

SEQ ID NO: 276247 - DNA, 20 bp, Artificial
  CRISPR gRNA sequence
tcctagcactttgggaggtc

SEQ ID NO: 276248 - DNA, 20 bp, Artificial
  CRISPR gRNA sequence
cctagcactttgggaggtca

SEQ ID NO: 276249 - DNA, 20 bp, Artificial
  CRISPR gRNA sequence
agcactttgggaggtcaagg

SEQ ID NO: 276250 - DNA, 20 bp, Artificial
  CRISPR gRNA sequence
gcactttgggaggtcaaggc

SEQ ID NO: 276251 - DNA, 20 bp, Artificial
  CRISPR gRNA sequence
actttgggaggtcaaggcag

SEQ ID NO: 276252 - DNA, 20 bp, Artificial
  CRISPR gRNA sequence
ctttgggaggtcaaggcagg

SEQ ID NO: 276253 - DNA, 20 bp, Artificial
  CRISPR gRNA sequence
tcaaggcaggaggatcgctt

SEQ ID NO: 276254 - DNA, 20 bp, Artificial
  CRISPR gRNA sequence
caaggcaggaggatcgcttg

SEQ ID NO: 276255 - DNA, 20 bp, Artificial
  CRISPR gRNA sequence
gcaggaggatcgcttgaggt

SEQ ID NO: 276256 - DNA, 20 bp, Artificial
  CRISPR gRNA sequence
caggaggatcgcttgaggtc

SEQ ID NO: 276257 - DNA, 20 bp, Artificial
  CRISPR gRNA sequence
ggaggatcgcttgaggtcag

SEQ ID NO: 276258 - DNA, 20 bp, Artificial
  CRISPR gRNA sequence
tcgcttgaggtcaggagttt

SEQ ID NO: 276259 - DNA, 20 bp, Artificial
  CRISPR gRNA sequence
tcaggagtttgagaccaccc

SEQ ID NO: 276260 - DNA, 20 bp, Artificial
  CRISPR gRNA sequence
tgagaccaccctggacaaca

SEQ ID NO: 276261 - DNA, 20 bp, Artificial
  CRISPR gRNA sequence
ctctactaaaaataaaaaat

SEQ ID NO: 276262 - DNA, 20 bp, Artificial
  CRISPR gRNA sequence
actaaaaataaaaaattagc

SEQ ID NO: 276263 - DNA, 20 bp, Artificial
  CRISPR gRNA sequence
ctaaaaataaaaaattagcc

SEQ ID NO: 276264 - DNA, 20 bp, Artificial
  CRISPR gRNA sequence
aaaaaattagccaggcatga

SEQ ID NO: 276265 - DNA, 20 bp, Artificial
  CRISPR gRNA sequence
ggcatgatggcacatgcctg

SEQ ID NO: 276266 - DNA, 20 bp, Artificial
  CRISPR gRNA sequence
atggcacatgcctgtagtcc

SEQ ID NO: 276267 - DNA, 20 bp, Artificial
  CRISPR gRNA sequence
cacatgcctgtagtcccagc

SEQ ID NO: 276268 - DNA, 20 bp, Artificial
  CRISPR gRNA sequence
gcctgtagtcccagctagtt

SEQ ID NO: 276269 - DNA, 20 bp, Artificial
  CRISPR gRNA sequence
ctgtagtcccagctagtttg

SEQ ID NO: 276270 - DNA, 20 bp, Artificial
  CRISPR gRNA sequence
tgtagtcccagctagtttgg

SEQ ID NO: 276271 - DNA, 20 bp, Artificial
  CRISPR gRNA sequence
tcccagctagtttggaggct

SEQ ID NO: 276272 - DNA, 20 bp, Artificial
  CRISPR gRNA sequence
agctagtttggaggctgaga

SEQ ID NO: 276273 - DNA, 20 bp, Artificial
  CRISPR gRNA sequence
gctagtttggaggctgagac

SEQ ID NO: 276274 - DNA, 20 bp, Artificial
  CRISPR gRNA sequence
tagtttggaggctgagacag

SEQ ID NO: 276275 - DNA, 20 bp, Artificial
  CRISPR gRNA sequence
acaggagaatcgcttgaacc

SEQ ID NO: 276276 - DNA, 20 bp, Artificial
  CRISPR gRNA sequence
caggagaatcgcttgaaccc

SEQ ID NO: 276277 - DNA, 20 bp, Artificial
  CRISPR gRNA sequence
ggagaatcgcttgaacccag

SEQ ID NO: 276278 - DNA, 20 bp, Artificial
  CRISPR gRNA sequence
gagaatcgcttgaacccagg

SEQ ID NO: 276279 - DNA, 20 bp, Artificial
  CRISPR gRNA sequence
aatcgcttgaacccaggagg

SEQ ID NO: 276280 - DNA, 20 bp, Artificial
  CRISPR gRNA sequence
tcgcttgaacccaggaggca

SEQ ID NO: 276281 - DNA, 20 bp, Artificial
  CRISPR gRNA sequence
cgcttgaacccaggaggcag

SEQ ID NO: 276282 - DNA, 20 bp, Artificial
  CRISPR gRNA sequence
aacccaggaggcagaggctg

SEQ ID NO: 276283 - DNA, 20 bp, Artificial
  CRISPR gRNA sequence
cccaggaggcagaggctgca

SEQ ID NO: 276284 - DNA, 20 bp, Artificial
  CRISPR gRNA sequence
ggcagaggctgcagagaccc

SEQ ID NO: 276285 - DNA, 20 bp, Artificial
  CRISPR gRNA sequence
gagatcacgccactgcactc

SEQ ID NO: 276286 - DNA, 20 bp, Artificial
  CRISPR gRNA sequence
cacgccactgcactctagcc

SEQ ID NO: 276287 - DNA, 20 bp, Artificial
  CRISPR gRNA sequence
acgccactgcactctagcct

SEQ ID NO: 276288 - DNA, 20 bp, Artificial
  CRISPR gRNA sequence
ctgcactctagcctgggtga

SEQ ID NO: 276289 - DNA, 20 bp, Artificial
  CRISPR gRNA sequence
gcactctagcctgggtgaca

SEQ ID NO: 276290 - DNA, 20 bp, Artificial
  CRISPR gRNA sequence
tctagcctgggtgacagagt

SEQ ID NO: 276291 - DNA, 20 bp, Artificial
  CRISPR gRNA sequence
tagcctgggtgacagagtaa

SEQ ID NO: 276292 - DNA, 20 bp, Artificial
  CRISPR gRNA sequence
ctccatctcaaaaaaaaaaa

SEQ ID NO: 276293 - DNA, 20 bp, Artificial
  CRISPR gRNA sequence
aaaagtttcaaaatctttct

SEQ ID NO: 276294 - DNA, 20 bp, Artificial
  CRISPR gRNA sequence
tttcaaaatctttcttggct

SEQ ID NO: 276295 - DNA, 20 bp, Artificial
  CRISPR gRNA sequence
aaatctttcttggcttagaa

SEQ ID NO: 276296 - DNA, 20 bp, Artificial
  CRISPR gRNA sequence
ccatctcccaccttttttct

SEQ ID NO: 276297 - DNA, 20 bp, Artificial
  CRISPR gRNA sequence
catctcccaccttttttcta

SEQ ID NO: 276298 - DNA, 20 bp, Artificial
  CRISPR gRNA sequence
tttttctaaggtgatctgtt

SEQ ID NO: 276299 - DNA, 20 bp, Artificial
  CRISPR gRNA sequence
ttttctaaggtgatctgttt

SEQ ID NO: 276300 - DNA, 20 bp, Artificial
  CRISPR gRNA sequence
tttctaaggtgatctgttta

SEQ ID NO: 276301 - DNA, 20 bp, Artificial
  CRISPR gRNA sequence
tgtttagggtaactactcct

SEQ ID NO: 276302 - DNA, 20 bp, Artificial
  CRISPR gRNA sequence
gtttagggtaactactcctg

SEQ ID NO: 276303 - DNA, 20 bp, Artificial
  CRISPR gRNA sequence
aactactcctgaggtcttgt

SEQ ID NO: 276304 - DNA, 20 bp, Artificial
  CRISPR gRNA sequence
tgtgagattgtgaacaatca

SEQ ID NO: 276305 - DNA, 20 bp, Artificial
  CRISPR gRNA sequence
tgaacaatcaaagacgttgt

SEQ ID NO: 276306 - DNA, 20 bp, Artificial
  CRISPR gRNA sequence
cctttgtatctcattttaat

SEQ ID NO: 276307 - DNA, 20 bp, Artificial
  CRISPR gRNA sequence
ccaatttttaccactcttaa

SEQ ID NO: 276308 - DNA, 20 bp, Artificial
  CRISPR gRNA sequence
caatttttaccactcttaat

SEQ ID NO: 276309 - DNA, 20 bp, Artificial
  CRISPR gRNA sequence
ttttaccactcttaatagga

SEQ ID NO: 276310 - DNA, 20 bp, Artificial
  CRISPR gRNA sequence
tttaccactcttaataggaa

SEQ ID NO: 276311 - DNA, 20 bp, Artificial
  CRISPR gRNA sequence
ttaccactcttaataggaaa

SEQ ID NO: 276312 - DNA, 20 bp, Artificial
  CRISPR gRNA sequence
ccactcttaataggaaaggg

SEQ ID NO: 276313 - DNA, 20 bp, Artificial
  CRISPR gRNA sequence
cactcttaataggaaagggt

SEQ ID NO: 276314 - DNA, 20 bp, Artificial
  CRISPR gRNA sequence
aaagggtaggaatgtcttac

SEQ ID NO: 276315 - DNA, 20 bp, Artificial
  CRISPR gRNA sequence
aagggtaggaatgtcttaca

SEQ ID NO: 276316 - DNA, 20 bp, Artificial
  CRISPR gRNA sequence
gtaggaatgtcttacaagga

SEQ ID NO: 276317 - DNA, 20 bp, Artificial
  CRISPR gRNA sequence
taggaatgtcttacaaggaa

SEQ ID NO: 276318 - DNA, 20 bp, Artificial
  CRISPR gRNA sequence
atgtcttacaaggaaaggaa

SEQ ID NO: 276319 - DNA, 20 bp, Artificial
  CRISPR gRNA sequence
tgtcttacaaggaaaggaat

SEQ ID NO: 276320 - DNA, 20 bp, Artificial
  CRISPR gRNA sequence
aggaataggtgcacatgttt

SEQ ID NO: 276321 - DNA, 20 bp, Artificial
  CRISPR gRNA sequence
ggaataggtgcacatgtttt

SEQ ID NO: 276322 - DNA, 20 bp, Artificial
  CRISPR gRNA sequence
aataggtgcacatgttttag

SEQ ID NO: 276323 - DNA, 20 bp, Artificial
  CRISPR gRNA sequence
ataggtgcacatgttttagg

SEQ ID NO: 276324 - DNA, 20 bp, Artificial
  CRISPR gRNA sequence
ggaggaaaaatccattaacc

SEQ ID NO: 276325 - DNA, 20 bp, Artificial
  CRISPR gRNA sequence
aaaaatccattaacctagtt

SEQ ID NO: 276326 - DNA, 20 bp, Artificial
  CRISPR gRNA sequence
agttaagctgttaacgaatg

SEQ ID NO: 276327 - DNA, 20 bp, Artificial
  CRISPR gRNA sequence
aagctgttaacgaatgtagc

SEQ ID NO: 276328 - DNA, 20 bp, Artificial
  CRISPR gRNA sequence
tagctagttctcaaacatgc

SEQ ID NO: 276329 - DNA, 20 bp, Artificial
  CRISPR gRNA sequence
ttctcaaacatgccagttaa

SEQ ID NO: 276330 - DNA, 20 bp, Artificial
  CRISPR gRNA sequence
ctcaaacatgccagttaatg

SEQ ID NO: 276331 - DNA, 20 bp, Artificial
  CRISPR gRNA sequence
tcaaacatgccagttaatgg

SEQ ID NO: 276332 - DNA, 20 bp, Artificial
  CRISPR gRNA sequence
agttaatggaggttttcata

SEQ ID NO: 276333 - DNA, 20 bp, Artificial
  CRISPR gRNA sequence
atattaccattttgcaatct

SEQ ID NO: 276334 - DNA, 20 bp, Artificial
  CRISPR gRNA sequence
tttgcaatcttagacaaata

SEQ ID NO: 276335 - DNA, 20 bp, Artificial
  CRISPR gRNA sequence
ttgcaatcttagacaaatat

SEQ ID NO: 276336 - DNA, 20 bp, Artificial
  CRISPR gRNA sequence
tgcaatcttagacaaatata

SEQ ID NO: 276337 - DNA, 20 bp, Artificial
  CRISPR gRNA sequence
ccaacgtgtcctatttgcct

SEQ ID NO: 276338 - DNA, 20 bp, Artificial
  CRISPR gRNA sequence
ctatttgcctgagactttcc

SEQ ID NO: 276339 - DNA, 20 bp, Artificial
  CRISPR gRNA sequence
gcctgagactttcccagttt

SEQ ID NO: 276340 - DNA, 20 bp, Artificial
  CRISPR gRNA sequence
tgtgccccaaataaaccctt

SEQ ID NO: 276341 - DNA, 20 bp, Artificial
  CRISPR gRNA sequence
caaataaaccctttggttct

SEQ ID NO: 276342 - DNA, 20 bp, Artificial
  CRISPR gRNA sequence
aaaccctttggttctgagca

SEQ ID NO: 276343 - DNA, 20 bp, Artificial
  CRISPR gRNA sequence
accctttggttctgagcaaa

SEQ ID NO: 276344 - DNA, 20 bp, Artificial
  CRISPR gRNA sequence
ccctttggttctgagcaaag

SEQ ID NO: 276345 - DNA, 20 bp, Artificial
  CRISPR gRNA sequence
ttctgagcaaagaggatacc

SEQ ID NO: 276346 - DNA, 20 bp, Artificial
  CRISPR gRNA sequence
aagaggatacctggtcactc

SEQ ID NO: 276347 - DNA, 20 bp, Artificial
  CRISPR gRNA sequence
cctggtcactctagccaaat

SEQ ID NO: 276348 - DNA, 20 bp, Artificial
  CRISPR gRNA sequence
tggtcactctagccaaatga

SEQ ID NO: 276349 - DNA, 20 bp, Artificial
  CRISPR gRNA sequence
attccttgcttctcaaattg

SEQ ID NO: 276350 - DNA, 20 bp, Artificial
  CRISPR gRNA sequence
tctcaaattgtggtcctcca

SEQ ID NO: 276351 - DNA, 20 bp, Artificial
  CRISPR gRNA sequence
caaattgtggtcctccacag

SEQ ID NO: 276352 - DNA, 20 bp, Artificial
  CRISPR gRNA sequence
tgtggtcctccacagcagca

SEQ ID NO: 276353 - DNA, 20 bp, Artificial
  CRISPR gRNA sequence
gtggtcctccacagcagcac

SEQ ID NO: 276354 - DNA, 20 bp, Artificial
  CRISPR gRNA sequence
cagcagcacaggcatcacct

SEQ ID NO: 276355 - DNA, 20 bp, Artificial
  CRISPR gRNA sequence
gcagcacaggcatcacctga

SEQ ID NO: 276356 - DNA, 20 bp, Artificial
  CRISPR gRNA sequence
ggcatcacctgagagcttgt

SEQ ID NO: 276357 - DNA, 20 bp, Artificial
  CRISPR gRNA sequence
catcacctgagagcttgtta

SEQ ID NO: 276358 - DNA, 20 bp, Artificial
  CRISPR gRNA sequence
atcacctgagagcttgttag

SEQ ID NO: 276359 - DNA, 20 bp, Artificial
  CRISPR gRNA sequence
ctgagagcttgttagaggtg

SEQ ID NO: 276360 - DNA, 20 bp, Artificial
  CRISPR gRNA sequence
ttgttagaggtgcagaatct

SEQ ID NO: 276361 - DNA, 20 bp, Artificial
  CRISPR gRNA sequence
agaatctcagatccaaaccc

SEQ ID NO: 276362 - DNA, 20 bp, Artificial
  CRISPR gRNA sequence
cttaaatctgcatttttaac

SEQ ID NO: 276363 - DNA, 20 bp, Artificial
  CRISPR gRNA sequence
caagaccctcaaatgactca

SEQ ID NO: 276364 - DNA, 20 bp, Artificial
  CRISPR gRNA sequence
aagaccctcaaatgactcat

SEQ ID NO: 276365 - DNA, 20 bp, Artificial
  CRISPR gRNA sequence
caaatgactcataggcttat

SEQ ID NO: 276366 - DNA, 20 bp, Artificial
  CRISPR gRNA sequence
tcataggcttataagcattt

SEQ ID NO: 276367 - DNA, 20 bp, Artificial
  CRISPR gRNA sequence
aaacactgctttgactcaat

SEQ ID NO: 276368 - DNA, 20 bp, Artificial
  CRISPR gRNA sequence
tttgactcaattggaaaatt

SEQ ID NO: 276369 - DNA, 20 bp, Artificial
  CRISPR gRNA sequence
ggaaaattcagaatgcttct

SEQ ID NO: 276370 - DNA, 20 bp, Artificial
  CRISPR gRNA sequence
gaatgcttctcagcaaaatt

SEQ ID NO: 276371 - DNA, 20 bp, Artificial
  CRISPR gRNA sequence
gcttctcagcaaaattaagc

SEQ ID NO: 276372 - DNA, 20 bp, Artificial
  CRISPR gRNA sequence
cctttttgtcttccctttac

SEQ ID NO: 276373 - DNA, 20 bp, Artificial
  CRISPR gRNA sequence
tttgtccacccacacaccct

SEQ ID NO: 276374 - DNA, 20 bp, Artificial
  CRISPR gRNA sequence
acccacacaccctcggttct

SEQ ID NO: 276375 - DNA, 20 bp, Artificial
  CRISPR gRNA sequence
accctcggttctgagtaccc

SEQ ID NO: 276376 - DNA, 20 bp, Artificial
  CRISPR gRNA sequence
gaaatctcacattgtcccct

SEQ ID NO: 276377 - DNA, 20 bp, Artificial
  CRISPR gRNA sequence
attgtccccttagctgtcct

SEQ ID NO: 276378 - DNA, 20 bp, Artificial
  CRISPR gRNA sequence
tagctgtccttggtctctta

SEQ ID NO: 276379 - DNA, 20 bp, Artificial
  CRISPR gRNA sequence
ctcttacggtaatctgctaa

SEQ ID NO: 276380 - DNA, 20 bp, Artificial
  CRISPR gRNA sequence
tcttacggtaatctgctaat

SEQ ID NO: 276381 - DNA, 20 bp, Artificial
  CRISPR gRNA sequence
cttacggtaatctgctaata

SEQ ID NO: 276382 - DNA, 20 bp, Artificial
  CRISPR gRNA sequence
atgtttccttttctcactct

SEQ ID NO: 276383 - DNA, 20 bp, Artificial
  CRISPR gRNA sequence
tatccaaattcacctgacct

SEQ ID NO: 276384 - DNA, 20 bp, Artificial
  CRISPR gRNA sequence
acctgagtctacttctctct

SEQ ID NO: 276385 - DNA, 20 bp, Artificial
  CRISPR gRNA sequence
tgagtctacttctctctcgg

SEQ ID NO: 276386 - DNA, 20 bp, Artificial
  CRISPR gRNA sequence
cttctctctcggtagtccat

SEQ ID NO: 276387 - DNA, 20 bp, Artificial
  CRISPR gRNA sequence
tctctctcggtagtccatta

SEQ ID NO: 276388 - DNA, 20 bp, Artificial
  CRISPR gRNA sequence
ctctctcggtagtccattag

SEQ ID NO: 276389 - DNA, 20 bp, Artificial
  CRISPR gRNA sequence
cctaatgtaattaactaata

SEQ ID NO: 276390 - DNA, 20 bp, Artificial
  CRISPR gRNA sequence
ctaatgtaattaactaatac

SEQ ID NO: 276391 - DNA, 20 bp, Artificial
  CRISPR gRNA sequence
aatacaggctaatatatttg

SEQ ID NO: 276392 - DNA, 20 bp, Artificial
  CRISPR gRNA sequence
ccaccccccaccccccaccc

SEQ ID NO: 276393 - DNA, 20 bp, Artificial
  CRISPR gRNA sequence
caccccccaccccccacccc

SEQ ID NO: 276394 - DNA, 20 bp, Artificial
  CRISPR gRNA sequence
gaaacacattttcattttaa

SEQ ID NO: 276395 - DNA, 20 bp, Artificial
  CRISPR gRNA sequence
aaacacattttcattttaac

SEQ ID NO: 276396 - DNA, 20 bp, Artificial
  CRISPR gRNA sequence
aacacattttcattttaaca

SEQ ID NO: 276397 - DNA, 20 bp, Artificial
  CRISPR gRNA sequence
tcattttaacagggatcttt

SEQ ID NO: 276398 - DNA, 20 bp, Artificial
  CRISPR gRNA sequence
cattttaacagggatctttt

SEQ ID NO: 276399 - DNA, 20 bp, Artificial
  CRISPR gRNA sequence
ttttaacagggatcttttag

SEQ ID NO: 276400 - DNA, 20 bp, Artificial
  CRISPR gRNA sequence
tttaacagggatcttttagg

SEQ ID NO: 276401 - DNA, 20 bp, Artificial
  CRISPR gRNA sequence
gggatcttttaggaggaaaa

SEQ ID NO: 276402 - DNA, 20 bp, Artificial
  CRISPR gRNA sequence
gatcttttaggaggaaaatg

SEQ ID NO: 276403 - DNA, 20 bp, Artificial
  CRISPR gRNA sequence
taggaggaaaatggagaaac

SEQ ID NO: 276404 - DNA, 20 bp, Artificial
  CRISPR gRNA sequence
gaggaaaatggagaaactag

SEQ ID NO: 276405 - DNA, 20 bp, Artificial
  CRISPR gRNA sequence
aggaaaatggagaaactagc

SEQ ID NO: 276406 - DNA, 20 bp, Artificial
  CRISPR gRNA sequence
aatggagaaactagcaggaa

SEQ ID NO: 276407 - DNA, 20 bp, Artificial
  CRISPR gRNA sequence
gcaggaatggctatgatgat

SEQ ID NO: 276408 - DNA, 20 bp, Artificial
  CRISPR gRNA sequence
ggctatgatgatgagaattt

SEQ ID NO: 276409 - DNA, 20 bp, Artificial
  CRISPR gRNA sequence
gctatgatgatgagaatttc

SEQ ID NO: 276410 - DNA, 20 bp, Artificial
  CRISPR gRNA sequence
tatgatgatgagaatttcag

SEQ ID NO: 276411 - DNA, 20 bp, Artificial
  CRISPR gRNA sequence
gagaatttcaggagtcaatg

SEQ ID NO: 276412 - DNA, 20 bp, Artificial
  CRISPR gRNA sequence
agaatttcaggagtcaatgc

SEQ ID NO: 276413 - DNA, 20 bp, Artificial
  CRISPR gRNA sequence
gtcaatgcaggtgaaaatcg

SEQ ID NO: 276414 - DNA, 20 bp, Artificial
  CRISPR gRNA sequence
aatgcaggtgaaaatcgtgg

SEQ ID NO: 276415 - DNA, 20 bp, Artificial
  CRISPR gRNA sequence
tgcaggtgaaaatcgtggaa

SEQ ID NO: 276416 - DNA, 20 bp, Artificial
  CRISPR gRNA sequence
gcaggtgaaaatcgtggaag

SEQ ID NO: 276417 - DNA, 20 bp, Artificial
  CRISPR gRNA sequence
ggtgaaaatcgtggaagagg

SEQ ID NO: 276418 - DNA, 20 bp, Artificial
  CRISPR gRNA sequence
gtgaaaatcgtggaagaggt

SEQ ID NO: 276419 - DNA, 20 bp, Artificial
  CRISPR gRNA sequence
cgtggaagaggtaggcttct

SEQ ID NO: 276420 - DNA, 20 bp, Artificial
  CRISPR gRNA sequence
tataataatttattctatcc

SEQ ID NO: 276421 - DNA, 20 bp, Artificial
  CRISPR gRNA sequence
taataatttattctatccaa

SEQ ID NO: 276422 - DNA, 20 bp, Artificial
  CRISPR gRNA sequence
taatttattctatccaagag

SEQ ID NO: 276423 - DNA, 20 bp, Artificial
  CRISPR gRNA sequence
atttattctatccaagagca

SEQ ID NO: 276424 - DNA, 20 bp, Artificial
  CRISPR gRNA sequence
ccaagagcagagaaaacact

SEQ ID NO: 276425 - DNA, 20 bp, Artificial
  CRISPR gRNA sequence
agcagagaaaacactgagtg

SEQ ID NO: 276426 - DNA, 20 bp, Artificial
  CRISPR gRNA sequence
gaaaacactgagtgaagttt

SEQ ID NO: 276427 - DNA, 20 bp, Artificial
  CRISPR gRNA sequence
acactgagtgaagtttaaga

SEQ ID NO: 276428 - DNA, 20 bp, Artificial
  CRISPR gRNA sequence
aagatagttccatgtaactt

SEQ ID NO: 276429 - DNA, 20 bp, Artificial
  CRISPR gRNA sequence
tggcttactccccacaactt

SEQ ID NO: 276430 - DNA, 20 bp, Artificial
  CRISPR gRNA sequence
ggcttactccccacaacttt

SEQ ID NO: 276431 - DNA, 20 bp, Artificial
  CRISPR gRNA sequence
ccacaactttaggtgtgatc

SEQ ID NO: 276432 - DNA, 20 bp, Artificial
  CRISPR gRNA sequence
aggtgtgatctggatgtcac

SEQ ID NO: 276433 - DNA, 20 bp, Artificial
  CRISPR gRNA sequence
tgatctggatgtcacaagta

SEQ ID NO: 276434 - DNA, 20 bp, Artificial
  CRISPR gRNA sequence
atgtcacaagtaaagattca

SEQ ID NO: 276435 - DNA, 20 bp, Artificial
  CRISPR gRNA sequence
catagctaatgattaaaaca

SEQ ID NO: 276436 - DNA, 20 bp, Artificial
  CRISPR gRNA sequence
ctaatgattaaaacaaagaa

SEQ ID NO: 276437 - DNA, 20 bp, Artificial
  CRISPR gRNA sequence
tgattaaaacaaagaacagt

SEQ ID NO: 276438 - DNA, 20 bp, Artificial
  CRISPR gRNA sequence
gattaaaacaaagaacagta

SEQ ID NO: 276439 - DNA, 20 bp, Artificial
  CRISPR gRNA sequence
gaacagtaaggaattcacta

SEQ ID NO: 276440 - DNA, 20 bp, Artificial
  CRISPR gRNA sequence
aattcactacggatctgctg

SEQ ID NO: 276441 - DNA, 20 bp, Artificial
  CRISPR gRNA sequence
tgctgaagttatctattatc

SEQ ID NO: 276442 - DNA, 20 bp, Artificial
  CRISPR gRNA sequence
gctgaagttatctattatca

SEQ ID NO: 276443 - DNA, 20 bp, Artificial
  CRISPR gRNA sequence
gttaatcattatgttttatt

SEQ ID NO: 276444 - DNA, 20 bp, Artificial
  CRISPR gRNA sequence
atcattatgttttattaagt

SEQ ID NO: 276445 - DNA, 20 bp, Artificial
  CRISPR gRNA sequence
attatgttttattaagtaag

SEQ ID NO: 276446 - DNA, 20 bp, Artificial
  CRISPR gRNA sequence
gttttattaagtaagaagtt

SEQ ID NO: 276447 - DNA, 20 bp, Artificial
  CRISPR gRNA sequence
gtaagaagtttggttttcac

SEQ ID NO: 276448 - DNA, 20 bp, Artificial
  CRISPR gRNA sequence
aagaagtttggttttcacta

SEQ ID NO: 276449 - DNA, 20 bp, Artificial
  CRISPR gRNA sequence
agaagtttggttttcactag

SEQ ID NO: 276450 - DNA, 20 bp, Artificial
  CRISPR gRNA sequence
ttggttttcactagaggctc

SEQ ID NO: 276451 - DNA, 20 bp, Artificial
  CRISPR gRNA sequence
ttcactagaggctcaagtcc

SEQ ID NO: 276452 - DNA, 20 bp, Artificial
  CRISPR gRNA sequence
tcactagaggctcaagtccc

SEQ ID NO: 276453 - DNA, 20 bp, Artificial
  CRISPR gRNA sequence
cactagaggctcaagtccca

SEQ ID NO: 276454 - DNA, 20 bp, Artificial
  CRISPR gRNA sequence
actagaggctcaagtcccag

SEQ ID NO: 276455 - DNA, 20 bp, Artificial
  CRISPR gRNA sequence
ggctcaagtcccaggggaaa

SEQ ID NO: 276456 - DNA, 20 bp, Artificial
  CRISPR gRNA sequence
tatgttcaaatttcaactgt

SEQ ID NO: 276457 - DNA, 20 bp, Artificial
  CRISPR gRNA sequence
aaatttcaactgtgagaaaa

SEQ ID NO: 276458 - DNA, 20 bp, Artificial
  CRISPR gRNA sequence
tcaactgtgagaaaatggct

SEQ ID NO: 276459 - DNA, 20 bp, Artificial
  CRISPR gRNA sequence
caactgtgagaaaatggctc

SEQ ID NO: 276460 - DNA, 20 bp, Artificial
  CRISPR gRNA sequence
aactgtgagaaaatggctca

SEQ ID NO: 276461 - DNA, 20 bp, Artificial
  CRISPR gRNA sequence
cagggatataatttctcaaa

SEQ ID NO: 276462 - DNA, 20 bp, Artificial
  CRISPR gRNA sequence
agggatataatttctcaaaa

SEQ ID NO: 276463 - DNA, 20 bp, Artificial
  CRISPR gRNA sequence
gggatataatttctcaaaaa

SEQ ID NO: 276464 - DNA, 20 bp, Artificial
  CRISPR gRNA sequence
taatttctcaaaaagggctc

SEQ ID NO: 276465 - DNA, 20 bp, Artificial
  CRISPR gRNA sequence
aaaaagggctctggctcctt

SEQ ID NO: 276466 - DNA, 20 bp, Artificial
  CRISPR gRNA sequence
cctctgttatactgtaatta

SEQ ID NO: 276467 - DNA, 20 bp, Artificial
  CRISPR gRNA sequence
ccctttgcaaaattatgact

SEQ ID NO: 276468 - DNA, 20 bp, Artificial
  CRISPR gRNA sequence
ttgcaaaattatgactgaga

SEQ ID NO: 276469 - DNA, 20 bp, Artificial
  CRISPR gRNA sequence
aattatgactgagacagtga

SEQ ID NO: 276470 - DNA, 20 bp, Artificial
  CRISPR gRNA sequence
ttatgactgagacagtgaaa

SEQ ID NO: 276471 - DNA, 20 bp, Artificial
  CRISPR gRNA sequence
ccatcttgcttctaacctcc

SEQ ID NO: 276472 - DNA, 20 bp, Artificial
  CRISPR gRNA sequence
aagctatctttgttcactcc

SEQ ID NO: 276473 - DNA, 20 bp, Artificial
  CRISPR gRNA sequence
agctatctttgttcactcct

SEQ ID NO: 276474 - DNA, 20 bp, Artificial
  CRISPR gRNA sequence
tctttgttcactcctgggtg

SEQ ID NO: 276475 - DNA, 20 bp, Artificial
  CRISPR gRNA sequence
ctttgttcactcctgggtgt

SEQ ID NO: 276476 - DNA, 20 bp, Artificial
  CRISPR gRNA sequence
ggtgtaggctgaactaactt

SEQ ID NO: 276477 - DNA, 20 bp, Artificial
  CRISPR gRNA sequence
gtaggctgaactaactttgg

SEQ ID NO: 276478 - DNA, 20 bp, Artificial
  CRISPR gRNA sequence
aactaactttggtagaaact

SEQ ID NO: 276479 - DNA, 20 bp, Artificial
  CRISPR gRNA sequence
tttggtagaaacttagttta

SEQ ID NO: 276480 - DNA, 20 bp, Artificial
  CRISPR gRNA sequence
gaaacttagtttatagttta

SEQ ID NO: 276481 - DNA, 20 bp, Artificial
  CRISPR gRNA sequence
tatagtttatagtttaaaca

SEQ ID NO: 276482 - DNA, 20 bp, Artificial
  CRISPR gRNA sequence
gtttatagtttaaacaaaga

SEQ ID NO: 276483 - DNA, 20 bp, Artificial
  CRISPR gRNA sequence
agtttaaacaaagatggtaa

SEQ ID NO: 276484 - DNA, 20 bp, Artificial
  CRISPR gRNA sequence
atggtaacagccctttccca

SEQ ID NO: 276485 - DNA, 20 bp, Artificial
  CRISPR gRNA sequence
gtaacagccctttcccaaag

SEQ ID NO: 276486 - DNA, 20 bp, Artificial
  CRISPR gRNA sequence
aagcagacctccttcttgcc

SEQ ID NO: 276487 - DNA, 20 bp, Artificial
  CRISPR gRNA sequence
agcagacctccttcttgcct

SEQ ID NO: 276488 - DNA, 20 bp, Artificial
  CRISPR gRNA sequence
gcagacctccttcttgcctg

SEQ ID NO: 276489 - DNA, 20 bp, Artificial
  CRISPR gRNA sequence
agacctccttcttgcctggg

SEQ ID NO: 276490 - DNA, 20 bp, Artificial
  CRISPR gRNA sequence
cctccttcttgcctggggag

SEQ ID NO: 276491 - DNA, 20 bp, Artificial
  CRISPR gRNA sequence
tggggagtagattgcctttg

SEQ ID NO: 276492 - DNA, 20 bp, Artificial
  CRISPR gRNA sequence
ggggagtagattgcctttgt

SEQ ID NO: 276493 - DNA, 20 bp, Artificial
  CRISPR gRNA sequence
tgcctttgtaggactaacat

SEQ ID NO: 276494 - DNA, 20 bp, Artificial
  CRISPR gRNA sequence
gtaggactaacattagccac

SEQ ID NO: 276495 - DNA, 20 bp, Artificial
  CRISPR gRNA sequence
actaacattagccacaagat

SEQ ID NO: 276496 - DNA, 20 bp, Artificial
  CRISPR gRNA sequence
agccacaagattagaaatta

SEQ ID NO: 276497 - DNA, 20 bp, Artificial
  CRISPR gRNA sequence
caagattagaaattatggtt

SEQ ID NO: 276498 - DNA, 20 bp, Artificial
  CRISPR gRNA sequence
aagattagaaattatggttt

SEQ ID NO: 276499 - DNA, 20 bp, Artificial
  CRISPR gRNA sequence
gattagaaattatggtttag

SEQ ID NO: 276500 - DNA, 20 bp, Artificial
  CRISPR gRNA sequence
attatggtttaggagtcata

SEQ ID NO: 276501 - DNA, 20 bp, Artificial
  CRISPR gRNA sequence
tggtttaggagtcataaagc

SEQ ID NO: 276502 - DNA, 20 bp, Artificial
  CRISPR gRNA sequence
gtcataaagctggatgctat

SEQ ID NO: 276503 - DNA, 20 bp, Artificial
  CRISPR gRNA sequence
accctccctaaactgctcct

SEQ ID NO: 276504 - DNA, 20 bp, Artificial
  CRISPR gRNA sequence
ccctaaactgctcctaagat

SEQ ID NO: 276505 - DNA, 20 bp, Artificial
  CRISPR gRNA sequence
tgctcctaagatcagtgctt

SEQ ID NO: 276506 - DNA, 20 bp, Artificial
  CRISPR gRNA sequence
tcagtgcttgagctattttg

SEQ ID NO: 276507 - DNA, 20 bp, Artificial
  CRISPR gRNA sequence
tttgcagcccctgcacttga

SEQ ID NO: 276508 - DNA, 20 bp, Artificial
  CRISPR gRNA sequence
agcccctgcacttgatggat

SEQ ID NO: 276509 - DNA, 20 bp, Artificial
  CRISPR gRNA sequence
cctgcacttgatggatcagc

SEQ ID NO: 276510 - DNA, 20 bp, Artificial
  CRISPR gRNA sequence
atggatcagctggcaccacc

SEQ ID NO: 276511 - DNA, 20 bp, Artificial
  CRISPR gRNA sequence
aactgactcatctgatcttg

SEQ ID NO: 276512 - DNA, 20 bp, Artificial
  CRISPR gRNA sequence
gatcttgtggccccccaacc

SEQ ID NO: 276513 - DNA, 20 bp, Artificial
  CRISPR gRNA sequence
gtggccccccaacccagtgc

SEQ ID NO: 276514 - DNA, 20 bp, Artificial
  CRISPR gRNA sequence
gccccccaacccagtgcaag

SEQ ID NO: 276515 - DNA, 20 bp, Artificial
  CRISPR gRNA sequence
cccaacccagtgcaagaaga

SEQ ID NO: 276516 - DNA, 20 bp, Artificial
  CRISPR gRNA sequence
aagacagcttcaactcccta

SEQ ID NO: 276517 - DNA, 20 bp, Artificial
  CRISPR gRNA sequence
tggtatcatccctgaccaat

SEQ ID NO: 276518 - DNA, 20 bp, Artificial
  CRISPR gRNA sequence
ccctgaccaatcagcactcc

SEQ ID NO: 276519 - DNA, 20 bp, Artificial
  CRISPR gRNA sequence
aatcagcactcccagctcac

SEQ ID NO: 276520 - DNA, 20 bp, Artificial
  CRISPR gRNA sequence
ctggcttcccccgacccacc

SEQ ID NO: 276521 - DNA, 20 bp, Artificial
  CRISPR gRNA sequence
tccttaaaaactctgctccc

SEQ ID NO: 276522 - DNA, 20 bp, Artificial
  CRISPR gRNA sequence
aactctgctccccagatgct

SEQ ID NO: 276523 - DNA, 20 bp, Artificial
  CRISPR gRNA sequence
ctctgctccccagatgcttg

SEQ ID NO: 276524 - DNA, 20 bp, Artificial
  CRISPR gRNA sequence
ctgctccccagatgcttgga

SEQ ID NO: 276525 - DNA, 20 bp, Artificial
  CRISPR gRNA sequence
atgcttggagagactgattt

SEQ ID NO: 276526 - DNA, 20 bp, Artificial
  CRISPR gRNA sequence
tttgagtaatgataaaactc

SEQ ID NO: 276527 - DNA, 20 bp, Artificial
  CRISPR gRNA sequence
taaaactccggtctcccgca

SEQ ID NO: 276528 - DNA, 20 bp, Artificial
  CRISPR gRNA sequence
actccggtctcccgcacagc

SEQ ID NO: 276529 - DNA, 20 bp, Artificial
  CRISPR gRNA sequence
attcccctgtcttgatgaat

SEQ ID NO: 276530 - DNA, 20 bp, Artificial
  CRISPR gRNA sequence
atgaattggctctatctacg

SEQ ID NO: 276531 - DNA, 20 bp, Artificial
  CRISPR gRNA sequence
aattggctctatctacgcag

SEQ ID NO: 276532 - DNA, 20 bp, Artificial
  CRISPR gRNA sequence
attggctctatctacgcagc

SEQ ID NO: 276533 - DNA, 20 bp, Artificial
  CRISPR gRNA sequence
gctctatctacgcagcaggc

SEQ ID NO: 276534 - DNA, 20 bp, Artificial
  CRISPR gRNA sequence
ctctatctacgcagcaggcg

SEQ ID NO: 276535 - DNA, 20 bp, Artificial
  CRISPR gRNA sequence
agcaggcgaggtaaacctct

SEQ ID NO: 276536 - DNA, 20 bp, Artificial
  CRISPR gRNA sequence
gcaggcgaggtaaacctctt

SEQ ID NO: 276537 - DNA, 20 bp, Artificial
  CRISPR gRNA sequence
ggcgaggtaaacctcttggg

SEQ ID NO: 276538 - DNA, 20 bp, Artificial
  CRISPR gRNA sequence
aacctcttgggtggttacaa

SEQ ID NO: 276539 - DNA, 20 bp, Artificial
  CRISPR gRNA sequence
tcttgggtggttacaaaagc

SEQ ID NO: 276540 - DNA, 20 bp, Artificial
  CRISPR gRNA sequence
cttgggtggttacaaaagca

SEQ ID NO: 276541 - DNA, 20 bp, Artificial
  CRISPR gRNA sequence
ttgggtggttacaaaagcaa

SEQ ID NO: 276542 - DNA, 20 bp, Artificial
  CRISPR gRNA sequence
agcaagggtcctttctttcc

SEQ ID NO: 276543 - DNA, 20 bp, Artificial
  CRISPR gRNA sequence
gggtcctttctttccgagac

SEQ ID NO: 276544 - DNA, 20 bp, Artificial
  CRISPR gRNA sequence
ccagaaatgcttgccttcca

SEQ ID NO: 276545 - DNA, 20 bp, Artificial
  CRISPR gRNA sequence
gaaatgcttgccttccacag

SEQ ID NO: 276546 - DNA, 20 bp, Artificial
  CRISPR gRNA sequence
aaatgcttgccttccacagt

SEQ ID NO: 276547 - DNA, 20 bp, Artificial
  CRISPR gRNA sequence
ttccacagtaggtacataaa

SEQ ID NO: 276548 - DNA, 20 bp, Artificial
  CRISPR gRNA sequence
tccacagtaggtacataaac

SEQ ID NO: 276549 - DNA, 20 bp, Artificial
  CRISPR gRNA sequence
ccacagtaggtacataaaca

SEQ ID NO: 276550 - DNA, 20 bp, Artificial
  CRISPR gRNA sequence
cagggctttgattcataaat

SEQ ID NO: 276551 - DNA, 20 bp, Artificial
  CRISPR gRNA sequence
taaattagtttttttccttg

SEQ ID NO: 276552 - DNA, 20 bp, Artificial
  CRISPR gRNA sequence
attagtttttttccttgtgg

SEQ ID NO: 276553 - DNA, 20 bp, Artificial
  CRISPR gRNA sequence
ttagtttttttccttgtggc

SEQ ID NO: 276554 - DNA, 20 bp, Artificial
  CRISPR gRNA sequence
tctaactttttttttttttt

SEQ ID NO: 276555 - DNA, 20 bp, Artificial
  CRISPR gRNA sequence
acttttttttttttttaaga

SEQ ID NO: 276556 - DNA, 20 bp, Artificial
  CRISPR gRNA sequence
ttttttttttttttaagaca

SEQ ID NO: 276557 - DNA, 20 bp, Artificial
  CRISPR gRNA sequence
ttttaagacagagtctctac

SEQ ID NO: 276558 - DNA, 20 bp, Artificial
  CRISPR gRNA sequence
taagacagagtctctaccag

SEQ ID NO: 276559 - DNA, 20 bp, Artificial
  CRISPR gRNA sequence
aagacagagtctctaccagt

SEQ ID NO: 276560 - DNA, 20 bp, Artificial
  CRISPR gRNA sequence
agacagagtctctaccagta

SEQ ID NO: 276561 - DNA, 20 bp, Artificial
  CRISPR gRNA sequence
gaaatgctcaccctcctctg

SEQ ID NO: 276562 - DNA, 20 bp, Artificial
  CRISPR gRNA sequence
tactttttttttttttgaaa

SEQ ID NO: 276563 - DNA, 20 bp, Artificial
  CRISPR gRNA sequence
acagtctttgctctgtcacc

SEQ ID NO: 276564 - DNA, 20 bp, Artificial
  CRISPR gRNA sequence
cagtctttgctctgtcacca

SEQ ID NO: 276565 - DNA, 20 bp, Artificial
  CRISPR gRNA sequence
ctttgctctgtcaccaaggc

SEQ ID NO: 276566 - DNA, 20 bp, Artificial
  CRISPR gRNA sequence
ttgctctgtcaccaaggctg

SEQ ID NO: 276567 - DNA, 20 bp, Artificial
  CRISPR gRNA sequence
ctgtcaccaaggctggagtg

SEQ ID NO: 276568 - DNA, 20 bp, Artificial
  CRISPR gRNA sequence
tcaccaaggctggagtgcag

SEQ ID NO: 276569 - DNA, 20 bp, Artificial
  CRISPR gRNA sequence
tcactgcaacctccgcctcc

SEQ ID NO: 276570 - DNA, 20 bp, Artificial
  CRISPR gRNA sequence
cactgcaacctccgcctccc

SEQ ID NO: 276571 - DNA, 20 bp, Artificial
  CRISPR gRNA sequence
aacctccgcctcccaggttc

SEQ ID NO: 276572 - DNA, 20 bp, Artificial
  CRISPR gRNA sequence
ttcaagtgattctcctgcct

SEQ ID NO: 276573 - DNA, 20 bp, Artificial
  CRISPR gRNA sequence
ttctcctgcctcagcctcct

SEQ ID NO: 276574 - DNA, 20 bp, Artificial
  CRISPR gRNA sequence
tcctgcctcagcctcctgag

SEQ ID NO: 276575 - DNA, 20 bp, Artificial
  CRISPR gRNA sequence
ctgagtagccaacacgtccc

SEQ ID NO: 276576 - DNA, 20 bp, Artificial
  CRISPR gRNA sequence
ctggctaatttttgtatttt

SEQ ID NO: 276577 - DNA, 20 bp, Artificial
  CRISPR gRNA sequence
gctaatttttgtatttttag

SEQ ID NO: 276578 - DNA, 20 bp, Artificial
  CRISPR gRNA sequence
taatttttgtatttttagta

SEQ ID NO: 276579 - DNA, 20 bp, Artificial
  CRISPR gRNA sequence
ttttgtatttttagtagaga

SEQ ID NO: 276580 - DNA, 20 bp, Artificial
  CRISPR gRNA sequence
tttgtatttttagtagagat

SEQ ID NO: 276581 - DNA, 20 bp, Artificial
  CRISPR gRNA sequence
ttgtatttttagtagagatg

SEQ ID NO: 276582 - DNA, 20 bp, Artificial
  CRISPR gRNA sequence
gagatggggtttcaccatgt

SEQ ID NO: 276583 - DNA, 20 bp, Artificial
  CRISPR gRNA sequence
agatggggtttcaccatgtt

SEQ ID NO: 276584 - DNA, 20 bp, Artificial
  CRISPR gRNA sequence
tggggtttcaccatgttggg

SEQ ID NO: 276585 - DNA, 20 bp, Artificial
  CRISPR gRNA sequence
ggggtttcaccatgttgggc

SEQ ID NO: 276586 - DNA, 20 bp, Artificial
  CRISPR gRNA sequence
tttcaccatgttgggcaggc

SEQ ID NO: 276587 - DNA, 20 bp, Artificial
  CRISPR gRNA sequence
caggctggtctcaaactcct

SEQ ID NO: 276588 - DNA, 20 bp, Artificial
  CRISPR gRNA sequence
ggtctcaaactcctgagctc

SEQ ID NO: 276589 - DNA, 20 bp, Artificial
  CRISPR gRNA sequence
ctcaagccatccacccacct

SEQ ID NO: 276590 - DNA, 20 bp, Artificial
  CRISPR gRNA sequence
ccacccaccttggcctccca

SEQ ID NO: 276591 - DNA, 20 bp, Artificial
  CRISPR gRNA sequence
ccttggcctcccaaagtgct

SEQ ID NO: 276592 - DNA, 20 bp, Artificial
  CRISPR gRNA sequence
aagtgctgagccaccgcacc

SEQ ID NO: 276593 - DNA, 20 bp, Artificial
  CRISPR gRNA sequence
ttctctaacatctaattttt

SEQ ID NO: 276594 - DNA, 20 bp, Artificial
  CRISPR gRNA sequence
tctctaacatctaatttttc

SEQ ID NO: 276595 - DNA, 20 bp, Artificial
  CRISPR gRNA sequence
aatttttcaggactgactgc

SEQ ID NO: 276596 - DNA, 20 bp, Artificial
  CRISPR gRNA sequence
ttcaggactgactgctagat

SEQ ID NO: 276597 - DNA, 20 bp, Artificial
  CRISPR gRNA sequence
caggactgactgctagatta

SEQ ID NO: 276598 - DNA, 20 bp, Artificial
  CRISPR gRNA sequence
tagagcttcaaatatgcaat

SEQ ID NO: 276599 - DNA, 20 bp, Artificial
  CRISPR gRNA sequence
aattatcactttgaaaatat

SEQ ID NO: 276600 - DNA, 20 bp, Artificial
  CRISPR gRNA sequence
ttgaaaatattagaatataa

SEQ ID NO: 276601 - DNA, 20 bp, Artificial
  CRISPR gRNA sequence
aaatattagaatataatagt

SEQ ID NO: 276602 - DNA, 20 bp, Artificial
  CRISPR gRNA sequence
attagaatataatagtaaga

SEQ ID NO: 276603 - DNA, 20 bp, Artificial
  CRISPR gRNA sequence
atataatagtaagatagcca

SEQ ID NO: 276604 - DNA, 20 bp, Artificial
  CRISPR gRNA sequence
tagtaagatagccatagtaa

SEQ ID NO: 276605 - DNA, 20 bp, Artificial
  CRISPR gRNA sequence
cgttcacatactacctgaaa

SEQ ID NO: 276606 - DNA, 20 bp, Artificial
  CRISPR gRNA sequence
cttttttttttttttttttt

SEQ ID NO: 276607 - DNA, 20 bp, Artificial
  CRISPR gRNA sequence
ttttttttttttttttgaga

SEQ ID NO: 276608 - DNA, 20 bp, Artificial
  CRISPR gRNA sequence
ttttttttttttttgagatg

SEQ ID NO: 276609 - DNA, 20 bp, Artificial
  CRISPR gRNA sequence
tggagtcttgctatgtcacc

SEQ ID NO: 276610 - DNA, 20 bp, Artificial
  CRISPR gRNA sequence
ggagtcttgctatgtcaccc

SEQ ID NO: 276611 - DNA, 20 bp, Artificial
  CRISPR gRNA sequence
tcttgctatgtcacccaggc

SEQ ID NO: 276612 - DNA, 20 bp, Artificial
  CRISPR gRNA sequence
ttgctatgtcacccaggctg

SEQ ID NO: 276613 - DNA, 20 bp, Artificial
  CRISPR gRNA sequence
atgtcacccaggctggagtg

SEQ ID NO: 276614 - DNA, 20 bp, Artificial
  CRISPR gRNA sequence
tcacccaggctggagtgcag

SEQ ID NO: 276615 - DNA, 20 bp, Artificial
  CRISPR gRNA sequence
ggagtgcagtggtgcaatct

SEQ ID NO: 276616 - DNA, 20 bp, Artificial
  CRISPR gRNA sequence
tcattgcaacctccgcctcc

SEQ ID NO: 276617 - DNA, 20 bp, Artificial
  CRISPR gRNA sequence
cattgcaacctccgcctccc

SEQ ID NO: 276618 - DNA, 20 bp, Artificial
  CRISPR gRNA sequence
aacctccgcctcccaggttc

SEQ ID NO: 276619 - DNA, 20 bp, Artificial
  CRISPR gRNA sequence
gttcaagcgattctctgcct

SEQ ID NO: 276620 - DNA, 20 bp, Artificial
  CRISPR gRNA sequence
cgattctctgcctcagcctc

SEQ ID NO: 276621 - DNA, 20 bp, Artificial
  CRISPR gRNA sequence
attctctgcctcagcctcca

SEQ ID NO: 276622 - DNA, 20 bp, Artificial
  CRISPR gRNA sequence
ctctgcctcagcctccagag

SEQ ID NO: 276623 - DNA, 20 bp, Artificial
  CRISPR gRNA sequence
gcctcagcctccagagtagc

SEQ ID NO: 276624 - DNA, 20 bp, Artificial
  CRISPR gRNA sequence
cctcagcctccagagtagct

SEQ ID NO: 276625 - DNA, 20 bp, Artificial
  CRISPR gRNA sequence
ctccagagtagctgggatta

SEQ ID NO: 276626 - DNA, 20 bp, Artificial
  CRISPR gRNA sequence
tccagagtagctgggattac

SEQ ID NO: 276627 - DNA, 20 bp, Artificial
  CRISPR gRNA sequence
caggaatgcgccaccacatc

SEQ ID NO: 276628 - DNA, 20 bp, Artificial
  CRISPR gRNA sequence
aatgcgccaccacatctggc

SEQ ID NO: 276629 - DNA, 20 bp, Artificial
  CRISPR gRNA sequence
ctggctagtttttgtatttt

SEQ ID NO: 276630 - DNA, 20 bp, Artificial
  CRISPR gRNA sequence
gctagtttttgtatttttag

SEQ ID NO: 276631 - DNA, 20 bp, Artificial
  CRISPR gRNA sequence
ctagtttttgtatttttagt

SEQ ID NO: 276632 - DNA, 20 bp, Artificial
  CRISPR gRNA sequence
tagtttttgtatttttagta

SEQ ID NO: 276633 - DNA, 20 bp, Artificial
  CRISPR gRNA sequence
ttttgtatttttagtaggga

SEQ ID NO: 276634 - DNA, 20 bp, Artificial
  CRISPR gRNA sequence
ttgtatttttagtagggacg

SEQ ID NO: 276635 - DNA, 20 bp, Artificial
  CRISPR gRNA sequence
gggacggagtttcgctatgt

SEQ ID NO: 276636 - DNA, 20 bp, Artificial
  CRISPR gRNA sequence
cggagtttcgctatgttggc

SEQ ID NO: 276637 - DNA, 20 bp, Artificial
  CRISPR gRNA sequence
ggagtttcgctatgttggcc

SEQ ID NO: 276638 - DNA, 20 bp, Artificial
  CRISPR gRNA sequence
tttcgctatgttggccaggc

SEQ ID NO: 276639 - DNA, 20 bp, Artificial
  CRISPR gRNA sequence
ggtcttgaactcatgacctc

SEQ ID NO: 276640 - DNA, 20 bp, Artificial
  CRISPR gRNA sequence
ctcaagtgatccgcctgcct

SEQ ID NO: 276641 - DNA, 20 bp, Artificial
  CRISPR gRNA sequence
ccgcctgccttggcctccca

SEQ ID NO: 276642 - DNA, 20 bp, Artificial
  CRISPR gRNA sequence
ccttggcctcccaaagtgct

SEQ ID NO: 276643 - DNA, 20 bp, Artificial
  CRISPR gRNA sequence
ctcccaaagtgctgagatta

SEQ ID NO: 276644 - DNA, 20 bp, Artificial
  CRISPR gRNA sequence
tcccaaagtgctgagattac

SEQ ID NO: 276645 - DNA, 20 bp, Artificial
  CRISPR gRNA sequence
agtgctgagattacaggcat

SEQ ID NO: 276646 - DNA, 20 bp, Artificial
  CRISPR gRNA sequence
caggcataagccaccatacc

SEQ ID NO: 276647 - DNA, 20 bp, Artificial
  CRISPR gRNA sequence
acccagccccgttacctttt

SEQ ID NO: 276648 - DNA, 20 bp, Artificial
  CRISPR gRNA sequence
accttttcagcatactttca

SEQ ID NO: 276649 - DNA, 20 bp, Artificial
  CRISPR gRNA sequence
ccttttcagcatactttcac

SEQ ID NO: 276650 - DNA, 20 bp, Artificial
  CRISPR gRNA sequence
ctttcacaggcatatattgc

SEQ ID NO: 276651 - DNA, 20 bp, Artificial
  CRISPR gRNA sequence
tttcacaggcatatattgct

SEQ ID NO: 276652 - DNA, 20 bp, Artificial
  CRISPR gRNA sequence
caggcatatattgctgggtc

SEQ ID NO: 276653 - DNA, 20 bp, Artificial
  CRISPR gRNA sequence
atatattgctgggtcaagtg

SEQ ID NO: 276654 - DNA, 20 bp, Artificial
  CRISPR gRNA sequence
attgctgggtcaagtgcagt

SEQ ID NO: 276655 - DNA, 20 bp, Artificial
  CRISPR gRNA sequence
gctgggtcaagtgcagttag

SEQ ID NO: 276656 - DNA, 20 bp, Artificial
  CRISPR gRNA sequence
ggtcaagtgcagttagtagc

SEQ ID NO: 276657 - DNA, 20 bp, Artificial
  CRISPR gRNA sequence
gtcaagtgcagttagtagca

SEQ ID NO: 276658 - DNA, 20 bp, Artificial
  CRISPR gRNA sequence
agcaaggctacatcaaatca

SEQ ID NO: 276659 - DNA, 20 bp, Artificial
  CRISPR gRNA sequence
atcaaatcaaagatgcccct

SEQ ID NO: 276660 - DNA, 20 bp, Artificial
  CRISPR gRNA sequence
aaagatgccccttggtgatt

SEQ ID NO: 276661 - DNA, 20 bp, Artificial
  CRISPR gRNA sequence
agatgccccttggtgattga

SEQ ID NO: 276662 - DNA, 20 bp, Artificial
  CRISPR gRNA sequence
gatgccccttggtgattgag

SEQ ID NO: 276663 - DNA, 20 bp, Artificial
  CRISPR gRNA sequence
ttggtgattgagaggctctt

SEQ ID NO: 276664 - DNA, 20 bp, Artificial
  CRISPR gRNA sequence
tggtgattgagaggctcttt

SEQ ID NO: 276665 - DNA, 20 bp, Artificial
  CRISPR gRNA sequence
agaggctctttaggtcatta

SEQ ID NO: 276666 - DNA, 20 bp, Artificial
  CRISPR gRNA sequence
tttaggtcattatagtgccc

SEQ ID NO: 276667 - DNA, 20 bp, Artificial
  CRISPR gRNA sequence
ttaggtcattatagtgcccc

SEQ ID NO: 276668 - DNA, 20 bp, Artificial
  CRISPR gRNA sequence
caggatgattgtcatgaact

SEQ ID NO: 276669 - DNA, 20 bp, Artificial
  CRISPR gRNA sequence
gtcatgaacttggattgtca

SEQ ID NO: 276670 - DNA, 20 bp, Artificial
  CRISPR gRNA sequence
aacttggattgtcaaagaac

SEQ ID NO: 276671 - DNA, 20 bp, Artificial
  CRISPR gRNA sequence
gaacaagaaatgcacattaa

SEQ ID NO: 276672 - DNA, 20 bp, Artificial
  CRISPR gRNA sequence
tgcacattaacagatatttc

SEQ ID NO: 276673 - DNA, 20 bp, Artificial
  CRISPR gRNA sequence
gcacattaacagatatttcc

SEQ ID NO: 276674 - DNA, 20 bp, Artificial
  CRISPR gRNA sequence
agatatttccaggacatctt

SEQ ID NO: 276675 - DNA, 20 bp, Artificial
  CRISPR gRNA sequence
tccaggacatctttagaaac

SEQ ID NO: 276676 - DNA, 20 bp, Artificial
  CRISPR gRNA sequence
ggacatctttagaaaccagt

SEQ ID NO: 276677 - DNA, 20 bp, Artificial
  CRISPR gRNA sequence
acatctttagaaaccagtta

SEQ ID NO: 276678 - DNA, 20 bp, Artificial
  CRISPR gRNA sequence
gttagagtttattgtacaac

SEQ ID NO: 276679 - DNA, 20 bp, Artificial
  CRISPR gRNA sequence
tagagtttattgtacaacta

SEQ ID NO: 276680 - DNA, 20 bp, Artificial
  CRISPR gRNA sequence
acaactagagacttaactcc

SEQ ID NO: 276681 - DNA, 20 bp, Artificial
  CRISPR gRNA sequence
agacttaactccaagaaatg

SEQ ID NO: 276682 - DNA, 20 bp, Artificial
  CRISPR gRNA sequence
ttaactccaagaaatgaagt

SEQ ID NO: 276683 - DNA, 20 bp, Artificial
  CRISPR gRNA sequence
aagtgagatacatccctctt

SEQ ID NO: 276684 - DNA, 20 bp, Artificial
  CRISPR gRNA sequence
aaaattttcacctaaatcaa

SEQ ID NO: 276685 - DNA, 20 bp, Artificial
  CRISPR gRNA sequence
atcaatagccatgtgtcttt

SEQ ID NO: 276686 - DNA, 20 bp, Artificial
  CRISPR gRNA sequence
tcaatagccatgtgtcttta

SEQ ID NO: 276687 - DNA, 20 bp, Artificial
  CRISPR gRNA sequence
caatagccatgtgtctttaa

SEQ ID NO: 276688 - DNA, 20 bp, Artificial
  CRISPR gRNA sequence
catgtgtctttaagggcatt

SEQ ID NO: 276689 - DNA, 20 bp, Artificial
  CRISPR gRNA sequence
taagggcattaagaatctgc

SEQ ID NO: 276690 - DNA, 20 bp, Artificial
  CRISPR gRNA sequence
gcattaagaatctgccggcc

SEQ ID NO: 276691 - DNA, 20 bp, Artificial
  CRISPR gRNA sequence
attaagaatctgccggccta

SEQ ID NO: 276692 - DNA, 20 bp, Artificial
  CRISPR gRNA sequence
ctgccggcctagagtaaaat

SEQ ID NO: 276693 - DNA, 20 bp, Artificial
  CRISPR gRNA sequence
tttgactgataacgtcactt

SEQ ID NO: 276694 - DNA, 20 bp, Artificial
  CRISPR gRNA sequence
actgataacgtcacttcagc

SEQ ID NO: 276695 - DNA, 20 bp, Artificial
  CRISPR gRNA sequence
ctgataacgtcacttcagcc

SEQ ID NO: 276696 - DNA, 20 bp, Artificial
  CRISPR gRNA sequence
agccaggtgttcccgcttga

SEQ ID NO: 276697 - DNA, 20 bp, Artificial
  CRISPR gRNA sequence
aaagcgtctttttcatactt

SEQ ID NO: 276698 - DNA, 20 bp, Artificial
  CRISPR gRNA sequence
acactcgtatgtgccctcgt

SEQ ID NO: 276699 - DNA, 20 bp, Artificial
  CRISPR gRNA sequence
tcgtatgtgccctcgtcaga

SEQ ID NO: 276700 - DNA, 20 bp, Artificial
  CRISPR gRNA sequence
cgtatgtgccctcgtcagat

SEQ ID NO: 276701 - DNA, 20 bp, Artificial
  CRISPR gRNA sequence
gtgccctcgtcagatgggcg

SEQ ID NO: 276702 - DNA, 20 bp, Artificial
  CRISPR gRNA sequence
gccctcgtcagatgggcgca

SEQ ID NO: 276703 - DNA, 20 bp, Artificial
  CRISPR gRNA sequence
tcgtcagatgggcgcagagc

SEQ ID NO: 276704 - DNA, 20 bp, Artificial
  CRISPR gRNA sequence
cgtcagatgggcgcagagcc

SEQ ID NO: 276705 - DNA, 20 bp, Artificial
  CRISPR gRNA sequence
gcgcagagccaggatcacaa

SEQ ID NO: 276706 - DNA, 20 bp, Artificial
  CRISPR gRNA sequence
gcagagccaggatcacaatg

SEQ ID NO: 276707 - DNA, 20 bp, Artificial
  CRISPR gRNA sequence
agagccaggatcacaatgga

SEQ ID NO: 276708 - DNA, 20 bp, Artificial
  CRISPR gRNA sequence
gagccaggatcacaatggag

SEQ ID NO: 276709 - DNA, 20 bp, Artificial
  CRISPR gRNA sequence
gatcacaatggagaggttat

SEQ ID NO: 276710 - DNA, 20 bp, Artificial
  CRISPR gRNA sequence
agaggttattagtgatatca

SEQ ID NO: 276711 - DNA, 20 bp, Artificial
  CRISPR gRNA sequence
gttattagtgatatcaaaga

SEQ ID NO: 276712 - DNA, 20 bp, Artificial
  CRISPR gRNA sequence
tagtgatatcaaagatggtc

SEQ ID NO: 276713 - DNA, 20 bp, Artificial
  CRISPR gRNA sequence
gatggtccggttcttgtact

SEQ ID NO: 276714 - DNA, 20 bp, Artificial
  CRISPR gRNA sequence
atggtccggttcttgtactc

SEQ ID NO: 276715 - DNA, 20 bp, Artificial
  CRISPR gRNA sequence
gggccatatattcatgtccc

SEQ ID NO: 276716 - DNA, 20 bp, Artificial
  CRISPR gRNA sequence
attcatgtccccagacatca

SEQ ID NO: 276717 - DNA, 20 bp, Artificial
  CRISPR gRNA sequence
atgtccccagacatcatagt

SEQ ID NO: 276718 - DNA, 20 bp, Artificial
  CRISPR gRNA sequence
ccattttcttctccttttgc

SEQ ID NO: 276719 - DNA, 20 bp, Artificial
  CRISPR gRNA sequence
ttttcttctccttttgccag

SEQ ID NO: 276720 - DNA, 20 bp, Artificial
  CRISPR gRNA sequence
ctccttttgccagtagatgc

SEQ ID NO: 276721 - DNA, 20 bp, Artificial
  CRISPR gRNA sequence
cagtagatgcgagtttgtgc

SEQ ID NO: 276722 - DNA, 20 bp, Artificial
  CRISPR gRNA sequence
agtttgtgccagctcttcaa

SEQ ID NO: 276723 - DNA, 20 bp, Artificial
  CRISPR gRNA sequence
caacagaaacattgtgacca

SEQ ID NO: 276724 - DNA, 20 bp, Artificial
  CRISPR gRNA sequence
aacagaaacattgtgaccac

SEQ ID NO: 276725 - DNA, 20 bp, Artificial
  CRISPR gRNA sequence
gaaacattgtgaccacagga

SEQ ID NO: 276726 - DNA, 20 bp, Artificial
  CRISPR gRNA sequence
tgccacttctttcacttcct

SEQ ID NO: 276727 - DNA, 20 bp, Artificial
  CRISPR gRNA sequence
ctttcacttccttggtcacg

SEQ ID NO: 276728 - DNA, 20 bp, Artificial
  CRISPR gRNA sequence
ggtcacgtggataacaccta

SEQ ID NO: 276729 - DNA, 20 bp, Artificial
  CRISPR gRNA sequence
tcacgtggataacacctatg

SEQ ID NO: 276730 - DNA, 20 bp, Artificial
  CRISPR gRNA sequence
acgtggataacacctatgga

SEQ ID NO: 276731 - DNA, 20 bp, Artificial
  CRISPR gRNA sequence
cgtggataacacctatggag

SEQ ID NO: 276732 - DNA, 20 bp, Artificial
  CRISPR gRNA sequence
aacacctatggagaggcaaa

SEQ ID NO: 276733 - DNA, 20 bp, Artificial
  CRISPR gRNA sequence
tatggagaggcaaacagaac

SEQ ID NO: 276734 - DNA, 20 bp, Artificial
  CRISPR gRNA sequence
gattgtatatttattaaata

SEQ ID NO: 276735 - DNA, 20 bp, Artificial
  CRISPR gRNA sequence
attaaatacagattcctgca

SEQ ID NO: 276736 - DNA, 20 bp, Artificial
  CRISPR gRNA sequence
aatacagattcctgcatggt

SEQ ID NO: 276737 - DNA, 20 bp, Artificial
  CRISPR gRNA sequence
atacagattcctgcatggtc

SEQ ID NO: 276738 - DNA, 20 bp, Artificial
  CRISPR gRNA sequence
cctgcatggtcaggaatcca

SEQ ID NO: 276739 - DNA, 20 bp, Artificial
  CRISPR gRNA sequence
catggtcaggaatccaaagt

SEQ ID NO: 276740 - DNA, 20 bp, Artificial
  CRISPR gRNA sequence
ggtcaggaatccaaagtcgg

SEQ ID NO: 276741 - DNA, 20 bp, Artificial
  CRISPR gRNA sequence
gaatccaaagtcggcagtaa

SEQ ID NO: 276742 - DNA, 20 bp, Artificial
  CRISPR gRNA sequence
aagtcggcagtaacagaact

SEQ ID NO: 276743 - DNA, 20 bp, Artificial
  CRISPR gRNA sequence
agtcggcagtaacagaactt

SEQ ID NO: 276744 - DNA, 20 bp, Artificial
  CRISPR gRNA sequence
gtcggcagtaacagaactta

SEQ ID NO: 276745 - DNA, 20 bp, Artificial
  CRISPR gRNA sequence
agaacttagggtgttgtgtc

SEQ ID NO: 276746 - DNA, 20 bp, Artificial
  CRISPR gRNA sequence
gggtgttgtgtctagtgact

SEQ ID NO: 276747 - DNA, 20 bp, Artificial
  CRISPR gRNA sequence
ctagtgactaagtatcaatc

SEQ ID NO: 276748 - DNA, 20 bp, Artificial
  CRISPR gRNA sequence
tatcaatccagtttgatttt

SEQ ID NO: 276749 - DNA, 20 bp, Artificial
  CRISPR gRNA sequence
atcaatccagtttgattttt

SEQ ID NO: 276750 - DNA, 20 bp, Artificial
  CRISPR gRNA sequence
tcaatccagtttgatttttg

SEQ ID NO: 276751 - DNA, 20 bp, Artificial
  CRISPR gRNA sequence
tcttcattttttaaaaattg

SEQ ID NO: 276752 - DNA, 20 bp, Artificial
  CRISPR gRNA sequence
aattgtggtaaaaaacacaa

SEQ ID NO: 276753 - DNA, 20 bp, Artificial
  CRISPR gRNA sequence
attgtggtaaaaaacacaac

SEQ ID NO: 276754 - DNA, 20 bp, Artificial
  CRISPR gRNA sequence
tggtaaaaaacacaacaggc

SEQ ID NO: 276755 - DNA, 20 bp, Artificial
  CRISPR gRNA sequence
ggtaaaaaacacaacaggct

SEQ ID NO: 276756 - DNA, 20 bp, Artificial
  CRISPR gRNA sequence
aaaacacaacaggctgggcg

SEQ ID NO: 276757 - DNA, 20 bp, Artificial
  CRISPR gRNA sequence
acacaacaggctgggcgtgg

SEQ ID NO: 276758 - DNA, 20 bp, Artificial
  CRISPR gRNA sequence
gtggctcacgcctgtaatcc

SEQ ID NO: 276759 - DNA, 20 bp, Artificial
  CRISPR gRNA sequence
cgcctgtaatcccagcactt

SEQ ID NO: 276760 - DNA, 20 bp, Artificial
  CRISPR gRNA sequence
gcctgtaatcccagcacttt

SEQ ID NO: 276761 - DNA, 20 bp, Artificial
  CRISPR gRNA sequence
ctgtaatcccagcactttgg

SEQ ID NO: 276762 - DNA, 20 bp, Artificial
  CRISPR gRNA sequence
tgtaatcccagcactttggg

SEQ ID NO: 276763 - DNA, 20 bp, Artificial
  CRISPR gRNA sequence
tcccagcactttgggaggcc

SEQ ID NO: 276764 - DNA, 20 bp, Artificial
  CRISPR gRNA sequence
cccagcactttgggaggccg

SEQ ID NO: 276765 - DNA, 20 bp, Artificial
  CRISPR gRNA sequence
agcactttgggaggccgagg

SEQ ID NO: 276766 - DNA, 20 bp, Artificial
  CRISPR gRNA sequence
gcactttgggaggccgaggc

SEQ ID NO: 276767 - DNA, 20 bp, Artificial
  CRISPR gRNA sequence
ctttgggaggccgaggcagg

SEQ ID NO: 276768 - DNA, 20 bp, Artificial
  CRISPR gRNA sequence
ccgaggcaggcagatcactt

SEQ ID NO: 276769 - DNA, 20 bp, Artificial
  CRISPR gRNA sequence
cgaggcaggcagatcacttg

SEQ ID NO: 276770 - DNA, 20 bp, Artificial
  CRISPR gRNA sequence
gcaggcagatcacttgaggt

SEQ ID NO: 276771 - DNA, 20 bp, Artificial
  CRISPR gRNA sequence
caggcagatcacttgaggtc

SEQ ID NO: 276772 - DNA, 20 bp, Artificial
  CRISPR gRNA sequence
ggcagatcacttgaggtcag

SEQ ID NO: 276773 - DNA, 20 bp, Artificial
  CRISPR gRNA sequence
tcacttgaggtcaggagttc

SEQ ID NO: 276774 - DNA, 20 bp, Artificial
  CRISPR gRNA sequence
tgaggtcaggagttcgagac

SEQ ID NO: 276775 - DNA, 20 bp, Artificial
  CRISPR gRNA sequence
gtcaggagttcgagaccagc

SEQ ID NO: 276776 - DNA, 20 bp, Artificial
  CRISPR gRNA sequence
tcaggagttcgagaccagcc

SEQ ID NO: 276777 - DNA, 20 bp, Artificial
  CRISPR gRNA sequence
cgagaccagccgggccaaca

SEQ ID NO: 276778 - DNA, 20 bp, Artificial
  CRISPR gRNA sequence
ctactaaaaatacaaaaaat

SEQ ID NO: 276779 - DNA, 20 bp, Artificial
  CRISPR gRNA sequence
taaaaatacaaaaaattagc

SEQ ID NO: 276780 - DNA, 20 bp, Artificial
  CRISPR gRNA sequence
aaaaatacaaaaaattagcc

SEQ ID NO: 276781 - DNA, 20 bp, Artificial
  CRISPR gRNA sequence
tacaaaaaattagccgggtg

SEQ ID NO: 276782 - DNA, 20 bp, Artificial
  CRISPR gRNA sequence
aaaaaattagccgggtgtgg

SEQ ID NO: 276783 - DNA, 20 bp, Artificial
  CRISPR gRNA sequence
aaattagccgggtgtggtgg

SEQ ID NO: 276784 - DNA, 20 bp, Artificial
  CRISPR gRNA sequence
aattagccgggtgtggtggc

SEQ ID NO: 276785 - DNA, 20 bp, Artificial
  CRISPR gRNA sequence
gccgggtgtggtggcgggtg

SEQ ID NO: 276786 - DNA, 20 bp, Artificial
  CRISPR gRNA sequence
ggtggcgggtgtagtaatcc

SEQ ID NO: 276787 - DNA, 20 bp, Artificial
  CRISPR gRNA sequence
gtgtagtaatcccagctact

SEQ ID NO: 276788 - DNA, 20 bp, Artificial
  CRISPR gRNA sequence
tgtagtaatcccagctactc

SEQ ID NO: 276789 - DNA, 20 bp, Artificial
  CRISPR gRNA sequence
tagtaatcccagctactcgg

SEQ ID NO: 276790 - DNA, 20 bp, Artificial
  CRISPR gRNA sequence
agtaatcccagctactcggg

SEQ ID NO: 276791 - DNA, 20 bp, Artificial
  CRISPR gRNA sequence
tcccagctactcgggaggct

SEQ ID NO: 276792 - DNA, 20 bp, Artificial
  CRISPR gRNA sequence
cccagctactcgggaggctg

SEQ ID NO: 276793 - DNA, 20 bp, Artificial
  CRISPR gRNA sequence
agctactcgggaggctgagg

SEQ ID NO: 276794 - DNA, 20 bp, Artificial
  CRISPR gRNA sequence
gctactcgggaggctgaggc

SEQ ID NO: 276795 - DNA, 20 bp, Artificial
  CRISPR gRNA sequence
tactcgggaggctgaggcag

SEQ ID NO: 276796 - DNA, 20 bp, Artificial
  CRISPR gRNA sequence
gcaggagaatcacttgaacc

SEQ ID NO: 276797 - DNA, 20 bp, Artificial
  CRISPR gRNA sequence
caggagaatcacttgaaccc

SEQ ID NO: 276798 - DNA, 20 bp, Artificial
  CRISPR gRNA sequence
ggagaatcacttgaacccag

SEQ ID NO: 276799 - DNA, 20 bp, Artificial
  CRISPR gRNA sequence
gagaatcacttgaacccagg

SEQ ID NO: 276800 - DNA, 20 bp, Artificial
  CRISPR gRNA sequence
aatcacttgaacccaggagg

SEQ ID NO: 276801 - DNA, 20 bp, Artificial
  CRISPR gRNA sequence
tcacttgaacccaggaggcg

SEQ ID NO: 276802 - DNA, 20 bp, Artificial
  CRISPR gRNA sequence
cacttgaacccaggaggcgg

SEQ ID NO: 276803 - DNA, 20 bp, Artificial
  CRISPR gRNA sequence
aacccaggaggcggaggttg

SEQ ID NO: 276804 - DNA, 20 bp, Artificial
  CRISPR gRNA sequence
caggaggcggaggttgcagt

SEQ ID NO: 276805 - DNA, 20 bp, Artificial
  CRISPR gRNA sequence
ggcggaggttgcagtaagct

SEQ ID NO: 276806 - DNA, 20 bp, Artificial
  CRISPR gRNA sequence
agtaagctgagattgcaccc

SEQ ID NO: 276807 - DNA, 20 bp, Artificial
  CRISPR gRNA sequence
gctgagattgcaccccagcc

SEQ ID NO: 276808 - DNA, 20 bp, Artificial
  CRISPR gRNA sequence
ctgagattgcaccccagcct

SEQ ID NO: 276809 - DNA, 20 bp, Artificial
  CRISPR gRNA sequence
tgcaccccagcctgggcaac

SEQ ID NO: 276810 - DNA, 20 bp, Artificial
  CRISPR gRNA sequence
caccccagcctgggcaacaa

SEQ ID NO: 276811 - DNA, 20 bp, Artificial
  CRISPR gRNA sequence
ttatcatcttattgattttt

SEQ ID NO: 276812 - DNA, 20 bp, Artificial
  CRISPR gRNA sequence
cttattgatttttaagtgta

SEQ ID NO: 276813 - DNA, 20 bp, Artificial
  CRISPR gRNA sequence
tgatttttaagtgtacagtt

SEQ ID NO: 276814 - DNA, 20 bp, Artificial
  CRISPR gRNA sequence
gtgtacagttcagtaatgtt

SEQ ID NO: 276815 - DNA, 20 bp, Artificial
  CRISPR gRNA sequence
atattcacattgttgtgaaa

SEQ ID NO: 276816 - DNA, 20 bp, Artificial
  CRISPR gRNA sequence
attgttgtgaaacagatctc

SEQ ID NO: 276817 - DNA, 20 bp, Artificial
  CRISPR gRNA sequence
cccctttccccctctcccct

SEQ ID NO: 276818 - DNA, 20 bp, Artificial
  CRISPR gRNA sequence
ccccctctcccctcagcctc

SEQ ID NO: 276819 - DNA, 20 bp, Artificial
  CRISPR gRNA sequence
tctgtttgtttgtatgaatt

SEQ ID NO: 276820 - DNA, 20 bp, Artificial
  CRISPR gRNA sequence
tggctactttaaatatctca

SEQ ID NO: 276821 - DNA, 20 bp, Artificial
  CRISPR gRNA sequence
ctttaaatatctcatagaaa

SEQ ID NO: 276822 - DNA, 20 bp, Artificial
  CRISPR gRNA sequence
ctcatagaaatagaatcata

SEQ ID NO: 276823 - DNA, 20 bp, Artificial
  CRISPR gRNA sequence
gaaatagaatcatacagtaa

SEQ ID NO: 276824 - DNA, 20 bp, Artificial
  CRISPR gRNA sequence
agtaacagcctgtttatgat

SEQ ID NO: 276825 - DNA, 20 bp, Artificial
  CRISPR gRNA sequence
tatgattggcttatttcact

SEQ ID NO: 276826 - DNA, 20 bp, Artificial
  CRISPR gRNA sequence
tcacttagcatgatgcactc

SEQ ID NO: 276827 - DNA, 20 bp, Artificial
  CRISPR gRNA sequence
cacttagcatgatgcactca

SEQ ID NO: 276828 - DNA, 20 bp, Artificial
  CRISPR gRNA sequence
ctcaaggttcattcacgttg

SEQ ID NO: 276829 - DNA, 20 bp, Artificial
  CRISPR gRNA sequence
attcacgttgtagcatatga

SEQ ID NO: 276830 - DNA, 20 bp, Artificial
  CRISPR gRNA sequence
ttcacgttgtagcatatgat

SEQ ID NO: 276831 - DNA, 20 bp, Artificial
  CRISPR gRNA sequence
atgataggatttccttcctt

SEQ ID NO: 276832 - DNA, 20 bp, Artificial
  CRISPR gRNA sequence
aggatttccttcctttggaa

SEQ ID NO: 276833 - DNA, 20 bp, Artificial
  CRISPR gRNA sequence
aatggtaatgatatgatcat

SEQ ID NO: 276834 - DNA, 20 bp, Artificial
  CRISPR gRNA sequence
atggtaatgatatgatcata

SEQ ID NO: 276835 - DNA, 20 bp, Artificial
  CRISPR gRNA sequence
tttgtttgcccattcatctg

SEQ ID NO: 276836 - DNA, 20 bp, Artificial
  CRISPR gRNA sequence
tttgcccattcatctgtaga

SEQ ID NO: 276837 - DNA, 20 bp, Artificial
  CRISPR gRNA sequence
ttcatctgtagatggacatt

SEQ ID NO: 276838 - DNA, 20 bp, Artificial
  CRISPR gRNA sequence
ttggcttgcttcccacctcc

SEQ ID NO: 276839 - DNA, 20 bp, Artificial
  CRISPR gRNA sequence
ctactgtgctgctatgaaca

SEQ ID NO: 276840 - DNA, 20 bp, Artificial
  CRISPR gRNA sequence
tactgtgctgctatgaacat

SEQ ID NO: 276841 - DNA, 20 bp, Artificial
  CRISPR gRNA sequence
gggtgtgcaaatatctcttc

SEQ ID NO: 276842 - DNA, 20 bp, Artificial
  CRISPR gRNA sequence
gaccctgctttcaattctta

SEQ ID NO: 276843 - DNA, 20 bp, Artificial
  CRISPR gRNA sequence
tttcaattcttatggatata

SEQ ID NO: 276844 - DNA, 20 bp, Artificial
  CRISPR gRNA sequence
cttatggatatatggaattt

SEQ ID NO: 276845 - DNA, 20 bp, Artificial
  CRISPR gRNA sequence
ttatggatatatggaatttt

SEQ ID NO: 276846 - DNA, 20 bp, Artificial
  CRISPR gRNA sequence
tatggatatatggaattttg

SEQ ID NO: 276847 - DNA, 20 bp, Artificial
  CRISPR gRNA sequence
tatggaattttggggtcata

SEQ ID NO: 276848 - DNA, 20 bp, Artificial
  CRISPR gRNA sequence
ggaattttggggtcatatgg

SEQ ID NO: 276849 - DNA, 20 bp, Artificial
  CRISPR gRNA sequence
agttctatttttaattttct

SEQ ID NO: 276850 - DNA, 20 bp, Artificial
  CRISPR gRNA sequence
gttctatttttaattttctg

SEQ ID NO: 276851 - DNA, 20 bp, Artificial
  CRISPR gRNA sequence
aattttctgaggaacctcaa

SEQ ID NO: 276852 - DNA, 20 bp, Artificial
  CRISPR gRNA sequence
aacctcaatagtgttttcta

SEQ ID NO: 276853 - DNA, 20 bp, Artificial
  CRISPR gRNA sequence
ctcaatagtgttttctatag

SEQ ID NO: 276854 - DNA, 20 bp, Artificial
  CRISPR gRNA sequence
tgcacccgcaatgcttgtta

SEQ ID NO: 276855 - DNA, 20 bp, Artificial
  CRISPR gRNA sequence
gcacccgcaatgcttgttaa

SEQ ID NO: 276856 - DNA, 20 bp, Artificial
  CRISPR gRNA sequence
gcaatgcttgttaaaggttt

SEQ ID NO: 276857 - DNA, 20 bp, Artificial
  CRISPR gRNA sequence
atgcttgttaaaggttttgg

SEQ ID NO: 276858 - DNA, 20 bp, Artificial
  CRISPR gRNA sequence
aggttttggaagtcactatc

SEQ ID NO: 276859 - DNA, 20 bp, Artificial
  CRISPR gRNA sequence
gattgcataaaaaacaaatt

SEQ ID NO: 276860 - DNA, 20 bp, Artificial
  CRISPR gRNA sequence
atttggttttgaaaacaatg

SEQ ID NO: 276861 - DNA, 20 bp, Artificial
  CRISPR gRNA sequence
tgaagacaaatcactaaaat

SEQ ID NO: 276862 - DNA, 20 bp, Artificial
  CRISPR gRNA sequence
aatcactaaaatcagactca

SEQ ID NO: 276863 - DNA, 20 bp, Artificial
  CRISPR gRNA sequence
ctatccccttcctttttctt

SEQ ID NO: 276864 - DNA, 20 bp, Artificial
  CRISPR gRNA sequence
agaattttccaatgacatgc

SEQ ID NO: 276865 - DNA, 20 bp, Artificial
  CRISPR gRNA sequence
ttccaatgacatgcaagatt

SEQ ID NO: 276866 - DNA, 20 bp, Artificial
  CRISPR gRNA sequence
tccaatgacatgcaagattt

SEQ ID NO: 276867 - DNA, 20 bp, Artificial
  CRISPR gRNA sequence
caatgacatgcaagatttag

SEQ ID NO: 276868 - DNA, 20 bp, Artificial
  CRISPR gRNA sequence
tgcaagatttaggagcatat

SEQ ID NO: 276869 - DNA, 20 bp, Artificial
  CRISPR gRNA sequence
agcatatgagccttctctca

SEQ ID NO: 276870 - DNA, 20 bp, Artificial
  CRISPR gRNA sequence
atatgagccttctctcacag

SEQ ID NO: 276871 - DNA, 20 bp, Artificial
  CRISPR gRNA sequence
tatgagccttctctcacagc

SEQ ID NO: 276872 - DNA, 20 bp, Artificial
  CRISPR gRNA sequence
ctctcacagcaggcaatttt

SEQ ID NO: 276873 - DNA, 20 bp, Artificial
  CRISPR gRNA sequence
tagtcctattacttcttatt

SEQ ID NO: 276874 - DNA, 20 bp, Artificial
  CRISPR gRNA sequence
cctaacacaataccaccccc

SEQ ID NO: 276875 - DNA, 20 bp, Artificial
  CRISPR gRNA sequence
taacacaataccacccccaa

SEQ ID NO: 276876 - DNA, 20 bp, Artificial
  CRISPR gRNA sequence
cacaataccacccccaagag

SEQ ID NO: 276877 - DNA, 20 bp, Artificial
  CRISPR gRNA sequence
ataccacccccaagagaagt

SEQ ID NO: 276878 - DNA, 20 bp, Artificial
  CRISPR gRNA sequence
aagagaagtcagtcctgact

SEQ ID NO: 276879 - DNA, 20 bp, Artificial
  CRISPR gRNA sequence
agagaagtcagtcctgacta

SEQ ID NO: 276880 - DNA, 20 bp, Artificial
  CRISPR gRNA sequence
gtcagtcctgactaaggttc

SEQ ID NO: 276881 - DNA, 20 bp, Artificial
  CRISPR gRNA sequence
tcagtcctgactaaggttct

SEQ ID NO: 276882 - DNA, 20 bp, Artificial
  CRISPR gRNA sequence
cctgactaaggttctgggta

SEQ ID NO: 276883 - DNA, 20 bp, Artificial
  CRISPR gRNA sequence
gactaaggttctgggtacag

SEQ ID NO: 276884 - DNA, 20 bp, Artificial
  CRISPR gRNA sequence
taaggttctgggtacagtgg

SEQ ID NO: 276885 - DNA, 20 bp, Artificial
  CRISPR gRNA sequence
ggttctgggtacagtggtgg

SEQ ID NO: 276886 - DNA, 20 bp, Artificial
  CRISPR gRNA sequence
ttctgggtacagtggtggtg

SEQ ID NO: 276887 - DNA, 20 bp, Artificial
  CRISPR gRNA sequence
tctgggtacagtggtggtgg

SEQ ID NO: 276888 - DNA, 20 bp, Artificial
  CRISPR gRNA sequence
tgggtacagtggtggtggag

SEQ ID NO: 276889 - DNA, 20 bp, Artificial
  CRISPR gRNA sequence
gggtacagtggtggtggagg

SEQ ID NO: 276890 - DNA, 20 bp, Artificial
  CRISPR gRNA sequence
ggtacagtggtggtggagga

SEQ ID NO: 276891 - DNA, 20 bp, Artificial
  CRISPR gRNA sequence
cagtggtggtggaggagggc

SEQ ID NO: 276892 - DNA, 20 bp, Artificial
  CRISPR gRNA sequence
agtggtggtggaggagggca

SEQ ID NO: 276893 - DNA, 20 bp, Artificial
  CRISPR gRNA sequence
tgctgttgcccacctctgtc

SEQ ID NO: 276894 - DNA, 20 bp, Artificial
  CRISPR gRNA sequence
gttgcccacctctgtctaga

SEQ ID NO: 276895 - DNA, 20 bp, Artificial
  CRISPR gRNA sequence
tcctttttttgcttcctctg

SEQ ID NO: 276896 - DNA, 20 bp, Artificial
  CRISPR gRNA sequence
tttttttgcttcctctgtgg

SEQ ID NO: 276897 - DNA, 20 bp, Artificial
  CRISPR gRNA sequence
cttcctctgtggtggctcta

SEQ ID NO: 276898 - DNA, 20 bp, Artificial
  CRISPR gRNA sequence
tcctctgtggtggctctatg

SEQ ID NO: 276899 - DNA, 20 bp, Artificial
  CRISPR gRNA sequence
cctctgtggtggctctatgg

SEQ ID NO: 276900 - DNA, 20 bp, Artificial
  CRISPR gRNA sequence
ctctgtggtggctctatgga

SEQ ID NO: 276901 - DNA, 20 bp, Artificial
  CRISPR gRNA sequence
tctgtggtggctctatggag

SEQ ID NO: 276902 - DNA, 20 bp, Artificial
  CRISPR gRNA sequence
tggtggctctatggagggga

SEQ ID NO: 276903 - DNA, 20 bp, Artificial
  CRISPR gRNA sequence
ggtggctctatggaggggac

SEQ ID NO: 276904 - DNA, 20 bp, Artificial
  CRISPR gRNA sequence
taatcccccaacaaccccac

SEQ ID NO: 276905 - DNA, 20 bp, Artificial
  CRISPR gRNA sequence
gtattattttccccattttg

SEQ ID NO: 276906 - DNA, 20 bp, Artificial
  CRISPR gRNA sequence
attttccccattttgcagct

SEQ ID NO: 276907 - DNA, 20 bp, Artificial
  CRISPR gRNA sequence
attttgcagctgagacaact

SEQ ID NO: 276908 - DNA, 20 bp, Artificial
  CRISPR gRNA sequence
tttgcagctgagacaactga

SEQ ID NO: 276909 - DNA, 20 bp, Artificial
  CRISPR gRNA sequence
gctgagacaactgagagatt

SEQ ID NO: 276910 - DNA, 20 bp, Artificial
  CRISPR gRNA sequence
tgagacaactgagagattga

SEQ ID NO: 276911 - DNA, 20 bp, Artificial
  CRISPR gRNA sequence
gagacaactgagagattgag

SEQ ID NO: 276912 - DNA, 20 bp, Artificial
  CRISPR gRNA sequence
aactgagagattgagaggtt

SEQ ID NO: 276913 - DNA, 20 bp, Artificial
  CRISPR gRNA sequence
actgagagattgagaggttc

SEQ ID NO: 276914 - DNA, 20 bp, Artificial
  CRISPR gRNA sequence
gagagattgagaggttcagg

SEQ ID NO: 276915 - DNA, 20 bp, Artificial
  CRISPR gRNA sequence
attgagaggttcaggaagtc

SEQ ID NO: 276916 - DNA, 20 bp, Artificial
  CRISPR gRNA sequence
ttgagaggttcaggaagtct

SEQ ID NO: 276917 - DNA, 20 bp, Artificial
  CRISPR gRNA sequence
gaggttcaggaagtctagga

SEQ ID NO: 276918 - DNA, 20 bp, Artificial
  CRISPR gRNA sequence
aggttcaggaagtctaggac

SEQ ID NO: 276919 - DNA, 20 bp, Artificial
  CRISPR gRNA sequence
ggttcaggaagtctaggaca

SEQ ID NO: 276920 - DNA, 20 bp, Artificial
  CRISPR gRNA sequence
tcaggaagtctaggacaggg

SEQ ID NO: 276921 - DNA, 20 bp, Artificial
  CRISPR gRNA sequence
caggaagtctaggacagggc

SEQ ID NO: 276922 - DNA, 20 bp, Artificial
  CRISPR gRNA sequence
aagtctaggacagggcaggt

SEQ ID NO: 276923 - DNA, 20 bp, Artificial
  CRISPR gRNA sequence
aggacagggcaggtcagcct

SEQ ID NO: 276924 - DNA, 20 bp, Artificial
  CRISPR gRNA sequence
gcaggtcagcctgagattcc

SEQ ID NO: 276925 - DNA, 20 bp, Artificial
  CRISPR gRNA sequence
caggtcagcctgagattcca

SEQ ID NO: 276926 - DNA, 20 bp, Artificial
  CRISPR gRNA sequence
aggtcagcctgagattccaa

SEQ ID NO: 276927 - DNA, 20 bp, Artificial
  CRISPR gRNA sequence
tccaagggcctatgattctg

SEQ ID NO: 276928 - DNA, 20 bp, Artificial
  CRISPR gRNA sequence
atgattctgcagtcatgacg

SEQ ID NO: 276929 - DNA, 20 bp, Artificial
  CRISPR gRNA sequence
ctgcagtcatgacgaagaat

SEQ ID NO: 276930 - DNA, 20 bp, Artificial
  CRISPR gRNA sequence
tgcagtcatgacgaagaata

SEQ ID NO: 276931 - DNA, 20 bp, Artificial
  CRISPR gRNA sequence
gcagtcatgacgaagaataa

SEQ ID NO: 276932 - DNA, 20 bp, Artificial
  CRISPR gRNA sequence
agtcatgacgaagaataagg

SEQ ID NO: 276933 - DNA, 20 bp, Artificial
  CRISPR gRNA sequence
gtcatgacgaagaataaggg

SEQ ID NO: 276934 - DNA, 20 bp, Artificial
  CRISPR gRNA sequence
tcatgacgaagaataaggga

SEQ ID NO: 276935 - DNA, 20 bp, Artificial
  CRISPR gRNA sequence
atgacgaagaataagggagg

SEQ ID NO: 276936 - DNA, 20 bp, Artificial
  CRISPR gRNA sequence
gaagaataagggagggagat

SEQ ID NO: 276937 - DNA, 20 bp, Artificial
  CRISPR gRNA sequence
aagaataagggagggagatg

SEQ ID NO: 276938 - DNA, 20 bp, Artificial
  CRISPR gRNA sequence
ggagggagatgaggtcaact

SEQ ID NO: 276939 - DNA, 20 bp, Artificial
  CRISPR gRNA sequence
gggagatgaggtcaactaag

SEQ ID NO: 276940 - DNA, 20 bp, Artificial
  CRISPR gRNA sequence
gaggtcaactaagaagaaaa

SEQ ID NO: 276941 - DNA, 20 bp, Artificial
  CRISPR gRNA sequence
ggtcaactaagaagaaaaaa

SEQ ID NO: 276942 - DNA, 20 bp, Artificial
  CRISPR gRNA sequence
gtcaactaagaagaaaaaag

SEQ ID NO: 276943 - DNA, 20 bp, Artificial
  CRISPR gRNA sequence
tcaactaagaagaaaaaaga

SEQ ID NO: 276944 - DNA, 20 bp, Artificial
  CRISPR gRNA sequence
aaagagggccatactttaaa

SEQ ID NO: 276945 - DNA, 20 bp, Artificial
  CRISPR gRNA sequence
aagagggccatactttaaat

SEQ ID NO: 276946 - DNA, 20 bp, Artificial
  CRISPR gRNA sequence
agggccatactttaaatagg

SEQ ID NO: 276947 - DNA, 20 bp, Artificial
  CRISPR gRNA sequence
gggccatactttaaataggt

SEQ ID NO: 276948 - DNA, 20 bp, Artificial
  CRISPR gRNA sequence
ggccatactttaaataggta

SEQ ID NO: 276949 - DNA, 20 bp, Artificial
  CRISPR gRNA sequence
tattcatgaattctcactta

SEQ ID NO: 276950 - DNA, 20 bp, Artificial
  CRISPR gRNA sequence
tcatgaattctcacttacag

SEQ ID NO: 276951 - DNA, 20 bp, Artificial
  CRISPR gRNA sequence
catgaattctcacttacaga

SEQ ID NO: 276952 - DNA, 20 bp, Artificial
  CRISPR gRNA sequence
cttacagaaggcctccttct

SEQ ID NO: 276953 - DNA, 20 bp, Artificial
  CRISPR gRNA sequence
tccttcttggatctgttgcc

SEQ ID NO: 276954 - DNA, 20 bp, Artificial
  CRISPR gRNA sequence
ctgttgcctggtcacttgat

SEQ ID NO: 276955 - DNA, 20 bp, Artificial
  CRISPR gRNA sequence
tgttgcctggtcacttgatt

SEQ ID NO: 276956 - DNA, 20 bp, Artificial
  CRISPR gRNA sequence
tcacttgattaggtaatttt

SEQ ID NO: 276957 - DNA, 20 bp, Artificial
  CRISPR gRNA sequence
ttttcagctactactgcctt

SEQ ID NO: 276958 - DNA, 20 bp, Artificial
  CRISPR gRNA sequence
ctactactgccttgagaaat

SEQ ID NO: 276959 - DNA, 20 bp, Artificial
  CRISPR gRNA sequence
tactactgccttgagaaata

SEQ ID NO: 276960 - DNA, 20 bp, Artificial
  CRISPR gRNA sequence
tactgccttgagaaataagg

SEQ ID NO: 276961 - DNA, 20 bp, Artificial
  CRISPR gRNA sequence
taaggaagaatttcactgta

SEQ ID NO: 276962 - DNA, 20 bp, Artificial
  CRISPR gRNA sequence
agaatttcactgtaaagacc

SEQ ID NO: 276963 - DNA, 20 bp, Artificial
  CRISPR gRNA sequence
tttcccttgcgtttctccta

SEQ ID NO: 276964 - DNA, 20 bp, Artificial
  CRISPR gRNA sequence
cacacacacacacacacaca

SEQ ID NO: 276965 - DNA, 20 bp, Artificial
  CRISPR gRNA sequence
acacgcattcatttaaacta

SEQ ID NO: 276966 - DNA, 20 bp, Artificial
  CRISPR gRNA sequence
tacagaactgcatttaaccg

SEQ ID NO: 276967 - DNA, 20 bp, Artificial
  CRISPR gRNA sequence
acagaactgcatttaaccgt

SEQ ID NO: 276968 - DNA, 20 bp, Artificial
  CRISPR gRNA sequence
tttaaccgtgggaaaaatct

SEQ ID NO: 276969 - DNA, 20 bp, Artificial
  CRISPR gRNA sequence
atctaagaataaattttatc

SEQ ID NO: 276970 - DNA, 20 bp, Artificial
  CRISPR gRNA sequence
gaataaattttatccagatt

SEQ ID NO: 276971 - DNA, 20 bp, Artificial
  CRISPR gRNA sequence
aaattttatccagattaagt

SEQ ID NO: 276972 - DNA, 20 bp, Artificial
  CRISPR gRNA sequence
tatccagattaagtgagcta

SEQ ID NO: 276973 - DNA, 20 bp, Artificial
  CRISPR gRNA sequence
caatccatttcatgtgactt

SEQ ID NO: 276974 - DNA, 20 bp, Artificial
  CRISPR gRNA sequence
tccatttcatgtgacttcag

SEQ ID NO: 276975 - DNA, 20 bp, Artificial
  CRISPR gRNA sequence
ttcatgtgacttcagtggcg

SEQ ID NO: 276976 - DNA, 20 bp, Artificial
  CRISPR gRNA sequence
gtgacttcagtggcgtggca

SEQ ID NO: 276977 - DNA, 20 bp, Artificial
  CRISPR gRNA sequence
tgacttcagtggcgtggcac

SEQ ID NO: 276978 - DNA, 20 bp, Artificial
  CRISPR gRNA sequence
gattcctccccttttcactt

SEQ ID NO: 276979 - DNA, 20 bp, Artificial
  CRISPR gRNA sequence
cccttttcacttgagtgact

SEQ ID NO: 276980 - DNA, 20 bp, Artificial
  CRISPR gRNA sequence
ccttttcacttgagtgactt

SEQ ID NO: 276981 - DNA, 20 bp, Artificial
  CRISPR gRNA sequence
cttgagtgacttaggattta

SEQ ID NO: 276982 - DNA, 20 bp, Artificial
  CRISPR gRNA sequence
gacttaggatttaaagctct

SEQ ID NO: 276983 - DNA, 20 bp, Artificial
  CRISPR gRNA sequence
acttaggatttaaagctctc

SEQ ID NO: 276984 - DNA, 20 bp, Artificial
  CRISPR gRNA sequence
ctacttccctacctacctta

SEQ ID NO: 276985 - DNA, 20 bp, Artificial
  CRISPR gRNA sequence
tacttccctacctaccttaa

SEQ ID NO: 276986 - DNA, 20 bp, Artificial
  CRISPR gRNA sequence
ccttaaaggcaaccatgact

SEQ ID NO: 276987 - DNA, 20 bp, Artificial
  CRISPR gRNA sequence
accctgctaacatccttgcc

SEQ ID NO: 276988 - DNA, 20 bp, Artificial
  CRISPR gRNA sequence
cctgctaacatccttgccta

SEQ ID NO: 276989 - DNA, 20 bp, Artificial
  CRISPR gRNA sequence
ctgctaacatccttgcctag

SEQ ID NO: 276990 - DNA, 20 bp, Artificial
  CRISPR gRNA sequence
catccttgcctagaggctcc

SEQ ID NO: 276991 - DNA, 20 bp, Artificial
  CRISPR gRNA sequence
gcctagaggctcctggttgt

SEQ ID NO: 276992 - DNA, 20 bp, Artificial
  CRISPR gRNA sequence
gaggctcctggttgttggta

SEQ ID NO: 276993 - DNA, 20 bp, Artificial
  CRISPR gRNA sequence
ctcctggttgttggtataga

SEQ ID NO: 276994 - DNA, 20 bp, Artificial
  CRISPR gRNA sequence
ttgttggtatagaaagaaca

SEQ ID NO: 276995 - DNA, 20 bp, Artificial
  CRISPR gRNA sequence
tgttggtatagaaagaacat

SEQ ID NO: 276996 - DNA, 20 bp, Artificial
  CRISPR gRNA sequence
ttttcattcaataaaatcca

SEQ ID NO: 276997 - DNA, 20 bp, Artificial
  CRISPR gRNA sequence
tcattcaataaaatccacag

SEQ ID NO: 276998 - DNA, 20 bp, Artificial
  CRISPR gRNA sequence
cacagtagttgtgtgacctt

SEQ ID NO: 276999 - DNA, 20 bp, Artificial
  CRISPR gRNA sequence
tactttacttctctgaaccc

SEQ ID NO: 277000 - DNA, 20 bp, Artificial
  CRISPR gRNA sequence
ctgaaccccagtcttcacat

SEQ ID NO: 277001 - DNA, 20 bp, Artificial
  CRISPR gRNA sequence
tcttcacattggttattatg

SEQ ID NO: 277002 - DNA, 20 bp, Artificial
  CRISPR gRNA sequence
ggttattatgaagattaaat

SEQ ID NO: 277003 - DNA, 20 bp, Artificial
  CRISPR gRNA sequence
agattaaatgagataattta

SEQ ID NO: 277004 - DNA, 20 bp, Artificial
  CRISPR gRNA sequence
taaatgagataatttatggc

SEQ ID NO: 277005 - DNA, 20 bp, Artificial
  CRISPR gRNA sequence
acatactgtaattcaatgcc

SEQ ID NO: 277006 - DNA, 20 bp, Artificial
  CRISPR gRNA sequence
aatcccattctcctttctcc

SEQ ID NO: 277007 - DNA, 20 bp, Artificial
  CRISPR gRNA sequence
atcccattctcctttctcca

SEQ ID NO: 277008 - DNA, 20 bp, Artificial
  CRISPR gRNA sequence
tcccattctcctttctccaa

SEQ ID NO: 277009 - DNA, 20 bp, Artificial
  CRISPR gRNA sequence
cccattctcctttctccaag

SEQ ID NO: 277010 - DNA, 20 bp, Artificial
  CRISPR gRNA sequence
ccattctcctttctccaagg

SEQ ID NO: 277011 - DNA, 20 bp, Artificial
  CRISPR gRNA sequence
ttctcctttctccaaggggg

SEQ ID NO: 277012 - DNA, 20 bp, Artificial
  CRISPR gRNA sequence
tctcctttctccaagggggt

SEQ ID NO: 277013 - DNA, 20 bp, Artificial
  CRISPR gRNA sequence
ctcctttctccaagggggtg

SEQ ID NO: 277014 - DNA, 20 bp, Artificial
  CRISPR gRNA sequence
tggggaatttaccaacctct

SEQ ID NO: 277015 - DNA, 20 bp, Artificial
  CRISPR gRNA sequence
ggggaatttaccaacctcta

SEQ ID NO: 277016 - DNA, 20 bp, Artificial
  CRISPR gRNA sequence
aaggcttttgatttcgtctt

SEQ ID NO: 277017 - DNA, 20 bp, Artificial
  CRISPR gRNA sequence
cgtctttggacaatttgact

SEQ ID NO: 277018 - DNA, 20 bp, Artificial
  CRISPR gRNA sequence
gtctttggacaatttgactg

SEQ ID NO: 277019 - DNA, 20 bp, Artificial
  CRISPR gRNA sequence
tttggacaatttgactgagg

SEQ ID NO: 277020 - DNA, 20 bp, Artificial
  CRISPR gRNA sequence
ttttgctttgctttatgttg

SEQ ID NO: 277021 - DNA, 20 bp, Artificial
  CRISPR gRNA sequence
tgttgaagtctgtttccctc

SEQ ID NO: 277022 - DNA, 20 bp, Artificial
  CRISPR gRNA sequence
tctcattcttcttatgtaac

SEQ ID NO: 277023 - DNA, 20 bp, Artificial
  CRISPR gRNA sequence
ttcttatgtaacaagacttg

SEQ ID NO: 277024 - DNA, 20 bp, Artificial
  CRISPR gRNA sequence
aacaagacttgcagatatct

SEQ ID NO: 277025 - DNA, 20 bp, Artificial
  CRISPR gRNA sequence
acaagacttgcagatatctg

SEQ ID NO: 277026 - DNA, 20 bp, Artificial
  CRISPR gRNA sequence
aggatacttatatcctctct

SEQ ID NO: 277027 - DNA, 20 bp, Artificial
  CRISPR gRNA sequence
tacttatatcctctctcaga

SEQ ID NO: 277028 - DNA, 20 bp, Artificial
  CRISPR gRNA sequence
tcctctctcagacagttctg

SEQ ID NO: 277029 - DNA, 20 bp, Artificial
  CRISPR gRNA sequence
cctctctcagacagttctgc

SEQ ID NO: 277030 - DNA, 20 bp, Artificial
  CRISPR gRNA sequence
gttccttattgatgtactga

SEQ ID NO: 277031 - DNA, 20 bp, Artificial
  CRISPR gRNA sequence
cttattgatgtactgaaagt

SEQ ID NO: 277032 - DNA, 20 bp, Artificial
  CRISPR gRNA sequence
ccctcactttcctcactaca

SEQ ID NO: 277033 - DNA, 20 bp, Artificial
  CRISPR gRNA sequence
atttgtgtgtatattttttt

SEQ ID NO: 277034 - DNA, 20 bp, Artificial
  CRISPR gRNA sequence
ttgtgtgtatatttttttga

SEQ ID NO: 277035 - DNA, 20 bp, Artificial
  CRISPR gRNA sequence
gtgtgtatatttttttgaga

SEQ ID NO: 277036 - DNA, 20 bp, Artificial
  CRISPR gRNA sequence
tatatttttttgagagagcg

SEQ ID NO: 277037 - DNA, 20 bp, Artificial
  CRISPR gRNA sequence
gagagcgaagtcactaaatc

SEQ ID NO: 277038 - DNA, 20 bp, Artificial
  CRISPR gRNA sequence
agtcactaaatctagcattc

SEQ ID NO: 277039 - DNA, 20 bp, Artificial
  CRISPR gRNA sequence
ccagacatccactgtgtgat

SEQ ID NO: 277040 - DNA, 20 bp, Artificial
  CRISPR gRNA sequence
catccactgtgtgattggct

SEQ ID NO: 277041 - DNA, 20 bp, Artificial
  CRISPR gRNA sequence
tccactgtgtgattggctca

SEQ ID NO: 277042 - DNA, 20 bp, Artificial
  CRISPR gRNA sequence
actgtgtgattggctcagag

SEQ ID NO: 277043 - DNA, 20 bp, Artificial
  CRISPR gRNA sequence
tgattggctcagagtagaac

SEQ ID NO: 277044 - DNA, 20 bp, Artificial
  CRISPR gRNA sequence
gattggctcagagtagaacc

SEQ ID NO: 277045 - DNA, 20 bp, Artificial
  CRISPR gRNA sequence
tttacctaaatctatgtttg

SEQ ID NO: 277046 - DNA, 20 bp, Artificial
  CRISPR gRNA sequence
aaatctatgtttgcagccta

SEQ ID NO: 277047 - DNA, 20 bp, Artificial
  CRISPR gRNA sequence
taaagttgaattcaatatat

SEQ ID NO: 277048 - DNA, 20 bp, Artificial
  CRISPR gRNA sequence
agttgaattcaatatattag

SEQ ID NO: 277049 - DNA, 20 bp, Artificial
  CRISPR gRNA sequence
ataactattgatatactgac

SEQ ID NO: 277050 - DNA, 20 bp, Artificial
  CRISPR gRNA sequence
ctgtgtgctgctcctacatc

SEQ ID NO: 277051 - DNA, 20 bp, Artificial
  CRISPR gRNA sequence
cagttcaacaccccaccaaa

SEQ ID NO: 277052 - DNA, 20 bp, Artificial
  CRISPR gRNA sequence
agttcaacaccccaccaaat

SEQ ID NO: 277053 - DNA, 20 bp, Artificial
  CRISPR gRNA sequence
aacaccccaccaaatgggta

SEQ ID NO: 277054 - DNA, 20 bp, Artificial
  CRISPR gRNA sequence
ccaaatgggtaaagctcttc

SEQ ID NO: 277055 - DNA, 20 bp, Artificial
  CRISPR gRNA sequence
ttccagtgacgttatctttc

SEQ ID NO: 277056 - DNA, 20 bp, Artificial
  CRISPR gRNA sequence
ccagtgacgttatctttcaa

SEQ ID NO: 277057 - DNA, 20 bp, Artificial
  CRISPR gRNA sequence
gttatctttcaagagttatc

SEQ ID NO: 277058 - DNA, 20 bp, Artificial
  CRISPR gRNA sequence
ccccttccctgaatctccat

SEQ ID NO: 277059 - DNA, 20 bp, Artificial
  CRISPR gRNA sequence
ttctttttcttttttttttt

SEQ ID NO: 277060 - DNA, 20 bp, Artificial
  CRISPR gRNA sequence
ttttctttttttttttgaga

SEQ ID NO: 277061 - DNA, 20 bp, Artificial
  CRISPR gRNA sequence
ttctttttttttttgagacg

SEQ ID NO: 277062 - DNA, 20 bp, Artificial
  CRISPR gRNA sequence
cggagtcttgttcttttgcc

SEQ ID NO: 277063 - DNA, 20 bp, Artificial
  CRISPR gRNA sequence
ggagtcttgttcttttgccc

SEQ ID NO: 277064 - DNA, 20 bp, Artificial
  CRISPR gRNA sequence
tcttgttcttttgcccaggc

SEQ ID NO: 277065 - DNA, 20 bp, Artificial
  CRISPR gRNA sequence
ttgttcttttgcccaggctg

SEQ ID NO: 277066 - DNA, 20 bp, Artificial
  CRISPR gRNA sequence
cttttgcccaggctggagtg

SEQ ID NO: 277067 - DNA, 20 bp, Artificial
  CRISPR gRNA sequence
ttgcccaggctggagtgaag

SEQ ID NO: 277068 - DNA, 20 bp, Artificial
  CRISPR gRNA sequence
ggagtgaagtggcgcgatct

SEQ ID NO: 277069 - DNA, 20 bp, Artificial
  CRISPR gRNA sequence
ctcactgcaacctccacccc

SEQ ID NO: 277070 - DNA, 20 bp, Artificial
  CRISPR gRNA sequence
tcactgcaacctccaccccc

SEQ ID NO: 277071 - DNA, 20 bp, Artificial
  CRISPR gRNA sequence
caacctccacccccaggttc

SEQ ID NO: 277072 - DNA, 20 bp, Artificial
  CRISPR gRNA sequence
cctccacccccaggttcaag

SEQ ID NO: 277073 - DNA, 20 bp, Artificial
  CRISPR gRNA sequence
ttcaagcagttctcctgcct

SEQ ID NO: 277074 - DNA, 20 bp, Artificial
  CRISPR gRNA sequence
ttctcctgcctcagcctcct

SEQ ID NO: 277075 - DNA, 20 bp, Artificial
  CRISPR gRNA sequence
tcctgcctcagcctcctgag

SEQ ID NO: 277076 - DNA, 20 bp, Artificial
  CRISPR gRNA sequence
gcctcagcctcctgagtagc

SEQ ID NO: 277077 - DNA, 20 bp, Artificial
  CRISPR gRNA sequence
cctcagcctcctgagtagct

SEQ ID NO: 277078 - DNA, 20 bp, Artificial
  CRISPR gRNA sequence
ctcctgagtagctgggatta

SEQ ID NO: 277079 - DNA, 20 bp, Artificial
  CRISPR gRNA sequence
tcctgagtagctgggattac

SEQ ID NO: 277080 - DNA, 20 bp, Artificial
  CRISPR gRNA sequence
caggcgcccgccatcatgcc

SEQ ID NO: 277081 - DNA, 20 bp, Artificial
  CRISPR gRNA sequence
ccagctaatttttgtatttt

SEQ ID NO: 277082 - DNA, 20 bp, Artificial
  CRISPR gRNA sequence
gctaatttttgtatttttag

SEQ ID NO: 277083 - DNA, 20 bp, Artificial
  CRISPR gRNA sequence
taatttttgtatttttagta

SEQ ID NO: 277084 - DNA, 20 bp, Artificial
  CRISPR gRNA sequence
ttttgtatttttagtagaga

SEQ ID NO: 277085 - DNA, 20 bp, Artificial
  CRISPR gRNA sequence
tttgtatttttagtagagac

SEQ ID NO: 277086 - DNA, 20 bp, Artificial
  CRISPR gRNA sequence
ttgtatttttagtagagaca

SEQ ID NO: 277087 - DNA, 20 bp, Artificial
  CRISPR gRNA sequence
agggtttccaccatgtttgc

SEQ ID NO: 277088 - DNA, 20 bp, Artificial
  CRISPR gRNA sequence
gggtttccaccatgtttgcc

SEQ ID NO: 277089 - DNA, 20 bp, Artificial
  CRISPR gRNA sequence
ttccaccatgtttgccaggc

SEQ ID NO: 277090 - DNA, 20 bp, Artificial
  CRISPR gRNA sequence
tggtctcaaactcctgatct

SEQ ID NO: 277091 - DNA, 20 bp, Artificial
  CRISPR gRNA sequence
ggtctcaaactcctgatctc

SEQ ID NO: 277092 - DNA, 20 bp, Artificial
  CRISPR gRNA sequence
ctcaggtgatcctcccacct

SEQ ID NO: 277093 - DNA, 20 bp, Artificial
  CRISPR gRNA sequence
acctcagcctcccaaaatgc

SEQ ID NO: 277094 - DNA, 20 bp, Artificial
  CRISPR gRNA sequence
cctcagcctcccaaaatgct

SEQ ID NO: 277095 - DNA, 20 bp, Artificial
  CRISPR gRNA sequence
tcccaaaatgctgggattac

SEQ ID NO: 277096 - DNA, 20 bp, Artificial
  CRISPR gRNA sequence
aatgctgggattacaagtgt

SEQ ID NO: 277097 - DNA, 20 bp, Artificial
  CRISPR gRNA sequence
caagtgtgagccaccacgcc

SEQ ID NO: 277098 - DNA, 20 bp, Artificial
  CRISPR gRNA sequence
gccaccacgcctagcatgat

SEQ ID NO: 277099 - DNA, 20 bp, Artificial
  CRISPR gRNA sequence
ctagcatgatgagacatcgt

SEQ ID NO: 277100 - DNA, 20 bp, Artificial
  CRISPR gRNA sequence
gatgagacatcgtgagcatt

SEQ ID NO: 277101 - DNA, 20 bp, Artificial
  CRISPR gRNA sequence
atcgtgagcattcagaaata

SEQ ID NO: 277102 - DNA, 20 bp, Artificial
  CRISPR gRNA sequence
tgagcattcagaaatatgga

SEQ ID NO: 277103 - DNA, 20 bp, Artificial
  CRISPR gRNA sequence
gagcattcagaaatatggaa

SEQ ID NO: 277104 - DNA, 20 bp, Artificial
  CRISPR gRNA sequence
acctgcttgtcttatgtata

SEQ ID NO: 277105 - DNA, 20 bp, Artificial
  CRISPR gRNA sequence
gcttgtcttatgtatatagc

SEQ ID NO: 277106 - DNA, 20 bp, Artificial
  CRISPR gRNA sequence
tgtatatagccagatgccta

SEQ ID NO: 277107 - DNA, 20 bp, Artificial
  CRISPR gRNA sequence
gtatatagccagatgcctat

SEQ ID NO: 277108 - DNA, 20 bp, Artificial
  CRISPR gRNA sequence
atagccagatgcctatgggc

SEQ ID NO: 277109 - DNA, 20 bp, Artificial
  CRISPR gRNA sequence
tagccagatgcctatgggcc

SEQ ID NO: 277110 - DNA, 20 bp, Artificial
  CRISPR gRNA sequence
gccagatgcctatgggccag

SEQ ID NO: 277111 - DNA, 20 bp, Artificial
  CRISPR gRNA sequence
gatgcctatgggccaggagt

SEQ ID NO: 277112 - DNA, 20 bp, Artificial
  CRISPR gRNA sequence
atgcctatgggccaggagtt

SEQ ID NO: 277113 - DNA, 20 bp, Artificial
  CRISPR gRNA sequence
tgcctatgggccaggagttg

SEQ ID NO: 277114 - DNA, 20 bp, Artificial
  CRISPR gRNA sequence
tatgggccaggagttgggga

SEQ ID NO: 277115 - DNA, 20 bp, Artificial
  CRISPR gRNA sequence
tgggccaggagttggggaca

SEQ ID NO: 277116 - DNA, 20 bp, Artificial
  CRISPR gRNA sequence
ccaggagttggggacagaga

SEQ ID NO: 277117 - DNA, 20 bp, Artificial
  CRISPR gRNA sequence
caggagttggggacagagac

SEQ ID NO: 277118 - DNA, 20 bp, Artificial
  CRISPR gRNA sequence
aggagttggggacagagaca

SEQ ID NO: 277119 - DNA, 20 bp, Artificial
  CRISPR gRNA sequence
gggacagagacagggatccc

SEQ ID NO: 277120 - DNA, 20 bp, Artificial
  CRISPR gRNA sequence
cagagacagggatccctagt

SEQ ID NO: 277121 - DNA, 20 bp, Artificial
  CRISPR gRNA sequence
gacagggatccctagtgagt

SEQ ID NO: 277122 - DNA, 20 bp, Artificial
  CRISPR gRNA sequence
gggatccctagtgagtgaga

SEQ ID NO: 277123 - DNA, 20 bp, Artificial
  CRISPR gRNA sequence
tagtgagtgagaaagtccac

SEQ ID NO: 277124 - DNA, 20 bp, Artificial
  CRISPR gRNA sequence
agaaagtccactggtcccct

SEQ ID NO: 277125 - DNA, 20 bp, Artificial
  CRISPR gRNA sequence
aagtccactggtcccctgag

SEQ ID NO: 277126 - DNA, 20 bp, Artificial
  CRISPR gRNA sequence
ccctgagaagacctgaatat

SEQ ID NO: 277127 - DNA, 20 bp, Artificial
  CRISPR gRNA sequence
ctgaatataagtgccaacca

SEQ ID NO: 277128 - DNA, 20 bp, Artificial
  CRISPR gRNA sequence
tgaatataagtgccaaccat

SEQ ID NO: 277129 - DNA, 20 bp, Artificial
  CRISPR gRNA sequence
catgggttaaacgatgtgct

SEQ ID NO: 277130 - DNA, 20 bp, Artificial
  CRISPR gRNA sequence
ttaaacgatgtgctcagccc

SEQ ID NO: 277131 - DNA, 20 bp, Artificial
  CRISPR gRNA sequence
taaacgatgtgctcagcccc

SEQ ID NO: 277132 - DNA, 20 bp, Artificial
  CRISPR gRNA sequence
aaacgatgtgctcagcccca

SEQ ID NO: 277133 - DNA, 20 bp, Artificial
  CRISPR gRNA sequence
aacgatgtgctcagccccag

SEQ ID NO: 277134 - DNA, 20 bp, Artificial
  CRISPR gRNA sequence
ctcagccccaggggatatga

SEQ ID NO: 277135 - DNA, 20 bp, Artificial
  CRISPR gRNA sequence
cccaggggatatgaaagtca

SEQ ID NO: 277136 - DNA, 20 bp, Artificial
  CRISPR gRNA sequence
ggggatatgaaagtcatagt

SEQ ID NO: 277137 - DNA, 20 bp, Artificial
  CRISPR gRNA sequence
gggatatgaaagtcatagta

SEQ ID NO: 277138 - DNA, 20 bp, Artificial
  CRISPR gRNA sequence
aaagtcatagtaaggaatgt

SEQ ID NO: 277139 - DNA, 20 bp, Artificial
  CRISPR gRNA sequence
atagtaaggaatgtgagatc

SEQ ID NO: 277140 - DNA, 20 bp, Artificial
  CRISPR gRNA sequence
gtaaggaatgtgagatctgg

SEQ ID NO: 277141 - DNA, 20 bp, Artificial
  CRISPR gRNA sequence
taaggaatgtgagatctgga

SEQ ID NO: 277142 - DNA, 20 bp, Artificial
  CRISPR gRNA sequence
aaggaatgtgagatctggaa

SEQ ID NO: 277143 - DNA, 20 bp, Artificial
  CRISPR gRNA sequence
tccatgatcattcattctcg

SEQ ID NO: 277144 - DNA, 20 bp, Artificial
  CRISPR gRNA sequence
cgtggccttatcttacaaat

SEQ ID NO: 277145 - DNA, 20 bp, Artificial
  CRISPR gRNA sequence
gtggccttatcttacaaatg

SEQ ID NO: 277146 - DNA, 20 bp, Artificial
  CRISPR gRNA sequence
atcttacaaatgaggaaact

SEQ ID NO: 277147 - DNA, 20 bp, Artificial
  CRISPR gRNA sequence
acaaatgaggaaactgagct

SEQ ID NO: 277148 - DNA, 20 bp, Artificial
  CRISPR gRNA sequence
caaatgaggaaactgagctg

SEQ ID NO: 277149 - DNA, 20 bp, Artificial
  CRISPR gRNA sequence
gaggaaactgagctgaggaa

SEQ ID NO: 277150 - DNA, 20 bp, Artificial
  CRISPR gRNA sequence
ctgaggaaaagaaactgccc

SEQ ID NO: 277151 - DNA, 20 bp, Artificial
  CRISPR gRNA sequence
tttacacatttttttctttc

SEQ ID NO: 277152 - DNA, 20 bp, Artificial
  CRISPR gRNA sequence
acatttttttctttctggcc

SEQ ID NO: 277153 - DNA, 20 bp, Artificial
  CRISPR gRNA sequence
catttttttctttctggccc

SEQ ID NO: 277154 - DNA, 20 bp, Artificial
  CRISPR gRNA sequence
ttctttctggcccaggcttt

SEQ ID NO: 277155 - DNA, 20 bp, Artificial
  CRISPR gRNA sequence
tctttctggcccaggctttt

SEQ ID NO: 277156 - DNA, 20 bp, Artificial
  CRISPR gRNA sequence
ctttctggcccaggctttta

SEQ ID NO: 277157 - DNA, 20 bp, Artificial
  CRISPR gRNA sequence
ttcttgtttaccgatttctt

SEQ ID NO: 277158 - DNA, 20 bp, Artificial
  CRISPR gRNA sequence
tttaccgatttcttcagttt

SEQ ID NO: 277159 - DNA, 20 bp, Artificial
  CRISPR gRNA sequence
ttaccgatttcttcagtttt

SEQ ID NO: 277160 - DNA, 20 bp, Artificial
  CRISPR gRNA sequence
atttcttcagttttaggcca

SEQ ID NO: 277161 - DNA, 20 bp, Artificial
  CRISPR gRNA sequence
cttcagttttaggccacagt

SEQ ID NO: 277162 - DNA, 20 bp, Artificial
  CRISPR gRNA sequence
agttttaggccacagtcagt

SEQ ID NO: 277163 - DNA, 20 bp, Artificial
  CRISPR gRNA sequence
taggccacagtcagtaagtt

SEQ ID NO: 277164 - DNA, 20 bp, Artificial
  CRISPR gRNA sequence
tgtccccacccaccccaatc

SEQ ID NO: 277165 - DNA, 20 bp, Artificial
  CRISPR gRNA sequence
cccaatccagccctaccact

SEQ ID NO: 277166 - DNA, 20 bp, Artificial
  CRISPR gRNA sequence
ccactgagcccttttgctat

SEQ ID NO: 277167 - DNA, 20 bp, Artificial
  CRISPR gRNA sequence
agcccttttgctataagaaa

SEQ ID NO: 277168 - DNA, 20 bp, Artificial
  CRISPR gRNA sequence
cccttttgctataagaaaca

SEQ ID NO: 277169 - DNA, 20 bp, Artificial
  CRISPR gRNA sequence
tgctataagaaacagagtcc

SEQ ID NO: 277170 - DNA, 20 bp, Artificial
  CRISPR gRNA sequence
gctataagaaacagagtccc

SEQ ID NO: 277171 - DNA, 20 bp, Artificial
  CRISPR gRNA sequence
taagaaacagagtcccaggc

SEQ ID NO: 277172 - DNA, 20 bp, Artificial
  CRISPR gRNA sequence
aagaaacagagtcccaggcc

SEQ ID NO: 277173 - DNA, 20 bp, Artificial
  CRISPR gRNA sequence
gagtcccaggccgggcatca

SEQ ID NO: 277174 - DNA, 20 bp, Artificial
  CRISPR gRNA sequence
caggccgggcatcatggctc

SEQ ID NO: 277175 - DNA, 20 bp, Artificial
  CRISPR gRNA sequence
atggctcaagcctgtaatcc

SEQ ID NO: 277176 - DNA, 20 bp, Artificial
  CRISPR gRNA sequence
agcctgtaatcccagcactt

SEQ ID NO: 277177 - DNA, 20 bp, Artificial
  CRISPR gRNA sequence
gcctgtaatcccagcacttt

SEQ ID NO: 277178 - DNA, 20 bp, Artificial
  CRISPR gRNA sequence
ctgtaatcccagcactttgg

SEQ ID NO: 277179 - DNA, 20 bp, Artificial
  CRISPR gRNA sequence
tgtaatcccagcactttggg

SEQ ID NO: 277180 - DNA, 20 bp, Artificial
  CRISPR gRNA sequence
tcccagcactttgggaggct

SEQ ID NO: 277181 - DNA, 20 bp, Artificial
  CRISPR gRNA sequence
cccagcactttgggaggctg

SEQ ID NO: 277182 - DNA, 20 bp, Artificial
  CRISPR gRNA sequence
agcactttgggaggctgagg

SEQ ID NO: 277183 - DNA, 20 bp, Artificial
  CRISPR gRNA sequence
gcactttgggaggctgaggt

SEQ ID NO: 277184 - DNA, 20 bp, Artificial
  CRISPR gRNA sequence
ctttgggaggctgaggtggg

SEQ ID NO: 277185 - DNA, 20 bp, Artificial
  CRISPR gRNA sequence
ggctgaggtgggcagatcac

SEQ ID NO: 277186 - DNA, 20 bp, Artificial
  CRISPR gRNA sequence
gctgaggtgggcagatcacg

SEQ ID NO: 277187 - DNA, 20 bp, Artificial
  CRISPR gRNA sequence
aggtgggcagatcacgaggt

SEQ ID NO: 277188 - DNA, 20 bp, Artificial
  CRISPR gRNA sequence
ggtgggcagatcacgaggtc

SEQ ID NO: 277189 - DNA, 20 bp, Artificial
  CRISPR gRNA sequence
tgggcagatcacgaggtcag

SEQ ID NO: 277190 - DNA, 20 bp, Artificial
  CRISPR gRNA sequence
gatcacgaggtcaggagttt

SEQ ID NO: 277191 - DNA, 20 bp, Artificial
  CRISPR gRNA sequence
cgaggtcaggagtttgagac

SEQ ID NO: 277192 - DNA, 20 bp, Artificial
  CRISPR gRNA sequence
tcaggagtttgagaccagcc

SEQ ID NO: 277193 - DNA, 20 bp, Artificial
  CRISPR gRNA sequence
tgagaccagcctggtcaaca

SEQ ID NO: 277194 - DNA, 20 bp, Artificial
  CRISPR gRNA sequence
tactaaaaatacaaaaaaat

SEQ ID NO: 277195 - DNA, 20 bp, Artificial
  CRISPR gRNA sequence
aaaaatacaaaaaaattagc

SEQ ID NO: 277196 - DNA, 20 bp, Artificial
  CRISPR gRNA sequence
aaaatacaaaaaaattagcc

SEQ ID NO: 277197 - DNA, 20 bp, Artificial
  CRISPR gRNA sequence
aaaaaattagccgggcatgt

SEQ ID NO: 277198 - DNA, 20 bp, Artificial
  CRISPR gRNA sequence
aaaaattagccgggcatgtt

SEQ ID NO: 277199 - DNA, 20 bp, Artificial
  CRISPR gRNA sequence
ttgggacacacctgtaatcc

SEQ ID NO: 277200 - DNA, 20 bp, Artificial
  CRISPR gRNA sequence
cacctgtaatcccagctact

SEQ ID NO: 277201 - DNA, 20 bp, Artificial
  CRISPR gRNA sequence
acctgtaatcccagctactt

SEQ ID NO: 277202 - DNA, 20 bp, Artificial
  CRISPR gRNA sequence
ctgtaatcccagctacttag

SEQ ID NO: 277203 - DNA, 20 bp, Artificial
  CRISPR gRNA sequence
tgtaatcccagctacttagg

SEQ ID NO: 277204 - DNA, 20 bp, Artificial
  CRISPR gRNA sequence
tcccagctacttaggaggct

SEQ ID NO: 277205 - DNA, 20 bp, Artificial
  CRISPR gRNA sequence
cccagctacttaggaggctg

SEQ ID NO: 277206 - DNA, 20 bp, Artificial
  CRISPR gRNA sequence
agctacttaggaggctgagg

SEQ ID NO: 277207 - DNA, 20 bp, Artificial
  CRISPR gRNA sequence
gctacttaggaggctgaggc

SEQ ID NO: 277208 - DNA, 20 bp, Artificial
  CRISPR gRNA sequence
tacttaggaggctgaggcag

SEQ ID NO: 277209 - DNA, 20 bp, Artificial
  CRISPR gRNA sequence
gcaggagaatcacttgaacc

SEQ ID NO: 277210 - DNA, 20 bp, Artificial
  CRISPR gRNA sequence
caggagaatcacttgaacct

SEQ ID NO: 277211 - DNA, 20 bp, Artificial
  CRISPR gRNA sequence
ggagaatcacttgaacctgg

SEQ ID NO: 277212 - DNA, 20 bp, Artificial
  CRISPR gRNA sequence
gagaatcacttgaacctggg

SEQ ID NO: 277213 - DNA, 20 bp, Artificial
  CRISPR gRNA sequence
aatcacttgaacctgggagg

SEQ ID NO: 277214 - DNA, 20 bp, Artificial
  CRISPR gRNA sequence
tcacttgaacctgggaggca

SEQ ID NO: 277215 - DNA, 20 bp, Artificial
  CRISPR gRNA sequence
cacttgaacctgggaggcag

SEQ ID NO: 277216 - DNA, 20 bp, Artificial
  CRISPR gRNA sequence
aacctgggaggcagaggttg

SEQ ID NO: 277217 - DNA, 20 bp, Artificial
  CRISPR gRNA sequence
tgggaggcagaggttgcagt

SEQ ID NO: 277218 - DNA, 20 bp, Artificial
  CRISPR gRNA sequence
ggcagaggttgcagtgagcc

SEQ ID NO: 277219 - DNA, 20 bp, Artificial
  CRISPR gRNA sequence
aagatcacaccactgcactc

SEQ ID NO: 277220 - DNA, 20 bp, Artificial
  CRISPR gRNA sequence
cacaccactgcactccagct

SEQ ID NO: 277221 - DNA, 20 bp, Artificial
  CRISPR gRNA sequence
acaccactgcactccagctt

SEQ ID NO: 277222 - DNA, 20 bp, Artificial
  CRISPR gRNA sequence
ctgcactccagcttgggtga

SEQ ID NO: 277223 - DNA, 20 bp, Artificial
  CRISPR gRNA sequence
gcactccagcttgggtgaca

SEQ ID NO: 277224 - DNA, 20 bp, Artificial
  CRISPR gRNA sequence
tccagcttgggtgacagagt

SEQ ID NO: 277225 - DNA, 20 bp, Artificial
  CRISPR gRNA sequence
aaataaataaataaataaat

SEQ ID NO: 277226 - DNA, 20 bp, Artificial
  CRISPR gRNA sequence
ataaataaataaataagaaa

SEQ ID NO: 277227 - DNA, 20 bp, Artificial
  CRISPR gRNA sequence
aaataaataaataagaaaca

SEQ ID NO: 277228 - DNA, 20 bp, Artificial
  CRISPR gRNA sequence
aaacagagtccctttctttc

SEQ ID NO: 277229 - DNA, 20 bp, Artificial
  CRISPR gRNA sequence
aacagagtccctttctttcc

SEQ ID NO: 277230 - DNA, 20 bp, Artificial
  CRISPR gRNA sequence
tccaggcctgattgatccca

SEQ ID NO: 277231 - DNA, 20 bp, Artificial
  CRISPR gRNA sequence
cctgattgatcccatggttc

SEQ ID NO: 277232 - DNA, 20 bp, Artificial
  CRISPR gRNA sequence
ctgattgatcccatggttcc

SEQ ID NO: 277233 - DNA, 20 bp, Artificial
  CRISPR gRNA sequence
gactcccatgcttatacctt

SEQ ID NO: 277234 - DNA, 20 bp, Artificial
  CRISPR gRNA sequence
tggactatttctaccatctt

SEQ ID NO: 277235 - DNA, 20 bp, Artificial
  CRISPR gRNA sequence
ggactatttctaccatcttc

SEQ ID NO: 277236 - DNA, 20 bp, Artificial
  CRISPR gRNA sequence
ccatcttcaggtaccctaaa

SEQ ID NO: 277237 - DNA, 20 bp, Artificial
  CRISPR gRNA sequence
atatcctgcctttatctctt

SEQ ID NO: 277238 - DNA, 20 bp, Artificial
  CRISPR gRNA sequence
tttatctctttggctatctg

SEQ ID NO: 277239 - DNA, 20 bp, Artificial
  CRISPR gRNA sequence
catgccatacaattaccctc

SEQ ID NO: 277240 - DNA, 20 bp, Artificial
  CRISPR gRNA sequence
catacaattaccctccagcc

SEQ ID NO: 277241 - DNA, 20 bp, Artificial
  CRISPR gRNA sequence
ctccagcctggatttgctaa

SEQ ID NO: 277242 - DNA, 20 bp, Artificial
  CRISPR gRNA sequence
ccagcctggatttgctaaaa

SEQ ID NO: 277243 - DNA, 20 bp, Artificial
  CRISPR gRNA sequence
tgttcatttctccatccaca

SEQ ID NO: 277244 - DNA, 20 bp, Artificial
  CRISPR gRNA sequence
atttctccatccacatagcc

SEQ ID NO: 277245 - DNA, 20 bp, Artificial
  CRISPR gRNA sequence
tccacatagccaagaaatat

SEQ ID NO: 277246 - DNA, 20 bp, Artificial
  CRISPR gRNA sequence
cagcatatcaatatctaaac

SEQ ID NO: 277247 - DNA, 20 bp, Artificial
  CRISPR gRNA sequence
taaactagtctctgtgtcaa

SEQ ID NO: 277248 - DNA, 20 bp, Artificial
  CRISPR gRNA sequence
tcaatagcaccaaaattcct

SEQ ID NO: 277249 - DNA, 20 bp, Artificial
  CRISPR gRNA sequence
atagcaccaaaattccttag

SEQ ID NO: 277250 - DNA, 20 bp, Artificial
  CRISPR gRNA sequence
tagcaccaaaattccttagc

SEQ ID NO: 277251 - DNA, 20 bp, Artificial
  CRISPR gRNA sequence
aggctgtattttctgatttt

SEQ ID NO: 277252 - DNA, 20 bp, Artificial
  CRISPR gRNA sequence
gtattttctgatttttggtt

SEQ ID NO: 277253 - DNA, 20 bp, Artificial
  CRISPR gRNA sequence
ttttctgatttttggtttag

SEQ ID NO: 277254 - DNA, 20 bp, Artificial
  CRISPR gRNA sequence
tttctgatttttggtttaga

SEQ ID NO: 277255 - DNA, 20 bp, Artificial
  CRISPR gRNA sequence
gatttttggtttagaaggca

SEQ ID NO: 277256 - DNA, 20 bp, Artificial
  CRISPR gRNA sequence
gaaggcatggtcattcttcc

SEQ ID NO: 277257 - DNA, 20 bp, Artificial
  CRISPR gRNA sequence
aaggcatggtcattcttcct

SEQ ID NO: 277258 - DNA, 20 bp, Artificial
  CRISPR gRNA sequence
tcattcttcctaggctcttg

SEQ ID NO: 277259 - DNA, 20 bp, Artificial
  CRISPR gRNA sequence
cattcttcctaggctcttgt

SEQ ID NO: 277260 - DNA, 20 bp, Artificial
  CRISPR gRNA sequence
taggctcttgtaggacctaa

SEQ ID NO: 277261 - DNA, 20 bp, Artificial
  CRISPR gRNA sequence
gctcttgtaggacctaaaag

SEQ ID NO: 277262 - DNA, 20 bp, Artificial
  CRISPR gRNA sequence
cctaaaagcagcatccctct

SEQ ID NO: 277263 - DNA, 20 bp, Artificial
  CRISPR gRNA sequence
ctaaaagcagcatccctcta

SEQ ID NO: 277264 - DNA, 20 bp, Artificial
  CRISPR gRNA sequence
gcagcatccctctaaggccc

SEQ ID NO: 277265 - DNA, 20 bp, Artificial
  CRISPR gRNA sequence
aggccccagcgccccctgcc

SEQ ID NO: 277266 - DNA, 20 bp, Artificial
  CRISPR gRNA sequence
tgctgtcgtactgtgccttc

SEQ ID NO: 277267 - DNA, 20 bp, Artificial
  CRISPR gRNA sequence
gctgtcgtactgtgccttct

SEQ ID NO: 277268 - DNA, 20 bp, Artificial
  CRISPR gRNA sequence
cttctgggccctgtatcccc

SEQ ID NO: 277269 - DNA, 20 bp, Artificial
  CRISPR gRNA sequence
tctgggccctgtatcccctg

SEQ ID NO: 277270 - DNA, 20 bp, Artificial
  CRISPR gRNA sequence
ctgtatcccctggagccaca

SEQ ID NO: 277271 - DNA, 20 bp, Artificial
  CRISPR gRNA sequence
tggagccacacagatcccct

SEQ ID NO: 277272 - DNA, 20 bp, Artificial
  CRISPR gRNA sequence
ggagccacacagatcccctt

SEQ ID NO: 277273 - DNA, 20 bp, Artificial
  CRISPR gRNA sequence
gagccacacagatcccctta

SEQ ID NO: 277274 - DNA, 20 bp, Artificial
  CRISPR gRNA sequence
gccacacagatccccttagg

SEQ ID NO: 277275 - DNA, 20 bp, Artificial
  CRISPR gRNA sequence
cccttagggagacccatgtc

SEQ ID NO: 277276 - DNA, 20 bp, Artificial
  CRISPR gRNA sequence
ccttagggagacccatgtct

SEQ ID NO: 277277 - DNA, 20 bp, Artificial
  CRISPR gRNA sequence
cttagggagacccatgtcta

SEQ ID NO: 277278 - DNA, 20 bp, Artificial
  CRISPR gRNA sequence
tgtctagggacttcatttcc

SEQ ID NO: 277279 - DNA, 20 bp, Artificial
  CRISPR gRNA sequence
ttccaagccctctcttttct

SEQ ID NO: 277280 - DNA, 20 bp, Artificial
  CRISPR gRNA sequence
aagccctctcttttcttaga

SEQ ID NO: 277281 - DNA, 20 bp, Artificial
  CRISPR gRNA sequence
ccctctcttttcttagatag

SEQ ID NO: 277282 - DNA, 20 bp, Artificial
  CRISPR gRNA sequence
cctctcttttcttagatagc

SEQ ID NO: 277283 - DNA, 20 bp, Artificial
  CRISPR gRNA sequence
tttcttagatagcaggatca

SEQ ID NO: 277284 - DNA, 20 bp, Artificial
  CRISPR gRNA sequence
ttcttagatagcaggatcat

SEQ ID NO: 277285 - DNA, 20 bp, Artificial
  CRISPR gRNA sequence
tcttagatagcaggatcatg

SEQ ID NO: 277286 - DNA, 20 bp, Artificial
  CRISPR gRNA sequence
atagcaggatcatggggcac

SEQ ID NO: 277287 - DNA, 20 bp, Artificial
  CRISPR gRNA sequence
ctagcacctttccatctcac

SEQ ID NO: 277288 - DNA, 20 bp, Artificial
  CRISPR gRNA sequence
tccatctcaccagccattct

SEQ ID NO: 277289 - DNA, 20 bp, Artificial
  CRISPR gRNA sequence
ccatctcaccagccattctc

SEQ ID NO: 277290 - DNA, 20 bp, Artificial
  CRISPR gRNA sequence
agccattctcaggcctctgt

SEQ ID NO: 277291 - DNA, 20 bp, Artificial
  CRISPR gRNA sequence
ttctcaggcctctgtcagac

SEQ ID NO: 277292 - DNA, 20 bp, Artificial
  CRISPR gRNA sequence
ggcctctgtcagactggata

SEQ ID NO: 277293 - DNA, 20 bp, Artificial
  CRISPR gRNA sequence
gactggatacggccccacca

SEQ ID NO: 277294 - DNA, 20 bp, Artificial
  CRISPR gRNA sequence
gccccaccacagcactgaac

SEQ ID NO: 277295 - DNA, 20 bp, Artificial
  CRISPR gRNA sequence
cccaccacagcactgaacaa

SEQ ID NO: 277296 - DNA, 20 bp, Artificial
  CRISPR gRNA sequence
caccacagcactgaacaaga

SEQ ID NO: 277297 - DNA, 20 bp, Artificial
  CRISPR gRNA sequence
tgaacaagagagttttgtga

SEQ ID NO: 277298 - DNA, 20 bp, Artificial
  CRISPR gRNA sequence
acaagagagttttgtgatgg

SEQ ID NO: 277299 - DNA, 20 bp, Artificial
  CRISPR gRNA sequence
caagagagttttgtgatggt

SEQ ID NO: 277300 - DNA, 20 bp, Artificial
  CRISPR gRNA sequence
tgtgatggtgggtatttgca

SEQ ID NO: 277301 - DNA, 20 bp, Artificial
  CRISPR gRNA sequence
tggtgggtatttgcatagca

SEQ ID NO: 277302 - DNA, 20 bp, Artificial
  CRISPR gRNA sequence
gggtatttgcatagcaaagt

SEQ ID NO: 277303 - DNA, 20 bp, Artificial
  CRISPR gRNA sequence
ggtatttgcatagcaaagtg

SEQ ID NO: 277304 - DNA, 20 bp, Artificial
  CRISPR gRNA sequence
catagcaaagtgaggtaatg

SEQ ID NO: 277305 - DNA, 20 bp, Artificial
  CRISPR gRNA sequence
gcaaagtgaggtaatgcaga

SEQ ID NO: 277306 - DNA, 20 bp, Artificial
  CRISPR gRNA sequence
caaagtgaggtaatgcagaa

SEQ ID NO: 277307 - DNA, 20 bp, Artificial
  CRISPR gRNA sequence
tgaggtaatgcagaaaggtc

SEQ ID NO: 277308 - DNA, 20 bp, Artificial
  CRISPR gRNA sequence
gaggtaatgcagaaaggtcc

SEQ ID NO: 277309 - DNA, 20 bp, Artificial
  CRISPR gRNA sequence
gaaaggtccaggcacctctt

SEQ ID NO: 277310 - DNA, 20 bp, Artificial
  CRISPR gRNA sequence
gcacctcttcagcaattgtg

SEQ ID NO: 277311 - DNA, 20 bp, Artificial
  CRISPR gRNA sequence
gcaattgtgtggaatgttgc

SEQ ID NO: 277312 - DNA, 20 bp, Artificial
  CRISPR gRNA sequence
aatgttgccagtccctgctt

SEQ ID NO: 277313 - DNA, 20 bp, Artificial
  CRISPR gRNA sequence
atgttgccagtccctgcttt

SEQ ID NO: 277314 - DNA, 20 bp, Artificial
  CRISPR gRNA sequence
tgttgccagtccctgcttta

SEQ ID NO: 277315 - DNA, 20 bp, Artificial
  CRISPR gRNA sequence
gctttagggaatataactga

SEQ ID NO: 277316 - DNA, 20 bp, Artificial
  CRISPR gRNA sequence
tagggaatataactgaaaga

SEQ ID NO: 277317 - DNA, 20 bp, Artificial
  CRISPR gRNA sequence
agggaatataactgaaagaa

SEQ ID NO: 277318 - DNA, 20 bp, Artificial
  CRISPR gRNA sequence
gaatataactgaaagaaagg

SEQ ID NO: 277319 - DNA, 20 bp, Artificial
  CRISPR gRNA sequence
gaaagaaaggaagaaataaa

SEQ ID NO: 277320 - DNA, 20 bp, Artificial
  CRISPR gRNA sequence
gaaataaaaagacatacttg

SEQ ID NO: 277321 - DNA, 20 bp, Artificial
  CRISPR gRNA sequence
aaataaaaagacatacttga

SEQ ID NO: 277322 - DNA, 20 bp, Artificial
  CRISPR gRNA sequence
aataaaaagacatacttgaa

SEQ ID NO: 277323 - DNA, 20 bp, Artificial
  CRISPR gRNA sequence
taaaaagacatacttgaagg

SEQ ID NO: 277324 - DNA, 20 bp, Artificial
  CRISPR gRNA sequence
cttgaagggagcatatttca

SEQ ID NO: 277325 - DNA, 20 bp, Artificial
  CRISPR gRNA sequence
agggagcatatttcaaagtg

SEQ ID NO: 277326 - DNA, 20 bp, Artificial
  CRISPR gRNA sequence
atttcaaagtgaagctatat

SEQ ID NO: 277327 - DNA, 20 bp, Artificial
  CRISPR gRNA sequence
aagtgaagctatattagcta

SEQ ID NO: 277328 - DNA, 20 bp, Artificial
  CRISPR gRNA sequence
ctaaagatcaaatgacaacc

SEQ ID NO: 277329 - DNA, 20 bp, Artificial
  CRISPR gRNA sequence
aatgacaacccagacactcc

SEQ ID NO: 277330 - DNA, 20 bp, Artificial
  CRISPR gRNA sequence
ccagacactcctagtgttgc

SEQ ID NO: 277331 - DNA, 20 bp, Artificial
  CRISPR gRNA sequence
cagacactcctagtgttgca

SEQ ID NO: 277332 - DNA, 20 bp, Artificial
  CRISPR gRNA sequence
cactcctagtgttgcaagga

SEQ ID NO: 277333 - DNA, 20 bp, Artificial
  CRISPR gRNA sequence
tgttgcaaggaaagcaaaat

SEQ ID NO: 277334 - DNA, 20 bp, Artificial
  CRISPR gRNA sequence
aaggaaagcaaaatgagacg

SEQ ID NO: 277335 - DNA, 20 bp, Artificial
  CRISPR gRNA sequence
gaaagcaaaatgagacgtag

SEQ ID NO: 277336 - DNA, 20 bp, Artificial
  CRISPR gRNA sequence
aaagcaaaatgagacgtaga

SEQ ID NO: 277337 - DNA, 20 bp, Artificial
  CRISPR gRNA sequence
aatgagacgtagaaggaaca

SEQ ID NO: 277338 - DNA, 20 bp, Artificial
  CRISPR gRNA sequence
atgagacgtagaaggaacat

SEQ ID NO: 277339 - DNA, 20 bp, Artificial
  CRISPR gRNA sequence
gctatccatctccattgact

SEQ ID NO: 277340 - DNA, 20 bp, Artificial
  CRISPR gRNA sequence
atctccattgacttggattc

SEQ ID NO: 277341 - DNA, 20 bp, Artificial
  CRISPR gRNA sequence
attgacttggattctagtcc

SEQ ID NO: 277342 - DNA, 20 bp, Artificial
  CRISPR gRNA sequence
cttggattctagtcccagct

SEQ ID NO: 277343 - DNA, 20 bp, Artificial
  CRISPR gRNA sequence
tctgtttcttcatctctaaa

SEQ ID NO: 277344 - DNA, 20 bp, Artificial
  CRISPR gRNA sequence
ctgtttcttcatctctaaat

SEQ ID NO: 277345 - DNA, 20 bp, Artificial
  CRISPR gRNA sequence
taggtatgacacctacccct

SEQ ID NO: 277346 - DNA, 20 bp, Artificial
  CRISPR gRNA sequence
aggtatgacacctacccctt

SEQ ID NO: 277347 - DNA, 20 bp, Artificial
  CRISPR gRNA sequence
cacctaccccttgggatcac

SEQ ID NO: 277348 - DNA, 20 bp, Artificial
  CRISPR gRNA sequence
cttgggatcactggaaaatt

SEQ ID NO: 277349 - DNA, 20 bp, Artificial
  CRISPR gRNA sequence
aattaaatgatataaataaa

SEQ ID NO: 277350 - DNA, 20 bp, Artificial
  CRISPR gRNA sequence
tgatataaataaaaagtccc

SEQ ID NO: 277351 - DNA, 20 bp, Artificial
  CRISPR gRNA sequence
gatataaataaaaagtccca

SEQ ID NO: 277352 - DNA, 20 bp, Artificial
  CRISPR gRNA sequence
aataaaaagtcccaaggaca

SEQ ID NO: 277353 - DNA, 20 bp, Artificial
  CRISPR gRNA sequence
aaaaagtcccaaggacatag

SEQ ID NO: 277354 - DNA, 20 bp, Artificial
  CRISPR gRNA sequence
aaaagtcccaaggacatagc

SEQ ID NO: 277355 - DNA, 20 bp, Artificial
  CRISPR gRNA sequence
ggacatagcaggtcttctgt

SEQ ID NO: 277356 - DNA, 20 bp, Artificial
  CRISPR gRNA sequence
acatagcaggtcttctgtaa

SEQ ID NO: 277357 - DNA, 20 bp, Artificial
  CRISPR gRNA sequence
tcttacctttcatttcactc

SEQ ID NO: 277358 - DNA, 20 bp, Artificial
  CRISPR gRNA sequence
cttacctttcatttcactca

SEQ ID NO: 277359 - DNA, 20 bp, Artificial
  CRISPR gRNA sequence
ttacctttcatttcactcaa

SEQ ID NO: 277360 - DNA, 20 bp, Artificial
  CRISPR gRNA sequence
atttcactcaagggttatgt

SEQ ID NO: 277361 - DNA, 20 bp, Artificial
  CRISPR gRNA sequence
caagggttatgtcagatata

SEQ ID NO: 277362 - DNA, 20 bp, Artificial
  CRISPR gRNA sequence
atgtcagatatatagcactc

SEQ ID NO: 277363 - DNA, 20 bp, Artificial
  CRISPR gRNA sequence
atagcactctggtcttgcta

SEQ ID NO: 277364 - DNA, 20 bp, Artificial
  CRISPR gRNA sequence
tagcactctggtcttgctat

SEQ ID NO: 277365 - DNA, 20 bp, Artificial
  CRISPR gRNA sequence
actctggtcttgctatgggc

SEQ ID NO: 277366 - DNA, 20 bp, Artificial
  CRISPR gRNA sequence
tggtcttgctatgggccaga

SEQ ID NO: 277367 - DNA, 20 bp, Artificial
  CRISPR gRNA sequence
cttgctatgggccagacaga

SEQ ID NO: 277368 - DNA, 20 bp, Artificial
  CRISPR gRNA sequence
cagacagcaactcacttgtc

SEQ ID NO: 277369 - DNA, 20 bp, Artificial
  CRISPR gRNA sequence
agacagcaactcacttgtct

SEQ ID NO: 277370 - DNA, 20 bp, Artificial
  CRISPR gRNA sequence
ttgtctgggcctcccaataa

SEQ ID NO: 277371 - DNA, 20 bp, Artificial
  CRISPR gRNA sequence
tgtctgggcctcccaataat

SEQ ID NO: 277372 - DNA, 20 bp, Artificial
  CRISPR gRNA sequence
gtctgggcctcccaataata

SEQ ID NO: 277373 - DNA, 20 bp, Artificial
  CRISPR gRNA sequence
cccaccgaactattcattcc

SEQ ID NO: 277374 - DNA, 20 bp, Artificial
  CRISPR gRNA sequence
actattcattcccagccaaa

SEQ ID NO: 277375 - DNA, 20 bp, Artificial
  CRISPR gRNA sequence
ccaatatttctcactgattt

SEQ ID NO: 277376 - DNA, 20 bp, Artificial
  CRISPR gRNA sequence
ttctcactgattttggtatg

SEQ ID NO: 277377 - DNA, 20 bp, Artificial
  CRISPR gRNA sequence
attttggtatgtggtgatgt

SEQ ID NO: 277378 - DNA, 20 bp, Artificial
  CRISPR gRNA sequence
gtatgtggtgatgttagcaa

SEQ ID NO: 277379 - DNA, 20 bp, Artificial
  CRISPR gRNA sequence
ggtgatgttagcaaaagtga

SEQ ID NO: 277380 - DNA, 20 bp, Artificial
  CRISPR gRNA sequence
tgttagcaaaagtgaaagca

SEQ ID NO: 277381 - DNA, 20 bp, Artificial
  CRISPR gRNA sequence
aaaagtgaaagcatagctga

SEQ ID NO: 277382 - DNA, 20 bp, Artificial
  CRISPR gRNA sequence
aagtgaaagcatagctgaaa

SEQ ID NO: 277383 - DNA, 20 bp, Artificial
  CRISPR gRNA sequence
gtgaaagcatagctgaaaga

SEQ ID NO: 277384 - DNA, 20 bp, Artificial
  CRISPR gRNA sequence
aaagagagactatctaattt

SEQ ID NO: 277385 - DNA, 20 bp, Artificial
  CRISPR gRNA sequence
agactatctaattttggtga

SEQ ID NO: 277386 - DNA, 20 bp, Artificial
  CRISPR gRNA sequence
taattttggtgatggcttct

SEQ ID NO: 277387 - DNA, 20 bp, Artificial
  CRISPR gRNA sequence
aattttggtgatggcttctg

SEQ ID NO: 277388 - DNA, 20 bp, Artificial
  CRISPR gRNA sequence
ttttggtgatggcttctgag

SEQ ID NO: 277389 - DNA, 20 bp, Artificial
  CRISPR gRNA sequence
gcttctgaggagtttttgtc

SEQ ID NO: 277390 - DNA, 20 bp, Artificial
  CRISPR gRNA sequence
gagtttttgtccagccttct

SEQ ID NO: 277391 - DNA, 20 bp, Artificial
  CRISPR gRNA sequence
agtttttgtccagccttctg

SEQ ID NO: 277392 - DNA, 20 bp, Artificial
  CRISPR gRNA sequence
tttttgtccagccttctgag

SEQ ID NO: 277393 - DNA, 20 bp, Artificial
  CRISPR gRNA sequence
ttgtccagccttctgaggag

SEQ ID NO: 277394 - DNA, 20 bp, Artificial
  CRISPR gRNA sequence
gtccagccttctgaggagaa

SEQ ID NO: 277395 - DNA, 20 bp, Artificial
  CRISPR gRNA sequence
gccttctgaggagaagagtg

SEQ ID NO: 277396 - DNA, 20 bp, Artificial
  CRISPR gRNA sequence
ttctgaggagaagagtgaag

SEQ ID NO: 277397 - DNA, 20 bp, Artificial
  CRISPR gRNA sequence
aggagaagagtgaagaagaa

SEQ ID NO: 277398 - DNA, 20 bp, Artificial
  CRISPR gRNA sequence
ggagaagagtgaagaagaac

SEQ ID NO: 277399 - DNA, 20 bp, Artificial
  CRISPR gRNA sequence
tgaagaagaacaggactaaa

SEQ ID NO: 277400 - DNA, 20 bp, Artificial
  CRISPR gRNA sequence
aagaagaacaggactaaaaa

SEQ ID NO: 277401 - DNA, 20 bp, Artificial
  CRISPR gRNA sequence
agaagaacaggactaaaaag

SEQ ID NO: 277402 - DNA, 20 bp, Artificial
  CRISPR gRNA sequence
ccaaaatcttccgaacaatt

SEQ ID NO: 277403 - DNA, 20 bp, Artificial
  CRISPR gRNA sequence
gaacaatttggaaattcaca

SEQ ID NO: 277404 - DNA, 20 bp, Artificial
  CRISPR gRNA sequence
aacaatttggaaattcacac

SEQ ID NO: 277405 - DNA, 20 bp, Artificial
  CRISPR gRNA sequence
tggaaattcacacgggaacc

SEQ ID NO: 277406 - DNA, 20 bp, Artificial
  CRISPR gRNA sequence
tcacacgggaacccagtttt

SEQ ID NO: 277407 - DNA, 20 bp, Artificial
  CRISPR gRNA sequence
cacacgggaacccagttttc

SEQ ID NO: 277408 - DNA, 20 bp, Artificial
  CRISPR gRNA sequence
gttttcgggattccaccaca

SEQ ID NO: 277409 - DNA, 20 bp, Artificial
  CRISPR gRNA sequence
tttcgggattccaccacaca

SEQ ID NO: 277410 - DNA, 20 bp, Artificial
  CRISPR gRNA sequence
gggattccaccacacagaga

SEQ ID NO: 277411 - DNA, 20 bp, Artificial
  CRISPR gRNA sequence
caccacacagagacagaaaa

SEQ ID NO: 277412 - DNA, 20 bp, Artificial
  CRISPR gRNA sequence
aaatttgcccaaatttatat

SEQ ID NO: 277413 - DNA, 20 bp, Artificial
  CRISPR gRNA sequence
tatatcagttttgtctgttt

SEQ ID NO: 277414 - DNA, 20 bp, Artificial
  CRISPR gRNA sequence
atatcagttttgtctgtttt

SEQ ID NO: 277415 - DNA, 20 bp, Artificial
  CRISPR gRNA sequence
tatcagttttgtctgtttta

SEQ ID NO: 277416 - DNA, 20 bp, Artificial
  CRISPR gRNA sequence
tttagggactccatcacaca

SEQ ID NO: 277417 - DNA, 20 bp, Artificial
  CRISPR gRNA sequence
ctccatcacacacggacaaa

SEQ ID NO: 277418 - DNA, 20 bp, Artificial
  CRISPR gRNA sequence
catcacacacggacaaaaag

SEQ ID NO: 277419 - DNA, 20 bp, Artificial
  CRISPR gRNA sequence
cggacaaaaagcagttgaaa

SEQ ID NO: 277420 - DNA, 20 bp, Artificial
  CRISPR gRNA sequence
tctaacgattttgtctgctt

SEQ ID NO: 277421 - DNA, 20 bp, Artificial
  CRISPR gRNA sequence
attttgtctgcttcagtgac

SEQ ID NO: 277422 - DNA, 20 bp, Artificial
  CRISPR gRNA sequence
ttgtctgcttcagtgactgg

SEQ ID NO: 277423 - DNA, 20 bp, Artificial
  CRISPR gRNA sequence
tgtctgcttcagtgactggc

SEQ ID NO: 277424 - DNA, 20 bp, Artificial
  CRISPR gRNA sequence
gtctgcttcagtgactggcg

SEQ ID NO: 277425 - DNA, 20 bp, Artificial
  CRISPR gRNA sequence
gcttcagtgactggcgggga

SEQ ID NO: 277426 - DNA, 20 bp, Artificial
  CRISPR gRNA sequence
cagtgactggcggggaaagt

SEQ ID NO: 277427 - DNA, 20 bp, Artificial
  CRISPR gRNA sequence
tggcggggaaagtcagcacc

SEQ ID NO: 277428 - DNA, 20 bp, Artificial
  CRISPR gRNA sequence
caatattactgtctcaaacc

SEQ ID NO: 277429 - DNA, 20 bp, Artificial
  CRISPR gRNA sequence
tcaaacctggttgaacttct

SEQ ID NO: 277430 - DNA, 20 bp, Artificial
  CRISPR gRNA sequence
cttgctttgccatttttgaa

SEQ ID NO: 277431 - DNA, 20 bp, Artificial
  CRISPR gRNA sequence
ttgctttgccatttttgaat

SEQ ID NO: 277432 - DNA, 20 bp, Artificial
  CRISPR gRNA sequence
attgtaacacctacccaacc

SEQ ID NO: 277433 - DNA, 20 bp, Artificial
  CRISPR gRNA sequence
gtaacacctacccaacccag

SEQ ID NO: 277434 - DNA, 20 bp, Artificial
  CRISPR gRNA sequence
taacacctacccaacccagt

SEQ ID NO: 277435 - DNA, 20 bp, Artificial
  CRISPR gRNA sequence
ctacccaacccagtgggtgc

SEQ ID NO: 277436 - DNA, 20 bp, Artificial
  CRISPR gRNA sequence
tacccaacccagtgggtgca

SEQ ID NO: 277437 - DNA, 20 bp, Artificial
  CRISPR gRNA sequence
tgggtgcaaggattcaaaat

SEQ ID NO: 277438 - DNA, 20 bp, Artificial
  CRISPR gRNA sequence
aaatgagatactgctcataa

SEQ ID NO: 277439 - DNA, 20 bp, Artificial
  CRISPR gRNA sequence
ctgctcataaaagtcctcca

SEQ ID NO: 277440 - DNA, 20 bp, Artificial
  CRISPR gRNA sequence
taaaagtcctccacagtacc

SEQ ID NO: 277441 - DNA, 20 bp, Artificial
  CRISPR gRNA sequence
aaaagtcctccacagtacct

SEQ ID NO: 277442 - DNA, 20 bp, Artificial
  CRISPR gRNA sequence
ctccacagtacctaggacat

SEQ ID NO: 277443 - DNA, 20 bp, Artificial
  CRISPR gRNA sequence
ccacagtacctaggacatta

SEQ ID NO: 277444 - DNA, 20 bp, Artificial
  CRISPR gRNA sequence
cacagtacctaggacattag

SEQ ID NO: 277445 - DNA, 20 bp, Artificial
  CRISPR gRNA sequence
acagtacctaggacattaga

SEQ ID NO: 277446 - DNA, 20 bp, Artificial
  CRISPR gRNA sequence
agtacctaggacattagagg

SEQ ID NO: 277447 - DNA, 20 bp, Artificial
  CRISPR gRNA sequence
cctaggacattagagggagc

SEQ ID NO: 277448 - DNA, 20 bp, Artificial
  CRISPR gRNA sequence
gagggagccagtgtcttccc

SEQ ID NO: 277449 - DNA, 20 bp, Artificial
  CRISPR gRNA sequence
gggagccagtgtcttcccca

SEQ ID NO: 277450 - DNA, 20 bp, Artificial
  CRISPR gRNA sequence
gtcttccccagagatccaca

SEQ ID NO: 277451 - DNA, 20 bp, Artificial
  CRISPR gRNA sequence
ccccagagatccacacagtt

SEQ ID NO: 277452 - DNA, 20 bp, Artificial
  CRISPR gRNA sequence
cccagagatccacacagttc

SEQ ID NO: 277453 - DNA, 20 bp, Artificial
  CRISPR gRNA sequence
tttgctcacatctactctcg

SEQ ID NO: 277454 - DNA, 20 bp, Artificial
  CRISPR gRNA sequence
actctcgtggccccttgtca

SEQ ID NO: 277455 - DNA, 20 bp, Artificial
  CRISPR gRNA sequence
tctcgtggccccttgtcaaa

SEQ ID NO: 277456 - DNA, 20 bp, Artificial
  CRISPR gRNA sequence
ctcgtggccccttgtcaaag

SEQ ID NO: 277457 - DNA, 20 bp, Artificial
  CRISPR gRNA sequence
cttccctgactctccttgaa

SEQ ID NO: 277458 - DNA, 20 bp, Artificial
  CRISPR gRNA sequence
ccctccatcctgctactctt

SEQ ID NO: 277459 - DNA, 20 bp, Artificial
  CRISPR gRNA sequence
ttgcctgatttgtttctctt

SEQ ID NO: 277460 - DNA, 20 bp, Artificial
  CRISPR gRNA sequence
tgcctgatttgtttctcttc

SEQ ID NO: 277461 - DNA, 20 bp, Artificial
  CRISPR gRNA sequence
tttctcttcaggcttgtctc

SEQ ID NO: 277462 - DNA, 20 bp, Artificial
  CRISPR gRNA sequence
acaactgtgatgtatattta

SEQ ID NO: 277463 - DNA, 20 bp, Artificial
  CRISPR gRNA sequence
caactgtgatgtatatttac

SEQ ID NO: 277464 - DNA, 20 bp, Artificial
  CRISPR gRNA sequence
atgtgatacataattacgta

SEQ ID NO: 277465 - DNA, 20 bp, Artificial
  CRISPR gRNA sequence
gtgatacataattacgtatg

SEQ ID NO: 277466 - DNA, 20 bp, Artificial
  CRISPR gRNA sequence
cataattacgtatggagcta

SEQ ID NO: 277467 - DNA, 20 bp, Artificial
  CRISPR gRNA sequence
taattacgtatggagctatg

SEQ ID NO: 277468 - DNA, 20 bp, Artificial
  CRISPR gRNA sequence
ttacgtatggagctatggag

SEQ ID NO: 277469 - DNA, 20 bp, Artificial
  CRISPR gRNA sequence
acgtatggagctatggagca

SEQ ID NO: 277470 - DNA, 20 bp, Artificial
  CRISPR gRNA sequence
cgtatggagctatggagcag

SEQ ID NO: 277471 - DNA, 20 bp, Artificial
  CRISPR gRNA sequence
tttgttcactgccatatctg

SEQ ID NO: 277472 - DNA, 20 bp, Artificial
  CRISPR gRNA sequence
actgccatatctgcagtgtc

SEQ ID NO: 277473 - DNA, 20 bp, Artificial
  CRISPR gRNA sequence
catatctgcagtgtctagaa

SEQ ID NO: 277474 - DNA, 20 bp, Artificial
  CRISPR gRNA sequence
atatctgcagtgtctagaac

SEQ ID NO: 277475 - DNA, 20 bp, Artificial
  CRISPR gRNA sequence
tatctgcagtgtctagaaca

SEQ ID NO: 277476 - DNA, 20 bp, Artificial
  CRISPR gRNA sequence
gcagtgtctagaacagggcc

SEQ ID NO: 277477 - DNA, 20 bp, Artificial
  CRISPR gRNA sequence
ctagaacagggcctggccca

SEQ ID NO: 277478 - DNA, 20 bp, Artificial
  CRISPR gRNA sequence
gaacagggcctggcccatag

SEQ ID NO: 277479 - DNA, 20 bp, Artificial
  CRISPR gRNA sequence
aacagggcctggcccatagt

SEQ ID NO: 277480 - DNA, 20 bp, Artificial
  CRISPR gRNA sequence
cctggcccatagtaggtgct

SEQ ID NO: 277481 - DNA, 20 bp, Artificial
  CRISPR gRNA sequence
atacttgctgaatgcatgtc

SEQ ID NO: 277482 - DNA, 20 bp, Artificial
  CRISPR gRNA sequence
tacttgctgaatgcatgtct

SEQ ID NO: 277483 - DNA, 20 bp, Artificial
  CRISPR gRNA sequence
ctgaatgcatgtctaggcat

SEQ ID NO: 277484 - DNA, 20 bp, Artificial
  CRISPR gRNA sequence
tgaatgcatgtctaggcatg

SEQ ID NO: 277485 - DNA, 20 bp, Artificial
  CRISPR gRNA sequence
atgtctaggcatgaggaaat

SEQ ID NO: 277486 - DNA, 20 bp, Artificial
  CRISPR gRNA sequence
tgtctaggcatgaggaaatg

SEQ ID NO: 277487 - DNA, 20 bp, Artificial
  CRISPR gRNA sequence
aggcatgaggaaatgaggtc

SEQ ID NO: 277488 - DNA, 20 bp, Artificial
  CRISPR gRNA sequence
tggctccatccactgtgtat

SEQ ID NO: 277489 - DNA, 20 bp, Artificial
  CRISPR gRNA sequence
tgtattagaatcataacctt

SEQ ID NO: 277490 - DNA, 20 bp, Artificial
  CRISPR gRNA sequence
ttagaatcataaccttgagc

SEQ ID NO: 277491 - DNA, 20 bp, Artificial
  CRISPR gRNA sequence
aatcataaccttgagcaagc

SEQ ID NO: 277492 - DNA, 20 bp, Artificial
  CRISPR gRNA sequence
atcataaccttgagcaagct

SEQ ID NO: 277493 - DNA, 20 bp, Artificial
  CRISPR gRNA sequence
agcaagctgggtaacctctc

SEQ ID NO: 277494 - DNA, 20 bp, Artificial
  CRISPR gRNA sequence
gcaagctgggtaacctctct

SEQ ID NO: 277495 - DNA, 20 bp, Artificial
  CRISPR gRNA sequence
tgggtaacctctctgggctt

SEQ ID NO: 277496 - DNA, 20 bp, Artificial
  CRISPR gRNA sequence
gggtaacctctctgggcttc

SEQ ID NO: 277497 - DNA, 20 bp, Artificial
  CRISPR gRNA sequence
caggttccatctctgtaaaa

SEQ ID NO: 277498 - DNA, 20 bp, Artificial
  CRISPR gRNA sequence
tgatttgaatgtgtccccta

SEQ ID NO: 277499 - DNA, 20 bp, Artificial
  CRISPR gRNA sequence
gatttgaatgtgtcccctaa

SEQ ID NO: 277500 - DNA, 20 bp, Artificial
  CRISPR gRNA sequence
gtcccctaaaggttttgtgt

SEQ ID NO: 277501 - DNA, 20 bp, Artificial
  CRISPR gRNA sequence
ttgtgttggaaatttaattc

SEQ ID NO: 277502 - DNA, 20 bp, Artificial
  CRISPR gRNA sequence
tgtgttggaaatttaattcc

SEQ ID NO: 277503 - DNA, 20 bp, Artificial
  CRISPR gRNA sequence
aaatttaattccgggtgcaa

SEQ ID NO: 277504 - DNA, 20 bp, Artificial
  CRISPR gRNA sequence
attccgggtgcaacagtgtt

SEQ ID NO: 277505 - DNA, 20 bp, Artificial
  CRISPR gRNA sequence
ggtgcaacagtgttgagaat

SEQ ID NO: 277506 - DNA, 20 bp, Artificial
  CRISPR gRNA sequence
gtgcaacagtgttgagaatt

SEQ ID NO: 277507 - DNA, 20 bp, Artificial
  CRISPR gRNA sequence
ttgagaattgggactgttaa

SEQ ID NO: 277508 - DNA, 20 bp, Artificial
  CRISPR gRNA sequence
tgagaattgggactgttaaa

SEQ ID NO: 277509 - DNA, 20 bp, Artificial
  CRISPR gRNA sequence
tgggactgttaaaaggtgat

SEQ ID NO: 277510 - DNA, 20 bp, Artificial
  CRISPR gRNA sequence
gggactgttaaaaggtgatt

SEQ ID NO: 277511 - DNA, 20 bp, Artificial
  CRISPR gRNA sequence
gttaaaaggtgattaggtca

SEQ ID NO: 277512 - DNA, 20 bp, Artificial
  CRISPR gRNA sequence
taaaaggtgattaggtcatg

SEQ ID NO: 277513 - DNA, 20 bp, Artificial
  CRISPR gRNA sequence
tcatggagactctgccatca

SEQ ID NO: 277514 - DNA, 20 bp, Artificial
  CRISPR gRNA sequence
ggagactctgccatcatgga

SEQ ID NO: 277515 - DNA, 20 bp, Artificial
  CRISPR gRNA sequence
atggattaatgccatttttt

SEQ ID NO: 277516 - DNA, 20 bp, Artificial
  CRISPR gRNA sequence
tggattaatgccattttttt

SEQ ID NO: 277517 - DNA, 20 bp, Artificial
  CRISPR gRNA sequence
gattaatgccatttttttgg

SEQ ID NO: 277518 - DNA, 20 bp, Artificial
  CRISPR gRNA sequence
taatgccatttttttgggag

SEQ ID NO: 277519 - DNA, 20 bp, Artificial
  CRISPR gRNA sequence
aatgccatttttttgggagt

SEQ ID NO: 277520 - DNA, 20 bp, Artificial
  CRISPR gRNA sequence
ttttgggagtgggttcacta

SEQ ID NO: 277521 - DNA, 20 bp, Artificial
  CRISPR gRNA sequence
tgggagtgggttcactacag

SEQ ID NO: 277522 - DNA, 20 bp, Artificial
  CRISPR gRNA sequence
gggagtgggttcactacagc

SEQ ID NO: 277523 - DNA, 20 bp, Artificial
  CRISPR gRNA sequence
gagtgggttcactacagcag

SEQ ID NO: 277524 - DNA, 20 bp, Artificial
  CRISPR gRNA sequence
tgggttcactacagcaggag

SEQ ID NO: 277525 - DNA, 20 bp, Artificial
  CRISPR gRNA sequence
gcaggagtggcttccttata

SEQ ID NO: 277526 - DNA, 20 bp, Artificial
  CRISPR gRNA sequence
caggagtggcttccttataa

SEQ ID NO: 277527 - DNA, 20 bp, Artificial
  CRISPR gRNA sequence
agtggcttccttataaagga

SEQ ID NO: 277528 - DNA, 20 bp, Artificial
  CRISPR gRNA sequence
ttccttataaaggatggttt

SEQ ID NO: 277529 - DNA, 20 bp, Artificial
  CRISPR gRNA sequence
gcctccttcctactctgcct

SEQ ID NO: 277530 - DNA, 20 bp, Artificial
  CRISPR gRNA sequence
cctccttcctactctgcctt

SEQ ID NO: 277531 - DNA, 20 bp, Artificial
  CRISPR gRNA sequence
tgcctttctatcctctgcca

SEQ ID NO: 277532 - DNA, 20 bp, Artificial
  CRISPR gRNA sequence
gcctttctatcctctgccat

SEQ ID NO: 277533 - DNA, 20 bp, Artificial
  CRISPR gRNA sequence
tcctctgccatgggatgatg

SEQ ID NO: 277534 - DNA, 20 bp, Artificial
  CRISPR gRNA sequence
ctgccatgggatgatgcagc

SEQ ID NO: 277535 - DNA, 20 bp, Artificial
  CRISPR gRNA sequence
ccatgggatgatgcagcaag

SEQ ID NO: 277536 - DNA, 20 bp, Artificial
  CRISPR gRNA sequence
catgggatgatgcagcaaga

SEQ ID NO: 277537 - DNA, 20 bp, Artificial
  CRISPR gRNA sequence
tgcagcaagaaggtcctcat

SEQ ID NO: 277538 - DNA, 20 bp, Artificial
  CRISPR gRNA sequence
agaaggtcctcatcagatgt

SEQ ID NO: 277539 - DNA, 20 bp, Artificial
  CRISPR gRNA sequence
agatgtgagccccttgacct

SEQ ID NO: 277540 - DNA, 20 bp, Artificial
  CRISPR gRNA sequence
ccccttgaccttggacttcc

SEQ ID NO: 277541 - DNA, 20 bp, Artificial
  CRISPR gRNA sequence
accttggacttcccagcctc

SEQ ID NO: 277542 - DNA, 20 bp, Artificial
  CRISPR gRNA sequence
ggacttcccagcctccagaa

SEQ ID NO: 277543 - DNA, 20 bp, Artificial
  CRISPR gRNA sequence
ttcccagcctccagaacagt

SEQ ID NO: 277544 - DNA, 20 bp, Artificial
  CRISPR gRNA sequence
ctttctaaattacccaatgt

SEQ ID NO: 277545 - DNA, 20 bp, Artificial
  CRISPR gRNA sequence
tttctaaattacccaatgtc

SEQ ID NO: 277546 - DNA, 20 bp, Artificial
  CRISPR gRNA sequence
caatgtcaggtattctgtta

SEQ ID NO: 277547 - DNA, 20 bp, Artificial
  CRISPR gRNA sequence
tgtcaggtattctgttatag

SEQ ID NO: 277548 - DNA, 20 bp, Artificial
  CRISPR gRNA sequence
tctgttatagcagcacaaac

SEQ ID NO: 277549 - DNA, 20 bp, Artificial
  CRISPR gRNA sequence
atagcagcacaaaccagacc

SEQ ID NO: 277550 - DNA, 20 bp, Artificial
  CRISPR gRNA sequence
cctgcttcacataattatca

SEQ ID NO: 277551 - DNA, 20 bp, Artificial
  CRISPR gRNA sequence
cataattatcacagcgatca

SEQ ID NO: 277552 - DNA, 20 bp, Artificial
  CRISPR gRNA sequence
ataattatcacagcgatcac

SEQ ID NO: 277553 - DNA, 20 bp, Artificial
  CRISPR gRNA sequence
tcacagcgatcacaggatac

SEQ ID NO: 277554 - DNA, 20 bp, Artificial
  CRISPR gRNA sequence
atcacaggataccagatgta

SEQ ID NO: 277555 - DNA, 20 bp, Artificial
  CRISPR gRNA sequence
gtaaagtgctttcttaactt

SEQ ID NO: 277556 - DNA, 20 bp, Artificial
  CRISPR gRNA sequence
cttaactttagaatgctcta

SEQ ID NO: 277557 - DNA, 20 bp, Artificial
  CRISPR gRNA sequence
aatgctctacagattttaaa

SEQ ID NO: 277558 - DNA, 20 bp, Artificial
  CRISPR gRNA sequence
atgctctacagattttaaat

SEQ ID NO: 277559 - DNA, 20 bp, Artificial
  CRISPR gRNA sequence
tgctctacagattttaaatg

SEQ ID NO: 277560 - DNA, 20 bp, Artificial
  CRISPR gRNA sequence
ctgttctttctcatgcacaa

SEQ ID NO: 277561 - DNA, 20 bp, Artificial
  CRISPR gRNA sequence
tttgctgaaccacaccccca

SEQ ID NO: 277562 - DNA, 20 bp, Artificial
  CRISPR gRNA sequence
ttgctgaaccacacccccat

SEQ ID NO: 277563 - DNA, 20 bp, Artificial
  CRISPR gRNA sequence
gaaccacacccccataggac

SEQ ID NO: 277564 - DNA, 20 bp, Artificial
  CRISPR gRNA sequence
ccataggaccagcatcacca

SEQ ID NO: 277565 - DNA, 20 bp, Artificial
  CRISPR gRNA sequence
accagcatcaccatggtaac

SEQ ID NO: 277566 - DNA, 20 bp, Artificial
  CRISPR gRNA sequence
aactggctgattcttgaact

SEQ ID NO: 277567 - DNA, 20 bp, Artificial
  CRISPR gRNA sequence
gctgattcttgaactgagtt

SEQ ID NO: 277568 - DNA, 20 bp, Artificial
  CRISPR gRNA sequence
tgaactgagttcagtgccca

SEQ ID NO: 277569 - DNA, 20 bp, Artificial
  CRISPR gRNA sequence
ctgagttcagtgcccatagc

SEQ ID NO: 277570 - DNA, 20 bp, Artificial
  CRISPR gRNA sequence
ttcagtgcccatagctggca

SEQ ID NO: 277571 - DNA, 20 bp, Artificial
  CRISPR gRNA sequence
tcagtgcccatagctggcat

SEQ ID NO: 277572 - DNA, 20 bp, Artificial
  CRISPR gRNA sequence
cagtgcccatagctggcatg

SEQ ID NO: 277573 - DNA, 20 bp, Artificial
  CRISPR gRNA sequence
gtgcccatagctggcatggg

SEQ ID NO: 277574 - DNA, 20 bp, Artificial
  CRISPR gRNA sequence
gcccctcctgcacctctacc

SEQ ID NO: 277575 - DNA, 20 bp, Artificial
  CRISPR gRNA sequence
cctcctgcacctctacccag

SEQ ID NO: 277576 - DNA, 20 bp, Artificial
  CRISPR gRNA sequence
cctgcacctctacccagcag

SEQ ID NO: 277577 - DNA, 20 bp, Artificial
  CRISPR gRNA sequence
cacctctacccagcagcagt

SEQ ID NO: 277578 - DNA, 20 bp, Artificial
  CRISPR gRNA sequence
tctacccagcagcagtcaga

SEQ ID NO: 277579 - DNA, 20 bp, Artificial
  CRISPR gRNA sequence
ctacccagcagcagtcagaa

SEQ ID NO: 277580 - DNA, 20 bp, Artificial
  CRISPR gRNA sequence
tacccagcagcagtcagaaa

SEQ ID NO: 277581 - DNA, 20 bp, Artificial
  CRISPR gRNA sequence
cagcagcagtcagaaagggc

SEQ ID NO: 277582 - DNA, 20 bp, Artificial
  CRISPR gRNA sequence
gcagcagtcagaaagggcca

SEQ ID NO: 277583 - DNA, 20 bp, Artificial
  CRISPR gRNA sequence
cagcagtcagaaagggccag

SEQ ID NO: 277584 - DNA, 20 bp, Artificial
  CRISPR gRNA sequence
gaaagggccagaggctgtga

SEQ ID NO: 277585 - DNA, 20 bp, Artificial
  CRISPR gRNA sequence
aaagggccagaggctgtgaa

SEQ ID NO: 277586 - DNA, 20 bp, Artificial
  CRISPR gRNA sequence
agggccagaggctgtgaaag

SEQ ID NO: 277587 - DNA, 20 bp, Artificial
  CRISPR gRNA sequence
gggccagaggctgtgaaagg

SEQ ID NO: 277588 - DNA, 20 bp, Artificial
  CRISPR gRNA sequence
ccagaggctgtgaaaggagg

SEQ ID NO: 277589 - DNA, 20 bp, Artificial
  CRISPR gRNA sequence
agaggctgtgaaaggaggcg

SEQ ID NO: 277590 - DNA, 20 bp, Artificial
  CRISPR gRNA sequence
aggctgtgaaaggaggcgga

SEQ ID NO: 277591 - DNA, 20 bp, Artificial
  CRISPR gRNA sequence
ctgtgaaaggaggcggagag

SEQ ID NO: 277592 - DNA, 20 bp, Artificial
  CRISPR gRNA sequence
tgtgaaaggaggcggagaga

SEQ ID NO: 277593 - DNA, 20 bp, Artificial
  CRISPR gRNA sequence
gaaaggaggcggagagaagg

SEQ ID NO: 277594 - DNA, 20 bp, Artificial
  CRISPR gRNA sequence
aaggaggcggagagaaggca

SEQ ID NO: 277595 - DNA, 20 bp, Artificial
  CRISPR gRNA sequence
aggcggagagaaggcagaga

SEQ ID NO: 277596 - DNA, 20 bp, Artificial
  CRISPR gRNA sequence
ggagagaaggcagagatgga

SEQ ID NO: 277597 - DNA, 20 bp, Artificial
  CRISPR gRNA sequence
cggcaacgctgctcgccttc

SEQ ID NO: 277598 - DNA, 20 bp, Artificial
  CRISPR gRNA sequence
ctcgccttctggcgaatgca

SEQ ID NO: 277599 - DNA, 20 bp, Artificial
  CRISPR gRNA sequence
gcatggaaactgcccacctg

SEQ ID NO: 277600 - DNA, 20 bp, Artificial
  CRISPR gRNA sequence
catggaaactgcccacctgt

SEQ ID NO: 277601 - DNA, 20 bp, Artificial
  CRISPR gRNA sequence
atggaaactgcccacctgta

SEQ ID NO: 277602 - DNA, 20 bp, Artificial
  CRISPR gRNA sequence
tgcccacctgtagggcacaa

SEQ ID NO: 277603 - DNA, 20 bp, Artificial
  CRISPR gRNA sequence
gcccacctgtagggcacaat

SEQ ID NO: 277604 - DNA, 20 bp, Artificial
  CRISPR gRNA sequence
cccacctgtagggcacaata

SEQ ID NO: 277605 - DNA, 20 bp, Artificial
  CRISPR gRNA sequence
atagggacactcaacactgc

SEQ ID NO: 277606 - DNA, 20 bp, Artificial
  CRISPR gRNA sequence
acactcaacactgctggcct

SEQ ID NO: 277607 - DNA, 20 bp, Artificial
  CRISPR gRNA sequence
ctctgcctctcctgacccct

SEQ ID NO: 277608 - DNA, 20 bp, Artificial
  CRISPR gRNA sequence
tgctctgaccacttcaactc

SEQ ID NO: 277609 - DNA, 20 bp, Artificial
  CRISPR gRNA sequence
ccacttcaactctggactgc

SEQ ID NO: 277610 - DNA, 20 bp, Artificial
  CRISPR gRNA sequence
actctggactgctagccaca

SEQ ID NO: 277611 - DNA, 20 bp, Artificial
  CRISPR gRNA sequence
ctctggactgctagccacac

SEQ ID NO: 277612 - DNA, 20 bp, Artificial
  CRISPR gRNA sequence
ctggactgctagccacacag

SEQ ID NO: 277613 - DNA, 20 bp, Artificial
  CRISPR gRNA sequence
ggactgctagccacacagga

SEQ ID NO: 277614 - DNA, 20 bp, Artificial
  CRISPR gRNA sequence
gactgctagccacacaggag

SEQ ID NO: 277615 - DNA, 20 bp, Artificial
  CRISPR gRNA sequence
tgctagccacacaggagagg

SEQ ID NO: 277616 - DNA, 20 bp, Artificial
  CRISPR gRNA sequence
agaggaagctatttgccaac

SEQ ID NO: 277617 - DNA, 20 bp, Artificial
  CRISPR gRNA sequence
aggaagctatttgccaacaa

SEQ ID NO: 277618 - DNA, 20 bp, Artificial
  CRISPR gRNA sequence
aagctatttgccaacaagag

SEQ ID NO: 277619 - DNA, 20 bp, Artificial
  CRISPR gRNA sequence
gctatttgccaacaagagta

SEQ ID NO: 277620 - DNA, 20 bp, Artificial
  CRISPR gRNA sequence
tgccaacaagagtagagacc

SEQ ID NO: 277621 - DNA, 20 bp, Artificial
  CRISPR gRNA sequence
agagtagagaccaagaattt

SEQ ID NO: 277622 - DNA, 20 bp, Artificial
  CRISPR gRNA sequence
caagaattttagacaaataa

SEQ ID NO: 277623 - DNA, 20 bp, Artificial
  CRISPR gRNA sequence
tagacaaataatggacctct

SEQ ID NO: 277624 - DNA, 20 bp, Artificial
  CRISPR gRNA sequence
caaataatggacctctcggc

SEQ ID NO: 277625 - DNA, 20 bp, Artificial
  CRISPR gRNA sequence
aaataatggacctctcggcc

SEQ ID NO: 277626 - DNA, 20 bp, Artificial
  CRISPR gRNA sequence
atggacctctcggccgggcg

SEQ ID NO: 277627 - DNA, 20 bp, Artificial
  CRISPR gRNA sequence
gacctctcggccgggcgtgg

SEQ ID NO: 277628 - DNA, 20 bp, Artificial
  CRISPR gRNA sequence
gtggctcacgcctgtaatcc

SEQ ID NO: 277629 - DNA, 20 bp, Artificial
  CRISPR gRNA sequence
cgcctgtaatcccagcactt

SEQ ID NO: 277630 - DNA, 20 bp, Artificial
  CRISPR gRNA sequence
gcctgtaatcccagcacttt

SEQ ID NO: 277631 - DNA, 20 bp, Artificial
  CRISPR gRNA sequence
ctgtaatcccagcactttgg

SEQ ID NO: 277632 - DNA, 20 bp, Artificial
  CRISPR gRNA sequence
tgtaatcccagcactttggg

SEQ ID NO: 277633 - DNA, 20 bp, Artificial
  CRISPR gRNA sequence
tcccagcactttgggaggcc

SEQ ID NO: 277634 - DNA, 20 bp, Artificial
  CRISPR gRNA sequence
cccagcactttgggaggccg

SEQ ID NO: 277635 - DNA, 20 bp, Artificial
  CRISPR gRNA sequence
agcactttgggaggccgagg

SEQ ID NO: 277636 - DNA, 20 bp, Artificial
  CRISPR gRNA sequence
gcactttgggaggccgaggc

SEQ ID NO: 277637 - DNA, 20 bp, Artificial
  CRISPR gRNA sequence
ctttgggaggccgaggcagg

SEQ ID NO: 277638 - DNA, 20 bp, Artificial
  CRISPR gRNA sequence
ggaggccgaggcaggcggat

SEQ ID NO: 277639 - DNA, 20 bp, Artificial
  CRISPR gRNA sequence
gaggccgaggcaggcggatc

SEQ ID NO: 277640 - DNA, 20 bp, Artificial
  CRISPR gRNA sequence
ggccgaggcaggcggatcag

SEQ ID NO: 277641 - DNA, 20 bp, Artificial
  CRISPR gRNA sequence
gcaggcggatcaggagctcg

SEQ ID NO: 277642 - DNA, 20 bp, Artificial
  CRISPR gRNA sequence
caggagctcgaagatcatcc

SEQ ID NO: 277643 - DNA, 20 bp, Artificial
  CRISPR gRNA sequence
gaagatcatcctggctaata

SEQ ID NO: 277644 - DNA, 20 bp, Artificial
  CRISPR gRNA sequence
aaaatacaaaaaaaataaat

SEQ ID NO: 277645 - DNA, 20 bp, Artificial
  CRISPR gRNA sequence
tacaaaaaaaataaattagc

SEQ ID NO: 277646 - DNA, 20 bp, Artificial
  CRISPR gRNA sequence
acaaaaaaaataaattagcc

SEQ ID NO: 277647 - DNA, 20 bp, Artificial
  CRISPR gRNA sequence
aaaaataaattagccaggcg

SEQ ID NO: 277648 - DNA, 20 bp, Artificial
  CRISPR gRNA sequence
aataaattagccaggcgtgg

SEQ ID NO: 277649 - DNA, 20 bp, Artificial
  CRISPR gRNA sequence
aaattagccaggcgtggtgg

SEQ ID NO: 277650 - DNA, 20 bp, Artificial
  CRISPR gRNA sequence
aattagccaggcgtggtggc

SEQ ID NO: 277651 - DNA, 20 bp, Artificial
  CRISPR gRNA sequence
gtggcgggctgatttttgtg

SEQ ID NO: 277652 - DNA, 20 bp, Artificial
  CRISPR gRNA sequence
ggcgggctgatttttgtgtg

SEQ ID NO: 277653 - DNA, 20 bp, Artificial
  CRISPR gRNA sequence
gcgggctgatttttgtgtgg

SEQ ID NO: 277654 - DNA, 20 bp, Artificial
  CRISPR gRNA sequence
tttgtgtggaggacttttac

SEQ ID NO: 277655 - DNA, 20 bp, Artificial
  CRISPR gRNA sequence
tggaggacttttacgagctg

SEQ ID NO: 277656 - DNA, 20 bp, Artificial
  CRISPR gRNA sequence
acttttacgagctgtagtcc

SEQ ID NO: 277657 - DNA, 20 bp, Artificial
  CRISPR gRNA sequence
gagctgtagtcccagctact

SEQ ID NO: 277658 - DNA, 20 bp, Artificial
  CRISPR gRNA sequence
agctgtagtcccagctactc

SEQ ID NO: 277659 - DNA, 20 bp, Artificial
  CRISPR gRNA sequence
ctgtagtcccagctactcgg

SEQ ID NO: 277660 - DNA, 20 bp, Artificial
  CRISPR gRNA sequence
tgtagtcccagctactcggg

SEQ ID NO: 277661 - DNA, 20 bp, Artificial
  CRISPR gRNA sequence
tcccagctactcgggaggct

SEQ ID NO: 277662 - DNA, 20 bp, Artificial
  CRISPR gRNA sequence
cccagctactcgggaggctg

SEQ ID NO: 277663 - DNA, 20 bp, Artificial
  CRISPR gRNA sequence
agctactcgggaggctgagg

SEQ ID NO: 277664 - DNA, 20 bp, Artificial
  CRISPR gRNA sequence
gctactcgggaggctgaggc

SEQ ID NO: 277665 - DNA, 20 bp, Artificial
  CRISPR gRNA sequence
tactcgggaggctgaggcag

SEQ ID NO: 277666 - DNA, 20 bp, Artificial
  CRISPR gRNA sequence
gggaggctgaggcaggagaa

SEQ ID NO: 277667 - DNA, 20 bp, Artificial
  CRISPR gRNA sequence
tgaggcaggagaatggcgtg

SEQ ID NO: 277668 - DNA, 20 bp, Artificial
  CRISPR gRNA sequence
gcaggagaatggcgtgaagc

SEQ ID NO: 277669 - DNA, 20 bp, Artificial
  CRISPR gRNA sequence
caggagaatggcgtgaagcc

SEQ ID NO: 277670 - DNA, 20 bp, Artificial
  CRISPR gRNA sequence
ggagaatggcgtgaagccgg

SEQ ID NO: 277671 - DNA, 20 bp, Artificial
  CRISPR gRNA sequence
gagaatggcgtgaagccggg

SEQ ID NO: 277672 - DNA, 20 bp, Artificial
  CRISPR gRNA sequence
aatggcgtgaagccgggagg

SEQ ID NO: 277673 - DNA, 20 bp, Artificial
  CRISPR gRNA sequence
tggcgtgaagccgggaggcg

SEQ ID NO: 277674 - DNA, 20 bp, Artificial
  CRISPR gRNA sequence
cgggaggcggagcttgctgt

SEQ ID NO: 277675 - DNA, 20 bp, Artificial
  CRISPR gRNA sequence
aggcggagcttgctgtgagc

SEQ ID NO: 277676 - DNA, 20 bp, Artificial
  CRISPR gRNA sequence
gcggagcttgctgtgagcca

SEQ ID NO: 277677 - DNA, 20 bp, Artificial
  CRISPR gRNA sequence
gagattgtgccactgcactc

SEQ ID NO: 277678 - DNA, 20 bp, Artificial
  CRISPR gRNA sequence
tgtgccactgcactccagct

SEQ ID NO: 277679 - DNA, 20 bp, Artificial
  CRISPR gRNA sequence
gtgccactgcactccagctt

SEQ ID NO: 277680 - DNA, 20 bp, Artificial
  CRISPR gRNA sequence
ctgcactccagcttgggcga

SEQ ID NO: 277681 - DNA, 20 bp, Artificial
  CRISPR gRNA sequence
gcactccagcttgggcgaca

SEQ ID NO: 277682 - DNA, 20 bp, Artificial
  CRISPR gRNA sequence
tccagcttgggcgacagagc

SEQ ID NO: 277683 - DNA, 20 bp, Artificial
  CRISPR gRNA sequence
aaaaaaaaaaaaaaaaaaaa

SEQ ID NO: 277684 - DNA, 20 bp, Artificial
  CRISPR gRNA sequence
aaaaaaaaaaaaaaaaaaaa

SEQ ID NO: 277685 - DNA, 20 bp, Artificial
  CRISPR gRNA sequence
aaaaaaaaaaaggacctctc

SEQ ID NO: 277686 - DNA, 20 bp, Artificial
  CRISPR gRNA sequence
aaaaaaaaaaggacctctca

SEQ ID NO: 277687 - DNA, 20 bp, Artificial
  CRISPR gRNA sequence
aaaaaaaaaggacctctcaa

SEQ ID NO: 277688 - DNA, 20 bp, Artificial
  CRISPR gRNA sequence
gacctctcaagggctcaatc

SEQ ID NO: 277689 - DNA, 20 bp, Artificial
  CRISPR gRNA sequence
acctctcaagggctcaatct

SEQ ID NO: 277690 - DNA, 20 bp, Artificial
  CRISPR gRNA sequence
ctcaagggctcaatctaggc

SEQ ID NO: 277691 - DNA, 20 bp, Artificial
  CRISPR gRNA sequence
tcaagggctcaatctaggcc

SEQ ID NO: 277692 - DNA, 20 bp, Artificial
  CRISPR gRNA sequence
aggccaggcacccgtaatcc

SEQ ID NO: 277693 - DNA, 20 bp, Artificial
  CRISPR gRNA sequence
cacccgtaatcccagcactt

SEQ ID NO: 277694 - DNA, 20 bp, Artificial
  CRISPR gRNA sequence
acccgtaatcccagcacttt

SEQ ID NO: 277695 - DNA, 20 bp, Artificial
  CRISPR gRNA sequence
ccgtaatcccagcactttgg

SEQ ID NO: 277696 - DNA, 20 bp, Artificial
  CRISPR gRNA sequence
aatcccagcactttgggagc

SEQ ID NO: 277697 - DNA, 20 bp, Artificial
  CRISPR gRNA sequence
cagcactttgggagctggcc

SEQ ID NO: 277698 - DNA, 20 bp, Artificial
  CRISPR gRNA sequence
agcactttgggagctggcca

SEQ ID NO: 277699 - DNA, 20 bp, Artificial
  CRISPR gRNA sequence
actttgggagctggccaagg

SEQ ID NO: 277700 - DNA, 20 bp, Artificial
  CRISPR gRNA sequence
ctttgggagctggccaaggc

SEQ ID NO: 277701 - DNA, 20 bp, Artificial
  CRISPR gRNA sequence
tgggagctggccaaggcggg

SEQ ID NO: 277702 - DNA, 20 bp, Artificial
  CRISPR gRNA sequence
ccaaggcgggtggattgctt

SEQ ID NO: 277703 - DNA, 20 bp, Artificial
  CRISPR gRNA sequence
gcgggtggattgcttgagcc

SEQ ID NO: 277704 - DNA, 20 bp, Artificial
  CRISPR gRNA sequence
cgggtggattgcttgagccc

SEQ ID NO: 277705 - DNA, 20 bp, Artificial
  CRISPR gRNA sequence
ttgcttgagcccaggaaatc

SEQ ID NO: 277706 - DNA, 20 bp, Artificial
  CRISPR gRNA sequence
tgagcccaggaaatcgagac

SEQ ID NO: 277707 - DNA, 20 bp, Artificial
  CRISPR gRNA sequence
ccaggaaatcgagaccagcc

SEQ ID NO: 277708 - DNA, 20 bp, Artificial
  CRISPR gRNA sequence
caggaaatcgagaccagcct

SEQ ID NO: 277709 - DNA, 20 bp, Artificial
  CRISPR gRNA sequence
cgagaccagcctaggcaaca

SEQ ID NO: 277710 - DNA, 20 bp, Artificial
  CRISPR gRNA sequence
aaaaaccccatcgctacaaa

SEQ ID NO: 277711 - DNA, 20 bp, Artificial
  CRISPR gRNA sequence
atcgctacaaaaagaaaaaa

SEQ ID NO: 277712 - DNA, 20 bp, Artificial
  CRISPR gRNA sequence
aaatagatctcaatctacaa

SEQ ID NO: 277713 - DNA, 20 bp, Artificial
  CRISPR gRNA sequence
tctacaacagaatattattt

SEQ ID NO: 277714 - DNA, 20 bp, Artificial
  CRISPR gRNA sequence
tattatttcagaatattatt

SEQ ID NO: 277715 - DNA, 20 bp, Artificial
  CRISPR gRNA sequence
agaatattatttggccgtaa

SEQ ID NO: 277716 - DNA, 20 bp, Artificial
  CRISPR gRNA sequence
tatttggccgtaaaagcgaa

SEQ ID NO: 277717 - DNA, 20 bp, Artificial
  CRISPR gRNA sequence
tttggccgtaaaagcgaatg

SEQ ID NO: 277718 - DNA, 20 bp, Artificial
  CRISPR gRNA sequence
gtaaaagcgaatggagtact

SEQ ID NO: 277719 - DNA, 20 bp, Artificial
  CRISPR gRNA sequence
gtactaagacatacgcaaca

SEQ ID NO: 277720 - DNA, 20 bp, Artificial
  CRISPR gRNA sequence
cgcaacatggatgaacctga

SEQ ID NO: 277721 - DNA, 20 bp, Artificial
  CRISPR gRNA sequence
aacctgaaagacataatgct

SEQ ID NO: 277722 - DNA, 20 bp, Artificial
  CRISPR gRNA sequence
aaagacataatgctcagtga

SEQ ID NO: 277723 - DNA, 20 bp, Artificial
  CRISPR gRNA sequence
taatgctcagtgaaagaaaa

SEQ ID NO: 277724 - DNA, 20 bp, Artificial
  CRISPR gRNA sequence
cacgaaacgccacatattgt

SEQ ID NO: 277725 - DNA, 20 bp, Artificial
  CRISPR gRNA sequence
cacatattgtaagaaatgtc

SEQ ID NO: 277726 - DNA, 20 bp, Artificial
  CRISPR gRNA sequence
ccagaatattctttcttacc

SEQ ID NO: 277727 - DNA, 20 bp, Artificial
  CRISPR gRNA sequence
attctttcttacctggattc

SEQ ID NO: 277728 - DNA, 20 bp, Artificial
  CRISPR gRNA sequence
ttacctggattctggaaaaa

SEQ ID NO: 277729 - DNA, 20 bp, Artificial
  CRISPR gRNA sequence
tacctggattctggaaaaaa

SEQ ID NO: 277730 - DNA, 20 bp, Artificial
  CRISPR gRNA sequence
ctggattctggaaaaaaagg

SEQ ID NO: 277731 - DNA, 20 bp, Artificial
  CRISPR gRNA sequence
ggattctggaaaaaaaggaa

SEQ ID NO: 277732 - DNA, 20 bp, Artificial
  CRISPR gRNA sequence
ctggaaaaaaaggaagagaa

SEQ ID NO: 277733 - DNA, 20 bp, Artificial
  CRISPR gRNA sequence
aggaagagaaaagaaatgtc

SEQ ID NO: 277734 - DNA, 20 bp, Artificial
  CRISPR gRNA sequence
gagaaaagaaatgtctagaa

SEQ ID NO: 277735 - DNA, 20 bp, Artificial
  CRISPR gRNA sequence
agaaaagaaatgtctagaac

SEQ ID NO: 277736 - DNA, 20 bp, Artificial
  CRISPR gRNA sequence
gtctagaacaggcaaattca

SEQ ID NO: 277737 - DNA, 20 bp, Artificial
  CRISPR gRNA sequence
ctagaacaggcaaattcata

SEQ ID NO: 277738 - DNA, 20 bp, Artificial
  CRISPR gRNA sequence
aacaggcaaattcatagaga

SEQ ID NO: 277739 - DNA, 20 bp, Artificial
  CRISPR gRNA sequence
caggcaaattcatagagaca

SEQ ID NO: 277740 - DNA, 20 bp, Artificial
  CRISPR gRNA sequence
ggcaaattcatagagacaga

SEQ ID NO: 277741 - DNA, 20 bp, Artificial
  CRISPR gRNA sequence
catagagacagagagtaaat

SEQ ID NO: 277742 - DNA, 20 bp, Artificial
  CRISPR gRNA sequence
agagacagagagtaaattag

SEQ ID NO: 277743 - DNA, 20 bp, Artificial
  CRISPR gRNA sequence
gagagtaaattagtggttac

SEQ ID NO: 277744 - DNA, 20 bp, Artificial
  CRISPR gRNA sequence
agagtaaattagtggttacg

SEQ ID NO: 277745 - DNA, 20 bp, Artificial
  CRISPR gRNA sequence
agtaaattagtggttacgag

SEQ ID NO: 277746 - DNA, 20 bp, Artificial
  CRISPR gRNA sequence
aattagtggttacgaggaga

SEQ ID NO: 277747 - DNA, 20 bp, Artificial
  CRISPR gRNA sequence
attagtggttacgaggagat

SEQ ID NO: 277748 - DNA, 20 bp, Artificial
  CRISPR gRNA sequence
ttagtggttacgaggagatg

SEQ ID NO: 277749 - DNA, 20 bp, Artificial
  CRISPR gRNA sequence
ggttacgaggagatggggta

SEQ ID NO: 277750 - DNA, 20 bp, Artificial
  CRISPR gRNA sequence
gttacgaggagatggggtac

SEQ ID NO: 277751 - DNA, 20 bp, Artificial
  CRISPR gRNA sequence
ttacgaggagatggggtaca

SEQ ID NO: 277752 - DNA, 20 bp, Artificial
  CRISPR gRNA sequence
tacgaggagatggggtacag

SEQ ID NO: 277753 - DNA, 20 bp, Artificial
  CRISPR gRNA sequence
gagatggggtacaggggaat

SEQ ID NO: 277754 - DNA, 20 bp, Artificial
  CRISPR gRNA sequence
agatggggtacaggggaatg

SEQ ID NO: 277755 - DNA, 20 bp, Artificial
  CRISPR gRNA sequence
atggggtacaggggaatgag

SEQ ID NO: 277756 - DNA, 20 bp, Artificial
  CRISPR gRNA sequence
gggtacaggggaatgaggag

SEQ ID NO: 277757 - DNA, 20 bp, Artificial
  CRISPR gRNA sequence
gaatgaggagtagctgcaaa

SEQ ID NO: 277758 - DNA, 20 bp, Artificial
  CRISPR gRNA sequence
aatgaggagtagctgcaaat

SEQ ID NO: 277759 - DNA, 20 bp, Artificial
  CRISPR gRNA sequence
ggagtagctgcaaataggcg

SEQ ID NO: 277760 - DNA, 20 bp, Artificial
  CRISPR gRNA sequence
gagtagctgcaaataggcgc

SEQ ID NO: 277761 - DNA, 20 bp, Artificial
  CRISPR gRNA sequence
aataggcgcaggtttctttc

SEQ ID NO: 277762 - DNA, 20 bp, Artificial
  CRISPR gRNA sequence
ataggcgcaggtttctttct

SEQ ID NO: 277763 - DNA, 20 bp, Artificial
  CRISPR gRNA sequence
tgatgatttccatcatcatc

SEQ ID NO: 277764 - DNA, 20 bp, Artificial
  CRISPR gRNA sequence
tcatccagaacatttccttc

SEQ ID NO: 277765 - DNA, 20 bp, Artificial
  CRISPR gRNA sequence
catttccttctggaattcga

SEQ ID NO: 277766 - DNA, 20 bp, Artificial
  CRISPR gRNA sequence
cttctggaattcgatagtga

SEQ ID NO: 277767 - DNA, 20 bp, Artificial
  CRISPR gRNA sequence
ctggaattcgatagtgatgg

SEQ ID NO: 277768 - DNA, 20 bp, Artificial
  CRISPR gRNA sequence
tatttatttatttatttact

SEQ ID NO: 277769 - DNA, 20 bp, Artificial
  CRISPR gRNA sequence
atttatttatttatttactg

SEQ ID NO: 277770 - DNA, 20 bp, Artificial
  CRISPR gRNA sequence
tatttatttatttactgagg

SEQ ID NO: 277771 - DNA, 20 bp, Artificial
  CRISPR gRNA sequence
tttatttatttactgaggca

SEQ ID NO: 277772 - DNA, 20 bp, Artificial
  CRISPR gRNA sequence
tctcgctctgttgcccatgc

SEQ ID NO: 277773 - DNA, 20 bp, Artificial
  CRISPR gRNA sequence
tcgctctgttgcccatgctg

SEQ ID NO: 277774 - DNA, 20 bp, Artificial
  CRISPR gRNA sequence
ctgttgcccatgctggagtg

SEQ ID NO: 277775 - DNA, 20 bp, Artificial
  CRISPR gRNA sequence
ttgcccatgctggagtgcag

SEQ ID NO: 277776 - DNA, 20 bp, Artificial
  CRISPR gRNA sequence
ggagtgcagtggcatgatct

SEQ ID NO: 277777 - DNA, 20 bp, Artificial
  CRISPR gRNA sequence
agtggcatgatcttggctca

SEQ ID NO: 277778 - DNA, 20 bp, Artificial
  CRISPR gRNA sequence
ctcacagcaacccccgcctc

SEQ ID NO: 277779 - DNA, 20 bp, Artificial
  CRISPR gRNA sequence
tcacagcaacccccgcctcc

SEQ ID NO: 277780 - DNA, 20 bp, Artificial
  CRISPR gRNA sequence
cacagcaacccccgcctcca

SEQ ID NO: 277781 - DNA, 20 bp, Artificial
  CRISPR gRNA sequence
cccccgcctccagggttcaa

SEQ ID NO: 277782 - DNA, 20 bp, Artificial
  CRISPR gRNA sequence
ttcaaaagattctcctgcct

SEQ ID NO: 277783 - DNA, 20 bp, Artificial
  CRISPR gRNA sequence
ttctcctgcctcagcctcct

SEQ ID NO: 277784 - DNA, 20 bp, Artificial
  CRISPR gRNA sequence
tcctgcctcagcctcctgag

SEQ ID NO: 277785 - DNA, 20 bp, Artificial
  CRISPR gRNA sequence
gcctcagcctcctgagtagc

SEQ ID NO: 277786 - DNA, 20 bp, Artificial
  CRISPR gRNA sequence
cctcagcctcctgagtagct

SEQ ID NO: 277787 - DNA, 20 bp, Artificial
  CRISPR gRNA sequence
ctcctgagtagctaggatta

SEQ ID NO: 277788 - DNA, 20 bp, Artificial
  CRISPR gRNA sequence
tcctgagtagctaggattaa

SEQ ID NO: 277789 - DNA, 20 bp, Artificial
  CRISPR gRNA sequence
agtagctaggattaaaggca

SEQ ID NO: 277790 - DNA, 20 bp, Artificial
  CRISPR gRNA sequence
gtagctaggattaaaggcac

SEQ ID NO: 277791 - DNA, 20 bp, Artificial
  CRISPR gRNA sequence
aaggcacgggccaccttgtg

SEQ ID NO: 277792 - DNA, 20 bp, Artificial
  CRISPR gRNA sequence
gtggttaatttttgcatttt

SEQ ID NO: 277793 - DNA, 20 bp, Artificial
  CRISPR gRNA sequence
gttaatttttgcatttttag

SEQ ID NO: 277794 - DNA, 20 bp, Artificial
  CRISPR gRNA sequence
taatttttgcatttttagta

SEQ ID NO: 277795 - DNA, 20 bp, Artificial
  CRISPR gRNA sequence
ttttgcatttttagtagaga

SEQ ID NO: 277796 - DNA, 20 bp, Artificial
  CRISPR gRNA sequence
tttgcatttttagtagagac

SEQ ID NO: 277797 - DNA, 20 bp, Artificial
  CRISPR gRNA sequence
ttgcatttttagtagagaca

SEQ ID NO: 277798 - DNA, 20 bp, Artificial
  CRISPR gRNA sequence
gagacagggttttaccatgt

SEQ ID NO: 277799 - DNA, 20 bp, Artificial
  CRISPR gRNA sequence
cagggttttaccatgttggc

SEQ ID NO: 277800 - DNA, 20 bp, Artificial
  CRISPR gRNA sequence
agggttttaccatgttggcc

SEQ ID NO: 277801 - DNA, 20 bp, Artificial
  CRISPR gRNA sequence
ttttaccatgttggccaggc

SEQ ID NO: 277802 - DNA, 20 bp, Artificial
  CRISPR gRNA sequence
tggtctcaaactcctgacct

SEQ ID NO: 277803 - DNA, 20 bp, Artificial
  CRISPR gRNA sequence
ggtctcaaactcctgacctc

SEQ ID NO: 277804 - DNA, 20 bp, Artificial
  CRISPR gRNA sequence
ctcaggtgatccacccatct

SEQ ID NO: 277805 - DNA, 20 bp, Artificial
  CRISPR gRNA sequence
atctcggcctcccaaaatgc

SEQ ID NO: 277806 - DNA, 20 bp, Artificial
  CRISPR gRNA sequence
tctcggcctcccaaaatgct

SEQ ID NO: 277807 - DNA, 20 bp, Artificial
  CRISPR gRNA sequence
ctcccaaaatgctgggattg

SEQ ID NO: 277808 - DNA, 20 bp, Artificial
  CRISPR gRNA sequence
tcccaaaatgctgggattgc

SEQ ID NO: 277809 - DNA, 20 bp, Artificial
  CRISPR gRNA sequence
ccaaaatgctgggattgcag

SEQ ID NO: 277810 - DNA, 20 bp, Artificial
  CRISPR gRNA sequence
aatgctgggattgcaggagt

SEQ ID NO: 277811 - DNA, 20 bp, Artificial
  CRISPR gRNA sequence
caggagtgagccaccgtgcc

SEQ ID NO: 277812 - DNA, 20 bp, Artificial
  CRISPR gRNA sequence
gtcattgcaaataaaacatg

SEQ ID NO: 277813 - DNA, 20 bp, Artificial
  CRISPR gRNA sequence
tcattgcaaataaaacatga

SEQ ID NO: 277814 - DNA, 20 bp, Artificial
  CRISPR gRNA sequence
cattgcaaataaaacatgaa

SEQ ID NO: 277815 - DNA, 20 bp, Artificial
  CRISPR gRNA sequence
caaataaaacatgaagggaa

SEQ ID NO: 277816 - DNA, 20 bp, Artificial
  CRISPR gRNA sequence
ataaaacatgaagggaaaag

SEQ ID NO: 277817 - DNA, 20 bp, Artificial
  CRISPR gRNA sequence
gggaaaagaagaatccatac

SEQ ID NO: 277818 - DNA, 20 bp, Artificial
  CRISPR gRNA sequence
ggaaaagaagaatccatact

SEQ ID NO: 277819 - DNA, 20 bp, Artificial
  CRISPR gRNA sequence
aaagaagaatccatactagg

SEQ ID NO: 277820 - DNA, 20 bp, Artificial
  CRISPR gRNA sequence
aatccatactaggaagacct

SEQ ID NO: 277821 - DNA, 20 bp, Artificial
  CRISPR gRNA sequence
tcttccccaccctctccgtg

SEQ ID NO: 277822 - DNA, 20 bp, Artificial
  CRISPR gRNA sequence
cccaccctctccgtgcagcc

SEQ ID NO: 277823 - DNA, 20 bp, Artificial
  CRISPR gRNA sequence
caccctctccgtgcagcctg

SEQ ID NO: 277824 - DNA, 20 bp, Artificial
  CRISPR gRNA sequence
accctctccgtgcagcctgg

SEQ ID NO: 277825 - DNA, 20 bp, Artificial
  CRISPR gRNA sequence
ctccgtgcagcctggaggcc

SEQ ID NO: 277826 - DNA, 20 bp, Artificial
  CRISPR gRNA sequence
ccgtgcagcctggaggcctg

SEQ ID NO: 277827 - DNA, 20 bp, Artificial
  CRISPR gRNA sequence
cgtgcagcctggaggcctgg

SEQ ID NO: 277828 - DNA, 20 bp, Artificial
  CRISPR gRNA sequence
gcctggaggcctggaggatg

SEQ ID NO: 277829 - DNA, 20 bp, Artificial
  CRISPR gRNA sequence
tggaggcctggaggatgcag

SEQ ID NO: 277830 - DNA, 20 bp, Artificial
  CRISPR gRNA sequence
ggcctggaggatgcagtggc

SEQ ID NO: 277831 - DNA, 20 bp, Artificial
  CRISPR gRNA sequence
aggatgcagtggccagtctg

SEQ ID NO: 277832 - DNA, 20 bp, Artificial
  CRISPR gRNA sequence
ccagtctgcagtgcccctcc

SEQ ID NO: 277833 - DNA, 20 bp, Artificial
  CRISPR gRNA sequence
cagtctgcagtgcccctccc

SEQ ID NO: 277834 - DNA, 20 bp, Artificial
  CRISPR gRNA sequence
agtctgcagtgcccctccca

SEQ ID NO: 277835 - DNA, 20 bp, Artificial
  CRISPR gRNA sequence
tctgcagtgcccctcccagg

SEQ ID NO: 277836 - DNA, 20 bp, Artificial
  CRISPR gRNA sequence
cctcccagggagttcaacct

SEQ ID NO: 277837 - DNA, 20 bp, Artificial
  CRISPR gRNA sequence
cccagggagttcaacctcag

SEQ ID NO: 277838 - DNA, 20 bp, Artificial
  CRISPR gRNA sequence
agttcaacctcagcagccgt

SEQ ID NO: 277839 - DNA, 20 bp, Artificial
  CRISPR gRNA sequence
ttcaacctcagcagccgtta

SEQ ID NO: 277840 - DNA, 20 bp, Artificial
  CRISPR gRNA sequence
caacctcagcagccgttaga

SEQ ID NO: 277841 - DNA, 20 bp, Artificial
  CRISPR gRNA sequence
aacctcagcagccgttagag

SEQ ID NO: 277842 - DNA, 20 bp, Artificial
  CRISPR gRNA sequence
cgttagagaggctgccctcg

SEQ ID NO: 277843 - DNA, 20 bp, Artificial
  CRISPR gRNA sequence
gttagagaggctgccctcgc

SEQ ID NO: 277844 - DNA, 20 bp, Artificial
  CRISPR gRNA sequence
ttagagaggctgccctcgca

SEQ ID NO: 277845 - DNA, 20 bp, Artificial
  CRISPR gRNA sequence
tagagaggctgccctcgcag

SEQ ID NO: 277846 - DNA, 20 bp, Artificial
  CRISPR gRNA sequence
aggctgccctcgcaggggtc

SEQ ID NO: 277847 - DNA, 20 bp, Artificial
  CRISPR gRNA sequence
ggctgccctcgcaggggtct

SEQ ID NO: 277848 - DNA, 20 bp, Artificial
  CRISPR gRNA sequence
ctgccctcgcaggggtctgg

SEQ ID NO: 277849 - DNA, 20 bp, Artificial
  CRISPR gRNA sequence
gggagctgcatcaccactgc

SEQ ID NO: 277850 - DNA, 20 bp, Artificial
  CRISPR gRNA sequence
agctgcatcaccactgctag

SEQ ID NO: 277851 - DNA, 20 bp, Artificial
  CRISPR gRNA sequence
ctgcatcaccactgctagtg

SEQ ID NO: 277852 - DNA, 20 bp, Artificial
  CRISPR gRNA sequence
catcaccactgctagtggag

SEQ ID NO: 277853 - DNA, 20 bp, Artificial
  CRISPR gRNA sequence
atcaccactgctagtggaga

SEQ ID NO: 277854 - DNA, 20 bp, Artificial
  CRISPR gRNA sequence
tcaccactgctagtggagaa

SEQ ID NO: 277855 - DNA, 20 bp, Artificial
  CRISPR gRNA sequence
accactgctagtggagaagg

SEQ ID NO: 277856 - DNA, 20 bp, Artificial
  CRISPR gRNA sequence
cactgctagtggagaaggga

SEQ ID NO: 277857 - DNA, 20 bp, Artificial
  CRISPR gRNA sequence
tgctagtggagaagggagag

SEQ ID NO: 277858 - DNA, 20 bp, Artificial
  CRISPR gRNA sequence
tagtggagaagggagagaag

SEQ ID NO: 277859 - DNA, 20 bp, Artificial
  CRISPR gRNA sequence
tcttttaactcaccaaatga

SEQ ID NO: 277860 - DNA, 20 bp, Artificial
  CRISPR gRNA sequence
cttttaactcaccaaatgac

SEQ ID NO: 277861 - DNA, 20 bp, Artificial
  CRISPR gRNA sequence
cgggacatacatgatctccc

SEQ ID NO: 277862 - DNA, 20 bp, Artificial
  CRISPR gRNA sequence
catgatctccctggaaacac

SEQ ID NO: 277863 - DNA, 20 bp, Artificial
  CRISPR gRNA sequence
gactatgaaataaacattct

SEQ ID NO: 277864 - DNA, 20 bp, Artificial
  CRISPR gRNA sequence
atgaaataaacattcttaga

SEQ ID NO: 277865 - DNA, 20 bp, Artificial
  CRISPR gRNA sequence
ataaacattcttagaaagaa

SEQ ID NO: 277866 - DNA, 20 bp, Artificial
  CRISPR gRNA sequence
aacattcttagaaagaatgg

SEQ ID NO: 277867 - DNA, 20 bp, Artificial
  CRISPR gRNA sequence
cttagaaagaatggaagata

SEQ ID NO: 277868 - DNA, 20 bp, Artificial
  CRISPR gRNA sequence
aaagaatggaagatatagaa

SEQ ID NO: 277869 - DNA, 20 bp, Artificial
  CRISPR gRNA sequence
gaagatatagaaaagcgtga

SEQ ID NO: 277870 - DNA, 20 bp, Artificial
  CRISPR gRNA sequence
tcacctattgtctcaccacc

SEQ ID NO: 277871 - DNA, 20 bp, Artificial
  CRISPR gRNA sequence
acctattgtctcaccacctg

SEQ ID NO: 277872 - DNA, 20 bp, Artificial
  CRISPR gRNA sequence
cctggagattttaccgttcc

SEQ ID NO: 277873 - DNA, 20 bp, Artificial
  CRISPR gRNA sequence
gtttgtgcacactcttccaa

SEQ ID NO: 277874 - DNA, 20 bp, Artificial
  CRISPR gRNA sequence
tttgtgcacactcttccaac

SEQ ID NO: 277875 - DNA, 20 bp, Artificial
  CRISPR gRNA sequence
tgtgcacactcttccaacag

SEQ ID NO: 277876 - DNA, 20 bp, Artificial
  CRISPR gRNA sequence
cccccctctaaatgtttgat

SEQ ID NO: 277877 - DNA, 20 bp, Artificial
  CRISPR gRNA sequence
ccccctctaaatgtttgatt

SEQ ID NO: 277878 - DNA, 20 bp, Artificial
  CRISPR gRNA sequence
aaatgtttgattaggtgaac

SEQ ID NO: 277879 - DNA, 20 bp, Artificial
  CRISPR gRNA sequence
attaggtgaactagcaccga

SEQ ID NO: 277880 - DNA, 20 bp, Artificial
  CRISPR gRNA sequence
ttaggtgaactagcaccgac

SEQ ID NO: 277881 - DNA, 20 bp, Artificial
  CRISPR gRNA sequence
taggtgaactagcaccgaca

SEQ ID NO: 277882 - DNA, 20 bp, Artificial
  CRISPR gRNA sequence
tgaactagcaccgacagggc

SEQ ID NO: 277883 - DNA, 20 bp, Artificial
  CRISPR gRNA sequence
agcaccgacagggctggtgt

SEQ ID NO: 277884 - DNA, 20 bp, Artificial
  CRISPR gRNA sequence
gacagggctggtgtcagccc

SEQ ID NO: 277885 - DNA, 20 bp, Artificial
  CRISPR gRNA sequence
acagggctggtgtcagccct

SEQ ID NO: 277886 - DNA, 20 bp, Artificial
  CRISPR gRNA sequence
ggctggtgtcagccctgggc

SEQ ID NO: 277887 - DNA, 20 bp, Artificial
  CRISPR gRNA sequence
gctggtgtcagccctgggct

SEQ ID NO: 277888 - DNA, 20 bp, Artificial
  CRISPR gRNA sequence
gtcagccctgggctaggtgc

SEQ ID NO: 277889 - DNA, 20 bp, Artificial
  CRISPR gRNA sequence
ggctaggtgctagccacaca

SEQ ID NO: 277890 - DNA, 20 bp, Artificial
  CRISPR gRNA sequence
gctaggtgctagccacacaa

SEQ ID NO: 277891 - DNA, 20 bp, Artificial
  CRISPR gRNA sequence
taggtgctagccacacaaag

SEQ ID NO: 277892 - DNA, 20 bp, Artificial
  CRISPR gRNA sequence
tgctagccacacaaaggaga

SEQ ID NO: 277893 - DNA, 20 bp, Artificial
  CRISPR gRNA sequence
gctagccacacaaaggagac

SEQ ID NO: 277894 - DNA, 20 bp, Artificial
  CRISPR gRNA sequence
agccacacaaaggagacagg

SEQ ID NO: 277895 - DNA, 20 bp, Artificial
  CRISPR gRNA sequence
ccacacaaaggagacaggca

SEQ ID NO: 277896 - DNA, 20 bp, Artificial
  CRISPR gRNA sequence
gagacaggcagagctgcctc

SEQ ID NO: 277897 - DNA, 20 bp, Artificial
  CRISPR gRNA sequence
acaggcagagctgcctctgg

SEQ ID NO: 277898 - DNA, 20 bp, Artificial
  CRISPR gRNA sequence
agagctgcctctggcagcca

SEQ ID NO: 277899 - DNA, 20 bp, Artificial
  CRISPR gRNA sequence
gagctgcctctggcagccac

SEQ ID NO: 277900 - DNA, 20 bp, Artificial
  CRISPR gRNA sequence
cctctggcagccacaggctt

SEQ ID NO: 277901 - DNA, 20 bp, Artificial
  CRISPR gRNA sequence
tcctgacttttccccctgtt

SEQ ID NO: 277902 - DNA, 20 bp, Artificial
  CRISPR gRNA sequence
ttactttttctctttctaaa

SEQ ID NO: 277903 - DNA, 20 bp, Artificial
  CRISPR gRNA sequence
atttatatccttaaaatgca

SEQ ID NO: 277904 - DNA, 20 bp, Artificial
  CRISPR gRNA sequence
tttatatccttaaaatgcac

SEQ ID NO: 277905 - DNA, 20 bp, Artificial
  CRISPR gRNA sequence
ttatatccttaaaatgcaca

SEQ ID NO: 277906 - DNA, 20 bp, Artificial
  CRISPR gRNA sequence
aaaatgcacagggacttgaa

SEQ ID NO: 277907 - DNA, 20 bp, Artificial
  CRISPR gRNA sequence
gggacttgaacagctgttgt

SEQ ID NO: 277908 - DNA, 20 bp, Artificial
  CRISPR gRNA sequence
ggacttgaacagctgttgtc

SEQ ID NO: 277909 - DNA, 20 bp, Artificial
  CRISPR gRNA sequence
gacttgaacagctgttgtca

SEQ ID NO: 277910 - DNA, 20 bp, Artificial
  CRISPR gRNA sequence
agctgttgtcagggtgatga

SEQ ID NO: 277911 - DNA, 20 bp, Artificial
  CRISPR gRNA sequence
atggcaacaatcactgctca

SEQ ID NO: 277912 - DNA, 20 bp, Artificial
  CRISPR gRNA sequence
tggcaacaatcactgctcat

SEQ ID NO: 277913 - DNA, 20 bp, Artificial
  CRISPR gRNA sequence
atcactgctcatgggacccc

SEQ ID NO: 277914 - DNA, 20 bp, Artificial
  CRISPR gRNA sequence
tcactgctcatgggacccct

SEQ ID NO: 277915 - DNA, 20 bp, Artificial
  CRISPR gRNA sequence
tgctcatgggacccctgggc

SEQ ID NO: 277916 - DNA, 20 bp, Artificial
  CRISPR gRNA sequence
tcatgggacccctgggccag

SEQ ID NO: 277917 - DNA, 20 bp, Artificial
  CRISPR gRNA sequence
ggacccctgggccagcagca

SEQ ID NO: 277918 - DNA, 20 bp, Artificial
  CRISPR gRNA sequence
cccctgggccagcagcatag

SEQ ID NO: 277919 - DNA, 20 bp, Artificial
  CRISPR gRNA sequence
cagcatagcggtgtgtgttg

SEQ ID NO: 277920 - DNA, 20 bp, Artificial
  CRISPR gRNA sequence
agcatagcggtgtgtgttgc

SEQ ID NO: 277921 - DNA, 20 bp, Artificial
  CRISPR gRNA sequence
gcatagcggtgtgtgttgca

SEQ ID NO: 277922 - DNA, 20 bp, Artificial
  CRISPR gRNA sequence
atagcggtgtgtgttgcagg

SEQ ID NO: 277923 - DNA, 20 bp, Artificial
  CRISPR gRNA sequence
agcggtgtgtgttgcaggga

SEQ ID NO: 277924 - DNA, 20 bp, Artificial
  CRISPR gRNA sequence
gcggtgtgtgttgcagggag

SEQ ID NO: 277925 - DNA, 20 bp, Artificial
  CRISPR gRNA sequence
ggtgtgtgttgcagggagag

SEQ ID NO: 277926 - DNA, 20 bp, Artificial
  CRISPR gRNA sequence
gtgtgtgttgcagggagagg

SEQ ID NO: 277927 - DNA, 20 bp, Artificial
  CRISPR gRNA sequence
aggaggatgtgttctgtgaa

SEQ ID NO: 277928 - DNA, 20 bp, Artificial
  CRISPR gRNA sequence
aggatgtgttctgtgaatgg

SEQ ID NO: 277929 - DNA, 20 bp, Artificial
  CRISPR gRNA sequence
ttctgtgaatggtggcactt

SEQ ID NO: 277930 - DNA, 20 bp, Artificial
  CRISPR gRNA sequence
tctgtgaatggtggcacttt

SEQ ID NO: 277931 - DNA, 20 bp, Artificial
  CRISPR gRNA sequence
ctgtgaatggtggcactttg

SEQ ID NO: 277932 - DNA, 20 bp, Artificial
  CRISPR gRNA sequence
tggggtattctcttttctcc

SEQ ID NO: 277933 - DNA, 20 bp, Artificial
  CRISPR gRNA sequence
ttctcttttctcctagctct

SEQ ID NO: 277934 - DNA, 20 bp, Artificial
  CRISPR gRNA sequence
ttctcctagctctgagttct

SEQ ID NO: 277935 - DNA, 20 bp, Artificial
  CRISPR gRNA sequence
gttctcagactataaactta

SEQ ID NO: 277936 - DNA, 20 bp, Artificial
  CRISPR gRNA sequence
ttctcagactataaacttat

SEQ ID NO: 277937 - DNA, 20 bp, Artificial
  CRISPR gRNA sequence
acatctcttgcctcctccta

SEQ ID NO: 277938 - DNA, 20 bp, Artificial
  CRISPR gRNA sequence
catctcttgcctcctcctac

SEQ ID NO: 277939 - DNA, 20 bp, Artificial
  CRISPR gRNA sequence
tctcttgcctcctcctacag

SEQ ID NO: 277940 - DNA, 20 bp, Artificial
  CRISPR gRNA sequence
ctcttgcctcctcctacagg

SEQ ID NO: 277941 - DNA, 20 bp, Artificial
  CRISPR gRNA sequence
ggaggcctttcccctctcct

SEQ ID NO: 277942 - DNA, 20 bp, Artificial
  CRISPR gRNA sequence
ttagacctgaccctctctta

SEQ ID NO: 277943 - DNA, 20 bp, Artificial
  CRISPR gRNA sequence
tagacctgaccctctcttaa

SEQ ID NO: 277944 - DNA, 20 bp, Artificial
  CRISPR gRNA sequence
gaccctctcttaaaggactc

SEQ ID NO: 277945 - DNA, 20 bp, Artificial
  CRISPR gRNA sequence
cttaaaggactccagctctg

SEQ ID NO: 277946 - DNA, 20 bp, Artificial
  CRISPR gRNA sequence
ttaaaggactccagctctga

SEQ ID NO: 277947 - DNA, 20 bp, Artificial
  CRISPR gRNA sequence
ggactccagctctgaaggaa

SEQ ID NO: 277948 - DNA, 20 bp, Artificial
  CRISPR gRNA sequence
gaaggaaaagctgcccacat

SEQ ID NO: 277949 - DNA, 20 bp, Artificial
  CRISPR gRNA sequence
ctgcccacattggtccctct

SEQ ID NO: 277950 - DNA, 20 bp, Artificial
  CRISPR gRNA sequence
tgcccacattggtccctctg

SEQ ID NO: 277951 - DNA, 20 bp, Artificial
  CRISPR gRNA sequence
gcccacattggtccctctga

SEQ ID NO: 277952 - DNA, 20 bp, Artificial
  CRISPR gRNA sequence
ccctctgagggctgccctgt

SEQ ID NO: 277953 - DNA, 20 bp, Artificial
  CRISPR gRNA sequence
ctctgagggctgccctgtta

SEQ ID NO: 277954 - DNA, 20 bp, Artificial
  CRISPR gRNA sequence
agcctctgccttactgccac

SEQ ID NO: 277955 - DNA, 20 bp, Artificial
  CRISPR gRNA sequence
gccttactgccaccagttgc

SEQ ID NO: 277956 - DNA, 20 bp, Artificial
  CRISPR gRNA sequence
ccaccagttgctggactata

SEQ ID NO: 277957 - DNA, 20 bp, Artificial
  CRISPR gRNA sequence
cagttgctggactataaagt

SEQ ID NO: 277958 - DNA, 20 bp, Artificial
  CRISPR gRNA sequence
agttgctggactataaagtc

SEQ ID NO: 277959 - DNA, 20 bp, Artificial
  CRISPR gRNA sequence
gtcaggcgtttctgcctcca

SEQ ID NO: 277960 - DNA, 20 bp, Artificial
  CRISPR gRNA sequence
ggcgtttctgcctccataga

SEQ ID NO: 277961 - DNA, 20 bp, Artificial
  CRISPR gRNA sequence
gcctccatagacagtgcctg

SEQ ID NO: 277962 - DNA, 20 bp, Artificial
  CRISPR gRNA sequence
cctccatagacagtgcctgc

SEQ ID NO: 277963 - DNA, 20 bp, Artificial
  CRISPR gRNA sequence
atagacagtgcctgcaggcc

SEQ ID NO: 277964 - DNA, 20 bp, Artificial
  CRISPR gRNA sequence
agacagtgcctgcaggccta

SEQ ID NO: 277965 - DNA, 20 bp, Artificial
  CRISPR gRNA sequence
gacagtgcctgcaggcctag

SEQ ID NO: 277966 - DNA, 20 bp, Artificial
  CRISPR gRNA sequence
acagtgcctgcaggcctaga

SEQ ID NO: 277967 - DNA, 20 bp, Artificial
  CRISPR gRNA sequence
cagtgcctgcaggcctagag

SEQ ID NO: 277968 - DNA, 20 bp, Artificial
  CRISPR gRNA sequence
agtgcctgcaggcctagagg

SEQ ID NO: 277969 - DNA, 20 bp, Artificial
  CRISPR gRNA sequence
tgcctgcaggcctagagggg

SEQ ID NO: 277970 - DNA, 20 bp, Artificial
  CRISPR gRNA sequence
cctgcaggcctagaggggga

SEQ ID NO: 277971 - DNA, 20 bp, Artificial
  CRISPR gRNA sequence
ctgcaggcctagagggggag

SEQ ID NO: 277972 - DNA, 20 bp, Artificial
  CRISPR gRNA sequence
gcaggcctagagggggagag

SEQ ID NO: 277973 - DNA, 20 bp, Artificial
  CRISPR gRNA sequence
cctagagggggagaggagcc

SEQ ID NO: 277974 - DNA, 20 bp, Artificial
  CRISPR gRNA sequence
gagggggagaggagcctggc

SEQ ID NO: 277975 - DNA, 20 bp, Artificial
  CRISPR gRNA sequence
tggttccaccctgtgcatga

SEQ ID NO: 277976 - DNA, 20 bp, Artificial
  CRISPR gRNA sequence
gttccaccctgtgcatgaaa

SEQ ID NO: 277977 - DNA, 20 bp, Artificial
  CRISPR gRNA sequence
ttccaccctgtgcatgaaag

SEQ ID NO: 277978 - DNA, 20 bp, Artificial
  CRISPR gRNA sequence
ccaccctgtgcatgaaagag

SEQ ID NO: 277979 - DNA, 20 bp, Artificial
  CRISPR gRNA sequence
gaaagaggagtcccttcccc

SEQ ID NO: 277980 - DNA, 20 bp, Artificial
  CRISPR gRNA sequence
aaagaggagtcccttcccct

SEQ ID NO: 277981 - DNA, 20 bp, Artificial
  CRISPR gRNA sequence
gagtcccttcccctgggcat

SEQ ID NO: 277982 - DNA, 20 bp, Artificial
  CRISPR gRNA sequence
tcccttcccctgggcatcag

SEQ ID NO: 277983 - DNA, 20 bp, Artificial
  CRISPR gRNA sequence
ttcccctgggcatcagtggc

SEQ ID NO: 277984 - DNA, 20 bp, Artificial
  CRISPR gRNA sequence
tcccctgggcatcagtggct

SEQ ID NO: 277985 - DNA, 20 bp, Artificial
  CRISPR gRNA sequence
cctgggcatcagtggctggg

SEQ ID NO: 277986 - DNA, 20 bp, Artificial
  CRISPR gRNA sequence
ctgggcatcagtggctgggc

SEQ ID NO: 277987 - DNA, 20 bp, Artificial
  CRISPR gRNA sequence
gggcatcagtggctgggcag

SEQ ID NO: 277988 - DNA, 20 bp, Artificial
  CRISPR gRNA sequence
ggcatcagtggctgggcagg

SEQ ID NO: 277989 - DNA, 20 bp, Artificial
  CRISPR gRNA sequence
catcagtggctgggcaggag

SEQ ID NO: 277990 - DNA, 20 bp, Artificial
  CRISPR gRNA sequence
tcagtggctgggcaggagga

SEQ ID NO: 277991 - DNA, 20 bp, Artificial
  CRISPR gRNA sequence
cagtggctgggcaggaggag

SEQ ID NO: 277992 - DNA, 20 bp, Artificial
  CRISPR gRNA sequence
agtggctgggcaggaggaga

SEQ ID NO: 277993 - DNA, 20 bp, Artificial
  CRISPR gRNA sequence
gtggctgggcaggaggagag

SEQ ID NO: 277994 - DNA, 20 bp, Artificial
  CRISPR gRNA sequence
tggctgggcaggaggagagg

SEQ ID NO: 277995 - DNA, 20 bp, Artificial
  CRISPR gRNA sequence
gagggggaacacctctgcca

SEQ ID NO: 277996 - DNA, 20 bp, Artificial
  CRISPR gRNA sequence
ggaacacctctgccatggtg

SEQ ID NO: 277997 - DNA, 20 bp, Artificial
  CRISPR gRNA sequence
acacctctgccatggtgtgg

SEQ ID NO: 277998 - DNA, 20 bp, Artificial
  CRISPR gRNA sequence
cacctctgccatggtgtggc

SEQ ID NO: 277999 - DNA, 20 bp, Artificial
  CRISPR gRNA sequence
cctctgccatggtgtggcag

SEQ ID NO: 278000 - DNA, 20 bp, Artificial
  CRISPR gRNA sequence
tctgccatggtgtggcagga

SEQ ID NO: 278001 - DNA, 20 bp, Artificial
  CRISPR gRNA sequence
ctgccatggtgtggcaggag

SEQ ID NO: 278002 - DNA, 20 bp, Artificial
  CRISPR gRNA sequence
ccatggtgtggcaggagagg

SEQ ID NO: 278003 - DNA, 20 bp, Artificial
  CRISPR gRNA sequence
catggtgtggcaggagagga

SEQ ID NO: 278004 - DNA, 20 bp, Artificial
  CRISPR gRNA sequence
tgtggcaggagaggaaggcc

SEQ ID NO: 278005 - DNA, 20 bp, Artificial
  CRISPR gRNA sequence
caggagaggaaggcctagtg

SEQ ID NO: 278006 - DNA, 20 bp, Artificial
  CRISPR gRNA sequence
gcaaatctctgccctgaata

SEQ ID NO: 278007 - DNA, 20 bp, Artificial
  CRISPR gRNA sequence
tcactgaatctcacctccca

SEQ ID NO: 278008 - DNA, 20 bp, Artificial
  CRISPR gRNA sequence
ctcacacctacactcccgtt

SEQ ID NO: 278009 - DNA, 20 bp, Artificial
  CRISPR gRNA sequence
acacctacactcccgttgag

SEQ ID NO: 278010 - DNA, 20 bp, Artificial
  CRISPR gRNA sequence
cagtcctcactaattttaca

SEQ ID NO: 278011 - DNA, 20 bp, Artificial
  CRISPR gRNA sequence
tgatccaattcttttcatta

SEQ ID NO: 278012 - DNA, 20 bp, Artificial
  CRISPR gRNA sequence
cttttcattaaagacatcat

SEQ ID NO: 278013 - DNA, 20 bp, Artificial
  CRISPR gRNA sequence
aagacatcatcagttactgt

SEQ ID NO: 278014 - DNA, 20 bp, Artificial
  CRISPR gRNA sequence
ttactgaaataacctcctaa

SEQ ID NO: 278015 - DNA, 20 bp, Artificial
  CRISPR gRNA sequence
tactgaaataacctcctaat

SEQ ID NO: 278016 - DNA, 20 bp, Artificial
  CRISPR gRNA sequence
acctcctaataggttttgca

SEQ ID NO: 278017 - DNA, 20 bp, Artificial
  CRISPR gRNA sequence
taggttttgcacagtcactg

SEQ ID NO: 278018 - DNA, 20 bp, Artificial
  CRISPR gRNA sequence
agtcactgtggctgccctac

SEQ ID NO: 278019 - DNA, 20 bp, Artificial
  CRISPR gRNA sequence
ctacaagccactctgttctt

SEQ ID NO: 278020 - DNA, 20 bp, Artificial
  CRISPR gRNA sequence
gtaacacttttttcctttta

SEQ ID NO: 278021 - DNA, 20 bp, Artificial
  CRISPR gRNA sequence
acctttactactgaaactca

SEQ ID NO: 278022 - DNA, 20 bp, Artificial
  CRISPR gRNA sequence
ctactgaaactcaaagtgta

SEQ ID NO: 278023 - DNA, 20 bp, Artificial
  CRISPR gRNA sequence
ctgaaactcaaagtgtatgg

SEQ ID NO: 278024 - DNA, 20 bp, Artificial
  CRISPR gRNA sequence
gaaactcaaagtgtatggtg

SEQ ID NO: 278025 - DNA, 20 bp, Artificial
  CRISPR gRNA sequence
actcaaagtgtatggtggag

SEQ ID NO: 278026 - DNA, 20 bp, Artificial
  CRISPR gRNA sequence
agtgtatggtggagcagcat

SEQ ID NO: 278027 - DNA, 20 bp, Artificial
  CRISPR gRNA sequence
ggagcagcatcagcatcacc

SEQ ID NO: 278028 - DNA, 20 bp, Artificial
  CRISPR gRNA sequence
gagcagcatcagcatcacct

SEQ ID NO: 278029 - DNA, 20 bp, Artificial
  CRISPR gRNA sequence
agcatcacctaggtgcttct

SEQ ID NO: 278030 - DNA, 20 bp, Artificial
  CRISPR gRNA sequence
ctaggtgcttcttagaaatg

SEQ ID NO: 278031 - DNA, 20 bp, Artificial
  CRISPR gRNA sequence
ttcttagaaatgcagaatct

SEQ ID NO: 278032 - DNA, 20 bp, Artificial
  CRISPR gRNA sequence
tcttagaaatgcagaatctc

SEQ ID NO: 278033 - DNA, 20 bp, Artificial
  CRISPR gRNA sequence
cagaatctcaggccccatcc

SEQ ID NO: 278034 - DNA, 20 bp, Artificial
  CRISPR gRNA sequence
gccccatcccagacccacct

SEQ ID NO: 278035 - DNA, 20 bp, Artificial
  CRISPR gRNA sequence
ccatcccagacccacctaag

SEQ ID NO: 278036 - DNA, 20 bp, Artificial
  CRISPR gRNA sequence
cagacccacctaagcagaaa

SEQ ID NO: 278037 - DNA, 20 bp, Artificial
  CRISPR gRNA sequence
acagcatttaaaaaactata

SEQ ID NO: 278038 - DNA, 20 bp, Artificial
  CRISPR gRNA sequence
actatatagactttattttt

SEQ ID NO: 278039 - DNA, 20 bp, Artificial
  CRISPR gRNA sequence
tatatagactttatttttta

SEQ ID NO: 278040 - DNA, 20 bp, Artificial
  CRISPR gRNA sequence
tttattttttagagctgctt

SEQ ID NO: 278041 - DNA, 20 bp, Artificial
  CRISPR gRNA sequence
ttattttttagagctgcttt

SEQ ID NO: 278042 - DNA, 20 bp, Artificial
  CRISPR gRNA sequence
tcatcgaaaaattgaatgta

SEQ ID NO: 278043 - DNA, 20 bp, Artificial
  CRISPR gRNA sequence
accccctccccacatattca

SEQ ID NO: 278044 - DNA, 20 bp, Artificial
  CRISPR gRNA sequence
ccactgtctacatcctgcgc

SEQ ID NO: 278045 - DNA, 20 bp, Artificial
  CRISPR gRNA sequence
cactgtctacatcctgcgcc

SEQ ID NO: 278046 - DNA, 20 bp, Artificial
  CRISPR gRNA sequence
actgtctacatcctgcgcca

SEQ ID NO: 278047 - DNA, 20 bp, Artificial
  CRISPR gRNA sequence
gtctacatcctgcgccaggg

SEQ ID NO: 278048 - DNA, 20 bp, Artificial
  CRISPR gRNA sequence
catcattaccaccccaaatc

SEQ ID NO: 278049 - DNA, 20 bp, Artificial
  CRISPR gRNA sequence
tcattaccaccccaaatcta

SEQ ID NO: 278050 - DNA, 20 bp, Artificial
  CRISPR gRNA sequence
cccaaatctagagttcacga

SEQ ID NO: 278051 - DNA, 20 bp, Artificial
  CRISPR gRNA sequence
ccaaatctagagttcacgat

SEQ ID NO: 278052 - DNA, 20 bp, Artificial
  CRISPR gRNA sequence
caaatctagagttcacgata

SEQ ID NO: 278053 - DNA, 20 bp, Artificial
  CRISPR gRNA sequence
aaatctagagttcacgatag

SEQ ID NO: 278054 - DNA, 20 bp, Artificial
  CRISPR gRNA sequence
ttcacgataggggtcactcc

SEQ ID NO: 278055 - DNA, 20 bp, Artificial
  CRISPR gRNA sequence
tcctggtattgcatattcta

SEQ ID NO: 278056 - DNA, 20 bp, Artificial
  CRISPR gRNA sequence
tattgcatattctatggatt

SEQ ID NO: 278057 - DNA, 20 bp, Artificial
  CRISPR gRNA sequence
attgcatattctatggattt

SEQ ID NO: 278058 - DNA, 20 bp, Artificial
  CRISPR gRNA sequence
atgacttatatctatcatta

SEQ ID NO: 278059 - DNA, 20 bp, Artificial
  CRISPR gRNA sequence
cattacagtattatgcaaaa

SEQ ID NO: 278060 - DNA, 20 bp, Artificial
  CRISPR gRNA sequence
ctctaaaaaattccctgtgc

SEQ ID NO: 278061 - DNA, 20 bp, Artificial
  CRISPR gRNA sequence
ctgtgctagaaactgcaatt

SEQ ID NO: 278062 - DNA, 20 bp, Artificial
  CRISPR gRNA sequence
ctgcaatttagcaaaacccc

SEQ ID NO: 278063 - DNA, 20 bp, Artificial
  CRISPR gRNA sequence
tgcaatttagcaaaaccccc

SEQ ID NO: 278064 - DNA, 20 bp, Artificial
  CRISPR gRNA sequence
tagcaaaacccccaggctat

SEQ ID NO: 278065 - DNA, 20 bp, Artificial
  CRISPR gRNA sequence
ccaggctattggtatgtgta

SEQ ID NO: 278066 - DNA, 20 bp, Artificial
  CRISPR gRNA sequence
aggctattggtatgtgtaaa

SEQ ID NO: 278067 - DNA, 20 bp, Artificial
  CRISPR gRNA sequence
tggtatgtgtaaagagtgaa

SEQ ID NO: 278068 - DNA, 20 bp, Artificial
  CRISPR gRNA sequence
gtatgtgtaaagagtgaaca

SEQ ID NO: 278069 - DNA, 20 bp, Artificial
  CRISPR gRNA sequence
gtgtaaagagtgaacagagc

SEQ ID NO: 278070 - DNA, 20 bp, Artificial
  CRISPR gRNA sequence
tgtaaagagtgaacagagct

SEQ ID NO: 278071 - DNA, 20 bp, Artificial
  CRISPR gRNA sequence
gtaaagagtgaacagagctg

SEQ ID NO: 278072 - DNA, 20 bp, Artificial
  CRISPR gRNA sequence
aagagtgaacagagctgggg

SEQ ID NO: 278073 - DNA, 20 bp, Artificial
  CRISPR gRNA sequence
ggtagaccacgccactctcc

SEQ ID NO: 278074 - DNA, 20 bp, Artificial
  CRISPR gRNA sequence
gtagaccacgccactctcct

SEQ ID NO: 278075 - DNA, 20 bp, Artificial
  CRISPR gRNA sequence
ccacgccactctcctgggta

SEQ ID NO: 278076 - DNA, 20 bp, Artificial
  CRISPR gRNA sequence
tctcctgggtaaagcccttc

SEQ ID NO: 278077 - DNA, 20 bp, Artificial
  CRISPR gRNA sequence
ccagcttcctgaataacatg

SEQ ID NO: 278078 - DNA, 20 bp, Artificial
  CRISPR gRNA sequence
gattcatgattataactcac

SEQ ID NO: 278079 - DNA, 20 bp, Artificial
  CRISPR gRNA sequence
attataactcacaagtgctg

SEQ ID NO: 278080 - DNA, 20 bp, Artificial
  CRISPR gRNA sequence
ttataactcacaagtgctgc

SEQ ID NO: 278081 - DNA, 20 bp, Artificial
  CRISPR gRNA sequence
tataactcacaagtgctgca

SEQ ID NO: 278082 - DNA, 20 bp, Artificial
  CRISPR gRNA sequence
ctcacaagtgctgcagggtc

SEQ ID NO: 278083 - DNA, 20 bp, Artificial
  CRISPR gRNA sequence
agggtccggttcttgctcac

SEQ ID NO: 278084 - DNA, 20 bp, Artificial
  CRISPR gRNA sequence
gggtccggttcttgctcact

SEQ ID NO: 278085 - DNA, 20 bp, Artificial
  CRISPR gRNA sequence
ccggttcttgctcactgggc

SEQ ID NO: 278086 - DNA, 20 bp, Artificial
  CRISPR gRNA sequence
gtccctcctctgctacttcc

SEQ ID NO: 278087 - DNA, 20 bp, Artificial
  CRISPR gRNA sequence
agctcactgccccttcttgc

SEQ ID NO: 278088 - DNA, 20 bp, Artificial
  CRISPR gRNA sequence
tcactgccccttcttgctgg

SEQ ID NO: 278089 - DNA, 20 bp, Artificial
  CRISPR gRNA sequence
actgccccttcttgctggca

SEQ ID NO: 278090 - DNA, 20 bp, Artificial
  CRISPR gRNA sequence
ctgccccttcttgctggcag

SEQ ID NO: 278091 - DNA, 20 bp, Artificial
  CRISPR gRNA sequence
ccccttcttgctggcagagg

SEQ ID NO: 278092 - DNA, 20 bp, Artificial
  CRISPR gRNA sequence
ttcttgctggcagaggaaga

SEQ ID NO: 278093 - DNA, 20 bp, Artificial
  CRISPR gRNA sequence
agaggaagacagcacttcct

SEQ ID NO: 278094 - DNA, 20 bp, Artificial
  CRISPR gRNA sequence
gaggaagacagcacttcctc

SEQ ID NO: 278095 - DNA, 20 bp, Artificial
  CRISPR gRNA sequence
gaagacagcacttcctcagg

SEQ ID NO: 278096 - DNA, 20 bp, Artificial
  CRISPR gRNA sequence
gtgcctgtgccctgccttca

SEQ ID NO: 278097 - DNA, 20 bp, Artificial
  CRISPR gRNA sequence
tgccctgccttcaaagcacg

SEQ ID NO: 278098 - DNA, 20 bp, Artificial
  CRISPR gRNA sequence
aagcacgtggctttgtttgt

SEQ ID NO: 278099 - DNA, 20 bp, Artificial
  CRISPR gRNA sequence
acactttaacacattcattt

SEQ ID NO: 278100 - DNA, 20 bp, Artificial
  CRISPR gRNA sequence
ctttaacacattcatttgag

SEQ ID NO: 278101 - DNA, 20 bp, Artificial
  CRISPR gRNA sequence
acattcatttgagtggctat

SEQ ID NO: 278102 - DNA, 20 bp, Artificial
  CRISPR gRNA sequence
acttttcctctttccaatga

SEQ ID NO: 278103 - DNA, 20 bp, Artificial
  CRISPR gRNA sequence
atagtaaatttcacaaatgc

SEQ ID NO: 278104 - DNA, 20 bp, Artificial
  CRISPR gRNA sequence
agtaaatttcacaaatgcaa

SEQ ID NO: 278105 - DNA, 20 bp, Artificial
  CRISPR gRNA sequence
aaatgcaagagccatgtccc

SEQ ID NO: 278106 - DNA, 20 bp, Artificial
  CRISPR gRNA sequence
aatgcaagagccatgtcccc

SEQ ID NO: 278107 - DNA, 20 bp, Artificial
  CRISPR gRNA sequence
agagccatgtccccaggacc

SEQ ID NO: 278108 - DNA, 20 bp, Artificial
  CRISPR gRNA sequence
catgtccccaggaccaagaa

SEQ ID NO: 278109 - DNA, 20 bp, Artificial
  CRISPR gRNA sequence
caggaccaagaaaagtctct

SEQ ID NO: 278110 - DNA, 20 bp, Artificial
  CRISPR gRNA sequence
caagaaaagtctcttggttt

SEQ ID NO: 278111 - DNA, 20 bp, Artificial
  CRISPR gRNA sequence
aagaaaagtctcttggtttt

SEQ ID NO: 278112 - DNA, 20 bp, Artificial
  CRISPR gRNA sequence
gaaaagtctcttggttttag

SEQ ID NO: 278113 - DNA, 20 bp, Artificial
  CRISPR gRNA sequence
attaataaatgattaaacaa

SEQ ID NO: 278114 - DNA, 20 bp, Artificial
  CRISPR gRNA sequence
aaaagaatgaacacctgtgc

SEQ ID NO: 278115 - DNA, 20 bp, Artificial
  CRISPR gRNA sequence
cttacctttgtgcctttgtc

SEQ ID NO: 278116 - DNA, 20 bp, Artificial
  CRISPR gRNA sequence
ttacctttgtgcctttgtcc

SEQ ID NO: 278117 - DNA, 20 bp, Artificial
  CRISPR gRNA sequence
gtccaggctgttgccctgac

SEQ ID NO: 278118 - DNA, 20 bp, Artificial
  CRISPR gRNA sequence
atcatccatctgcctctgta

SEQ ID NO: 278119 - DNA, 20 bp, Artificial
  CRISPR gRNA sequence
aaagcctgccctccttcctg

SEQ ID NO: 278120 - DNA, 20 bp, Artificial
  CRISPR gRNA sequence
ctgccctccttcctgcagcc

SEQ ID NO: 278121 - DNA, 20 bp, Artificial
  CRISPR gRNA sequence
cagtctgttacccactttcc

SEQ ID NO: 278122 - DNA, 20 bp, Artificial
  CRISPR gRNA sequence
ttacccactttcccagatct

SEQ ID NO: 278123 - DNA, 20 bp, Artificial
  CRISPR gRNA sequence
tacccactttcccagatctt

SEQ ID NO: 278124 - DNA, 20 bp, Artificial
  CRISPR gRNA sequence
agatcttgggctcctacaat

SEQ ID NO: 278125 - DNA, 20 bp, Artificial
  CRISPR gRNA sequence
gatcttgggctcctacaatc

SEQ ID NO: 278126 - DNA, 20 bp, Artificial
  CRISPR gRNA sequence
atcttgggctcctacaatca

SEQ ID NO: 278127 - DNA, 20 bp, Artificial
  CRISPR gRNA sequence
gggctcctacaatcagggca

SEQ ID NO: 278128 - DNA, 20 bp, Artificial
  CRISPR gRNA sequence
tgctctttgcttgttctaca

SEQ ID NO: 278129 - DNA, 20 bp, Artificial
  CRISPR gRNA sequence
gctctttgcttgttctacat

SEQ ID NO: 278130 - DNA, 20 bp, Artificial
  CRISPR gRNA sequence
tttgcttgttctacatgggt

SEQ ID NO: 278131 - DNA, 20 bp, Artificial
  CRISPR gRNA sequence
atttccgcaactaacatatg

SEQ ID NO: 278132 - DNA, 20 bp, Artificial
  CRISPR gRNA sequence
taacatatgcagacctcttt

SEQ ID NO: 278133 - DNA, 20 bp, Artificial
  CRISPR gRNA sequence
tatgcagacctctttgagtg

SEQ ID NO: 278134 - DNA, 20 bp, Artificial
  CRISPR gRNA sequence
atgcagacctctttgagtgc

SEQ ID NO: 278135 - DNA, 20 bp, Artificial
  CRISPR gRNA sequence
ctctttgagtgcaggaatcc

SEQ ID NO: 278136 - DNA, 20 bp, Artificial
  CRISPR gRNA sequence
aatcctagcctcaactttta

SEQ ID NO: 278137 - DNA, 20 bp, Artificial
  CRISPR gRNA sequence
ctcaacttttatggcccacc

SEQ ID NO: 278138 - DNA, 20 bp, Artificial
  CRISPR gRNA sequence
tttatggcccacctggcaca

SEQ ID NO: 278139 - DNA, 20 bp, Artificial
  CRISPR gRNA sequence
atggcccacctggcacacag

SEQ ID NO: 278140 - DNA, 20 bp, Artificial
  CRISPR gRNA sequence
tggcccacctggcacacagt

SEQ ID NO: 278141 - DNA, 20 bp, Artificial
  CRISPR gRNA sequence
cagtaggtgcttcattgact

SEQ ID NO: 278142 - DNA, 20 bp, Artificial
  CRISPR gRNA sequence
gtgcttcattgactcagtca

SEQ ID NO: 278143 - DNA, 20 bp, Artificial
  CRISPR gRNA sequence
cttcattgactcagtcacag

SEQ ID NO: 278144 - DNA, 20 bp, Artificial
  CRISPR gRNA sequence
cattgactcagtcacagcag

SEQ ID NO: 278145 - DNA, 20 bp, Artificial
  CRISPR gRNA sequence
agtcacagcagcagtaaaac

SEQ ID NO: 278146 - DNA, 20 bp, Artificial
  CRISPR gRNA sequence
gtcacagcagcagtaaaacc

SEQ ID NO: 278147 - DNA, 20 bp, Artificial
  CRISPR gRNA sequence
gcagcagtaaaaccaggatg

SEQ ID NO: 278148 - DNA, 20 bp, Artificial
  CRISPR gRNA sequence
cagtaaaaccaggatgtagc

SEQ ID NO: 278149 - DNA, 20 bp, Artificial
  CRISPR gRNA sequence
gtaaaaccaggatgtagcta

SEQ ID NO: 278150 - DNA, 20 bp, Artificial
  CRISPR gRNA sequence
ccaggatgtagctagagaac

SEQ ID NO: 278151 - DNA, 20 bp, Artificial
  CRISPR gRNA sequence
caggatgtagctagagaaca

SEQ ID NO: 278152 - DNA, 20 bp, Artificial
  CRISPR gRNA sequence
ctttcctaaacatctttctt

SEQ ID NO: 278153 - DNA, 20 bp, Artificial
  CRISPR gRNA sequence
aaacatctttctttagctca

SEQ ID NO: 278154 - DNA, 20 bp, Artificial
  CRISPR gRNA sequence
ttttccttgtacaatttcta

SEQ ID NO: 278155 - DNA, 20 bp, Artificial
  CRISPR gRNA sequence
cttgtacaatttctaaagtc

SEQ ID NO: 278156 - DNA, 20 bp, Artificial
  CRISPR gRNA sequence
ttgtacaatttctaaagtct

SEQ ID NO: 278157 - DNA, 20 bp, Artificial
  CRISPR gRNA sequence
ccagactttagaaattgtac

SEQ ID NO: 278158 - DNA, 20 bp, Artificial
  CRISPR gRNA sequence
cagactttagaaattgtaca

SEQ ID NO: 278159 - DNA, 20 bp, Artificial
  CRISPR gRNA sequence
agaaattgtacaaggaaaat

SEQ ID NO: 278160 - DNA, 20 bp, Artificial
  CRISPR gRNA sequence
gaaattgtacaaggaaaatt

SEQ ID NO: 278161 - DNA, 20 bp, Artificial
  CRISPR gRNA sequence
aaattgtacaaggaaaatta

SEQ ID NO: 278162 - DNA, 20 bp, Artificial
  CRISPR gRNA sequence
tgtacaaggaaaattagggt

SEQ ID NO: 278163 - DNA, 20 bp, Artificial
  CRISPR gRNA sequence
tacaaggaaaattagggtca

SEQ ID NO: 278164 - DNA, 20 bp, Artificial
  CRISPR gRNA sequence
acaaggaaaattagggtcag

SEQ ID NO: 278165 - DNA, 20 bp, Artificial
  CRISPR gRNA sequence
ggaaaattagggtcagaggt

SEQ ID NO: 278166 - DNA, 20 bp, Artificial
  CRISPR gRNA sequence
aaattagggtcagaggtaag

SEQ ID NO: 278167 - DNA, 20 bp, Artificial
  CRISPR gRNA sequence
tagggtcagaggtaagtgga

SEQ ID NO: 278168 - DNA, 20 bp, Artificial
  CRISPR gRNA sequence
gggtcagaggtaagtggaaa

SEQ ID NO: 278169 - DNA, 20 bp, Artificial
  CRISPR gRNA sequence
gtaagtggaaagagatcttt

SEQ ID NO: 278170 - DNA, 20 bp, Artificial
  CRISPR gRNA sequence
ggaaagagatctttgagcta

SEQ ID NO: 278171 - DNA, 20 bp, Artificial
  CRISPR gRNA sequence
agagatctttgagctaaaga

SEQ ID NO: 278172 - DNA, 20 bp, Artificial
  CRISPR gRNA sequence
ttgagctaaagaaagatgtt

SEQ ID NO: 278173 - DNA, 20 bp, Artificial
  CRISPR gRNA sequence
tgagctaaagaaagatgttt

SEQ ID NO: 278174 - DNA, 20 bp, Artificial
  CRISPR gRNA sequence
ctaaagaaagatgtttagga

SEQ ID NO: 278175 - DNA, 20 bp, Artificial
  CRISPR gRNA sequence
taggaaagcaccttgttctc

SEQ ID NO: 278176 - DNA, 20 bp, Artificial
  CRISPR gRNA sequence
cttgttctctagctacatcc

SEQ ID NO: 278177 - DNA, 20 bp, Artificial
  CRISPR gRNA sequence
gttttactgctgctgtgact

SEQ ID NO: 278178 - DNA, 20 bp, Artificial
  CRISPR gRNA sequence
ctgctgtgactgagtcaatg

SEQ ID NO: 278179 - DNA, 20 bp, Artificial
  CRISPR gRNA sequence
atgaagcacctactgtgtgc

SEQ ID NO: 278180 - DNA, 20 bp, Artificial
  CRISPR gRNA sequence
tgaagcacctactgtgtgcc

SEQ ID NO: 278181 - DNA, 20 bp, Artificial
  CRISPR gRNA sequence
agcacctactgtgtgccagg

SEQ ID NO: 278182 - DNA, 20 bp, Artificial
  CRISPR gRNA sequence
gcacctactgtgtgccaggt

SEQ ID NO: 278183 - DNA, 20 bp, Artificial
  CRISPR gRNA sequence
gtgtgccaggtgggccataa

SEQ ID NO: 278184 - DNA, 20 bp, Artificial
  CRISPR gRNA sequence
ccaggtgggccataaaagtt

SEQ ID NO: 278185 - DNA, 20 bp, Artificial
  CRISPR gRNA sequence
caggtgggccataaaagttg

SEQ ID NO: 278186 - DNA, 20 bp, Artificial
  CRISPR gRNA sequence
tgggccataaaagttgaggc

SEQ ID NO: 278187 - DNA, 20 bp, Artificial
  CRISPR gRNA sequence
gggccataaaagttgaggct

SEQ ID NO: 278188 - DNA, 20 bp, Artificial
  CRISPR gRNA sequence
ggctaggattcctgcactca

SEQ ID NO: 278189 - DNA, 20 bp, Artificial
  CRISPR gRNA sequence
ctaggattcctgcactcaaa

SEQ ID NO: 278190 - DNA, 20 bp, Artificial
  CRISPR gRNA sequence
taggattcctgcactcaaag

SEQ ID NO: 278191 - DNA, 20 bp, Artificial
  CRISPR gRNA sequence
tcaaagaggtctgcatatgt

SEQ ID NO: 278192 - DNA, 20 bp, Artificial
  CRISPR gRNA sequence
aggtctgcatatgttagttg

SEQ ID NO: 278193 - DNA, 20 bp, Artificial
  CRISPR gRNA sequence
atgttagttgcggaaatgca

SEQ ID NO: 278194 - DNA, 20 bp, Artificial
  CRISPR gRNA sequence
aaatgcaaagctaacccatg

SEQ ID NO: 278195 - DNA, 20 bp, Artificial
  CRISPR gRNA sequence
aaagctaacccatgtagaac

SEQ ID NO: 278196 - DNA, 20 bp, Artificial
  CRISPR gRNA sequence
taacccatgtagaacaagca

SEQ ID NO: 278197 - DNA, 20 bp, Artificial
  CRISPR gRNA sequence
acccatgtagaacaagcaaa

SEQ ID NO: 278198 - DNA, 20 bp, Artificial
  CRISPR gRNA sequence
gaaatgctttgccctgattg

SEQ ID NO: 278199 - DNA, 20 bp, Artificial
  CRISPR gRNA sequence
aaatgctttgccctgattgt

SEQ ID NO: 278200 - DNA, 20 bp, Artificial
  CRISPR gRNA sequence
atgctttgccctgattgtag

SEQ ID NO: 278201 - DNA, 20 bp, Artificial
  CRISPR gRNA sequence
tgccctgattgtaggagccc

SEQ ID NO: 278202 - DNA, 20 bp, Artificial
  CRISPR gRNA sequence
gattgtaggagcccaagatc

SEQ ID NO: 278203 - DNA, 20 bp, Artificial
  CRISPR gRNA sequence
attgtaggagcccaagatct

SEQ ID NO: 278204 - DNA, 20 bp, Artificial
  CRISPR gRNA sequence
taggagcccaagatctggga

SEQ ID NO: 278205 - DNA, 20 bp, Artificial
  CRISPR gRNA sequence
gagcccaagatctgggaaag

SEQ ID NO: 278206 - DNA, 20 bp, Artificial
  CRISPR gRNA sequence
agcccaagatctgggaaagt

SEQ ID NO: 278207 - DNA, 20 bp, Artificial
  CRISPR gRNA sequence
agatctgggaaagtgggtaa

SEQ ID NO: 278208 - DNA, 20 bp, Artificial
  CRISPR gRNA sequence
tgggaaagtgggtaacagac

SEQ ID NO: 278209 - DNA, 20 bp, Artificial
  CRISPR gRNA sequence
gggaaagtgggtaacagact

SEQ ID NO: 278210 - DNA, 20 bp, Artificial
  CRISPR gRNA sequence
gtgggtaacagactgggctg

SEQ ID NO: 278211 - DNA, 20 bp, Artificial
  CRISPR gRNA sequence
tgggtaacagactgggctgc

SEQ ID NO: 278212 - DNA, 20 bp, Artificial
  CRISPR gRNA sequence
gtaacagactgggctgcagg

SEQ ID NO: 278213 - DNA, 20 bp, Artificial
  CRISPR gRNA sequence
taacagactgggctgcagga

SEQ ID NO: 278214 - DNA, 20 bp, Artificial
  CRISPR gRNA sequence
acagactgggctgcaggaag

SEQ ID NO: 278215 - DNA, 20 bp, Artificial
  CRISPR gRNA sequence
cagactgggctgcaggaagg

SEQ ID NO: 278216 - DNA, 20 bp, Artificial
  CRISPR gRNA sequence
agactgggctgcaggaagga

SEQ ID NO: 278217 - DNA, 20 bp, Artificial
  CRISPR gRNA sequence
ctgggctgcaggaaggaggg

SEQ ID NO: 278218 - DNA, 20 bp, Artificial
  CRISPR gRNA sequence
tgggctgcaggaaggagggc

SEQ ID NO: 278219 - DNA, 20 bp, Artificial
  CRISPR gRNA sequence
aggaaggagggcaggcttta

SEQ ID NO: 278220 - DNA, 20 bp, Artificial
  CRISPR gRNA sequence
gaaggagggcaggctttaca

SEQ ID NO: 278221 - DNA, 20 bp, Artificial
  CRISPR gRNA sequence
aaggagggcaggctttacag

SEQ ID NO: 278222 - DNA, 20 bp, Artificial
  CRISPR gRNA sequence
gagggcaggctttacagagg

SEQ ID NO: 278223 - DNA, 20 bp, Artificial
  CRISPR gRNA sequence
gcaggctttacagaggcaga

SEQ ID NO: 278224 - DNA, 20 bp, Artificial
  CRISPR gRNA sequence
ttacagaggcagatggatga

SEQ ID NO: 278225 - DNA, 20 bp, Artificial
  CRISPR gRNA sequence
acagaggcagatggatgatg

SEQ ID NO: 278226 - DNA, 20 bp, Artificial
  CRISPR gRNA sequence
agaggcagatggatgatgga

SEQ ID NO: 278227 - DNA, 20 bp, Artificial
  CRISPR gRNA sequence
aggcagatggatgatggaga

SEQ ID NO: 278228 - DNA, 20 bp, Artificial
  CRISPR gRNA sequence
ggatgatggagagagaattc

SEQ ID NO: 278229 - DNA, 20 bp, Artificial
  CRISPR gRNA sequence
gatggagagagaattctggt

SEQ ID NO: 278230 - DNA, 20 bp, Artificial
  CRISPR gRNA sequence
atggagagagaattctggtc

SEQ ID NO: 278231 - DNA, 20 bp, Artificial
  CRISPR gRNA sequence
tggagagagaattctggtca

SEQ ID NO: 278232 - DNA, 20 bp, Artificial
  CRISPR gRNA sequence
gagaattctggtcagggcaa

SEQ ID NO: 278233 - DNA, 20 bp, Artificial
  CRISPR gRNA sequence
ttctggtcagggcaacagcc

SEQ ID NO: 278234 - DNA, 20 bp, Artificial
  CRISPR gRNA sequence
tcagggcaacagcctggaca

SEQ ID NO: 278235 - DNA, 20 bp, Artificial
  CRISPR gRNA sequence
cagggcaacagcctggacaa

SEQ ID NO: 278236 - DNA, 20 bp, Artificial
  CRISPR gRNA sequence
acagcctggacaaaggcaca

SEQ ID NO: 278237 - DNA, 20 bp, Artificial
  CRISPR gRNA sequence
cagcctggacaaaggcacaa

SEQ ID NO: 278238 - DNA, 20 bp, Artificial
  CRISPR gRNA sequence
ctggacaaaggcacaaaggt

SEQ ID NO: 278239 - DNA, 20 bp, Artificial
  CRISPR gRNA sequence
tggacaaaggcacaaaggta

SEQ ID NO: 278240 - DNA, 20 bp, Artificial
  CRISPR gRNA sequence
aaaggcacaaaggtaaggat

SEQ ID NO: 278241 - DNA, 20 bp, Artificial
  CRISPR gRNA sequence
aaggcacaaaggtaaggatg

SEQ ID NO: 278242 - DNA, 20 bp, Artificial
  CRISPR gRNA sequence
cacaaaggtaaggatgaggc

SEQ ID NO: 278243 - DNA, 20 bp, Artificial
  CRISPR gRNA sequence
aggtaaggatgaggctggca

SEQ ID NO: 278244 - DNA, 20 bp, Artificial
  CRISPR gRNA sequence
ggtaaggatgaggctggcac

SEQ ID NO: 278245 - DNA, 20 bp, Artificial
  CRISPR gRNA sequence
tttattaattcaacaaacat

SEQ ID NO: 278246 - DNA, 20 bp, Artificial
  CRISPR gRNA sequence
catgagcatctcctaaaacc

SEQ ID NO: 278247 - DNA, 20 bp, Artificial
  CRISPR gRNA sequence
tgagcatctcctaaaaccaa

SEQ ID NO: 278248 - DNA, 20 bp, Artificial
  CRISPR gRNA sequence
taaaaccaagagacttttct

SEQ ID NO: 278249 - DNA, 20 bp, Artificial
  CRISPR gRNA sequence
caagagacttttcttggtcc

SEQ ID NO: 278250 - DNA, 20 bp, Artificial
  CRISPR gRNA sequence
aagagacttttcttggtcct

SEQ ID NO: 278251 - DNA, 20 bp, Artificial
  CRISPR gRNA sequence
agagacttttcttggtcctg

SEQ ID NO: 278252 - DNA, 20 bp, Artificial
  CRISPR gRNA sequence
ttttcttggtcctggggaca

SEQ ID NO: 278253 - DNA, 20 bp, Artificial
  CRISPR gRNA sequence
tttgtgaaatttactatcat

SEQ ID NO: 278254 - DNA, 20 bp, Artificial
  CRISPR gRNA sequence
tgaaatttactatcattgga

SEQ ID NO: 278255 - DNA, 20 bp, Artificial
  CRISPR gRNA sequence
aaatttactatcattggaaa

SEQ ID NO: 278256 - DNA, 20 bp, Artificial
  CRISPR gRNA sequence
aatttactatcattggaaag

SEQ ID NO: 278257 - DNA, 20 bp, Artificial
  CRISPR gRNA sequence
actatcattggaaagaggaa

SEQ ID NO: 278258 - DNA, 20 bp, Artificial
  CRISPR gRNA sequence
aaagaggaaaagtaatccaa

SEQ ID NO: 278259 - DNA, 20 bp, Artificial
  CRISPR gRNA sequence
ccactcaaatgaatgtgtta

SEQ ID NO: 278260 - DNA, 20 bp, Artificial
  CRISPR gRNA sequence
caaatgaatgtgttaaagtg

SEQ ID NO: 278261 - DNA, 20 bp, Artificial
  CRISPR gRNA sequence
taaagtgtggccaacaaaca

SEQ ID NO: 278262 - DNA, 20 bp, Artificial
  CRISPR gRNA sequence
aaacaaagccacgtgctttg

SEQ ID NO: 278263 - DNA, 20 bp, Artificial
  CRISPR gRNA sequence
aacaaagccacgtgctttga

SEQ ID NO: 278264 - DNA, 20 bp, Artificial
  CRISPR gRNA sequence
aaagccacgtgctttgaagg

SEQ ID NO: 278265 - DNA, 20 bp, Artificial
  CRISPR gRNA sequence
aagccacgtgctttgaaggc

SEQ ID NO: 278266 - DNA, 20 bp, Artificial
  CRISPR gRNA sequence
agccacgtgctttgaaggca

SEQ ID NO: 278267 - DNA, 20 bp, Artificial
  CRISPR gRNA sequence
cgtgctttgaaggcagggca

SEQ ID NO: 278268 - DNA, 20 bp, Artificial
  CRISPR gRNA sequence
gtgctttgaaggcagggcac

SEQ ID NO: 278269 - DNA, 20 bp, Artificial
  CRISPR gRNA sequence
gcagggcacaggcactgcct

SEQ ID NO: 278270 - DNA, 20 bp, Artificial
  CRISPR gRNA sequence
cagggcacaggcactgcctg

SEQ ID NO: 278271 - DNA, 20 bp, Artificial
  CRISPR gRNA sequence
ggcacaggcactgcctgagg

SEQ ID NO: 278272 - DNA, 20 bp, Artificial
  CRISPR gRNA sequence
gaagtgctgtcttcctctgc

SEQ ID NO: 278273 - DNA, 20 bp, Artificial
  CRISPR gRNA sequence
tgctgtcttcctctgccagc

SEQ ID NO: 278274 - DNA, 20 bp, Artificial
  CRISPR gRNA sequence
tgtcttcctctgccagcaag

SEQ ID NO: 278275 - DNA, 20 bp, Artificial
  CRISPR gRNA sequence
gtcttcctctgccagcaaga

SEQ ID NO: 278276 - DNA, 20 bp, Artificial
  CRISPR gRNA sequence
tcttcctctgccagcaagaa

SEQ ID NO: 278277 - DNA, 20 bp, Artificial
  CRISPR gRNA sequence
cttcctctgccagcaagaag

SEQ ID NO: 278278 - DNA, 20 bp, Artificial
  CRISPR gRNA sequence
cctctgccagcaagaagggg

SEQ ID NO: 278279 - DNA, 20 bp, Artificial
  CRISPR gRNA sequence
tgccagcaagaaggggcagt

SEQ ID NO: 278280 - DNA, 20 bp, Artificial
  CRISPR gRNA sequence
agcaagaaggggcagtgagc

SEQ ID NO: 278281 - DNA, 20 bp, Artificial
  CRISPR gRNA sequence
gcaagaaggggcagtgagct

SEQ ID NO: 278282 - DNA, 20 bp, Artificial
  CRISPR gRNA sequence
agaaggggcagtgagctggg

SEQ ID NO: 278283 - DNA, 20 bp, Artificial
  CRISPR gRNA sequence
aggggcagtgagctgggaag

SEQ ID NO: 278284 - DNA, 20 bp, Artificial
  CRISPR gRNA sequence
ggcagtgagctgggaagtag

SEQ ID NO: 278285 - DNA, 20 bp, Artificial
  CRISPR gRNA sequence
cagtgagctgggaagtagca

SEQ ID NO: 278286 - DNA, 20 bp, Artificial
  CRISPR gRNA sequence
agtgagctgggaagtagcag

SEQ ID NO: 278287 - DNA, 20 bp, Artificial
  CRISPR gRNA sequence
tgagctgggaagtagcagag

SEQ ID NO: 278288 - DNA, 20 bp, Artificial
  CRISPR gRNA sequence
gagctgggaagtagcagagg

SEQ ID NO: 278289 - DNA, 20 bp, Artificial
  CRISPR gRNA sequence
agctgggaagtagcagagga

SEQ ID NO: 278290 - DNA, 20 bp, Artificial
  CRISPR gRNA sequence
ggaagtagcagaggagggac

SEQ ID NO: 278291 - DNA, 20 bp, Artificial
  CRISPR gRNA sequence
tagcagaggagggactggcc

SEQ ID NO: 278292 - DNA, 20 bp, Artificial
  CRISPR gRNA sequence
agaggagggactggcccagt

SEQ ID NO: 278293 - DNA, 20 bp, Artificial
  CRISPR gRNA sequence
gagggactggcccagtgagc

SEQ ID NO: 278294 - DNA, 20 bp, Artificial
  CRISPR gRNA sequence
ctggcccagtgagcaagaac

SEQ ID NO: 278295 - DNA, 20 bp, Artificial
  CRISPR gRNA sequence
tgagcaagaaccggaccctg

SEQ ID NO: 278296 - DNA, 20 bp, Artificial
  CRISPR gRNA sequence
ccggaccctgcagcacttgt

SEQ ID NO: 278297 - DNA, 20 bp, Artificial
  CRISPR gRNA sequence
tcatgaatccgcatgttatt

SEQ ID NO: 278298 - DNA, 20 bp, Artificial
  CRISPR gRNA sequence
catgaatccgcatgttattc

SEQ ID NO: 278299 - DNA, 20 bp, Artificial
  CRISPR gRNA sequence
gaatccgcatgttattcagg

SEQ ID NO: 278300 - DNA, 20 bp, Artificial
  CRISPR gRNA sequence
ccgcatgttattcaggaagc

SEQ ID NO: 278301 - DNA, 20 bp, Artificial
  CRISPR gRNA sequence
catgttattcaggaagctgg

SEQ ID NO: 278302 - DNA, 20 bp, Artificial
  CRISPR gRNA sequence
atgttattcaggaagctgga

SEQ ID NO: 278303 - DNA, 20 bp, Artificial
  CRISPR gRNA sequence
tgttattcaggaagctggaa

SEQ ID NO: 278304 - DNA, 20 bp, Artificial
  CRISPR gRNA sequence
gaagctggaagggctttacc

SEQ ID NO: 278305 - DNA, 20 bp, Artificial
  CRISPR gRNA sequence
aagctggaagggctttaccc

SEQ ID NO: 278306 - DNA, 20 bp, Artificial
  CRISPR gRNA sequence
gctggaagggctttacccag

SEQ ID NO: 278307 - DNA, 20 bp, Artificial
  CRISPR gRNA sequence
tggaagggctttacccagga

SEQ ID NO: 278308 - DNA, 20 bp, Artificial
  CRISPR gRNA sequence
aagggctttacccaggagag

SEQ ID NO: 278309 - DNA, 20 bp, Artificial
  CRISPR gRNA sequence
ctttacccaggagagtggcg

SEQ ID NO: 278310 - DNA, 20 bp, Artificial
  CRISPR gRNA sequence
gagagtggcgtggtctaccc

SEQ ID NO: 278311 - DNA, 20 bp, Artificial
  CRISPR gRNA sequence
tcactctttacacataccaa

SEQ ID NO: 278312 - DNA, 20 bp, Artificial
  CRISPR gRNA sequence
ctttacacataccaatagcc

SEQ ID NO: 278313 - DNA, 20 bp, Artificial
  CRISPR gRNA sequence
tttacacataccaatagcct

SEQ ID NO: 278314 - DNA, 20 bp, Artificial
  CRISPR gRNA sequence
ttacacataccaatagcctg

SEQ ID NO: 278315 - DNA, 20 bp, Artificial
  CRISPR gRNA sequence
tacacataccaatagcctgg

SEQ ID NO: 278316 - DNA, 20 bp, Artificial
  CRISPR gRNA sequence
ctgggggttttgctaaattg

SEQ ID NO: 278317 - DNA, 20 bp, Artificial
  CRISPR gRNA sequence
ttttgctaaattgcagtttc

SEQ ID NO: 278318 - DNA, 20 bp, Artificial
  CRISPR gRNA sequence
ctaaattgcagtttctagca

SEQ ID NO: 278319 - DNA, 20 bp, Artificial
  CRISPR gRNA sequence
taaattgcagtttctagcac

SEQ ID NO: 278320 - DNA, 20 bp, Artificial
  CRISPR gRNA sequence
aaattgcagtttctagcaca

SEQ ID NO: 278321 - DNA, 20 bp, Artificial
  CRISPR gRNA sequence
ttctagcacagggaattttt

SEQ ID NO: 278322 - DNA, 20 bp, Artificial
  CRISPR gRNA sequence
ctagcacagggaatttttta

SEQ ID NO: 278323 - DNA, 20 bp, Artificial
  CRISPR gRNA sequence
gcacagggaattttttagag

SEQ ID NO: 278324 - DNA, 20 bp, Artificial
  CRISPR gRNA sequence
tttgcataatactgtaatga

SEQ ID NO: 278325 - DNA, 20 bp, Artificial
  CRISPR gRNA sequence
aatactgtaatgatagatat

SEQ ID NO: 278326 - DNA, 20 bp, Artificial
  CRISPR gRNA sequence
tataaatttgcccaaatcca

SEQ ID NO: 278327 - DNA, 20 bp, Artificial
  CRISPR gRNA sequence
atccatagaatatgcaatac

SEQ ID NO: 278328 - DNA, 20 bp, Artificial
  CRISPR gRNA sequence
tccatagaatatgcaatacc

SEQ ID NO: 278329 - DNA, 20 bp, Artificial
  CRISPR gRNA sequence
catagaatatgcaataccag

SEQ ID NO: 278330 - DNA, 20 bp, Artificial
  CRISPR gRNA sequence
gtgacccctatcgtgaactc

SEQ ID NO: 278331 - DNA, 20 bp, Artificial
  CRISPR gRNA sequence
cctatcgtgaactctagatt

SEQ ID NO: 278332 - DNA, 20 bp, Artificial
  CRISPR gRNA sequence
ctatcgtgaactctagattt

SEQ ID NO: 278333 - DNA, 20 bp, Artificial
  CRISPR gRNA sequence
tatcgtgaactctagatttg

SEQ ID NO: 278334 - DNA, 20 bp, Artificial
  CRISPR gRNA sequence
cgtgaactctagatttgggg

SEQ ID NO: 278335 - DNA, 20 bp, Artificial
  CRISPR gRNA sequence
gtggtaatgatgtgttaatg

SEQ ID NO: 278336 - DNA, 20 bp, Artificial
  CRISPR gRNA sequence
tggtaatgatgtgttaatgt

SEQ ID NO: 278337 - DNA, 20 bp, Artificial
  CRISPR gRNA sequence
gtaggttcattgattgtaac

SEQ ID NO: 278338 - DNA, 20 bp, Artificial
  CRISPR gRNA sequence
ttgtaacaagtgtactgccc

SEQ ID NO: 278339 - DNA, 20 bp, Artificial
  CRISPR gRNA sequence
acaagtgtactgccctggcg

SEQ ID NO: 278340 - DNA, 20 bp, Artificial
  CRISPR gRNA sequence
caagtgtactgccctggcgc

SEQ ID NO: 278341 - DNA, 20 bp, Artificial
  CRISPR gRNA sequence
tactgccctggcgcaggatg

SEQ ID NO: 278342 - DNA, 20 bp, Artificial
  CRISPR gRNA sequence
gccctggcgcaggatgtaga

SEQ ID NO: 278343 - DNA, 20 bp, Artificial
  CRISPR gRNA sequence
ctggcgcaggatgtagacag

SEQ ID NO: 278344 - DNA, 20 bp, Artificial
  CRISPR gRNA sequence
gcgcaggatgtagacagtgg

SEQ ID NO: 278345 - DNA, 20 bp, Artificial
  CRISPR gRNA sequence
caggatgtagacagtggcgg

SEQ ID NO: 278346 - DNA, 20 bp, Artificial
  CRISPR gRNA sequence
tggcggaagctgtgaatatg

SEQ ID NO: 278347 - DNA, 20 bp, Artificial
  CRISPR gRNA sequence
ggcggaagctgtgaatatgt

SEQ ID NO: 278348 - DNA, 20 bp, Artificial
  CRISPR gRNA sequence
gcggaagctgtgaatatgtg

SEQ ID NO: 278349 - DNA, 20 bp, Artificial
  CRISPR gRNA sequence
ggaagctgtgaatatgtggg

SEQ ID NO: 278350 - DNA, 20 bp, Artificial
  CRISPR gRNA sequence
gaagctgtgaatatgtgggg

SEQ ID NO: 278351 - DNA, 20 bp, Artificial
  CRISPR gRNA sequence
aagctgtgaatatgtgggga

SEQ ID NO: 278352 - DNA, 20 bp, Artificial
  CRISPR gRNA sequence
agctgtgaatatgtggggag

SEQ ID NO: 278353 - DNA, 20 bp, Artificial
  CRISPR gRNA sequence
gctgtgaatatgtggggagg

SEQ ID NO: 278354 - DNA, 20 bp, Artificial
  CRISPR gRNA sequence
tcaatttttcgatgaaccta

SEQ ID NO: 278355 - DNA, 20 bp, Artificial
  CRISPR gRNA sequence
atttttcgatgaacctaaag

SEQ ID NO: 278356 - DNA, 20 bp, Artificial
  CRISPR gRNA sequence
taaagcagctctaaaaaata

SEQ ID NO: 278357 - DNA, 20 bp, Artificial
  CRISPR gRNA sequence
tctaaaaaataaagtctata

SEQ ID NO: 278358 - DNA, 20 bp, Artificial
  CRISPR gRNA sequence
ttttaaatgctgtttctgct

SEQ ID NO: 278359 - DNA, 20 bp, Artificial
  CRISPR gRNA sequence
tttaaatgctgtttctgctt

SEQ ID NO: 278360 - DNA, 20 bp, Artificial
  CRISPR gRNA sequence
aaatgctgtttctgcttagg

SEQ ID NO: 278361 - DNA, 20 bp, Artificial
  CRISPR gRNA sequence
aatgctgtttctgcttaggt

SEQ ID NO: 278362 - DNA, 20 bp, Artificial
  CRISPR gRNA sequence
tgtttctgcttaggtgggtc

SEQ ID NO: 278363 - DNA, 20 bp, Artificial
  CRISPR gRNA sequence
gtttctgcttaggtgggtct

SEQ ID NO: 278364 - DNA, 20 bp, Artificial
  CRISPR gRNA sequence
ctgcttaggtgggtctggga

SEQ ID NO: 278365 - DNA, 20 bp, Artificial
  CRISPR gRNA sequence
tgcttaggtgggtctgggat

SEQ ID NO: 278366 - DNA, 20 bp, Artificial
  CRISPR gRNA sequence
gcttaggtgggtctgggatg

SEQ ID NO: 278367 - DNA, 20 bp, Artificial
  CRISPR gRNA sequence
gtgggtctgggatggggcct

SEQ ID NO: 278368 - DNA, 20 bp, Artificial
  CRISPR gRNA sequence
gcctgagattctgcatttct

SEQ ID NO: 278369 - DNA, 20 bp, Artificial
  CRISPR gRNA sequence
tgagattctgcatttctaag

SEQ ID NO: 278370 - DNA, 20 bp, Artificial
  CRISPR gRNA sequence
ctgcatttctaagaagcacc

SEQ ID NO: 278371 - DNA, 20 bp, Artificial
  CRISPR gRNA sequence
tgcatttctaagaagcacct

SEQ ID NO: 278372 - DNA, 20 bp, Artificial
  CRISPR gRNA sequence
gctgctccaccatacacttt

SEQ ID NO: 278373 - DNA, 20 bp, Artificial
  CRISPR gRNA sequence
ccaccatacactttgagttt

SEQ ID NO: 278374 - DNA, 20 bp, Artificial
  CRISPR gRNA sequence
ccatacactttgagtttcag

SEQ ID NO: 278375 - DNA, 20 bp, Artificial
  CRISPR gRNA sequence
cactttgagtttcagtagta

SEQ ID NO: 278376 - DNA, 20 bp, Artificial
  CRISPR gRNA sequence
actttgagtttcagtagtaa

SEQ ID NO: 278377 - DNA, 20 bp, Artificial
  CRISPR gRNA sequence
aaaggtgtaaataactttaa

SEQ ID NO: 278378 - DNA, 20 bp, Artificial
  CRISPR gRNA sequence
aaggtgtaaataactttaaa

SEQ ID NO: 278379 - DNA, 20 bp, Artificial
  CRISPR gRNA sequence
aaataactttaaaaggaaaa

SEQ ID NO: 278380 - DNA, 20 bp, Artificial
  CRISPR gRNA sequence
aaaggaaaaaagtgttactg

SEQ ID NO: 278381 - DNA, 20 bp, Artificial
  CRISPR gRNA sequence
aaaaaagtgttactgaagaa

SEQ ID NO: 278382 - DNA, 20 bp, Artificial
  CRISPR gRNA sequence
aaaagtgttactgaagaaca

SEQ ID NO: 278383 - DNA, 20 bp, Artificial
  CRISPR gRNA sequence
agtgttactgaagaacagag

SEQ ID NO: 278384 - DNA, 20 bp, Artificial
  CRISPR gRNA sequence
ctgaagaacagagtggcttg

SEQ ID NO: 278385 - DNA, 20 bp, Artificial
  CRISPR gRNA sequence
tgaagaacagagtggcttgt

SEQ ID NO: 278386 - DNA, 20 bp, Artificial
  CRISPR gRNA sequence
gaagaacagagtggcttgta

SEQ ID NO: 278387 - DNA, 20 bp, Artificial
  CRISPR gRNA sequence
gaacagagtggcttgtaggg

SEQ ID NO: 278388 - DNA, 20 bp, Artificial
  CRISPR gRNA sequence
agtggcttgtagggcagcca

SEQ ID NO: 278389 - DNA, 20 bp, Artificial
  CRISPR gRNA sequence
agtgactgtgcaaaacctat

SEQ ID NO: 278390 - DNA, 20 bp, Artificial
  CRISPR gRNA sequence
gtgactgtgcaaaacctatt

SEQ ID NO: 278391 - DNA, 20 bp, Artificial
  CRISPR gRNA sequence
gactgtgcaaaacctattag

SEQ ID NO: 278392 - DNA, 20 bp, Artificial
  CRISPR gRNA sequence
actgtgcaaaacctattagg

SEQ ID NO: 278393 - DNA, 20 bp, Artificial
  CRISPR gRNA sequence
aacctattaggaggttattt

SEQ ID NO: 278394 - DNA, 20 bp, Artificial
  CRISPR gRNA sequence
gaggttatttcagtaactta

SEQ ID NO: 278395 - DNA, 20 bp, Artificial
  CRISPR gRNA sequence
ctgatgatgtctttaatgaa

SEQ ID NO: 278396 - DNA, 20 bp, Artificial
  CRISPR gRNA sequence
atgtctttaatgaaaagaat

SEQ ID NO: 278397 - DNA, 20 bp, Artificial
  CRISPR gRNA sequence
tttaatgaaaagaattggat

SEQ ID NO: 278398 - DNA, 20 bp, Artificial
  CRISPR gRNA sequence
aatgaaaagaattggatcag

SEQ ID NO: 278399 - DNA, 20 bp, Artificial
  CRISPR gRNA sequence
atgaaaagaattggatcaga

SEQ ID NO: 278400 - DNA, 20 bp, Artificial
  CRISPR gRNA sequence
aaaagaattggatcagaagg

SEQ ID NO: 278401 - DNA, 20 bp, Artificial
  CRISPR gRNA sequence
ttggatcagaaggaagttga

SEQ ID NO: 278402 - DNA, 20 bp, Artificial
  CRISPR gRNA sequence
tggatcagaaggaagttgat

SEQ ID NO: 278403 - DNA, 20 bp, Artificial
  CRISPR gRNA sequence
tcagaaggaagttgatgggt

SEQ ID NO: 278404 - DNA, 20 bp, Artificial
  CRISPR gRNA sequence
agaaggaagttgatgggttg

SEQ ID NO: 278405 - DNA, 20 bp, Artificial
  CRISPR gRNA sequence
aaggaagttgatgggttgga

SEQ ID NO: 278406 - DNA, 20 bp, Artificial
  CRISPR gRNA sequence
gagtgtgtaccatgtaaaat

SEQ ID NO: 278407 - DNA, 20 bp, Artificial
  CRISPR gRNA sequence
gtgtaccatgtaaaattagt

SEQ ID NO: 278408 - DNA, 20 bp, Artificial
  CRISPR gRNA sequence
tgtaccatgtaaaattagtg

SEQ ID NO: 278409 - DNA, 20 bp, Artificial
  CRISPR gRNA sequence
aattagtgaggactgctcaa

SEQ ID NO: 278410 - DNA, 20 bp, Artificial
  CRISPR gRNA sequence
attagtgaggactgctcaac

SEQ ID NO: 278411 - DNA, 20 bp, Artificial
  CRISPR gRNA sequence
tagtgaggactgctcaacgg

SEQ ID NO: 278412 - DNA, 20 bp, Artificial
  CRISPR gRNA sequence
aggactgctcaacgggagtg

SEQ ID NO: 278413 - DNA, 20 bp, Artificial
  CRISPR gRNA sequence
ggactgctcaacgggagtgt

SEQ ID NO: 278414 - DNA, 20 bp, Artificial
  CRISPR gRNA sequence
ctcaacgggagtgtaggtgt

SEQ ID NO: 278415 - DNA, 20 bp, Artificial
  CRISPR gRNA sequence
agtgtaggtgtgagtgtgca

SEQ ID NO: 278416 - DNA, 20 bp, Artificial
  CRISPR gRNA sequence
gtgtgagtgtgcatggtctg

SEQ ID NO: 278417 - DNA, 20 bp, Artificial
  CRISPR gRNA sequence
tgtgagtgtgcatggtctgt

SEQ ID NO: 278418 - DNA, 20 bp, Artificial
  CRISPR gRNA sequence
tgagtgtgcatggtctgtgg

SEQ ID NO: 278419 - DNA, 20 bp, Artificial
  CRISPR gRNA sequence
gagtgtgcatggtctgtggg

SEQ ID NO: 278420 - DNA, 20 bp, Artificial
  CRISPR gRNA sequence
gtgcatggtctgtgggaggt

SEQ ID NO: 278421 - DNA, 20 bp, Artificial
  CRISPR gRNA sequence
ggtctgtgggaggtgagatt

SEQ ID NO: 278422 - DNA, 20 bp, Artificial
  CRISPR gRNA sequence
gaggtgagattcagtgaata

SEQ ID NO: 278423 - DNA, 20 bp, Artificial
  CRISPR gRNA sequence
gtgagattcagtgaatacag

SEQ ID NO: 278424 - DNA, 20 bp, Artificial
  CRISPR gRNA sequence
gagattcagtgaatacagtg

SEQ ID NO: 278425 - DNA, 20 bp, Artificial
  CRISPR gRNA sequence
attcagtgaatacagtggag

SEQ ID NO: 278426 - DNA, 20 bp, Artificial
  CRISPR gRNA sequence
ttcagtgaatacagtggagt

SEQ ID NO: 278427 - DNA, 20 bp, Artificial
  CRISPR gRNA sequence
aatacagtggagtaggatta

SEQ ID NO: 278428 - DNA, 20 bp, Artificial
  CRISPR gRNA sequence
tacagtggagtaggattata

SEQ ID NO: 278429 - DNA, 20 bp, Artificial
  CRISPR gRNA sequence
acagtggagtaggattatag

SEQ ID NO: 278430 - DNA, 20 bp, Artificial
  CRISPR gRNA sequence
cagtggagtaggattataga

SEQ ID NO: 278431 - DNA, 20 bp, Artificial
  CRISPR gRNA sequence
ggattatagagggctttatt

SEQ ID NO: 278432 - DNA, 20 bp, Artificial
  CRISPR gRNA sequence
gattatagagggctttattc

SEQ ID NO: 278433 - DNA, 20 bp, Artificial
  CRISPR gRNA sequence
attatagagggctttattca

SEQ ID NO: 278434 - DNA, 20 bp, Artificial
  CRISPR gRNA sequence
atagagggctttattcaggg

SEQ ID NO: 278435 - DNA, 20 bp, Artificial
  CRISPR gRNA sequence
agagggctttattcagggca

SEQ ID NO: 278436 - DNA, 20 bp, Artificial
  CRISPR gRNA sequence
agggcagagatttgccacac

SEQ ID NO: 278437 - DNA, 20 bp, Artificial
  CRISPR gRNA sequence
gggcagagatttgccacact

SEQ ID NO: 278438 - DNA, 20 bp, Artificial
  CRISPR gRNA sequence
cttcctctcctgccacacca

SEQ ID NO: 278439 - DNA, 20 bp, Artificial
  CRISPR gRNA sequence
cctctcctgccacaccatgg

SEQ ID NO: 278440 - DNA, 20 bp, Artificial
  CRISPR gRNA sequence
tctcctgccacaccatggca

SEQ ID NO: 278441 - DNA, 20 bp, Artificial
  CRISPR gRNA sequence
ctcctgccacaccatggcag

SEQ ID NO: 278442 - DNA, 20 bp, Artificial
  CRISPR gRNA sequence
gttccccctctcctcctgcc

SEQ ID NO: 278443 - DNA, 20 bp, Artificial
  CRISPR gRNA sequence
cctgcccagccactgatgcc

SEQ ID NO: 278444 - DNA, 20 bp, Artificial
  CRISPR gRNA sequence
ctgcccagccactgatgccc

SEQ ID NO: 278445 - DNA, 20 bp, Artificial
  CRISPR gRNA sequence
tgcccagccactgatgccca

SEQ ID NO: 278446 - DNA, 20 bp, Artificial
  CRISPR gRNA sequence
gcccagccactgatgcccag

SEQ ID NO: 278447 - DNA, 20 bp, Artificial
  CRISPR gRNA sequence
cagccactgatgcccagggg

SEQ ID NO: 278448 - DNA, 20 bp, Artificial
  CRISPR gRNA sequence
agccactgatgcccagggga

SEQ ID NO: 278449 - DNA, 20 bp, Artificial
  CRISPR gRNA sequence
gccactgatgcccaggggaa

SEQ ID NO: 278450 - DNA, 20 bp, Artificial
  CRISPR gRNA sequence
agggactcctctttcatgca

SEQ ID NO: 278451 - DNA, 20 bp, Artificial
  CRISPR gRNA sequence
gggactcctctttcatgcac

SEQ ID NO: 278452 - DNA, 20 bp, Artificial
  CRISPR gRNA sequence
ggactcctctttcatgcaca

SEQ ID NO: 278453 - DNA, 20 bp, Artificial
  CRISPR gRNA sequence
ctcctctttcatgcacaggg

SEQ ID NO: 278454 - DNA, 20 bp, Artificial
  CRISPR gRNA sequence
tttcatgcacagggtggaac

SEQ ID NO: 278455 - DNA, 20 bp, Artificial
  CRISPR gRNA sequence
atgcacagggtggaaccagc

SEQ ID NO: 278456 - DNA, 20 bp, Artificial
  CRISPR gRNA sequence
tgcacagggtggaaccagcc

SEQ ID NO: 278457 - DNA, 20 bp, Artificial
  CRISPR gRNA sequence
gccaggctcctctccccctc

SEQ ID NO: 278458 - DNA, 20 bp, Artificial
  CRISPR gRNA sequence
ccaggctcctctccccctct

SEQ ID NO: 278459 - DNA, 20 bp, Artificial
  CRISPR gRNA sequence
cctctccccctctaggcctg

SEQ ID NO: 278460 - DNA, 20 bp, Artificial
  CRISPR gRNA sequence
ctctccccctctaggcctgc

SEQ ID NO: 278461 - DNA, 20 bp, Artificial
  CRISPR gRNA sequence
aggcctgcaggcactgtcta

SEQ ID NO: 278462 - DNA, 20 bp, Artificial
  CRISPR gRNA sequence
gcctgcaggcactgtctatg

SEQ ID NO: 278463 - DNA, 20 bp, Artificial
  CRISPR gRNA sequence
cctgcaggcactgtctatgg

SEQ ID NO: 278464 - DNA, 20 bp, Artificial
  CRISPR gRNA sequence
gcaggcactgtctatggagg

SEQ ID NO: 278465 - DNA, 20 bp, Artificial
  CRISPR gRNA sequence
ggcagaaacgcctgacttta

SEQ ID NO: 278466 - DNA, 20 bp, Artificial
  CRISPR gRNA sequence
aaacgcctgactttatagtc

SEQ ID NO: 278467 - DNA, 20 bp, Artificial
  CRISPR gRNA sequence
tgactttatagtccagcaac

SEQ ID NO: 278468 - DNA, 20 bp, Artificial
  CRISPR gRNA sequence
ctttatagtccagcaactgg

SEQ ID NO: 278469 - DNA, 20 bp, Artificial
  CRISPR gRNA sequence
tatagtccagcaactggtgg

SEQ ID NO: 278470 - DNA, 20 bp, Artificial
  CRISPR gRNA sequence
gtccagcaactggtggcagt

SEQ ID NO: 278471 - DNA, 20 bp, Artificial
  CRISPR gRNA sequence
tccagcaactggtggcagta

SEQ ID NO: 278472 - DNA, 20 bp, Artificial
  CRISPR gRNA sequence
agcaactggtggcagtaagg

SEQ ID NO: 278473 - DNA, 20 bp, Artificial
  CRISPR gRNA sequence
caactggtggcagtaaggca

SEQ ID NO: 278474 - DNA, 20 bp, Artificial
  CRISPR gRNA sequence
aactggtggcagtaaggcag

SEQ ID NO: 278475 - DNA, 20 bp, Artificial
  CRISPR gRNA sequence
cagtaaggcagaggctctaa

SEQ ID NO: 278476 - DNA, 20 bp, Artificial
  CRISPR gRNA sequence
agtaaggcagaggctctaac

SEQ ID NO: 278477 - DNA, 20 bp, Artificial
  CRISPR gRNA sequence
gtaaggcagaggctctaaca

SEQ ID NO: 278478 - DNA, 20 bp, Artificial
  CRISPR gRNA sequence
aggcagaggctctaacaggg

SEQ ID NO: 278479 - DNA, 20 bp, Artificial
  CRISPR gRNA sequence
ggctctaacagggcagccct

SEQ ID NO: 278480 - DNA, 20 bp, Artificial
  CRISPR gRNA sequence
ctctaacagggcagccctca

SEQ ID NO: 278481 - DNA, 20 bp, Artificial
  CRISPR gRNA sequence
tctaacagggcagccctcag

SEQ ID NO: 278482 - DNA, 20 bp, Artificial
  CRISPR gRNA sequence
ctaacagggcagccctcaga

SEQ ID NO: 278483 - DNA, 20 bp, Artificial
  CRISPR gRNA sequence
agccctcagagggaccaatg

SEQ ID NO: 278484 - DNA, 20 bp, Artificial
  CRISPR gRNA sequence
gccctcagagggaccaatgt

SEQ ID NO: 278485 - DNA, 20 bp, Artificial
  CRISPR gRNA sequence
ctcagagggaccaatgtggg

SEQ ID NO: 278486 - DNA, 20 bp, Artificial
  CRISPR gRNA sequence
aatgtgggcagcttttcctt

SEQ ID NO: 278487 - DNA, 20 bp, Artificial
  CRISPR gRNA sequence
tgtgggcagcttttccttca

SEQ ID NO: 278488 - DNA, 20 bp, Artificial
  CRISPR gRNA sequence
ggcagcttttccttcagagc

SEQ ID NO: 278489 - DNA, 20 bp, Artificial
  CRISPR gRNA sequence
cagcttttccttcagagctg

SEQ ID NO: 278490 - DNA, 20 bp, Artificial
  CRISPR gRNA sequence
cttcagagctggagtccttt

SEQ ID NO: 278491 - DNA, 20 bp, Artificial
  CRISPR gRNA sequence
tcagagctggagtcctttaa

SEQ ID NO: 278492 - DNA, 20 bp, Artificial
  CRISPR gRNA sequence
agagctggagtcctttaaga

SEQ ID NO: 278493 - DNA, 20 bp, Artificial
  CRISPR gRNA sequence
gagctggagtcctttaagag

SEQ ID NO: 278494 - DNA, 20 bp, Artificial
  CRISPR gRNA sequence
agctggagtcctttaagaga

SEQ ID NO: 278495 - DNA, 20 bp, Artificial
  CRISPR gRNA sequence
ggagtcctttaagagagggt

SEQ ID NO: 278496 - DNA, 20 bp, Artificial
  CRISPR gRNA sequence
gagtcctttaagagagggtc

SEQ ID NO: 278497 - DNA, 20 bp, Artificial
  CRISPR gRNA sequence
tttaagagagggtcaggtct

SEQ ID NO: 278498 - DNA, 20 bp, Artificial
  CRISPR gRNA sequence
ttaagagagggtcaggtcta

SEQ ID NO: 278499 - DNA, 20 bp, Artificial
  CRISPR gRNA sequence
aagagagggtcaggtctaag

SEQ ID NO: 278500 - DNA, 20 bp, Artificial
  CRISPR gRNA sequence
gagagggtcaggtctaagga

SEQ ID NO: 278501 - DNA, 20 bp, Artificial
  CRISPR gRNA sequence
agagggtcaggtctaaggag

SEQ ID NO: 278502 - DNA, 20 bp, Artificial
  CRISPR gRNA sequence
gagggtcaggtctaaggaga

SEQ ID NO: 278503 - DNA, 20 bp, Artificial
  CRISPR gRNA sequence
agggtcaggtctaaggagag

SEQ ID NO: 278504 - DNA, 20 bp, Artificial
  CRISPR gRNA sequence
tcaggtctaaggagagggga

SEQ ID NO: 278505 - DNA, 20 bp, Artificial
  CRISPR gRNA sequence
caggtctaaggagaggggaa

SEQ ID NO: 278506 - DNA, 20 bp, Artificial
  CRISPR gRNA sequence
gagaggggaaaggcctcctg

SEQ ID NO: 278507 - DNA, 20 bp, Artificial
  CRISPR gRNA sequence
agaggggaaaggcctcctgt

SEQ ID NO: 278508 - DNA, 20 bp, Artificial
  CRISPR gRNA sequence
aggggaaaggcctcctgtag

SEQ ID NO: 278509 - DNA, 20 bp, Artificial
  CRISPR gRNA sequence
ggggaaaggcctcctgtagg

SEQ ID NO: 278510 - DNA, 20 bp, Artificial
  CRISPR gRNA sequence
ggaaaggcctcctgtaggag

SEQ ID NO: 278511 - DNA, 20 bp, Artificial
  CRISPR gRNA sequence
gaaaggcctcctgtaggagg

SEQ ID NO: 278512 - DNA, 20 bp, Artificial
  CRISPR gRNA sequence
ggcctcctgtaggaggaggc

SEQ ID NO: 278513 - DNA, 20 bp, Artificial
  CRISPR gRNA sequence
cctcctgtaggaggaggcaa

SEQ ID NO: 278514 - DNA, 20 bp, Artificial
  CRISPR gRNA sequence
gtaggaggaggcaagagatg

SEQ ID NO: 278515 - DNA, 20 bp, Artificial
  CRISPR gRNA sequence
taggaggaggcaagagatgt

SEQ ID NO: 278516 - DNA, 20 bp, Artificial
  CRISPR gRNA sequence
ggaggcaagagatgtaggaa

SEQ ID NO: 278517 - DNA, 20 bp, Artificial
  CRISPR gRNA sequence
gtaggaaaagcattgcctat

SEQ ID NO: 278518 - DNA, 20 bp, Artificial
  CRISPR gRNA sequence
aagcattgcctataagttta

SEQ ID NO: 278519 - DNA, 20 bp, Artificial
  CRISPR gRNA sequence
tgcctataagtttatagtct

SEQ ID NO: 278520 - DNA, 20 bp, Artificial
  CRISPR gRNA sequence
aagtttatagtctgagaact

SEQ ID NO: 278521 - DNA, 20 bp, Artificial
  CRISPR gRNA sequence
gtttatagtctgagaactca

SEQ ID NO: 278522 - DNA, 20 bp, Artificial
  CRISPR gRNA sequence
atagtctgagaactcagagc

SEQ ID NO: 278523 - DNA, 20 bp, Artificial
  CRISPR gRNA sequence
tagtctgagaactcagagct

SEQ ID NO: 278524 - DNA, 20 bp, Artificial
  CRISPR gRNA sequence
gtctgagaactcagagctag

SEQ ID NO: 278525 - DNA, 20 bp, Artificial
  CRISPR gRNA sequence
agaactcagagctaggagaa

SEQ ID NO: 278526 - DNA, 20 bp, Artificial
  CRISPR gRNA sequence
aactcagagctaggagaaaa

SEQ ID NO: 278527 - DNA, 20 bp, Artificial
  CRISPR gRNA sequence
ggagaaaagagaatacccca

SEQ ID NO: 278528 - DNA, 20 bp, Artificial
  CRISPR gRNA sequence
ccccaaagtgccaccattca

SEQ ID NO: 278529 - DNA, 20 bp, Artificial
  CRISPR gRNA sequence
aacacacaccgctatgctgc

SEQ ID NO: 278530 - DNA, 20 bp, Artificial
  CRISPR gRNA sequence
acaccgctatgctgctggcc

SEQ ID NO: 278531 - DNA, 20 bp, Artificial
  CRISPR gRNA sequence
caccgctatgctgctggccc

SEQ ID NO: 278532 - DNA, 20 bp, Artificial
  CRISPR gRNA sequence
accgctatgctgctggccca

SEQ ID NO: 278533 - DNA, 20 bp, Artificial
  CRISPR gRNA sequence
ccgctatgctgctggcccag

SEQ ID NO: 278534 - DNA, 20 bp, Artificial
  CRISPR gRNA sequence
tgctggcccaggggtcccat

SEQ ID NO: 278535 - DNA, 20 bp, Artificial
  CRISPR gRNA sequence
tggcccaggggtcccatgag

SEQ ID NO: 278536 - DNA, 20 bp, Artificial
  CRISPR gRNA sequence
tgccatcatcaccctgacaa

SEQ ID NO: 278537 - DNA, 20 bp, Artificial
  CRISPR gRNA sequence
caccctgacaacagctgttc

SEQ ID NO: 278538 - DNA, 20 bp, Artificial
  CRISPR gRNA sequence
ttcaagtccctgtgcatttt

SEQ ID NO: 278539 - DNA, 20 bp, Artificial
  CRISPR gRNA sequence
tcaagtccctgtgcatttta

SEQ ID NO: 278540 - DNA, 20 bp, Artificial
  CRISPR gRNA sequence
ttaaggatataaatactgtt

SEQ ID NO: 278541 - DNA, 20 bp, Artificial
  CRISPR gRNA sequence
ggatataaatactgtttaga

SEQ ID NO: 278542 - DNA, 20 bp, Artificial
  CRISPR gRNA sequence
atataaatactgtttagaaa

SEQ ID NO: 278543 - DNA, 20 bp, Artificial
  CRISPR gRNA sequence
atactgtttagaaagagaaa

SEQ ID NO: 278544 - DNA, 20 bp, Artificial
  CRISPR gRNA sequence
tgtttagaaagagaaaaagt

SEQ ID NO: 278545 - DNA, 20 bp, Artificial
  CRISPR gRNA sequence
gtttagaaagagaaaaagta

SEQ ID NO: 278546 - DNA, 20 bp, Artificial
  CRISPR gRNA sequence
gaaagagaaaaagtaaggat

SEQ ID NO: 278547 - DNA, 20 bp, Artificial
  CRISPR gRNA sequence
gagaaaaagtaaggatcaga

SEQ ID NO: 278548 - DNA, 20 bp, Artificial
  CRISPR gRNA sequence
aaagtaaggatcagatggta

SEQ ID NO: 278549 - DNA, 20 bp, Artificial
  CRISPR gRNA sequence
agtaaggatcagatggtaca

SEQ ID NO: 278550 - DNA, 20 bp, Artificial
  CRISPR gRNA sequence
tcagatggtacagagtatat

SEQ ID NO: 278551 - DNA, 20 bp, Artificial
  CRISPR gRNA sequence
gatggtacagagtatatgag

SEQ ID NO: 278552 - DNA, 20 bp, Artificial
  CRISPR gRNA sequence
atggtacagagtatatgagc

SEQ ID NO: 278553 - DNA, 20 bp, Artificial
  CRISPR gRNA sequence
tggtacagagtatatgagca

SEQ ID NO: 278554 - DNA, 20 bp, Artificial
  CRISPR gRNA sequence
gtatatgagcagggtctaaa

SEQ ID NO: 278555 - DNA, 20 bp, Artificial
  CRISPR gRNA sequence
tatatgagcagggtctaaac

SEQ ID NO: 278556 - DNA, 20 bp, Artificial
  CRISPR gRNA sequence
atatgagcagggtctaaaca

SEQ ID NO: 278557 - DNA, 20 bp, Artificial
  CRISPR gRNA sequence
tatgagcagggtctaaacag

SEQ ID NO: 278558 - DNA, 20 bp, Artificial
  CRISPR gRNA sequence
atgagcagggtctaaacagg

SEQ ID NO: 278559 - DNA, 20 bp, Artificial
  CRISPR gRNA sequence
cagggtctaaacagggggaa

SEQ ID NO: 278560 - DNA, 20 bp, Artificial
  CRISPR gRNA sequence
gtctaaacagggggaaaagt

SEQ ID NO: 278561 - DNA, 20 bp, Artificial
  CRISPR gRNA sequence
tctaaacagggggaaaagtc

SEQ ID NO: 278562 - DNA, 20 bp, Artificial
  CRISPR gRNA sequence
acagggggaaaagtcaggaa

SEQ ID NO: 278563 - DNA, 20 bp, Artificial
  CRISPR gRNA sequence
gtcaggaacagtgtgaacac

SEQ ID NO: 278564 - DNA, 20 bp, Artificial
  CRISPR gRNA sequence
tcaggaacagtgtgaacacg

SEQ ID NO: 278565 - DNA, 20 bp, Artificial
  CRISPR gRNA sequence
aggaacagtgtgaacacgag

SEQ ID NO: 278566 - DNA, 20 bp, Artificial
  CRISPR gRNA sequence
agtgtgaacacgaggagaca

SEQ ID NO: 278567 - DNA, 20 bp, Artificial
  CRISPR gRNA sequence
gtgtgaacacgaggagacac

SEQ ID NO: 278568 - DNA, 20 bp, Artificial
  CRISPR gRNA sequence
cacgaggagacacaggtctc

SEQ ID NO: 278569 - DNA, 20 bp, Artificial
  CRISPR gRNA sequence
agacacaggtctcaagcctg

SEQ ID NO: 278570 - DNA, 20 bp, Artificial
  CRISPR gRNA sequence
ggtctcaagcctgtggctgc

SEQ ID NO: 278571 - DNA, 20 bp, Artificial
  CRISPR gRNA sequence
tctcaagcctgtggctgcca

SEQ ID NO: 278572 - DNA, 20 bp, Artificial
  CRISPR gRNA sequence
ctcaagcctgtggctgccag

SEQ ID NO: 278573 - DNA, 20 bp, Artificial
  CRISPR gRNA sequence
aagcctgtggctgccagagg

SEQ ID NO: 278574 - DNA, 20 bp, Artificial
  CRISPR gRNA sequence
ctctgcctgtctcctttgtg

SEQ ID NO: 278575 - DNA, 20 bp, Artificial
  CRISPR gRNA sequence
gcctgtctcctttgtgtggc

SEQ ID NO: 278576 - DNA, 20 bp, Artificial
  CRISPR gRNA sequence
tcctttgtgtggctagcacc

SEQ ID NO: 278577 - DNA, 20 bp, Artificial
  CRISPR gRNA sequence
tgtgtggctagcacctagcc

SEQ ID NO: 278578 - DNA, 20 bp, Artificial
  CRISPR gRNA sequence
gtgtggctagcacctagccc

SEQ ID NO: 278579 - DNA, 20 bp, Artificial
  CRISPR gRNA sequence
tgtggctagcacctagccca

SEQ ID NO: 278580 - DNA, 20 bp, Artificial
  CRISPR gRNA sequence
acctagcccagggctgacac

SEQ ID NO: 278581 - DNA, 20 bp, Artificial
  CRISPR gRNA sequence
agggctgacaccagccctgt

SEQ ID NO: 278582 - DNA, 20 bp, Artificial
  CRISPR gRNA sequence
gacaccagccctgtcggtgc

SEQ ID NO: 278583 - DNA, 20 bp, Artificial
  CRISPR gRNA sequence
agttcacctaatcaaacatt

SEQ ID NO: 278584 - DNA, 20 bp, Artificial
  CRISPR gRNA sequence
ttcacctaatcaaacattta

SEQ ID NO: 278585 - DNA, 20 bp, Artificial
  CRISPR gRNA sequence
tcacctaatcaaacatttag

SEQ ID NO: 278586 - DNA, 20 bp, Artificial
  CRISPR gRNA sequence
cacctaatcaaacatttaga

SEQ ID NO: 278587 - DNA, 20 bp, Artificial
  CRISPR gRNA sequence
acctaatcaaacatttagag

SEQ ID NO: 278588 - DNA, 20 bp, Artificial
  CRISPR gRNA sequence
cctaatcaaacatttagagg

SEQ ID NO: 278589 - DNA, 20 bp, Artificial
  CRISPR gRNA sequence
ctaatcaaacatttagaggg

SEQ ID NO: 278590 - DNA, 20 bp, Artificial
  CRISPR gRNA sequence
tagaggggggtcactcctgt

SEQ ID NO: 278591 - DNA, 20 bp, Artificial
  CRISPR gRNA sequence
aggggggtcactcctgttgg

SEQ ID NO: 278592 - DNA, 20 bp, Artificial
  CRISPR gRNA sequence
gggggtcactcctgttggaa

SEQ ID NO: 278593 - DNA, 20 bp, Artificial
  CRISPR gRNA sequence
ttggaagagtgtgcacaaac

SEQ ID NO: 278594 - DNA, 20 bp, Artificial
  CRISPR gRNA sequence
tggaagagtgtgcacaaacc

SEQ ID NO: 278595 - DNA, 20 bp, Artificial
  CRISPR gRNA sequence
gagtgtgcacaaaccaggaa

SEQ ID NO: 278596 - DNA, 20 bp, Artificial
  CRISPR gRNA sequence
accaggaacggtaaaatctc

SEQ ID NO: 278597 - DNA, 20 bp, Artificial
  CRISPR gRNA sequence
ccaggaacggtaaaatctcc

SEQ ID NO: 278598 - DNA, 20 bp, Artificial
  CRISPR gRNA sequence
ggaacggtaaaatctccagg

SEQ ID NO: 278599 - DNA, 20 bp, Artificial
  CRISPR gRNA sequence
cggtaaaatctccaggtggt

SEQ ID NO: 278600 - DNA, 20 bp, Artificial
  CRISPR gRNA sequence
atctccaggtggtgagacaa

SEQ ID NO: 278601 - DNA, 20 bp, Artificial
  CRISPR gRNA sequence
tctccaggtggtgagacaat

SEQ ID NO: 278602 - DNA, 20 bp, Artificial
  CRISPR gRNA sequence
ctatatcttccattctttct

SEQ ID NO: 278603 - DNA, 20 bp, Artificial
  CRISPR gRNA sequence
ttctaagaatgtttatttca

SEQ ID NO: 278604 - DNA, 20 bp, Artificial
  CRISPR gRNA sequence
aagaatgtttatttcatagt

SEQ ID NO: 278605 - DNA, 20 bp, Artificial
  CRISPR gRNA sequence
agaatgtttatttcatagtc

SEQ ID NO: 278606 - DNA, 20 bp, Artificial
  CRISPR gRNA sequence
gaatgtttatttcatagtca

SEQ ID NO: 278607 - DNA, 20 bp, Artificial
  CRISPR gRNA sequence
agggaaaatgtttatttaaa

SEQ ID NO: 278608 - DNA, 20 bp, Artificial
  CRISPR gRNA sequence
aaaaagcacacttgtgtttc

SEQ ID NO: 278609 - DNA, 20 bp, Artificial
  CRISPR gRNA sequence
aaaagcacacttgtgtttcc

SEQ ID NO: 278610 - DNA, 20 bp, Artificial
  CRISPR gRNA sequence
aaagcacacttgtgtttcca

SEQ ID NO: 278611 - DNA, 20 bp, Artificial
  CRISPR gRNA sequence
agcacacttgtgtttccagg

SEQ ID NO: 278612 - DNA, 20 bp, Artificial
  CRISPR gRNA sequence
atcatgtatgtcccgtcatt

SEQ ID NO: 278613 - DNA, 20 bp, Artificial
  CRISPR gRNA sequence
tgtatgtcccgtcatttggt

SEQ ID NO: 278614 - DNA, 20 bp, Artificial
  CRISPR gRNA sequence
cccgtcatttggtgagttaa

SEQ ID NO: 278615 - DNA, 20 bp, Artificial
  CRISPR gRNA sequence
tgcttctctcccttctccac

SEQ ID NO: 278616 - DNA, 20 bp, Artificial
  CRISPR gRNA sequence
ttctctcccttctccactag

SEQ ID NO: 278617 - DNA, 20 bp, Artificial
  CRISPR gRNA sequence
tctcccttctccactagcag

SEQ ID NO: 278618 - DNA, 20 bp, Artificial
  CRISPR gRNA sequence
ctccactagcagtggtgatg

SEQ ID NO: 278619 - DNA, 20 bp, Artificial
  CRISPR gRNA sequence
agcagtggtgatgcagctcc

SEQ ID NO: 278620 - DNA, 20 bp, Artificial
  CRISPR gRNA sequence
tgcagctcccagacccctgc

SEQ ID NO: 278621 - DNA, 20 bp, Artificial
  CRISPR gRNA sequence
gcagctcccagacccctgcg

SEQ ID NO: 278622 - DNA, 20 bp, Artificial
  CRISPR gRNA sequence
cagctcccagacccctgcga

SEQ ID NO: 278623 - DNA, 20 bp, Artificial
  CRISPR gRNA sequence
ctcccagacccctgcgaggg

SEQ ID NO: 278624 - DNA, 20 bp, Artificial
  CRISPR gRNA sequence
tgcgagggcagcctctctaa

SEQ ID NO: 278625 - DNA, 20 bp, Artificial
  CRISPR gRNA sequence
cagcctctctaacggctgct

SEQ ID NO: 278626 - DNA, 20 bp, Artificial
  CRISPR gRNA sequence
agcctctctaacggctgctg

SEQ ID NO: 278627 - DNA, 20 bp, Artificial
  CRISPR gRNA sequence
gctgctgaggttgaactccc

SEQ ID NO: 278628 - DNA, 20 bp, Artificial
  CRISPR gRNA sequence
ctgctgaggttgaactccct

SEQ ID NO: 278629 - DNA, 20 bp, Artificial
  CRISPR gRNA sequence
gctgaggttgaactccctgg

SEQ ID NO: 278630 - DNA, 20 bp, Artificial
  CRISPR gRNA sequence
ctgaggttgaactccctggg

SEQ ID NO: 278631 - DNA, 20 bp, Artificial
  CRISPR gRNA sequence
tgaggttgaactccctggga

SEQ ID NO: 278632 - DNA, 20 bp, Artificial
  CRISPR gRNA sequence
gaggttgaactccctgggag

SEQ ID NO: 278633 - DNA, 20 bp, Artificial
  CRISPR gRNA sequence
actccctgggaggggcactg

SEQ ID NO: 278634 - DNA, 20 bp, Artificial
  CRISPR gRNA sequence
ctgggaggggcactgcagac

SEQ ID NO: 278635 - DNA, 20 bp, Artificial
  CRISPR gRNA sequence
agactggccactgcatcctc

SEQ ID NO: 278636 - DNA, 20 bp, Artificial
  CRISPR gRNA sequence
gactggccactgcatcctcc

SEQ ID NO: 278637 - DNA, 20 bp, Artificial
  CRISPR gRNA sequence
cactgcatcctccaggcctc

SEQ ID NO: 278638 - DNA, 20 bp, Artificial
  CRISPR gRNA sequence
actgcatcctccaggcctcc

SEQ ID NO: 278639 - DNA, 20 bp, Artificial
  CRISPR gRNA sequence
ctccaggcctccaggctgca

SEQ ID NO: 278640 - DNA, 20 bp, Artificial
  CRISPR gRNA sequence
ccaggcctccaggctgcacg

SEQ ID NO: 278641 - DNA, 20 bp, Artificial
  CRISPR gRNA sequence
aggcctccaggctgcacgga

SEQ ID NO: 278642 - DNA, 20 bp, Artificial
  CRISPR gRNA sequence
ggcctccaggctgcacggag

SEQ ID NO: 278643 - DNA, 20 bp, Artificial
  CRISPR gRNA sequence
gcctccaggctgcacggaga

SEQ ID NO: 278644 - DNA, 20 bp, Artificial
  CRISPR gRNA sequence
tccaggctgcacggagaggg

SEQ ID NO: 278645 - DNA, 20 bp, Artificial
  CRISPR gRNA sequence
ccaggctgcacggagagggt

SEQ ID NO: 278646 - DNA, 20 bp, Artificial
  CRISPR gRNA sequence
caggctgcacggagagggtg

SEQ ID NO: 278647 - DNA, 20 bp, Artificial
  CRISPR gRNA sequence
gctgcacggagagggtgggg

SEQ ID NO: 278648 - DNA, 20 bp, Artificial
  CRISPR gRNA sequence
cggagagggtggggaagact

SEQ ID NO: 278649 - DNA, 20 bp, Artificial
  CRISPR gRNA sequence
ggagagggtggggaagactc

SEQ ID NO: 278650 - DNA, 20 bp, Artificial
  CRISPR gRNA sequence
ggggaagactcaggtcttcc

SEQ ID NO: 278651 - DNA, 20 bp, Artificial
  CRISPR gRNA sequence
agactcaggtcttcctagta

SEQ ID NO: 278652 - DNA, 20 bp, Artificial
  CRISPR gRNA sequence
acataaaattcaacgtttta

SEQ ID NO: 278653 - DNA, 20 bp, Artificial
  CRISPR gRNA sequence
acgttttaaagtatacaatt

SEQ ID NO: 278654 - DNA, 20 bp, Artificial
  CRISPR gRNA sequence
tttaaagtatacaattcagc

SEQ ID NO: 278655 - DNA, 20 bp, Artificial
  CRISPR gRNA sequence
ttaaagtatacaattcagcc

SEQ ID NO: 278656 - DNA, 20 bp, Artificial
  CRISPR gRNA sequence
gtatacaattcagccaggca

SEQ ID NO: 278657 - DNA, 20 bp, Artificial
  CRISPR gRNA sequence
tacaattcagccaggcacgg

SEQ ID NO: 278658 - DNA, 20 bp, Artificial
  CRISPR gRNA sequence
gtggctcactcctgcaatcc

SEQ ID NO: 278659 - DNA, 20 bp, Artificial
  CRISPR gRNA sequence
ctcctgcaatcccagcattt

SEQ ID NO: 278660 - DNA, 20 bp, Artificial
  CRISPR gRNA sequence
tcctgcaatcccagcatttt

SEQ ID NO: 278661 - DNA, 20 bp, Artificial
  CRISPR gRNA sequence
ctgcaatcccagcattttgg

SEQ ID NO: 278662 - DNA, 20 bp, Artificial
  CRISPR gRNA sequence
tgcaatcccagcattttggg

SEQ ID NO: 278663 - DNA, 20 bp, Artificial
  CRISPR gRNA sequence
tcccagcattttgggaggcc

SEQ ID NO: 278664 - DNA, 20 bp, Artificial
  CRISPR gRNA sequence
agcattttgggaggccgaga

SEQ ID NO: 278665 - DNA, 20 bp, Artificial
  CRISPR gRNA sequence
gcattttgggaggccgagat

SEQ ID NO: 278666 - DNA, 20 bp, Artificial
  CRISPR gRNA sequence
ttttgggaggccgagatggg

SEQ ID NO: 278667 - DNA, 20 bp, Artificial
  CRISPR gRNA sequence
ccgagatgggtggatcacct

SEQ ID NO: 278668 - DNA, 20 bp, Artificial
  CRISPR gRNA sequence
cgagatgggtggatcacctg

SEQ ID NO: 278669 - DNA, 20 bp, Artificial
  CRISPR gRNA sequence
atgggtggatcacctgaggt

SEQ ID NO: 278670 - DNA, 20 bp, Artificial
  CRISPR gRNA sequence
tgggtggatcacctgaggtc

SEQ ID NO: 278671 - DNA, 20 bp, Artificial
  CRISPR gRNA sequence
ggtggatcacctgaggtcag

SEQ ID NO: 278672 - DNA, 20 bp, Artificial
  CRISPR gRNA sequence
tcacctgaggtcaggagttt

SEQ ID NO: 278673 - DNA, 20 bp, Artificial
  CRISPR gRNA sequence
tgaggtcaggagtttgagac

SEQ ID NO: 278674 - DNA, 20 bp, Artificial
  CRISPR gRNA sequence
tcaggagtttgagaccagcc

SEQ ID NO: 278675 - DNA, 20 bp, Artificial
  CRISPR gRNA sequence
tgagaccagcctggccaaca

SEQ ID NO: 278676 - DNA, 20 bp, Artificial
  CRISPR gRNA sequence
aatgcaaaaattaaccacac

SEQ ID NO: 278677 - DNA, 20 bp, Artificial
  CRISPR gRNA sequence
atgcaaaaattaaccacaca

SEQ ID NO: 278678 - DNA, 20 bp, Artificial
  CRISPR gRNA sequence
caaaaattaaccacacaagg

SEQ ID NO: 278679 - DNA, 20 bp, Artificial
  CRISPR gRNA sequence
gtggcccgtgcctttaatcc

SEQ ID NO: 278680 - DNA, 20 bp, Artificial
  CRISPR gRNA sequence
tgcctttaatcctagctact

SEQ ID NO: 278681 - DNA, 20 bp, Artificial
  CRISPR gRNA sequence
gcctttaatcctagctactc

SEQ ID NO: 278682 - DNA, 20 bp, Artificial
  CRISPR gRNA sequence
ctttaatcctagctactcag

SEQ ID NO: 278683 - DNA, 20 bp, Artificial
  CRISPR gRNA sequence
tttaatcctagctactcagg

SEQ ID NO: 278684 - DNA, 20 bp, Artificial
  CRISPR gRNA sequence
tcctagctactcaggaggct

SEQ ID NO: 278685 - DNA, 20 bp, Artificial
  CRISPR gRNA sequence
cctagctactcaggaggctg

SEQ ID NO: 278686 - DNA, 20 bp, Artificial
  CRISPR gRNA sequence
agctactcaggaggctgagg

SEQ ID NO: 278687 - DNA, 20 bp, Artificial
  CRISPR gRNA sequence
gctactcaggaggctgaggc

SEQ ID NO: 278688 - DNA, 20 bp, Artificial
  CRISPR gRNA sequence
tactcaggaggctgaggcag

SEQ ID NO: 278689 - DNA, 20 bp, Artificial
  CRISPR gRNA sequence
caggagaatcttttgaaccc

SEQ ID NO: 278690 - DNA, 20 bp, Artificial
  CRISPR gRNA sequence
ggagaatcttttgaaccctg

SEQ ID NO: 278691 - DNA, 20 bp, Artificial
  CRISPR gRNA sequence
gagaatcttttgaaccctgg

SEQ ID NO: 278692 - DNA, 20 bp, Artificial
  CRISPR gRNA sequence
aatcttttgaaccctggagg

SEQ ID NO: 278693 - DNA, 20 bp, Artificial
  CRISPR gRNA sequence
atcttttgaaccctggaggc

SEQ ID NO: 278694 - DNA, 20 bp, Artificial
  CRISPR gRNA sequence
tcttttgaaccctggaggcg

SEQ ID NO: 278695 - DNA, 20 bp, Artificial
  CRISPR gRNA sequence
cttttgaaccctggaggcgg

SEQ ID NO: 278696 - DNA, 20 bp, Artificial
  CRISPR gRNA sequence
ctggaggcgggggttgctgt

SEQ ID NO: 278697 - DNA, 20 bp, Artificial
  CRISPR gRNA sequence
ggcgggggttgctgtgagcc

SEQ ID NO: 278698 - DNA, 20 bp, Artificial
  CRISPR gRNA sequence
aagatcatgccactgcactc

SEQ ID NO: 278699 - DNA, 20 bp, Artificial
  CRISPR gRNA sequence
catgccactgcactccagca

SEQ ID NO: 278700 - DNA, 20 bp, Artificial
  CRISPR gRNA sequence
atgccactgcactccagcat

SEQ ID NO: 278701 - DNA, 20 bp, Artificial
  CRISPR gRNA sequence
ctgcactccagcatgggcaa

SEQ ID NO: 278702 - DNA, 20 bp, Artificial
  CRISPR gRNA sequence
gcactccagcatgggcaaca

SEQ ID NO: 278703 - DNA, 20 bp, Artificial
  CRISPR gRNA sequence
tccagcatgggcaacagagc

SEQ ID NO: 278704 - DNA, 20 bp, Artificial
  CRISPR gRNA sequence
aacagagcgagactctgcct

SEQ ID NO: 278705 - DNA, 20 bp, Artificial
  CRISPR gRNA sequence
aataaataaataaataaata

SEQ ID NO: 278706 - DNA, 20 bp, Artificial
  CRISPR gRNA sequence
aataaataaagtgtacaatt

SEQ ID NO: 278707 - DNA, 20 bp, Artificial
  CRISPR gRNA sequence
aaataaagtgtacaattcag

SEQ ID NO: 278708 - DNA, 20 bp, Artificial
  CRISPR gRNA sequence
aataaagtgtacaattcagt

SEQ ID NO: 278709 - DNA, 20 bp, Artificial
  CRISPR gRNA sequence
gtgtacaattcagtgggttt

SEQ ID NO: 278710 - DNA, 20 bp, Artificial
  CRISPR gRNA sequence
ccaccatcactatcgaattc

SEQ ID NO: 278711 - DNA, 20 bp, Artificial
  CRISPR gRNA sequence
ccatcactatcgaattccag

SEQ ID NO: 278712 - DNA, 20 bp, Artificial
  CRISPR gRNA sequence
catcactatcgaattccaga

SEQ ID NO: 278713 - DNA, 20 bp, Artificial
  CRISPR gRNA sequence
aattccagaaggaaatgttc

SEQ ID NO: 278714 - DNA, 20 bp, Artificial
  CRISPR gRNA sequence
ggaaatgttctggatgatga

SEQ ID NO: 278715 - DNA, 20 bp, Artificial
  CRISPR gRNA sequence
gatgatggaaatcatcatcc

SEQ ID NO: 278716 - DNA, 20 bp, Artificial
  CRISPR gRNA sequence
atggaaatcatcatcccaga

SEQ ID NO: 278717 - DNA, 20 bp, Artificial
  CRISPR gRNA sequence
aagaaacctgcgcctatttg

SEQ ID NO: 278718 - DNA, 20 bp, Artificial
  CRISPR gRNA sequence
ctctatgaatttgcctgttc

SEQ ID NO: 278719 - DNA, 20 bp, Artificial
  CRISPR gRNA sequence
cttttctcttcctttttttc

SEQ ID NO: 278720 - DNA, 20 bp, Artificial
  CRISPR gRNA sequence
cttcctttttttccagaatc

SEQ ID NO: 278721 - DNA, 20 bp, Artificial
  CRISPR gRNA sequence
ttcctttttttccagaatcc

SEQ ID NO: 278722 - DNA, 20 bp, Artificial
  CRISPR gRNA sequence
tttttttccagaatccaggt

SEQ ID NO: 278723 - DNA, 20 bp, Artificial
  CRISPR gRNA sequence
tttccagaatccaggtaaga

SEQ ID NO: 278724 - DNA, 20 bp, Artificial
  CRISPR gRNA sequence
ccaggtaagaaagaatattc

SEQ ID NO: 278725 - DNA, 20 bp, Artificial
  CRISPR gRNA sequence
tggacatttcttacaatatg

SEQ ID NO: 278726 - DNA, 20 bp, Artificial
  CRISPR gRNA sequence
cgtgactattttctttcact

SEQ ID NO: 278727 - DNA, 20 bp, Artificial
  CRISPR gRNA sequence
tcactgagcattatgtcttt

SEQ ID NO: 278728 - DNA, 20 bp, Artificial
  CRISPR gRNA sequence
cactgagcattatgtctttc

SEQ ID NO: 278729 - DNA, 20 bp, Artificial
  CRISPR gRNA sequence
catccatgttgcgtatgtct

SEQ ID NO: 278730 - DNA, 20 bp, Artificial
  CRISPR gRNA sequence
tagtactccattcgctttta

SEQ ID NO: 278731 - DNA, 20 bp, Artificial
  CRISPR gRNA sequence
tctgaaataatattctgttg

SEQ ID NO: 278732 - DNA, 20 bp, Artificial
  CRISPR gRNA sequence
ataatattctgttgtagatt

SEQ ID NO: 278733 - DNA, 20 bp, Artificial
  CRISPR gRNA sequence
agatctattttttctttttg

SEQ ID NO: 278734 - DNA, 20 bp, Artificial
  CRISPR gRNA sequence
attttttctttttgtagcga

SEQ ID NO: 278735 - DNA, 20 bp, Artificial
  CRISPR gRNA sequence
ttttttctttttgtagcgat

SEQ ID NO: 278736 - DNA, 20 bp, Artificial
  CRISPR gRNA sequence
tttttctttttgtagcgatg

SEQ ID NO: 278737 - DNA, 20 bp, Artificial
  CRISPR gRNA sequence
ggggtttttgctatgttgcc

SEQ ID NO: 278738 - DNA, 20 bp, Artificial
  CRISPR gRNA sequence
gggtttttgctatgttgcct

SEQ ID NO: 278739 - DNA, 20 bp, Artificial
  CRISPR gRNA sequence
ttttgctatgttgcctaggc

SEQ ID NO: 278740 - DNA, 20 bp, Artificial
  CRISPR gRNA sequence
ctaggctggtctcgatttcc

SEQ ID NO: 278741 - DNA, 20 bp, Artificial
  CRISPR gRNA sequence
taggctggtctcgatttcct

SEQ ID NO: 278742 - DNA, 20 bp, Artificial
  CRISPR gRNA sequence
ggtctcgatttcctgggctc

SEQ ID NO: 278743 - DNA, 20 bp, Artificial
  CRISPR gRNA sequence
ctcaagcaatccacccgcct

SEQ ID NO: 278744 - DNA, 20 bp, Artificial
  CRISPR gRNA sequence
agcaatccacccgccttggc

SEQ ID NO: 278745 - DNA, 20 bp, Artificial
  CRISPR gRNA sequence
cccgccttggccagctccca

SEQ ID NO: 278746 - DNA, 20 bp, Artificial
  CRISPR gRNA sequence
ttggccagctcccaaagtgc

SEQ ID NO: 278747 - DNA, 20 bp, Artificial
  CRISPR gRNA sequence
tggccagctcccaaagtgct

SEQ ID NO: 278748 - DNA, 20 bp, Artificial
  CRISPR gRNA sequence
ctcccaaagtgctgggatta

SEQ ID NO: 278749 - DNA, 20 bp, Artificial
  CRISPR gRNA sequence
tcccaaagtgctgggattac

SEQ ID NO: 278750 - DNA, 20 bp, Artificial
  CRISPR gRNA sequence
gtgctgggattacgggtgcc

SEQ ID NO: 278751 - DNA, 20 bp, Artificial
  CRISPR gRNA sequence
gggattacgggtgcctggcc

SEQ ID NO: 278752 - DNA, 20 bp, Artificial
  CRISPR gRNA sequence
acgggtgcctggcctagatt

SEQ ID NO: 278753 - DNA, 20 bp, Artificial
  CRISPR gRNA sequence
ctggcctagattgagccctt

SEQ ID NO: 278754 - DNA, 20 bp, Artificial
  CRISPR gRNA sequence
ggcctagattgagcccttga

SEQ ID NO: 278755 - DNA, 20 bp, Artificial
  CRISPR gRNA sequence
gcctagattgagcccttgag

SEQ ID NO: 278756 - DNA, 20 bp, Artificial
  CRISPR gRNA sequence
tttttttttttttttttttt

SEQ ID NO: 278757 - DNA, 20 bp, Artificial
  CRISPR gRNA sequence
ttttttttttttttttgaga

SEQ ID NO: 278758 - DNA, 20 bp, Artificial
  CRISPR gRNA sequence
ttttttttttttttgagaca

SEQ ID NO: 278759 - DNA, 20 bp, Artificial
  CRISPR gRNA sequence
agagtcttgctctgtcgccc

SEQ ID NO: 278760 - DNA, 20 bp, Artificial
  CRISPR gRNA sequence
tcttgctctgtcgcccaagc

SEQ ID NO: 278761 - DNA, 20 bp, Artificial
  CRISPR gRNA sequence
ttgctctgtcgcccaagctg

SEQ ID NO: 278762 - DNA, 20 bp, Artificial
  CRISPR gRNA sequence
ctgtcgcccaagctggagtg

SEQ ID NO: 278763 - DNA, 20 bp, Artificial
  CRISPR gRNA sequence
tcgcccaagctggagtgcag

SEQ ID NO: 278764 - DNA, 20 bp, Artificial
  CRISPR gRNA sequence
gagtgcagtggcacaatctc

SEQ ID NO: 278765 - DNA, 20 bp, Artificial
  CRISPR gRNA sequence
gtggcacaatctctggctca

SEQ ID NO: 278766 - DNA, 20 bp, Artificial
  CRISPR gRNA sequence
cacaatctctggctcacagc

SEQ ID NO: 278767 - DNA, 20 bp, Artificial
  CRISPR gRNA sequence
tcacagcaagctccgcctcc

SEQ ID NO: 278768 - DNA, 20 bp, Artificial
  CRISPR gRNA sequence
ttcacgccattctcctgcct

SEQ ID NO: 278769 - DNA, 20 bp, Artificial
  CRISPR gRNA sequence
ttctcctgcctcagcctccc

SEQ ID NO: 278770 - DNA, 20 bp, Artificial
  CRISPR gRNA sequence
tcctgcctcagcctcccgag

SEQ ID NO: 278771 - DNA, 20 bp, Artificial
  CRISPR gRNA sequence
gcctcagcctcccgagtagc

SEQ ID NO: 278772 - DNA, 20 bp, Artificial
  CRISPR gRNA sequence
cctcagcctcccgagtagct

SEQ ID NO: 278773 - DNA, 20 bp, Artificial
  CRISPR gRNA sequence
ctcccgagtagctgggacta

SEQ ID NO: 278774 - DNA, 20 bp, Artificial
  CRISPR gRNA sequence
gctgggactacagctcgtaa

SEQ ID NO: 278775 - DNA, 20 bp, Artificial
  CRISPR gRNA sequence
aaagtcctccacacaaaaat

SEQ ID NO: 278776 - DNA, 20 bp, Artificial
  CRISPR gRNA sequence
aatcagcccgccaccacgcc

SEQ ID NO: 278777 - DNA, 20 bp, Artificial
  CRISPR gRNA sequence
atttattttttttgtatttt

SEQ ID NO: 278778 - DNA, 20 bp, Artificial
  CRISPR gRNA sequence
tattttttttgtatttttag

SEQ ID NO: 278779 - DNA, 20 bp, Artificial
  CRISPR gRNA sequence
ttttttttgtatttttagta

SEQ ID NO: 278780 - DNA, 20 bp, Artificial
  CRISPR gRNA sequence
ttttgtatttttagtagaga

SEQ ID NO: 278781 - DNA, 20 bp, Artificial
  CRISPR gRNA sequence
tttgtatttttagtagagac

SEQ ID NO: 278782 - DNA, 20 bp, Artificial
  CRISPR gRNA sequence
ttgtatttttagtagagacg

SEQ ID NO: 278783 - DNA, 20 bp, Artificial
  CRISPR gRNA sequence
gagacggggtttcaccgtat

SEQ ID NO: 278784 - DNA, 20 bp, Artificial
  CRISPR gRNA sequence
cggggtttcaccgtattagc

SEQ ID NO: 278785 - DNA, 20 bp, Artificial
  CRISPR gRNA sequence
ggggtttcaccgtattagcc

SEQ ID NO: 278786 - DNA, 20 bp, Artificial
  CRISPR gRNA sequence
tattagccaggatgatcttc

SEQ ID NO: 278787 - DNA, 20 bp, Artificial
  CRISPR gRNA sequence
agctcctgatccgcctgcct

SEQ ID NO: 278788 - DNA, 20 bp, Artificial
  CRISPR gRNA sequence
ccgcctgcctcggcctccca

SEQ ID NO: 278789 - DNA, 20 bp, Artificial
  CRISPR gRNA sequence
gcctcggcctcccaaagtgc

SEQ ID NO: 278790 - DNA, 20 bp, Artificial
  CRISPR gRNA sequence
cctcggcctcccaaagtgct

SEQ ID NO: 278791 - DNA, 20 bp, Artificial
  CRISPR gRNA sequence
ctcccaaagtgctgggatta

SEQ ID NO: 278792 - DNA, 20 bp, Artificial
  CRISPR gRNA sequence
tcccaaagtgctgggattac

SEQ ID NO: 278793 - DNA, 20 bp, Artificial
  CRISPR gRNA sequence
agtgctgggattacaggcgt

SEQ ID NO: 278794 - DNA, 20 bp, Artificial
  CRISPR gRNA sequence
caggcgtgagccaccacgcc

SEQ ID NO: 278795 - DNA, 20 bp, Artificial
  CRISPR gRNA sequence
gtgagccaccacgcccggcc

SEQ ID NO: 278796 - DNA, 20 bp, Artificial
  CRISPR gRNA sequence
gagccaccacgcccggccga

SEQ ID NO: 278797 - DNA, 20 bp, Artificial
  CRISPR gRNA sequence
agccaccacgcccggccgag

SEQ ID NO: 278798 - DNA, 20 bp, Artificial
  CRISPR gRNA sequence
cattatttgtctaaaattct

SEQ ID NO: 278799 - DNA, 20 bp, Artificial
  CRISPR gRNA sequence
ttcttggtctctactcttgt

SEQ ID NO: 278800 - DNA, 20 bp, Artificial
  CRISPR gRNA sequence
tctctactcttgttggcaaa

SEQ ID NO: 278801 - DNA, 20 bp, Artificial
  CRISPR gRNA sequence
aaatagcttcctctcctgtg

SEQ ID NO: 278802 - DNA, 20 bp, Artificial
  CRISPR gRNA sequence
agcttcctctcctgtgtggc

SEQ ID NO: 278803 - DNA, 20 bp, Artificial
  CRISPR gRNA sequence
ttcctctcctgtgtggctag

SEQ ID NO: 278804 - DNA, 20 bp, Artificial
  CRISPR gRNA sequence
ctcctgtgtggctagcagtc

SEQ ID NO: 278805 - DNA, 20 bp, Artificial
  CRISPR gRNA sequence
cctgtgtggctagcagtcca

SEQ ID NO: 278806 - DNA, 20 bp, Artificial
  CRISPR gRNA sequence
tggctagcagtccagagttg

SEQ ID NO: 278807 - DNA, 20 bp, Artificial
  CRISPR gRNA sequence
ctagcagtccagagttgaag

SEQ ID NO: 278808 - DNA, 20 bp, Artificial
  CRISPR gRNA sequence
cagtccagagttgaagtggt

SEQ ID NO: 278809 - DNA, 20 bp, Artificial
  CRISPR gRNA sequence
gtccagagttgaagtggtca

SEQ ID NO: 278810 - DNA, 20 bp, Artificial
  CRISPR gRNA sequence
cagagttgaagtggtcagag

SEQ ID NO: 278811 - DNA, 20 bp, Artificial
  CRISPR gRNA sequence
agagttgaagtggtcagagc

SEQ ID NO: 278812 - DNA, 20 bp, Artificial
  CRISPR gRNA sequence
agttgaagtggtcagagcag

SEQ ID NO: 278813 - DNA, 20 bp, Artificial
  CRISPR gRNA sequence
gttgaagtggtcagagcagg

SEQ ID NO: 278814 - DNA, 20 bp, Artificial
  CRISPR gRNA sequence
ttgaagtggtcagagcagga

SEQ ID NO: 278815 - DNA, 20 bp, Artificial
  CRISPR gRNA sequence
aagtggtcagagcaggaggg

SEQ ID NO: 278816 - DNA, 20 bp, Artificial
  CRISPR gRNA sequence
gtcagagcaggagggtggcc

SEQ ID NO: 278817 - DNA, 20 bp, Artificial
  CRISPR gRNA sequence
tcagagcaggagggtggcca

SEQ ID NO: 278818 - DNA, 20 bp, Artificial
  CRISPR gRNA sequence
cagagcaggagggtggccaa

SEQ ID NO: 278819 - DNA, 20 bp, Artificial
  CRISPR gRNA sequence
agagcaggagggtggccaag

SEQ ID NO: 278820 - DNA, 20 bp, Artificial
  CRISPR gRNA sequence
caggagggtggccaaggggt

SEQ ID NO: 278821 - DNA, 20 bp, Artificial
  CRISPR gRNA sequence
aggagggtggccaaggggtc

SEQ ID NO: 278822 - DNA, 20 bp, Artificial
  CRISPR gRNA sequence
gagggtggccaaggggtcag

SEQ ID NO: 278823 - DNA, 20 bp, Artificial
  CRISPR gRNA sequence
gggtggccaaggggtcagga

SEQ ID NO: 278824 - DNA, 20 bp, Artificial
  CRISPR gRNA sequence
ggtggccaaggggtcaggag

SEQ ID NO: 278825 - DNA, 20 bp, Artificial
  CRISPR gRNA sequence
ggccaaggggtcaggagagg

SEQ ID NO: 278826 - DNA, 20 bp, Artificial
  CRISPR gRNA sequence
ccaaggggtcaggagaggca

SEQ ID NO: 278827 - DNA, 20 bp, Artificial
  CRISPR gRNA sequence
caaggggtcaggagaggcag

SEQ ID NO: 278828 - DNA, 20 bp, Artificial
  CRISPR gRNA sequence
ggtcaggagaggcagaggct

SEQ ID NO: 278829 - DNA, 20 bp, Artificial
  CRISPR gRNA sequence
gtcaggagaggcagaggctg

SEQ ID NO: 278830 - DNA, 20 bp, Artificial
  CRISPR gRNA sequence
ggagaggcagaggctgaggc

SEQ ID NO: 278831 - DNA, 20 bp, Artificial
  CRISPR gRNA sequence
gaggcagaggctgaggccag

SEQ ID NO: 278832 - DNA, 20 bp, Artificial
  CRISPR gRNA sequence
aggctgaggccagcagtgtt

SEQ ID NO: 278833 - DNA, 20 bp, Artificial
  CRISPR gRNA sequence
agtgtccctattgtgcccta

SEQ ID NO: 278834 - DNA, 20 bp, Artificial
  CRISPR gRNA sequence
gtgtccctattgtgccctac

SEQ ID NO: 278835 - DNA, 20 bp, Artificial
  CRISPR gRNA sequence
tccctattgtgccctacagg

SEQ ID NO: 278836 - DNA, 20 bp, Artificial
  CRISPR gRNA sequence
ccctattgtgccctacaggt

SEQ ID NO: 278837 - DNA, 20 bp, Artificial
  CRISPR gRNA sequence
tattgtgccctacaggtggg

SEQ ID NO: 278838 - DNA, 20 bp, Artificial
  CRISPR gRNA sequence
ggcagtttccatgcattcgc

SEQ ID NO: 278839 - DNA, 20 bp, Artificial
  CRISPR gRNA sequence
agtttccatgcattcgccag

SEQ ID NO: 278840 - DNA, 20 bp, Artificial
  CRISPR gRNA sequence
gtttccatgcattcgccaga

SEQ ID NO: 278841 - DNA, 20 bp, Artificial
  CRISPR gRNA sequence
ccatgcattcgccagaaggc

SEQ ID NO: 278842 - DNA, 20 bp, Artificial
  CRISPR gRNA sequence
tgcattcgccagaaggcgag

SEQ ID NO: 278843 - DNA, 20 bp, Artificial
  CRISPR gRNA sequence
cttctctccgcctcctttca

SEQ ID NO: 278844 - DNA, 20 bp, Artificial
  CRISPR gRNA sequence
ccgcctcctttcacagcctc

SEQ ID NO: 278845 - DNA, 20 bp, Artificial
  CRISPR gRNA sequence
tggccctttctgactgctgc

SEQ ID NO: 278846 - DNA, 20 bp, Artificial
  CRISPR gRNA sequence
ggccctttctgactgctgct

SEQ ID NO: 278847 - DNA, 20 bp, Artificial
  CRISPR gRNA sequence
cctttctgactgctgctggg

SEQ ID NO: 278848 - DNA, 20 bp, Artificial
  CRISPR gRNA sequence
tttctgactgctgctgggta

SEQ ID NO: 278849 - DNA, 20 bp, Artificial
  CRISPR gRNA sequence
ttctgactgctgctgggtag

SEQ ID NO: 278850 - DNA, 20 bp, Artificial
  CRISPR gRNA sequence
actgctgctgggtagaggtg

SEQ ID NO: 278851 - DNA, 20 bp, Artificial
  CRISPR gRNA sequence
ctgctgctgggtagaggtgc

SEQ ID NO: 278852 - DNA, 20 bp, Artificial
  CRISPR gRNA sequence
gctgctgggtagaggtgcag

SEQ ID NO: 278853 - DNA, 20 bp, Artificial
  CRISPR gRNA sequence
ctgctgggtagaggtgcagg

SEQ ID NO: 278854 - DNA, 20 bp, Artificial
  CRISPR gRNA sequence
tgctgggtagaggtgcagga

SEQ ID NO: 278855 - DNA, 20 bp, Artificial
  CRISPR gRNA sequence
gctgggtagaggtgcaggag

SEQ ID NO: 278856 - DNA, 20 bp, Artificial
  CRISPR gRNA sequence
gcaggaggggctccccatgc

SEQ ID NO: 278857 - DNA, 20 bp, Artificial
  CRISPR gRNA sequence
ggggctccccatgccagcta

SEQ ID NO: 278858 - DNA, 20 bp, Artificial
  CRISPR gRNA sequence
gggctccccatgccagctat

SEQ ID NO: 278859 - DNA, 20 bp, Artificial
  CRISPR gRNA sequence
ccagctatgggcactgaact

SEQ ID NO: 278860 - DNA, 20 bp, Artificial
  CRISPR gRNA sequence
atgggcactgaactcagttc

SEQ ID NO: 278861 - DNA, 20 bp, Artificial
  CRISPR gRNA sequence
actgaactcagttcaagaat

SEQ ID NO: 278862 - DNA, 20 bp, Artificial
  CRISPR gRNA sequence
aactcagttcaagaatcagc

SEQ ID NO: 278863 - DNA, 20 bp, Artificial
  CRISPR gRNA sequence
caagaatcagccagttacca

SEQ ID NO: 278864 - DNA, 20 bp, Artificial
  CRISPR gRNA sequence
gccagttaccatggtgatgc

SEQ ID NO: 278865 - DNA, 20 bp, Artificial
  CRISPR gRNA sequence
ccatggtgatgctggtccta

SEQ ID NO: 278866 - DNA, 20 bp, Artificial
  CRISPR gRNA sequence
catggtgatgctggtcctat

SEQ ID NO: 278867 - DNA, 20 bp, Artificial
  CRISPR gRNA sequence
atggtgatgctggtcctatg

SEQ ID NO: 278868 - DNA, 20 bp, Artificial
  CRISPR gRNA sequence
tggtgatgctggtcctatgg

SEQ ID NO: 278869 - DNA, 20 bp, Artificial
  CRISPR gRNA sequence
atgctggtcctatgggggtg

SEQ ID NO: 278870 - DNA, 20 bp, Artificial
  CRISPR gRNA sequence
ggtcctatgggggtgtggtt

SEQ ID NO: 278871 - DNA, 20 bp, Artificial
  CRISPR gRNA sequence
tatgggggtgtggttcagca

SEQ ID NO: 278872 - DNA, 20 bp, Artificial
  CRISPR gRNA sequence
gggggtgtggttcagcaaag

SEQ ID NO: 278873 - DNA, 20 bp, Artificial
  CRISPR gRNA sequence
ggggtgtggttcagcaaagc

SEQ ID NO: 278874 - DNA, 20 bp, Artificial
  CRISPR gRNA sequence
caaagcaggctgttgtgcat

SEQ ID NO: 278875 - DNA, 20 bp, Artificial
  CRISPR gRNA sequence
gcaggctgttgtgcatgaga

SEQ ID NO: 278876 - DNA, 20 bp, Artificial
  CRISPR gRNA sequence
ctgttgtgcatgagaaagaa

SEQ ID NO: 278877 - DNA, 20 bp, Artificial
  CRISPR gRNA sequence
acagccccatttaaaatctg

SEQ ID NO: 278878 - DNA, 20 bp, Artificial
  CRISPR gRNA sequence
agccccatttaaaatctgta

SEQ ID NO: 278879 - DNA, 20 bp, Artificial
  CRISPR gRNA sequence
aaaatctgtagagcattcta

SEQ ID NO: 278880 - DNA, 20 bp, Artificial
  CRISPR gRNA sequence
ctgtagagcattctaaagtt

SEQ ID NO: 278881 - DNA, 20 bp, Artificial
  CRISPR gRNA sequence
agagcattctaaagttaaga

SEQ ID NO: 278882 - DNA, 20 bp, Artificial
  CRISPR gRNA sequence
ttaagaaagcactttacatc

SEQ ID NO: 278883 - DNA, 20 bp, Artificial
  CRISPR gRNA sequence
atcgctgtgataattatgtg

SEQ ID NO: 278884 - DNA, 20 bp, Artificial
  CRISPR gRNA sequence
gctgtgataattatgtgaag

SEQ ID NO: 278885 - DNA, 20 bp, Artificial
  CRISPR gRNA sequence
ctgtgataattatgtgaagc

SEQ ID NO: 278886 - DNA, 20 bp, Artificial
  CRISPR gRNA sequence
tgtgataattatgtgaagca

SEQ ID NO: 278887 - DNA, 20 bp, Artificial
  CRISPR gRNA sequence
gataattatgtgaagcaggg

SEQ ID NO: 278888 - DNA, 20 bp, Artificial
  CRISPR gRNA sequence
attatgtgaagcagggaaga

SEQ ID NO: 278889 - DNA, 20 bp, Artificial
  CRISPR gRNA sequence
agcagggaagatagttatct

SEQ ID NO: 278890 - DNA, 20 bp, Artificial
  CRISPR gRNA sequence
ggaagatagttatctcggtc

SEQ ID NO: 278891 - DNA, 20 bp, Artificial
  CRISPR gRNA sequence
tctggtttgtgctgctataa

SEQ ID NO: 278892 - DNA, 20 bp, Artificial
  CRISPR gRNA sequence
tataacagaatacctgacat

SEQ ID NO: 278893 - DNA, 20 bp, Artificial
  CRISPR gRNA sequence
ataacagaatacctgacatt

SEQ ID NO: 278894 - DNA, 20 bp, Artificial
  CRISPR gRNA sequence
atacctgacattgggtaatt

SEQ ID NO: 278895 - DNA, 20 bp, Artificial
  CRISPR gRNA sequence
ctgacattgggtaatttaga

SEQ ID NO: 278896 - DNA, 20 bp, Artificial
  CRISPR gRNA sequence
attgggtaatttagaaagaa

SEQ ID NO: 278897 - DNA, 20 bp, Artificial
  CRISPR gRNA sequence
tgggtaatttagaaagaaca

SEQ ID NO: 278898 - DNA, 20 bp, Artificial
  CRISPR gRNA sequence
agatttatttcttactgttc

SEQ ID NO: 278899 - DNA, 20 bp, Artificial
  CRISPR gRNA sequence
atttatttcttactgttctg

SEQ ID NO: 278900 - DNA, 20 bp, Artificial
  CRISPR gRNA sequence
tttatttcttactgttctgg

SEQ ID NO: 278901 - DNA, 20 bp, Artificial
  CRISPR gRNA sequence
tttcttactgttctggaggc

SEQ ID NO: 278902 - DNA, 20 bp, Artificial
  CRISPR gRNA sequence
ttcttactgttctggaggct

SEQ ID NO: 278903 - DNA, 20 bp, Artificial
  CRISPR gRNA sequence
ttactgttctggaggctggg

SEQ ID NO: 278904 - DNA, 20 bp, Artificial
  CRISPR gRNA sequence
ttctggaggctgggaagtcc

SEQ ID NO: 278905 - DNA, 20 bp, Artificial
  CRISPR gRNA sequence
tctggaggctgggaagtcca

SEQ ID NO: 278906 - DNA, 20 bp, Artificial
  CRISPR gRNA sequence
aggctgggaagtccaaggtc

SEQ ID NO: 278907 - DNA, 20 bp, Artificial
  CRISPR gRNA sequence
ggctgggaagtccaaggtca

SEQ ID NO: 278908 - DNA, 20 bp, Artificial
  CRISPR gRNA sequence
gctgggaagtccaaggtcaa

SEQ ID NO: 278909 - DNA, 20 bp, Artificial
  CRISPR gRNA sequence
ctgggaagtccaaggtcaag

SEQ ID NO: 278910 - DNA, 20 bp, Artificial
  CRISPR gRNA sequence
tcaaggggctcacatctgat

SEQ ID NO: 278911 - DNA, 20 bp, Artificial
  CRISPR gRNA sequence
caaggggctcacatctgatg

SEQ ID NO: 278912 - DNA, 20 bp, Artificial
  CRISPR gRNA sequence
cttcttgctgcatcatccca

SEQ ID NO: 278913 - DNA, 20 bp, Artificial
  CRISPR gRNA sequence
cttgctgcatcatcccatgg

SEQ ID NO: 278914 - DNA, 20 bp, Artificial
  CRISPR gRNA sequence
tgctgcatcatcccatggca

SEQ ID NO: 278915 - DNA, 20 bp, Artificial
  CRISPR gRNA sequence
gctgcatcatcccatggcag

SEQ ID NO: 278916 - DNA, 20 bp, Artificial
  CRISPR gRNA sequence
catcatcccatggcagagga

SEQ ID NO: 278917 - DNA, 20 bp, Artificial
  CRISPR gRNA sequence
atcccatggcagaggataga

SEQ ID NO: 278918 - DNA, 20 bp, Artificial
  CRISPR gRNA sequence
tcccatggcagaggatagaa

SEQ ID NO: 278919 - DNA, 20 bp, Artificial
  CRISPR gRNA sequence
catggcagaggatagaaagg

SEQ ID NO: 278920 - DNA, 20 bp, Artificial
  CRISPR gRNA sequence
atggcagaggatagaaaggc

SEQ ID NO: 278921 - DNA, 20 bp, Artificial
  CRISPR gRNA sequence
ggcagaggatagaaaggcag

SEQ ID NO: 278922 - DNA, 20 bp, Artificial
  CRISPR gRNA sequence
cagaggatagaaaggcagga

SEQ ID NO: 278923 - DNA, 20 bp, Artificial
  CRISPR gRNA sequence
aaaggcaggagagcacgccc

SEQ ID NO: 278924 - DNA, 20 bp, Artificial
  CRISPR gRNA sequence
aaggcaggagagcacgccca

SEQ ID NO: 278925 - DNA, 20 bp, Artificial
  CRISPR gRNA sequence
gcaggagagcacgcccaagg

SEQ ID NO: 278926 - DNA, 20 bp, Artificial
  CRISPR gRNA sequence
aggagagcacgcccaaggca

SEQ ID NO: 278927 - DNA, 20 bp, Artificial
  CRISPR gRNA sequence
agagcacgcccaaggcagag

SEQ ID NO: 278928 - DNA, 20 bp, Artificial
  CRISPR gRNA sequence
gagcacgcccaaggcagagt

SEQ ID NO: 278929 - DNA, 20 bp, Artificial
  CRISPR gRNA sequence
cacgcccaaggcagagtagg

SEQ ID NO: 278930 - DNA, 20 bp, Artificial
  CRISPR gRNA sequence
acgcccaaggcagagtagga

SEQ ID NO: 278931 - DNA, 20 bp, Artificial
  CRISPR gRNA sequence
gcccaaggcagagtaggaag

SEQ ID NO: 278932 - DNA, 20 bp, Artificial
  CRISPR gRNA sequence
cccaaggcagagtaggaagg

SEQ ID NO: 278933 - DNA, 20 bp, Artificial
  CRISPR gRNA sequence
aggccaaaaccatcctttat

SEQ ID NO: 278934 - DNA, 20 bp, Artificial
  CRISPR gRNA sequence
ggccaaaaccatcctttata

SEQ ID NO: 278935 - DNA, 20 bp, Artificial
  CRISPR gRNA sequence
caaaaccatcctttataagg

SEQ ID NO: 278936 - DNA, 20 bp, Artificial
  CRISPR gRNA sequence
taaggaagccactcctgctg

SEQ ID NO: 278937 - DNA, 20 bp, Artificial
  CRISPR gRNA sequence
tgaacccactcccaaaaaaa

SEQ ID NO: 278938 - DNA, 20 bp, Artificial
  CRISPR gRNA sequence
tggcattaatccatccatga

SEQ ID NO: 278939 - DNA, 20 bp, Artificial
  CRISPR gRNA sequence
cattaatccatccatgatgg

SEQ ID NO: 278940 - DNA, 20 bp, Artificial
  CRISPR gRNA sequence
ttaatccatccatgatggca

SEQ ID NO: 278941 - DNA, 20 bp, Artificial
  CRISPR gRNA sequence
atgacctaatcaccttttaa

SEQ ID NO: 278942 - DNA, 20 bp, Artificial
  CRISPR gRNA sequence
attctcaacactgttgcacc

SEQ ID NO: 278943 - DNA, 20 bp, Artificial
  CRISPR gRNA sequence
aatttccaacacaaaacctt

SEQ ID NO: 278944 - DNA, 20 bp, Artificial
  CRISPR gRNA sequence
atttccaacacaaaaccttt

SEQ ID NO: 278945 - DNA, 20 bp, Artificial
  CRISPR gRNA sequence
tttccaacacaaaaccttta

SEQ ID NO: 278946 - DNA, 20 bp, Artificial
  CRISPR gRNA sequence
ttccaacacaaaacctttag

SEQ ID NO: 278947 - DNA, 20 bp, Artificial
  CRISPR gRNA sequence
taggggacacattcaaatca

SEQ ID NO: 278948 - DNA, 20 bp, Artificial
  CRISPR gRNA sequence
acacattcaaatcatagcaa

SEQ ID NO: 278949 - DNA, 20 bp, Artificial
  CRISPR gRNA sequence
atagtattatgactgtttta

SEQ ID NO: 278950 - DNA, 20 bp, Artificial
  CRISPR gRNA sequence
agtattatgactgttttaca

SEQ ID NO: 278951 - DNA, 20 bp, Artificial
  CRISPR gRNA sequence
ttatgactgttttacagaga

SEQ ID NO: 278952 - DNA, 20 bp, Artificial
  CRISPR gRNA sequence
ttttacagagatggaacctg

SEQ ID NO: 278953 - DNA, 20 bp, Artificial
  CRISPR gRNA sequence
cagagatggaacctgaagcc

SEQ ID NO: 278954 - DNA, 20 bp, Artificial
  CRISPR gRNA sequence
gagatggaacctgaagccca

SEQ ID NO: 278955 - DNA, 20 bp, Artificial
  CRISPR gRNA sequence
gatggaacctgaagcccaga

SEQ ID NO: 278956 - DNA, 20 bp, Artificial
  CRISPR gRNA sequence
atggaacctgaagcccagag

SEQ ID NO: 278957 - DNA, 20 bp, Artificial
  CRISPR gRNA sequence
tgaagcccagagaggttacc

SEQ ID NO: 278958 - DNA, 20 bp, Artificial
  CRISPR gRNA sequence
agaggttacccagcttgctc

SEQ ID NO: 278959 - DNA, 20 bp, Artificial
  CRISPR gRNA sequence
gaggttacccagcttgctca

SEQ ID NO: 278960 - DNA, 20 bp, Artificial
  CRISPR gRNA sequence
aaggttatgattctaataca

SEQ ID NO: 278961 - DNA, 20 bp, Artificial
  CRISPR gRNA sequence
gttatgattctaatacacag

SEQ ID NO: 278962 - DNA, 20 bp, Artificial
  CRISPR gRNA sequence
tgattctaatacacagtgga

SEQ ID NO: 278963 - DNA, 20 bp, Artificial
  CRISPR gRNA sequence
attctaatacacagtggatg

SEQ ID NO: 278964 - DNA, 20 bp, Artificial
  CRISPR gRNA sequence
taatacacagtggatggagc

SEQ ID NO: 278965 - DNA, 20 bp, Artificial
  CRISPR gRNA sequence
agacctcatttcctcatgcc

SEQ ID NO: 278966 - DNA, 20 bp, Artificial
  CRISPR gRNA sequence
ctcatgcctagacatgcatt

SEQ ID NO: 278967 - DNA, 20 bp, Artificial
  CRISPR gRNA sequence
tgcctagacatgcattcagc

SEQ ID NO: 278968 - DNA, 20 bp, Artificial
  CRISPR gRNA sequence
gcattcagcaagtatttact

SEQ ID NO: 278969 - DNA, 20 bp, Artificial
  CRISPR gRNA sequence
tatttactgagcacctacta

SEQ ID NO: 278970 - DNA, 20 bp, Artificial
  CRISPR gRNA sequence
atttactgagcacctactat

SEQ ID NO: 278971 - DNA, 20 bp, Artificial
  CRISPR gRNA sequence
actgagcacctactatgggc

SEQ ID NO: 278972 - DNA, 20 bp, Artificial
  CRISPR gRNA sequence
ctgagcacctactatgggcc

SEQ ID NO: 278973 - DNA, 20 bp, Artificial
  CRISPR gRNA sequence
ctatgggccaggccctgttc

SEQ ID NO: 278974 - DNA, 20 bp, Artificial
  CRISPR gRNA sequence
aggccctgttctagacactg

SEQ ID NO: 278975 - DNA, 20 bp, Artificial
  CRISPR gRNA sequence
tgttctagacactgcagata

SEQ ID NO: 278976 - DNA, 20 bp, Artificial
  CRISPR gRNA sequence
tctagacactgcagatatgg

SEQ ID NO: 278977 - DNA, 20 bp, Artificial
  CRISPR gRNA sequence
tgcagatatggcagtgaaca

SEQ ID NO: 278978 - DNA, 20 bp, Artificial
  CRISPR gRNA sequence
gcagatatggcagtgaacaa

SEQ ID NO: 278979 - DNA, 20 bp, Artificial
  CRISPR gRNA sequence
agatatggcagtgaacaaag

SEQ ID NO: 278980 - DNA, 20 bp, Artificial
  CRISPR gRNA sequence
gatatggcagtgaacaaagg

SEQ ID NO: 278981 - DNA, 20 bp, Artificial
  CRISPR gRNA sequence
atggcagtgaacaaaggagg

SEQ ID NO: 278982 - DNA, 20 bp, Artificial
  CRISPR gRNA sequence
aggaggaagcctctgctcca

SEQ ID NO: 278983 - DNA, 20 bp, Artificial
  CRISPR gRNA sequence
atacctgtaaatatacatca

SEQ ID NO: 278984 - DNA, 20 bp, Artificial
  CRISPR gRNA sequence
acagttgtaaaaatatatat

SEQ ID NO: 278985 - DNA, 20 bp, Artificial
  CRISPR gRNA sequence
ttgtaaaaatatatatcagc

SEQ ID NO: 278986 - DNA, 20 bp, Artificial
  CRISPR gRNA sequence
gtaaaaatatatatcagctg

SEQ ID NO: 278987 - DNA, 20 bp, Artificial
  CRISPR gRNA sequence
aatatatatcagctggagac

SEQ ID NO: 278988 - DNA, 20 bp, Artificial
  CRISPR gRNA sequence
atcagctggagacaagcctg

SEQ ID NO: 278989 - DNA, 20 bp, Artificial
  CRISPR gRNA sequence
cagctggagacaagcctgaa

SEQ ID NO: 278990 - DNA, 20 bp, Artificial
  CRISPR gRNA sequence
aagcctgaagagaaacaaat

SEQ ID NO: 278991 - DNA, 20 bp, Artificial
  CRISPR gRNA sequence
agcctgaagagaaacaaatc

SEQ ID NO: 278992 - DNA, 20 bp, Artificial
  CRISPR gRNA sequence
gaagagaaacaaatcaggca

SEQ ID NO: 278993 - DNA, 20 bp, Artificial
  CRISPR gRNA sequence
agagaaacaaatcaggcaaa

SEQ ID NO: 278994 - DNA, 20 bp, Artificial
  CRISPR gRNA sequence
caaatcaggcaaagagacta

SEQ ID NO: 278995 - DNA, 20 bp, Artificial
  CRISPR gRNA sequence
aatcaggcaaagagactaaa

SEQ ID NO: 278996 - DNA, 20 bp, Artificial
  CRISPR gRNA sequence
caggcaaagagactaaagag

SEQ ID NO: 278997 - DNA, 20 bp, Artificial
  CRISPR gRNA sequence
gcaaagagactaaagagtag

SEQ ID NO: 278998 - DNA, 20 bp, Artificial
  CRISPR gRNA sequence
caaagagactaaagagtagc

SEQ ID NO: 278999 - DNA, 20 bp, Artificial
  CRISPR gRNA sequence
gagactaaagagtagcagga

SEQ ID NO: 279000 - DNA, 20 bp, Artificial
  CRISPR gRNA sequence
gactaaagagtagcaggatg

SEQ ID NO: 279001 - DNA, 20 bp, Artificial
  CRISPR gRNA sequence
actaaagagtagcaggatgg

SEQ ID NO: 279002 - DNA, 20 bp, Artificial
  CRISPR gRNA sequence
ctaaagagtagcaggatgga

SEQ ID NO: 279003 - DNA, 20 bp, Artificial
  CRISPR gRNA sequence
taaagagtagcaggatggag

SEQ ID NO: 279004 - DNA, 20 bp, Artificial
  CRISPR gRNA sequence
aaagagtagcaggatggagg

SEQ ID NO: 279005 - DNA, 20 bp, Artificial
  CRISPR gRNA sequence
aagagtagcaggatggaggg

SEQ ID NO: 279006 - DNA, 20 bp, Artificial
  CRISPR gRNA sequence
agtagcaggatggagggggg

SEQ ID NO: 279007 - DNA, 20 bp, Artificial
  CRISPR gRNA sequence
gtagcaggatggaggggggc

SEQ ID NO: 279008 - DNA, 20 bp, Artificial
  CRISPR gRNA sequence
tagcaggatggaggggggca

SEQ ID NO: 279009 - DNA, 20 bp, Artificial
  CRISPR gRNA sequence
gcaggatggaggggggcagg

SEQ ID NO: 279010 - DNA, 20 bp, Artificial
  CRISPR gRNA sequence
caggatggaggggggcaggg

SEQ ID NO: 279011 - DNA, 20 bp, Artificial
  CRISPR gRNA sequence
atggaggggggcagggagga

SEQ ID NO: 279012 - DNA, 20 bp, Artificial
  CRISPR gRNA sequence
cagggaggatggcgctgttc

SEQ ID NO: 279013 - DNA, 20 bp, Artificial
  CRISPR gRNA sequence
agggaggatggcgctgttca

SEQ ID NO: 279014 - DNA, 20 bp, Artificial
  CRISPR gRNA sequence
ggaggatggcgctgttcaag

SEQ ID NO: 279015 - DNA, 20 bp, Artificial
  CRISPR gRNA sequence
aggatggcgctgttcaagga

SEQ ID NO: 279016 - DNA, 20 bp, Artificial
  CRISPR gRNA sequence
tggcgctgttcaaggagagt

SEQ ID NO: 279017 - DNA, 20 bp, Artificial
  CRISPR gRNA sequence
ggcgctgttcaaggagagtc

SEQ ID NO: 279018 - DNA, 20 bp, Artificial
  CRISPR gRNA sequence
gcgctgttcaaggagagtca

SEQ ID NO: 279019 - DNA, 20 bp, Artificial
  CRISPR gRNA sequence
ctgttcaaggagagtcaggg

SEQ ID NO: 279020 - DNA, 20 bp, Artificial
  CRISPR gRNA sequence
tgttcaaggagagtcaggga

SEQ ID NO: 279021 - DNA, 20 bp, Artificial
  CRISPR gRNA sequence
tcagggaaggcctctttgac

SEQ ID NO: 279022 - DNA, 20 bp, Artificial
  CRISPR gRNA sequence
cagggaaggcctctttgaca

SEQ ID NO: 279023 - DNA, 20 bp, Artificial
  CRISPR gRNA sequence
agggaaggcctctttgacaa

SEQ ID NO: 279024 - DNA, 20 bp, Artificial
  CRISPR gRNA sequence
gggaaggcctctttgacaag

SEQ ID NO: 279025 - DNA, 20 bp, Artificial
  CRISPR gRNA sequence
cctctttgacaaggggccac

SEQ ID NO: 279026 - DNA, 20 bp, Artificial
  CRISPR gRNA sequence
tctttgacaaggggccacga

SEQ ID NO: 279027 - DNA, 20 bp, Artificial
  CRISPR gRNA sequence
ttgacaaggggccacgagag

SEQ ID NO: 279028 - DNA, 20 bp, Artificial
  CRISPR gRNA sequence
ggggccacgagagtagatgt

SEQ ID NO: 279029 - DNA, 20 bp, Artificial
  CRISPR gRNA sequence
cacgagagtagatgtgagca

SEQ ID NO: 279030 - DNA, 20 bp, Artificial
  CRISPR gRNA sequence
gagagtagatgtgagcaaag

SEQ ID NO: 279031 - DNA, 20 bp, Artificial
  CRISPR gRNA sequence
agagtagatgtgagcaaagt

SEQ ID NO: 279032 - DNA, 20 bp, Artificial
  CRISPR gRNA sequence
aaagtgggacctgaactgtg

SEQ ID NO: 279033 - DNA, 20 bp, Artificial
  CRISPR gRNA sequence
acctgaactgtgtggatctc

SEQ ID NO: 279034 - DNA, 20 bp, Artificial
  CRISPR gRNA sequence
cctgaactgtgtggatctct

SEQ ID NO: 279035 - DNA, 20 bp, Artificial
  CRISPR gRNA sequence
ctgaactgtgtggatctctg

SEQ ID NO: 279036 - DNA, 20 bp, Artificial
  CRISPR gRNA sequence
aactgtgtggatctctgggg

SEQ ID NO: 279037 - DNA, 20 bp, Artificial
  CRISPR gRNA sequence
tggatctctggggaagacac

SEQ ID NO: 279038 - DNA, 20 bp, Artificial
  CRISPR gRNA sequence
actggctccctctaatgtcc

SEQ ID NO: 279039 - DNA, 20 bp, Artificial
  CRISPR gRNA sequence
ctggctccctctaatgtcct

SEQ ID NO: 279040 - DNA, 20 bp, Artificial
  CRISPR gRNA sequence
ctctaatgtcctaggtactg

SEQ ID NO: 279041 - DNA, 20 bp, Artificial
  CRISPR gRNA sequence
ctaatgtcctaggtactgtg

SEQ ID NO: 279042 - DNA, 20 bp, Artificial
  CRISPR gRNA sequence
taatgtcctaggtactgtgg

SEQ ID NO: 279043 - DNA, 20 bp, Artificial
  CRISPR gRNA sequence
gtactgtggaggacttttat

SEQ ID NO: 279044 - DNA, 20 bp, Artificial
  CRISPR gRNA sequence
ctgtggaggacttttatgag

SEQ ID NO: 279045 - DNA, 20 bp, Artificial
  CRISPR gRNA sequence
ttttgaatccttgcacccac

SEQ ID NO: 279046 - DNA, 20 bp, Artificial
  CRISPR gRNA sequence
tttgaatccttgcacccact

SEQ ID NO: 279047 - DNA, 20 bp, Artificial
  CRISPR gRNA sequence
aatccttgcacccactgggt

SEQ ID NO: 279048 - DNA, 20 bp, Artificial
  CRISPR gRNA sequence
atccttgcacccactgggtt

SEQ ID NO: 279049 - DNA, 20 bp, Artificial
  CRISPR gRNA sequence
cttgcacccactgggttggg

SEQ ID NO: 279050 - DNA, 20 bp, Artificial
  CRISPR gRNA sequence
ttgcacccactgggttgggt

SEQ ID NO: 279051 - DNA, 20 bp, Artificial
  CRISPR gRNA sequence
ttacaatgcccattcaaaaa

SEQ ID NO: 279052 - DNA, 20 bp, Artificial
  CRISPR gRNA sequence
atgcccattcaaaaatggca

SEQ ID NO: 279053 - DNA, 20 bp, Artificial
  CRISPR gRNA sequence
ccattcaaaaatggcaaagc

SEQ ID NO: 279054 - DNA, 20 bp, Artificial
  CRISPR gRNA sequence
caaaaatggcaaagcaagct

SEQ ID NO: 279055 - DNA, 20 bp, Artificial
  CRISPR gRNA sequence
aaatggcaaagcaagctcag

SEQ ID NO: 279056 - DNA, 20 bp, Artificial
  CRISPR gRNA sequence
agcaagctcagaagttcaac

SEQ ID NO: 279057 - DNA, 20 bp, Artificial
  CRISPR gRNA sequence
gcaagctcagaagttcaacc

SEQ ID NO: 279058 - DNA, 20 bp, Artificial
  CRISPR gRNA sequence
tcagaagttcaaccaggttt

SEQ ID NO: 279059 - DNA, 20 bp, Artificial
  CRISPR gRNA sequence
aagttcaaccaggtttgaga

SEQ ID NO: 279060 - DNA, 20 bp, Artificial
  CRISPR gRNA sequence
aggtttgagacagtaatatt

SEQ ID NO: 279061 - DNA, 20 bp, Artificial
  CRISPR gRNA sequence
gacagtaatattgagatttc

SEQ ID NO: 279062 - DNA, 20 bp, Artificial
  CRISPR gRNA sequence
acagtaatattgagatttcc

SEQ ID NO: 279063 - DNA, 20 bp, Artificial
  CRISPR gRNA sequence
caggtgctgactttccccgc

SEQ ID NO: 279064 - DNA, 20 bp, Artificial
  CRISPR gRNA sequence
actttccccgccagtcactg

SEQ ID NO: 279065 - DNA, 20 bp, Artificial
  CRISPR gRNA sequence
ttccccgccagtcactgaag

SEQ ID NO: 279066 - DNA, 20 bp, Artificial
  CRISPR gRNA sequence
actgaagcagacaaaatcgt

SEQ ID NO: 279067 - DNA, 20 bp, Artificial
  CRISPR gRNA sequence
tgaagcagacaaaatcgtta

SEQ ID NO: 279068 - DNA, 20 bp, Artificial
  CRISPR gRNA sequence
tgctttttgtccgtgtgtga

SEQ ID NO: 279069 - DNA, 20 bp, Artificial
  CRISPR gRNA sequence
ctttttgtccgtgtgtgatg

SEQ ID NO: 279070 - DNA, 20 bp, Artificial
  CRISPR gRNA sequence
gtgtgatggagtccctaaaa

SEQ ID NO: 279071 - DNA, 20 bp, Artificial
  CRISPR gRNA sequence
agacaaaactgatataaatt

SEQ ID NO: 279072 - DNA, 20 bp, Artificial
  CRISPR gRNA sequence
gacaaaactgatataaattt

SEQ ID NO: 279073 - DNA, 20 bp, Artificial
  CRISPR gRNA sequence
gactgttttctgtctctgtg

SEQ ID NO: 279074 - DNA, 20 bp, Artificial
  CRISPR gRNA sequence
tgttttctgtctctgtgtgg

SEQ ID NO: 279075 - DNA, 20 bp, Artificial
  CRISPR gRNA sequence
tgtggtggaatcccgaaaac

SEQ ID NO: 279076 - DNA, 20 bp, Artificial
  CRISPR gRNA sequence
gtggtggaatcccgaaaact

SEQ ID NO: 279077 - DNA, 20 bp, Artificial
  CRISPR gRNA sequence
gtgtgaatttccaaattgtt

SEQ ID NO: 279078 - DNA, 20 bp, Artificial
  CRISPR gRNA sequence
tgaatttccaaattgttcgg

SEQ ID NO: 279079 - DNA, 20 bp, Artificial
  CRISPR gRNA sequence
ccaaattgttcggaagattt

SEQ ID NO: 279080 - DNA, 20 bp, Artificial
  CRISPR gRNA sequence
caaattgttcggaagatttt

SEQ ID NO: 279081 - DNA, 20 bp, Artificial
  CRISPR gRNA sequence
agattttgggttcctctttt

SEQ ID NO: 279082 - DNA, 20 bp, Artificial
  CRISPR gRNA sequence
ttcttcttcactcttctcct

SEQ ID NO: 279083 - DNA, 20 bp, Artificial
  CRISPR gRNA sequence
ttcttcactcttctcctcag

SEQ ID NO: 279084 - DNA, 20 bp, Artificial
  CRISPR gRNA sequence
tcttcactcttctcctcaga

SEQ ID NO: 279085 - DNA, 20 bp, Artificial
  CRISPR gRNA sequence
cactcttctcctcagaaggc

SEQ ID NO: 279086 - DNA, 20 bp, Artificial
  CRISPR gRNA sequence
aaggctggacaaaaactcct

SEQ ID NO: 279087 - DNA, 20 bp, Artificial
  CRISPR gRNA sequence
gctggacaaaaactcctcag

SEQ ID NO: 279088 - DNA, 20 bp, Artificial
  CRISPR gRNA sequence
tcagaagccatcaccaaaat

SEQ ID NO: 279089 - DNA, 20 bp, Artificial
  CRISPR gRNA sequence
aagccatcaccaaaattaga

SEQ ID NO: 279090 - DNA, 20 bp, Artificial
  CRISPR gRNA sequence
aaattagatagtctctcttt

SEQ ID NO: 279091 - DNA, 20 bp, Artificial
  CRISPR gRNA sequence
acatcaccacataccaaaat

SEQ ID NO: 279092 - DNA, 20 bp, Artificial
  CRISPR gRNA sequence
caccacataccaaaatcagt

SEQ ID NO: 279093 - DNA, 20 bp, Artificial
  CRISPR gRNA sequence
ccaaaatcagtgagaaatat

SEQ ID NO: 279094 - DNA, 20 bp, Artificial
  CRISPR gRNA sequence
gagaaatattggattctttt

SEQ ID NO: 279095 - DNA, 20 bp, Artificial
  CRISPR gRNA sequence
aatattggattctttttggc

SEQ ID NO: 279096 - DNA, 20 bp, Artificial
  CRISPR gRNA sequence
atattggattctttttggct

SEQ ID NO: 279097 - DNA, 20 bp, Artificial
  CRISPR gRNA sequence
tctttttggctgggaatgaa

SEQ ID NO: 279098 - DNA, 20 bp, Artificial
  CRISPR gRNA sequence
ttggctgggaatgaatagtt

SEQ ID NO: 279099 - DNA, 20 bp, Artificial
  CRISPR gRNA sequence
gctgggaatgaatagttcgg

SEQ ID NO: 279100 - DNA, 20 bp, Artificial
  CRISPR gRNA sequence
ctgggaatgaatagttcggt

SEQ ID NO: 279101 - DNA, 20 bp, Artificial
  CRISPR gRNA sequence
tgggaatgaatagttcggtg

SEQ ID NO: 279102 - DNA, 20 bp, Artificial
  CRISPR gRNA sequence
aatgaatagttcggtgggga

SEQ ID NO: 279103 - DNA, 20 bp, Artificial
  CRISPR gRNA sequence
gtggggaaagaccctattat

SEQ ID NO: 279104 - DNA, 20 bp, Artificial
  CRISPR gRNA sequence
tggggaaagaccctattatt

SEQ ID NO: 279105 - DNA, 20 bp, Artificial
  CRISPR gRNA sequence
gggaaagaccctattattgg

SEQ ID NO: 279106 - DNA, 20 bp, Artificial
  CRISPR gRNA sequence
ggaaagaccctattattggg

SEQ ID NO: 279107 - DNA, 20 bp, Artificial
  CRISPR gRNA sequence
gaccctattattgggaggcc

SEQ ID NO: 279108 - DNA, 20 bp, Artificial
  CRISPR gRNA sequence
tattattgggaggcccagac

SEQ ID NO: 279109 - DNA, 20 bp, Artificial
  CRISPR gRNA sequence
attgggaggcccagacaagt

SEQ ID NO: 279110 - DNA, 20 bp, Artificial
  CRISPR gRNA sequence
caagtgagttgctgtctgtc

SEQ ID NO: 279111 - DNA, 20 bp, Artificial
  CRISPR gRNA sequence
gttgctgtctgtctggccca

SEQ ID NO: 279112 - DNA, 20 bp, Artificial
  CRISPR gRNA sequence
ctgtctgtctggcccatagc

SEQ ID NO: 279113 - DNA, 20 bp, Artificial
  CRISPR gRNA sequence
tgtctggcccatagcaagac

SEQ ID NO: 279114 - DNA, 20 bp, Artificial
  CRISPR gRNA sequence
tctggcccatagcaagacca

SEQ ID NO: 279115 - DNA, 20 bp, Artificial
  CRISPR gRNA sequence
atatatctgacataaccctt

SEQ ID NO: 279116 - DNA, 20 bp, Artificial
  CRISPR gRNA sequence
ataacccttgagtgaaatga

SEQ ID NO: 279117 - DNA, 20 bp, Artificial
  CRISPR gRNA sequence
taacccttgagtgaaatgaa

SEQ ID NO: 279118 - DNA, 20 bp, Artificial
  CRISPR gRNA sequence
ccttgagtgaaatgaaaggt

SEQ ID NO: 279119 - DNA, 20 bp, Artificial
  CRISPR gRNA sequence
ttgagtgaaatgaaaggtaa

SEQ ID NO: 279120 - DNA, 20 bp, Artificial
  CRISPR gRNA sequence
gtgaaatgaaaggtaagagt

SEQ ID NO: 279121 - DNA, 20 bp, Artificial
  CRISPR gRNA sequence
aaatgaaaggtaagagttgg

SEQ ID NO: 279122 - DNA, 20 bp, Artificial
  CRISPR gRNA sequence
tgaaaggtaagagttggcag

SEQ ID NO: 279123 - DNA, 20 bp, Artificial
  CRISPR gRNA sequence
gaaaggtaagagttggcagt

SEQ ID NO: 279124 - DNA, 20 bp, Artificial
  CRISPR gRNA sequence
aaggtaagagttggcagtgg

SEQ ID NO: 279125 - DNA, 20 bp, Artificial
  CRISPR gRNA sequence
aggtaagagttggcagtggg

SEQ ID NO: 279126 - DNA, 20 bp, Artificial
  CRISPR gRNA sequence
gtaagagttggcagtgggag

SEQ ID NO: 279127 - DNA, 20 bp, Artificial
  CRISPR gRNA sequence
taagagttggcagtgggagg

SEQ ID NO: 279128 - DNA, 20 bp, Artificial
  CRISPR gRNA sequence
aagagttggcagtgggagga

SEQ ID NO: 279129 - DNA, 20 bp, Artificial
  CRISPR gRNA sequence
gagttggcagtgggaggagg

SEQ ID NO: 279130 - DNA, 20 bp, Artificial
  CRISPR gRNA sequence
tggcagtgggaggagggaga

SEQ ID NO: 279131 - DNA, 20 bp, Artificial
  CRISPR gRNA sequence
ggaggagggagaaagaaaaa

SEQ ID NO: 279132 - DNA, 20 bp, Artificial
  CRISPR gRNA sequence
aagaaaaatggaaactctta

SEQ ID NO: 279133 - DNA, 20 bp, Artificial
  CRISPR gRNA sequence
aaaaatggaaactcttacag

SEQ ID NO: 279134 - DNA, 20 bp, Artificial
  CRISPR gRNA sequence
cagaagacctgctatgtcct

SEQ ID NO: 279135 - DNA, 20 bp, Artificial
  CRISPR gRNA sequence
agaagacctgctatgtcctt

SEQ ID NO: 279136 - DNA, 20 bp, Artificial
  CRISPR gRNA sequence
tttaattgaactgaattttc

SEQ ID NO: 279137 - DNA, 20 bp, Artificial
  CRISPR gRNA sequence
ctgaattttccagtgatccc

SEQ ID NO: 279138 - DNA, 20 bp, Artificial
  CRISPR gRNA sequence
tgaattttccagtgatccca

SEQ ID NO: 279139 - DNA, 20 bp, Artificial
  CRISPR gRNA sequence
gaattttccagtgatcccaa

SEQ ID NO: 279140 - DNA, 20 bp, Artificial
  CRISPR gRNA sequence
aattttccagtgatcccaag

SEQ ID NO: 279141 - DNA, 20 bp, Artificial
  CRISPR gRNA sequence
tttccagtgatcccaagggg

SEQ ID NO: 279142 - DNA, 20 bp, Artificial
  CRISPR gRNA sequence
ttccagtgatcccaaggggt

SEQ ID NO: 279143 - DNA, 20 bp, Artificial
  CRISPR gRNA sequence
gggtaggtgtcatacctatt

SEQ ID NO: 279144 - DNA, 20 bp, Artificial
  CRISPR gRNA sequence
gtaggtgtcatacctattta

SEQ ID NO: 279145 - DNA, 20 bp, Artificial
  CRISPR gRNA sequence
gtcatacctatttagagatg

SEQ ID NO: 279146 - DNA, 20 bp, Artificial
  CRISPR gRNA sequence
cctatttagagatgaagaaa

SEQ ID NO: 279147 - DNA, 20 bp, Artificial
  CRISPR gRNA sequence
agatgaagaaacagatgaaa

SEQ ID NO: 279148 - DNA, 20 bp, Artificial
  CRISPR gRNA sequence
gaagaaacagatgaaacagc

SEQ ID NO: 279149 - DNA, 20 bp, Artificial
  CRISPR gRNA sequence
gaaacagatgaaacagcaag

SEQ ID NO: 279150 - DNA, 20 bp, Artificial
  CRISPR gRNA sequence
agatgaaacagcaagtggct

SEQ ID NO: 279151 - DNA, 20 bp, Artificial
  CRISPR gRNA sequence
gaaacagcaagtggctgagc

SEQ ID NO: 279152 - DNA, 20 bp, Artificial
  CRISPR gRNA sequence
aaacagcaagtggctgagct

SEQ ID NO: 279153 - DNA, 20 bp, Artificial
  CRISPR gRNA sequence
gcaagtggctgagctgggac

SEQ ID NO: 279154 - DNA, 20 bp, Artificial
  CRISPR gRNA sequence
ctgagctgggactagaatcc

SEQ ID NO: 279155 - DNA, 20 bp, Artificial
  CRISPR gRNA sequence
gggactagaatccaagtcaa

SEQ ID NO: 279156 - DNA, 20 bp, Artificial
  CRISPR gRNA sequence
gactagaatccaagtcaatg

SEQ ID NO: 279157 - DNA, 20 bp, Artificial
  CRISPR gRNA sequence
agaatccaagtcaatggaga

SEQ ID NO: 279158 - DNA, 20 bp, Artificial
  CRISPR gRNA sequence
tccaagtcaatggagatgga

SEQ ID NO: 279159 - DNA, 20 bp, Artificial
  CRISPR gRNA sequence
ttttgctttccttgcaacac

SEQ ID NO: 279160 - DNA, 20 bp, Artificial
  CRISPR gRNA sequence
tttgctttccttgcaacact

SEQ ID NO: 279161 - DNA, 20 bp, Artificial
  CRISPR gRNA sequence
tgctttccttgcaacactag

SEQ ID NO: 279162 - DNA, 20 bp, Artificial
  CRISPR gRNA sequence
cttgcaacactaggagtgtc

SEQ ID NO: 279163 - DNA, 20 bp, Artificial
  CRISPR gRNA sequence
ttgcaacactaggagtgtct

SEQ ID NO: 279164 - DNA, 20 bp, Artificial
  CRISPR gRNA sequence
ctgggttgtcatttgatctt

SEQ ID NO: 279165 - DNA, 20 bp, Artificial
  CRISPR gRNA sequence
catttgatctttagctaata

SEQ ID NO: 279166 - DNA, 20 bp, Artificial
  CRISPR gRNA sequence
ctttgaaatatgctcccttc

SEQ ID NO: 279167 - DNA, 20 bp, Artificial
  CRISPR gRNA sequence
ttttatttcttcctttcttt

SEQ ID NO: 279168 - DNA, 20 bp, Artificial
  CRISPR gRNA sequence
tctttcagttatattcccta

SEQ ID NO: 279169 - DNA, 20 bp, Artificial
  CRISPR gRNA sequence
ttcagttatattccctaaag

SEQ ID NO: 279170 - DNA, 20 bp, Artificial
  CRISPR gRNA sequence
tcagttatattccctaaagc

SEQ ID NO: 279171 - DNA, 20 bp, Artificial
  CRISPR gRNA sequence
cagttatattccctaaagca

SEQ ID NO: 279172 - DNA, 20 bp, Artificial
  CRISPR gRNA sequence
atattccctaaagcagggac

SEQ ID NO: 279173 - DNA, 20 bp, Artificial
  CRISPR gRNA sequence
aacattccacacaattgctg

SEQ ID NO: 279174 - DNA, 20 bp, Artificial
  CRISPR gRNA sequence
cattccacacaattgctgaa

SEQ ID NO: 279175 - DNA, 20 bp, Artificial
  CRISPR gRNA sequence
attccacacaattgctgaag

SEQ ID NO: 279176 - DNA, 20 bp, Artificial
  CRISPR gRNA sequence
acaattgctgaagaggtgcc

SEQ ID NO: 279177 - DNA, 20 bp, Artificial
  CRISPR gRNA sequence
catcacaaaactctcttgtt

SEQ ID NO: 279178 - DNA, 20 bp, Artificial
  CRISPR gRNA sequence
aactctcttgttcagtgctg

SEQ ID NO: 279179 - DNA, 20 bp, Artificial
  CRISPR gRNA sequence
tctcttgttcagtgctgtgg

SEQ ID NO: 279180 - DNA, 20 bp, Artificial
  CRISPR gRNA sequence
ctcttgttcagtgctgtggt

SEQ ID NO: 279181 - DNA, 20 bp, Artificial
  CRISPR gRNA sequence
tcttgttcagtgctgtggtg

SEQ ID NO: 279182 - DNA, 20 bp, Artificial
  CRISPR gRNA sequence
tgctgtggtggggccgtatc

SEQ ID NO: 279183 - DNA, 20 bp, Artificial
  CRISPR gRNA sequence
tggggccgtatccagtctga

SEQ ID NO: 279184 - DNA, 20 bp, Artificial
  CRISPR gRNA sequence
gggccgtatccagtctgaca

SEQ ID NO: 279185 - DNA, 20 bp, Artificial
  CRISPR gRNA sequence
ggccgtatccagtctgacag

SEQ ID NO: 279186 - DNA, 20 bp, Artificial
  CRISPR gRNA sequence
atccagtctgacagaggcct

SEQ ID NO: 279187 - DNA, 20 bp, Artificial
  CRISPR gRNA sequence
gtctgacagaggcctgagaa

SEQ ID NO: 279188 - DNA, 20 bp, Artificial
  CRISPR gRNA sequence
gacagaggcctgagaatggc

SEQ ID NO: 279189 - DNA, 20 bp, Artificial
  CRISPR gRNA sequence
gaggcctgagaatggctggt

SEQ ID NO: 279190 - DNA, 20 bp, Artificial
  CRISPR gRNA sequence
cctgagaatggctggtgaga

SEQ ID NO: 279191 - DNA, 20 bp, Artificial
  CRISPR gRNA sequence
agaatggctggtgagatgga

SEQ ID NO: 279192 - DNA, 20 bp, Artificial
  CRISPR gRNA sequence
gaatggctggtgagatggaa

SEQ ID NO: 279193 - DNA, 20 bp, Artificial
  CRISPR gRNA sequence
ctggtgagatggaaaggtgc

SEQ ID NO: 279194 - DNA, 20 bp, Artificial
  CRISPR gRNA sequence
gccccatgatcctgctatct

SEQ ID NO: 279195 - DNA, 20 bp, Artificial
  CRISPR gRNA sequence
atgatcctgctatctaagaa

SEQ ID NO: 279196 - DNA, 20 bp, Artificial
  CRISPR gRNA sequence
gatcctgctatctaagaaaa

SEQ ID NO: 279197 - DNA, 20 bp, Artificial
  CRISPR gRNA sequence
tcctgctatctaagaaaaga

SEQ ID NO: 279198 - DNA, 20 bp, Artificial
  CRISPR gRNA sequence
cctgctatctaagaaaagag

SEQ ID NO: 279199 - DNA, 20 bp, Artificial
  CRISPR gRNA sequence
ctgctatctaagaaaagaga

SEQ ID NO: 279200 - DNA, 20 bp, Artificial
  CRISPR gRNA sequence
atctaagaaaagagagggct

SEQ ID NO: 279201 - DNA, 20 bp, Artificial
  CRISPR gRNA sequence
aaagagagggcttggaaatg

SEQ ID NO: 279202 - DNA, 20 bp, Artificial
  CRISPR gRNA sequence
gggcttggaaatgaagtccc

SEQ ID NO: 279203 - DNA, 20 bp, Artificial
  CRISPR gRNA sequence
ggaaatgaagtccctagaca

SEQ ID NO: 279204 - DNA, 20 bp, Artificial
  CRISPR gRNA sequence
gaaatgaagtccctagacat

SEQ ID NO: 279205 - DNA, 20 bp, Artificial
  CRISPR gRNA sequence
ccctagacatgggtctccct

SEQ ID NO: 279206 - DNA, 20 bp, Artificial
  CRISPR gRNA sequence
cctagacatgggtctcccta

SEQ ID NO: 279207 - DNA, 20 bp, Artificial
  CRISPR gRNA sequence
ctagacatgggtctccctaa

SEQ ID NO: 279208 - DNA, 20 bp, Artificial
  CRISPR gRNA sequence
tagacatgggtctccctaag

SEQ ID NO: 279209 - DNA, 20 bp, Artificial
  CRISPR gRNA sequence
tctccctaaggggatctgtg

SEQ ID NO: 279210 - DNA, 20 bp, Artificial
  CRISPR gRNA sequence
taaggggatctgtgtggctc

SEQ ID NO: 279211 - DNA, 20 bp, Artificial
  CRISPR gRNA sequence
aaggggatctgtgtggctcc

SEQ ID NO: 279212 - DNA, 20 bp, Artificial
  CRISPR gRNA sequence
aggggatctgtgtggctcca

SEQ ID NO: 279213 - DNA, 20 bp, Artificial
  CRISPR gRNA sequence
ggggatctgtgtggctccag

SEQ ID NO: 279214 - DNA, 20 bp, Artificial
  CRISPR gRNA sequence
ctgtgtggctccaggggata

SEQ ID NO: 279215 - DNA, 20 bp, Artificial
  CRISPR gRNA sequence
tgtgtggctccaggggatac

SEQ ID NO: 279216 - DNA, 20 bp, Artificial
  CRISPR gRNA sequence
gtgtggctccaggggataca

SEQ ID NO: 279217 - DNA, 20 bp, Artificial
  CRISPR gRNA sequence
gctccaggggatacagggcc

SEQ ID NO: 279218 - DNA, 20 bp, Artificial
  CRISPR gRNA sequence
ccaggggatacagggcccag

SEQ ID NO: 279219 - DNA, 20 bp, Artificial
  CRISPR gRNA sequence
caggggatacagggcccaga

SEQ ID NO: 279220 - DNA, 20 bp, Artificial
  CRISPR gRNA sequence
gatacagggcccagaaggca

SEQ ID NO: 279221 - DNA, 20 bp, Artificial
  CRISPR gRNA sequence
gcccagaaggcacagtacga

SEQ ID NO: 279222 - DNA, 20 bp, Artificial
  CRISPR gRNA sequence
aaggcacagtacgacagcac

SEQ ID NO: 279223 - DNA, 20 bp, Artificial
  CRISPR gRNA sequence
aggcacagtacgacagcact

SEQ ID NO: 279224 - DNA, 20 bp, Artificial
  CRISPR gRNA sequence
cacagtacgacagcactggg

SEQ ID NO: 279225 - DNA, 20 bp, Artificial
  CRISPR gRNA sequence
acagtacgacagcactgggc

SEQ ID NO: 279226 - DNA, 20 bp, Artificial
  CRISPR gRNA sequence
cagtacgacagcactgggca

SEQ ID NO: 279227 - DNA, 20 bp, Artificial
  CRISPR gRNA sequence
agtacgacagcactgggcag

SEQ ID NO: 279228 - DNA, 20 bp, Artificial
  CRISPR gRNA sequence
gtacgacagcactgggcagg

SEQ ID NO: 279229 - DNA, 20 bp, Artificial
  CRISPR gRNA sequence
cagcactgggcagggggcgc

SEQ ID NO: 279230 - DNA, 20 bp, Artificial
  CRISPR gRNA sequence
agcactgggcagggggcgct

SEQ ID NO: 279231 - DNA, 20 bp, Artificial
  CRISPR gRNA sequence
gcactgggcagggggcgctg

SEQ ID NO: 279232 - DNA, 20 bp, Artificial
  CRISPR gRNA sequence
ggcagggggcgctggggcct

SEQ ID NO: 279233 - DNA, 20 bp, Artificial
  CRISPR gRNA sequence
cagggggcgctggggcctta

SEQ ID NO: 279234 - DNA, 20 bp, Artificial
  CRISPR gRNA sequence
agggggcgctggggccttag

SEQ ID NO: 279235 - DNA, 20 bp, Artificial
  CRISPR gRNA sequence
gggggcgctggggccttaga

SEQ ID NO: 279236 - DNA, 20 bp, Artificial
  CRISPR gRNA sequence
ccttagagggatgctgcttt

SEQ ID NO: 279237 - DNA, 20 bp, Artificial
  CRISPR gRNA sequence
cttagagggatgctgctttt

SEQ ID NO: 279238 - DNA, 20 bp, Artificial
  CRISPR gRNA sequence
atgctgcttttaggtcctac

SEQ ID NO: 279239 - DNA, 20 bp, Artificial
  CRISPR gRNA sequence
gctgcttttaggtcctacaa

SEQ ID NO: 279240 - DNA, 20 bp, Artificial
  CRISPR gRNA sequence
ttttaggtcctacaagagcc

SEQ ID NO: 279241 - DNA, 20 bp, Artificial
  CRISPR gRNA sequence
tttaggtcctacaagagcct

SEQ ID NO: 279242 - DNA, 20 bp, Artificial
  CRISPR gRNA sequence
aggtcctacaagagcctagg

SEQ ID NO: 279243 - DNA, 20 bp, Artificial
  CRISPR gRNA sequence
atgccttctaaaccaaaaat

SEQ ID NO: 279244 - DNA, 20 bp, Artificial
  CRISPR gRNA sequence
aaaccaaaaatcagaaaata

SEQ ID NO: 279245 - DNA, 20 bp, Artificial
  CRISPR gRNA sequence
atcagaaaatacagcctgct

SEQ ID NO: 279246 - DNA, 20 bp, Artificial
  CRISPR gRNA sequence
tcagaaaatacagcctgcta

SEQ ID NO: 279247 - DNA, 20 bp, Artificial
  CRISPR gRNA sequence
tacagcctgctaaggaattt

SEQ ID NO: 279248 - DNA, 20 bp, Artificial
  CRISPR gRNA sequence
gaattttggtgctattgaca

SEQ ID NO: 279249 - DNA, 20 bp, Artificial
  CRISPR gRNA sequence
attttggtgctattgacaca

SEQ ID NO: 279250 - DNA, 20 bp, Artificial
  CRISPR gRNA sequence
ggtgctattgacacagagac

SEQ ID NO: 279251 - DNA, 20 bp, Artificial
  CRISPR gRNA sequence
tattgacacagagactagtt

SEQ ID NO: 279252 - DNA, 20 bp, Artificial
  CRISPR gRNA sequence
attgatatgctgatatttct

SEQ ID NO: 279253 - DNA, 20 bp, Artificial
  CRISPR gRNA sequence
gctgatatttcttggctatg

SEQ ID NO: 279254 - DNA, 20 bp, Artificial
  CRISPR gRNA sequence
atatttcttggctatgtgga

SEQ ID NO: 279255 - DNA, 20 bp, Artificial
  CRISPR gRNA sequence
atttcttggctatgtggatg

SEQ ID NO: 279256 - DNA, 20 bp, Artificial
  CRISPR gRNA sequence
tatgtggatggagaaatgaa

SEQ ID NO: 279257 - DNA, 20 bp, Artificial
  CRISPR gRNA sequence
attttaaataaaaactcttt

SEQ ID NO: 279258 - DNA, 20 bp, Artificial
  CRISPR gRNA sequence
aaaaactcttttagcaaatc

SEQ ID NO: 279259 - DNA, 20 bp, Artificial
  CRISPR gRNA sequence
aaaactcttttagcaaatcc

SEQ ID NO: 279260 - DNA, 20 bp, Artificial
  CRISPR gRNA sequence
ctcttttagcaaatccaggc

SEQ ID NO: 279261 - DNA, 20 bp, Artificial
  CRISPR gRNA sequence
cttttagcaaatccaggctg

SEQ ID NO: 279262 - DNA, 20 bp, Artificial
  CRISPR gRNA sequence
ttttagcaaatccaggctgg

SEQ ID NO: 279263 - DNA, 20 bp, Artificial
  CRISPR gRNA sequence
tttagcaaatccaggctgga

SEQ ID NO: 279264 - DNA, 20 bp, Artificial
  CRISPR gRNA sequence
caggctggagggtaattgta

SEQ ID NO: 279265 - DNA, 20 bp, Artificial
  CRISPR gRNA sequence
tggagggtaattgtatggca

SEQ ID NO: 279266 - DNA, 20 bp, Artificial
  CRISPR gRNA sequence
taattgtatggcatggactg

SEQ ID NO: 279267 - DNA, 20 bp, Artificial
  CRISPR gRNA sequence
tgtatggcatggactgcaga

SEQ ID NO: 279268 - DNA, 20 bp, Artificial
  CRISPR gRNA sequence
gcatggactgcagatagcca

SEQ ID NO: 279269 - DNA, 20 bp, Artificial
  CRISPR gRNA sequence
atggactgcagatagccaaa

SEQ ID NO: 279270 - DNA, 20 bp, Artificial
  CRISPR gRNA sequence
tgcagatagccaaagagata

SEQ ID NO: 279271 - DNA, 20 bp, Artificial
  CRISPR gRNA sequence
gcagatagccaaagagataa

SEQ ID NO: 279272 - DNA, 20 bp, Artificial
  CRISPR gRNA sequence
gatagccaaagagataaagg

SEQ ID NO: 279273 - DNA, 20 bp, Artificial
  CRISPR gRNA sequence
atagccaaagagataaaggc

SEQ ID NO: 279274 - DNA, 20 bp, Artificial
  CRISPR gRNA sequence
aaagagataaaggcaggata

SEQ ID NO: 279275 - DNA, 20 bp, Artificial
  CRISPR gRNA sequence
aagagataaaggcaggatat

SEQ ID NO: 279276 - DNA, 20 bp, Artificial
  CRISPR gRNA sequence
ggcaggatataggatccatt

SEQ ID NO: 279277 - DNA, 20 bp, Artificial
  CRISPR gRNA sequence
gcaggatataggatccattt

SEQ ID NO: 279278 - DNA, 20 bp, Artificial
  CRISPR gRNA sequence
caggatataggatccattta

SEQ ID NO: 279279 - DNA, 20 bp, Artificial
  CRISPR gRNA sequence
ggatccatttagggtacctg

SEQ ID NO: 279280 - DNA, 20 bp, Artificial
  CRISPR gRNA sequence
ccatttagggtacctgaaga

SEQ ID NO: 279281 - DNA, 20 bp, Artificial
  CRISPR gRNA sequence
tttagggtacctgaagatgg

SEQ ID NO: 279282 - DNA, 20 bp, Artificial
  CRISPR gRNA sequence
gtacctgaagatggtagaaa

SEQ ID NO: 279283 - DNA, 20 bp, Artificial
  CRISPR gRNA sequence
aagatggtagaaatagtcca

SEQ ID NO: 279284 - DNA, 20 bp, Artificial
  CRISPR gRNA sequence
agatggtagaaatagtccaa

SEQ ID NO: 279285 - DNA, 20 bp, Artificial
  CRISPR gRNA sequence
tagaaatagtccaaaggtat

SEQ ID NO: 279286 - DNA, 20 bp, Artificial
  CRISPR gRNA sequence
atagtccaaaggtataagca

SEQ ID NO: 279287 - DNA, 20 bp, Artificial
  CRISPR gRNA sequence
tagtccaaaggtataagcat

SEQ ID NO: 279288 - DNA, 20 bp, Artificial
  CRISPR gRNA sequence
gtccaaaggtataagcatgg

SEQ ID NO: 279289 - DNA, 20 bp, Artificial
  CRISPR gRNA sequence
tataagcatgggagtcattt

SEQ ID NO: 279290 - DNA, 20 bp, Artificial
  CRISPR gRNA sequence
gcatgggagtcatttcagcc

SEQ ID NO: 279291 - DNA, 20 bp, Artificial
  CRISPR gRNA sequence
gtcatttcagcctggaacca

SEQ ID NO: 279292 - DNA, 20 bp, Artificial
  CRISPR gRNA sequence
tcatttcagcctggaaccat

SEQ ID NO: 279293 - DNA, 20 bp, Artificial
  CRISPR gRNA sequence
cctggaaccatgggatcaat

SEQ ID NO: 279294 - DNA, 20 bp, Artificial
  CRISPR gRNA sequence
ctggaaccatgggatcaatc

SEQ ID NO: 279295 - DNA, 20 bp, Artificial
  CRISPR gRNA sequence
accatgggatcaatcaggcc

SEQ ID NO: 279296 - DNA, 20 bp, Artificial
  CRISPR gRNA sequence
tgggatcaatcaggcctgga

SEQ ID NO: 279297 - DNA, 20 bp, Artificial
  CRISPR gRNA sequence
atcaatcaggcctggaaaga

SEQ ID NO: 279298 - DNA, 20 bp, Artificial
  CRISPR gRNA sequence
tcaatcaggcctggaaagaa

SEQ ID NO: 279299 - DNA, 20 bp, Artificial
  CRISPR gRNA sequence
caatcaggcctggaaagaaa

SEQ ID NO: 279300 - DNA, 20 bp, Artificial
  CRISPR gRNA sequence
tttatttatttatttatttt

SEQ ID NO: 279301 - DNA, 20 bp, Artificial
  CRISPR gRNA sequence
tttatttatttattttgaga

SEQ ID NO: 279302 - DNA, 20 bp, Artificial
  CRISPR gRNA sequence
tatttatttattttgagacg

SEQ ID NO: 279303 - DNA, 20 bp, Artificial
  CRISPR gRNA sequence
ggagtctcactctgtcaccc

SEQ ID NO: 279304 - DNA, 20 bp, Artificial
  CRISPR gRNA sequence
tctcactctgtcacccaagc

SEQ ID NO: 279305 - DNA, 20 bp, Artificial
  CRISPR gRNA sequence
tcactctgtcacccaagctg

SEQ ID NO: 279306 - DNA, 20 bp, Artificial
  CRISPR gRNA sequence
ctgtcacccaagctggagtg

SEQ ID NO: 279307 - DNA, 20 bp, Artificial
  CRISPR gRNA sequence
tcacccaagctggagtgcag

SEQ ID NO: 279308 - DNA, 20 bp, Artificial
  CRISPR gRNA sequence
ggagtgcagtggtgtgatct

SEQ ID NO: 279309 - DNA, 20 bp, Artificial
  CRISPR gRNA sequence
tcactgcaacctctgcctcc

SEQ ID NO: 279310 - DNA, 20 bp, Artificial
  CRISPR gRNA sequence
cactgcaacctctgcctccc

SEQ ID NO: 279311 - DNA, 20 bp, Artificial
  CRISPR gRNA sequence
aacctctgcctcccaggttc

SEQ ID NO: 279312 - DNA, 20 bp, Artificial
  CRISPR gRNA sequence
ttcaagtgattctcctgcct

SEQ ID NO: 279313 - DNA, 20 bp, Artificial
  CRISPR gRNA sequence
ttctcctgcctcagcctcct

SEQ ID NO: 279314 - DNA, 20 bp, Artificial
  CRISPR gRNA sequence
tcctgcctcagcctcctaag

SEQ ID NO: 279315 - DNA, 20 bp, Artificial
  CRISPR gRNA sequence
gcctcagcctcctaagtagc

SEQ ID NO: 279316 - DNA, 20 bp, Artificial
  CRISPR gRNA sequence
cctcagcctcctaagtagct

SEQ ID NO: 279317 - DNA, 20 bp, Artificial
  CRISPR gRNA sequence
ctcctaagtagctgggatta

SEQ ID NO: 279318 - DNA, 20 bp, Artificial
  CRISPR gRNA sequence
tcctaagtagctgggattac

SEQ ID NO: 279319 - DNA, 20 bp, Artificial
  CRISPR gRNA sequence
caggtgtgtcccaacatgcc

SEQ ID NO: 279320 - DNA, 20 bp, Artificial
  CRISPR gRNA sequence
ggctaatttttttgtatttt

SEQ ID NO: 279321 - DNA, 20 bp, Artificial
  CRISPR gRNA sequence
taatttttttgtatttttag

SEQ ID NO: 279322 - DNA, 20 bp, Artificial
  CRISPR gRNA sequence
atttttttgtatttttagta

SEQ ID NO: 279323 - DNA, 20 bp, Artificial
  CRISPR gRNA sequence
ttttgtatttttagtagaga

SEQ ID NO: 279324 - DNA, 20 bp, Artificial
  CRISPR gRNA sequence
tttgtatttttagtagagat

SEQ ID NO: 279325 - DNA, 20 bp, Artificial
  CRISPR gRNA sequence
ttgtatttttagtagagatg

SEQ ID NO: 279326 - DNA, 20 bp, Artificial
  CRISPR gRNA sequence
tggggtttcaccatgttgac

SEQ ID NO: 279327 - DNA, 20 bp, Artificial
  CRISPR gRNA sequence
ggggtttcaccatgttgacc

SEQ ID NO: 279328 - DNA, 20 bp, Artificial
  CRISPR gRNA sequence
tttcaccatgttgaccaggc

SEQ ID NO: 279329 - DNA, 20 bp, Artificial
  CRISPR gRNA sequence
acctcgtgatctgcccacct

SEQ ID NO: 279330 - DNA, 20 bp, Artificial
  CRISPR gRNA sequence
ctgcccacctcagcctccca

SEQ ID NO: 279331 - DNA, 20 bp, Artificial
  CRISPR gRNA sequence
acctcagcctcccaaagtgc

SEQ ID NO: 279332 - DNA, 20 bp, Artificial
  CRISPR gRNA sequence
cctcagcctcccaaagtgct

SEQ ID NO: 279333 - DNA, 20 bp, Artificial
  CRISPR gRNA sequence
ctcccaaagtgctgggatta

SEQ ID NO: 279334 - DNA, 20 bp, Artificial
  CRISPR gRNA sequence
tcccaaagtgctgggattac

SEQ ID NO: 279335 - DNA, 20 bp, Artificial
  CRISPR gRNA sequence
agtgctgggattacaggctt

SEQ ID NO: 279336 - DNA, 20 bp, Artificial
  CRISPR gRNA sequence
caggcttgagccatgatgcc

SEQ ID NO: 279337 - DNA, 20 bp, Artificial
  CRISPR gRNA sequence
ttgagccatgatgcccggcc

SEQ ID NO: 279338 - DNA, 20 bp, Artificial
  CRISPR gRNA sequence
tgagccatgatgcccggcct

SEQ ID NO: 279339 - DNA, 20 bp, Artificial
  CRISPR gRNA sequence
gcctgggactctgtttctta

SEQ ID NO: 279340 - DNA, 20 bp, Artificial
  CRISPR gRNA sequence
gactctgtttcttatagcaa

SEQ ID NO: 279341 - DNA, 20 bp, Artificial
  CRISPR gRNA sequence
actctgtttcttatagcaaa

SEQ ID NO: 279342 - DNA, 20 bp, Artificial
  CRISPR gRNA sequence
ctctgtttcttatagcaaaa

SEQ ID NO: 279343 - DNA, 20 bp, Artificial
  CRISPR gRNA sequence
tttcttatagcaaaagggct

SEQ ID NO: 279344 - DNA, 20 bp, Artificial
  CRISPR gRNA sequence
cttatagcaaaagggctcag

SEQ ID NO: 279345 - DNA, 20 bp, Artificial
  CRISPR gRNA sequence
atagcaaaagggctcagtgg

SEQ ID NO: 279346 - DNA, 20 bp, Artificial
  CRISPR gRNA sequence
tagcaaaagggctcagtggt

SEQ ID NO: 279347 - DNA, 20 bp, Artificial
  CRISPR gRNA sequence
agcaaaagggctcagtggta

SEQ ID NO: 279348 - DNA, 20 bp, Artificial
  CRISPR gRNA sequence
aaagggctcagtggtagggc

SEQ ID NO: 279349 - DNA, 20 bp, Artificial
  CRISPR gRNA sequence
gctcagtggtagggctggat

SEQ ID NO: 279350 - DNA, 20 bp, Artificial
  CRISPR gRNA sequence
ctcagtggtagggctggatt

SEQ ID NO: 279351 - DNA, 20 bp, Artificial
  CRISPR gRNA sequence
tcagtggtagggctggattg

SEQ ID NO: 279352 - DNA, 20 bp, Artificial
  CRISPR gRNA sequence
gtggtagggctggattgggg

SEQ ID NO: 279353 - DNA, 20 bp, Artificial
  CRISPR gRNA sequence
tggtagggctggattggggt

SEQ ID NO: 279354 - DNA, 20 bp, Artificial
  CRISPR gRNA sequence
tagggctggattggggtggg

SEQ ID NO: 279355 - DNA, 20 bp, Artificial
  CRISPR gRNA sequence
agggctggattggggtgggt

SEQ ID NO: 279356 - DNA, 20 bp, Artificial
  CRISPR gRNA sequence
gggctggattggggtgggtg

SEQ ID NO: 279357 - DNA, 20 bp, Artificial
  CRISPR gRNA sequence
tggattggggtgggtgggga

SEQ ID NO: 279358 - DNA, 20 bp, Artificial
  CRISPR gRNA sequence
ggggtgggtggggacagtgt

SEQ ID NO: 279359 - DNA, 20 bp, Artificial
  CRISPR gRNA sequence
ttggcttaacttactgactg

SEQ ID NO: 279360 - DNA, 20 bp, Artificial
  CRISPR gRNA sequence
ctgactgtggcctaaaactg

SEQ ID NO: 279361 - DNA, 20 bp, Artificial
  CRISPR gRNA sequence
tggcctaaaactgaagaaat

SEQ ID NO: 279362 - DNA, 20 bp, Artificial
  CRISPR gRNA sequence
aactgaagaaatcggtaaac

SEQ ID NO: 279363 - DNA, 20 bp, Artificial
  CRISPR gRNA sequence
tgaagaaatcggtaaacaag

SEQ ID NO: 279364 - DNA, 20 bp, Artificial
  CRISPR gRNA sequence
aaatcggtaaacaagaagaa

SEQ ID NO: 279365 - DNA, 20 bp, Artificial
  CRISPR gRNA sequence
aacaagaagaatggccctaa

SEQ ID NO: 279366 - DNA, 20 bp, Artificial
  CRISPR gRNA sequence
gaagaatggccctaaaagcc

SEQ ID NO: 279367 - DNA, 20 bp, Artificial
  CRISPR gRNA sequence
aagaatggccctaaaagcct

SEQ ID NO: 279368 - DNA, 20 bp, Artificial
  CRISPR gRNA sequence
atggccctaaaagcctgggc

SEQ ID NO: 279369 - DNA, 20 bp, Artificial
  CRISPR gRNA sequence
ccctaaaagcctgggccaga

SEQ ID NO: 279370 - DNA, 20 bp, Artificial
  CRISPR gRNA sequence
aagaaaaaaatgtgtaaaac

SEQ ID NO: 279371 - DNA, 20 bp, Artificial
  CRISPR gRNA sequence
agaaaaaaatgtgtaaaact

SEQ ID NO: 279372 - DNA, 20 bp, Artificial
  CRISPR gRNA sequence
gaaaaaaatgtgtaaaactg

SEQ ID NO: 279373 - DNA, 20 bp, Artificial
  CRISPR gRNA sequence
aaaaatgtgtaaaactgggg

SEQ ID NO: 279374 - DNA, 20 bp, Artificial
  CRISPR gRNA sequence
ctggggcagtttcttttcct

SEQ ID NO: 279375 - DNA, 20 bp, Artificial
  CRISPR gRNA sequence
gcagtttcttttcctcagct

SEQ ID NO: 279376 - DNA, 20 bp, Artificial
  CRISPR gRNA sequence
agctcagtttcctcatttgt

SEQ ID NO: 279377 - DNA, 20 bp, Artificial
  CRISPR gRNA sequence
agtttcctcatttgtaagat

SEQ ID NO: 279378 - DNA, 20 bp, Artificial
  CRISPR gRNA sequence
gtttcctcatttgtaagata

SEQ ID NO: 279379 - DNA, 20 bp, Artificial
  CRISPR gRNA sequence
catttgtaagataaggccac

SEQ ID NO: 279380 - DNA, 20 bp, Artificial
  CRISPR gRNA sequence
gccacgagaatgaatgatca

SEQ ID NO: 279381 - DNA, 20 bp, Artificial
  CRISPR gRNA sequence
acgagaatgaatgatcatgg

SEQ ID NO: 279382 - DNA, 20 bp, Artificial
  CRISPR gRNA sequence
atgatcatggaagtcccttc

SEQ ID NO: 279383 - DNA, 20 bp, Artificial
  CRISPR gRNA sequence
actatgactttcatatcccc

SEQ ID NO: 279384 - DNA, 20 bp, Artificial
  CRISPR gRNA sequence
ctatgactttcatatcccct

SEQ ID NO: 279385 - DNA, 20 bp, Artificial
  CRISPR gRNA sequence
tatgactttcatatcccctg

SEQ ID NO: 279386 - DNA, 20 bp, Artificial
  CRISPR gRNA sequence
ctttcatatcccctggggct

SEQ ID NO: 279387 - DNA, 20 bp, Artificial
  CRISPR gRNA sequence
tgagcacatcgtttaaccca

SEQ ID NO: 279388 - DNA, 20 bp, Artificial
  CRISPR gRNA sequence
cacatcgtttaacccatggt

SEQ ID NO: 279389 - DNA, 20 bp, Artificial
  CRISPR gRNA sequence
ccatggttggcacttatatt

SEQ ID NO: 279390 - DNA, 20 bp, Artificial
  CRISPR gRNA sequence
catggttggcacttatattc

SEQ ID NO: 279391 - DNA, 20 bp, Artificial
  CRISPR gRNA sequence
cacttatattcaggtcttct

SEQ ID NO: 279392 - DNA, 20 bp, Artificial
  CRISPR gRNA sequence
acttatattcaggtcttctc

SEQ ID NO: 279393 - DNA, 20 bp, Artificial
  CRISPR gRNA sequence
cttatattcaggtcttctca

SEQ ID NO: 279394 - DNA, 20 bp, Artificial
  CRISPR gRNA sequence
ttatattcaggtcttctcag

SEQ ID NO: 279395 - DNA, 20 bp, Artificial
  CRISPR gRNA sequence
ttcaggtcttctcaggggac

SEQ ID NO: 279396 - DNA, 20 bp, Artificial
  CRISPR gRNA sequence
aggtcttctcaggggaccag

SEQ ID NO: 279397 - DNA, 20 bp, Artificial
  CRISPR gRNA sequence
cagtggactttctcactcac

SEQ ID NO: 279398 - DNA, 20 bp, Artificial
  CRISPR gRNA sequence
agtggactttctcactcact

SEQ ID NO: 279399 - DNA, 20 bp, Artificial
  CRISPR gRNA sequence
gtggactttctcactcacta

SEQ ID NO: 279400 - DNA, 20 bp, Artificial
  CRISPR gRNA sequence
ctgtctctgtccccaactcc

SEQ ID NO: 279401 - DNA, 20 bp, Artificial
  CRISPR gRNA sequence
tgtccccaactcctggccca

SEQ ID NO: 279402 - DNA, 20 bp, Artificial
  CRISPR gRNA sequence
gtccccaactcctggcccat

SEQ ID NO: 279403 - DNA, 20 bp, Artificial
  CRISPR gRNA sequence
actcctggcccataggcatc

SEQ ID NO: 279404 - DNA, 20 bp, Artificial
  CRISPR gRNA sequence
aggcatctggctatatacat

SEQ ID NO: 279405 - DNA, 20 bp, Artificial
  CRISPR gRNA sequence
tctggctatatacataagac

SEQ ID NO: 279406 - DNA, 20 bp, Artificial
  CRISPR gRNA sequence
ggctatatacataagacaag

SEQ ID NO: 279407 - DNA, 20 bp, Artificial
  CRISPR gRNA sequence
gctatatacataagacaagc

SEQ ID NO: 279408 - DNA, 20 bp, Artificial
  CRISPR gRNA sequence
ctcacgatgtctcatcatgc

SEQ ID NO: 279409 - DNA, 20 bp, Artificial
  CRISPR gRNA sequence
tcacgatgtctcatcatgct

SEQ ID NO: 279410 - DNA, 20 bp, Artificial
  CRISPR gRNA sequence
atgtctcatcatgctaggcg

SEQ ID NO: 279411 - DNA, 20 bp, Artificial
  CRISPR gRNA sequence
tctcatcatgctaggcgtgg

SEQ ID NO: 279412 - DNA, 20 bp, Artificial
  CRISPR gRNA sequence
gtggctcacacttgtaatcc

SEQ ID NO: 279413 - DNA, 20 bp, Artificial
  CRISPR gRNA sequence
cacttgtaatcccagcattt

SEQ ID NO: 279414 - DNA, 20 bp, Artificial
  CRISPR gRNA sequence
acttgtaatcccagcatttt

SEQ ID NO: 279415 - DNA, 20 bp, Artificial
  CRISPR gRNA sequence
ttgtaatcccagcattttgg

SEQ ID NO: 279416 - DNA, 20 bp, Artificial
  CRISPR gRNA sequence
tgtaatcccagcattttggg

SEQ ID NO: 279417 - DNA, 20 bp, Artificial
  CRISPR gRNA sequence
tcccagcattttgggaggct

SEQ ID NO: 279418 - DNA, 20 bp, Artificial
  CRISPR gRNA sequence
cccagcattttgggaggctg

SEQ ID NO: 279419 - DNA, 20 bp, Artificial
  CRISPR gRNA sequence
agcattttgggaggctgagg

SEQ ID NO: 279420 - DNA, 20 bp, Artificial
  CRISPR gRNA sequence
gcattttgggaggctgaggt

SEQ ID NO: 279421 - DNA, 20 bp, Artificial
  CRISPR gRNA sequence
attttgggaggctgaggtgg

SEQ ID NO: 279422 - DNA, 20 bp, Artificial
  CRISPR gRNA sequence
ttttgggaggctgaggtggg

SEQ ID NO: 279423 - DNA, 20 bp, Artificial
  CRISPR gRNA sequence
ctgaggtgggaggatcacct

SEQ ID NO: 279424 - DNA, 20 bp, Artificial
  CRISPR gRNA sequence
gtgggaggatcacctgagat

SEQ ID NO: 279425 - DNA, 20 bp, Artificial
  CRISPR gRNA sequence
tgggaggatcacctgagatc

SEQ ID NO: 279426 - DNA, 20 bp, Artificial
  CRISPR gRNA sequence
ggaggatcacctgagatcag

SEQ ID NO: 279427 - DNA, 20 bp, Artificial
  CRISPR gRNA sequence
tcacctgagatcaggagttt

SEQ ID NO: 279428 - DNA, 20 bp, Artificial
  CRISPR gRNA sequence
tgagatcaggagtttgagac

SEQ ID NO: 279429 - DNA, 20 bp, Artificial
  CRISPR gRNA sequence
tcaggagtttgagaccagcc

SEQ ID NO: 279430 - DNA, 20 bp, Artificial
  CRISPR gRNA sequence
tgagaccagcctggcaaaca

SEQ ID NO: 279431 - DNA, 20 bp, Artificial
  CRISPR gRNA sequence
gaccagcctggcaaacatgg

SEQ ID NO: 279432 - DNA, 20 bp, Artificial
  CRISPR gRNA sequence
tctactaaaaatacaaaaat

SEQ ID NO: 279433 - DNA, 20 bp, Artificial
  CRISPR gRNA sequence
ctaaaaatacaaaaattagc

SEQ ID NO: 279434 - DNA, 20 bp, Artificial
  CRISPR gRNA sequence
taaaaatacaaaaattagct

SEQ ID NO: 279435 - DNA, 20 bp, Artificial
  CRISPR gRNA sequence
caaaaattagctgggcatga

SEQ ID NO: 279436 - DNA, 20 bp, Artificial
  CRISPR gRNA sequence
aaattagctgggcatgatgg

SEQ ID NO: 279437 - DNA, 20 bp, Artificial
  CRISPR gRNA sequence
aattagctgggcatgatggc

SEQ ID NO: 279438 - DNA, 20 bp, Artificial
  CRISPR gRNA sequence
atggcgggcgcctgtaatcc

SEQ ID NO: 279439 - DNA, 20 bp, Artificial
  CRISPR gRNA sequence
cgcctgtaatcccagctact

SEQ ID NO: 279440 - DNA, 20 bp, Artificial
  CRISPR gRNA sequence
gcctgtaatcccagctactc

SEQ ID NO: 279441 - DNA, 20 bp, Artificial
  CRISPR gRNA sequence
ctgtaatcccagctactcag

SEQ ID NO: 279442 - DNA, 20 bp, Artificial
  CRISPR gRNA sequence
tgtaatcccagctactcagg

SEQ ID NO: 279443 - DNA, 20 bp, Artificial
  CRISPR gRNA sequence
tcccagctactcaggaggct

SEQ ID NO: 279444 - DNA, 20 bp, Artificial
  CRISPR gRNA sequence
cccagctactcaggaggctg

SEQ ID NO: 279445 - DNA, 20 bp, Artificial
  CRISPR gRNA sequence
agctactcaggaggctgagg

SEQ ID NO: 279446 - DNA, 20 bp, Artificial
  CRISPR gRNA sequence
gctactcaggaggctgaggc

SEQ ID NO: 279447 - DNA, 20 bp, Artificial
  CRISPR gRNA sequence
tactcaggaggctgaggcag

SEQ ID NO: 279448 - DNA, 20 bp, Artificial
  CRISPR gRNA sequence
gcaggagaactgcttgaacc

SEQ ID NO: 279449 - DNA, 20 bp, Artificial
  CRISPR gRNA sequence
caggagaactgcttgaacct

SEQ ID NO: 279450 - DNA, 20 bp, Artificial
  CRISPR gRNA sequence
aggagaactgcttgaacctg

SEQ ID NO: 279451 - DNA, 20 bp, Artificial
  CRISPR gRNA sequence
ggagaactgcttgaacctgg

SEQ ID NO: 279452 - DNA, 20 bp, Artificial
  CRISPR gRNA sequence
gaactgcttgaacctggggg

SEQ ID NO: 279453 - DNA, 20 bp, Artificial
  CRISPR gRNA sequence
actgcttgaacctgggggtg

SEQ ID NO: 279454 - DNA, 20 bp, Artificial
  CRISPR gRNA sequence
ctgcttgaacctgggggtgg

SEQ ID NO: 279455 - DNA, 20 bp, Artificial
  CRISPR gRNA sequence
gaacctgggggtggaggttg

SEQ ID NO: 279456 - DNA, 20 bp, Artificial
  CRISPR gRNA sequence
ctgggggtggaggttgcagt

SEQ ID NO: 279457 - DNA, 20 bp, Artificial
  CRISPR gRNA sequence
ggtggaggttgcagtgagct

SEQ ID NO: 279458 - DNA, 20 bp, Artificial
  CRISPR gRNA sequence
gagatcgcgccacttcactc

SEQ ID NO: 279459 - DNA, 20 bp, Artificial
  CRISPR gRNA sequence
cgcgccacttcactccagcc

SEQ ID NO: 279460 - DNA, 20 bp, Artificial
  CRISPR gRNA sequence
gcgccacttcactccagcct

SEQ ID NO: 279461 - DNA, 20 bp, Artificial
  CRISPR gRNA sequence
cttcactccagcctgggcaa

SEQ ID NO: 279462 - DNA, 20 bp, Artificial
  CRISPR gRNA sequence
tccagcctgggcaaaagaac

SEQ ID NO: 279463 - DNA, 20 bp, Artificial
  CRISPR gRNA sequence
gactccgtctcaaaaaaaaa

SEQ ID NO: 279464 - DNA, 20 bp, Artificial
  CRISPR gRNA sequence
gtctcaaaaaaaaaaagaaa

SEQ ID NO: 279465 - DNA, 20 bp, Artificial
  CRISPR gRNA sequence
aaaaaaaaagaaaaagaaaa

SEQ ID NO: 279466 - DNA, 20 bp, Artificial
  CRISPR gRNA sequence
aaaaagaaaaagaaaaaaga

SEQ ID NO: 279467 - DNA, 20 bp, Artificial
  CRISPR gRNA sequence
agaaaaagaaaaaagaaaga

SEQ ID NO: 279468 - DNA, 20 bp, Artificial
  CRISPR gRNA sequence
aagaaagatgtgtcgtctta

SEQ ID NO: 279469 - DNA, 20 bp, Artificial
  CRISPR gRNA sequence
gaaagatgtgtcgtcttatg

SEQ ID NO: 279470 - DNA, 20 bp, Artificial
  CRISPR gRNA sequence
tgtgtcgtcttatggagatt

SEQ ID NO: 279471 - DNA, 20 bp, Artificial
  CRISPR gRNA sequence
gtgtcgtcttatggagattc

SEQ ID NO: 279472 - DNA, 20 bp, Artificial
  CRISPR gRNA sequence
tgtcgtcttatggagattca

SEQ ID NO: 279473 - DNA, 20 bp, Artificial
  CRISPR gRNA sequence
cgtcttatggagattcaggg

SEQ ID NO: 279474 - DNA, 20 bp, Artificial
  CRISPR gRNA sequence
gtcttatggagattcaggga

SEQ ID NO: 279475 - DNA, 20 bp, Artificial
  CRISPR gRNA sequence
tcttatggagattcagggaa

SEQ ID NO: 279476 - DNA, 20 bp, Artificial
  CRISPR gRNA sequence
cttatggagattcagggaag

SEQ ID NO: 279477 - DNA, 20 bp, Artificial
  CRISPR gRNA sequence
atggagattcagggaagggg

SEQ ID NO: 279478 - DNA, 20 bp, Artificial
  CRISPR gRNA sequence
ttcagggaaggggaagattc

SEQ ID NO: 279479 - DNA, 20 bp, Artificial
  CRISPR gRNA sequence
agattctggataactcttga

SEQ ID NO: 279480 - DNA, 20 bp, Artificial
  CRISPR gRNA sequence
ctcttgaaagataacgtcac

SEQ ID NO: 279481 - DNA, 20 bp, Artificial
  CRISPR gRNA sequence
ttgaaagataacgtcactgg

SEQ ID NO: 279482 - DNA, 20 bp, Artificial
  CRISPR gRNA sequence
gaaagataacgtcactggaa

SEQ ID NO: 279483 - DNA, 20 bp, Artificial
  CRISPR gRNA sequence
ctggaagagctttacccatt

SEQ ID NO: 279484 - DNA, 20 bp, Artificial
  CRISPR gRNA sequence
gaagagctttacccatttgg

SEQ ID NO: 279485 - DNA, 20 bp, Artificial
  CRISPR gRNA sequence
aagagctttacccatttggt

SEQ ID NO: 279486 - DNA, 20 bp, Artificial
  CRISPR gRNA sequence
agagctttacccatttggtg

SEQ ID NO: 279487 - DNA, 20 bp, Artificial
  CRISPR gRNA sequence
catttggtggggtgttgaac

SEQ ID NO: 279488 - DNA, 20 bp, Artificial
  CRISPR gRNA sequence
gtggggtgttgaactggatg

SEQ ID NO: 279489 - DNA, 20 bp, Artificial
  CRISPR gRNA sequence
tggggtgttgaactggatgt

SEQ ID NO: 279490 - DNA, 20 bp, Artificial
  CRISPR gRNA sequence
gggtgttgaactggatgtag

SEQ ID NO: 279491 - DNA, 20 bp, Artificial
  CRISPR gRNA sequence
tgttgaactggatgtaggag

SEQ ID NO: 279492 - DNA, 20 bp, Artificial
  CRISPR gRNA sequence
ctggatgtaggagcagcaca

SEQ ID NO: 279493 - DNA, 20 bp, Artificial
  CRISPR gRNA sequence
gatgtaggagcagcacacag

SEQ ID NO: 279494 - DNA, 20 bp, Artificial
  CRISPR gRNA sequence
gcagcacacagtggtatgta

SEQ ID NO: 279495 - DNA, 20 bp, Artificial
  CRISPR gRNA sequence
cagcacacagtggtatgtat

SEQ ID NO: 279496 - DNA, 20 bp, Artificial
  CRISPR gRNA sequence
cacacagtggtatgtatagg

SEQ ID NO: 279497 - DNA, 20 bp, Artificial
  CRISPR gRNA sequence
gtatgtataggtggaaaaat

SEQ ID NO: 279498 - DNA, 20 bp, Artificial
  CRISPR gRNA sequence
tatgtataggtggaaaaata

SEQ ID NO: 279499 - DNA, 20 bp, Artificial
  CRISPR gRNA sequence
aaataaggcaatttgcttgt

SEQ ID NO: 279500 - DNA, 20 bp, Artificial
  CRISPR gRNA sequence
tttgcttgtcagtatatcaa

SEQ ID NO: 279501 - DNA, 20 bp, Artificial
  CRISPR gRNA sequence
gtatatcaatagttatatca

SEQ ID NO: 279502 - DNA, 20 bp, Artificial
  CRISPR gRNA sequence
tatatcaatagttatatcaa

SEQ ID NO: 279503 - DNA, 20 bp, Artificial
  CRISPR gRNA sequence
aatagttatatcaaaggtgt

SEQ ID NO: 279504 - DNA, 20 bp, Artificial
  CRISPR gRNA sequence
atagttatatcaaaggtgta

SEQ ID NO: 279505 - DNA, 20 bp, Artificial
  CRISPR gRNA sequence
gttatatcaaaggtgtaagg

SEQ ID NO: 279506 - DNA, 20 bp, Artificial
  CRISPR gRNA sequence
taatatattgaattcaactt

SEQ ID NO: 279507 - DNA, 20 bp, Artificial
  CRISPR gRNA sequence
aatatattgaattcaacttt

SEQ ID NO: 279508 - DNA, 20 bp, Artificial
  CRISPR gRNA sequence
tcaactttaggctgcaaaca

SEQ ID NO: 279509 - DNA, 20 bp, Artificial
  CRISPR gRNA sequence
ttaggctgcaaacatagatt

SEQ ID NO: 279510 - DNA, 20 bp, Artificial
  CRISPR gRNA sequence
taggctgcaaacatagattt

SEQ ID NO: 279511 - DNA, 20 bp, Artificial
  CRISPR gRNA sequence
tgcaaacatagatttaggta

SEQ ID NO: 279512 - DNA, 20 bp, Artificial
  CRISPR gRNA sequence
gcaaacatagatttaggtaa

SEQ ID NO: 279513 - DNA, 20 bp, Artificial
  CRISPR gRNA sequence
aacatagatttaggtaaagg

SEQ ID NO: 279514 - DNA, 20 bp, Artificial
  CRISPR gRNA sequence
aggtaaaggaagtgacaacc

SEQ ID NO: 279515 - DNA, 20 bp, Artificial
  CRISPR gRNA sequence
tgacaacccggttctactct

SEQ ID NO: 279516 - DNA, 20 bp, Artificial
  CRISPR gRNA sequence
tctactctgagccaatcaca

SEQ ID NO: 279517 - DNA, 20 bp, Artificial
  CRISPR gRNA sequence
actctgagccaatcacacag

SEQ ID NO: 279518 - DNA, 20 bp, Artificial
  CRISPR gRNA sequence
ccaatcacacagtggatgtc

SEQ ID NO: 279519 - DNA, 20 bp, Artificial
  CRISPR gRNA sequence
acagtggatgtctggaatgc

SEQ ID NO: 279520 - DNA, 20 bp, Artificial
  CRISPR gRNA sequence
gatgtctggaatgctagatt

SEQ ID NO: 279521 - DNA, 20 bp, Artificial
  CRISPR gRNA sequence
tacacacaaatcaaactgtg

SEQ ID NO: 279522 - DNA, 20 bp, Artificial
  CRISPR gRNA sequence
cacaaatcaaactgtgtagt

SEQ ID NO: 279523 - DNA, 20 bp, Artificial
  CRISPR gRNA sequence
acaaatcaaactgtgtagtg

SEQ ID NO: 279524 - DNA, 20 bp, Artificial
  CRISPR gRNA sequence
atcaaactgtgtagtgagga

SEQ ID NO: 279525 - DNA, 20 bp, Artificial
  CRISPR gRNA sequence
aactgtgtagtgaggaaagt

SEQ ID NO: 279526 - DNA, 20 bp, Artificial
  CRISPR gRNA sequence
actgtgtagtgaggaaagtg

SEQ ID NO: 279527 - DNA, 20 bp, Artificial
  CRISPR gRNA sequence
ctgtgtagtgaggaaagtga

SEQ ID NO: 279528 - DNA, 20 bp, Artificial
  CRISPR gRNA sequence
aaagtgagggtactcacttt

SEQ ID NO: 279529 - DNA, 20 bp, Artificial
  CRISPR gRNA sequence
ctcactttcagtacatcaat

SEQ ID NO: 279530 - DNA, 20 bp, Artificial
  CRISPR gRNA sequence
tcactttcagtacatcaata

SEQ ID NO: 279531 - DNA, 20 bp, Artificial
  CRISPR gRNA sequence
ttcagtacatcaataaggaa

SEQ ID NO: 279532 - DNA, 20 bp, Artificial
  CRISPR gRNA sequence
tcagtacatcaataaggaac

SEQ ID NO: 279533 - DNA, 20 bp, Artificial
  CRISPR gRNA sequence
cagtacatcaataaggaaca

SEQ ID NO: 279534 - DNA, 20 bp, Artificial
  CRISPR gRNA sequence
agtacatcaataaggaacag

SEQ ID NO: 279535 - DNA, 20 bp, Artificial
  CRISPR gRNA sequence
acatcaataaggaacagggg

SEQ ID NO: 279536 - DNA, 20 bp, Artificial
  CRISPR gRNA sequence
caataaggaacaggggcaga

SEQ ID NO: 279537 - DNA, 20 bp, Artificial
  CRISPR gRNA sequence
aataaggaacaggggcagat

SEQ ID NO: 279538 - DNA, 20 bp, Artificial
  CRISPR gRNA sequence
caggggcagatgggaacctg

SEQ ID NO: 279539 - DNA, 20 bp, Artificial
  CRISPR gRNA sequence
gggaacctgcagaactgtct

SEQ ID NO: 279540 - DNA, 20 bp, Artificial
  CRISPR gRNA sequence
gaacctgcagaactgtctga

SEQ ID NO: 279541 - DNA, 20 bp, Artificial
  CRISPR gRNA sequence
acctgcagaactgtctgaga

SEQ ID NO: 279542 - DNA, 20 bp, Artificial
  CRISPR gRNA sequence
cctgcagaactgtctgagag

SEQ ID NO: 279543 - DNA, 20 bp, Artificial
  CRISPR gRNA sequence
aactgtctgagagaggatat

SEQ ID NO: 279544 - DNA, 20 bp, Artificial
  CRISPR gRNA sequence
agagaggatataagtatcct

SEQ ID NO: 279545 - DNA, 20 bp, Artificial
  CRISPR gRNA sequence
aagtatcctcagatatctgc

SEQ ID NO: 279546 - DNA, 20 bp, Artificial
  CRISPR gRNA sequence
atctgcaagtcttgttacat

SEQ ID NO: 279547 - DNA, 20 bp, Artificial
  CRISPR gRNA sequence
tgcaagtcttgttacataag

SEQ ID NO: 279548 - DNA, 20 bp, Artificial
  CRISPR gRNA sequence
tcttgttacataagaagaat

SEQ ID NO: 279549 - DNA, 20 bp, Artificial
  CRISPR gRNA sequence
gatgtgttttgtaatgcatg

SEQ ID NO: 279550 - DNA, 20 bp, Artificial
  CRISPR gRNA sequence
gtgttttgtaatgcatgtag

SEQ ID NO: 279551 - DNA, 20 bp, Artificial
  CRISPR gRNA sequence
tttgtaatgcatgtagaagc

SEQ ID NO: 279552 - DNA, 20 bp, Artificial
  CRISPR gRNA sequence
tgtaatgcatgtagaagcta

SEQ ID NO: 279553 - DNA, 20 bp, Artificial
  CRISPR gRNA sequence
gtaatgcatgtagaagctag

SEQ ID NO: 279554 - DNA, 20 bp, Artificial
  CRISPR gRNA sequence
taatgcatgtagaagctaga

SEQ ID NO: 279555 - DNA, 20 bp, Artificial
  CRISPR gRNA sequence
atgtagaagctagagggaaa

SEQ ID NO: 279556 - DNA, 20 bp, Artificial
  CRISPR gRNA sequence
gggaaacagacttcaacata

SEQ ID NO: 279557 - DNA, 20 bp, Artificial
  CRISPR gRNA sequence
acagacttcaacataaagca

SEQ ID NO: 279558 - DNA, 20 bp, Artificial
  CRISPR gRNA sequence
aaagcaaagcaaaacttcct

SEQ ID NO: 279559 - DNA, 20 bp, Artificial
  CRISPR gRNA sequence
ttcctcagtcaaattgtcca

SEQ ID NO: 279560 - DNA, 20 bp, Artificial
  CRISPR gRNA sequence
ttgtccaaagacgaaatcaa

SEQ ID NO: 279561 - DNA, 20 bp, Artificial
  CRISPR gRNA sequence
aaagacgaaatcaaaagcct

SEQ ID NO: 279562 - DNA, 20 bp, Artificial
  CRISPR gRNA sequence
agacgaaatcaaaagcctta

SEQ ID NO: 279563 - DNA, 20 bp, Artificial
  CRISPR gRNA sequence
gacgaaatcaaaagccttag

SEQ ID NO: 279564 - DNA, 20 bp, Artificial
  CRISPR gRNA sequence
aaatcaaaagccttagaggt

SEQ ID NO: 279565 - DNA, 20 bp, Artificial
  CRISPR gRNA sequence
tggtaaattccccaccccct

SEQ ID NO: 279566 - DNA, 20 bp, Artificial
  CRISPR gRNA sequence
gtaaattccccacccccttg

SEQ ID NO: 279567 - DNA, 20 bp, Artificial
  CRISPR gRNA sequence
attccccacccccttggaga

SEQ ID NO: 279568 - DNA, 20 bp, Artificial
  CRISPR gRNA sequence
ttccccacccccttggagaa

SEQ ID NO: 279569 - DNA, 20 bp, Artificial
  CRISPR gRNA sequence
ccccacccccttggagaaag

SEQ ID NO: 279570 - DNA, 20 bp, Artificial
  CRISPR gRNA sequence
cccccttggagaaaggagaa

SEQ ID NO: 279571 - DNA, 20 bp, Artificial
  CRISPR gRNA sequence
ccccttggagaaaggagaat

SEQ ID NO: 279572 - DNA, 20 bp, Artificial
  CRISPR gRNA sequence
aggagaatgggattcatatt

SEQ ID NO: 279573 - DNA, 20 bp, Artificial
  CRISPR gRNA sequence
aatgggattcatatttggtg

SEQ ID NO: 279574 - DNA, 20 bp, Artificial
  CRISPR gRNA sequence
atgggattcatatttggtgt

SEQ ID NO: 279575 - DNA, 20 bp, Artificial
  CRISPR gRNA sequence
attcatatttggtgtgggtc

SEQ ID NO: 279576 - DNA, 20 bp, Artificial
  CRISPR gRNA sequence
ttcatatttggtgtgggtct

SEQ ID NO: 279577 - DNA, 20 bp, Artificial
  CRISPR gRNA sequence
tgggtctaggcattgaatta

SEQ ID NO: 279578 - DNA, 20 bp, Artificial
  CRISPR gRNA sequence
tcttcataataaccaatgtg

SEQ ID NO: 279579 - DNA, 20 bp, Artificial
  CRISPR gRNA sequence
ataataaccaatgtgaagac

SEQ ID NO: 279580 - DNA, 20 bp, Artificial
  CRISPR gRNA sequence
taataaccaatgtgaagact

SEQ ID NO: 279581 - DNA, 20 bp, Artificial
  CRISPR gRNA sequence
aataaccaatgtgaagactg

SEQ ID NO: 279582 - DNA, 20 bp, Artificial
  CRISPR gRNA sequence
ccaatgtgaagactggggtt

SEQ ID NO: 279583 - DNA, 20 bp, Artificial
  CRISPR gRNA sequence
aatgtgaagactggggttca

SEQ ID NO: 279584 - DNA, 20 bp, Artificial
  CRISPR gRNA sequence
gtgaagactggggttcagag

SEQ ID NO: 279585 - DNA, 20 bp, Artificial
  CRISPR gRNA sequence
gactggggttcagagaagta

SEQ ID NO: 279586 - DNA, 20 bp, Artificial
  CRISPR gRNA sequence
ggggttcagagaagtaaagt

SEQ ID NO: 279587 - DNA, 20 bp, Artificial
  CRISPR gRNA sequence
agaagtaaagtaagttgctt

SEQ ID NO: 279588 - DNA, 20 bp, Artificial
  CRISPR gRNA sequence
gaagtaaagtaagttgctta

SEQ ID NO: 279589 - DNA, 20 bp, Artificial
  CRISPR gRNA sequence
ttaaggtcacacaactactg

SEQ ID NO: 279590 - DNA, 20 bp, Artificial
  CRISPR gRNA sequence
tggattttattgaatgaaaa

SEQ ID NO: 279591 - DNA, 20 bp, Artificial
  CRISPR gRNA sequence
gttctttctataccaacaac

SEQ ID NO: 279592 - DNA, 20 bp, Artificial
  CRISPR gRNA sequence
ttctttctataccaacaacc

SEQ ID NO: 279593 - DNA, 20 bp, Artificial
  CRISPR gRNA sequence
ctttctataccaacaaccag

SEQ ID NO: 279594 - DNA, 20 bp, Artificial
  CRISPR gRNA sequence
taccaacaaccaggagcctc

SEQ ID NO: 279595 - DNA, 20 bp, Artificial
  CRISPR gRNA sequence
accaacaaccaggagcctct

SEQ ID NO: 279596 - DNA, 20 bp, Artificial
  CRISPR gRNA sequence
acaaccaggagcctctaggc

SEQ ID NO: 279597 - DNA, 20 bp, Artificial
  CRISPR gRNA sequence
caaccaggagcctctaggca

SEQ ID NO: 279598 - DNA, 20 bp, Artificial
  CRISPR gRNA sequence
gagcctctaggcaaggatgt

SEQ ID NO: 279599 - DNA, 20 bp, Artificial
  CRISPR gRNA sequence
cctctaggcaaggatgttag

SEQ ID NO: 279600 - DNA, 20 bp, Artificial
  CRISPR gRNA sequence
ctctaggcaaggatgttagc

SEQ ID NO: 279601 - DNA, 20 bp, Artificial
  CRISPR gRNA sequence
tctaggcaaggatgttagca

SEQ ID NO: 279602 - DNA, 20 bp, Artificial
  CRISPR gRNA sequence
ggatgttagcagggtgcact

SEQ ID NO: 279603 - DNA, 20 bp, Artificial
  CRISPR gRNA sequence
tagcagggtgcacttagtca

SEQ ID NO: 279604 - DNA, 20 bp, Artificial
  CRISPR gRNA sequence
acttagtcatggttgccttt

SEQ ID NO: 279605 - DNA, 20 bp, Artificial
  CRISPR gRNA sequence
cttagtcatggttgccttta

SEQ ID NO: 279606 - DNA, 20 bp, Artificial
  CRISPR gRNA sequence
agtcatggttgcctttaagg

SEQ ID NO: 279607 - DNA, 20 bp, Artificial
  CRISPR gRNA sequence
gtcatggttgcctttaaggt

SEQ ID NO: 279608 - DNA, 20 bp, Artificial
  CRISPR gRNA sequence
atggttgcctttaaggtagg

SEQ ID NO: 279609 - DNA, 20 bp, Artificial
  CRISPR gRNA sequence
tggttgcctttaaggtaggt

SEQ ID NO: 279610 - DNA, 20 bp, Artificial
  CRISPR gRNA sequence
ggttgcctttaaggtaggta

SEQ ID NO: 279611 - DNA, 20 bp, Artificial
  CRISPR gRNA sequence
tgcctttaaggtaggtaggg

SEQ ID NO: 279612 - DNA, 20 bp, Artificial
  CRISPR gRNA sequence
ctttaaggtaggtagggaag

SEQ ID NO: 279613 - DNA, 20 bp, Artificial
  CRISPR gRNA sequence
tttaaggtaggtagggaagt

SEQ ID NO: 279614 - DNA, 20 bp, Artificial
  CRISPR gRNA sequence
aaggtaggtagggaagtagg

SEQ ID NO: 279615 - DNA, 20 bp, Artificial
  CRISPR gRNA sequence
gtagggaagtaggcagtcct

SEQ ID NO: 279616 - DNA, 20 bp, Artificial
  CRISPR gRNA sequence
agggaagtaggcagtcctga

SEQ ID NO: 279617 - DNA, 20 bp, Artificial
  CRISPR gRNA sequence
tcctgagagctttaaatcct

SEQ ID NO: 279618 - DNA, 20 bp, Artificial
  CRISPR gRNA sequence
ctttaaatcctaagtcactc

SEQ ID NO: 279619 - DNA, 20 bp, Artificial
  CRISPR gRNA sequence
tcctaagtcactcaagtgaa

SEQ ID NO: 279620 - DNA, 20 bp, Artificial
  CRISPR gRNA sequence
cctaagtcactcaagtgaaa

SEQ ID NO: 279621 - DNA, 20 bp, Artificial
  CRISPR gRNA sequence
ctaagtcactcaagtgaaaa

SEQ ID NO: 279622 - DNA, 20 bp, Artificial
  CRISPR gRNA sequence
taagtcactcaagtgaaaag

SEQ ID NO: 279623 - DNA, 20 bp, Artificial
  CRISPR gRNA sequence
agtcactcaagtgaaaaggg

SEQ ID NO: 279624 - DNA, 20 bp, Artificial
  CRISPR gRNA sequence
gtcactcaagtgaaaagggg

SEQ ID NO: 279625 - DNA, 20 bp, Artificial
  CRISPR gRNA sequence
caagtgaaaaggggaggaat

SEQ ID NO: 279626 - DNA, 20 bp, Artificial
  CRISPR gRNA sequence
aagtgaaaaggggaggaatc

SEQ ID NO: 279627 - DNA, 20 bp, Artificial
  CRISPR gRNA sequence
gaggaatcaggatgtgtatt

SEQ ID NO: 279628 - DNA, 20 bp, Artificial
  CRISPR gRNA sequence
aggaatcaggatgtgtatta

SEQ ID NO: 279629 - DNA, 20 bp, Artificial
  CRISPR gRNA sequence
caggatgtgtattaaggtga

SEQ ID NO: 279630 - DNA, 20 bp, Artificial
  CRISPR gRNA sequence
gtgtattaaggtgacagatg

SEQ ID NO: 279631 - DNA, 20 bp, Artificial
  CRISPR gRNA sequence
tgtattaaggtgacagatga

SEQ ID NO: 279632 - DNA, 20 bp, Artificial
  CRISPR gRNA sequence
attcctgtgccacgccactg

SEQ ID NO: 279633 - DNA, 20 bp, Artificial
  CRISPR gRNA sequence
gccactgaagtcacatgaaa

SEQ ID NO: 279634 - DNA, 20 bp, Artificial
  CRISPR gRNA sequence
cacatgaaatggattgtctt

SEQ ID NO: 279635 - DNA, 20 bp, Artificial
  CRISPR gRNA sequence
tgtctttagctcacttaatc

SEQ ID NO: 279636 - DNA, 20 bp, Artificial
  CRISPR gRNA sequence
atctggataaaatttattct

SEQ ID NO: 279637 - DNA, 20 bp, Artificial
  CRISPR gRNA sequence
ttattcttagatttttccca

SEQ ID NO: 279638 - DNA, 20 bp, Artificial
  CRISPR gRNA sequence
atttttcccacggttaaatg

SEQ ID NO: 279639 - DNA, 20 bp, Artificial
  CRISPR gRNA sequence
cacggttaaatgcagttctg

SEQ ID NO: 279640 - DNA, 20 bp, Artificial
  CRISPR gRNA sequence
gttgttgcatcacgtgattg

SEQ ID NO: 279641 - DNA, 20 bp, Artificial
  CRISPR gRNA sequence
ttgttgcatcacgtgattgt

SEQ ID NO: 279642 - DNA, 20 bp, Artificial
  CRISPR gRNA sequence
tgttgcatcacgtgattgtg

SEQ ID NO: 279643 - DNA, 20 bp, Artificial
  CRISPR gRNA sequence
ttgcatcacgtgattgtggg

SEQ ID NO: 279644 - DNA, 20 bp, Artificial
  CRISPR gRNA sequence
gcatcacgtgattgtgggga

SEQ ID NO: 279645 - DNA, 20 bp, Artificial
  CRISPR gRNA sequence
catcacgtgattgtggggag

SEQ ID NO: 279646 - DNA, 20 bp, Artificial
  CRISPR gRNA sequence
atcacgtgattgtggggaga

SEQ ID NO: 279647 - DNA, 20 bp, Artificial
  CRISPR gRNA sequence
tcacgtgattgtggggagag

SEQ ID NO: 279648 - DNA, 20 bp, Artificial
  CRISPR gRNA sequence
gattgtggggagaggggctg

SEQ ID NO: 279649 - DNA, 20 bp, Artificial
  CRISPR gRNA sequence
attgtggggagaggggctgt

SEQ ID NO: 279650 - DNA, 20 bp, Artificial
  CRISPR gRNA sequence
tgtggggagaggggctgtag

SEQ ID NO: 279651 - DNA, 20 bp, Artificial
  CRISPR gRNA sequence
aggggctgtaggagaaacgc

SEQ ID NO: 279652 - DNA, 20 bp, Artificial
  CRISPR gRNA sequence
ggggctgtaggagaaacgca

SEQ ID NO: 279653 - DNA, 20 bp, Artificial
  CRISPR gRNA sequence
gggctgtaggagaaacgcaa

SEQ ID NO: 279654 - DNA, 20 bp, Artificial
  CRISPR gRNA sequence
gtaggagaaacgcaagggaa

SEQ ID NO: 279655 - DNA, 20 bp, Artificial
  CRISPR gRNA sequence
taggagaaacgcaagggaaa

SEQ ID NO: 279656 - DNA, 20 bp, Artificial
  CRISPR gRNA sequence
gagaaacgcaagggaaaagg

SEQ ID NO: 279657 - DNA, 20 bp, Artificial
  CRISPR gRNA sequence
aacgcaagggaaaaggcagt

SEQ ID NO: 279658 - DNA, 20 bp, Artificial
  CRISPR gRNA sequence
agggaaaaggcagtgagcat

SEQ ID NO: 279659 - DNA, 20 bp, Artificial
  CRISPR gRNA sequence
ggaaaaggcagtgagcatca

SEQ ID NO: 279660 - DNA, 20 bp, Artificial
  CRISPR gRNA sequence
aggcagtgagcatcagagac

SEQ ID NO: 279661 - DNA, 20 bp, Artificial
  CRISPR gRNA sequence
ggcagtgagcatcagagact

SEQ ID NO: 279662 - DNA, 20 bp, Artificial
  CRISPR gRNA sequence
catcagagactaggtcttta

SEQ ID NO: 279663 - DNA, 20 bp, Artificial
  CRISPR gRNA sequence
gaaattcttccttatttctc

SEQ ID NO: 279664 - DNA, 20 bp, Artificial
  CRISPR gRNA sequence
aaattcttccttatttctca

SEQ ID NO: 279665 - DNA, 20 bp, Artificial
  CRISPR gRNA sequence
ttcttccttatttctcaagg

SEQ ID NO: 279666 - DNA, 20 bp, Artificial
  CRISPR gRNA sequence
ttccttatttctcaaggcag

SEQ ID NO: 279667 - DNA, 20 bp, Artificial
  CRISPR gRNA sequence
cttatttctcaaggcagtag

SEQ ID NO: 279668 - DNA, 20 bp, Artificial
  CRISPR gRNA sequence
tagctgaaaattacctaatc

SEQ ID NO: 279669 - DNA, 20 bp, Artificial
  CRISPR gRNA sequence
aaattacctaatcaagtgac

SEQ ID NO: 279670 - DNA, 20 bp, Artificial
  CRISPR gRNA sequence
aattacctaatcaagtgacc

SEQ ID NO: 279671 - DNA, 20 bp, Artificial
  CRISPR gRNA sequence
ctaatcaagtgaccaggcaa

SEQ ID NO: 279672 - DNA, 20 bp, Artificial
  CRISPR gRNA sequence
agtgaccaggcaacagatcc

SEQ ID NO: 279673 - DNA, 20 bp, Artificial
  CRISPR gRNA sequence
gaccaggcaacagatccaag

SEQ ID NO: 279674 - DNA, 20 bp, Artificial
  CRISPR gRNA sequence
accaggcaacagatccaaga

SEQ ID NO: 279675 - DNA, 20 bp, Artificial
  CRISPR gRNA sequence
caggcaacagatccaagaag

SEQ ID NO: 279676 - DNA, 20 bp, Artificial
  CRISPR gRNA sequence
aggcaacagatccaagaagg

SEQ ID NO: 279677 - DNA, 20 bp, Artificial
  CRISPR gRNA sequence
ccaagaaggaggccttctgt

SEQ ID NO: 279678 - DNA, 20 bp, Artificial
  CRISPR gRNA sequence
gaaggaggccttctgtaagt

SEQ ID NO: 279679 - DNA, 20 bp, Artificial
  CRISPR gRNA sequence
gtgagaattcatgaataatg

SEQ ID NO: 279680 - DNA, 20 bp, Artificial
  CRISPR gRNA sequence
ttatattccctacctattta

SEQ ID NO: 279681 - DNA, 20 bp, Artificial
  CRISPR gRNA sequence
ttccctacctatttaaagta

SEQ ID NO: 279682 - DNA, 20 bp, Artificial
  CRISPR gRNA sequence
atggccctcttttttcttct

SEQ ID NO: 279683 - DNA, 20 bp, Artificial
  CRISPR gRNA sequence
cttattcttcgtcatgactg

SEQ ID NO: 279684 - DNA, 20 bp, Artificial
  CRISPR gRNA sequence
tcgtcatgactgcagaatca

SEQ ID NO: 279685 - DNA, 20 bp, Artificial
  CRISPR gRNA sequence
cgtcatgactgcagaatcat

SEQ ID NO: 279686 - DNA, 20 bp, Artificial
  CRISPR gRNA sequence
actgcagaatcataggccct

SEQ ID NO: 279687 - DNA, 20 bp, Artificial
  CRISPR gRNA sequence
atcataggcccttggaatct

SEQ ID NO: 279688 - DNA, 20 bp, Artificial
  CRISPR gRNA sequence
tcataggcccttggaatctc

SEQ ID NO: 279689 - DNA, 20 bp, Artificial
  CRISPR gRNA sequence
caggctgacctgccctgtcc

SEQ ID NO: 279690 - DNA, 20 bp, Artificial
  CRISPR gRNA sequence
tcctgaacctctcaatctct

SEQ ID NO: 279691 - DNA, 20 bp, Artificial
  CRISPR gRNA sequence
tctcaatctctcagttgtct

SEQ ID NO: 279692 - DNA, 20 bp, Artificial
  CRISPR gRNA sequence
cagttgtctcagctgcaaaa

SEQ ID NO: 279693 - DNA, 20 bp, Artificial
  CRISPR gRNA sequence
agttgtctcagctgcaaaat

SEQ ID NO: 279694 - DNA, 20 bp, Artificial
  CRISPR gRNA sequence
gttgtctcagctgcaaaatg

SEQ ID NO: 279695 - DNA, 20 bp, Artificial
  CRISPR gRNA sequence
ggaaaataatacatatcttg

SEQ ID NO: 279696 - DNA, 20 bp, Artificial
  CRISPR gRNA sequence
gaaaataatacatatcttgt

SEQ ID NO: 279697 - DNA, 20 bp, Artificial
  CRISPR gRNA sequence
aaaataatacatatcttgtg

SEQ ID NO: 279698 - DNA, 20 bp, Artificial
  CRISPR gRNA sequence
tacatatcttgtggggttgt

SEQ ID NO: 279699 - DNA, 20 bp, Artificial
  CRISPR gRNA sequence
acatatcttgtggggttgtt

SEQ ID NO: 279700 - DNA, 20 bp, Artificial
  CRISPR gRNA sequence
catatcttgtggggttgttg

SEQ ID NO: 279701 - DNA, 20 bp, Artificial
  CRISPR gRNA sequence
atatcttgtggggttgttgg

SEQ ID NO: 279702 - DNA, 20 bp, Artificial
  CRISPR gRNA sequence
tgttgggggattaaatgaca

SEQ ID NO: 279703 - DNA, 20 bp, Artificial
  CRISPR gRNA sequence
catagcacctgtcccctcca

SEQ ID NO: 279704 - DNA, 20 bp, Artificial
  CRISPR gRNA sequence
tagcacctgtcccctccata

SEQ ID NO: 279705 - DNA, 20 bp, Artificial
  CRISPR gRNA sequence
tcccctccatagagccacca

SEQ ID NO: 279706 - DNA, 20 bp, Artificial
  CRISPR gRNA sequence
ccctccatagagccaccaca

SEQ ID NO: 279707 - DNA, 20 bp, Artificial
  CRISPR gRNA sequence
cctccatagagccaccacag

SEQ ID NO: 279708 - DNA, 20 bp, Artificial
  CRISPR gRNA sequence
ccatagagccaccacagagg

SEQ ID NO: 279709 - DNA, 20 bp, Artificial
  CRISPR gRNA sequence
caccacagaggaagcaaaaa

SEQ ID NO: 279710 - DNA, 20 bp, Artificial
  CRISPR gRNA sequence
accacagaggaagcaaaaaa

SEQ ID NO: 279711 - DNA, 20 bp, Artificial
  CRISPR gRNA sequence
gaggaagcaaaaaaaggaaa

SEQ ID NO: 279712 - DNA, 20 bp, Artificial
  CRISPR gRNA sequence
caaaaaaaggaaatagtatg

SEQ ID NO: 279713 - DNA, 20 bp, Artificial
  CRISPR gRNA sequence
aaaaaaggaaatagtatgaa

SEQ ID NO: 279714 - DNA, 20 bp, Artificial
  CRISPR gRNA sequence
gtatgaagagtaattcaata

SEQ ID NO: 279715 - DNA, 20 bp, Artificial
  CRISPR gRNA sequence
tatgaagagtaattcaatat

SEQ ID NO: 279716 - DNA, 20 bp, Artificial
  CRISPR gRNA sequence
gtaattcaatataggctatc

SEQ ID NO: 279717 - DNA, 20 bp, Artificial
  CRISPR gRNA sequence
ttcaatataggctatctaga

SEQ ID NO: 279718 - DNA, 20 bp, Artificial
  CRISPR gRNA sequence
caatataggctatctagaca

SEQ ID NO: 279719 - DNA, 20 bp, Artificial
  CRISPR gRNA sequence
aatataggctatctagacag

SEQ ID NO: 279720 - DNA, 20 bp, Artificial
  CRISPR gRNA sequence
ataggctatctagacagagg

SEQ ID NO: 279721 - DNA, 20 bp, Artificial
  CRISPR gRNA sequence
taggctatctagacagaggt

SEQ ID NO: 279722 - DNA, 20 bp, Artificial
  CRISPR gRNA sequence
atctagacagaggtgggcaa

SEQ ID NO: 279723 - DNA, 20 bp, Artificial
  CRISPR gRNA sequence
tcctccaccaccactgtacc

SEQ ID NO: 279724 - DNA, 20 bp, Artificial
  CRISPR gRNA sequence
caccactgtacccagaacct

SEQ ID NO: 279725 - DNA, 20 bp, Artificial
  CRISPR gRNA sequence
actgtacccagaaccttagt

SEQ ID NO: 279726 - DNA, 20 bp, Artificial
  CRISPR gRNA sequence
ctgtacccagaaccttagtc

SEQ ID NO: 279727 - DNA, 20 bp, Artificial
  CRISPR gRNA sequence
tagtcaggactgacttctct

SEQ ID NO: 279728 - DNA, 20 bp, Artificial
  CRISPR gRNA sequence
agtcaggactgacttctctt

SEQ ID NO: 279729 - DNA, 20 bp, Artificial
  CRISPR gRNA sequence
gtcaggactgacttctcttg

SEQ ID NO: 279730 - DNA, 20 bp, Artificial
  CRISPR gRNA sequence
tcaggactgacttctcttgg

SEQ ID NO: 279731 - DNA, 20 bp, Artificial
  CRISPR gRNA sequence
ggactgacttctcttggggg

SEQ ID NO: 279732 - DNA, 20 bp, Artificial
  CRISPR gRNA sequence
tcttgggggtggtattgtgt

SEQ ID NO: 279733 - DNA, 20 bp, Artificial
  CRISPR gRNA sequence
cttgggggtggtattgtgtt

SEQ ID NO: 279734 - DNA, 20 bp, Artificial
  CRISPR gRNA sequence
ttgtgttaggtaaaccaaat

SEQ ID NO: 279735 - DNA, 20 bp, Artificial
  CRISPR gRNA sequence
tgttaggtaaaccaaataag

SEQ ID NO: 279736 - DNA, 20 bp, Artificial
  CRISPR gRNA sequence
gtaaaccaaataagaagtaa

SEQ ID NO: 279737 - DNA, 20 bp, Artificial
  CRISPR gRNA sequence
taaaccaaataagaagtaat

SEQ ID NO: 279738 - DNA, 20 bp, Artificial
  CRISPR gRNA sequence
gactaaaaattgcctgctgt

SEQ ID NO: 279739 - DNA, 20 bp, Artificial
  CRISPR gRNA sequence
ctaaaaattgcctgctgtga

SEQ ID NO: 279740 - DNA, 20 bp, Artificial
  CRISPR gRNA sequence
aaaattgcctgctgtgagag

SEQ ID NO: 279741 - DNA, 20 bp, Artificial
  CRISPR gRNA sequence
aaattgcctgctgtgagaga

SEQ ID NO: 279742 - DNA, 20 bp, Artificial
  CRISPR gRNA sequence
tcctaaatcttgcatgtcat

SEQ ID NO: 279743 - DNA, 20 bp, Artificial
  CRISPR gRNA sequence
catgtcattggaaaattctc

SEQ ID NO: 279744 - DNA, 20 bp, Artificial
  CRISPR gRNA sequence
attggaaaattctcaagaaa

SEQ ID NO: 279745 - DNA, 20 bp, Artificial
  CRISPR gRNA sequence
ttggaaaattctcaagaaaa

SEQ ID NO: 279746 - DNA, 20 bp, Artificial
  CRISPR gRNA sequence
gaaaattctcaagaaaaagg

SEQ ID NO: 279747 - DNA, 20 bp, Artificial
  CRISPR gRNA sequence
aaaattctcaagaaaaagga

SEQ ID NO: 279748 - DNA, 20 bp, Artificial
  CRISPR gRNA sequence
aaattctcaagaaaaaggaa

SEQ ID NO: 279749 - DNA, 20 bp, Artificial
  CRISPR gRNA sequence
aattctcaagaaaaaggaag

SEQ ID NO: 279750 - DNA, 20 bp, Artificial
  CRISPR gRNA sequence
ctcaagaaaaaggaagggga

SEQ ID NO: 279751 - DNA, 20 bp, Artificial
  CRISPR gRNA sequence
tcaagaaaaaggaaggggat

SEQ ID NO: 279752 - DNA, 20 bp, Artificial
  CRISPR gRNA sequence
ataggttatgttataatgat

SEQ ID NO: 279753 - DNA, 20 bp, Artificial
  CRISPR gRNA sequence
tgttataatgattggtccat

SEQ ID NO: 279754 - DNA, 20 bp, Artificial
  CRISPR gRNA sequence
ttggtccatgagtctgattt

SEQ ID NO: 279755 - DNA, 20 bp, Artificial
  CRISPR gRNA sequence
gttttttatgcaatcacatt

SEQ ID NO: 279756 - DNA, 20 bp, Artificial
  CRISPR gRNA sequence
gcaatcacatttagtttttc

SEQ ID NO: 279757 - DNA, 20 bp, Artificial
  CRISPR gRNA sequence
tcacatttagtttttctaga

SEQ ID NO: 279758 - DNA, 20 bp, Artificial
  CRISPR gRNA sequence
tgacttccaaaacctttaac

SEQ ID NO: 279759 - DNA, 20 bp, Artificial
  CRISPR gRNA sequence
aaaacctttaacaagcattg

SEQ ID NO: 279760 - DNA, 20 bp, Artificial
  CRISPR gRNA sequence
aaacctttaacaagcattgc

SEQ ID NO: 279761 - DNA, 20 bp, Artificial
  CRISPR gRNA sequence
cattgcgggtgcaactgcta

SEQ ID NO: 279762 - DNA, 20 bp, Artificial
  CRISPR gRNA sequence
ctgctatagaaaacactatt

SEQ ID NO: 279763 - DNA, 20 bp, Artificial
  CRISPR gRNA sequence
tgctatagaaaacactattg

SEQ ID NO: 279764 - DNA, 20 bp, Artificial
  CRISPR gRNA sequence
aaaacactattgaggttcct

SEQ ID NO: 279765 - DNA, 20 bp, Artificial
  CRISPR gRNA sequence
gttcctcagaaaattaaaaa

SEQ ID NO: 279766 - DNA, 20 bp, Artificial
  CRISPR gRNA sequence
ccaaaattccatatatccat

SEQ ID NO: 279767 - DNA, 20 bp, Artificial
  CRISPR gRNA sequence
catatatccataagaattga

SEQ ID NO: 279768 - DNA, 20 bp, Artificial
  CRISPR gRNA sequence
atatccataagaattgaaag

SEQ ID NO: 279769 - DNA, 20 bp, Artificial
  CRISPR gRNA sequence
tatccataagaattgaaagc

SEQ ID NO: 279770 - DNA, 20 bp, Artificial
  CRISPR gRNA sequence
atccataagaattgaaagca

SEQ ID NO: 279771 - DNA, 20 bp, Artificial
  CRISPR gRNA sequence
gaattgaaagcagggtcttg

SEQ ID NO: 279772 - DNA, 20 bp, Artificial
  CRISPR gRNA sequence
attgaaagcagggtcttgaa

SEQ ID NO: 279773 - DNA, 20 bp, Artificial
  CRISPR gRNA sequence
tatttgcacacccatgttca

SEQ ID NO: 279774 - DNA, 20 bp, Artificial
  CRISPR gRNA sequence
ttgcacacccatgttcatag

SEQ ID NO: 279775 - DNA, 20 bp, Artificial
  CRISPR gRNA sequence
cacccatgttcatagcagca

SEQ ID NO: 279776 - DNA, 20 bp, Artificial
  CRISPR gRNA sequence
ccatgttcatagcagcacag

SEQ ID NO: 279777 - DNA, 20 bp, Artificial
  CRISPR gRNA sequence
gttcatagcagcacagtagc

SEQ ID NO: 279778 - DNA, 20 bp, Artificial
  CRISPR gRNA sequence
ttcatagcagcacagtagcc

SEQ ID NO: 279779 - DNA, 20 bp, Artificial
  CRISPR gRNA sequence
catagcagcacagtagccag

SEQ ID NO: 279780 - DNA, 20 bp, Artificial
  CRISPR gRNA sequence
atagcagcacagtagccagg

SEQ ID NO: 279781 - DNA, 20 bp, Artificial
  CRISPR gRNA sequence
gcagcacagtagccaggagg

SEQ ID NO: 279782 - DNA, 20 bp, Artificial
  CRISPR gRNA sequence
cagcacagtagccaggaggt

SEQ ID NO: 279783 - DNA, 20 bp, Artificial
  CRISPR gRNA sequence
cacagtagccaggaggtggg

SEQ ID NO: 279784 - DNA, 20 bp, Artificial
  CRISPR gRNA sequence
gtagccaggaggtgggaagc

SEQ ID NO: 279785 - DNA, 20 bp, Artificial
  CRISPR gRNA sequence
gcaagccaaatgtccatcta

SEQ ID NO: 279786 - DNA, 20 bp, Artificial
  CRISPR gRNA sequence
aatgtccatctacagatgaa

SEQ ID NO: 279787 - DNA, 20 bp, Artificial
  CRISPR gRNA sequence
atgtccatctacagatgaat

SEQ ID NO: 279788 - DNA, 20 bp, Artificial
  CRISPR gRNA sequence
atgaatgggcaaacaaaatg

SEQ ID NO: 279789 - DNA, 20 bp, Artificial
  CRISPR gRNA sequence
tgaatgggcaaacaaaatgt

SEQ ID NO: 279790 - DNA, 20 bp, Artificial
  CRISPR gRNA sequence
gaatgggcaaacaaaatgtg

SEQ ID NO: 279791 - DNA, 20 bp, Artificial
  CRISPR gRNA sequence
aatgggcaaacaaaatgtgg

SEQ ID NO: 279792 - DNA, 20 bp, Artificial
  CRISPR gRNA sequence
atgggcaaacaaaatgtggg

SEQ ID NO: 279793 - DNA, 20 bp, Artificial
  CRISPR gRNA sequence
tgggcaaacaaaatgtgggg

SEQ ID NO: 279794 - DNA, 20 bp, Artificial
  CRISPR gRNA sequence
gggcaaacaaaatgtggggg

SEQ ID NO: 279795 - DNA, 20 bp, Artificial
  CRISPR gRNA sequence
ggcaaacaaaatgtgggggg

SEQ ID NO: 279796 - DNA, 20 bp, Artificial
  CRISPR gRNA sequence
atcatatcattaccattcca

SEQ ID NO: 279797 - DNA, 20 bp, Artificial
  CRISPR gRNA sequence
tcatatcattaccattccaa

SEQ ID NO: 279798 - DNA, 20 bp, Artificial
  CRISPR gRNA sequence
tatcattaccattccaaagg

SEQ ID NO: 279799 - DNA, 20 bp, Artificial
  CRISPR gRNA sequence
atcattaccattccaaagga

SEQ ID NO: 279800 - DNA, 20 bp, Artificial
  CRISPR gRNA sequence
ctacaacgtgaatgaacctt

SEQ ID NO: 279801 - DNA, 20 bp, Artificial
  CRISPR gRNA sequence
aaccttgagtgcatcatgct

SEQ ID NO: 279802 - DNA, 20 bp, Artificial
  CRISPR gRNA sequence
tgcatcatgctaagtgaaat

SEQ ID NO: 279803 - DNA, 20 bp, Artificial
  CRISPR gRNA sequence
tgaaataagccaatcataaa

SEQ ID NO: 279804 - DNA, 20 bp, Artificial
  CRISPR gRNA sequence
gaaataagccaatcataaac

SEQ ID NO: 279805 - DNA, 20 bp, Artificial
  CRISPR gRNA sequence
ctgtatgattctatttctat

SEQ ID NO: 279806 - DNA, 20 bp, Artificial
  CRISPR gRNA sequence
ctatttctatgagatattta

SEQ ID NO: 279807 - DNA, 20 bp, Artificial
  CRISPR gRNA sequence
tttctatgagatatttaaag

SEQ ID NO: 279808 - DNA, 20 bp, Artificial
  CRISPR gRNA sequence
gccaaattcatacaaacaaa

SEQ ID NO: 279809 - DNA, 20 bp, Artificial
  CRISPR gRNA sequence
attcatacaaacaaacagaa

SEQ ID NO: 279810 - DNA, 20 bp, Artificial
  CRISPR gRNA sequence
acaaacagaatggcaattgc

SEQ ID NO: 279811 - DNA, 20 bp, Artificial
  CRISPR gRNA sequence
aaacagaatggcaattgcca

SEQ ID NO: 279812 - DNA, 20 bp, Artificial
  CRISPR gRNA sequence
aacagaatggcaattgccag

SEQ ID NO: 279813 - DNA, 20 bp, Artificial
  CRISPR gRNA sequence
aatggcaattgccagaggct

SEQ ID NO: 279814 - DNA, 20 bp, Artificial
  CRISPR gRNA sequence
atggcaattgccagaggctg

SEQ ID NO: 279815 - DNA, 20 bp, Artificial
  CRISPR gRNA sequence
tggcaattgccagaggctga

SEQ ID NO: 279816 - DNA, 20 bp, Artificial
  CRISPR gRNA sequence
ggcaattgccagaggctgag

SEQ ID NO: 279817 - DNA, 20 bp, Artificial
  CRISPR gRNA sequence
caattgccagaggctgaggg

SEQ ID NO: 279818 - DNA, 20 bp, Artificial
  CRISPR gRNA sequence
attgccagaggctgagggga

SEQ ID NO: 279819 - DNA, 20 bp, Artificial
  CRISPR gRNA sequence
ttgccagaggctgaggggag

SEQ ID NO: 279820 - DNA, 20 bp, Artificial
  CRISPR gRNA sequence
tgccagaggctgaggggaga

SEQ ID NO: 279821 - DNA, 20 bp, Artificial
  CRISPR gRNA sequence
gccagaggctgaggggagag

SEQ ID NO: 279822 - DNA, 20 bp, Artificial
  CRISPR gRNA sequence
ccagaggctgaggggagagg

SEQ ID NO: 279823 - DNA, 20 bp, Artificial
  CRISPR gRNA sequence
aggctgaggggagaggggga

SEQ ID NO: 279824 - DNA, 20 bp, Artificial
  CRISPR gRNA sequence
ggctgaggggagagggggaa

SEQ ID NO: 279825 - DNA, 20 bp, Artificial
  CRISPR gRNA sequence
gctgaggggagagggggaaa

SEQ ID NO: 279826 - DNA, 20 bp, Artificial
  CRISPR gRNA sequence
ctgaggggagagggggaaag

SEQ ID NO: 279827 - DNA, 20 bp, Artificial
  CRISPR gRNA sequence
gaggggagagggggaaaggg

SEQ ID NO: 279828 - DNA, 20 bp, Artificial
  CRISPR gRNA sequence
gggaaaggggagttgtttaa

SEQ ID NO: 279829 - DNA, 20 bp, Artificial
  CRISPR gRNA sequence
ggaaaggggagttgtttaat

SEQ ID NO: 279830 - DNA, 20 bp, Artificial
  CRISPR gRNA sequence
ggggagttgtttaatgggca

SEQ ID NO: 279831 - DNA, 20 bp, Artificial
  CRISPR gRNA sequence
ggagttgtttaatgggcata

SEQ ID NO: 279832 - DNA, 20 bp, Artificial
  CRISPR gRNA sequence
gtttaatgggcatagagttt

SEQ ID NO: 279833 - DNA, 20 bp, Artificial
  CRISPR gRNA sequence
atttgcaaaatgaaaatttc

SEQ ID NO: 279834 - DNA, 20 bp, Artificial
  CRISPR gRNA sequence
ttgcaaaatgaaaatttcta

SEQ ID NO: 279835 - DNA, 20 bp, Artificial
  CRISPR gRNA sequence
ctgtacacttaaaaatcaat

SEQ ID NO: 279836 - DNA, 20 bp, Artificial
  CRISPR gRNA sequence
tgtttgtttgtttgtttgtt

SEQ ID NO: 279837 - DNA, 20 bp, Artificial
  CRISPR gRNA sequence
tttgtttgtttgtttgtttg

SEQ ID NO: 279838 - DNA, 20 bp, Artificial
  CRISPR gRNA sequence
tttgtttgtttgtttggaga

SEQ ID NO: 279839 - DNA, 20 bp, Artificial
  CRISPR gRNA sequence
tgtttgtttgtttggagatg

SEQ ID NO: 279840 - DNA, 20 bp, Artificial
  CRISPR gRNA sequence
ggagttttgctcttgttgcc

SEQ ID NO: 279841 - DNA, 20 bp, Artificial
  CRISPR gRNA sequence
gagttttgctcttgttgccc

SEQ ID NO: 279842 - DNA, 20 bp, Artificial
  CRISPR gRNA sequence
tttgctcttgttgcccaggc

SEQ ID NO: 279843 - DNA, 20 bp, Artificial
  CRISPR gRNA sequence
ttgctcttgttgcccaggct

SEQ ID NO: 279844 - DNA, 20 bp, Artificial
  CRISPR gRNA sequence
tgctcttgttgcccaggctg

SEQ ID NO: 279845 - DNA, 20 bp, Artificial
  CRISPR gRNA sequence
cccaggctggggtgcaatct

SEQ ID NO: 279846 - DNA, 20 bp, Artificial
  CRISPR gRNA sequence
ttactgcaacctccgcctcc

SEQ ID NO: 279847 - DNA, 20 bp, Artificial
  CRISPR gRNA sequence
tactgcaacctccgcctcct

SEQ ID NO: 279848 - DNA, 20 bp, Artificial
  CRISPR gRNA sequence
aacctccgcctcctgggttc

SEQ ID NO: 279849 - DNA, 20 bp, Artificial
  CRISPR gRNA sequence
ttcaagtgattctcctgcct

SEQ ID NO: 279850 - DNA, 20 bp, Artificial
  CRISPR gRNA sequence
ttctcctgcctcagcctccc

SEQ ID NO: 279851 - DNA, 20 bp, Artificial
  CRISPR gRNA sequence
tcctgcctcagcctcccgag

SEQ ID NO: 279852 - DNA, 20 bp, Artificial
  CRISPR gRNA sequence
gcctcagcctcccgagtagc

SEQ ID NO: 279853 - DNA, 20 bp, Artificial
  CRISPR gRNA sequence
cctcagcctcccgagtagct

SEQ ID NO: 279854 - DNA, 20 bp, Artificial
  CRISPR gRNA sequence
actacacccgccaccacacc

SEQ ID NO: 279855 - DNA, 20 bp, Artificial
  CRISPR gRNA sequence
cggctaattttttgtatttt

SEQ ID NO: 279856 - DNA, 20 bp, Artificial
  CRISPR gRNA sequence
ctaattttttgtatttttag

SEQ ID NO: 279857 - DNA, 20 bp, Artificial
  CRISPR gRNA sequence
aattttttgtatttttagta

SEQ ID NO: 279858 - DNA, 20 bp, Artificial
  CRISPR gRNA sequence
ttttgtatttttagtagaga

SEQ ID NO: 279859 - DNA, 20 bp, Artificial
  CRISPR gRNA sequence
ttgtatttttagtagagaca

SEQ ID NO: 279860 - DNA, 20 bp, Artificial
  CRISPR gRNA sequence
gagacagagtttcaccatgt

SEQ ID NO: 279861 - DNA, 20 bp, Artificial
  CRISPR gRNA sequence
agagtttcaccatgttggcc

SEQ ID NO: 279862 - DNA, 20 bp, Artificial
  CRISPR gRNA sequence
tttcaccatgttggcccggc

SEQ ID NO: 279863 - DNA, 20 bp, Artificial
  CRISPR gRNA sequence
ggtctcgaactcctgacctc

SEQ ID NO: 279864 - DNA, 20 bp, Artificial
  CRISPR gRNA sequence
ctcaagtgatctgcctgcct

SEQ ID NO: 279865 - DNA, 20 bp, Artificial
  CRISPR gRNA sequence
ctgcctgcctcggcctccca

SEQ ID NO: 279866 - DNA, 20 bp, Artificial
  CRISPR gRNA sequence
gcctcggcctcccaaagtgc

SEQ ID NO: 279867 - DNA, 20 bp, Artificial
  CRISPR gRNA sequence
cctcggcctcccaaagtgct

SEQ ID NO: 279868 - DNA, 20 bp, Artificial
  CRISPR gRNA sequence
ctcccaaagtgctgggatta

SEQ ID NO: 279869 - DNA, 20 bp, Artificial
  CRISPR gRNA sequence
tcccaaagtgctgggattac

SEQ ID NO: 279870 - DNA, 20 bp, Artificial
  CRISPR gRNA sequence
agtgctgggattacaggcgt

SEQ ID NO: 279871 - DNA, 20 bp, Artificial
  CRISPR gRNA sequence
caggcgtgagccaccacgcc

SEQ ID NO: 279872 - DNA, 20 bp, Artificial
  CRISPR gRNA sequence
accacaatttttaaaaaatg

SEQ ID NO: 279873 - DNA, 20 bp, Artificial
  CRISPR gRNA sequence
cacaatttttaaaaaatgaa

SEQ ID NO: 279874 - DNA, 20 bp, Artificial
  CRISPR gRNA sequence
ttaaaaaatgaagagaaaaa

SEQ ID NO: 279875 - DNA, 20 bp, Artificial
  CRISPR gRNA sequence
aatgaagagaaaaaaagcat

SEQ ID NO: 279876 - DNA, 20 bp, Artificial
  CRISPR gRNA sequence
atgaagagaaaaaaagcatt

SEQ ID NO: 279877 - DNA, 20 bp, Artificial
  CRISPR gRNA sequence
tgaagagaaaaaaagcattg

SEQ ID NO: 279878 - DNA, 20 bp, Artificial
  CRISPR gRNA sequence
ggggaccccaaaaatcaaac

SEQ ID NO: 279879 - DNA, 20 bp, Artificial
  CRISPR gRNA sequence
aatcaaactggattgatact

SEQ ID NO: 279880 - DNA, 20 bp, Artificial
  CRISPR gRNA sequence
ctggattgatacttagtcac

SEQ ID NO: 279881 - DNA, 20 bp, Artificial
  CRISPR gRNA sequence
gtcactagacacaacaccct

SEQ ID NO: 279882 - DNA, 20 bp, Artificial
  CRISPR gRNA sequence
agttctgttactgccgactt

SEQ ID NO: 279883 - DNA, 20 bp, Artificial
  CRISPR gRNA sequence
actttggattcctgaccatg

SEQ ID NO: 279884 - DNA, 20 bp, Artificial
  CRISPR gRNA sequence
ctttggattcctgaccatgc

SEQ ID NO: 279885 - DNA, 20 bp, Artificial
  CRISPR gRNA sequence
ttgttctgtttgcctctcca

SEQ ID NO: 279886 - DNA, 20 bp, Artificial
  CRISPR gRNA sequence
tgttctgtttgcctctccat

SEQ ID NO: 279887 - DNA, 20 bp, Artificial
  CRISPR gRNA sequence
taggtgttatccacgtgacc

SEQ ID NO: 279888 - DNA, 20 bp, Artificial
  CRISPR gRNA sequence
aggtgttatccacgtgacca

SEQ ID NO: 279889 - DNA, 20 bp, Artificial
  CRISPR gRNA sequence
tgttatccacgtgaccaagg

SEQ ID NO: 279890 - DNA, 20 bp, Artificial
  CRISPR gRNA sequence
ccacgtgaccaaggaagtga

SEQ ID NO: 279891 - DNA, 20 bp, Artificial
  CRISPR gRNA sequence
cgtgaccaaggaagtgaaag

SEQ ID NO: 279892 - DNA, 20 bp, Artificial
  CRISPR gRNA sequence
gaccaaggaagtgaaagaag

SEQ ID NO: 279893 - DNA, 20 bp, Artificial
  CRISPR gRNA sequence
gaagtggcaacgctgtcctg

SEQ ID NO: 279894 - DNA, 20 bp, Artificial
  CRISPR gRNA sequence
tggtcacaatgtttctgttg

SEQ ID NO: 279895 - DNA, 20 bp, Artificial
  CRISPR gRNA sequence
gtcacaatgtttctgttgaa

SEQ ID NO: 279896 - DNA, 20 bp, Artificial
  CRISPR gRNA sequence
caatgtttctgttgaagagc

SEQ ID NO: 279897 - DNA, 20 bp, Artificial
  CRISPR gRNA sequence
tggcacaaactcgcatctac

SEQ ID NO: 279898 - DNA, 20 bp, Artificial
  CRISPR gRNA sequence
aaactcgcatctactggcaa

SEQ ID NO: 279899 - DNA, 20 bp, Artificial
  CRISPR gRNA sequence
aactcgcatctactggcaaa

SEQ ID NO: 279900 - DNA, 20 bp, Artificial
  CRISPR gRNA sequence
ctcgcatctactggcaaaag

SEQ ID NO: 279901 - DNA, 20 bp, Artificial
  CRISPR gRNA sequence
gcatctactggcaaaaggag

SEQ ID NO: 279902 - DNA, 20 bp, Artificial
  CRISPR gRNA sequence
ctggcaaaaggagaagaaaa

SEQ ID NO: 279903 - DNA, 20 bp, Artificial
  CRISPR gRNA sequence
atggtgctgactatgatgtc

SEQ ID NO: 279904 - DNA, 20 bp, Artificial
  CRISPR gRNA sequence
tggtgctgactatgatgtct

SEQ ID NO: 279905 - DNA, 20 bp, Artificial
  CRISPR gRNA sequence
ggtgctgactatgatgtctg

SEQ ID NO: 279906 - DNA, 20 bp, Artificial
  CRISPR gRNA sequence
tgtctggggacatgaatata

SEQ ID NO: 279907 - DNA, 20 bp, Artificial
  CRISPR gRNA sequence
gggacatgaatatatggccc

SEQ ID NO: 279908 - DNA, 20 bp, Artificial
  CRISPR gRNA sequence
tgaatatatggcccgagtac

SEQ ID NO: 279909 - DNA, 20 bp, Artificial
  CRISPR gRNA sequence
tatggcccgagtacaagaac

SEQ ID NO: 279910 - DNA, 20 bp, Artificial
  CRISPR gRNA sequence
taacctctccattgtgatcc

SEQ ID NO: 279911 - DNA, 20 bp, Artificial
  CRISPR gRNA sequence
tggctctgcgcccatctgac

SEQ ID NO: 279912 - DNA, 20 bp, Artificial
  CRISPR gRNA sequence
ggctctgcgcccatctgacg

SEQ ID NO: 279913 - DNA, 20 bp, Artificial
  CRISPR gRNA sequence
gctctgcgcccatctgacga

SEQ ID NO: 279914 - DNA, 20 bp, Artificial
  CRISPR gRNA sequence
catctgacgagggcacatac

SEQ ID NO: 279915 - DNA, 20 bp, Artificial
  CRISPR gRNA sequence
catacgagtgtgttgttctg

SEQ ID NO: 279916 - DNA, 20 bp, Artificial
  CRISPR gRNA sequence
tgttgttctgaagtatgaaa

SEQ ID NO: 279917 - DNA, 20 bp, Artificial
  CRISPR gRNA sequence
agtatgaaaaagacgctttc

SEQ ID NO: 279918 - DNA, 20 bp, Artificial
  CRISPR gRNA sequence
atgaaaaagacgctttcaag

SEQ ID NO: 279919 - DNA, 20 bp, Artificial
  CRISPR gRNA sequence
tgaaaaagacgctttcaagc

SEQ ID NO: 279920 - DNA, 20 bp, Artificial
  CRISPR gRNA sequence
cgctttcaagcgggaacacc

SEQ ID NO: 279921 - DNA, 20 bp, Artificial
  CRISPR gRNA sequence
caagcgggaacacctggctg

SEQ ID NO: 279922 - DNA, 20 bp, Artificial
  CRISPR gRNA sequence
cctggctgaagtgacgttat

SEQ ID NO: 279923 - DNA, 20 bp, Artificial
  CRISPR gRNA sequence
tgaagtgacgttatcagtca

SEQ ID NO: 279924 - DNA, 20 bp, Artificial
  CRISPR gRNA sequence
gaagtgacgttatcagtcaa

SEQ ID NO: 279925 - DNA, 20 bp, Artificial
  CRISPR gRNA sequence
tgacgttatcagtcaaaggt

SEQ ID NO: 279926 - DNA, 20 bp, Artificial
  CRISPR gRNA sequence
cgttatcagtcaaaggttgg

SEQ ID NO: 279927 - DNA, 20 bp, Artificial
  CRISPR gRNA sequence
gttatcagtcaaaggttggt

SEQ ID NO: 279928 - DNA, 20 bp, Artificial
  CRISPR gRNA sequence
gggattttctgattttactc

SEQ ID NO: 279929 - DNA, 20 bp, Artificial
  CRISPR gRNA sequence
ggattttctgattttactct

SEQ ID NO: 279930 - DNA, 20 bp, Artificial
  CRISPR gRNA sequence
tttctgattttactctaggc

SEQ ID NO: 279931 - DNA, 20 bp, Artificial
  CRISPR gRNA sequence
ctgattttactctaggccgg

SEQ ID NO: 279932 - DNA, 20 bp, Artificial
  CRISPR gRNA sequence
gcagattcttaatgccctta

SEQ ID NO: 279933 - DNA, 20 bp, Artificial
  CRISPR gRNA sequence
ttaatgcccttaaagacaca

SEQ ID NO: 279934 - DNA, 20 bp, Artificial
  CRISPR gRNA sequence
aagacacatggctattgatt

SEQ ID NO: 279935 - DNA, 20 bp, Artificial
  CRISPR gRNA sequence
agacacatggctattgattt

SEQ ID NO: 279936 - DNA, 20 bp, Artificial
  CRISPR gRNA sequence
tttaggtgaaaattttacca

SEQ ID NO: 279937 - DNA, 20 bp, Artificial
  CRISPR gRNA sequence
taggtgaaaattttaccaaa

SEQ ID NO: 279938 - DNA, 20 bp, Artificial
  CRISPR gRNA sequence
aggtgaaaattttaccaaag

SEQ ID NO: 279939 - DNA, 20 bp, Artificial
  CRISPR gRNA sequence
ggtgaaaattttaccaaaga

SEQ ID NO: 279940 - DNA, 20 bp, Artificial
  CRISPR gRNA sequence
atgtatctcacttcatttct

SEQ ID NO: 279941 - DNA, 20 bp, Artificial
  CRISPR gRNA sequence
gtatctcacttcatttcttg

SEQ ID NO: 279942 - DNA, 20 bp, Artificial
  CRISPR gRNA sequence
tcacttcatttcttggagtt

SEQ ID NO: 279943 - DNA, 20 bp, Artificial
  CRISPR gRNA sequence
atttcttggagttaagtctc

SEQ ID NO: 279944 - DNA, 20 bp, Artificial
  CRISPR gRNA sequence
gttgtacaataaactctaac

SEQ ID NO: 279945 - DNA, 20 bp, Artificial
  CRISPR gRNA sequence
taaactctaactggtttcta

SEQ ID NO: 279946 - DNA, 20 bp, Artificial
  CRISPR gRNA sequence
actggtttctaaagatgtcc

SEQ ID NO: 279947 - DNA, 20 bp, Artificial
  CRISPR gRNA sequence
ttcttgttctttgacaatcc

SEQ ID NO: 279948 - DNA, 20 bp, Artificial
  CRISPR gRNA sequence
caagttcatgacaatcatcc

SEQ ID NO: 279949 - DNA, 20 bp, Artificial
  CRISPR gRNA sequence
aagttcatgacaatcatcct

SEQ ID NO: 279950 - DNA, 20 bp, Artificial
  CRISPR gRNA sequence
agttcatgacaatcatcctg

SEQ ID NO: 279951 - DNA, 20 bp, Artificial
  CRISPR gRNA sequence
tggggcactataatgaccta

SEQ ID NO: 279952 - DNA, 20 bp, Artificial
  CRISPR gRNA sequence
gggcactataatgacctaaa

SEQ ID NO: 279953 - DNA, 20 bp, Artificial
  CRISPR gRNA sequence
taaagagcctctcaatcacc

SEQ ID NO: 279954 - DNA, 20 bp, Artificial
  CRISPR gRNA sequence
aaagagcctctcaatcacca

SEQ ID NO: 279955 - DNA, 20 bp, Artificial
  CRISPR gRNA sequence
aagagcctctcaatcaccaa

SEQ ID NO: 279956 - DNA, 20 bp, Artificial
  CRISPR gRNA sequence
agagcctctcaatcaccaag

SEQ ID NO: 279957 - DNA, 20 bp, Artificial
  CRISPR gRNA sequence
ggggcatctttgatttgatg

SEQ ID NO: 279958 - DNA, 20 bp, Artificial
  CRISPR gRNA sequence
gctactaactgcacttgacc

SEQ ID NO: 279959 - DNA, 20 bp, Artificial
  CRISPR gRNA sequence
ccagcaatatatgcctgtga

SEQ ID NO: 279960 - DNA, 20 bp, Artificial
  CRISPR gRNA sequence
gcctgtgaaagtatgctgaa

SEQ ID NO: 279961 - DNA, 20 bp, Artificial
  CRISPR gRNA sequence
cctgtgaaagtatgctgaaa

SEQ ID NO: 279962 - DNA, 20 bp, Artificial
  CRISPR gRNA sequence
aaagtatgctgaaaaggtaa

SEQ ID NO: 279963 - DNA, 20 bp, Artificial
  CRISPR gRNA sequence
aagtatgctgaaaaggtaac

SEQ ID NO: 279964 - DNA, 20 bp, Artificial
  CRISPR gRNA sequence
agtatgctgaaaaggtaacg

SEQ ID NO: 279965 - DNA, 20 bp, Artificial
  CRISPR gRNA sequence
tgctgaaaaggtaacggggc

SEQ ID NO: 279966 - DNA, 20 bp, Artificial
  CRISPR gRNA sequence
gctgaaaaggtaacggggct

SEQ ID NO: 279967 - DNA, 20 bp, Artificial
  CRISPR gRNA sequence
aaaggtaacggggctgggta

SEQ ID NO: 279968 - DNA, 20 bp, Artificial
  CRISPR gRNA sequence
ggtaacggggctgggtatgg

SEQ ID NO: 279969 - DNA, 20 bp, Artificial
  CRISPR gRNA sequence
gtggcttatgcctgtaatct

SEQ ID NO: 279970 - DNA, 20 bp, Artificial
  CRISPR gRNA sequence
tgcctgtaatctcagcactt

SEQ ID NO: 279971 - DNA, 20 bp, Artificial
  CRISPR gRNA sequence
gcctgtaatctcagcacttt

SEQ ID NO: 279972 - DNA, 20 bp, Artificial
  CRISPR gRNA sequence
ctgtaatctcagcactttgg

SEQ ID NO: 279973 - DNA, 20 bp, Artificial
  CRISPR gRNA sequence
tgtaatctcagcactttggg

SEQ ID NO: 279974 - DNA, 20 bp, Artificial
  CRISPR gRNA sequence
tctcagcactttgggaggcc

SEQ ID NO: 279975 - DNA, 20 bp, Artificial
  CRISPR gRNA sequence
ctcagcactttgggaggcca

SEQ ID NO: 279976 - DNA, 20 bp, Artificial
  CRISPR gRNA sequence
agcactttgggaggccaagg

SEQ ID NO: 279977 - DNA, 20 bp, Artificial
  CRISPR gRNA sequence
gcactttgggaggccaaggc

SEQ ID NO: 279978 - DNA, 20 bp, Artificial
  CRISPR gRNA sequence
ctttgggaggccaaggcagg

SEQ ID NO: 279979 - DNA, 20 bp, Artificial
  CRISPR gRNA sequence
ccaaggcaggcggatcactt

SEQ ID NO: 279980 - DNA, 20 bp, Artificial
  CRISPR gRNA sequence
caaggcaggcggatcacttg

SEQ ID NO: 279981 - DNA, 20 bp, Artificial
  CRISPR gRNA sequence
ggcggatcacttgaggtcat

SEQ ID NO: 279982 - DNA, 20 bp, Artificial
  CRISPR gRNA sequence
tcacttgaggtcatgagttc

SEQ ID NO: 279983 - DNA, 20 bp, Artificial
  CRISPR gRNA sequence
tgaggtcatgagttcaagac

SEQ ID NO: 279984 - DNA, 20 bp, Artificial
  CRISPR gRNA sequence
tcatgagttcaagaccagcc

SEQ ID NO: 279985 - DNA, 20 bp, Artificial
  CRISPR gRNA sequence
caagaccagcctggccaaca

SEQ ID NO: 279986 - DNA, 20 bp, Artificial
  CRISPR gRNA sequence
cctactaaaaatacaaaaac

SEQ ID NO: 279987 - DNA, 20 bp, Artificial
  CRISPR gRNA sequence
ctaaaaatacaaaaactagc

SEQ ID NO: 279988 - DNA, 20 bp, Artificial
  CRISPR gRNA sequence
atacaaaaactagccagatg

SEQ ID NO: 279989 - DNA, 20 bp, Artificial
  CRISPR gRNA sequence
caaaaactagccagatgtgg

SEQ ID NO: 279990 - DNA, 20 bp, Artificial
  CRISPR gRNA sequence
gtggcgcattcctgtaatcc

SEQ ID NO: 279991 - DNA, 20 bp, Artificial
  CRISPR gRNA sequence
tcctgtaatcccagctactc

SEQ ID NO: 279992 - DNA, 20 bp, Artificial
  CRISPR gRNA sequence
ctgtaatcccagctactctg

SEQ ID NO: 279993 - DNA, 20 bp, Artificial
  CRISPR gRNA sequence
tgtaatcccagctactctgg

SEQ ID NO: 279994 - DNA, 20 bp, Artificial
  CRISPR gRNA sequence
tcccagctactctggaggct

SEQ ID NO: 279995 - DNA, 20 bp, Artificial
  CRISPR gRNA sequence
cccagctactctggaggctg

SEQ ID NO: 279996 - DNA, 20 bp, Artificial
  CRISPR gRNA sequence
agctactctggaggctgagg

SEQ ID NO: 279997 - DNA, 20 bp, Artificial
  CRISPR gRNA sequence
ctactctggaggctgaggca

SEQ ID NO: 279998 - DNA, 20 bp, Artificial
  CRISPR gRNA sequence
ggcagagaatcgcttgaacc

SEQ ID NO: 279999 - DNA, 20 bp, Artificial
  CRISPR gRNA sequence
gcagagaatcgcttgaacct

SEQ ID NO: 280000 - DNA, 20 bp, Artificial
  CRISPR gRNA sequence
agagaatcgcttgaacctgg

SEQ ID NO: 280001 - DNA, 20 bp, Artificial
  CRISPR gRNA sequence
gagaatcgcttgaacctggg

SEQ ID NO: 280002 - DNA, 20 bp, Artificial
  CRISPR gRNA sequence
aatcgcttgaacctgggagg

SEQ ID NO: 280003 - DNA, 20 bp, Artificial
  CRISPR gRNA sequence
tcgcttgaacctgggaggcg

SEQ ID NO: 280004 - DNA, 20 bp, Artificial
  CRISPR gRNA sequence
cgcttgaacctgggaggcgg

SEQ ID NO: 280005 - DNA, 20 bp, Artificial
  CRISPR gRNA sequence
tgggaggcggaggttgcaat

SEQ ID NO: 280006 - DNA, 20 bp, Artificial
  CRISPR gRNA sequence
ggcggaggttgcaatgagct

SEQ ID NO: 280007 - DNA, 20 bp, Artificial
  CRISPR gRNA sequence
gagattgcaccactgcactc

SEQ ID NO: 280008 - DNA, 20 bp, Artificial
  CRISPR gRNA sequence
tgcaccactgcactccagcc

SEQ ID NO: 280009 - DNA, 20 bp, Artificial
  CRISPR gRNA sequence
gcaccactgcactccagcct

SEQ ID NO: 280010 - DNA, 20 bp, Artificial
  CRISPR gRNA sequence
gcactccagcctgggtgaca

SEQ ID NO: 280011 - DNA, 20 bp, Artificial
  CRISPR gRNA sequence
tccagcctgggtgacatagc

SEQ ID NO: 280012 - DNA, 20 bp, Artificial
  CRISPR gRNA sequence
ctcaaaaaaaaaaaaaaaaa

SEQ ID NO: 280013 - DNA, 20 bp, Artificial
  CRISPR gRNA sequence
aaaaaaaaaaaaaagaacaa

SEQ ID NO: 280014 - DNA, 20 bp, Artificial
  CRISPR gRNA sequence
aaaaaaaaaaaagaacaatg

SEQ ID NO: 280015 - DNA, 20 bp, Artificial
  CRISPR gRNA sequence
aaaaaaaaaaagaacaatgg

SEQ ID NO: 280016 - DNA, 20 bp, Artificial
  CRISPR gRNA sequence
atggaggcataaatcttttt

SEQ ID NO: 280017 - DNA, 20 bp, Artificial
  CRISPR gRNA sequence
tggaggcataaatctttttc

SEQ ID NO: 280018 - DNA, 20 bp, Artificial
  CRISPR gRNA sequence
aggcataaatctttttcagg

SEQ ID NO: 280019 - DNA, 20 bp, Artificial
  CRISPR gRNA sequence
tatgtgaacgtctattacta

SEQ ID NO: 280020 - DNA, 20 bp, Artificial
  CRISPR gRNA sequence
attatattctaatattttca

SEQ ID NO: 280021 - DNA, 20 bp, Artificial
  CRISPR gRNA sequence
atttacttattgcatatttg

SEQ ID NO: 280022 - DNA, 20 bp, Artificial
  CRISPR gRNA sequence
gcatatttgaagctctaatc

SEQ ID NO: 280023 - DNA, 20 bp, Artificial
  CRISPR gRNA sequence
tatttgaagctctaatctag

SEQ ID NO: 280024 - DNA, 20 bp, Artificial
  CRISPR gRNA sequence
tgaagctctaatctagcagt

SEQ ID NO: 280025 - DNA, 20 bp, Artificial
  CRISPR gRNA sequence
agcagtcagtcctgaaaaat

SEQ ID NO: 280026 - DNA, 20 bp, Artificial
  CRISPR gRNA sequence
agtcctgaaaaattagatgt

SEQ ID NO: 280027 - DNA, 20 bp, Artificial
  CRISPR gRNA sequence
tcctgaaaaattagatgtta

SEQ ID NO: 280028 - DNA, 20 bp, Artificial
  CRISPR gRNA sequence
aaaattagatgttagagaat

SEQ ID NO: 280029 - DNA, 20 bp, Artificial
  CRISPR gRNA sequence
aaattagatgttagagaatt

SEQ ID NO: 280030 - DNA, 20 bp, Artificial
  CRISPR gRNA sequence
tagatgttagagaattgggc

SEQ ID NO: 280031 - DNA, 20 bp, Artificial
  CRISPR gRNA sequence
agatgttagagaattgggcc

SEQ ID NO: 280032 - DNA, 20 bp, Artificial
  CRISPR gRNA sequence
ttagagaattgggccaggtg

SEQ ID NO: 280033 - DNA, 20 bp, Artificial
  CRISPR gRNA sequence
gagaattgggccaggtgcgg

SEQ ID NO: 280034 - DNA, 20 bp, Artificial
  CRISPR gRNA sequence
ttgggccaggtgcggtggct

SEQ ID NO: 280035 - DNA, 20 bp, Artificial
  CRISPR gRNA sequence
ggtgcggtggctcagcactt

SEQ ID NO: 280036 - DNA, 20 bp, Artificial
  CRISPR gRNA sequence
gtgcggtggctcagcacttt

SEQ ID NO: 280037 - DNA, 20 bp, Artificial
  CRISPR gRNA sequence
gcggtggctcagcactttgg

SEQ ID NO: 280038 - DNA, 20 bp, Artificial
  CRISPR gRNA sequence
cggtggctcagcactttggg

SEQ ID NO: 280039 - DNA, 20 bp, Artificial
  CRISPR gRNA sequence
gctcagcactttgggaggcc

SEQ ID NO: 280040 - DNA, 20 bp, Artificial
  CRISPR gRNA sequence
ctcagcactttgggaggcca

SEQ ID NO: 280041 - DNA, 20 bp, Artificial
  CRISPR gRNA sequence
agcactttgggaggccaagg

SEQ ID NO: 280042 - DNA, 20 bp, Artificial
  CRISPR gRNA sequence
gcactttgggaggccaaggt

SEQ ID NO: 280043 - DNA, 20 bp, Artificial
  CRISPR gRNA sequence
ctttgggaggccaaggtggg

SEQ ID NO: 280044 - DNA, 20 bp, Artificial
  CRISPR gRNA sequence
gggaggccaaggtgggtgga

SEQ ID NO: 280045 - DNA, 20 bp, Artificial
  CRISPR gRNA sequence
ccaaggtgggtggatggctt

SEQ ID NO: 280046 - DNA, 20 bp, Artificial
  CRISPR gRNA sequence
gtgggtggatggcttgagct

SEQ ID NO: 280047 - DNA, 20 bp, Artificial
  CRISPR gRNA sequence
tgggtggatggcttgagctc

SEQ ID NO: 280048 - DNA, 20 bp, Artificial
  CRISPR gRNA sequence
ggtggatggcttgagctcag

SEQ ID NO: 280049 - DNA, 20 bp, Artificial
  CRISPR gRNA sequence
tggcttgagctcaggagttt

SEQ ID NO: 280050 - DNA, 20 bp, Artificial
  CRISPR gRNA sequence
tgagctcaggagtttgagac

SEQ ID NO: 280051 - DNA, 20 bp, Artificial
  CRISPR gRNA sequence
tgagaccagcctgcccaaca

SEQ ID NO: 280052 - DNA, 20 bp, Artificial
  CRISPR gRNA sequence
tctactaaaaatacaaaaat

SEQ ID NO: 280053 - DNA, 20 bp, Artificial
  CRISPR gRNA sequence
ctaaaaatacaaaaattagc

SEQ ID NO: 280054 - DNA, 20 bp, Artificial
  CRISPR gRNA sequence
taaaaatacaaaaattagcc

SEQ ID NO: 280055 - DNA, 20 bp, Artificial
  CRISPR gRNA sequence
aaaaatacaaaaattagcca

SEQ ID NO: 280056 - DNA, 20 bp, Artificial
  CRISPR gRNA sequence
aaaattagccagggacgtgt

SEQ ID NO: 280057 - DNA, 20 bp, Artificial
  CRISPR gRNA sequence
ccagggacgtgttggctact

SEQ ID NO: 280058 - DNA, 20 bp, Artificial
  CRISPR gRNA sequence
cagggacgtgttggctactc

SEQ ID NO: 280059 - DNA, 20 bp, Artificial
  CRISPR gRNA sequence
gggacgtgttggctactcag

SEQ ID NO: 280060 - DNA, 20 bp, Artificial
  CRISPR gRNA sequence
ggacgtgttggctactcagg

SEQ ID NO: 280061 - DNA, 20 bp, Artificial
  CRISPR gRNA sequence
tgttggctactcaggaggct

SEQ ID NO: 280062 - DNA, 20 bp, Artificial
  CRISPR gRNA sequence
gttggctactcaggaggctg

SEQ ID NO: 280063 - DNA, 20 bp, Artificial
  CRISPR gRNA sequence
ggctactcaggaggctgagg

SEQ ID NO: 280064 - DNA, 20 bp, Artificial
  CRISPR gRNA sequence
gctactcaggaggctgaggc

SEQ ID NO: 280065 - DNA, 20 bp, Artificial
  CRISPR gRNA sequence
tactcaggaggctgaggcag

SEQ ID NO: 280066 - DNA, 20 bp, Artificial
  CRISPR gRNA sequence
gcaggagaatcacttgaacc

SEQ ID NO: 280067 - DNA, 20 bp, Artificial
  CRISPR gRNA sequence
caggagaatcacttgaacct

SEQ ID NO: 280068 - DNA, 20 bp, Artificial
  CRISPR gRNA sequence
ggagaatcacttgaacctgg

SEQ ID NO: 280069 - DNA, 20 bp, Artificial
  CRISPR gRNA sequence
gagaatcacttgaacctggg

SEQ ID NO: 280070 - DNA, 20 bp, Artificial
  CRISPR gRNA sequence
aatcacttgaacctgggagg

SEQ ID NO: 280071 - DNA, 20 bp, Artificial
  CRISPR gRNA sequence
tcacttgaacctgggaggcg

SEQ ID NO: 280072 - DNA, 20 bp, Artificial
  CRISPR gRNA sequence
cacttgaacctgggaggcgg

SEQ ID NO: 280073 - DNA, 20 bp, Artificial
  CRISPR gRNA sequence
aacctgggaggcggaggttg

SEQ ID NO: 280074 - DNA, 20 bp, Artificial
  CRISPR gRNA sequence
tgggaggcggaggttgcagt

SEQ ID NO: 280075 - DNA, 20 bp, Artificial
  CRISPR gRNA sequence
gaggcggaggttgcagtgag

SEQ ID NO: 280076 - DNA, 20 bp, Artificial
  CRISPR gRNA sequence
ggcggaggttgcagtgagca

SEQ ID NO: 280077 - DNA, 20 bp, Artificial
  CRISPR gRNA sequence
gaggttgcagtgagcagaga

SEQ ID NO: 280078 - DNA, 20 bp, Artificial
  CRISPR gRNA sequence
gagatggtgccactgcactc

SEQ ID NO: 280079 - DNA, 20 bp, Artificial
  CRISPR gRNA sequence
gtgccactgcactccagcct

SEQ ID NO: 280080 - DNA, 20 bp, Artificial
  CRISPR gRNA sequence
ctgcactccagccttggtga

SEQ ID NO: 280081 - DNA, 20 bp, Artificial
  CRISPR gRNA sequence
gcactccagccttggtgaca

SEQ ID NO: 280082 - DNA, 20 bp, Artificial
  CRISPR gRNA sequence
ccagccttggtgacagagca

SEQ ID NO: 280083 - DNA, 20 bp, Artificial
  CRISPR gRNA sequence
gactgtttcaaaaaaaaaaa

SEQ ID NO: 280084 - DNA, 20 bp, Artificial
  CRISPR gRNA sequence
tgtttcaaaaaaaaaaaaag

SEQ ID NO: 280085 - DNA, 20 bp, Artificial
  CRISPR gRNA sequence
aaaaaaaaaaaagtagacta

SEQ ID NO: 280086 - DNA, 20 bp, Artificial
  CRISPR gRNA sequence
aaaaaaaaaagtagactaca

SEQ ID NO: 280087 - DNA, 20 bp, Artificial
  CRISPR gRNA sequence
aaaaaaaaagtagactacag

SEQ ID NO: 280088 - DNA, 20 bp, Artificial
  CRISPR gRNA sequence
aaaaaaagtagactacagag

SEQ ID NO: 280089 - DNA, 20 bp, Artificial
  CRISPR gRNA sequence
aaaaaagtagactacagagg

SEQ ID NO: 280090 - DNA, 20 bp, Artificial
  CRISPR gRNA sequence
aaaaagtagactacagagga

SEQ ID NO: 280091 - DNA, 20 bp, Artificial
  CRISPR gRNA sequence
agtagactacagaggagggt

SEQ ID NO: 280092 - DNA, 20 bp, Artificial
  CRISPR gRNA sequence
gagggtgagcatttccctac

SEQ ID NO: 280093 - DNA, 20 bp, Artificial
  CRISPR gRNA sequence
ggtgagcatttccctactgg

SEQ ID NO: 280094 - DNA, 20 bp, Artificial
  CRISPR gRNA sequence
tgagcatttccctactggta

SEQ ID NO: 280095 - DNA, 20 bp, Artificial
  CRISPR gRNA sequence
tctgtcttaaaaaaaaaaaa

SEQ ID NO: 280096 - DNA, 20 bp, Artificial
  CRISPR gRNA sequence
tcttaaaaaaaaaaaaaagt

SEQ ID NO: 280097 - DNA, 20 bp, Artificial
  CRISPR gRNA sequence
ttaaaaaaaaaaaaaagtta

SEQ ID NO: 280098 - DNA, 20 bp, Artificial
  CRISPR gRNA sequence
aaaaaaaaaagttagagaat

SEQ ID NO: 280099 - DNA, 20 bp, Artificial
  CRISPR gRNA sequence
gcataattaattcctgccac

SEQ ID NO: 280100 - DNA, 20 bp, Artificial
  CRISPR gRNA sequence
cataattaattcctgccaca

SEQ ID NO: 280101 - DNA, 20 bp, Artificial
  CRISPR gRNA sequence
aaaaactaatttatgaatca

SEQ ID NO: 280102 - DNA, 20 bp, Artificial
  CRISPR gRNA sequence
ccctgtttatgtacctactg

SEQ ID NO: 280103 - DNA, 20 bp, Artificial
  CRISPR gRNA sequence
tgtttatgtacctactgtgg

SEQ ID NO: 280104 - DNA, 20 bp, Artificial
  CRISPR gRNA sequence
gtttatgtacctactgtgga

SEQ ID NO: 280105 - DNA, 20 bp, Artificial
  CRISPR gRNA sequence
atgtacctactgtggaaggc

SEQ ID NO: 280106 - DNA, 20 bp, Artificial
  CRISPR gRNA sequence
ctgtggaaggcaagcatttc

SEQ ID NO: 280107 - DNA, 20 bp, Artificial
  CRISPR gRNA sequence
aaggcaagcatttctggtct

SEQ ID NO: 280108 - DNA, 20 bp, Artificial
  CRISPR gRNA sequence
caagcatttctggtctcgga

SEQ ID NO: 280109 - DNA, 20 bp, Artificial
  CRISPR gRNA sequence
catttctggtctcggaaaga

SEQ ID NO: 280110 - DNA, 20 bp, Artificial
  CRISPR gRNA sequence
atttctggtctcggaaagaa

SEQ ID NO: 280111 - DNA, 20 bp, Artificial
  CRISPR gRNA sequence
ccttgcttttgtaaccaccc

SEQ ID NO: 280112 - DNA, 20 bp, Artificial
  CRISPR gRNA sequence
ttgcttttgtaaccacccaa

SEQ ID NO: 280113 - DNA, 20 bp, Artificial
  CRISPR gRNA sequence
tgcttttgtaaccacccaag

SEQ ID NO: 280114 - DNA, 20 bp, Artificial
  CRISPR gRNA sequence
ggtttacctcgcctgctgcg

SEQ ID NO: 280115 - DNA, 20 bp, Artificial
  CRISPR gRNA sequence
tacctcgcctgctgcgtaga

SEQ ID NO: 280116 - DNA, 20 bp, Artificial
  CRISPR gRNA sequence
cctcgcctgctgcgtagata

SEQ ID NO: 280117 - DNA, 20 bp, Artificial
  CRISPR gRNA sequence
gtagatagagccaattcatc

SEQ ID NO: 280118 - DNA, 20 bp, Artificial
  CRISPR gRNA sequence
atagagccaattcatcaaga

SEQ ID NO: 280119 - DNA, 20 bp, Artificial
  CRISPR gRNA sequence
tagagccaattcatcaagac

SEQ ID NO: 280120 - DNA, 20 bp, Artificial
  CRISPR gRNA sequence
agagccaattcatcaagaca

SEQ ID NO: 280121 - DNA, 20 bp, Artificial
  CRISPR gRNA sequence
gagccaattcatcaagacag

SEQ ID NO: 280122 - DNA, 20 bp, Artificial
  CRISPR gRNA sequence
tcaagacaggggaattgcaa

SEQ ID NO: 280123 - DNA, 20 bp, Artificial
  CRISPR gRNA sequence
aagacaggggaattgcaata

SEQ ID NO: 280124 - DNA, 20 bp, Artificial
  CRISPR gRNA sequence
gacaggggaattgcaataga

SEQ ID NO: 280125 - DNA, 20 bp, Artificial
  CRISPR gRNA sequence
caggggaattgcaatagaga

SEQ ID NO: 280126 - DNA, 20 bp, Artificial
  CRISPR gRNA sequence
gagagtaatttacgcacaac

SEQ ID NO: 280127 - DNA, 20 bp, Artificial
  CRISPR gRNA sequence
tttacgcacaactggctgtg

SEQ ID NO: 280128 - DNA, 20 bp, Artificial
  CRISPR gRNA sequence
ttacgcacaactggctgtgc

SEQ ID NO: 280129 - DNA, 20 bp, Artificial
  CRISPR gRNA sequence
acgcacaactggctgtgcgg

SEQ ID NO: 280130 - DNA, 20 bp, Artificial
  CRISPR gRNA sequence
caactggctgtgcgggagac

SEQ ID NO: 280131 - DNA, 20 bp, Artificial
  CRISPR gRNA sequence
actggctgtgcgggagaccg

SEQ ID NO: 280132 - DNA, 20 bp, Artificial
  CRISPR gRNA sequence
agttttatcattactcaaat

SEQ ID NO: 280133 - DNA, 20 bp, Artificial
  CRISPR gRNA sequence
ttactcaaatcagtctctcc

SEQ ID NO: 280134 - DNA, 20 bp, Artificial
  CRISPR gRNA sequence
aatcagtctctccaagcatc

SEQ ID NO: 280135 - DNA, 20 bp, Artificial
  CRISPR gRNA sequence
atcagtctctccaagcatct

SEQ ID NO: 280136 - DNA, 20 bp, Artificial
  CRISPR gRNA sequence
tcagtctctccaagcatctg

SEQ ID NO: 280137 - DNA, 20 bp, Artificial
  CRISPR gRNA sequence
agtctctccaagcatctggg

SEQ ID NO: 280138 - DNA, 20 bp, Artificial
  CRISPR gRNA sequence
ctctccaagcatctggggag

SEQ ID NO: 280139 - DNA, 20 bp, Artificial
  CRISPR gRNA sequence
ctccaagcatctggggagca

SEQ ID NO: 280140 - DNA, 20 bp, Artificial
  CRISPR gRNA sequence
atctggggagcagagttttt

SEQ ID NO: 280141 - DNA, 20 bp, Artificial
  CRISPR gRNA sequence
tctggggagcagagttttta

SEQ ID NO: 280142 - DNA, 20 bp, Artificial
  CRISPR gRNA sequence
gcagagtttttaaggataac

SEQ ID NO: 280143 - DNA, 20 bp, Artificial
  CRISPR gRNA sequence
cagagtttttaaggataact

SEQ ID NO: 280144 - DNA, 20 bp, Artificial
  CRISPR gRNA sequence
agtttttaaggataactagg

SEQ ID NO: 280145 - DNA, 20 bp, Artificial
  CRISPR gRNA sequence
gtttttaaggataactaggt

SEQ ID NO: 280146 - DNA, 20 bp, Artificial
  CRISPR gRNA sequence
ttaaggataactaggtgggt

SEQ ID NO: 280147 - DNA, 20 bp, Artificial
  CRISPR gRNA sequence
taaggataactaggtgggtc

SEQ ID NO: 280148 - DNA, 20 bp, Artificial
  CRISPR gRNA sequence
aaggataactaggtgggtcg

SEQ ID NO: 280149 - DNA, 20 bp, Artificial
  CRISPR gRNA sequence
aggataactaggtgggtcgg

SEQ ID NO: 280150 - DNA, 20 bp, Artificial
  CRISPR gRNA sequence
ataactaggtgggtcggggg

SEQ ID NO: 280151 - DNA, 20 bp, Artificial
  CRISPR gRNA sequence
ctaggtgggtcgggggaagc

SEQ ID NO: 280152 - DNA, 20 bp, Artificial
  CRISPR gRNA sequence
gtgggtcgggggaagccagt

SEQ ID NO: 280153 - DNA, 20 bp, Artificial
  CRISPR gRNA sequence
gtcgggggaagccagtgagc

SEQ ID NO: 280154 - DNA, 20 bp, Artificial
  CRISPR gRNA sequence
tcgggggaagccagtgagct

SEQ ID NO: 280155 - DNA, 20 bp, Artificial
  CRISPR gRNA sequence
gggggaagccagtgagctgg

SEQ ID NO: 280156 - DNA, 20 bp, Artificial
  CRISPR gRNA sequence
agtgagctgggagtgctgat

SEQ ID NO: 280157 - DNA, 20 bp, Artificial
  CRISPR gRNA sequence
agctgggagtgctgattggt

SEQ ID NO: 280158 - DNA, 20 bp, Artificial
  CRISPR gRNA sequence
gctgggagtgctgattggtc

SEQ ID NO: 280159 - DNA, 20 bp, Artificial
  CRISPR gRNA sequence
ctgggagtgctgattggtca

SEQ ID NO: 280160 - DNA, 20 bp, Artificial
  CRISPR gRNA sequence
attggtcagggatgatacca

SEQ ID NO: 280161 - DNA, 20 bp, Artificial
  CRISPR gRNA sequence
ttggtcagggatgataccat

SEQ ID NO: 280162 - DNA, 20 bp, Artificial
  CRISPR gRNA sequence
tggtcagggatgataccata

SEQ ID NO: 280163 - DNA, 20 bp, Artificial
  CRISPR gRNA sequence
gtcagggatgataccatagg

SEQ ID NO: 280164 - DNA, 20 bp, Artificial
  CRISPR gRNA sequence
gatgataccatagggagttg

SEQ ID NO: 280165 - DNA, 20 bp, Artificial
  CRISPR gRNA sequence
ttgaagctgtcttcttgcac

SEQ ID NO: 280166 - DNA, 20 bp, Artificial
  CRISPR gRNA sequence
tgaagctgtcttcttgcact

SEQ ID NO: 280167 - DNA, 20 bp, Artificial
  CRISPR gRNA sequence
gctgtcttcttgcactgggt

SEQ ID NO: 280168 - DNA, 20 bp, Artificial
  CRISPR gRNA sequence
ctgtcttcttgcactgggtt

SEQ ID NO: 280169 - DNA, 20 bp, Artificial
  CRISPR gRNA sequence
tgtcttcttgcactgggttg

SEQ ID NO: 280170 - DNA, 20 bp, Artificial
  CRISPR gRNA sequence
gtcttcttgcactgggttgg

SEQ ID NO: 280171 - DNA, 20 bp, Artificial
  CRISPR gRNA sequence
tcttcttgcactgggttggg

SEQ ID NO: 280172 - DNA, 20 bp, Artificial
  CRISPR gRNA sequence
gcactgggttggggggccac

SEQ ID NO: 280173 - DNA, 20 bp, Artificial
  CRISPR gRNA sequence
gggttggggggccacaagat

SEQ ID NO: 280174 - DNA, 20 bp, Artificial
  CRISPR gRNA sequence
ggggggccacaagatcagat

SEQ ID NO: 280175 - DNA, 20 bp, Artificial
  CRISPR gRNA sequence
ggccacaagatcagatgagt

SEQ ID NO: 280176 - DNA, 20 bp, Artificial
  CRISPR gRNA sequence
gatgagtcagtttattgatc

SEQ ID NO: 280177 - DNA, 20 bp, Artificial
  CRISPR gRNA sequence
atgagtcagtttattgatct

SEQ ID NO: 280178 - DNA, 20 bp, Artificial
  CRISPR gRNA sequence
agtcagtttattgatctggg

SEQ ID NO: 280179 - DNA, 20 bp, Artificial
  CRISPR gRNA sequence
tttattgatctgggtggtgc

SEQ ID NO: 280180 - DNA, 20 bp, Artificial
  CRISPR gRNA sequence
gtggtgccagctgatccatc

SEQ ID NO: 280181 - DNA, 20 bp, Artificial
  CRISPR gRNA sequence
gccagctgatccatcaagtg

SEQ ID NO: 280182 - DNA, 20 bp, Artificial
  CRISPR gRNA sequence
ccagctgatccatcaagtgc

SEQ ID NO: 280183 - DNA, 20 bp, Artificial
  CRISPR gRNA sequence
cagctgatccatcaagtgca

SEQ ID NO: 280184 - DNA, 20 bp, Artificial
  CRISPR gRNA sequence
agctgatccatcaagtgcag

SEQ ID NO: 280185 - DNA, 20 bp, Artificial
  CRISPR gRNA sequence
caagtgcaggggctgcaaaa

SEQ ID NO: 280186 - DNA, 20 bp, Artificial
  CRISPR gRNA sequence
caggggctgcaaaatagctc

SEQ ID NO: 280187 - DNA, 20 bp, Artificial
  CRISPR gRNA sequence
aatagctcaagcactgatct

SEQ ID NO: 280188 - DNA, 20 bp, Artificial
  CRISPR gRNA sequence
atagctcaagcactgatctt

SEQ ID NO: 280189 - DNA, 20 bp, Artificial
  CRISPR gRNA sequence
agctcaagcactgatcttag

SEQ ID NO: 280190 - DNA, 20 bp, Artificial
  CRISPR gRNA sequence
tcaagcactgatcttaggag

SEQ ID NO: 280191 - DNA, 20 bp, Artificial
  CRISPR gRNA sequence
cactgatcttaggagcagtt

SEQ ID NO: 280192 - DNA, 20 bp, Artificial
  CRISPR gRNA sequence
actgatcttaggagcagttt

SEQ ID NO: 280193 - DNA, 20 bp, Artificial
  CRISPR gRNA sequence
ctgatcttaggagcagttta

SEQ ID NO: 280194 - DNA, 20 bp, Artificial
  CRISPR gRNA sequence
gatcttaggagcagtttagg

SEQ ID NO: 280195 - DNA, 20 bp, Artificial
  CRISPR gRNA sequence
atcttaggagcagtttaggg

SEQ ID NO: 280196 - DNA, 20 bp, Artificial
  CRISPR gRNA sequence
tcttaggagcagtttaggga

SEQ ID NO: 280197 - DNA, 20 bp, Artificial
  CRISPR gRNA sequence
aggagcagtttagggagggt

SEQ ID NO: 280198 - DNA, 20 bp, Artificial
  CRISPR gRNA sequence
tagggagggtcagaatctca

SEQ ID NO: 280199 - DNA, 20 bp, Artificial
  CRISPR gRNA sequence
ggtcagaatctcatagcatc

SEQ ID NO: 280200 - DNA, 20 bp, Artificial
  CRISPR gRNA sequence
aaccataatttctaatcttg

SEQ ID NO: 280201 - DNA, 20 bp, Artificial
  CRISPR gRNA sequence
tctaatcttgtggctaatgt

SEQ ID NO: 280202 - DNA, 20 bp, Artificial
  CRISPR gRNA sequence
tggctaatgttagtcctaca

SEQ ID NO: 280203 - DNA, 20 bp, Artificial
  CRISPR gRNA sequence
ggctaatgttagtcctacaa

SEQ ID NO: 280204 - DNA, 20 bp, Artificial
  CRISPR gRNA sequence
tacaaaggcaatctactccc

SEQ ID NO: 280205 - DNA, 20 bp, Artificial
  CRISPR gRNA sequence
acaaaggcaatctactcccc

SEQ ID NO: 280206 - DNA, 20 bp, Artificial
  CRISPR gRNA sequence
aggcaatctactccccaggc

SEQ ID NO: 280207 - DNA, 20 bp, Artificial
  CRISPR gRNA sequence
caatctactccccaggcaag

SEQ ID NO: 280208 - DNA, 20 bp, Artificial
  CRISPR gRNA sequence
aatctactccccaggcaaga

SEQ ID NO: 280209 - DNA, 20 bp, Artificial
  CRISPR gRNA sequence
tctactccccaggcaagaag

SEQ ID NO: 280210 - DNA, 20 bp, Artificial
  CRISPR gRNA sequence
ctactccccaggcaagaagg

SEQ ID NO: 280211 - DNA, 20 bp, Artificial
  CRISPR gRNA sequence
ggcaagaaggaggtctgctt

SEQ ID NO: 280212 - DNA, 20 bp, Artificial
  CRISPR gRNA sequence
gcaagaaggaggtctgcttt

SEQ ID NO: 280213 - DNA, 20 bp, Artificial
  CRISPR gRNA sequence
gaaggaggtctgctttggga

SEQ ID NO: 280214 - DNA, 20 bp, Artificial
  CRISPR gRNA sequence
aaggaggtctgctttgggaa

SEQ ID NO: 280215 - DNA, 20 bp, Artificial
  CRISPR gRNA sequence
aggaggtctgctttgggaaa

SEQ ID NO: 280216 - DNA, 20 bp, Artificial
  CRISPR gRNA sequence
taaactataaactataaact

SEQ ID NO: 280217 - DNA, 20 bp, Artificial
  CRISPR gRNA sequence
tataaactaagtttctacca

SEQ ID NO: 280218 - DNA, 20 bp, Artificial
  CRISPR gRNA sequence
aactaagtttctaccaaagt

SEQ ID NO: 280219 - DNA, 20 bp, Artificial
  CRISPR gRNA sequence
agtttctaccaaagttagtt

SEQ ID NO: 280220 - DNA, 20 bp, Artificial
  CRISPR gRNA sequence
aagttagttcagcctacacc

SEQ ID NO: 280221 - DNA, 20 bp, Artificial
  CRISPR gRNA sequence
agttagttcagcctacaccc

SEQ ID NO: 280222 - DNA, 20 bp, Artificial
  CRISPR gRNA sequence
ttagttcagcctacacccag

SEQ ID NO: 280223 - DNA, 20 bp, Artificial
  CRISPR gRNA sequence
cctacacccaggagtgaaca

SEQ ID NO: 280224 - DNA, 20 bp, Artificial
  CRISPR gRNA sequence
cacccaggagtgaacaaaga

SEQ ID NO: 280225 - DNA, 20 bp, Artificial
  CRISPR gRNA sequence
aggagtgaacaaagatagct

SEQ ID NO: 280226 - DNA, 20 bp, Artificial
  CRISPR gRNA sequence
gagtgaacaaagatagcttg

SEQ ID NO: 280227 - DNA, 20 bp, Artificial
  CRISPR gRNA sequence
agtgaacaaagatagcttgg

SEQ ID NO: 280228 - DNA, 20 bp, Artificial
  CRISPR gRNA sequence
aacaaagatagcttggaggt

SEQ ID NO: 280229 - DNA, 20 bp, Artificial
  CRISPR gRNA sequence
aaagatagcttggaggttag

SEQ ID NO: 280230 - DNA, 20 bp, Artificial
  CRISPR gRNA sequence
atagcttggaggttagaagc

SEQ ID NO: 280231 - DNA, 20 bp, Artificial
  CRISPR gRNA sequence
cttggaggttagaagcaaga

SEQ ID NO: 280232 - DNA, 20 bp, Artificial
  CRISPR gRNA sequence
tggaggttagaagcaagatg

SEQ ID NO: 280233 - DNA, 20 bp, Artificial
  CRISPR gRNA sequence
ggttagaagcaagatggagt

SEQ ID NO: 280234 - DNA, 20 bp, Artificial
  CRISPR gRNA sequence
gaagcaagatggagtcagtt

SEQ ID NO: 280235 - DNA, 20 bp, Artificial
  CRISPR gRNA sequence
caagatggagtcagttaagt

SEQ ID NO: 280236 - DNA, 20 bp, Artificial
  CRISPR gRNA sequence
ttagatctctttcactgtct

SEQ ID NO: 280237 - DNA, 20 bp, Artificial
  CRISPR gRNA sequence
gtctcagtcataattttgca

SEQ ID NO: 280238 - DNA, 20 bp, Artificial
  CRISPR gRNA sequence
tctcagtcataattttgcaa

SEQ ID NO: 280239 - DNA, 20 bp, Artificial
  CRISPR gRNA sequence
ctcagtcataattttgcaaa

SEQ ID NO: 280240 - DNA, 20 bp, Artificial
  CRISPR gRNA sequence
tcagtcataattttgcaaag

SEQ ID NO: 280241 - DNA, 20 bp, Artificial
  CRISPR gRNA sequence
cagtcataattttgcaaagg

SEQ ID NO: 280242 - DNA, 20 bp, Artificial
  CRISPR gRNA sequence
agggggtttcactttaatta

SEQ ID NO: 280243 - DNA, 20 bp, Artificial
  CRISPR gRNA sequence
tcactttaattacagtataa

SEQ ID NO: 280244 - DNA, 20 bp, Artificial
  CRISPR gRNA sequence
actttaattacagtataaca

SEQ ID NO: 280245 - DNA, 20 bp, Artificial
  CRISPR gRNA sequence
ctttaattacagtataacag

SEQ ID NO: 280246 - DNA, 20 bp, Artificial
  CRISPR gRNA sequence
cagtataacagaggatactg

SEQ ID NO: 280247 - DNA, 20 bp, Artificial
  CRISPR gRNA sequence
agtataacagaggatactga

SEQ ID NO: 280248 - DNA, 20 bp, Artificial
  CRISPR gRNA sequence
tataacagaggatactgaag

SEQ ID NO: 280249 - DNA, 20 bp, Artificial
  CRISPR gRNA sequence
acagaggatactgaaggagc

SEQ ID NO: 280250 - DNA, 20 bp, Artificial
  CRISPR gRNA sequence
agaggatactgaaggagcca

SEQ ID NO: 280251 - DNA, 20 bp, Artificial
  CRISPR gRNA sequence
aaggagccagagcccttttt

SEQ ID NO: 280252 - DNA, 20 bp, Artificial
  CRISPR gRNA sequence
ttttgagaaattatatccct

SEQ ID NO: 280253 - DNA, 20 bp, Artificial
  CRISPR gRNA sequence
atccctgagccattttctca

SEQ ID NO: 280254 - DNA, 20 bp, Artificial
  CRISPR gRNA sequence
gaacatatttctttttcccc

SEQ ID NO: 280255 - DNA, 20 bp, Artificial
  CRISPR gRNA sequence
aacatatttctttttcccct

SEQ ID NO: 280256 - DNA, 20 bp, Artificial
  CRISPR gRNA sequence
ttctttttcccctgggactt

SEQ ID NO: 280257 - DNA, 20 bp, Artificial
  CRISPR gRNA sequence
tcccctgggacttgagcctc

SEQ ID NO: 280258 - DNA, 20 bp, Artificial
  CRISPR gRNA sequence
ataatgattaaccttgataa

SEQ ID NO: 280259 - DNA, 20 bp, Artificial
  CRISPR gRNA sequence
accttgataatagataactt

SEQ ID NO: 280260 - DNA, 20 bp, Artificial
  CRISPR gRNA sequence
ttgataatagataacttcag

SEQ ID NO: 280261 - DNA, 20 bp, Artificial
  CRISPR gRNA sequence
agataacttcagcagatccg

SEQ ID NO: 280262 - DNA, 20 bp, Artificial
  CRISPR gRNA sequence
ctgttctttgttttaatcat

SEQ ID NO: 280263 - DNA, 20 bp, Artificial
  CRISPR gRNA sequence
gaatctttacttgtgacatc

SEQ ID NO: 280264 - DNA, 20 bp, Artificial
  CRISPR gRNA sequence
tgacatccagatcacaccta

SEQ ID NO: 280265 - DNA, 20 bp, Artificial
  CRISPR gRNA sequence
ccagatcacacctaaagttg

SEQ ID NO: 280266 - DNA, 20 bp, Artificial
  CRISPR gRNA sequence
cagatcacacctaaagttgt

SEQ ID NO: 280267 - DNA, 20 bp, Artificial
  CRISPR gRNA sequence
agatcacacctaaagttgtg

SEQ ID NO: 280268 - DNA, 20 bp, Artificial
  CRISPR gRNA sequence
atcacacctaaagttgtggg

SEQ ID NO: 280269 - DNA, 20 bp, Artificial
  CRISPR gRNA sequence
cacctaaagttgtggggagt

SEQ ID NO: 280270 - DNA, 20 bp, Artificial
  CRISPR gRNA sequence
aagttgtggggagtaagcca

SEQ ID NO: 280271 - DNA, 20 bp, Artificial
  CRISPR gRNA sequence
gggagtaagccaaagttaca

SEQ ID NO: 280272 - DNA, 20 bp, Artificial
  CRISPR gRNA sequence
gaactatcttaaacttcact

SEQ ID NO: 280273 - DNA, 20 bp, Artificial
  CRISPR gRNA sequence
ctcagtgttttctctgctct

SEQ ID NO: 280274 - DNA, 20 bp, Artificial
  CRISPR gRNA sequence
gtgttttctctgctcttgga

SEQ ID NO: 280275 - DNA, 20 bp, Artificial
  CRISPR gRNA sequence
ggatagaataaattattata

SEQ ID NO: 280276 - DNA, 20 bp, Artificial
  CRISPR gRNA sequence
attatatggtgatgtgattt

SEQ ID NO: 280277 - DNA, 20 bp, Artificial
  CRISPR gRNA sequence
ttatatggtgatgtgatttg

SEQ ID NO: 280278 - DNA, 20 bp, Artificial
  CRISPR gRNA sequence
tatatggtgatgtgatttga

SEQ ID NO: 280279 - DNA, 20 bp, Artificial
  CRISPR gRNA sequence
atatggtgatgtgatttgag

SEQ ID NO: 280280 - DNA, 20 bp, Artificial
  CRISPR gRNA sequence
gatgtgatttgaggggtact

SEQ ID NO: 280281 - DNA, 20 bp, Artificial
  CRISPR gRNA sequence
gtgatttgaggggtactaag

SEQ ID NO: 280282 - DNA, 20 bp, Artificial
  CRISPR gRNA sequence
tcctgaaattctcatcatca

SEQ ID NO: 280283 - DNA, 20 bp, Artificial
  CRISPR gRNA sequence
atcatcatagccattcctgc

SEQ ID NO: 280284 - DNA, 20 bp, Artificial
  CRISPR gRNA sequence
tttctccattttcctcctaa

SEQ ID NO: 280285 - DNA, 20 bp, Artificial
  CRISPR gRNA sequence
taaaatgaaaatgtgtttcc

SEQ ID NO: 280286 - DNA, 20 bp, Artificial
  CRISPR gRNA sequence
aaaatgaaaatgtgtttcct

SEQ ID NO: 280287 - DNA, 20 bp, Artificial
  CRISPR gRNA sequence
aaatgaaaatgtgtttcctg

SEQ ID NO: 280288 - DNA, 20 bp, Artificial
  CRISPR gRNA sequence
tgaaaatgtgtttcctgggg

SEQ ID NO: 280289 - DNA, 20 bp, Artificial
  CRISPR gRNA sequence
gaaaatgtgtttcctggggt

SEQ ID NO: 280290 - DNA, 20 bp, Artificial
  CRISPR gRNA sequence
aaaatgtgtttcctggggtg

SEQ ID NO: 280291 - DNA, 20 bp, Artificial
  CRISPR gRNA sequence
aaatgtgtttcctggggtgg

SEQ ID NO: 280292 - DNA, 20 bp, Artificial
  CRISPR gRNA sequence
aatgtgtttcctggggtggg

SEQ ID NO: 280293 - DNA, 20 bp, Artificial
  CRISPR gRNA sequence
gtgtttcctggggtgggggg

SEQ ID NO: 280294 - DNA, 20 bp, Artificial
  CRISPR gRNA sequence
tgtttcctggggtggggggt

SEQ ID NO: 280295 - DNA, 20 bp, Artificial
  CRISPR gRNA sequence
gtttcctggggtggggggtg

SEQ ID NO: 280296 - DNA, 20 bp, Artificial
  CRISPR gRNA sequence
tttcctggggtggggggtgg

SEQ ID NO: 280297 - DNA, 20 bp, Artificial
  CRISPR gRNA sequence
ttcctggggtggggggtggg

SEQ ID NO: 280298 - DNA, 20 bp, Artificial
  CRISPR gRNA sequence
ctggggtggggggtgggggg

SEQ ID NO: 280299 - DNA, 20 bp, Artificial
  CRISPR gRNA sequence
gggtggcaccacaaatatat

SEQ ID NO: 280300 - DNA, 20 bp, Artificial
  CRISPR gRNA sequence
acaaatatattagcctgtat

SEQ ID NO: 280301 - DNA, 20 bp, Artificial
  CRISPR gRNA sequence
cctgtattagttaattacat

SEQ ID NO: 280302 - DNA, 20 bp, Artificial
  CRISPR gRNA sequence
ctgtattagttaattacatt

SEQ ID NO: 280303 - DNA, 20 bp, Artificial
  CRISPR gRNA sequence
agttaattacattaggtacg

SEQ ID NO: 280304 - DNA, 20 bp, Artificial
  CRISPR gRNA sequence
ttaggtacgtagtcctctaa

SEQ ID NO: 280305 - DNA, 20 bp, Artificial
  CRISPR gRNA sequence
tagtcctctaatggactacc

SEQ ID NO: 280306 - DNA, 20 bp, Artificial
  CRISPR gRNA sequence
gtcctctaatggactaccga

SEQ ID NO: 280307 - DNA, 20 bp, Artificial
  CRISPR gRNA sequence
cctctaatggactaccgaga

SEQ ID NO: 280308 - DNA, 20 bp, Artificial
  CRISPR gRNA sequence
ctaatggactaccgagagag

SEQ ID NO: 280309 - DNA, 20 bp, Artificial
  CRISPR gRNA sequence
atggactaccgagagagaag

SEQ ID NO: 280310 - DNA, 20 bp, Artificial
  CRISPR gRNA sequence
taccgagagagaagtagact

SEQ ID NO: 280311 - DNA, 20 bp, Artificial
  CRISPR gRNA sequence
accgagagagaagtagactc

SEQ ID NO: 280312 - DNA, 20 bp, Artificial
  CRISPR gRNA sequence
agagagaagtagactcaggt

SEQ ID NO: 280313 - DNA, 20 bp, Artificial
  CRISPR gRNA sequence
gagagaagtagactcaggtc

SEQ ID NO: 280314 - DNA, 20 bp, Artificial
  CRISPR gRNA sequence
agactcaggtcaggtgaatt

SEQ ID NO: 280315 - DNA, 20 bp, Artificial
  CRISPR gRNA sequence
tcaggtcaggtgaatttgga

SEQ ID NO: 280316 - DNA, 20 bp, Artificial
  CRISPR gRNA sequence
gtcaggtgaatttggataga

SEQ ID NO: 280317 - DNA, 20 bp, Artificial
  CRISPR gRNA sequence
tgaatttggatagaaagata

SEQ ID NO: 280318 - DNA, 20 bp, Artificial
  CRISPR gRNA sequence
atttggatagaaagataaag

SEQ ID NO: 280319 - DNA, 20 bp, Artificial
  CRISPR gRNA sequence
aaagataaagaagaaaatcc

SEQ ID NO: 280320 - DNA, 20 bp, Artificial
  CRISPR gRNA sequence
agataaagaagaaaatccaa

SEQ ID NO: 280321 - DNA, 20 bp, Artificial
  CRISPR gRNA sequence
aaagaagaaaatccaagagt

SEQ ID NO: 280322 - DNA, 20 bp, Artificial
  CRISPR gRNA sequence
agaaaatccaagagtgagaa

SEQ ID NO: 280323 - DNA, 20 bp, Artificial
  CRISPR gRNA sequence
gaaaatccaagagtgagaaa

SEQ ID NO: 280324 - DNA, 20 bp, Artificial
  CRISPR gRNA sequence
gtgagaaaaggaaacatttc

SEQ ID NO: 280325 - DNA, 20 bp, Artificial
  CRISPR gRNA sequence
tgagaaaaggaaacatttca

SEQ ID NO: 280326 - DNA, 20 bp, Artificial
  CRISPR gRNA sequence
gagaaaaggaaacatttcaa

SEQ ID NO: 280327 - DNA, 20 bp, Artificial
  CRISPR gRNA sequence
agaaaaggaaacatttcaag

SEQ ID NO: 280328 - DNA, 20 bp, Artificial
  CRISPR gRNA sequence
gaaaaggaaacatttcaagg

SEQ ID NO: 280329 - DNA, 20 bp, Artificial
  CRISPR gRNA sequence
aaaaggaaacatttcaaggg

SEQ ID NO: 280330 - DNA, 20 bp, Artificial
  CRISPR gRNA sequence
aggaaacatttcaagggggg

SEQ ID NO: 280331 - DNA, 20 bp, Artificial
  CRISPR gRNA sequence
ggaaacatttcaaggggggc

SEQ ID NO: 280332 - DNA, 20 bp, Artificial
  CRISPR gRNA sequence
tcaaggggggcaggccctat

SEQ ID NO: 280333 - DNA, 20 bp, Artificial
  CRISPR gRNA sequence
aggggggcaggccctattag

SEQ ID NO: 280334 - DNA, 20 bp, Artificial
  CRISPR gRNA sequence
ccctattagcagattaccgt

SEQ ID NO: 280335 - DNA, 20 bp, Artificial
  CRISPR gRNA sequence
ctattagcagattaccgtaa

SEQ ID NO: 280336 - DNA, 20 bp, Artificial
  CRISPR gRNA sequence
gcagattaccgtaagagacc

SEQ ID NO: 280337 - DNA, 20 bp, Artificial
  CRISPR gRNA sequence
cagattaccgtaagagacca

SEQ ID NO: 280338 - DNA, 20 bp, Artificial
  CRISPR gRNA sequence
ttaccgtaagagaccaagga

SEQ ID NO: 280339 - DNA, 20 bp, Artificial
  CRISPR gRNA sequence
gtaagagaccaaggacagct

SEQ ID NO: 280340 - DNA, 20 bp, Artificial
  CRISPR gRNA sequence
taagagaccaaggacagcta

SEQ ID NO: 280341 - DNA, 20 bp, Artificial
  CRISPR gRNA sequence
aagagaccaaggacagctaa

SEQ ID NO: 280342 - DNA, 20 bp, Artificial
  CRISPR gRNA sequence
agagaccaaggacagctaag

SEQ ID NO: 280343 - DNA, 20 bp, Artificial
  CRISPR gRNA sequence
gacagctaaggggacaatgt

SEQ ID NO: 280344 - DNA, 20 bp, Artificial
  CRISPR gRNA sequence
aggggacaatgtgagatttc

SEQ ID NO: 280345 - DNA, 20 bp, Artificial
  CRISPR gRNA sequence
ggggacaatgtgagatttct

SEQ ID NO: 280346 - DNA, 20 bp, Artificial
  CRISPR gRNA sequence
gggacaatgtgagatttctg

SEQ ID NO: 280347 - DNA, 20 bp, Artificial
  CRISPR gRNA sequence
tgtgagatttctggggtact

SEQ ID NO: 280348 - DNA, 20 bp, Artificial
  CRISPR gRNA sequence
tttctggggtactcagaacc

SEQ ID NO: 280349 - DNA, 20 bp, Artificial
  CRISPR gRNA sequence
ttctggggtactcagaaccg

SEQ ID NO: 280350 - DNA, 20 bp, Artificial
  CRISPR gRNA sequence
tctggggtactcagaaccga

SEQ ID NO: 280351 - DNA, 20 bp, Artificial
  CRISPR gRNA sequence
tactcagaaccgagggtgtg

SEQ ID NO: 280352 - DNA, 20 bp, Artificial
  CRISPR gRNA sequence
actcagaaccgagggtgtgt

SEQ ID NO: 280353 - DNA, 20 bp, Artificial
  CRISPR gRNA sequence
cagaaccgagggtgtgtggg

SEQ ID NO: 280354 - DNA, 20 bp, Artificial
  CRISPR gRNA sequence
gtgtgtgggtggacaaaatc

SEQ ID NO: 280355 - DNA, 20 bp, Artificial
  CRISPR gRNA sequence
tgggtggacaaaatccagta

SEQ ID NO: 280356 - DNA, 20 bp, Artificial
  CRISPR gRNA sequence
gggtggacaaaatccagtaa

SEQ ID NO: 280357 - DNA, 20 bp, Artificial
  CRISPR gRNA sequence
ggtggacaaaatccagtaaa

SEQ ID NO: 280358 - DNA, 20 bp, Artificial
  CRISPR gRNA sequence
ggacaaaatccagtaaaggg

SEQ ID NO: 280359 - DNA, 20 bp, Artificial
  CRISPR gRNA sequence
tccagtaaagggaagacaaa

SEQ ID NO: 280360 - DNA, 20 bp, Artificial
  CRISPR gRNA sequence
ccagtaaagggaagacaaaa

SEQ ID NO: 280361 - DNA, 20 bp, Artificial
  CRISPR gRNA sequence
gtcactcgcttaattttgct

SEQ ID NO: 280362 - DNA, 20 bp, Artificial
  CRISPR gRNA sequence
actcgcttaattttgctgag

SEQ ID NO: 280363 - DNA, 20 bp, Artificial
  CRISPR gRNA sequence
gcattctgaattttccaatt

SEQ ID NO: 280364 - DNA, 20 bp, Artificial
  CRISPR gRNA sequence
tgaattttccaattgagtca

SEQ ID NO: 280365 - DNA, 20 bp, Artificial
  CRISPR gRNA sequence
attttccaattgagtcaaag

SEQ ID NO: 280366 - DNA, 20 bp, Artificial
  CRISPR gRNA sequence
agtgtttctcaaatgcttat

SEQ ID NO: 280367 - DNA, 20 bp, Artificial
  CRISPR gRNA sequence
tcaaatgcttataagcctat

SEQ ID NO: 280368 - DNA, 20 bp, Artificial
  CRISPR gRNA sequence
tataagcctatgagtcattt

SEQ ID NO: 280369 - DNA, 20 bp, Artificial
  CRISPR gRNA sequence
ataagcctatgagtcatttg

SEQ ID NO: 280370 - DNA, 20 bp, Artificial
  CRISPR gRNA sequence
taagcctatgagtcatttga

SEQ ID NO: 280371 - DNA, 20 bp, Artificial
  CRISPR gRNA sequence
tgagggtcttgttaaaaatg

SEQ ID NO: 280372 - DNA, 20 bp, Artificial
  CRISPR gRNA sequence
cttgttaaaaatgcagattt

SEQ ID NO: 280373 - DNA, 20 bp, Artificial
  CRISPR gRNA sequence
taaaaatgcagatttaagtt

SEQ ID NO: 280374 - DNA, 20 bp, Artificial
  CRISPR gRNA sequence
aaatgcagatttaagttcag

SEQ ID NO: 280375 - DNA, 20 bp, Artificial
  CRISPR gRNA sequence
aatgcagatttaagttcagt

SEQ ID NO: 280376 - DNA, 20 bp, Artificial
  CRISPR gRNA sequence
agatttaagttcagtaggtc

SEQ ID NO: 280377 - DNA, 20 bp, Artificial
  CRISPR gRNA sequence
gatttaagttcagtaggtct

SEQ ID NO: 280378 - DNA, 20 bp, Artificial
  CRISPR gRNA sequence
atttaagttcagtaggtctg

SEQ ID NO: 280379 - DNA, 20 bp, Artificial
  CRISPR gRNA sequence
agttcagtaggtctggggtt

SEQ ID NO: 280380 - DNA, 20 bp, Artificial
  CRISPR gRNA sequence
taggtctggggtttggatct

SEQ ID NO: 280381 - DNA, 20 bp, Artificial
  CRISPR gRNA sequence
tgagattctgcacctctaac

SEQ ID NO: 280382 - DNA, 20 bp, Artificial
  CRISPR gRNA sequence
ctgcacctctaacaagctct

SEQ ID NO: 280383 - DNA, 20 bp, Artificial
  CRISPR gRNA sequence
tgcacctctaacaagctctc

SEQ ID NO: 280384 - DNA, 20 bp, Artificial
  CRISPR gRNA sequence
aggtgatgcctgtgctgctg

SEQ ID NO: 280385 - DNA, 20 bp, Artificial
  CRISPR gRNA sequence
gtgatgcctgtgctgctgtg

SEQ ID NO: 280386 - DNA, 20 bp, Artificial
  CRISPR gRNA sequence
tgatgcctgtgctgctgtgg

SEQ ID NO: 280387 - DNA, 20 bp, Artificial
  CRISPR gRNA sequence
gctgtggaggaccacaattt

SEQ ID NO: 280388 - DNA, 20 bp, Artificial
  CRISPR gRNA sequence
gtggaggaccacaatttgag

SEQ ID NO: 280389 - DNA, 20 bp, Artificial
  CRISPR gRNA sequence
aggaccacaatttgagaagc

SEQ ID NO: 280390 - DNA, 20 bp, Artificial
  CRISPR gRNA sequence
ggaccacaatttgagaagca

SEQ ID NO: 280391 - DNA, 20 bp, Artificial
  CRISPR gRNA sequence
aatttgagaagcaaggaatt

SEQ ID NO: 280392 - DNA, 20 bp, Artificial
  CRISPR gRNA sequence
caaggaattaagctctcatt

SEQ ID NO: 280393 - DNA, 20 bp, Artificial
  CRISPR gRNA sequence
gaattaagctctcatttggc

SEQ ID NO: 280394 - DNA, 20 bp, Artificial
  CRISPR gRNA sequence
attaagctctcatttggcta

SEQ ID NO: 280395 - DNA, 20 bp, Artificial
  CRISPR gRNA sequence
tctcatttggctagagtgac

SEQ ID NO: 280396 - DNA, 20 bp, Artificial
  CRISPR gRNA sequence
ctcatttggctagagtgacc

SEQ ID NO: 280397 - DNA, 20 bp, Artificial
  CRISPR gRNA sequence
gaccaggtatcctctttgct

SEQ ID NO: 280398 - DNA, 20 bp, Artificial
  CRISPR gRNA sequence
atcctctttgctcagaacca

SEQ ID NO: 280399 - DNA, 20 bp, Artificial
  CRISPR gRNA sequence
tcctctttgctcagaaccaa

SEQ ID NO: 280400 - DNA, 20 bp, Artificial
  CRISPR gRNA sequence
cctctttgctcagaaccaaa

SEQ ID NO: 280401 - DNA, 20 bp, Artificial
  CRISPR gRNA sequence
tcagaaccaaagggtttatt

SEQ ID NO: 280402 - DNA, 20 bp, Artificial
  CRISPR gRNA sequence
cagaaccaaagggtttattt

SEQ ID NO: 280403 - DNA, 20 bp, Artificial
  CRISPR gRNA sequence
agaaccaaagggtttatttg

SEQ ID NO: 280404 - DNA, 20 bp, Artificial
  CRISPR gRNA sequence
aaagggtttatttggggcac

SEQ ID NO: 280405 - DNA, 20 bp, Artificial
  CRISPR gRNA sequence
tatttggggcacaagatttt

SEQ ID NO: 280406 - DNA, 20 bp, Artificial
  CRISPR gRNA sequence
aagatttttggtgctaaaac

SEQ ID NO: 280407 - DNA, 20 bp, Artificial
  CRISPR gRNA sequence
agatttttggtgctaaaact

SEQ ID NO: 280408 - DNA, 20 bp, Artificial
  CRISPR gRNA sequence
ttttggtgctaaaactggga

SEQ ID NO: 280409 - DNA, 20 bp, Artificial
  CRISPR gRNA sequence
tgctaaaactgggaaagtct

SEQ ID NO: 280410 - DNA, 20 bp, Artificial
  CRISPR gRNA sequence
gctaaaactgggaaagtctc

SEQ ID NO: 280411 - DNA, 20 bp, Artificial
  CRISPR gRNA sequence
ctgggaaagtctcaggcaaa

SEQ ID NO: 280412 - DNA, 20 bp, Artificial
  CRISPR gRNA sequence
tgggaaagtctcaggcaaat

SEQ ID NO: 280413 - DNA, 20 bp, Artificial
  CRISPR gRNA sequence
ctcaggcaaataggacacgt

SEQ ID NO: 280414 - DNA, 20 bp, Artificial
  CRISPR gRNA sequence
tggttaccctatatttgtct

SEQ ID NO: 280415 - DNA, 20 bp, Artificial
  CRISPR gRNA sequence
atttgtctaagattgcaaaa

SEQ ID NO: 280416 - DNA, 20 bp, Artificial
  CRISPR gRNA sequence
gcaaaatggtaatataatat

SEQ ID NO: 280417 - DNA, 20 bp, Artificial
  CRISPR gRNA sequence
atggtaatataatatcagca

SEQ ID NO: 280418 - DNA, 20 bp, Artificial
  CRISPR gRNA sequence
atatgaaaacctccattaac

SEQ ID NO: 280419 - DNA, 20 bp, Artificial
  CRISPR gRNA sequence
ctccattaactggcatgttt

SEQ ID NO: 280420 - DNA, 20 bp, Artificial
  CRISPR gRNA sequence
taactggcatgtttgagaac

SEQ ID NO: 280421 - DNA, 20 bp, Artificial
  CRISPR gRNA sequence
gaactagctacattcgttaa

SEQ ID NO: 280422 - DNA, 20 bp, Artificial
  CRISPR gRNA sequence
acattcgttaacagcttaac

SEQ ID NO: 280423 - DNA, 20 bp, Artificial
  CRISPR gRNA sequence
cattcgttaacagcttaact

SEQ ID NO: 280424 - DNA, 20 bp, Artificial
  CRISPR gRNA sequence
taacagcttaactaggttaa

SEQ ID NO: 280425 - DNA, 20 bp, Artificial
  CRISPR gRNA sequence
gcacctattcctttccttgt

SEQ ID NO: 280426 - DNA, 20 bp, Artificial
  CRISPR gRNA sequence
cattcctaccctttcctatt

SEQ ID NO: 280427 - DNA, 20 bp, Artificial
  CRISPR gRNA sequence
ttcctaccctttcctattaa

SEQ ID NO: 280428 - DNA, 20 bp, Artificial
  CRISPR gRNA sequence
ctaccctttcctattaagag

SEQ ID NO: 280429 - DNA, 20 bp, Artificial
  CRISPR gRNA sequence
ctattaagagtggtaaaaat

SEQ ID NO: 280430 - DNA, 20 bp, Artificial
  CRISPR gRNA sequence
tattaagagtggtaaaaatt

SEQ ID NO: 280431 - DNA, 20 bp, Artificial
  CRISPR gRNA sequence
ttgggttaactaattaaaat

SEQ ID NO: 280432 - DNA, 20 bp, Artificial
  CRISPR gRNA sequence
actaattaaaatgagataca

SEQ ID NO: 280433 - DNA, 20 bp, Artificial
  CRISPR gRNA sequence
ctaattaaaatgagatacaa

SEQ ID NO: 280434 - DNA, 20 bp, Artificial
  CRISPR gRNA sequence
aaaatgagatacaaaggtta

SEQ ID NO: 280435 - DNA, 20 bp, Artificial
  CRISPR gRNA sequence
ttgattgttcacaatctcac

SEQ ID NO: 280436 - DNA, 20 bp, Artificial
  CRISPR gRNA sequence
ttcacaatctcacaagacct

SEQ ID NO: 280437 - DNA, 20 bp, Artificial
  CRISPR gRNA sequence
tcacaatctcacaagacctc

SEQ ID NO: 280438 - DNA, 20 bp, Artificial
  CRISPR gRNA sequence
acaatctcacaagacctcag

SEQ ID NO: 280439 - DNA, 20 bp, Artificial
  CRISPR gRNA sequence
atctcacaagacctcaggag

SEQ ID NO: 280440 - DNA, 20 bp, Artificial
  CRISPR gRNA sequence
tcaggagtagttaccctaaa

SEQ ID NO: 280441 - DNA, 20 bp, Artificial
  CRISPR gRNA sequence
ttaccctaaacagatcacct

SEQ ID NO: 280442 - DNA, 20 bp, Artificial
  CRISPR gRNA sequence
aaacagatcaccttagaaaa

SEQ ID NO: 280443 - DNA, 20 bp, Artificial
  CRISPR gRNA sequence
aacagatcaccttagaaaaa

SEQ ID NO: 280444 - DNA, 20 bp, Artificial
  CRISPR gRNA sequence
agatcaccttagaaaaaagg

SEQ ID NO: 280445 - DNA, 20 bp, Artificial
  CRISPR gRNA sequence
gatcaccttagaaaaaaggt

SEQ ID NO: 280446 - DNA, 20 bp, Artificial
  CRISPR gRNA sequence
tcaccttagaaaaaaggtgg

SEQ ID NO: 280447 - DNA, 20 bp, Artificial
  CRISPR gRNA sequence
cttagaaaaaaggtgggaga

SEQ ID NO: 280448 - DNA, 20 bp, Artificial
  CRISPR gRNA sequence
tagaaaaaaggtgggagatg

SEQ ID NO: 280449 - DNA, 20 bp, Artificial
  CRISPR gRNA sequence
aaaaggtgggagatggagtt

SEQ ID NO: 280450 - DNA, 20 bp, Artificial
  CRISPR gRNA sequence
aaaggtgggagatggagttt

SEQ ID NO: 280451 - DNA, 20 bp, Artificial
  CRISPR gRNA sequence
gatggagtttaggctgttct

SEQ ID NO: 280452 - DNA, 20 bp, Artificial
  CRISPR gRNA sequence
agtttaggctgttctaagcc

SEQ ID NO: 280453 - DNA, 20 bp, Artificial
  CRISPR gRNA sequence
taggctgttctaagccaaga

SEQ ID NO: 280454 - DNA, 20 bp, Artificial
  CRISPR gRNA sequence
ttgaaacttttttttttttt

SEQ ID NO: 280455 - DNA, 20 bp, Artificial
  CRISPR gRNA sequence
aactttttttttttttgaga

SEQ ID NO: 280456 - DNA, 20 bp, Artificial
  CRISPR gRNA sequence
ctttttttttttttgagatg

SEQ ID NO: 280457 - DNA, 20 bp, Artificial
  CRISPR gRNA sequence
gagtctcttactctgtcacc

SEQ ID NO: 280458 - DNA, 20 bp, Artificial
  CRISPR gRNA sequence
agtctcttactctgtcaccc

SEQ ID NO: 280459 - DNA, 20 bp, Artificial
  CRISPR gRNA sequence
tcttactctgtcacccaggc

SEQ ID NO: 280460 - DNA, 20 bp, Artificial
  CRISPR gRNA sequence
ttactctgtcacccaggcta

SEQ ID NO: 280461 - DNA, 20 bp, Artificial
  CRISPR gRNA sequence
ctgtcacccaggctagagtg

SEQ ID NO: 280462 - DNA, 20 bp, Artificial
  CRISPR gRNA sequence
tcacccaggctagagtgcag

SEQ ID NO: 280463 - DNA, 20 bp, Artificial
  CRISPR gRNA sequence
agagtgcagtggcgtgatct

SEQ ID NO: 280464 - DNA, 20 bp, Artificial
  CRISPR gRNA sequence
gagtgcagtggcgtgatctc

SEQ ID NO: 280465 - DNA, 20 bp, Artificial
  CRISPR gRNA sequence
ggcgtgatctcgggtctctg

SEQ ID NO: 280466 - DNA, 20 bp, Artificial
  CRISPR gRNA sequence
tctctgcagcctctgcctcc

SEQ ID NO: 280467 - DNA, 20 bp, Artificial
  CRISPR gRNA sequence
ctctgcagcctctgcctcct

SEQ ID NO: 280468 - DNA, 20 bp, Artificial
  CRISPR gRNA sequence
agcctctgcctcctgggttc

SEQ ID NO: 280469 - DNA, 20 bp, Artificial
  CRISPR gRNA sequence
ttcaagcgattctcctgtct

SEQ ID NO: 280470 - DNA, 20 bp, Artificial
  CRISPR gRNA sequence
tcctgtctcagcctccaaac

SEQ ID NO: 280471 - DNA, 20 bp, Artificial
  CRISPR gRNA sequence
gtctcagcctccaaactagc

SEQ ID NO: 280472 - DNA, 20 bp, Artificial
  CRISPR gRNA sequence
tctcagcctccaaactagct

SEQ ID NO: 280473 - DNA, 20 bp, Artificial
  CRISPR gRNA sequence
ctccaaactagctgggacta

SEQ ID NO: 280474 - DNA, 20 bp, Artificial
  CRISPR gRNA sequence
tccaaactagctgggactac

SEQ ID NO: 280475 - DNA, 20 bp, Artificial
  CRISPR gRNA sequence
caggcatgtgccatcatgcc

SEQ ID NO: 280476 - DNA, 20 bp, Artificial
  CRISPR gRNA sequence
cctggctaattttttatttt

SEQ ID NO: 280477 - DNA, 20 bp, Artificial
  CRISPR gRNA sequence
ggctaattttttatttttag

SEQ ID NO: 280478 - DNA, 20 bp, Artificial
  CRISPR gRNA sequence
ctaattttttatttttagta

SEQ ID NO: 280479 - DNA, 20 bp, Artificial
  CRISPR gRNA sequence
tttttatttttagtagagac

SEQ ID NO: 280480 - DNA, 20 bp, Artificial
  CRISPR gRNA sequence
ttttatttttagtagagaca

SEQ ID NO: 280481 - DNA, 20 bp, Artificial
  CRISPR gRNA sequence
caaggtttcactatgttgtc

SEQ ID NO: 280482 - DNA, 20 bp, Artificial
  CRISPR gRNA sequence
aaggtttcactatgttgtcc

SEQ ID NO: 280483 - DNA, 20 bp, Artificial
  CRISPR gRNA sequence
aggtttcactatgttgtcca

SEQ ID NO: 280484 - DNA, 20 bp, Artificial
  CRISPR gRNA sequence
tttcactatgttgtccaggg

SEQ ID NO: 280485 - DNA, 20 bp, Artificial
  CRISPR gRNA sequence
ggtctcaaactcctgacctc

SEQ ID NO: 280486 - DNA, 20 bp, Artificial
  CRISPR gRNA sequence
cctcctgccttgacctccca

SEQ ID NO: 280487 - DNA, 20 bp, Artificial
  CRISPR gRNA sequence
gccttgacctcccaaagtgc

SEQ ID NO: 280488 - DNA, 20 bp, Artificial
  CRISPR gRNA sequence
ccttgacctcccaaagtgct

SEQ ID NO: 280489 - DNA, 20 bp, Artificial
  CRISPR gRNA sequence
ctcccaaagtgctaggatta

SEQ ID NO: 280490 - DNA, 20 bp, Artificial
  CRISPR gRNA sequence
tcccaaagtgctaggattac

SEQ ID NO: 280491 - DNA, 20 bp, Artificial
  CRISPR gRNA sequence
agtgctaggattacaggcat

SEQ ID NO: 280492 - DNA, 20 bp, Artificial
  CRISPR gRNA sequence
ctaggattacaggcatgagc

SEQ ID NO: 280493 - DNA, 20 bp, Artificial
  CRISPR gRNA sequence
caggcatgagccagcacacc

SEQ ID NO: 280494 - DNA, 20 bp, Artificial
  CRISPR gRNA sequence
ccagcacacctggccttgaa

SEQ ID NO: 280495 - DNA, 20 bp, Artificial
  CRISPR gRNA sequence
ccttgaaaagatttttaata

SEQ ID NO: 280496 - DNA, 20 bp, Artificial
  CRISPR gRNA sequence
aagatttttaatacagttcc

SEQ ID NO: 280497 - DNA, 20 bp, Artificial
  CRISPR gRNA sequence
tttaatacagttcctggtat

SEQ ID NO: 280498 - DNA, 20 bp, Artificial
  CRISPR gRNA sequence
aatacagttcctggtatgag

SEQ ID NO: 280499 - DNA, 20 bp, Artificial
  CRISPR gRNA sequence
tggtatgagtggcattcctg

SEQ ID NO: 280500 - DNA, 20 bp, Artificial
  CRISPR gRNA sequence
cattcctgtagtttatttcc

SEQ ID NO: 280501 - DNA, 20 bp, Artificial
  CRISPR gRNA sequence
ctgtagtttatttcccagaa

SEQ ID NO: 280502 - DNA, 20 bp, Artificial
  CRISPR gRNA sequence
tagtttatttcccagaaaag

SEQ ID NO: 280503 - DNA, 20 bp, Artificial
  CRISPR gRNA sequence
gtttatttcccagaaaagca

SEQ ID NO: 280504 - DNA, 20 bp, Artificial
  CRISPR gRNA sequence
tttcccagaaaagcagagca

SEQ ID NO: 280505 - DNA, 20 bp, Artificial
  CRISPR gRNA sequence
catgaatcatattaataatt

SEQ ID NO: 280506 - DNA, 20 bp, Artificial
  CRISPR gRNA sequence
atgaatcatattaataattt

SEQ ID NO: 280507 - DNA, 20 bp, Artificial
  CRISPR gRNA sequence
atattaataatttaggatat

SEQ ID NO: 280508 - DNA, 20 bp, Artificial
  CRISPR gRNA sequence
taatttaggatatgagtttt

SEQ ID NO: 280509 - DNA, 20 bp, Artificial
  CRISPR gRNA sequence
gtttttggatttattattcc

SEQ ID NO: 280510 - DNA, 20 bp, Artificial
  CRISPR gRNA sequence
acaaaacatattgatgttat

SEQ ID NO: 280511 - DNA, 20 bp, Artificial
  CRISPR gRNA sequence
tattgatgttataagaaaca

SEQ ID NO: 280512 - DNA, 20 bp, Artificial
  CRISPR gRNA sequence
ataagaaacacagaatattc

SEQ ID NO: 280513 - DNA, 20 bp, Artificial
  CRISPR gRNA sequence
acacagaatattctagatat

SEQ ID NO: 280514 - DNA, 20 bp, Artificial
  CRISPR gRNA sequence
atatcagctgcctgtgtcat

SEQ ID NO: 280515 - DNA, 20 bp, Artificial
  CRISPR gRNA sequence
tgtgtcatgagtcgatctta

SEQ ID NO: 280516 - DNA, 20 bp, Artificial
  CRISPR gRNA sequence
gtgtcatgagtcgatcttat

SEQ ID NO: 280517 - DNA, 20 bp, Artificial
  CRISPR gRNA sequence
atcttataggataaattaat

SEQ ID NO: 280518 - DNA, 20 bp, Artificial
  CRISPR gRNA sequence
ttataggataaattaataag

SEQ ID NO: 280519 - DNA, 20 bp, Artificial
  CRISPR gRNA sequence
tataggataaattaataagt

SEQ ID NO: 280520 - DNA, 20 bp, Artificial
  CRISPR gRNA sequence
gaaataacaatgccaactaa

SEQ ID NO: 280521 - DNA, 20 bp, Artificial
  CRISPR gRNA sequence
ataacaatgccaactaaaag

SEQ ID NO: 280522 - DNA, 20 bp, Artificial
  CRISPR gRNA sequence
aatgccaactaaaagtggct

SEQ ID NO: 280523 - DNA, 20 bp, Artificial
  CRISPR gRNA sequence
atgccaactaaaagtggctc

SEQ ID NO: 280524 - DNA, 20 bp, Artificial
  CRISPR gRNA sequence
ggaacatatcaaacttcatt

SEQ ID NO: 280525 - DNA, 20 bp, Artificial
  CRISPR gRNA sequence
gaacatatcaaacttcattt

SEQ ID NO: 280526 - DNA, 20 bp, Artificial
  CRISPR gRNA sequence
aacatatcaaacttcattta

SEQ ID NO: 280527 - DNA, 20 bp, Artificial
  CRISPR gRNA sequence
tatcaaacttcatttaggga

SEQ ID NO: 280528 - DNA, 20 bp, Artificial
  CRISPR gRNA sequence
atcaaacttcatttagggac

SEQ ID NO: 280529 - DNA, 20 bp, Artificial
  CRISPR gRNA sequence
tcaaacttcatttagggaca

SEQ ID NO: 280530 - DNA, 20 bp, Artificial
  CRISPR gRNA sequence
attgaaacaaacaaaaaaaa

SEQ ID NO: 280531 - DNA, 20 bp, Artificial
  CRISPR gRNA sequence
ttgaaacaaacaaaaaaaaa

SEQ ID NO: 280532 - DNA, 20 bp, Artificial
  CRISPR gRNA sequence
atccaacttttcctctttcc

SEQ ID NO: 280533 - DNA, 20 bp, Artificial
  CRISPR gRNA sequence
gcaattatcatcatttgtca

SEQ ID NO: 280534 - DNA, 20 bp, Artificial
  CRISPR gRNA sequence
tccctttatcctcattattg

SEQ ID NO: 280535 - DNA, 20 bp, Artificial
  CRISPR gRNA sequence
ccctttatcctcattattgt

SEQ ID NO: 280536 - DNA, 20 bp, Artificial
  CRISPR gRNA sequence
ctcattattgtaggtgccac

SEQ ID NO: 280537 - DNA, 20 bp, Artificial
  CRISPR gRNA sequence
tcattattgtaggtgccaca

SEQ ID NO: 280538 - DNA, 20 bp, Artificial
  CRISPR gRNA sequence
taggtgccacaaggcattcc

SEQ ID NO: 280539 - DNA, 20 bp, Artificial
  CRISPR gRNA sequence
gtgccacaaggcattcctgg

SEQ ID NO: 280540 - DNA, 20 bp, Artificial
  CRISPR gRNA sequence
cattcctggaagtgtttgcc

SEQ ID NO: 280541 - DNA, 20 bp, Artificial
  CRISPR gRNA sequence
cctggcaacctgatttaaat

SEQ ID NO: 280542 - DNA, 20 bp, Artificial
  CRISPR gRNA sequence
ctggcaacctgatttaaatg

SEQ ID NO: 280543 - DNA, 20 bp, Artificial
  CRISPR gRNA sequence
tggcaacctgatttaaatga

SEQ ID NO: 280544 - DNA, 20 bp, Artificial
  CRISPR gRNA sequence
ggcaacctgatttaaatgag

SEQ ID NO: 280545 - DNA, 20 bp, Artificial
  CRISPR gRNA sequence
gcaacctgatttaaatgagg

SEQ ID NO: 280546 - DNA, 20 bp, Artificial
  CRISPR gRNA sequence
ttaaatgagggggcttacct

SEQ ID NO: 280547 - DNA, 20 bp, Artificial
  CRISPR gRNA sequence
aaatgagggggcttacctaa

SEQ ID NO: 280548 - DNA, 20 bp, Artificial
  CRISPR gRNA sequence
atgagggggcttacctaaga

SEQ ID NO: 280549 - DNA, 20 bp, Artificial
  CRISPR gRNA sequence
tgagggggcttacctaagag

SEQ ID NO: 280550 - DNA, 20 bp, Artificial
  CRISPR gRNA sequence
acctaagagaggataaattc

SEQ ID NO: 280551 - DNA, 20 bp, Artificial
  CRISPR gRNA sequence
attcaagacccacttaaata

SEQ ID NO: 280552 - DNA, 20 bp, Artificial
  CRISPR gRNA sequence
cacttaaatatagctatcat

SEQ ID NO: 280553 - DNA, 20 bp, Artificial
  CRISPR gRNA sequence
taaatatagctatcattggc

SEQ ID NO: 280554 - DNA, 20 bp, Artificial
  CRISPR gRNA sequence
aaatatagctatcattggct

SEQ ID NO: 280555 - DNA, 20 bp, Artificial
  CRISPR gRNA sequence
tagctatcattggctgggtg

SEQ ID NO: 280556 - DNA, 20 bp, Artificial
  CRISPR gRNA sequence
ctatcattggctgggtgtgg

SEQ ID NO: 280557 - DNA, 20 bp, Artificial
  CRISPR gRNA sequence
gtggctcacgcctgtaatcc

SEQ ID NO: 280558 - DNA, 20 bp, Artificial
  CRISPR gRNA sequence
cgcctgtaatcccagcactt

SEQ ID NO: 280559 - DNA, 20 bp, Artificial
  CRISPR gRNA sequence
gcctgtaatcccagcacttt

SEQ ID NO: 280560 - DNA, 20 bp, Artificial
  CRISPR gRNA sequence
ctgtaatcccagcactttgg

SEQ ID NO: 280561 - DNA, 20 bp, Artificial
  CRISPR gRNA sequence
tgtaatcccagcactttggg

SEQ ID NO: 280562 - DNA, 20 bp, Artificial
  CRISPR gRNA sequence
tcccagcactttgggaggcc

SEQ ID NO: 280563 - DNA, 20 bp, Artificial
  CRISPR gRNA sequence
cccagcactttgggaggccg

SEQ ID NO: 280564 - DNA, 20 bp, Artificial
  CRISPR gRNA sequence
gcactttgggaggccgaggc

SEQ ID NO: 280565 - DNA, 20 bp, Artificial
  CRISPR gRNA sequence
ctttgggaggccgaggctgg

SEQ ID NO: 280566 - DNA, 20 bp, Artificial
  CRISPR gRNA sequence
ggccgaggctggtggatcac

SEQ ID NO: 280567 - DNA, 20 bp, Artificial
  CRISPR gRNA sequence
gccgaggctggtggatcacg

SEQ ID NO: 280568 - DNA, 20 bp, Artificial
  CRISPR gRNA sequence
aggctggtggatcacgaggt

SEQ ID NO: 280569 - DNA, 20 bp, Artificial
  CRISPR gRNA sequence
ggctggtggatcacgaggtc

SEQ ID NO: 280570 - DNA, 20 bp, Artificial
  CRISPR gRNA sequence
ctggtggatcacgaggtcag

SEQ ID NO: 280571 - DNA, 20 bp, Artificial
  CRISPR gRNA sequence
gatcacgaggtcaggagact

SEQ ID NO: 280572 - DNA, 20 bp, Artificial
  CRISPR gRNA sequence
tcaggagactgagaccatcc

SEQ ID NO: 280573 - DNA, 20 bp, Artificial
  CRISPR gRNA sequence
tgagaccatcctggctaaca

SEQ ID NO: 280574 - DNA, 20 bp, Artificial
  CRISPR gRNA sequence
cccatctctattaaaaatac

SEQ ID NO: 280575 - DNA, 20 bp, Artificial
  CRISPR gRNA sequence
ctattaaaaatacaagaaat

SEQ ID NO: 280576 - DNA, 20 bp, Artificial
  CRISPR gRNA sequence
taaaaatacaagaaattaga

SEQ ID NO: 280577 - DNA, 20 bp, Artificial
  CRISPR gRNA sequence
aaatacaagaaattagatgg

SEQ ID NO: 280578 - DNA, 20 bp, Artificial
  CRISPR gRNA sequence
tacaagaaattagatggtag

SEQ ID NO: 280579 - DNA, 20 bp, Artificial
  CRISPR gRNA sequence
aagaaattagatggtagtgg

SEQ ID NO: 280580 - DNA, 20 bp, Artificial
  CRISPR gRNA sequence
agaaattagatggtagtggt

SEQ ID NO: 280581 - DNA, 20 bp, Artificial
  CRISPR gRNA sequence
atggtagtggtgggctcctg

SEQ ID NO: 280582 - DNA, 20 bp, Artificial
  CRISPR gRNA sequence
gtggtgggctcctgtagtcc

SEQ ID NO: 280583 - DNA, 20 bp, Artificial
  CRISPR gRNA sequence
tcctgtagtcccagctactc

SEQ ID NO: 280584 - DNA, 20 bp, Artificial
  CRISPR gRNA sequence
ctgtagtcccagctactctg

SEQ ID NO: 280585 - DNA, 20 bp, Artificial
  CRISPR gRNA sequence
tgtagtcccagctactctgg

SEQ ID NO: 280586 - DNA, 20 bp, Artificial
  CRISPR gRNA sequence
tcccagctactctggaggct

SEQ ID NO: 280587 - DNA, 20 bp, Artificial
  CRISPR gRNA sequence
cccagctactctggaggctg

SEQ ID NO: 280588 - DNA, 20 bp, Artificial
  CRISPR gRNA sequence
agctactctggaggctgagg

SEQ ID NO: 280589 - DNA, 20 bp, Artificial
  CRISPR gRNA sequence
gctactctggaggctgaggc

SEQ ID NO: 280590 - DNA, 20 bp, Artificial
  CRISPR gRNA sequence
tactctggaggctgaggcag

SEQ ID NO: 280591 - DNA, 20 bp, Artificial
  CRISPR gRNA sequence
gcaggagaatcacttgaacc

SEQ ID NO: 280592 - DNA, 20 bp, Artificial
  CRISPR gRNA sequence
aggagaatcacttgaacccg

SEQ ID NO: 280593 - DNA, 20 bp, Artificial
  CRISPR gRNA sequence
ggagaatcacttgaacccgg

SEQ ID NO: 280594 - DNA, 20 bp, Artificial
  CRISPR gRNA sequence
tcacttgaacccggaggttg

SEQ ID NO: 280595 - DNA, 20 bp, Artificial
  CRISPR gRNA sequence
ttgaacccggaggttgcagt

SEQ ID NO: 280596 - DNA, 20 bp, Artificial
  CRISPR gRNA sequence
cccggaggttgcagtaagcc

SEQ ID NO: 280597 - DNA, 20 bp, Artificial
  CRISPR gRNA sequence
gaggttgcagtaagccaaga

SEQ ID NO: 280598 - DNA, 20 bp, Artificial
  CRISPR gRNA sequence
aagatggtgccactgcactc

SEQ ID NO: 280599 - DNA, 20 bp, Artificial
  CRISPR gRNA sequence
ggtgccactgcactccagcc

SEQ ID NO: 280600 - DNA, 20 bp, Artificial
  CRISPR gRNA sequence
gtgccactgcactccagcct

SEQ ID NO: 280601 - DNA, 20 bp, Artificial
  CRISPR gRNA sequence
ctgcactccagcctgggcaa

SEQ ID NO: 280602 - DNA, 20 bp, Artificial
  CRISPR gRNA sequence
gcactccagcctgggcaaca

SEQ ID NO: 280603 - DNA, 20 bp, Artificial
  CRISPR gRNA sequence
tccagcctgggcaacagagt

SEQ ID NO: 280604 - DNA, 20 bp, Artificial
  CRISPR gRNA sequence
ggcaacagagtgagactatt

SEQ ID NO: 280605 - DNA, 20 bp, Artificial
  CRISPR gRNA sequence
ctatttagtttcctgtgtgt

SEQ ID NO: 280606 - DNA, 20 bp, Artificial
  CRISPR gRNA sequence
tatttagtttcctgtgtgtc

SEQ ID NO: 280607 - DNA, 20 bp, Artificial
  CRISPR gRNA sequence
tgtgtgtcaggctctgtgct

SEQ ID NO: 280608 - DNA, 20 bp, Artificial
  CRISPR gRNA sequence
tcatttaattcttacaaccc

SEQ ID NO: 280609 - DNA, 20 bp, Artificial
  CRISPR gRNA sequence
catttaattcttacaaccct

SEQ ID NO: 280610 - DNA, 20 bp, Artificial
  CRISPR gRNA sequence
attcttacaaccctgggtat

SEQ ID NO: 280611 - DNA, 20 bp, Artificial
  CRISPR gRNA sequence
gtattagtgtccctatctta

SEQ ID NO: 280612 - DNA, 20 bp, Artificial
  CRISPR gRNA sequence
agtgtccctatcttatagat

SEQ ID NO: 280613 - DNA, 20 bp, Artificial
  CRISPR gRNA sequence
atcttatagatgagcaaact

SEQ ID NO: 280614 - DNA, 20 bp, Artificial
  CRISPR gRNA sequence
agatgagcaaactaagacta

SEQ ID NO: 280615 - DNA, 20 bp, Artificial
  CRISPR gRNA sequence
gatgagcaaactaagactaa

SEQ ID NO: 280616 - DNA, 20 bp, Artificial
  CRISPR gRNA sequence
gagcaaactaagactaaagg

SEQ ID NO: 280617 - DNA, 20 bp, Artificial
  CRISPR gRNA sequence
agcaaactaagactaaaggt

SEQ ID NO: 280618 - DNA, 20 bp, Artificial
  CRISPR gRNA sequence
aactaagactaaaggtgggt

SEQ ID NO: 280619 - DNA, 20 bp, Artificial
  CRISPR gRNA sequence
aggtgggtaagttattgacc

SEQ ID NO: 280620 - DNA, 20 bp, Artificial
  CRISPR gRNA sequence
ggtgggtaagttattgaccc

SEQ ID NO: 280621 - DNA, 20 bp, Artificial
  CRISPR gRNA sequence
gtgggtaagttattgaccca

SEQ ID NO: 280622 - DNA, 20 bp, Artificial
  CRISPR gRNA sequence
agttattgacccagggtcac

SEQ ID NO: 280623 - DNA, 20 bp, Artificial
  CRISPR gRNA sequence
gttattgacccagggtcaca

SEQ ID NO: 280624 - DNA, 20 bp, Artificial
  CRISPR gRNA sequence
attgacccagggtcacaagg

SEQ ID NO: 280625 - DNA, 20 bp, Artificial
  CRISPR gRNA sequence
ccagggtcacaaggcagaac

SEQ ID NO: 280626 - DNA, 20 bp, Artificial
  CRISPR gRNA sequence
tatgctacatgacatctctg

SEQ ID NO: 280627 - DNA, 20 bp, Artificial
  CRISPR gRNA sequence
atgctacatgacatctctgt

SEQ ID NO: 280628 - DNA, 20 bp, Artificial
  CRISPR gRNA sequence
tgctacatgacatctctgtg

SEQ ID NO: 280629 - DNA, 20 bp, Artificial
  CRISPR gRNA sequence
catgacatctctgtggggct

SEQ ID NO: 280630 - DNA, 20 bp, Artificial
  CRISPR gRNA sequence
gtggggctcagaattctgaa

SEQ ID NO: 280631 - DNA, 20 bp, Artificial
  CRISPR gRNA sequence
ggctcagaattctgaaaaga

SEQ ID NO: 280632 - DNA, 20 bp, Artificial
  CRISPR gRNA sequence
gaaaagaaagctaactctat

SEQ ID NO: 280633 - DNA, 20 bp, Artificial
  CRISPR gRNA sequence
aaaagaaagctaactctatg

SEQ ID NO: 280634 - DNA, 20 bp, Artificial
  CRISPR gRNA sequence
aagaaagctaactctatgag

SEQ ID NO: 280635 - DNA, 20 bp, Artificial
  CRISPR gRNA sequence
tgaatccctacattcatgct

SEQ ID NO: 280636 - DNA, 20 bp, Artificial
  CRISPR gRNA sequence
atccctacattcatgctaag

SEQ ID NO: 280637 - DNA, 20 bp, Artificial
  CRISPR gRNA sequence
aagctaatctctttatgtgt

SEQ ID NO: 280638 - DNA, 20 bp, Artificial
  CRISPR gRNA sequence
atctctttatgtgtaagaat

SEQ ID NO: 280639 - DNA, 20 bp, Artificial
  CRISPR gRNA sequence
atgtgtaagaataagtgacg

SEQ ID NO: 280640 - DNA, 20 bp, Artificial
  CRISPR gRNA sequence
agaataagtgacgaagccgc

SEQ ID NO: 280641 - DNA, 20 bp, Artificial
  CRISPR gRNA sequence
gaataagtgacgaagccgct

SEQ ID NO: 280642 - DNA, 20 bp, Artificial
  CRISPR gRNA sequence
ttttcctgtactttgtactt

SEQ ID NO: 280643 - DNA, 20 bp, Artificial
  CRISPR gRNA sequence
ctttgtacttcagaatctta

SEQ ID NO: 280644 - DNA, 20 bp, Artificial
  CRISPR gRNA sequence
tttgtacttcagaatcttat

SEQ ID NO: 280645 - DNA, 20 bp, Artificial
  CRISPR gRNA sequence
ttgtacttcagaatcttatg

SEQ ID NO: 280646 - DNA, 20 bp, Artificial
  CRISPR gRNA sequence
gatcaaatatataaatgaaa

SEQ ID NO: 280647 - DNA, 20 bp, Artificial
  CRISPR gRNA sequence
tataaatgaaacagtgcctc

SEQ ID NO: 280648 - DNA, 20 bp, Artificial
  CRISPR gRNA sequence
ataaatgaaacagtgcctca

SEQ ID NO: 280649 - DNA, 20 bp, Artificial
  CRISPR gRNA sequence
taaatgaaacagtgcctcaa

SEQ ID NO: 280650 - DNA, 20 bp, Artificial
  CRISPR gRNA sequence
aaacagtgcctcaagggtct

SEQ ID NO: 280651 - DNA, 20 bp, Artificial
  CRISPR gRNA sequence
acagtgcctcaagggtcttg

SEQ ID NO: 280652 - DNA, 20 bp, Artificial
  CRISPR gRNA sequence
cagtgcctcaagggtcttgg

SEQ ID NO: 280653 - DNA, 20 bp, Artificial
  CRISPR gRNA sequence
caagggtcttggaggaatgc

SEQ ID NO: 280654 - DNA, 20 bp, Artificial
  CRISPR gRNA sequence
aagggtcttggaggaatgct

SEQ ID NO: 280655 - DNA, 20 bp, Artificial
  CRISPR gRNA sequence
ggtcttggaggaatgctagg

SEQ ID NO: 280656 - DNA, 20 bp, Artificial
  CRISPR gRNA sequence
gtcttggaggaatgctagga

SEQ ID NO: 280657 - DNA, 20 bp, Artificial
  CRISPR gRNA sequence
gaaggccttcctgtcccttt

SEQ ID NO: 280658 - DNA, 20 bp, Artificial
  CRISPR gRNA sequence
aaggccttcctgtcccttta

SEQ ID NO: 280659 - DNA, 20 bp, Artificial
  CRISPR gRNA sequence
ccctttaaggcatatcaaaa

SEQ ID NO: 280660 - DNA, 20 bp, Artificial
  CRISPR gRNA sequence
ttaaggcatatcaaaatagt

SEQ ID NO: 280661 - DNA, 20 bp, Artificial
  CRISPR gRNA sequence
aaatagtaagaaaaacaata

SEQ ID NO: 280662 - DNA, 20 bp, Artificial
  CRISPR gRNA sequence
gtaagaaaaacaataaagtg

SEQ ID NO: 280663 - DNA, 20 bp, Artificial
  CRISPR gRNA sequence
aacaataaagtgtggtgaat

SEQ ID NO: 280664 - DNA, 20 bp, Artificial
  CRISPR gRNA sequence
acaataaagtgtggtgaatg

SEQ ID NO: 280665 - DNA, 20 bp, Artificial
  CRISPR gRNA sequence
aagtgtggtgaatgaggtta

SEQ ID NO: 280666 - DNA, 20 bp, Artificial
  CRISPR gRNA sequence
agtgtggtgaatgaggttat

SEQ ID NO: 280667 - DNA, 20 bp, Artificial
  CRISPR gRNA sequence
aggttataggctcaatgttg

SEQ ID NO: 280668 - DNA, 20 bp, Artificial
  CRISPR gRNA sequence
ataggctcaatgttgtagtt

SEQ ID NO: 280669 - DNA, 20 bp, Artificial
  CRISPR gRNA sequence
tcaatgttgtagtttggata

SEQ ID NO: 280670 - DNA, 20 bp, Artificial
  CRISPR gRNA sequence
caatgttgtagtttggatat

SEQ ID NO: 280671 - DNA, 20 bp, Artificial
  CRISPR gRNA sequence
gtttggatataggtttttct

SEQ ID NO: 280672 - DNA, 20 bp, Artificial
  CRISPR gRNA sequence
atataggtttttctgagtaa

SEQ ID NO: 280673 - DNA, 20 bp, Artificial
  CRISPR gRNA sequence
tttttttttttaatttcaac

SEQ ID NO: 280674 - DNA, 20 bp, Artificial
  CRISPR gRNA sequence
ttttttttttaatttcaacc

SEQ ID NO: 280675 - DNA, 20 bp, Artificial
  CRISPR gRNA sequence
atttcaaccaggtatttaat

SEQ ID NO: 280676 - DNA, 20 bp, Artificial
  CRISPR gRNA sequence
aaccaggtatttaattggtc

SEQ ID NO: 280677 - DNA, 20 bp, Artificial
  CRISPR gRNA sequence
cacaatatacaaatttctga

SEQ ID NO: 280678 - DNA, 20 bp, Artificial
  CRISPR gRNA sequence
acaatatacaaatttctgaa

SEQ ID NO: 280679 - DNA, 20 bp, Artificial
  CRISPR gRNA sequence
gaaaggcatctcctgtttga

SEQ ID NO: 280680 - DNA, 20 bp, Artificial
  CRISPR gRNA sequence
ggcatctcctgtttgaaagc

SEQ ID NO: 280681 - DNA, 20 bp, Artificial
  CRISPR gRNA sequence
ctcctgtttgaaagctagca

SEQ ID NO: 280682 - DNA, 20 bp, Artificial
  CRISPR gRNA sequence
aagctagcatagcttcatcc

SEQ ID NO: 280683 - DNA, 20 bp, Artificial
  CRISPR gRNA sequence
cttcatcccagtaattaatt

SEQ ID NO: 280684 - DNA, 20 bp, Artificial
  CRISPR gRNA sequence
aattaattcggacaaatata

SEQ ID NO: 280685 - DNA, 20 bp, Artificial
  CRISPR gRNA sequence
ggacaaatatatagaacacc

SEQ ID NO: 280686 - DNA, 20 bp, Artificial
  CRISPR gRNA sequence
caaatatatagaacaccaag

SEQ ID NO: 280687 - DNA, 20 bp, Artificial
  CRISPR gRNA sequence
aagaagtcataaattatgca

SEQ ID NO: 280688 - DNA, 20 bp, Artificial
  CRISPR gRNA sequence
aagtcataaattatgcatgg

SEQ ID NO: 280689 - DNA, 20 bp, Artificial
  CRISPR gRNA sequence
aaccaattaacaactaaact

SEQ ID NO: 280690 - DNA, 20 bp, Artificial
  CRISPR gRNA sequence
acaactaaactcagtctata

SEQ ID NO: 280691 - DNA, 20 bp, Artificial
  CRISPR gRNA sequence
ctatacagctttctattttt

SEQ ID NO: 280692 - DNA, 20 bp, Artificial
  CRISPR gRNA sequence
tatacagctttctatttttc

SEQ ID NO: 280693 - DNA, 20 bp, Artificial
  CRISPR gRNA sequence
atgcacattaaataaataaa

SEQ ID NO: 280694 - DNA, 20 bp, Artificial
  CRISPR gRNA sequence
aaatgaaaacattactgatg

SEQ ID NO: 280695 - DNA, 20 bp, Artificial
  CRISPR gRNA sequence
aaaacattactgatgtggtt

SEQ ID NO: 280696 - DNA, 20 bp, Artificial
  CRISPR gRNA sequence
aacattactgatgtggttca

SEQ ID NO: 280697 - DNA, 20 bp, Artificial
  CRISPR gRNA sequence
ttttcttctcacctaaaata

SEQ ID NO: 280698 - DNA, 20 bp, Artificial
  CRISPR gRNA sequence
ttcttctcacctaaaataaa

SEQ ID NO: 280699 - DNA, 20 bp, Artificial
  CRISPR gRNA sequence
aaaataaagagctttgccca

SEQ ID NO: 280700 - DNA, 20 bp, Artificial
  CRISPR gRNA sequence
agctttgcccatggtctcat

SEQ ID NO: 280701 - DNA, 20 bp, Artificial
  CRISPR gRNA sequence
gctttgcccatggtctcatg

SEQ ID NO: 280702 - DNA, 20 bp, Artificial
  CRISPR gRNA sequence
tgcccatggtctcatgagga

SEQ ID NO: 280703 - DNA, 20 bp, Artificial
  CRISPR gRNA sequence
ggtctcatgaggacagaata

SEQ ID NO: 280704 - DNA, 20 bp, Artificial
  CRISPR gRNA sequence
tctcatgaggacagaataaa

SEQ ID NO: 280705 - DNA, 20 bp, Artificial
  CRISPR gRNA sequence
ctcatgaggacagaataaag

SEQ ID NO: 280706 - DNA, 20 bp, Artificial
  CRISPR gRNA sequence
tcatgaggacagaataaaga

SEQ ID NO: 280707 - DNA, 20 bp, Artificial
  CRISPR gRNA sequence
catgaggacagaataaagag

SEQ ID NO: 280708 - DNA, 20 bp, Artificial
  CRISPR gRNA sequence
taaagaggggaaaacccatc

SEQ ID NO: 280709 - DNA, 20 bp, Artificial
  CRISPR gRNA sequence
atatgcaaattaaaaaatac

SEQ ID NO: 280710 - DNA, 20 bp, Artificial
  CRISPR gRNA sequence
aaattaaaaaatactggtca

SEQ ID NO: 280711 - DNA, 20 bp, Artificial
  CRISPR gRNA sequence
aattaaaaaatactggtcat

SEQ ID NO: 280712 - DNA, 20 bp, Artificial
  CRISPR gRNA sequence
actggtcatgggtgtttttt

SEQ ID NO: 280713 - DNA, 20 bp, Artificial
  CRISPR gRNA sequence
ctggtcatgggtgttttttt

SEQ ID NO: 280714 - DNA, 20 bp, Artificial
  CRISPR gRNA sequence
tggtcatgggtgtttttttg

SEQ ID NO: 280715 - DNA, 20 bp, Artificial
  CRISPR gRNA sequence
atgggtgtttttttggggta

SEQ ID NO: 280716 - DNA, 20 bp, Artificial
  CRISPR gRNA sequence
tgggtgtttttttggggtat

SEQ ID NO: 280717 - DNA, 20 bp, Artificial
  CRISPR gRNA sequence
gggtgtttttttggggtatg

SEQ ID NO: 280718 - DNA, 20 bp, Artificial
  CRISPR gRNA sequence
ttttttggggtatggggtgt

SEQ ID NO: 280719 - DNA, 20 bp, Artificial
  CRISPR gRNA sequence
ttggggtatggggtgttggt

SEQ ID NO: 280720 - DNA, 20 bp, Artificial
  CRISPR gRNA sequence
tatggggtgttggtgagact

SEQ ID NO: 280721 - DNA, 20 bp, Artificial
  CRISPR gRNA sequence
ggggtgttggtgagactcag

SEQ ID NO: 280722 - DNA, 20 bp, Artificial
  CRISPR gRNA sequence
gtgttggtgagactcagtag

SEQ ID NO: 280723 - DNA, 20 bp, Artificial
  CRISPR gRNA sequence
gtgagactcagtagaagcaa

SEQ ID NO: 280724 - DNA, 20 bp, Artificial
  CRISPR gRNA sequence
gaagcaaaagctcatgacta

SEQ ID NO: 280725 - DNA, 20 bp, Artificial
  CRISPR gRNA sequence
cgcacacaatgccccctcaa

SEQ ID NO: 280726 - DNA, 20 bp, Artificial
  CRISPR gRNA sequence
gcacacaatgccccctcaaa

SEQ ID NO: 280727 - DNA, 20 bp, Artificial
  CRISPR gRNA sequence
cacaatgccccctcaaaagg

SEQ ID NO: 280728 - DNA, 20 bp, Artificial
  CRISPR gRNA sequence
acaatgccccctcaaaaggc

SEQ ID NO: 280729 - DNA, 20 bp, Artificial
  CRISPR gRNA sequence
ccccctcaaaaggcaggtca

SEQ ID NO: 280730 - DNA, 20 bp, Artificial
  CRISPR gRNA sequence
cccctcaaaaggcaggtcac

SEQ ID NO: 280731 - DNA, 20 bp, Artificial
  CRISPR gRNA sequence
caggtcacaggtttgtaaat

SEQ ID NO: 280732 - DNA, 20 bp, Artificial
  CRISPR gRNA sequence
aggtcacaggtttgtaaatt

SEQ ID NO: 280733 - DNA, 20 bp, Artificial
  CRISPR gRNA sequence
tcacaggtttgtaaattagg

SEQ ID NO: 280734 - DNA, 20 bp, Artificial
  CRISPR gRNA sequence
ggcagcattttcctttctcc

SEQ ID NO: 280735 - DNA, 20 bp, Artificial
  CRISPR gRNA sequence
caagatctcctctccttgac

SEQ ID NO: 280736 - DNA, 20 bp, Artificial
  CRISPR gRNA sequence
atgttttctctctccccatc

SEQ ID NO: 280737 - DNA, 20 bp, Artificial
  CRISPR gRNA sequence
atctagaccctttccaacga

SEQ ID NO: 280738 - DNA, 20 bp, Artificial
  CRISPR gRNA sequence
ttccaacgaaagttctatgt

SEQ ID NO: 280739 - DNA, 20 bp, Artificial
  CRISPR gRNA sequence
tccaacgaaagttctatgtt

SEQ ID NO: 280740 - DNA, 20 bp, Artificial
  CRISPR gRNA sequence
cgaaagttctatgttaggca

SEQ ID NO: 280741 - DNA, 20 bp, Artificial
  CRISPR gRNA sequence
gccttctctatttatgtatt

SEQ ID NO: 280742 - DNA, 20 bp, Artificial
  CRISPR gRNA sequence
ctctatttatgtattgagtt

SEQ ID NO: 280743 - DNA, 20 bp, Artificial
  CRISPR gRNA sequence
tctatttatgtattgagttt

SEQ ID NO: 280744 - DNA, 20 bp, Artificial
  CRISPR gRNA sequence
atttatgtattgagtttagg

SEQ ID NO: 280745 - DNA, 20 bp, Artificial
  CRISPR gRNA sequence
atgtattgagtttaggtagc

SEQ ID NO: 280746 - DNA, 20 bp, Artificial
  CRISPR gRNA sequence
attgagtttaggtagccaga

SEQ ID NO: 280747 - DNA, 20 bp, Artificial
  CRISPR gRNA sequence
gtttaggtagccagaaagaa

SEQ ID NO: 280748 - DNA, 20 bp, Artificial
  CRISPR gRNA sequence
tttaggtagccagaaagaaa

SEQ ID NO: 280749 - DNA, 20 bp, Artificial
  CRISPR gRNA sequence
ttaggtagccagaaagaaaa

SEQ ID NO: 280750 - DNA, 20 bp, Artificial
  CRISPR gRNA sequence
aaaagggaaacacaacttca

SEQ ID NO: 280751 - DNA, 20 bp, Artificial
  CRISPR gRNA sequence
aagggaaacacaacttcatg

SEQ ID NO: 280752 - DNA, 20 bp, Artificial
  CRISPR gRNA sequence
catggagcccttacctgtaa

SEQ ID NO: 280753 - DNA, 20 bp, Artificial
  CRISPR gRNA sequence
cccttacctgtaacagactt

SEQ ID NO: 280754 - DNA, 20 bp, Artificial
  CRISPR gRNA sequence
cttacctgtaacagacttaa

SEQ ID NO: 280755 - DNA, 20 bp, Artificial
  CRISPR gRNA sequence
gacttaagagtcaatgttca

SEQ ID NO: 280756 - DNA, 20 bp, Artificial
  CRISPR gRNA sequence
acttaagagtcaatgttcaa

SEQ ID NO: 280757 - DNA, 20 bp, Artificial
  CRISPR gRNA sequence
agagtcaatgttcaaaggat

SEQ ID NO: 280758 - DNA, 20 bp, Artificial
  CRISPR gRNA sequence
gagtcaatgttcaaaggata

SEQ ID NO: 280759 - DNA, 20 bp, Artificial
  CRISPR gRNA sequence
caatgttcaaaggataaggc

SEQ ID NO: 280760 - DNA, 20 bp, Artificial
  CRISPR gRNA sequence
gttcaaaggataaggccaga

SEQ ID NO: 280761 - DNA, 20 bp, Artificial
  CRISPR gRNA sequence
ttcaaaggataaggccagaa

SEQ ID NO: 280762 - DNA, 20 bp, Artificial
  CRISPR gRNA sequence
caaaggataaggccagaaag

SEQ ID NO: 280763 - DNA, 20 bp, Artificial
  CRISPR gRNA sequence
aaaggataaggccagaaagg

SEQ ID NO: 280764 - DNA, 20 bp, Artificial
  CRISPR gRNA sequence
aaggccagaaaggaggacat

SEQ ID NO: 280765 - DNA, 20 bp, Artificial
  CRISPR gRNA sequence
ggacatgagaaaccattctc

SEQ ID NO: 280766 - DNA, 20 bp, Artificial
  CRISPR gRNA sequence
acatgagaaaccattctcaa

SEQ ID NO: 280767 - DNA, 20 bp, Artificial
  CRISPR gRNA sequence
agaaaccattctcaagagca

SEQ ID NO: 280768 - DNA, 20 bp, Artificial
  CRISPR gRNA sequence
gaaaccattctcaagagcaa

SEQ ID NO: 280769 - DNA, 20 bp, Artificial
  CRISPR gRNA sequence
aaaccattctcaagagcaaa

SEQ ID NO: 280770 - DNA, 20 bp, Artificial
  CRISPR gRNA sequence
aaccattctcaagagcaaag

SEQ ID NO: 280771 - DNA, 20 bp, Artificial
  CRISPR gRNA sequence
cattctcaagagcaaagggg

SEQ ID NO: 280772 - DNA, 20 bp, Artificial
  CRISPR gRNA sequence
attctcaagagcaaaggggt

SEQ ID NO: 280773 - DNA, 20 bp, Artificial
  CRISPR gRNA sequence
ggggtaggcccctcatgtaa

SEQ ID NO: 280774 - DNA, 20 bp, Artificial
  CRISPR gRNA sequence
gtaaaagacgaccttttaaa

SEQ ID NO: 280775 - DNA, 20 bp, Artificial
  CRISPR gRNA sequence
aagacgaccttttaaaaagc

SEQ ID NO: 280776 - DNA, 20 bp, Artificial
  CRISPR gRNA sequence
agacgaccttttaaaaagca

SEQ ID NO: 280777 - DNA, 20 bp, Artificial
  CRISPR gRNA sequence
ggaaatgctaaccacaaatt

SEQ ID NO: 280778 - DNA, 20 bp, Artificial
  CRISPR gRNA sequence
gaaatgctaaccacaaattt

SEQ ID NO: 280779 - DNA, 20 bp, Artificial
  CRISPR gRNA sequence
tgctaaccacaaatttagga

SEQ ID NO: 280780 - DNA, 20 bp, Artificial
  CRISPR gRNA sequence
ccacaaatttaggatagtga

SEQ ID NO: 280781 - DNA, 20 bp, Artificial
  CRISPR gRNA sequence
gatagtgatagtgattacct

SEQ ID NO: 280782 - DNA, 20 bp, Artificial
  CRISPR gRNA sequence
atagtgatagtgattacctt

SEQ ID NO: 280783 - DNA, 20 bp, Artificial
  CRISPR gRNA sequence
tgatagtgattaccttaggt

SEQ ID NO: 280784 - DNA, 20 bp, Artificial
  CRISPR gRNA sequence
gatagtgattaccttaggta

SEQ ID NO: 280785 - DNA, 20 bp, Artificial
  CRISPR gRNA sequence
atagtgattaccttaggtaa

SEQ ID NO: 280786 - DNA, 20 bp, Artificial
  CRISPR gRNA sequence
tgattaccttaggtaaggga

SEQ ID NO: 280787 - DNA, 20 bp, Artificial
  CRISPR gRNA sequence
attaccttaggtaagggaaa

SEQ ID NO: 280788 - DNA, 20 bp, Artificial
  CRISPR gRNA sequence
taccttaggtaagggaaaga

SEQ ID NO: 280789 - DNA, 20 bp, Artificial
  CRISPR gRNA sequence
accttaggtaagggaaagag

SEQ ID NO: 280790 - DNA, 20 bp, Artificial
  CRISPR gRNA sequence
ccttaggtaagggaaagaga

SEQ ID NO: 280791 - DNA, 20 bp, Artificial
  CRISPR gRNA sequence
aggtaagggaaagagaggga

SEQ ID NO: 280792 - DNA, 20 bp, Artificial
  CRISPR gRNA sequence
ggtaagggaaagagagggac

SEQ ID NO: 280793 - DNA, 20 bp, Artificial
  CRISPR gRNA sequence
agggaaagagagggacagga

SEQ ID NO: 280794 - DNA, 20 bp, Artificial
  CRISPR gRNA sequence
gggaaagagagggacaggat

SEQ ID NO: 280795 - DNA, 20 bp, Artificial
  CRISPR gRNA sequence
caggataggtgacatcatac

SEQ ID NO: 280796 - DNA, 20 bp, Artificial
  CRISPR gRNA sequence
gataggtgacatcataccag

SEQ ID NO: 280797 - DNA, 20 bp, Artificial
  CRISPR gRNA sequence
tcataccagcagatttacct

SEQ ID NO: 280798 - DNA, 20 bp, Artificial
  CRISPR gRNA sequence
agatttacctaagttactgt

SEQ ID NO: 280799 - DNA, 20 bp, Artificial
  CRISPR gRNA sequence
taagttactgtcagtgtttt

SEQ ID NO: 280800 - DNA, 20 bp, Artificial
  CRISPR gRNA sequence
ctgtcagtgtttttggtctc

SEQ ID NO: 280801 - DNA, 20 bp, Artificial
  CRISPR gRNA sequence
cagtgtttttggtctcaagt

SEQ ID NO: 280802 - DNA, 20 bp, Artificial
  CRISPR gRNA sequence
gtttttggtctcaagttgga

SEQ ID NO: 280803 - DNA, 20 bp, Artificial
  CRISPR gRNA sequence
tttggtctcaagttggatgg

SEQ ID NO: 280804 - DNA, 20 bp, Artificial
  CRISPR gRNA sequence
ttggtctcaagttggatggt

SEQ ID NO: 280805 - DNA, 20 bp, Artificial
  CRISPR gRNA sequence
caagttggatggtgggtttt

SEQ ID NO: 280806 - DNA, 20 bp, Artificial
  CRISPR gRNA sequence
aagttggatggtgggttttc

SEQ ID NO: 280807 - DNA, 20 bp, Artificial
  CRISPR gRNA sequence
gggttttcaggcgttcgcta

SEQ ID NO: 280808 - DNA, 20 bp, Artificial
  CRISPR gRNA sequence
ttcaggcgttcgctatagtt

SEQ ID NO: 280809 - DNA, 20 bp, Artificial
  CRISPR gRNA sequence
gctatagtttagtaaataaa

SEQ ID NO: 280810 - DNA, 20 bp, Artificial
  CRISPR gRNA sequence
tagtaaataaatagataaca

SEQ ID NO: 280811 - DNA, 20 bp, Artificial
  CRISPR gRNA sequence
taaataaatagataacatag

SEQ ID NO: 280812 - DNA, 20 bp, Artificial
  CRISPR gRNA sequence
taaatagataacatagaaga

SEQ ID NO: 280813 - DNA, 20 bp, Artificial
  CRISPR gRNA sequence
gaaagccacttgcgtacttc

SEQ ID NO: 280814 - DNA, 20 bp, Artificial
  CRISPR gRNA sequence
cacttgcgtacttcaagcat

SEQ ID NO: 280815 - DNA, 20 bp, Artificial
  CRISPR gRNA sequence
acttgcgtacttcaagcatc

SEQ ID NO: 280816 - DNA, 20 bp, Artificial
  CRISPR gRNA sequence
tgcgtacttcaagcatcagg

SEQ ID NO: 280817 - DNA, 20 bp, Artificial
  CRISPR gRNA sequence
acttcaagcatcaggaagaa

SEQ ID NO: 280818 - DNA, 20 bp, Artificial
  CRISPR gRNA sequence
tcaagcatcaggaagaaaag

SEQ ID NO: 280819 - DNA, 20 bp, Artificial
  CRISPR gRNA sequence
aagcatcaggaagaaaagaa

SEQ ID NO: 280820 - DNA, 20 bp, Artificial
  CRISPR gRNA sequence
catcaggaagaaaagaagag

SEQ ID NO: 280821 - DNA, 20 bp, Artificial
  CRISPR gRNA sequence
tcaggaagaaaagaagagaa

SEQ ID NO: 280822 - DNA, 20 bp, Artificial
  CRISPR gRNA sequence
ggaagaaaagaagagaagag

SEQ ID NO: 280823 - DNA, 20 bp, Artificial
  CRISPR gRNA sequence
gaaaagaagagaagagaaga

SEQ ID NO: 280824 - DNA, 20 bp, Artificial
  CRISPR gRNA sequence
aaaagaagagaagagaagaa

SEQ ID NO: 280825 - DNA, 20 bp, Artificial
  CRISPR gRNA sequence
aaagaagagaagagaagaaa

SEQ ID NO: 280826 - DNA, 20 bp, Artificial
  CRISPR gRNA sequence
aagagaagagaagaaaggga

SEQ ID NO: 280827 - DNA, 20 bp, Artificial
  CRISPR gRNA sequence
agagaagagaagaaagggaa

SEQ ID NO: 280828 - DNA, 20 bp, Artificial
  CRISPR gRNA sequence
aagagaagaaagggaaagga

SEQ ID NO: 280829 - DNA, 20 bp, Artificial
  CRISPR gRNA sequence
gaagaaagggaaaggaaaga

SEQ ID NO: 280830 - DNA, 20 bp, Artificial
  CRISPR gRNA sequence
aaagggaaaggaaagaaaga

SEQ ID NO: 280831 - DNA, 20 bp, Artificial
  CRISPR gRNA sequence
aagggaaaggaaagaaagaa

SEQ ID NO: 280832 - DNA, 20 bp, Artificial
  CRISPR gRNA sequence
gaaaggaaagaaagaaaggc

SEQ ID NO: 280833 - DNA, 20 bp, Artificial
  CRISPR gRNA sequence
aaaggaaagaaagaaaggca

SEQ ID NO: 280834 - DNA, 20 bp, Artificial
  CRISPR gRNA sequence
aaagaaagaaaggcaaggtc

SEQ ID NO: 280835 - DNA, 20 bp, Artificial
  CRISPR gRNA sequence
aagaaaggcaaggtcaagaa

SEQ ID NO: 280836 - DNA, 20 bp, Artificial
  CRISPR gRNA sequence
aaggcaaggtcaagaaaaga

SEQ ID NO: 280837 - DNA, 20 bp, Artificial
  CRISPR gRNA sequence
aggcaaggtcaagaaaagat

SEQ ID NO: 280838 - DNA, 20 bp, Artificial
  CRISPR gRNA sequence
ggtcaagaaaagataggctc

SEQ ID NO: 280839 - DNA, 20 bp, Artificial
  CRISPR gRNA sequence
gaaaagataggctctggtgt

SEQ ID NO: 280840 - DNA, 20 bp, Artificial
  CRISPR gRNA sequence
agataggctctggtgtcaga

SEQ ID NO: 280841 - DNA, 20 bp, Artificial
  CRISPR gRNA sequence
gatttgaattctgccattac

SEQ ID NO: 280842 - DNA, 20 bp, Artificial
  CRISPR gRNA sequence
tgaattctgccattactggt

SEQ ID NO: 280843 - DNA, 20 bp, Artificial
  CRISPR gRNA sequence
gttataatttctctaaacct

SEQ ID NO: 280844 - DNA, 20 bp, Artificial
  CRISPR gRNA sequence
cagtttgattacttataaaa

SEQ ID NO: 280845 - DNA, 20 bp, Artificial
  CRISPR gRNA sequence
ttataaaatggaaattatat

SEQ ID NO: 280846 - DNA, 20 bp, Artificial
  CRISPR gRNA sequence
tataaaatggaaattatatt

SEQ ID NO: 280847 - DNA, 20 bp, Artificial
  CRISPR gRNA sequence
ttactgatctttgacctttt

SEQ ID NO: 280848 - DNA, 20 bp, Artificial
  CRISPR gRNA sequence
agatctacaacctacctctc

SEQ ID NO: 280849 - DNA, 20 bp, Artificial
  CRISPR gRNA sequence
gatctacaacctacctctct

SEQ ID NO: 280850 - DNA, 20 bp, Artificial
  CRISPR gRNA sequence
atctacaacctacctctcta

SEQ ID NO: 280851 - DNA, 20 bp, Artificial
  CRISPR gRNA sequence
tacctctctagggtttctgt

SEQ ID NO: 280852 - DNA, 20 bp, Artificial
  CRISPR gRNA sequence
acctctctagggtttctgtg

SEQ ID NO: 280853 - DNA, 20 bp, Artificial
  CRISPR gRNA sequence
ggtttctgtgaggacaaaat

SEQ ID NO: 280854 - DNA, 20 bp, Artificial
  CRISPR gRNA sequence
gtttctgtgaggacaaaatg

SEQ ID NO: 280855 - DNA, 20 bp, Artificial
  CRISPR gRNA sequence
ctgtgaggacaaaatgaggt

SEQ ID NO: 280856 - DNA, 20 bp, Artificial
  CRISPR gRNA sequence
tgtgaggacaaaatgaggta

SEQ ID NO: 280857 - DNA, 20 bp, Artificial
  CRISPR gRNA sequence
ggacaaaatgaggtaaggtc

SEQ ID NO: 280858 - DNA, 20 bp, Artificial
  CRISPR gRNA sequence
aaggtccagacctaacaaac

SEQ ID NO: 280859 - DNA, 20 bp, Artificial
  CRISPR gRNA sequence
ggtccagacctaacaaacaa

SEQ ID NO: 280860 - DNA, 20 bp, Artificial
  CRISPR gRNA sequence
agacctaacaaacaagagtt

SEQ ID NO: 280861 - DNA, 20 bp, Artificial
  CRISPR gRNA sequence
tcttcatctcttacaattgc

SEQ ID NO: 280862 - DNA, 20 bp, Artificial
  CRISPR gRNA sequence
tcttacaattgcaagtactc

SEQ ID NO: 280863 - DNA, 20 bp, Artificial
  CRISPR gRNA sequence
ctacttctcctttctgtaat

SEQ ID NO: 280864 - DNA, 20 bp, Artificial
  CRISPR gRNA sequence
tgccctcctatctccatcaa

SEQ ID NO: 280865 - DNA, 20 bp, Artificial
  CRISPR gRNA sequence
cctcctatctccatcaaaag

SEQ ID NO: 280866 - DNA, 20 bp, Artificial
  CRISPR gRNA sequence
tatctccatcaaaagtggca

SEQ ID NO: 280867 - DNA, 20 bp, Artificial
  CRISPR gRNA sequence
gatataaccaattcaaatca

SEQ ID NO: 280868 - DNA, 20 bp, Artificial
  CRISPR gRNA sequence
taaccaattcaaatcaaagt

SEQ ID NO: 280869 - DNA, 20 bp, Artificial
  CRISPR gRNA sequence
ttcaaatcaaagttagtctt

SEQ ID NO: 280870 - DNA, 20 bp, Artificial
  CRISPR gRNA sequence
gattatacataactattaat

SEQ ID NO: 280871 - DNA, 20 bp, Artificial
  CRISPR gRNA sequence
acataactattaatgagtaa

SEQ ID NO: 280872 - DNA, 20 bp, Artificial
  CRISPR gRNA sequence
cataactattaatgagtaat

SEQ ID NO: 280873 - DNA, 20 bp, Artificial
  CRISPR gRNA sequence
aactattaatgagtaatggg

SEQ ID NO: 280874 - DNA, 20 bp, Artificial
  CRISPR gRNA sequence
tgttttgttttgttgttttt

SEQ ID NO: 280875 - DNA, 20 bp, Artificial
  CRISPR gRNA sequence
gttttgttgtttttgagatg

SEQ ID NO: 280876 - DNA, 20 bp, Artificial
  CRISPR gRNA sequence
tgaagccttgctcttttgcc

SEQ ID NO: 280877 - DNA, 20 bp, Artificial
  CRISPR gRNA sequence
gaagccttgctcttttgccc

SEQ ID NO: 280878 - DNA, 20 bp, Artificial
  CRISPR gRNA sequence
ccttgctcttttgcccaggc

SEQ ID NO: 280879 - DNA, 20 bp, Artificial
  CRISPR gRNA sequence
ttgctcttttgcccaggctg

SEQ ID NO: 280880 - DNA, 20 bp, Artificial
  CRISPR gRNA sequence
cttttgcccaggctggagtg

SEQ ID NO: 280881 - DNA, 20 bp, Artificial
  CRISPR gRNA sequence
ggagtgaagtcgtacgatct

SEQ ID NO: 280882 - DNA, 20 bp, Artificial
  CRISPR gRNA sequence
taactgcaatctccaccctc

SEQ ID NO: 280883 - DNA, 20 bp, Artificial
  CRISPR gRNA sequence
aactgcaatctccaccctct

SEQ ID NO: 280884 - DNA, 20 bp, Artificial
  CRISPR gRNA sequence
aatctccaccctctgggttc

SEQ ID NO: 280885 - DNA, 20 bp, Artificial
  CRISPR gRNA sequence
ttcaagccattctcttgcct

SEQ ID NO: 280886 - DNA, 20 bp, Artificial
  CRISPR gRNA sequence
ttctcttgccttagcctccc

SEQ ID NO: 280887 - DNA, 20 bp, Artificial
  CRISPR gRNA sequence
tcttgccttagcctcccgag

SEQ ID NO: 280888 - DNA, 20 bp, Artificial
  CRISPR gRNA sequence
gccttagcctcccgagtagc

SEQ ID NO: 280889 - DNA, 20 bp, Artificial
  CRISPR gRNA sequence
ccttagcctcccgagtagct

SEQ ID NO: 280890 - DNA, 20 bp, Artificial
  CRISPR gRNA sequence
ctcccgagtagctgggatta

SEQ ID NO: 280891 - DNA, 20 bp, Artificial
  CRISPR gRNA sequence
tcccgagtagctgggattat

SEQ ID NO: 280892 - DNA, 20 bp, Artificial
  CRISPR gRNA sequence
taggcgcctgccaccacgcc

SEQ ID NO: 280893 - DNA, 20 bp, Artificial
  CRISPR gRNA sequence
ctggttaatttatgtatttt

SEQ ID NO: 280894 - DNA, 20 bp, Artificial
  CRISPR gRNA sequence
gttaatttatgtatttttgg

SEQ ID NO: 280895 - DNA, 20 bp, Artificial
  CRISPR gRNA sequence
taatttatgtatttttggta

SEQ ID NO: 280896 - DNA, 20 bp, Artificial
  CRISPR gRNA sequence
ttatgtatttttggtagaga

SEQ ID NO: 280897 - DNA, 20 bp, Artificial
  CRISPR gRNA sequence
tatgtatttttggtagagat

SEQ ID NO: 280898 - DNA, 20 bp, Artificial
  CRISPR gRNA sequence
atgtatttttggtagagatg

SEQ ID NO: 280899 - DNA, 20 bp, Artificial
  CRISPR gRNA sequence
gagatggggttttgccatgt

SEQ ID NO: 280900 - DNA, 20 bp, Artificial
  CRISPR gRNA sequence
tggggttttgccatgttagc

SEQ ID NO: 280901 - DNA, 20 bp, Artificial
  CRISPR gRNA sequence
ggggttttgccatgttagcc

SEQ ID NO: 280902 - DNA, 20 bp, Artificial
  CRISPR gRNA sequence
ttttgccatgttagccaggc

SEQ ID NO: 280903 - DNA, 20 bp, Artificial
  CRISPR gRNA sequence
tggtctcaaactcctgacct

SEQ ID NO: 280904 - DNA, 20 bp, Artificial
  CRISPR gRNA sequence
ggtctcaaactcctgacctc

SEQ ID NO: 280905 - DNA, 20 bp, Artificial
  CRISPR gRNA sequence
ctcaggtgttccacctgcct

SEQ ID NO: 280906 - DNA, 20 bp, Artificial
  CRISPR gRNA sequence
ccacctgcctcggcctccca

SEQ ID NO: 280907 - DNA, 20 bp, Artificial
  CRISPR gRNA sequence
gcctcggcctcccaaagtgc

SEQ ID NO: 280908 - DNA, 20 bp, Artificial
  CRISPR gRNA sequence
cctcggcctcccaaagtgct

SEQ ID NO: 280909 - DNA, 20 bp, Artificial
  CRISPR gRNA sequence
ctcccaaagtgctgggatta

SEQ ID NO: 280910 - DNA, 20 bp, Artificial
  CRISPR gRNA sequence
tcccaaagtgctgggattac

SEQ ID NO: 280911 - DNA, 20 bp, Artificial
  CRISPR gRNA sequence
ccaaagtgctgggattacag

SEQ ID NO: 280912 - DNA, 20 bp, Artificial
  CRISPR gRNA sequence
agtgctgggattacaggagt

SEQ ID NO: 280913 - DNA, 20 bp, Artificial
  CRISPR gRNA sequence
caggagtgagccactgcacc

SEQ ID NO: 280914 - DNA, 20 bp, Artificial
  CRISPR gRNA sequence
gcctttatcaattcttatta

SEQ ID NO: 280915 - DNA, 20 bp, Artificial
  CRISPR gRNA sequence
ttatcaattcttattaaagc

SEQ ID NO: 280916 - DNA, 20 bp, Artificial
  CRISPR gRNA sequence
aaaataaacctctacacaca

SEQ ID NO: 280917 - DNA, 20 bp, Artificial
  CRISPR gRNA sequence
aaataaacctctacacacat

SEQ ID NO: 280918 - DNA, 20 bp, Artificial
  CRISPR gRNA sequence
atatattcttgttctttctt

SEQ ID NO: 280919 - DNA, 20 bp, Artificial
  CRISPR gRNA sequence
ttagctgacttccctacacc

SEQ ID NO: 280920 - DNA, 20 bp, Artificial
  CRISPR gRNA sequence
gaaattccaacttctaatat

SEQ ID NO: 280921 - DNA, 20 bp, Artificial
  CRISPR gRNA sequence
attccaacttctaatattag

SEQ ID NO: 280922 - DNA, 20 bp, Artificial
  CRISPR gRNA sequence
ttccaacttctaatattaga

SEQ ID NO: 280923 - DNA, 20 bp, Artificial
  CRISPR gRNA sequence
aggataatttgctcaacctc

SEQ ID NO: 280924 - DNA, 20 bp, Artificial
  CRISPR gRNA sequence
gataatttgctcaacctctg

SEQ ID NO: 280925 - DNA, 20 bp, Artificial
  CRISPR gRNA sequence
ataatttgctcaacctctgg

SEQ ID NO: 280926 - DNA, 20 bp, Artificial
  CRISPR gRNA sequence
ctcaacctctggaggttttc

SEQ ID NO: 280927 - DNA, 20 bp, Artificial
  CRISPR gRNA sequence
caacctctggaggttttcca

SEQ ID NO: 280928 - DNA, 20 bp, Artificial
  CRISPR gRNA sequence
ttccagagcctcacctctcc

SEQ ID NO: 280929 - DNA, 20 bp, Artificial
  CRISPR gRNA sequence
agagcctcacctctcctggt

SEQ ID NO: 280930 - DNA, 20 bp, Artificial
  CRISPR gRNA sequence
cacctctcctggttggaaaa

SEQ ID NO: 280931 - DNA, 20 bp, Artificial
  CRISPR gRNA sequence
cctctcctggttggaaaatg

SEQ ID NO: 280932 - DNA, 20 bp, Artificial
  CRISPR gRNA sequence
ctcctggttggaaaatggag

SEQ ID NO: 280933 - DNA, 20 bp, Artificial
  CRISPR gRNA sequence
attaaatgccatcaacacaa

SEQ ID NO: 280934 - DNA, 20 bp, Artificial
  CRISPR gRNA sequence
catcaacacaacagtttccc

SEQ ID NO: 280935 - DNA, 20 bp, Artificial
  CRISPR gRNA sequence
tttcccaagatcctgaaact

SEQ ID NO: 280936 - DNA, 20 bp, Artificial
  CRISPR gRNA sequence
gaaactgagctctatgctgt

SEQ ID NO: 280937 - DNA, 20 bp, Artificial
  CRISPR gRNA sequence
actgagctctatgctgttag

SEQ ID NO: 280938 - DNA, 20 bp, Artificial
  CRISPR gRNA sequence
ctatgctgttagcagcaaac

SEQ ID NO: 280939 - DNA, 20 bp, Artificial
  CRISPR gRNA sequence
ttcaatatgacaaccaacca

SEQ ID NO: 280940 - DNA, 20 bp, Artificial
  CRISPR gRNA sequence
acagcttcatgtgtctcatc

SEQ ID NO: 280941 - DNA, 20 bp, Artificial
  CRISPR gRNA sequence
ttcatgtgtctcatcaagta

SEQ ID NO: 280942 - DNA, 20 bp, Artificial
  CRISPR gRNA sequence
ctcatcaagtatggacattt

SEQ ID NO: 280943 - DNA, 20 bp, Artificial
  CRISPR gRNA sequence
catcaagtatggacatttaa

SEQ ID NO: 280944 - DNA, 20 bp, Artificial
  CRISPR gRNA sequence
atggacatttaagagtgaat

SEQ ID NO: 280945 - DNA, 20 bp, Artificial
  CRISPR gRNA sequence
gagtgaatcagaccttcaac

SEQ ID NO: 280946 - DNA, 20 bp, Artificial
  CRISPR gRNA sequence
cagaccttcaactggaatac

SEQ ID NO: 280947 - DNA, 20 bp, Artificial
  CRISPR gRNA sequence
ccttcaactggaatacaagt

SEQ ID NO: 280948 - DNA, 20 bp, Artificial
  CRISPR gRNA sequence
acaagtaagtgacattgttc

SEQ ID NO: 280949 - DNA, 20 bp, Artificial
  CRISPR gRNA sequence
caagtaagtgacattgttct

SEQ ID NO: 280950 - DNA, 20 bp, Artificial
  CRISPR gRNA sequence
aagtaagtgacattgttctg

SEQ ID NO: 280951 - DNA, 20 bp, Artificial
  CRISPR gRNA sequence
gtaagtgacattgttctggg

SEQ ID NO: 280952 - DNA, 20 bp, Artificial
  CRISPR gRNA sequence
tctactatatcgaatctaaa

SEQ ID NO: 280953 - DNA, 20 bp, Artificial
  CRISPR gRNA sequence
tcgaatctaaaaagacaata

SEQ ID NO: 280954 - DNA, 20 bp, Artificial
  CRISPR gRNA sequence
agtcgtgtcatttaatgatg

SEQ ID NO: 280955 - DNA, 20 bp, Artificial
  CRISPR gRNA sequence
taatgatgtggatacatttt

SEQ ID NO: 280956 - DNA, 20 bp, Artificial
  CRISPR gRNA sequence
cattttgagaaatgcatcat

SEQ ID NO: 280957 - DNA, 20 bp, Artificial
  CRISPR gRNA sequence
attttgagaaatgcatcatt

SEQ ID NO: 280958 - DNA, 20 bp, Artificial
  CRISPR gRNA sequence
ttctgtcattgtctgaacat

SEQ ID NO: 280959 - DNA, 20 bp, Artificial
  CRISPR gRNA sequence
ctgtcattgtctgaacatca

SEQ ID NO: 280960 - DNA, 20 bp, Artificial
  CRISPR gRNA sequence
agagtgtatttacataaacc

SEQ ID NO: 280961 - DNA, 20 bp, Artificial
  CRISPR gRNA sequence
tgtatttacataaacctaga

SEQ ID NO: 280962 - DNA, 20 bp, Artificial
  CRISPR gRNA sequence
ttacataaacctagatggta

SEQ ID NO: 280963 - DNA, 20 bp, Artificial
  CRISPR gRNA sequence
ggtacagcctactgcacacc

SEQ ID NO: 280964 - DNA, 20 bp, Artificial
  CRISPR gRNA sequence
gtacagcctactgcacacct

SEQ ID NO: 280965 - DNA, 20 bp, Artificial
  CRISPR gRNA sequence
tactgcacacctaggctaca

SEQ ID NO: 280966 - DNA, 20 bp, Artificial
  CRISPR gRNA sequence
cacacctaggctacatggta

SEQ ID NO: 280967 - DNA, 20 bp, Artificial
  CRISPR gRNA sequence
ctaggctacatggtacagcc

SEQ ID NO: 280968 - DNA, 20 bp, Artificial
  CRISPR gRNA sequence
atggtacagcccagtgctct

SEQ ID NO: 280969 - DNA, 20 bp, Artificial
  CRISPR gRNA sequence
tggtacagcccagtgctctg

SEQ ID NO: 280970 - DNA, 20 bp, Artificial
  CRISPR gRNA sequence
tctgaggctacacacctgta

SEQ ID NO: 280971 - DNA, 20 bp, Artificial
  CRISPR gRNA sequence
atgttaccatactgaacaca

SEQ ID NO: 280972 - DNA, 20 bp, Artificial
  CRISPR gRNA sequence
tgttaccatactgaacacat

SEQ ID NO: 280973 - DNA, 20 bp, Artificial
  CRISPR gRNA sequence
taccatactgaacacatagg

SEQ ID NO: 280974 - DNA, 20 bp, Artificial
  CRISPR gRNA sequence
ataggcagttgtaacacaat

SEQ ID NO: 280975 - DNA, 20 bp, Artificial
  CRISPR gRNA sequence
caataagtatttgtgtatct

SEQ ID NO: 280976 - DNA, 20 bp, Artificial
  CRISPR gRNA sequence
tatctaagcgtatgtaaaca

SEQ ID NO: 280977 - DNA, 20 bp, Artificial
  CRISPR gRNA sequence
atctaagcgtatgtaaacat

SEQ ID NO: 280978 - DNA, 20 bp, Artificial
  CRISPR gRNA sequence
aagcgtatgtaaacatagga

SEQ ID NO: 280979 - DNA, 20 bp, Artificial
  CRISPR gRNA sequence
agcgtatgtaaacataggaa

SEQ ID NO: 280980 - DNA, 20 bp, Artificial
  CRISPR gRNA sequence
atgtaaacataggaaaggta

SEQ ID NO: 280981 - DNA, 20 bp, Artificial
  CRISPR gRNA sequence
ggaaaggtacagtaaaaata

SEQ ID NO: 280982 - DNA, 20 bp, Artificial
  CRISPR gRNA sequence
aatacggtattataatttta

SEQ ID NO: 280983 - DNA, 20 bp, Artificial
  CRISPR gRNA sequence
atacggtattataattttat

SEQ ID NO: 280984 - DNA, 20 bp, Artificial
  CRISPR gRNA sequence
tgggactaccatcatatatg

SEQ ID NO: 280985 - DNA, 20 bp, Artificial
  CRISPR gRNA sequence
atgccattgaaaatgttaca

SEQ ID NO: 280986 - DNA, 20 bp, Artificial
  CRISPR gRNA sequence
catggcacattactgtaact

SEQ ID NO: 280987 - DNA, 20 bp, Artificial
  CRISPR gRNA sequence
gcacattactgtaactcagc

SEQ ID NO: 280988 - DNA, 20 bp, Artificial
  CRISPR gRNA sequence
taactcagccagatacattt

SEQ ID NO: 280989 - DNA, 20 bp, Artificial
  CRISPR gRNA sequence
aattgtcgtatttattttga

SEQ ID NO: 280990 - DNA, 20 bp, Artificial
  CRISPR gRNA sequence
tttattttgatagtgtttta

SEQ ID NO: 280991 - DNA, 20 bp, Artificial
  CRISPR gRNA sequence
atagtgttttatagtgtttt

SEQ ID NO: 280992 - DNA, 20 bp, Artificial
  CRISPR gRNA sequence
tgtgctattatgacttatta

SEQ ID NO: 280993 - DNA, 20 bp, Artificial
  CRISPR gRNA sequence
tgacttattaaagtcactgt

SEQ ID NO: 280994 - DNA, 20 bp, Artificial
  CRISPR gRNA sequence
tattaaagtcactgtgagac

SEQ ID NO: 280995 - DNA, 20 bp, Artificial
  CRISPR gRNA sequence
attaaagtcactgtgagact

SEQ ID NO: 280996 - DNA, 20 bp, Artificial
  CRISPR gRNA sequence
agtcactgtgagactgggca

SEQ ID NO: 280997 - DNA, 20 bp, Artificial
  CRISPR gRNA sequence
cactgtgagactgggcacag

SEQ ID NO: 280998 - DNA, 20 bp, Artificial
  CRISPR gRNA sequence
gtggctcatgcctgtaatcc

SEQ ID NO: 280999 - DNA, 20 bp, Artificial
  CRISPR gRNA sequence
tgcctgtaatcccagcactt

SEQ ID NO: 281000 - DNA, 20 bp, Artificial
  CRISPR gRNA sequence
gcctgtaatcccagcacttt

SEQ ID NO: 281001 - DNA, 20 bp, Artificial
  CRISPR gRNA sequence
ctgtaatcccagcactttgg

SEQ ID NO: 281002 - DNA, 20 bp, Artificial
  CRISPR gRNA sequence
tgtaatcccagcactttggg

SEQ ID NO: 281003 - DNA, 20 bp, Artificial
  CRISPR gRNA sequence
cccagcactttgggaggctg

SEQ ID NO: 281004 - DNA, 20 bp, Artificial
  CRISPR gRNA sequence
agcactttgggaggctgaag

SEQ ID NO: 281005 - DNA, 20 bp, Artificial
  CRISPR gRNA sequence
gcactttgggaggctgaagt

SEQ ID NO: 281006 - DNA, 20 bp, Artificial
  CRISPR gRNA sequence
actttgggaggctgaagtgg

SEQ ID NO: 281007 - DNA, 20 bp, Artificial
  CRISPR gRNA sequence
ctttgggaggctgaagtggg

SEQ ID NO: 281008 - DNA, 20 bp, Artificial
  CRISPR gRNA sequence
ctgaagtgggaggatcactt

SEQ ID NO: 281009 - DNA, 20 bp, Artificial
  CRISPR gRNA sequence
gtgggaggatcacttgagcc

SEQ ID NO: 281010 - DNA, 20 bp, Artificial
  CRISPR gRNA sequence
tgggaggatcacttgagccc

SEQ ID NO: 281011 - DNA, 20 bp, Artificial
  CRISPR gRNA sequence
ggaggatcacttgagcccag

SEQ ID NO: 281012 - DNA, 20 bp, Artificial
  CRISPR gRNA sequence
tcacttgagcccaggagttc

SEQ ID NO: 281013 - DNA, 20 bp, Artificial
  CRISPR gRNA sequence
tgagcccaggagttcaagac

SEQ ID NO: 281014 - DNA, 20 bp, Artificial
  CRISPR gRNA sequence
cccaggagttcaagaccagc

SEQ ID NO: 281015 - DNA, 20 bp, Artificial
  CRISPR gRNA sequence
ccaggagttcaagaccagct

SEQ ID NO: 281016 - DNA, 20 bp, Artificial
  CRISPR gRNA sequence
ggagttcaagaccagctggg

SEQ ID NO: 281017 - DNA, 20 bp, Artificial
  CRISPR gRNA sequence
caagaccagctgggaagcat

SEQ ID NO: 281018 - DNA, 20 bp, Artificial
  CRISPR gRNA sequence
agcatgagactctgactcta

SEQ ID NO: 281019 - DNA, 20 bp, Artificial
  CRISPR gRNA sequence
ctacagaacatttaaaaaat

SEQ ID NO: 281020 - DNA, 20 bp, Artificial
  CRISPR gRNA sequence
agaacatttaaaaaattagc

SEQ ID NO: 281021 - DNA, 20 bp, Artificial
  CRISPR gRNA sequence
gaacatttaaaaaattagcc

SEQ ID NO: 281022 - DNA, 20 bp, Artificial
  CRISPR gRNA sequence
tttaaaaaattagccaggct

SEQ ID NO: 281023 - DNA, 20 bp, Artificial
  CRISPR gRNA sequence
ggcttggtgacacacatgtg

SEQ ID NO: 281024 - DNA, 20 bp, Artificial
  CRISPR gRNA sequence
gtgacacacatgtgtagtcc

SEQ ID NO: 281025 - DNA, 20 bp, Artificial
  CRISPR gRNA sequence
tgacacacatgtgtagtcct

SEQ ID NO: 281026 - DNA, 20 bp, Artificial
  CRISPR gRNA sequence
catgtgtagtcctaggtact

SEQ ID NO: 281027 - DNA, 20 bp, Artificial
  CRISPR gRNA sequence
atgtgtagtcctaggtactt

SEQ ID NO: 281028 - DNA, 20 bp, Artificial
  CRISPR gRNA sequence
gtgtagtcctaggtacttgg

SEQ ID NO: 281029 - DNA, 20 bp, Artificial
  CRISPR gRNA sequence
tgtagtcctaggtacttggg

SEQ ID NO: 281030 - DNA, 20 bp, Artificial
  CRISPR gRNA sequence
gtagtcctaggtacttggga

SEQ ID NO: 281031 - DNA, 20 bp, Artificial
  CRISPR gRNA sequence
tcctaggtacttgggagggt

SEQ ID NO: 281032 - DNA, 20 bp, Artificial
  CRISPR gRNA sequence
cctaggtacttgggagggta

SEQ ID NO: 281033 - DNA, 20 bp, Artificial
  CRISPR gRNA sequence
aggtacttgggagggtaagg

SEQ ID NO: 281034 - DNA, 20 bp, Artificial
  CRISPR gRNA sequence
ggtacttgggagggtaaggt

SEQ ID NO: 281035 - DNA, 20 bp, Artificial
  CRISPR gRNA sequence
acttgggagggtaaggtggg

SEQ ID NO: 281036 - DNA, 20 bp, Artificial
  CRISPR gRNA sequence
gtaaggtgggtggcttactt

SEQ ID NO: 281037 - DNA, 20 bp, Artificial
  CRISPR gRNA sequence
gtgggtggcttacttgagcc

SEQ ID NO: 281038 - DNA, 20 bp, Artificial
  CRISPR gRNA sequence
tgggtggcttacttgagccc

SEQ ID NO: 281039 - DNA, 20 bp, Artificial
  CRISPR gRNA sequence
tacttgagcccaggtgttca

SEQ ID NO: 281040 - DNA, 20 bp, Artificial
  CRISPR gRNA sequence
agcccaggtgttcaaagttg

SEQ ID NO: 281041 - DNA, 20 bp, Artificial
  CRISPR gRNA sequence
caggtgttcaaagttgcagt

SEQ ID NO: 281042 - DNA, 20 bp, Artificial
  CRISPR gRNA sequence
gtgagctatgatcatgccac

SEQ ID NO: 281043 - DNA, 20 bp, Artificial
  CRISPR gRNA sequence
atgatcatgccactagactc

SEQ ID NO: 281044 - DNA, 20 bp, Artificial
  CRISPR gRNA sequence
catgccactagactccagcc

SEQ ID NO: 281045 - DNA, 20 bp, Artificial
  CRISPR gRNA sequence
atgccactagactccagcct

SEQ ID NO: 281046 - DNA, 20 bp, Artificial
  CRISPR gRNA sequence
ctagactccagcctgggcaa

SEQ ID NO: 281047 - DNA, 20 bp, Artificial
  CRISPR gRNA sequence
agactccagcctgggcaaca

SEQ ID NO: 281048 - DNA, 20 bp, Artificial
  CRISPR gRNA sequence
tccagcctgggcaacagagt

SEQ ID NO: 281049 - DNA, 20 bp, Artificial
  CRISPR gRNA sequence
gagtgagaccctgtctctaa

SEQ ID NO: 281050 - DNA, 20 bp, Artificial
  CRISPR gRNA sequence
aaaaataaatttaaaaaata

SEQ ID NO: 281051 - DNA, 20 bp, Artificial
  CRISPR gRNA sequence
aaaaaataaagtcactgtgc

SEQ ID NO: 281052 - DNA, 20 bp, Artificial
  CRISPR gRNA sequence
aaaaataaagtcactgtgca

SEQ ID NO: 281053 - DNA, 20 bp, Artificial
  CRISPR gRNA sequence
atttatttatttattttttt

SEQ ID NO: 281054 - DNA, 20 bp, Artificial
  CRISPR gRNA sequence
atttatttatttttttgaga

SEQ ID NO: 281055 - DNA, 20 bp, Artificial
  CRISPR gRNA sequence
cagtgtctcgccctgttgcc

SEQ ID NO: 281056 - DNA, 20 bp, Artificial
  CRISPR gRNA sequence
agtgtctcgccctgttgccc

SEQ ID NO: 281057 - DNA, 20 bp, Artificial
  CRISPR gRNA sequence
tctcgccctgttgcccaggc

SEQ ID NO: 281058 - DNA, 20 bp, Artificial
  CRISPR gRNA sequence
tcgccctgttgcccaggctg

SEQ ID NO: 281059 - DNA, 20 bp, Artificial
  CRISPR gRNA sequence
ctgttgcccaggctggagtg

SEQ ID NO: 281060 - DNA, 20 bp, Artificial
  CRISPR gRNA sequence
ttgcccaggctggagtgcag

SEQ ID NO: 281061 - DNA, 20 bp, Artificial
  CRISPR gRNA sequence
ggagtgcagtggcacaatct

SEQ ID NO: 281062 - DNA, 20 bp, Artificial
  CRISPR gRNA sequence
tcactgcaacctccaccttc

SEQ ID NO: 281063 - DNA, 20 bp, Artificial
  CRISPR gRNA sequence
cactgcaacctccaccttcc

SEQ ID NO: 281064 - DNA, 20 bp, Artificial
  CRISPR gRNA sequence
aacctccaccttccaggttc

SEQ ID NO: 281065 - DNA, 20 bp, Artificial
  CRISPR gRNA sequence
ttcaagcaattcttctgcct

SEQ ID NO: 281066 - DNA, 20 bp, Artificial
  CRISPR gRNA sequence
ttctgcctcagcctcccgaa

SEQ ID NO: 281067 - DNA, 20 bp, Artificial
  CRISPR gRNA sequence
gcctcagcctcccgaatagc

SEQ ID NO: 281068 - DNA, 20 bp, Artificial
  CRISPR gRNA sequence
cctcagcctcccgaatagct

SEQ ID NO: 281069 - DNA, 20 bp, Artificial
  CRISPR gRNA sequence
ctcccgaatagctgggatta

SEQ ID NO: 281070 - DNA, 20 bp, Artificial
  CRISPR gRNA sequence
tcccgaatagctgggattac

SEQ ID NO: 281071 - DNA, 20 bp, Artificial
  CRISPR gRNA sequence
atagctgggattacaggcgc

SEQ ID NO: 281072 - DNA, 20 bp, Artificial
  CRISPR gRNA sequence
caggcgccagccaccaccct

SEQ ID NO: 281073 - DNA, 20 bp, Artificial
  CRISPR gRNA sequence
cggctaattttttctatctt

SEQ ID NO: 281074 - DNA, 20 bp, Artificial
  CRISPR gRNA sequence
ctaattttttctatctttag

SEQ ID NO: 281075 - DNA, 20 bp, Artificial
  CRISPR gRNA sequence
aattttttctatctttagtg

SEQ ID NO: 281076 - DNA, 20 bp, Artificial
  CRISPR gRNA sequence
ttttctatctttagtggaga

SEQ ID NO: 281077 - DNA, 20 bp, Artificial
  CRISPR gRNA sequence
tttctatctttagtggagat

SEQ ID NO: 281078 - DNA, 20 bp, Artificial
  CRISPR gRNA sequence
ttctatctttagtggagatg

SEQ ID NO: 281079 - DNA, 20 bp, Artificial
  CRISPR gRNA sequence
gagatggggtttcaccatgt

SEQ ID NO: 281080 - DNA, 20 bp, Artificial
  CRISPR gRNA sequence
tggggtttcaccatgttggt

SEQ ID NO: 281081 - DNA, 20 bp, Artificial
  CRISPR gRNA sequence
ggggtttcaccatgttggtc

SEQ ID NO: 281082 - DNA, 20 bp, Artificial
  CRISPR gRNA sequence
tttcaccatgttggtcaggc

SEQ ID NO: 281083 - DNA, 20 bp, Artificial
  CRISPR gRNA sequence
acctcgtgatccgcccgcct

SEQ ID NO: 281084 - DNA, 20 bp, Artificial
  CRISPR gRNA sequence
ccgcccgcctcagcctccca

SEQ ID NO: 281085 - DNA, 20 bp, Artificial
  CRISPR gRNA sequence
gcctcagcctcccaaagtgc

SEQ ID NO: 281086 - DNA, 20 bp, Artificial
  CRISPR gRNA sequence
cctcagcctcccaaagtgct

SEQ ID NO: 281087 - DNA, 20 bp, Artificial
  CRISPR gRNA sequence
ctcccaaagtgctgggatta

SEQ ID NO: 281088 - DNA, 20 bp, Artificial
  CRISPR gRNA sequence
tcccaaagtgctgggattac

SEQ ID NO: 281089 - DNA, 20 bp, Artificial
  CRISPR gRNA sequence
agtgctgggattacaggtgt

SEQ ID NO: 281090 - DNA, 20 bp, Artificial
  CRISPR gRNA sequence
caggtgtgagccactgcacc

SEQ ID NO: 281091 - DNA, 20 bp, Artificial
  CRISPR gRNA sequence
actaaaaaccattatccatc

SEQ ID NO: 281092 - DNA, 20 bp, Artificial
  CRISPR gRNA sequence
catcaagcattcatcttaaa

SEQ ID NO: 281093 - DNA, 20 bp, Artificial
  CRISPR gRNA sequence
ttaaaaagtttttgtaacaa

SEQ ID NO: 281094 - DNA, 20 bp, Artificial
  CRISPR gRNA sequence
tgtaacaatagtattattga

SEQ ID NO: 281095 - DNA, 20 bp, Artificial
  CRISPR gRNA sequence
aagcattaaaatttgccctt

SEQ ID NO: 281096 - DNA, 20 bp, Artificial
  CRISPR gRNA sequence
ttgccctttggaactgccct

SEQ ID NO: 281097 - DNA, 20 bp, Artificial
  CRISPR gRNA sequence
tgccctttggaactgccctt

SEQ ID NO: 281098 - DNA, 20 bp, Artificial
  CRISPR gRNA sequence
gccctttggaactgccctta

SEQ ID NO: 281099 - DNA, 20 bp, Artificial
  CRISPR gRNA sequence
tggaactgcccttagggatt

SEQ ID NO: 281100 - DNA, 20 bp, Artificial
  CRISPR gRNA sequence
agggatttggtgctttcttt

SEQ ID NO: 281101 - DNA, 20 bp, Artificial
  CRISPR gRNA sequence
gggatttggtgctttctttt

SEQ ID NO: 281102 - DNA, 20 bp, Artificial
  CRISPR gRNA sequence
ggatttggtgctttctttta

SEQ ID NO: 281103 - DNA, 20 bp, Artificial
  CRISPR gRNA sequence
tttagggcatgccacccaca

SEQ ID NO: 281104 - DNA, 20 bp, Artificial
  CRISPR gRNA sequence
atgccacccacacggttcca

SEQ ID NO: 281105 - DNA, 20 bp, Artificial
  CRISPR gRNA sequence
tgccaaacaatttttttttg

SEQ ID NO: 281106 - DNA, 20 bp, Artificial
  CRISPR gRNA sequence
gccaaacaatttttttttgt

SEQ ID NO: 281107 - DNA, 20 bp, Artificial
  CRISPR gRNA sequence
tgtgggcgaatgtgcttttt

SEQ ID NO: 281108 - DNA, 20 bp, Artificial
  CRISPR gRNA sequence
atgtgctttttaagaactac

SEQ ID NO: 281109 - DNA, 20 bp, Artificial
  CRISPR gRNA sequence
ctactggttcattctgaacc

SEQ ID NO: 281110 - DNA, 20 bp, Artificial
  CRISPR gRNA sequence
ggttcattctgaaccaagtc

SEQ ID NO: 281111 - DNA, 20 bp, Artificial
  CRISPR gRNA sequence
gttcattctgaaccaagtct

SEQ ID NO: 281112 - DNA, 20 bp, Artificial
  CRISPR gRNA sequence
attctgaaccaagtctggga

SEQ ID NO: 281113 - DNA, 20 bp, Artificial
  CRISPR gRNA sequence
ttctgaaccaagtctgggaa

SEQ ID NO: 281114 - DNA, 20 bp, Artificial
  CRISPR gRNA sequence
gaaccaagtctgggaaaggt

SEQ ID NO: 281115 - DNA, 20 bp, Artificial
  CRISPR gRNA sequence
ggtgagtgacaaactccttg

SEQ ID NO: 281116 - DNA, 20 bp, Artificial
  CRISPR gRNA sequence
ccttgaagacaacgcctgaa

SEQ ID NO: 281117 - DNA, 20 bp, Artificial
  CRISPR gRNA sequence
ttgaagacaacgcctgaaaa

SEQ ID NO: 281118 - DNA, 20 bp, Artificial
  CRISPR gRNA sequence
tgaagacaacgcctgaaaag

SEQ ID NO: 281119 - DNA, 20 bp, Artificial
  CRISPR gRNA sequence
cgcctgaaaagaggtcattt

SEQ ID NO: 281120 - DNA, 20 bp, Artificial
  CRISPR gRNA sequence
cctgaaaagaggtcattttg

SEQ ID NO: 281121 - DNA, 20 bp, Artificial
  CRISPR gRNA sequence
gagcaaatattttaccctac

SEQ ID NO: 281122 - DNA, 20 bp, Artificial
  CRISPR gRNA sequence
caaatattttaccctactgg

SEQ ID NO: 281123 - DNA, 20 bp, Artificial
  CRISPR gRNA sequence
taccctactggtagtaaact

SEQ ID NO: 281124 - DNA, 20 bp, Artificial
  CRISPR gRNA sequence
ccctactggtagtaaactca

SEQ ID NO: 281125 - DNA, 20 bp, Artificial
  CRISPR gRNA sequence
tcagagaattctctttcccc

SEQ ID NO: 281126 - DNA, 20 bp, Artificial
  CRISPR gRNA sequence
agagaattctctttccccaa

SEQ ID NO: 281127 - DNA, 20 bp, Artificial
  CRISPR gRNA sequence
gagaattctctttccccaag

SEQ ID NO: 281128 - DNA, 20 bp, Artificial
  CRISPR gRNA sequence
aaaatatacaatgaaaacga

SEQ ID NO: 281129 - DNA, 20 bp, Artificial
  CRISPR gRNA sequence
aaatatacaatgaaaacgat

SEQ ID NO: 281130 - DNA, 20 bp, Artificial
  CRISPR gRNA sequence
ttatatgaatatatacatct

SEQ ID NO: 281131 - DNA, 20 bp, Artificial
  CRISPR gRNA sequence
tatatgaatatatacatctt

SEQ ID NO: 281132 - DNA, 20 bp, Artificial
  CRISPR gRNA sequence
tatacatcttaggcctataa

SEQ ID NO: 281133 - DNA, 20 bp, Artificial
  CRISPR gRNA sequence
tcttaggcctataatggctt

SEQ ID NO: 281134 - DNA, 20 bp, Artificial
  CRISPR gRNA sequence
aggcctataatggcttaaga

SEQ ID NO: 281135 - DNA, 20 bp, Artificial
  CRISPR gRNA sequence
aatggcttaagatggcttac

SEQ ID NO: 281136 - DNA, 20 bp, Artificial
  CRISPR gRNA sequence
atggcttaagatggcttaca

SEQ ID NO: 281137 - DNA, 20 bp, Artificial
  CRISPR gRNA sequence
gatggcttacaaggtgaact

SEQ ID NO: 281138 - DNA, 20 bp, Artificial
  CRISPR gRNA sequence
taatacttgtttaaattgta

SEQ ID NO: 281139 - DNA, 20 bp, Artificial
  CRISPR gRNA sequence
aaattgtacggctgatcata

SEQ ID NO: 281140 - DNA, 20 bp, Artificial
  CRISPR gRNA sequence
attgtacggctgatcataca

SEQ ID NO: 281141 - DNA, 20 bp, Artificial
  CRISPR gRNA sequence
ttgtacggctgatcatacag

SEQ ID NO: 281142 - DNA, 20 bp, Artificial
  CRISPR gRNA sequence
gctgatcatacagaggacca

SEQ ID NO: 281143 - DNA, 20 bp, Artificial
  CRISPR gRNA sequence
ctgatcatacagaggaccac

SEQ ID NO: 281144 - DNA, 20 bp, Artificial
  CRISPR gRNA sequence
caggtctctctccctacccc

SEQ ID NO: 281145 - DNA, 20 bp, Artificial
  CRISPR gRNA sequence
ctacccctagccccactccc

SEQ ID NO: 281146 - DNA, 20 bp, Artificial
  CRISPR gRNA sequence
tacccctagccccactccca

SEQ ID NO: 281147 - DNA, 20 bp, Artificial
  CRISPR gRNA sequence
cctagccccactcccaagga

SEQ ID NO: 281148 - DNA, 20 bp, Artificial
  CRISPR gRNA sequence
ctagccccactcccaaggat

SEQ ID NO: 281149 - DNA, 20 bp, Artificial
  CRISPR gRNA sequence
ggataggttttgtgactgta

SEQ ID NO: 281150 - DNA, 20 bp, Artificial
  CRISPR gRNA sequence
aggttttgtgactgtatagt

SEQ ID NO: 281151 - DNA, 20 bp, Artificial
  CRISPR gRNA sequence
atagtaagaaacaaaacact

SEQ ID NO: 281152 - DNA, 20 bp, Artificial
  CRISPR gRNA sequence
aaacactgagtttgataata

SEQ ID NO: 281153 - DNA, 20 bp, Artificial
  CRISPR gRNA sequence
ttgataatacagttgcacat

SEQ ID NO: 281154 - DNA, 20 bp, Artificial
  CRISPR gRNA sequence
tacagttgcacataagtata

SEQ ID NO: 281155 - DNA, 20 bp, Artificial
  CRISPR gRNA sequence
atagcacaatatatactata

SEQ ID NO: 281156 - DNA, 20 bp, Artificial
  CRISPR gRNA sequence
attcttcatgtctttacttg

SEQ ID NO: 281157 - DNA, 20 bp, Artificial
  CRISPR gRNA sequence
tgtctttacttgtagttgcg

SEQ ID NO: 281158 - DNA, 20 bp, Artificial
  CRISPR gRNA sequence
ctttacttgtagttgcgaag

SEQ ID NO: 281159 - DNA, 20 bp, Artificial
  CRISPR gRNA sequence
gcgaagtggataatttattt

SEQ ID NO: 281160 - DNA, 20 bp, Artificial
  CRISPR gRNA sequence
agtggataatttattttaga

SEQ ID NO: 281161 - DNA, 20 bp, Artificial
  CRISPR gRNA sequence
ataatttattttagatggtc

SEQ ID NO: 281162 - DNA, 20 bp, Artificial
  CRISPR gRNA sequence
gatggtctagtaattcatgc

SEQ ID NO: 281163 - DNA, 20 bp, Artificial
  CRISPR gRNA sequence
tgctagtgtatgatttactc

SEQ ID NO: 281164 - DNA, 20 bp, Artificial
  CRISPR gRNA sequence
atgatttactctagatcttt

SEQ ID NO: 281165 - DNA, 20 bp, Artificial
  CRISPR gRNA sequence
ctctagatctttcagtgtta

SEQ ID NO: 281166 - DNA, 20 bp, Artificial
  CRISPR gRNA sequence
tagatctttcagtgttacag

SEQ ID NO: 281167 - DNA, 20 bp, Artificial
  CRISPR gRNA sequence
agattttttttttttttttt

SEQ ID NO: 281168 - DNA, 20 bp, Artificial
  CRISPR gRNA sequence
ttttttttttttttttgaga

SEQ ID NO: 281169 - DNA, 20 bp, Artificial
  CRISPR gRNA sequence
ttttttttttttttgagacg

SEQ ID NO: 281170 - DNA, 20 bp, Artificial
  CRISPR gRNA sequence
cggagtctcgctctgtcacc

SEQ ID NO: 281171 - DNA, 20 bp, Artificial
  CRISPR gRNA sequence
ggagtctcgctctgtcaccc

SEQ ID NO: 281172 - DNA, 20 bp, Artificial
  CRISPR gRNA sequence
tctcgctctgtcacccaggc

SEQ ID NO: 281173 - DNA, 20 bp, Artificial
  CRISPR gRNA sequence
tcgctctgtcacccaggctg

SEQ ID NO: 281174 - DNA, 20 bp, Artificial
  CRISPR gRNA sequence
ctgtcacccaggctggagtg

SEQ ID NO: 281175 - DNA, 20 bp, Artificial
  CRISPR gRNA sequence
tcacccaggctggagtgcag

SEQ ID NO: 281176 - DNA, 20 bp, Artificial
  CRISPR gRNA sequence
ggagtgcagtggcgtgatct

SEQ ID NO: 281177 - DNA, 20 bp, Artificial
  CRISPR gRNA sequence
tcactgtaacctccgcctcc

SEQ ID NO: 281178 - DNA, 20 bp, Artificial
  CRISPR gRNA sequence
cactgtaacctccgcctccc

SEQ ID NO: 281179 - DNA, 20 bp, Artificial
  CRISPR gRNA sequence
aacctccgcctcccaggttg

SEQ ID NO: 281180 - DNA, 20 bp, Artificial
  CRISPR gRNA sequence
ttgaagcaattctcctgtct

SEQ ID NO: 281181 - DNA, 20 bp, Artificial
  CRISPR gRNA sequence
tcctgtctcagcctcctgtg

SEQ ID NO: 281182 - DNA, 20 bp, Artificial
  CRISPR gRNA sequence
gtctcagcctcctgtgtagc

SEQ ID NO: 281183 - DNA, 20 bp, Artificial
  CRISPR gRNA sequence
tctcagcctcctgtgtagct

SEQ ID NO: 281184 - DNA, 20 bp, Artificial
  CRISPR gRNA sequence
ctcctgtgtagctgggacta

SEQ ID NO: 281185 - DNA, 20 bp, Artificial
  CRISPR gRNA sequence
tcctgtgtagctgggactac

SEQ ID NO: 281186 - DNA, 20 bp, Artificial
  CRISPR gRNA sequence
gtagctgggactacaggtgc

SEQ ID NO: 281187 - DNA, 20 bp, Artificial
  CRISPR gRNA sequence
caggtgccagccaccacaca

SEQ ID NO: 281188 - DNA, 20 bp, Artificial
  CRISPR gRNA sequence
acagataatttttgtatttt

SEQ ID NO: 281189 - DNA, 20 bp, Artificial
  CRISPR gRNA sequence
gataatttttgtatttttag

SEQ ID NO: 281190 - DNA, 20 bp, Artificial
  CRISPR gRNA sequence
taatttttgtatttttagta

SEQ ID NO: 281191 - DNA, 20 bp, Artificial
  CRISPR gRNA sequence
ttttgtatttttagtagaga

SEQ ID NO: 281192 - DNA, 20 bp, Artificial
  CRISPR gRNA sequence
ttgtatttttagtagagatg

SEQ ID NO: 281193 - DNA, 20 bp, Artificial
  CRISPR gRNA sequence
gagatggagtttcaccacgt

SEQ ID NO: 281194 - DNA, 20 bp, Artificial
  CRISPR gRNA sequence
tggagtttcaccacgttggt

SEQ ID NO: 281195 - DNA, 20 bp, Artificial
  CRISPR gRNA sequence
ggagtttcaccacgttggtc

SEQ ID NO: 281196 - DNA, 20 bp, Artificial
  CRISPR gRNA sequence
tttcaccacgttggtcaggc

SEQ ID NO: 281197 - DNA, 20 bp, Artificial
  CRISPR gRNA sequence
tggtcttgaactctcgacct

SEQ ID NO: 281198 - DNA, 20 bp, Artificial
  CRISPR gRNA sequence
ggtcttgaactctcgacctt

SEQ ID NO: 281199 - DNA, 20 bp, Artificial
  CRISPR gRNA sequence
cttaggtgatctgcccgcct

SEQ ID NO: 281200 - DNA, 20 bp, Artificial
  CRISPR gRNA sequence
ctgcccgcctcagcctccca

SEQ ID NO: 281201 - DNA, 20 bp, Artificial
  CRISPR gRNA sequence
cgcctcagcctcccaaagtg

SEQ ID NO: 281202 - DNA, 20 bp, Artificial
  CRISPR gRNA sequence
cctcagcctcccaaagtgtg

SEQ ID NO: 281203 - DNA, 20 bp, Artificial
  CRISPR gRNA sequence
ctcccaaagtgtggagatta

SEQ ID NO: 281204 - DNA, 20 bp, Artificial
  CRISPR gRNA sequence
tcccaaagtgtggagattac

SEQ ID NO: 281205 - DNA, 20 bp, Artificial
  CRISPR gRNA sequence
agtgtggagattacaggcat

SEQ ID NO: 281206 - DNA, 20 bp, Artificial
  CRISPR gRNA sequence
caggcatgagccaccatgcc

SEQ ID NO: 281207 - DNA, 20 bp, Artificial
  CRISPR gRNA sequence
tgagccaccatgcccggcta

SEQ ID NO: 281208 - DNA, 20 bp, Artificial
  CRISPR gRNA sequence
gccaccatgcccggctacag

SEQ ID NO: 281209 - DNA, 20 bp, Artificial
  CRISPR gRNA sequence
gattctttattttcctcaat

SEQ ID NO: 281210 - DNA, 20 bp, Artificial
  CRISPR gRNA sequence
ctcaatgagacaaaatttcc

SEQ ID NO: 281211 - DNA, 20 bp, Artificial
  CRISPR gRNA sequence
tcaatgagacaaaatttcct

SEQ ID NO: 281212 - DNA, 20 bp, Artificial
  CRISPR gRNA sequence
acaaaatttcctgggaaaat

SEQ ID NO: 281213 - DNA, 20 bp, Artificial
  CRISPR gRNA sequence
tattgatactccaaacttac

SEQ ID NO: 281214 - DNA, 20 bp, Artificial
  CRISPR gRNA sequence
tactccaaacttaccagtct

SEQ ID NO: 281215 - DNA, 20 bp, Artificial
  CRISPR gRNA sequence
tgtaaaaattttattaaaat

SEQ ID NO: 281216 - DNA, 20 bp, Artificial
  CRISPR gRNA sequence
gtaaaaattttattaaaatg

SEQ ID NO: 281217 - DNA, 20 bp, Artificial
  CRISPR gRNA sequence
aaaatgaggcttcaatcata

SEQ ID NO: 281218 - DNA, 20 bp, Artificial
  CRISPR gRNA sequence
cttcaatcatatagtttatt

SEQ ID NO: 281219 - DNA, 20 bp, Artificial
  CRISPR gRNA sequence
ctatttttactttcttgtta

SEQ ID NO: 281220 - DNA, 20 bp, Artificial
  CRISPR gRNA sequence
attttacattattctgattg

SEQ ID NO: 281221 - DNA, 20 bp, Artificial
  CRISPR gRNA sequence
ttttacattattctgattga

SEQ ID NO: 281222 - DNA, 20 bp, Artificial
  CRISPR gRNA sequence
tacattattctgattgaagg

SEQ ID NO: 281223 - DNA, 20 bp, Artificial
  CRISPR gRNA sequence
ttctgattgaaggcagaaaa

SEQ ID NO: 281224 - DNA, 20 bp, Artificial
  CRISPR gRNA sequence
tgattgaaggcagaaaacag

SEQ ID NO: 281225 - DNA, 20 bp, Artificial
  CRISPR gRNA sequence
attgaaggcagaaaacagta

SEQ ID NO: 281226 - DNA, 20 bp, Artificial
  CRISPR gRNA sequence
tagagtactgattattaaat

SEQ ID NO: 281227 - DNA, 20 bp, Artificial
  CRISPR gRNA sequence
gattattaaatcagtaatac

SEQ ID NO: 281228 - DNA, 20 bp, Artificial
  CRISPR gRNA sequence
ttaaatcagtaatactagct

SEQ ID NO: 281229 - DNA, 20 bp, Artificial
  CRISPR gRNA sequence
gcttggattgcattttgatt

SEQ ID NO: 281230 - DNA, 20 bp, Artificial
  CRISPR gRNA sequence
gatttggacattatttatat

SEQ ID NO: 281231 - DNA, 20 bp, Artificial
  CRISPR gRNA sequence
acattatttatattggaata

SEQ ID NO: 281232 - DNA, 20 bp, Artificial
  CRISPR gRNA sequence
atggatatatgtgacattct

SEQ ID NO: 281233 - DNA, 20 bp, Artificial
  CRISPR gRNA sequence
atatatgtgacattctaaga

SEQ ID NO: 281234 - DNA, 20 bp, Artificial
  CRISPR gRNA sequence
tatatgtgacattctaagac

SEQ ID NO: 281235 - DNA, 20 bp, Artificial
  CRISPR gRNA sequence
atatgtgacattctaagaca

SEQ ID NO: 281236 - DNA, 20 bp, Artificial
  CRISPR gRNA sequence
tatgtgacattctaagacag

SEQ ID NO: 281237 - DNA, 20 bp, Artificial
  CRISPR gRNA sequence
tgacattctaagacaggggt

SEQ ID NO: 281238 - DNA, 20 bp, Artificial
  CRISPR gRNA sequence
ttggcaaatttttttctgaa

SEQ ID NO: 281239 - DNA, 20 bp, Artificial
  CRISPR gRNA sequence
ggcaaatttttttctgaata

SEQ ID NO: 281240 - DNA, 20 bp, Artificial
  CRISPR gRNA sequence
aatttttttctgaatagagc

SEQ ID NO: 281241 - DNA, 20 bp, Artificial
  CRISPR gRNA sequence
tttttctgaatagagccaga

SEQ ID NO: 281242 - DNA, 20 bp, Artificial
  CRISPR gRNA sequence
agccagatagtaaatatttt

SEQ ID NO: 281243 - DNA, 20 bp, Artificial
  CRISPR gRNA sequence
agtaaatattttaagctttg

SEQ ID NO: 281244 - DNA, 20 bp, Artificial
  CRISPR gRNA sequence
tattttaagctttgcagtca

SEQ ID NO: 281245 - DNA, 20 bp, Artificial
  CRISPR gRNA sequence
ttgcaacaactcaattctgc

SEQ ID NO: 281246 - DNA, 20 bp, Artificial
  CRISPR gRNA sequence
caactcaattctgctggttg

SEQ ID NO: 281247 - DNA, 20 bp, Artificial
  CRISPR gRNA sequence
ttctgctggttgtagcacaa

SEQ ID NO: 281248 - DNA, 20 bp, Artificial
  CRISPR gRNA sequence
tgctggttgtagcacaaaag

SEQ ID NO: 281249 - DNA, 20 bp, Artificial
  CRISPR gRNA sequence
ttgtagcacaaaagcagcca

SEQ ID NO: 281250 - DNA, 20 bp, Artificial
  CRISPR gRNA sequence
gcacaaaagcagccacagac

SEQ ID NO: 281251 - DNA, 20 bp, Artificial
  CRISPR gRNA sequence
caagacataaatgaatgaca

SEQ ID NO: 281252 - DNA, 20 bp, Artificial
  CRISPR gRNA sequence
tttttctttttttttttttt

SEQ ID NO: 281253 - DNA, 20 bp, Artificial
  CRISPR gRNA sequence
tcttttttttttttttgaga

SEQ ID NO: 281254 - DNA, 20 bp, Artificial
  CRISPR gRNA sequence
ttttttttttttttgagaca

SEQ ID NO: 281255 - DNA, 20 bp, Artificial
  CRISPR gRNA sequence
agagtttcactcttgttgcc

SEQ ID NO: 281256 - DNA, 20 bp, Artificial
  CRISPR gRNA sequence
gagtttcactcttgttgccc

SEQ ID NO: 281257 - DNA, 20 bp, Artificial
  CRISPR gRNA sequence
ttcactcttgttgcccaggc

SEQ ID NO: 281258 - DNA, 20 bp, Artificial
  CRISPR gRNA sequence
cactcttgttgcccaggctg

SEQ ID NO: 281259 - DNA, 20 bp, Artificial
  CRISPR gRNA sequence
ttgcccaggctggagtgcaa

SEQ ID NO: 281260 - DNA, 20 bp, Artificial
  CRISPR gRNA sequence
caggctggagtgcaatggtg

SEQ ID NO: 281261 - DNA, 20 bp, Artificial
  CRISPR gRNA sequence
ggagtgcaatggtgtggtct

SEQ ID NO: 281262 - DNA, 20 bp, Artificial
  CRISPR gRNA sequence
tcactgcaacctctgcctcc

SEQ ID NO: 281263 - DNA, 20 bp, Artificial
  CRISPR gRNA sequence
cactgcaacctctgcctccc

SEQ ID NO: 281264 - DNA, 20 bp, Artificial
  CRISPR gRNA sequence
ttcaaacgattctcctgcct

SEQ ID NO: 281265 - DNA, 20 bp, Artificial
  CRISPR gRNA sequence
ttctcctgcctcagcctccc

SEQ ID NO: 281266 - DNA, 20 bp, Artificial
  CRISPR gRNA sequence
tcctgcctcagcctcccaag

SEQ ID NO: 281267 - DNA, 20 bp, Artificial
  CRISPR gRNA sequence
gcctcagcctcccaagtagc

SEQ ID NO: 281268 - DNA, 20 bp, Artificial
  CRISPR gRNA sequence
cctcagcctcccaagtagct

SEQ ID NO: 281269 - DNA, 20 bp, Artificial
  CRISPR gRNA sequence
ctcccaagtagctgggatta

SEQ ID NO: 281270 - DNA, 20 bp, Artificial
  CRISPR gRNA sequence
tcccaagtagctgggattac

SEQ ID NO: 281271 - DNA, 20 bp, Artificial
  CRISPR gRNA sequence
caggtgcctgcctccacaac

SEQ ID NO: 281272 - DNA, 20 bp, Artificial
  CRISPR gRNA sequence
ggctaatttatgtattttct

SEQ ID NO: 281273 - DNA, 20 bp, Artificial
  CRISPR gRNA sequence
taatttatgtattttcttag

SEQ ID NO: 281274 - DNA, 20 bp, Artificial
  CRISPR gRNA sequence
atttatgtattttcttagtg

SEQ ID NO: 281275 - DNA, 20 bp, Artificial
  CRISPR gRNA sequence
atgtattttcttagtggaga

SEQ ID NO: 281276 - DNA, 20 bp, Artificial
  CRISPR gRNA sequence
tgtattttcttagtggagat

SEQ ID NO: 281277 - DNA, 20 bp, Artificial
  CRISPR gRNA sequence
gtattttcttagtggagatg

SEQ ID NO: 281278 - DNA, 20 bp, Artificial
  CRISPR gRNA sequence
gagatggggtttcaccatgt

SEQ ID NO: 281279 - DNA, 20 bp, Artificial
  CRISPR gRNA sequence
tggggtttcaccatgttggt

SEQ ID NO: 281280 - DNA, 20 bp, Artificial
  CRISPR gRNA sequence
ggggtttcaccatgttggtc

SEQ ID NO: 281281 - DNA, 20 bp, Artificial
  CRISPR gRNA sequence
tttcaccatgttggtcaggc

SEQ ID NO: 281282 - DNA, 20 bp, Artificial
  CRISPR gRNA sequence
tggtctcgaactcctgatct

SEQ ID NO: 281283 - DNA, 20 bp, Artificial
  CRISPR gRNA sequence
ggtctcgaactcctgatctc

SEQ ID NO: 281284 - DNA, 20 bp, Artificial
  CRISPR gRNA sequence
ctcaggtgatccatctgcct

SEQ ID NO: 281285 - DNA, 20 bp, Artificial
  CRISPR gRNA sequence
ccatctgcctcagcctctca

SEQ ID NO: 281286 - DNA, 20 bp, Artificial
  CRISPR gRNA sequence
ctctcaaagcgctgtgatta

SEQ ID NO: 281287 - DNA, 20 bp, Artificial
  CRISPR gRNA sequence
tctcaaagcgctgtgattac

SEQ ID NO: 281288 - DNA, 20 bp, Artificial
  CRISPR gRNA sequence
agcgctgtgattacaggtgt

SEQ ID NO: 281289 - DNA, 20 bp, Artificial
  CRISPR gRNA sequence
caggtgtgagccactacacc

SEQ ID NO: 281290 - DNA, 20 bp, Artificial
  CRISPR gRNA sequence
caaaatttcatttttaaaaa

SEQ ID NO: 281291 - DNA, 20 bp, Artificial
  CRISPR gRNA sequence
aaaatttcatttttaaaaac

SEQ ID NO: 281292 - DNA, 20 bp, Artificial
  CRISPR gRNA sequence
ttcatttttaaaaacaggtg

SEQ ID NO: 281293 - DNA, 20 bp, Artificial
  CRISPR gRNA sequence
tcatttttaaaaacaggtgc

SEQ ID NO: 281294 - DNA, 20 bp, Artificial
  CRISPR gRNA sequence
ttttaaaaacaggtgcagga

SEQ ID NO: 281295 - DNA, 20 bp, Artificial
  CRISPR gRNA sequence
tttaaaaacaggtgcaggac

SEQ ID NO: 281296 - DNA, 20 bp, Artificial
  CRISPR gRNA sequence
aaacaggtgcaggacaggtt

SEQ ID NO: 281297 - DNA, 20 bp, Artificial
  CRISPR gRNA sequence
caggtttggcccatgtgcta

SEQ ID NO: 281298 - DNA, 20 bp, Artificial
  CRISPR gRNA sequence
gtgctatagtttgctaactt

SEQ ID NO: 281299 - DNA, 20 bp, Artificial
  CRISPR gRNA sequence
tgctatagtttgctaactta

SEQ ID NO: 281300 - DNA, 20 bp, Artificial
  CRISPR gRNA sequence
acttaaggtttttgtctttg

SEQ ID NO: 281301 - DNA, 20 bp, Artificial
  CRISPR gRNA sequence
aaggtttttgtctttgtggc

SEQ ID NO: 281302 - DNA, 20 bp, Artificial
  CRISPR gRNA sequence
ggtttttgtctttgtggctg

SEQ ID NO: 281303 - DNA, 20 bp, Artificial
  CRISPR gRNA sequence
tttttgtctttgtggctgga

SEQ ID NO: 281304 - DNA, 20 bp, Artificial
  CRISPR gRNA sequence
tctttgtggctggagagctt

SEQ ID NO: 281305 - DNA, 20 bp, Artificial
  CRISPR gRNA sequence
ctttgtggctggagagcttt

SEQ ID NO: 281306 - DNA, 20 bp, Artificial
  CRISPR gRNA sequence
tttgtggctggagagcttta

SEQ ID NO: 281307 - DNA, 20 bp, Artificial
  CRISPR gRNA sequence
atgtctcaaatctcattaat

SEQ ID NO: 281308 - DNA, 20 bp, Artificial
  CRISPR gRNA sequence
atctcattaattggactgtg

SEQ ID NO: 281309 - DNA, 20 bp, Artificial
  CRISPR gRNA sequence
tctcattaattggactgtgt

SEQ ID NO: 281310 - DNA, 20 bp, Artificial
  CRISPR gRNA sequence
ctcattaattggactgtgtg

SEQ ID NO: 281311 - DNA, 20 bp, Artificial
  CRISPR gRNA sequence
tggactgtgtggggattctt

SEQ ID NO: 281312 - DNA, 20 bp, Artificial
  CRISPR gRNA sequence
gtgtggggattctttagaat

SEQ ID NO: 281313 - DNA, 20 bp, Artificial
  CRISPR gRNA sequence
ttctttagaataagattcaa

SEQ ID NO: 281314 - DNA, 20 bp, Artificial
  CRISPR gRNA sequence
aaaagcaaataatgcattta

SEQ ID NO: 281315 - DNA, 20 bp, Artificial
  CRISPR gRNA sequence
aaagcaaataatgcatttat

SEQ ID NO: 281316 - DNA, 20 bp, Artificial
  CRISPR gRNA sequence
agcaaataatgcatttatag

SEQ ID NO: 281317 - DNA, 20 bp, Artificial
  CRISPR gRNA sequence
gcaaataatgcatttatagg

SEQ ID NO: 281318 - DNA, 20 bp, Artificial
  CRISPR gRNA sequence
taatgcatttataggaggtc

SEQ ID NO: 281319 - DNA, 20 bp, Artificial
  CRISPR gRNA sequence
aatgcatttataggaggtca

SEQ ID NO: 281320 - DNA, 20 bp, Artificial
  CRISPR gRNA sequence
atgcatttataggaggtcaa

SEQ ID NO: 281321 - DNA, 20 bp, Artificial
  CRISPR gRNA sequence
tgcactaacaaatatacatt

SEQ ID NO: 281322 - DNA, 20 bp, Artificial
  CRISPR gRNA sequence
acaaatatacattaagtgta

SEQ ID NO: 281323 - DNA, 20 bp, Artificial
  CRISPR gRNA sequence
tacattaagtgtatagtaca

SEQ ID NO: 281324 - DNA, 20 bp, Artificial
  CRISPR gRNA sequence
tatagtacatagaaatgtta

SEQ ID NO: 281325 - DNA, 20 bp, Artificial
  CRISPR gRNA sequence
atagtacatagaaatgttac

SEQ ID NO: 281326 - DNA, 20 bp, Artificial
  CRISPR gRNA sequence
tacatagaaatgttacaggt

SEQ ID NO: 281327 - DNA, 20 bp, Artificial
  CRISPR gRNA sequence
acatagaaatgttacaggtc

SEQ ID NO: 281328 - DNA, 20 bp, Artificial
  CRISPR gRNA sequence
catagaaatgttacaggtca

SEQ ID NO: 281329 - DNA, 20 bp, Artificial
  CRISPR gRNA sequence
gaaatgttacaggtcagggt

SEQ ID NO: 281330 - DNA, 20 bp, Artificial
  CRISPR gRNA sequence
gttacaggtcagggtgagta

SEQ ID NO: 281331 - DNA, 20 bp, Artificial
  CRISPR gRNA sequence
gtcagggtgagtaaagcttt

SEQ ID NO: 281332 - DNA, 20 bp, Artificial
  CRISPR gRNA sequence
tcagggtgagtaaagctttg

SEQ ID NO: 281333 - DNA, 20 bp, Artificial
  CRISPR gRNA sequence
gctttgaggtgaaaatgtat

SEQ ID NO: 281334 - DNA, 20 bp, Artificial
  CRISPR gRNA sequence
cccttttcatgctgctgata

SEQ ID NO: 281335 - DNA, 20 bp, Artificial
  CRISPR gRNA sequence
ctgctgataaagacataccc

SEQ ID NO: 281336 - DNA, 20 bp, Artificial
  CRISPR gRNA sequence
gataaagacatacccgagac

SEQ ID NO: 281337 - DNA, 20 bp, Artificial
  CRISPR gRNA sequence
ataaagacatacccgagact

SEQ ID NO: 281338 - DNA, 20 bp, Artificial
  CRISPR gRNA sequence
actgggcaacttacaaaata

SEQ ID NO: 281339 - DNA, 20 bp, Artificial
  CRISPR gRNA sequence
tgggcaacttacaaaataaa

SEQ ID NO: 281340 - DNA, 20 bp, Artificial
  CRISPR gRNA sequence
gggcaacttacaaaataaag

SEQ ID NO: 281341 - DNA, 20 bp, Artificial
  CRISPR gRNA sequence
acaaaataaagaggtttaat

SEQ ID NO: 281342 - DNA, 20 bp, Artificial
  CRISPR gRNA sequence
aagaggtttaattagactca

SEQ ID NO: 281343 - DNA, 20 bp, Artificial
  CRISPR gRNA sequence
attagactcacagttccacg

SEQ ID NO: 281344 - DNA, 20 bp, Artificial
  CRISPR gRNA sequence
gactcacagttccacgtggc

SEQ ID NO: 281345 - DNA, 20 bp, Artificial
  CRISPR gRNA sequence
actcacagttccacgtggct

SEQ ID NO: 281346 - DNA, 20 bp, Artificial
  CRISPR gRNA sequence
ctcacagttccacgtggctg

SEQ ID NO: 281347 - DNA, 20 bp, Artificial
  CRISPR gRNA sequence
cacagttccacgtggctggg

SEQ ID NO: 281348 - DNA, 20 bp, Artificial
  CRISPR gRNA sequence
acagttccacgtggctgggg

SEQ ID NO: 281349 - DNA, 20 bp, Artificial
  CRISPR gRNA sequence
tggggaggcctcacaaatca

SEQ ID NO: 281350 - DNA, 20 bp, Artificial
  CRISPR gRNA sequence
ggaggcctcacaaatcatgg

SEQ ID NO: 281351 - DNA, 20 bp, Artificial
  CRISPR gRNA sequence
ggcctcacaaatcatggcag

SEQ ID NO: 281352 - DNA, 20 bp, Artificial
  CRISPR gRNA sequence
gcctcacaaatcatggcaga

SEQ ID NO: 281353 - DNA, 20 bp, Artificial
  CRISPR gRNA sequence
cacaaatcatggcagaaggc

SEQ ID NO: 281354 - DNA, 20 bp, Artificial
  CRISPR gRNA sequence
acaaatcatggcagaaggca

SEQ ID NO: 281355 - DNA, 20 bp, Artificial
  CRISPR gRNA sequence
aaatcatggcagaaggcaag

SEQ ID NO: 281356 - DNA, 20 bp, Artificial
  CRISPR gRNA sequence
aatcatggcagaaggcaagg

SEQ ID NO: 281357 - DNA, 20 bp, Artificial
  CRISPR gRNA sequence
tcatggcagaaggcaaggag

SEQ ID NO: 281358 - DNA, 20 bp, Artificial
  CRISPR gRNA sequence
ggcagaaggcaaggaggagc

SEQ ID NO: 281359 - DNA, 20 bp, Artificial
  CRISPR gRNA sequence
ggagcaagtcatgtcttatg

SEQ ID NO: 281360 - DNA, 20 bp, Artificial
  CRISPR gRNA sequence
caagtcatgtcttatgtgga

SEQ ID NO: 281361 - DNA, 20 bp, Artificial
  CRISPR gRNA sequence
gtcatgtcttatgtggatgg

SEQ ID NO: 281362 - DNA, 20 bp, Artificial
  CRISPR gRNA sequence
atgtcttatgtggatggcag

SEQ ID NO: 281363 - DNA, 20 bp, Artificial
  CRISPR gRNA sequence
tgtggatggcagcagccaaa

SEQ ID NO: 281364 - DNA, 20 bp, Artificial
  CRISPR gRNA sequence
tggatggcagcagccaaaaa

SEQ ID NO: 281365 - DNA, 20 bp, Artificial
  CRISPR gRNA sequence
gatggcagcagccaaaaaga

SEQ ID NO: 281366 - DNA, 20 bp, Artificial
  CRISPR gRNA sequence
ccaaaaagagagcttgttat

SEQ ID NO: 281367 - DNA, 20 bp, Artificial
  CRISPR gRNA sequence
caaaaagagagcttgttata

SEQ ID NO: 281368 - DNA, 20 bp, Artificial
  CRISPR gRNA sequence
aactcctgtttttaaactat

SEQ ID NO: 281369 - DNA, 20 bp, Artificial
  CRISPR gRNA sequence
tttaaactatcagatctcgt

SEQ ID NO: 281370 - DNA, 20 bp, Artificial
  CRISPR gRNA sequence
tgagactcattaactatcac

SEQ ID NO: 281371 - DNA, 20 bp, Artificial
  CRISPR gRNA sequence
gagactcattaactatcaca

SEQ ID NO: 281372 - DNA, 20 bp, Artificial
  CRISPR gRNA sequence
ctcattaactatcacaagga

SEQ ID NO: 281373 - DNA, 20 bp, Artificial
  CRISPR gRNA sequence
taactatcacaaggacagtg

SEQ ID NO: 281374 - DNA, 20 bp, Artificial
  CRISPR gRNA sequence
aactatcacaaggacagtgc

SEQ ID NO: 281375 - DNA, 20 bp, Artificial
  CRISPR gRNA sequence
atcacaaggacagtgcagga

SEQ ID NO: 281376 - DNA, 20 bp, Artificial
  CRISPR gRNA sequence
aaagactcgcccccataatt

SEQ ID NO: 281377 - DNA, 20 bp, Artificial
  CRISPR gRNA sequence
ataattcagtcacctcccac

SEQ ID NO: 281378 - DNA, 20 bp, Artificial
  CRISPR gRNA sequence
taattcagtcacctcccact

SEQ ID NO: 281379 - DNA, 20 bp, Artificial
  CRISPR gRNA sequence
tgggttcctcccatgacatg

SEQ ID NO: 281380 - DNA, 20 bp, Artificial
  CRISPR gRNA sequence
cccatgacatgtggcaactg

SEQ ID NO: 281381 - DNA, 20 bp, Artificial
  CRISPR gRNA sequence
ccatgacatgtggcaactgt

SEQ ID NO: 281382 - DNA, 20 bp, Artificial
  CRISPR gRNA sequence
atgacatgtggcaactgtgg

SEQ ID NO: 281383 - DNA, 20 bp, Artificial
  CRISPR gRNA sequence
aactgtgggagttataattc

SEQ ID NO: 281384 - DNA, 20 bp, Artificial
  CRISPR gRNA sequence
tgggagttataattcaagat

SEQ ID NO: 281385 - DNA, 20 bp, Artificial
  CRISPR gRNA sequence
ttataattcaagatgagatt

SEQ ID NO: 281386 - DNA, 20 bp, Artificial
  CRISPR gRNA sequence
tataattcaagatgagattt

SEQ ID NO: 281387 - DNA, 20 bp, Artificial
  CRISPR gRNA sequence
aattcaagatgagatttggg

SEQ ID NO: 281388 - DNA, 20 bp, Artificial
  CRISPR gRNA sequence
attcaagatgagatttgggt

SEQ ID NO: 281389 - DNA, 20 bp, Artificial
  CRISPR gRNA sequence
ttcaagatgagatttgggtg

SEQ ID NO: 281390 - DNA, 20 bp, Artificial
  CRISPR gRNA sequence
atgagatttgggtggggaca

SEQ ID NO: 281391 - DNA, 20 bp, Artificial
  CRISPR gRNA sequence
gggacacagccaaaccatat

SEQ ID NO: 281392 - DNA, 20 bp, Artificial
  CRISPR gRNA sequence
atatcagtaaataactgatt

SEQ ID NO: 281393 - DNA, 20 bp, Artificial
  CRISPR gRNA sequence
ctgatttggaaaaaaaaaaa

SEQ ID NO: 281394 - DNA, 20 bp, Artificial
  CRISPR gRNA sequence
aaagcccaaatgtattaatt

SEQ ID NO: 281395 - DNA, 20 bp, Artificial
  CRISPR gRNA sequence
gcccaaatgtattaattaag

SEQ ID NO: 281396 - DNA, 20 bp, Artificial
  CRISPR gRNA sequence
attgcgcatatgattctttt

SEQ ID NO: 281397 - DNA, 20 bp, Artificial
  CRISPR gRNA sequence
gcatatgattctttttagtg

SEQ ID NO: 281398 - DNA, 20 bp, Artificial
  CRISPR gRNA sequence
tttgttttcccttgataaac

SEQ ID NO: 281399 - DNA, 20 bp, Artificial
  CRISPR gRNA sequence
gttttcccttgataaactgg

SEQ ID NO: 281400 - DNA, 20 bp, Artificial
  CRISPR gRNA sequence
ttttcccttgataaactgga

SEQ ID NO: 281401 - DNA, 20 bp, Artificial
  CRISPR gRNA sequence
ttcccttgataaactggaag

SEQ ID NO: 281402 - DNA, 20 bp, Artificial
  CRISPR gRNA sequence
aactggaaggagatacatct

SEQ ID NO: 281403 - DNA, 20 bp, Artificial
  CRISPR gRNA sequence
ctggaaggagatacatctga

SEQ ID NO: 281404 - DNA, 20 bp, Artificial
  CRISPR gRNA sequence
ggaaggagatacatctgaga

SEQ ID NO: 281405 - DNA, 20 bp, Artificial
  CRISPR gRNA sequence
atctgagagagtcatactca

SEQ ID NO: 281406 - DNA, 20 bp, Artificial
  CRISPR gRNA sequence
tcatactcatggtatctaat

SEQ ID NO: 281407 - DNA, 20 bp, Artificial
  CRISPR gRNA sequence
tatctaataagctacatgtg

SEQ ID NO: 281408 - DNA, 20 bp, Artificial
  CRISPR gRNA sequence
cctcacaccgctctgtacct

SEQ ID NO: 281409 - DNA, 20 bp, Artificial
  CRISPR gRNA sequence
ccgctctgtaccttggattc

SEQ ID NO: 281410 - DNA, 20 bp, Artificial
  CRISPR gRNA sequence
cgctctgtaccttggattct

SEQ ID NO: 281411 - DNA, 20 bp, Artificial
  CRISPR gRNA sequence
ggattctgggtctgcccctg

SEQ ID NO: 281412 - DNA, 20 bp, Artificial
  CRISPR gRNA sequence
gattctgggtctgcccctgt

SEQ ID NO: 281413 - DNA, 20 bp, Artificial
  CRISPR gRNA sequence
ctgcccctgtgggatgttac

SEQ ID NO: 281414 - DNA, 20 bp, Artificial
  CRISPR gRNA sequence
tgcccctgtgggatgttacc

SEQ ID NO: 281415 - DNA, 20 bp, Artificial
  CRISPR gRNA sequence
ggatgttaccaggtttctaa

SEQ ID NO: 281416 - DNA, 20 bp, Artificial
  CRISPR gRNA sequence
gatgttaccaggtttctaac

SEQ ID NO: 281417 - DNA, 20 bp, Artificial
  CRISPR gRNA sequence
gtttctaacaggtgtcacaa

SEQ ID NO: 281418 - DNA, 20 bp, Artificial
  CRISPR gRNA sequence
aacaggtgtcacaatagacc

SEQ ID NO: 281419 - DNA, 20 bp, Artificial
  CRISPR gRNA sequence
agacctggcttgctgctact

SEQ ID NO: 281420 - DNA, 20 bp, Artificial
  CRISPR gRNA sequence
gacctggcttgctgctactg

SEQ ID NO: 281421 - DNA, 20 bp, Artificial
  CRISPR gRNA sequence
cctcacacacatactctctc

SEQ ID NO: 281422 - DNA, 20 bp, Artificial
  CRISPR gRNA sequence
ctcacacacatactctctct

SEQ ID NO: 281423 - DNA, 20 bp, Artificial
  CRISPR gRNA sequence
atactctctctaggttgaat

SEQ ID NO: 281424 - DNA, 20 bp, Artificial
  CRISPR gRNA sequence
tactctctctaggttgaatg

SEQ ID NO: 281425 - DNA, 20 bp, Artificial
  CRISPR gRNA sequence
tctaggttgaatgaggcttg

SEQ ID NO: 281426 - DNA, 20 bp, Artificial
  CRISPR gRNA sequence
ggttgaatgaggcttgtgga

SEQ ID NO: 281427 - DNA, 20 bp, Artificial
  CRISPR gRNA sequence
gttgaatgaggcttgtggat

SEQ ID NO: 281428 - DNA, 20 bp, Artificial
  CRISPR gRNA sequence
atgaggcttgtggatgggtg

SEQ ID NO: 281429 - DNA, 20 bp, Artificial
  CRISPR gRNA sequence
gaggcttgtggatgggtgtg

SEQ ID NO: 281430 - DNA, 20 bp, Artificial
  CRISPR gRNA sequence
gcttgtggatgggtgtggag

SEQ ID NO: 281431 - DNA, 20 bp, Artificial
  CRISPR gRNA sequence
tgtggatgggtgtggagtgg

SEQ ID NO: 281432 - DNA, 20 bp, Artificial
  CRISPR gRNA sequence
gatgggtgtggagtggaagc

SEQ ID NO: 281433 - DNA, 20 bp, Artificial
  CRISPR gRNA sequence
atgggtgtggagtggaagcc

SEQ ID NO: 281434 - DNA, 20 bp, Artificial
  CRISPR gRNA sequence
gtggagtggaagccaggaat

SEQ ID NO: 281435 - DNA, 20 bp, Artificial
  CRISPR gRNA sequence
tggaagccaggaatgagctg

SEQ ID NO: 281436 - DNA, 20 bp, Artificial
  CRISPR gRNA sequence
gctgaagcctgtgaaacttc

SEQ ID NO: 281437 - DNA, 20 bp, Artificial
  CRISPR gRNA sequence
ctgtgaaacttctagactcc

SEQ ID NO: 281438 - DNA, 20 bp, Artificial
  CRISPR gRNA sequence
tgtgaaacttctagactccc

SEQ ID NO: 281439 - DNA, 20 bp, Artificial
  CRISPR gRNA sequence
cttctagactcccaggataa

SEQ ID NO: 281440 - DNA, 20 bp, Artificial
  CRISPR gRNA sequence
gactcccaggataacagcaa

SEQ ID NO: 281441 - DNA, 20 bp, Artificial
  CRISPR gRNA sequence
ttttgtgtcattctaatctg

SEQ ID NO: 281442 - DNA, 20 bp, Artificial
  CRISPR gRNA sequence
ttgtgtcattctaatctgta

SEQ ID NO: 281443 - DNA, 20 bp, Artificial
  CRISPR gRNA sequence
tgtgtcattctaatctgtag

SEQ ID NO: 281444 - DNA, 20 bp, Artificial
  CRISPR gRNA sequence
taatctgtagaggtcaactc

SEQ ID NO: 281445 - DNA, 20 bp, Artificial
  CRISPR gRNA sequence
cttgatgtctccattcaatc

SEQ ID NO: 281446 - DNA, 20 bp, Artificial
  CRISPR gRNA sequence
ctccattcaatctggtgttt

SEQ ID NO: 281447 - DNA, 20 bp, Artificial
  CRISPR gRNA sequence
ccattcaatctggtgtttta

SEQ ID NO: 281448 - DNA, 20 bp, Artificial
  CRISPR gRNA sequence
atctggtgttttagagaaaa

SEQ ID NO: 281449 - DNA, 20 bp, Artificial
  CRISPR gRNA sequence
aaaccaactatcctgtcttt

SEQ ID NO: 281450 - DNA, 20 bp, Artificial
  CRISPR gRNA sequence
ccaactatcctgtctttaag

SEQ ID NO: 281451 - DNA, 20 bp, Artificial
  CRISPR gRNA sequence
actatcctgtctttaagtgg

SEQ ID NO: 281452 - DNA, 20 bp, Artificial
  CRISPR gRNA sequence
ctatcctgtctttaagtggt

SEQ ID NO: 281453 - DNA, 20 bp, Artificial
  CRISPR gRNA sequence
gtaggtacactatgattaaa

SEQ ID NO: 281454 - DNA, 20 bp, Artificial
  CRISPR gRNA sequence
taggtacactatgattaaat

SEQ ID NO: 281455 - DNA, 20 bp, Artificial
  CRISPR gRNA sequence
ctatgattaaataggtgttt

SEQ ID NO: 281456 - DNA, 20 bp, Artificial
  CRISPR gRNA sequence
tttcagaatgattactgtga

SEQ ID NO: 281457 - DNA, 20 bp, Artificial
  CRISPR gRNA sequence
attactgtgacagcaatgtg

SEQ ID NO: 281458 - DNA, 20 bp, Artificial
  CRISPR gRNA sequence
ttactgtgacagcaatgtgc

SEQ ID NO: 281459 - DNA, 20 bp, Artificial
  CRISPR gRNA sequence
actgtgacagcaatgtgcag

SEQ ID NO: 281460 - DNA, 20 bp, Artificial
  CRISPR gRNA sequence
cagcaatgtgcaggagttat

SEQ ID NO: 281461 - DNA, 20 bp, Artificial
  CRISPR gRNA sequence
gcaatgtgcaggagttatta

SEQ ID NO: 281462 - DNA, 20 bp, Artificial
  CRISPR gRNA sequence
gtgcaggagttattagagcc

SEQ ID NO: 281463 - DNA, 20 bp, Artificial
  CRISPR gRNA sequence
tgcaggagttattagagcct

SEQ ID NO: 281464 - DNA, 20 bp, Artificial
  CRISPR gRNA sequence
tattagagcctaggaaacct

SEQ ID NO: 281465 - DNA, 20 bp, Artificial
  CRISPR gRNA sequence
attagagcctaggaaacctg

SEQ ID NO: 281466 - DNA, 20 bp, Artificial
  CRISPR gRNA sequence
agcctaggaaacctgaggca

SEQ ID NO: 281467 - DNA, 20 bp, Artificial
  CRISPR gRNA sequence
cctaggaaacctgaggcaaa

SEQ ID NO: 281468 - DNA, 20 bp, Artificial
  CRISPR gRNA sequence
gaaacctgaggcaaagagac

SEQ ID NO: 281469 - DNA, 20 bp, Artificial
  CRISPR gRNA sequence
gaggcaaagagaccggtttg

SEQ ID NO: 281470 - DNA, 20 bp, Artificial
  CRISPR gRNA sequence
aggcaaagagaccggtttgc

SEQ ID NO: 281471 - DNA, 20 bp, Artificial
  CRISPR gRNA sequence
gagaccggtttgcaggctac

SEQ ID NO: 281472 - DNA, 20 bp, Artificial
  CRISPR gRNA sequence
agaccggtttgcaggctact

SEQ ID NO: 281473 - DNA, 20 bp, Artificial
  CRISPR gRNA sequence
ccggtttgcaggctactagg

SEQ ID NO: 281474 - DNA, 20 bp, Artificial
  CRISPR gRNA sequence
cggtttgcaggctactaggt

SEQ ID NO: 281475 - DNA, 20 bp, Artificial
  CRISPR gRNA sequence
gtttgcaggctactaggtgg

SEQ ID NO: 281476 - DNA, 20 bp, Artificial
  CRISPR gRNA sequence
caggctactaggtgggagat

SEQ ID NO: 281477 - DNA, 20 bp, Artificial
  CRISPR gRNA sequence
gtgggagatgagaaaaatct

SEQ ID NO: 281478 - DNA, 20 bp, Artificial
  CRISPR gRNA sequence
agatgagaaaaatctcagct

SEQ ID NO: 281479 - DNA, 20 bp, Artificial
  CRISPR gRNA sequence
gatgagaaaaatctcagcta

SEQ ID NO: 281480 - DNA, 20 bp, Artificial
  CRISPR gRNA sequence
gagaaaaatctcagctaagg

SEQ ID NO: 281481 - DNA, 20 bp, Artificial
  CRISPR gRNA sequence
tcagctaaggcagttgctgc

SEQ ID NO: 281482 - DNA, 20 bp, Artificial
  CRISPR gRNA sequence
agctaaggcagttgctgcaa

SEQ ID NO: 281483 - DNA, 20 bp, Artificial
  CRISPR gRNA sequence
ggcagttgctgcaagagatt

SEQ ID NO: 281484 - DNA, 20 bp, Artificial
  CRISPR gRNA sequence
gcagttgctgcaagagattt

SEQ ID NO: 281485 - DNA, 20 bp, Artificial
  CRISPR gRNA sequence
gctgcaagagatttgggaaa

SEQ ID NO: 281486 - DNA, 20 bp, Artificial
  CRISPR gRNA sequence
gcaagagatttgggaaaaag

SEQ ID NO: 281487 - DNA, 20 bp, Artificial
  CRISPR gRNA sequence
gagatttgggaaaaagcagt

SEQ ID NO: 281488 - DNA, 20 bp, Artificial
  CRISPR gRNA sequence
tgggaaaaagcagtaagttc

SEQ ID NO: 281489 - DNA, 20 bp, Artificial
  CRISPR gRNA sequence
ggaaaaagcagtaagttcca

SEQ ID NO: 281490 - DNA, 20 bp, Artificial
  CRISPR gRNA sequence
ttccagagatattctgaata

SEQ ID NO: 281491 - DNA, 20 bp, Artificial
  CRISPR gRNA sequence
gagatattctgaatatagaa

SEQ ID NO: 281492 - DNA, 20 bp, Artificial
  CRISPR gRNA sequence
aatatagaacagaaaataca

SEQ ID NO: 281493 - DNA, 20 bp, Artificial
  CRISPR gRNA sequence
atatagaacagaaaatacat

SEQ ID NO: 281494 - DNA, 20 bp, Artificial
  CRISPR gRNA sequence
atagaacagaaaatacatgg

SEQ ID NO: 281495 - DNA, 20 bp, Artificial
  CRISPR gRNA sequence
gaaaatacatgggagcctac

SEQ ID NO: 281496 - DNA, 20 bp, Artificial
  CRISPR gRNA sequence
aaaatacatgggagcctact

SEQ ID NO: 281497 - DNA, 20 bp, Artificial
  CRISPR gRNA sequence
atacatgggagcctactggg

SEQ ID NO: 281498 - DNA, 20 bp, Artificial
  CRISPR gRNA sequence
atgggagcctactgggaagt

SEQ ID NO: 281499 - DNA, 20 bp, Artificial
  CRISPR gRNA sequence
cctactgggaagtgagcaca

SEQ ID NO: 281500 - DNA, 20 bp, Artificial
  CRISPR gRNA sequence
gaaaataccacactcttatt

SEQ ID NO: 281501 - DNA, 20 bp, Artificial
  CRISPR gRNA sequence
aaaataccacactcttattt

SEQ ID NO: 281502 - DNA, 20 bp, Artificial
  CRISPR gRNA sequence
ctcttatttgggtaactaaa

SEQ ID NO: 281503 - DNA, 20 bp, Artificial
  CRISPR gRNA sequence
ggtattgttattcactgaaa

SEQ ID NO: 281504 - DNA, 20 bp, Artificial
  CRISPR gRNA sequence
gtattgttattcactgaaat

SEQ ID NO: 281505 - DNA, 20 bp, Artificial
  CRISPR gRNA sequence
attgttattcactgaaatgg

SEQ ID NO: 281506 - DNA, 20 bp, Artificial
  CRISPR gRNA sequence
ttcactgaaatgggagaata

SEQ ID NO: 281507 - DNA, 20 bp, Artificial
  CRISPR gRNA sequence
ctgaaatgggagaatacagc

SEQ ID NO: 281508 - DNA, 20 bp, Artificial
  CRISPR gRNA sequence
aaatgggagaatacagctgg

SEQ ID NO: 281509 - DNA, 20 bp, Artificial
  CRISPR gRNA sequence
tacagctggtagatatgatt

SEQ ID NO: 281510 - DNA, 20 bp, Artificial
  CRISPR gRNA sequence
gctggtagatatgatttgga

SEQ ID NO: 281511 - DNA, 20 bp, Artificial
  CRISPR gRNA sequence
ggtagatatgatttggaaag

SEQ ID NO: 281512 - DNA, 20 bp, Artificial
  CRISPR gRNA sequence
gtagatatgatttggaaagc

SEQ ID NO: 281513 - DNA, 20 bp, Artificial
  CRISPR gRNA sequence
gatatgatttggaaagcagg

SEQ ID NO: 281514 - DNA, 20 bp, Artificial
  CRISPR gRNA sequence
tggaaagcaggtagtaaatt

SEQ ID NO: 281515 - DNA, 20 bp, Artificial
  CRISPR gRNA sequence
gtagtaaattcagttttaat

SEQ ID NO: 281516 - DNA, 20 bp, Artificial
  CRISPR gRNA sequence
tagtaaattcagttttaatc

SEQ ID NO: 281517 - DNA, 20 bp, Artificial
  CRISPR gRNA sequence
taaattcagttttaatcagg

SEQ ID NO: 281518 - DNA, 20 bp, Artificial
  CRISPR gRNA sequence
aattcagttttaatcaggtg

SEQ ID NO: 281519 - DNA, 20 bp, Artificial
  CRISPR gRNA sequence
ttttaatcaggtggagatgc

SEQ ID NO: 281520 - DNA, 20 bp, Artificial
  CRISPR gRNA sequence
atccatccaatatacaaatt

SEQ ID NO: 281521 - DNA, 20 bp, Artificial
  CRISPR gRNA sequence
caatatacaaatttagaaat

SEQ ID NO: 281522 - DNA, 20 bp, Artificial
  CRISPR gRNA sequence
atacaaatttagaaatcaga

SEQ ID NO: 281523 - DNA, 20 bp, Artificial
  CRISPR gRNA sequence
ttttttctttgtctttttct

SEQ ID NO: 281524 - DNA, 20 bp, Artificial
  CRISPR gRNA sequence
ttctttgtctttttctgaga

SEQ ID NO: 281525 - DNA, 20 bp, Artificial
  CRISPR gRNA sequence
tagattctcactctgtcacc

SEQ ID NO: 281526 - DNA, 20 bp, Artificial
  CRISPR gRNA sequence
agattctcactctgtcaccc

SEQ ID NO: 281527 - DNA, 20 bp, Artificial
  CRISPR gRNA sequence
tctcactctgtcacccaggc

SEQ ID NO: 281528 - DNA, 20 bp, Artificial
  CRISPR gRNA sequence
tcactctgtcacccaggctg

SEQ ID NO: 281529 - DNA, 20 bp, Artificial
  CRISPR gRNA sequence
cccaggctggagtgcaatct

SEQ ID NO: 281530 - DNA, 20 bp, Artificial
  CRISPR gRNA sequence
cattgcaacctctgtctccc

SEQ ID NO: 281531 - DNA, 20 bp, Artificial
  CRISPR gRNA sequence
aacctctgtctccctggttc

SEQ ID NO: 281532 - DNA, 20 bp, Artificial
  CRISPR gRNA sequence
ttcaagcaattctcttgctt

SEQ ID NO: 281533 - DNA, 20 bp, Artificial
  CRISPR gRNA sequence
ttctcttgcttcagcctcct

SEQ ID NO: 281534 - DNA, 20 bp, Artificial
  CRISPR gRNA sequence
gcttcagcctcctgagtacc

SEQ ID NO: 281535 - DNA, 20 bp, Artificial
  CRISPR gRNA sequence
cttcagcctcctgagtacct

SEQ ID NO: 281536 - DNA, 20 bp, Artificial
  CRISPR gRNA sequence
gcctcctgagtacctgggat

SEQ ID NO: 281537 - DNA, 20 bp, Artificial
  CRISPR gRNA sequence
ccgataattttttgtacttt

SEQ ID NO: 281538 - DNA, 20 bp, Artificial
  CRISPR gRNA sequence
ataattttttgtacttttag

SEQ ID NO: 281539 - DNA, 20 bp, Artificial
  CRISPR gRNA sequence
aattttttgtacttttagta

SEQ ID NO: 281540 - DNA, 20 bp, Artificial
  CRISPR gRNA sequence
ttttgtacttttagtagaga

SEQ ID NO: 281541 - DNA, 20 bp, Artificial
  CRISPR gRNA sequence
tttgtacttttagtagagac

SEQ ID NO: 281542 - DNA, 20 bp, Artificial
  CRISPR gRNA sequence
ttgtacttttagtagagaca

SEQ ID NO: 281543 - DNA, 20 bp, Artificial
  CRISPR gRNA sequence
gagacagggtttcactatgt

SEQ ID NO: 281544 - DNA, 20 bp, Artificial
  CRISPR gRNA sequence
cagggtttcactatgttggc

SEQ ID NO: 281545 - DNA, 20 bp, Artificial
  CRISPR gRNA sequence
agggtttcactatgttggcc

SEQ ID NO: 281546 - DNA, 20 bp, Artificial
  CRISPR gRNA sequence
tttcactatgttggccaggc

SEQ ID NO: 281547 - DNA, 20 bp, Artificial
  CRISPR gRNA sequence
tggtctcgaactcctgacct

SEQ ID NO: 281548 - DNA, 20 bp, Artificial
  CRISPR gRNA sequence
ggtctcgaactcctgacctc

SEQ ID NO: 281549 - DNA, 20 bp, Artificial
  CRISPR gRNA sequence
ctcaggtgatctgcccacct

SEQ ID NO: 281550 - DNA, 20 bp, Artificial
  CRISPR gRNA sequence
ctgcccaccttggcctccca

SEQ ID NO: 281551 - DNA, 20 bp, Artificial
  CRISPR gRNA sequence
accttggcctcccaaagtgc

SEQ ID NO: 281552 - DNA, 20 bp, Artificial
  CRISPR gRNA sequence
ctcccaaagtgccagaatta

SEQ ID NO: 281553 - DNA, 20 bp, Artificial
  CRISPR gRNA sequence
tcccaaagtgccagaattac

SEQ ID NO: 281554 - DNA, 20 bp, Artificial
  CRISPR gRNA sequence
agtgccagaattacaggtgt

SEQ ID NO: 281555 - DNA, 20 bp, Artificial
  CRISPR gRNA sequence
caggtgtgagccactgtgcc

SEQ ID NO: 281556 - DNA, 20 bp, Artificial
  CRISPR gRNA sequence
tgagccactgtgcccagcct

SEQ ID NO: 281557 - DNA, 20 bp, Artificial
  CRISPR gRNA sequence
ccactgtgcccagcctcaga

SEQ ID NO: 281558 - DNA, 20 bp, Artificial
  CRISPR gRNA sequence
tcagatggcatttcaaatct

SEQ ID NO: 281559 - DNA, 20 bp, Artificial
  CRISPR gRNA sequence
cagatggcatttcaaatctc

SEQ ID NO: 281560 - DNA, 20 bp, Artificial
  CRISPR gRNA sequence
ggcatttcaaatctcaggtg

SEQ ID NO: 281561 - DNA, 20 bp, Artificial
  CRISPR gRNA sequence
catttcaaatctcaggtgtg

SEQ ID NO: 281562 - DNA, 20 bp, Artificial
  CRISPR gRNA sequence
atttcaaatctcaggtgtgg

SEQ ID NO: 281563 - DNA, 20 bp, Artificial
  CRISPR gRNA sequence
caggtgtggaggatattacc

SEQ ID NO: 281564 - DNA, 20 bp, Artificial
  CRISPR gRNA sequence
aggtgtggaggatattaccc

SEQ ID NO: 281565 - DNA, 20 bp, Artificial
  CRISPR gRNA sequence
tgtggaggatattacccagg

SEQ ID NO: 281566 - DNA, 20 bp, Artificial
  CRISPR gRNA sequence
aggatattacccaggaagac

SEQ ID NO: 281567 - DNA, 20 bp, Artificial
  CRISPR gRNA sequence
ggatattacccaggaagact

SEQ ID NO: 281568 - DNA, 20 bp, Artificial
  CRISPR gRNA sequence
gatattacccaggaagactg

SEQ ID NO: 281569 - DNA, 20 bp, Artificial
  CRISPR gRNA sequence
ttacccaggaagactggggc

SEQ ID NO: 281570 - DNA, 20 bp, Artificial
  CRISPR gRNA sequence
ccaggaagactggggccagt

SEQ ID NO: 281571 - DNA, 20 bp, Artificial
  CRISPR gRNA sequence
caggaagactggggccagta

SEQ ID NO: 281572 - DNA, 20 bp, Artificial
  CRISPR gRNA sequence
aggaagactggggccagtaa

SEQ ID NO: 281573 - DNA, 20 bp, Artificial
  CRISPR gRNA sequence
tggggccagtaagggcaaaa

SEQ ID NO: 281574 - DNA, 20 bp, Artificial
  CRISPR gRNA sequence
ggggccagtaagggcaaaat

SEQ ID NO: 281575 - DNA, 20 bp, Artificial
  CRISPR gRNA sequence
gggcaaaatgggaccacaaa

SEQ ID NO: 281576 - DNA, 20 bp, Artificial
  CRISPR gRNA sequence
tgggaccacaaacagaacca

SEQ ID NO: 281577 - DNA, 20 bp, Artificial
  CRISPR gRNA sequence
gggaccacaaacagaaccat

SEQ ID NO: 281578 - DNA, 20 bp, Artificial
  CRISPR gRNA sequence
accatgggaacaacaataat

SEQ ID NO: 281579 - DNA, 20 bp, Artificial
  CRISPR gRNA sequence
catgggaacaacaataatta

SEQ ID NO: 281580 - DNA, 20 bp, Artificial
  CRISPR gRNA sequence
atgggaacaacaataattag

SEQ ID NO: 281581 - DNA, 20 bp, Artificial
  CRISPR gRNA sequence
aacaacaataattagaggac

SEQ ID NO: 281582 - DNA, 20 bp, Artificial
  CRISPR gRNA sequence
aacaataattagaggacaag

SEQ ID NO: 281583 - DNA, 20 bp, Artificial
  CRISPR gRNA sequence
caataattagaggacaagaa

SEQ ID NO: 281584 - DNA, 20 bp, Artificial
  CRISPR gRNA sequence
aataattagaggacaagaag

SEQ ID NO: 281585 - DNA, 20 bp, Artificial
  CRISPR gRNA sequence
aattagaggacaagaagagg

SEQ ID NO: 281586 - DNA, 20 bp, Artificial
  CRISPR gRNA sequence
gaggacaagaagaggaagaa

SEQ ID NO: 281587 - DNA, 20 bp, Artificial
  CRISPR gRNA sequence
agaagaggaagaaaagcctt

SEQ ID NO: 281588 - DNA, 20 bp, Artificial
  CRISPR gRNA sequence
aagaggaagaaaagccttca

SEQ ID NO: 281589 - DNA, 20 bp, Artificial
  CRISPR gRNA sequence
agaaaagccttcagagaaaa

SEQ ID NO: 281590 - DNA, 20 bp, Artificial
  CRISPR gRNA sequence
aaaagccttcagagaaaacg

SEQ ID NO: 281591 - DNA, 20 bp, Artificial
  CRISPR gRNA sequence
agaaaacggagtgcaacaaa

SEQ ID NO: 281592 - DNA, 20 bp, Artificial
  CRISPR gRNA sequence
cggagtgcaacaaacagaaa

SEQ ID NO: 281593 - DNA, 20 bp, Artificial
  CRISPR gRNA sequence
agtgcaacaaacagaaacag

SEQ ID NO: 281594 - DNA, 20 bp, Artificial
  CRISPR gRNA sequence
gtgcaacaaacagaaacaga

SEQ ID NO: 281595 - DNA, 20 bp, Artificial
  CRISPR gRNA sequence
caaacagaaacagaaggatg

SEQ ID NO: 281596 - DNA, 20 bp, Artificial
  CRISPR gRNA sequence
aacagaaggatgtggtgtca

SEQ ID NO: 281597 - DNA, 20 bp, Artificial
  CRISPR gRNA sequence
agaaggatgtggtgtcacag

SEQ ID NO: 281598 - DNA, 20 bp, Artificial
  CRISPR gRNA sequence
atgtggtgtcacagaagtcc

SEQ ID NO: 281599 - DNA, 20 bp, Artificial
  CRISPR gRNA sequence
tggtgtcacagaagtccaag

SEQ ID NO: 281600 - DNA, 20 bp, Artificial
  CRISPR gRNA sequence
ggtgtcacagaagtccaaga

SEQ ID NO: 281601 - DNA, 20 bp, Artificial
  CRISPR gRNA sequence
tgtcacagaagtccaagaag

SEQ ID NO: 281602 - DNA, 20 bp, Artificial
  CRISPR gRNA sequence
cacagaagtccaagaaggag

SEQ ID NO: 281603 - DNA, 20 bp, Artificial
  CRISPR gRNA sequence
aagaaggagaagattccaac

SEQ ID NO: 281604 - DNA, 20 bp, Artificial
  CRISPR gRNA sequence
ccaactggctaaatgctgat

SEQ ID NO: 281605 - DNA, 20 bp, Artificial
  CRISPR gRNA sequence
actggctaaatgctgatgag

SEQ ID NO: 281606 - DNA, 20 bp, Artificial
  CRISPR gRNA sequence
atgctgatgagaagtccaat

SEQ ID NO: 281607 - DNA, 20 bp, Artificial
  CRISPR gRNA sequence
atgagaagtccaataagcaa

SEQ ID NO: 281608 - DNA, 20 bp, Artificial
  CRISPR gRNA sequence
aataagcaaaagaataaaac

SEQ ID NO: 281609 - DNA, 20 bp, Artificial
  CRISPR gRNA sequence
ataagcaaaagaataaaact

SEQ ID NO: 281610 - DNA, 20 bp, Artificial
  CRISPR gRNA sequence
gcaaaagaataaaactaggc

SEQ ID NO: 281611 - DNA, 20 bp, Artificial
  CRISPR gRNA sequence
caaaagaataaaactaggcc

SEQ ID NO: 281612 - DNA, 20 bp, Artificial
  CRISPR gRNA sequence
gaataaaactaggccaggcg

SEQ ID NO: 281613 - DNA, 20 bp, Artificial
  CRISPR gRNA sequence
taaaactaggccaggcgcag

SEQ ID NO: 281614 - DNA, 20 bp, Artificial
  CRISPR gRNA sequence
gtggctcatgcctgtaatcc

SEQ ID NO: 281615 - DNA, 20 bp, Artificial
  CRISPR gRNA sequence
tgcctgtaatcccagcactg

SEQ ID NO: 281616 - DNA, 20 bp, Artificial
  CRISPR gRNA sequence
gcctgtaatcccagcactgt

SEQ ID NO: 281617 - DNA, 20 bp, Artificial
  CRISPR gRNA sequence
ctgtaatcccagcactgtgg

SEQ ID NO: 281618 - DNA, 20 bp, Artificial
  CRISPR gRNA sequence
tgtaatcccagcactgtggg

SEQ ID NO: 281619 - DNA, 20 bp, Artificial
  CRISPR gRNA sequence
tcccagcactgtgggaggcc

SEQ ID NO: 281620 - DNA, 20 bp, Artificial
  CRISPR gRNA sequence
agcactgtgggaggccaaga

SEQ ID NO: 281621 - DNA, 20 bp, Artificial
  CRISPR gRNA sequence
gcactgtgggaggccaagac

SEQ ID NO: 281622 - DNA, 20 bp, Artificial
  CRISPR gRNA sequence
actgtgggaggccaagacag

SEQ ID NO: 281623 - DNA, 20 bp, Artificial
  CRISPR gRNA sequence
ccaagacaggagaatcacct

SEQ ID NO: 281624 - DNA, 20 bp, Artificial
  CRISPR gRNA sequence
caagacaggagaatcacctg

SEQ ID NO: 281625 - DNA, 20 bp, Artificial
  CRISPR gRNA sequence
acaggagaatcacctgaggt

SEQ ID NO: 281626 - DNA, 20 bp, Artificial
  CRISPR gRNA sequence
caggagaatcacctgaggtc

SEQ ID NO: 281627 - DNA, 20 bp, Artificial
  CRISPR gRNA sequence
ggagaatcacctgaggtcag

SEQ ID NO: 281628 - DNA, 20 bp, Artificial
  CRISPR gRNA sequence
tcacctgaggtcaggagttc

SEQ ID NO: 281629 - DNA, 20 bp, Artificial
  CRISPR gRNA sequence
tgaggtcaggagttcgagac

SEQ ID NO: 281630 - DNA, 20 bp, Artificial
  CRISPR gRNA sequence
tcaggagttcgagaccagtc

SEQ ID NO: 281631 - DNA, 20 bp, Artificial
  CRISPR gRNA sequence
cgagaccagtctggccaaca

SEQ ID NO: 281632 - DNA, 20 bp, Artificial
  CRISPR gRNA sequence
gagaccagtctggccaacat

SEQ ID NO: 281633 - DNA, 20 bp, Artificial
  CRISPR gRNA sequence
agaccagtctggccaacatg

SEQ ID NO: 281634 - DNA, 20 bp, Artificial
  CRISPR gRNA sequence
tctactgaaaatacaaaaat

SEQ ID NO: 281635 - DNA, 20 bp, Artificial
  CRISPR gRNA sequence
ctgaaaatacaaaaattagc

SEQ ID NO: 281636 - DNA, 20 bp, Artificial
  CRISPR gRNA sequence
tgaaaatacaaaaattagct

SEQ ID NO: 281637 - DNA, 20 bp, Artificial
  CRISPR gRNA sequence
atacaaaaattagctgggtg

SEQ ID NO: 281638 - DNA, 20 bp, Artificial
  CRISPR gRNA sequence
caaaaattagctgggtgtgg

SEQ ID NO: 281639 - DNA, 20 bp, Artificial
  CRISPR gRNA sequence
gtggcacgcccctgtaatcc

SEQ ID NO: 281640 - DNA, 20 bp, Artificial
  CRISPR gRNA sequence
cccctgtaatcccagctact

SEQ ID NO: 281641 - DNA, 20 bp, Artificial
  CRISPR gRNA sequence
ccctgtaatcccagctactc

SEQ ID NO: 281642 - DNA, 20 bp, Artificial
  CRISPR gRNA sequence
ctgtaatcccagctactcgg

SEQ ID NO: 281643 - DNA, 20 bp, Artificial
  CRISPR gRNA sequence
tgtaatcccagctactcggg

SEQ ID NO: 281644 - DNA, 20 bp, Artificial
  CRISPR gRNA sequence
tcccagctactcgggaggct

SEQ ID NO: 281645 - DNA, 20 bp, Artificial
  CRISPR gRNA sequence
cccagctactcgggaggctg

SEQ ID NO: 281646 - DNA, 20 bp, Artificial
  CRISPR gRNA sequence
agctactcgggaggctgagg

SEQ ID NO: 281647 - DNA, 20 bp, Artificial
  CRISPR gRNA sequence
gctactcgggaggctgaggc

SEQ ID NO: 281648 - DNA, 20 bp, Artificial
  CRISPR gRNA sequence
tactcgggaggctgaggcag

SEQ ID NO: 281649 - DNA, 20 bp, Artificial
  CRISPR gRNA sequence
gcaggagaattccttgaact

SEQ ID NO: 281650 - DNA, 20 bp, Artificial
  CRISPR gRNA sequence
caggagaattccttgaactc

SEQ ID NO: 281651 - DNA, 20 bp, Artificial
  CRISPR gRNA sequence
ggagaattccttgaactcgg

SEQ ID NO: 281652 - DNA, 20 bp, Artificial
  CRISPR gRNA sequence
gagaattccttgaactcggg

SEQ ID NO: 281653 - DNA, 20 bp, Artificial
  CRISPR gRNA sequence
aattccttgaactcgggagg

SEQ ID NO: 281654 - DNA, 20 bp, Artificial
  CRISPR gRNA sequence
ttccttgaactcgggaggca

SEQ ID NO: 281655 - DNA, 20 bp, Artificial
  CRISPR gRNA sequence
aactcgggaggcagagattg

SEQ ID NO: 281656 - DNA, 20 bp, Artificial
  CRISPR gRNA sequence
cgggaggcagagattgcagt

SEQ ID NO: 281657 - DNA, 20 bp, Artificial
  CRISPR gRNA sequence
ggcagagattgcagtgagct

SEQ ID NO: 281658 - DNA, 20 bp, Artificial
  CRISPR gRNA sequence
gagatcacatcactgcactc

SEQ ID NO: 281659 - DNA, 20 bp, Artificial
  CRISPR gRNA sequence
cacatcactgcactccagcc

SEQ ID NO: 281660 - DNA, 20 bp, Artificial
  CRISPR gRNA sequence
cactgcactccagcctggcc

SEQ ID NO: 281661 - DNA, 20 bp, Artificial
  CRISPR gRNA sequence
actgcactccagcctggcct

SEQ ID NO: 281662 - DNA, 20 bp, Artificial
  CRISPR gRNA sequence
ccagcctggcctgggaaaca

SEQ ID NO: 281663 - DNA, 20 bp, Artificial
  CRISPR gRNA sequence
tggcctgggaaacacagtga

SEQ ID NO: 281664 - DNA, 20 bp, Artificial
  CRISPR gRNA sequence
aaataaataaaacttaccac

SEQ ID NO: 281665 - DNA, 20 bp, Artificial
  CRISPR gRNA sequence
aataaataaaacttaccact

SEQ ID NO: 281666 - DNA, 20 bp, Artificial
  CRISPR gRNA sequence
ataaaacttaccactgggtt

SEQ ID NO: 281667 - DNA, 20 bp, Artificial
  CRISPR gRNA sequence
ttaccactgggtttggtaat

SEQ ID NO: 281668 - DNA, 20 bp, Artificial
  CRISPR gRNA sequence
actgggtttggtaatcagaa

SEQ ID NO: 281669 - DNA, 20 bp, Artificial
  CRISPR gRNA sequence
ggtaatcagaaaagtaaaaa

SEQ ID NO: 281670 - DNA, 20 bp, Artificial
  CRISPR gRNA sequence
gtaatcagaaaagtaaaaac

SEQ ID NO: 281671 - DNA, 20 bp, Artificial
  CRISPR gRNA sequence
taatcagaaaagtaaaaaca

SEQ ID NO: 281672 - DNA, 20 bp, Artificial
  CRISPR gRNA sequence
aaaagtaaaaacagggatct

SEQ ID NO: 281673 - DNA, 20 bp, Artificial
  CRISPR gRNA sequence
aacagggatcttggactccc

SEQ ID NO: 281674 - DNA, 20 bp, Artificial
  CRISPR gRNA sequence
gactccctggaccctctctc

SEQ ID NO: 281675 - DNA, 20 bp, Artificial
  CRISPR gRNA sequence
cctggaccctctctccagcc

SEQ ID NO: 281676 - DNA, 20 bp, Artificial
  CRISPR gRNA sequence
tctctccagcccagccttgc

SEQ ID NO: 281677 - DNA, 20 bp, Artificial
  CRISPR gRNA sequence
agccttgctagctccgcctg

SEQ ID NO: 281678 - DNA, 20 bp, Artificial
  CRISPR gRNA sequence
tgctcctgcctccgactcaa

SEQ ID NO: 281679 - DNA, 20 bp, Artificial
  CRISPR gRNA sequence
gcctccgactcaatggtttg

SEQ ID NO: 281680 - DNA, 20 bp, Artificial
  CRISPR gRNA sequence
cctccgactcaatggtttgc

SEQ ID NO: 281681 - DNA, 20 bp, Artificial
  CRISPR gRNA sequence
aatggtttgcaggaaaaatt

SEQ ID NO: 281682 - DNA, 20 bp, Artificial
  CRISPR gRNA sequence
gtttgcaggaaaaatttaga

SEQ ID NO: 281683 - DNA, 20 bp, Artificial
  CRISPR gRNA sequence
gaaaaatttagatagcacaa

SEQ ID NO: 281684 - DNA, 20 bp, Artificial
  CRISPR gRNA sequence
aaatttagatagcacaacag

SEQ ID NO: 281685 - DNA, 20 bp, Artificial
  CRISPR gRNA sequence
aacagtggcaattcacaatg

SEQ ID NO: 281686 - DNA, 20 bp, Artificial
  CRISPR gRNA sequence
cagtggcaattcacaatgaa

SEQ ID NO: 281687 - DNA, 20 bp, Artificial
  CRISPR gRNA sequence
atctactgcaaatcctacta

SEQ ID NO: 281688 - DNA, 20 bp, Artificial
  CRISPR gRNA sequence
actgcaaatcctactatgga

SEQ ID NO: 281689 - DNA, 20 bp, Artificial
  CRISPR gRNA sequence
tcctactatggaaagaaata

SEQ ID NO: 281690 - DNA, 20 bp, Artificial
  CRISPR gRNA sequence
cctactatggaaagaaatat

SEQ ID NO: 281691 - DNA, 20 bp, Artificial
  CRISPR gRNA sequence
tggaaagaaatatgggacaa

SEQ ID NO: 281692 - DNA, 20 bp, Artificial
  CRISPR gRNA sequence
ggaaagaaatatgggacaaa

SEQ ID NO: 281693 - DNA, 20 bp, Artificial
  CRISPR gRNA sequence
aaatatgggacaaaaggcta

SEQ ID NO: 281694 - DNA, 20 bp, Artificial
  CRISPR gRNA sequence
gggacaaaaggctatggtta

SEQ ID NO: 281695 - DNA, 20 bp, Artificial
  CRISPR gRNA sequence
caaaaggctatggttatggc

SEQ ID NO: 281696 - DNA, 20 bp, Artificial
  CRISPR gRNA sequence
aaaaggctatggttatggcc

SEQ ID NO: 281697 - DNA, 20 bp, Artificial
  CRISPR gRNA sequence
aaaggctatggttatggcca

SEQ ID NO: 281698 - DNA, 20 bp, Artificial
  CRISPR gRNA sequence
tatggttatggccagggtgc

SEQ ID NO: 281699 - DNA, 20 bp, Artificial
  CRISPR gRNA sequence
gggtgctggcacgcttaaca

SEQ ID NO: 281700 - DNA, 20 bp, Artificial
  CRISPR gRNA sequence
gctggcacgcttaacatggc

SEQ ID NO: 281701 - DNA, 20 bp, Artificial
  CRISPR gRNA sequence
tggcacgcttaacatggcga

SEQ ID NO: 281702 - DNA, 20 bp, Artificial
  CRISPR gRNA sequence
ggcacgcttaacatggcgag

SEQ ID NO: 281703 - DNA, 20 bp, Artificial
  CRISPR gRNA sequence
cgcttaacatggcgagaggc

SEQ ID NO: 281704 - DNA, 20 bp, Artificial
  CRISPR gRNA sequence
gcttaacatggcgagaggct

SEQ ID NO: 281705 - DNA, 20 bp, Artificial
  CRISPR gRNA sequence
atggcgagaggctgggcatc

SEQ ID NO: 281706 - DNA, 20 bp, Artificial
  CRISPR gRNA sequence
cgagaggctgggcatcaagc

SEQ ID NO: 281707 - DNA, 20 bp, Artificial
  CRISPR gRNA sequence
agaggctgggcatcaagcca

SEQ ID NO: 281708 - DNA, 20 bp, Artificial
  CRISPR gRNA sequence
aggctgggcatcaagccaga

SEQ ID NO: 281709 - DNA, 20 bp, Artificial
  CRISPR gRNA sequence
gcatcaagccagagagtgtt

SEQ ID NO: 281710 - DNA, 20 bp, Artificial
  CRISPR gRNA sequence
ccagagagtgttcagcctca

SEQ ID NO: 281711 - DNA, 20 bp, Artificial
  CRISPR gRNA sequence
cagagagtgttcagcctcac

SEQ ID NO: 281712 - DNA, 20 bp, Artificial
  CRISPR gRNA sequence
gttcagcctcacaggcctac

SEQ ID NO: 281713 - DNA, 20 bp, Artificial
  CRISPR gRNA sequence
caaatgcttctaaatttgct

SEQ ID NO: 281714 - DNA, 20 bp, Artificial
  CRISPR gRNA sequence
tctaaatttgctcagaaata

SEQ ID NO: 281715 - DNA, 20 bp, Artificial
  CRISPR gRNA sequence
taaatttgctcagaaatatg

SEQ ID NO: 281716 - DNA, 20 bp, Artificial
  CRISPR gRNA sequence
aaatttgctcagaaatatgg

SEQ ID NO: 281717 - DNA, 20 bp, Artificial
  CRISPR gRNA sequence
ctcagaaatatggaggtgct

SEQ ID NO: 281718 - DNA, 20 bp, Artificial
  CRISPR gRNA sequence
ggaggtgctgagaaatgttc

SEQ ID NO: 281719 - DNA, 20 bp, Artificial
  CRISPR gRNA sequence
gctgagaaatgttccagatg

SEQ ID NO: 281720 - DNA, 20 bp, Artificial
  CRISPR gRNA sequence
ctgagaaatgttccagatgt

SEQ ID NO: 281721 - DNA, 20 bp, Artificial
  CRISPR gRNA sequence
tgagaaatgttccagatgtg

SEQ ID NO: 281722 - DNA, 20 bp, Artificial
  CRISPR gRNA sequence
gggattctgtatatgctgcc

SEQ ID NO: 281723 - DNA, 20 bp, Artificial
  CRISPR gRNA sequence
attctgtatatgctgccgag

SEQ ID NO: 281724 - DNA, 20 bp, Artificial
  CRISPR gRNA sequence
tatgctgccgagaagataat

SEQ ID NO: 281725 - DNA, 20 bp, Artificial
  CRISPR gRNA sequence
tgctgccgagaagataattg

SEQ ID NO: 281726 - DNA, 20 bp, Artificial
  CRISPR gRNA sequence
gccgagaagataattggagc

SEQ ID NO: 281727 - DNA, 20 bp, Artificial
  CRISPR gRNA sequence
agaagataattggagctgga

SEQ ID NO: 281728 - DNA, 20 bp, Artificial
  CRISPR gRNA sequence
taattggagctggaaagccc

SEQ ID NO: 281729 - DNA, 20 bp, Artificial
  CRISPR gRNA sequence
aaaactgtttctgatgtgca

SEQ ID NO: 281730 - DNA, 20 bp, Artificial
  CRISPR gRNA sequence
tgtttctgatgtgcaaagtg

SEQ ID NO: 281731 - DNA, 20 bp, Artificial
  CRISPR gRNA sequence
gtttctgatgtgcaaagtgt

SEQ ID NO: 281732 - DNA, 20 bp, Artificial
  CRISPR gRNA sequence
tctgatgtgcaaagtgtggg

SEQ ID NO: 281733 - DNA, 20 bp, Artificial
  CRISPR gRNA sequence
tgatgtgcaaagtgtgggaa

SEQ ID NO: 281734 - DNA, 20 bp, Artificial
  CRISPR gRNA sequence
atcaacaactctgactgaaa

SEQ ID NO: 281735 - DNA, 20 bp, Artificial
  CRISPR gRNA sequence
aacaactctgactgaaaaag

SEQ ID NO: 281736 - DNA, 20 bp, Artificial
  CRISPR gRNA sequence
acaactctgactgaaaaaga

SEQ ID NO: 281737 - DNA, 20 bp, Artificial
  CRISPR gRNA sequence
gaaggtgaaatctattgtaa

SEQ ID NO: 281738 - DNA, 20 bp, Artificial
  CRISPR gRNA sequence
tattgtaatggtgctatgca

SEQ ID NO: 281739 - DNA, 20 bp, Artificial
  CRISPR gRNA sequence
tggtgctatgcaaagaactt

SEQ ID NO: 281740 - DNA, 20 bp, Artificial
  CRISPR gRNA sequence
ggtgctatgcaaagaacttt

SEQ ID NO: 281741 - DNA, 20 bp, Artificial
  CRISPR gRNA sequence
atgcaaagaactttgggccc

SEQ ID NO: 281742 - DNA, 20 bp, Artificial
  CRISPR gRNA sequence
tgcaaagaactttgggccca

SEQ ID NO: 281743 - DNA, 20 bp, Artificial
  CRISPR gRNA sequence
gcaaagaactttgggcccaa

SEQ ID NO: 281744 - DNA, 20 bp, Artificial
  CRISPR gRNA sequence
aactttgggcccaagggatt

SEQ ID NO: 281745 - DNA, 20 bp, Artificial
  CRISPR gRNA sequence
gggcccaagggatttggcta

SEQ ID NO: 281746 - DNA, 20 bp, Artificial
  CRISPR gRNA sequence
caagggatttggctatggcc

SEQ ID NO: 281747 - DNA, 20 bp, Artificial
  CRISPR gRNA sequence
aagggatttggctatggcca

SEQ ID NO: 281748 - DNA, 20 bp, Artificial
  CRISPR gRNA sequence
gggatttggctatggccaag

SEQ ID NO: 281749 - DNA, 20 bp, Artificial
  CRISPR gRNA sequence
atttggctatggccaaggag

SEQ ID NO: 281750 - DNA, 20 bp, Artificial
  CRISPR gRNA sequence
tttggctatggccaaggagc

SEQ ID NO: 281751 - DNA, 20 bp, Artificial
  CRISPR gRNA sequence
ttggctatggccaaggagca

SEQ ID NO: 281752 - DNA, 20 bp, Artificial
  CRISPR gRNA sequence
tggctatggccaaggagcag

SEQ ID NO: 281753 - DNA, 20 bp, Artificial
  CRISPR gRNA sequence
caggggctcttgttcatgcc

SEQ ID NO: 281754 - DNA, 20 bp, Artificial
  CRISPR gRNA sequence
ggctcttgttcatgcccagt

SEQ ID NO: 281755 - DNA, 20 bp, Artificial
  CRISPR gRNA sequence
gctcttgttcatgcccagta

SEQ ID NO: 281756 - DNA, 20 bp, Artificial
  CRISPR gRNA sequence
tgcccagtaaggtgtaaacc

SEQ ID NO: 281757 - DNA, 20 bp, Artificial
  CRISPR gRNA sequence
taaggtgtaaacccagaact

SEQ ID NO: 281758 - DNA, 20 bp, Artificial
  CRISPR gRNA sequence
agaactaagcatcacacatt

SEQ ID NO: 281759 - DNA, 20 bp, Artificial
  CRISPR gRNA sequence
ttgagaatctcttcataatc

SEQ ID NO: 281760 - DNA, 20 bp, Artificial
  CRISPR gRNA sequence
tgagaatctcttcataatct

SEQ ID NO: 281761 - DNA, 20 bp, Artificial
  CRISPR gRNA sequence
atctcttcataatctaggca

SEQ ID NO: 281762 - DNA, 20 bp, Artificial
  CRISPR gRNA sequence
aaactactgtgaaattctac

SEQ ID NO: 281763 - DNA, 20 bp, Artificial
  CRISPR gRNA sequence
tgtgaaattctaccagcatt

SEQ ID NO: 281764 - DNA, 20 bp, Artificial
  CRISPR gRNA sequence
actgtatattaccctgtact

SEQ ID NO: 281765 - DNA, 20 bp, Artificial
  CRISPR gRNA sequence
tatattaccctgtacttgga

SEQ ID NO: 281766 - DNA, 20 bp, Artificial
  CRISPR gRNA sequence
atattaccctgtacttggat

SEQ ID NO: 281767 - DNA, 20 bp, Artificial
  CRISPR gRNA sequence
taccctgtacttggataggc

SEQ ID NO: 281768 - DNA, 20 bp, Artificial
  CRISPR gRNA sequence
tggataggctggctaactca

SEQ ID NO: 281769 - DNA, 20 bp, Artificial
  CRISPR gRNA sequence
taggctggctaactcatagt

SEQ ID NO: 281770 - DNA, 20 bp, Artificial
  CRISPR gRNA sequence
ggctggctaactcatagtga

SEQ ID NO: 281771 - DNA, 20 bp, Artificial
  CRISPR gRNA sequence
ctggctaactcatagtgaga

SEQ ID NO: 281772 - DNA, 20 bp, Artificial
  CRISPR gRNA sequence
tatccttttgctttattcac

SEQ ID NO: 281773 - DNA, 20 bp, Artificial
  CRISPR gRNA sequence
tgctttattcactagcattt

SEQ ID NO: 281774 - DNA, 20 bp, Artificial
  CRISPR gRNA sequence
gctttattcactagcatttt

SEQ ID NO: 281775 - DNA, 20 bp, Artificial
  CRISPR gRNA sequence
ctttattcactagcattttg

SEQ ID NO: 281776 - DNA, 20 bp, Artificial
  CRISPR gRNA sequence
tttattcactagcattttgg

SEQ ID NO: 281777 - DNA, 20 bp, Artificial
  CRISPR gRNA sequence
ttatgttttaaataaaactt

SEQ ID NO: 281778 - DNA, 20 bp, Artificial
  CRISPR gRNA sequence
ttaaataaaacttcagcatg

SEQ ID NO: 281779 - DNA, 20 bp, Artificial
  CRISPR gRNA sequence
aacttcagcatgaagaaaaa

SEQ ID NO: 281780 - DNA, 20 bp, Artificial
  CRISPR gRNA sequence
agaaaaaaagtaaaaacaat

SEQ ID NO: 281781 - DNA, 20 bp, Artificial
  CRISPR gRNA sequence
aaaaagtaaaaacaataagt

SEQ ID NO: 281782 - DNA, 20 bp, Artificial
  CRISPR gRNA sequence
gtaaatattcatttatttgt

SEQ ID NO: 281783 - DNA, 20 bp, Artificial
  CRISPR gRNA sequence
catttatttgtaagccattt

SEQ ID NO: 281784 - DNA, 20 bp, Artificial
  CRISPR gRNA sequence
tttatttgtaagccatttca

SEQ ID NO: 281785 - DNA, 20 bp, Artificial
  CRISPR gRNA sequence
gtaagccatttcagagaaac

SEQ ID NO: 281786 - DNA, 20 bp, Artificial
  CRISPR gRNA sequence
tttcagagaaaccagaaaat

SEQ ID NO: 281787 - DNA, 20 bp, Artificial
  CRISPR gRNA sequence
ttgtgtccctgccgtttttc

SEQ ID NO: 281788 - DNA, 20 bp, Artificial
  CRISPR gRNA sequence
atgttgctaatgattcctca

SEQ ID NO: 281789 - DNA, 20 bp, Artificial
  CRISPR gRNA sequence
ttgctaatgattcctcaaag

SEQ ID NO: 281790 - DNA, 20 bp, Artificial
  CRISPR gRNA sequence
atgattcctcaaagcagctg

SEQ ID NO: 281791 - DNA, 20 bp, Artificial
  CRISPR gRNA sequence
cagctgaagaataaatactg

SEQ ID NO: 281792 - DNA, 20 bp, Artificial
  CRISPR gRNA sequence
tgcagctgctgctcctgatc

SEQ ID NO: 281793 - DNA, 20 bp, Artificial
  CRISPR gRNA sequence
cagctgctgctcctgatctg

SEQ ID NO: 281794 - DNA, 20 bp, Artificial
  CRISPR gRNA sequence
agctgctgctcctgatctgg

SEQ ID NO: 281795 - DNA, 20 bp, Artificial
  CRISPR gRNA sequence
gctgctgctcctgatctgga

SEQ ID NO: 281796 - DNA, 20 bp, Artificial
  CRISPR gRNA sequence
ctgctcctgatctggaggga

SEQ ID NO: 281797 - DNA, 20 bp, Artificial
  CRISPR gRNA sequence
gatctggagggatggacccg

SEQ ID NO: 281798 - DNA, 20 bp, Artificial
  CRISPR gRNA sequence
tgtacttcttgtgctctctg

SEQ ID NO: 281799 - DNA, 20 bp, Artificial
  CRISPR gRNA sequence
gtacttcttgtgctctctgt

SEQ ID NO: 281800 - DNA, 20 bp, Artificial
  CRISPR gRNA sequence
tctctgtgggactgaaacta

SEQ ID NO: 281801 - DNA, 20 bp, Artificial
  CRISPR gRNA sequence
aaactacagctgataacctt

SEQ ID NO: 281802 - DNA, 20 bp, Artificial
  CRISPR gRNA sequence
taaccttcagtgctctcttc

SEQ ID NO: 281803 - DNA, 20 bp, Artificial
  CRISPR gRNA sequence
aaccttcagtgctctcttct

SEQ ID NO: 281804 - DNA, 20 bp, Artificial
  CRISPR gRNA sequence
ttcagtgctctcttctagga

SEQ ID NO: 281805 - DNA, 20 bp, Artificial
  CRISPR gRNA sequence
ggatggtcccacctaatacc

SEQ ID NO: 281806 - DNA, 20 bp, Artificial
  CRISPR gRNA sequence
taccaagccatatccacact

SEQ ID NO: 281807 - DNA, 20 bp, Artificial
  CRISPR gRNA sequence
atccacacttagttctttgc

SEQ ID NO: 281808 - DNA, 20 bp, Artificial
  CRISPR gRNA sequence
ccagacttgttctgtgtttc

SEQ ID NO: 281809 - DNA, 20 bp, Artificial
  CRISPR gRNA sequence
gacttgttctgtgtttccag

SEQ ID NO: 281810 - DNA, 20 bp, Artificial
  CRISPR gRNA sequence
tgttctgtgtttccagtagc

SEQ ID NO: 281811 - DNA, 20 bp, Artificial
  CRISPR gRNA sequence
ttctgtgtttccagtagcta

SEQ ID NO: 281812 - DNA, 20 bp, Artificial
  CRISPR gRNA sequence
tctgtgtttccagtagctag

SEQ ID NO: 281813 - DNA, 20 bp, Artificial
  CRISPR gRNA sequence
ctgtgtttccagtagctaga

SEQ ID NO: 281814 - DNA, 20 bp, Artificial
  CRISPR gRNA sequence
ggtgaaaaacctgtatccga

SEQ ID NO: 281815 - DNA, 20 bp, Artificial
  CRISPR gRNA sequence
tgtatccgaaagtgaatgca

SEQ ID NO: 281816 - DNA, 20 bp, Artificial
  CRISPR gRNA sequence
atccgaaagtgaatgcaaag

SEQ ID NO: 281817 - DNA, 20 bp, Artificial
  CRISPR gRNA sequence
tgaatgcaaagtggctcctg

SEQ ID NO: 281818 - DNA, 20 bp, Artificial
  CRISPR gRNA sequence
caaagtggctcctgtagctt

SEQ ID NO: 281819 - DNA, 20 bp, Artificial
  CRISPR gRNA sequence
aaagtggctcctgtagcttt

SEQ ID NO: 281820 - DNA, 20 bp, Artificial
  CRISPR gRNA sequence
aagtggctcctgtagcttta

SEQ ID NO: 281821 - DNA, 20 bp, Artificial
  CRISPR gRNA sequence
tggctcctgtagctttaggg

SEQ ID NO: 281822 - DNA, 20 bp, Artificial
  CRISPR gRNA sequence
agctttagggcagctactgt

SEQ ID NO: 281823 - DNA, 20 bp, Artificial
  CRISPR gRNA sequence
gctttagggcagctactgtg

SEQ ID NO: 281824 - DNA, 20 bp, Artificial
  CRISPR gRNA sequence
tagggcagctactgtgaggt

SEQ ID NO: 281825 - DNA, 20 bp, Artificial
  CRISPR gRNA sequence
agggcagctactgtgaggta

SEQ ID NO: 281826 - DNA, 20 bp, Artificial
  CRISPR gRNA sequence
gggcagctactgtgaggtaa

SEQ ID NO: 281827 - DNA, 20 bp, Artificial
  CRISPR gRNA sequence
gtgtgtgatgtgtatgtgtt

SEQ ID NO: 281828 - DNA, 20 bp, Artificial
  CRISPR gRNA sequence
gtgtgatgtgtatgtgttga

SEQ ID NO: 281829 - DNA, 20 bp, Artificial
  CRISPR gRNA sequence
gtgatgtgtatgtgttgaga

SEQ ID NO: 281830 - DNA, 20 bp, Artificial
  CRISPR gRNA sequence
gtatgtgttgagagagaata

SEQ ID NO: 281831 - DNA, 20 bp, Artificial
  CRISPR gRNA sequence
tgtgttgagagagaatatgg

SEQ ID NO: 281832 - DNA, 20 bp, Artificial
  CRISPR gRNA sequence
gtgttgagagagaatatggt

SEQ ID NO: 281833 - DNA, 20 bp, Artificial
  CRISPR gRNA sequence
gttgagagagaatatggtag

SEQ ID NO: 281834 - DNA, 20 bp, Artificial
  CRISPR gRNA sequence
agagagaatatggtaggaga

SEQ ID NO: 281835 - DNA, 20 bp, Artificial
  CRISPR gRNA sequence
gagagaatatggtaggagaa

SEQ ID NO: 281836 - DNA, 20 bp, Artificial
  CRISPR gRNA sequence
agagaatatggtaggagaaa

SEQ ID NO: 281837 - DNA, 20 bp, Artificial
  CRISPR gRNA sequence
agaatatggtaggagaaagg

SEQ ID NO: 281838 - DNA, 20 bp, Artificial
  CRISPR gRNA sequence
atatggtaggagaaagggag

SEQ ID NO: 281839 - DNA, 20 bp, Artificial
  CRISPR gRNA sequence
tatggtaggagaaagggaga

SEQ ID NO: 281840 - DNA, 20 bp, Artificial
  CRISPR gRNA sequence
gagaaagggagaaggcacga

SEQ ID NO: 281841 - DNA, 20 bp, Artificial
  CRISPR gRNA sequence
gaaagggagaaggcacgaca

SEQ ID NO: 281842 - DNA, 20 bp, Artificial
  CRISPR gRNA sequence
gggagaaggcacgacagagc

SEQ ID NO: 281843 - DNA, 20 bp, Artificial
  CRISPR gRNA sequence
gagaaggcacgacagagcta

SEQ ID NO: 281844 - DNA, 20 bp, Artificial
  CRISPR gRNA sequence
aaggcacgacagagctagag

SEQ ID NO: 281845 - DNA, 20 bp, Artificial
  CRISPR gRNA sequence
aggcacgacagagctagaga

SEQ ID NO: 281846 - DNA, 20 bp, Artificial
  CRISPR gRNA sequence
gagctagagaaggaaaaata

SEQ ID NO: 281847 - DNA, 20 bp, Artificial
  CRISPR gRNA sequence
aaggaaaaataaagtatacc

SEQ ID NO: 281848 - DNA, 20 bp, Artificial
  CRISPR gRNA sequence
acctagaacacaacatcaac

SEQ ID NO: 281849 - DNA, 20 bp, Artificial
  CRISPR gRNA sequence
agaacacaacatcaaccagt

SEQ ID NO: 281850 - DNA, 20 bp, Artificial
  CRISPR gRNA sequence
acacaacatcaaccagttag

SEQ ID NO: 281851 - DNA, 20 bp, Artificial
  CRISPR gRNA sequence
aaccagttagtagtaacaca

SEQ ID NO: 281852 - DNA, 20 bp, Artificial
  CRISPR gRNA sequence
tagtaacacatagttataat

SEQ ID NO: 281853 - DNA, 20 bp, Artificial
  CRISPR gRNA sequence
atagttataatcagctataa

SEQ ID NO: 281854 - DNA, 20 bp, Artificial
  CRISPR gRNA sequence
ttataatcagctataaaagt

SEQ ID NO: 281855 - DNA, 20 bp, Artificial
  CRISPR gRNA sequence
ctataaaagtgagatactgc

SEQ ID NO: 281856 - DNA, 20 bp, Artificial
  CRISPR gRNA sequence
aaaagtgagatactgcaaga

SEQ ID NO: 281857 - DNA, 20 bp, Artificial
  CRISPR gRNA sequence
tactgcaagatggcttgtaa

SEQ ID NO: 281858 - DNA, 20 bp, Artificial
  CRISPR gRNA sequence
tggcttgtaaaagatttcct

SEQ ID NO: 281859 - DNA, 20 bp, Artificial
  CRISPR gRNA sequence
ttccttatgtcaacttaact

SEQ ID NO: 281860 - DNA, 20 bp, Artificial
  CRISPR gRNA sequence
tcaacttaactcagtaaatg

SEQ ID NO: 281861 - DNA, 20 bp, Artificial
  CRISPR gRNA sequence
tcagtaaatgcagacattca

SEQ ID NO: 281862 - DNA, 20 bp, Artificial
  CRISPR gRNA sequence
aatatgtgacatctgactat

SEQ ID NO: 281863 - DNA, 20 bp, Artificial
  CRISPR gRNA sequence
tctgactattagttgcccac

SEQ ID NO: 281864 - DNA, 20 bp, Artificial
  CRISPR gRNA sequence
cacaagtatgtgcctgattg

SEQ ID NO: 281865 - DNA, 20 bp, Artificial
  CRISPR gRNA sequence
gcctgattgaagaattatgc

SEQ ID NO: 281866 - DNA, 20 bp, Artificial
  CRISPR gRNA sequence
gaattatgcaagaaaaatgc

SEQ ID NO: 281867 - DNA, 20 bp, Artificial
  CRISPR gRNA sequence
ttatgcaagaaaaatgctag

SEQ ID NO: 281868 - DNA, 20 bp, Artificial
  CRISPR gRNA sequence
aaatgctagcagctgcatac

SEQ ID NO: 281869 - DNA, 20 bp, Artificial
  CRISPR gRNA sequence
atgctagcagctgcatactg

SEQ ID NO: 281870 - DNA, 20 bp, Artificial
  CRISPR gRNA sequence
gctagcagctgcatactgga

SEQ ID NO: 281871 - DNA, 20 bp, Artificial
  CRISPR gRNA sequence
ctgcatactggagagctgac

SEQ ID NO: 281872 - DNA, 20 bp, Artificial
  CRISPR gRNA sequence
tgcatactggagagctgacc

SEQ ID NO: 281873 - DNA, 20 bp, Artificial
  CRISPR gRNA sequence
actggagagctgaccaggca

SEQ ID NO: 281874 - DNA, 20 bp, Artificial
  CRISPR gRNA sequence
accaggcaaagaatactcca

SEQ ID NO: 281875 - DNA, 20 bp, Artificial
  CRISPR gRNA sequence
atactccacagttgcatcaa

SEQ ID NO: 281876 - DNA, 20 bp, Artificial
  CRISPR gRNA sequence
ccacagttgcatcaatagaa

SEQ ID NO: 281877 - DNA, 20 bp, Artificial
  CRISPR gRNA sequence
cacagttgcatcaatagaaa

SEQ ID NO: 281878 - DNA, 20 bp, Artificial
  CRISPR gRNA sequence
ttgcatcaatagaaaaggca

SEQ ID NO: 281879 - DNA, 20 bp, Artificial
  CRISPR gRNA sequence
caatagaaaaggcacagaat

SEQ ID NO: 281880 - DNA, 20 bp, Artificial
  CRISPR gRNA sequence
aaaaggcacagaatgagtat

SEQ ID NO: 281881 - DNA, 20 bp, Artificial
  CRISPR gRNA sequence
aaaggcacagaatgagtatc

SEQ ID NO: 281882 - DNA, 20 bp, Artificial
  CRISPR gRNA sequence
ggcacagaatgagtatcagg

SEQ ID NO: 281883 - DNA, 20 bp, Artificial
  CRISPR gRNA sequence
acagaatgagtatcaggcag

SEQ ID NO: 281884 - DNA, 20 bp, Artificial
  CRISPR gRNA sequence
cagaatgagtatcaggcagt

SEQ ID NO: 281885 - DNA, 20 bp, Artificial
  CRISPR gRNA sequence
aggcagtaggaaatacatta

SEQ ID NO: 281886 - DNA, 20 bp, Artificial
  CRISPR gRNA sequence
acattattcttttccctcca

SEQ ID NO: 281887 - DNA, 20 bp, Artificial
  CRISPR gRNA sequence
attcttttccctccatagcc

SEQ ID NO: 281888 - DNA, 20 bp, Artificial
  CRISPR gRNA sequence
ttttccctccatagccaagc

SEQ ID NO: 281889 - DNA, 20 bp, Artificial
  CRISPR gRNA sequence
ttccctccatagccaagcaa

SEQ ID NO: 281890 - DNA, 20 bp, Artificial
  CRISPR gRNA sequence
ctgataacctgctcccatcc

SEQ ID NO: 281891 - DNA, 20 bp, Artificial
  CRISPR gRNA sequence
tgataacctgctcccatcct

SEQ ID NO: 281892 - DNA, 20 bp, Artificial
  CRISPR gRNA sequence
ctgggccattaccttaatct

SEQ ID NO: 281893 - DNA, 20 bp, Artificial
  CRISPR gRNA sequence
attaccttaatctcagtaaa

SEQ ID NO: 281894 - DNA, 20 bp, Artificial
  CRISPR gRNA sequence
tatgctgcctgacctactgt

SEQ ID NO: 281895 - DNA, 20 bp, Artificial
  CRISPR gRNA sequence
catcatcctgatctcaattc

SEQ ID NO: 281896 - DNA, 20 bp, Artificial
  CRISPR gRNA sequence
catcctgatctcaattctgg

SEQ ID NO: 281897 - DNA, 20 bp, Artificial
  CRISPR gRNA sequence
aagatcaaactttattacca

SEQ ID NO: 281898 - DNA, 20 bp, Artificial
  CRISPR gRNA sequence
caaactttattaccatggtt

SEQ ID NO: 281899 - DNA, 20 bp, Artificial
  CRISPR gRNA sequence
ccatggttcggcatctctct

SEQ ID NO: 281900 - DNA, 20 bp, Artificial
  CRISPR gRNA sequence
catggttcggcatctctctg

SEQ ID NO: 281901 - DNA, 20 bp, Artificial
  CRISPR gRNA sequence
tcggcatctctctgaggttt

SEQ ID NO: 281902 - DNA, 20 bp, Artificial
  CRISPR gRNA sequence
ctattcgcttctcatgttta

SEQ ID NO: 281903 - DNA, 20 bp, Artificial
  CRISPR gRNA sequence
tcgcttctcatgtttacagc

SEQ ID NO: 281904 - DNA, 20 bp, Artificial
  CRISPR gRNA sequence
tcatgtttacagcaagccta

SEQ ID NO: 281905 - DNA, 20 bp, Artificial
  CRISPR gRNA sequence
cagcaagcctatggaaacat

SEQ ID NO: 281906 - DNA, 20 bp, Artificial
  CRISPR gRNA sequence
tctcctttacttgtctcaac

SEQ ID NO: 281907 - DNA, 20 bp, Artificial
  CRISPR gRNA sequence
aacaagttctgttcattcac

SEQ ID NO: 281908 - DNA, 20 bp, Artificial
  CRISPR gRNA sequence
ttcattcactggacattttc

SEQ ID NO: 281909 - DNA, 20 bp, Artificial
  CRISPR gRNA sequence
ccggacacctcctacgtgtg

SEQ ID NO: 281910 - DNA, 20 bp, Artificial
  CRISPR gRNA sequence
ctacgtgtgtggcactctac

SEQ ID NO: 281911 - DNA, 20 bp, Artificial
  CRISPR gRNA sequence
tacgtgtgtggcactctact

SEQ ID NO: 281912 - DNA, 20 bp, Artificial
  CRISPR gRNA sequence
tgtggcactctactaggcac

SEQ ID NO: 281913 - DNA, 20 bp, Artificial
  CRISPR gRNA sequence
ggcactggaattacaatgac

SEQ ID NO: 281914 - DNA, 20 bp, Artificial
  CRISPR gRNA sequence
actggaattacaatgacaag

SEQ ID NO: 281915 - DNA, 20 bp, Artificial
  CRISPR gRNA sequence
gacaagaagtcactgccctc

SEQ ID NO: 281916 - DNA, 20 bp, Artificial
  CRISPR gRNA sequence
actgccctcaagacacattc

SEQ ID NO: 281917 - DNA, 20 bp, Artificial
  CRISPR gRNA sequence
cctcaagacacattctagtt

SEQ ID NO: 281918 - DNA, 20 bp, Artificial
  CRISPR gRNA sequence
tccctgactttatatatttt

SEQ ID NO: 281919 - DNA, 20 bp, Artificial
  CRISPR gRNA sequence
cctgactttatatatttttg

SEQ ID NO: 281920 - DNA, 20 bp, Artificial
  CRISPR gRNA sequence
ctttatatatttttggagac

SEQ ID NO: 281921 - DNA, 20 bp, Artificial
  CRISPR gRNA sequence
tttatatatttttggagact

SEQ ID NO: 281922 - DNA, 20 bp, Artificial
  CRISPR gRNA sequence
ttatatatttttggagactg

SEQ ID NO: 281923 - DNA, 20 bp, Artificial
  CRISPR gRNA sequence
tgatattctaattttttttt

SEQ ID NO: 281924 - DNA, 20 bp, Artificial
  CRISPR gRNA sequence
gatattctaattttttttta

SEQ ID NO: 281925 - DNA, 20 bp, Artificial
  CRISPR gRNA sequence
atattctaatttttttttaa

SEQ ID NO: 281926 - DNA, 20 bp, Artificial
  CRISPR gRNA sequence
tctaatttttttttaagggc

SEQ ID NO: 281927 - DNA, 20 bp, Artificial
  CRISPR gRNA sequence
tttttaagggctagtcgatt

SEQ ID NO: 281928 - DNA, 20 bp, Artificial
  CRISPR gRNA sequence
ttaagggctagtcgatttgg

SEQ ID NO: 281929 - DNA, 20 bp, Artificial
  CRISPR gRNA sequence
taagggctagtcgatttggc

SEQ ID NO: 281930 - DNA, 20 bp, Artificial
  CRISPR gRNA sequence
ggctagtcgatttggcaggt

SEQ ID NO: 281931 - DNA, 20 bp, Artificial
  CRISPR gRNA sequence
gtgagttgttacacactcct

SEQ ID NO: 281932 - DNA, 20 bp, Artificial
  CRISPR gRNA sequence
ttagtgaattccaacttcca

SEQ ID NO: 281933 - DNA, 20 bp, Artificial
  CRISPR gRNA sequence
ctgatattctaattttgatt

SEQ ID NO: 281934 - DNA, 20 bp, Artificial
  CRISPR gRNA sequence
gatattctaattttgatttg

SEQ ID NO: 281935 - DNA, 20 bp, Artificial
  CRISPR gRNA sequence
ttctaattttgatttggagt

SEQ ID NO: 281936 - DNA, 20 bp, Artificial
  CRISPR gRNA sequence
ctaattttgatttggagtta

SEQ ID NO: 281937 - DNA, 20 bp, Artificial
  CRISPR gRNA sequence
tttgatttggagttagagaa

SEQ ID NO: 281938 - DNA, 20 bp, Artificial
  CRISPR gRNA sequence
ttgatttggagttagagaaa

SEQ ID NO: 281939 - DNA, 20 bp, Artificial
  CRISPR gRNA sequence
aaaggcaaattgacaaattt

SEQ ID NO: 281940 - DNA, 20 bp, Artificial
  CRISPR gRNA sequence
aattgacaaattttggtgcc

SEQ ID NO: 281941 - DNA, 20 bp, Artificial
  CRISPR gRNA sequence
ggtgccaagaatcattttct

SEQ ID NO: 281942 - DNA, 20 bp, Artificial
  CRISPR gRNA sequence
tgccaagaatcattttcttg

SEQ ID NO: 281943 - DNA, 20 bp, Artificial
  CRISPR gRNA sequence
gccaagaatcattttcttgg

SEQ ID NO: 281944 - DNA, 20 bp, Artificial
  CRISPR gRNA sequence
caagaatcattttcttggag

SEQ ID NO: 281945 - DNA, 20 bp, Artificial
  CRISPR gRNA sequence
aagaatcattttcttggagg

SEQ ID NO: 281946 - DNA, 20 bp, Artificial
  CRISPR gRNA sequence
agaatcattttcttggagga

SEQ ID NO: 281947 - DNA, 20 bp, Artificial
  CRISPR gRNA sequence
tcattttcttggaggagggc

SEQ ID NO: 281948 - DNA, 20 bp, Artificial
  CRISPR gRNA sequence
gagggcaagatgcactaata

SEQ ID NO: 281949 - DNA, 20 bp, Artificial
  CRISPR gRNA sequence
caagatgcactaatacagtt

SEQ ID NO: 281950 - DNA, 20 bp, Artificial
  CRISPR gRNA sequence
aatacagttgagaaactaca

SEQ ID NO: 281951 - DNA, 20 bp, Artificial
  CRISPR gRNA sequence
gttgagaaactacatggcta

SEQ ID NO: 281952 - DNA, 20 bp, Artificial
  CRISPR gRNA sequence
ttgagaaactacatggctac

SEQ ID NO: 281953 - DNA, 20 bp, Artificial
  CRISPR gRNA sequence
caggtgatctcaccaattct

SEQ ID NO: 281954 - DNA, 20 bp, Artificial
  CRISPR gRNA sequence
tctcaccaattctcagttct

SEQ ID NO: 281955 - DNA, 20 bp, Artificial
  CRISPR gRNA sequence
ctcaccaattctcagttctt

SEQ ID NO: 281956 - DNA, 20 bp, Artificial
  CRISPR gRNA sequence
ccaattctcagttcttgggc

SEQ ID NO: 281957 - DNA, 20 bp, Artificial
  CRISPR gRNA sequence
caattctcagttcttgggct

SEQ ID NO: 281958 - DNA, 20 bp, Artificial
  CRISPR gRNA sequence
ttctcagttcttgggctggg

SEQ ID NO: 281959 - DNA, 20 bp, Artificial
  CRISPR gRNA sequence
tctcagttcttgggctgggt

SEQ ID NO: 281960 - DNA, 20 bp, Artificial
  CRISPR gRNA sequence
ctcagttcttgggctgggtg

SEQ ID NO: 281961 - DNA, 20 bp, Artificial
  CRISPR gRNA sequence
agttcttgggctgggtgggg

SEQ ID NO: 281962 - DNA, 20 bp, Artificial
  CRISPR gRNA sequence
gtggctcatgcctgtaatcc

SEQ ID NO: 281963 - DNA, 20 bp, Artificial
  CRISPR gRNA sequence
tgcctgtaatcccagcactt

SEQ ID NO: 281964 - DNA, 20 bp, Artificial
  CRISPR gRNA sequence
gcctgtaatcccagcacttt

SEQ ID NO: 281965 - DNA, 20 bp, Artificial
  CRISPR gRNA sequence
ctgtaatcccagcactttgg

SEQ ID NO: 281966 - DNA, 20 bp, Artificial
  CRISPR gRNA sequence
tgtaatcccagcactttggg

SEQ ID NO: 281967 - DNA, 20 bp, Artificial
  CRISPR gRNA sequence
tcccagcactttgggaggcc

SEQ ID NO: 281968 - DNA, 20 bp, Artificial
  CRISPR gRNA sequence
cccagcactttgggaggcca

SEQ ID NO: 281969 - DNA, 20 bp, Artificial
  CRISPR gRNA sequence
agcactttgggaggccaagg

SEQ ID NO: 281970 - DNA, 20 bp, Artificial
  CRISPR gRNA sequence
gcactttgggaggccaaggc

SEQ ID NO: 281971 - DNA, 20 bp, Artificial
  CRISPR gRNA sequence
ctttgggaggccaaggcagg

SEQ ID NO: 281972 - DNA, 20 bp, Artificial
  CRISPR gRNA sequence
ccaaggcaggtggatcactt

SEQ ID NO: 281973 - DNA, 20 bp, Artificial
  CRISPR gRNA sequence
caaggcaggtggatcactta

SEQ ID NO: 281974 - DNA, 20 bp, Artificial
  CRISPR gRNA sequence
gcaggtggatcacttaaggt

SEQ ID NO: 281975 - DNA, 20 bp, Artificial
  CRISPR gRNA sequence
caggtggatcacttaaggtc

SEQ ID NO: 281976 - DNA, 20 bp, Artificial
  CRISPR gRNA sequence
ggtggatcacttaaggtcag

SEQ ID NO: 281977 - DNA, 20 bp, Artificial
  CRISPR gRNA sequence
tcacttaaggtcaggagttc

SEQ ID NO: 281978 - DNA, 20 bp, Artificial
  CRISPR gRNA sequence
taaggtcaggagttcgagac

SEQ ID NO: 281979 - DNA, 20 bp, Artificial
  CRISPR gRNA sequence
tcaggagttcgagaccggcc

SEQ ID NO: 281980 - DNA, 20 bp, Artificial
  CRISPR gRNA sequence
cgagaccggcctggccaaca

SEQ ID NO: 281981 - DNA, 20 bp, Artificial
  CRISPR gRNA sequence
tctactaaaaatacaaaaat

SEQ ID NO: 281982 - DNA, 20 bp, Artificial
  CRISPR gRNA sequence
ctaaaaatacaaaaattagc

SEQ ID NO: 281983 - DNA, 20 bp, Artificial
  CRISPR gRNA sequence
taaaaatacaaaaattagcc

SEQ ID NO: 281984 - DNA, 20 bp, Artificial
  CRISPR gRNA sequence
atacaaaaattagccaggca

SEQ ID NO: 281985 - DNA, 20 bp, Artificial
  CRISPR gRNA sequence
caaaaattagccaggcatgg

SEQ ID NO: 281986 - DNA, 20 bp, Artificial
  CRISPR gRNA sequence
ggcatggtggcgtgcacctg

SEQ ID NO: 281987 - DNA, 20 bp, Artificial
  CRISPR gRNA sequence
gtggcgtgcacctgtagtcc

SEQ ID NO: 281988 - DNA, 20 bp, Artificial
  CRISPR gRNA sequence
cacctgtagtcctagctact

SEQ ID NO: 281989 - DNA, 20 bp, Artificial
  CRISPR gRNA sequence
acctgtagtcctagctactc

SEQ ID NO: 281990 - DNA, 20 bp, Artificial
  CRISPR gRNA sequence
ctgtagtcctagctactcag

SEQ ID NO: 281991 - DNA, 20 bp, Artificial
  CRISPR gRNA sequence
tgtagtcctagctactcagg

SEQ ID NO: 281992 - DNA, 20 bp, Artificial
  CRISPR gRNA sequence
cctagctactcaggaggctg

SEQ ID NO: 281993 - DNA, 20 bp, Artificial
  CRISPR gRNA sequence
agctactcaggaggctgaag

SEQ ID NO: 281994 - DNA, 20 bp, Artificial
  CRISPR gRNA sequence
gctactcaggaggctgaagc

SEQ ID NO: 281995 - DNA, 20 bp, Artificial
  CRISPR gRNA sequence
tactcaggaggctgaagcag

SEQ ID NO: 281996 - DNA, 20 bp, Artificial
  CRISPR gRNA sequence
gcaggagaattgcttgaacc

SEQ ID NO: 281997 - DNA, 20 bp, Artificial
  CRISPR gRNA sequence
caggagaattgcttgaaccc

SEQ ID NO: 281998 - DNA, 20 bp, Artificial
  CRISPR gRNA sequence
attgcttgaacccaggaacc

SEQ ID NO: 281999 - DNA, 20 bp, Artificial
  CRISPR gRNA sequence
ttgcttgaacccaggaaccc

SEQ ID NO: 282000 - DNA, 20 bp, Artificial
  CRISPR gRNA sequence
gcttgaacccaggaacccag

SEQ ID NO: 282001 - DNA, 20 bp, Artificial
  CRISPR gRNA sequence
cttgaacccaggaacccagg

SEQ ID NO: 282002 - DNA, 20 bp, Artificial
  CRISPR gRNA sequence
gaacccaggaacccaggagg

SEQ ID NO: 282003 - DNA, 20 bp, Artificial
  CRISPR gRNA sequence
acccaggaacccaggaggcg

SEQ ID NO: 282004 - DNA, 20 bp, Artificial
  CRISPR gRNA sequence
aacccaggaggcggagactg

SEQ ID NO: 282005 - DNA, 20 bp, Artificial
  CRISPR gRNA sequence
caggaggcggagactgcagt

SEQ ID NO: 282006 - DNA, 20 bp, Artificial
  CRISPR gRNA sequence
ggcggagactgcagtgagcc

SEQ ID NO: 282007 - DNA, 20 bp, Artificial
  CRISPR gRNA sequence
aagatcatgccattgcactc

SEQ ID NO: 282008 - DNA, 20 bp, Artificial
  CRISPR gRNA sequence
catgccattgcactccagcc

SEQ ID NO: 282009 - DNA, 20 bp, Artificial
  CRISPR gRNA sequence
atgccattgcactccagcct

SEQ ID NO: 282010 - DNA, 20 bp, Artificial
  CRISPR gRNA sequence
ttgcactccagcctgggtga

SEQ ID NO: 282011 - DNA, 20 bp, Artificial
  CRISPR gRNA sequence
gcactccagcctgggtgaca

SEQ ID NO: 282012 - DNA, 20 bp, Artificial
  CRISPR gRNA sequence
tccagcctgggtgacagagt

SEQ ID NO: 282013 - DNA, 20 bp, Artificial
  CRISPR gRNA sequence
tcaaaacacaaaccaattct

SEQ ID NO: 282014 - DNA, 20 bp, Artificial
  CRISPR gRNA sequence
cttagttctttttttttttt

SEQ ID NO: 282015 - DNA, 20 bp, Artificial
  CRISPR gRNA sequence
gttcttttttttttttgaga

SEQ ID NO: 282016 - DNA, 20 bp, Artificial
  CRISPR gRNA sequence
tcttttttttttttgagatg

SEQ ID NO: 282017 - DNA, 20 bp, Artificial
  CRISPR gRNA sequence
tggagtctcactctgccacc

SEQ ID NO: 282018 - DNA, 20 bp, Artificial
  CRISPR gRNA sequence
ggagtctcactctgccaccc

SEQ ID NO: 282019 - DNA, 20 bp, Artificial
  CRISPR gRNA sequence
tctcactctgccacccaggc

SEQ ID NO: 282020 - DNA, 20 bp, Artificial
  CRISPR gRNA sequence
tcactctgccacccaggctg

SEQ ID NO: 282021 - DNA, 20 bp, Artificial
  CRISPR gRNA sequence
tggagtgtatgccccgatct

SEQ ID NO: 282022 - DNA, 20 bp, Artificial
  CRISPR gRNA sequence
ctcactgcacctccgcctcc

SEQ ID NO: 282023 - DNA, 20 bp, Artificial
  CRISPR gRNA sequence
tcactgcacctccgcctccc

SEQ ID NO: 282024 - DNA, 20 bp, Artificial
  CRISPR gRNA sequence
cacctccgcctcccaggttc

SEQ ID NO: 282025 - DNA, 20 bp, Artificial
  CRISPR gRNA sequence
cccaggttcaagcaattatc

SEQ ID NO: 282026 - DNA, 20 bp, Artificial
  CRISPR gRNA sequence
ttcaagcaattatccggcct

SEQ ID NO: 282027 - DNA, 20 bp, Artificial
  CRISPR gRNA sequence
ttatccggcctcagcctcct

SEQ ID NO: 282028 - DNA, 20 bp, Artificial
  CRISPR gRNA sequence
tccggcctcagcctcctgag

SEQ ID NO: 282029 - DNA, 20 bp, Artificial
  CRISPR gRNA sequence
gcctcagcctcctgagtagc

SEQ ID NO: 282030 - DNA, 20 bp, Artificial
  CRISPR gRNA sequence
cctcagcctcctgagtagct

SEQ ID NO: 282031 - DNA, 20 bp, Artificial
  CRISPR gRNA sequence
ctcctgagtagctgggacta

SEQ ID NO: 282032 - DNA, 20 bp, Artificial
  CRISPR gRNA sequence
tcctgagtagctgggactac

SEQ ID NO: 282033 - DNA, 20 bp, Artificial
  CRISPR gRNA sequence
ctaatttttttttgtatttt

SEQ ID NO: 282034 - DNA, 20 bp, Artificial
  CRISPR gRNA sequence
atttttttttgtatttttag

SEQ ID NO: 282035 - DNA, 20 bp, Artificial
  CRISPR gRNA sequence
ttttttttgtatttttagta

SEQ ID NO: 282036 - DNA, 20 bp, Artificial
  CRISPR gRNA sequence
ttttgtatttttagtagaga

SEQ ID NO: 282037 - DNA, 20 bp, Artificial
  CRISPR gRNA sequence
tttgtatttttagtagagac

SEQ ID NO: 282038 - DNA, 20 bp, Artificial
  CRISPR gRNA sequence
ttgtatttttagtagagacg

SEQ ID NO: 282039 - DNA, 20 bp, Artificial
  CRISPR gRNA sequence
gagacggggtttcaccatgt

SEQ ID NO: 282040 - DNA, 20 bp, Artificial
  CRISPR gRNA sequence
cggggtttcaccatgttggc

SEQ ID NO: 282041 - DNA, 20 bp, Artificial
  CRISPR gRNA sequence
ggggtttcaccatgttggcc

SEQ ID NO: 282042 - DNA, 20 bp, Artificial
  CRISPR gRNA sequence
tttcaccatgttggccagga

SEQ ID NO: 282043 - DNA, 20 bp, Artificial
  CRISPR gRNA sequence
acctcgtgatccgcctgcct

SEQ ID NO: 282044 - DNA, 20 bp, Artificial
  CRISPR gRNA sequence
ccgcctgccttggcttccca

SEQ ID NO: 282045 - DNA, 20 bp, Artificial
  CRISPR gRNA sequence
gccttggcttcccaaagtgc

SEQ ID NO: 282046 - DNA, 20 bp, Artificial
  CRISPR gRNA sequence
ccttggcttcccaaagtgct

SEQ ID NO: 282047 - DNA, 20 bp, Artificial
  CRISPR gRNA sequence
gtgctgggacttcttgtctt

SEQ ID NO: 282048 - DNA, 20 bp, Artificial
  CRISPR gRNA sequence
acttcttgtctttggaattc

SEQ ID NO: 282049 - DNA, 20 bp, Artificial
  CRISPR gRNA sequence
gtctttggaattccagtgcc

SEQ ID NO: 282050 - DNA, 20 bp, Artificial
  CRISPR gRNA sequence
tttggaattccagtgcctag

SEQ ID NO: 282051 - DNA, 20 bp, Artificial
  CRISPR gRNA sequence
tggaattccagtgcctagta

SEQ ID NO: 282052 - DNA, 20 bp, Artificial
  CRISPR gRNA sequence
ctagtagagtgccacacaca

SEQ ID NO: 282053 - DNA, 20 bp, Artificial
  CRISPR gRNA sequence
tagtagagtgccacacacat

SEQ ID NO: 282054 - DNA, 20 bp, Artificial
  CRISPR gRNA sequence
gtgccacacacataggtgtc

SEQ ID NO: 282055 - DNA, 20 bp, Artificial
  CRISPR gRNA sequence
ctggaaaatgtccattttct

SEQ ID NO: 282056 - DNA, 20 bp, Artificial
  CRISPR gRNA sequence
tgtccattttctcagttctt

SEQ ID NO: 282057 - DNA, 20 bp, Artificial
  CRISPR gRNA sequence
agttctttagaatacatttt

SEQ ID NO: 282058 - DNA, 20 bp, Artificial
  CRISPR gRNA sequence
tagaatacatttttggatga

SEQ ID NO: 282059 - DNA, 20 bp, Artificial
  CRISPR gRNA sequence
tacatttttggatgaaagat

SEQ ID NO: 282060 - DNA, 20 bp, Artificial
  CRISPR gRNA sequence
acatttttggatgaaagatc

SEQ ID NO: 282061 - DNA, 20 bp, Artificial
  CRISPR gRNA sequence
atttttggatgaaagatcag

SEQ ID NO: 282062 - DNA, 20 bp, Artificial
  CRISPR gRNA sequence
tttggatgaaagatcaggag

SEQ ID NO: 282063 - DNA, 20 bp, Artificial
  CRISPR gRNA sequence
agatcaggagtggctgatga

SEQ ID NO: 282064 - DNA, 20 bp, Artificial
  CRISPR gRNA sequence
tcaggagtggctgatgaaag

SEQ ID NO: 282065 - DNA, 20 bp, Artificial
  CRISPR gRNA sequence
aggagtggctgatgaaagaa

SEQ ID NO: 282066 - DNA, 20 bp, Artificial
  CRISPR gRNA sequence
tgatgaaagaagagatttct

SEQ ID NO: 282067 - DNA, 20 bp, Artificial
  CRISPR gRNA sequence
taccctatgaatttacactt

SEQ ID NO: 282068 - DNA, 20 bp, Artificial
  CRISPR gRNA sequence
accctatgaatttacacttt

SEQ ID NO: 282069 - DNA, 20 bp, Artificial
  CRISPR gRNA sequence
tgaatttacactttgggtgt

SEQ ID NO: 282070 - DNA, 20 bp, Artificial
  CRISPR gRNA sequence
tcaatctctatgattaaatg

SEQ ID NO: 282071 - DNA, 20 bp, Artificial
  CRISPR gRNA sequence
aatctctatgattaaatgaa

SEQ ID NO: 282072 - DNA, 20 bp, Artificial
  CRISPR gRNA sequence
atctctatgattaaatgaag

SEQ ID NO: 282073 - DNA, 20 bp, Artificial
  CRISPR gRNA sequence
attaaatgaagaggaactgc

SEQ ID NO: 282074 - DNA, 20 bp, Artificial
  CRISPR gRNA sequence
aagaggaactgctagttcta

SEQ ID NO: 282075 - DNA, 20 bp, Artificial
  CRISPR gRNA sequence
ctagttctatggtccgaaat

SEQ ID NO: 282076 - DNA, 20 bp, Artificial
  CRISPR gRNA sequence
tagttctatggtccgaaata

SEQ ID NO: 282077 - DNA, 20 bp, Artificial
  CRISPR gRNA sequence
ataaggccataatcactatg

SEQ ID NO: 282078 - DNA, 20 bp, Artificial
  CRISPR gRNA sequence
taaggccataatcactatga

SEQ ID NO: 282079 - DNA, 20 bp, Artificial
  CRISPR gRNA sequence
aaggccataatcactatgaa

SEQ ID NO: 282080 - DNA, 20 bp, Artificial
  CRISPR gRNA sequence
aggccataatcactatgaag

SEQ ID NO: 282081 - DNA, 20 bp, Artificial
  CRISPR gRNA sequence
aggggtaccaacccttcttt

SEQ ID NO: 282082 - DNA, 20 bp, Artificial
  CRISPR gRNA sequence
ggtaccaacccttctttgag

SEQ ID NO: 282083 - DNA, 20 bp, Artificial
  CRISPR gRNA sequence
gtacactgatcaaataaaat

SEQ ID NO: 282084 - DNA, 20 bp, Artificial
  CRISPR gRNA sequence
cactgatcaaataaaatcgg

SEQ ID NO: 282085 - DNA, 20 bp, Artificial
  CRISPR gRNA sequence
tcaacatctgctgattttcc

SEQ ID NO: 282086 - DNA, 20 bp, Artificial
  CRISPR gRNA sequence
caacatctgctgattttccc

SEQ ID NO: 282087 - DNA, 20 bp, Artificial
  CRISPR gRNA sequence
ctgctgattttcccaggctt

SEQ ID NO: 282088 - DNA, 20 bp, Artificial
  CRISPR gRNA sequence
tttagcaccaaaaaaaccca

SEQ ID NO: 282089 - DNA, 20 bp, Artificial
  CRISPR gRNA sequence
caccaaaaaaacccaaagct

SEQ ID NO: 282090 - DNA, 20 bp, Artificial
  CRISPR gRNA sequence
ccaaagctcagtgaattctt

SEQ ID NO: 282091 - DNA, 20 bp, Artificial
  CRISPR gRNA sequence
aaagctcagtgaattcttta

SEQ ID NO: 282092 - DNA, 20 bp, Artificial
  CRISPR gRNA sequence
agctcagtgaattctttaga

SEQ ID NO: 282093 - DNA, 20 bp, Artificial
  CRISPR gRNA sequence
tgctgttaacaacttatccc

SEQ ID NO: 282094 - DNA, 20 bp, Artificial
  CRISPR gRNA sequence
gctgttaacaacttatccca

SEQ ID NO: 282095 - DNA, 20 bp, Artificial
  CRISPR gRNA sequence
ctgttaacaacttatcccaa

SEQ ID NO: 282096 - DNA, 20 bp, Artificial
  CRISPR gRNA sequence
ttaacaacttatcccaaggg

SEQ ID NO: 282097 - DNA, 20 bp, Artificial
  CRISPR gRNA sequence
taacaacttatcccaagggt

SEQ ID NO: 282098 - DNA, 20 bp, Artificial
  CRISPR gRNA sequence
cttatcccaagggtaggata

SEQ ID NO: 282099 - DNA, 20 bp, Artificial
  CRISPR gRNA sequence
tatcccaagggtaggataaa

SEQ ID NO: 282100 - DNA, 20 bp, Artificial
  CRISPR gRNA sequence
atcccaagggtaggataaag

SEQ ID NO: 282101 - DNA, 20 bp, Artificial
  CRISPR gRNA sequence
aagggtaggataaagaggtc

SEQ ID NO: 282102 - DNA, 20 bp, Artificial
  CRISPR gRNA sequence
ggtaggataaagaggtctgg

SEQ ID NO: 282103 - DNA, 20 bp, Artificial
  CRISPR gRNA sequence
gtaggataaagaggtctggt

SEQ ID NO: 282104 - DNA, 20 bp, Artificial
  CRISPR gRNA sequence
taaagaggtctggtgggctc

SEQ ID NO: 282105 - DNA, 20 bp, Artificial
  CRISPR gRNA sequence
aaagaggtctggtgggctca

SEQ ID NO: 282106 - DNA, 20 bp, Artificial
  CRISPR gRNA sequence
tgtttctaataccaactatc

SEQ ID NO: 282107 - DNA, 20 bp, Artificial
  CRISPR gRNA sequence
ccagtgttacccctttaatt

SEQ ID NO: 282108 - DNA, 20 bp, Artificial
  CRISPR gRNA sequence
cagtgttacccctttaattc

SEQ ID NO: 282109 - DNA, 20 bp, Artificial
  CRISPR gRNA sequence
agtgttacccctttaattca

SEQ ID NO: 282110 - DNA, 20 bp, Artificial
  CRISPR gRNA sequence
gtgttacccctttaattcag

SEQ ID NO: 282111 - DNA, 20 bp, Artificial
  CRISPR gRNA sequence
gctctcatcctcaacattat

SEQ ID NO: 282112 - DNA, 20 bp, Artificial
  CRISPR gRNA sequence
cctcaacattattggcattt

SEQ ID NO: 282113 - DNA, 20 bp, Artificial
  CRISPR gRNA sequence
ctcaacattattggcatttt

SEQ ID NO: 282114 - DNA, 20 bp, Artificial
  CRISPR gRNA sequence
acattattggcattttgggc

SEQ ID NO: 282115 - DNA, 20 bp, Artificial
  CRISPR gRNA sequence
ggcaagataattctttgttt

SEQ ID NO: 282116 - DNA, 20 bp, Artificial
  CRISPR gRNA sequence
caagataattctttgttttg

SEQ ID NO: 282117 - DNA, 20 bp, Artificial
  CRISPR gRNA sequence
gagtgctgttctgtgcactg

SEQ ID NO: 282118 - DNA, 20 bp, Artificial
  CRISPR gRNA sequence
agtgctgttctgtgcactgt

SEQ ID NO: 282119 - DNA, 20 bp, Artificial
  CRISPR gRNA sequence
tctgtgcactgtaggatgtt

SEQ ID NO: 282120 - DNA, 20 bp, Artificial
  CRISPR gRNA sequence
gtgcactgtaggatgtttag

SEQ ID NO: 282121 - DNA, 20 bp, Artificial
  CRISPR gRNA sequence
aggatgtttagcagcttcct

SEQ ID NO: 282122 - DNA, 20 bp, Artificial
  CRISPR gRNA sequence
agcctctactcactacatgc

SEQ ID NO: 282123 - DNA, 20 bp, Artificial
  CRISPR gRNA sequence
ctctactcactacatgccag

SEQ ID NO: 282124 - DNA, 20 bp, Artificial
  CRISPR gRNA sequence
cgacaatcaaaaatatcccc

SEQ ID NO: 282125 - DNA, 20 bp, Artificial
  CRISPR gRNA sequence
agcattgccaaatgtcccct

SEQ ID NO: 282126 - DNA, 20 bp, Artificial
  CRISPR gRNA sequence
tgccaaatgtccccttggca

SEQ ID NO: 282127 - DNA, 20 bp, Artificial
  CRISPR gRNA sequence
ccaaatgtccccttggcaaa

SEQ ID NO: 282128 - DNA, 20 bp, Artificial
  CRISPR gRNA sequence
caaatgtccccttggcaaag

SEQ ID NO: 282129 - DNA, 20 bp, Artificial
  CRISPR gRNA sequence
gtccccttggcaaagaggta

SEQ ID NO: 282130 - DNA, 20 bp, Artificial
  CRISPR gRNA sequence
ccccttggcaaagaggtaaa

SEQ ID NO: 282131 - DNA, 20 bp, Artificial
  CRISPR gRNA sequence
cccttggcaaagaggtaaag

SEQ ID NO: 282132 - DNA, 20 bp, Artificial
  CRISPR gRNA sequence
ccttggcaaagaggtaaaga

SEQ ID NO: 282133 - DNA, 20 bp, Artificial
  CRISPR gRNA sequence
ttggcaaagaggtaaagagg

SEQ ID NO: 282134 - DNA, 20 bp, Artificial
  CRISPR gRNA sequence
ggagcattgtaaatcacccc

SEQ ID NO: 282135 - DNA, 20 bp, Artificial
  CRISPR gRNA sequence
ttgtaaatcacccctggtat

SEQ ID NO: 282136 - DNA, 20 bp, Artificial
  CRISPR gRNA sequence
tggtataagaacaactgctc

SEQ ID NO: 282137 - DNA, 20 bp, Artificial
  CRISPR gRNA sequence
agaacaactgctccagttct

SEQ ID NO: 282138 - DNA, 20 bp, Artificial
  CRISPR gRNA sequence
caactgctccagttctaagc

SEQ ID NO: 282139 - DNA, 20 bp, Artificial
  CRISPR gRNA sequence
tccagttctaagccagtctg

SEQ ID NO: 282140 - DNA, 20 bp, Artificial
  CRISPR gRNA sequence
gccagtctgaagccttgcta

SEQ ID NO: 282141 - DNA, 20 bp, Artificial
  CRISPR gRNA sequence
ctaaagtaaatattaacata

SEQ ID NO: 282142 - DNA, 20 bp, Artificial
  CRISPR gRNA sequence
taaagtaaatattaacatat

SEQ ID NO: 282143 - DNA, 20 bp, Artificial
  CRISPR gRNA sequence
ttaacatatgggcacaattc

SEQ ID NO: 282144 - DNA, 20 bp, Artificial
  CRISPR gRNA sequence
taacatatgggcacaattca

SEQ ID NO: 282145 - DNA, 20 bp, Artificial
  CRISPR gRNA sequence
aacatatgggcacaattcaa

SEQ ID NO: 282146 - DNA, 20 bp, Artificial
  CRISPR gRNA sequence
tattgtttgttcttgtctcc

SEQ ID NO: 282147 - DNA, 20 bp, Artificial
  CRISPR gRNA sequence
attgtttgttcttgtctcca

SEQ ID NO: 282148 - DNA, 20 bp, Artificial
  CRISPR gRNA sequence
tgtctccaaggctttgcccc

SEQ ID NO: 282149 - DNA, 20 bp, Artificial
  CRISPR gRNA sequence
caaggctttgccccaagatg

SEQ ID NO: 282150 - DNA, 20 bp, Artificial
  CRISPR gRNA sequence
aggctttgccccaagatgca

SEQ ID NO: 282151 - DNA, 20 bp, Artificial
  CRISPR gRNA sequence
gctttgccccaagatgcaga

SEQ ID NO: 282152 - DNA, 20 bp, Artificial
  CRISPR gRNA sequence
tttgccccaagatgcagaga

SEQ ID NO: 282153 - DNA, 20 bp, Artificial
  CRISPR gRNA sequence
gccccaagatgcagagagag

SEQ ID NO: 282154 - DNA, 20 bp, Artificial
  CRISPR gRNA sequence
ccccaagatgcagagagaga

SEQ ID NO: 282155 - DNA, 20 bp, Artificial
  CRISPR gRNA sequence
ccaagatgcagagagagaag

SEQ ID NO: 282156 - DNA, 20 bp, Artificial
  CRISPR gRNA sequence
caagatgcagagagagaagg

SEQ ID NO: 282157 - DNA, 20 bp, Artificial
  CRISPR gRNA sequence
gcagagagagaaggaggaat

SEQ ID NO: 282158 - DNA, 20 bp, Artificial
  CRISPR gRNA sequence
agagagagaaggaggaatga

SEQ ID NO: 282159 - DNA, 20 bp, Artificial
  CRISPR gRNA sequence
agaaggaggaatgagagatt

SEQ ID NO: 282160 - DNA, 20 bp, Artificial
  CRISPR gRNA sequence
aggaggaatgagagattgag

SEQ ID NO: 282161 - DNA, 20 bp, Artificial
  CRISPR gRNA sequence
ggaggaatgagagattgaga

SEQ ID NO: 282162 - DNA, 20 bp, Artificial
  CRISPR gRNA sequence
gaggaatgagagattgagaa

SEQ ID NO: 282163 - DNA, 20 bp, Artificial
  CRISPR gRNA sequence
aatgagagattgagaaggga

SEQ ID NO: 282164 - DNA, 20 bp, Artificial
  CRISPR gRNA sequence
aaagtgtacgccctgtataa

SEQ ID NO: 282165 - DNA, 20 bp, Artificial
  CRISPR gRNA sequence
gccctgtataacagtgtccg

SEQ ID NO: 282166 - DNA, 20 bp, Artificial
  CRISPR gRNA sequence
ctgtataacagtgtccgcag

SEQ ID NO: 282167 - DNA, 20 bp, Artificial
  CRISPR gRNA sequence
ataacagtgtccgcagaagc

SEQ ID NO: 282168 - DNA, 20 bp, Artificial
  CRISPR gRNA sequence
taacagtgtccgcagaagca

SEQ ID NO: 282169 - DNA, 20 bp, Artificial
  CRISPR gRNA sequence
aacagtgtccgcagaagcaa

SEQ ID NO: 282170 - DNA, 20 bp, Artificial
  CRISPR gRNA sequence
acagtgtccgcagaagcaag

SEQ ID NO: 282171 - DNA, 20 bp, Artificial
  CRISPR gRNA sequence
cgcagaagcaaggggctgaa

SEQ ID NO: 282172 - DNA, 20 bp, Artificial
  CRISPR gRNA sequence
caaggggctgaaaagatctg

SEQ ID NO: 282173 - DNA, 20 bp, Artificial
  CRISPR gRNA sequence
aaggggctgaaaagatctga

SEQ ID NO: 282174 - DNA, 20 bp, Artificial
  CRISPR gRNA sequence
gggctgaaaagatctgaagg

SEQ ID NO: 282175 - DNA, 20 bp, Artificial
  CRISPR gRNA sequence
gtagcctccgtcatctcttc

SEQ ID NO: 282176 - DNA, 20 bp, Artificial
  CRISPR gRNA sequence
tagcctccgtcatctcttct

SEQ ID NO: 282177 - DNA, 20 bp, Artificial
  CRISPR gRNA sequence
gtcatctcttctgggataca

SEQ ID NO: 282178 - DNA, 20 bp, Artificial
  CRISPR gRNA sequence
cttctgggatacatggatcg

SEQ ID NO: 282179 - DNA, 20 bp, Artificial
  CRISPR gRNA sequence
ttctgggatacatggatcgt

SEQ ID NO: 282180 - DNA, 20 bp, Artificial
  CRISPR gRNA sequence
tctgggatacatggatcgtg

SEQ ID NO: 282181 - DNA, 20 bp, Artificial
  CRISPR gRNA sequence
acatggatcgtggggatcat

SEQ ID NO: 282182 - DNA, 20 bp, Artificial
  CRISPR gRNA sequence
catggatcgtggggatcatg

SEQ ID NO: 282183 - DNA, 20 bp, Artificial
  CRISPR gRNA sequence
attcttcccttaacaaattt

SEQ ID NO: 282184 - DNA, 20 bp, Artificial
  CRISPR gRNA sequence
accttcttaaaaacctcttt

SEQ ID NO: 282185 - DNA, 20 bp, Artificial
  CRISPR gRNA sequence
ttaaaaacctctttcagatt

SEQ ID NO: 282186 - DNA, 20 bp, Artificial
  CRISPR gRNA sequence
ctctttcagattaagctgaa

SEQ ID NO: 282187 - DNA, 20 bp, Artificial
  CRISPR gRNA sequence
agattaagctgaacagttac

SEQ ID NO: 282188 - DNA, 20 bp, Artificial
  CRISPR gRNA sequence
taagctgaacagttacaaga

SEQ ID NO: 282189 - DNA, 20 bp, Artificial
  CRISPR gRNA sequence
ctgaacagttacaagatggc

SEQ ID NO: 282190 - DNA, 20 bp, Artificial
  CRISPR gRNA sequence
gccatcttgaattgtcttgt

SEQ ID NO: 282191 - DNA, 20 bp, Artificial
  CRISPR gRNA sequence
tatctattaaacactaattt

SEQ ID NO: 282192 - DNA, 20 bp, Artificial
  CRISPR gRNA sequence
gttcatcttgaatattcctg

SEQ ID NO: 282193 - DNA, 20 bp, Artificial
  CRISPR gRNA sequence
tcatttttccctctatctct

SEQ ID NO: 282194 - DNA, 20 bp, Artificial
  CRISPR gRNA sequence
cctctatctctcagtattga

SEQ ID NO: 282195 - DNA, 20 bp, Artificial
  CRISPR gRNA sequence
tctctcagtattgatggaca

SEQ ID NO: 282196 - DNA, 20 bp, Artificial
  CRISPR gRNA sequence
ctctcagtattgatggacat

SEQ ID NO: 282197 - DNA, 20 bp, Artificial
  CRISPR gRNA sequence
cagtattgatggacatgggt

SEQ ID NO: 282198 - DNA, 20 bp, Artificial
  CRISPR gRNA sequence
agtattgatggacatgggtt

SEQ ID NO: 282199 - DNA, 20 bp, Artificial
  CRISPR gRNA sequence
gtattgatggacatgggttg

SEQ ID NO: 282200 - DNA, 20 bp, Artificial
  CRISPR gRNA sequence
ggggtcactttgtattaaca

SEQ ID NO: 282201 - DNA, 20 bp, Artificial
  CRISPR gRNA sequence
taacacggtaacattttcat

SEQ ID NO: 282202 - DNA, 20 bp, Artificial
  CRISPR gRNA sequence
gtttctctgcctcttactaa

SEQ ID NO: 282203 - DNA, 20 bp, Artificial
  CRISPR gRNA sequence
ctcatcctactgacgaatca

SEQ ID NO: 282204 - DNA, 20 bp, Artificial
  CRISPR gRNA sequence
catcctactgacgaatcatg

SEQ ID NO: 282205 - DNA, 20 bp, Artificial
  CRISPR gRNA sequence
tcatggagccaaatttcaca

SEQ ID NO: 282206 - DNA, 20 bp, Artificial
  CRISPR gRNA sequence
cattttcccactcaaaaact

SEQ ID NO: 282207 - DNA, 20 bp, Artificial
  CRISPR gRNA sequence
tttcccactcaaaaactcag

SEQ ID NO: 282208 - DNA, 20 bp, Artificial
  CRISPR gRNA sequence
tcccactcaaaaactcagaa

SEQ ID NO: 282209 - DNA, 20 bp, Artificial
  CRISPR gRNA sequence
agaagagaccccactgccta

SEQ ID NO: 282210 - DNA, 20 bp, Artificial
  CRISPR gRNA sequence
gaccccactgcctacagaaa

SEQ ID NO: 282211 - DNA, 20 bp, Artificial
  CRISPR gRNA sequence
tgcctacagaaaaagcttca

SEQ ID NO: 282212 - DNA, 20 bp, Artificial
  CRISPR gRNA sequence
ctttttaactttccacattc

SEQ ID NO: 282213 - DNA, 20 bp, Artificial
  CRISPR gRNA sequence
cacattccagctgatctctt

SEQ ID NO: 282214 - DNA, 20 bp, Artificial
  CRISPR gRNA sequence
tcttcagtctaaataccctt

SEQ ID NO: 282215 - DNA, 20 bp, Artificial
  CRISPR gRNA sequence
tctgtcaattgttcctcaca

SEQ ID NO: 282216 - DNA, 20 bp, Artificial
  CRISPR gRNA sequence
caattgttcctcacatggca

SEQ ID NO: 282217 - DNA, 20 bp, Artificial
  CRISPR gRNA sequence
tcctcacatggcatggtttc

SEQ ID NO: 282218 - DNA, 20 bp, Artificial
  CRISPR gRNA sequence
tttccagtgcctcacatgaa

SEQ ID NO: 282219 - DNA, 20 bp, Artificial
  CRISPR gRNA sequence
ttccagtgcctcacatgaat

SEQ ID NO: 282220 - DNA, 20 bp, Artificial
  CRISPR gRNA sequence
tccagtgcctcacatgaatg

SEQ ID NO: 282221 - DNA, 20 bp, Artificial
  CRISPR gRNA sequence
cctcacatgaatggggtaaa

SEQ ID NO: 282222 - DNA, 20 bp, Artificial
  CRISPR gRNA sequence
gaatggggtaaacggaaccc

SEQ ID NO: 282223 - DNA, 20 bp, Artificial
  CRISPR gRNA sequence
gtaaacggaacccaagactt

SEQ ID NO: 282224 - DNA, 20 bp, Artificial
  CRISPR gRNA sequence
ggaacccaagactttagatt

SEQ ID NO: 282225 - DNA, 20 bp, Artificial
  CRISPR gRNA sequence
ttaatgactctacatacaat

SEQ ID NO: 282226 - DNA, 20 bp, Artificial
  CRISPR gRNA sequence
acaatgagataattattatc

SEQ ID NO: 282227 - DNA, 20 bp, Artificial
  CRISPR gRNA sequence
caatgagataattattatct

SEQ ID NO: 282228 - DNA, 20 bp, Artificial
  CRISPR gRNA sequence
aatgagataattattatctg

SEQ ID NO: 282229 - DNA, 20 bp, Artificial
  CRISPR gRNA sequence
gataattattatctggggtc

SEQ ID NO: 282230 - DNA, 20 bp, Artificial
  CRISPR gRNA sequence
tctggaatgtccatcctgtt

SEQ ID NO: 282231 - DNA, 20 bp, Artificial
  CRISPR gRNA sequence
tggaatgtccatcctgttaa

SEQ ID NO: 282232 - DNA, 20 bp, Artificial
  CRISPR gRNA sequence
gaatgtccatcctgttaaga

SEQ ID NO: 282233 - DNA, 20 bp, Artificial
  CRISPR gRNA sequence
cctgttaagagagcctaaca

SEQ ID NO: 282234 - DNA, 20 bp, Artificial
  CRISPR gRNA sequence
aagagagcctaacacagcac

SEQ ID NO: 282235 - DNA, 20 bp, Artificial
  CRISPR gRNA sequence
gcctaacacagcactagctt

SEQ ID NO: 282236 - DNA, 20 bp, Artificial
  CRISPR gRNA sequence
aacacagcactagctttagt

SEQ ID NO: 282237 - DNA, 20 bp, Artificial
  CRISPR gRNA sequence
tttagtgagtcacaaatccc

SEQ ID NO: 282238 - DNA, 20 bp, Artificial
  CRISPR gRNA sequence
ttagtgagtcacaaatcccc

SEQ ID NO: 282239 - DNA, 20 bp, Artificial
  CRISPR gRNA sequence
atccccaggtattttcatgc

SEQ ID NO: 282240 - DNA, 20 bp, Artificial
  CRISPR gRNA sequence
ccccaggtattttcatgcaa

SEQ ID NO: 282241 - DNA, 20 bp, Artificial
  CRISPR gRNA sequence
tcatgcaagagaaacttaca

SEQ ID NO: 282242 - DNA, 20 bp, Artificial
  CRISPR gRNA sequence
catgcaagagaaacttacat

SEQ ID NO: 282243 - DNA, 20 bp, Artificial
  CRISPR gRNA sequence
gagaaacttacatgggacat

SEQ ID NO: 282244 - DNA, 20 bp, Artificial
  CRISPR gRNA sequence
tacatgggacattagaatcc

SEQ ID NO: 282245 - DNA, 20 bp, Artificial
  CRISPR gRNA sequence
catgggacattagaatccaa

SEQ ID NO: 282246 - DNA, 20 bp, Artificial
  CRISPR gRNA sequence
agaatccaagagactgatat

SEQ ID NO: 282247 - DNA, 20 bp, Artificial
  CRISPR gRNA sequence
gaatccaagagactgatatc

SEQ ID NO: 282248 - DNA, 20 bp, Artificial
  CRISPR gRNA sequence
aagagactgatatcaggtcc

SEQ ID NO: 282249 - DNA, 20 bp, Artificial
  CRISPR gRNA sequence
agagactgatatcaggtccc

SEQ ID NO: 282250 - DNA, 20 bp, Artificial
  CRISPR gRNA sequence
gactgatatcaggtcccagg

SEQ ID NO: 282251 - DNA, 20 bp, Artificial
  CRISPR gRNA sequence
atcaggtcccaggtagttat

SEQ ID NO: 282252 - DNA, 20 bp, Artificial
  CRISPR gRNA sequence
tagttataagcctccctaaa

SEQ ID NO: 282253 - DNA, 20 bp, Artificial
  CRISPR gRNA sequence
ataagcctccctaaacagtt

SEQ ID NO: 282254 - DNA, 20 bp, Artificial
  CRISPR gRNA sequence
cagttcagctttgacttgtg

SEQ ID NO: 282255 - DNA, 20 bp, Artificial
  CRISPR gRNA sequence
agttcagctttgacttgtga

SEQ ID NO: 282256 - DNA, 20 bp, Artificial
  CRISPR gRNA sequence
cagctttgacttgtgaaggt

SEQ ID NO: 282257 - DNA, 20 bp, Artificial
  CRISPR gRNA sequence
gctttgacttgtgaaggtta

SEQ ID NO: 282258 - DNA, 20 bp, Artificial
  CRISPR gRNA sequence
tgtgaaggttagagtaacac

SEQ ID NO: 282259 - DNA, 20 bp, Artificial
  CRISPR gRNA sequence
aggttagagtaacaccagta

SEQ ID NO: 282260 - DNA, 20 bp, Artificial
  CRISPR gRNA sequence
ggttagagtaacaccagtat

SEQ ID NO: 282261 - DNA, 20 bp, Artificial
  CRISPR gRNA sequence
agtaacaccagtataggaat

SEQ ID NO: 282262 - DNA, 20 bp, Artificial
  CRISPR gRNA sequence
caaaattatctttaaaaata

SEQ ID NO: 282263 - DNA, 20 bp, Artificial
  CRISPR gRNA sequence
aaaattatctttaaaaataa

SEQ ID NO: 282264 - DNA, 20 bp, Artificial
  CRISPR gRNA sequence
ttatctttaaaaataaagga

SEQ ID NO: 282265 - DNA, 20 bp, Artificial
  CRISPR gRNA sequence
ctttaaaaataaaggaaagc

SEQ ID NO: 282266 - DNA, 20 bp, Artificial
  CRISPR gRNA sequence
aaggaaagcaagaattgtcc

SEQ ID NO: 282267 - DNA, 20 bp, Artificial
  CRISPR gRNA sequence
aggaaagcaagaattgtcct

SEQ ID NO: 282268 - DNA, 20 bp, Artificial
  CRISPR gRNA sequence
aaagcaagaattgtcctggg

SEQ ID NO: 282269 - DNA, 20 bp, Artificial
  CRISPR gRNA sequence
aagcaagaattgtcctgggc

SEQ ID NO: 282270 - DNA, 20 bp, Artificial
  CRISPR gRNA sequence
gcaagaattgtcctgggcag

SEQ ID NO: 282271 - DNA, 20 bp, Artificial
  CRISPR gRNA sequence
caagaattgtcctgggcagg

SEQ ID NO: 282272 - DNA, 20 bp, Artificial
  CRISPR gRNA sequence
aagaattgtcctgggcagga

SEQ ID NO: 282273 - DNA, 20 bp, Artificial
  CRISPR gRNA sequence
agaattgtcctgggcaggag

SEQ ID NO: 282274 - DNA, 20 bp, Artificial
  CRISPR gRNA sequence
gaattgtcctgggcaggagg

SEQ ID NO: 282275 - DNA, 20 bp, Artificial
  CRISPR gRNA sequence
gggcaggagggggaaatata

SEQ ID NO: 282276 - DNA, 20 bp, Artificial
  CRISPR gRNA sequence
aatacctgacgcttatacaa

SEQ ID NO: 282277 - DNA, 20 bp, Artificial
  CRISPR gRNA sequence
atacctgacgcttatacaac

SEQ ID NO: 282278 - DNA, 20 bp, Artificial
  CRISPR gRNA sequence
gcaaaaacactatttcatct

SEQ ID NO: 282279 - DNA, 20 bp, Artificial
  CRISPR gRNA sequence
agtcttataaaaatctctat

SEQ ID NO: 282280 - DNA, 20 bp, Artificial
  CRISPR gRNA sequence
ttataaaaatctctatgagc

SEQ ID NO: 282281 - DNA, 20 bp, Artificial
  CRISPR gRNA sequence
caagatctatttccatgtta

SEQ ID NO: 282282 - DNA, 20 bp, Artificial
  CRISPR gRNA sequence
aagatctatttccatgttat

SEQ ID NO: 282283 - DNA, 20 bp, Artificial
  CRISPR gRNA sequence
gatctatttccatgttatgg

SEQ ID NO: 282284 - DNA, 20 bp, Artificial
  CRISPR gRNA sequence
tctatttccatgttatggga

SEQ ID NO: 282285 - DNA, 20 bp, Artificial
  CRISPR gRNA sequence
ccatgttatgggagagaaac

SEQ ID NO: 282286 - DNA, 20 bp, Artificial
  CRISPR gRNA sequence
atgttatgggagagaaacca

SEQ ID NO: 282287 - DNA, 20 bp, Artificial
  CRISPR gRNA sequence
tgttatgggagagaaaccag

SEQ ID NO: 282288 - DNA, 20 bp, Artificial
  CRISPR gRNA sequence
ggagagaaaccagaggctcc

SEQ ID NO: 282289 - DNA, 20 bp, Artificial
  CRISPR gRNA sequence
agagaaaccagaggctccca

SEQ ID NO: 282290 - DNA, 20 bp, Artificial
  CRISPR gRNA sequence
gagaaaccagaggctcccag

SEQ ID NO: 282291 - DNA, 20 bp, Artificial
  CRISPR gRNA sequence
accagaggctcccagaggtt

SEQ ID NO: 282292 - DNA, 20 bp, Artificial
  CRISPR gRNA sequence
cagaggctcccagaggttaa

SEQ ID NO: 282293 - DNA, 20 bp, Artificial
  CRISPR gRNA sequence
agaggttaagagatttgctt

SEQ ID NO: 282294 - DNA, 20 bp, Artificial
  CRISPR gRNA sequence
gaggttaagagatttgcttg

SEQ ID NO: 282295 - DNA, 20 bp, Artificial
  CRISPR gRNA sequence
taagagatttgcttgaggta

SEQ ID NO: 282296 - DNA, 20 bp, Artificial
  CRISPR gRNA sequence
ttgcttgaggtacggtcata

SEQ ID NO: 282297 - DNA, 20 bp, Artificial
  CRISPR gRNA sequence
gaggtacggtcatacagatg

SEQ ID NO: 282298 - DNA, 20 bp, Artificial
  CRISPR gRNA sequence
tacagatgaagaataaaacc

SEQ ID NO: 282299 - DNA, 20 bp, Artificial
  CRISPR gRNA sequence
aataaaaccaagattcaaac

SEQ ID NO: 282300 - DNA, 20 bp, Artificial
  CRISPR gRNA sequence
caagattcaaactggacatc

SEQ ID NO: 282301 - DNA, 20 bp, Artificial
  CRISPR gRNA sequence
ttcaaactggacatcaagtt

SEQ ID NO: 282302 - DNA, 20 bp, Artificial
  CRISPR gRNA sequence
tcaaactggacatcaagttc

SEQ ID NO: 282303 - DNA, 20 bp, Artificial
  CRISPR gRNA sequence
aggctcctttccctacaacc

SEQ ID NO: 282304 - DNA, 20 bp, Artificial
  CRISPR gRNA sequence
ctcctttccctacaacctgg

SEQ ID NO: 282305 - DNA, 20 bp, Artificial
  CRISPR gRNA sequence
gcctacacatattttccccc

SEQ ID NO: 282306 - DNA, 20 bp, Artificial
  CRISPR gRNA sequence
cctacacatattttccccca

SEQ ID NO: 282307 - DNA, 20 bp, Artificial
  CRISPR gRNA sequence
acacatattttcccccaagg

SEQ ID NO: 282308 - DNA, 20 bp, Artificial
  CRISPR gRNA sequence
ctgaatgcttgctcactcct

SEQ ID NO: 282309 - DNA, 20 bp, Artificial
  CRISPR gRNA sequence
actcctcagaatgtcttttc

SEQ ID NO: 282310 - DNA, 20 bp, Artificial
  CRISPR gRNA sequence
ctcctcagaatgtcttttcc

SEQ ID NO: 282311 - DNA, 20 bp, Artificial
  CRISPR gRNA sequence
tcttttccaggatgttgctc

SEQ ID NO: 282312 - DNA, 20 bp, Artificial
  CRISPR gRNA sequence
tccaggatgttgctctggct

SEQ ID NO: 282313 - DNA, 20 bp, Artificial
  CRISPR gRNA sequence
ttcttgactttctatctaaa

SEQ ID NO: 282314 - DNA, 20 bp, Artificial
  CRISPR gRNA sequence
tatctaaaaagtcttctgct

SEQ ID NO: 282315 - DNA, 20 bp, Artificial
  CRISPR gRNA sequence
tctgctgatacttcaaaatg

SEQ ID NO: 282316 - DNA, 20 bp, Artificial
  CRISPR gRNA sequence
gtgtacccaatcttctacac

SEQ ID NO: 282317 - DNA, 20 bp, Artificial
  CRISPR gRNA sequence
tgtacccaatcttctacaca

SEQ ID NO: 282318 - DNA, 20 bp, Artificial
  CRISPR gRNA sequence
cttctacacaaggccttctg

SEQ ID NO: 282319 - DNA, 20 bp, Artificial
  CRISPR gRNA sequence
ccttctgtggtcatcttgtc

SEQ ID NO: 282320 - DNA, 20 bp, Artificial
  CRISPR gRNA sequence
gtggtcatcttgtctagctc

SEQ ID NO: 282321 - DNA, 20 bp, Artificial
  CRISPR gRNA sequence
gtcatcttgtctagctcaag

SEQ ID NO: 282322 - DNA, 20 bp, Artificial
  CRISPR gRNA sequence
ctcaagcagttccacctcta

SEQ ID NO: 282323 - DNA, 20 bp, Artificial
  CRISPR gRNA sequence
tatagcacatctcataccac

SEQ ID NO: 282324 - DNA, 20 bp, Artificial
  CRISPR gRNA sequence
cacatctcataccaccagca

SEQ ID NO: 282325 - DNA, 20 bp, Artificial
  CRISPR gRNA sequence
acatctcataccaccagcat

SEQ ID NO: 282326 - DNA, 20 bp, Artificial
  CRISPR gRNA sequence
atcttccttctatcctttac

SEQ ID NO: 282327 - DNA, 20 bp, Artificial
  CRISPR gRNA sequence
atcctttactggactgtatg

SEQ ID NO: 282328 - DNA, 20 bp, Artificial
  CRISPR gRNA sequence
tcctttactggactgtatgt

SEQ ID NO: 282329 - DNA, 20 bp, Artificial
  CRISPR gRNA sequence
ggactgtatgtaggtttatt

SEQ ID NO: 282330 - DNA, 20 bp, Artificial
  CRISPR gRNA sequence
gtatgtaggtttattgagaa

SEQ ID NO: 282331 - DNA, 20 bp, Artificial
  CRISPR gRNA sequence
tgagaaaagcaaccatgcct

SEQ ID NO: 282332 - DNA, 20 bp, Artificial
  CRISPR gRNA sequence
agaaaagcaaccatgcctga

SEQ ID NO: 282333 - DNA, 20 bp, Artificial
  CRISPR gRNA sequence
atgcctgagagccccacaca

SEQ ID NO: 282334 - DNA, 20 bp, Artificial
  CRISPR gRNA sequence
cctgagagccccacacatag

SEQ ID NO: 282335 - DNA, 20 bp, Artificial
  CRISPR gRNA sequence
tgagagccccacacatagaa

SEQ ID NO: 282336 - DNA, 20 bp, Artificial
  CRISPR gRNA sequence
gagccccacacatagaagag

SEQ ID NO: 282337 - DNA, 20 bp, Artificial
  CRISPR gRNA sequence
catagaagagtggcttgatc

SEQ ID NO: 282338 - DNA, 20 bp, Artificial
  CRISPR gRNA sequence
gagtggcttgatcaagcatt

SEQ ID NO: 282339 - DNA, 20 bp, Artificial
  CRISPR gRNA sequence
tgatcaagcatttggtcgtt

SEQ ID NO: 282340 - DNA, 20 bp, Artificial
  CRISPR gRNA sequence
agcatttggtcgtttggtaa

SEQ ID NO: 282341 - DNA, 20 bp, Artificial
  CRISPR gRNA sequence
tttggtcgtttggtaatagc

SEQ ID NO: 282342 - DNA, 20 bp, Artificial
  CRISPR gRNA sequence
tttcatgtgacaaaaattgc

SEQ ID NO: 282343 - DNA, 20 bp, Artificial
  CRISPR gRNA sequence
tcatgtgacaaaaattgcca

SEQ ID NO: 282344 - DNA, 20 bp, Artificial
  CRISPR gRNA sequence
tgtgacaaaaattgccagag

SEQ ID NO: 282345 - DNA, 20 bp, Artificial
  CRISPR gRNA sequence
aaaattgccagagtagtttt

SEQ ID NO: 282346 - DNA, 20 bp, Artificial
  CRISPR gRNA sequence
ttttaagttctctcataatt

SEQ ID NO: 282347 - DNA, 20 bp, Artificial
  CRISPR gRNA sequence
agctttcccttcatattctt

SEQ ID NO: 282348 - DNA, 20 bp, Artificial
  CRISPR gRNA sequence
cttcatattcttcagctatc

SEQ ID NO: 282349 - DNA, 20 bp, Artificial
  CRISPR gRNA sequence
ttcatattcttcagctatca

SEQ ID NO: 282350 - DNA, 20 bp, Artificial
  CRISPR gRNA sequence
ctatcaaggttactgtgtac

SEQ ID NO: 282351 - DNA, 20 bp, Artificial
  CRISPR gRNA sequence
caaggttactgtgtacaagc

SEQ ID NO: 282352 - DNA, 20 bp, Artificial
  CRISPR gRNA sequence
aaggttactgtgtacaagct

SEQ ID NO: 282353 - DNA, 20 bp, Artificial
  CRISPR gRNA sequence
ctgggaatacccttgatctt

SEQ ID NO: 282354 - DNA, 20 bp, Artificial
  CRISPR gRNA sequence
ttgagattaaaatgtaaatt

SEQ ID NO: 282355 - DNA, 20 bp, Artificial
  CRISPR gRNA sequence
gagattaaaatgtaaattaa

SEQ ID NO: 282356 - DNA, 20 bp, Artificial
  CRISPR gRNA sequence
taaattaagagattaaaatt

SEQ ID NO: 282357 - DNA, 20 bp, Artificial
  CRISPR gRNA sequence
tttaatatataaataaattt

SEQ ID NO: 282358 - DNA, 20 bp, Artificial
  CRISPR gRNA sequence
gttttcctcctttgccaata

SEQ ID NO: 282359 - DNA, 20 bp, Artificial
  CRISPR gRNA sequence
ttttcctcctttgccaatat

SEQ ID NO: 282360 - DNA, 20 bp, Artificial
  CRISPR gRNA sequence
tttcctcctttgccaatata

SEQ ID NO: 282361 - DNA, 20 bp, Artificial
  CRISPR gRNA sequence
taatcatttctttgttttct

SEQ ID NO: 282362 - DNA, 20 bp, Artificial
  CRISPR gRNA sequence
aatcatttctttgttttctc

SEQ ID NO: 282363 - DNA, 20 bp, Artificial
  CRISPR gRNA sequence
catttgcaattgacctcttc

SEQ ID NO: 282364 - DNA, 20 bp, Artificial
  CRISPR gRNA sequence
atttgcaattgacctcttct

SEQ ID NO: 282365 - DNA, 20 bp, Artificial
  CRISPR gRNA sequence
acctcttctgggaacttcct

SEQ ID NO: 282366 - DNA, 20 bp, Artificial
  CRISPR gRNA sequence
cttctgggaacttcctcaga

SEQ ID NO: 282367 - DNA, 20 bp, Artificial
  CRISPR gRNA sequence
gggaacttcctcagatggac

SEQ ID NO: 282368 - DNA, 20 bp, Artificial
  CRISPR gRNA sequence
gccctttacgtatctgctct

SEQ ID NO: 282369 - DNA, 20 bp, Artificial
  CRISPR gRNA sequence
ccctttacgtatctgctctt

SEQ ID NO: 282370 - DNA, 20 bp, Artificial
  CRISPR gRNA sequence
tcttaggtgcttcttcactt

SEQ ID NO: 282371 - DNA, 20 bp, Artificial
  CRISPR gRNA sequence
tcttcacttcagttgctttg

SEQ ID NO: 282372 - DNA, 20 bp, Artificial
  CRISPR gRNA sequence
cttcacttcagttgctttgc

SEQ ID NO: 282373 - DNA, 20 bp, Artificial
  CRISPR gRNA sequence
cacttcagttgctttgcagg

SEQ ID NO: 282374 - DNA, 20 bp, Artificial
  CRISPR gRNA sequence
gttgctttgcaggaagtgtc

SEQ ID NO: 282375 - DNA, 20 bp, Artificial
  CRISPR gRNA sequence
tgctttgcaggaagtgtcta

SEQ ID NO: 282376 - DNA, 20 bp, Artificial
  CRISPR gRNA sequence
gctttgcaggaagtgtctag

SEQ ID NO: 282377 - DNA, 20 bp, Artificial
  CRISPR gRNA sequence
aggaagtgtctagaggaata

SEQ ID NO: 282378 - DNA, 20 bp, Artificial
  CRISPR gRNA sequence
aagtgtctagaggaatatgg

SEQ ID NO: 282379 - DNA, 20 bp, Artificial
  CRISPR gRNA sequence
agtgtctagaggaatatggt

SEQ ID NO: 282380 - DNA, 20 bp, Artificial
  CRISPR gRNA sequence
ctagaggaatatggtgggca

SEQ ID NO: 282381 - DNA, 20 bp, Artificial
  CRISPR gRNA sequence
gaggaatatggtgggcacag

SEQ ID NO: 282382 - DNA, 20 bp, Artificial
  CRISPR gRNA sequence
gaatatggtgggcacagaag

SEQ ID NO: 282383 - DNA, 20 bp, Artificial
  CRISPR gRNA sequence
ggtgggcacagaagtagctc

SEQ ID NO: 282384 - DNA, 20 bp, Artificial
  CRISPR gRNA sequence
tagctctggtgaccttgatc

SEQ ID NO: 282385 - DNA, 20 bp, Artificial
  CRISPR gRNA sequence
agctctggtgaccttgatca

SEQ ID NO: 282386 - DNA, 20 bp, Artificial
  CRISPR gRNA sequence
gatcaaggtgttttgaaatg

SEQ ID NO: 282387 - DNA, 20 bp, Artificial
  CRISPR gRNA sequence
ttttgaaatgcagaattctt

SEQ ID NO: 282388 - DNA, 20 bp, Artificial
  CRISPR gRNA sequence
aatgcagaattcttgagttc

SEQ ID NO: 282389 - DNA, 20 bp, Artificial
  CRISPR gRNA sequence
gcagaattcttgagttctgg

SEQ ID NO: 282390 - DNA, 20 bp, Artificial
  CRISPR gRNA sequence
cagaattcttgagttctgga

SEQ ID NO: 282391 - DNA, 20 bp, Artificial
  CRISPR gRNA sequence
agaattcttgagttctggaa

SEQ ID NO: 282392 - DNA, 20 bp, Artificial
  CRISPR gRNA sequence
ttgagttctggaagggactt

SEQ ID NO: 282393 - DNA, 20 bp, Artificial
  CRISPR gRNA sequence
gagttctggaagggacttta

SEQ ID NO: 282394 - DNA, 20 bp, Artificial
  CRISPR gRNA sequence
gaagggactttagagaatac

SEQ ID NO: 282395 - DNA, 20 bp, Artificial
  CRISPR gRNA sequence
taccagtgttattaatgaca

SEQ ID NO: 282396 - DNA, 20 bp, Artificial
  CRISPR gRNA sequence
accagtgttattaatgacaa

SEQ ID NO: 282397 - DNA, 20 bp, Artificial
  CRISPR gRNA sequence
ttattaatgacaaaggcact

SEQ ID NO: 282398 - DNA, 20 bp, Artificial
  CRISPR gRNA sequence
tattaatgacaaaggcactg

SEQ ID NO: 282399 - DNA, 20 bp, Artificial
  CRISPR gRNA sequence
atgacaaaggcactgaggcc

SEQ ID NO: 282400 - DNA, 20 bp, Artificial
  CRISPR gRNA sequence
tgacaaaggcactgaggccc

SEQ ID NO: 282401 - DNA, 20 bp, Artificial
  CRISPR gRNA sequence
gacaaaggcactgaggccca

SEQ ID NO: 282402 - DNA, 20 bp, Artificial
  CRISPR gRNA sequence
caaaggcactgaggcccagg

SEQ ID NO: 282403 - DNA, 20 bp, Artificial
  CRISPR gRNA sequence
aaaggcactgaggcccaggg

SEQ ID NO: 282404 - DNA, 20 bp, Artificial
  CRISPR gRNA sequence
gggaggtgacccgaattata

SEQ ID NO: 282405 - DNA, 20 bp, Artificial
  CRISPR gRNA sequence
ggaggtgacccgaattataa

SEQ ID NO: 282406 - DNA, 20 bp, Artificial
  CRISPR gRNA sequence
gtgacccgaattataaaggc

SEQ ID NO: 282407 - DNA, 20 bp, Artificial
  CRISPR gRNA sequence
cgaattataaaggccagcgc

SEQ ID NO: 282408 - DNA, 20 bp, Artificial
  CRISPR gRNA sequence
taaaggccagcgccagaacc

SEQ ID NO: 282409 - DNA, 20 bp, Artificial
  CRISPR gRNA sequence
gaacccagatttcctaactc

SEQ ID NO: 282410 - DNA, 20 bp, Artificial
  CRISPR gRNA sequence
ctggtgctctttccctttat

SEQ ID NO: 282411 - DNA, 20 bp, Artificial
  CRISPR gRNA sequence
tccctttatcagtttgactg

SEQ ID NO: 282412 - DNA, 20 bp, Artificial
  CRISPR gRNA sequence
tttgactgtggcctgttaac

SEQ ID NO: 282413 - DNA, 20 bp, Artificial
  CRISPR gRNA sequence
tggtatatacatatatatgt

SEQ ID NO: 282414 - DNA, 20 bp, Artificial
  CRISPR gRNA sequence
ggtatatacatatatatgtc

SEQ ID NO: 282415 - DNA, 20 bp, Artificial
  CRISPR gRNA sequence
atacatatatatgtcaggca

SEQ ID NO: 282416 - DNA, 20 bp, Artificial
  CRISPR gRNA sequence
tatgtcaggcaaagtgctgc

SEQ ID NO: 282417 - DNA, 20 bp, Artificial
  CRISPR gRNA sequence
gtcaggcaaagtgctgctgg

SEQ ID NO: 282418 - DNA, 20 bp, Artificial
  CRISPR gRNA sequence
aggcaaagtgctgctggaag

SEQ ID NO: 282419 - DNA, 20 bp, Artificial
  CRISPR gRNA sequence
aagtagaatttgtccaataa

SEQ ID NO: 282420 - DNA, 20 bp, Artificial
  CRISPR gRNA sequence
agtagaatttgtccaataac

SEQ ID NO: 282421 - DNA, 20 bp, Artificial
  CRISPR gRNA sequence
gtccaataacaggtcaactt

SEQ ID NO: 282422 - DNA, 20 bp, Artificial
  CRISPR gRNA sequence
ccaataacaggtcaacttca

SEQ ID NO: 282423 - DNA, 20 bp, Artificial
  CRISPR gRNA sequence
actatctgatttcctaatgt

SEQ ID NO: 282424 - DNA, 20 bp, Artificial
  CRISPR gRNA sequence
tatctgatttcctaatgtca

SEQ ID NO: 282425 - DNA, 20 bp, Artificial
  CRISPR gRNA sequence
ctgatttcctaatgtcagag

SEQ ID NO: 282426 - DNA, 20 bp, Artificial
  CRISPR gRNA sequence
atttcctaatgtcagagtag

SEQ ID NO: 282427 - DNA, 20 bp, Artificial
  CRISPR gRNA sequence
ttttatgctgctgtttacaa

SEQ ID NO: 282428 - DNA, 20 bp, Artificial
  CRISPR gRNA sequence
caaaagcccaatgtaatgca

SEQ ID NO: 282429 - DNA, 20 bp, Artificial
  CRISPR gRNA sequence
aaaagcccaatgtaatgcat

SEQ ID NO: 282430 - DNA, 20 bp, Artificial
  CRISPR gRNA sequence
agcccaatgtaatgcatagg

SEQ ID NO: 282431 - DNA, 20 bp, Artificial
  CRISPR gRNA sequence
aatgtaatgcataggaagta

SEQ ID NO: 282432 - DNA, 20 bp, Artificial
  CRISPR gRNA sequence
aagtatggcatgaacatctt

SEQ ID NO: 282433 - DNA, 20 bp, Artificial
  CRISPR gRNA sequence
agtatggcatgaacatcttt

SEQ ID NO: 282434 - DNA, 20 bp, Artificial
  CRISPR gRNA sequence
tatggcatgaacatctttag

SEQ ID NO: 282435 - DNA, 20 bp, Artificial
  CRISPR gRNA sequence
gaacatctttaggagactaa

SEQ ID NO: 282436 - DNA, 20 bp, Artificial
  CRISPR gRNA sequence
gagactaatggaaatattat

SEQ ID NO: 282437 - DNA, 20 bp, Artificial
  CRISPR gRNA sequence
aaatattattggtgtttacc

SEQ ID NO: 282438 - DNA, 20 bp, Artificial
  CRISPR gRNA sequence
ctgctctctcactcccccat

SEQ ID NO: 282439 - DNA, 20 bp, Artificial
  CRISPR gRNA sequence
tgctctctcactcccccatg

SEQ ID NO: 282440 - DNA, 20 bp, Artificial
  CRISPR gRNA sequence
tctcactcccccatgaggta

SEQ ID NO: 282441 - DNA, 20 bp, Artificial
  CRISPR gRNA sequence
cactcccccatgaggtacag

SEQ ID NO: 282442 - DNA, 20 bp, Artificial
  CRISPR gRNA sequence
cccccatgaggtacagcaga

SEQ ID NO: 282443 - DNA, 20 bp, Artificial
  CRISPR gRNA sequence
ccccatgaggtacagcagaa

SEQ ID NO: 282444 - DNA, 20 bp, Artificial
  CRISPR gRNA sequence
ccatgaggtacagcagaaag

SEQ ID NO: 282445 - DNA, 20 bp, Artificial
  CRISPR gRNA sequence
actaatttcctctgacatgt

SEQ ID NO: 282446 - DNA, 20 bp, Artificial
  CRISPR gRNA sequence
gacatgtaagacgaatgatt

SEQ ID NO: 282447 - DNA, 20 bp, Artificial
  CRISPR gRNA sequence
acatgtaagacgaatgattt

SEQ ID NO: 282448 - DNA, 20 bp, Artificial
  CRISPR gRNA sequence
cgaatgatttaggtacgtca

SEQ ID NO: 282449 - DNA, 20 bp, Artificial
  CRISPR gRNA sequence
atgatttaggtacgtcaaag

SEQ ID NO: 282450 - DNA, 20 bp, Artificial
  CRISPR gRNA sequence
atttaggtacgtcaaagcag

SEQ ID NO: 282451 - DNA, 20 bp, Artificial
  CRISPR gRNA sequence
ggtacgtcaaagcagtagtc

SEQ ID NO: 282452 - DNA, 20 bp, Artificial
  CRISPR gRNA sequence
gtacgtcaaagcagtagtca

SEQ ID NO: 282453 - DNA, 20 bp, Artificial
  CRISPR gRNA sequence
acgtcaaagcagtagtcaag

SEQ ID NO: 282454 - DNA, 20 bp, Artificial
  CRISPR gRNA sequence
cgtcaaagcagtagtcaagg

SEQ ID NO: 282455 - DNA, 20 bp, Artificial
  CRISPR gRNA sequence
aaagcagtagtcaaggagga

SEQ ID NO: 282456 - DNA, 20 bp, Artificial
  CRISPR gRNA sequence
aagcagtagtcaaggaggaa

SEQ ID NO: 282457 - DNA, 20 bp, Artificial
  CRISPR gRNA sequence
agcagtagtcaaggaggaaa

SEQ ID NO: 282458 - DNA, 20 bp, Artificial
  CRISPR gRNA sequence
gtagtcaaggaggaaaggga

SEQ ID NO: 282459 - DNA, 20 bp, Artificial
  CRISPR gRNA sequence
aggaggaaagggatagtcca

SEQ ID NO: 282460 - DNA, 20 bp, Artificial
  CRISPR gRNA sequence
ggatagtccaaagacttaac

SEQ ID NO: 282461 - DNA, 20 bp, Artificial
  CRISPR gRNA sequence
aagacttaactggttcatat

SEQ ID NO: 282462 - DNA, 20 bp, Artificial
  CRISPR gRNA sequence
ggactgataatctctttaaa

SEQ ID NO: 282463 - DNA, 20 bp, Artificial
  CRISPR gRNA sequence
ctctttaaatggctttatgc

SEQ ID NO: 282464 - DNA, 20 bp, Artificial
  CRISPR gRNA sequence
ctcatttgtaaaatatttat

SEQ ID NO: 282465 - DNA, 20 bp, Artificial
  CRISPR gRNA sequence
tttgtaaaatatttatgaga

SEQ ID NO: 282466 - DNA, 20 bp, Artificial
  CRISPR gRNA sequence
agaaagttctcatttaaaat

SEQ ID NO: 282467 - DNA, 20 bp, Artificial
  CRISPR gRNA sequence
taaaatgagatcgttgttta

SEQ ID NO: 282468 - DNA, 20 bp, Artificial
  CRISPR gRNA sequence
ttgtttacagtgtatgtact

SEQ ID NO: 282469 - DNA, 20 bp, Artificial
  CRISPR gRNA sequence
tttacagtgtatgtactaag

SEQ ID NO: 282470 - DNA, 20 bp, Artificial
  CRISPR gRNA sequence
cagtgtatgtactaagcagt

SEQ ID NO: 282471 - DNA, 20 bp, Artificial
  CRISPR gRNA sequence
taagctatcttcaaatgtct

SEQ ID NO: 282472 - DNA, 20 bp, Artificial
  CRISPR gRNA sequence
aagctatcttcaaatgtcta

SEQ ID NO: 282473 - DNA, 20 bp, Artificial
  CRISPR gRNA sequence
ctatcttcaaatgtctaagg

SEQ ID NO: 282474 - DNA, 20 bp, Artificial
  CRISPR gRNA sequence
tctaaggtagtaactttcca

SEQ ID NO: 282475 - DNA, 20 bp, Artificial
  CRISPR gRNA sequence
ctaaggtagtaactttccat

SEQ ID NO: 282476 - DNA, 20 bp, Artificial
  CRISPR gRNA sequence
taaggtagtaactttccata

SEQ ID NO: 282477 - DNA, 20 bp, Artificial
  CRISPR gRNA sequence
aactttccatagggcctcct

SEQ ID NO: 282478 - DNA, 20 bp, Artificial
  CRISPR gRNA sequence
tagggcctccttagatccct

SEQ ID NO: 282479 - DNA, 20 bp, Artificial
  CRISPR gRNA sequence
gcctccttagatccctaaga

SEQ ID NO: 282480 - DNA, 20 bp, Artificial
  CRISPR gRNA sequence
ctaagatggctttttctcct

SEQ ID NO: 282481 - DNA, 20 bp, Artificial
  CRISPR gRNA sequence
ctttttctccttggtatttc

SEQ ID NO: 282482 - DNA, 20 bp, Artificial
  CRISPR gRNA sequence
tttttctccttggtatttct

SEQ ID NO: 282483 - DNA, 20 bp, Artificial
  CRISPR gRNA sequence
tttctgggtctttctgacat

SEQ ID NO: 282484 - DNA, 20 bp, Artificial
  CRISPR gRNA sequence
ctgggtctttctgacatcag

SEQ ID NO: 282485 - DNA, 20 bp, Artificial
  CRISPR gRNA sequence
gggtctttctgacatcagca

SEQ ID NO: 282486 - DNA, 20 bp, Artificial
  CRISPR gRNA sequence
ttctgacatcagcagagaac

SEQ ID NO: 282487 - DNA, 20 bp, Artificial
  CRISPR gRNA sequence
gacatcagcagagaactgga

SEQ ID NO: 282488 - DNA, 20 bp, Artificial
  CRISPR gRNA sequence
agcagagaactggaaagaca

SEQ ID NO: 282489 - DNA, 20 bp, Artificial
  CRISPR gRNA sequence
aactgccttccacaattcac

SEQ ID NO: 282490 - DNA, 20 bp, Artificial
  CRISPR gRNA sequence
ccttccacaattcactagac

SEQ ID NO: 282491 - DNA, 20 bp, Artificial
  CRISPR gRNA sequence
tccacaattcactagaccag

SEQ ID NO: 282492 - DNA, 20 bp, Artificial
  CRISPR gRNA sequence
acaattcactagaccagaag

SEQ ID NO: 282493 - DNA, 20 bp, Artificial
  CRISPR gRNA sequence
accagaagtggacgcaactt

SEQ ID NO: 282494 - DNA, 20 bp, Artificial
  CRISPR gRNA sequence
gaagtggacgcaacttaagc

SEQ ID NO: 282495 - DNA, 20 bp, Artificial
  CRISPR gRNA sequence
aagtggacgcaacttaagct

SEQ ID NO: 282496 - DNA, 20 bp, Artificial
  CRISPR gRNA sequence
cacattatcatctgaaaatc

SEQ ID NO: 282497 - DNA, 20 bp, Artificial
  CRISPR gRNA sequence
cattatcatctgaaaatctg

SEQ ID NO: 282498 - DNA, 20 bp, Artificial
  CRISPR gRNA sequence
tctgaaaatctggagttgaa

SEQ ID NO: 282499 - DNA, 20 bp, Artificial
  CRISPR gRNA sequence
aatctggagttgaacagcaa

SEQ ID NO: 282500 - DNA, 20 bp, Artificial
  CRISPR gRNA sequence
ctggagttgaacagcaaaag

SEQ ID NO: 282501 - DNA, 20 bp, Artificial
  CRISPR gRNA sequence
tttctcaaatgcacatctca

SEQ ID NO: 282502 - DNA, 20 bp, Artificial
  CRISPR gRNA sequence
ctcaaatgcacatctcatgg

SEQ ID NO: 282503 - DNA, 20 bp, Artificial
  CRISPR gRNA sequence
atgcacatctcatggcagct

SEQ ID NO: 282504 - DNA, 20 bp, Artificial
  CRISPR gRNA sequence
ctcatggcagctaagccaca

SEQ ID NO: 282505 - DNA, 20 bp, Artificial
  CRISPR gRNA sequence
tggcagctaagccacatggc

SEQ ID NO: 282506 - DNA, 20 bp, Artificial
  CRISPR gRNA sequence
ggcagctaagccacatggct

SEQ ID NO: 282507 - DNA, 20 bp, Artificial
  CRISPR gRNA sequence
agccacatggctgggattta

SEQ ID NO: 282508 - DNA, 20 bp, Artificial
  CRISPR gRNA sequence
tggctgggatttaaagcctt

SEQ ID NO: 282509 - DNA, 20 bp, Artificial
  CRISPR gRNA sequence
gctgggatttaaagccttta

SEQ ID NO: 282510 - DNA, 20 bp, Artificial
  CRISPR gRNA sequence
ggatttaaagcctttagagc

SEQ ID NO: 282511 - DNA, 20 bp, Artificial
  CRISPR gRNA sequence
aagcctttagagccagccca

SEQ ID NO: 282512 - DNA, 20 bp, Artificial
  CRISPR gRNA sequence
ttagagccagcccatggctt

SEQ ID NO: 282513 - DNA, 20 bp, Artificial
  CRISPR gRNA sequence
cctgtgtaaaactatattct

SEQ ID NO: 282514 - DNA, 20 bp, Artificial
  CRISPR gRNA sequence
gtaaaactatattctcagtg

SEQ ID NO: 282515 - DNA, 20 bp, Artificial
  CRISPR gRNA sequence
taaaactatattctcagtgt

SEQ ID NO: 282516 - DNA, 20 bp, Artificial
  CRISPR gRNA sequence
aaaactatattctcagtgta

SEQ ID NO: 282517 - DNA, 20 bp, Artificial
  CRISPR gRNA sequence
actatattctcagtgtaggg

SEQ ID NO: 282518 - DNA, 20 bp, Artificial
  CRISPR gRNA sequence
tatattctcagtgtagggca

SEQ ID NO: 282519 - DNA, 20 bp, Artificial
  CRISPR gRNA sequence
tattctcagtgtagggcaga

SEQ ID NO: 282520 - DNA, 20 bp, Artificial
  CRISPR gRNA sequence
attctcagtgtagggcagag

SEQ ID NO: 282521 - DNA, 20 bp, Artificial
  CRISPR gRNA sequence
gagaggtctaacaccaacat

SEQ ID NO: 282522 - DNA, 20 bp, Artificial
  CRISPR gRNA sequence
agaggtctaacaccaacata

SEQ ID NO: 282523 - DNA, 20 bp, Artificial
  CRISPR gRNA sequence
ctaacaccaacataaggtac

SEQ ID NO: 282524 - DNA, 20 bp, Artificial
  CRISPR gRNA sequence
acaccaacataaggtactag

SEQ ID NO: 282525 - DNA, 20 bp, Artificial
  CRISPR gRNA sequence
agcagtgtttcccgtattga

SEQ ID NO: 282526 - DNA, 20 bp, Artificial
  CRISPR gRNA sequence
gcagtgtttcccgtattgac

SEQ ID NO: 282527 - DNA, 20 bp, Artificial
  CRISPR gRNA sequence
taattcttttcttttccatt

SEQ ID NO: 282528 - DNA, 20 bp, Artificial
  CRISPR gRNA sequence
ttttcttttccatttagtaa

SEQ ID NO: 282529 - DNA, 20 bp, Artificial
  CRISPR gRNA sequence
gatgactatgtttctattct

SEQ ID NO: 282530 - DNA, 20 bp, Artificial
  CRISPR gRNA sequence
taagtaattcctgtattcta

SEQ ID NO: 282531 - DNA, 20 bp, Artificial
  CRISPR gRNA sequence
gtaattcctgtattctacag

SEQ ID NO: 282532 - DNA, 20 bp, Artificial
  CRISPR gRNA sequence
ttctacagcagatactttgt

SEQ ID NO: 282533 - DNA, 20 bp, Artificial
  CRISPR gRNA sequence
gatactttgtcagcaatact

SEQ ID NO: 282534 - DNA, 20 bp, Artificial
  CRISPR gRNA sequence
atactttgtcagcaatacta

SEQ ID NO: 282535 - DNA, 20 bp, Artificial
  CRISPR gRNA sequence
tactttgtcagcaatactaa

SEQ ID NO: 282536 - DNA, 20 bp, Artificial
  CRISPR gRNA sequence
tttgtcagcaatactaaggg

SEQ ID NO: 282537 - DNA, 20 bp, Artificial
  CRISPR gRNA sequence
caatactaagggaagaaaca

SEQ ID NO: 282538 - DNA, 20 bp, Artificial
  CRISPR gRNA sequence
ttgaatttgtattttatttc

SEQ ID NO: 282539 - DNA, 20 bp, Artificial
  CRISPR gRNA sequence
gtattttatttcaagtgtca

SEQ ID NO: 282540 - DNA, 20 bp, Artificial
  CRISPR gRNA sequence
agaaatcatctttgtttatt

SEQ ID NO: 282541 - DNA, 20 bp, Artificial
  CRISPR gRNA sequence
atttacactcacactgcttc

SEQ ID NO: 282542 - DNA, 20 bp, Artificial
  CRISPR gRNA sequence
tttacactcacactgcttcc

SEQ ID NO: 282543 - DNA, 20 bp, Artificial
  CRISPR gRNA sequence
tcacactgcttccaggaccc

SEQ ID NO: 282544 - DNA, 20 bp, Artificial
  CRISPR gRNA sequence
cacactgcttccaggaccca

SEQ ID NO: 282545 - DNA, 20 bp, Artificial
  CRISPR gRNA sequence
acactgcttccaggacccaa

SEQ ID NO: 282546 - DNA, 20 bp, Artificial
  CRISPR gRNA sequence
tccaggacccaagggtttca

SEQ ID NO: 282547 - DNA, 20 bp, Artificial
  CRISPR gRNA sequence
tcacagaccatttgcctacc

SEQ ID NO: 282548 - DNA, 20 bp, Artificial
  CRISPR gRNA sequence
gttctttcctctcctctttc

SEQ ID NO: 282549 - DNA, 20 bp, Artificial
  CRISPR gRNA sequence
ctcctctttccagtgatttc

SEQ ID NO: 282550 - DNA, 20 bp, Artificial
  CRISPR gRNA sequence
atttctagaataccctttca

SEQ ID NO: 282551 - DNA, 20 bp, Artificial
  CRISPR gRNA sequence
tttctagaataccctttcaa

SEQ ID NO: 282552 - DNA, 20 bp, Artificial
  CRISPR gRNA sequence
tttatttactgcttaaaatc

SEQ ID NO: 282553 - DNA, 20 bp, Artificial
  CRISPR gRNA sequence
ttatttactgcttaaaatct

SEQ ID NO: 282554 - DNA, 20 bp, Artificial
  CRISPR gRNA sequence
tttactgcttaaaatctagg

SEQ ID NO: 282555 - DNA, 20 bp, Artificial
  CRISPR gRNA sequence
ttactgcttaaaatctaggt

SEQ ID NO: 282556 - DNA, 20 bp, Artificial
  CRISPR gRNA sequence
ctgcttaaaatctaggtggg

SEQ ID NO: 282557 - DNA, 20 bp, Artificial
  CRISPR gRNA sequence
ttcatgtatgcatatattga

SEQ ID NO: 282558 - DNA, 20 bp, Artificial
  CRISPR gRNA sequence
tgatagattaatacaaacat

SEQ ID NO: 282559 - DNA, 20 bp, Artificial
  CRISPR gRNA sequence
ataagtatgtatttaaattt

SEQ ID NO: 282560 - DNA, 20 bp, Artificial
  CRISPR gRNA sequence
taagtatgtatttaaattta

SEQ ID NO: 282561 - DNA, 20 bp, Artificial
  CRISPR gRNA sequence
atgtatttaaatttaaggat

SEQ ID NO: 282562 - DNA, 20 bp, Artificial
  CRISPR gRNA sequence
tttaaatttaaggataagta

SEQ ID NO: 282563 - DNA, 20 bp, Artificial
  CRISPR gRNA sequence
aatttaaggataagtaaagt

SEQ ID NO: 282564 - DNA, 20 bp, Artificial
  CRISPR gRNA sequence
tttaaggataagtaaagtga

SEQ ID NO: 282565 - DNA, 20 bp, Artificial
  CRISPR gRNA sequence
taagtaaagtgagagtacaa

SEQ ID NO: 282566 - DNA, 20 bp, Artificial
  CRISPR gRNA sequence
gagtacaacagccccattct

SEQ ID NO: 282567 - DNA, 20 bp, Artificial
  CRISPR gRNA sequence
cagccccattcttagttaaa

SEQ ID NO: 282568 - DNA, 20 bp, Artificial
  CRISPR gRNA sequence
ccattcttagttaaaaagaa

SEQ ID NO: 282569 - DNA, 20 bp, Artificial
  CRISPR gRNA sequence
ttagttaaaaagaaaagaaa

SEQ ID NO: 282570 - DNA, 20 bp, Artificial
  CRISPR gRNA sequence
taaaaagaaaagaaaaagac

SEQ ID NO: 282571 - DNA, 20 bp, Artificial
  CRISPR gRNA sequence
aaaagaaaagaaaaagacaa

SEQ ID NO: 282572 - DNA, 20 bp, Artificial
  CRISPR gRNA sequence
gaaaagaaaaagacaagagc

SEQ ID NO: 282573 - DNA, 20 bp, Artificial
  CRISPR gRNA sequence
agagcaagccactgccacca

SEQ ID NO: 282574 - DNA, 20 bp, Artificial
  CRISPR gRNA sequence
gagcaagccactgccaccac

SEQ ID NO: 282575 - DNA, 20 bp, Artificial
  CRISPR gRNA sequence
gccactgccaccacaggtac

SEQ ID NO: 282576 - DNA, 20 bp, Artificial
  CRISPR gRNA sequence
gtaccagcacttaaatttgt

SEQ ID NO: 282577 - DNA, 20 bp, Artificial
  CRISPR gRNA sequence
tttttcttttctttttaact

SEQ ID NO: 282578 - DNA, 20 bp, Artificial
  CRISPR gRNA sequence
atctatcaatatatgcatac

SEQ ID NO: 282579 - DNA, 20 bp, Artificial
  CRISPR gRNA sequence
catttcgcaaaagattaaag

SEQ ID NO: 282580 - DNA, 20 bp, Artificial
  CRISPR gRNA sequence
atattcatgtggtcctttga

SEQ ID NO: 282581 - DNA, 20 bp, Artificial
  CRISPR gRNA sequence
gcaaatggtctgtgaaaccc

SEQ ID NO: 282582 - DNA, 20 bp, Artificial
  CRISPR gRNA sequence
ccttgggtcctggaagcagt

SEQ ID NO: 282583 - DNA, 20 bp, Artificial
  CRISPR gRNA sequence
tgctgacaaagtatctgctg

SEQ ID NO: 282584 - DNA, 20 bp, Artificial
  CRISPR gRNA sequence
aagtatctgctgtagaatac

SEQ ID NO: 282585 - DNA, 20 bp, Artificial
  CRISPR gRNA sequence
tgtagaatacaggaattact

SEQ ID NO: 282586 - DNA, 20 bp, Artificial
  CRISPR gRNA sequence
tgttactaaatggaaaagaa

SEQ ID NO: 282587 - DNA, 20 bp, Artificial
  CRISPR gRNA sequence
aatggaaaagaaaagaatta

SEQ ID NO: 282588 - DNA, 20 bp, Artificial
  CRISPR gRNA sequence
agacctctctgccctacact

SEQ ID NO: 282589 - DNA, 20 bp, Artificial
  CRISPR gRNA sequence
ttgcgtccacttctggtcta

SEQ ID NO: 282590 - DNA, 20 bp, Artificial
  CRISPR gRNA sequence
tggaaggcagttttagagaa

SEQ ID NO: 282591 - DNA, 20 bp, Artificial
  CRISPR gRNA sequence
cagttttagagaaaggagtc

SEQ ID NO: 282592 - DNA, 20 bp, Artificial
  CRISPR gRNA sequence
caaggagaaaaagccatctt

SEQ ID NO: 282593 - DNA, 20 bp, Artificial
  CRISPR gRNA sequence
catgtcagaggaaattagtt

SEQ ID NO: 282594 - DNA, 20 bp, Artificial
  CRISPR gRNA sequence
ctttctgctgtacctcatgg

SEQ ID NO: 282595 - DNA, 20 bp, Artificial
  CRISPR gRNA sequence
agagaacacaatgaaaaaaa

SEQ ID NO: 282596 - DNA, 20 bp, Artificial
  CRISPR gRNA sequence
acaatgaaaaaaatggaata

SEQ ID NO: 282597 - DNA, 20 bp, Artificial
  CRISPR gRNA sequence
ctgataaagggaaagagcac

SEQ ID NO: 282598 - DNA, 20 bp, Artificial
  CRISPR gRNA sequence
gagcaccagagttaggaaat

SEQ ID NO: 282599 - DNA, 20 bp, Artificial
  CRISPR gRNA sequence
ctggcgctggcctttataat

SEQ ID NO: 282600 - DNA, 20 bp, Artificial
  CRISPR gRNA sequence
taaagtcccttccagaactc

SEQ ID NO: 282601 - DNA, 20 bp, Artificial
  CRISPR gRNA sequence
cagatacgtaaagggcaagg

SEQ ID NO: 282602 - DNA, 20 bp, Artificial
  CRISPR gRNA sequence
tacattttaatctcaagatc

SEQ ID NO: 282603 - DNA, 20 bp, Artificial
  CRISPR gRNA sequence
cacagtaaccttgatagctg

SEQ ID NO: 282604 - DNA, 20 bp, Artificial
  CRISPR gRNA sequence
tgaagaatatgaagggaaag

SEQ ID NO: 282605 - DNA, 20 bp, Artificial
  CRISPR gRNA sequence
aacctacatacagtccagta

SEQ ID NO: 282606 - DNA, 20 bp, Artificial
  CRISPR gRNA sequence
agaaggccttgtgtagaaga

SEQ ID NO: 282607 - DNA, 20 bp, Artificial
  CRISPR gRNA sequence
atcctggaaaagacattctg

SEQ ID NO: 282608 - DNA, 20 bp, Artificial
  CRISPR gRNA sequence
attcagtggaaatgaaaaaa

SEQ ID NO: 282609 - DNA, 20 bp, Artificial
  CRISPR gRNA sequence
gcctgaacttgatgtccagt

SEQ ID NO: 282610 - DNA, 20 bp, Artificial
  CRISPR gRNA sequence
tgggacctgatatcagtctc

SEQ ID NO: 282611 - DNA, 20 bp, Artificial
  CRISPR gRNA sequence
tctcttgcatgaaaatacct

SEQ ID NO: 282612 - DNA, 20 bp, Artificial
  CRISPR gRNA sequence
gctgtgttaggctctcttaa

SEQ ID NO: 282613 - DNA, 20 bp, Artificial
  CRISPR gRNA sequence
aataattatctcattgtatg

SEQ ID NO: 282614 - DNA, 20 bp, Artificial
  CRISPR gRNA sequence
ttaagaccaaatctaaagtc

SEQ ID NO: 282615 - DNA, 20 bp, Artificial
  CRISPR gRNA sequence
aggaacaattgacagaactc

SEQ ID NO: 282616 - DNA, 20 bp, Artificial
  CRISPR gRNA sequence
tttagactgaagagatcagc

SEQ ID NO: 282617 - DNA, 20 bp, Artificial
  CRISPR gRNA sequence
gaagctttttctgtaggcag

SEQ ID NO: 282618 - DNA, 20 bp, Artificial
  CRISPR gRNA sequence
tgtaggcagtggggtctctt

SEQ ID NO: 282619 - DNA, 20 bp, Artificial
  CRISPR gRNA sequence
gtggggtctcttctgagttt

SEQ ID NO: 282620 - DNA, 20 bp, Artificial
  CRISPR gRNA sequence
tgagtgggaaaatgacatga

SEQ ID NO: 282621 - DNA, 20 bp, Artificial
  CRISPR gRNA sequence
ttggctccatgattcgtcag

SEQ ID NO: 282622 - DNA, 20 bp, Artificial
  CRISPR gRNA sequence
ctccatgattcgtcagtagg

SEQ ID NO: 282623 - DNA, 20 bp, Artificial
  CRISPR gRNA sequence
actgagagatagagggaaaa

SEQ ID NO: 282624 - DNA, 20 bp, Artificial
  CRISPR gRNA sequence
tagagggaaaaatgaatgat

SEQ ID NO: 282625 - DNA, 20 bp, Artificial
  CRISPR gRNA sequence
tcagaataagaagttaccac

SEQ ID NO: 282626 - DNA, 20 bp, Artificial
  CRISPR gRNA sequence
aaattagtgtttaatagata

SEQ ID NO: 282627 - DNA, 20 bp, Artificial
  CRISPR gRNA sequence
gacaagacaattcaagatgg

SEQ ID NO: 282628 - DNA, 20 bp, Artificial
  CRISPR gRNA sequence
tgcatatggggagaaaggag

SEQ ID NO: 282629 - DNA, 20 bp, Artificial
  CRISPR gRNA sequence
gtttttaagaaggtgaggta

SEQ ID NO: 282630 - DNA, 20 bp, Artificial
  CRISPR gRNA sequence
cagcttaaatttgttaaggg

SEQ ID NO: 282631 - DNA, 20 bp, Artificial
  CRISPR gRNA sequence
aaatgataagtaagtttccc

SEQ ID NO: 282632 - DNA, 20 bp, Artificial
  CRISPR gRNA sequence
ggagcagttgttcttatacc

SEQ ID NO: 282633 - DNA, 20 bp, Artificial
  CRISPR gRNA sequence
ggggacatttggcaatgctt

SEQ ID NO: 282634 - DNA, 20 bp, Artificial
  CRISPR gRNA sequence
tttgattgtcgcaacgggca

SEQ ID NO: 282635 - DNA, 20 bp, Artificial
  CRISPR gRNA sequence
aggggtgctactggcatgta

SEQ ID NO: 282636 - DNA, 20 bp, Artificial
  CRISPR gRNA sequence
cagaacagcactccaaaaca

SEQ ID NO: 282637 - DNA, 20 bp, Artificial
  CRISPR gRNA sequence
cccaaaatgccaataatgtt

SEQ ID NO: 282638 - DNA, 20 bp, Artificial
  CRISPR gRNA sequence
aatgttgaggatgagagccc

SEQ ID NO: 282639 - DNA, 20 bp, Artificial
  CRISPR gRNA sequence
gatgagagcccctgaattaa

SEQ ID NO: 282640 - DNA, 20 bp, Artificial
  CRISPR gRNA sequence
cctgaattaaaggggtaaca

SEQ ID NO: 282641 - DNA, 20 bp, Artificial
  CRISPR gRNA sequence
agacctctttatcctaccct

SEQ ID NO: 282642 - DNA, 20 bp, Artificial
  CRISPR gRNA sequence
ttaacagcacatactctcta

SEQ ID NO: 282643 - DNA, 20 bp, Artificial
  CRISPR gRNA sequence
tctaaagaattcactgagct

SEQ ID NO: 282644 - DNA, 20 bp, Artificial
  CRISPR gRNA sequence
tacatgatttctactcaaag

SEQ ID NO: 282645 - DNA, 20 bp, Artificial
  CRISPR gRNA sequence
acacccaaagtgtaaattca

SEQ ID NO: 282646 - DNA, 20 bp, Artificial
  CRISPR gRNA sequence
tgtggcactctactaggcac

SEQ ID NO: 282647 - DNA, 20 bp, Artificial
  CRISPR gRNA sequence
actttgggaagccaaggcag

SEQ ID NO: 282648 - DNA, 20 bp, Artificial
  CRISPR gRNA sequence
agctactcaggaggctgagg

SEQ ID NO: 282649 - DNA, 20 bp, Artificial
  CRISPR gRNA sequence
atcggggcatacactccagc

SEQ ID NO: 282650 - DNA, 20 bp, Artificial
  CRISPR gRNA sequence
atacactccagcctgggtgg

SEQ ID NO: 282651 - DNA, 20 bp, Artificial
  CRISPR gRNA sequence
ctcaaaaaaaaaaaagaact

SEQ ID NO: 282652 - DNA, 20 bp, Artificial
  CRISPR gRNA sequence
aattggtttgtgttttgaga

SEQ ID NO: 282653 - DNA, 20 bp, Artificial
  CRISPR gRNA sequence
tctcactctgtcacccaggc

SEQ ID NO: 282654 - DNA, 20 bp, Artificial
  CRISPR gRNA sequence
ctcactgcagtctccgcctc

SEQ ID NO: 282655 - DNA, 20 bp, Artificial
  CRISPR gRNA sequence
agtctccgcctcctgggttc

SEQ ID NO: 282656 - DNA, 20 bp, Artificial
  CRISPR gRNA sequence
aattctcctgcttcagcctc

SEQ ID NO: 282657 - DNA, 20 bp, Artificial
  CRISPR gRNA sequence
ttttgtatttttagtagaga

SEQ ID NO: 282658 - DNA, 20 bp, Artificial
  CRISPR gRNA sequence
gccttggcctcccaaagtgc

SEQ ID NO: 282659 - DNA, 20 bp, Artificial
  CRISPR gRNA sequence
ccccacccagcccaagaact

SEQ ID NO: 282660 - DNA, 20 bp, Artificial
  CRISPR gRNA sequence
ctctaactccaaatcaaaat

SEQ ID NO: 282661 - DNA, 20 bp, Artificial
  CRISPR gRNA sequence
aatcaaaattagaatatcag

SEQ ID NO: 282662 - DNA, 20 bp, Artificial
  CRISPR gRNA sequence
aggatggtggccatggaagt

SEQ ID NO: 282663 - DNA, 20 bp, Artificial
  CRISPR gRNA sequence
atggaagttggaattcacta

SEQ ID NO: 282664 - DNA, 20 bp, Artificial
  CRISPR gRNA sequence
actagcccttaaaaaaaaat

SEQ ID NO: 282665 - DNA, 20 bp, Artificial
  CRISPR gRNA sequence
aaaaaataaacagactaaac

SEQ ID NO: 282666 - DNA, 20 bp, Artificial
  CRISPR gRNA sequence
attgtaattccagtgcctag

SEQ ID NO: 282667 - DNA, 20 bp, Artificial
  CRISPR gRNA sequence
aggtgtccggaaaatgtcca

SEQ ID NO: 282668 - DNA, 20 bp, Artificial
  CRISPR gRNA sequence
gcttgctgtaaacatgagaa

SEQ ID NO: 282669 - DNA, 20 bp, Artificial
  CRISPR gRNA sequence
ggtaataaagtttgatcttc

SEQ ID NO: 282670 - DNA, 20 bp, Artificial
  CRISPR gRNA sequence
tgatcttccagaattgagat

SEQ ID NO: 282671 - DNA, 20 bp, Artificial
  CRISPR gRNA sequence
ctgagattaaggtaatggcc

SEQ ID NO: 282672 - DNA, 20 bp, Artificial
  CRISPR gRNA sequence
ttgcttggctatggagggaa

SEQ ID NO: 282673 - DNA, 20 bp, Artificial
  CRISPR gRNA sequence
cttttctattgatgcaactg

SEQ ID NO: 282674 - DNA, 20 bp, Artificial
  CRISPR gRNA sequence
ttaaaagtgaaaaagatact

SEQ ID NO: 282675 - DNA, 20 bp, Artificial
  CRISPR gRNA sequence
actttgaatgtctgcattta

SEQ ID NO: 282676 - DNA, 20 bp, Artificial
  CRISPR gRNA sequence
gagccactttgcattcactt

SEQ ID NO: 282677 - DNA, 20 bp, Artificial
  CRISPR gRNA sequence
agtctggcaaagaactaagt

SEQ ID NO: 282678 - DNA, 20 bp, Artificial
  CRISPR gRNA sequence
caagaagtacacaaggaaat

SEQ ID NO: 282679 - DNA, 20 bp, Artificial
  CRISPR gRNA sequence
tggggaggagaaaggtgttg

SEQ ID NO: 282680 - DNA, 20 bp, Artificial
  CRISPR gRNA sequence
gtgttggtggatatggtgct

SEQ ID NO: 282681 - DNA, 20 bp, Artificial
  CRISPR gRNA sequence
tttattcttcagctgctttg

SEQ ID NO: 282682 - DNA, 20 bp, Artificial
  CRISPR gRNA sequence
ctgaaatggcttacaaataa

SEQ ID NO: 282683 - DNA, 20 bp, Artificial
  CRISPR gRNA sequence
aatgttcccccaaaatgcta

SEQ ID NO: 282684 - DNA, 20 bp, Artificial
  CRISPR gRNA sequence
aatgctagtgaataaagcaa

SEQ ID NO: 282685 - DNA, 20 bp, Artificial
  CRISPR gRNA sequence
cgacacagtgctctctcact

SEQ ID NO: 282686 - DNA, 20 bp, Artificial
  CRISPR gRNA sequence
ttagccagcctatccaagta

SEQ ID NO: 282687 - DNA, 20 bp, Artificial
  CRISPR gRNA sequence
tatacagtactcaatgctgg

SEQ ID NO: 282688 - DNA, 20 bp, Artificial
  CRISPR gRNA sequence
tcaatgtgtgatgcttagtt

SEQ ID NO: 282689 - DNA, 20 bp, Artificial
  CRISPR gRNA sequence
atttcaccttctttttcagt

SEQ ID NO: 282690 - DNA, 20 bp, Artificial
  CRISPR gRNA sequence
tatcttctcggcagcatata

SEQ ID NO: 282691 - DNA, 20 bp, Artificial
  CRISPR gRNA sequence
ctgagcaaatttagaagcat

SEQ ID NO: 282692 - DNA, 20 bp, Artificial
  CRISPR gRNA sequence
tcccatatttctttccatag

SEQ ID NO: 282693 - DNA, 20 bp, Artificial
  CRISPR gRNA sequence
ttgcagtagatctcttcatt

SEQ ID NO: 282694 - DNA, 20 bp, Artificial
  CRISPR gRNA sequence
taaatttttcctgcaaacca

SEQ ID NO: 282695 - DNA, 20 bp, Artificial
  CRISPR gRNA sequence
tagcaaggctgggctggaga

SEQ ID NO: 282696 - DNA, 20 bp, Artificial
  CRISPR gRNA sequence
tgggctggagagagggtcca

SEQ ID NO: 282697 - DNA, 20 bp, Artificial
  CRISPR gRNA sequence
ctgtgtttcccaggccaggc

SEQ ID NO: 282698 - DNA, 20 bp, Artificial
  CRISPR gRNA sequence
ctcactgcaatctctgcctc

SEQ ID NO: 282699 - DNA, 20 bp, Artificial
  CRISPR gRNA sequence
atctctgcctcccgagttca

SEQ ID NO: 282700 - DNA, 20 bp, Artificial
  CRISPR gRNA sequence
aattctcctgcctcagcctc

SEQ ID NO: 282701 - DNA, 20 bp, Artificial
  CRISPR gRNA sequence
gcctcagcctcccgagtagc

SEQ ID NO: 282702 - DNA, 20 bp, Artificial
  CRISPR gRNA sequence
ttttgtattttcagtagaga

SEQ ID NO: 282703 - DNA, 20 bp, Artificial
  CRISPR gRNA sequence
gtcttggcctcccacagtgc

SEQ ID NO: 282704 - DNA, 20 bp, Artificial
  CRISPR gRNA sequence
ctcatcagcatttagccagt

SEQ ID NO: 282705 - DNA, 20 bp, Artificial
  CRISPR gRNA sequence
ccttactggccccagtcttc

SEQ ID NO: 282706 - DNA, 20 bp, Artificial
  CRISPR gRNA sequence
tgggcagatcacctgaggtc

SEQ ID NO: 282707 - DNA, 20 bp, Artificial
  CRISPR gRNA sequence
agtacaaaaaattatcggtg

SEQ ID NO: 282708 - DNA, 20 bp, Artificial
  CRISPR gRNA sequence
tactcaggaggctgaagcaa

SEQ ID NO: 282709 - DNA, 20 bp, Artificial
  CRISPR gRNA sequence
agccaagattgcactccagc

SEQ ID NO: 282710 - DNA, 20 bp, Artificial
  CRISPR gRNA sequence
ttgcactccagcctgggtga

SEQ ID NO: 282711 - DNA, 20 bp, Artificial
  CRISPR gRNA sequence
tccagcctgggtgacagagt

SEQ ID NO: 282712 - DNA, 20 bp, Artificial
  CRISPR gRNA sequence
ctgatttctaaatttgtata

SEQ ID NO: 282713 - DNA, 20 bp, Artificial
  CRISPR gRNA sequence
tttctaaatttgtatattgg

SEQ ID NO: 282714 - DNA, 20 bp, Artificial
  CRISPR gRNA sequence
gcatctccacctgattaaaa

SEQ ID NO: 282715 - DNA, 20 bp, Artificial
  CRISPR gRNA sequence
agctgtattctcccatttca

SEQ ID NO: 282716 - DNA, 20 bp, Artificial
  CRISPR gRNA sequence
taccatttagttacccaaat

SEQ ID NO: 282717 - DNA, 20 bp, Artificial
  CRISPR gRNA sequence
tgtattttctgttctatatt

SEQ ID NO: 282718 - DNA, 20 bp, Artificial
  CRISPR gRNA sequence
gtgtacctaccacttaaaga

SEQ ID NO: 282719 - DNA, 20 bp, Artificial
  CRISPR gRNA sequence
tttttctctaaaacaccaga

SEQ ID NO: 282720 - DNA, 20 bp, Artificial
  CRISPR gRNA sequence
tggagacatcaagtgattac

SEQ ID NO: 282721 - DNA, 20 bp, Artificial
  CRISPR gRNA sequence
cagagttgacctctacagat

SEQ ID NO: 282722 - DNA, 20 bp, Artificial
  CRISPR gRNA sequence
caagccattgctgttatcct

SEQ ID NO: 282723 - DNA, 20 bp, Artificial
  CRISPR gRNA sequence
caagcctcattcaacctaga

SEQ ID NO: 282724 - DNA, 20 bp, Artificial
  CRISPR gRNA sequence
acatcccacaggggcagacc

SEQ ID NO: 282725 - DNA, 20 bp, Artificial
  CRISPR gRNA sequence
catgtagcttattagatacc

SEQ ID NO: 282726 - DNA, 20 bp, Artificial
  CRISPR gRNA sequence
tttggtgagactacactaaa

SEQ ID NO: 282727 - DNA, 20 bp, Artificial
  CRISPR gRNA sequence
gtccccacccaaatctcatc

SEQ ID NO: 282728 - DNA, 20 bp, Artificial
  CRISPR gRNA sequence
aggaacccagtgggaggtga

SEQ ID NO: 282729 - DNA, 20 bp, Artificial
  CRISPR gRNA sequence
gaggtgactgaattatgggg

SEQ ID NO: 282730 - DNA, 20 bp, Artificial
  CRISPR gRNA sequence
cactgtccttgtgatagtta

SEQ ID NO: 282731 - DNA, 20 bp, Artificial
  CRISPR gRNA sequence
agatctgatagtttaaaaac

SEQ ID NO: 282732 - DNA, 20 bp, Artificial
  CRISPR gRNA sequence
ctccccagccacgtggaact

SEQ ID NO: 282733 - DNA, 20 bp, Artificial
  CRISPR gRNA sequence
attttgtaagttgcccagtc

SEQ ID NO: 282734 - DNA, 20 bp, Artificial
  CRISPR gRNA sequence
tataaatgcattatttgctt

SEQ ID NO: 282735 - DNA, 20 bp, Artificial
  CRISPR gRNA sequence
tgcttttgaatcttattcta

SEQ ID NO: 282736 - DNA, 20 bp, Artificial
  CRISPR gRNA sequence
ttaaaaatgaaattttgtgg

SEQ ID NO: 282737 - DNA, 20 bp, Artificial
  CRISPR gRNA sequence
gctttgagaggctgaggcag

SEQ ID NO: 282738 - DNA, 20 bp, Artificial
  CRISPR gRNA sequence
cagatggatcacctgagatc

SEQ ID NO: 282739 - DNA, 20 bp, Artificial
  CRISPR gRNA sequence
tacttgggaggctgaggcag

SEQ ID NO: 282740 - DNA, 20 bp, Artificial
  CRISPR gRNA sequence
tgcactccagcctgggcaac

SEQ ID NO: 282741 - DNA, 20 bp, Artificial
  CRISPR gRNA sequence
tgcttttgtgctacaaccag

SEQ ID NO: 282742 - DNA, 20 bp, Artificial
  CRISPR gRNA sequence
ttgtgctacaaccagcagaa

SEQ ID NO: 282743 - DNA, 20 bp, Artificial
  CRISPR gRNA sequence
aaatttgccaacccctgtct

SEQ ID NO: 282744 - DNA, 20 bp, Artificial
  CRISPR gRNA sequence
tactgttttctgccttcaat

SEQ ID NO: 282745 - DNA, 20 bp, Artificial
  CRISPR gRNA sequence
atgactgagactggtaagtt

SEQ ID NO: 282746 - DNA, 20 bp, Artificial
  CRISPR gRNA sequence
ttgtctcattgaggaaaata

SEQ ID NO: 282747 - DNA, 20 bp, Artificial
  CRISPR gRNA sequence
cgggcagatcacctaaggtc

SEQ ID NO: 282748 - DNA, 20 bp, Artificial
  CRISPR gRNA sequence
tacacaggaggctgagacag

SEQ ID NO: 282749 - DNA, 20 bp, Artificial
  CRISPR gRNA sequence
tcacgccactgcactccagc

SEQ ID NO: 282750 - DNA, 20 bp, Artificial
  CRISPR gRNA sequence
tgctgtaacactgaaagatc

SEQ ID NO: 282751 - DNA, 20 bp, Artificial
  CRISPR gRNA sequence
agagtaaatcatacactagc

SEQ ID NO: 282752 - DNA, 20 bp, Artificial
  CRISPR gRNA sequence
caactacaagtaaagacatg

SEQ ID NO: 282753 - DNA, 20 bp, Artificial
  CRISPR gRNA sequence
cagtcacaaaacctatcctt

SEQ ID NO: 282754 - DNA, 20 bp, Artificial
  CRISPR gRNA sequence
ctatccttgggagtggggct

SEQ ID NO: 282755 - DNA, 20 bp, Artificial
  CRISPR gRNA sequence
gatttcacctcttggggaaa

SEQ ID NO: 282756 - DNA, 20 bp, Artificial
  CRISPR gRNA sequence
tcttggggaaagagaattct

SEQ ID NO: 282757 - DNA, 20 bp, Artificial
  CRISPR gRNA sequence
ttctctgagtttactaccag

SEQ ID NO: 282758 - DNA, 20 bp, Artificial
  CRISPR gRNA sequence
cttttcaggcgttgtcttca

SEQ ID NO: 282759 - DNA, 20 bp, Artificial
  CRISPR gRNA sequence
cacctttcccagacttggtt

SEQ ID NO: 282760 - DNA, 20 bp, Artificial
  CRISPR gRNA sequence
gtttggcaccatggaaccgt

SEQ ID NO: 282761 - DNA, 20 bp, Artificial
  CRISPR gRNA sequence
tgttacaaaaactttttaag

SEQ ID NO: 282762 - DNA, 20 bp, Artificial
  CRISPR gRNA sequence
ctttttaagatgaatgcttg

SEQ ID NO: 282763 - DNA, 20 bp, Artificial
  CRISPR gRNA sequence
tttttagtatatataaattt

SEQ ID NO: 282764 - DNA, 20 bp, Artificial
  CRISPR gRNA sequence
tttattacaagaaaataagg

SEQ ID NO: 282765 - DNA, 20 bp, Artificial
  CRISPR gRNA sequence
actttgggaggctgaggcgg

SEQ ID NO: 282766 - DNA, 20 bp, Artificial
  CRISPR gRNA sequence
ggcgggcggatcacgaggtc

SEQ ID NO: 282767 - DNA, 20 bp, Artificial
  CRISPR gRNA sequence
aaagatagaaaaaattagcc

SEQ ID NO: 282768 - DNA, 20 bp, Artificial
  CRISPR gRNA sequence
tattcgggaggctgaggcag

SEQ ID NO: 282769 - DNA, 20 bp, Artificial
  CRISPR gRNA sequence
ttatttatttcttttagaga

SEQ ID NO: 282770 - DNA, 20 bp, Artificial
  CRISPR gRNA sequence
tctcactctgttgcccaggc

SEQ ID NO: 282771 - DNA, 20 bp, Artificial
  CRISPR gRNA sequence
ctaattttttaaatgttctg

SEQ ID NO: 282772 - DNA, 20 bp, Artificial
  CRISPR gRNA sequence
ttttaaatgttctgtagagt

SEQ ID NO: 282773 - DNA, 20 bp, Artificial
  CRISPR gRNA sequence
acttcagcctcccaaagtgc

SEQ ID NO: 282774 - DNA, 20 bp, Artificial
  CRISPR gRNA sequence
caattctaaaatgtatctgg

SEQ ID NO: 282775 - DNA, 20 bp, Artificial
  CRISPR gRNA sequence
ctctgatgttcagacaatga

SEQ ID NO: 282776 - DNA, 20 bp, Artificial
  CRISPR gRNA sequence
aacagcatagagctcagttt

SEQ ID NO: 282777 - DNA, 20 bp, Artificial
  CRISPR gRNA sequence
atccttctaatattagaagt

SEQ ID NO: 282778 - DNA, 20 bp, Artificial
  CRISPR gRNA sequence
aagtcagctaaagaaagaac

SEQ ID NO: 282779 - DNA, 20 bp, Artificial
  CRISPR gRNA sequence
aataattttctagctttaat

SEQ ID NO: 282780 - DNA, 20 bp, Artificial
  CRISPR gRNA sequence
caggtggaacacctgaggtc

SEQ ID NO: 282781 - DNA, 20 bp, Artificial
  CRISPR gRNA sequence
tactcgggaggctaaggcaa

SEQ ID NO: 282782 - DNA, 20 bp, Artificial
  CRISPR gRNA sequence
aagagaatggcttgaaccca

SEQ ID NO: 282783 - DNA, 20 bp, Artificial
  CRISPR gRNA sequence
caaaaacaacaaaacaaaac

SEQ ID NO: 282784 - DNA, 20 bp, Artificial
  CRISPR gRNA sequence
atccaaagactaactttgat

SEQ ID NO: 282785 - DNA, 20 bp, Artificial
  CRISPR gRNA sequence
gaaaggagaagtaggttcgt

SEQ ID NO: 282786 - DNA, 20 bp, Artificial
  CRISPR gRNA sequence
ttcgtgtgaataaatgttgc

SEQ ID NO: 282787 - DNA, 20 bp, Artificial
  CRISPR gRNA sequence
caattgtaagagatgaagag

SEQ ID NO: 282788 - DNA, 20 bp, Artificial
  CRISPR gRNA sequence
ttataactaaccagtaatgg

SEQ ID NO: 282789 - DNA, 20 bp, Artificial
  CRISPR gRNA sequence
gggcctacccctttgctctt

SEQ ID NO: 282790 - DNA, 20 bp, Artificial
  CRISPR gRNA sequence
aacatagaactttcgttgga

SEQ ID NO: 282791 - DNA, 20 bp, Artificial
  CRISPR gRNA sequence
tgagggggcattgtgtgcgt

SEQ ID NO: 282792 - DNA, 20 bp, Artificial
  CRISPR gRNA sequence
gtcatgagcttttgcttcta

SEQ ID NO: 282793 - DNA, 20 bp, Artificial
  CRISPR gRNA sequence
tttaatttgcatatttattt

SEQ ID NO: 282794 - DNA, 20 bp, Artificial
  CRISPR gRNA sequence
atttgcatatttatttctgg

SEQ ID NO: 282795 - DNA, 20 bp, Artificial
  CRISPR gRNA sequence
aaaatatcattgaaatgtat

SEQ ID NO: 282796 - DNA, 20 bp, Artificial
  CRISPR gRNA sequence
atgtatttgaataaatttat

SEQ ID NO: 282797 - DNA, 20 bp, Artificial
  CRISPR gRNA sequence
ataaatttatttgaattcat

SEQ ID NO: 282798 - DNA, 20 bp, Artificial
  CRISPR gRNA sequence
aaaatagaaagctgtataga

SEQ ID NO: 282799 - DNA, 20 bp, Artificial
  CRISPR gRNA sequence
gtttagttgttaattggttt

SEQ ID NO: 282800 - DNA, 20 bp, Artificial
  CRISPR gRNA sequence
ttggtgttctatatatttgt

SEQ ID NO: 282801 - DNA, 20 bp, Artificial
  CRISPR gRNA sequence
tatttgtccgaattaattac

SEQ ID NO: 282802 - DNA, 20 bp, Artificial
  CRISPR gRNA sequence
aaagagattagcttcttagc

SEQ ID NO: 282803 - DNA, 20 bp, Artificial
  CRISPR gRNA sequence
tagcttcttagcatgaatgt

SEQ ID NO: 282804 - DNA, 20 bp, Artificial
  CRISPR gRNA sequence
gtagggattcaatctcctca

SEQ ID NO: 282805 - DNA, 20 bp, Artificial
  CRISPR gRNA sequence
catagagttagctttctttt

SEQ ID NO: 282806 - DNA, 20 bp, Artificial
  CRISPR gRNA sequence
accagttctgccttgtgacc

SEQ ID NO: 282807 - DNA, 20 bp, Artificial
  CRISPR gRNA sequence
aagatagggacactaatacc

SEQ ID NO: 282808 - DNA, 20 bp, Artificial
  CRISPR gRNA sequence
acactaatacccagggttgt

SEQ ID NO: 282809 - DNA, 20 bp, Artificial
  CRISPR gRNA sequence
tctcactctgttgcccaggc

SEQ ID NO: 282810 - DNA, 20 bp, Artificial
  CRISPR gRNA sequence
atcttggcttactgcaacct

SEQ ID NO: 282811 - DNA, 20 bp, Artificial
  CRISPR gRNA sequence
gattctcctgcctcagcctc

SEQ ID NO: 282812 - DNA, 20 bp, Artificial
  CRISPR gRNA sequence
tcttgtatttttaatagaga

SEQ ID NO: 282813 - DNA, 20 bp, Artificial
  CRISPR gRNA sequence
tggggtttcactgtgttagc

SEQ ID NO: 282814 - DNA, 20 bp, Artificial
  CRISPR gRNA sequence
gcctcggcctcccaaagtgc

SEQ ID NO: 282815 - DNA, 20 bp, Artificial
  CRISPR gRNA sequence
ccaatgatagctatatttaa

SEQ ID NO: 282816 - DNA, 20 bp, Artificial
  CRISPR gRNA sequence
tagctatatttaagtgggtc

SEQ ID NO: 282817 - DNA, 20 bp, Artificial
  CRISPR gRNA sequence
gttgccaggcaaacacttcc

SEQ ID NO: 282818 - DNA, 20 bp, Artificial
  CRISPR gRNA sequence
cttgtggcacctacaataat

SEQ ID NO: 282819 - DNA, 20 bp, Artificial
  CRISPR gRNA sequence
ttgccaggaaagaggaaaag

SEQ ID NO: 282820 - DNA, 20 bp, Artificial
  CRISPR gRNA sequence
tgacacaggcagctgatatc

SEQ ID NO: 282821 - DNA, 20 bp, Artificial
  CRISPR gRNA sequence
atatgttttgtgttataact

SEQ ID NO: 282822 - DNA, 20 bp, Artificial
  CRISPR gRNA sequence
ttttctgggaaataaactac

SEQ ID NO: 282823 - DNA, 20 bp, Artificial
  CRISPR gRNA sequence
actttgggaggtcaaggcag

SEQ ID NO: 282824 - DNA, 20 bp, Artificial
  CRISPR gRNA sequence
caggaggatcgcttgaggtc

SEQ ID NO: 282825 - DNA, 20 bp, Artificial
  CRISPR gRNA sequence
tagtttggaggctgagacag

SEQ ID NO: 282826 - DNA, 20 bp, Artificial
  CRISPR gRNA sequence
tcacgccactgcactctagc

SEQ ID NO: 282827 - DNA, 20 bp, Artificial
  CRISPR gRNA sequence
ctgcactctagcctgggtga

SEQ ID NO: 282828 - DNA, 20 bp, Artificial
  CRISPR gRNA sequence
tttttctaaggtgatctgtt

SEQ ID NO: 282829 - DNA, 20 bp, Artificial
  CRISPR gRNA sequence
ttttaccactcttaatagga

SEQ ID NO: 282830 - DNA, 20 bp, Artificial
  CRISPR gRNA sequence
cactcttaataggaaagggt

SEQ ID NO: 282831 - DNA, 20 bp, Artificial
  CRISPR gRNA sequence
taggaatgtcttacaaggaa

SEQ ID NO: 282832 - DNA, 20 bp, Artificial
  CRISPR gRNA sequence
ttaacctagttaagctgtta

SEQ ID NO: 282833 - DNA, 20 bp, Artificial
  CRISPR gRNA sequence
tttgcaatcttagacaaata

SEQ ID NO: 282834 - DNA, 20 bp, Artificial
  CRISPR gRNA sequence
accctttggttctgagcaaa

SEQ ID NO: 282835 - DNA, 20 bp, Artificial
  CRISPR gRNA sequence
ctgagagcttgttagaggtg

SEQ ID NO: 282836 - DNA, 20 bp, Artificial
  CRISPR gRNA sequence
tttgactcaattggaaaatt

SEQ ID NO: 282837 - DNA, 20 bp, Artificial
  CRISPR gRNA sequence
atgcttctcagcaaaattaa

SEQ ID NO: 282838 - DNA, 20 bp, Artificial
  CRISPR gRNA sequence
acctttttgtcttcccttta

SEQ ID NO: 282839 - DNA, 20 bp, Artificial
  CRISPR gRNA sequence
ccacccacacaccctcggtt

SEQ ID NO: 282840 - DNA, 20 bp, Artificial
  CRISPR gRNA sequence
aatgtttccttttctcactc

SEQ ID NO: 282841 - DNA, 20 bp, Artificial
  CRISPR gRNA sequence
tctatccaaattcacctgac

SEQ ID NO: 282842 - DNA, 20 bp, Artificial
  CRISPR gRNA sequence
aaacacattttcattttaac

SEQ ID NO: 282843 - DNA, 20 bp, Artificial
  CRISPR gRNA sequence
aggaaaatggagaaactagc

SEQ ID NO: 282844 - DNA, 20 bp, Artificial
  CRISPR gRNA sequence
gcaggaatggctatgatgat

SEQ ID NO: 282845 - DNA, 20 bp, Artificial
  CRISPR gRNA sequence
gctatgatgatgagaatttc

SEQ ID NO: 282846 - DNA, 20 bp, Artificial
  CRISPR gRNA sequence
atccaagagcagagaaaaca

SEQ ID NO: 282847 - DNA, 20 bp, Artificial
  CRISPR gRNA sequence
cccacaactttaggtgtgat

SEQ ID NO: 282848 - DNA, 20 bp, Artificial
  CRISPR gRNA sequence
gattaaaacaaagaacagta

SEQ ID NO: 282849 - DNA, 20 bp, Artificial
  CRISPR gRNA sequence
agaacagtaaggaattcact

SEQ ID NO: 282850 - DNA, 20 bp, Artificial
  CRISPR gRNA sequence
caactgtgagaaaatggctc

SEQ ID NO: 282851 - DNA, 20 bp, Artificial
  CRISPR gRNA sequence
caagctatctttgttcactc

SEQ ID NO: 282852 - DNA, 20 bp, Artificial
  CRISPR gRNA sequence
gcagacctccttcttgcctg

SEQ ID NO: 282853 - DNA, 20 bp, Artificial
  CRISPR gRNA sequence
aagattagaaattatggttt

SEQ ID NO: 282854 - DNA, 20 bp, Artificial
  CRISPR gRNA sequence
atggtttaggagtcataaag

SEQ ID NO: 282855 - DNA, 20 bp, Artificial
  CRISPR gRNA sequence
ttttgcagcccctgcacttg

SEQ ID NO: 282856 - DNA, 20 bp, Artificial
  CRISPR gRNA sequence
agatgcttggagagactgat

SEQ ID NO: 282857 - DNA, 20 bp, Artificial
  CRISPR gRNA sequence
attgcaattcccctgtcttg

SEQ ID NO: 282858 - DNA, 20 bp, Artificial
  CRISPR gRNA sequence
cagcaggcgaggtaaacctc

SEQ ID NO: 282859 - DNA, 20 bp, Artificial
  CRISPR gRNA sequence
tcttgggtggttacaaaagc

SEQ ID NO: 282860 - DNA, 20 bp, Artificial
  CRISPR gRNA sequence
ttagtttttttccttgtggc

SEQ ID NO: 282861 - DNA, 20 bp, Artificial
  CRISPR gRNA sequence
acttttttttttttttaaga

SEQ ID NO: 282862 - DNA, 20 bp, Artificial
  CRISPR gRNA sequence
ctttgctctgtcaccaaggc

SEQ ID NO: 282863 - DNA, 20 bp, Artificial
  CRISPR gRNA sequence
gattctcctgcctcagcctc

SEQ ID NO: 282864 - DNA, 20 bp, Artificial
  CRISPR gRNA sequence
ttttgtatttttagtagaga

SEQ ID NO: 282865 - DNA, 20 bp, Artificial
  CRISPR gRNA sequence
aattatcactttgaaaatat

SEQ ID NO: 282866 - DNA, 20 bp, Artificial
  CRISPR gRNA sequence
ttttttttttttttttgaga

SEQ ID NO: 282867 - DNA, 20 bp, Artificial
  CRISPR gRNA sequence
tcttgctatgtcacccaggc

SEQ ID NO: 282868 - DNA, 20 bp, Artificial
  CRISPR gRNA sequence
cgattctctgcctcagcctc

SEQ ID NO: 282869 - DNA, 20 bp, Artificial
  CRISPR gRNA sequence
gcctcagcctccagagtagc

SEQ ID NO: 282870 - DNA, 20 bp, Artificial
  CRISPR gRNA sequence
tccagagtagctgggattac

SEQ ID NO: 282871 - DNA, 20 bp, Artificial
  CRISPR gRNA sequence
ttttgtatttttagtaggga

SEQ ID NO: 282872 - DNA, 20 bp, Artificial
  CRISPR gRNA sequence
actttcacaggcatatattg

SEQ ID NO: 282873 - DNA, 20 bp, Artificial
  CRISPR gRNA sequence
tttaggtcattatagtgccc

SEQ ID NO: 282874 - DNA, 20 bp, Artificial
  CRISPR gRNA sequence
ccaggatgattgtcatgaac

SEQ ID NO: 282875 - DNA, 20 bp, Artificial
  CRISPR gRNA sequence
ggacatctttagaaaccagt

SEQ ID NO: 282876 - DNA, 20 bp, Artificial
  CRISPR gRNA sequence
catgtgtctttaagggcatt

SEQ ID NO: 282877 - DNA, 20 bp, Artificial
  CRISPR gRNA sequence
gcattaagaatctgccggcc

SEQ ID NO: 282878 - DNA, 20 bp, Artificial
  CRISPR gRNA sequence
tcgtcagatgggcgcagagc

SEQ ID NO: 282879 - DNA, 20 bp, Artificial
  CRISPR gRNA sequence
ttctccttttgccagtagat

SEQ ID NO: 282880 - DNA, 20 bp, Artificial
  CRISPR gRNA sequence
tctttcacttccttggtcac

SEQ ID NO: 282881 - DNA, 20 bp, Artificial
  CRISPR gRNA sequence
atacagattcctgcatggtc

SEQ ID NO: 282882 - DNA, 20 bp, Artificial
  CRISPR gRNA sequence
aagtcggcagtaacagaact

SEQ ID NO: 282883 - DNA, 20 bp, Artificial
  CRISPR gRNA sequence
tatcaatccagtttgatttt

SEQ ID NO: 282884 - DNA, 20 bp, Artificial
  CRISPR gRNA sequence
caggcagatcacttgaggtc

SEQ ID NO: 282885 - DNA, 20 bp, Artificial
  CRISPR gRNA sequence
ctaaaaatacaaaaaattag

SEQ ID NO: 282886 - DNA, 20 bp, Artificial
  CRISPR gRNA sequence
aaaattagccgggtgtggtg

SEQ ID NO: 282887 - DNA, 20 bp, Artificial
  CRISPR gRNA sequence
tactcgggaggctgaggcag

SEQ ID NO: 282888 - DNA, 20 bp, Artificial
  CRISPR gRNA sequence
ttgccattctgtttgtttgt

SEQ ID NO: 282889 - DNA, 20 bp, Artificial
  CRISPR gRNA sequence
ctttaaatatctcatagaaa

SEQ ID NO: 282890 - DNA, 20 bp, Artificial
  CRISPR gRNA sequence
attcacgttgtagcatatga

SEQ ID NO: 282891 - DNA, 20 bp, Artificial
  CRISPR gRNA sequence
atgataggatttccttcctt

SEQ ID NO: 282892 - DNA, 20 bp, Artificial
  CRISPR gRNA sequence
aatggtaatgatatgatcat

SEQ ID NO: 282893 - DNA, 20 bp, Artificial
  CRISPR gRNA sequence
atgatatgatcataaggata

SEQ ID NO: 282894 - DNA, 20 bp, Artificial
  CRISPR gRNA sequence
gctactgtgctgctatgaac

SEQ ID NO: 282895 - DNA, 20 bp, Artificial
  CRISPR gRNA sequence
agaccctgctttcaattctt

SEQ ID NO: 282896 - DNA, 20 bp, Artificial
  CRISPR gRNA sequence
tttcaattcttatggatata

SEQ ID NO: 282897 - DNA, 20 bp, Artificial
  CRISPR gRNA sequence
cttatggatatatggaattt

SEQ ID NO: 282898 - DNA, 20 bp, Artificial
  CRISPR gRNA sequence
ctatccccttcctttttctt

SEQ ID NO: 282899 - DNA, 20 bp, Artificial
  CRISPR gRNA sequence
agtcagtcctgactaaggtt

SEQ ID NO: 282900 - DNA, 20 bp, Artificial
  CRISPR gRNA sequence
ctctgtctagatagcctata

SEQ ID NO: 282901 - DNA, 20 bp, Artificial
  CRISPR gRNA sequence
atgattctgcagtcatgacg

SEQ ID NO: 282902 - DNA, 20 bp, Artificial
  CRISPR gRNA sequence
ggccatactttaaataggta

SEQ ID NO: 282903 - DNA, 20 bp, Artificial
  CRISPR gRNA sequence
ataatcaatcttcattattc

SEQ ID NO: 282904 - DNA, 20 bp, Artificial
  CRISPR gRNA sequence
acttacagaaggcctccttc

SEQ ID NO: 282905 - DNA, 20 bp, Artificial
  CRISPR gRNA sequence
tactgccttgagaaataagg

SEQ ID NO: 282906 - DNA, 20 bp, Artificial
  CRISPR gRNA sequence
tttaaccgtgggaaaaatct

SEQ ID NO: 282907 - DNA, 20 bp, Artificial
  CRISPR gRNA sequence
tgacttcagtggcgtggcac

SEQ ID NO: 282908 - DNA, 20 bp, Artificial
  CRISPR gRNA sequence
ctgattcctccccttttcac

SEQ ID NO: 282909 - DNA, 20 bp, Artificial
  CRISPR gRNA sequence
cccttttcacttgagtgact

SEQ ID NO: 282910 - DNA, 20 bp, Artificial
  CRISPR gRNA sequence
tgcctagacccacaccaaat

SEQ ID NO: 282911 - DNA, 20 bp, Artificial
  CRISPR gRNA sequence
tcccattctcctttctccaa

SEQ ID NO: 282912 - DNA, 20 bp, Artificial
  CRISPR gRNA sequence
ctcctttctccaagggggtg

SEQ ID NO: 282913 - DNA, 20 bp, Artificial
  CRISPR gRNA sequence
aacaagacttgcagatatct

SEQ ID NO: 282914 - DNA, 20 bp, Artificial
  CRISPR gRNA sequence
tccttattgatgtactgaaa

SEQ ID NO: 282915 - DNA, 20 bp, Artificial
  CRISPR gRNA sequence
catccactgtgtgattggct

SEQ ID NO: 282916 - DNA, 20 bp, Artificial
  CRISPR gRNA sequence
gtgattggctcagagtagaa

SEQ ID NO: 282917 - DNA, 20 bp, Artificial
  CRISPR gRNA sequence
tctatgtttgcagcctaaag

SEQ ID NO: 282918 - DNA, 20 bp, Artificial
  CRISPR gRNA sequence
ccagttcaacaccccaccaa

SEQ ID NO: 282919 - DNA, 20 bp, Artificial
  CRISPR gRNA sequence
ttccagtgacgttatctttc

SEQ ID NO: 282920 - DNA, 20 bp, Artificial
  CRISPR gRNA sequence
gttatctttcaagagttatc

SEQ ID NO: 282921 - DNA, 20 bp, Artificial
  CRISPR gRNA sequence
atccagaatcttccccttcc

SEQ ID NO: 282922 - DNA, 20 bp, Artificial
  CRISPR gRNA sequence
ttttctttttttttttgaga

SEQ ID NO: 282923 - DNA, 20 bp, Artificial
  CRISPR gRNA sequence
tcttgttcttttgcccaggc

SEQ ID NO: 282924 - DNA, 20 bp, Artificial
  CRISPR gRNA sequence
agttctcctgcctcagcctc

SEQ ID NO: 282925 - DNA, 20 bp, Artificial
  CRISPR gRNA sequence
gcctcagcctcctgagtagc

SEQ ID NO: 282926 - DNA, 20 bp, Artificial
  CRISPR gRNA sequence
ttttgtatttttagtagaga

SEQ ID NO: 282927 - DNA, 20 bp, Artificial
  CRISPR gRNA sequence
acctcagcctcccaaaatgc

SEQ ID NO: 282928 - DNA, 20 bp, Artificial
  CRISPR gRNA sequence
tagccagatgcctatgggcc

SEQ ID NO: 282929 - DNA, 20 bp, Artificial
  CRISPR gRNA sequence
caggagttggggacagagac

SEQ ID NO: 282930 - DNA, 20 bp, Artificial
  CRISPR gRNA sequence
gacagagacagggatcccta

SEQ ID NO: 282931 - DNA, 20 bp, Artificial
  CRISPR gRNA sequence
cactggtcccctgagaagac

SEQ ID NO: 282932 - DNA, 20 bp, Artificial
  CRISPR gRNA sequence
cctgaatataagtgccaacc

SEQ ID NO: 282933 - DNA, 20 bp, Artificial
  CRISPR gRNA sequence
aaacgatgtgctcagcccca

SEQ ID NO: 282934 - DNA, 20 bp, Artificial
  CRISPR gRNA sequence
gggatatgaaagtcatagta

SEQ ID NO: 282935 - DNA, 20 bp, Artificial
  CRISPR gRNA sequence
agcccttttgctataagaaa

SEQ ID NO: 282936 - DNA, 20 bp, Artificial
  CRISPR gRNA sequence
ggtgggcagatcacgaggtc

SEQ ID NO: 282937 - DNA, 20 bp, Artificial
  CRISPR gRNA sequence
tacttaggaggctgaggcag

SEQ ID NO: 282938 - DNA, 20 bp, Artificial
  CRISPR gRNA sequence
tcacaccactgcactccagc

SEQ ID NO: 282939 - DNA, 20 bp, Artificial
  CRISPR gRNA sequence
ctgcactccagcttgggtga

SEQ ID NO: 282940 - DNA, 20 bp, Artificial
  CRISPR gRNA sequence
ataaataaataaataagaaa

SEQ ID NO: 282941 - DNA, 20 bp, Artificial
  CRISPR gRNA sequence
accatcttcaggtaccctaa

SEQ ID NO: 282942 - DNA, 20 bp, Artificial
  CRISPR gRNA sequence
ccatacaattaccctccagc

SEQ ID NO: 282943 - DNA, 20 bp, Artificial
  CRISPR gRNA sequence
ctccagcctggatttgctaa

SEQ ID NO: 282944 - DNA, 20 bp, Artificial
  CRISPR gRNA sequence
ccctctcttttcttagatag

SEQ ID NO: 282945 - DNA, 20 bp, Artificial
  CRISPR gRNA sequence
attctcaggcctctgtcaga

SEQ ID NO: 282946 - DNA, 20 bp, Artificial
  CRISPR gRNA sequence
cccaccacagcactgaacaa

SEQ ID NO: 282947 - DNA, 20 bp, Artificial
  CRISPR gRNA sequence
aacaagagagttttgtgatg

SEQ ID NO: 282948 - DNA, 20 bp, Artificial
  CRISPR gRNA sequence
gcacctcttcagcaattgtg

SEQ ID NO: 282949 - DNA, 20 bp, Artificial
  CRISPR gRNA sequence
tgttgccagtccctgcttta

SEQ ID NO: 282950 - DNA, 20 bp, Artificial
  CRISPR gRNA sequence
ggctatccatctccattgac

SEQ ID NO: 282951 - DNA, 20 bp, Artificial
  CRISPR gRNA sequence
taggtatgacacctacccct

SEQ ID NO: 282952 - DNA, 20 bp, Artificial
  CRISPR gRNA sequence
ggacatagcaggtcttctgt

SEQ ID NO: 282953 - DNA, 20 bp, Artificial
  CRISPR gRNA sequence
tcttacctttcatttcactc

SEQ ID NO: 282954 - DNA, 20 bp, Artificial
  CRISPR gRNA sequence
ttgtctgggcctcccaataa

SEQ ID NO: 282955 - DNA, 20 bp, Artificial
  CRISPR gRNA sequence
actattcattcccagccaaa

SEQ ID NO: 282956 - DNA, 20 bp, Artificial
  CRISPR gRNA sequence
aattttggtgatggcttctg

SEQ ID NO: 282957 - DNA, 20 bp, Artificial
  CRISPR gRNA sequence
ttgtccagccttctgaggag

SEQ ID NO: 282958 - DNA, 20 bp, Artificial
  CRISPR gRNA sequence
tcacacgggaacccagtttt

SEQ ID NO: 282959 - DNA, 20 bp, Artificial
  CRISPR gRNA sequence
ctgagcttgctttgccattt

SEQ ID NO: 282960 - DNA, 20 bp, Artificial
  CRISPR gRNA sequence
tgtaacacctacccaaccca

SEQ ID NO: 282961 - DNA, 20 bp, Artificial
  CRISPR gRNA sequence
ctacccaacccagtgggtgc

SEQ ID NO: 282962 - DNA, 20 bp, Artificial
  CRISPR gRNA sequence
aggtgctcagtaaatacttg

SEQ ID NO: 282963 - DNA, 20 bp, Artificial
  CRISPR gRNA sequence
tggctccatccactgtgtat

SEQ ID NO: 282964 - DNA, 20 bp, Artificial
  CRISPR gRNA sequence
gaatcataaccttgagcaag

SEQ ID NO: 282965 - DNA, 20 bp, Artificial
  CRISPR gRNA sequence
cataatactattgctatgat

SEQ ID NO: 282966 - DNA, 20 bp, Artificial
  CRISPR gRNA sequence
tttgtgttggaaatttaatt

SEQ ID NO: 282967 - DNA, 20 bp, Artificial
  CRISPR gRNA sequence
attccgggtgcaacagtgtt

SEQ ID NO: 282968 - DNA, 20 bp, Artificial
  CRISPR gRNA sequence
gtcatggagactctgccatc

SEQ ID NO: 282969 - DNA, 20 bp, Artificial
  CRISPR gRNA sequence
tggagactctgccatcatgg

SEQ ID NO: 282970 - DNA, 20 bp, Artificial
  CRISPR gRNA sequence
tggattaatgccattttttt

SEQ ID NO: 282971 - DNA, 20 bp, Artificial
  CRISPR gRNA sequence
ttaatgccatttttttggga

SEQ ID NO: 282972 - DNA, 20 bp, Artificial
  CRISPR gRNA sequence
gggagtgggttcactacagc

SEQ ID NO: 282973 - DNA, 20 bp, Artificial
  CRISPR gRNA sequence
gcaggagtggcttccttata

SEQ ID NO: 282974 - DNA, 20 bp, Artificial
  CRISPR gRNA sequence
tgcctttctatcctctgcca

SEQ ID NO: 282975 - DNA, 20 bp, Artificial
  CRISPR gRNA sequence
cataattatcacagcgatca

SEQ ID NO: 282976 - DNA, 20 bp, Artificial
  CRISPR gRNA sequence
gtaaagtgctttcttaactt

SEQ ID NO: 282977 - DNA, 20 bp, Artificial
  CRISPR gRNA sequence
gtaactggctgattcttgaa

SEQ ID NO: 282978 - DNA, 20 bp, Artificial
  CRISPR gRNA sequence
gcaacgctgctcgccttctg

SEQ ID NO: 282979 - DNA, 20 bp, Artificial
  CRISPR gRNA sequence
agaggaagctatttgccaac

SEQ ID NO: 282980 - DNA, 20 bp, Artificial
  CRISPR gRNA sequence
tgccaacaagagtagagacc

SEQ ID NO: 282981 - DNA, 20 bp, Artificial
  CRISPR gRNA sequence
actttgggaggccgaggcag

SEQ ID NO: 282982 - DNA, 20 bp, Artificial
  CRISPR gRNA sequence
tactcgggaggctgaggcag

SEQ ID NO: 282983 - DNA, 20 bp, Artificial
  CRISPR gRNA sequence
cactttgggagctggccaag

SEQ ID NO: 282984 - DNA, 20 bp, Artificial
  CRISPR gRNA sequence
ttgggagctggccaaggcgg

SEQ ID NO: 282985 - DNA, 20 bp, Artificial
  CRISPR gRNA sequence
aaatagatctcaatctacaa

SEQ ID NO: 282986 - DNA, 20 bp, Artificial
  CRISPR gRNA sequence
tctacaacagaatattattt

SEQ ID NO: 282987 - DNA, 20 bp, Artificial
  CRISPR gRNA sequence
aatattatttggccgtaaaa

SEQ ID NO: 282988 - DNA, 20 bp, Artificial
  CRISPR gRNA sequence
tatttggccgtaaaagcgaa

SEQ ID NO: 282989 - DNA, 20 bp, Artificial
  CRISPR gRNA sequence
agtactaagacatacgcaac

SEQ ID NO: 282990 - DNA, 20 bp, Artificial
  CRISPR gRNA sequence
cacatattgtaagaaatgtc

SEQ ID NO: 282991 - DNA, 20 bp, Artificial
  CRISPR gRNA sequence
tccagaatattctttcttac

SEQ ID NO: 282992 - DNA, 20 bp, Artificial
  CRISPR gRNA sequence
caggcaaattcatagagaca

SEQ ID NO: 282993 - DNA, 20 bp, Artificial
  CRISPR gRNA sequence
aattagtggttacgaggaga

SEQ ID NO: 282994 - DNA, 20 bp, Artificial
  CRISPR gRNA sequence
tacgaggagatggggtacag

SEQ ID NO: 282995 - DNA, 20 bp, Artificial
  CRISPR gRNA sequence
agatggggtacaggggaatg

SEQ ID NO: 282996 - DNA, 20 bp, Artificial
  CRISPR gRNA sequence
aataggcgcaggtttctttc

SEQ ID NO: 282997 - DNA, 20 bp, Artificial
  CRISPR gRNA sequence
tcatccagaacatttccttc

SEQ ID NO: 282998 - DNA, 20 bp, Artificial
  CRISPR gRNA sequence
tgcaaatatactaaaaccca

SEQ ID NO: 282999 - DNA, 20 bp, Artificial
  CRISPR gRNA sequence
tatttatttatttactgagg

SEQ ID NO: 283000 - DNA, 20 bp, Artificial
  CRISPR gRNA sequence
tctcgctctgttgcccatgc

SEQ ID NO: 283001 - DNA, 20 bp, Artificial
  CRISPR gRNA sequence
ctcacagcaacccccgcctc

SEQ ID NO: 283002 - DNA, 20 bp, Artificial
  CRISPR gRNA sequence
gattctcctgcctcagcctc

SEQ ID NO: 283003 - DNA, 20 bp, Artificial
  CRISPR gRNA sequence
gcctcagcctcctgagtagc

SEQ ID NO: 283004 - DNA, 20 bp, Artificial
  CRISPR gRNA sequence
ttttgcatttttagtagaga

SEQ ID NO: 283005 - DNA, 20 bp, Artificial
  CRISPR gRNA sequence
atctcggcctcccaaaatgc

SEQ ID NO: 283006 - DNA, 20 bp, Artificial
  CRISPR gRNA sequence
tcccaaaatgctgggattgc

SEQ ID NO: 283007 - DNA, 20 bp, Artificial
  CRISPR gRNA sequence
gagtgagccaccgtgcctgg

SEQ ID NO: 283008 - DNA, 20 bp, Artificial
  CRISPR gRNA sequence
gaattgtatactttaaaacg

SEQ ID NO: 283009 - DNA, 20 bp, Artificial
  CRISPR gRNA sequence
ataaaacatgaagggaaaag

SEQ ID NO: 283010 - DNA, 20 bp, Artificial
  CRISPR gRNA sequence
agaatccatactaggaagac

SEQ ID NO: 283011 - DNA, 20 bp, Artificial
  CRISPR gRNA sequence
ccgtgcagcctggaggcctg

SEQ ID NO: 283012 - DNA, 20 bp, Artificial
  CRISPR gRNA sequence
agtctgcagtgcccctccca

SEQ ID NO: 283013 - DNA, 20 bp, Artificial
  CRISPR gRNA sequence
gttagagaggctgccctcgc

SEQ ID NO: 283014 - DNA, 20 bp, Artificial
  CRISPR gRNA sequence
atgaaataaacattcttaga

SEQ ID NO: 283015 - DNA, 20 bp, Artificial
  CRISPR gRNA sequence
tttgtgcacactcttccaac

SEQ ID NO: 283016 - DNA, 20 bp, Artificial
  CRISPR gRNA sequence
gggacttgaacagctgttgt

SEQ ID NO: 283017 - DNA, 20 bp, Artificial
  CRISPR gRNA sequence
ggtgtgtgttgcagggagag

SEQ ID NO: 283018 - DNA, 20 bp, Artificial
  CRISPR gRNA sequence
gggagaggaggatgtgttct

SEQ ID NO: 283019 - DNA, 20 bp, Artificial
  CRISPR gRNA sequence
ttctgtgaatggtggcactt

SEQ ID NO: 283020 - DNA, 20 bp, Artificial
  CRISPR gRNA sequence
tattctcttttctcctagct

SEQ ID NO: 283021 - DNA, 20 bp, Artificial
  CRISPR gRNA sequence
ttccaccctgtgcatgaaag

SEQ ID NO: 283022 - DNA, 20 bp, Artificial
  CRISPR gRNA sequence
tagtgtggcaaatctctgcc

SEQ ID NO: 283023 - DNA, 20 bp, Artificial
  CRISPR gRNA sequence
atcctactccactgtattca

SEQ ID NO: 283024 - DNA, 20 bp, Artificial
  CRISPR gRNA sequence
ctaggtgcttcttagaaatg

SEQ ID NO: 283025 - DNA, 20 bp, Artificial
  CRISPR gRNA sequence
gctttaggttcatcgaaaaa

SEQ ID NO: 283026 - DNA, 20 bp, Artificial
  CRISPR gRNA sequence
catcattaccaccccaaatc

SEQ ID NO: 283027 - DNA, 20 bp, Artificial
  CRISPR gRNA sequence
ccaaatctagagttcacgat

SEQ ID NO: 283028 - DNA, 20 bp, Artificial
  CRISPR gRNA sequence
ctcctggtattgcatattct

SEQ ID NO: 283029 - DNA, 20 bp, Artificial
  CRISPR gRNA sequence
ccaggctattggtatgtgta

SEQ ID NO: 283030 - DNA, 20 bp, Artificial
  CRISPR gRNA sequence
gtgtaaagagtgaacagagc

SEQ ID NO: 283031 - DNA, 20 bp, Artificial
  CRISPR gRNA sequence
gggtagaccacgccactctc

SEQ ID NO: 283032 - DNA, 20 bp, Artificial
  CRISPR gRNA sequence
ggtaaagcccttccagcttc

SEQ ID NO: 283033 - DNA, 20 bp, Artificial
  CRISPR gRNA sequence
tccagcttcctgaataacat

SEQ ID NO: 283034 - DNA, 20 bp, Artificial
  CRISPR gRNA sequence
attataactcacaagtgctg

SEQ ID NO: 283035 - DNA, 20 bp, Artificial
  CRISPR gRNA sequence
ccacactttaacacattcat

SEQ ID NO: 283036 - DNA, 20 bp, Artificial
  CRISPR gRNA sequence
cacattcatttgagtggcta

SEQ ID NO: 283037 - DNA, 20 bp, Artificial
  CRISPR gRNA sequence
ttaggagatgctcatgtttg

SEQ ID NO: 283038 - DNA, 20 bp, Artificial
  CRISPR gRNA sequence
attaataaatgattaaacaa

SEQ ID NO: 283039 - DNA, 20 bp, Artificial
  CRISPR gRNA sequence
gtccaggctgttgccctgac

SEQ ID NO: 283040 - DNA, 20 bp, Artificial
  CRISPR gRNA sequence
ttgctctttgcttgttctac

SEQ ID NO: 283041 - DNA, 20 bp, Artificial
  CRISPR gRNA sequence
actaacatatgcagacctct

SEQ ID NO: 283042 - DNA, 20 bp, Artificial
  CRISPR gRNA sequence
atgcagacctctttgagtgc

SEQ ID NO: 283043 - DNA, 20 bp, Artificial
  CRISPR gRNA sequence
agtcacagcagcagtaaaac

SEQ ID NO: 283044 - DNA, 20 bp, Artificial
  CRISPR gRNA sequence
ccttgtacaatttctaaagt

SEQ ID NO: 283045 - DNA, 20 bp, Artificial
  CRISPR gRNA sequence
agaaattgtacaaggaaaat

SEQ ID NO: 283046 - DNA, 20 bp, Artificial
  CRISPR gRNA sequence
tggttttactgctgctgtga

SEQ ID NO: 283047 - DNA, 20 bp, Artificial
  CRISPR gRNA sequence
tgggccataaaagttgaggc

SEQ ID NO: 283048 - DNA, 20 bp, Artificial
  CRISPR gRNA sequence
ggagcccaagatctgggaaa

SEQ ID NO: 283049 - DNA, 20 bp, Artificial
  CRISPR gRNA sequence
ggcaggctttacagaggcag

SEQ ID NO: 283050 - DNA, 20 bp, Artificial
  CRISPR gRNA sequence
aggcagatggatgatggaga

SEQ ID NO: 283051 - DNA, 20 bp, Artificial
  CRISPR gRNA sequence
ctggacaaaggcacaaaggt

SEQ ID NO: 283052 - DNA, 20 bp, Artificial
  CRISPR gRNA sequence
gtaatccaatagccactcaa

SEQ ID NO: 283053 - DNA, 20 bp, Artificial
  CRISPR gRNA sequence
aaccggaccctgcagcactt

SEQ ID NO: 283054 - DNA, 20 bp, Artificial
  CRISPR gRNA sequence
agcacttgtgagttataatc

SEQ ID NO: 283055 - DNA, 20 bp, Artificial
  CRISPR gRNA sequence
gctggaagggctttacccag

SEQ ID NO: 283056 - DNA, 20 bp, Artificial
  CRISPR gRNA sequence
tttacacataccaatagcct

SEQ ID NO: 283057 - DNA, 20 bp, Artificial
  CRISPR gRNA sequence
aaattgcagtttctagcaca

SEQ ID NO: 283058 - DNA, 20 bp, Artificial
  CRISPR gRNA sequence
acagggaattttttagagaa

SEQ ID NO: 283059 - DNA, 20 bp, Artificial
  CRISPR gRNA sequence
tataaatttgcccaaatcca

SEQ ID NO: 283060 - DNA, 20 bp, Artificial
  CRISPR gRNA sequence
tccatagaatatgcaatacc

SEQ ID NO: 283061 - DNA, 20 bp, Artificial
  CRISPR gRNA sequence
cctatcgtgaactctagatt

SEQ ID NO: 283062 - DNA, 20 bp, Artificial
  CRISPR gRNA sequence
acaagtgtactgccctggcg

SEQ ID NO: 283063 - DNA, 20 bp, Artificial
  CRISPR gRNA sequence
tgtagacagtggcggaagct

SEQ ID NO: 283064 - DNA, 20 bp, Artificial
  CRISPR gRNA sequence
aagctgtgaatatgtgggga

SEQ ID NO: 283065 - DNA, 20 bp, Artificial
  CRISPR gRNA sequence
taaatgctgtttctgcttag

SEQ ID NO: 283066 - DNA, 20 bp, Artificial
  CRISPR gRNA sequence
tgtttctgcttaggtgggtc

SEQ ID NO: 283067 - DNA, 20 bp, Artificial
  CRISPR gRNA sequence
atgctgctccaccatacact

SEQ ID NO: 283068 - DNA, 20 bp, Artificial
  CRISPR gRNA sequence
aaaaaagtgttactgaagaa

SEQ ID NO: 283069 - DNA, 20 bp, Artificial
  CRISPR gRNA sequence
ctgatgatgtctttaatgaa

SEQ ID NO: 283070 - DNA, 20 bp, Artificial
  CRISPR gRNA sequence
gatgtctttaatgaaaagaa

SEQ ID NO: 283071 - DNA, 20 bp, Artificial
  CRISPR gRNA sequence
attggatcagaaggaagttg

SEQ ID NO: 283072 - DNA, 20 bp, Artificial
  CRISPR gRNA sequence
agaaggaagttgatgggttg

SEQ ID NO: 283073 - DNA, 20 bp, Artificial
  CRISPR gRNA sequence
attagtgaggactgctcaac

SEQ ID NO: 283074 - DNA, 20 bp, Artificial
  CRISPR gRNA sequence
tgctcaacgggagtgtaggt

SEQ ID NO: 283075 - DNA, 20 bp, Artificial
  CRISPR gRNA sequence
tctgtgggaggtgagattca

SEQ ID NO: 283076 - DNA, 20 bp, Artificial
  CRISPR gRNA sequence
gtgagattcagtgaatacag

SEQ ID NO: 283077 - DNA, 20 bp, Artificial
  CRISPR gRNA sequence
attcagtgaatacagtggag

SEQ ID NO: 283078 - DNA, 20 bp, Artificial
  CRISPR gRNA sequence
agggactcctctttcatgca

SEQ ID NO: 283079 - DNA, 20 bp, Artificial
  CRISPR gRNA sequence
ggcagcttttccttcagagc

SEQ ID NO: 283080 - DNA, 20 bp, Artificial
  CRISPR gRNA sequence
agagctggagtcctttaaga

SEQ ID NO: 283081 - DNA, 20 bp, Artificial
  CRISPR gRNA sequence
aactcagagctaggagaaaa

SEQ ID NO: 283082 - DNA, 20 bp, Artificial
  CRISPR gRNA sequence
caccgctatgctgctggccc

SEQ ID NO: 283083 - DNA, 20 bp, Artificial
  CRISPR gRNA sequence
ttcaagtccctgtgcatttt

SEQ ID NO: 283084 - DNA, 20 bp, Artificial
  CRISPR gRNA sequence
tgtttagaaagagaaaaagt

SEQ ID NO: 283085 - DNA, 20 bp, Artificial
  CRISPR gRNA sequence
aaagtaaggatcagatggta

SEQ ID NO: 283086 - DNA, 20 bp, Artificial
  CRISPR gRNA sequence
gatggtacagagtatatgag

SEQ ID NO: 283087 - DNA, 20 bp, Artificial
  CRISPR gRNA sequence
acctaatcaaacatttagag

SEQ ID NO: 283088 - DNA, 20 bp, Artificial
  CRISPR gRNA sequence
aggggggtcactcctgttgg

SEQ ID NO: 283089 - DNA, 20 bp, Artificial
  CRISPR gRNA sequence
ctatatcttccattctttct

SEQ ID NO: 283090 - DNA, 20 bp, Artificial
  CRISPR gRNA sequence
catgtatgtcccgtcatttg

SEQ ID NO: 283091 - DNA, 20 bp, Artificial
  CRISPR gRNA sequence
aggcctccaggctgcacgga

SEQ ID NO: 283092 - DNA, 20 bp, Artificial
  CRISPR gRNA sequence
aagactcaggtcttcctagt

SEQ ID NO: 283093 - DNA, 20 bp, Artificial
  CRISPR gRNA sequence
cagcattttgggaggccgag

SEQ ID NO: 283094 - DNA, 20 bp, Artificial
  CRISPR gRNA sequence
attttgggaggccgagatgg

SEQ ID NO: 283095 - DNA, 20 bp, Artificial
  CRISPR gRNA sequence
tgggtggatcacctgaggtc

SEQ ID NO: 283096 - DNA, 20 bp, Artificial
  CRISPR gRNA sequence
tactcaggaggctgaggcag

SEQ ID NO: 283097 - DNA, 20 bp, Artificial
  CRISPR gRNA sequence
atcttttgaaccctggaggc

SEQ ID NO: 283098 - DNA, 20 bp, Artificial
  CRISPR gRNA sequence
taaataaagtgtacaattca

SEQ ID NO: 283099 - DNA, 20 bp, Artificial
  CRISPR gRNA sequence
ttgtgaaaccaccatcacta

SEQ ID NO: 283100 - DNA, 20 bp, Artificial
  CRISPR gRNA sequence
gaattccagaaggaaatgtt

SEQ ID NO: 283101 - DNA, 20 bp, Artificial
  CRISPR gRNA sequence
ctaatttactctctgtctct

SEQ ID NO: 283102 - DNA, 20 bp, Artificial
  CRISPR gRNA sequence
cttttctcttcctttttttc

SEQ ID NO: 283103 - DNA, 20 bp, Artificial
  CRISPR gRNA sequence
tttccagaatccaggtaaga

SEQ ID NO: 283104 - DNA, 20 bp, Artificial
  CRISPR gRNA sequence
attttttctttttgtagcga

SEQ ID NO: 283105 - DNA, 20 bp, Artificial
  CRISPR gRNA sequence
ttggccagctcccaaagtgc

SEQ ID NO: 283106 - DNA, 20 bp, Artificial
  CRISPR gRNA sequence
gctcccaaagtgctgggatt

SEQ ID NO: 283107 - DNA, 20 bp, Artificial
  CRISPR gRNA sequence
ttttttttttttttttgaga

SEQ ID NO: 283108 - DNA, 20 bp, Artificial
  CRISPR gRNA sequence
tcttgctctgtcgcccaagc

SEQ ID NO: 283109 - DNA, 20 bp, Artificial
  CRISPR gRNA sequence
cattctcctgcctcagcctc

SEQ ID NO: 283110 - DNA, 20 bp, Artificial
  CRISPR gRNA sequence
ttttgtatttttagtagaga

SEQ ID NO: 283111 - DNA, 20 bp, Artificial
  CRISPR gRNA sequence
cggggtttcaccgtattagc

SEQ ID NO: 283112 - DNA, 20 bp, Artificial
  CRISPR gRNA sequence
gcctcggcctcccaaagtgc

SEQ ID NO: 283113 - DNA, 20 bp, Artificial
  CRISPR gRNA sequence
ctcctgtgtggctagcagtc

SEQ ID NO: 283114 - DNA, 20 bp, Artificial
  CRISPR gRNA sequence
agttgaagtggtcagagcag

SEQ ID NO: 283115 - DNA, 20 bp, Artificial
  CRISPR gRNA sequence
tcagagcaggagggtggcca

SEQ ID NO: 283116 - DNA, 20 bp, Artificial
  CRISPR gRNA sequence
agaggctgaggccagcagtg

SEQ ID NO: 283117 - DNA, 20 bp, Artificial
  CRISPR gRNA sequence
ctggccctttctgactgctg

SEQ ID NO: 283118 - DNA, 20 bp, Artificial
  CRISPR gRNA sequence
atgggcactgaactcagttc

SEQ ID NO: 283119 - DNA, 20 bp, Artificial
  CRISPR gRNA sequence
catggtgatgctggtcctat

SEQ ID NO: 283120 - DNA, 20 bp, Artificial
  CRISPR gRNA sequence
tctggtttgtgctgctataa

SEQ ID NO: 283121 - DNA, 20 bp, Artificial
  CRISPR gRNA sequence
ctataacagaatacctgaca

SEQ ID NO: 283122 - DNA, 20 bp, Artificial
  CRISPR gRNA sequence
tgctgcatcatcccatggca

SEQ ID NO: 283123 - DNA, 20 bp, Artificial
  CRISPR gRNA sequence
gcaggagagcacgcccaagg

SEQ ID NO: 283124 - DNA, 20 bp, Artificial
  CRISPR gRNA sequence
cattaatccatccatgatgg

SEQ ID NO: 283125 - DNA, 20 bp, Artificial
  CRISPR gRNA sequence
attctcaacactgttgcacc

SEQ ID NO: 283126 - DNA, 20 bp, Artificial
  CRISPR gRNA sequence
ggttatgattctaatacaca

SEQ ID NO: 283127 - DNA, 20 bp, Artificial
  CRISPR gRNA sequence
caaatcaggcaaagagacta

SEQ ID NO: 283128 - DNA, 20 bp, Artificial
  CRISPR gRNA sequence
gcaaagagactaaagagtag

SEQ ID NO: 283129 - DNA, 20 bp, Artificial
  CRISPR gRNA sequence
gcaggatggaggggggcagg

SEQ ID NO: 283130 - DNA, 20 bp, Artificial
  CRISPR gRNA sequence
ggaggatggcgctgttcaag

SEQ ID NO: 283131 - DNA, 20 bp, Artificial
  CRISPR gRNA sequence
cctctttgacaaggggccac

SEQ ID NO: 283132 - DNA, 20 bp, Artificial
  CRISPR gRNA sequence
caaagtgggacctgaactgt

SEQ ID NO: 283133 - DNA, 20 bp, Artificial
  CRISPR gRNA sequence
tttatgagcagtatctcatt

SEQ ID NO: 283134 - DNA, 20 bp, Artificial
  CRISPR gRNA sequence
attttgaatccttgcaccca

SEQ ID NO: 283135 - DNA, 20 bp, Artificial
  CRISPR gRNA sequence
gaatccttgcacccactggg

SEQ ID NO: 283136 - DNA, 20 bp, Artificial
  CRISPR gRNA sequence
tgctttttgtccgtgtgtga

SEQ ID NO: 283137 - DNA, 20 bp, Artificial
  CRISPR gRNA sequence
tgttttctgtctctgtgtgg

SEQ ID NO: 283138 - DNA, 20 bp, Artificial
  CRISPR gRNA sequence
gtgtggtggaatcccgaaaa

SEQ ID NO: 283139 - DNA, 20 bp, Artificial
  CRISPR gRNA sequence
cccgaaaactgggttcccgt

SEQ ID NO: 283140 - DNA, 20 bp, Artificial
  CRISPR gRNA sequence
tccaaattgttcggaagatt

SEQ ID NO: 283141 - DNA, 20 bp, Artificial
  CRISPR gRNA sequence
accaaaatcagtgagaaata

SEQ ID NO: 283142 - DNA, 20 bp, Artificial
  CRISPR gRNA sequence
atattggattctttttggct

SEQ ID NO: 283143 - DNA, 20 bp, Artificial
  CRISPR gRNA sequence
tggattctttttggctggga

SEQ ID NO: 283144 - DNA, 20 bp, Artificial
  CRISPR gRNA sequence
ttattgggaggcccagacaa

SEQ ID NO: 283145 - DNA, 20 bp, Artificial
  CRISPR gRNA sequence
tgtctggcccatagcaagac

SEQ ID NO: 283146 - DNA, 20 bp, Artificial
  CRISPR gRNA sequence
ctatatatctgacataaccc

SEQ ID NO: 283147 - DNA, 20 bp, Artificial
  CRISPR gRNA sequence
ccttgagtgaaatgaaaggt

SEQ ID NO: 283148 - DNA, 20 bp, Artificial
  CRISPR gRNA sequence
atttatatcatttaattgaa

SEQ ID NO: 283149 - DNA, 20 bp, Artificial
  CRISPR gRNA sequence
tgaattttccagtgatccca

SEQ ID NO: 283150 - DNA, 20 bp, Artificial
  CRISPR gRNA sequence
gcaagtggctgagctgggac

SEQ ID NO: 283151 - DNA, 20 bp, Artificial
  CRISPR gRNA sequence
tagaatccaagtcaatggag

SEQ ID NO: 283152 - DNA, 20 bp, Artificial
  CRISPR gRNA sequence
tttgctttccttgcaacact

SEQ ID NO: 283153 - DNA, 20 bp, Artificial
  CRISPR gRNA sequence
ccttgcaacactaggagtgt

SEQ ID NO: 283154 - DNA, 20 bp, Artificial
  CRISPR gRNA sequence
atccagtctgacagaggcct

SEQ ID NO: 283155 - DNA, 20 bp, Artificial
  CRISPR gRNA sequence
tggaaatgaagtccctagac

SEQ ID NO: 283156 - DNA, 20 bp, Artificial
  CRISPR gRNA sequence
ctagacatgggtctccctaa

SEQ ID NO: 283157 - DNA, 20 bp, Artificial
  CRISPR gRNA sequence
aggggatctgtgtggctcca

SEQ ID NO: 283158 - DNA, 20 bp, Artificial
  CRISPR gRNA sequence
agggggcgctggggccttag

SEQ ID NO: 283159 - DNA, 20 bp, Artificial
  CRISPR gRNA sequence
aggtcctacaagagcctagg

SEQ ID NO: 283160 - DNA, 20 bp, Artificial
  CRISPR gRNA sequence
tcagaaaatacagcctgcta

SEQ ID NO: 283161 - DNA, 20 bp, Artificial
  CRISPR gRNA sequence
tgctgatatttcttggctat

SEQ ID NO: 283162 - DNA, 20 bp, Artificial
  CRISPR gRNA sequence
tatgtggatggagaaatgaa

SEQ ID NO: 283163 - DNA, 20 bp, Artificial
  CRISPR gRNA sequence
cttttagcaaatccaggctg

SEQ ID NO: 283164 - DNA, 20 bp, Artificial
  CRISPR gRNA sequence
gatagccaaagagataaagg

SEQ ID NO: 283165 - DNA, 20 bp, Artificial
  CRISPR gRNA sequence
aaagagataaaggcaggata

SEQ ID NO: 283166 - DNA, 20 bp, Artificial
  CRISPR gRNA sequence
ggcaggatataggatccatt

SEQ ID NO: 283167 - DNA, 20 bp, Artificial
  CRISPR gRNA sequence
tagtccaaaggtataagcat

SEQ ID NO: 283168 - DNA, 20 bp, Artificial
  CRISPR gRNA sequence
gtcatttcagcctggaacca

SEQ ID NO: 283169 - DNA, 20 bp, Artificial
  CRISPR gRNA sequence
tttatttatttattttgaga

SEQ ID NO: 283170 - DNA, 20 bp, Artificial
  CRISPR gRNA sequence
tctcactctgtcacccaagc

SEQ ID NO: 283171 - DNA, 20 bp, Artificial
  CRISPR gRNA sequence
gcctcagcctcctaagtagc

SEQ ID NO: 283172 - DNA, 20 bp, Artificial
  CRISPR gRNA sequence
ttttgtatttttagtagaga

SEQ ID NO: 283173 - DNA, 20 bp, Artificial
  CRISPR gRNA sequence
acctcagcctcccaaagtgc

SEQ ID NO: 283174 - DNA, 20 bp, Artificial
  CRISPR gRNA sequence
aaaagggctcagtggtaggg

SEQ ID NO: 283175 - DNA, 20 bp, Artificial
  CRISPR gRNA sequence
gctcagtggtagggctggat

SEQ ID NO: 283176 - DNA, 20 bp, Artificial
  CRISPR gRNA sequence
agtggtagggctggattggg

SEQ ID NO: 283177 - DNA, 20 bp, Artificial
  CRISPR gRNA sequence
tgaagaaatcggtaaacaag

SEQ ID NO: 283178 - DNA, 20 bp, Artificial
  CRISPR gRNA sequence
catttgtaagataaggccac

SEQ ID NO: 283179 - DNA, 20 bp, Artificial
  CRISPR gRNA sequence
tgtaagataaggccacgaga

SEQ ID NO: 283180 - DNA, 20 bp, Artificial
  CRISPR gRNA sequence
agtggactttctcactcact

SEQ ID NO: 283181 - DNA, 20 bp, Artificial
  CRISPR gRNA sequence
gcaggtgcctttccatattt

SEQ ID NO: 283182 - DNA, 20 bp, Artificial
  CRISPR gRNA sequence
attttgggaggctgaggtgg

SEQ ID NO: 283183 - DNA, 20 bp, Artificial
  CRISPR gRNA sequence
tgggaggatcacctgagatc

SEQ ID NO: 283184 - DNA, 20 bp, Artificial
  CRISPR gRNA sequence
caggagaactgcttgaacct

SEQ ID NO: 283185 - DNA, 20 bp, Artificial
  CRISPR gRNA sequence
attcagggaaggggaagatt

SEQ ID NO: 283186 - DNA, 20 bp, Artificial
  CRISPR gRNA sequence
gaagagctttacccatttgg

SEQ ID NO: 283187 - DNA, 20 bp, Artificial
  CRISPR gRNA sequence
ccatttggtggggtgttgaa

SEQ ID NO: 283188 - DNA, 20 bp, Artificial
  CRISPR gRNA sequence
gtaaggtggctgctaatata

SEQ ID NO: 283189 - DNA, 20 bp, Artificial
  CRISPR gRNA sequence
tactctgagccaatcacaca

SEQ ID NO: 283190 - DNA, 20 bp, Artificial
  CRISPR gRNA sequence
ccaatcacacagtggatgtc

SEQ ID NO: 283191 - DNA, 20 bp, Artificial
  CRISPR gRNA sequence
aactgtgtagtgaggaaagt

SEQ ID NO: 283192 - DNA, 20 bp, Artificial
  CRISPR gRNA sequence
acctgcagaactgtctgaga

SEQ ID NO: 283193 - DNA, 20 bp, Artificial
  CRISPR gRNA sequence
tgcaagtcttgttacataag

SEQ ID NO: 283194 - DNA, 20 bp, Artificial
  CRISPR gRNA sequence
ccccacccccttggagaaag

SEQ ID NO: 283195 - DNA, 20 bp, Artificial
  CRISPR gRNA sequence
cccccttggagaaaggagaa

SEQ ID NO: 283196 - DNA, 20 bp, Artificial
  CRISPR gRNA sequence
gaatgggattcatatttggt

SEQ ID NO: 283197 - DNA, 20 bp, Artificial
  CRISPR gRNA sequence
atttggtgtgggtctaggca

SEQ ID NO: 283198 - DNA, 20 bp, Artificial
  CRISPR gRNA sequence
ataataaccaatgtgaagac

SEQ ID NO: 283199 - DNA, 20 bp, Artificial
  CRISPR gRNA sequence
cttaaggtcacacaactact

SEQ ID NO: 283200 - DNA, 20 bp, Artificial
  CRISPR gRNA sequence
cacaactactgtggatttta

SEQ ID NO: 283201 - DNA, 20 bp, Artificial
  CRISPR gRNA sequence
acaaccaggagcctctaggc

SEQ ID NO: 283202 - DNA, 20 bp, Artificial
  CRISPR gRNA sequence
cctctaggcaaggatgttag

SEQ ID NO: 283203 - DNA, 20 bp, Artificial
  CRISPR gRNA sequence
gtcactcaagtgaaaagggg

SEQ ID NO: 283204 - DNA, 20 bp, Artificial
  CRISPR gRNA sequence
caagtgaaaaggggaggaat

SEQ ID NO: 283205 - DNA, 20 bp, Artificial
  CRISPR gRNA sequence
cgccactgaagtcacatgaa

SEQ ID NO: 283206 - DNA, 20 bp, Artificial
  CRISPR gRNA sequence
ttgtctttagctcacttaat

SEQ ID NO: 283207 - DNA, 20 bp, Artificial
  CRISPR gRNA sequence
aatgcagttctgtagtttaa

SEQ ID NO: 283208 - DNA, 20 bp, Artificial
  CRISPR gRNA sequence
gaaggaggccttctgtaagt

SEQ ID NO: 283209 - DNA, 20 bp, Artificial
  CRISPR gRNA sequence
ccttctgtaagtgagaattc

SEQ ID NO: 283210 - DNA, 20 bp, Artificial
  CRISPR gRNA sequence
cttattcttcgtcatgactg

SEQ ID NO: 283211 - DNA, 20 bp, Artificial
  CRISPR gRNA sequence
actgcagaatcataggccct

SEQ ID NO: 283212 - DNA, 20 bp, Artificial
  CRISPR gRNA sequence
ggaaaataatacatatcttg

SEQ ID NO: 283213 - DNA, 20 bp, Artificial
  CRISPR gRNA sequence
catatcttgtggggttgttg

SEQ ID NO: 283214 - DNA, 20 bp, Artificial
  CRISPR gRNA sequence
caaaaaaaggaaatagtatg

SEQ ID NO: 283215 - DNA, 20 bp, Artificial
  CRISPR gRNA sequence
agtcaggactgacttctctt

SEQ ID NO: 283216 - DNA, 20 bp, Artificial
  CRISPR gRNA sequence
aaattctcaagaaaaaggaa

SEQ ID NO: 283217 - DNA, 20 bp, Artificial
  CRISPR gRNA sequence
tatgttataatgattggtcc

SEQ ID NO: 283218 - DNA, 20 bp, Artificial
  CRISPR gRNA sequence
caaaacctttaacaagcatt

SEQ ID NO: 283219 - DNA, 20 bp, Artificial
  CRISPR gRNA sequence
ccaaaattccatatatccat

SEQ ID NO: 283220 - DNA, 20 bp, Artificial
  CRISPR gRNA sequence
atatccataagaattgaaag

SEQ ID NO: 283221 - DNA, 20 bp, Artificial
  CRISPR gRNA sequence
agccaaatgtccatctacag

SEQ ID NO: 283222 - DNA, 20 bp, Artificial
  CRISPR gRNA sequence
tgggcaaacaaaatgtgggg

SEQ ID NO: 283223 - DNA, 20 bp, Artificial
  CRISPR gRNA sequence
atcctatcatatgctacaac

SEQ ID NO: 283224 - DNA, 20 bp, Artificial
  CRISPR gRNA sequence
tgctacaacgtgaatgaacc

SEQ ID NO: 283225 - DNA, 20 bp, Artificial
  CRISPR gRNA sequence
gccaaattcatacaaacaaa

SEQ ID NO: 283226 - DNA, 20 bp, Artificial
  CRISPR gRNA sequence
ctgaggggagagggggaaag

SEQ ID NO: 283227 - DNA, 20 bp, Artificial
  CRISPR gRNA sequence
ggggagttgtttaatgggca

SEQ ID NO: 283228 - DNA, 20 bp, Artificial
  CRISPR gRNA sequence
gagatctgtttcacaacaat

SEQ ID NO: 283229 - DNA, 20 bp, Artificial
  CRISPR gRNA sequence
tttgtttgtttgtttggaga

SEQ ID NO: 283230 - DNA, 20 bp, Artificial
  CRISPR gRNA sequence
tttgctcttgttgcccaggc

SEQ ID NO: 283231 - DNA, 20 bp, Artificial
  CRISPR gRNA sequence
cttactgcaacctccgcctc

SEQ ID NO: 283232 - DNA, 20 bp, Artificial
  CRISPR gRNA sequence
gattctcctgcctcagcctc

SEQ ID NO: 283233 - DNA, 20 bp, Artificial
  CRISPR gRNA sequence
gcctcagcctcccgagtagc

SEQ ID NO: 283234 - DNA, 20 bp, Artificial
  CRISPR gRNA sequence
ttttgtatttttagtagaga

SEQ ID NO: 283235 - DNA, 20 bp, Artificial
  CRISPR gRNA sequence
gcctcggcctcccaaagtgc

SEQ ID NO: 283236 - DNA, 20 bp, Artificial
  CRISPR gRNA sequence
tggggaccccaaaaatcaaa

SEQ ID NO: 283237 - DNA, 20 bp, Artificial
  CRISPR gRNA sequence
aagttctgttactgccgact

SEQ ID NO: 283238 - DNA, 20 bp, Artificial
  CRISPR gRNA sequence
ctttggattcctgaccatgc

SEQ ID NO: 283239 - DNA, 20 bp, Artificial
  CRISPR gRNA sequence
tgactatgatgtctggggac

SEQ ID NO: 283240 - DNA, 20 bp, Artificial
  CRISPR gRNA sequence
tggggacatgaatatatggc

SEQ ID NO: 283241 - DNA, 20 bp, Artificial
  CRISPR gRNA sequence
cccatctgacgagggcacat

SEQ ID NO: 283242 - DNA, 20 bp, Artificial
  CRISPR gRNA sequence
cgttatcagtcaaaggttgg

SEQ ID NO: 283243 - DNA, 20 bp, Artificial
  CRISPR gRNA sequence
aggtgaaaattttaccaaag

SEQ ID NO: 283244 - DNA, 20 bp, Artificial
  CRISPR gRNA sequence
atgtatctcacttcatttct

SEQ ID NO: 283245 - DNA, 20 bp, Artificial
  CRISPR gRNA sequence
atgctgaaaaggtaacgggg

SEQ ID NO: 283246 - DNA, 20 bp, Artificial
  CRISPR gRNA sequence
actttgggaggccaaggcag

SEQ ID NO: 283247 - DNA, 20 bp, Artificial
  CRISPR gRNA sequence
caggcggatcacttgaggtc

SEQ ID NO: 283248 - DNA, 20 bp, Artificial
  CRISPR gRNA sequence
ctactctggaggctgaggca

SEQ ID NO: 283249 - DNA, 20 bp, Artificial
  CRISPR gRNA sequence
ttgcaccactgcactccagc

SEQ ID NO: 283250 - DNA, 20 bp, Artificial
  CRISPR gRNA sequence
tcctgaaaaattagatgtta

SEQ ID NO: 283251 - DNA, 20 bp, Artificial
  CRISPR gRNA sequence
cagcactttgggaggccaag

SEQ ID NO: 283252 - DNA, 20 bp, Artificial
  CRISPR gRNA sequence
actttgggaggccaaggtgg

SEQ ID NO: 283253 - DNA, 20 bp, Artificial
  CRISPR gRNA sequence
tgggtggatggcttgagctc

SEQ ID NO: 283254 - DNA, 20 bp, Artificial
  CRISPR gRNA sequence
tactcaggaggctgaggcag

SEQ ID NO: 283255 - DNA, 20 bp, Artificial
  CRISPR gRNA sequence
aaaaaaagtagactacagag

SEQ ID NO: 283256 - DNA, 20 bp, Artificial
  CRISPR gRNA sequence
ttaaaaaaaaaaaaaagtta

SEQ ID NO: 283257 - DNA, 20 bp, Artificial
  CRISPR gRNA sequence
aaaaaaaaaaagttagagaa

SEQ ID NO: 283258 - DNA, 20 bp, Artificial
  CRISPR gRNA sequence
acaaggaaaaaaactaattt

SEQ ID NO: 283259 - DNA, 20 bp, Artificial
  CRISPR gRNA sequence
gagccaattcatcaagacag

SEQ ID NO: 283260 - DNA, 20 bp, Artificial
  CRISPR gRNA sequence
gacaggggaattgcaataga

SEQ ID NO: 283261 - DNA, 20 bp, Artificial
  CRISPR gRNA sequence
caactggctgtgcgggagac

SEQ ID NO: 283262 - DNA, 20 bp, Artificial
  CRISPR gRNA sequence
ctctccaagcatctggggag

SEQ ID NO: 283263 - DNA, 20 bp, Artificial
  CRISPR gRNA sequence
atctggggagcagagttttt

SEQ ID NO: 283264 - DNA, 20 bp, Artificial
  CRISPR gRNA sequence
gagtttttaaggataactag

SEQ ID NO: 283265 - DNA, 20 bp, Artificial
  CRISPR gRNA sequence
tcgggggaagccagtgagct

SEQ ID NO: 283266 - DNA, 20 bp, Artificial
  CRISPR gRNA sequence
gctgggagtgctgattggtc

SEQ ID NO: 283267 - DNA, 20 bp, Artificial
  CRISPR gRNA sequence
tggtcagggatgataccata

SEQ ID NO: 283268 - DNA, 20 bp, Artificial
  CRISPR gRNA sequence
gttgaagctgtcttcttgca

SEQ ID NO: 283269 - DNA, 20 bp, Artificial
  CRISPR gRNA sequence
ttggggggccacaagatcag

SEQ ID NO: 283270 - DNA, 20 bp, Artificial
  CRISPR gRNA sequence
agatgagtcagtttattgat

SEQ ID NO: 283271 - DNA, 20 bp, Artificial
  CRISPR gRNA sequence
gatcttaggagcagtttagg

SEQ ID NO: 283272 - DNA, 20 bp, Artificial
  CRISPR gRNA sequence
aggagcagtttagggagggt

SEQ ID NO: 283273 - DNA, 20 bp, Artificial
  CRISPR gRNA sequence
agttagttcagcctacaccc

SEQ ID NO: 283274 - DNA, 20 bp, Artificial
  CRISPR gRNA sequence
cttggaggttagaagcaaga

SEQ ID NO: 283275 - DNA, 20 bp, Artificial
  CRISPR gRNA sequence
ctcagtcataattttgcaaa

SEQ ID NO: 283276 - DNA, 20 bp, Artificial
  CRISPR gRNA sequence
actttaattacagtataaca

SEQ ID NO: 283277 - DNA, 20 bp, Artificial
  CRISPR gRNA sequence
ataacttcagcagatccgta

SEQ ID NO: 283278 - DNA, 20 bp, Artificial
  CRISPR gRNA sequence
ctttgttttaatcattagct

SEQ ID NO: 283279 - DNA, 20 bp, Artificial
  CRISPR gRNA sequence
agatcacacctaaagttgtg

SEQ ID NO: 283280 - DNA, 20 bp, Artificial
  CRISPR gRNA sequence
actcagtgttttctctgctc

SEQ ID NO: 283281 - DNA, 20 bp, Artificial
  CRISPR gRNA sequence
gtgttttctctgctcttgga

SEQ ID NO: 283282 - DNA, 20 bp, Artificial
  CRISPR gRNA sequence
ttatatggtgatgtgatttg

SEQ ID NO: 283283 - DNA, 20 bp, Artificial
  CRISPR gRNA sequence
taaaatgaaaatgtgtttcc

SEQ ID NO: 283284 - DNA, 20 bp, Artificial
  CRISPR gRNA sequence
aaaatgtgtttcctggggtg

SEQ ID NO: 283285 - DNA, 20 bp, Artificial
  CRISPR gRNA sequence
gtttcctggggtggggggtg

SEQ ID NO: 283286 - DNA, 20 bp, Artificial
  CRISPR gRNA sequence
gagaagtagactcaggtcag

SEQ ID NO: 283287 - DNA, 20 bp, Artificial
  CRISPR gRNA sequence
tagactcaggtcaggtgaat

SEQ ID NO: 283288 - DNA, 20 bp, Artificial
  CRISPR gRNA sequence
aaagataaagaagaaaatcc

SEQ ID NO: 283289 - DNA, 20 bp, Artificial
  CRISPR gRNA sequence
aggggacaatgtgagatttc

SEQ ID NO: 283290 - DNA, 20 bp, Artificial
  CRISPR gRNA sequence
tttctggggtactcagaacc

SEQ ID NO: 283291 - DNA, 20 bp, Artificial
  CRISPR gRNA sequence
gtactcagaaccgagggtgt

SEQ ID NO: 283292 - DNA, 20 bp, Artificial
  CRISPR gRNA sequence
taattttgctgagaagcatt

SEQ ID NO: 283293 - DNA, 20 bp, Artificial
  CRISPR gRNA sequence
aagcattctgaattttccaa

SEQ ID NO: 283294 - DNA, 20 bp, Artificial
  CRISPR gRNA sequence
tctcaaatgcttataagcct

SEQ ID NO: 283295 - DNA, 20 bp, Artificial
  CRISPR gRNA sequence
tataagcctatgagtcattt

SEQ ID NO: 283296 - DNA, 20 bp, Artificial
  CRISPR gRNA sequence
agatttaagttcagtaggtc

SEQ ID NO: 283297 - DNA, 20 bp, Artificial
  CRISPR gRNA sequence
aagttcagtaggtctggggt

SEQ ID NO: 283298 - DNA, 20 bp, Artificial
  CRISPR gRNA sequence
ggaccacaatttgagaagca

SEQ ID NO: 283299 - DNA, 20 bp, Artificial
  CRISPR gRNA sequence
gaattaagctctcatttggc

SEQ ID NO: 283300 - DNA, 20 bp, Artificial
  CRISPR gRNA sequence
atcctctttgctcagaacca

SEQ ID NO: 283301 - DNA, 20 bp, Artificial
  CRISPR gRNA sequence
ttaacagcttaactaggtta

SEQ ID NO: 283302 - DNA, 20 bp, Artificial
  CRISPR gRNA sequence
cattcctaccctttcctatt

SEQ ID NO: 283303 - DNA, 20 bp, Artificial
  CRISPR gRNA sequence
cctattaagagtggtaaaaa

SEQ ID NO: 283304 - DNA, 20 bp, Artificial
  CRISPR gRNA sequence
tcacaatctcacaagacctc

SEQ ID NO: 283305 - DNA, 20 bp, Artificial
  CRISPR gRNA sequence
cttagaaaaaaggtgggaga

SEQ ID NO: 283306 - DNA, 20 bp, Artificial
  CRISPR gRNA sequence
aactttttttttttttgaga

SEQ ID NO: 283307 - DNA, 20 bp, Artificial
  CRISPR gRNA sequence
tcttactctgtcacccaggc

SEQ ID NO: 283308 - DNA, 20 bp, Artificial
  CRISPR gRNA sequence
tagagtgcagtggcgtgatc

SEQ ID NO: 283309 - DNA, 20 bp, Artificial
  CRISPR gRNA sequence
gtctctgcagcctctgcctc

SEQ ID NO: 283310 - DNA, 20 bp, Artificial
  CRISPR gRNA sequence
caaggtttcactatgttgtc

SEQ ID NO: 283311 - DNA, 20 bp, Artificial
  CRISPR gRNA sequence
gccttgacctcccaaagtgc

SEQ ID NO: 283312 - DNA, 20 bp, Artificial
  CRISPR gRNA sequence
tttttaatacagttcctggt

SEQ ID NO: 283313 - DNA, 20 bp, Artificial
  CRISPR gRNA sequence
agcagagcacagaaatgaac

SEQ ID NO: 283314 - DNA, 20 bp, Artificial
  CRISPR gRNA sequence
catgaatcatattaataatt

SEQ ID NO: 283315 - DNA, 20 bp, Artificial
  CRISPR gRNA sequence
tcatattaataatttaggat

SEQ ID NO: 283316 - DNA, 20 bp, Artificial
  CRISPR gRNA sequence
ataatttaggatatgagttt

SEQ ID NO: 283317 - DNA, 20 bp, Artificial
  CRISPR gRNA sequence
tattgatgttataagaaaca

SEQ ID NO: 283318 - DNA, 20 bp, Artificial
  CRISPR gRNA sequence
agatatcagctgcctgtgtc

SEQ ID NO: 283319 - DNA, 20 bp, Artificial
  CRISPR gRNA sequence
tgtgtcatgagtcgatctta

SEQ ID NO: 283320 - DNA, 20 bp, Artificial
  CRISPR gRNA sequence
tatcaaacttcatttaggga

SEQ ID NO: 283321 - DNA, 20 bp, Artificial
  CRISPR gRNA sequence
atgagggggcttacctaaga

SEQ ID NO: 283322 - DNA, 20 bp, Artificial
  CRISPR gRNA sequence
ttaaatatagctatcattgg

SEQ ID NO: 283323 - DNA, 20 bp, Artificial
  CRISPR gRNA sequence
actttgggaggccgaggctg

SEQ ID NO: 283324 - DNA, 20 bp, Artificial
  CRISPR gRNA sequence
tactctggaggctgaggcag

SEQ ID NO: 283325 - DNA, 20 bp, Artificial
  CRISPR gRNA sequence
ctgcactccagcctgggcaa

SEQ ID NO: 283326 - DNA, 20 bp, Artificial
  CRISPR gRNA sequence
gtcatttaattcttacaacc

SEQ ID NO: 283327 - DNA, 20 bp, Artificial
  CRISPR gRNA sequence
tgagcaaactaagactaaag

SEQ ID NO: 283328 - DNA, 20 bp, Artificial
  CRISPR gRNA sequence
aggtgggtaagttattgacc

SEQ ID NO: 283329 - DNA, 20 bp, Artificial
  CRISPR gRNA sequence
catgacatctctgtggggct

SEQ ID NO: 283330 - DNA, 20 bp, Artificial
  CRISPR gRNA sequence
aagctaactctatgaggaga

SEQ ID NO: 283331 - DNA, 20 bp, Artificial
  CRISPR gRNA sequence
aagctaatctctttatgtgt

SEQ ID NO: 283332 - DNA, 20 bp, Artificial
  CRISPR gRNA sequence
ttttcctgtactttgtactt

SEQ ID NO: 283333 - DNA, 20 bp, Artificial
  CRISPR gRNA sequence
tttgtacttcagaatcttat

SEQ ID NO: 283334 - DNA, 20 bp, Artificial
  CRISPR gRNA sequence
tataaatgaaacagtgcctc

SEQ ID NO: 283335 - DNA, 20 bp, Artificial
  CRISPR gRNA sequence
cagtgcctcaagggtcttgg

SEQ ID NO: 283336 - DNA, 20 bp, Artificial
  CRISPR gRNA sequence
aagaaaaacaataaagtgtg

SEQ ID NO: 283337 - DNA, 20 bp, Artificial
  CRISPR gRNA sequence
tataggctcaatgttgtagt

SEQ ID NO: 283338 - DNA, 20 bp, Artificial
  CRISPR gRNA sequence
tagtttggatataggttttt

SEQ ID NO: 283339 - DNA, 20 bp, Artificial
  CRISPR gRNA sequence
aaaataattaaaaaattcaa

SEQ ID NO: 283340 - DNA, 20 bp, Artificial
  CRISPR gRNA sequence
aaaacattactgatgtggtt

SEQ ID NO: 283341 - DNA, 20 bp, Artificial
  CRISPR gRNA sequence
tgcccatggtctcatgagga

SEQ ID NO: 283342 - DNA, 20 bp, Artificial
  CRISPR gRNA sequence
caaattaaaaaatactggtc

SEQ ID NO: 283343 - DNA, 20 bp, Artificial
  CRISPR gRNA sequence
actggtcatgggtgtttttt

SEQ ID NO: 283344 - DNA, 20 bp, Artificial
  CRISPR gRNA sequence
atgggtgtttttttggggta

SEQ ID NO: 283345 - DNA, 20 bp, Artificial
  CRISPR gRNA sequence
aagccttctctatttatgta

SEQ ID NO: 283346 - DNA, 20 bp, Artificial
  CRISPR gRNA sequence
cccttacctgtaacagactt

SEQ ID NO: 283347 - DNA, 20 bp, Artificial
  CRISPR gRNA sequence
gacttaagagtcaatgttca

SEQ ID NO: 283348 - DNA, 20 bp, Artificial
  CRISPR gRNA sequence
gaaaccattctcaagagcaa

SEQ ID NO: 283349 - DNA, 20 bp, Artificial
  CRISPR gRNA sequence
ggaaatgctaaccacaaatt

SEQ ID NO: 283350 - DNA, 20 bp, Artificial
  CRISPR gRNA sequence
aggtaagggaaagagaggga

SEQ ID NO: 283351 - DNA, 20 bp, Artificial
  CRISPR gRNA sequence
tcagtgtttttggtctcaag

SEQ ID NO: 283352 - DNA, 20 bp, Artificial
  CRISPR gRNA sequence
ttttggtctcaagttggatg

SEQ ID NO: 283353 - DNA, 20 bp, Artificial
  CRISPR gRNA sequence
ggctctggtgtcagacagat

SEQ ID NO: 283354 - DNA, 20 bp, Artificial
  CRISPR gRNA sequence
agatctacaacctacctctc

SEQ ID NO: 283355 - DNA, 20 bp, Artificial
  CRISPR gRNA sequence
aaggtccagacctaacaaac

SEQ ID NO: 283356 - DNA, 20 bp, Artificial
  CRISPR gRNA sequence
tatctccatcaaaagtggca

SEQ ID NO: 283357 - DNA, 20 bp, Artificial
  CRISPR gRNA sequence
attcaaatcaaagttagtct

SEQ ID NO: 283358 - DNA, 20 bp, Artificial
  CRISPR gRNA sequence
tggattatacataactatta

SEQ ID NO: 283359 - DNA, 20 bp, Artificial
  CRISPR gRNA sequence
ccttgctcttttgcccaggc

SEQ ID NO: 283360 - DNA, 20 bp, Artificial
  CRISPR gRNA sequence
ctaactgcaatctccaccct

SEQ ID NO: 283361 - DNA, 20 bp, Artificial
  CRISPR gRNA sequence
cattctcttgccttagcctc

SEQ ID NO: 283362 - DNA, 20 bp, Artificial
  CRISPR gRNA sequence
gccttagcctcccgagtagc

SEQ ID NO: 283363 - DNA, 20 bp, Artificial
  CRISPR gRNA sequence
ttatgtatttttggtagaga

SEQ ID NO: 283364 - DNA, 20 bp, Artificial
  CRISPR gRNA sequence
gcctcggcctcccaaagtgc

SEQ ID NO: 283365 - DNA, 20 bp, Artificial
  CRISPR gRNA sequence
tcccaaagtgctgggattac

SEQ ID NO: 283366 - DNA, 20 bp, Artificial
  CRISPR gRNA sequence
attccaacttctaatattag

SEQ ID NO: 283367 - DNA, 20 bp, Artificial
  CRISPR gRNA sequence
ctcctggttggaaaatggag

SEQ ID NO: 283368 - DNA, 20 bp, Artificial
  CRISPR gRNA sequence
tctatgctgttagcagcaaa

SEQ ID NO: 283369 - DNA, 20 bp, Artificial
  CRISPR gRNA sequence
ctcatcaagtatggacattt

SEQ ID NO: 283370 - DNA, 20 bp, Artificial
  CRISPR gRNA sequence
tcaagtatggacatttaaga

SEQ ID NO: 283371 - DNA, 20 bp, Artificial
  CRISPR gRNA sequence
gagtgaatcagaccttcaac

SEQ ID NO: 283372 - DNA, 20 bp, Artificial
  CRISPR gRNA sequence
aagtaagtgacattgttctg

SEQ ID NO: 283373 - DNA, 20 bp, Artificial
  CRISPR gRNA sequence
tctggggagtttctactata

SEQ ID NO: 283374 - DNA, 20 bp, Artificial
  CRISPR gRNA sequence
tagtcgtgtcatttaatgat

SEQ ID NO: 283375 - DNA, 20 bp, Artificial
  CRISPR gRNA sequence
ttctgtcattgtctgaacat

SEQ ID NO: 283376 - DNA, 20 bp, Artificial
  CRISPR gRNA sequence
tgggactaccatcatatatg

SEQ ID NO: 283377 - DNA, 20 bp, Artificial
  CRISPR gRNA sequence
taactcagccagatacattt

SEQ ID NO: 283378 - DNA, 20 bp, Artificial
  CRISPR gRNA sequence
actttgggaggctgaagtgg

SEQ ID NO: 283379 - DNA, 20 bp, Artificial
  CRISPR gRNA sequence
tgggaggatcacttgagccc

SEQ ID NO: 283380 - DNA, 20 bp, Artificial
  CRISPR gRNA sequence
gtgtagtcctaggtacttgg

SEQ ID NO: 283381 - DNA, 20 bp, Artificial
  CRISPR gRNA sequence
taggtacttgggagggtaag

SEQ ID NO: 283382 - DNA, 20 bp, Artificial
  CRISPR gRNA sequence
ctagactccagcctgggcaa

SEQ ID NO: 283383 - DNA, 20 bp, Artificial
  CRISPR gRNA sequence
tctcgccctgttgcccaggc

SEQ ID NO: 283384 - DNA, 20 bp, Artificial
  CRISPR gRNA sequence
aattcttctgcctcagcctc

SEQ ID NO: 283385 - DNA, 20 bp, Artificial
  CRISPR gRNA sequence
gcctcagcctcccgaatagc

SEQ ID NO: 283386 - DNA, 20 bp, Artificial
  CRISPR gRNA sequence
ttttctatctttagtggaga

SEQ ID NO: 283387 - DNA, 20 bp, Artificial
  CRISPR gRNA sequence
gcctcagcctcccaaagtgc

SEQ ID NO: 283388 - DNA, 20 bp, Artificial
  CRISPR gRNA sequence
tgccctttggaactgccctt

SEQ ID NO: 283389 - DNA, 20 bp, Artificial
  CRISPR gRNA sequence
caaacaatttttttttgtgg

SEQ ID NO: 283390 - DNA, 20 bp, Artificial
  CRISPR gRNA sequence
ctgaaccaagtctgggaaag

SEQ ID NO: 283391 - DNA, 20 bp, Artificial
  CRISPR gRNA sequence
ccctactggtagtaaactca

SEQ ID NO: 283392 - DNA, 20 bp, Artificial
  CRISPR gRNA sequence
gaaaatatacaatgaaaacg

SEQ ID NO: 283393 - DNA, 20 bp, Artificial
  CRISPR gRNA sequence
aatgaaaacgatgggtttat

SEQ ID NO: 283394 - DNA, 20 bp, Artificial
  CRISPR gRNA sequence
ctacccctagccccactccc

SEQ ID NO: 283395 - DNA, 20 bp, Artificial
  CRISPR gRNA sequence
gtatagtaagaaacaaaaca

SEQ ID NO: 283396 - DNA, 20 bp, Artificial
  CRISPR gRNA sequence
tctttacttgtagttgcgaa

SEQ ID NO: 283397 - DNA, 20 bp, Artificial
  CRISPR gRNA sequence
ttttttttttttttttgaga

SEQ ID NO: 283398 - DNA, 20 bp, Artificial
  CRISPR gRNA sequence
tctcgctctgtcacccaggc

SEQ ID NO: 283399 - DNA, 20 bp, Artificial
  CRISPR gRNA sequence
ttttgtatttttagtagaga

SEQ ID NO: 283400 - DNA, 20 bp, Artificial
  CRISPR gRNA sequence
tgattgaaggcagaaaacag

SEQ ID NO: 283401 - DNA, 20 bp, Artificial
  CRISPR gRNA sequence
attaaatcagtaatactagc

SEQ ID NO: 283402 - DNA, 20 bp, Artificial
  CRISPR gRNA sequence
gatttggacattatttatat

SEQ ID NO: 283403 - DNA, 20 bp, Artificial
  CRISPR gRNA sequence
gacattatttatattggaat

SEQ ID NO: 283404 - DNA, 20 bp, Artificial
  CRISPR gRNA sequence
tatatgtgacattctaagac

SEQ ID NO: 283405 - DNA, 20 bp, Artificial
  CRISPR gRNA sequence
aggggttggcaaattttttt

SEQ ID NO: 283406 - DNA, 20 bp, Artificial
  CRISPR gRNA sequence
cagccacagacaagacataa

SEQ ID NO: 283407 - DNA, 20 bp, Artificial
  CRISPR gRNA sequence
tcttttttttttttttgaga

SEQ ID NO: 283408 - DNA, 20 bp, Artificial
  CRISPR gRNA sequence
ttcactcttgttgcccaggc

SEQ ID NO: 283409 - DNA, 20 bp, Artificial
  CRISPR gRNA sequence
gcctcagcctcccaagtagc

SEQ ID NO: 283410 - DNA, 20 bp, Artificial
  CRISPR gRNA sequence
atgtattttcttagtggaga

SEQ ID NO: 283411 - DNA, 20 bp, Artificial
  CRISPR gRNA sequence
tctttgtggctggagagctt

SEQ ID NO: 283412 - DNA, 20 bp, Artificial
  CRISPR gRNA sequence
tctcattaattggactgtgt

SEQ ID NO: 283413 - DNA, 20 bp, Artificial
  CRISPR gRNA sequence
tggactgtgtggggattctt

SEQ ID NO: 283414 - DNA, 20 bp, Artificial
  CRISPR gRNA sequence
tacatagaaatgttacaggt

SEQ ID NO: 283415 - DNA, 20 bp, Artificial
  CRISPR gRNA sequence
tagaaatgttacaggtcagg

SEQ ID NO: 283416 - DNA, 20 bp, Artificial
  CRISPR gRNA sequence
aggagcaagtcatgtcttat

SEQ ID NO: 283417 - DNA, 20 bp, Artificial
  CRISPR gRNA sequence
cataattcagtcacctccca

SEQ ID NO: 283418 - DNA, 20 bp, Artificial
  CRISPR gRNA sequence
ccatgacatgtggcaactgt

SEQ ID NO: 283419 - DNA, 20 bp, Artificial
  CRISPR gRNA sequence
gttataattcaagatgagat

SEQ ID NO: 283420 - DNA, 20 bp, Artificial
  CRISPR gRNA sequence
agcccaaatgtattaattaa

SEQ ID NO: 283421 - DNA, 20 bp, Artificial
  CRISPR gRNA sequence
ctggaaggagatacatctga

SEQ ID NO: 283422 - DNA, 20 bp, Artificial
  CRISPR gRNA sequence
ccctcacaccgctctgtacc

SEQ ID NO: 283423 - DNA, 20 bp, Artificial
  CRISPR gRNA sequence
accgctctgtaccttggatt

SEQ ID NO: 283424 - DNA, 20 bp, Artificial
  CRISPR gRNA sequence
ggattctgggtctgcccctg

SEQ ID NO: 283425 - DNA, 20 bp, Artificial
  CRISPR gRNA sequence
acacacatactctctctagg

SEQ ID NO: 283426 - DNA, 20 bp, Artificial
  CRISPR gRNA sequence
ctctaggttgaatgaggctt

SEQ ID NO: 283427 - DNA, 20 bp, Artificial
  CRISPR gRNA sequence
aggttgaatgaggcttgtgg

SEQ ID NO: 283428 - DNA, 20 bp, Artificial
  CRISPR gRNA sequence
atgaggcttgtggatgggtg

SEQ ID NO: 283429 - DNA, 20 bp, Artificial
  CRISPR gRNA sequence
atgggtgtggagtggaagcc

SEQ ID NO: 283430 - DNA, 20 bp, Artificial
  CRISPR gRNA sequence
ctgtgaaacttctagactcc

SEQ ID NO: 283431 - DNA, 20 bp, Artificial
  CRISPR gRNA sequence
ctatgattaaataggtgttt

SEQ ID NO: 283432 - DNA, 20 bp, Artificial
  CRISPR gRNA sequence
ttactgtgacagcaatgtgc

SEQ ID NO: 283433 - DNA, 20 bp, Artificial
  CRISPR gRNA sequence
cagtaagttccagagatatt

SEQ ID NO: 283434 - DNA, 20 bp, Artificial
  CRISPR gRNA sequence
agaaaataccacactcttat

SEQ ID NO: 283435 - DNA, 20 bp, Artificial
  CRISPR gRNA sequence
attgttattcactgaaatgg

SEQ ID NO: 283436 - DNA, 20 bp, Artificial
  CRISPR gRNA sequence
tctcactctgtcacccaggc

SEQ ID NO: 283437 - DNA, 20 bp, Artificial
  CRISPR gRNA sequence
aattctcttgcttcagcctc

SEQ ID NO: 283438 - DNA, 20 bp, Artificial
  CRISPR gRNA sequence
gcttcagcctcctgagtacc

SEQ ID NO: 283439 - DNA, 20 bp, Artificial
  CRISPR gRNA sequence
ttttgtacttttagtagaga

SEQ ID NO: 283440 - DNA, 20 bp, Artificial
  CRISPR gRNA sequence
accttggcctcccaaagtgc

SEQ ID NO: 283441 - DNA, 20 bp, Artificial
  CRISPR gRNA sequence
catttcaaatctcaggtgtg

SEQ ID NO: 283442 - DNA, 20 bp, Artificial
  CRISPR gRNA sequence
agaaaagccttcagagaaaa

SEQ ID NO: 283443 - DNA, 20 bp, Artificial
  CRISPR gRNA sequence
agtgcaacaaacagaaacag

SEQ ID NO: 283444 - DNA, 20 bp, Artificial
  CRISPR gRNA sequence
atgagaagtccaataagcaa

SEQ ID NO: 283445 - DNA, 20 bp, Artificial
  CRISPR gRNA sequence
actgtgggaggccaagacag

SEQ ID NO: 283446 - DNA, 20 bp, Artificial
  CRISPR gRNA sequence
caggagaatcacctgaggtc

SEQ ID NO: 283447 - DNA, 20 bp, Artificial
  CRISPR gRNA sequence
actgaaaatacaaaaattag

SEQ ID NO: 283448 - DNA, 20 bp, Artificial
  CRISPR gRNA sequence
tactcgggaggctgaggcag

SEQ ID NO: 283449 - DNA, 20 bp, Artificial
  CRISPR gRNA sequence
taaataaataaaacttacca

SEQ ID NO: 283450 - DNA, 20 bp, Artificial
  CRISPR gRNA sequence
gtaatcagaaaagtaaaaac

SEQ ID NO: 283451 - DNA, 20 bp, Artificial
  CRISPR gRNA sequence
caaaaggctatggttatggc

SEQ ID NO: 283452 - DNA, 20 bp, Artificial
  CRISPR gRNA sequence
agaggctgggcatcaagcca

SEQ ID NO: 283453 - DNA, 20 bp, Artificial
  CRISPR gRNA sequence
ctgagaaatgttccagatgt

SEQ ID NO: 283454 - DNA, 20 bp, Artificial
  CRISPR gRNA sequence
tctgatgtgcaaagtgtggg

SEQ ID NO: 283455 - DNA, 20 bp, Artificial
  CRISPR gRNA sequence
tgcaaagtgtgggaagagtc

SEQ ID NO: 283456 - DNA, 20 bp, Artificial
  CRISPR gRNA sequence
tgcaaagaactttgggccca

SEQ ID NO: 283457 - DNA, 20 bp, Artificial
  CRISPR gRNA sequence
agaactaagcatcacacatt

SEQ ID NO: 283458 - DNA, 20 bp, Artificial
  CRISPR gRNA sequence
actgtgaaattctaccagca

SEQ ID NO: 283459 - DNA, 20 bp, Artificial
  CRISPR gRNA sequence
tactgtatattaccctgtac

SEQ ID NO: 283460 - DNA, 20 bp, Artificial
  CRISPR gRNA sequence
atgattcctcaaagcagctg

SEQ ID NO: 283461 - DNA, 20 bp, Artificial
  CRISPR gRNA sequence
agctgctgctcctgatctgg

SEQ ID NO: 283462 - DNA, 20 bp, Artificial
  CRISPR gRNA sequence
taaccttcagtgctctcttc

SEQ ID NO: 283463 - DNA, 20 bp, Artificial
  CRISPR gRNA sequence
ttctgtgtttccagtagcta

SEQ ID NO: 283464 - DNA, 20 bp, Artificial
  CRISPR gRNA sequence
tgaaaaacctgtatccgaaa

SEQ ID NO: 283465 - DNA, 20 bp, Artificial
  CRISPR gRNA sequence
tagggcagctactgtgaggt

SEQ ID NO: 283466 - DNA, 20 bp, Artificial
  CRISPR gRNA sequence
gtgatgtgtatgtgttgaga

SEQ ID NO: 283467 - DNA, 20 bp, Artificial
  CRISPR gRNA sequence
tggcttgtaaaagatttcct

SEQ ID NO: 283468 - DNA, 20 bp, Artificial
  CRISPR gRNA sequence
cacaagtatgtgcctgattg

SEQ ID NO: 283469 - DNA, 20 bp, Artificial
  CRISPR gRNA sequence
actggagagctgaccaggca

SEQ ID NO: 283470 - DNA, 20 bp, Artificial
  CRISPR gRNA sequence
ttgcatcaatagaaaaggca

SEQ ID NO: 283471 - DNA, 20 bp, Artificial
  CRISPR gRNA sequence
atcaatagaaaaggcacaga

SEQ ID NO: 283472 - DNA, 20 bp, Artificial
  CRISPR gRNA sequence
attaccttaatctcagtaaa

SEQ ID NO: 283473 - DNA, 20 bp, Artificial
  CRISPR gRNA sequence
tgtggcactctactaggcac

SEQ ID NO: 283474 - DNA, 20 bp, Artificial
  CRISPR gRNA sequence
ctttatatatttttggagac

SEQ ID NO: 283475 - DNA, 20 bp, Artificial
  CRISPR gRNA sequence
agggctagtcgatttggcag

SEQ ID NO: 283476 - DNA, 20 bp, Artificial
  CRISPR gRNA sequence
gagttgttacacactcctta

SEQ ID NO: 283477 - DNA, 20 bp, Artificial
  CRISPR gRNA sequence
ctgatattctaattttgatt

SEQ ID NO: 283478 - DNA, 20 bp, Artificial
  CRISPR gRNA sequence
aattgacaaattttggtgcc

SEQ ID NO: 283479 - DNA, 20 bp, Artificial
  CRISPR gRNA sequence
accaattctcagttcttggg

SEQ ID NO: 283480 - DNA, 20 bp, Artificial
  CRISPR gRNA sequence
ttctcagttcttgggctggg

SEQ ID NO: 283481 - DNA, 20 bp, Artificial
  CRISPR gRNA sequence
actttgggaggccaaggcag

SEQ ID NO: 283482 - DNA, 20 bp, Artificial
  CRISPR gRNA sequence
caggtggatcacttaaggtc

SEQ ID NO: 283483 - DNA, 20 bp, Artificial
  CRISPR gRNA sequence
tactcaggaggctgaagcag

SEQ ID NO: 283484 - DNA, 20 bp, Artificial
  CRISPR gRNA sequence
tcatgccattgcactccagc

SEQ ID NO: 283485 - DNA, 20 bp, Artificial
  CRISPR gRNA sequence
ttgcactccagcctgggtga

SEQ ID NO: 283486 - DNA, 20 bp, Artificial
  CRISPR gRNA sequence
gttcttttttttttttgaga

SEQ ID NO: 283487 - DNA, 20 bp, Artificial
  CRISPR gRNA sequence
tctcactctgccacccaggc

SEQ ID NO: 283488 - DNA, 20 bp, Artificial
  CRISPR gRNA sequence
aattatccggcctcagcctc

SEQ ID NO: 283489 - DNA, 20 bp, Artificial
  CRISPR gRNA sequence
ttttgtatttttagtagaga

SEQ ID NO: 283490 - DNA, 20 bp, Artificial
  CRISPR gRNA sequence
cggggtttcaccatgttggc

SEQ ID NO: 283491 - DNA, 20 bp, Artificial
  CRISPR gRNA sequence
gtgctgggacttcttgtctt

SEQ ID NO: 283492 - DNA, 20 bp, Artificial
  CRISPR gRNA sequence
tttggaattccagtgcctag

SEQ ID NO: 283493 - DNA, 20 bp, Artificial
  CRISPR gRNA sequence
tgtccattttctcagttctt

SEQ ID NO: 283494 - DNA, 20 bp, Artificial
  CRISPR gRNA sequence
cagttctttagaatacattt

SEQ ID NO: 283495 - DNA, 20 bp, Artificial
  CRISPR gRNA sequence
acatttttggatgaaagatc

SEQ ID NO: 283496 - DNA, 20 bp, Artificial
  CRISPR gRNA sequence
tttctaagatattttaccct

SEQ ID NO: 283497 - DNA, 20 bp, Artificial
  CRISPR gRNA sequence
ttaccctatgaatttacact

SEQ ID NO: 283498 - DNA, 20 bp, Artificial
  CRISPR gRNA sequence
taaggccataatcactatga

SEQ ID NO: 283499 - DNA, 20 bp, Artificial
  CRISPR gRNA sequence
gaaggggtaccaacccttct

SEQ ID NO: 283500 - DNA, 20 bp, Artificial
  CRISPR gRNA sequence
ccaaaaaaacccaaagctca

SEQ ID NO: 283501 - DNA, 20 bp, Artificial
  CRISPR gRNA sequence
aaagctcagtgaattcttta

SEQ ID NO: 283502 - DNA, 20 bp, Artificial
  CRISPR gRNA sequence
tgctgttaacaacttatccc

SEQ ID NO: 283503 - DNA, 20 bp, Artificial
  CRISPR gRNA sequence
ttaacaacttatcccaaggg

SEQ ID NO: 283504 - DNA, 20 bp, Artificial
  CRISPR gRNA sequence
taaagaggtctggtgggctc

SEQ ID NO: 283505 - DNA, 20 bp, Artificial
  CRISPR gRNA sequence
ggcaagataattctttgttt

SEQ ID NO: 283506 - DNA, 20 bp, Artificial
  CRISPR gRNA sequence
gagtgctgttctgtgcactg

SEQ ID NO: 283507 - DNA, 20 bp, Artificial
  CRISPR gRNA sequence
caagatgcagagagagaagg

SEQ ID NO: 283508 - DNA, 20 bp, Artificial
  CRISPR gRNA sequence
gtagcctccgtcatctcttc

SEQ ID NO: 283509 - DNA, 20 bp, Artificial
  CRISPR gRNA sequence
cgtcatctcttctgggatac

SEQ ID NO: 283510 - DNA, 20 bp, Artificial
  CRISPR gRNA sequence
ttctgggatacatggatcgt

SEQ ID NO: 283511 - DNA, 20 bp, Artificial
  CRISPR gRNA sequence
catgtttccattctgccatc

SEQ ID NO: 283512 - DNA, 20 bp, Artificial
  CRISPR gRNA sequence
attatctattaaacactaat

SEQ ID NO: 283513 - DNA, 20 bp, Artificial
  CRISPR gRNA sequence
aacactaatttgagttcatc

SEQ ID NO: 283514 - DNA, 20 bp, Artificial
  CRISPR gRNA sequence
atctctcagtattgatggac

SEQ ID NO: 283515 - DNA, 20 bp, Artificial
  CRISPR gRNA sequence
cagtattgatggacatgggt

SEQ ID NO: 283516 - DNA, 20 bp, Artificial
  CRISPR gRNA sequence
ctaacagactcatcctactg

SEQ ID NO: 283517 - DNA, 20 bp, Artificial
  CRISPR gRNA sequence
tcatggagccaaatttcaca

SEQ ID NO: 283518 - DNA, 20 bp, Artificial
  CRISPR gRNA sequence
tctcttcagtctaaataccc

SEQ ID NO: 283519 - DNA, 20 bp, Artificial
  CRISPR gRNA sequence
catggtttccagtgcctcac

SEQ ID NO: 283520 - DNA, 20 bp, Artificial
  CRISPR gRNA sequence
tttccagtgcctcacatgaa

SEQ ID NO: 283521 - DNA, 20 bp, Artificial
  CRISPR gRNA sequence
acaatgagataattattatc

SEQ ID NO: 283522 - DNA, 20 bp, Artificial
  CRISPR gRNA sequence
gataattattatctggggtc

SEQ ID NO: 283523 - DNA, 20 bp, Artificial
  CRISPR gRNA sequence
ctaacacagcactagcttta

SEQ ID NO: 283524 - DNA, 20 bp, Artificial
  CRISPR gRNA sequence
gagaaacttacatgggacat

SEQ ID NO: 283525 - DNA, 20 bp, Artificial
  CRISPR gRNA sequence
cagctttgacttgtgaaggt

SEQ ID NO: 283526 - DNA, 20 bp, Artificial
  CRISPR gRNA sequence
ggttagagtaacaccagtat

SEQ ID NO: 283527 - DNA, 20 bp, Artificial
  CRISPR gRNA sequence
ctttaaaaataaaggaaagc

SEQ ID NO: 283528 - DNA, 20 bp, Artificial
  CRISPR gRNA sequence
gaggtacggtcatacagatg

SEQ ID NO: 283529 - DNA, 20 bp, Artificial
  CRISPR gRNA sequence
atcctgttttttcatttcca

SEQ ID NO: 283530 - DNA, 20 bp, Artificial
  CRISPR gRNA sequence
ctgaatgcttgctcactcct

SEQ ID NO: 283531 - DNA, 20 bp, Artificial
  CRISPR gRNA sequence
actcctcagaatgtcttttc

SEQ ID NO: 283532 - DNA, 20 bp, Artificial
  CRISPR gRNA sequence
cctgagagccccacacatag

SEQ ID NO: 283533 - DNA, 20 bp, Artificial
  CRISPR gRNA sequence
tttcatgtgacaaaaattgc

SEQ ID NO: 283534 - DNA, 20 bp, Artificial
  CRISPR gRNA sequence
aaggttactgtgtacaagct

SEQ ID NO: 283535 - DNA, 20 bp, Artificial
  CRISPR gRNA sequence
gttttcctcctttgccaata

SEQ ID NO: 283536 - DNA, 20 bp, Artificial
  CRISPR gRNA sequence
gctttgcaggaagtgtctag

SEQ ID NO: 283537 - DNA, 20 bp, Artificial
  CRISPR gRNA sequence
gatcaaggtgttttgaaatg

SEQ ID NO: 283538 - DNA, 20 bp, Artificial
  CRISPR gRNA sequence
tgttttgaaatgcagaattc

SEQ ID NO: 283539 - DNA, 20 bp, Artificial
  CRISPR gRNA sequence
gagttctggaagggacttta

SEQ ID NO: 283540 - DNA, 20 bp, Artificial
  CRISPR gRNA sequence
ctgaggcccagggaggtgac

SEQ ID NO: 283541 - DNA, 20 bp, Artificial
  CRISPR gRNA sequence
aggcaaagtgctgctggaag

SEQ ID NO: 283542 - DNA, 20 bp, Artificial
  CRISPR gRNA sequence
actatctgatttcctaatgt

SEQ ID NO: 283543 - DNA, 20 bp, Artificial
  CRISPR gRNA sequence
aatttcctctgacatgtaag

SEQ ID NO: 283544 - DNA, 20 bp, Artificial
  CRISPR gRNA sequence
aagcagtagtcaaggaggaa

SEQ ID NO: 283545 - DNA, 20 bp, Artificial
  CRISPR gRNA sequence
gctttttctccttggtattt

SEQ ID NO: 283546 - DNA, 20 bp, Artificial
  CRISPR gRNA sequence
gaagtggacgcaacttaagc

SEQ ID NO: 283547 - DNA, 20 bp, Artificial
  CRISPR gRNA sequence
cacattatcatctgaaaatc

SEQ ID NO: 283548 - DNA, 20 bp, Artificial
  CRISPR gRNA sequence
tggcagctaagccacatggc

SEQ ID NO: 283549 - DNA, 20 bp, Artificial
  CRISPR gRNA sequence
gcagtgtttcccgtattgac

SEQ ID NO: 283550 - DNA, 20 bp, Artificial
  CRISPR gRNA sequence
taatgctgatctactttttg

SEQ ID NO: 283551 - DNA, 20 bp, Artificial
  CRISPR gRNA sequence
tcacactgcttccaggaccc

SEQ ID NO: 283552 - DNA, 20 bp, Artificial
  CRISPR gRNA sequence
ctcctctttccagtgatttc

SEQ ID NO: 283553 - DNA, 20 bp, Artificial
  CRISPR gRNA sequence
ataccctttcaaaggaccac

SEQ ID NO: 283554 - DNA, 20 bp, Artificial
  CRISPR gRNA sequence
atttactgcttaaaatctag

SEQ ID NO: 283555 - DNA, 20 bp, Artificial
  CRISPR gRNA sequence
actgcttaaaatctaggtgg

SEQ ID NO: 283556 - DNA, 20 bp, Artificial
  CRISPR gRNA sequence
ataagtatgtatttaaattt

SEQ ID NO: 283557 - DNA, 20 bp, Artificial
  CRISPR gRNA sequence
aatttaaggataagtaaagt

SEQ ID NO: 283558 - DNA, 20 bp, Artificial
  CRISPR gRNA sequence
gtgctggtacctgtggtggc

SEQ ID NO: 283559 - DNA, 20 bp, Artificial
  CRISPR gRNA sequence
ccttaaatttaaatacatac

SEQ ID NO: 283560 - DNA, 20 bp, Artificial
  CRISPR gRNA sequence
tacatgaatatatccaccca

SEQ ID NO: 283561 - DNA, 20 bp, Artificial
  CRISPR gRNA sequence
cagtaaataaaacatttcgc

SEQ ID NO: 283562 - DNA, 20 bp, Artificial
  CRISPR gRNA sequence
gcagtgtgagtgtaaatgtg

SEQ ID NO: 283563 - DNA, 20 bp, Artificial
  CRISPR gRNA sequence
gtgagtgtaaatgtgtagtg

SEQ ID NO: 283564 - DNA, 20 bp, Artificial
  CRISPR gRNA sequence
ggtttcatctaaataaacaa

SEQ ID NO: 283565 - DNA, 20 bp, Artificial
  CRISPR gRNA sequence
ttattaaagaaacggttcaa

SEQ ID NO: 283566 - DNA, 20 bp, Artificial
  CRISPR gRNA sequence
tctctgccctacactgagaa

SEQ ID NO: 283567 - DNA, 20 bp, Artificial
  CRISPR gRNA sequence
aatatagttttacacaggag

SEQ ID NO: 283568 - DNA, 20 bp, Artificial
  CRISPR gRNA sequence
taaagccatgggctggctct

SEQ ID NO: 283569 - DNA, 20 bp, Artificial
  CRISPR gRNA sequence
aaggctttaaatcccagcca

SEQ ID NO: 283570 - DNA, 20 bp, Artificial
  CRISPR gRNA sequence
gtcttcttttgctgttcaac

SEQ ID NO: 283571 - DNA, 20 bp, Artificial
  CRISPR gRNA sequence
ctccagattttcagatgata

SEQ ID NO: 283572 - DNA, 20 bp, Artificial
  CRISPR gRNA sequence
tcagatgataatgtgattat

SEQ ID NO: 283573 - DNA, 20 bp, Artificial
  CRISPR gRNA sequence
tggtctagtgaattgtggaa

SEQ ID NO: 283574 - DNA, 20 bp, Artificial
  CRISPR gRNA sequence
tactaccttagacatttgaa

SEQ ID NO: 283575 - DNA, 20 bp, Artificial
  CRISPR gRNA sequence
ttagacatttgaagatagct

SEQ ID NO: 283576 - DNA, 20 bp, Artificial
  CRISPR gRNA sequence
aactagcataaagccattta

SEQ ID NO: 283577 - DNA, 20 bp, Artificial
  CRISPR gRNA sequence
ctatccctttcctccttgac

SEQ ID NO: 283578 - DNA, 20 bp, Artificial
  CRISPR gRNA sequence
cgtcttacatgtcagaggaa

SEQ ID NO: 283579 - DNA, 20 bp, Artificial
  CRISPR gRNA sequence
catacttcctatgcattaca

SEQ ID NO: 283580 - DNA, 20 bp, Artificial
  CRISPR gRNA sequence
tgggacctgagaaaacaaag

SEQ ID NO: 283581 - DNA, 20 bp, Artificial
  CRISPR gRNA sequence
atctcaagatcaagggtatt

SEQ ID NO: 283582 - DNA, 20 bp, Artificial
  CRISPR gRNA sequence
acatgaaatatcgatcaggc

SEQ ID NO: 283583 - DNA, 20 bp, Artificial
  CRISPR gRNA sequence
ccagctattaccaaacgacc

SEQ ID NO: 283584 - DNA, 20 bp, Artificial
  CRISPR gRNA sequence
tgtgtggggctctcaggcat

SEQ ID NO: 283585 - DNA, 20 bp, Artificial
  CRISPR gRNA sequence
gagatgtgctatagaggtgg

SEQ ID NO: 283586 - DNA, 20 bp, Artificial
  CRISPR gRNA sequence
gaccacagaaggccttgtgt

SEQ ID NO: 283587 - DNA, 20 bp, Artificial
  CRISPR gRNA sequence
cttgtgtagaagattgggta

SEQ ID NO: 283588 - DNA, 20 bp, Artificial
  CRISPR gRNA sequence
aaaggagcctgaacttgatg

SEQ ID NO: 283589 - DNA, 20 bp, Artificial
  CRISPR gRNA sequence
acttgatgtccagtttgaat

SEQ ID NO: 283590 - DNA, 20 bp, Artificial
  CRISPR gRNA sequence
tctcttaacctctgggagcc

SEQ ID NO: 283591 - DNA, 20 bp, Artificial
  CRISPR gRNA sequence
atggaaatagatcttgctca

SEQ ID NO: 283592 - DNA, 20 bp, Artificial
  CRISPR gRNA sequence
tttataagactaagatgaaa

SEQ ID NO: 283593 - DNA, 20 bp, Artificial
  CRISPR gRNA sequence
cccctcctgcccaggacaat

SEQ ID NO: 283594 - DNA, 20 bp, Artificial
  CRISPR gRNA sequence
accttcacaagtcaaagctg

SEQ ID NO: 283595 - DNA, 20 bp, Artificial
  CRISPR gRNA sequence
gtcaaagctgaactgtttag

SEQ ID NO: 283596 - DNA, 20 bp, Artificial
  CRISPR gRNA sequence
ctgggacctgatatcagtct

SEQ ID NO: 283597 - DNA, 20 bp, Artificial
  CRISPR gRNA sequence
cttggattctaatgtcccat

SEQ ID NO: 283598 - DNA, 20 bp, Artificial
  CRISPR gRNA sequence
ttctcttgcatgaaaatacc

SEQ ID NO: 283599 - DNA, 20 bp, Artificial
  CRISPR gRNA sequence
accaaatctaaagtcttggg

SEQ ID NO: 283600 - DNA, 20 bp, Artificial
  CRISPR gRNA sequence
agctggaatgtggaaagtta

SEQ ID NO: 283601 - DNA, 20 bp, Artificial
  CRISPR gRNA sequence
tgtggaaagttaaaaagctt

SEQ ID NO: 283602 - DNA, 20 bp, Artificial
  CRISPR gRNA sequence
tgtaggcagtggggtctctt

SEQ ID NO: 283603 - DNA, 20 bp, Artificial
  CRISPR gRNA sequence
attctttgtgaaatttggct

SEQ ID NO: 283604 - DNA, 20 bp, Artificial
  CRISPR gRNA sequence
tattcaagatgaactcaaat

SEQ ID NO: 283605 - DNA, 20 bp, Artificial
  CRISPR gRNA sequence
tgccagccatcttgtaactg

SEQ ID NO: 283606 - DNA, 20 bp, Artificial
  CRISPR gRNA sequence
actgttcagcttaatctgaa

SEQ ID NO: 283607 - DNA, 20 bp, Artificial
  CRISPR gRNA sequence
gaaggtgaggtagtgggtaa

SEQ ID NO: 283608 - DNA, 20 bp, Artificial
  CRISPR gRNA sequence
accttcagatcttttcagcc

SEQ ID NO: 283609 - DNA, 20 bp, Artificial
  CRISPR gRNA sequence
acaaacaataaaaatgataa

SEQ ID NO: 283610 - DNA, 20 bp, Artificial
  CRISPR gRNA sequence
tatgttaatatttactttag

SEQ ID NO: 283611 - DNA, 20 bp, Artificial
  CRISPR gRNA sequence
ttactttagcaaggcttcag

SEQ ID NO: 283612 - DNA, 20 bp, Artificial
  CRISPR gRNA sequence
agcagttgttcttataccag

SEQ ID NO: 283613 - DNA, 20 bp, Artificial
  CRISPR gRNA sequence
tttgccaaggggacatttgg

SEQ ID NO: 283614 - DNA, 20 bp, Artificial
  CRISPR gRNA sequence
ttggcaatgcttggggatat

SEQ ID NO: 283615 - DNA, 20 bp, Artificial
  CRISPR gRNA sequence
catactctctaaagaattca

SEQ ID NO: 283616 - DNA, 20 bp, Artificial
  CRISPR gRNA sequence
tctaaagaattcactgagct

SEQ ID NO: 283617 - DNA, 20 bp, Artificial
  CRISPR gRNA sequence
aaaatcagcagatgttgatc

SEQ ID NO: 283618 - DNA, 20 bp, Artificial
  CRISPR gRNA sequence
cgattttatttgatcagtgt

SEQ ID NO: 283619 - DNA, 20 bp, Artificial
  CRISPR gRNA sequence
gaagggttggtaccccttca

SEQ ID NO: 283620 - DNA, 20 bp, Artificial
  CRISPR gRNA sequence
agttcctcttcatttaatca

SEQ ID NO: 283621 - DNA, 20 bp, Artificial
  CRISPR gRNA sequence
tcaggaggctgaggccggat

SEQ ID NO: 283622 - DNA, 20 bp, Artificial
  CRISPR gRNA sequence
aaaaaaaaaaagaactaaga

SEQ ID NO: 283623 - DNA, 20 bp, Artificial
  CRISPR gRNA sequence
aaaaagaactaagaattggt

SEQ ID NO: 283624 - DNA, 20 bp, Artificial
  CRISPR gRNA sequence
ttcctgggttcaagcaattc

SEQ ID NO: 283625 - DNA, 20 bp, Artificial
  CRISPR gRNA sequence
ttttgtatttttagtagaga

SEQ ID NO: 283626 - DNA, 20 bp, Artificial
  CRISPR gRNA sequence
tgccttggcctcccaaagtg

SEQ ID NO: 283627 - DNA, 20 bp, Artificial
  CRISPR gRNA sequence
ggtgagatcacctgtagcca

SEQ ID NO: 283628 - DNA, 20 bp, Artificial
  CRISPR gRNA sequence
catcttgccctcctccaaga

SEQ ID NO: 283629 - DNA, 20 bp, Artificial
  CRISPR gRNA sequence
agaatatcatttagcatcag

SEQ ID NO: 283630 - DNA, 20 bp, Artificial
  CRISPR gRNA sequence
gagacaagtaaaggagatgc

SEQ ID NO: 283631 - DNA, 20 bp, Artificial
  CRISPR gRNA sequence
aaggagatgctcatgtttcc

SEQ ID NO: 283632 - DNA, 20 bp, Artificial
  CRISPR gRNA sequence
gagatgccgaaccatggtaa

SEQ ID NO: 283633 - DNA, 20 bp, Artificial
  CRISPR gRNA sequence
tatcacaaaaattccattta

SEQ ID NO: 283634 - DNA, 20 bp, Artificial
  CRISPR gRNA sequence
gcaggttatcaggaaaatgc

SEQ ID NO: 283635 - DNA, 20 bp, Artificial
  CRISPR gRNA sequence
actgagttaagttgacataa

SEQ ID NO: 283636 - DNA, 20 bp, Artificial
  CRISPR gRNA sequence
ttgcagtatctcacttttat

SEQ ID NO: 283637 - DNA, 20 bp, Artificial
  CRISPR gRNA sequence
ctttgcattcactttcggat

SEQ ID NO: 283638 - DNA, 20 bp, Artificial
  CRISPR gRNA sequence
ggcaaagaactaagtgtgga

SEQ ID NO: 283639 - DNA, 20 bp, Artificial
  CRISPR gRNA sequence
gagcactgaaggttatcagc

SEQ ID NO: 283640 - DNA, 20 bp, Artificial
  CRISPR gRNA sequence
agctgcagtatttattcttc

SEQ ID NO: 283641 - DNA, 20 bp, Artificial
  CRISPR gRNA sequence
caaattatagcagctcattt

SEQ ID NO: 283642 - DNA, 20 bp, Artificial
  CRISPR gRNA sequence
tcattttctggtttctctga

SEQ ID NO: 283643 - DNA, 20 bp, Artificial
  CRISPR gRNA sequence
taaatgaatatttactaact

SEQ ID NO: 283644 - DNA, 20 bp, Artificial
  CRISPR gRNA sequence
tttactttttttcttcatgc

SEQ ID NO: 283645 - DNA, 20 bp, Artificial
  CRISPR gRNA sequence
caatgctggtagaatttcac

SEQ ID NO: 283646 - DNA, 20 bp, Artificial
  CRISPR gRNA sequence
atttcacagtagtttagtgt

SEQ ID NO: 283647 - DNA, 20 bp, Artificial
  CRISPR gRNA sequence
agtgttaaagattatctgtg

SEQ ID NO: 283648 - DNA, 20 bp, Artificial
  CRISPR gRNA sequence
ttatctgtgcctagattatg

SEQ ID NO: 283649 - DNA, 20 bp, Artificial
  CRISPR gRNA sequence
atgaagagattctcaatgtg

SEQ ID NO: 283650 - DNA, 20 bp, Artificial
  CRISPR gRNA sequence
tcaatgtgtgatgcttagtt

SEQ ID NO: 283651 - DNA, 20 bp, Artificial
  CRISPR gRNA sequence
tctttgcatagcaccattac

SEQ ID NO: 283652 - DNA, 20 bp, Artificial
  CRISPR gRNA sequence
ccttctttttcagtcagagt

SEQ ID NO: 283653 - DNA, 20 bp, Artificial
  CRISPR gRNA sequence
cccacactttgcacatcaga

SEQ ID NO: 283654 - DNA, 20 bp, Artificial
  CRISPR gRNA sequence
atcagaaacagtttttgtgc

SEQ ID NO: 283655 - DNA, 20 bp, Artificial
  CRISPR gRNA sequence
tctgagcaaatttagaagca

SEQ ID NO: 283656 - DNA, 20 bp, Artificial
  CRISPR gRNA sequence
gcctgtgaggctgaacactc

SEQ ID NO: 283657 - DNA, 20 bp, Artificial
  CRISPR gRNA sequence
gtcccatatttctttccata

SEQ ID NO: 283658 - DNA, 20 bp, Artificial
  CRISPR gRNA sequence
gggtccagggagtccaagat

SEQ ID NO: 283659 - DNA, 20 bp, Artificial
  CRISPR gRNA sequence
caagatccctgtttttactt

SEQ ID NO: 283660 - DNA, 20 bp, Artificial
  CRISPR gRNA sequence
tctgattaccaaacccagtg

SEQ ID NO: 283661 - DNA, 20 bp, Artificial
  CRISPR gRNA sequence
ttatttaagacggactttca

SEQ ID NO: 283662 - DNA, 20 bp, Artificial
  CRISPR gRNA sequence
tgcctcagcctcccgagtag

SEQ ID NO: 283663 - DNA, 20 bp, Artificial
  CRISPR gRNA sequence
ttttgtattttcagtagaga

SEQ ID NO: 283664 - DNA, 20 bp, Artificial
  CRISPR gRNA sequence
ggtctcgaactcctgacctc

SEQ ID NO: 283665 - DNA, 20 bp, Artificial
  CRISPR gRNA sequence
tgtcttggcctcccacagtg

SEQ ID NO: 283666 - DNA, 20 bp, Artificial
  CRISPR gRNA sequence
gcatgagccactgcgcctgg

SEQ ID NO: 283667 - DNA, 20 bp, Artificial
  CRISPR gRNA sequence
cgcctggcctagttttattc

SEQ ID NO: 283668 - DNA, 20 bp, Artificial
  CRISPR gRNA sequence
acttctgtgacaccacatcc

SEQ ID NO: 283669 - DNA, 20 bp, Artificial
  CRISPR gRNA sequence
gtgacaccacatccttctgt

SEQ ID NO: 283670 - DNA, 20 bp, Artificial
  CRISPR gRNA sequence
ttctgtttctgtttgttgca

SEQ ID NO: 283671 - DNA, 20 bp, Artificial
  CRISPR gRNA sequence
tgttgcactccgttttctct

SEQ ID NO: 283672 - DNA, 20 bp, Artificial
  CRISPR gRNA sequence
aattattgttgttcccatgg

SEQ ID NO: 283673 - DNA, 20 bp, Artificial
  CRISPR gRNA sequence
ctgggtaatatcctccacac

SEQ ID NO: 283674 - DNA, 20 bp, Artificial
  CRISPR gRNA sequence
tcaggaggctgaagcaagag

SEQ ID NO: 283675 - DNA, 20 bp, Artificial
  CRISPR gRNA sequence
gagacagaggttgcaatgag

SEQ ID NO: 283676 - DNA, 20 bp, Artificial
  CRISPR gRNA sequence
aaaaaaaaaaaagaagtgcc

SEQ ID NO: 283677 - DNA, 20 bp, Artificial
  CRISPR gRNA sequence
ggatggatgccagcatctcc

SEQ ID NO: 283678 - DNA, 20 bp, Artificial
  CRISPR gRNA sequence
tgattaaaactgaatttact

SEQ ID NO: 283679 - DNA, 20 bp, Artificial
  CRISPR gRNA sequence
ttcagaatatctctggaact

SEQ ID NO: 283680 - DNA, 20 bp, Artificial
  CRISPR gRNA sequence
tcttgcagcaactgccttag

SEQ ID NO: 283681 - DNA, 20 bp, Artificial
  CRISPR gRNA sequence
tgcaaaccggtctctttgcc

SEQ ID NO: 283682 - DNA, 20 bp, Artificial
  CRISPR gRNA sequence
taccacttaaagacaggata

SEQ ID NO: 283683 - DNA, 20 bp, Artificial
  CRISPR gRNA sequence
ttttcttttttctctaaaac

SEQ ID NO: 283684 - DNA, 20 bp, Artificial
  CRISPR gRNA sequence
ccagattgaatggagacatc

SEQ ID NO: 283685 - DNA, 20 bp, Artificial
  CRISPR gRNA sequence
tgattaccagagttgacctc

SEQ ID NO: 283686 - DNA, 20 bp, Artificial
  CRISPR gRNA sequence
tgctgttatcctgggagtct

SEQ ID NO: 283687 - DNA, 20 bp, Artificial
  CRISPR gRNA sequence
cctgggagtctagaagtttc

SEQ ID NO: 283688 - DNA, 20 bp, Artificial
  CRISPR gRNA sequence
ttcacaggcttcagctcatt

SEQ ID NO: 283689 - DNA, 20 bp, Artificial
  CRISPR gRNA sequence
ggtgtgagggcatctgcaca

SEQ ID NO: 283690 - DNA, 20 bp, Artificial
  CRISPR gRNA sequence
ctctctcagatgtatctcct

SEQ ID NO: 283691 - DNA, 20 bp, Artificial
  CRISPR gRNA sequence
taaaaagaatcatatgcgca

SEQ ID NO: 283692 - DNA, 20 bp, Artificial
  CRISPR gRNA sequence
aatccgcttaattaatacat

SEQ ID NO: 283693 - DNA, 20 bp, Artificial
  CRISPR gRNA sequence
ccaaatcagttatttactga

SEQ ID NO: 283694 - DNA, 20 bp, Artificial
  CRISPR gRNA sequence
taatgagtctcacgagatct

SEQ ID NO: 283695 - DNA, 20 bp, Artificial
  CRISPR gRNA sequence
agatctgatagtttaaaaac

SEQ ID NO: 283696 - DNA, 20 bp, Artificial
  CRISPR gRNA sequence
ttgctcctccttgccttctg

SEQ ID NO: 283697 - DNA, 20 bp, Artificial
  CRISPR gRNA sequence
ggactaatacattttcacct

SEQ ID NO: 283698 - DNA, 20 bp, Artificial
  CRISPR gRNA sequence
tgacctcctataaatgcatt

SEQ ID NO: 283699 - DNA, 20 bp, Artificial
  CRISPR gRNA sequence
atccccacacagtccaatta

SEQ ID NO: 283700 - DNA, 20 bp, Artificial
  CRISPR gRNA sequence
atgggccaaacctgtcctgc

SEQ ID NO: 283701 - DNA, 20 bp, Artificial
  CRISPR gRNA sequence
gtggctcacacctgtaatca

SEQ ID NO: 283702 - DNA, 20 bp, Artificial
  CRISPR gRNA sequence
ttgggaggctgaggcaggag

SEQ ID NO: 283703 - DNA, 20 bp, Artificial
  CRISPR gRNA sequence
ttcatttatgtcttgtctgt

SEQ ID NO: 283704 - DNA, 20 bp, Artificial
  CRISPR gRNA sequence
tgcaacagagactgtgactg

SEQ ID NO: 283705 - DNA, 20 bp, Artificial
  CRISPR gRNA sequence
aatgcaatccaagctagtat

SEQ ID NO: 283706 - DNA, 20 bp, Artificial
  CRISPR gRNA sequence
tgatttaataatcagtactc

SEQ ID NO: 283707 - DNA, 20 bp, Artificial
  CRISPR gRNA sequence
aaatagagacttaataaact

SEQ ID NO: 283708 - DNA, 20 bp, Artificial
  CRISPR gRNA sequence
ataaaagatgactgagactg

SEQ ID NO: 283709 - DNA, 20 bp, Artificial
  CRISPR gRNA sequence
tggagtatcaatagtcatgt

SEQ ID NO: 283710 - DNA, 20 bp, Artificial
  CRISPR gRNA sequence
tatcaatagtcatgtcaaag

SEQ ID NO: 283711 - DNA, 20 bp, Artificial
  CRISPR gRNA sequence
acaggaggctgagacaggag

SEQ ID NO: 283712 - DNA, 20 bp, Artificial
  CRISPR gRNA sequence
tgcaactgtattatcaaact

SEQ ID NO: 283713 - DNA, 20 bp, Artificial
  CRISPR gRNA sequence
ctgtattatcaaactcagtg

SEQ ID NO: 283714 - DNA, 20 bp, Artificial
  CRISPR gRNA sequence
tgtatatattcatataaacc

SEQ ID NO: 283715 - DNA, 20 bp, Artificial
  CRISPR gRNA sequence
cgttttcattgtatattttc

SEQ ID NO: 283716 - DNA, 20 bp, Artificial
  CRISPR gRNA sequence
tcttggggaaagagaattct

SEQ ID NO: 283717 - DNA, 20 bp, Artificial
  CRISPR gRNA sequence
cttttcaggcgttgtcttca

SEQ ID NO: 283718 - DNA, 20 bp, Artificial
  CRISPR gRNA sequence
cacattcgcccacaaaaaaa

SEQ ID NO: 283719 - DNA, 20 bp, Artificial
  CRISPR gRNA sequence
cagttccaaagggcaaattt

SEQ ID NO: 283720 - DNA, 20 bp, Artificial
  CRISPR gRNA sequence
ttacaaaaactttttaagat

SEQ ID NO: 283721 - DNA, 20 bp, Artificial
  CRISPR gRNA sequence
aagatgaatgcttgatggat

SEQ ID NO: 283722 - DNA, 20 bp, Artificial
  CRISPR gRNA sequence
tcgggaggctgaggcagaag

SEQ ID NO: 283723 - DNA, 20 bp, Artificial
  CRISPR gRNA sequence
aaggtggaggttgcagtgag

SEQ ID NO: 283724 - DNA, 20 bp, Artificial
  CRISPR gRNA sequence
tgttctgtagagtcagagtc

SEQ ID NO: 283725 - DNA, 20 bp, Artificial
  CRISPR gRNA sequence
cacttcagcctcccaaagtg

SEQ ID NO: 283726 - DNA, 20 bp, Artificial
  CRISPR gRNA sequence
gtatttttactgtacctttc

SEQ ID NO: 283727 - DNA, 20 bp, Artificial
  CRISPR gRNA sequence
tgtacctttcctatgtttac

SEQ ID NO: 283728 - DNA, 20 bp, Artificial
  CRISPR gRNA sequence
tgtgcagtaggctgtaccat

SEQ ID NO: 283729 - DNA, 20 bp, Artificial
  CRISPR gRNA sequence
tgacacgactatattgtctt

SEQ ID NO: 283730 - DNA, 20 bp, Artificial
  CRISPR gRNA sequence
tacttgtattccagttgaag

SEQ ID NO: 283731 - DNA, 20 bp, Artificial
  CRISPR gRNA sequence
ggttggttgtcatattgaaa

SEQ ID NO: 283732 - DNA, 20 bp, Artificial
  CRISPR gRNA sequence
ttgctgctaacagcatagag

SEQ ID NO: 283733 - DNA, 20 bp, Artificial
  CRISPR gRNA sequence
agttacaaacctatgtgtgt

SEQ ID NO: 283734 - DNA, 20 bp, Artificial
  CRISPR gRNA sequence
ggtttatttttaaataattt

SEQ ID NO: 283735 - DNA, 20 bp, Artificial
  CRISPR gRNA sequence
caggtggaacacctgaggtc

SEQ ID NO: 283736 - DNA, 20 bp, Artificial
  CRISPR gRNA sequence
tcgggaggctaaggcaagag

SEQ ID NO: 283737 - DNA, 20 bp, Artificial
  CRISPR gRNA sequence
aatggcttgaacccagaggg

SEQ ID NO: 283738 - DNA, 20 bp, Artificial
  CRISPR gRNA sequence
ctccagcctgggcaaaagag

SEQ ID NO: 283739 - DNA, 20 bp, Artificial
  CRISPR gRNA sequence
atgtataatccaaagactaa

SEQ ID NO: 283740 - DNA, 20 bp, Artificial
  CRISPR gRNA sequence
atgaagagaagaataataga

SEQ ID NO: 283741 - DNA, 20 bp, Artificial
  CRISPR gRNA sequence
atagacaacgtttactgaac

SEQ ID NO: 283742 - DNA, 20 bp, Artificial
  CRISPR gRNA sequence
ggtcaaagatcagtaatttc

SEQ ID NO: 283743 - DNA, 20 bp, Artificial
  CRISPR gRNA sequence
cattttataagtaatcaaac

SEQ ID NO: 283744 - DNA, 20 bp, Artificial
  CRISPR gRNA sequence
ctcttctcttcttttcttcc

SEQ ID NO: 283745 - DNA, 20 bp, Artificial
  CRISPR gRNA sequence
cctgatgcttgaagtacgca

SEQ ID NO: 283746 - DNA, 20 bp, Artificial
  CRISPR gRNA sequence
taaatttgtggttagcattt

SEQ ID NO: 283747 - DNA, 20 bp, Artificial
  CRISPR gRNA sequence
cctacccctttgctcttgag

SEQ ID NO: 283748 - DNA, 20 bp, Artificial
  CRISPR gRNA sequence
caggtaagggctccatgaag

SEQ ID NO: 283749 - DNA, 20 bp, Artificial
  CRISPR gRNA sequence
aaactcaatacataaataga

SEQ ID NO: 283750 - DNA, 20 bp, Artificial
  CRISPR gRNA sequence
gcaggcattgaactatagtc

SEQ ID NO: 283751 - DNA, 20 bp, Artificial
  CRISPR gRNA sequence
attgaactatagtcatgagc

SEQ ID NO: 283752 - DNA, 20 bp, Artificial
  CRISPR gRNA sequence
atttgcatatttatttctgg

SEQ ID NO: 283753 - DNA, 20 bp, Artificial
  CRISPR gRNA sequence
aaaactctgaaccacatcag

SEQ ID NO: 283754 - DNA, 20 bp, Artificial
  CRISPR gRNA sequence
aattattttgatagtagaca

SEQ ID NO: 283755 - DNA, 20 bp, Artificial
  CRISPR gRNA sequence
aaaatagaaagctgtataga

SEQ ID NO: 283756 - DNA, 20 bp, Artificial
  CRISPR gRNA sequence
tagactgagtttagttgtta

SEQ ID NO: 283757 - DNA, 20 bp, Artificial
  CRISPR gRNA sequence
aattactgggatgaagctat

SEQ ID NO: 283758 - DNA, 20 bp, Artificial
  CRISPR gRNA sequence
taacctcattcaccacactt

SEQ ID NO: 283759 - DNA, 20 bp, Artificial
  CRISPR gRNA sequence
ttcctccaagacccttgagg

SEQ ID NO: 283760 - DNA, 20 bp, Artificial
  CRISPR gRNA sequence
catttatatatttgatcccc

SEQ ID NO: 283761 - DNA, 20 bp, Artificial
  CRISPR gRNA sequence
aacataggagaaagatacct

SEQ ID NO: 283762 - DNA, 20 bp, Artificial
  CRISPR gRNA sequence
gtcacttattcttacacata

SEQ ID NO: 283763 - DNA, 20 bp, Artificial
  CRISPR gRNA sequence
ttattcttacacataaagag

SEQ ID NO: 283764 - DNA, 20 bp, Artificial
  CRISPR gRNA sequence
ttagcttcttagcatgaatg

SEQ ID NO: 283765 - DNA, 20 bp, Artificial
  CRISPR gRNA sequence
ggattcaatctcctcataga

SEQ ID NO: 283766 - DNA, 20 bp, Artificial
  CRISPR gRNA sequence
gtagcatatggtcatcaaaa

SEQ ID NO: 283767 - DNA, 20 bp, Artificial
  CRISPR gRNA sequence
ataacttacccacctttagt

SEQ ID NO: 283768 - DNA, 20 bp, Artificial
  CRISPR gRNA sequence
ctggagtgcagtggcaccat

SEQ ID NO: 283769 - DNA, 20 bp, Artificial
  CRISPR gRNA sequence
ttactgcaacctccgggttc

SEQ ID NO: 283770 - DNA, 20 bp, Artificial
  CRISPR gRNA sequence
tcttgtatttttaatagaga

SEQ ID NO: 283771 - DNA, 20 bp, Artificial
  CRISPR gRNA sequence
agcctcggcctcccaaagtg

SEQ ID NO: 283772 - DNA, 20 bp, Artificial
  CRISPR gRNA sequence
attgccaggaaagaggaaaa

SEQ ID NO: 283773 - DNA, 20 bp, Artificial
  CRISPR gRNA sequence
gaggtgaagttacctttttt

SEQ ID NO: 283774 - DNA, 20 bp, Artificial
  CRISPR gRNA sequence
tgaagttacctttttttttt

SEQ ID NO: 283775 - DNA, 20 bp, Artificial
  CRISPR gRNA sequence
caatgaaccctgtccctaaa

SEQ ID NO: 283776 - DNA, 20 bp, Artificial
  CRISPR gRNA sequence
cagctgatatctagaatatt

SEQ ID NO: 283777 - DNA, 20 bp, Artificial
  CRISPR gRNA sequence
ctgtgtttcttataacatca

SEQ ID NO: 283778 - DNA, 20 bp, Artificial
  CRISPR gRNA sequence
actcatatcctaaattatta

SEQ ID NO: 283779 - DNA, 20 bp, Artificial
  CRISPR gRNA sequence
gattcatgttcatttctgtg

SEQ ID NO: 283780 - DNA, 20 bp, Artificial
  CRISPR gRNA sequence
ttgggaggtcaaggcaggag

SEQ ID NO: 283781 - DNA, 20 bp, Artificial
  CRISPR gRNA sequence
caggaggatcgcttgaggtc

SEQ ID NO: 283782 - DNA, 20 bp, Artificial
  CRISPR gRNA sequence
ggcacatgcctgtagtccca

SEQ ID NO: 283783 - DNA, 20 bp, Artificial
  CRISPR gRNA sequence
tttggaggctgagacaggag

SEQ ID NO: 283784 - DNA, 20 bp, Artificial
  CRISPR gRNA sequence
gactccatctcaaaaaaaaa

SEQ ID NO: 283785 - DNA, 20 bp, Artificial
  CRISPR gRNA sequence
aaaaaagtttcaaaatcttt

SEQ ID NO: 283786 - DNA, 20 bp, Artificial
  CRISPR gRNA sequence
cccaccttttttctaaggtg

SEQ ID NO: 283787 - DNA, 20 bp, Artificial
  CRISPR gRNA sequence
gtaactactcctgaggtctt

SEQ ID NO: 283788 - DNA, 20 bp, Artificial
  CRISPR gRNA sequence
acaaggaaaggaataggtgc

SEQ ID NO: 283789 - DNA, 20 bp, Artificial
  CRISPR gRNA sequence
tctcaaacatgccagttaat

SEQ ID NO: 283790 - DNA, 20 bp, Artificial
  CRISPR gRNA sequence
tcctatttgcctgagacttt

SEQ ID NO: 283791 - DNA, 20 bp, Artificial
  CRISPR gRNA sequence
cctggtcactctagccaaat

SEQ ID NO: 283792 - DNA, 20 bp, Artificial
  CRISPR gRNA sequence
agccaaatgagagcttaatt

SEQ ID NO: 283793 - DNA, 20 bp, Artificial
  CRISPR gRNA sequence
cagcagcacaggcatcacct

SEQ ID NO: 283794 - DNA, 20 bp, Artificial
  CRISPR gRNA sequence
acaagaccctcaaatgactc

SEQ ID NO: 283795 - DNA, 20 bp, Artificial
  CRISPR gRNA sequence
gcttataagcatttgagaaa

SEQ ID NO: 283796 - DNA, 20 bp, Artificial
  CRISPR gRNA sequence
tgactcaattggaaaattca

SEQ ID NO: 283797 - DNA, 20 bp, Artificial
  CRISPR gRNA sequence
gacctttttgtcttcccttt

SEQ ID NO: 283798 - DNA, 20 bp, Artificial
  CRISPR gRNA sequence
aatagggcctgccccccttg

SEQ ID NO: 283799 - DNA, 20 bp, Artificial
  CRISPR gRNA sequence
aaatgtttccttttctcact

SEQ ID NO: 283800 - DNA, 20 bp, Artificial
  CRISPR gRNA sequence
aggtgaaaatcgtggaagag

SEQ ID NO: 283801 - DNA, 20 bp, Artificial
  CRISPR gRNA sequence
agagcagagaaaacactgag

SEQ ID NO: 283802 - DNA, 20 bp, Artificial
  CRISPR gRNA sequence
ttaagatagttccatgtaac

SEQ ID NO: 283803 - DNA, 20 bp, Artificial
  CRISPR gRNA sequence
tgtgatctggatgtcacaag

SEQ ID NO: 283804 - DNA, 20 bp, Artificial
  CRISPR gRNA sequence
cacaagtaaagattcatagc

SEQ ID NO: 283805 - DNA, 20 bp, Artificial
  CRISPR gRNA sequence
tctattatcaaggttaatca

SEQ ID NO: 283806 - DNA, 20 bp, Artificial
  CRISPR gRNA sequence
tcattatgttttattaagta

SEQ ID NO: 283807 - DNA, 20 bp, Artificial
  CRISPR gRNA sequence
atgttttattaagtaagaag

SEQ ID NO: 283808 - DNA, 20 bp, Artificial
  CRISPR gRNA sequence
atctaacttaactgactcca

SEQ ID NO: 283809 - DNA, 20 bp, Artificial
  CRISPR gRNA sequence
tgaactaactttggtagaaa

SEQ ID NO: 283810 - DNA, 20 bp, Artificial
  CRISPR gRNA sequence
actttggtagaaacttagtt

SEQ ID NO: 283811 - DNA, 20 bp, Artificial
  CRISPR gRNA sequence
tagaaacttagtttatagtt

SEQ ID NO: 283812 - DNA, 20 bp, Artificial
  CRISPR gRNA sequence
gacctccttcttgcctgggg

SEQ ID NO: 283813 - DNA, 20 bp, Artificial
  CRISPR gRNA sequence
ttgtaggactaacattagcc

SEQ ID NO: 283814 - DNA, 20 bp, Artificial
  CRISPR gRNA sequence
ttagccacaagattagaaat

SEQ ID NO: 283815 - DNA, 20 bp, Artificial
  CRISPR gRNA sequence
gagtcataaagctggatgct

SEQ ID NO: 283816 - DNA, 20 bp, Artificial
  CRISPR gRNA sequence
ccctaaactgctcctaagat

SEQ ID NO: 283817 - DNA, 20 bp, Artificial
  CRISPR gRNA sequence
cccccaacccagtgcaagaa

SEQ ID NO: 283818 - DNA, 20 bp, Artificial
  CRISPR gRNA sequence
ccaatcagcactcccagctc

SEQ ID NO: 283819 - DNA, 20 bp, Artificial
  CRISPR gRNA sequence
ccttaaaaactctgctcccc

SEQ ID NO: 283820 - DNA, 20 bp, Artificial
  CRISPR gRNA sequence
gctccccagatgcttggaga

SEQ ID NO: 283821 - DNA, 20 bp, Artificial
  CRISPR gRNA sequence
tcctttctttccgagaccag

SEQ ID NO: 283822 - DNA, 20 bp, Artificial
  CRISPR gRNA sequence
ttccacagtaggtacataaa

SEQ ID NO: 283823 - DNA, 20 bp, Artificial
  CRISPR gRNA sequence
cagtaggtacataaacaggg

SEQ ID NO: 283824 - DNA, 20 bp, Artificial
  CRISPR gRNA sequence
aacagggctttgattcataa

SEQ ID NO: 283825 - DNA, 20 bp, Artificial
  CRISPR gRNA sequence
aacctccgcctcccaggttc

SEQ ID NO: 283826 - DNA, 20 bp, Artificial
  CRISPR gRNA sequence
ttttgtatttttagtagaga

SEQ ID NO: 283827 - DNA, 20 bp, Artificial
  CRISPR gRNA sequence
ctaatttttcaggactgact

SEQ ID NO: 283828 - DNA, 20 bp, Artificial
  CRISPR gRNA sequence
ttcaggactgactgctagat

SEQ ID NO: 283829 - DNA, 20 bp, Artificial
  CRISPR gRNA sequence
gacgttcacatactacctga

SEQ ID NO: 283830 - DNA, 20 bp, Artificial
  CRISPR gRNA sequence
aacctccgcctcccaggttc

SEQ ID NO: 283831 - DNA, 20 bp, Artificial
  CRISPR gRNA sequence
tgcctcagcctccagagtag

SEQ ID NO: 283832 - DNA, 20 bp, Artificial
  CRISPR gRNA sequence
ggaatgcgccaccacatctg

SEQ ID NO: 283833 - DNA, 20 bp, Artificial
  CRISPR gRNA sequence
ttttgtatttttagtaggga

SEQ ID NO: 283834 - DNA, 20 bp, Artificial
  CRISPR gRNA sequence
tgccttggcctcccaaagtg

SEQ ID NO: 283835 - DNA, 20 bp, Artificial
  CRISPR gRNA sequence
atcaaatcaaagatgcccct

SEQ ID NO: 283836 - DNA, 20 bp, Artificial
  CRISPR gRNA sequence
taggtcattatagtgcccca

SEQ ID NO: 283837 - DNA, 20 bp, Artificial
  CRISPR gRNA sequence
cccaggatgattgtcatgaa

SEQ ID NO: 283838 - DNA, 20 bp, Artificial
  CRISPR gRNA sequence
ggacatctttagaaaccagt

SEQ ID NO: 283839 - DNA, 20 bp, Artificial
  CRISPR gRNA sequence
acgtcacttcagccaggtgt

SEQ ID NO: 283840 - DNA, 20 bp, Artificial
  CRISPR gRNA sequence
ttctccttttgccagtagat

SEQ ID NO: 283841 - DNA, 20 bp, Artificial
  CRISPR gRNA sequence
cctatggagaggcaaacaga

SEQ ID NO: 283842 - DNA, 20 bp, Artificial
  CRISPR gRNA sequence
aagattgtatatttattaaa

SEQ ID NO: 283843 - DNA, 20 bp, Artificial
  CRISPR gRNA sequence
gtctagtgactaagtatcaa

SEQ ID NO: 283844 - DNA, 20 bp, Artificial
  CRISPR gRNA sequence
agtgactaagtatcaatcca

SEQ ID NO: 283845 - DNA, 20 bp, Artificial
  CRISPR gRNA sequence
agtttgatttttggggtccc

SEQ ID NO: 283846 - DNA, 20 bp, Artificial
  CRISPR gRNA sequence
gaggcggaggttgcagtaag

SEQ ID NO: 283847 - DNA, 20 bp, Artificial
  CRISPR gRNA sequence
taacataaaatttatcatct

SEQ ID NO: 283848 - DNA, 20 bp, Artificial
  CRISPR gRNA sequence
tcagcctctggcaattgcca

SEQ ID NO: 283849 - DNA, 20 bp, Artificial
  CRISPR gRNA sequence
cctctggcaattgccattct

SEQ ID NO: 283850 - DNA, 20 bp, Artificial
  CRISPR gRNA sequence
aatagaatcatacagtaaca

SEQ ID NO: 283851 - DNA, 20 bp, Artificial
  CRISPR gRNA sequence
atcatacagtaacagcctgt

SEQ ID NO: 283852 - DNA, 20 bp, Artificial
  CRISPR gRNA sequence
acagtaacagcctgtttatg

SEQ ID NO: 283853 - DNA, 20 bp, Artificial
  CRISPR gRNA sequence
cattcacgttgtagcatatg

SEQ ID NO: 283854 - DNA, 20 bp, Artificial
  CRISPR gRNA sequence
cacacacacccccccccaca

SEQ ID NO: 283855 - DNA, 20 bp, Artificial
  CRISPR gRNA sequence
cattcatctgtagatggaca

SEQ ID NO: 283856 - DNA, 20 bp, Artificial
  CRISPR gRNA sequence
catctgtagatggacatttg

SEQ ID NO: 283857 - DNA, 20 bp, Artificial
  CRISPR gRNA sequence
gtgcaaatatctcttcaaga

SEQ ID NO: 283858 - DNA, 20 bp, Artificial
  CRISPR gRNA sequence
aattttctgaggaacctcaa

SEQ ID NO: 283859 - DNA, 20 bp, Artificial
  CRISPR gRNA sequence
ttctatagcagttgcacccg

SEQ ID NO: 283860 - DNA, 20 bp, Artificial
  CRISPR gRNA sequence
ttgcacccgcaatgcttgtt

SEQ ID NO: 283861 - DNA, 20 bp, Artificial
  CRISPR gRNA sequence
tcactatctagaaaaactaa

SEQ ID NO: 283862 - DNA, 20 bp, Artificial
  CRISPR gRNA sequence
gtgattgcataaaaaacaaa

SEQ ID NO: 283863 - DNA, 20 bp, Artificial
  CRISPR gRNA sequence
tgagaattttccaatgacat

SEQ ID NO: 283864 - DNA, 20 bp, Artificial
  CRISPR gRNA sequence
tttagtcctattacttctta

SEQ ID NO: 283865 - DNA, 20 bp, Artificial
  CRISPR gRNA sequence
ctcttcatactatttccttt

SEQ ID NO: 283866 - DNA, 20 bp, Artificial
  CRISPR gRNA sequence
attttgcagctgagacaact

SEQ ID NO: 283867 - DNA, 20 bp, Artificial
  CRISPR gRNA sequence
ctaggacagggcaggtcagc

SEQ ID NO: 283868 - DNA, 20 bp, Artificial
  CRISPR gRNA sequence
cagcctgagattccaagggc

SEQ ID NO: 283869 - DNA, 20 bp, Artificial
  CRISPR gRNA sequence
cttggatctgttgcctggtc

SEQ ID NO: 283870 - DNA, 20 bp, Artificial
  CRISPR gRNA sequence
gatgctcactgccttttccc

SEQ ID NO: 283871 - DNA, 20 bp, Artificial
  CRISPR gRNA sequence
aaatctaagaataaatttta

SEQ ID NO: 283872 - DNA, 20 bp, Artificial
  CRISPR gRNA sequence
atctgtcaccttaatacaca

SEQ ID NO: 283873 - DNA, 20 bp, Artificial
  CRISPR gRNA sequence
ccccttttcacttgagtgac

SEQ ID NO: 283874 - DNA, 20 bp, Artificial
  CRISPR gRNA sequence
gttgttggtatagaaagaac

SEQ ID NO: 283875 - DNA, 20 bp, Artificial
  CRISPR gRNA sequence
agtcttcacattggttatta

SEQ ID NO: 283876 - DNA, 20 bp, Artificial
  CRISPR gRNA sequence
gtggggaatttaccaacctc

SEQ ID NO: 283877 - DNA, 20 bp, Artificial
  CRISPR gRNA sequence
aatttaccaacctctaaggc

SEQ ID NO: 283878 - DNA, 20 bp, Artificial
  CRISPR gRNA sequence
tctttggacaatttgactga

SEQ ID NO: 283879 - DNA, 20 bp, Artificial
  CRISPR gRNA sequence
ggacaatttgactgaggaag

SEQ ID NO: 283880 - DNA, 20 bp, Artificial
  CRISPR gRNA sequence
atttgactgaggaagttttg

SEQ ID NO: 283881 - DNA, 20 bp, Artificial
  CRISPR gRNA sequence
ttgctttgctttatgttgaa

SEQ ID NO: 283882 - DNA, 20 bp, Artificial
  CRISPR gRNA sequence
tatgttgaagtctgtttccc

SEQ ID NO: 283883 - DNA, 20 bp, Artificial
  CRISPR gRNA sequence
taccctcactttcctcacta

SEQ ID NO: 283884 - DNA, 20 bp, Artificial
  CRISPR gRNA sequence
ctcactttcctcactacaca

SEQ ID NO: 283885 - DNA, 20 bp, Artificial
  CRISPR gRNA sequence
tagcattccagacatccact

SEQ ID NO: 283886 - DNA, 20 bp, Artificial
  CRISPR gRNA sequence
gtcacttcctttacctaaat

SEQ ID NO: 283887 - DNA, 20 bp, Artificial
  CRISPR gRNA sequence
tgcctcagcctcctgagtag

SEQ ID NO: 283888 - DNA, 20 bp, Artificial
  CRISPR gRNA sequence
ttttgtatttttagtagaga

SEQ ID NO: 283889 - DNA, 20 bp, Artificial
  CRISPR gRNA sequence
tagtagagacagggtttcca

SEQ ID NO: 283890 - DNA, 20 bp, Artificial
  CRISPR gRNA sequence
cacctcagcctcccaaaatg

SEQ ID NO: 283891 - DNA, 20 bp, Artificial
  CRISPR gRNA sequence
attcagaaatatggaaaggc

SEQ ID NO: 283892 - DNA, 20 bp, Artificial
  CRISPR gRNA sequence
agctgaggaaaagaaactgc

SEQ ID NO: 283893 - DNA, 20 bp, Artificial
  CRISPR gRNA sequence
cacatttttttctttctggc

SEQ ID NO: 283894 - DNA, 20 bp, Artificial
  CRISPR gRNA sequence
caggcttttagggccattct

SEQ ID NO: 283895 - DNA, 20 bp, Artificial
  CRISPR gRNA sequence
ttagggccattcttcttgtt

SEQ ID NO: 283896 - DNA, 20 bp, Artificial
  CRISPR gRNA sequence
tcttcttgtttaccgatttc

SEQ ID NO: 283897 - DNA, 20 bp, Artificial
  CRISPR gRNA sequence
ggtgggcagatcacgaggtc

SEQ ID NO: 283898 - DNA, 20 bp, Artificial
  CRISPR gRNA sequence
ccaagatcacaccactgcac

SEQ ID NO: 283899 - DNA, 20 bp, Artificial
  CRISPR gRNA sequence
cagagtccctttctttccag

SEQ ID NO: 283900 - DNA, 20 bp, Artificial
  CRISPR gRNA sequence
gttccaggctgaaatgactc

SEQ ID NO: 283901 - DNA, 20 bp, Artificial
  CRISPR gRNA sequence
gccatacaattaccctccag

SEQ ID NO: 283902 - DNA, 20 bp, Artificial
  CRISPR gRNA sequence
ctccagcctggatttgctaa

SEQ ID NO: 283903 - DNA, 20 bp, Artificial
  CRISPR gRNA sequence
attccttagcaggctgtatt

SEQ ID NO: 283904 - DNA, 20 bp, Artificial
  CRISPR gRNA sequence
gcaggctgtattttctgatt

SEQ ID NO: 283905 - DNA, 20 bp, Artificial
  CRISPR gRNA sequence
cccaccacagcactgaacaa

SEQ ID NO: 283906 - DNA, 20 bp, Artificial
  CRISPR gRNA sequence
ttgtgtggaatgttgccagt

SEQ ID NO: 283907 - DNA, 20 bp, Artificial
  CRISPR gRNA sequence
gggctatccatctccattga

SEQ ID NO: 283908 - DNA, 20 bp, Artificial
  CRISPR gRNA sequence
ctagtcccagctcagccact

SEQ ID NO: 283909 - DNA, 20 bp, Artificial
  CRISPR gRNA sequence
gctcagccacttgctgtttc

SEQ ID NO: 283910 - DNA, 20 bp, Artificial
  CRISPR gRNA sequence
ggacatagcaggtcttctgt

SEQ ID NO: 283911 - DNA, 20 bp, Artificial
  CRISPR gRNA sequence
aaaaagaatccaatatttct

SEQ ID NO: 283912 - DNA, 20 bp, Artificial
  CRISPR gRNA sequence
agagactatctaattttggt

SEQ ID NO: 283913 - DNA, 20 bp, Artificial
  CRISPR gRNA sequence
aattttggtgatggcttctg

SEQ ID NO: 283914 - DNA, 20 bp, Artificial
  CRISPR gRNA sequence
tttggaaattcacacgggaa

SEQ ID NO: 283915 - DNA, 20 bp, Artificial
  CRISPR gRNA sequence
ttcacacgggaacccagttt

SEQ ID NO: 283916 - DNA, 20 bp, Artificial
  CRISPR gRNA sequence
ataaatttgcccaaatttat

SEQ ID NO: 283917 - DNA, 20 bp, Artificial
  CRISPR gRNA sequence
cccaaatttatatcagtttt

SEQ ID NO: 283918 - DNA, 20 bp, Artificial
  CRISPR gRNA sequence
agttgaaacggaaatgtctc

SEQ ID NO: 283919 - DNA, 20 bp, Artificial
  CRISPR gRNA sequence
gaaatgtctctaacgatttt

SEQ ID NO: 283920 - DNA, 20 bp, Artificial
  CRISPR gRNA sequence
tctcaaacctggttgaactt

SEQ ID NO: 283921 - DNA, 20 bp, Artificial
  CRISPR gRNA sequence
aaacctggttgaacttctga

SEQ ID NO: 283922 - DNA, 20 bp, Artificial
  CRISPR gRNA sequence
cctacccaacccagtgggtg

SEQ ID NO: 283923 - DNA, 20 bp, Artificial
  CRISPR gRNA sequence
tgctactctttagtctcttt

SEQ ID NO: 283924 - DNA, 20 bp, Artificial
  CRISPR gRNA sequence
ctctttagtctctttgcctg

SEQ ID NO: 283925 - DNA, 20 bp, Artificial
  CRISPR gRNA sequence
tttgcctgatttgtttctct

SEQ ID NO: 283926 - DNA, 20 bp, Artificial
  CRISPR gRNA sequence
tacgtatggagctatggagc

SEQ ID NO: 283927 - DNA, 20 bp, Artificial
  CRISPR gRNA sequence
gagcaagctgggtaacctct

SEQ ID NO: 283928 - DNA, 20 bp, Artificial
  CRISPR gRNA sequence
aaacagtcataatactattg

SEQ ID NO: 283929 - DNA, 20 bp, Artificial
  CRISPR gRNA sequence
atgatttgaatgtgtcccct

SEQ ID NO: 283930 - DNA, 20 bp, Artificial
  CRISPR gRNA sequence
tgagaattgggactgttaaa

SEQ ID NO: 283931 - DNA, 20 bp, Artificial
  CRISPR gRNA sequence
atggagactctgccatcatg

SEQ ID NO: 283932 - DNA, 20 bp, Artificial
  CRISPR gRNA sequence
agtgggttcactacagcagg

SEQ ID NO: 283933 - DNA, 20 bp, Artificial
  CRISPR gRNA sequence
ggagtggcttccttataaag

SEQ ID NO: 283934 - DNA, 20 bp, Artificial
  CRISPR gRNA sequence
cagaccgagataactatctt

SEQ ID NO: 283935 - DNA, 20 bp, Artificial
  CRISPR gRNA sequence
atcacaggataccagatgta

SEQ ID NO: 283936 - DNA, 20 bp, Artificial
  CRISPR gRNA sequence
ttcttaactttagaatgctc

SEQ ID NO: 283937 - DNA, 20 bp, Artificial
  CRISPR gRNA sequence
gttctttctcatgcacaaca

SEQ ID NO: 283938 - DNA, 20 bp, Artificial
  CRISPR gRNA sequence
ccagcatcaccatggtaact

SEQ ID NO: 283939 - DNA, 20 bp, Artificial
  CRISPR gRNA sequence
attagccaggcgtggtggcg

SEQ ID NO: 283940 - DNA, 20 bp, Artificial
  CRISPR gRNA sequence
aatggcgtgaagccgggagg

SEQ ID NO: 283941 - DNA, 20 bp, Artificial
  CRISPR gRNA sequence
aggcggagcttgctgtgagc

SEQ ID NO: 283942 - DNA, 20 bp, Artificial
  CRISPR gRNA sequence
cagagattgtgccactgcac

SEQ ID NO: 283943 - DNA, 20 bp, Artificial
  CRISPR gRNA sequence
tttgggagctggccaaggcg

SEQ ID NO: 283944 - DNA, 20 bp, Artificial
  CRISPR gRNA sequence
ggagctggccaaggcgggtg

SEQ ID NO: 283945 - DNA, 20 bp, Artificial
  CRISPR gRNA sequence
gtccagaatattctttctta

SEQ ID NO: 283946 - DNA, 20 bp, Artificial
  CRISPR gRNA sequence
aggagtagctgcaaataggc

SEQ ID NO: 283947 - DNA, 20 bp, Artificial
  CRISPR gRNA sequence
gcgcaggtttctttctggga

SEQ ID NO: 283948 - DNA, 20 bp, Artificial
  CRISPR gRNA sequence
ttctggaattcgatagtgat

SEQ ID NO: 283949 - DNA, 20 bp, Artificial
  CRISPR gRNA sequence
aacccccgcctccagggttc

SEQ ID NO: 283950 - DNA, 20 bp, Artificial
  CRISPR gRNA sequence
tgcctcagcctcctgagtag

SEQ ID NO: 283951 - DNA, 20 bp, Artificial
  CRISPR gRNA sequence
ttttgcatttttagtagaga

SEQ ID NO: 283952 - DNA, 20 bp, Artificial
  CRISPR gRNA sequence
catctcggcctcccaaaatg

SEQ ID NO: 283953 - DNA, 20 bp, Artificial
  CRISPR gRNA sequence
tgatctccctggaaacacaa

SEQ ID NO: 283954 - DNA, 20 bp, Artificial
  CRISPR gRNA sequence
tcacctattgtctcaccacc

SEQ ID NO: 283955 - DNA, 20 bp, Artificial
  CRISPR gRNA sequence
cacctggagattttaccgtt

SEQ ID NO: 283956 - DNA, 20 bp, Artificial
  CRISPR gRNA sequence
aacaggagtgacccccctct

SEQ ID NO: 283957 - DNA, 20 bp, Artificial
  CRISPR gRNA sequence
ggagtgacccccctctaaat

SEQ ID NO: 283958 - DNA, 20 bp, Artificial
  CRISPR gRNA sequence
cagagctgcctctggcagcc

SEQ ID NO: 283959 - DNA, 20 bp, Artificial
  CRISPR gRNA sequence
acactgttcctgacttttcc

SEQ ID NO: 283960 - DNA, 20 bp, Artificial
  CRISPR gRNA sequence
tcagactataaacttatagg

SEQ ID NO: 283961 - DNA, 20 bp, Artificial
  CRISPR gRNA sequence
agttgctggactataaagtc

SEQ ID NO: 283962 - DNA, 20 bp, Artificial
  CRISPR gRNA sequence
gttactgaaataacctccta

SEQ ID NO: 283963 - DNA, 20 bp, Artificial
  CRISPR gRNA sequence
gagcagcatcagcatcacct

SEQ ID NO: 283964 - DNA, 20 bp, Artificial
  CRISPR gRNA sequence
atatagactttattttttag

SEQ ID NO: 283965 - DNA, 20 bp, Artificial
  CRISPR gRNA sequence
taaccccctccccacatatt

SEQ ID NO: 283966 - DNA, 20 bp, Artificial
  CRISPR gRNA sequence
actcctggtattgcatattc

SEQ ID NO: 283967 - DNA, 20 bp, Artificial
  CRISPR gRNA sequence
atcattacagtattatgcaa

SEQ ID NO: 283968 - DNA, 20 bp, Artificial
  CRISPR gRNA sequence
actctcctgggtaaagccct

SEQ ID NO: 283969 - DNA, 20 bp, Artificial
  CRISPR gRNA sequence
ttccagcttcctgaataaca

SEQ ID NO: 283970 - DNA, 20 bp, Artificial
  CRISPR gRNA sequence
ttcctgaataacatgcggat

SEQ ID NO: 283971 - DNA, 20 bp, Artificial
  CRISPR gRNA sequence
tgtgccctgccttcaaagca

SEQ ID NO: 283972 - DNA, 20 bp, Artificial
  CRISPR gRNA sequence
cctgccttcaaagcacgtgg

SEQ ID NO: 283973 - DNA, 20 bp, Artificial
  CRISPR gRNA sequence
acacattcatttgagtggct

SEQ ID NO: 283974 - DNA, 20 bp, Artificial
  CRISPR gRNA sequence
cccaggaccaagaaaagtct

SEQ ID NO: 283975 - DNA, 20 bp, Artificial
  CRISPR gRNA sequence
ctcttggttttaggagatgc

SEQ ID NO: 283976 - DNA, 20 bp, Artificial
  CRISPR gRNA sequence
ctcatgtttgttgaattaat

SEQ ID NO: 283977 - DNA, 20 bp, Artificial
  CRISPR gRNA sequence
gggcaaagcatttcattgct

SEQ ID NO: 283978 - DNA, 20 bp, Artificial
  CRISPR gRNA sequence
tctttgcttgttctacatgg

SEQ ID NO: 283979 - DNA, 20 bp, Artificial
  CRISPR gRNA sequence
tggcccacctggcacacagt

SEQ ID NO: 283980 - DNA, 20 bp, Artificial
  CRISPR gRNA sequence
caggatgtagctagagaaca

SEQ ID NO: 283981 - DNA, 20 bp, Artificial
  CRISPR gRNA sequence
ccttgtacaatttctaaagt

SEQ ID NO: 283982 - DNA, 20 bp, Artificial
  CRISPR gRNA sequence
gagatctttgagctaaagaa

SEQ ID NO: 283983 - DNA, 20 bp, Artificial
  CRISPR gRNA sequence
accttgttctctagctacat

SEQ ID NO: 283984 - DNA, 20 bp, Artificial
  CRISPR gRNA sequence
gtgggccataaaagttgagg

SEQ ID NO: 283985 - DNA, 20 bp, Artificial
  CRISPR gRNA sequence
agaacaagcaaagagcaatg

SEQ ID NO: 283986 - DNA, 20 bp, Artificial
  CRISPR gRNA sequence
aagagcaatgaaatgctttg

SEQ ID NO: 283987 - DNA, 20 bp, Artificial
  CRISPR gRNA sequence
actgggctgcaggaaggagg

SEQ ID NO: 283988 - DNA, 20 bp, Artificial
  CRISPR gRNA sequence
gctggcacaggtgttcattc

SEQ ID NO: 283989 - DNA, 20 bp, Artificial
  CRISPR gRNA sequence
tgtggccaacaaacaaagcc

SEQ ID NO: 283990 - DNA, 20 bp, Artificial
  CRISPR gRNA sequence
catgttattcaggaagctgg

SEQ ID NO: 283991 - DNA, 20 bp, Artificial
  CRISPR gRNA sequence
tttacacataccaatagcct

SEQ ID NO: 283992 - DNA, 20 bp, Artificial
  CRISPR gRNA sequence
gcctgggggttttgctaaat

SEQ ID NO: 283993 - DNA, 20 bp, Artificial
  CRISPR gRNA sequence
gagtgacccctatcgtgaac

SEQ ID NO: 283994 - DNA, 20 bp, Artificial
  CRISPR gRNA sequence
atgatgtgttaatgtaggtt

SEQ ID NO: 283995 - DNA, 20 bp, Artificial
  CRISPR gRNA sequence
gctctaaaaaataaagtcta

SEQ ID NO: 283996 - DNA, 20 bp, Artificial
  CRISPR gRNA sequence
agtctatatagttttttaaa

SEQ ID NO: 283997 - DNA, 20 bp, Artificial
  CRISPR gRNA sequence
tatagttttttaaatgctgt

SEQ ID NO: 283998 - DNA, 20 bp, Artificial
  CRISPR gRNA sequence
aggtgggtctgggatggggc

SEQ ID NO: 283999 - DNA, 20 bp, Artificial
  CRISPR gRNA sequence
atgctgctccaccatacact

SEQ ID NO: 284000 - DNA, 20 bp, Artificial
  CRISPR gRNA sequence
aaagtgttactgaagaacag

SEQ ID NO: 284001 - DNA, 20 bp, Artificial
  CRISPR gRNA sequence
gtgtgcatggtctgtgggag

SEQ ID NO: 284002 - DNA, 20 bp, Artificial
  CRISPR gRNA sequence
gattcagtgaatacagtgga

SEQ ID NO: 284003 - DNA, 20 bp, Artificial
  CRISPR gRNA sequence
tacagtggagtaggattata

SEQ ID NO: 284004 - DNA, 20 bp, Artificial
  CRISPR gRNA sequence
atagagggctttattcaggg

SEQ ID NO: 284005 - DNA, 20 bp, Artificial
  CRISPR gRNA sequence
ccctcagagggaccaatgtg

SEQ ID NO: 284006 - DNA, 20 bp, Artificial
  CRISPR gRNA sequence
atgtaggaaaagcattgcct

SEQ ID NO: 284007 - DNA, 20 bp, Artificial
  CRISPR gRNA sequence
tggcccaggggtcccatgag

SEQ ID NO: 284008 - DNA, 20 bp, Artificial
  CRISPR gRNA sequence
gtgcattttaaggatataaa

SEQ ID NO: 284009 - DNA, 20 bp, Artificial
  CRISPR gRNA sequence
ggtgagacaataggtgactt

SEQ ID NO: 284010 - DNA, 20 bp, Artificial
  CRISPR gRNA sequence
atatcttccattctttctaa

SEQ ID NO: 284011 - DNA, 20 bp, Artificial
  CRISPR gRNA sequence
gtttatttcatagtcaggga

SEQ ID NO: 284012 - DNA, 20 bp, Artificial
  CRISPR gRNA sequence
tgtttatttaaaaagcacac

SEQ ID NO: 284013 - DNA, 20 bp, Artificial
  CRISPR gRNA sequence
gagttaaaagatgttgtgtc

SEQ ID NO: 284014 - DNA, 20 bp, Artificial
  CRISPR gRNA sequence
gaagactcaggtcttcctag

SEQ ID NO: 284015 - DNA, 20 bp, Artificial
  CRISPR gRNA sequence
tatggattcttcttttccct

SEQ ID NO: 284016 - DNA, 20 bp, Artificial
  CRISPR gRNA sequence
atttgcaatgacataaaatt

SEQ ID NO: 284017 - DNA, 20 bp, Artificial
  CRISPR gRNA sequence
tgggtggatcacctgaggtc

SEQ ID NO: 284018 - DNA, 20 bp, Artificial
  CRISPR gRNA sequence
taaataaagtgtacaattca

SEQ ID NO: 284019 - DNA, 20 bp, Artificial
  CRISPR gRNA sequence
tggacatttcttacaatatg

SEQ ID NO: 284020 - DNA, 20 bp, Artificial
  CRISPR gRNA sequence
tgcgtatgtcttagtactcc

SEQ ID NO: 284021 - DNA, 20 bp, Artificial
  CRISPR gRNA sequence
attctgaaataatattctgt

SEQ ID NO: 284022 - DNA, 20 bp, Artificial
  CRISPR gRNA sequence
attttttctttttgtagcga

SEQ ID NO: 284023 - DNA, 20 bp, Artificial
  CRISPR gRNA sequence
tgctatgttgcctaggctgg

SEQ ID NO: 284024 - DNA, 20 bp, Artificial
  CRISPR gRNA sequence
cttggccagctcccaaagtg

SEQ ID NO: 284025 - DNA, 20 bp, Artificial
  CRISPR gRNA sequence
ctgggattacgggtgcctgg

SEQ ID NO: 284026 - DNA, 20 bp, Artificial
  CRISPR gRNA sequence
gctcacagcaagctccgcct

SEQ ID NO: 284027 - DNA, 20 bp, Artificial
  CRISPR gRNA sequence
ttttgtatttttagtagaga

SEQ ID NO: 284028 - DNA, 20 bp, Artificial
  CRISPR gRNA sequence
tgcctcggcctcccaaagtg

SEQ ID NO: 284029 - DNA, 20 bp, Artificial
  CRISPR gRNA sequence
ggtctctactcttgttggca

SEQ ID NO: 284030 - DNA, 20 bp, Artificial
  CRISPR gRNA sequence
cctattgtgccctacaggtg

SEQ ID NO: 284031 - DNA, 20 bp, Artificial
  CRISPR gRNA sequence
agggaagatagttatctcgg

SEQ ID NO: 284032 - DNA, 20 bp, Artificial
  CRISPR gRNA sequence
attgggtaatttagaaagaa

SEQ ID NO: 284033 - DNA, 20 bp, Artificial
  CRISPR gRNA sequence
aatcatagcaatagtattat

SEQ ID NO: 284034 - DNA, 20 bp, Artificial
  CRISPR gRNA sequence
cctgaagcccagagaggtta

SEQ ID NO: 284035 - DNA, 20 bp, Artificial
  CRISPR gRNA sequence
gttacccagcttgctcaagg

SEQ ID NO: 284036 - DNA, 20 bp, Artificial
  CRISPR gRNA sequence
aagcaagctcagaagttcaa

SEQ ID NO: 284037 - DNA, 20 bp, Artificial
  CRISPR gRNA sequence
ccaggtttgagacagtaata

SEQ ID NO: 284038 - DNA, 20 bp, Artificial
  CRISPR gRNA sequence
gacaaaatcgttagagacat

SEQ ID NO: 284039 - DNA, 20 bp, Artificial
  CRISPR gRNA sequence
gttagagacatttccgtttc

SEQ ID NO: 284040 - DNA, 20 bp, Artificial
  CRISPR gRNA sequence
aatttgggcaaatttataat

SEQ ID NO: 284041 - DNA, 20 bp, Artificial
  CRISPR gRNA sequence
tgtgaatttccaaattgttc

SEQ ID NO: 284042 - DNA, 20 bp, Artificial
  CRISPR gRNA sequence
ttagatagtctctctttcag

SEQ ID NO: 284043 - DNA, 20 bp, Artificial
  CRISPR gRNA sequence
taccaaaatcagtgagaaat

SEQ ID NO: 284044 - DNA, 20 bp, Artificial
  CRISPR gRNA sequence
catgttccttctacgtctca

SEQ ID NO: 284045 - DNA, 20 bp, Artificial
  CRISPR gRNA sequence
gtcatttgatctttagctaa

SEQ ID NO: 284046 - DNA, 20 bp, Artificial
  CRISPR gRNA sequence
tcctgctatctaagaaaaga

SEQ ID NO: 284047 - DNA, 20 bp, Artificial
  CRISPR gRNA sequence
gcgctggggccttagaggga

SEQ ID NO: 284048 - DNA, 20 bp, Artificial
  CRISPR gRNA sequence
ttggtgctattgacacagag

SEQ ID NO: 284049 - DNA, 20 bp, Artificial
  CRISPR gRNA sequence
caggcctggaaagaaaggga

SEQ ID NO: 284050 - DNA, 20 bp, Artificial
  CRISPR gRNA sequence
aacctctgcctcccaggttc

SEQ ID NO: 284051 - DNA, 20 bp, Artificial
  CRISPR gRNA sequence
tgcctcagcctcctaagtag

SEQ ID NO: 284052 - DNA, 20 bp, Artificial
  CRISPR gRNA sequence
ttttgtatttttagtagaga

SEQ ID NO: 284053 - DNA, 20 bp, Artificial
  CRISPR gRNA sequence
cacctcagcctcccaaagtg

SEQ ID NO: 284054 - DNA, 20 bp, Artificial
  CRISPR gRNA sequence
cctcccaaagtgctgggatt

SEQ ID NO: 284055 - DNA, 20 bp, Artificial
  CRISPR gRNA sequence
ccatgatgcccggcctggga

SEQ ID NO: 284056 - DNA, 20 bp, Artificial
  CRISPR gRNA sequence
caaaagggctcagtggtagg

SEQ ID NO: 284057 - DNA, 20 bp, Artificial
  CRISPR gRNA sequence
ttggggtgggtggggacagt

SEQ ID NO: 284058 - DNA, 20 bp, Artificial
  CRISPR gRNA sequence
aaaaaaatgtgtaaaactgg

SEQ ID NO: 284059 - DNA, 20 bp, Artificial
  CRISPR gRNA sequence
gggcagtttcttttcctcag

SEQ ID NO: 284060 - DNA, 20 bp, Artificial
  CRISPR gRNA sequence
atatcccctggggctgagca

SEQ ID NO: 284061 - DNA, 20 bp, Artificial
  CRISPR gRNA sequence
tgggaggatcacctgagatc

SEQ ID NO: 284062 - DNA, 20 bp, Artificial
  CRISPR gRNA sequence
tcaggaggctgaggcaggag

SEQ ID NO: 284063 - DNA, 20 bp, Artificial
  CRISPR gRNA sequence
aagaaagatgtgtcgtctta

SEQ ID NO: 284064 - DNA, 20 bp, Artificial
  CRISPR gRNA sequence
ttatggagattcagggaagg

SEQ ID NO: 284065 - DNA, 20 bp, Artificial
  CRISPR gRNA sequence
ttgaaagataacgtcactgg

SEQ ID NO: 284066 - DNA, 20 bp, Artificial
  CRISPR gRNA sequence
ataggtggaaaaataaggca

SEQ ID NO: 284067 - DNA, 20 bp, Artificial
  CRISPR gRNA sequence
attcaactttaggctgcaaa

SEQ ID NO: 284068 - DNA, 20 bp, Artificial
  CRISPR gRNA sequence
acacagtggatgtctggaat

SEQ ID NO: 284069 - DNA, 20 bp, Artificial
  CRISPR gRNA sequence
tgttacataagaagaatgag

SEQ ID NO: 284070 - DNA, 20 bp, Artificial
  CRISPR gRNA sequence
acccccttggagaaaggaga

SEQ ID NO: 284071 - DNA, 20 bp, Artificial
  CRISPR gRNA sequence
tctaggcattgaattacagt

SEQ ID NO: 284072 - DNA, 20 bp, Artificial
  CRISPR gRNA sequence
gggttcagagaagtaaagta

SEQ ID NO: 284073 - DNA, 20 bp, Artificial
  CRISPR gRNA sequence
gcttaaggtcacacaactac

SEQ ID NO: 284074 - DNA, 20 bp, Artificial
  CRISPR gRNA sequence
gtagggaagtaggcagtcct

SEQ ID NO: 284075 - DNA, 20 bp, Artificial
  CRISPR gRNA sequence
tgtgtattaaggtgacagat

SEQ ID NO: 284076 - DNA, 20 bp, Artificial
  CRISPR gRNA sequence
acgccactgaagtcacatga

SEQ ID NO: 284077 - DNA, 20 bp, Artificial
  CRISPR gRNA sequence
taatctggataaaatttatt

SEQ ID NO: 284078 - DNA, 20 bp, Artificial
  CRISPR gRNA sequence
cccacggttaaatgcagttc

SEQ ID NO: 284079 - DNA, 20 bp, Artificial
  CRISPR gRNA sequence
tgtgtgtgtgttgttgcatc

SEQ ID NO: 284080 - DNA, 20 bp, Artificial
  CRISPR gRNA sequence
aagtgagaattcatgaataa

SEQ ID NO: 284081 - DNA, 20 bp, Artificial
  CRISPR gRNA sequence
gagaattcatgaataatgaa

SEQ ID NO: 284082 - DNA, 20 bp, Artificial
  CRISPR gRNA sequence
acatatcttgtggggttgtt

SEQ ID NO: 284083 - DNA, 20 bp, Artificial
  CRISPR gRNA sequence
gaaggggataggttatgtta

SEQ ID NO: 284084 - DNA, 20 bp, Artificial
  CRISPR gRNA sequence
ttataatgattggtccatga

SEQ ID NO: 284085 - DNA, 20 bp, Artificial
  CRISPR gRNA sequence
ttggtccatgagtctgattt

SEQ ID NO: 284086 - DNA, 20 bp, Artificial
  CRISPR gRNA sequence
tgattttagtgatttgtctt

SEQ ID NO: 284087 - DNA, 20 bp, Artificial
  CRISPR gRNA sequence
ttcattgttttcaaaaccaa

SEQ ID NO: 284088 - DNA, 20 bp, Artificial
  CRISPR gRNA sequence
ttgttttttatgcaatcaca

SEQ ID NO: 284089 - DNA, 20 bp, Artificial
  CRISPR gRNA sequence
atcataaacaggctgttact

SEQ ID NO: 284090 - DNA, 20 bp, Artificial
  CRISPR gRNA sequence
aggggagagggggaaagggg

SEQ ID NO: 284091 - DNA, 20 bp, Artificial
  CRISPR gRNA sequence
ggggagttgtttaatgggca

SEQ ID NO: 284092 - DNA, 20 bp, Artificial
  CRISPR gRNA sequence
ttgtttaatgggcatagagt

SEQ ID NO: 284093 - DNA, 20 bp, Artificial
  CRISPR gRNA sequence
caaaatgaaaatttctagag

SEQ ID NO: 284094 - DNA, 20 bp, Artificial
  CRISPR gRNA sequence
aagatgataaattttatgtt

SEQ ID NO: 284095 - DNA, 20 bp, Artificial
  CRISPR gRNA sequence
tgataaattttatgttatgt

SEQ ID NO: 284096 - DNA, 20 bp, Artificial
  CRISPR gRNA sequence
aaattttatgttatgtgttt

SEQ ID NO: 284097 - DNA, 20 bp, Artificial
  CRISPR gRNA sequence
tttatgttatgtgtttgttt

SEQ ID NO: 284098 - DNA, 20 bp, Artificial
  CRISPR gRNA sequence
tgttatgtgtttgtttgttt

SEQ ID NO: 284099 - DNA, 20 bp, Artificial
  CRISPR gRNA sequence
atgtgtttgtttgtttgttt

SEQ ID NO: 284100 - DNA, 20 bp, Artificial
  CRISPR gRNA sequence
tttgtttgtttgtttggaga

SEQ ID NO: 284101 - DNA, 20 bp, Artificial
  CRISPR gRNA sequence
tgcccaggctggggtgcaat

SEQ ID NO: 284102 - DNA, 20 bp, Artificial
  CRISPR gRNA sequence
aacctccgcctcctgggttc

SEQ ID NO: 284103 - DNA, 20 bp, Artificial
  CRISPR gRNA sequence
tgcctcagcctcccgagtag

SEQ ID NO: 284104 - DNA, 20 bp, Artificial
  CRISPR gRNA sequence
ttttgtatttttagtagaga

SEQ ID NO: 284105 - DNA, 20 bp, Artificial
  CRISPR gRNA sequence
tgcctcggcctcccaaagtg

SEQ ID NO: 284106 - DNA, 20 bp, Artificial
  CRISPR gRNA sequence
gagccaccacgcccagcctg

SEQ ID NO: 284107 - DNA, 20 bp, Artificial
  CRISPR gRNA sequence
ttggggaccccaaaaatcaa

SEQ ID NO: 284108 - DNA, 20 bp, Artificial
  CRISPR gRNA sequence
taagttctgttactgccgac

SEQ ID NO: 284109 - DNA, 20 bp, Artificial
  CRISPR gRNA sequence
ttaataaatatacaatcttg

SEQ ID NO: 284110 - DNA, 20 bp, Artificial
  CRISPR gRNA sequence
gcaacgctgtcctgtggtca

SEQ ID NO: 284111 - DNA, 20 bp, Artificial
  CRISPR gRNA sequence
gttgttctgaagtatgaaaa

SEQ ID NO: 284112 - DNA, 20 bp, Artificial
  CRISPR gRNA sequence
acgttatcagtcaaaggttg

SEQ ID NO: 284113 - DNA, 20 bp, Artificial
  CRISPR gRNA sequence
agtcaaaggttggtgggatt

SEQ ID NO: 284114 - DNA, 20 bp, Artificial
  CRISPR gRNA sequence
ttctgattttactctaggcc

SEQ ID NO: 284115 - DNA, 20 bp, Artificial
  CRISPR gRNA sequence
tgcccttaaagacacatggc

SEQ ID NO: 284116 - DNA, 20 bp, Artificial
  CRISPR gRNA sequence
tagttgtacaataaactcta

SEQ ID NO: 284117 - DNA, 20 bp, Artificial
  CRISPR gRNA sequence
tctcaatcaccaaggggcat

SEQ ID NO: 284118 - DNA, 20 bp, Artificial
  CRISPR gRNA sequence
aaggtaacggggctgggtat

SEQ ID NO: 284119 - DNA, 20 bp, Artificial
  CRISPR gRNA sequence
ctctggaggctgaggcagag

SEQ ID NO: 284120 - DNA, 20 bp, Artificial
  CRISPR gRNA sequence
gaggcggaggttgcaatgag

SEQ ID NO: 284121 - DNA, 20 bp, Artificial
  CRISPR gRNA sequence
ttgggaggccaaggtgggtg

SEQ ID NO: 284122 - DNA, 20 bp, Artificial
  CRISPR gRNA sequence
tgggtggatggcttgagctc

SEQ ID NO: 284123 - DNA, 20 bp, Artificial
  CRISPR gRNA sequence
agccttggtgacagagcaaa

SEQ ID NO: 284124 - DNA, 20 bp, Artificial
  CRISPR gRNA sequence
aactaatttatgaatcaaag

SEQ ID NO: 284125 - DNA, 20 bp, Artificial
  CRISPR gRNA sequence
tggtctcggaaagaaaggac

SEQ ID NO: 284126 - DNA, 20 bp, Artificial
  CRISPR gRNA sequence
cttgcttttgtaaccaccca

SEQ ID NO: 284127 - DNA, 20 bp, Artificial
  CRISPR gRNA sequence
caactggctgtgcgggagac

SEQ ID NO: 284128 - DNA, 20 bp, Artificial
  CRISPR gRNA sequence
ctctccaagcatctggggag

SEQ ID NO: 284129 - DNA, 20 bp, Artificial
  CRISPR gRNA sequence
ggaagccagtgagctgggag

SEQ ID NO: 284130 - DNA, 20 bp, Artificial
  CRISPR gRNA sequence
ggggccacaagatcagatga

SEQ ID NO: 284131 - DNA, 20 bp, Artificial
  CRISPR gRNA sequence
gctcaagcactgatcttagg

SEQ ID NO: 284132 - DNA, 20 bp, Artificial
  CRISPR gRNA sequence
agggtcagaatctcatagca

SEQ ID NO: 284133 - DNA, 20 bp, Artificial
  CRISPR gRNA sequence
actccccaggcaagaaggag

SEQ ID NO: 284134 - DNA, 20 bp, Artificial
  CRISPR gRNA sequence
tgggaaagggctgttaccat

SEQ ID NO: 284135 - DNA, 20 bp, Artificial
  CRISPR gRNA sequence
tttaaactataaactataaa

SEQ ID NO: 284136 - DNA, 20 bp, Artificial
  CRISPR gRNA sequence
tacacccaggagtgaacaaa

SEQ ID NO: 284137 - DNA, 20 bp, Artificial
  CRISPR gRNA sequence
ctcagtcataattttgcaaa

SEQ ID NO: 284138 - DNA, 20 bp, Artificial
  CRISPR gRNA sequence
acttcttacttaataaaaca

SEQ ID NO: 284139 - DNA, 20 bp, Artificial
  CRISPR gRNA sequence
gtagtgaattccttactgtt

SEQ ID NO: 284140 - DNA, 20 bp, Artificial
  CRISPR gRNA sequence
gaactatcttaaacttcact

SEQ ID NO: 284141 - DNA, 20 bp, Artificial
  CRISPR gRNA sequence
gaataaattattatatggtg

SEQ ID NO: 284142 - DNA, 20 bp, Artificial
  CRISPR gRNA sequence
tactaagaagcctacctctt

SEQ ID NO: 284143 - DNA, 20 bp, Artificial
  CRISPR gRNA sequence
tcatcatcatagccattcct

SEQ ID NO: 284144 - DNA, 20 bp, Artificial
  CRISPR gRNA sequence
agatccctgttaaaatgaaa

SEQ ID NO: 284145 - DNA, 20 bp, Artificial
  CRISPR gRNA sequence
caaggggggcaggccctatt

SEQ ID NO: 284146 - DNA, 20 bp, Artificial
  CRISPR gRNA sequence
aggacagctaaggggacaat

SEQ ID NO: 284147 - DNA, 20 bp, Artificial
  CRISPR gRNA sequence
aaagggaagacaaaaaggtc

SEQ ID NO: 284148 - DNA, 20 bp, Artificial
  CRISPR gRNA sequence
attttccaattgagtcaaag

SEQ ID NO: 284149 - DNA, 20 bp, Artificial
  CRISPR gRNA sequence
gagtcaaagcagtgtttctc

SEQ ID NO: 284150 - DNA, 20 bp, Artificial
  CRISPR gRNA sequence
tttgagggtcttgttaaaaa

SEQ ID NO: 284151 - DNA, 20 bp, Artificial
  CRISPR gRNA sequence
agatttaagttcagtaggtc

SEQ ID NO: 284152 - DNA, 20 bp, Artificial
  CRISPR gRNA sequence
agtaggtctggggtttggat

SEQ ID NO: 284153 - DNA, 20 bp, Artificial
  CRISPR gRNA sequence
atcctctttgctcagaacca

SEQ ID NO: 284154 - DNA, 20 bp, Artificial
  CRISPR gRNA sequence
ccaaagggtttatttggggc

SEQ ID NO: 284155 - DNA, 20 bp, Artificial
  CRISPR gRNA sequence
gttggttaccctatatttgt

SEQ ID NO: 284156 - DNA, 20 bp, Artificial
  CRISPR gRNA sequence
atgaaaacctccattaactg

SEQ ID NO: 284157 - DNA, 20 bp, Artificial
  CRISPR gRNA sequence
gagaactagctacattcgtt

SEQ ID NO: 284158 - DNA, 20 bp, Artificial
  CRISPR gRNA sequence
gttaacagcttaactaggtt

SEQ ID NO: 284159 - DNA, 20 bp, Artificial
  CRISPR gRNA sequence
aggttacagtcttacaacgt

SEQ ID NO: 284160 - DNA, 20 bp, Artificial
  CRISPR gRNA sequence
cttagaaaaaaggtgggaga

SEQ ID NO: 284161 - DNA, 20 bp, Artificial
  CRISPR gRNA sequence
tttaggctgttctaagccaa

SEQ ID NO: 284162 - DNA, 20 bp, Artificial
  CRISPR gRNA sequence
agcctctgcctcctgggttc

SEQ ID NO: 284163 - DNA, 20 bp, Artificial
  CRISPR gRNA sequence
ttttttatttttagtagaga

SEQ ID NO: 284164 - DNA, 20 bp, Artificial
  CRISPR gRNA sequence
tgccttgacctcccaaagtg

SEQ ID NO: 284165 - DNA, 20 bp, Artificial
  CRISPR gRNA sequence
agccagcacacctggccttg

SEQ ID NO: 284166 - DNA, 20 bp, Artificial
  CRISPR gRNA sequence
cctggtatgagtggcattcc

SEQ ID NO: 284167 - DNA, 20 bp, Artificial
  CRISPR gRNA sequence
tcatattaataatttaggat

SEQ ID NO: 284168 - DNA, 20 bp, Artificial
  CRISPR gRNA sequence
aataatttaggatatgagtt

SEQ ID NO: 284169 - DNA, 20 bp, Artificial
  CRISPR gRNA sequence
tggcaattatcatcatttgt

SEQ ID NO: 284170 - DNA, 20 bp, Artificial
  CRISPR gRNA sequence
gtgccacaaggcattcctgg

SEQ ID NO: 284171 - DNA, 20 bp, Artificial
  CRISPR gRNA sequence
ctggaagtgtttgcctggca

SEQ ID NO: 284172 - DNA, 20 bp, Artificial
  CRISPR gRNA sequence
tggcaacctgatttaaatga

SEQ ID NO: 284173 - DNA, 20 bp, Artificial
  CRISPR gRNA sequence
tgggcaacagagtgagacta

SEQ ID NO: 284174 - DNA, 20 bp, Artificial
  CRISPR gRNA sequence
tgtgtgtcaggctctgtgct

SEQ ID NO: 284175 - DNA, 20 bp, Artificial
  CRISPR gRNA sequence
acccagggtcacaaggcaga

SEQ ID NO: 284176 - DNA, 20 bp, Artificial
  CRISPR gRNA sequence
aaggcagaactggttttaaa

SEQ ID NO: 284177 - DNA, 20 bp, Artificial
  CRISPR gRNA sequence
aaaagaaagctaactctatg

SEQ ID NO: 284178 - DNA, 20 bp, Artificial
  CRISPR gRNA sequence
tgaggttataggctcaatgt

SEQ ID NO: 284179 - DNA, 20 bp, Artificial
  CRISPR gRNA sequence
ctcaatgttgtagtttggat

SEQ ID NO: 284180 - DNA, 20 bp, Artificial
  CRISPR gRNA sequence
acaaatttctgaaaggcatc

SEQ ID NO: 284181 - DNA, 20 bp, Artificial
  CRISPR gRNA sequence
atctcctgtttgaaagctag

SEQ ID NO: 284182 - DNA, 20 bp, Artificial
  CRISPR gRNA sequence
taacaactaaactcagtcta

SEQ ID NO: 284183 - DNA, 20 bp, Artificial
  CRISPR gRNA sequence
tctatacagctttctatttt

SEQ ID NO: 284184 - DNA, 20 bp, Artificial
  CRISPR gRNA sequence
aaaacattactgatgtggtt

SEQ ID NO: 284185 - DNA, 20 bp, Artificial
  CRISPR gRNA sequence
ttttcttctcacctaaaata

SEQ ID NO: 284186 - DNA, 20 bp, Artificial
  CRISPR gRNA sequence
aattaaaaaatactggtcat

SEQ ID NO: 284187 - DNA, 20 bp, Artificial
  CRISPR gRNA sequence
gccccctcaaaaggcaggtc

SEQ ID NO: 284188 - DNA, 20 bp, Artificial
  CRISPR gRNA sequence
tccaagatctcctctccttg

SEQ ID NO: 284189 - DNA, 20 bp, Artificial
  CRISPR gRNA sequence
tctcctctccttgaccagat

SEQ ID NO: 284190 - DNA, 20 bp, Artificial
  CRISPR gRNA sequence
aagccttctctatttatgta

SEQ ID NO: 284191 - DNA, 20 bp, Artificial
  CRISPR gRNA sequence
ccacaaatttaggatagtga

SEQ ID NO: 284192 - DNA, 20 bp, Artificial
  CRISPR gRNA sequence
aggataggtgacatcatacc

SEQ ID NO: 284193 - DNA, 20 bp, Artificial
  CRISPR gRNA sequence
agatttacctaagttactgt

SEQ ID NO: 284194 - DNA, 20 bp, Artificial
  CRISPR gRNA sequence
ttttggtctcaagttggatg

SEQ ID NO: 284195 - DNA, 20 bp, Artificial
  CRISPR gRNA sequence
gtgggttttcaggcgttcgc

SEQ ID NO: 284196 - DNA, 20 bp, Artificial
  CRISPR gRNA sequence
aaagataggctctggtgtca

SEQ ID NO: 284197 - DNA, 20 bp, Artificial
  CRISPR gRNA sequence
tagttataatttctctaaac

SEQ ID NO: 284198 - DNA, 20 bp, Artificial
  CRISPR gRNA sequence
tataatttctctaaacctca

SEQ ID NO: 284199 - DNA, 20 bp, Artificial
  CRISPR gRNA sequence
agatctacaacctacctctc

SEQ ID NO: 284200 - DNA, 20 bp, Artificial
  CRISPR gRNA sequence
aattcaaatcaaagttagtc

SEQ ID NO: 284201 - DNA, 20 bp, Artificial
  CRISPR gRNA sequence
attatatctcattttatcat

SEQ ID NO: 284202 - DNA, 20 bp, Artificial
  CRISPR gRNA sequence
atctcattttatcattcttg

SEQ ID NO: 284203 - DNA, 20 bp, Artificial
  CRISPR gRNA sequence
ttatcattcttgttttgttt

SEQ ID NO: 284204 - DNA, 20 bp, Artificial
  CRISPR gRNA sequence
tgccttagcctcccgagtag

SEQ ID NO: 284205 - DNA, 20 bp, Artificial
  CRISPR gRNA sequence
ttatgtatttttggtagaga

SEQ ID NO: 284206 - DNA, 20 bp, Artificial
  CRISPR gRNA sequence
tgcctcggcctcccaaagtg

SEQ ID NO: 284207 - DNA, 20 bp, Artificial
  CRISPR gRNA sequence
aaaaataaacctctacacac

SEQ ID NO: 284208 - DNA, 20 bp, Artificial
  CRISPR gRNA sequence
ggataatttgctcaacctct

SEQ ID NO: 284209 - DNA, 20 bp, Artificial
  CRISPR gRNA sequence
gaattaaatgccatcaacac

SEQ ID NO: 284210 - DNA, 20 bp, Artificial
  CRISPR gRNA sequence
ctctatgctgttagcagcaa

SEQ ID NO: 284211 - DNA, 20 bp, Artificial
  CRISPR gRNA sequence
atttcaatatgacaaccaac

SEQ ID NO: 284212 - DNA, 20 bp, Artificial
  CRISPR gRNA sequence
aagtaagtgacattgttctg

SEQ ID NO: 284213 - DNA, 20 bp, Artificial
  CRISPR gRNA sequence
aattgtcgtatttattttga

SEQ ID NO: 284214 - DNA, 20 bp, Artificial
  CRISPR gRNA sequence
tttattttgatagtgtttta

SEQ ID NO: 284215 - DNA, 20 bp, Artificial
  CRISPR gRNA sequence
cagaacatttaaaaaattag

SEQ ID NO: 284216 - DNA, 20 bp, Artificial
  CRISPR gRNA sequence
gtacttgggagggtaaggtg

SEQ ID NO: 284217 - DNA, 20 bp, Artificial
  CRISPR gRNA sequence
tgcctcagcctcccgaatag

SEQ ID NO: 284218 - DNA, 20 bp, Artificial
  CRISPR gRNA sequence
ttttctatctttagtggaga

SEQ ID NO: 284219 - DNA, 20 bp, Artificial
  CRISPR gRNA sequence
cgcctcagcctcccaaagtg

SEQ ID NO: 284220 - DNA, 20 bp, Artificial
  CRISPR gRNA sequence
tccatcaagcattcatctta

SEQ ID NO: 284221 - DNA, 20 bp, Artificial
  CRISPR gRNA sequence
ttgccctttggaactgccct

SEQ ID NO: 284222 - DNA, 20 bp, Artificial
  CRISPR gRNA sequence
tggaactgcccttagggatt

SEQ ID NO: 284223 - DNA, 20 bp, Artificial
  CRISPR gRNA sequence
caatttttttttgtgggcga

SEQ ID NO: 284224 - DNA, 20 bp, Artificial
  CRISPR gRNA sequence
gaaaatatacaatgaaaacg

SEQ ID NO: 284225 - DNA, 20 bp, Artificial
  CRISPR gRNA sequence
tatatacatcttaggcctat

SEQ ID NO: 284226 - DNA, 20 bp, Artificial
  CRISPR gRNA sequence
ttaggcctataatggcttaa

SEQ ID NO: 284227 - DNA, 20 bp, Artificial
  CRISPR gRNA sequence
gagatgctcaaaatattaat

SEQ ID NO: 284228 - DNA, 20 bp, Artificial
  CRISPR gRNA sequence
ccctagccccactcccaagg

SEQ ID NO: 284229 - DNA, 20 bp, Artificial
  CRISPR gRNA sequence
gtatagtaagaaacaaaaca

SEQ ID NO: 284230 - DNA, 20 bp, Artificial
  CRISPR gRNA sequence
gtctagtaattcatgctagt

SEQ ID NO: 284231 - DNA, 20 bp, Artificial
  CRISPR gRNA sequence
tctagatctttcagtgttac

SEQ ID NO: 284232 - DNA, 20 bp, Artificial
  CRISPR gRNA sequence
ttttgtatttttagtagaga

SEQ ID NO: 284233 - DNA, 20 bp, Artificial
  CRISPR gRNA sequence
cgcctcagcctcccaaagtg

SEQ ID NO: 284234 - DNA, 20 bp, Artificial
  CRISPR gRNA sequence
gagccaccatgcccggctac

SEQ ID NO: 284235 - DNA, 20 bp, Artificial
  CRISPR gRNA sequence
ttgtaaaaattttattaaaa

SEQ ID NO: 284236 - DNA, 20 bp, Artificial
  CRISPR gRNA sequence
ttaaaatgaggcttcaatca

SEQ ID NO: 284237 - DNA, 20 bp, Artificial
  CRISPR gRNA sequence
atttaaccaattttacatta

SEQ ID NO: 284238 - DNA, 20 bp, Artificial
  CRISPR gRNA sequence
gaaggcagaaaacagtagag

SEQ ID NO: 284239 - DNA, 20 bp, Artificial
  CRISPR gRNA sequence
ctgattattaaatcagtaat

SEQ ID NO: 284240 - DNA, 20 bp, Artificial
  CRISPR gRNA sequence
tattaaatcagtaatactag

SEQ ID NO: 284241 - DNA, 20 bp, Artificial
  CRISPR gRNA sequence
taatactagcttggattgca

SEQ ID NO: 284242 - DNA, 20 bp, Artificial
  CRISPR gRNA sequence
agagccagatagtaaatatt

SEQ ID NO: 284243 - DNA, 20 bp, Artificial
  CRISPR gRNA sequence
tcttttttttttttttgaga

SEQ ID NO: 284244 - DNA, 20 bp, Artificial
  CRISPR gRNA sequence
aacctctgcctcccaggttc

SEQ ID NO: 284245 - DNA, 20 bp, Artificial
  CRISPR gRNA sequence
tgcctcagcctcccaagtag

SEQ ID NO: 284246 - DNA, 20 bp, Artificial
  CRISPR gRNA sequence
atgtattttcttagtggaga

SEQ ID NO: 284247 - DNA, 20 bp, Artificial
  CRISPR gRNA sequence
tgcctcagcctctcaaagcg

SEQ ID NO: 284248 - DNA, 20 bp, Artificial
  CRISPR gRNA sequence
tttttaaaaacaggtgcagg

SEQ ID NO: 284249 - DNA, 20 bp, Artificial
  CRISPR gRNA sequence
gacaggtttggcccatgtgc

SEQ ID NO: 284250 - DNA, 20 bp, Artificial
  CRISPR gRNA sequence
tgtgctatagtttgctaact

SEQ ID NO: 284251 - DNA, 20 bp, Artificial
  CRISPR gRNA sequence
ggtttttgtctttgtggctg

SEQ ID NO: 284252 - DNA, 20 bp, Artificial
  CRISPR gRNA sequence
atctcattaattggactgtg

SEQ ID NO: 284253 - DNA, 20 bp, Artificial
  CRISPR gRNA sequence
ctgtgtggggattctttaga

SEQ ID NO: 284254 - DNA, 20 bp, Artificial
  CRISPR gRNA sequence
atgttacaggtcagggtgag

SEQ ID NO: 284255 - DNA, 20 bp, Artificial
  CRISPR gRNA sequence
ctgggcaacttacaaaataa

SEQ ID NO: 284256 - DNA, 20 bp, Artificial
  CRISPR gRNA sequence
tggatggcagcagccaaaaa

SEQ ID NO: 284257 - DNA, 20 bp, Artificial
  CRISPR gRNA sequence
agagcttgttataaggaaac

SEQ ID NO: 284258 - DNA, 20 bp, Artificial
  CRISPR gRNA sequence
tgtgggagttataattcaag

SEQ ID NO: 284259 - DNA, 20 bp, Artificial
  CRISPR gRNA sequence
gccaaaccatatcagtaaat

SEQ ID NO: 284260 - DNA, 20 bp, Artificial
  CRISPR gRNA sequence
aagcccaaatgtattaatta

SEQ ID NO: 284261 - DNA, 20 bp, Artificial
  CRISPR gRNA sequence
attaattaagcggattgcgc

SEQ ID NO: 284262 - DNA, 20 bp, Artificial
  CRISPR gRNA sequence
ttttagtgtagtctcaccaa

SEQ ID NO: 284263 - DNA, 20 bp, Artificial
  CRISPR gRNA sequence
gccctcacaccgctctgtac

SEQ ID NO: 284264 - DNA, 20 bp, Artificial
  CRISPR gRNA sequence
tctgcccctgtgggatgtta

SEQ ID NO: 284265 - DNA, 20 bp, Artificial
  CRISPR gRNA sequence
ctaacaggtgtcacaataga

SEQ ID NO: 284266 - DNA, 20 bp, Artificial
  CRISPR gRNA sequence
catactctctctaggttgaa

SEQ ID NO: 284267 - DNA, 20 bp, Artificial
  CRISPR gRNA sequence
tagactcccaggataacagc

SEQ ID NO: 284268 - DNA, 20 bp, Artificial
  CRISPR gRNA sequence
cttgatgtctccattcaatc

SEQ ID NO: 284269 - DNA, 20 bp, Artificial
  CRISPR gRNA sequence
gtctttaagtggtaggtaca

SEQ ID NO: 284270 - DNA, 20 bp, Artificial
  CRISPR gRNA sequence
taggtacactatgattaaat

SEQ ID NO: 284271 - DNA, 20 bp, Artificial
  CRISPR gRNA sequence
atgattaaataggtgtttca

SEQ ID NO: 284272 - DNA, 20 bp, Artificial
  CRISPR gRNA sequence
aggaaacctgaggcaaagag

SEQ ID NO: 284273 - DNA, 20 bp, Artificial
  CRISPR gRNA sequence
tcagctaaggcagttgctgc

SEQ ID NO: 284274 - DNA, 20 bp, Artificial
  CRISPR gRNA sequence
tgggagaatacagctggtag

SEQ ID NO: 284275 - DNA, 20 bp, Artificial
  CRISPR gRNA sequence
tttggaaagcaggtagtaaa

SEQ ID NO: 284276 - DNA, 20 bp, Artificial
  CRISPR gRNA sequence
ttttctttgtctttttctga

SEQ ID NO: 284277 - DNA, 20 bp, Artificial
  CRISPR gRNA sequence
ctccctggttcaagcaattc

SEQ ID NO: 284278 - DNA, 20 bp, Artificial
  CRISPR gRNA sequence
tgcttcagcctcctgagtac

SEQ ID NO: 284279 - DNA, 20 bp, Artificial
  CRISPR gRNA sequence
ttttgtacttttagtagaga

SEQ ID NO: 284280 - DNA, 20 bp, Artificial
  CRISPR gRNA sequence
gtcacagaagtccaagaagg

SEQ ID NO: 284281 - DNA, 20 bp, Artificial
  CRISPR gRNA sequence
aattccttgaactcgggagg

SEQ ID NO: 284282 - DNA, 20 bp, Artificial
  CRISPR gRNA sequence
taaataaataaaacttacca

SEQ ID NO: 284283 - DNA, 20 bp, Artificial
  CRISPR gRNA sequence
catgctcctgcctccgactc

SEQ ID NO: 284284 - DNA, 20 bp, Artificial
  CRISPR gRNA sequence
tggttatggccagggtgctg

SEQ ID NO: 284285 - DNA, 20 bp, Artificial
  CRISPR gRNA sequence
cacaggcctacaagaaatcc

SEQ ID NO: 284286 - DNA, 20 bp, Artificial
  CRISPR gRNA sequence
gctgagaaatgttccagatg

SEQ ID NO: 284287 - DNA, 20 bp, Artificial
  CRISPR gRNA sequence
ctggaaagccctggcacaaa

SEQ ID NO: 284288 - DNA, 20 bp, Artificial
  CRISPR gRNA sequence
atgcaaagaactttgggccc

SEQ ID NO: 284289 - DNA, 20 bp, Artificial
  CRISPR gRNA sequence
gagagcactgtgtcgtatcc

SEQ ID NO: 284290 - DNA, 20 bp, Artificial
  CRISPR gRNA sequence
attttgggggaacatttctt

SEQ ID NO: 284291 - DNA, 20 bp, Artificial
  CRISPR gRNA sequence
gctgctataatttgtgtccc

SEQ ID NO: 284292 - DNA, 20 bp, Artificial
  CRISPR gRNA sequence
gccgtttttccagatgttgc

SEQ ID NO: 284293 - DNA, 20 bp, Artificial
  CRISPR gRNA sequence
agttctttgccagacttgtt

SEQ ID NO: 284294 - DNA, 20 bp, Artificial
  CRISPR gRNA sequence
agtgaatgcaaagtggctcc

SEQ ID NO: 284295 - DNA, 20 bp, Artificial
  CRISPR gRNA sequence
ataaaagtgagatactgcaa

SEQ ID NO: 284296 - DNA, 20 bp, Artificial
  CRISPR gRNA sequence
gatactgcaagatggcttgt

SEQ ID NO: 284297 - DNA, 20 bp, Artificial
  CRISPR gRNA sequence
ttagttgcccacaagtatgt

SEQ ID NO: 284298 - DNA, 20 bp, Artificial
  CRISPR gRNA sequence
accatggttcggcatctctc

SEQ ID NO: 284299 - DNA, 20 bp, Artificial
  CRISPR gRNA sequence
tctctctgaggttttagcct

SEQ ID NO: 284300 - DNA, 20 bp, Artificial
  CRISPR gRNA sequence
ggttttagcctattcgcttc

SEQ ID NO: 284301 - DNA, 20 bp, Artificial
  CRISPR gRNA sequence
tcactgccctcaagacacat

SEQ ID NO: 284302 - DNA, 20 bp, Artificial
  CRISPR gRNA sequence
tcaagacacattctagttta

SEQ ID NO: 284303 - DNA, 20 bp, Artificial
  CRISPR gRNA sequence
ctttatatatttttggagac

SEQ ID NO: 284304 - DNA, 20 bp, Artificial
  CRISPR gRNA sequence
gggtttgctaactaatttga

SEQ ID NO: 284305 - DNA, 20 bp, Artificial
  CRISPR gRNA sequence
ctaatttttttttaagggct

SEQ ID NO: 284306 - DNA, 20 bp, Artificial
  CRISPR gRNA sequence
ccatcctgctgatattctaa

SEQ ID NO: 284307 - DNA, 20 bp, Artificial
  CRISPR gRNA sequence
tcaggaggctgaagcaggag

SEQ ID NO: 284308 - DNA, 20 bp, Artificial
  CRISPR gRNA sequence
ttttgtatttttagtagaga

SEQ ID NO: 284309 - DNA, 20 bp, Artificial
  CRISPR gRNA sequence
tgacctcgtgatccgcctgc

SEQ ID NO: 284310 - DNA, 20 bp, Artificial
  CRISPR gRNA sequence
tcaggagtggctgatgaaag

SEQ ID NO: 284311 - DNA, 20 bp, Artificial
  CRISPR gRNA sequence
acatatgctgccctcaatct

SEQ ID NO: 284312 - DNA, 20 bp, Artificial
  CRISPR gRNA sequence
aaaatcggaagatcaacatc

SEQ ID NO: 284313 - DNA, 20 bp, Artificial
  CRISPR gRNA sequence
atcaacatctgctgattttc

SEQ ID NO: 284314 - DNA, 20 bp, Artificial
  CRISPR gRNA sequence
aagaggtctggtgggctcaa

SEQ ID NO: 284315 - DNA, 20 bp, Artificial
  CRISPR gRNA sequence
gcattttgggcaagataatt

SEQ ID NO: 284316 - DNA, 20 bp, Artificial
  CRISPR gRNA sequence
gtgctgttctgtgcactgta

SEQ ID NO: 284317 - DNA, 20 bp, Artificial
  CRISPR gRNA sequence
ctgtgcactgtaggatgttt

SEQ ID NO: 284318 - DNA, 20 bp, Artificial
  CRISPR gRNA sequence
ggaaacttacttatcatttt

SEQ ID NO: 284319 - DNA, 20 bp, Artificial
  CRISPR gRNA sequence
ttattgtttgttcttgtctc

SEQ ID NO: 284320 - DNA, 20 bp, Artificial
  CRISPR gRNA sequence
gcagagagagaaggaggaat

SEQ ID NO: 284321 - DNA, 20 bp, Artificial
  CRISPR gRNA sequence
ttcttcccttaacaaattta

SEQ ID NO: 284322 - DNA, 20 bp, Artificial
  CRISPR gRNA sequence
tcaccttcttaaaaacctct

SEQ ID NO: 284323 - DNA, 20 bp, Artificial
  CRISPR gRNA sequence
ctcctttctccccatatgca

SEQ ID NO: 284324 - DNA, 20 bp, Artificial
  CRISPR gRNA sequence
taatgtaacctcttcttttg

SEQ ID NO: 284325 - DNA, 20 bp, Artificial
  CRISPR gRNA sequence
attaacacggtaacattttc

SEQ ID NO: 284326 - DNA, 20 bp, Artificial
  CRISPR gRNA sequence
gagaccccactgcctacaga

SEQ ID NO: 284327 - DNA, 20 bp, Artificial
  CRISPR gRNA sequence
actgcctacagaaaaagctt

SEQ ID NO: 284328 - DNA, 20 bp, Artificial
  CRISPR gRNA sequence
gtcaattgttcctcacatgg

SEQ ID NO: 284329 - DNA, 20 bp, Artificial
  CRISPR gRNA sequence
gggtaaacggaacccaagac

SEQ ID NO: 284330 - DNA, 20 bp, Artificial
  CRISPR gRNA sequence
ttaagagagcctaacacagc

SEQ ID NO: 284331 - DNA, 20 bp, Artificial
  CRISPR gRNA sequence
ttataagcctccctaaacag

SEQ ID NO: 284332 - DNA, 20 bp, Artificial
  CRISPR gRNA sequence
gaaaaatgaaaaataatacc

SEQ ID NO: 284333 - DNA, 20 bp, Artificial
  CRISPR gRNA sequence
tacctgacgcttatacaaca

SEQ ID NO: 284334 - DNA, 20 bp, Artificial
  CRISPR gRNA sequence
accagaggctcccagaggtt

SEQ ID NO: 284335 - DNA, 20 bp, Artificial
  CRISPR gRNA sequence
aggctcccagaggttaagag

SEQ ID NO: 284336 - DNA, 20 bp, Artificial
  CRISPR gRNA sequence
catacagatgaagaataaaa

SEQ ID NO: 284337 - DNA, 20 bp, Artificial
  CRISPR gRNA sequence
ggcagtgtctcaacttccta

SEQ ID NO: 284338 - DNA, 20 bp, Artificial
  CRISPR gRNA sequence
cctgttttttcatttccact

SEQ ID NO: 284339 - DNA, 20 bp, Artificial
  CRISPR gRNA sequence
catctcataccaccagcata

SEQ ID NO: 284340 - DNA, 20 bp, Artificial
  CRISPR gRNA sequence
tatcctttactggactgtat

SEQ ID NO: 284341 - DNA, 20 bp, Artificial
  CRISPR gRNA sequence
gagagccccacacatagaag

SEQ ID NO: 284342 - DNA, 20 bp, Artificial
  CRISPR gRNA sequence
agtggcttgatcaagcattt

SEQ ID NO: 284343 - DNA, 20 bp, Artificial
  CRISPR gRNA sequence
catgtgacaaaaattgccag

SEQ ID NO: 284344 - DNA, 20 bp, Artificial
  CRISPR gRNA sequence
agttttaagttctctcataa

SEQ ID NO: 284345 - DNA, 20 bp, Artificial
  CRISPR gRNA sequence
agctgggaatacccttgatc

SEQ ID NO: 284346 - DNA, 20 bp, Artificial
  CRISPR gRNA sequence
ttgagattaaaatgtaaatt

SEQ ID NO: 284347 - DNA, 20 bp, Artificial
  CRISPR gRNA sequence
ttaatatataaataaattta

SEQ ID NO: 284348 - DNA, 20 bp, Artificial
  CRISPR gRNA sequence
gttttcctcctttgccaata

SEQ ID NO: 284349 - DNA, 20 bp, Artificial
  CRISPR gRNA sequence
agggtttgatgtaatcattt

SEQ ID NO: 284350 - DNA, 20 bp, Artificial
  CRISPR gRNA sequence
ctgggaacttcctcagatgg

SEQ ID NO: 284351 - DNA, 20 bp, Artificial
  CRISPR gRNA sequence
ccctttacgtatctgctctt

SEQ ID NO: 284352 - DNA, 20 bp, Artificial
  CRISPR gRNA sequence
cttaggtgcttcttcacttc

SEQ ID NO: 284353 - DNA, 20 bp, Artificial
  CRISPR gRNA sequence
agctctggtgaccttgatca

SEQ ID NO: 284354 - DNA, 20 bp, Artificial
  CRISPR gRNA sequence
tataaaggccagcgccagaa

SEQ ID NO: 284355 - DNA, 20 bp, Artificial
  CRISPR gRNA sequence
ctctggtgctctttcccttt

SEQ ID NO: 284356 - DNA, 20 bp, Artificial
  CRISPR gRNA sequence
acaggtcaacttcagagact

SEQ ID NO: 284357 - DNA, 20 bp, Artificial
  CRISPR gRNA sequence
tgatttcctaatgtcagagt

SEQ ID NO: 284358 - DNA, 20 bp, Artificial
  CRISPR gRNA sequence
cagagtagaagattttatgc

SEQ ID NO: 284359 - DNA, 20 bp, Artificial
  CRISPR gRNA sequence
gagactaatggaaatattat

SEQ ID NO: 284360 - DNA, 20 bp, Artificial
  CRISPR gRNA sequence
tttcctctgacatgtaagac

SEQ ID NO: 284361 - DNA, 20 bp, Artificial
  CRISPR gRNA sequence
ttggactgataatctcttta

SEQ ID NO: 284362 - DNA, 20 bp, Artificial
  CRISPR gRNA sequence
atctctttaaatggctttat

SEQ ID NO: 284363 - DNA, 20 bp, Artificial
  CRISPR gRNA sequence
gttctcatttaaaatgagat

SEQ ID NO: 284364 - DNA, 20 bp, Artificial
  CRISPR gRNA sequence
gggcctccttagatccctaa

SEQ ID NO: 284365 - DNA, 20 bp, Artificial
  CRISPR gRNA sequence
atggcagctaagccacatgg

SEQ ID NO: 284366 - DNA, 20 bp, Artificial
  CRISPR gRNA sequence
taaagcctttagagccagcc

SEQ ID NO: 284367 - DNA, 20 bp, Artificial
  CRISPR gRNA sequence
tggctttagctacctcacta

SEQ ID NO: 284368 - DNA, 20 bp, Artificial
  CRISPR gRNA sequence
acaccaacataaggtactag

SEQ ID NO: 284369 - DNA, 20 bp, Artificial
  CRISPR gRNA sequence
tttagtaacagttgtgatga

SEQ ID NO: 284370 - DNA, 20 bp, Artificial
  CRISPR gRNA sequence
taagggaagaaacaaagttg

SEQ ID NO: 284371 - DNA, 20 bp, Artificial
  CRISPR gRNA sequence
tcaagtgtcaaagaaatcat

SEQ ID NO: 284372 - DNA, 20 bp, Artificial
  CRISPR gRNA sequence
acactacacatttacactca

SEQ ID NO: 284373 - DNA, 20 bp, Artificial
  CRISPR gRNA sequence
tcacactgcttccaggaccc

SEQ ID NO: 284374 - DNA, 20 bp, Artificial
  CRISPR gRNA sequence
gttctttcctctcctctttc

SEQ ID NO: 284375 - DNA, 20 bp, Artificial
  CRISPR gRNA sequence
ttcaactttaatcttttgcg

SEQ ID NO: 284376 - DNA, 20 bp, Artificial
  CRISPR gRNA sequence
cttttgcgaaatgttttatt

SEQ ID NO: 284377 - DNA, 20 bp, Artificial
  CRISPR gRNA sequence
tattcatgtatgcatatatt

SEQ ID NO: 284378 - DNA, 20 bp, Artificial
  CRISPR gRNA sequence
ctttttcttttctttttaac

SEQ ID NO: 284379 - DNA, 20 bp, Artificial
  CRISPR gRNA sequence
tggtcctttgaaagggtatt

SEQ ID NO: 284380 - DNA, 20 bp, Artificial
  CRISPR gRNA sequence
aaaagtagatcagcattatt

SEQ ID NO: 284381 - DNA, 20 bp, Artificial
  CRISPR gRNA sequence
ttgctgacaaagtatctgct

SEQ ID NO: 284382 - DNA, 20 bp, Artificial
  CRISPR gRNA sequence
ctgtagaatacaggaattac

SEQ ID NO: 284383 - DNA, 20 bp, Artificial
  CRISPR gRNA sequence
gaatacaggaattacttaga

SEQ ID NO: 284384 - DNA, 20 bp, Artificial
  CRISPR gRNA sequence
cacaactgttactaaatgga

SEQ ID NO: 284385 - DNA, 20 bp, Artificial
  CRISPR gRNA sequence
ctgttactaaatggaaaaga

SEQ ID NO: 284386 - DNA, 20 bp, Artificial
  CRISPR gRNA sequence
tagacctctctgccctacac

SEQ ID NO: 284387 - DNA, 20 bp, Artificial
  CRISPR gRNA sequence
gctgccatgagatgtgcatt

SEQ ID NO: 284388 - DNA, 20 bp, Artificial
  CRISPR gRNA sequence
gaattgtggaaggcagtttt

SEQ ID NO: 284389 - DNA, 20 bp, Artificial
  CRISPR gRNA sequence
tttccagttctctgctgatg

SEQ ID NO: 284390 - DNA, 20 bp, Artificial
  CRISPR gRNA sequence
tctgctgatgtcagaaagac

SEQ ID NO: 284391 - DNA, 20 bp, Artificial
  CRISPR gRNA sequence
gaaagacccagaaataccaa

SEQ ID NO: 284392 - DNA, 20 bp, Artificial
  CRISPR gRNA sequence
ctaaagtcccttccagaact

SEQ ID NO: 284393 - DNA, 20 bp, Artificial
  CRISPR gRNA sequence
ttgcaaatggaggtgggacc

SEQ ID NO: 284394 - DNA, 20 bp, Artificial
  CRISPR gRNA sequence
gaggtgggacctgagaaaac

SEQ ID NO: 284395 - DNA, 20 bp, Artificial
  CRISPR gRNA sequence
acacagtaaccttgatagct

SEQ ID NO: 284396 - DNA, 20 bp, Artificial
  CRISPR gRNA sequence
ctgagcagaagactttttag

SEQ ID NO: 284397 - DNA, 20 bp, Artificial
  CRISPR gRNA sequence
agactttttagatagaaagt

SEQ ID NO: 284398 - DNA, 20 bp, Artificial
  CRISPR gRNA sequence
tgagtctgttagtaagaggc

SEQ ID NO: 284399 - DNA, 20 bp, Artificial
  CRISPR gRNA sequence
atagagggaaaaatgaatga

SEQ ID NO: 284400 - DNA, 20 bp, Artificial
  CRISPR gRNA sequence
tgacaagacaattcaagatg

SEQ ID NO: 284401 - DNA, 20 bp, Artificial
  CRISPR gRNA sequence
attaagcaaattgcatatgg

SEQ ID NO: 284402 - DNA, 20 bp, Artificial
  CRISPR gRNA sequence
acagcttaaatttgttaagg

SEQ ID NO: 284403 - DNA, 20 bp, Artificial
  CRISPR gRNA sequence
acagaacagcactccaaaac

SEQ ID NO: 284404 - DNA, 20 bp, Artificial
  CRISPR gRNA sequence
gtaacactggatagttggta

SEQ ID NO: 284405 - DNA, 20 bp, Artificial
  CRISPR gRNA sequence
gttaacagcacatactctct

SEQ ID NO: 284406 - DNA, 20 bp, Artificial
  CRISPR gRNA sequence
aattcatagggtaaaatatc

SEQ ID NO: 284407 - DNA, 20 bp, Artificial
  CRISPR gRNA sequence
aaaaatgtattctaaagaac

SEQ ID NO: 284408 - DNA, 20 bp, Artificial
  CRISPR gRNA sequence
tctcaaaaaaaaaaaagaac

SEQ ID NO: 284409 - DNA, 20 bp, Artificial
  CRISPR gRNA sequence
accccacccagcccaagaac

SEQ ID NO: 284410 - DNA, 20 bp, Artificial
  CRISPR gRNA sequence
tagtgcatcttgccctcctc

SEQ ID NO: 284411 - DNA, 20 bp, Artificial
  CRISPR gRNA sequence
tctctaactccaaatcaaaa

SEQ ID NO: 284412 - DNA, 20 bp, Artificial
  CRISPR gRNA sequence
gactagcccttaaaaaaaaa

SEQ ID NO: 284413 - DNA, 20 bp, Artificial
  CRISPR gRNA sequence
aattagaatatcatttagca

SEQ ID NO: 284414 - DNA, 20 bp, Artificial
  CRISPR gRNA sequence
gaaaaaataaacagactaaa

SEQ ID NO: 284415 - DNA, 20 bp, Artificial
  CRISPR gRNA sequence
tggtaataaagtttgatctt

SEQ ID NO: 284416 - DNA, 20 bp, Artificial
  CRISPR gRNA sequence
cttgcttggctatggaggga

SEQ ID NO: 284417 - DNA, 20 bp, Artificial
  CRISPR gRNA sequence
caaggaaatgagggtgggga

SEQ ID NO: 284418 - DNA, 20 bp, Artificial
  CRISPR gRNA sequence
gaagttttatttaaaacata

SEQ ID NO: 284419 - DNA, 20 bp, Artificial
  CRISPR gRNA sequence
atatacagtactcaatgctg

SEQ ID NO: 284420 - DNA, 20 bp, Artificial
  CRISPR gRNA sequence
ctcttcccacactttgcaca

SEQ ID NO: 284421 - DNA, 20 bp, Artificial
  CRISPR gRNA sequence
ttatcttctcggcagcatat

SEQ ID NO: 284422 - DNA, 20 bp, Artificial
  CRISPR gRNA sequence
gtactcaggaggctgaagca

SEQ ID NO: 284423 - DNA, 20 bp, Artificial
  CRISPR gRNA sequence
ctccagcctgggtgacagag

SEQ ID NO: 284424 - DNA, 20 bp, Artificial
  CRISPR gRNA sequence
tgacagagtgagaatctatc

SEQ ID NO: 284425 - DNA, 20 bp, Artificial
  CRISPR gRNA sequence
aatctatctcagaaaaagac

SEQ ID NO: 284426 - DNA, 20 bp, Artificial
  CRISPR gRNA sequence
atgtattttctgttctatat

SEQ ID NO: 284427 - DNA, 20 bp, Artificial
  CRISPR gRNA sequence
ccagagttgacctctacaga

SEQ ID NO: 284428 - DNA, 20 bp, Artificial
  CRISPR gRNA sequence
caggtctattgtgacacctg

SEQ ID NO: 284429 - DNA, 20 bp, Artificial
  CRISPR gRNA sequence
aacatcccacaggggcagac

SEQ ID NO: 284430 - DNA, 20 bp, Artificial
  CRISPR gRNA sequence
atttggtgagactacactaa

SEQ ID NO: 284431 - DNA, 20 bp, Artificial
  CRISPR gRNA sequence
ttgcttttgaatcttattct

SEQ ID NO: 284432 - DNA, 20 bp, Artificial
  CRISPR gRNA sequence
tggtgaaaccccatctccac

SEQ ID NO: 284433 - DNA, 20 bp, Artificial
  CRISPR gRNA sequence
ctacttgggaggctgaggca

SEQ ID NO: 284434 - DNA, 20 bp, Artificial
  CRISPR gRNA sequence
ctctgtctcaaaaaaaaaaa

SEQ ID NO: 284435 - DNA, 20 bp, Artificial
  CRISPR gRNA sequence
ctcaaaaaaaaaaaaaagaa

SEQ ID NO: 284436 - DNA, 20 bp, Artificial
  CRISPR gRNA sequence
aaaaaagaaaaagaaaaaaa

SEQ ID NO: 284437 - DNA, 20 bp, Artificial
  CRISPR gRNA sequence
ctgcttttgtgctacaacca

SEQ ID NO: 284438 - DNA, 20 bp, Artificial
  CRISPR gRNA sequence
tatttactatctggctctat

SEQ ID NO: 284439 - DNA, 20 bp, Artificial
  CRISPR gRNA sequence
aaaatttgccaacccctgtc

SEQ ID NO: 284440 - DNA, 20 bp, Artificial
  CRISPR gRNA sequence
ctactgttttctgccttcaa

SEQ ID NO: 284441 - DNA, 20 bp, Artificial
  CRISPR gRNA sequence
ttggttaaataatgctataa

SEQ ID NO: 284442 - DNA, 20 bp, Artificial
  CRISPR gRNA sequence
tttgtctcattgaggaaaat

SEQ ID NO: 284443 - DNA, 20 bp, Artificial
  CRISPR gRNA sequence
ctacacaggaggctgagaca

SEQ ID NO: 284444 - DNA, 20 bp, Artificial
  CRISPR gRNA sequence
gcaactacaagtaaagacat

SEQ ID NO: 284445 - DNA, 20 bp, Artificial
  CRISPR gRNA sequence
tgatttcacctcttggggaa

SEQ ID NO: 284446 - DNA, 20 bp, Artificial
  CRISPR gRNA sequence
tcacctttcccagacttggt

SEQ ID NO: 284447 - DNA, 20 bp, Artificial
  CRISPR gRNA sequence
cgtgtgggtggcatgcccta

SEQ ID NO: 284448 - DNA, 20 bp, Artificial
  CRISPR gRNA sequence
gtttttagtatatataaatt

SEQ ID NO: 284449 - DNA, 20 bp, Artificial
  CRISPR gRNA sequence
aaattttagaatatttatta

SEQ ID NO: 284450 - DNA, 20 bp, Artificial
  CRISPR gRNA sequence
aaaccccatctccactaaag

SEQ ID NO: 284451 - DNA, 20 bp, Artificial
  CRISPR gRNA sequence
ctattcgggaggctgaggca

SEQ ID NO: 284452 - DNA, 20 bp, Artificial
  CRISPR gRNA sequence
aaaaataaataaataaataa

SEQ ID NO: 284453 - DNA, 20 bp, Artificial
  CRISPR gRNA sequence
actctgatgttcagacaatg

SEQ ID NO: 284454 - DNA, 20 bp, Artificial
  CRISPR gRNA sequence
gtctttttagattcgatata

SEQ ID NO: 284455 - DNA, 20 bp, Artificial
  CRISPR gRNA sequence
taggtgtagggaagtcagct

SEQ ID NO: 284456 - DNA, 20 bp, Artificial
  CRISPR gRNA sequence
gaagtcagctaaagaaagaa

SEQ ID NO: 284457 - DNA, 20 bp, Artificial
  CRISPR gRNA sequence
aaataattttctagctttaa

SEQ ID NO: 284458 - DNA, 20 bp, Artificial
  CRISPR gRNA sequence
ctactcgggaggctaaggca

SEQ ID NO: 284459 - DNA, 20 bp, Artificial
  CRISPR gRNA sequence
tcaaaaacaacaaaacaaaa

SEQ ID NO: 284460 - DNA, 20 bp, Artificial
  CRISPR gRNA sequence
gagataggagggcacttatt

SEQ ID NO: 284461 - DNA, 20 bp, Artificial
  CRISPR gRNA sequence
gcaattgtaagagatgaaga

SEQ ID NO: 284462 - DNA, 20 bp, Artificial
  CRISPR gRNA sequence
ccttacctcattttgtcctc

SEQ ID NO: 284463 - DNA, 20 bp, Artificial
  CRISPR gRNA sequence
aagtaatcaaactgaggttt

SEQ ID NO: 284464 - DNA, 20 bp, Artificial
  CRISPR gRNA sequence
attataactaaccagtaatg

SEQ ID NO: 284465 - DNA, 20 bp, Artificial
  CRISPR gRNA sequence
ggggcctacccctttgctct

SEQ ID NO: 284466 - DNA, 20 bp, Artificial
  CRISPR gRNA sequence
gaaagggtctagatggggag

SEQ ID NO: 284467 - DNA, 20 bp, Artificial
  CRISPR gRNA sequence
ggtcaaggagaggagatctt

SEQ ID NO: 284468 - DNA, 20 bp, Artificial
  CRISPR gRNA sequence
aagctctttattttaggtga

SEQ ID NO: 284469 - DNA, 20 bp, Artificial
  CRISPR gRNA sequence
tgcatatggaagcctgaaaa

SEQ ID NO: 284470 - DNA, 20 bp, Artificial
  CRISPR gRNA sequence
tttcaaacaggagatgcctt

SEQ ID NO: 284471 - DNA, 20 bp, Artificial
  CRISPR gRNA sequence
aaaaaaaagtagtcttttac

SEQ ID NO: 284472 - DNA, 20 bp, Artificial
  CRISPR gRNA sequence
aaataaatgcagagaacata

SEQ ID NO: 284473 - DNA, 20 bp, Artificial
  CRISPR gRNA sequence
tcatagagttagctttcttt

SEQ ID NO: 284474 - DNA, 20 bp, Artificial
  CRISPR gRNA sequence
gacactaatacccagggttg

SEQ ID NO: 284475 - DNA, 20 bp, Artificial
  CRISPR gRNA sequence
agaattaaatgacatcgttc

SEQ ID NO: 284476 - DNA, 20 bp, Artificial
  CRISPR gRNA sequence
atgacacaggcagctgatat

SEQ ID NO: 284477 - DNA, 20 bp, Artificial
  CRISPR gRNA sequence
ctagtttggaggctgagaca

SEQ ID NO: 284478 - DNA, 20 bp, Artificial
  CRISPR gRNA sequence
cctgagagcttgttagaggt

SEQ ID NO: 284479 - DNA, 20 bp, Artificial
  CRISPR gRNA sequence
ctcataggcttataagcatt

SEQ ID NO: 284480 - DNA, 20 bp, Artificial
  CRISPR gRNA sequence
ctttgactcaattggaaaat

SEQ ID NO: 284481 - DNA, 20 bp, Artificial
  CRISPR gRNA sequence
caccctcggttctgagtacc

SEQ ID NO: 284482 - DNA, 20 bp, Artificial
  CRISPR gRNA sequence
ggatcttttaggaggaaaat

SEQ ID NO: 284483 - DNA, 20 bp, Artificial
  CRISPR gRNA sequence
agcaggaatggctatgatga

SEQ ID NO: 284484 - DNA, 20 bp, Artificial
  CRISPR gRNA sequence
aatttattctatccaagagc

SEQ ID NO: 284485 - DNA, 20 bp, Artificial
  CRISPR gRNA sequence
aggctcaagtcccaggggaa

SEQ ID NO: 284486 - DNA, 20 bp, Artificial
  CRISPR gRNA sequence
atatgttcaaatttcaactg

SEQ ID NO: 284487 - DNA, 20 bp, Artificial
  CRISPR gRNA sequence
tgtaggctgaactaactttg

SEQ ID NO: 284488 - DNA, 20 bp, Artificial
  CRISPR gRNA sequence
gactaacattagccacaaga

SEQ ID NO: 284489 - DNA, 20 bp, Artificial
  CRISPR gRNA sequence
agggtcctttctttccgaga

SEQ ID NO: 284490 - DNA, 20 bp, Artificial
  CRISPR gRNA sequence
aaattatcactttgaaaata

SEQ ID NO: 284491 - DNA, 20 bp, Artificial
  CRISPR gRNA sequence
gaacttggattgtcaaagaa

SEQ ID NO: 284492 - DNA, 20 bp, Artificial
  CRISPR gRNA sequence
cagatatttccaggacatct

SEQ ID NO: 284493 - DNA, 20 bp, Artificial
  CRISPR gRNA sequence
tacaactagagacttaactc

SEQ ID NO: 284494 - DNA, 20 bp, Artificial
  CRISPR gRNA sequence
ccatgtgtctttaagggcat

SEQ ID NO: 284495 - DNA, 20 bp, Artificial
  CRISPR gRNA sequence
tctgccggcctagagtaaaa

SEQ ID NO: 284496 - DNA, 20 bp, Artificial
  CRISPR gRNA sequence
gagtttgtgccagctcttca

SEQ ID NO: 284497 - DNA, 20 bp, Artificial
  CRISPR gRNA sequence
ctactcgggaggctgaggca

SEQ ID NO: 284498 - DNA, 20 bp, Artificial
  CRISPR gRNA sequence
cattgttgtgaaacagatct

SEQ ID NO: 284499 - DNA, 20 bp, Artificial
  CRISPR gRNA sequence
ttggctactttaaatatctc

SEQ ID NO: 284500 - DNA, 20 bp, Artificial
  CRISPR gRNA sequence
actttaaatatctcatagaa

SEQ ID NO: 284501 - DNA, 20 bp, Artificial
  CRISPR gRNA sequence
aaggttttggaagtcactat

SEQ ID NO: 284502 - DNA, 20 bp, Artificial
  CRISPR gRNA sequence
cctatccccttcctttttct

SEQ ID NO: 284503 - DNA, 20 bp, Artificial
  CRISPR gRNA sequence
tatgattctgcagtcatgac

SEQ ID NO: 284504 - DNA, 20 bp, Artificial
  CRISPR gRNA sequence
agggagatgaggtcaactaa

SEQ ID NO: 284505 - DNA, 20 bp, Artificial
  CRISPR gRNA sequence
attttcagctactactgcct

SEQ ID NO: 284506 - DNA, 20 bp, Artificial
  CRISPR gRNA sequence
ctactgccttgagaaataag

SEQ ID NO: 284507 - DNA, 20 bp, Artificial
  CRISPR gRNA sequence
atttaaccgtgggaaaaatc

SEQ ID NO: 284508 - DNA, 20 bp, Artificial
  CRISPR gRNA sequence
agaggctcctggttgttggt

SEQ ID NO: 284509 - DNA, 20 bp, Artificial
  CRISPR gRNA sequence
cgttatctttcaagagttat

SEQ ID NO: 284510 - DNA, 20 bp, Artificial
  CRISPR gRNA sequence
tgatgagacatcgtgagcat

SEQ ID NO: 284511 - DNA, 20 bp, Artificial
  CRISPR gRNA sequence
agacagggatccctagtgag

SEQ ID NO: 284512 - DNA, 20 bp, Artificial
  CRISPR gRNA sequence
tgaggaaactgagctgagga

SEQ ID NO: 284513 - DNA, 20 bp, Artificial
  CRISPR gRNA sequence
accactgagcccttttgcta

SEQ ID NO: 284514 - DNA, 20 bp, Artificial
  CRISPR gRNA sequence
ctacttaggaggctgaggca

SEQ ID NO: 284515 - DNA, 20 bp, Artificial
  CRISPR gRNA sequence
taaataaataaataaataaa

SEQ ID NO: 284516 - DNA, 20 bp, Artificial
  CRISPR gRNA sequence
catttctccatccacatagc

SEQ ID NO: 284517 - DNA, 20 bp, Artificial
  CRISPR gRNA sequence
gcatagcaaagtgaggtaat

SEQ ID NO: 284518 - DNA, 20 bp, Artificial
  CRISPR gRNA sequence
tgctttagggaatataactg

SEQ ID NO: 284519 - DNA, 20 bp, Artificial
  CRISPR gRNA sequence
ggaatataactgaaagaaag

SEQ ID NO: 284520 - DNA, 20 bp, Artificial
  CRISPR gRNA sequence
aactattcattcccagccaa

SEQ ID NO: 284521 - DNA, 20 bp, Artificial
  CRISPR gRNA sequence
cgggattccaccacacagag

SEQ ID NO: 284522 - DNA, 20 bp, Artificial
  CRISPR gRNA sequence
ctggctccatccactgtgta

SEQ ID NO: 284523 - DNA, 20 bp, Artificial
  CRISPR gRNA sequence
aattccgggtgcaacagtgt

SEQ ID NO: 284524 - DNA, 20 bp, Artificial
  CRISPR gRNA sequence
cttcccagcctccagaacag

SEQ ID NO: 284525 - DNA, 20 bp, Artificial
  CRISPR gRNA sequence
tgtaaagtgctttcttaact

SEQ ID NO: 284526 - DNA, 20 bp, Artificial
  CRISPR gRNA sequence
gcacctctacccagcagcag

SEQ ID NO: 284527 - DNA, 20 bp, Artificial
  CRISPR gRNA sequence
ttgccaacaagagtagagac

SEQ ID NO: 284528 - DNA, 20 bp, Artificial
  CRISPR gRNA sequence
ctactcgggaggctgaggca

SEQ ID NO: 284529 - DNA, 20 bp, Artificial
  CRISPR gRNA sequence
caaaaaccccatcgctacaa

SEQ ID NO: 284530 - DNA, 20 bp, Artificial
  CRISPR gRNA sequence
aaaatagatctcaatctaca

SEQ ID NO: 284531 - DNA, 20 bp, Artificial
  CRISPR gRNA sequence
atctacaacagaatattatt

SEQ ID NO: 284532 - DNA, 20 bp, Artificial
  CRISPR gRNA sequence
gaaagacataatgctcagtg

SEQ ID NO: 284533 - DNA, 20 bp, Artificial
  CRISPR gRNA sequence
tcacgaaacgccacatattg

SEQ ID NO: 284534 - DNA, 20 bp, Artificial
  CRISPR gRNA sequence
ccacatattgtaagaaatgt

SEQ ID NO: 284535 - DNA, 20 bp, Artificial
  CRISPR gRNA sequence
tggattctggaaaaaaagga

SEQ ID NO: 284536 - DNA, 20 bp, Artificial
  CRISPR gRNA sequence
tctggaaaaaaaggaagaga

SEQ ID NO: 284537 - DNA, 20 bp, Artificial
  CRISPR gRNA sequence
aataaaacatgaagggaaaa

SEQ ID NO: 284538 - DNA, 20 bp, Artificial
  CRISPR gRNA sequence
tgactatgaaataaacattc

SEQ ID NO: 284539 - DNA, 20 bp, Artificial
  CRISPR gRNA sequence
tatgaaataaacattcttag

SEQ ID NO: 284540 - DNA, 20 bp, Artificial
  CRISPR gRNA sequence
tcttagaaagaatggaagat

SEQ ID NO: 284541 - DNA, 20 bp, Artificial
  CRISPR gRNA sequence
cagcatcacctaggtgcttc

SEQ ID NO: 284542 - DNA, 20 bp, Artificial
  CRISPR gRNA sequence
cctaggtgcttcttagaaat

SEQ ID NO: 284543 - DNA, 20 bp, Artificial
  CRISPR gRNA sequence
cccatcccagacccacctaa

SEQ ID NO: 284544 - DNA, 20 bp, Artificial
  CRISPR gRNA sequence
tctctaaaaaattccctgtg

SEQ ID NO: 284545 - DNA, 20 bp, Artificial
  CRISPR gRNA sequence
aagagccatgtccccaggac

SEQ ID NO: 284546 - DNA, 20 bp, Artificial
  CRISPR gRNA sequence
aattaataaatgattaaaca

SEQ ID NO: 284547 - DNA, 20 bp, Artificial
  CRISPR gRNA sequence
tgtccaggctgttgccctga

SEQ ID NO: 284548 - DNA, 20 bp, Artificial
  CRISPR gRNA sequence
tggaaagagatctttgagct

SEQ ID NO: 284549 - DNA, 20 bp, Artificial
  CRISPR gRNA sequence
gaggcagatggatgatggag

SEQ ID NO: 284550 - DNA, 20 bp, Artificial
  CRISPR gRNA sequence
ttataaatttgcccaaatcc

SEQ ID NO: 284551 - DNA, 20 bp, Artificial
  CRISPR gRNA sequence
actgatgatgtctttaatga

SEQ ID NO: 284552 - DNA, 20 bp, Artificial
  CRISPR gRNA sequence
tgcaggcactgtctatggag

SEQ ID NO: 284553 - DNA, 20 bp, Artificial
  CRISPR gRNA sequence
agtctgagaactcagagcta

SEQ ID NO: 284554 - DNA, 20 bp, Artificial
  CRISPR gRNA sequence
gaactcagagctaggagaaa

SEQ ID NO: 284555 - DNA, 20 bp, Artificial
  CRISPR gRNA sequence
tttaaggatataaatactgt

SEQ ID NO: 284556 - DNA, 20 bp, Artificial
  CRISPR gRNA sequence
gatataaatactgtttagaa

SEQ ID NO: 284557 - DNA, 20 bp, Artificial
  CRISPR gRNA sequence
tctatatcttccattctttc

SEQ ID NO: 284558 - DNA, 20 bp, Artificial
  CRISPR gRNA sequence
ctactcaggaggctgaggca

SEQ ID NO: 284559 - DNA, 20 bp, Artificial
  CRISPR gRNA sequence
tgatgatggaaatcatcatc

SEQ ID NO: 284560 - DNA, 20 bp, Artificial
  CRISPR gRNA sequence
gatggaaatcatcatcccag

SEQ ID NO: 284561 - DNA, 20 bp, Artificial
  CRISPR gRNA sequence
tcttttctcttccttttttt

SEQ ID NO: 284562 - DNA, 20 bp, Artificial
  CRISPR gRNA sequence
ctttttttccagaatccagg

SEQ ID NO: 284563 - DNA, 20 bp, Artificial
  CRISPR gRNA sequence
ttttccagaatccaggtaag

SEQ ID NO: 284564 - DNA, 20 bp, Artificial
  CRISPR gRNA sequence
tatgggcactgaactcagtt

SEQ ID NO: 284565 - DNA, 20 bp, Artificial
  CRISPR gRNA sequence
gcaaagcaggctgttgtgca

SEQ ID NO: 284566 - DNA, 20 bp, Artificial
  CRISPR gRNA sequence
tctgtagagcattctaaagt

SEQ ID NO: 284567 - DNA, 20 bp, Artificial
  CRISPR gRNA sequence
gtctggtttgtgctgctata

SEQ ID NO: 284568 - DNA, 20 bp, Artificial
  CRISPR gRNA sequence
aatacctgacattgggtaat

SEQ ID NO: 284569 - DNA, 20 bp, Artificial
  CRISPR gRNA sequence
gcatcatcccatggcagagg

SEQ ID NO: 284570 - DNA, 20 bp, Artificial
  CRISPR gRNA sequence
tcagctggagacaagcctga

SEQ ID NO: 284571 - DNA, 20 bp, Artificial
  CRISPR gRNA sequence
tcaccacataccaaaatcag

SEQ ID NO: 284572 - DNA, 20 bp, Artificial
  CRISPR gRNA sequence
agagttggcagtgggaggag

SEQ ID NO: 284573 - DNA, 20 bp, Artificial
  CRISPR gRNA sequence
ttggcagtgggaggagggag

SEQ ID NO: 284574 - DNA, 20 bp, Artificial
  CRISPR gRNA sequence
tgtcatacctatttagagat

SEQ ID NO: 284575 - DNA, 20 bp, Artificial
  CRISPR gRNA sequence
agcaagtggctgagctggga

SEQ ID NO: 284576 - DNA, 20 bp, Artificial
  CRISPR gRNA sequence
tatccagtctgacagaggcc

SEQ ID NO: 284577 - DNA, 20 bp, Artificial
  CRISPR gRNA sequence
tgccccatgatcctgctatc

SEQ ID NO: 284578 - DNA, 20 bp, Artificial
  CRISPR gRNA sequence
taggtcctacaagagcctag

SEQ ID NO: 284579 - DNA, 20 bp, Artificial
  CRISPR gRNA sequence
catgccttctaaaccaaaaa

SEQ ID NO: 284580 - DNA, 20 bp, Artificial
  CRISPR gRNA sequence
tatttcttggctatgtggat

SEQ ID NO: 284581 - DNA, 20 bp, Artificial
  CRISPR gRNA sequence
ctatgtggatggagaaatga

SEQ ID NO: 284582 - DNA, 20 bp, Artificial
  CRISPR gRNA sequence
atttagggtacctgaagatg

SEQ ID NO: 284583 - DNA, 20 bp, Artificial
  CRISPR gRNA sequence
atgggatcaatcaggcctgg

SEQ ID NO: 284584 - DNA, 20 bp, Artificial
  CRISPR gRNA sequence
actgactgtggcctaaaact

SEQ ID NO: 284585 - DNA, 20 bp, Artificial
  CRISPR gRNA sequence
ctgaagaaatcggtaaacaa

SEQ ID NO: 284586 - DNA, 20 bp, Artificial
  CRISPR gRNA sequence
aatggccctaaaagcctggg

SEQ ID NO: 284587 - DNA, 20 bp, Artificial
  CRISPR gRNA sequence
gccctaaaagcctgggccag

SEQ ID NO: 284588 - DNA, 20 bp, Artificial
  CRISPR gRNA sequence
tcatttgtaagataaggcca

SEQ ID NO: 284589 - DNA, 20 bp, Artificial
  CRISPR gRNA sequence
agactccgtctcaaaaaaaa

SEQ ID NO: 284590 - DNA, 20 bp, Artificial
  CRISPR gRNA sequence
cgtctcaaaaaaaaaaagaa

SEQ ID NO: 284591 - DNA, 20 bp, Artificial
  CRISPR gRNA sequence
aaaaaaaaaagaaaaagaaa

SEQ ID NO: 284592 - DNA, 20 bp, Artificial
  CRISPR gRNA sequence
aaaaaagaaaaagaaaaaag

SEQ ID NO: 284593 - DNA, 20 bp, Artificial
  CRISPR gRNA sequence
ctgcaagtcttgttacataa

SEQ ID NO: 284594 - DNA, 20 bp, Artificial
  CRISPR gRNA sequence
ggtaaattccccaccccctt

SEQ ID NO: 284595 - DNA, 20 bp, Artificial
  CRISPR gRNA sequence
tccccacccccttggagaaa

SEQ ID NO: 284596 - DNA, 20 bp, Artificial
  CRISPR gRNA sequence
ttgtggggagaggggctgta

SEQ ID NO: 284597 - DNA, 20 bp, Artificial
  CRISPR gRNA sequence
agaaggaggccttctgtaag

SEQ ID NO: 284598 - DNA, 20 bp, Artificial
  CRISPR gRNA sequence
ccttattcttcgtcatgact

SEQ ID NO: 284599 - DNA, 20 bp, Artificial
  CRISPR gRNA sequence
gcatgtcattggaaaattct

SEQ ID NO: 284600 - DNA, 20 bp, Artificial
  CRISPR gRNA sequence
gcattgcgggtgcaactgct

SEQ ID NO: 284601 - DNA, 20 bp, Artificial
  CRISPR gRNA sequence
gaaaacactattgaggttcc

SEQ ID NO: 284602 - DNA, 20 bp, Artificial
  CRISPR gRNA sequence
cccaaaattccatatatcca

SEQ ID NO: 284603 - DNA, 20 bp, Artificial
  CRISPR gRNA sequence
agccaaattcatacaaacaa

SEQ ID NO: 284604 - DNA, 20 bp, Artificial
  CRISPR gRNA sequence
ccacaatttttaaaaaatga

SEQ ID NO: 284605 - DNA, 20 bp, Artificial
  CRISPR gRNA sequence
cgcatctactggcaaaagga

SEQ ID NO: 284606 - DNA, 20 bp, Artificial
  CRISPR gRNA sequence
gctactctggaggctgaggc

SEQ ID NO: 284607 - DNA, 20 bp, Artificial
  CRISPR gRNA sequence
gtcctgaaaaattagatgtt

SEQ ID NO: 284608 - DNA, 20 bp, Artificial
  CRISPR gRNA sequence
ctactcaggaggctgaggca

SEQ ID NO: 284609 - DNA, 20 bp, Artificial
  CRISPR gRNA sequence
cttaaaaaaaaaaaaaagtt

SEQ ID NO: 284610 - DNA, 20 bp, Artificial
  CRISPR gRNA sequence
gcaagcatttctggtctcgg

SEQ ID NO: 284611 - DNA, 20 bp, Artificial
  CRISPR gRNA sequence
taggagcagtttagggaggg

SEQ ID NO: 284612 - DNA, 20 bp, Artificial
  CRISPR gRNA sequence
gaaggagccagagccctttt

SEQ ID NO: 284613 - DNA, 20 bp, Artificial
  CRISPR gRNA sequence
agtgttttctctgctcttgg

SEQ ID NO: 284614 - DNA, 20 bp, Artificial
  CRISPR gRNA sequence
ctcaggtcaggtgaatttgg

SEQ ID NO: 284615 - DNA, 20 bp, Artificial
  CRISPR gRNA sequence
aatttggatagaaagataaa

SEQ ID NO: 284616 - DNA, 20 bp, Artificial
  CRISPR gRNA sequence
taaagaagaaaatccaagag

SEQ ID NO: 284617 - DNA, 20 bp, Artificial
  CRISPR gRNA sequence
gttaccctaaacagatcacc

SEQ ID NO: 284618 - DNA, 20 bp, Artificial
  CRISPR gRNA sequence
gagtttaggctgttctaagc

SEQ ID NO: 284619 - DNA, 20 bp, Artificial
  CRISPR gRNA sequence
gcattcctgtagtttatttc

SEQ ID NO: 284620 - DNA, 20 bp, Artificial
  CRISPR gRNA sequence
atttcccagaaaagcagagc

SEQ ID NO: 284621 - DNA, 20 bp, Artificial
  CRISPR gRNA sequence
cacaaaacatattgatgtta

SEQ ID NO: 284622 - DNA, 20 bp, Artificial
  CRISPR gRNA sequence
atattgatgttataagaaac

SEQ ID NO: 284623 - DNA, 20 bp, Artificial
  CRISPR gRNA sequence
ccccatctctattaaaaata

SEQ ID NO: 284624 - DNA, 20 bp, Artificial
  CRISPR gRNA sequence
ctactctggaggctgaggca

SEQ ID NO: 284625 - DNA, 20 bp, Artificial
  CRISPR gRNA sequence
acatgacatctctgtggggc

SEQ ID NO: 284626 - DNA, 20 bp, Artificial
  CRISPR gRNA sequence
tgtggggctcagaattctga

SEQ ID NO: 284627 - DNA, 20 bp, Artificial
  CRISPR gRNA sequence
gaagctaatctctttatgtg

SEQ ID NO: 284628 - DNA, 20 bp, Artificial
  CRISPR gRNA sequence
attttcctgtactttgtact

SEQ ID NO: 284629 - DNA, 20 bp, Artificial
  CRISPR gRNA sequence
tttaaggcatatcaaaatag

SEQ ID NO: 284630 - DNA, 20 bp, Artificial
  CRISPR gRNA sequence
ttgcccatggtctcatgagg

SEQ ID NO: 284631 - DNA, 20 bp, Artificial
  CRISPR gRNA sequence
ataaagaggggaaaacccat

SEQ ID NO: 284632 - DNA, 20 bp, Artificial
  CRISPR gRNA sequence
tatgtattgagtttaggtag

SEQ ID NO: 284633 - DNA, 20 bp, Artificial
  CRISPR gRNA sequence
tattgagtttaggtagccag

SEQ ID NO: 284634 - DNA, 20 bp, Artificial
  CRISPR gRNA sequence
tcaatgttcaaaggataagg

SEQ ID NO: 284635 - DNA, 20 bp, Artificial
  CRISPR gRNA sequence
taaggccagaaaggaggaca

SEQ ID NO: 284636 - DNA, 20 bp, Artificial
  CRISPR gRNA sequence
gtaaataaatagataacata

SEQ ID NO: 284637 - DNA, 20 bp, Artificial
  CRISPR gRNA sequence
ttgcgtacttcaagcatcag

SEQ ID NO: 284638 - DNA, 20 bp, Artificial
  CRISPR gRNA sequence
aggaagaaaagaagagaaga

SEQ ID NO: 284639 - DNA, 20 bp, Artificial
  CRISPR gRNA sequence
gaagagaagaaagggaaagg

SEQ ID NO: 284640 - DNA, 20 bp, Artificial
  CRISPR gRNA sequence
agaagaaagggaaaggaaag

SEQ ID NO: 284641 - DNA, 20 bp, Artificial
  CRISPR gRNA sequence
gaaagaaagaaaggcaaggt

SEQ ID NO: 284642 - DNA, 20 bp, Artificial
  CRISPR gRNA sequence
ctatctccatcaaaagtggc

SEQ ID NO: 284643 - DNA, 20 bp, Artificial
  CRISPR gRNA sequence
tttatcaattcttattaaag

SEQ ID NO: 284644 - DNA, 20 bp, Artificial
  CRISPR gRNA sequence
tctcctggttggaaaatgga

SEQ ID NO: 284645 - DNA, 20 bp, Artificial
  CRISPR gRNA sequence
ttaatgatgtggatacattt

SEQ ID NO: 284646 - DNA, 20 bp, Artificial
  CRISPR gRNA sequence
atgggactaccatcatatat

SEQ ID NO: 284647 - DNA, 20 bp, Artificial
  CRISPR gRNA sequence
gtaactcagccagatacatt

SEQ ID NO: 284648 - DNA, 20 bp, Artificial
  CRISPR gRNA sequence
agagtgagaccctgtctcta

SEQ ID NO: 284649 - DNA, 20 bp, Artificial
  CRISPR gRNA sequence
accctactggtagtaaactc

SEQ ID NO: 284650 - DNA, 20 bp, Artificial
  CRISPR gRNA sequence
taggttttgtgactgtatag

SEQ ID NO: 284651 - DNA, 20 bp, Artificial
  CRISPR gRNA sequence
ttacattattctgattgaag

SEQ ID NO: 284652 - DNA, 20 bp, Artificial
  CRISPR gRNA sequence
ttggactgtgtggggattct

SEQ ID NO: 284653 - DNA, 20 bp, Artificial
  CRISPR gRNA sequence
atacattaagtgtatagtac

SEQ ID NO: 284654 - DNA, 20 bp, Artificial
  CRISPR gRNA sequence
tccattcaatctggtgtttt

SEQ ID NO: 284655 - DNA, 20 bp, Artificial
  CRISPR gRNA sequence
aatctggtgttttagagaaa

SEQ ID NO: 284656 - DNA, 20 bp, Artificial
  CRISPR gRNA sequence
actatgattaaataggtgtt

SEQ ID NO: 284657 - DNA, 20 bp, Artificial
  CRISPR gRNA sequence
gcaggctactaggtgggaga

SEQ ID NO: 284658 - DNA, 20 bp, Artificial
  CRISPR gRNA sequence
agagatattctgaatataga

SEQ ID NO: 284659 - DNA, 20 bp, Artificial
  CRISPR gRNA sequence
gcctactgggaagtgagcac

SEQ ID NO: 284660 - DNA, 20 bp, Artificial
  CRISPR gRNA sequence
tattgttattcactgaaatg

SEQ ID NO: 284661 - DNA, 20 bp, Artificial
  CRISPR gRNA sequence
catccatccaatatacaaat

SEQ ID NO: 284662 - DNA, 20 bp, Artificial
  CRISPR gRNA sequence
caccttggcctcccaaagtg

SEQ ID NO: 284663 - DNA, 20 bp, Artificial
  CRISPR gRNA sequence
taattagaggacaagaagag

SEQ ID NO: 284664 - DNA, 20 bp, Artificial
  CRISPR gRNA sequence
gaagaggaagaaaagccttc

SEQ ID NO: 284665 - DNA, 20 bp, Artificial
  CRISPR gRNA sequence
gagaaaacggagtgcaacaa

SEQ ID NO: 284666 - DNA, 20 bp, Artificial
  CRISPR gRNA sequence
gatgagaagtccaataagca

SEQ ID NO: 284667 - DNA, 20 bp, Artificial
  CRISPR gRNA sequence
cactgtgggaggccaagaca

SEQ ID NO: 284668 - DNA, 20 bp, Artificial
  CRISPR gRNA sequence
ctactcgggaggctgaggca

SEQ ID NO: 284669 - DNA, 20 bp, Artificial
  CRISPR gRNA sequence
cttaccactgggtttggtaa

SEQ ID NO: 284670 - DNA, 20 bp, Artificial
  CRISPR gRNA sequence
tactgcaaatcctactatgg

SEQ ID NO: 284671 - DNA, 20 bp, Artificial
  CRISPR gRNA sequence
tgttcagcctcacaggccta

SEQ ID NO: 284672 - DNA, 20 bp, Artificial
  CRISPR gRNA sequence
ccaaatgcttctaaatttgc

SEQ ID NO: 284673 - DNA, 20 bp, Artificial
  CRISPR gRNA sequence
gctcagaaatatggaggtgc

SEQ ID NO: 284674 - DNA, 20 bp, Artificial
  CRISPR gRNA sequence
cagaactaagcatcacacat

SEQ ID NO: 284675 - DNA, 20 bp, Artificial
  CRISPR gRNA sequence
tttaaataaaacttcagcat

SEQ ID NO: 284676 - DNA, 20 bp, Artificial
  CRISPR gRNA sequence
atttatttgtaagccatttc

SEQ ID NO: 284677 - DNA, 20 bp, Artificial
  CRISPR gRNA sequence
tgtaagccatttcagagaaa

SEQ ID NO: 284678 - DNA, 20 bp, Artificial
  CRISPR gRNA sequence
aatgattcctcaaagcagct

SEQ ID NO: 284679 - DNA, 20 bp, Artificial
  CRISPR gRNA sequence
tgtgatgtgtatgtgttgag

SEQ ID NO: 284680 - DNA, 20 bp, Artificial
  CRISPR gRNA sequence
tgttgagagagaatatggta

SEQ ID NO: 284681 - DNA, 20 bp, Artificial
  CRISPR gRNA sequence
atggcttgtaaaagatttcc

SEQ ID NO: 284682 - DNA, 20 bp, Artificial
  CRISPR gRNA sequence
ccacaagtatgtgcctgatt

SEQ ID NO: 284683 - DNA, 20 bp, Artificial
  CRISPR gRNA sequence
tgcctgattgaagaattatg

SEQ ID NO: 284684 - DNA, 20 bp, Artificial
  CRISPR gRNA sequence
tactggagagctgaccaggc

SEQ ID NO: 284685 - DNA, 20 bp, Artificial
  CRISPR gRNA sequence
aatactccacagttgcatca

SEQ ID NO: 284686 - DNA, 20 bp, Artificial
  CRISPR gRNA sequence
gttgcatcaatagaaaaggc

SEQ ID NO: 284687 - DNA, 20 bp, Artificial
  CRISPR gRNA sequence
tctaattttgatttggagtt

SEQ ID NO: 284688 - DNA, 20 bp, Artificial
  CRISPR gRNA sequence
aaattgacaaattttggtgc

SEQ ID NO: 284689 - DNA, 20 bp, Artificial
  CRISPR gRNA sequence
gcaagatgcactaatacagt

SEQ ID NO: 284690 - DNA, 20 bp, Artificial
  CRISPR gRNA sequence
ctactcaggaggctgaagca

SEQ ID NO: 284691 - DNA, 20 bp, Artificial
  CRISPR gRNA sequence
atgtccattttctcagttct

SEQ ID NO: 284692 - DNA, 20 bp, Artificial
  CRISPR gRNA sequence
gggtaccaacccttctttga

SEQ ID NO: 284693 - DNA, 20 bp, Artificial
  CRISPR gRNA sequence
atcatggagccaaatttcac

SEQ ID NO: 284694 - DNA, 20 bp, Artificial
  CRISPR gRNA sequence
cagaagagaccccactgcct

SEQ ID NO: 284695 - DNA, 20 bp, Artificial
  CRISPR gRNA sequence
tccccaggtattttcatgca

SEQ ID NO: 284696 - DNA, 20 bp, Artificial
  CRISPR gRNA sequence
agagaaacttacatgggaca

SEQ ID NO: 284697 - DNA, 20 bp, Artificial
  CRISPR gRNA sequence
tctttaaaaataaaggaaag

SEQ ID NO: 284698 - DNA, 20 bp, Artificial
  CRISPR gRNA sequence
tgggcaggagggggaaatat

SEQ ID NO: 284699 - DNA, 20 bp, Artificial
  CRISPR gRNA sequence
atctatttccatgttatggg

SEQ ID NO: 284700 - DNA, 20 bp, Artificial
  CRISPR gRNA sequence
tgaggtacggtcatacagat

SEQ ID NO: 284701 - DNA, 20 bp, Artificial
  CRISPR gRNA sequence
actgaatgcttgctcactcc

SEQ ID NO: 284702 - DNA, 20 bp, Artificial
  CRISPR gRNA sequence
tggactgtatgtaggtttat

SEQ ID NO: 284703 - DNA, 20 bp, Artificial
  CRISPR gRNA sequence
tgatcaaggtgttttgaaat

SEQ ID NO: 284704 - DNA, 20 bp, Artificial
  CRISPR gRNA sequence
tgagttctggaagggacttt

SEQ ID NO: 284705 - DNA, 20 bp, Artificial
  CRISPR gRNA sequence
caggcaaagtgctgctggaa

SEQ ID NO: 284706 - DNA, 20 bp, Artificial
  CRISPR gRNA sequence
tcactcccccatgaggtaca

SEQ ID NO: 284707 - DNA, 20 bp, Artificial
  CRISPR gRNA sequence
cctcatttgtaaaatattta

SEQ ID NO: 284708 - DNA, 20 bp, Artificial
  CRISPR gRNA sequence
ctttgtcagcaatactaagg

SEQ ID NO: 284709 - DNA, 20 bp, Artificial
  CRISPR gRNA sequence
tgtattttatttcaagtgtc

SEQ ID NO: 284710 - DNA, 20 bp, Artificial
  CRISPR gRNA sequence
tctcctctttccagtgattt

SEQ ID NO: 284711 - DNA, 20 bp, Artificial
  CRISPR gRNA sequence
acagccccattcttagttaa

SEQ ID NO: 284712 - DNA, 20 bp, Artificial
  CRISPR gRNA sequence
cccattcttagttaaaaaga

SEQ ID NO: 284713 - DNA, 20 bp, Artificial
  CRISPR gRNA sequence
cctagattttaagcagtaaa

SEQ ID NO: 284714 - DNA, 20 bp, Artificial
  CRISPR gRNA sequence
aactcaagaattctgcattt

SEQ ID NO: 284715 - DNA, 20 bp, Artificial
  CRISPR gRNA sequence
caaatggaggtgggacctga

SEQ ID NO: 284716 - DNA, 20 bp, Artificial
  CRISPR gRNA sequence
accctatattggcaaaggag

SEQ ID NO: 284717 - DNA, 20 bp, Artificial
  CRISPR gRNA sequence
agctgaattatgagagaact

SEQ ID NO: 284718 - DNA, 20 bp, Artificial
  CRISPR gRNA sequence
caagcattcagtggaaatga

SEQ ID NO: 284719 - DNA, 20 bp, Artificial
  CRISPR gRNA sequence
aagatgaaatagtgtttttg

SEQ ID NO: 284720 - DNA, 20 bp, Artificial
  CRISPR gRNA sequence
taagaaggtgaggtagtggg

SEQ ID NO: 284721 - DNA, 20 bp, Artificial
  CRISPR gRNA sequence
cagtgcacagaacagcactc

SEQ ID NO: 284722 - DNA, 20 bp, Artificial
  CRISPR gRNA sequence
aacatgagaagcgaataggc

SEQ ID NO: 284723 - DNA, 20 bp, Artificial
  CRISPR gRNA sequence
gaatcattagcaacatctgg

SEQ ID NO: 284724 - DNA, 20 bp, Artificial
  CRISPR gRNA sequence
cttcatgctgaagttttatt

SEQ ID NO: 284725 - DNA, 20 bp, Artificial
  CRISPR gRNA sequence
tgccagcatctccacctgat

SEQ ID NO: 284726 - DNA, 20 bp, Artificial
  CRISPR gRNA sequence
gttggtttttcttttttctc

SEQ ID NO: 284727 - DNA, 20 bp, Artificial
  CRISPR gRNA sequence
ctccttccagtttatcaagg

SEQ ID NO: 284728 - DNA, 20 bp, Artificial
  CRISPR gRNA sequence
ctcacgagatctgatagttt

SEQ ID NO: 284729 - DNA, 20 bp, Artificial
  CRISPR gRNA sequence
agctctccagccacaaagac

SEQ ID NO: 284730 - DNA, 20 bp, Artificial
  CRISPR gRNA sequence
tgtttcttactatacagtca

SEQ ID NO: 284731 - DNA, 20 bp, Artificial
  CRISPR gRNA sequence
ttcaataatactattgttac

SEQ ID NO: 284732 - DNA, 20 bp, Artificial
  CRISPR gRNA sequence
cacatgtcatttgtatatct

SEQ ID NO: 284733 - DNA, 20 bp, Artificial
  CRISPR gRNA sequence
ttgtatatctaaaaacacta

SEQ ID NO: 284734 - DNA, 20 bp, Artificial
  CRISPR gRNA sequence
ccaggagaggtgaggctctg

SEQ ID NO: 284735 - DNA, 20 bp, Artificial
  CRISPR gRNA sequence
gaccagcctggctaacatgg

SEQ ID NO: 284736 - DNA, 20 bp, Artificial
  CRISPR gRNA sequence
aaagagcaaggcttcatctc

SEQ ID NO: 284737 - DNA, 20 bp, Artificial
  CRISPR gRNA sequence
aggcttcatctcaaaaacaa

SEQ ID NO: 284738 - DNA, 20 bp, Artificial
  CRISPR gRNA sequence
tcatctcaaaaacaacaaaa

SEQ ID NO: 284739 - DNA, 20 bp, Artificial
  CRISPR gRNA sequence
ctaaactatagcgaacgcct

SEQ ID NO: 284740 - DNA, 20 bp, Artificial
  CRISPR gRNA sequence
ccaccatccaacttgagacc

SEQ ID NO: 284741 - DNA, 20 bp, Artificial
  CRISPR gRNA sequence
agggtctagatggggagaga

SEQ ID NO: 284742 - DNA, 20 bp, Artificial
  CRISPR gRNA sequence
accaacaccccataccccaa

SEQ ID NO: 284743 - DNA, 20 bp, Artificial
  CRISPR gRNA sequence
tctttattttaggtgagaag

SEQ ID NO: 284744 - DNA, 20 bp, Artificial
  CRISPR gRNA sequence
aaaagtagtcttttactcag

SEQ ID NO: 284745 - DNA, 20 bp, Artificial
  CRISPR gRNA sequence
tggtcatcaaaagcaggttt

SEQ ID NO: 284746 - DNA, 20 bp, Artificial
  CRISPR gRNA sequence
taactaggaataataaatcc

SEQ ID NO: 284747 - DNA, 20 bp, Artificial
  CRISPR gRNA sequence
ttattctatccaagagcaga

SEQ ID NO: 284748 - DNA, 20 bp, Artificial
  CRISPR gRNA sequence
aaagattcatagctaatgat

SEQ ID NO: 284749 - DNA, 20 bp, Artificial
  CRISPR gRNA sequence
cgacccacctagttatcctt

SEQ ID NO: 284750 - DNA, 20 bp, Artificial
  CRISPR gRNA sequence
gagactgatttgagtaatga

SEQ ID NO: 284751 - DNA, 20 bp, Artificial
  CRISPR gRNA sequence
attttttaaaaattgtggta

SEQ ID NO: 284752 - DNA, 20 bp, Artificial
  CRISPR gRNA sequence
cccagcctgggcaacaagag

SEQ ID NO: 284753 - DNA, 20 bp, Artificial
  CRISPR gRNA sequence
ttttggaagtcactatctag

SEQ ID NO: 284754 - DNA, 20 bp, Artificial
  CRISPR gRNA sequence
aaactaaatgtgattgcata

SEQ ID NO: 284755 - DNA, 20 bp, Artificial
  CRISPR gRNA sequence
taaaaaacaaatttggtttt

SEQ ID NO: 284756 - DNA, 20 bp, Artificial
  CRISPR gRNA sequence
tcagtggcgtggcacaggaa

SEQ ID NO: 284757 - DNA, 20 bp, Artificial
  CRISPR gRNA sequence
tctagcttctacatgcatta

SEQ ID NO: 284758 - DNA, 20 bp, Artificial
  CRISPR gRNA sequence
gattccaccacacagagaca

SEQ ID NO: 284759 - DNA, 20 bp, Artificial
  CRISPR gRNA sequence
ggcttcaggttccatctctg

SEQ ID NO: 284760 - DNA, 20 bp, Artificial
  CRISPR gRNA sequence
accagcctaggcaacatagc

SEQ ID NO: 284761 - DNA, 20 bp, Artificial
  CRISPR gRNA sequence
tcacaacattgcaaatatac

SEQ ID NO: 284762 - DNA, 20 bp, Artificial
  CRISPR gRNA sequence
cctggctgaattgtatactt

SEQ ID NO: 284763 - DNA, 20 bp, Artificial
  CRISPR gRNA sequence
gaattttatgtcattgcaaa

SEQ ID NO: 284764 - DNA, 20 bp, Artificial
  CRISPR gRNA sequence
ctaagcagaaacagcattta

SEQ ID NO: 284765 - DNA, 20 bp, Artificial
  CRISPR gRNA sequence
tgctagaaactgcaatttag

SEQ ID NO: 284766 - DNA, 20 bp, Artificial
  CRISPR gRNA sequence
tgactcagtcacagcagcag

SEQ ID NO: 284767 - DNA, 20 bp, Artificial
  CRISPR gRNA sequence
caacaaacatgagcatctcc

SEQ ID NO: 284768 - DNA, 20 bp, Artificial
  CRISPR gRNA sequence
gggcagccacagtgactgtg

SEQ ID NO: 284769 - DNA, 20 bp, Artificial
  CRISPR gRNA sequence
gaccagcctggccaacatgg

SEQ ID NO: 284770 - DNA, 20 bp, Artificial
  CRISPR gRNA sequence
aggcagagtaggaaggaggc

SEQ ID NO: 284771 - DNA, 20 bp, Artificial
  CRISPR gRNA sequence
ccggaattaaatttccaaca

SEQ ID NO: 284772 - DNA, 20 bp, Artificial
  CRISPR gRNA sequence
tccgtgtgtgatggagtccc

SEQ ID NO: 284773 - DNA, 20 bp, Artificial
  CRISPR gRNA sequence
gatggagtccctaaaacaga

SEQ ID NO: 284774 - DNA, 20 bp, Artificial
  CRISPR gRNA sequence
tctctgtgtggtggaatccc

SEQ ID NO: 284775 - DNA, 20 bp, Artificial
  CRISPR gRNA sequence
ttctcctcagaaggctggac

SEQ ID NO: 284776 - DNA, 20 bp, Artificial
  CRISPR gRNA sequence
tatgcaaatacccaccatca

SEQ ID NO: 284777 - DNA, 20 bp, Artificial
  CRISPR gRNA sequence
atgaacagaatattttaaat

SEQ ID NO: 284778 - DNA, 20 bp, Artificial
  CRISPR gRNA sequence
ttaacttactgactgtggcc

SEQ ID NO: 284779 - DNA, 20 bp, Artificial
  CRISPR gRNA sequence
gccagaaagaaaaaaatgtg

SEQ ID NO: 284780 - DNA, 20 bp, Artificial
  CRISPR gRNA sequence
gacttcaacataaagcaaag

SEQ ID NO: 284781 - DNA, 20 bp, Artificial
  CRISPR gRNA sequence
tgatttgtcttcattgtttt

SEQ ID NO: 284782 - DNA, 20 bp, Artificial
  CRISPR gRNA sequence
tttttctagatagtgacttc

SEQ ID NO: 284783 - DNA, 20 bp, Artificial
  CRISPR gRNA sequence
ttgcgggtgcaactgctata

SEQ ID NO: 284784 - DNA, 20 bp, Artificial
  CRISPR gRNA sequence
tccgtccctactaaaaatac

SEQ ID NO: 284785 - DNA, 20 bp, Artificial
  CRISPR gRNA sequence
ttaattcctgccacaaggaa

SEQ ID NO: 284786 - DNA, 20 bp, Artificial
  CRISPR gRNA sequence
ctgggacttgagcctctagt

SEQ ID NO: 284787 - DNA, 20 bp, Artificial
  CRISPR gRNA sequence
aaaccaaacttcttacttaa

SEQ ID NO: 284788 - DNA, 20 bp, Artificial
  CRISPR gRNA sequence
gggcacaagatttttggtgc

SEQ ID NO: 284789 - DNA, 20 bp, Artificial
  CRISPR gRNA sequence
taatatcagcatagccatat

SEQ ID NO: 284790 - DNA, 20 bp, Artificial
  CRISPR gRNA sequence
ggttaatggatttttcctcc

SEQ ID NO: 284791 - DNA, 20 bp, Artificial
  CRISPR gRNA sequence
tattattcctagttataaca

SEQ ID NO: 284792 - DNA, 20 bp, Artificial
  CRISPR gRNA sequence
tcacaaggcagaactggttt

SEQ ID NO: 284793 - DNA, 20 bp, Artificial
  CRISPR gRNA sequence
aggcatatcaaaatagtaag

SEQ ID NO: 284794 - DNA, 20 bp, Artificial
  CRISPR gRNA sequence
tttcaatgatattttcaaat

SEQ ID NO: 284795 - DNA, 20 bp, Artificial
  CRISPR gRNA sequence
tgaggacagaataaagaggg

SEQ ID NO: 284796 - DNA, 20 bp, Artificial
  CRISPR gRNA sequence
ttctaaaatttatatatact

SEQ ID NO: 284797 - DNA, 20 bp, Artificial
  CRISPR gRNA sequence
atcatttgaaaatatacaat

SEQ ID NO: 284798 - DNA, 20 bp, Artificial
  CRISPR gRNA sequence
tgtgactgtatagtaagaaa

SEQ ID NO: 284799 - DNA, 20 bp, Artificial
  CRISPR gRNA sequence
cattattctgattgaaggca

SEQ ID NO: 284800 - DNA, 20 bp, Artificial
  CRISPR gRNA sequence
agccacaaaatttcattttt

SEQ ID NO: 284801 - DNA, 20 bp, Artificial
  CRISPR gRNA sequence
tggtgttttagagaaaaaag

SEQ ID NO: 284802 - DNA, 20 bp, Artificial
  CRISPR gRNA sequence
gaggaagaaaagccttcaga

SEQ ID NO: 284803 - DNA, 20 bp, Artificial
  CRISPR gRNA sequence
aagtccaataagcaaaagaa

SEQ ID NO: 284804 - DNA, 20 bp, Artificial
  CRISPR gRNA sequence
taaataaataaataaataaa

SEQ ID NO: 284805 - DNA, 20 bp, Artificial
  CRISPR gRNA sequence
ggtttggtaatcagaaaagt

SEQ ID NO: 284806 - DNA, 20 bp, Artificial
  CRISPR gRNA sequence
gagctggaaagccctggcac

SEQ ID NO: 284807 - DNA, 20 bp, Artificial
  CRISPR gRNA sequence
catttcttttatgttttaaa

SEQ ID NO: 284808 - DNA, 20 bp, Artificial
  CRISPR gRNA sequence
tcagcatgaagaaaaaaagt

SEQ ID NO: 284809 - DNA, 20 bp, Artificial
  CRISPR gRNA sequence
tttccagtagctagagggtg

SEQ ID NO: 284810 - DNA, 20 bp, Artificial
  CRISPR gRNA sequence
tggggtttgctaactaattt

SEQ ID NO: 284811 - DNA, 20 bp, Artificial
  CRISPR gRNA sequence
gacagagtgagactccatct

SEQ ID NO: 284812 - DNA, 20 bp, Artificial
  CRISPR gRNA sequence
ttcccaggctttagcaccaa

SEQ ID NO: 284813 - DNA, 20 bp, Artificial
  CRISPR gRNA sequence
acccactacctcaccttctt

SEQ ID NO: 284814 - DNA, 20 bp, Artificial
  CRISPR gRNA sequence
gtcatgtcattttcccactc

SEQ ID NO: 284815 - DNA, 20 bp, Artificial
  CRISPR gRNA sequence
tatacaacaggttgttttgc

SEQ ID NO: 284816 - DNA, 20 bp, Artificial
  CRISPR gRNA sequence
acggtcatacagatgaagaa

SEQ ID NO: 284817 - DNA, 20 bp, Artificial
  CRISPR gRNA sequence
cagcagaaaggagaactatc

SEQ ID NO: 284818 - DNA, 20 bp, Artificial
  CRISPR gRNA sequence
ttactcatgactcctttctc

SEQ ID NO: 284819 - DNA, 20 bp, Artificial
  CRISPR gRNA sequence
tcacaaaccttgctcctgtg

SEQ ID NO: 284820 - DNA, 20 bp, Artificial
  CRISPR gRNA sequence
acaaatttaagtgctggtac

SEQ ID NO: 284821 - DNA, 20 bp, Artificial
  CRISPR gRNA sequence
aagtgctggtacctgtggtg

SEQ ID NO: 284822 - DNA, 20 bp, Artificial
  CRISPR gRNA sequence
agtgctggtacctgtggtgg

SEQ ID NO: 284823 - DNA, 20 bp, Artificial
  CRISPR gRNA sequence
gtacctgtggtggcagtggc

SEQ ID NO: 284824 - DNA, 20 bp, Artificial
  CRISPR gRNA sequence
tggtggcagtggcttgctct

SEQ ID NO: 284825 - DNA, 20 bp, Artificial
  CRISPR gRNA sequence
gctcttgtctttttcttttc

SEQ ID NO: 284826 - DNA, 20 bp, Artificial
  CRISPR gRNA sequence
ctcttgtctttttcttttct

SEQ ID NO: 284827 - DNA, 20 bp, Artificial
  CRISPR gRNA sequence
ttgtctttttcttttctttt

SEQ ID NO: 284828 - DNA, 20 bp, Artificial
  CRISPR gRNA sequence
gtctttttcttttcttttta

SEQ ID NO: 284829 - DNA, 20 bp, Artificial
  CRISPR gRNA sequence
tctttttcttttctttttaa

SEQ ID NO: 284830 - DNA, 20 bp, Artificial
  CRISPR gRNA sequence
tttcttttctttttaactaa

SEQ ID NO: 284831 - DNA, 20 bp, Artificial
  CRISPR gRNA sequence
ttcttttctttttaactaag

SEQ ID NO: 284832 - DNA, 20 bp, Artificial
  CRISPR gRNA sequence
tcttttctttttaactaaga

SEQ ID NO: 284833 - DNA, 20 bp, Artificial
  CRISPR gRNA sequence
cttttctttttaactaagaa

SEQ ID NO: 284834 - DNA, 20 bp, Artificial
  CRISPR gRNA sequence
ttttctttttaactaagaat

SEQ ID NO: 284835 - DNA, 20 bp, Artificial
  CRISPR gRNA sequence
ttctttttaactaagaatgg

SEQ ID NO: 284836 - DNA, 20 bp, Artificial
  CRISPR gRNA sequence
tctttttaactaagaatggg

SEQ ID NO: 284837 - DNA, 20 bp, Artificial
  CRISPR gRNA sequence
ctttttaactaagaatgggg

SEQ ID NO: 284838 - DNA, 20 bp, Artificial
  CRISPR gRNA sequence
tttttaactaagaatggggc

SEQ ID NO: 284839 - DNA, 20 bp, Artificial
  CRISPR gRNA sequence
tttaactaagaatggggctg

SEQ ID NO: 284840 - DNA, 20 bp, Artificial
  CRISPR gRNA sequence
ttaactaagaatggggctgt

SEQ ID NO: 284841 - DNA, 20 bp, Artificial
  CRISPR gRNA sequence
taactaagaatggggctgtt

SEQ ID NO: 284842 - DNA, 20 bp, Artificial
  CRISPR gRNA sequence
aactaagaatggggctgttg

SEQ ID NO: 284843 - DNA, 20 bp, Artificial
  CRISPR gRNA sequence
actaagaatggggctgttgt

SEQ ID NO: 284844 - DNA, 20 bp, Artificial
  CRISPR gRNA sequence
agaatggggctgttgtactc

SEQ ID NO: 284845 - DNA, 20 bp, Artificial
  CRISPR gRNA sequence
ttgtactctcactttactta

SEQ ID NO: 284846 - DNA, 20 bp, Artificial
  CRISPR gRNA sequence
tactctcactttacttatcc

SEQ ID NO: 284847 - DNA, 20 bp, Artificial
  CRISPR gRNA sequence
tcactttacttatccttaaa

SEQ ID NO: 284848 - DNA, 20 bp, Artificial
  CRISPR gRNA sequence
actttacttatccttaaatt

SEQ ID NO: 284849 - DNA, 20 bp, Artificial
  CRISPR gRNA sequence
tacttatccttaaatttaaa

SEQ ID NO: 284850 - DNA, 20 bp, Artificial
  CRISPR gRNA sequence
acttatccttaaatttaaat

SEQ ID NO: 284851 - DNA, 20 bp, Artificial
  CRISPR gRNA sequence
cttatccttaaatttaaata

SEQ ID NO: 284852 - DNA, 20 bp, Artificial
  CRISPR gRNA sequence
atccttaaatttaaatacat

SEQ ID NO: 284853 - DNA, 20 bp, Artificial
  CRISPR gRNA sequence
tccttaaatttaaatacata

SEQ ID NO: 284854 - DNA, 20 bp, Artificial
  CRISPR gRNA sequence
aaatttaaatacatacttat

SEQ ID NO: 284855 - DNA, 20 bp, Artificial
  CRISPR gRNA sequence
aatttaaatacatacttatg

SEQ ID NO: 284856 - DNA, 20 bp, Artificial
  CRISPR gRNA sequence
aaatacatacttatgtttgt

SEQ ID NO: 284857 - DNA, 20 bp, Artificial
  CRISPR gRNA sequence
aatacatacttatgtttgta

SEQ ID NO: 284858 - DNA, 20 bp, Artificial
  CRISPR gRNA sequence
atgtttgtattaatctatca

SEQ ID NO: 284859 - DNA, 20 bp, Artificial
  CRISPR gRNA sequence
tgtttgtattaatctatcaa

SEQ ID NO: 284860 - DNA, 20 bp, Artificial
  CRISPR gRNA sequence
gtattaatctatcaatatat

SEQ ID NO: 284861 - DNA, 20 bp, Artificial
  CRISPR gRNA sequence
tattaatctatcaatatatg

SEQ ID NO: 284862 - DNA, 20 bp, Artificial
  CRISPR gRNA sequence
atctatcaatatatgcatac

SEQ ID NO: 284863 - DNA, 20 bp, Artificial
  CRISPR gRNA sequence
tcaatatatgcatacatgaa

SEQ ID NO: 284864 - DNA, 20 bp, Artificial
  CRISPR gRNA sequence
gattttaagcagtaaataaa

SEQ ID NO: 284865 - DNA, 20 bp, Artificial
  CRISPR gRNA sequence
taagcagtaaataaaacatt

SEQ ID NO: 284866 - DNA, 20 bp, Artificial
  CRISPR gRNA sequence
aagcagtaaataaaacattt

SEQ ID NO: 284867 - DNA, 20 bp, Artificial
  CRISPR gRNA sequence
agcagtaaataaaacatttc

SEQ ID NO: 284868 - DNA, 20 bp, Artificial
  CRISPR gRNA sequence
cgcaaaagattaaagttgaa

SEQ ID NO: 284869 - DNA, 20 bp, Artificial
  CRISPR gRNA sequence
gcaaaagattaaagttgaat

SEQ ID NO: 284870 - DNA, 20 bp, Artificial
  CRISPR gRNA sequence
aagttgaattttacagttcg

SEQ ID NO: 284871 - DNA, 20 bp, Artificial
  CRISPR gRNA sequence
aattttacagttcgtatatt

SEQ ID NO: 284872 - DNA, 20 bp, Artificial
  CRISPR gRNA sequence
tacagttcgtatattcatgt

SEQ ID NO: 284873 - DNA, 20 bp, Artificial
  CRISPR gRNA sequence
acagttcgtatattcatgtg

SEQ ID NO: 284874 - DNA, 20 bp, Artificial
  CRISPR gRNA sequence
cagttcgtatattcatgtgg

SEQ ID NO: 284875 - DNA, 20 bp, Artificial
  CRISPR gRNA sequence
gtatattcatgtggtccttt

SEQ ID NO: 284876 - DNA, 20 bp, Artificial
  CRISPR gRNA sequence
atgtggtcctttgaaagggt

SEQ ID NO: 284877 - DNA, 20 bp, Artificial
  CRISPR gRNA sequence
tgaaagggtattctagaaat

SEQ ID NO: 284878 - DNA, 20 bp, Artificial
  CRISPR gRNA sequence
gaaagggtattctagaaatc

SEQ ID NO: 284879 - DNA, 20 bp, Artificial
  CRISPR gRNA sequence
aaagggtattctagaaatca

SEQ ID NO: 284880 - DNA, 20 bp, Artificial
  CRISPR gRNA sequence
tagaaatcactggaaagagg

SEQ ID NO: 284881 - DNA, 20 bp, Artificial
  CRISPR gRNA sequence
gaaatcactggaaagaggag

SEQ ID NO: 284882 - DNA, 20 bp, Artificial
  CRISPR gRNA sequence
gaaagaggagaggaaagaac

SEQ ID NO: 284883 - DNA, 20 bp, Artificial
  CRISPR gRNA sequence
tgaaacccttgggtcctgga

SEQ ID NO: 284884 - DNA, 20 bp, Artificial
  CRISPR gRNA sequence
gggtcctggaagcagtgtga

SEQ ID NO: 284885 - DNA, 20 bp, Artificial
  CRISPR gRNA sequence
ggtcctggaagcagtgtgag

SEQ ID NO: 284886 - DNA, 20 bp, Artificial
  CRISPR gRNA sequence
gaagcagtgtgagtgtaaat

SEQ ID NO: 284887 - DNA, 20 bp, Artificial
  CRISPR gRNA sequence
ggtttcatctaaataaacaa

SEQ ID NO: 284888 - DNA, 20 bp, Artificial
  CRISPR gRNA sequence
gtttcatctaaataaacaaa

SEQ ID NO: 284889 - DNA, 20 bp, Artificial
  CRISPR gRNA sequence
catctaaataaacaaagatg

SEQ ID NO: 284890 - DNA, 20 bp, Artificial
  CRISPR gRNA sequence
atctaaataaacaaagatga

SEQ ID NO: 284891 - DNA, 20 bp, Artificial
  CRISPR gRNA sequence
aataaacaaagatgatttct

SEQ ID NO: 284892 - DNA, 20 bp, Artificial
  CRISPR gRNA sequence
ctttgacacttgaaataaaa

SEQ ID NO: 284893 - DNA, 20 bp, Artificial
  CRISPR gRNA sequence
tttgacacttgaaataaaat

SEQ ID NO: 284894 - DNA, 20 bp, Artificial
  CRISPR gRNA sequence
tgacacttgaaataaaatac

SEQ ID NO: 284895 - DNA, 20 bp, Artificial
  CRISPR gRNA sequence
gacacttgaaataaaataca

SEQ ID NO: 284896 - DNA, 20 bp, Artificial
  CRISPR gRNA sequence
acacttgaaataaaatacaa

SEQ ID NO: 284897 - DNA, 20 bp, Artificial
  CRISPR gRNA sequence
gaaataaaatacaaattcaa

SEQ ID NO: 284898 - DNA, 20 bp, Artificial
  CRISPR gRNA sequence
aaataaaatacaaattcaac

SEQ ID NO: 284899 - DNA, 20 bp, Artificial
  CRISPR gRNA sequence
aacaaaaagtagatcagcat

SEQ ID NO: 284900 - DNA, 20 bp, Artificial
  CRISPR gRNA sequence
ttaaagaaacggttcaactt

SEQ ID NO: 284901 - DNA, 20 bp, Artificial
  CRISPR gRNA sequence
aagaaacggttcaactttgt

SEQ ID NO: 284902 - DNA, 20 bp, Artificial
  CRISPR gRNA sequence
aactttgtttcttcccttag

SEQ ID NO: 284903 - DNA, 20 bp, Artificial
  CRISPR gRNA sequence
tgtttcttcccttagtattg

SEQ ID NO: 284904 - DNA, 20 bp, Artificial
  CRISPR gRNA sequence
gtttcttcccttagtattgc

SEQ ID NO: 284905 - DNA, 20 bp, Artificial
  CRISPR gRNA sequence
tttcttcccttagtattgct

SEQ ID NO: 284906 - DNA, 20 bp, Artificial
  CRISPR gRNA sequence
cttcccttagtattgctgac

SEQ ID NO: 284907 - DNA, 20 bp, Artificial
  CRISPR gRNA sequence
ttcccttagtattgctgaca

SEQ ID NO: 284908 - DNA, 20 bp, Artificial
  CRISPR gRNA sequence
cccttagtattgctgacaaa

SEQ ID NO: 284909 - DNA, 20 bp, Artificial
  CRISPR gRNA sequence
ccttagtattgctgacaaag

SEQ ID NO: 284910 - DNA, 20 bp, Artificial
  CRISPR gRNA sequence
agtattgctgacaaagtatc

SEQ ID NO: 284911 - DNA, 20 bp, Artificial
  CRISPR gRNA sequence
gtattgctgacaaagtatct

SEQ ID NO: 284912 - DNA, 20 bp, Artificial
  CRISPR gRNA sequence
ctgacaaagtatctgctgta

SEQ ID NO: 284913 - DNA, 20 bp, Artificial
  CRISPR gRNA sequence
acaaagtatctgctgtagaa

SEQ ID NO: 284914 - DNA, 20 bp, Artificial
  CRISPR gRNA sequence
ctgtagaatacaggaattac

SEQ ID NO: 284915 - DNA, 20 bp, Artificial
  CRISPR gRNA sequence
tagaatacaggaattactta

SEQ ID NO: 284916 - DNA, 20 bp, Artificial
  CRISPR gRNA sequence
cttagaatagaaacatagtc

SEQ ID NO: 284917 - DNA, 20 bp, Artificial
  CRISPR gRNA sequence
agaatagaaacatagtcatc

SEQ ID NO: 284918 - DNA, 20 bp, Artificial
  CRISPR gRNA sequence
gaatagaaacatagtcatca

SEQ ID NO: 284919 - DNA, 20 bp, Artificial
  CRISPR gRNA sequence
ttactaaatggaaaagaaaa

SEQ ID NO: 284920 - DNA, 20 bp, Artificial
  CRISPR gRNA sequence
ctaaatggaaaagaaaagaa

SEQ ID NO: 284921 - DNA, 20 bp, Artificial
  CRISPR gRNA sequence
aatggaaaagaaaagaatta

SEQ ID NO: 284922 - DNA, 20 bp, Artificial
  CRISPR gRNA sequence
ttgagttaagtattcctgtc

SEQ ID NO: 284923 - DNA, 20 bp, Artificial
  CRISPR gRNA sequence
agttaagtattcctgtcaat

SEQ ID NO: 284924 - DNA, 20 bp, Artificial
  CRISPR gRNA sequence
agtattcctgtcaatacggg

SEQ ID NO: 284925 - DNA, 20 bp, Artificial
  CRISPR gRNA sequence
ctgtcaatacgggaaacact

SEQ ID NO: 284926 - DNA, 20 bp, Artificial
  CRISPR gRNA sequence
tcaatacgggaaacactgct

SEQ ID NO: 284927 - DNA, 20 bp, Artificial
  CRISPR gRNA sequence
ctagtaccttatgttggtgt

SEQ ID NO: 284928 - DNA, 20 bp, Artificial
  CRISPR gRNA sequence
gtaccttatgttggtgttag

SEQ ID NO: 284929 - DNA, 20 bp, Artificial
  CRISPR gRNA sequence
atgttggtgttagacctctc

SEQ ID NO: 284930 - DNA, 20 bp, Artificial
  CRISPR gRNA sequence
tgttggtgttagacctctct

SEQ ID NO: 284931 - DNA, 20 bp, Artificial
  CRISPR gRNA sequence
gtgttagacctctctgccct

SEQ ID NO: 284932 - DNA, 20 bp, Artificial
  CRISPR gRNA sequence
gacctctctgccctacactg

SEQ ID NO: 284933 - DNA, 20 bp, Artificial
  CRISPR gRNA sequence
tctgccctacactgagaata

SEQ ID NO: 284934 - DNA, 20 bp, Artificial
  CRISPR gRNA sequence
tgccctacactgagaatata

SEQ ID NO: 284935 - DNA, 20 bp, Artificial
  CRISPR gRNA sequence
ccctacactgagaatatagt

SEQ ID NO: 284936 - DNA, 20 bp, Artificial
  CRISPR gRNA sequence
cactgagaatatagttttac

SEQ ID NO: 284937 - DNA, 20 bp, Artificial
  CRISPR gRNA sequence
agaatatagttttacacagg

SEQ ID NO: 284938 - DNA, 20 bp, Artificial
  CRISPR gRNA sequence
tacacaggagcaaggtttgt

SEQ ID NO: 284939 - DNA, 20 bp, Artificial
  CRISPR gRNA sequence
acacaggagcaaggtttgtg

SEQ ID NO: 284940 - DNA, 20 bp, Artificial
  CRISPR gRNA sequence
cacaggagcaaggtttgtga

SEQ ID NO: 284941 - DNA, 20 bp, Artificial
  CRISPR gRNA sequence
gtgaagcagcatagtgaggt

SEQ ID NO: 284942 - DNA, 20 bp, Artificial
  CRISPR gRNA sequence
tgaagcagcatagtgaggta

SEQ ID NO: 284943 - DNA, 20 bp, Artificial
  CRISPR gRNA sequence
aagccatgggctggctctaa

SEQ ID NO: 284944 - DNA, 20 bp, Artificial
  CRISPR gRNA sequence
gctctaaaggctttaaatcc

SEQ ID NO: 284945 - DNA, 20 bp, Artificial
  CRISPR gRNA sequence
taaaggctttaaatcccagc

SEQ ID NO: 284946 - DNA, 20 bp, Artificial
  CRISPR gRNA sequence
aaggctttaaatcccagcca

SEQ ID NO: 284947 - DNA, 20 bp, Artificial
  CRISPR gRNA sequence
taaatcccagccatgtggct

SEQ ID NO: 284948 - DNA, 20 bp, Artificial
  CRISPR gRNA sequence
aaatcccagccatgtggctt

SEQ ID NO: 284949 - DNA, 20 bp, Artificial
  CRISPR gRNA sequence
aatcccagccatgtggctta

SEQ ID NO: 284950 - DNA, 20 bp, Artificial
  CRISPR gRNA sequence
agctgccatgagatgtgcat

SEQ ID NO: 284951 - DNA, 20 bp, Artificial
  CRISPR gRNA sequence
gctgccatgagatgtgcatt

SEQ ID NO: 284952 - DNA, 20 bp, Artificial
  CRISPR gRNA sequence
ccatgagatgtgcatttgag

SEQ ID NO: 284953 - DNA, 20 bp, Artificial
  CRISPR gRNA sequence
gagaaatgttgtcttctttt

SEQ ID NO: 284954 - DNA, 20 bp, Artificial
  CRISPR gRNA sequence
agaaatgttgtcttcttttg

SEQ ID NO: 284955 - DNA, 20 bp, Artificial
  CRISPR gRNA sequence
tcttcttttgctgttcaact

SEQ ID NO: 284956 - DNA, 20 bp, Artificial
  CRISPR gRNA sequence
cttttgctgttcaactccag

SEQ ID NO: 284957 - DNA, 20 bp, Artificial
  CRISPR gRNA sequence
ttttgctgttcaactccaga

SEQ ID NO: 284958 - DNA, 20 bp, Artificial
  CRISPR gRNA sequence
ttgctgttcaactccagatt

SEQ ID NO: 284959 - DNA, 20 bp, Artificial
  CRISPR gRNA sequence
tgctgttcaactccagattt

SEQ ID NO: 284960 - DNA, 20 bp, Artificial
  CRISPR gRNA sequence
gctgttcaactccagatttt

SEQ ID NO: 284961 - DNA, 20 bp, Artificial
  CRISPR gRNA sequence
ctgttcaactccagattttc

SEQ ID NO: 284962 - DNA, 20 bp, Artificial
  CRISPR gRNA sequence
ttcaactccagattttcaga

SEQ ID NO: 284963 - DNA, 20 bp, Artificial
  CRISPR gRNA sequence
aactccagattttcagatga

SEQ ID NO: 284964 - DNA, 20 bp, Artificial
  CRISPR gRNA sequence
cagattttcagatgataatg

SEQ ID NO: 284965 - DNA, 20 bp, Artificial
  CRISPR gRNA sequence
tcagatgataatgtgattat

SEQ ID NO: 284966 - DNA, 20 bp, Artificial
  CRISPR gRNA sequence
cagatgataatgtgattatc

SEQ ID NO: 284967 - DNA, 20 bp, Artificial
  CRISPR gRNA sequence
agatgataatgtgattatcc

SEQ ID NO: 284968 - DNA, 20 bp, Artificial
  CRISPR gRNA sequence
tcccagcttaagttgcgtcc

SEQ ID NO: 284969 - DNA, 20 bp, Artificial
  CRISPR gRNA sequence
aagttgcgtccacttctggt

SEQ ID NO: 284970 - DNA, 20 bp, Artificial
  CRISPR gRNA sequence
agttgcgtccacttctggtc

SEQ ID NO: 284971 - DNA, 20 bp, Artificial
  CRISPR gRNA sequence
cgtccacttctggtctagtg

SEQ ID NO: 284972 - DNA, 20 bp, Artificial
  CRISPR gRNA sequence
ctggtctagtgaattgtgga

SEQ ID NO: 284973 - DNA, 20 bp, Artificial
  CRISPR gRNA sequence
tggtctagtgaattgtggaa

SEQ ID NO: 284974 - DNA, 20 bp, Artificial
  CRISPR gRNA sequence
gtctagtgaattgtggaagg

SEQ ID NO: 284975 - DNA, 20 bp, Artificial
  CRISPR gRNA sequence
gtgaattgtggaaggcagtt

SEQ ID NO: 284976 - DNA, 20 bp, Artificial
  CRISPR gRNA sequence
tggaaggcagttttagagaa

SEQ ID NO: 284977 - DNA, 20 bp, Artificial
  CRISPR gRNA sequence
tagagaaaggagtcatgagt

SEQ ID NO: 284978 - DNA, 20 bp, Artificial
  CRISPR gRNA sequence
agagaaaggagtcatgagta

SEQ ID NO: 284979 - DNA, 20 bp, Artificial
  CRISPR gRNA sequence
gagaaaggagtcatgagtaa

SEQ ID NO: 284980 - DNA, 20 bp, Artificial
  CRISPR gRNA sequence
gctatgtctttccagttctc

SEQ ID NO: 284981 - DNA, 20 bp, Artificial
  CRISPR gRNA sequence
tgtctttccagttctctgct

SEQ ID NO: 284982 - DNA, 20 bp, Artificial
  CRISPR gRNA sequence
tccagttctctgctgatgtc

SEQ ID NO: 284983 - DNA, 20 bp, Artificial
  CRISPR gRNA sequence
ccagttctctgctgatgtca

SEQ ID NO: 284984 - DNA, 20 bp, Artificial
  CRISPR gRNA sequence
cagttctctgctgatgtcag

SEQ ID NO: 284985 - DNA, 20 bp, Artificial
  CRISPR gRNA sequence
tctgctgatgtcagaaagac

SEQ ID NO: 284986 - DNA, 20 bp, Artificial
  CRISPR gRNA sequence
tgctgatgtcagaaagaccc

SEQ ID NO: 284987 - DNA, 20 bp, Artificial
  CRISPR gRNA sequence
ctgatgtcagaaagacccag

SEQ ID NO: 284988 - DNA, 20 bp, Artificial
  CRISPR gRNA sequence
atgtcagaaagacccagaaa

SEQ ID NO: 284989 - DNA, 20 bp, Artificial
  CRISPR gRNA sequence
agggatctaaggaggcccta

SEQ ID NO: 284990 - DNA, 20 bp, Artificial
  CRISPR gRNA sequence
gggatctaaggaggccctat

SEQ ID NO: 284991 - DNA, 20 bp, Artificial
  CRISPR gRNA sequence
aggaggccctatggaaagtt

SEQ ID NO: 284992 - DNA, 20 bp, Artificial
  CRISPR gRNA sequence
tggaaagttactaccttaga

SEQ ID NO: 284993 - DNA, 20 bp, Artificial
  CRISPR gRNA sequence
ctaccttagacatttgaaga

SEQ ID NO: 284994 - DNA, 20 bp, Artificial
  CRISPR gRNA sequence
ccttagacatttgaagatag

SEQ ID NO: 284995 - DNA, 20 bp, Artificial
  CRISPR gRNA sequence
agacatttgaagatagctta

SEQ ID NO: 284996 - DNA, 20 bp, Artificial
  CRISPR gRNA sequence
gacatttgaagatagcttac

SEQ ID NO: 284997 - DNA, 20 bp, Artificial
  CRISPR gRNA sequence
gaagatagcttactgcttag

SEQ ID NO: 284998 - DNA, 20 bp, Artificial
  CRISPR gRNA sequence
aagatagcttactgcttagt

SEQ ID NO: 284999 - DNA, 20 bp, Artificial
  CRISPR gRNA sequence
actgcttagtacatacactg

SEQ ID NO: 285000 - DNA, 20 bp, Artificial
  CRISPR gRNA sequence
ctgcttagtacatacactgt

SEQ ID NO: 285001 - DNA, 20 bp, Artificial
  CRISPR gRNA sequence
cttagtacatacactgtaaa

SEQ ID NO: 285002 - DNA, 20 bp, Artificial
  CRISPR gRNA sequence
agtacatacactgtaaacaa

SEQ ID NO: 285003 - DNA, 20 bp, Artificial
  CRISPR gRNA sequence
gtacatacactgtaaacaac

SEQ ID NO: 285004 - DNA, 20 bp, Artificial
  CRISPR gRNA sequence
taaacaacgatctcatttta

SEQ ID NO: 285005 - DNA, 20 bp, Artificial
  CRISPR gRNA sequence
attttaaatgagaactttct

SEQ ID NO: 285006 - DNA, 20 bp, Artificial
  CRISPR gRNA sequence
taaatgagaactttctcata

SEQ ID NO: 285007 - DNA, 20 bp, Artificial
  CRISPR gRNA sequence
aaatgagaactttctcataa

SEQ ID NO: 285008 - DNA, 20 bp, Artificial
  CRISPR gRNA sequence
aatgagaactttctcataaa

SEQ ID NO: 285009 - DNA, 20 bp, Artificial
  CRISPR gRNA sequence
tctcataaatattttacaaa

SEQ ID NO: 285010 - DNA, 20 bp, Artificial
  CRISPR gRNA sequence
ctcataaatattttacaaat

SEQ ID NO: 285011 - DNA, 20 bp, Artificial
  CRISPR gRNA sequence
tcataaatattttacaaatg

SEQ ID NO: 285012 - DNA, 20 bp, Artificial
  CRISPR gRNA sequence
ataaatattttacaaatgag

SEQ ID NO: 285013 - DNA, 20 bp, Artificial
  CRISPR gRNA sequence
tacaaatgaggtcaaactag

SEQ ID NO: 285014 - DNA, 20 bp, Artificial
  CRISPR gRNA sequence
acaaatgaggtcaaactagc

SEQ ID NO: 285015 - DNA, 20 bp, Artificial
  CRISPR gRNA sequence
caaatgaggtcaaactagca

SEQ ID NO: 285016 - DNA, 20 bp, Artificial
  CRISPR gRNA sequence
gcataaagccatttaaagag

SEQ ID NO: 285017 - DNA, 20 bp, Artificial
  CRISPR gRNA sequence
aaagagattatcagtccaat

SEQ ID NO: 285018 - DNA, 20 bp, Artificial
  CRISPR gRNA sequence
aagagattatcagtccaata

SEQ ID NO: 285019 - DNA, 20 bp, Artificial
  CRISPR gRNA sequence
tcagtccaatatgaaccagt

SEQ ID NO: 285020 - DNA, 20 bp, Artificial
  CRISPR gRNA sequence
agtctttggactatcccttt

SEQ ID NO: 285021 - DNA, 20 bp, Artificial
  CRISPR gRNA sequence
tggactatccctttcctcct

SEQ ID NO: 285022 - DNA, 20 bp, Artificial
  CRISPR gRNA sequence
ggactatccctttcctcctt

SEQ ID NO: 285023 - DNA, 20 bp, Artificial
  CRISPR gRNA sequence
gactatccctttcctccttg

SEQ ID NO: 285024 - DNA, 20 bp, Artificial
  CRISPR gRNA sequence
tccctttcctccttgactac

SEQ ID NO: 285025 - DNA, 20 bp, Artificial
  CRISPR gRNA sequence
tcctccttgactactgcttt

SEQ ID NO: 285026 - DNA, 20 bp, Artificial
  CRISPR gRNA sequence
cctccttgactactgctttg

SEQ ID NO: 285027 - DNA, 20 bp, Artificial
  CRISPR gRNA sequence
ctccttgactactgctttga

SEQ ID NO: 285028 - DNA, 20 bp, Artificial
  CRISPR gRNA sequence
cttgactactgctttgacgt

SEQ ID NO: 285029 - DNA, 20 bp, Artificial
  CRISPR gRNA sequence
gactactgctttgacgtacc

SEQ ID NO: 285030 - DNA, 20 bp, Artificial
  CRISPR gRNA sequence
actactgctttgacgtacct

SEQ ID NO: 285031 - DNA, 20 bp, Artificial
  CRISPR gRNA sequence
ctgctttgacgtacctaaat

SEQ ID NO: 285032 - DNA, 20 bp, Artificial
  CRISPR gRNA sequence
ctttgacgtacctaaatcat

SEQ ID NO: 285033 - DNA, 20 bp, Artificial
  CRISPR gRNA sequence
tgacgtacctaaatcattcg

SEQ ID NO: 285034 - DNA, 20 bp, Artificial
  CRISPR gRNA sequence
gacgtacctaaatcattcgt

SEQ ID NO: 285035 - DNA, 20 bp, Artificial
  CRISPR gRNA sequence
acgtacctaaatcattcgtc

SEQ ID NO: 285036 - DNA, 20 bp, Artificial
  CRISPR gRNA sequence
aatcattcgtcttacatgtc

SEQ ID NO: 285037 - DNA, 20 bp, Artificial
  CRISPR gRNA sequence
gtcttacatgtcagaggaaa

SEQ ID NO: 285038 - DNA, 20 bp, Artificial
  CRISPR gRNA sequence
acatgtcagaggaaattagt

SEQ ID NO: 285039 - DNA, 20 bp, Artificial
  CRISPR gRNA sequence
catgtcagaggaaattagtt

SEQ ID NO: 285040 - DNA, 20 bp, Artificial
  CRISPR gRNA sequence
gttttggatagttctccttt

SEQ ID NO: 285041 - DNA, 20 bp, Artificial
  CRISPR gRNA sequence
tggatagttctcctttctgc

SEQ ID NO: 285042 - DNA, 20 bp, Artificial
  CRISPR gRNA sequence
ggatagttctcctttctgct

SEQ ID NO: 285043 - DNA, 20 bp, Artificial
  CRISPR gRNA sequence
gatagttctcctttctgctg

SEQ ID NO: 285044 - DNA, 20 bp, Artificial
  CRISPR gRNA sequence
tcctttctgctgtacctcat

SEQ ID NO: 285045 - DNA, 20 bp, Artificial
  CRISPR gRNA sequence
ctttctgctgtacctcatgg

SEQ ID NO: 285046 - DNA, 20 bp, Artificial
  CRISPR gRNA sequence
tctgctgtacctcatggggg

SEQ ID NO: 285047 - DNA, 20 bp, Artificial
  CRISPR gRNA sequence
ctgctgtacctcatggggga

SEQ ID NO: 285048 - DNA, 20 bp, Artificial
  CRISPR gRNA sequence
tgctgtacctcatgggggag

SEQ ID NO: 285049 - DNA, 20 bp, Artificial
  CRISPR gRNA sequence
ctgtacctcatgggggagtg

SEQ ID NO: 285050 - DNA, 20 bp, Artificial
  CRISPR gRNA sequence
tacctcatgggggagtgaga

SEQ ID NO: 285051 - DNA, 20 bp, Artificial
  CRISPR gRNA sequence
atgggggagtgagagagcag

SEQ ID NO: 285052 - DNA, 20 bp, Artificial
  CRISPR gRNA sequence
ggtaaacaccaataatattt

SEQ ID NO: 285053 - DNA, 20 bp, Artificial
  CRISPR gRNA sequence
ccattagtctcctaaagatg

SEQ ID NO: 285054 - DNA, 20 bp, Artificial
  CRISPR gRNA sequence
cattagtctcctaaagatgt

SEQ ID NO: 285055 - DNA, 20 bp, Artificial
  CRISPR gRNA sequence
gtctcctaaagatgttcatg

SEQ ID NO: 285056 - DNA, 20 bp, Artificial
  CRISPR gRNA sequence
ctaaagatgttcatgccata

SEQ ID NO: 285057 - DNA, 20 bp, Artificial
  CRISPR gRNA sequence
aagatgttcatgccatactt

SEQ ID NO: 285058 - DNA, 20 bp, Artificial
  CRISPR gRNA sequence
atgccatacttcctatgcat

SEQ ID NO: 285059 - DNA, 20 bp, Artificial
  CRISPR gRNA sequence
cctatgcattacattgggct

SEQ ID NO: 285060 - DNA, 20 bp, Artificial
  CRISPR gRNA sequence
ctatgcattacattgggctt

SEQ ID NO: 285061 - DNA, 20 bp, Artificial
  CRISPR gRNA sequence
tgcattacattgggcttttg

SEQ ID NO: 285062 - DNA, 20 bp, Artificial
  CRISPR gRNA sequence
cattgggcttttgtaaacag

SEQ ID NO: 285063 - DNA, 20 bp, Artificial
  CRISPR gRNA sequence
ggcttttgtaaacagcagca

SEQ ID NO: 285064 - DNA, 20 bp, Artificial
  CRISPR gRNA sequence
ttgtaaacagcagcataaaa

SEQ ID NO: 285065 - DNA, 20 bp, Artificial
  CRISPR gRNA sequence
tgtaaacagcagcataaaat

SEQ ID NO: 285066 - DNA, 20 bp, Artificial
  CRISPR gRNA sequence
gtaaacagcagcataaaatc

SEQ ID NO: 285067 - DNA, 20 bp, Artificial
  CRISPR gRNA sequence
taaacagcagcataaaatct

SEQ ID NO: 285068 - DNA, 20 bp, Artificial
  CRISPR gRNA sequence
ctactctgacattaggaaat

SEQ ID NO: 285069 - DNA, 20 bp, Artificial
  CRISPR gRNA sequence
tactctgacattaggaaatc

SEQ ID NO: 285070 - DNA, 20 bp, Artificial
  CRISPR gRNA sequence
ctctgacattaggaaatcag

SEQ ID NO: 285071 - DNA, 20 bp, Artificial
  CRISPR gRNA sequence
tgacattaggaaatcagata

SEQ ID NO: 285072 - DNA, 20 bp, Artificial
  CRISPR gRNA sequence
acattaggaaatcagatagt

SEQ ID NO: 285073 - DNA, 20 bp, Artificial
  CRISPR gRNA sequence
ggaaatcagatagtctctga

SEQ ID NO: 285074 - DNA, 20 bp, Artificial
  CRISPR gRNA sequence
tgaagttgacctgttattgg

SEQ ID NO: 285075 - DNA, 20 bp, Artificial
  CRISPR gRNA sequence
aagttgacctgttattggac

SEQ ID NO: 285076 - DNA, 20 bp, Artificial
  CRISPR gRNA sequence
acctgttattggacaaattc

SEQ ID NO: 285077 - DNA, 20 bp, Artificial
  CRISPR gRNA sequence
ttattggacaaattctactt

SEQ ID NO: 285078 - DNA, 20 bp, Artificial
  CRISPR gRNA sequence
ttggacaaattctacttcca

SEQ ID NO: 285079 - DNA, 20 bp, Artificial
  CRISPR gRNA sequence
gacaaattctacttccagca

SEQ ID NO: 285080 - DNA, 20 bp, Artificial
  CRISPR gRNA sequence
tacttccagcagcactttgc

SEQ ID NO: 285081 - DNA, 20 bp, Artificial
  CRISPR gRNA sequence
cttccagcagcactttgcct

SEQ ID NO: 285082 - DNA, 20 bp, Artificial
  CRISPR gRNA sequence
ccagcagcactttgcctgac

SEQ ID NO: 285083 - DNA, 20 bp, Artificial
  CRISPR gRNA sequence
cagcagcactttgcctgaca

SEQ ID NO: 285084 - DNA, 20 bp, Artificial
  CRISPR gRNA sequence
tgcctgacatatatatgtat

SEQ ID NO: 285085 - DNA, 20 bp, Artificial
  CRISPR gRNA sequence
gcctgacatatatatgtata

SEQ ID NO: 285086 - DNA, 20 bp, Artificial
  CRISPR gRNA sequence
cctgacatatatatgtatat

SEQ ID NO: 285087 - DNA, 20 bp, Artificial
  CRISPR gRNA sequence
acatatatatgtatatacca

SEQ ID NO: 285088 - DNA, 20 bp, Artificial
  CRISPR gRNA sequence
acaggccacagtcaaactga

SEQ ID NO: 285089 - DNA, 20 bp, Artificial
  CRISPR gRNA sequence
ataaagggaaagagcaccag

SEQ ID NO: 285090 - DNA, 20 bp, Artificial
  CRISPR gRNA sequence
ggaaatctgggttctggcgc

SEQ ID NO: 285091 - DNA, 20 bp, Artificial
  CRISPR gRNA sequence
ggttctggcgctggccttta

SEQ ID NO: 285092 - DNA, 20 bp, Artificial
  CRISPR gRNA sequence
tggcgctggcctttataatt

SEQ ID NO: 285093 - DNA, 20 bp, Artificial
  CRISPR gRNA sequence
gcgctggcctttataattcg

SEQ ID NO: 285094 - DNA, 20 bp, Artificial
  CRISPR gRNA sequence
gcctttataattcgggtcac

SEQ ID NO: 285095 - DNA, 20 bp, Artificial
  CRISPR gRNA sequence
tataattcgggtcacctccc

SEQ ID NO: 285096 - DNA, 20 bp, Artificial
  CRISPR gRNA sequence
ataattcgggtcacctccct

SEQ ID NO: 285097 - DNA, 20 bp, Artificial
  CRISPR gRNA sequence
taattcgggtcacctccctg

SEQ ID NO: 285098 - DNA, 20 bp, Artificial
  CRISPR gRNA sequence
gggtcacctccctgggcctc

SEQ ID NO: 285099 - DNA, 20 bp, Artificial
  CRISPR gRNA sequence
cctgggcctcagtgcctttg

SEQ ID NO: 285100 - DNA, 20 bp, Artificial
  CRISPR gRNA sequence
ggcctcagtgcctttgtcat

SEQ ID NO: 285101 - DNA, 20 bp, Artificial
  CRISPR gRNA sequence
agtgcctttgtcattaataa

SEQ ID NO: 285102 - DNA, 20 bp, Artificial
  CRISPR gRNA sequence
tgtcattaataacactggta

SEQ ID NO: 285103 - DNA, 20 bp, Artificial
  CRISPR gRNA sequence
gtcattaataacactggtat

SEQ ID NO: 285104 - DNA, 20 bp, Artificial
  CRISPR gRNA sequence
tcattaataacactggtatt

SEQ ID NO: 285105 - DNA, 20 bp, Artificial
  CRISPR gRNA sequence
ataacactggtattctctaa

SEQ ID NO: 285106 - DNA, 20 bp, Artificial
  CRISPR gRNA sequence
gtattctctaaagtcccttc

SEQ ID NO: 285107 - DNA, 20 bp, Artificial
  CRISPR gRNA sequence
tctaaagtcccttccagaac

SEQ ID NO: 285108 - DNA, 20 bp, Artificial
  CRISPR gRNA sequence
taaagtcccttccagaactc

SEQ ID NO: 285109 - DNA, 20 bp, Artificial
  CRISPR gRNA sequence
aagtcccttccagaactcaa

SEQ ID NO: 285110 - DNA, 20 bp, Artificial
  CRISPR gRNA sequence
ccagaactcaagaattctgc

SEQ ID NO: 285111 - DNA, 20 bp, Artificial
  CRISPR gRNA sequence
cagaactcaagaattctgca

SEQ ID NO: 285112 - DNA, 20 bp, Artificial
  CRISPR gRNA sequence
aagaattctgcatttcaaaa

SEQ ID NO: 285113 - DNA, 20 bp, Artificial
  CRISPR gRNA sequence
tgcatttcaaaacaccttga

SEQ ID NO: 285114 - DNA, 20 bp, Artificial
  CRISPR gRNA sequence
catttcaaaacaccttgatc

SEQ ID NO: 285115 - DNA, 20 bp, Artificial
  CRISPR gRNA sequence
caaaacaccttgatcaaggt

SEQ ID NO: 285116 - DNA, 20 bp, Artificial
  CRISPR gRNA sequence
aaaacaccttgatcaaggtc

SEQ ID NO: 285117 - DNA, 20 bp, Artificial
  CRISPR gRNA sequence
gatcaaggtcaccagagcta

SEQ ID NO: 285118 - DNA, 20 bp, Artificial
  CRISPR gRNA sequence
atcaaggtcaccagagctac

SEQ ID NO: 285119 - DNA, 20 bp, Artificial
  CRISPR gRNA sequence
cttctgtgcccaccatattc

SEQ ID NO: 285120 - DNA, 20 bp, Artificial
  CRISPR gRNA sequence
ctgtgcccaccatattcctc

SEQ ID NO: 285121 - DNA, 20 bp, Artificial
  CRISPR gRNA sequence
tgtgcccaccatattcctct

SEQ ID NO: 285122 - DNA, 20 bp, Artificial
  CRISPR gRNA sequence
tgcccaccatattcctctag

SEQ ID NO: 285123 - DNA, 20 bp, Artificial
  CRISPR gRNA sequence
ctctagacacttcctgcaaa

SEQ ID NO: 285124 - DNA, 20 bp, Artificial
  CRISPR gRNA sequence
tagacacttcctgcaaagca

SEQ ID NO: 285125 - DNA, 20 bp, Artificial
  CRISPR gRNA sequence
gacacttcctgcaaagcaac

SEQ ID NO: 285126 - DNA, 20 bp, Artificial
  CRISPR gRNA sequence
cctgcaaagcaactgaagtg

SEQ ID NO: 285127 - DNA, 20 bp, Artificial
  CRISPR gRNA sequence
ctgcaaagcaactgaagtga

SEQ ID NO: 285128 - DNA, 20 bp, Artificial
  CRISPR gRNA sequence
caaagcaactgaagtgaaga

SEQ ID NO: 285129 - DNA, 20 bp, Artificial
  CRISPR gRNA sequence
aagtgaagaagcacctaaga

SEQ ID NO: 285130 - DNA, 20 bp, Artificial
  CRISPR gRNA sequence
agagcagatacgtaaagggc

SEQ ID NO: 285131 - DNA, 20 bp, Artificial
  CRISPR gRNA sequence
gtccatctgaggaagttccc

SEQ ID NO: 285132 - DNA, 20 bp, Artificial
  CRISPR gRNA sequence
tccatctgaggaagttccca

SEQ ID NO: 285133 - DNA, 20 bp, Artificial
  CRISPR gRNA sequence
aggaagttcccagaagaggt

SEQ ID NO: 285134 - DNA, 20 bp, Artificial
  CRISPR gRNA sequence
ccagaagaggtcaattgcaa

SEQ ID NO: 285135 - DNA, 20 bp, Artificial
  CRISPR gRNA sequence
caaatggaggtgggacctga

SEQ ID NO: 285136 - DNA, 20 bp, Artificial
  CRISPR gRNA sequence
agaaaacaaagaaatgatta

SEQ ID NO: 285137 - DNA, 20 bp, Artificial
  CRISPR gRNA sequence
catcaaaccctatattggca

SEQ ID NO: 285138 - DNA, 20 bp, Artificial
  CRISPR gRNA sequence
tattggcaaaggaggaaaac

SEQ ID NO: 285139 - DNA, 20 bp, Artificial
  CRISPR gRNA sequence
gcaaaggaggaaaacatctt

SEQ ID NO: 285140 - DNA, 20 bp, Artificial
  CRISPR gRNA sequence
aaatttatttatatattaaa

SEQ ID NO: 285141 - DNA, 20 bp, Artificial
  CRISPR gRNA sequence
aatttatttatatattaaat

SEQ ID NO: 285142 - DNA, 20 bp, Artificial
  CRISPR gRNA sequence
atttatatattaaattatac

SEQ ID NO: 285143 - DNA, 20 bp, Artificial
  CRISPR gRNA sequence
tttatatattaaattataca

SEQ ID NO: 285144 - DNA, 20 bp, Artificial
  CRISPR gRNA sequence
atatattaaattatacatat

SEQ ID NO: 285145 - DNA, 20 bp, Artificial
  CRISPR gRNA sequence
tatattaaattatacatata

SEQ ID NO: 285146 - DNA, 20 bp, Artificial
  CRISPR gRNA sequence
aattatacatatataatttt

SEQ ID NO: 285147 - DNA, 20 bp, Artificial
  CRISPR gRNA sequence
tacatatataatttttaaat

SEQ ID NO: 285148 - DNA, 20 bp, Artificial
  CRISPR gRNA sequence
ttaaattatatatgtatata

SEQ ID NO: 285149 - DNA, 20 bp, Artificial
  CRISPR gRNA sequence
taaattatatatgtatatat

SEQ ID NO: 285150 - DNA, 20 bp, Artificial
  CRISPR gRNA sequence
aaattatatatgtatatatg

SEQ ID NO: 285151 - DNA, 20 bp, Artificial
  CRISPR gRNA sequence
aattatatatgtatatatgt

SEQ ID NO: 285152 - DNA, 20 bp, Artificial
  CRISPR gRNA sequence
tatatgtatatatgtatata

SEQ ID NO: 285153 - DNA, 20 bp, Artificial
  CRISPR gRNA sequence
aattatatatgtatatatat

SEQ ID NO: 285154 - DNA, 20 bp, Artificial
  CRISPR gRNA sequence
attatatatgtatatatata

SEQ ID NO: 285155 - DNA, 20 bp, Artificial
  CRISPR gRNA sequence
tatatgtatatatatatatt

SEQ ID NO: 285156 - DNA, 20 bp, Artificial
  CRISPR gRNA sequence
taaatataagatcttaattt

SEQ ID NO: 285157 - DNA, 20 bp, Artificial
  CRISPR gRNA sequence
aaatataagatcttaatttt

SEQ ID NO: 285158 - DNA, 20 bp, Artificial
  CRISPR gRNA sequence
aatataagatcttaatttta

SEQ ID NO: 285159 - DNA, 20 bp, Artificial
  CRISPR gRNA sequence
aattttaatctcttaattta

SEQ ID NO: 285160 - DNA, 20 bp, Artificial
  CRISPR gRNA sequence
attttaatctcttaatttac

SEQ ID NO: 285161 - DNA, 20 bp, Artificial
  CRISPR gRNA sequence
taatctcttaatttacattt

SEQ ID NO: 285162 - DNA, 20 bp, Artificial
  CRISPR gRNA sequence
aatctcttaatttacatttt

SEQ ID NO: 285163 - DNA, 20 bp, Artificial
  CRISPR gRNA sequence
atctcttaatttacatttta

SEQ ID NO: 285164 - DNA, 20 bp, Artificial
  CRISPR gRNA sequence
ttaatttacattttaatctc

SEQ ID NO: 285165 - DNA, 20 bp, Artificial
  CRISPR gRNA sequence
aatttacattttaatctcaa

SEQ ID NO: 285166 - DNA, 20 bp, Artificial
  CRISPR gRNA sequence
atttacattttaatctcaag

SEQ ID NO: 285167 - DNA, 20 bp, Artificial
  CRISPR gRNA sequence
acattttaatctcaagatca

SEQ ID NO: 285168 - DNA, 20 bp, Artificial
  CRISPR gRNA sequence
cattttaatctcaagatcaa

SEQ ID NO: 285169 - DNA, 20 bp, Artificial
  CRISPR gRNA sequence
taatctcaagatcaagggta

SEQ ID NO: 285170 - DNA, 20 bp, Artificial
  CRISPR gRNA sequence
aatctcaagatcaagggtat

SEQ ID NO: 285171 - DNA, 20 bp, Artificial
  CRISPR gRNA sequence
atctcaagatcaagggtatt

SEQ ID NO: 285172 - DNA, 20 bp, Artificial
  CRISPR gRNA sequence
aagatcaagggtattcccag

SEQ ID NO: 285173 - DNA, 20 bp, Artificial
  CRISPR gRNA sequence
ccagcttgtacacagtaacc

SEQ ID NO: 285174 - DNA, 20 bp, Artificial
  CRISPR gRNA sequence
gtacacagtaaccttgatag

SEQ ID NO: 285175 - DNA, 20 bp, Artificial
  CRISPR gRNA sequence
tacacagtaaccttgatagc

SEQ ID NO: 285176 - DNA, 20 bp, Artificial
  CRISPR gRNA sequence
gatagctgaagaatatgaag

SEQ ID NO: 285177 - DNA, 20 bp, Artificial
  CRISPR gRNA sequence
atagctgaagaatatgaagg

SEQ ID NO: 285178 - DNA, 20 bp, Artificial
  CRISPR gRNA sequence
aagaatatgaagggaaagct

SEQ ID NO: 285179 - DNA, 20 bp, Artificial
  CRISPR gRNA sequence
aattatgagagaacttaaaa

SEQ ID NO: 285180 - DNA, 20 bp, Artificial
  CRISPR gRNA sequence
tgagagaacttaaaactact

SEQ ID NO: 285181 - DNA, 20 bp, Artificial
  CRISPR gRNA sequence
aaaactactctggcaatttt

SEQ ID NO: 285182 - DNA, 20 bp, Artificial
  CRISPR gRNA sequence
aaactactctggcaattttt

SEQ ID NO: 285183 - DNA, 20 bp, Artificial
  CRISPR gRNA sequence
ctctggcaatttttgtcaca

SEQ ID NO: 285184 - DNA, 20 bp, Artificial
  CRISPR gRNA sequence
tggcaatttttgtcacatga

SEQ ID NO: 285185 - DNA, 20 bp, Artificial
  CRISPR gRNA sequence
gcaatttttgtcacatgaaa

SEQ ID NO: 285186 - DNA, 20 bp, Artificial
  CRISPR gRNA sequence
ttgtcacatgaaatatcgat

SEQ ID NO: 285187 - DNA, 20 bp, Artificial
  CRISPR gRNA sequence
tgtcacatgaaatatcgatc

SEQ ID NO: 285188 - DNA, 20 bp, Artificial
  CRISPR gRNA sequence
gtcacatgaaatatcgatca

SEQ ID NO: 285189 - DNA, 20 bp, Artificial
  CRISPR gRNA sequence
tcacatgaaatatcgatcag

SEQ ID NO: 285190 - DNA, 20 bp, Artificial
  CRISPR gRNA sequence
agttattaccagctattacc

SEQ ID NO: 285191 - DNA, 20 bp, Artificial
  CRISPR gRNA sequence
gttattaccagctattacca

SEQ ID NO: 285192 - DNA, 20 bp, Artificial
  CRISPR gRNA sequence
ttaccagctattaccaaacg

SEQ ID NO: 285193 - DNA, 20 bp, Artificial
  CRISPR gRNA sequence
ccagctattaccaaacgacc

SEQ ID NO: 285194 - DNA, 20 bp, Artificial
  CRISPR gRNA sequence
ttaccaaacgaccaaatgct

SEQ ID NO: 285195 - DNA, 20 bp, Artificial
  CRISPR gRNA sequence
ccaaacgaccaaatgcttga

SEQ ID NO: 285196 - DNA, 20 bp, Artificial
  CRISPR gRNA sequence
gatcaagccactcttctatg

SEQ ID NO: 285197 - DNA, 20 bp, Artificial
  CRISPR gRNA sequence
atcaagccactcttctatgt

SEQ ID NO: 285198 - DNA, 20 bp, Artificial
  CRISPR gRNA sequence
ttctatgtgtggggctctca

SEQ ID NO: 285199 - DNA, 20 bp, Artificial
  CRISPR gRNA sequence
ctatgtgtggggctctcagg

SEQ ID NO: 285200 - DNA, 20 bp, Artificial
  CRISPR gRNA sequence
tatgtgtggggctctcaggc

SEQ ID NO: 285201 - DNA, 20 bp, Artificial
  CRISPR gRNA sequence
tgtgtggggctctcaggcat

SEQ ID NO: 285202 - DNA, 20 bp, Artificial
  CRISPR gRNA sequence
tcaggcatggttgcttttct

SEQ ID NO: 285203 - DNA, 20 bp, Artificial
  CRISPR gRNA sequence
aggcatggttgcttttctca

SEQ ID NO: 285204 - DNA, 20 bp, Artificial
  CRISPR gRNA sequence
cttttctcaataaacctaca

SEQ ID NO: 285205 - DNA, 20 bp, Artificial
  CRISPR gRNA sequence
ttctcaataaacctacatac

SEQ ID NO: 285206 - DNA, 20 bp, Artificial
  CRISPR gRNA sequence
tctcaataaacctacataca

SEQ ID NO: 285207 - DNA, 20 bp, Artificial
  CRISPR gRNA sequence
ctcaataaacctacatacag

SEQ ID NO: 285208 - DNA, 20 bp, Artificial
  CRISPR gRNA sequence
tcaataaacctacatacagt

SEQ ID NO: 285209 - DNA, 20 bp, Artificial
  CRISPR gRNA sequence
aataaacctacatacagtcc

SEQ ID NO: 285210 - DNA, 20 bp, Artificial
  CRISPR gRNA sequence
catacagtccagtaaaggat

SEQ ID NO: 285211 - DNA, 20 bp, Artificial
  CRISPR gRNA sequence
tgctggtggtatgagatgtg

SEQ ID NO: 285212 - DNA, 20 bp, Artificial
  CRISPR gRNA sequence
gtggtatgagatgtgctata

SEQ ID NO: 285213 - DNA, 20 bp, Artificial
  CRISPR gRNA sequence
tagaggtggaactgcttgag

SEQ ID NO: 285214 - DNA, 20 bp, Artificial
  CRISPR gRNA sequence
cttgagctagacaagatgac

SEQ ID NO: 285215 - DNA, 20 bp, Artificial
  CRISPR gRNA sequence
gagctagacaagatgaccac

SEQ ID NO: 285216 - DNA, 20 bp, Artificial
  CRISPR gRNA sequence
agctagacaagatgaccaca

SEQ ID NO: 285217 - DNA, 20 bp, Artificial
  CRISPR gRNA sequence
gacaagatgaccacagaagg

SEQ ID NO: 285218 - DNA, 20 bp, Artificial
  CRISPR gRNA sequence
gtgtagaagattgggtacac

SEQ ID NO: 285219 - DNA, 20 bp, Artificial
  CRISPR gRNA sequence
tgtagaagattgggtacacg

SEQ ID NO: 285220 - DNA, 20 bp, Artificial
  CRISPR gRNA sequence
ggtacacggcttcattttga

SEQ ID NO: 285221 - DNA, 20 bp, Artificial
  CRISPR gRNA sequence
cattttgaagtatcagcaga

SEQ ID NO: 285222 - DNA, 20 bp, Artificial
  CRISPR gRNA sequence
attttgaagtatcagcagac

SEQ ID NO: 285223 - DNA, 20 bp, Artificial
  CRISPR gRNA sequence
tgaagtatcagcagactgag

SEQ ID NO: 285224 - DNA, 20 bp, Artificial
  CRISPR gRNA sequence
gaagtatcagcagactgagc

SEQ ID NO: 285225 - DNA, 20 bp, Artificial
  CRISPR gRNA sequence
aagtatcagcagactgagca

SEQ ID NO: 285226 - DNA, 20 bp, Artificial
  CRISPR gRNA sequence
agcagaagactttttagata

SEQ ID NO: 285227 - DNA, 20 bp, Artificial
  CRISPR gRNA sequence
tttagatagaaagtcaagaa

SEQ ID NO: 285228 - DNA, 20 bp, Artificial
  CRISPR gRNA sequence
ttagatagaaagtcaagaaa

SEQ ID NO: 285229 - DNA, 20 bp, Artificial
  CRISPR gRNA sequence
tagatagaaagtcaagaaaa

SEQ ID NO: 285230 - DNA, 20 bp, Artificial
  CRISPR gRNA sequence
agatagaaagtcaagaaaat

SEQ ID NO: 285231 - DNA, 20 bp, Artificial
  CRISPR gRNA sequence
gatagaaagtcaagaaaatt

SEQ ID NO: 285232 - DNA, 20 bp, Artificial
  CRISPR gRNA sequence
tagataatgacagaactgag

SEQ ID NO: 285233 - DNA, 20 bp, Artificial
  CRISPR gRNA sequence
agccagagcaacatcctgga

SEQ ID NO: 285234 - DNA, 20 bp, Artificial
  CRISPR gRNA sequence
gaaaagacattctgaggagt

SEQ ID NO: 285235 - DNA, 20 bp, Artificial
  CRISPR gRNA sequence
tgaggagtgagcaagcattc

SEQ ID NO: 285236 - DNA, 20 bp, Artificial
  CRISPR gRNA sequence
aggagtgagcaagcattcag

SEQ ID NO: 285237 - DNA, 20 bp, Artificial
  CRISPR gRNA sequence
agtggaaatgaaaaaacagg

SEQ ID NO: 285238 - DNA, 20 bp, Artificial
  CRISPR gRNA sequence
agacactgccttgggggaaa

SEQ ID NO: 285239 - DNA, 20 bp, Artificial
  CRISPR gRNA sequence
ccttgggggaaaatatgtgt

SEQ ID NO: 285240 - DNA, 20 bp, Artificial
  CRISPR gRNA sequence
gggggaaaatatgtgtaggc

SEQ ID NO: 285241 - DNA, 20 bp, Artificial
  CRISPR gRNA sequence
ggggaaaatatgtgtaggct

SEQ ID NO: 285242 - DNA, 20 bp, Artificial
  CRISPR gRNA sequence
ccaggttgtagggaaaggag

SEQ ID NO: 285243 - DNA, 20 bp, Artificial
  CRISPR gRNA sequence
tagggaaaggagcctgaact

SEQ ID NO: 285244 - DNA, 20 bp, Artificial
  CRISPR gRNA sequence
aacttgatgtccagtttgaa

SEQ ID NO: 285245 - DNA, 20 bp, Artificial
  CRISPR gRNA sequence
gatgtccagtttgaatcttg

SEQ ID NO: 285246 - DNA, 20 bp, Artificial
  CRISPR gRNA sequence
atgtccagtttgaatcttgg

SEQ ID NO: 285247 - DNA, 20 bp, Artificial
  CRISPR gRNA sequence
gaatcttggttttattcttc

SEQ ID NO: 285248 - DNA, 20 bp, Artificial
  CRISPR gRNA sequence
aatcttggttttattcttca

SEQ ID NO: 285249 - DNA, 20 bp, Artificial
  CRISPR gRNA sequence
ggttttattcttcatctgta

SEQ ID NO: 285250 - DNA, 20 bp, Artificial
  CRISPR gRNA sequence
gttttattcttcatctgtat

SEQ ID NO: 285251 - DNA, 20 bp, Artificial
  CRISPR gRNA sequence
tattcttcatctgtatgacc

SEQ ID NO: 285252 - DNA, 20 bp, Artificial
  CRISPR gRNA sequence
attcttcatctgtatgaccg

SEQ ID NO: 285253 - DNA, 20 bp, Artificial
  CRISPR gRNA sequence
ttcttcatctgtatgaccgt

SEQ ID NO: 285254 - DNA, 20 bp, Artificial
  CRISPR gRNA sequence
ttcatctgtatgaccgtacc

SEQ ID NO: 285255 - DNA, 20 bp, Artificial
  CRISPR gRNA sequence
catctgtatgaccgtacctc

SEQ ID NO: 285256 - DNA, 20 bp, Artificial
  CRISPR gRNA sequence
atctgtatgaccgtacctca

SEQ ID NO: 285257 - DNA, 20 bp, Artificial
  CRISPR gRNA sequence
tatgaccgtacctcaagcaa

SEQ ID NO: 285258 - DNA, 20 bp, Artificial
  CRISPR gRNA sequence
aagcaaatctcttaacctct

SEQ ID NO: 285259 - DNA, 20 bp, Artificial
  CRISPR gRNA sequence
ttaacctctgggagcctctg

SEQ ID NO: 285260 - DNA, 20 bp, Artificial
  CRISPR gRNA sequence
aacctctgggagcctctggt

SEQ ID NO: 285261 - DNA, 20 bp, Artificial
  CRISPR gRNA sequence
acctctgggagcctctggtt

SEQ ID NO: 285262 - DNA, 20 bp, Artificial
  CRISPR gRNA sequence
tgggagcctctggtttctct

SEQ ID NO: 285263 - DNA, 20 bp, Artificial
  CRISPR gRNA sequence
ggagcctctggtttctctcc

SEQ ID NO: 285264 - DNA, 20 bp, Artificial
  CRISPR gRNA sequence
tggtttctctcccataacat

SEQ ID NO: 285265 - DNA, 20 bp, Artificial
  CRISPR gRNA sequence
gtttctctcccataacatgg

SEQ ID NO: 285266 - DNA, 20 bp, Artificial
  CRISPR gRNA sequence
ctctcccataacatggaaat

SEQ ID NO: 285267 - DNA, 20 bp, Artificial
  CRISPR gRNA sequence
tctcccataacatggaaata

SEQ ID NO: 285268 - DNA, 20 bp, Artificial
  CRISPR gRNA sequence
tcccataacatggaaataga

SEQ ID NO: 285269 - DNA, 20 bp, Artificial
  CRISPR gRNA sequence
ccataacatggaaatagatc

SEQ ID NO: 285270 - DNA, 20 bp, Artificial
  CRISPR gRNA sequence
gctcatagagatttttataa

SEQ ID NO: 285271 - DNA, 20 bp, Artificial
  CRISPR gRNA sequence
ctcatagagatttttataag

SEQ ID NO: 285272 - DNA, 20 bp, Artificial
  CRISPR gRNA sequence
atagagatttttataagact

SEQ ID NO: 285273 - DNA, 20 bp, Artificial
  CRISPR gRNA sequence
ttataagactaagatgaaat

SEQ ID NO: 285274 - DNA, 20 bp, Artificial
  CRISPR gRNA sequence
tataagactaagatgaaata

SEQ ID NO: 285275 - DNA, 20 bp, Artificial
  CRISPR gRNA sequence
ataagactaagatgaaatag

SEQ ID NO: 285276 - DNA, 20 bp, Artificial
  CRISPR gRNA sequence
taagactaagatgaaatagt

SEQ ID NO: 285277 - DNA, 20 bp, Artificial
  CRISPR gRNA sequence
agatgaaatagtgtttttgc

SEQ ID NO: 285278 - DNA, 20 bp, Artificial
  CRISPR gRNA sequence
ttgcaaaacaacctgttgta

SEQ ID NO: 285279 - DNA, 20 bp, Artificial
  CRISPR gRNA sequence
tgcaaaacaacctgttgtat

SEQ ID NO: 285280 - DNA, 20 bp, Artificial
  CRISPR gRNA sequence
gcaaaacaacctgttgtata

SEQ ID NO: 285281 - DNA, 20 bp, Artificial
  CRISPR gRNA sequence
caaaacaacctgttgtataa

SEQ ID NO: 285282 - DNA, 20 bp, Artificial
  CRISPR gRNA sequence
ttgtataagcgtcaggtatt

SEQ ID NO: 285283 - DNA, 20 bp, Artificial
  CRISPR gRNA sequence
tataagcgtcaggtattatt

SEQ ID NO: 285284 - DNA, 20 bp, Artificial
  CRISPR gRNA sequence
tttttcatttttctttatat

SEQ ID NO: 285285 - DNA, 20 bp, Artificial
  CRISPR gRNA sequence
ttcatttttctttatatttc

SEQ ID NO: 285286 - DNA, 20 bp, Artificial
  CRISPR gRNA sequence
tcatttttctttatatttcc

SEQ ID NO: 285287 - DNA, 20 bp, Artificial
  CRISPR gRNA sequence
catttttctttatatttccc

SEQ ID NO: 285288 - DNA, 20 bp, Artificial
  CRISPR gRNA sequence
atttttctttatatttcccc

SEQ ID NO: 285289 - DNA, 20 bp, Artificial
  CRISPR gRNA sequence
ttctttatatttccccctcc

SEQ ID NO: 285290 - DNA, 20 bp, Artificial
  CRISPR gRNA sequence
tctttatatttccccctcct

SEQ ID NO: 285291 - DNA, 20 bp, Artificial
  CRISPR gRNA sequence
ctttatatttccccctcctg

SEQ ID NO: 285292 - DNA, 20 bp, Artificial
  CRISPR gRNA sequence
tttatatttccccctcctgc

SEQ ID NO: 285293 - DNA, 20 bp, Artificial
  CRISPR gRNA sequence
tatatttccccctcctgccc

SEQ ID NO: 285294 - DNA, 20 bp, Artificial
  CRISPR gRNA sequence
atatttccccctcctgccca

SEQ ID NO: 285295 - DNA, 20 bp, Artificial
  CRISPR gRNA sequence
tatttccccctcctgcccag

SEQ ID NO: 285296 - DNA, 20 bp, Artificial
  CRISPR gRNA sequence
ccccctcctgcccaggacaa

SEQ ID NO: 285297 - DNA, 20 bp, Artificial
  CRISPR gRNA sequence
cccctcctgcccaggacaat

SEQ ID NO: 285298 - DNA, 20 bp, Artificial
  CRISPR gRNA sequence
ctgcccaggacaattcttgc

SEQ ID NO: 285299 - DNA, 20 bp, Artificial
  CRISPR gRNA sequence
cccaggacaattcttgcttt

SEQ ID NO: 285300 - DNA, 20 bp, Artificial
  CRISPR gRNA sequence
ttgctttcctttatttttaa

SEQ ID NO: 285301 - DNA, 20 bp, Artificial
  CRISPR gRNA sequence
gctttcctttatttttaaag

SEQ ID NO: 285302 - DNA, 20 bp, Artificial
  CRISPR gRNA sequence
ctttcctttatttttaaaga

SEQ ID NO: 285303 - DNA, 20 bp, Artificial
  CRISPR gRNA sequence
tcctttatttttaaagataa

SEQ ID NO: 285304 - DNA, 20 bp, Artificial
  CRISPR gRNA sequence
cctttatttttaaagataat

SEQ ID NO: 285305 - DNA, 20 bp, Artificial
  CRISPR gRNA sequence
ctttatttttaaagataatt

SEQ ID NO: 285306 - DNA, 20 bp, Artificial
  CRISPR gRNA sequence
tatttttaaagataattttg

SEQ ID NO: 285307 - DNA, 20 bp, Artificial
  CRISPR gRNA sequence
atttttaaagataattttgt

SEQ ID NO: 285308 - DNA, 20 bp, Artificial
  CRISPR gRNA sequence
tttttaaagataattttgta

SEQ ID NO: 285309 - DNA, 20 bp, Artificial
  CRISPR gRNA sequence
ttaaagataattttgtagac

SEQ ID NO: 285310 - DNA, 20 bp, Artificial
  CRISPR gRNA sequence
taaagataattttgtagact

SEQ ID NO: 285311 - DNA, 20 bp, Artificial
  CRISPR gRNA sequence
aaagataattttgtagacta

SEQ ID NO: 285312 - DNA, 20 bp, Artificial
  CRISPR gRNA sequence
aagataattttgtagactaa

SEQ ID NO: 285313 - DNA, 20 bp, Artificial
  CRISPR gRNA sequence
tgtagactaattcctatact

SEQ ID NO: 285314 - DNA, 20 bp, Artificial
  CRISPR gRNA sequence
gtagactaattcctatactg

SEQ ID NO: 285315 - DNA, 20 bp, Artificial
  CRISPR gRNA sequence
tagactaattcctatactgg

SEQ ID NO: 285316 - DNA, 20 bp, Artificial
  CRISPR gRNA sequence
attcctatactggtgttact

SEQ ID NO: 285317 - DNA, 20 bp, Artificial
  CRISPR gRNA sequence
ctatactggtgttactctaa

SEQ ID NO: 285318 - DNA, 20 bp, Artificial
  CRISPR gRNA sequence
tactggtgttactctaacct

SEQ ID NO: 285319 - DNA, 20 bp, Artificial
  CRISPR gRNA sequence
gtgttactctaaccttcaca

SEQ ID NO: 285320 - DNA, 20 bp, Artificial
  CRISPR gRNA sequence
ctctaaccttcacaagtcaa

SEQ ID NO: 285321 - DNA, 20 bp, Artificial
  CRISPR gRNA sequence
taaccttcacaagtcaaagc

SEQ ID NO: 285322 - DNA, 20 bp, Artificial
  CRISPR gRNA sequence
accttcacaagtcaaagctg

SEQ ID NO: 285323 - DNA, 20 bp, Artificial
  CRISPR gRNA sequence
cacaagtcaaagctgaactg

SEQ ID NO: 285324 - DNA, 20 bp, Artificial
  CRISPR gRNA sequence
acaagtcaaagctgaactgt

SEQ ID NO: 285325 - DNA, 20 bp, Artificial
  CRISPR gRNA sequence
aactgtttagggaggcttat

SEQ ID NO: 285326 - DNA, 20 bp, Artificial
  CRISPR gRNA sequence
tttagggaggcttataacta

SEQ ID NO: 285327 - DNA, 20 bp, Artificial
  CRISPR gRNA sequence
agggaggcttataactacct

SEQ ID NO: 285328 - DNA, 20 bp, Artificial
  CRISPR gRNA sequence
gggaggcttataactacctg

SEQ ID NO: 285329 - DNA, 20 bp, Artificial
  CRISPR gRNA sequence
ataactacctgggacctgat

SEQ ID NO: 285330 - DNA, 20 bp, Artificial
  CRISPR gRNA sequence
taactacctgggacctgata

SEQ ID NO: 285331 - DNA, 20 bp, Artificial
  CRISPR gRNA sequence
cctgggacctgatatcagtc

SEQ ID NO: 285332 - DNA, 20 bp, Artificial
  CRISPR gRNA sequence
ggacctgatatcagtctctt

SEQ ID NO: 285333 - DNA, 20 bp, Artificial
  CRISPR gRNA sequence
atatcagtctcttggattct

SEQ ID NO: 285334 - DNA, 20 bp, Artificial
  CRISPR gRNA sequence
ttggattctaatgtcccatg

SEQ ID NO: 285335 - DNA, 20 bp, Artificial
  CRISPR gRNA sequence
ggattctaatgtcccatgta

SEQ ID NO: 285336 - DNA, 20 bp, Artificial
  CRISPR gRNA sequence
gattctaatgtcccatgtaa

SEQ ID NO: 285337 - DNA, 20 bp, Artificial
  CRISPR gRNA sequence
taatgtcccatgtaagtttc

SEQ ID NO: 285338 - DNA, 20 bp, Artificial
  CRISPR gRNA sequence
atgtcccatgtaagtttctc

SEQ ID NO: 285339 - DNA, 20 bp, Artificial
  CRISPR gRNA sequence
ctcttgcatgaaaatacctg

SEQ ID NO: 285340 - DNA, 20 bp, Artificial
  CRISPR gRNA sequence
tcttgcatgaaaatacctgg

SEQ ID NO: 285341 - DNA, 20 bp, Artificial
  CRISPR gRNA sequence
ttgcatgaaaatacctgggg

SEQ ID NO: 285342 - DNA, 20 bp, Artificial
  CRISPR gRNA sequence
gcatgaaaatacctggggat

SEQ ID NO: 285343 - DNA, 20 bp, Artificial
  CRISPR gRNA sequence
catgaaaatacctggggatt

SEQ ID NO: 285344 - DNA, 20 bp, Artificial
  CRISPR gRNA sequence
gggatttgtgactcactaaa

SEQ ID NO: 285345 - DNA, 20 bp, Artificial
  CRISPR gRNA sequence
gtgactcactaaagctagtg

SEQ ID NO: 285346 - DNA, 20 bp, Artificial
  CRISPR gRNA sequence
tgactcactaaagctagtgc

SEQ ID NO: 285347 - DNA, 20 bp, Artificial
  CRISPR gRNA sequence
actaaagctagtgctgtgtt

SEQ ID NO: 285348 - DNA, 20 bp, Artificial
  CRISPR gRNA sequence
aagctagtgctgtgttaggc

SEQ ID NO: 285349 - DNA, 20 bp, Artificial
  CRISPR gRNA sequence
gtgctgtgttaggctctctt

SEQ ID NO: 285350 - DNA, 20 bp, Artificial
  CRISPR gRNA sequence
tgttaggctctcttaacagg

SEQ ID NO: 285351 - DNA, 20 bp, Artificial
  CRISPR gRNA sequence
ggctctcttaacaggatgga

SEQ ID NO: 285352 - DNA, 20 bp, Artificial
  CRISPR gRNA sequence
tcttaacaggatggacattc

SEQ ID NO: 285353 - DNA, 20 bp, Artificial
  CRISPR gRNA sequence
ttaacaggatggacattcca

SEQ ID NO: 285354 - DNA, 20 bp, Artificial
  CRISPR gRNA sequence
aacaggatggacattccaga

SEQ ID NO: 285355 - DNA, 20 bp, Artificial
  CRISPR gRNA sequence
acaggatggacattccagac

SEQ ID NO: 285356 - DNA, 20 bp, Artificial
  CRISPR gRNA sequence
cagaccccagataataatta

SEQ ID NO: 285357 - DNA, 20 bp, Artificial
  CRISPR gRNA sequence
tctcattgtatgtagagtca

SEQ ID NO: 285358 - DNA, 20 bp, Artificial
  CRISPR gRNA sequence
attgtatgtagagtcattaa

SEQ ID NO: 285359 - DNA, 20 bp, Artificial
  CRISPR gRNA sequence
tatgtagagtcattaagacc

SEQ ID NO: 285360 - DNA, 20 bp, Artificial
  CRISPR gRNA sequence
agaccaaatctaaagtcttg

SEQ ID NO: 285361 - DNA, 20 bp, Artificial
  CRISPR gRNA sequence
aagtcttgggttccgtttac

SEQ ID NO: 285362 - DNA, 20 bp, Artificial
  CRISPR gRNA sequence
gggttccgtttaccccattc

SEQ ID NO: 285363 - DNA, 20 bp, Artificial
  CRISPR gRNA sequence
ggttccgtttaccccattca

SEQ ID NO: 285364 - DNA, 20 bp, Artificial
  CRISPR gRNA sequence
cgtttaccccattcatgtga

SEQ ID NO: 285365 - DNA, 20 bp, Artificial
  CRISPR gRNA sequence
accccattcatgtgaggcac

SEQ ID NO: 285366 - DNA, 20 bp, Artificial
  CRISPR gRNA sequence
ccccattcatgtgaggcact

SEQ ID NO: 285367 - DNA, 20 bp, Artificial
  CRISPR gRNA sequence
atgtgaggcactggaaacca

SEQ ID NO: 285368 - DNA, 20 bp, Artificial
  CRISPR gRNA sequence
gaaaccatgccatgtgagga

SEQ ID NO: 285369 - DNA, 20 bp, Artificial
  CRISPR gRNA sequence
acagaactcaagggtattta

SEQ ID NO: 285370 - DNA, 20 bp, Artificial
  CRISPR gRNA sequence
aagggtatttagactgaaga

SEQ ID NO: 285371 - DNA, 20 bp, Artificial
  CRISPR gRNA sequence
agactgaagagatcagctgg

SEQ ID NO: 285372 - DNA, 20 bp, Artificial
  CRISPR gRNA sequence
gactgaagagatcagctgga

SEQ ID NO: 285373 - DNA, 20 bp, Artificial
  CRISPR gRNA sequence
aagagatcagctggaatgtg

SEQ ID NO: 285374 - DNA, 20 bp, Artificial
  CRISPR gRNA sequence
gaatgtggaaagttaaaaag

SEQ ID NO: 285375 - DNA, 20 bp, Artificial
  CRISPR gRNA sequence
aaaagctttgaagctttttc

SEQ ID NO: 285376 - DNA, 20 bp, Artificial
  CRISPR gRNA sequence
tgaagctttttctgtaggca

SEQ ID NO: 285377 - DNA, 20 bp, Artificial
  CRISPR gRNA sequence
gaagctttttctgtaggcag

SEQ ID NO: 285378 - DNA, 20 bp, Artificial
  CRISPR gRNA sequence
aagctttttctgtaggcagt

SEQ ID NO: 285379 - DNA, 20 bp, Artificial
  CRISPR gRNA sequence
tttctgtaggcagtggggtc

SEQ ID NO: 285380 - DNA, 20 bp, Artificial
  CRISPR gRNA sequence
ttctgtaggcagtggggtct

SEQ ID NO: 285381 - DNA, 20 bp, Artificial
  CRISPR gRNA sequence
tctgtaggcagtggggtctc

SEQ ID NO: 285382 - DNA, 20 bp, Artificial
  CRISPR gRNA sequence
ctgtaggcagtggggtctct

SEQ ID NO: 285383 - DNA, 20 bp, Artificial
  CRISPR gRNA sequence
tgtaggcagtggggtctctt

SEQ ID NO: 285384 - DNA, 20 bp, Artificial
  CRISPR gRNA sequence
taggcagtggggtctcttct

SEQ ID NO: 285385 - DNA, 20 bp, Artificial
  CRISPR gRNA sequence
ttctgagtttttgagtggga

SEQ ID NO: 285386 - DNA, 20 bp, Artificial
  CRISPR gRNA sequence
ctgagtttttgagtgggaaa

SEQ ID NO: 285387 - DNA, 20 bp, Artificial
  CRISPR gRNA sequence
tgagtttttgagtgggaaaa

SEQ ID NO: 285388 - DNA, 20 bp, Artificial
  CRISPR gRNA sequence
agtttttgagtgggaaaatg

SEQ ID NO: 285389 - DNA, 20 bp, Artificial
  CRISPR gRNA sequence
ttgagtgggaaaatgacatg

SEQ ID NO: 285390 - DNA, 20 bp, Artificial
  CRISPR gRNA sequence
tgagtgggaaaatgacatga

SEQ ID NO: 285391 - DNA, 20 bp, Artificial
  CRISPR gRNA sequence
gagtgggaaaatgacatgac

SEQ ID NO: 285392 - DNA, 20 bp, Artificial
  CRISPR gRNA sequence
agtgggaaaatgacatgaca

SEQ ID NO: 285393 - DNA, 20 bp, Artificial
  CRISPR gRNA sequence
tttgtgaaatttggctccat

SEQ ID NO: 285394 - DNA, 20 bp, Artificial
  CRISPR gRNA sequence
tgtgaaatttggctccatga

SEQ ID NO: 285395 - DNA, 20 bp, Artificial
  CRISPR gRNA sequence
gtgaaatttggctccatgat

SEQ ID NO: 285396 - DNA, 20 bp, Artificial
  CRISPR gRNA sequence
tgaaatttggctccatgatt

SEQ ID NO: 285397 - DNA, 20 bp, Artificial
  CRISPR gRNA sequence
ggctccatgattcgtcagta

SEQ ID NO: 285398 - DNA, 20 bp, Artificial
  CRISPR gRNA sequence
gctccatgattcgtcagtag

SEQ ID NO: 285399 - DNA, 20 bp, Artificial
  CRISPR gRNA sequence
catgattcgtcagtaggatg

SEQ ID NO: 285400 - DNA, 20 bp, Artificial
  CRISPR gRNA sequence
gtcagtaggatgagtctgtt

SEQ ID NO: 285401 - DNA, 20 bp, Artificial
  CRISPR gRNA sequence
ttagtaagaggcagagaaac

SEQ ID NO: 285402 - DNA, 20 bp, Artificial
  CRISPR gRNA sequence
gtaagaggcagagaaaccaa

SEQ ID NO: 285403 - DNA, 20 bp, Artificial
  CRISPR gRNA sequence
ccgtgttaatacaaagtgac

SEQ ID NO: 285404 - DNA, 20 bp, Artificial
  CRISPR gRNA sequence
atacaaagtgaccccaaccc

SEQ ID NO: 285405 - DNA, 20 bp, Artificial
  CRISPR gRNA sequence
agagatagagggaaaaatga

SEQ ID NO: 285406 - DNA, 20 bp, Artificial
  CRISPR gRNA sequence
ccacaggaatattcaagatg

SEQ ID NO: 285407 - DNA, 20 bp, Artificial
  CRISPR gRNA sequence
aagatgaactcaaattagtg

SEQ ID NO: 285408 - DNA, 20 bp, Artificial
  CRISPR gRNA sequence
aaattagtgtttaatagata

SEQ ID NO: 285409 - DNA, 20 bp, Artificial
  CRISPR gRNA sequence
gtgtttaatagataatgaat

SEQ ID NO: 285410 - DNA, 20 bp, Artificial
  CRISPR gRNA sequence
aatagataatgaattggctg

SEQ ID NO: 285411 - DNA, 20 bp, Artificial
  CRISPR gRNA sequence
atagataatgaattggctga

SEQ ID NO: 285412 - DNA, 20 bp, Artificial
  CRISPR gRNA sequence
gctgacaagacaattcaaga

SEQ ID NO: 285413 - DNA, 20 bp, Artificial
  CRISPR gRNA sequence
acaagacaattcaagatggc

SEQ ID NO: 285414 - DNA, 20 bp, Artificial
  CRISPR gRNA sequence
aagatggcagaatggaaaca

SEQ ID NO: 285415 - DNA, 20 bp, Artificial
  CRISPR gRNA sequence
cattaagcaaattgcatatg

SEQ ID NO: 285416 - DNA, 20 bp, Artificial
  CRISPR gRNA sequence
agcaaattgcatatggggag

SEQ ID NO: 285417 - DNA, 20 bp, Artificial
  CRISPR gRNA sequence
catatggggagaaaggagag

SEQ ID NO: 285418 - DNA, 20 bp, Artificial
  CRISPR gRNA sequence
gtaactgttcagcttaatct

SEQ ID NO: 285419 - DNA, 20 bp, Artificial
  CRISPR gRNA sequence
taactgttcagcttaatctg

SEQ ID NO: 285420 - DNA, 20 bp, Artificial
  CRISPR gRNA sequence
ttcagcttaatctgaaagag

SEQ ID NO: 285421 - DNA, 20 bp, Artificial
  CRISPR gRNA sequence
agcttaatctgaaagaggtt

SEQ ID NO: 285422 - DNA, 20 bp, Artificial
  CRISPR gRNA sequence
aatctgaaagaggtttttaa

SEQ ID NO: 285423 - DNA, 20 bp, Artificial
  CRISPR gRNA sequence
atctgaaagaggtttttaag

SEQ ID NO: 285424 - DNA, 20 bp, Artificial
  CRISPR gRNA sequence
aaagaggtttttaagaaggt

SEQ ID NO: 285425 - DNA, 20 bp, Artificial
  CRISPR gRNA sequence
ttaagaaggtgaggtagtgg

SEQ ID NO: 285426 - DNA, 20 bp, Artificial
  CRISPR gRNA sequence
taagaaggtgaggtagtggg

SEQ ID NO: 285427 - DNA, 20 bp, Artificial
  CRISPR gRNA sequence
aagaaggtgaggtagtgggt

SEQ ID NO: 285428 - DNA, 20 bp, Artificial
  CRISPR gRNA sequence
agaaggtgaggtagtgggta

SEQ ID NO: 285429 - DNA, 20 bp, Artificial
  CRISPR gRNA sequence
aaatttgttaagggaagaat

SEQ ID NO: 285430 - DNA, 20 bp, Artificial
  CRISPR gRNA sequence
aatttgttaagggaagaatg

SEQ ID NO: 285431 - DNA, 20 bp, Artificial
  CRISPR gRNA sequence
gttaagggaagaatgcctca

SEQ ID NO: 285432 - DNA, 20 bp, Artificial
  CRISPR gRNA sequence
ttaagggaagaatgcctcat

SEQ ID NO: 285433 - DNA, 20 bp, Artificial
  CRISPR gRNA sequence
agggaagaatgcctcatgat

SEQ ID NO: 285434 - DNA, 20 bp, Artificial
  CRISPR gRNA sequence
atgatccccacgatccatgt

SEQ ID NO: 285435 - DNA, 20 bp, Artificial
  CRISPR gRNA sequence
ccttcagatcttttcagccc

SEQ ID NO: 285436 - DNA, 20 bp, Artificial
  CRISPR gRNA sequence
cagatcttttcagccccttg

SEQ ID NO: 285437 - DNA, 20 bp, Artificial
  CRISPR gRNA sequence
agatcttttcagccccttgc

SEQ ID NO: 285438 - DNA, 20 bp, Artificial
  CRISPR gRNA sequence
ttcagccccttgcttctgcg

SEQ ID NO: 285439 - DNA, 20 bp, Artificial
  CRISPR gRNA sequence
tcagccccttgcttctgcgg

SEQ ID NO: 285440 - DNA, 20 bp, Artificial
  CRISPR gRNA sequence
cagccccttgcttctgcgga

SEQ ID NO: 285441 - DNA, 20 bp, Artificial
  CRISPR gRNA sequence
agccccttgcttctgcggac

SEQ ID NO: 285442 - DNA, 20 bp, Artificial
  CRISPR gRNA sequence
gcttctgcggacactgttat

SEQ ID NO: 285443 - DNA, 20 bp, Artificial
  CRISPR gRNA sequence
cttctgcggacactgttata

SEQ ID NO: 285444 - DNA, 20 bp, Artificial
  CRISPR gRNA sequence
ctgcggacactgttatacag

SEQ ID NO: 285445 - DNA, 20 bp, Artificial
  CRISPR gRNA sequence
tgcggacactgttatacagg

SEQ ID NO: 285446 - DNA, 20 bp, Artificial
  CRISPR gRNA sequence
cggacactgttatacagggc

SEQ ID NO: 285447 - DNA, 20 bp, Artificial
  CRISPR gRNA sequence
ttatacagggcgtacacttt

SEQ ID NO: 285448 - DNA, 20 bp, Artificial
  CRISPR gRNA sequence
tacagggcgtacactttccc

SEQ ID NO: 285449 - DNA, 20 bp, Artificial
  CRISPR gRNA sequence
tcccttctcaatctctcatt

SEQ ID NO: 285450 - DNA, 20 bp, Artificial
  CRISPR gRNA sequence
cccttctcaatctctcattc

SEQ ID NO: 285451 - DNA, 20 bp, Artificial
  CRISPR gRNA sequence
ccttctcaatctctcattcc

SEQ ID NO: 285452 - DNA, 20 bp, Artificial
  CRISPR gRNA sequence
ctcaatctctcattcctcct

SEQ ID NO: 285453 - DNA, 20 bp, Artificial
  CRISPR gRNA sequence
tcaatctctcattcctcctt

SEQ ID NO: 285454 - DNA, 20 bp, Artificial
  CRISPR gRNA sequence
aatctctcattcctccttct

SEQ ID NO: 285455 - DNA, 20 bp, Artificial
  CRISPR gRNA sequence
tcattcctccttctctctct

SEQ ID NO: 285456 - DNA, 20 bp, Artificial
  CRISPR gRNA sequence
attcctccttctctctctgc

SEQ ID NO: 285457 - DNA, 20 bp, Artificial
  CRISPR gRNA sequence
ctccttctctctctgcatct

SEQ ID NO: 285458 - DNA, 20 bp, Artificial
  CRISPR gRNA sequence
cttctctctctgcatcttgg

SEQ ID NO: 285459 - DNA, 20 bp, Artificial
  CRISPR gRNA sequence
ctctctctgcatcttggggc

SEQ ID NO: 285460 - DNA, 20 bp, Artificial
  CRISPR gRNA sequence
tctctctgcatcttggggca

SEQ ID NO: 285461 - DNA, 20 bp, Artificial
  CRISPR gRNA sequence
tctctgcatcttggggcaaa

SEQ ID NO: 285462 - DNA, 20 bp, Artificial
  CRISPR gRNA sequence
tctgcatcttggggcaaagc

SEQ ID NO: 285463 - DNA, 20 bp, Artificial
  CRISPR gRNA sequence
tgcatcttggggcaaagcct

SEQ ID NO: 285464 - DNA, 20 bp, Artificial
  CRISPR gRNA sequence
catcttggggcaaagccttg

SEQ ID NO: 285465 - DNA, 20 bp, Artificial
  CRISPR gRNA sequence
ggggcaaagccttggagaca

SEQ ID NO: 285466 - DNA, 20 bp, Artificial
  CRISPR gRNA sequence
gggcaaagccttggagacaa

SEQ ID NO: 285467 - DNA, 20 bp, Artificial
  CRISPR gRNA sequence
ggagacaagaacaaacaata

SEQ ID NO: 285468 - DNA, 20 bp, Artificial
  CRISPR gRNA sequence
gagacaagaacaaacaataa

SEQ ID NO: 285469 - DNA, 20 bp, Artificial
  CRISPR gRNA sequence
cccttgaattgtgcccatat

SEQ ID NO: 285470 - DNA, 20 bp, Artificial
  CRISPR gRNA sequence
ccttgaattgtgcccatatg

SEQ ID NO: 285471 - DNA, 20 bp, Artificial
  CRISPR gRNA sequence
gaattgtgcccatatgttaa

SEQ ID NO: 285472 - DNA, 20 bp, Artificial
  CRISPR gRNA sequence
aattgtgcccatatgttaat

SEQ ID NO: 285473 - DNA, 20 bp, Artificial
  CRISPR gRNA sequence
tgcccatatgttaatattta

SEQ ID NO: 285474 - DNA, 20 bp, Artificial
  CRISPR gRNA sequence
atatttactttagcaaggct

SEQ ID NO: 285475 - DNA, 20 bp, Artificial
  CRISPR gRNA sequence
actttagcaaggcttcagac

SEQ ID NO: 285476 - DNA, 20 bp, Artificial
  CRISPR gRNA sequence
ctttagcaaggcttcagact

SEQ ID NO: 285477 - DNA, 20 bp, Artificial
  CRISPR gRNA sequence
tagcaaggcttcagactggc

SEQ ID NO: 285478 - DNA, 20 bp, Artificial
  CRISPR gRNA sequence
agcaaggcttcagactggct

SEQ ID NO: 285479 - DNA, 20 bp, Artificial
  CRISPR gRNA sequence
gcaaggcttcagactggctt

SEQ ID NO: 285480 - DNA, 20 bp, Artificial
  CRISPR gRNA sequence
cagactggcttagaactgga

SEQ ID NO: 285481 - DNA, 20 bp, Artificial
  CRISPR gRNA sequence
agactggcttagaactggag

SEQ ID NO: 285482 - DNA, 20 bp, Artificial
  CRISPR gRNA sequence
gcttagaactggagcagttg

SEQ ID NO: 285483 - DNA, 20 bp, Artificial
  CRISPR gRNA sequence
agaactggagcagttgttct

SEQ ID NO: 285484 - DNA, 20 bp, Artificial
  CRISPR gRNA sequence
gaactggagcagttgttctt

SEQ ID NO: 285485 - DNA, 20 bp, Artificial
  CRISPR gRNA sequence
gagcagttgttcttatacca

SEQ ID NO: 285486 - DNA, 20 bp, Artificial
  CRISPR gRNA sequence
ttcttataccaggggtgatt

SEQ ID NO: 285487 - DNA, 20 bp, Artificial
  CRISPR gRNA sequence
ttataccaggggtgatttac

SEQ ID NO: 285488 - DNA, 20 bp, Artificial
  CRISPR gRNA sequence
ataccaggggtgatttacaa

SEQ ID NO: 285489 - DNA, 20 bp, Artificial
  CRISPR gRNA sequence
taccaggggtgatttacaat

SEQ ID NO: 285490 - DNA, 20 bp, Artificial
  CRISPR gRNA sequence
acaatgctccctctttacct

SEQ ID NO: 285491 - DNA, 20 bp, Artificial
  CRISPR gRNA sequence
caatgctccctctttacctc

SEQ ID NO: 285492 - DNA, 20 bp, Artificial
  CRISPR gRNA sequence
cctctttacctctttgccaa

SEQ ID NO: 285493 - DNA, 20 bp, Artificial
  CRISPR gRNA sequence
tttacctctttgccaagggg

SEQ ID NO: 285494 - DNA, 20 bp, Artificial
  CRISPR gRNA sequence
tacctctttgccaaggggac

SEQ ID NO: 285495 - DNA, 20 bp, Artificial
  CRISPR gRNA sequence
acctctttgccaaggggaca

SEQ ID NO: 285496 - DNA, 20 bp, Artificial
  CRISPR gRNA sequence
cctctttgccaaggggacat

SEQ ID NO: 285497 - DNA, 20 bp, Artificial
  CRISPR gRNA sequence
tttgccaaggggacatttgg

SEQ ID NO: 285498 - DNA, 20 bp, Artificial
  CRISPR gRNA sequence
tgccaaggggacatttggca

SEQ ID NO: 285499 - DNA, 20 bp, Artificial
  CRISPR gRNA sequence
gccaaggggacatttggcaa

SEQ ID NO: 285500 - DNA, 20 bp, Artificial
  CRISPR gRNA sequence
ccaaggggacatttggcaat

SEQ ID NO: 285501 - DNA, 20 bp, Artificial
  CRISPR gRNA sequence
ggcaatgcttggggatattt

SEQ ID NO: 285502 - DNA, 20 bp, Artificial
  CRISPR gRNA sequence
gcaatgcttggggatatttt

SEQ ID NO: 285503 - DNA, 20 bp, Artificial
  CRISPR gRNA sequence
ggggatatttttgattgtcg

SEQ ID NO: 285504 - DNA, 20 bp, Artificial
  CRISPR gRNA sequence
gggatatttttgattgtcgc

SEQ ID NO: 285505 - DNA, 20 bp, Artificial
  CRISPR gRNA sequence
ttgattgtcgcaacgggcaa

SEQ ID NO: 285506 - DNA, 20 bp, Artificial
  CRISPR gRNA sequence
tgattgtcgcaacgggcaag

SEQ ID NO: 285507 - DNA, 20 bp, Artificial
  CRISPR gRNA sequence
gattgtcgcaacgggcaagg

SEQ ID NO: 285508 - DNA, 20 bp, Artificial
  CRISPR gRNA sequence
attgtcgcaacgggcaaggg

SEQ ID NO: 285509 - DNA, 20 bp, Artificial
  CRISPR gRNA sequence
tcgcaacgggcaaggggtgc

SEQ ID NO: 285510 - DNA, 20 bp, Artificial
  CRISPR gRNA sequence
ctggcatgtagtgagtagag

SEQ ID NO: 285511 - DNA, 20 bp, Artificial
  CRISPR gRNA sequence
gcatgtagtgagtagaggct

SEQ ID NO: 285512 - DNA, 20 bp, Artificial
  CRISPR gRNA sequence
aggaagctgctaaacatcct

SEQ ID NO: 285513 - DNA, 20 bp, Artificial
  CRISPR gRNA sequence
ctaaacatcctacagtgcac

SEQ ID NO: 285514 - DNA, 20 bp, Artificial
  CRISPR gRNA sequence
aacatcctacagtgcacaga

SEQ ID NO: 285515 - DNA, 20 bp, Artificial
  CRISPR gRNA sequence
cagtgcacagaacagcactc

SEQ ID NO: 285516 - DNA, 20 bp, Artificial
  CRISPR gRNA sequence
caaaacaaagaattatcttg

SEQ ID NO: 285517 - DNA, 20 bp, Artificial
  CRISPR gRNA sequence
tcttgcccaaaatgccaata

SEQ ID NO: 285518 - DNA, 20 bp, Artificial
  CRISPR gRNA sequence
gcccaaaatgccaataatgt

SEQ ID NO: 285519 - DNA, 20 bp, Artificial
  CRISPR gRNA sequence
cccaaaatgccaataatgtt

SEQ ID NO: 285520 - DNA, 20 bp, Artificial
  CRISPR gRNA sequence
aggatgagagcccctgaatt

SEQ ID NO: 285521 - DNA, 20 bp, Artificial
  CRISPR gRNA sequence
aattaaaggggtaacactgg

SEQ ID NO: 285522 - DNA, 20 bp, Artificial
  CRISPR gRNA sequence
aaggggtaacactggatagt

SEQ ID NO: 285523 - DNA, 20 bp, Artificial
  CRISPR gRNA sequence
gatagttggtattagaaaca

SEQ ID NO: 285524 - DNA, 20 bp, Artificial
  CRISPR gRNA sequence
gtattagaaacatccttgag

SEQ ID NO: 285525 - DNA, 20 bp, Artificial
  CRISPR gRNA sequence
gaaacatccttgagcccacc

SEQ ID NO: 285526 - DNA, 20 bp, Artificial
  CRISPR gRNA sequence
gagcccaccagacctcttta

SEQ ID NO: 285527 - DNA, 20 bp, Artificial
  CRISPR gRNA sequence
agcccaccagacctctttat

SEQ ID NO: 285528 - DNA, 20 bp, Artificial
  CRISPR gRNA sequence
tttatcctacccttgggata

SEQ ID NO: 285529 - DNA, 20 bp, Artificial
  CRISPR gRNA sequence
tatcctacccttgggataag

SEQ ID NO: 285530 - DNA, 20 bp, Artificial
  CRISPR gRNA sequence
atcctacccttgggataagt

SEQ ID NO: 285531 - DNA, 20 bp, Artificial
  CRISPR gRNA sequence
tcctacccttgggataagtt

SEQ ID NO: 285532 - DNA, 20 bp, Artificial
  CRISPR gRNA sequence
cccttgggataagttgttaa

SEQ ID NO: 285533 - DNA, 20 bp, Artificial
  CRISPR gRNA sequence
gggataagttgttaacagca

SEQ ID NO: 285534 - DNA, 20 bp, Artificial
  CRISPR gRNA sequence
ggataagttgttaacagcac

SEQ ID NO: 285535 - DNA, 20 bp, Artificial
  CRISPR gRNA sequence
ttaacagcacatactctcta

SEQ ID NO: 285536 - DNA, 20 bp, Artificial
  CRISPR gRNA sequence
acagcacatactctctaaag

SEQ ID NO: 285537 - DNA, 20 bp, Artificial
  CRISPR gRNA sequence
tctaaagaattcactgagct

SEQ ID NO: 285538 - DNA, 20 bp, Artificial
  CRISPR gRNA sequence
taaagaattcactgagcttt

SEQ ID NO: 285539 - DNA, 20 bp, Artificial
  CRISPR gRNA sequence
aagaattcactgagctttgg

SEQ ID NO: 285540 - DNA, 20 bp, Artificial
  CRISPR gRNA sequence
actgagctttgggttttttt

SEQ ID NO: 285541 - DNA, 20 bp, Artificial
  CRISPR gRNA sequence
agctttgggtttttttggtg

SEQ ID NO: 285542 - DNA, 20 bp, Artificial
  CRISPR gRNA sequence
tgggtttttttggtgctaaa

SEQ ID NO: 285543 - DNA, 20 bp, Artificial
  CRISPR gRNA sequence
gggtttttttggtgctaaag

SEQ ID NO: 285544 - DNA, 20 bp, Artificial
  CRISPR gRNA sequence
ggtttttttggtgctaaagc

SEQ ID NO: 285545 - DNA, 20 bp, Artificial
  CRISPR gRNA sequence
ttttggtgctaaagcctggg

SEQ ID NO: 285546 - DNA, 20 bp, Artificial
  CRISPR gRNA sequence
tttggtgctaaagcctggga

SEQ ID NO: 285547 - DNA, 20 bp, Artificial
  CRISPR gRNA sequence
ttggtgctaaagcctgggaa

SEQ ID NO: 285548 - DNA, 20 bp, Artificial
  CRISPR gRNA sequence
tggtgctaaagcctgggaaa

SEQ ID NO: 285549 - DNA, 20 bp, Artificial
  CRISPR gRNA sequence
ggtgctaaagcctgggaaaa

SEQ ID NO: 285550 - DNA, 20 bp, Artificial
  CRISPR gRNA sequence
gtgctaaagcctgggaaaat

SEQ ID NO: 285551 - DNA, 20 bp, Artificial
  CRISPR gRNA sequence
aagcctgggaaaatcagcag

SEQ ID NO: 285552 - DNA, 20 bp, Artificial
  CRISPR gRNA sequence
ggaaaatcagcagatgttga

SEQ ID NO: 285553 - DNA, 20 bp, Artificial
  CRISPR gRNA sequence
atcttccgattttatttgat

SEQ ID NO: 285554 - DNA, 20 bp, Artificial
  CRISPR gRNA sequence
ccgattttatttgatcagtg

SEQ ID NO: 285555 - DNA, 20 bp, Artificial
  CRISPR gRNA sequence
cgattttatttgatcagtgt

SEQ ID NO: 285556 - DNA, 20 bp, Artificial
  CRISPR gRNA sequence
tatttgatcagtgtacatga

SEQ ID NO: 285557 - DNA, 20 bp, Artificial
  CRISPR gRNA sequence
atttgatcagtgtacatgat

SEQ ID NO: 285558 - DNA, 20 bp, Artificial
  CRISPR gRNA sequence
tttgatcagtgtacatgatt

SEQ ID NO: 285559 - DNA, 20 bp, Artificial
  CRISPR gRNA sequence
gatcagtgtacatgatttct

SEQ ID NO: 285560 - DNA, 20 bp, Artificial
  CRISPR gRNA sequence
atcagtgtacatgatttcta

SEQ ID NO: 285561 - DNA, 20 bp, Artificial
  CRISPR gRNA sequence
ctactcaaagaagggttggt

SEQ ID NO: 285562 - DNA, 20 bp, Artificial
  CRISPR gRNA sequence
tactcaaagaagggttggta

SEQ ID NO: 285563 - DNA, 20 bp, Artificial
  CRISPR gRNA sequence
ctcaaagaagggttggtacc

SEQ ID NO: 285564 - DNA, 20 bp, Artificial
  CRISPR gRNA sequence
aaagaagggttggtacccct

SEQ ID NO: 285565 - DNA, 20 bp, Artificial
  CRISPR gRNA sequence
gtaccccttcatagtgatta

SEQ ID NO: 285566 - DNA, 20 bp, Artificial
  CRISPR gRNA sequence
catagtgattatggccttat

SEQ ID NO: 285567 - DNA, 20 bp, Artificial
  CRISPR gRNA sequence
atagtgattatggccttatt

SEQ ID NO: 285568 - DNA, 20 bp, Artificial
  CRISPR gRNA sequence
tggccttatttcggaccata

SEQ ID NO: 285569 - DNA, 20 bp, Artificial
  CRISPR gRNA sequence
atttcggaccatagaactag

SEQ ID NO: 285570 - DNA, 20 bp, Artificial
  CRISPR gRNA sequence
tttcggaccatagaactagc

SEQ ID NO: 285571 - DNA, 20 bp, Artificial
  CRISPR gRNA sequence
cggaccatagaactagcagt

SEQ ID NO: 285572 - DNA, 20 bp, Artificial
  CRISPR gRNA sequence
ggaccatagaactagcagtt

SEQ ID NO: 285573 - DNA, 20 bp, Artificial
  CRISPR gRNA sequence
gcagttcctcttcatttaat

SEQ ID NO: 285574 - DNA, 20 bp, Artificial
  CRISPR gRNA sequence
ctcttcatttaatcatagag

SEQ ID NO: 285575 - DNA, 20 bp, Artificial
  CRISPR gRNA sequence
ttcatttaatcatagagatt

SEQ ID NO: 285576 - DNA, 20 bp, Artificial
  CRISPR gRNA sequence
catttaatcatagagattga

SEQ ID NO: 285577 - DNA, 20 bp, Artificial
  CRISPR gRNA sequence
atttaatcatagagattgag

SEQ ID NO: 285578 - DNA, 20 bp, Artificial
  CRISPR gRNA sequence
aatcatagagattgagggca

SEQ ID NO: 285579 - DNA, 20 bp, Artificial
  CRISPR gRNA sequence
atcatagagattgagggcag

SEQ ID NO: 285580 - DNA, 20 bp, Artificial
  CRISPR gRNA sequence
agggcagcatatgtctaaca

SEQ ID NO: 285581 - DNA, 20 bp, Artificial
  CRISPR gRNA sequence
acacccaaagtgtaaattca

SEQ ID NO: 285582 - DNA, 20 bp, Artificial
  CRISPR gRNA sequence
atagggtaaaatatcttaga

SEQ ID NO: 285583 - DNA, 20 bp, Artificial
  CRISPR gRNA sequence
agaaatctcttctttcatca

SEQ ID NO: 285584 - DNA, 20 bp, Artificial
  CRISPR gRNA sequence
gaaatctcttctttcatcag

SEQ ID NO: 285585 - DNA, 20 bp, Artificial
  CRISPR gRNA sequence
ttctttcatcagccactcct

SEQ ID NO: 285586 - DNA, 20 bp, Artificial
  CRISPR gRNA sequence
ctttcatcagccactcctga

SEQ ID NO: 285587 - DNA, 20 bp, Artificial
  CRISPR gRNA sequence
tttcatcagccactcctgat

SEQ ID NO: 285588 - DNA, 20 bp, Artificial
  CRISPR gRNA sequence
tcatcagccactcctgatct

SEQ ID NO: 285589 - DNA, 20 bp, Artificial
  CRISPR gRNA sequence
catcagccactcctgatctt

SEQ ID NO: 285590 - DNA, 20 bp, Artificial
  CRISPR gRNA sequence
atcagccactcctgatcttt

SEQ ID NO: 285591 - DNA, 20 bp, Artificial
  CRISPR gRNA sequence
ctgatctttcatccaaaaat

SEQ ID NO: 285592 - DNA, 20 bp, Artificial
  CRISPR gRNA sequence
atctttcatccaaaaatgta

SEQ ID NO: 285593 - DNA, 20 bp, Artificial
  CRISPR gRNA sequence
tcatccaaaaatgtattcta

SEQ ID NO: 285594 - DNA, 20 bp, Artificial
  CRISPR gRNA sequence
catccaaaaatgtattctaa

SEQ ID NO: 285595 - DNA, 20 bp, Artificial
  CRISPR gRNA sequence
atccaaaaatgtattctaaa

SEQ ID NO: 285596 - DNA, 20 bp, Artificial
  CRISPR gRNA sequence
taaagaactgagaaaatgga

SEQ ID NO: 285597 - DNA, 20 bp, Artificial
  CRISPR gRNA sequence
aagaactgagaaaatggaca

SEQ ID NO: 285598 - DNA, 20 bp, Artificial
  CRISPR gRNA sequence
agaaaatggacattttccag

SEQ ID NO: 285599 - DNA, 20 bp, Artificial
  CRISPR gRNA sequence
tccagacacctatgtgtgtg

SEQ ID NO: 285600 - DNA, 20 bp, Artificial
  CRISPR gRNA sequence
ccagacacctatgtgtgtgg

SEQ ID NO: 285601 - DNA, 20 bp, Artificial
  CRISPR gRNA sequence
cagacacctatgtgtgtggc

SEQ ID NO: 285602 - DNA, 20 bp, Artificial
  CRISPR gRNA sequence
tgtgtgtggcactctactag

SEQ ID NO: 285603 - DNA, 20 bp, Artificial
  CRISPR gRNA sequence
tactaggcactggaattcca

SEQ ID NO: 285604 - DNA, 20 bp, Artificial
  CRISPR gRNA sequence
ctaggcactggaattccaaa

SEQ ID NO: 285605 - DNA, 20 bp, Artificial
  CRISPR gRNA sequence
ggcactggaattccaaagac

SEQ ID NO: 285606 - DNA, 20 bp, Artificial
  CRISPR gRNA sequence
gaattccaaagacaagaagt

SEQ ID NO: 285607 - DNA, 20 bp, Artificial
  CRISPR gRNA sequence
caaagacaagaagtcccagc

SEQ ID NO: 285608 - DNA, 20 bp, Artificial
  CRISPR gRNA sequence
tgggaagccaaggcaggcgg

SEQ ID NO: 285609 - DNA, 20 bp, Artificial
  CRISPR gRNA sequence
gggaagccaaggcaggcgga

SEQ ID NO: 285610 - DNA, 20 bp, Artificial
  CRISPR gRNA sequence
ggaagccaaggcaggcggat

SEQ ID NO: 285611 - DNA, 20 bp, Artificial
  CRISPR gRNA sequence
gccaacatggtgaaaccccg

SEQ ID NO: 285612 - DNA, 20 bp, Artificial
  CRISPR gRNA sequence
tactaaaaatacaaaaaaaa

SEQ ID NO: 285613 - DNA, 20 bp, Artificial
  CRISPR gRNA sequence
ctaaaaatacaaaaaaaaat

SEQ ID NO: 285614 - DNA, 20 bp, Artificial
  CRISPR gRNA sequence
aaaatacaaaaaaaaattag

SEQ ID NO: 285615 - DNA, 20 bp, Artificial
  CRISPR gRNA sequence
gtcaggcgtggcagcacgca

SEQ ID NO: 285616 - DNA, 20 bp, Artificial
  CRISPR gRNA sequence
tagtcccagctactcaggag

SEQ ID NO: 285617 - DNA, 20 bp, Artificial
  CRISPR gRNA sequence
ctcaggaggctgaggccgga

SEQ ID NO: 285618 - DNA, 20 bp, Artificial
  CRISPR gRNA sequence
aggaggctgaggccggataa

SEQ ID NO: 285619 - DNA, 20 bp, Artificial
  CRISPR gRNA sequence
aggccggataattgcttgaa

SEQ ID NO: 285620 - DNA, 20 bp, Artificial
  CRISPR gRNA sequence
cttgaacctgggaggcggag

SEQ ID NO: 285621 - DNA, 20 bp, Artificial
  CRISPR gRNA sequence
gaacctgggaggcggaggtg

SEQ ID NO: 285622 - DNA, 20 bp, Artificial
  CRISPR gRNA sequence
aacctgggaggcggaggtgc

SEQ ID NO: 285623 - DNA, 20 bp, Artificial
  CRISPR gRNA sequence
ggaggcggaggtgcagtgag

SEQ ID NO: 285624 - DNA, 20 bp, Artificial
  CRISPR gRNA sequence
agatcggggcatacactcca

SEQ ID NO: 285625 - DNA, 20 bp, Artificial
  CRISPR gRNA sequence
cagcctgggtggcagagtga

SEQ ID NO: 285626 - DNA, 20 bp, Artificial
  CRISPR gRNA sequence
ggtggcagagtgagactcca

SEQ ID NO: 285627 - DNA, 20 bp, Artificial
  CRISPR gRNA sequence
catctcaaaaaaaaaaaaga

SEQ ID NO: 285628 - DNA, 20 bp, Artificial
  CRISPR gRNA sequence
aaaaaaaaaaaagaactaag

SEQ ID NO: 285629 - DNA, 20 bp, Artificial
  CRISPR gRNA sequence
agaattggtttgtgttttga

SEQ ID NO: 285630 - DNA, 20 bp, Artificial
  CRISPR gRNA sequence
gtttgtgttttgagatggag

SEQ ID NO: 285631 - DNA, 20 bp, Artificial
  CRISPR gRNA sequence
gtgttttgagatggagtctc

SEQ ID NO: 285632 - DNA, 20 bp, Artificial
  CRISPR gRNA sequence
tgttttgagatggagtctca

SEQ ID NO: 285633 - DNA, 20 bp, Artificial
  CRISPR gRNA sequence
tgagatggagtctcactctg

SEQ ID NO: 285634 - DNA, 20 bp, Artificial
  CRISPR gRNA sequence
gagatggagtctcactctgt

SEQ ID NO: 285635 - DNA, 20 bp, Artificial
  CRISPR gRNA sequence
agatggagtctcactctgtc

SEQ ID NO: 285636 - DNA, 20 bp, Artificial
  CRISPR gRNA sequence
actctgtcacccaggctgga

SEQ ID NO: 285637 - DNA, 20 bp, Artificial
  CRISPR gRNA sequence
tgtcacccaggctggagtgc

SEQ ID NO: 285638 - DNA, 20 bp, Artificial
  CRISPR gRNA sequence
tcacccaggctggagtgcaa

SEQ ID NO: 285639 - DNA, 20 bp, Artificial
  CRISPR gRNA sequence
gagtgcaatggcatgatctt

SEQ ID NO: 285640 - DNA, 20 bp, Artificial
  CRISPR gRNA sequence
ggctcactgcagtctccgcc

SEQ ID NO: 285641 - DNA, 20 bp, Artificial
  CRISPR gRNA sequence
gctcactgcagtctccgcct

SEQ ID NO: 285642 - DNA, 20 bp, Artificial
  CRISPR gRNA sequence
actgcagtctccgcctcctg

SEQ ID NO: 285643 - DNA, 20 bp, Artificial
  CRISPR gRNA sequence
cagtctccgcctcctgggtt

SEQ ID NO: 285644 - DNA, 20 bp, Artificial
  CRISPR gRNA sequence
cgcctcctgggttcctgggt

SEQ ID NO: 285645 - DNA, 20 bp, Artificial
  CRISPR gRNA sequence
ctgggttcctgggttcaagc

SEQ ID NO: 285646 - DNA, 20 bp, Artificial
  CRISPR gRNA sequence
ggttcctgggttcaagcaat

SEQ ID NO: 285647 - DNA, 20 bp, Artificial
  CRISPR gRNA sequence
ctgggttcaagcaattctcc

SEQ ID NO: 285648 - DNA, 20 bp, Artificial
  CRISPR gRNA sequence
ggttcaagcaattctcctgc

SEQ ID NO: 285649 - DNA, 20 bp, Artificial
  CRISPR gRNA sequence
aagcaattctcctgcttcag

SEQ ID NO: 285650 - DNA, 20 bp, Artificial
  CRISPR gRNA sequence
tcctgcttcagcctcctgag

SEQ ID NO: 285651 - DNA, 20 bp, Artificial
  CRISPR gRNA sequence
ctgcttcagcctcctgagta

SEQ ID NO: 285652 - DNA, 20 bp, Artificial
  CRISPR gRNA sequence
cttcagcctcctgagtagct

SEQ ID NO: 285653 - DNA, 20 bp, Artificial
  CRISPR gRNA sequence
cagcctcctgagtagctagg

SEQ ID NO: 285654 - DNA, 20 bp, Artificial
  CRISPR gRNA sequence
agcctcctgagtagctagga

SEQ ID NO: 285655 - DNA, 20 bp, Artificial
  CRISPR gRNA sequence
ctgagtagctaggactacag

SEQ ID NO: 285656 - DNA, 20 bp, Artificial
  CRISPR gRNA sequence
agtagctaggactacaggtg

SEQ ID NO: 285657 - DNA, 20 bp, Artificial
  CRISPR gRNA sequence
ggactacaggtgcacgccac

SEQ ID NO: 285658 - DNA, 20 bp, Artificial
  CRISPR gRNA sequence
caggtgcacgccaccatgcc

SEQ ID NO: 285659 - DNA, 20 bp, Artificial
  CRISPR gRNA sequence
gctaatttttgtatttttag

SEQ ID NO: 285660 - DNA, 20 bp, Artificial
  CRISPR gRNA sequence
atttttgtatttttagtaga

SEQ ID NO: 285661 - DNA, 20 bp, Artificial
  CRISPR gRNA sequence
ttgtatttttagtagagaca

SEQ ID NO: 285662 - DNA, 20 bp, Artificial
  CRISPR gRNA sequence
tgtatttttagtagagacag

SEQ ID NO: 285663 - DNA, 20 bp, Artificial
  CRISPR gRNA sequence
gtatttttagtagagacaga

SEQ ID NO: 285664 - DNA, 20 bp, Artificial
  CRISPR gRNA sequence
tatttttagtagagacagag

SEQ ID NO: 285665 - DNA, 20 bp, Artificial
  CRISPR gRNA sequence
ttagtagagacagagtttca

SEQ ID NO: 285666 - DNA, 20 bp, Artificial
  CRISPR gRNA sequence
tagtagagacagagtttcac

SEQ ID NO: 285667 - DNA, 20 bp, Artificial
  CRISPR gRNA sequence
agtagagacagagtttcacc

SEQ ID NO: 285668 - DNA, 20 bp, Artificial
  CRISPR gRNA sequence
gtagagacagagtttcacca

SEQ ID NO: 285669 - DNA, 20 bp, Artificial
  CRISPR gRNA sequence
caccatgttggccaggccgg

SEQ ID NO: 285670 - DNA, 20 bp, Artificial
  CRISPR gRNA sequence
accatgttggccaggccggt

SEQ ID NO: 285671 - DNA, 20 bp, Artificial
  CRISPR gRNA sequence
gccaggccggtctcgaactc

SEQ ID NO: 285672 - DNA, 20 bp, Artificial
  CRISPR gRNA sequence
gaactcctgaccttaagtga

SEQ ID NO: 285673 - DNA, 20 bp, Artificial
  CRISPR gRNA sequence
ctgaccttaagtgatccacc

SEQ ID NO: 285674 - DNA, 20 bp, Artificial
  CRISPR gRNA sequence
accttaagtgatccacctgc

SEQ ID NO: 285675 - DNA, 20 bp, Artificial
  CRISPR gRNA sequence
aagtgatccacctgccttgg

SEQ ID NO: 285676 - DNA, 20 bp, Artificial
  CRISPR gRNA sequence
agtgatccacctgccttggc

SEQ ID NO: 285677 - DNA, 20 bp, Artificial
  CRISPR gRNA sequence
ccttggcctcccaaagtgct

SEQ ID NO: 285678 - DNA, 20 bp, Artificial
  CRISPR gRNA sequence
ggcctcccaaagtgctggga

SEQ ID NO: 285679 - DNA, 20 bp, Artificial
  CRISPR gRNA sequence
gcctcccaaagtgctgggat

SEQ ID NO: 285680 - DNA, 20 bp, Artificial
  CRISPR gRNA sequence
ccaaagtgctgggattacag

SEQ ID NO: 285681 - DNA, 20 bp, Artificial
  CRISPR gRNA sequence
ggattacaggcatgagccac

SEQ ID NO: 285682 - DNA, 20 bp, Artificial
  CRISPR gRNA sequence
caggcatgagccaccccacc

SEQ ID NO: 285683 - DNA, 20 bp, Artificial
  CRISPR gRNA sequence
agaattggtgagatcacctg

SEQ ID NO: 285684 - DNA, 20 bp, Artificial
  CRISPR gRNA sequence
gtgagatcacctgtagccat

SEQ ID NO: 285685 - DNA, 20 bp, Artificial
  CRISPR gRNA sequence
tagccatgtagtttctcaac

SEQ ID NO: 285686 - DNA, 20 bp, Artificial
  CRISPR gRNA sequence
ctcaactgtattagtgcatc

SEQ ID NO: 285687 - DNA, 20 bp, Artificial
  CRISPR gRNA sequence
tcaactgtattagtgcatct

SEQ ID NO: 285688 - DNA, 20 bp, Artificial
  CRISPR gRNA sequence
aactgtattagtgcatcttg

SEQ ID NO: 285689 - DNA, 20 bp, Artificial
  CRISPR gRNA sequence
tattagtgcatcttgccctc

SEQ ID NO: 285690 - DNA, 20 bp, Artificial
  CRISPR gRNA sequence
gtgcatcttgccctcctcca

SEQ ID NO: 285691 - DNA, 20 bp, Artificial
  CRISPR gRNA sequence
gccctcctccaagaaaatga

SEQ ID NO: 285692 - DNA, 20 bp, Artificial
  CRISPR gRNA sequence
ccctcctccaagaaaatgat

SEQ ID NO: 285693 - DNA, 20 bp, Artificial
  CRISPR gRNA sequence
ctccaagaaaatgattcttg

SEQ ID NO: 285694 - DNA, 20 bp, Artificial
  CRISPR gRNA sequence
caagaaaatgattcttggca

SEQ ID NO: 285695 - DNA, 20 bp, Artificial
  CRISPR gRNA sequence
ttggcaccaaaatttgtcaa

SEQ ID NO: 285696 - DNA, 20 bp, Artificial
  CRISPR gRNA sequence
ggcaccaaaatttgtcaatt

SEQ ID NO: 285697 - DNA, 20 bp, Artificial
  CRISPR gRNA sequence
gcaccaaaatttgtcaattt

SEQ ID NO: 285698 - DNA, 20 bp, Artificial
  CRISPR gRNA sequence
gtcaatttgccttttctcta

SEQ ID NO: 285699 - DNA, 20 bp, Artificial
  CRISPR gRNA sequence
tcaatttgccttttctctaa

SEQ ID NO: 285700 - DNA, 20 bp, Artificial
  CRISPR gRNA sequence
gccttttctctaactccaaa

SEQ ID NO: 285701 - DNA, 20 bp, Artificial
  CRISPR gRNA sequence
ccttttctctaactccaaat

SEQ ID NO: 285702 - DNA, 20 bp, Artificial
  CRISPR gRNA sequence
ttctctaactccaaatcaaa

SEQ ID NO: 285703 - DNA, 20 bp, Artificial
  CRISPR gRNA sequence
tctctaactccaaatcaaaa

SEQ ID NO: 285704 - DNA, 20 bp, Artificial
  CRISPR gRNA sequence
ctctaactccaaatcaaaat

SEQ ID NO: 285705 - DNA, 20 bp, Artificial
  CRISPR gRNA sequence
tctaactccaaatcaaaatt

SEQ ID NO: 285706 - DNA, 20 bp, Artificial
  CRISPR gRNA sequence
taactccaaatcaaaattag

SEQ ID NO: 285707 - DNA, 20 bp, Artificial
  CRISPR gRNA sequence
actccaaatcaaaattagaa

SEQ ID NO: 285708 - DNA, 20 bp, Artificial
  CRISPR gRNA sequence
caaatcaaaattagaatatc

SEQ ID NO: 285709 - DNA, 20 bp, Artificial
  CRISPR gRNA sequence
gaatatcagcaggatggtgg

SEQ ID NO: 285710 - DNA, 20 bp, Artificial
  CRISPR gRNA sequence
gaattcactaaggagtgtgt

SEQ ID NO: 285711 - DNA, 20 bp, Artificial
  CRISPR gRNA sequence
actaaggagtgtgtaacaac

SEQ ID NO: 285712 - DNA, 20 bp, Artificial
  CRISPR gRNA sequence
aggagtgtgtaacaactcac

SEQ ID NO: 285713 - DNA, 20 bp, Artificial
  CRISPR gRNA sequence
acctgccaaatcgactagcc

SEQ ID NO: 285714 - DNA, 20 bp, Artificial
  CRISPR gRNA sequence
ccaaatcgactagcccttaa

SEQ ID NO: 285715 - DNA, 20 bp, Artificial
  CRISPR gRNA sequence
gcccttaaaaaaaaattaga

SEQ ID NO: 285716 - DNA, 20 bp, Artificial
  CRISPR gRNA sequence
aaaaaaaaattagaatatca

SEQ ID NO: 285717 - DNA, 20 bp, Artificial
  CRISPR gRNA sequence
aaaaaaaattagaatatcat

SEQ ID NO: 285718 - DNA, 20 bp, Artificial
  CRISPR gRNA sequence
gaatatcatttagcatcaga

SEQ ID NO: 285719 - DNA, 20 bp, Artificial
  CRISPR gRNA sequence
agcatcagaaacgttttcaa

SEQ ID NO: 285720 - DNA, 20 bp, Artificial
  CRISPR gRNA sequence
gcatcagaaacgttttcaaa

SEQ ID NO: 285721 - DNA, 20 bp, Artificial
  CRISPR gRNA sequence
tcaaattagttagcaaaccc

SEQ ID NO: 285722 - DNA, 20 bp, Artificial
  CRISPR gRNA sequence
caaattagttagcaaacccc

SEQ ID NO: 285723 - DNA, 20 bp, Artificial
  CRISPR gRNA sequence
aaattagttagcaaacccca

SEQ ID NO: 285724 - DNA, 20 bp, Artificial
  CRISPR gRNA sequence
gttagcaaaccccagtctcc

SEQ ID NO: 285725 - DNA, 20 bp, Artificial
  CRISPR gRNA sequence
gcaaaccccagtctccaaaa

SEQ ID NO: 285726 - DNA, 20 bp, Artificial
  CRISPR gRNA sequence
caaaaatatataaagtcagg

SEQ ID NO: 285727 - DNA, 20 bp, Artificial
  CRISPR gRNA sequence
aactagaatgtgtcttgagg

SEQ ID NO: 285728 - DNA, 20 bp, Artificial
  CRISPR gRNA sequence
gaatgtgtcttgagggcagt

SEQ ID NO: 285729 - DNA, 20 bp, Artificial
  CRISPR gRNA sequence
gagggcagtgacttcttgtc

SEQ ID NO: 285730 - DNA, 20 bp, Artificial
  CRISPR gRNA sequence
agggcagtgacttcttgtca

SEQ ID NO: 285731 - DNA, 20 bp, Artificial
  CRISPR gRNA sequence
cttgtcattgtaattccagt

SEQ ID NO: 285732 - DNA, 20 bp, Artificial
  CRISPR gRNA sequence
ttgtcattgtaattccagtg

SEQ ID NO: 285733 - DNA, 20 bp, Artificial
  CRISPR gRNA sequence
gtcattgtaattccagtgcc

SEQ ID NO: 285734 - DNA, 20 bp, Artificial
  CRISPR gRNA sequence
tcattgtaattccagtgcct

SEQ ID NO: 285735 - DNA, 20 bp, Artificial
  CRISPR gRNA sequence
taattccagtgcctagtaga

SEQ ID NO: 285736 - DNA, 20 bp, Artificial
  CRISPR gRNA sequence
cagtgcctagtagagtgcca

SEQ ID NO: 285737 - DNA, 20 bp, Artificial
  CRISPR gRNA sequence
gtagagtgccacacacgtag

SEQ ID NO: 285738 - DNA, 20 bp, Artificial
  CRISPR gRNA sequence
gttgagacaagtaaaggaga

SEQ ID NO: 285739 - DNA, 20 bp, Artificial
  CRISPR gRNA sequence
ttgagacaagtaaaggagat

SEQ ID NO: 285740 - DNA, 20 bp, Artificial
  CRISPR gRNA sequence
agacaagtaaaggagatgct

SEQ ID NO: 285741 - DNA, 20 bp, Artificial
  CRISPR gRNA sequence
atgtttccataggcttgctg

SEQ ID NO: 285742 - DNA, 20 bp, Artificial
  CRISPR gRNA sequence
ccataggcttgctgtaaaca

SEQ ID NO: 285743 - DNA, 20 bp, Artificial
  CRISPR gRNA sequence
cataggcttgctgtaaacat

SEQ ID NO: 285744 - DNA, 20 bp, Artificial
  CRISPR gRNA sequence
gctgtaaacatgagaagcga

SEQ ID NO: 285745 - DNA, 20 bp, Artificial
  CRISPR gRNA sequence
ctgtaaacatgagaagcgaa

SEQ ID NO: 285746 - DNA, 20 bp, Artificial
  CRISPR gRNA sequence
taaacatgagaagcgaatag

SEQ ID NO: 285747 - DNA, 20 bp, Artificial
  CRISPR gRNA sequence
aaacctcagagagatgccga

SEQ ID NO: 285748 - DNA, 20 bp, Artificial
  CRISPR gRNA sequence
agagagatgccgaaccatgg

SEQ ID NO: 285749 - DNA, 20 bp, Artificial
  CRISPR gRNA sequence
gatcttccagaattgagatc

SEQ ID NO: 285750 - DNA, 20 bp, Artificial
  CRISPR gRNA sequence
atcttccagaattgagatca

SEQ ID NO: 285751 - DNA, 20 bp, Artificial
  CRISPR gRNA sequence
ccagaattgagatcaggatg

SEQ ID NO: 285752 - DNA, 20 bp, Artificial
  CRISPR gRNA sequence
cagaattgagatcaggatga

SEQ ID NO: 285753 - DNA, 20 bp, Artificial
  CRISPR gRNA sequence
agatcaggatgatggtatga

SEQ ID NO: 285754 - DNA, 20 bp, Artificial
  CRISPR gRNA sequence
acagtaggtcaggcagcata

SEQ ID NO: 285755 - DNA, 20 bp, Artificial
  CRISPR gRNA sequence
cagtaggtcaggcagcatat

SEQ ID NO: 285756 - DNA, 20 bp, Artificial
  CRISPR gRNA sequence
catttactgagattaaggta

SEQ ID NO: 285757 - DNA, 20 bp, Artificial
  CRISPR gRNA sequence
actgagattaaggtaatggc

SEQ ID NO: 285758 - DNA, 20 bp, Artificial
  CRISPR gRNA sequence
ctgagattaaggtaatggcc

SEQ ID NO: 285759 - DNA, 20 bp, Artificial
  CRISPR gRNA sequence
agattaaggtaatggcccag

SEQ ID NO: 285760 - DNA, 20 bp, Artificial
  CRISPR gRNA sequence
aggtaatggcccaggatggg

SEQ ID NO: 285761 - DNA, 20 bp, Artificial
  CRISPR gRNA sequence
tcaggaaaatgctcttgctt

SEQ ID NO: 285762 - DNA, 20 bp, Artificial
  CRISPR gRNA sequence
ttgcttggctatggagggaa

SEQ ID NO: 285763 - DNA, 20 bp, Artificial
  CRISPR gRNA sequence
gcttggctatggagggaaaa

SEQ ID NO: 285764 - DNA, 20 bp, Artificial
  CRISPR gRNA sequence
cttggctatggagggaaaag

SEQ ID NO: 285765 - DNA, 20 bp, Artificial
  CRISPR gRNA sequence
ggctatggagggaaaagaat

SEQ ID NO: 285766 - DNA, 20 bp, Artificial
  CRISPR gRNA sequence
gctatggagggaaaagaata

SEQ ID NO: 285767 - DNA, 20 bp, Artificial
  CRISPR gRNA sequence
tggagggaaaagaataatgt

SEQ ID NO: 285768 - DNA, 20 bp, Artificial
  CRISPR gRNA sequence
taatgtatttcctactgcct

SEQ ID NO: 285769 - DNA, 20 bp, Artificial
  CRISPR gRNA sequence
cctactgcctgatactcatt

SEQ ID NO: 285770 - DNA, 20 bp, Artificial
  CRISPR gRNA sequence
ctactgcctgatactcattc

SEQ ID NO: 285771 - DNA, 20 bp, Artificial
  CRISPR gRNA sequence
ctgcctgatactcattctgt

SEQ ID NO: 285772 - DNA, 20 bp, Artificial
  CRISPR gRNA sequence
cctgatactcattctgtgcc

SEQ ID NO: 285773 - DNA, 20 bp, Artificial
  CRISPR gRNA sequence
atactcattctgtgcctttt

SEQ ID NO: 285774 - DNA, 20 bp, Artificial
  CRISPR gRNA sequence
attctgtgccttttctattg

SEQ ID NO: 285775 - DNA, 20 bp, Artificial
  CRISPR gRNA sequence
tgtgccttttctattgatgc

SEQ ID NO: 285776 - DNA, 20 bp, Artificial
  CRISPR gRNA sequence
tgccttttctattgatgcaa

SEQ ID NO: 285777 - DNA, 20 bp, Artificial
  CRISPR gRNA sequence
ttctattgatgcaactgtgg

SEQ ID NO: 285778 - DNA, 20 bp, Artificial
  CRISPR gRNA sequence
tctattgatgcaactgtgga

SEQ ID NO: 285779 - DNA, 20 bp, Artificial
  CRISPR gRNA sequence
ctattgatgcaactgtggag

SEQ ID NO: 285780 - DNA, 20 bp, Artificial
  CRISPR gRNA sequence
tattgatgcaactgtggagt

SEQ ID NO: 285781 - DNA, 20 bp, Artificial
  CRISPR gRNA sequence
ttgatgcaactgtggagtat

SEQ ID NO: 285782 - DNA, 20 bp, Artificial
  CRISPR gRNA sequence
atgcaactgtggagtattct

SEQ ID NO: 285783 - DNA, 20 bp, Artificial
  CRISPR gRNA sequence
tggagtattctttgcctggt

SEQ ID NO: 285784 - DNA, 20 bp, Artificial
  CRISPR gRNA sequence
tttgcctggtcagctctcca

SEQ ID NO: 285785 - DNA, 20 bp, Artificial
  CRISPR gRNA sequence
tgcctggtcagctctccagt

SEQ ID NO: 285786 - DNA, 20 bp, Artificial
  CRISPR gRNA sequence
gcctggtcagctctccagta

SEQ ID NO: 285787 - DNA, 20 bp, Artificial
  CRISPR gRNA sequence
cctggtcagctctccagtat

SEQ ID NO: 285788 - DNA, 20 bp, Artificial
  CRISPR gRNA sequence
gtcagctctccagtatgcag

SEQ ID NO: 285789 - DNA, 20 bp, Artificial
  CRISPR gRNA sequence
tccagtatgcagctgctagc

SEQ ID NO: 285790 - DNA, 20 bp, Artificial
  CRISPR gRNA sequence
cagtatgcagctgctagcat

SEQ ID NO: 285791 - DNA, 20 bp, Artificial
  CRISPR gRNA sequence
ctagcatttttcttgcataa

SEQ ID NO: 285792 - DNA, 20 bp, Artificial
  CRISPR gRNA sequence
gcatttttcttgcataattc

SEQ ID NO: 285793 - DNA, 20 bp, Artificial
  CRISPR gRNA sequence
ttcttgcataattcttcaat

SEQ ID NO: 285794 - DNA, 20 bp, Artificial
  CRISPR gRNA sequence
tcttgcataattcttcaatc

SEQ ID NO: 285795 - DNA, 20 bp, Artificial
  CRISPR gRNA sequence
cttgcataattcttcaatca

SEQ ID NO: 285796 - DNA, 20 bp, Artificial
  CRISPR gRNA sequence
ttgcataattcttcaatcag

SEQ ID NO: 285797 - DNA, 20 bp, Artificial
  CRISPR gRNA sequence
gcataattcttcaatcaggc

SEQ ID NO: 285798 - DNA, 20 bp, Artificial
  CRISPR gRNA sequence
cataattcttcaatcaggca

SEQ ID NO: 285799 - DNA, 20 bp, Artificial
  CRISPR gRNA sequence
ttcaatcaggcacatacttg

SEQ ID NO: 285800 - DNA, 20 bp, Artificial
  CRISPR gRNA sequence
caatcaggcacatacttgtg

SEQ ID NO: 285801 - DNA, 20 bp, Artificial
  CRISPR gRNA sequence
aatcaggcacatacttgtgg

SEQ ID NO: 285802 - DNA, 20 bp, Artificial
  CRISPR gRNA sequence
gtgggcaactaatagtcaga

SEQ ID NO: 285803 - DNA, 20 bp, Artificial
  CRISPR gRNA sequence
tgggcaactaatagtcagat

SEQ ID NO: 285804 - DNA, 20 bp, Artificial
  CRISPR gRNA sequence
atagtcagatgtcacatatt

SEQ ID NO: 285805 - DNA, 20 bp, Artificial
  CRISPR gRNA sequence
aaagtgaaaaagatactttg

SEQ ID NO: 285806 - DNA, 20 bp, Artificial
  CRISPR gRNA sequence
tgaatgtctgcatttactga

SEQ ID NO: 285807 - DNA, 20 bp, Artificial
  CRISPR gRNA sequence
gaatgtctgcatttactgag

SEQ ID NO: 285808 - DNA, 20 bp, Artificial
  CRISPR gRNA sequence
aatgtctgcatttactgagt

SEQ ID NO: 285809 - DNA, 20 bp, Artificial
  CRISPR gRNA sequence
catttactgagttaagttga

SEQ ID NO: 285810 - DNA, 20 bp, Artificial
  CRISPR gRNA sequence
actgagttaagttgacataa

SEQ ID NO: 285811 - DNA, 20 bp, Artificial
  CRISPR gRNA sequence
ctgagttaagttgacataag

SEQ ID NO: 285812 - DNA, 20 bp, Artificial
  CRISPR gRNA sequence
agttaagttgacataaggaa

SEQ ID NO: 285813 - DNA, 20 bp, Artificial
  CRISPR gRNA sequence
agttgacataaggaagattc

SEQ ID NO: 285814 - DNA, 20 bp, Artificial
  CRISPR gRNA sequence
acataaggaagattctaagg

SEQ ID NO: 285815 - DNA, 20 bp, Artificial
  CRISPR gRNA sequence
taaggaaatcttttacaagc

SEQ ID NO: 285816 - DNA, 20 bp, Artificial
  CRISPR gRNA sequence
aggaaatcttttacaagcca

SEQ ID NO: 285817 - DNA, 20 bp, Artificial
  CRISPR gRNA sequence
ttacaagccatcttgcagta

SEQ ID NO: 285818 - DNA, 20 bp, Artificial
  CRISPR gRNA sequence
tacaagccatcttgcagtat

SEQ ID NO: 285819 - DNA, 20 bp, Artificial
  CRISPR gRNA sequence
acaagccatcttgcagtatc

SEQ ID NO: 285820 - DNA, 20 bp, Artificial
  CRISPR gRNA sequence
caagccatcttgcagtatct

SEQ ID NO: 285821 - DNA, 20 bp, Artificial
  CRISPR gRNA sequence
gcagtatctcacttttatag

SEQ ID NO: 285822 - DNA, 20 bp, Artificial
  CRISPR gRNA sequence
cagtatctcacttttatagc

SEQ ID NO: 285823 - DNA, 20 bp, Artificial
  CRISPR gRNA sequence
acttttatagctgattataa

SEQ ID NO: 285824 - DNA, 20 bp, Artificial
  CRISPR gRNA sequence
ttatagctgattataactat

SEQ ID NO: 285825 - DNA, 20 bp, Artificial
  CRISPR gRNA sequence
tatagctgattataactatg

SEQ ID NO: 285826 - DNA, 20 bp, Artificial
  CRISPR gRNA sequence
atagctgattataactatgt

SEQ ID NO: 285827 - DNA, 20 bp, Artificial
  CRISPR gRNA sequence
tagctgattataactatgtg

SEQ ID NO: 285828 - DNA, 20 bp, Artificial
  CRISPR gRNA sequence
attataactatgtgttacta

SEQ ID NO: 285829 - DNA, 20 bp, Artificial
  CRISPR gRNA sequence
taactatgtgttactactaa

SEQ ID NO: 285830 - DNA, 20 bp, Artificial
  CRISPR gRNA sequence
tgtgttactactaactggtt

SEQ ID NO: 285831 - DNA, 20 bp, Artificial
  CRISPR gRNA sequence
ctactaactggttgatgttg

SEQ ID NO: 285832 - DNA, 20 bp, Artificial
  CRISPR gRNA sequence
ctaactggttgatgttgtgt

SEQ ID NO: 285833 - DNA, 20 bp, Artificial
  CRISPR gRNA sequence
actggttgatgttgtgttct

SEQ ID NO: 285834 - DNA, 20 bp, Artificial
  CRISPR gRNA sequence
gttgatgttgtgttctaggt

SEQ ID NO: 285835 - DNA, 20 bp, Artificial
  CRISPR gRNA sequence
atgttgtgttctaggtatac

SEQ ID NO: 285836 - DNA, 20 bp, Artificial
  CRISPR gRNA sequence
tgttctaggtatactttatt

SEQ ID NO: 285837 - DNA, 20 bp, Artificial
  CRISPR gRNA sequence
taggtatactttatttttcc

SEQ ID NO: 285838 - DNA, 20 bp, Artificial
  CRISPR gRNA sequence
ggtatactttatttttcctt

SEQ ID NO: 285839 - DNA, 20 bp, Artificial
  CRISPR gRNA sequence
tatttttccttctctagctc

SEQ ID NO: 285840 - DNA, 20 bp, Artificial
  CRISPR gRNA sequence
atttttccttctctagctct

SEQ ID NO: 285841 - DNA, 20 bp, Artificial
  CRISPR gRNA sequence
tttttccttctctagctctg

SEQ ID NO: 285842 - DNA, 20 bp, Artificial
  CRISPR gRNA sequence
ttccttctctagctctgtcg

SEQ ID NO: 285843 - DNA, 20 bp, Artificial
  CRISPR gRNA sequence
tccttctctagctctgtcgt

SEQ ID NO: 285844 - DNA, 20 bp, Artificial
  CRISPR gRNA sequence
ccttctctagctctgtcgtg

SEQ ID NO: 285845 - DNA, 20 bp, Artificial
  CRISPR gRNA sequence
cttctctagctctgtcgtgc

SEQ ID NO: 285846 - DNA, 20 bp, Artificial
  CRISPR gRNA sequence
ctctagctctgtcgtgcctt

SEQ ID NO: 285847 - DNA, 20 bp, Artificial
  CRISPR gRNA sequence
tctagctctgtcgtgccttc

SEQ ID NO: 285848 - DNA, 20 bp, Artificial
  CRISPR gRNA sequence
tagctctgtcgtgccttctc

SEQ ID NO: 285849 - DNA, 20 bp, Artificial
  CRISPR gRNA sequence
gctctgtcgtgccttctccc

SEQ ID NO: 285850 - DNA, 20 bp, Artificial
  CRISPR gRNA sequence
tgtcgtgccttctccctttc

SEQ ID NO: 285851 - DNA, 20 bp, Artificial
  CRISPR gRNA sequence
tcgtgccttctccctttctc

SEQ ID NO: 285852 - DNA, 20 bp, Artificial
  CRISPR gRNA sequence
ctccctttctcctaccatat

SEQ ID NO: 285853 - DNA, 20 bp, Artificial
  CRISPR gRNA sequence
tccctttctcctaccatatt

SEQ ID NO: 285854 - DNA, 20 bp, Artificial
  CRISPR gRNA sequence
cctttctcctaccatattct

SEQ ID NO: 285855 - DNA, 20 bp, Artificial
  CRISPR gRNA sequence
tctcctaccatattctctct

SEQ ID NO: 285856 - DNA, 20 bp, Artificial
  CRISPR gRNA sequence
ctcctaccatattctctctc

SEQ ID NO: 285857 - DNA, 20 bp, Artificial
  CRISPR gRNA sequence
tcctaccatattctctctca

SEQ ID NO: 285858 - DNA, 20 bp, Artificial
  CRISPR gRNA sequence
ctaccatattctctctcaac

SEQ ID NO: 285859 - DNA, 20 bp, Artificial
  CRISPR gRNA sequence
ccatattctctctcaacaca

SEQ ID NO: 285860 - DNA, 20 bp, Artificial
  CRISPR gRNA sequence
tctctcaacacatacacatc

SEQ ID NO: 285861 - DNA, 20 bp, Artificial
  CRISPR gRNA sequence
tctcaacacatacacatcac

SEQ ID NO: 285862 - DNA, 20 bp, Artificial
  CRISPR gRNA sequence
tcaacacatacacatcacac

SEQ ID NO: 285863 - DNA, 20 bp, Artificial
  CRISPR gRNA sequence
aacacatacacatcacacac

SEQ ID NO: 285864 - DNA, 20 bp, Artificial
  CRISPR gRNA sequence
acctcacagtagctgcccta

SEQ ID NO: 285865 - DNA, 20 bp, Artificial
  CRISPR gRNA sequence
cctcacagtagctgccctaa

SEQ ID NO: 285866 - DNA, 20 bp, Artificial
  CRISPR gRNA sequence
acagtagctgccctaaagct

SEQ ID NO: 285867 - DNA, 20 bp, Artificial
  CRISPR gRNA sequence
ccctaaagctacaggagcca

SEQ ID NO: 285868 - DNA, 20 bp, Artificial
  CRISPR gRNA sequence
aagctacaggagccactttg

SEQ ID NO: 285869 - DNA, 20 bp, Artificial
  CRISPR gRNA sequence
caggagccactttgcattca

SEQ ID NO: 285870 - DNA, 20 bp, Artificial
  CRISPR gRNA sequence
tgcattcactttcggataca

SEQ ID NO: 285871 - DNA, 20 bp, Artificial
  CRISPR gRNA sequence
gcattcactttcggatacag

SEQ ID NO: 285872 - DNA, 20 bp, Artificial
  CRISPR gRNA sequence
cattcactttcggatacagg

SEQ ID NO: 285873 - DNA, 20 bp, Artificial
  CRISPR gRNA sequence
actttcggatacaggttttt

SEQ ID NO: 285874 - DNA, 20 bp, Artificial
  CRISPR gRNA sequence
tcggatacaggtttttcacc

SEQ ID NO: 285875 - DNA, 20 bp, Artificial
  CRISPR gRNA sequence
cggatacaggtttttcaccc

SEQ ID NO: 285876 - DNA, 20 bp, Artificial
  CRISPR gRNA sequence
ggatacaggtttttcaccct

SEQ ID NO: 285877 - DNA, 20 bp, Artificial
  CRISPR gRNA sequence
ttcaccctctagctactgga

SEQ ID NO: 285878 - DNA, 20 bp, Artificial
  CRISPR gRNA sequence
tcaccctctagctactggaa

SEQ ID NO: 285879 - DNA, 20 bp, Artificial
  CRISPR gRNA sequence
caccctctagctactggaaa

SEQ ID NO: 285880 - DNA, 20 bp, Artificial
  CRISPR gRNA sequence
accctctagctactggaaac

SEQ ID NO: 285881 - DNA, 20 bp, Artificial
  CRISPR gRNA sequence
tagctactggaaacacagaa

SEQ ID NO: 285882 - DNA, 20 bp, Artificial
  CRISPR gRNA sequence
gctactggaaacacagaaca

SEQ ID NO: 285883 - DNA, 20 bp, Artificial
  CRISPR gRNA sequence
ctggaaacacagaacaagtc

SEQ ID NO: 285884 - DNA, 20 bp, Artificial
  CRISPR gRNA sequence
gaaacacagaacaagtctgg

SEQ ID NO: 285885 - DNA, 20 bp, Artificial
  CRISPR gRNA sequence
gcaaagaactaagtgtggat

SEQ ID NO: 285886 - DNA, 20 bp, Artificial
  CRISPR gRNA sequence
agtgtggatatggcttggta

SEQ ID NO: 285887 - DNA, 20 bp, Artificial
  CRISPR gRNA sequence
ggtattaggtgggaccatcc

SEQ ID NO: 285888 - DNA, 20 bp, Artificial
  CRISPR gRNA sequence
gtattaggtgggaccatcct

SEQ ID NO: 285889 - DNA, 20 bp, Artificial
  CRISPR gRNA sequence
ggtgggaccatcctagaaga

SEQ ID NO: 285890 - DNA, 20 bp, Artificial
  CRISPR gRNA sequence
gaagagagcactgaaggtta

SEQ ID NO: 285891 - DNA, 20 bp, Artificial
  CRISPR gRNA sequence
aaggttatcagctgtagttt

SEQ ID NO: 285892 - DNA, 20 bp, Artificial
  CRISPR gRNA sequence
tcagctgtagtttcagtccc

SEQ ID NO: 285893 - DNA, 20 bp, Artificial
  CRISPR gRNA sequence
tagtttcagtcccacagaga

SEQ ID NO: 285894 - DNA, 20 bp, Artificial
  CRISPR gRNA sequence
cagtcccacagagagcacaa

SEQ ID NO: 285895 - DNA, 20 bp, Artificial
  CRISPR gRNA sequence
agtcccacagagagcacaag

SEQ ID NO: 285896 - DNA, 20 bp, Artificial
  CRISPR gRNA sequence
gtggatatggtgctgcgggt

SEQ ID NO: 285897 - DNA, 20 bp, Artificial
  CRISPR gRNA sequence
cgggtccatccctccagatc

SEQ ID NO: 285898 - DNA, 20 bp, Artificial
  CRISPR gRNA sequence
cagatcaggagcagcagctg

SEQ ID NO: 285899 - DNA, 20 bp, Artificial
  CRISPR gRNA sequence
cagtatttattcttcagctg

SEQ ID NO: 285900 - DNA, 20 bp, Artificial
  CRISPR gRNA sequence
attcttcagctgctttgagg

SEQ ID NO: 285901 - DNA, 20 bp, Artificial
  CRISPR gRNA sequence
ttcttcagctgctttgagga

SEQ ID NO: 285902 - DNA, 20 bp, Artificial
  CRISPR gRNA sequence
ttcagctgctttgaggaatc

SEQ ID NO: 285903 - DNA, 20 bp, Artificial
  CRISPR gRNA sequence
cagctgctttgaggaatcat

SEQ ID NO: 285904 - DNA, 20 bp, Artificial
  CRISPR gRNA sequence
agctgctttgaggaatcatt

SEQ ID NO: 285905 - DNA, 20 bp, Artificial
  CRISPR gRNA sequence
ctttgaggaatcattagcaa

SEQ ID NO: 285906 - DNA, 20 bp, Artificial
  CRISPR gRNA sequence
tgaggaatcattagcaacat

SEQ ID NO: 285907 - DNA, 20 bp, Artificial
  CRISPR gRNA sequence
gaggaatcattagcaacatc

SEQ ID NO: 285908 - DNA, 20 bp, Artificial
  CRISPR gRNA sequence
aggaatcattagcaacatct

SEQ ID NO: 285909 - DNA, 20 bp, Artificial
  CRISPR gRNA sequence
gcaacatctggaaaaacggc

SEQ ID NO: 285910 - DNA, 20 bp, Artificial
  CRISPR gRNA sequence
gaaaaacggcagggacacaa

SEQ ID NO: 285911 - DNA, 20 bp, Artificial
  CRISPR gRNA sequence
tagcagctcattttctggtt

SEQ ID NO: 285912 - DNA, 20 bp, Artificial
  CRISPR gRNA sequence
attttctggtttctctgaaa

SEQ ID NO: 285913 - DNA, 20 bp, Artificial
  CRISPR gRNA sequence
tctggtttctctgaaatggc

SEQ ID NO: 285914 - DNA, 20 bp, Artificial
  CRISPR gRNA sequence
ctggtttctctgaaatggct

SEQ ID NO: 285915 - DNA, 20 bp, Artificial
  CRISPR gRNA sequence
tggtttctctgaaatggctt

SEQ ID NO: 285916 - DNA, 20 bp, Artificial
  CRISPR gRNA sequence
gtttctctgaaatggcttac

SEQ ID NO: 285917 - DNA, 20 bp, Artificial
  CRISPR gRNA sequence
ctctgaaatggcttacaaat

SEQ ID NO: 285918 - DNA, 20 bp, Artificial
  CRISPR gRNA sequence
tctgaaatggcttacaaata

SEQ ID NO: 285919 - DNA, 20 bp, Artificial
  CRISPR gRNA sequence
tgaaatggcttacaaataaa

SEQ ID NO: 285920 - DNA, 20 bp, Artificial
  CRISPR gRNA sequence
aaatggcttacaaataaatg

SEQ ID NO: 285921 - DNA, 20 bp, Artificial
  CRISPR gRNA sequence
acaaataaatgaatatttac

SEQ ID NO: 285922 - DNA, 20 bp, Artificial
  CRISPR gRNA sequence
caaataaatgaatatttact

SEQ ID NO: 285923 - DNA, 20 bp, Artificial
  CRISPR gRNA sequence
actaacttattgtttttact

SEQ ID NO: 285924 - DNA, 20 bp, Artificial
  CRISPR gRNA sequence
ctaacttattgtttttactt

SEQ ID NO: 285925 - DNA, 20 bp, Artificial
  CRISPR gRNA sequence
acttattgtttttacttttt

SEQ ID NO: 285926 - DNA, 20 bp, Artificial
  CRISPR gRNA sequence
attgtttttactttttttct

SEQ ID NO: 285927 - DNA, 20 bp, Artificial
  CRISPR gRNA sequence
ttgtttttactttttttctt

SEQ ID NO: 285928 - DNA, 20 bp, Artificial
  CRISPR gRNA sequence
tttttactttttttcttcat

SEQ ID NO: 285929 - DNA, 20 bp, Artificial
  CRISPR gRNA sequence
ttactttttttcttcatgct

SEQ ID NO: 285930 - DNA, 20 bp, Artificial
  CRISPR gRNA sequence
tactttttttcttcatgctg

SEQ ID NO: 285931 - DNA, 20 bp, Artificial
  CRISPR gRNA sequence
actttttttcttcatgctga

SEQ ID NO: 285932 - DNA, 20 bp, Artificial
  CRISPR gRNA sequence
ctttttttcttcatgctgaa

SEQ ID NO: 285933 - DNA, 20 bp, Artificial
  CRISPR gRNA sequence
tttttcttcatgctgaagtt

SEQ ID NO: 285934 - DNA, 20 bp, Artificial
  CRISPR gRNA sequence
ttttcttcatgctgaagttt

SEQ ID NO: 285935 - DNA, 20 bp, Artificial
  CRISPR gRNA sequence
tttcttcatgctgaagtttt

SEQ ID NO: 285936 - DNA, 20 bp, Artificial
  CRISPR gRNA sequence
ttcttcatgctgaagtttta

SEQ ID NO: 285937 - DNA, 20 bp, Artificial
  CRISPR gRNA sequence
tcttcatgctgaagttttat

SEQ ID NO: 285938 - DNA, 20 bp, Artificial
  CRISPR gRNA sequence
cttcatgctgaagttttatt

SEQ ID NO: 285939 - DNA, 20 bp, Artificial
  CRISPR gRNA sequence
ttcatgctgaagttttattt

SEQ ID NO: 285940 - DNA, 20 bp, Artificial
  CRISPR gRNA sequence
catgctgaagttttatttaa

SEQ ID NO: 285941 - DNA, 20 bp, Artificial
  CRISPR gRNA sequence
atgctgaagttttatttaaa

SEQ ID NO: 285942 - DNA, 20 bp, Artificial
  CRISPR gRNA sequence
aagttttatttaaaacataa

SEQ ID NO: 285943 - DNA, 20 bp, Artificial
  CRISPR gRNA sequence
tatttaaaacataaaagaaa

SEQ ID NO: 285944 - DNA, 20 bp, Artificial
  CRISPR gRNA sequence
atttaaaacataaaagaaat

SEQ ID NO: 285945 - DNA, 20 bp, Artificial
  CRISPR gRNA sequence
tttaaaacataaaagaaatg

SEQ ID NO: 285946 - DNA, 20 bp, Artificial
  CRISPR gRNA sequence
aaaacataaaagaaatgttc

SEQ ID NO: 285947 - DNA, 20 bp, Artificial
  CRISPR gRNA sequence
aaacataaaagaaatgttcc

SEQ ID NO: 285948 - DNA, 20 bp, Artificial
  CRISPR gRNA sequence
ccccaaaatgctagtgaata

SEQ ID NO: 285949 - DNA, 20 bp, Artificial
  CRISPR gRNA sequence
gtgaataaagcaaaaggata

SEQ ID NO: 285950 - DNA, 20 bp, Artificial
  CRISPR gRNA sequence
tctcactatgagttagccag

SEQ ID NO: 285951 - DNA, 20 bp, Artificial
  CRISPR gRNA sequence
tcactatgagttagccagcc

SEQ ID NO: 285952 - DNA, 20 bp, Artificial
  CRISPR gRNA sequence
actatgagttagccagccta

SEQ ID NO: 285953 - DNA, 20 bp, Artificial
  CRISPR gRNA sequence
tgagttagccagcctatcca

SEQ ID NO: 285954 - DNA, 20 bp, Artificial
  CRISPR gRNA sequence
gccagcctatccaagtacag

SEQ ID NO: 285955 - DNA, 20 bp, Artificial
  CRISPR gRNA sequence
tccaagtacagggtaatata

SEQ ID NO: 285956 - DNA, 20 bp, Artificial
  CRISPR gRNA sequence
aatgctggtagaatttcaca

SEQ ID NO: 285957 - DNA, 20 bp, Artificial
  CRISPR gRNA sequence
gtagaatttcacagtagttt

SEQ ID NO: 285958 - DNA, 20 bp, Artificial
  CRISPR gRNA sequence
cacagtagtttagtgttaaa

SEQ ID NO: 285959 - DNA, 20 bp, Artificial
  CRISPR gRNA sequence
acagtagtttagtgttaaag

SEQ ID NO: 285960 - DNA, 20 bp, Artificial
  CRISPR gRNA sequence
agtgttaaagattatctgtg

SEQ ID NO: 285961 - DNA, 20 bp, Artificial
  CRISPR gRNA sequence
gtgttaaagattatctgtgc

SEQ ID NO: 285962 - DNA, 20 bp, Artificial
  CRISPR gRNA sequence
aagattatctgtgcctagat

SEQ ID NO: 285963 - DNA, 20 bp, Artificial
  CRISPR gRNA sequence
tctgtgcctagattatgaag

SEQ ID NO: 285964 - DNA, 20 bp, Artificial
  CRISPR gRNA sequence
tgcctagattatgaagagat

SEQ ID NO: 285965 - DNA, 20 bp, Artificial
  CRISPR gRNA sequence
gattatgaagagattctcaa

SEQ ID NO: 285966 - DNA, 20 bp, Artificial
  CRISPR gRNA sequence
tgaagagattctcaatgtgt

SEQ ID NO: 285967 - DNA, 20 bp, Artificial
  CRISPR gRNA sequence
tcaatgtgtgatgcttagtt

SEQ ID NO: 285968 - DNA, 20 bp, Artificial
  CRISPR gRNA sequence
aatgtgtgatgcttagttct

SEQ ID NO: 285969 - DNA, 20 bp, Artificial
  CRISPR gRNA sequence
agttctgggtttacacctta

SEQ ID NO: 285970 - DNA, 20 bp, Artificial
  CRISPR gRNA sequence
gttctgggtttacaccttac

SEQ ID NO: 285971 - DNA, 20 bp, Artificial
  CRISPR gRNA sequence
tgggtttacaccttactggg

SEQ ID NO: 285972 - DNA, 20 bp, Artificial
  CRISPR gRNA sequence
ggtttacaccttactgggca

SEQ ID NO: 285973 - DNA, 20 bp, Artificial
  CRISPR gRNA sequence
acaccttactgggcatgaac

SEQ ID NO: 285974 - DNA, 20 bp, Artificial
  CRISPR gRNA sequence
caccttactgggcatgaaca

SEQ ID NO: 285975 - DNA, 20 bp, Artificial
  CRISPR gRNA sequence
actgggcatgaacaagagcc

SEQ ID NO: 285976 - DNA, 20 bp, Artificial
  CRISPR gRNA sequence
ctgggcatgaacaagagccc

SEQ ID NO: 285977 - DNA, 20 bp, Artificial
  CRISPR gRNA sequence
ggcatgaacaagagcccctg

SEQ ID NO: 285978 - DNA, 20 bp, Artificial
  CRISPR gRNA sequence
ctccttggccatagccaaat

SEQ ID NO: 285979 - DNA, 20 bp, Artificial
  CRISPR gRNA sequence
cttggccatagccaaatccc

SEQ ID NO: 285980 - DNA, 20 bp, Artificial
  CRISPR gRNA sequence
ggccatagccaaatcccttg

SEQ ID NO: 285981 - DNA, 20 bp, Artificial
  CRISPR gRNA sequence
gccatagccaaatcccttgg

SEQ ID NO: 285982 - DNA, 20 bp, Artificial
  CRISPR gRNA sequence
gggcccaaagttctttgcat

SEQ ID NO: 285983 - DNA, 20 bp, Artificial
  CRISPR gRNA sequence
ggcccaaagttctttgcata

SEQ ID NO: 285984 - DNA, 20 bp, Artificial
  CRISPR gRNA sequence
tttgcatagcaccattacaa

SEQ ID NO: 285985 - DNA, 20 bp, Artificial
  CRISPR gRNA sequence
tgcatagcaccattacaata

SEQ ID NO: 285986 - DNA, 20 bp, Artificial
  CRISPR gRNA sequence
gcatagcaccattacaatag

SEQ ID NO: 285987 - DNA, 20 bp, Artificial
  CRISPR gRNA sequence
catagcaccattacaataga

SEQ ID NO: 285988 - DNA, 20 bp, Artificial
  CRISPR gRNA sequence
caatagatttcaccttcttt

SEQ ID NO: 285989 - DNA, 20 bp, Artificial
  CRISPR gRNA sequence
caccttctttttcagtcaga

SEQ ID NO: 285990 - DNA, 20 bp, Artificial
  CRISPR gRNA sequence
accttctttttcagtcagag

SEQ ID NO: 285991 - DNA, 20 bp, Artificial
  CRISPR gRNA sequence
ctttttcagtcagagttgtt

SEQ ID NO: 285992 - DNA, 20 bp, Artificial
  CRISPR gRNA sequence
tttttcagtcagagttgttg

SEQ ID NO: 285993 - DNA, 20 bp, Artificial
  CRISPR gRNA sequence
tttcagtcagagttgttgat

SEQ ID NO: 285994 - DNA, 20 bp, Artificial
  CRISPR gRNA sequence
ttcagtcagagttgttgatt

SEQ ID NO: 285995 - DNA, 20 bp, Artificial
  CRISPR gRNA sequence
tcagtcagagttgttgattc

SEQ ID NO: 285996 - DNA, 20 bp, Artificial
  CRISPR gRNA sequence
cagtcagagttgttgattca

SEQ ID NO: 285997 - DNA, 20 bp, Artificial
  CRISPR gRNA sequence
agtcagagttgttgattcaa

SEQ ID NO: 285998 - DNA, 20 bp, Artificial
  CRISPR gRNA sequence
ttgattcaagactcttccca

SEQ ID NO: 285999 - DNA, 20 bp, Artificial
  CRISPR gRNA sequence
attcaagactcttcccacac

SEQ ID NO: 286000 - DNA, 20 bp, Artificial
  CRISPR gRNA sequence
aagactcttcccacactttg

SEQ ID NO: 286001 - DNA, 20 bp, Artificial
  CRISPR gRNA sequence
ttcccacactttgcacatca

SEQ ID NO: 286002 - DNA, 20 bp, Artificial
  CRISPR gRNA sequence
cccacactttgcacatcaga

SEQ ID NO: 286003 - DNA, 20 bp, Artificial
  CRISPR gRNA sequence
ccacactttgcacatcagaa

SEQ ID NO: 286004 - DNA, 20 bp, Artificial
  CRISPR gRNA sequence
tgcacatcagaaacagtttt

SEQ ID NO: 286005 - DNA, 20 bp, Artificial
  CRISPR gRNA sequence
gcacatcagaaacagttttt

SEQ ID NO: 286006 - DNA, 20 bp, Artificial
  CRISPR gRNA sequence
cacatcagaaacagtttttg

SEQ ID NO: 286007 - DNA, 20 bp, Artificial
  CRISPR gRNA sequence
ttgtgccagggctttccagc

SEQ ID NO: 286008 - DNA, 20 bp, Artificial
  CRISPR gRNA sequence
tgtgccagggctttccagct

SEQ ID NO: 286009 - DNA, 20 bp, Artificial
  CRISPR gRNA sequence
gtgccagggctttccagctc

SEQ ID NO: 286010 - DNA, 20 bp, Artificial
  CRISPR gRNA sequence
tgccagggctttccagctcc

SEQ ID NO: 286011 - DNA, 20 bp, Artificial
  CRISPR gRNA sequence
tccagctccaattatcttct

SEQ ID NO: 286012 - DNA, 20 bp, Artificial
  CRISPR gRNA sequence
ccagctccaattatcttctc

SEQ ID NO: 286013 - DNA, 20 bp, Artificial
  CRISPR gRNA sequence
cagctccaattatcttctcg

SEQ ID NO: 286014 - DNA, 20 bp, Artificial
  CRISPR gRNA sequence
caattatcttctcggcagca

SEQ ID NO: 286015 - DNA, 20 bp, Artificial
  CRISPR gRNA sequence
tcttctcggcagcatataca

SEQ ID NO: 286016 - DNA, 20 bp, Artificial
  CRISPR gRNA sequence
ctcggcagcatatacagaat

SEQ ID NO: 286017 - DNA, 20 bp, Artificial
  CRISPR gRNA sequence
tcggcagcatatacagaatc

SEQ ID NO: 286018 - DNA, 20 bp, Artificial
  CRISPR gRNA sequence
ggcagcatatacagaatccc

SEQ ID NO: 286019 - DNA, 20 bp, Artificial
  CRISPR gRNA sequence
gaacatttctcagcacctcc

SEQ ID NO: 286020 - DNA, 20 bp, Artificial
  CRISPR gRNA sequence
ctcagcacctccatatttct

SEQ ID NO: 286021 - DNA, 20 bp, Artificial
  CRISPR gRNA sequence
tcagcacctccatatttctg

SEQ ID NO: 286022 - DNA, 20 bp, Artificial
  CRISPR gRNA sequence
agcacctccatatttctgag

SEQ ID NO: 286023 - DNA, 20 bp, Artificial
  CRISPR gRNA sequence
catatttctgagcaaattta

SEQ ID NO: 286024 - DNA, 20 bp, Artificial
  CRISPR gRNA sequence
ctgagcaaatttagaagcat

SEQ ID NO: 286025 - DNA, 20 bp, Artificial
  CRISPR gRNA sequence
tgagcaaatttagaagcatt

SEQ ID NO: 286026 - DNA, 20 bp, Artificial
  CRISPR gRNA sequence
agcaaatttagaagcatttg

SEQ ID NO: 286027 - DNA, 20 bp, Artificial
  CRISPR gRNA sequence
agaagcatttggatttcttg

SEQ ID NO: 286028 - DNA, 20 bp, Artificial
  CRISPR gRNA sequence
gaagcatttggatttcttgt

SEQ ID NO: 286029 - DNA, 20 bp, Artificial
  CRISPR gRNA sequence
ggatttcttgtaggcctgtg

SEQ ID NO: 286030 - DNA, 20 bp, Artificial
  CRISPR gRNA sequence
gatttcttgtaggcctgtga

SEQ ID NO: 286031 - DNA, 20 bp, Artificial
  CRISPR gRNA sequence
cttgtaggcctgtgaggctg

SEQ ID NO: 286032 - DNA, 20 bp, Artificial
  CRISPR gRNA sequence
ttgtaggcctgtgaggctga

SEQ ID NO: 286033 - DNA, 20 bp, Artificial
  CRISPR gRNA sequence
gtaggcctgtgaggctgaac

SEQ ID NO: 286034 - DNA, 20 bp, Artificial
  CRISPR gRNA sequence
taggcctgtgaggctgaaca

SEQ ID NO: 286035 - DNA, 20 bp, Artificial
  CRISPR gRNA sequence
tgaggctgaacactctctgg

SEQ ID NO: 286036 - DNA, 20 bp, Artificial
  CRISPR gRNA sequence
aacactctctggcttgatgc

SEQ ID NO: 286037 - DNA, 20 bp, Artificial
  CRISPR gRNA sequence
tctggcttgatgcccagcct

SEQ ID NO: 286038 - DNA, 20 bp, Artificial
  CRISPR gRNA sequence
tggcttgatgcccagcctct

SEQ ID NO: 286039 - DNA, 20 bp, Artificial
  CRISPR gRNA sequence
gcttgatgcccagcctctcg

SEQ ID NO: 286040 - DNA, 20 bp, Artificial
  CRISPR gRNA sequence
gatgcccagcctctcgccat

SEQ ID NO: 286041 - DNA, 20 bp, Artificial
  CRISPR gRNA sequence
atgcccagcctctcgccatg

SEQ ID NO: 286042 - DNA, 20 bp, Artificial
  CRISPR gRNA sequence
tcgccatgttaagcgtgcca

SEQ ID NO: 286043 - DNA, 20 bp, Artificial
  CRISPR gRNA sequence
gccatgttaagcgtgccagc

SEQ ID NO: 286044 - DNA, 20 bp, Artificial
  CRISPR gRNA sequence
agcgtgccagcaccctggcc

SEQ ID NO: 286045 - DNA, 20 bp, Artificial
  CRISPR gRNA sequence
gccataaccatagccttttg

SEQ ID NO: 286046 - DNA, 20 bp, Artificial
  CRISPR gRNA sequence
ttgtcccatatttctttcca

SEQ ID NO: 286047 - DNA, 20 bp, Artificial
  CRISPR gRNA sequence
tgtcccatatttctttccat

SEQ ID NO: 286048 - DNA, 20 bp, Artificial
  CRISPR gRNA sequence
gtcccatatttctttccata

SEQ ID NO: 286049 - DNA, 20 bp, Artificial
  CRISPR gRNA sequence
tcccatatttctttccatag

SEQ ID NO: 286050 - DNA, 20 bp, Artificial
  CRISPR gRNA sequence
ctttccatagtaggatttgc

SEQ ID NO: 286051 - DNA, 20 bp, Artificial
  CRISPR gRNA sequence
tttccatagtaggatttgca

SEQ ID NO: 286052 - DNA, 20 bp, Artificial
  CRISPR gRNA sequence
tccatagtaggatttgcagt

SEQ ID NO: 286053 - DNA, 20 bp, Artificial
  CRISPR gRNA sequence
ccatagtaggatttgcagta

SEQ ID NO: 286054 - DNA, 20 bp, Artificial
  CRISPR gRNA sequence
catagtaggatttgcagtag

SEQ ID NO: 286055 - DNA, 20 bp, Artificial
  CRISPR gRNA sequence
gcagtagatctcttcattgt

SEQ ID NO: 286056 - DNA, 20 bp, Artificial
  CRISPR gRNA sequence
cagtagatctcttcattgtg

SEQ ID NO: 286057 - DNA, 20 bp, Artificial
  CRISPR gRNA sequence
ttcattgtgaattgccactg

SEQ ID NO: 286058 - DNA, 20 bp, Artificial
  CRISPR gRNA sequence
cattgtgaattgccactgtt

SEQ ID NO: 286059 - DNA, 20 bp, Artificial
  CRISPR gRNA sequence
attgtgaattgccactgttg

SEQ ID NO: 286060 - DNA, 20 bp, Artificial
  CRISPR gRNA sequence
tgaattgccactgttgtgct

SEQ ID NO: 286061 - DNA, 20 bp, Artificial
  CRISPR gRNA sequence
ccactgttgtgctatctaaa

SEQ ID NO: 286062 - DNA, 20 bp, Artificial
  CRISPR gRNA sequence
ttgtgctatctaaatttttc

SEQ ID NO: 286063 - DNA, 20 bp, Artificial
  CRISPR gRNA sequence
tgctatctaaatttttcctg

SEQ ID NO: 286064 - DNA, 20 bp, Artificial
  CRISPR gRNA sequence
tctaaatttttcctgcaaac

SEQ ID NO: 286065 - DNA, 20 bp, Artificial
  CRISPR gRNA sequence
aatttttcctgcaaaccatt

SEQ ID NO: 286066 - DNA, 20 bp, Artificial
  CRISPR gRNA sequence
ttcctgcaaaccattgagtc

SEQ ID NO: 286067 - DNA, 20 bp, Artificial
  CRISPR gRNA sequence
tcctgcaaaccattgagtcg

SEQ ID NO: 286068 - DNA, 20 bp, Artificial
  CRISPR gRNA sequence
cctgcaaaccattgagtcgg

SEQ ID NO: 286069 - DNA, 20 bp, Artificial
  CRISPR gRNA sequence
ctgcaaaccattgagtcgga

SEQ ID NO: 286070 - DNA, 20 bp, Artificial
  CRISPR gRNA sequence
caaaccattgagtcggaggc

SEQ ID NO: 286071 - DNA, 20 bp, Artificial
  CRISPR gRNA sequence
agtcggaggcaggagcatgc

SEQ ID NO: 286072 - DNA, 20 bp, Artificial
  CRISPR gRNA sequence
gcaaggctgggctggagaga

SEQ ID NO: 286073 - DNA, 20 bp, Artificial
  CRISPR gRNA sequence
ggctggagagagggtccagg

SEQ ID NO: 286074 - DNA, 20 bp, Artificial
  CRISPR gRNA sequence
gagagagggtccagggagtc

SEQ ID NO: 286075 - DNA, 20 bp, Artificial
  CRISPR gRNA sequence
tttttacttttctgattacc

SEQ ID NO: 286076 - DNA, 20 bp, Artificial
  CRISPR gRNA sequence
ttacttttctgattaccaaa

SEQ ID NO: 286077 - DNA, 20 bp, Artificial
  CRISPR gRNA sequence
tacttttctgattaccaaac

SEQ ID NO: 286078 - DNA, 20 bp, Artificial
  CRISPR gRNA sequence
acttttctgattaccaaacc

SEQ ID NO: 286079 - DNA, 20 bp, Artificial
  CRISPR gRNA sequence
cttttctgattaccaaaccc

SEQ ID NO: 286080 - DNA, 20 bp, Artificial
  CRISPR gRNA sequence
ttctgattaccaaacccagt

SEQ ID NO: 286081 - DNA, 20 bp, Artificial
  CRISPR gRNA sequence
tctgattaccaaacccagtg

SEQ ID NO: 286082 - DNA, 20 bp, Artificial
  CRISPR gRNA sequence
ctgattaccaaacccagtgg

SEQ ID NO: 286083 - DNA, 20 bp, Artificial
  CRISPR gRNA sequence
tgattaccaaacccagtggt

SEQ ID NO: 286084 - DNA, 20 bp, Artificial
  CRISPR gRNA sequence
attaccaaacccagtggtaa

SEQ ID NO: 286085 - DNA, 20 bp, Artificial
  CRISPR gRNA sequence
ccaaacccagtggtaagttt

SEQ ID NO: 286086 - DNA, 20 bp, Artificial
  CRISPR gRNA sequence
tatttatttatttatttatt

SEQ ID NO: 286087 - DNA, 20 bp, Artificial
  CRISPR gRNA sequence
atttatttatttatttattt

SEQ ID NO: 286088 - DNA, 20 bp, Artificial
  CRISPR gRNA sequence
tttatttatttatttattta

SEQ ID NO: 286089 - DNA, 20 bp, Artificial
  CRISPR gRNA sequence
atttatttatttatttattt

SEQ ID NO: 286090 - DNA, 20 bp, Artificial
  CRISPR gRNA sequence
tttatttatttatttattta

SEQ ID NO: 286091 - DNA, 20 bp, Artificial
  CRISPR gRNA sequence
atttatttatttatttaaga

SEQ ID NO: 286092 - DNA, 20 bp, Artificial
  CRISPR gRNA sequence
tttatttatttatttaagac

SEQ ID NO: 286093 - DNA, 20 bp, Artificial
  CRISPR gRNA sequence
atttatttatttaagacgga

SEQ ID NO: 286094 - DNA, 20 bp, Artificial
  CRISPR gRNA sequence
tttatttatttaagacggac

SEQ ID NO: 286095 - DNA, 20 bp, Artificial
  CRISPR gRNA sequence
atttatttaagacggacttt

SEQ ID NO: 286096 - DNA, 20 bp, Artificial
  CRISPR gRNA sequence
tttatttaagacggactttc

SEQ ID NO: 286097 - DNA, 20 bp, Artificial
  CRISPR gRNA sequence
atttaagacggactttcact

SEQ ID NO: 286098 - DNA, 20 bp, Artificial
  CRISPR gRNA sequence
tttaagacggactttcactg

SEQ ID NO: 286099 - DNA, 20 bp, Artificial
  CRISPR gRNA sequence
aagacggactttcactgtgt

SEQ ID NO: 286100 - DNA, 20 bp, Artificial
  CRISPR gRNA sequence
agacggactttcactgtgtt

SEQ ID NO: 286101 - DNA, 20 bp, Artificial
  CRISPR gRNA sequence
tcactgtgtttcccaggcca

SEQ ID NO: 286102 - DNA, 20 bp, Artificial
  CRISPR gRNA sequence
cactgtgtttcccaggccag

SEQ ID NO: 286103 - DNA, 20 bp, Artificial
  CRISPR gRNA sequence
actgtgtttcccaggccagg

SEQ ID NO: 286104 - DNA, 20 bp, Artificial
  CRISPR gRNA sequence
tgtttcccaggccaggctgg

SEQ ID NO: 286105 - DNA, 20 bp, Artificial
  CRISPR gRNA sequence
cccaggccaggctggagtgc

SEQ ID NO: 286106 - DNA, 20 bp, Artificial
  CRISPR gRNA sequence
ccaggccaggctggagtgca

SEQ ID NO: 286107 - DNA, 20 bp, Artificial
  CRISPR gRNA sequence
gagtgcagtgatgtgatctc

SEQ ID NO: 286108 - DNA, 20 bp, Artificial
  CRISPR gRNA sequence
agctcactgcaatctctgcc

SEQ ID NO: 286109 - DNA, 20 bp, Artificial
  CRISPR gRNA sequence
actgcaatctctgcctcccg

SEQ ID NO: 286110 - DNA, 20 bp, Artificial
  CRISPR gRNA sequence
caatctctgcctcccgagtt

SEQ ID NO: 286111 - DNA, 20 bp, Artificial
  CRISPR gRNA sequence
tgcctcccgagttcaaggaa

SEQ ID NO: 286112 - DNA, 20 bp, Artificial
  CRISPR gRNA sequence
cctcccgagttcaaggaatt

SEQ ID NO: 286113 - DNA, 20 bp, Artificial
  CRISPR gRNA sequence
ccgagttcaaggaattctcc

SEQ ID NO: 286114 - DNA, 20 bp, Artificial
  CRISPR gRNA sequence
aaggaattctcctgcctcag

SEQ ID NO: 286115 - DNA, 20 bp, Artificial
  CRISPR gRNA sequence
tcctgcctcagcctcccgag

SEQ ID NO: 286116 - DNA, 20 bp, Artificial
  CRISPR gRNA sequence
ctgcctcagcctcccgagta

SEQ ID NO: 286117 - DNA, 20 bp, Artificial
  CRISPR gRNA sequence
cctcagcctcccgagtagct

SEQ ID NO: 286118 - DNA, 20 bp, Artificial
  CRISPR gRNA sequence
agcctcccgagtagctggga

SEQ ID NO: 286119 - DNA, 20 bp, Artificial
  CRISPR gRNA sequence
ccgagtagctgggattacag

SEQ ID NO: 286120 - DNA, 20 bp, Artificial
  CRISPR gRNA sequence
ggattacaggggcgtgccac

SEQ ID NO: 286121 - DNA, 20 bp, Artificial
  CRISPR gRNA sequence
caggggcgtgccaccacacc

SEQ ID NO: 286122 - DNA, 20 bp, Artificial
  CRISPR gRNA sequence
atttttgtattttcagtaga

SEQ ID NO: 286123 - DNA, 20 bp, Artificial
  CRISPR gRNA sequence
ttgtattttcagtagagatg

SEQ ID NO: 286124 - DNA, 20 bp, Artificial
  CRISPR gRNA sequence
tgtattttcagtagagatgg

SEQ ID NO: 286125 - DNA, 20 bp, Artificial
  CRISPR gRNA sequence
gtattttcagtagagatggg

SEQ ID NO: 286126 - DNA, 20 bp, Artificial
  CRISPR gRNA sequence
tattttcagtagagatgggg

SEQ ID NO: 286127 - DNA, 20 bp, Artificial
  CRISPR gRNA sequence
tcagtagagatggggtttcc

SEQ ID NO: 286128 - DNA, 20 bp, Artificial
  CRISPR gRNA sequence
cagtagagatggggtttccc

SEQ ID NO: 286129 - DNA, 20 bp, Artificial
  CRISPR gRNA sequence
agtagagatggggtttcccc

SEQ ID NO: 286130 - DNA, 20 bp, Artificial
  CRISPR gRNA sequence
ccccatgttggccagactgg

SEQ ID NO: 286131 - DNA, 20 bp, Artificial
  CRISPR gRNA sequence
cccatgttggccagactggt

SEQ ID NO: 286132 - DNA, 20 bp, Artificial
  CRISPR gRNA sequence
gccagactggtctcgaactc

SEQ ID NO: 286133 - DNA, 20 bp, Artificial
  CRISPR gRNA sequence
gtctcgaactcctgacctca

SEQ ID NO: 286134 - DNA, 20 bp, Artificial
  CRISPR gRNA sequence
gaactcctgacctcaggtga

SEQ ID NO: 286135 - DNA, 20 bp, Artificial
  CRISPR gRNA sequence
ctgacctcaggtgattctcc

SEQ ID NO: 286136 - DNA, 20 bp, Artificial
  CRISPR gRNA sequence
acctcaggtgattctcctgt

SEQ ID NO: 286137 - DNA, 20 bp, Artificial
  CRISPR gRNA sequence
aggtgattctcctgtcttgg

SEQ ID NO: 286138 - DNA, 20 bp, Artificial
  CRISPR gRNA sequence
tcctgtcttggcctcccaca

SEQ ID NO: 286139 - DNA, 20 bp, Artificial
  CRISPR gRNA sequence
ctgtcttggcctcccacagt

SEQ ID NO: 286140 - DNA, 20 bp, Artificial
  CRISPR gRNA sequence
tcttggcctcccacagtgct

SEQ ID NO: 286141 - DNA, 20 bp, Artificial
  CRISPR gRNA sequence
ggcctcccacagtgctggga

SEQ ID NO: 286142 - DNA, 20 bp, Artificial
  CRISPR gRNA sequence
gcctcccacagtgctgggat

SEQ ID NO: 286143 - DNA, 20 bp, Artificial
  CRISPR gRNA sequence
ccacagtgctgggattacag

SEQ ID NO: 286144 - DNA, 20 bp, Artificial
  CRISPR gRNA sequence
ggattacaggcatgagccac

SEQ ID NO: 286145 - DNA, 20 bp, Artificial
  CRISPR gRNA sequence
caggcatgagccactgcgcc

SEQ ID NO: 286146 - DNA, 20 bp, Artificial
  CRISPR gRNA sequence
cgcctggcctagttttattc

SEQ ID NO: 286147 - DNA, 20 bp, Artificial
  CRISPR gRNA sequence
gcctagttttattcttttgc

SEQ ID NO: 286148 - DNA, 20 bp, Artificial
  CRISPR gRNA sequence
gttttattcttttgcttatt

SEQ ID NO: 286149 - DNA, 20 bp, Artificial
  CRISPR gRNA sequence
tattcttttgcttattggac

SEQ ID NO: 286150 - DNA, 20 bp, Artificial
  CRISPR gRNA sequence
attcttttgcttattggact

SEQ ID NO: 286151 - DNA, 20 bp, Artificial
  CRISPR gRNA sequence
ttcttttgcttattggactt

SEQ ID NO: 286152 - DNA, 20 bp, Artificial
  CRISPR gRNA sequence
ttttgcttattggacttctc

SEQ ID NO: 286153 - DNA, 20 bp, Artificial
  CRISPR gRNA sequence
ttgcttattggacttctcat

SEQ ID NO: 286154 - DNA, 20 bp, Artificial
  CRISPR gRNA sequence
tgcttattggacttctcatc

SEQ ID NO: 286155 - DNA, 20 bp, Artificial
  CRISPR gRNA sequence
gcttattggacttctcatca

SEQ ID NO: 286156 - DNA, 20 bp, Artificial
  CRISPR gRNA sequence
cttattggacttctcatcag

SEQ ID NO: 286157 - DNA, 20 bp, Artificial
  CRISPR gRNA sequence
attggacttctcatcagcat

SEQ ID NO: 286158 - DNA, 20 bp, Artificial
  CRISPR gRNA sequence
ttggacttctcatcagcatt

SEQ ID NO: 286159 - DNA, 20 bp, Artificial
  CRISPR gRNA sequence
gacttctcatcagcatttag

SEQ ID NO: 286160 - DNA, 20 bp, Artificial
  CRISPR gRNA sequence
ctcatcagcatttagccagt

SEQ ID NO: 286161 - DNA, 20 bp, Artificial
  CRISPR gRNA sequence
tcatcagcatttagccagtt

SEQ ID NO: 286162 - DNA, 20 bp, Artificial
  CRISPR gRNA sequence
atcagcatttagccagttgg

SEQ ID NO: 286163 - DNA, 20 bp, Artificial
  CRISPR gRNA sequence
agccagttggaatcttctcc

SEQ ID NO: 286164 - DNA, 20 bp, Artificial
  CRISPR gRNA sequence
gccagttggaatcttctcct

SEQ ID NO: 286165 - DNA, 20 bp, Artificial
  CRISPR gRNA sequence
gaatcttctccttcttggac

SEQ ID NO: 286166 - DNA, 20 bp, Artificial
  CRISPR gRNA sequence
ctccttcttggacttctgtg

SEQ ID NO: 286167 - DNA, 20 bp, Artificial
  CRISPR gRNA sequence
tccttcttggacttctgtga

SEQ ID NO: 286168 - DNA, 20 bp, Artificial
  CRISPR gRNA sequence
cttcttggacttctgtgaca

SEQ ID NO: 286169 - DNA, 20 bp, Artificial
  CRISPR gRNA sequence
cttggacttctgtgacacca

SEQ ID NO: 286170 - DNA, 20 bp, Artificial
  CRISPR gRNA sequence
ttggacttctgtgacaccac

SEQ ID NO: 286171 - DNA, 20 bp, Artificial
  CRISPR gRNA sequence
ggacttctgtgacaccacat

SEQ ID NO: 286172 - DNA, 20 bp, Artificial
  CRISPR gRNA sequence
gacttctgtgacaccacatc

SEQ ID NO: 286173 - DNA, 20 bp, Artificial
  CRISPR gRNA sequence
ctgtgacaccacatccttct

SEQ ID NO: 286174 - DNA, 20 bp, Artificial
  CRISPR gRNA sequence
tgtgacaccacatccttctg

SEQ ID NO: 286175 - DNA, 20 bp, Artificial
  CRISPR gRNA sequence
tgacaccacatccttctgtt

SEQ ID NO: 286176 - DNA, 20 bp, Artificial
  CRISPR gRNA sequence
ctgtttctgtttgttgcact

SEQ ID NO: 286177 - DNA, 20 bp, Artificial
  CRISPR gRNA sequence
tgtttctgtttgttgcactc

SEQ ID NO: 286178 - DNA, 20 bp, Artificial
  CRISPR gRNA sequence
tttctgtttgttgcactccg

SEQ ID NO: 286179 - DNA, 20 bp, Artificial
  CRISPR gRNA sequence
ctgtttgttgcactccgttt

SEQ ID NO: 286180 - DNA, 20 bp, Artificial
  CRISPR gRNA sequence
tgtttgttgcactccgtttt

SEQ ID NO: 286181 - DNA, 20 bp, Artificial
  CRISPR gRNA sequence
tttgttgcactccgttttct

SEQ ID NO: 286182 - DNA, 20 bp, Artificial
  CRISPR gRNA sequence
gttgcactccgttttctctg

SEQ ID NO: 286183 - DNA, 20 bp, Artificial
  CRISPR gRNA sequence
ttgcactccgttttctctga

SEQ ID NO: 286184 - DNA, 20 bp, Artificial
  CRISPR gRNA sequence
cactccgttttctctgaagg

SEQ ID NO: 286185 - DNA, 20 bp, Artificial
  CRISPR gRNA sequence
cgttttctctgaaggctttt

SEQ ID NO: 286186 - DNA, 20 bp, Artificial
  CRISPR gRNA sequence
tctctgaaggcttttcttcc

SEQ ID NO: 286187 - DNA, 20 bp, Artificial
  CRISPR gRNA sequence
ctctgaaggcttttcttcct

SEQ ID NO: 286188 - DNA, 20 bp, Artificial
  CRISPR gRNA sequence
tctgaaggcttttcttcctc

SEQ ID NO: 286189 - DNA, 20 bp, Artificial
  CRISPR gRNA sequence
tgaaggcttttcttcctctt

SEQ ID NO: 286190 - DNA, 20 bp, Artificial
  CRISPR gRNA sequence
aaggcttttcttcctcttct

SEQ ID NO: 286191 - DNA, 20 bp, Artificial
  CRISPR gRNA sequence
ttcttcctcttcttgtcctc

SEQ ID NO: 286192 - DNA, 20 bp, Artificial
  CRISPR gRNA sequence
tcttcctcttcttgtcctct

SEQ ID NO: 286193 - DNA, 20 bp, Artificial
  CRISPR gRNA sequence
cttcctcttcttgtcctcta

SEQ ID NO: 286194 - DNA, 20 bp, Artificial
  CRISPR gRNA sequence
ttcctcttcttgtcctctaa

SEQ ID NO: 286195 - DNA, 20 bp, Artificial
  CRISPR gRNA sequence
cctcttcttgtcctctaatt

SEQ ID NO: 286196 - DNA, 20 bp, Artificial
  CRISPR gRNA sequence
ctcttcttgtcctctaatta

SEQ ID NO: 286197 - DNA, 20 bp, Artificial
  CRISPR gRNA sequence
ttcttgtcctctaattattg

SEQ ID NO: 286198 - DNA, 20 bp, Artificial
  CRISPR gRNA sequence
cttgtcctctaattattgtt

SEQ ID NO: 286199 - DNA, 20 bp, Artificial
  CRISPR gRNA sequence
ttgtcctctaattattgttg

SEQ ID NO: 286200 - DNA, 20 bp, Artificial
  CRISPR gRNA sequence
gtcctctaattattgttgtt

SEQ ID NO: 286201 - DNA, 20 bp, Artificial
  CRISPR gRNA sequence
tcctctaattattgttgttc

SEQ ID NO: 286202 - DNA, 20 bp, Artificial
  CRISPR gRNA sequence
taattattgttgttcccatg

SEQ ID NO: 286203 - DNA, 20 bp, Artificial
  CRISPR gRNA sequence
attattgttgttcccatggt

SEQ ID NO: 286204 - DNA, 20 bp, Artificial
  CRISPR gRNA sequence
ttgttgttcccatggttctg

SEQ ID NO: 286205 - DNA, 20 bp, Artificial
  CRISPR gRNA sequence
ttgttcccatggttctgttt

SEQ ID NO: 286206 - DNA, 20 bp, Artificial
  CRISPR gRNA sequence
ttcccatggttctgtttgtg

SEQ ID NO: 286207 - DNA, 20 bp, Artificial
  CRISPR gRNA sequence
ccatggttctgtttgtggtc

SEQ ID NO: 286208 - DNA, 20 bp, Artificial
  CRISPR gRNA sequence
tgtttgtggtcccattttgc

SEQ ID NO: 286209 - DNA, 20 bp, Artificial
  CRISPR gRNA sequence
tttgtggtcccattttgccc

SEQ ID NO: 286210 - DNA, 20 bp, Artificial
  CRISPR gRNA sequence
gtggtcccattttgccctta

SEQ ID NO: 286211 - DNA, 20 bp, Artificial
  CRISPR gRNA sequence
tggtcccattttgcccttac

SEQ ID NO: 286212 - DNA, 20 bp, Artificial
  CRISPR gRNA sequence
tgcccttactggccccagtc

SEQ ID NO: 286213 - DNA, 20 bp, Artificial
  CRISPR gRNA sequence
gcccttactggccccagtct

SEQ ID NO: 286214 - DNA, 20 bp, Artificial
  CRISPR gRNA sequence
cccttactggccccagtctt

SEQ ID NO: 286215 - DNA, 20 bp, Artificial
  CRISPR gRNA sequence
actggccccagtcttcctgg

SEQ ID NO: 286216 - DNA, 20 bp, Artificial
  CRISPR gRNA sequence
ctggccccagtcttcctggg

SEQ ID NO: 286217 - DNA, 20 bp, Artificial
  CRISPR gRNA sequence
gccccagtcttcctgggtaa

SEQ ID NO: 286218 - DNA, 20 bp, Artificial
  CRISPR gRNA sequence
cctgggtaatatcctccaca

SEQ ID NO: 286219 - DNA, 20 bp, Artificial
  CRISPR gRNA sequence
ctgggtaatatcctccacac

SEQ ID NO: 286220 - DNA, 20 bp, Artificial
  CRISPR gRNA sequence
ggtaatatcctccacacctg

SEQ ID NO: 286221 - DNA, 20 bp, Artificial
  CRISPR gRNA sequence
cacacctgagatttgaaatg

SEQ ID NO: 286222 - DNA, 20 bp, Artificial
  CRISPR gRNA sequence
agatttgaaatgccatctga

SEQ ID NO: 286223 - DNA, 20 bp, Artificial
  CRISPR gRNA sequence
gaaatgccatctgaggctgg

SEQ ID NO: 286224 - DNA, 20 bp, Artificial
  CRISPR gRNA sequence
aaatgccatctgaggctggg

SEQ ID NO: 286225 - DNA, 20 bp, Artificial
  CRISPR gRNA sequence
aggctgggcacagtggctca

SEQ ID NO: 286226 - DNA, 20 bp, Artificial
  CRISPR gRNA sequence
ggcacagtggctcacacctg

SEQ ID NO: 286227 - DNA, 20 bp, Artificial
  CRISPR gRNA sequence
acacctgtaattctggcact

SEQ ID NO: 286228 - DNA, 20 bp, Artificial
  CRISPR gRNA sequence
taattctggcactttgggag

SEQ ID NO: 286229 - DNA, 20 bp, Artificial
  CRISPR gRNA sequence
tggcactttgggaggccaag

SEQ ID NO: 286230 - DNA, 20 bp, Artificial
  CRISPR gRNA sequence
gcactttgggaggccaaggt

SEQ ID NO: 286231 - DNA, 20 bp, Artificial
  CRISPR gRNA sequence
tgggaggccaaggtgggcag

SEQ ID NO: 286232 - DNA, 20 bp, Artificial
  CRISPR gRNA sequence
gggaggccaaggtgggcaga

SEQ ID NO: 286233 - DNA, 20 bp, Artificial
  CRISPR gRNA sequence
ggaggccaaggtgggcagat

SEQ ID NO: 286234 - DNA, 20 bp, Artificial
  CRISPR gRNA sequence
aggtcaggagttcgagacca

SEQ ID NO: 286235 - DNA, 20 bp, Artificial
  CRISPR gRNA sequence
gagaccagcctggccaacat

SEQ ID NO: 286236 - DNA, 20 bp, Artificial
  CRISPR gRNA sequence
gccaacatagtgaaaccctg

SEQ ID NO: 286237 - DNA, 20 bp, Artificial
  CRISPR gRNA sequence
tctctactaaaagtacaaaa

SEQ ID NO: 286238 - DNA, 20 bp, Artificial
  CRISPR gRNA sequence
tactaaaagtacaaaaaatt

SEQ ID NO: 286239 - DNA, 20 bp, Artificial
  CRISPR gRNA sequence
ctaaaagtacaaaaaattat

SEQ ID NO: 286240 - DNA, 20 bp, Artificial
  CRISPR gRNA sequence
aaagtacaaaaaattatcgg

SEQ ID NO: 286241 - DNA, 20 bp, Artificial
  CRISPR gRNA sequence
tcggtggcgagtaccaatcc

SEQ ID NO: 286242 - DNA, 20 bp, Artificial
  CRISPR gRNA sequence
aggaggctgaagcaagagaa

SEQ ID NO: 286243 - DNA, 20 bp, Artificial
  CRISPR gRNA sequence
aagcaagagaattgcttgaa

SEQ ID NO: 286244 - DNA, 20 bp, Artificial
  CRISPR gRNA sequence
cttgaaccagggagacagag

SEQ ID NO: 286245 - DNA, 20 bp, Artificial
  CRISPR gRNA sequence
gaaccagggagacagaggtt

SEQ ID NO: 286246 - DNA, 20 bp, Artificial
  CRISPR gRNA sequence
aaccagggagacagaggttg

SEQ ID NO: 286247 - DNA, 20 bp, Artificial
  CRISPR gRNA sequence
caatgagccaagattgcact

SEQ ID NO: 286248 - DNA, 20 bp, Artificial
  CRISPR gRNA sequence
cactccagcctgggtgacag

SEQ ID NO: 286249 - DNA, 20 bp, Artificial
  CRISPR gRNA sequence
cagcctgggtgacagagtga

SEQ ID NO: 286250 - DNA, 20 bp, Artificial
  CRISPR gRNA sequence
ggtgacagagtgagaatcta

SEQ ID NO: 286251 - DNA, 20 bp, Artificial
  CRISPR gRNA sequence
tctcagaaaaagacaaagaa

SEQ ID NO: 286252 - DNA, 20 bp, Artificial
  CRISPR gRNA sequence
agaaaaagacaaagaaaaaa

SEQ ID NO: 286253 - DNA, 20 bp, Artificial
  CRISPR gRNA sequence
atttctaaatttgtatattg

SEQ ID NO: 286254 - DNA, 20 bp, Artificial
  CRISPR gRNA sequence
ctaaatttgtatattggatg

SEQ ID NO: 286255 - DNA, 20 bp, Artificial
  CRISPR gRNA sequence
taaatttgtatattggatgg

SEQ ID NO: 286256 - DNA, 20 bp, Artificial
  CRISPR gRNA sequence
aatttgtatattggatggat

SEQ ID NO: 286257 - DNA, 20 bp, Artificial
  CRISPR gRNA sequence
gtatattggatggatgccag

SEQ ID NO: 286258 - DNA, 20 bp, Artificial
  CRISPR gRNA sequence
tatattggatggatgccagc

SEQ ID NO: 286259 - DNA, 20 bp, Artificial
  CRISPR gRNA sequence
gatggatgccagcatctcca

SEQ ID NO: 286260 - DNA, 20 bp, Artificial
  CRISPR gRNA sequence
cacctgattaaaactgaatt

SEQ ID NO: 286261 - DNA, 20 bp, Artificial
  CRISPR gRNA sequence
attaaaactgaatttactac

SEQ ID NO: 286262 - DNA, 20 bp, Artificial
  CRISPR gRNA sequence
aaactgaatttactacctgc

SEQ ID NO: 286263 - DNA, 20 bp, Artificial
  CRISPR gRNA sequence
aatttactacctgctttcca

SEQ ID NO: 286264 - DNA, 20 bp, Artificial
  CRISPR gRNA sequence
actacctgctttccaaatca

SEQ ID NO: 286265 - DNA, 20 bp, Artificial
  CRISPR gRNA sequence
ctacctgctttccaaatcat

SEQ ID NO: 286266 - DNA, 20 bp, Artificial
  CRISPR gRNA sequence
cctgctttccaaatcatatc

SEQ ID NO: 286267 - DNA, 20 bp, Artificial
  CRISPR gRNA sequence
ctttccaaatcatatctacc

SEQ ID NO: 286268 - DNA, 20 bp, Artificial
  CRISPR gRNA sequence
tccaaatcatatctaccagc

SEQ ID NO: 286269 - DNA, 20 bp, Artificial
  CRISPR gRNA sequence
ccaaatcatatctaccagct

SEQ ID NO: 286270 - DNA, 20 bp, Artificial
  CRISPR gRNA sequence
caaatcatatctaccagctg

SEQ ID NO: 286271 - DNA, 20 bp, Artificial
  CRISPR gRNA sequence
ccagctgtattctcccattt

SEQ ID NO: 286272 - DNA, 20 bp, Artificial
  CRISPR gRNA sequence
tattctcccatttcagtgaa

SEQ ID NO: 286273 - DNA, 20 bp, Artificial
  CRISPR gRNA sequence
tcccatttcagtgaataaca

SEQ ID NO: 286274 - DNA, 20 bp, Artificial
  CRISPR gRNA sequence
ccatttcagtgaataacaat

SEQ ID NO: 286275 - DNA, 20 bp, Artificial
  CRISPR gRNA sequence
cagtgaataacaataccatt

SEQ ID NO: 286276 - DNA, 20 bp, Artificial
  CRISPR gRNA sequence
agtgaataacaataccattt

SEQ ID NO: 286277 - DNA, 20 bp, Artificial
  CRISPR gRNA sequence
agttacccaaataagagtgt

SEQ ID NO: 286278 - DNA, 20 bp, Artificial
  CRISPR gRNA sequence
gttacccaaataagagtgtg

SEQ ID NO: 286279 - DNA, 20 bp, Artificial
  CRISPR gRNA sequence
cccaaataagagtgtggtat

SEQ ID NO: 286280 - DNA, 20 bp, Artificial
  CRISPR gRNA sequence
tctttgtgctcacttcccag

SEQ ID NO: 286281 - DNA, 20 bp, Artificial
  CRISPR gRNA sequence
ctttgtgctcacttcccagt

SEQ ID NO: 286282 - DNA, 20 bp, Artificial
  CRISPR gRNA sequence
tttgtgctcacttcccagta

SEQ ID NO: 286283 - DNA, 20 bp, Artificial
  CRISPR gRNA sequence
tgtgctcacttcccagtagg

SEQ ID NO: 286284 - DNA, 20 bp, Artificial
  CRISPR gRNA sequence
gtgctcacttcccagtaggc

SEQ ID NO: 286285 - DNA, 20 bp, Artificial
  CRISPR gRNA sequence
tgctcacttcccagtaggct

SEQ ID NO: 286286 - DNA, 20 bp, Artificial
  CRISPR gRNA sequence
acttcccagtaggctcccat

SEQ ID NO: 286287 - DNA, 20 bp, Artificial
  CRISPR gRNA sequence
cccagtaggctcccatgtat

SEQ ID NO: 286288 - DNA, 20 bp, Artificial
  CRISPR gRNA sequence
ccagtaggctcccatgtatt

SEQ ID NO: 286289 - DNA, 20 bp, Artificial
  CRISPR gRNA sequence
ccatgtattttctgttctat

SEQ ID NO: 286290 - DNA, 20 bp, Artificial
  CRISPR gRNA sequence
tctgttctatattcagaata

SEQ ID NO: 286291 - DNA, 20 bp, Artificial
  CRISPR gRNA sequence
ctgttctatattcagaatat

SEQ ID NO: 286292 - DNA, 20 bp, Artificial
  CRISPR gRNA sequence
tgttctatattcagaatatc

SEQ ID NO: 286293 - DNA, 20 bp, Artificial
  CRISPR gRNA sequence
ttctatattcagaatatctc

SEQ ID NO: 286294 - DNA, 20 bp, Artificial
  CRISPR gRNA sequence
tatattcagaatatctctgg

SEQ ID NO: 286295 - DNA, 20 bp, Artificial
  CRISPR gRNA sequence
tattcagaatatctctggaa

SEQ ID NO: 286296 - DNA, 20 bp, Artificial
  CRISPR gRNA sequence
agaatatctctggaacttac

SEQ ID NO: 286297 - DNA, 20 bp, Artificial
  CRISPR gRNA sequence
tggaacttactgctttttcc

SEQ ID NO: 286298 - DNA, 20 bp, Artificial
  CRISPR gRNA sequence
gaacttactgctttttccca

SEQ ID NO: 286299 - DNA, 20 bp, Artificial
  CRISPR gRNA sequence
actgctttttcccaaatctc

SEQ ID NO: 286300 - DNA, 20 bp, Artificial
  CRISPR gRNA sequence
ctgctttttcccaaatctct

SEQ ID NO: 286301 - DNA, 20 bp, Artificial
  CRISPR gRNA sequence
ctttttcccaaatctcttgc

SEQ ID NO: 286302 - DNA, 20 bp, Artificial
  CRISPR gRNA sequence
tttcccaaatctcttgcagc

SEQ ID NO: 286303 - DNA, 20 bp, Artificial
  CRISPR gRNA sequence
ttcccaaatctcttgcagca

SEQ ID NO: 286304 - DNA, 20 bp, Artificial
  CRISPR gRNA sequence
tcccaaatctcttgcagcaa

SEQ ID NO: 286305 - DNA, 20 bp, Artificial
  CRISPR gRNA sequence
cccaaatctcttgcagcaac

SEQ ID NO: 286306 - DNA, 20 bp, Artificial
  CRISPR gRNA sequence
ccaaatctcttgcagcaact

SEQ ID NO: 286307 - DNA, 20 bp, Artificial
  CRISPR gRNA sequence
ttgcagcaactgccttagct

SEQ ID NO: 286308 - DNA, 20 bp, Artificial
  CRISPR gRNA sequence
gcagcaactgccttagctga

SEQ ID NO: 286309 - DNA, 20 bp, Artificial
  CRISPR gRNA sequence
cagcaactgccttagctgag

SEQ ID NO: 286310 - DNA, 20 bp, Artificial
  CRISPR gRNA sequence
ccttagctgagatttttctc

SEQ ID NO: 286311 - DNA, 20 bp, Artificial
  CRISPR gRNA sequence
agctgagatttttctcatct

SEQ ID NO: 286312 - DNA, 20 bp, Artificial
  CRISPR gRNA sequence
gctgagatttttctcatctc

SEQ ID NO: 286313 - DNA, 20 bp, Artificial
  CRISPR gRNA sequence
agatttttctcatctcccac

SEQ ID NO: 286314 - DNA, 20 bp, Artificial
  CRISPR gRNA sequence
ttctcatctcccacctagta

SEQ ID NO: 286315 - DNA, 20 bp, Artificial
  CRISPR gRNA sequence
tctcatctcccacctagtag

SEQ ID NO: 286316 - DNA, 20 bp, Artificial
  CRISPR gRNA sequence
ctcatctcccacctagtagc

SEQ ID NO: 286317 - DNA, 20 bp, Artificial
  CRISPR gRNA sequence
tcatctcccacctagtagcc

SEQ ID NO: 286318 - DNA, 20 bp, Artificial
  CRISPR gRNA sequence
atctcccacctagtagcctg

SEQ ID NO: 286319 - DNA, 20 bp, Artificial
  CRISPR gRNA sequence
ccacctagtagcctgcaaac

SEQ ID NO: 286320 - DNA, 20 bp, Artificial
  CRISPR gRNA sequence
gtagcctgcaaaccggtctc

SEQ ID NO: 286321 - DNA, 20 bp, Artificial
  CRISPR gRNA sequence
caaaccggtctctttgcctc

SEQ ID NO: 286322 - DNA, 20 bp, Artificial
  CRISPR gRNA sequence
tttgcctcaggtttcctagg

SEQ ID NO: 286323 - DNA, 20 bp, Artificial
  CRISPR gRNA sequence
tgcctcaggtttcctaggct

SEQ ID NO: 286324 - DNA, 20 bp, Artificial
  CRISPR gRNA sequence
gcctcaggtttcctaggctc

SEQ ID NO: 286325 - DNA, 20 bp, Artificial
  CRISPR gRNA sequence
cctcaggtttcctaggctct

SEQ ID NO: 286326 - DNA, 20 bp, Artificial
  CRISPR gRNA sequence
aggtttcctaggctctaata

SEQ ID NO: 286327 - DNA, 20 bp, Artificial
  CRISPR gRNA sequence
cctaggctctaataactcct

SEQ ID NO: 286328 - DNA, 20 bp, Artificial
  CRISPR gRNA sequence
ctaggctctaataactcctg

SEQ ID NO: 286329 - DNA, 20 bp, Artificial
  CRISPR gRNA sequence
ggctctaataactcctgcac

SEQ ID NO: 286330 - DNA, 20 bp, Artificial
  CRISPR gRNA sequence
taataactcctgcacattgc

SEQ ID NO: 286331 - DNA, 20 bp, Artificial
  CRISPR gRNA sequence
ataactcctgcacattgctg

SEQ ID NO: 286332 - DNA, 20 bp, Artificial
  CRISPR gRNA sequence
ctgcacattgctgtcacagt

SEQ ID NO: 286333 - DNA, 20 bp, Artificial
  CRISPR gRNA sequence
cacattgctgtcacagtaat

SEQ ID NO: 286334 - DNA, 20 bp, Artificial
  CRISPR gRNA sequence
ctgtcacagtaatcattctg

SEQ ID NO: 286335 - DNA, 20 bp, Artificial
  CRISPR gRNA sequence
tcacagtaatcattctgaaa

SEQ ID NO: 286336 - DNA, 20 bp, Artificial
  CRISPR gRNA sequence
tgaaacacctatttaatcat

SEQ ID NO: 286337 - DNA, 20 bp, Artificial
  CRISPR gRNA sequence
aaacacctatttaatcatag

SEQ ID NO: 286338 - DNA, 20 bp, Artificial
  CRISPR gRNA sequence
tttaatcatagtgtacctac

SEQ ID NO: 286339 - DNA, 20 bp, Artificial
  CRISPR gRNA sequence
aatcatagtgtacctaccac

SEQ ID NO: 286340 - DNA, 20 bp, Artificial
  CRISPR gRNA sequence
atcatagtgtacctaccact

SEQ ID NO: 286341 - DNA, 20 bp, Artificial
  CRISPR gRNA sequence
ccacttaaagacaggatagt

SEQ ID NO: 286342 - DNA, 20 bp, Artificial
  CRISPR gRNA sequence
aaagacaggatagttggttt

SEQ ID NO: 286343 - DNA, 20 bp, Artificial
  CRISPR gRNA sequence
aagacaggatagttggtttt

SEQ ID NO: 286344 - DNA, 20 bp, Artificial
  CRISPR gRNA sequence
gtttttcttttttctctaaa

SEQ ID NO: 286345 - DNA, 20 bp, Artificial
  CRISPR gRNA sequence
ttcttttttctctaaaacac

SEQ ID NO: 286346 - DNA, 20 bp, Artificial
  CRISPR gRNA sequence
tcttttttctctaaaacacc

SEQ ID NO: 286347 - DNA, 20 bp, Artificial
  CRISPR gRNA sequence
cttttttctctaaaacacca

SEQ ID NO: 286348 - DNA, 20 bp, Artificial
  CRISPR gRNA sequence
ttttttctctaaaacaccag

SEQ ID NO: 286349 - DNA, 20 bp, Artificial
  CRISPR gRNA sequence
ttttctctaaaacaccagat

SEQ ID NO: 286350 - DNA, 20 bp, Artificial
  CRISPR gRNA sequence
tttctctaaaacaccagatt

SEQ ID NO: 286351 - DNA, 20 bp, Artificial
  CRISPR gRNA sequence
ttctctaaaacaccagattg

SEQ ID NO: 286352 - DNA, 20 bp, Artificial
  CRISPR gRNA sequence
tctctaaaacaccagattga

SEQ ID NO: 286353 - DNA, 20 bp, Artificial
  CRISPR gRNA sequence
ctctaaaacaccagattgaa

SEQ ID NO: 286354 - DNA, 20 bp, Artificial
  CRISPR gRNA sequence
tctaaaacaccagattgaat

SEQ ID NO: 286355 - DNA, 20 bp, Artificial
  CRISPR gRNA sequence
taaaacaccagattgaatgg

SEQ ID NO: 286356 - DNA, 20 bp, Artificial
  CRISPR gRNA sequence
aaacaccagattgaatggag

SEQ ID NO: 286357 - DNA, 20 bp, Artificial
  CRISPR gRNA sequence
aatggagacatcaagtgatt

SEQ ID NO: 286358 - DNA, 20 bp, Artificial
  CRISPR gRNA sequence
ccagagttgacctctacaga

SEQ ID NO: 286359 - DNA, 20 bp, Artificial
  CRISPR gRNA sequence
acctctacagattagaatga

SEQ ID NO: 286360 - DNA, 20 bp, Artificial
  CRISPR gRNA sequence
tacagattagaatgacacaa

SEQ ID NO: 286361 - DNA, 20 bp, Artificial
  CRISPR gRNA sequence
cagattagaatgacacaaaa

SEQ ID NO: 286362 - DNA, 20 bp, Artificial
  CRISPR gRNA sequence
gaatgacacaaaaaataaca

SEQ ID NO: 286363 - DNA, 20 bp, Artificial
  CRISPR gRNA sequence
ctgttatcctgggagtctag

SEQ ID NO: 286364 - DNA, 20 bp, Artificial
  CRISPR gRNA sequence
ttatcctgggagtctagaag

SEQ ID NO: 286365 - DNA, 20 bp, Artificial
  CRISPR gRNA sequence
tcctgggagtctagaagttt

SEQ ID NO: 286366 - DNA, 20 bp, Artificial
  CRISPR gRNA sequence
ggagtctagaagtttcacag

SEQ ID NO: 286367 - DNA, 20 bp, Artificial
  CRISPR gRNA sequence
gaagtttcacaggcttcagc

SEQ ID NO: 286368 - DNA, 20 bp, Artificial
  CRISPR gRNA sequence
cacaggcttcagctcattcc

SEQ ID NO: 286369 - DNA, 20 bp, Artificial
  CRISPR gRNA sequence
acaggcttcagctcattcct

SEQ ID NO: 286370 - DNA, 20 bp, Artificial
  CRISPR gRNA sequence
cagctcattcctggcttcca

SEQ ID NO: 286371 - DNA, 20 bp, Artificial
  CRISPR gRNA sequence
agctcattcctggcttccac

SEQ ID NO: 286372 - DNA, 20 bp, Artificial
  CRISPR gRNA sequence
attcctggcttccactccac

SEQ ID NO: 286373 - DNA, 20 bp, Artificial
  CRISPR gRNA sequence
ctggcttccactccacaccc

SEQ ID NO: 286374 - DNA, 20 bp, Artificial
  CRISPR gRNA sequence
gcttccactccacacccatc

SEQ ID NO: 286375 - DNA, 20 bp, Artificial
  CRISPR gRNA sequence
ccactccacacccatccaca

SEQ ID NO: 286376 - DNA, 20 bp, Artificial
  CRISPR gRNA sequence
cactccacacccatccacaa

SEQ ID NO: 286377 - DNA, 20 bp, Artificial
  CRISPR gRNA sequence
cacacccatccacaagcctc

SEQ ID NO: 286378 - DNA, 20 bp, Artificial
  CRISPR gRNA sequence
attcaacctagagagagtat

SEQ ID NO: 286379 - DNA, 20 bp, Artificial
  CRISPR gRNA sequence
aacctagagagagtatgtgt

SEQ ID NO: 286380 - DNA, 20 bp, Artificial
  CRISPR gRNA sequence
gagagagtatgtgtgtgagg

SEQ ID NO: 286381 - DNA, 20 bp, Artificial
  CRISPR gRNA sequence
agtagcagcaagccaggtct

SEQ ID NO: 286382 - DNA, 20 bp, Artificial
  CRISPR gRNA sequence
ttgtgacacctgttagaaac

SEQ ID NO: 286383 - DNA, 20 bp, Artificial
  CRISPR gRNA sequence
tgacacctgttagaaacctg

SEQ ID NO: 286384 - DNA, 20 bp, Artificial
  CRISPR gRNA sequence
ttagaaacctggtaacatcc

SEQ ID NO: 286385 - DNA, 20 bp, Artificial
  CRISPR gRNA sequence
gaaacctggtaacatcccac

SEQ ID NO: 286386 - DNA, 20 bp, Artificial
  CRISPR gRNA sequence
gtaacatcccacaggggcag

SEQ ID NO: 286387 - DNA, 20 bp, Artificial
  CRISPR gRNA sequence
cacatgtagcttattagata

SEQ ID NO: 286388 - DNA, 20 bp, Artificial
  CRISPR gRNA sequence
attagataccatgagtatga

SEQ ID NO: 286389 - DNA, 20 bp, Artificial
  CRISPR gRNA sequence
ttagataccatgagtatgac

SEQ ID NO: 286390 - DNA, 20 bp, Artificial
  CRISPR gRNA sequence
gataccatgagtatgactct

SEQ ID NO: 286391 - DNA, 20 bp, Artificial
  CRISPR gRNA sequence
tctcagatgtatctccttcc

SEQ ID NO: 286392 - DNA, 20 bp, Artificial
  CRISPR gRNA sequence
tcagatgtatctccttccag

SEQ ID NO: 286393 - DNA, 20 bp, Artificial
  CRISPR gRNA sequence
agatgtatctccttccagtt

SEQ ID NO: 286394 - DNA, 20 bp, Artificial
  CRISPR gRNA sequence
cttccagtttatcaagggaa

SEQ ID NO: 286395 - DNA, 20 bp, Artificial
  CRISPR gRNA sequence
ccagtttatcaagggaaaac

SEQ ID NO: 286396 - DNA, 20 bp, Artificial
  CRISPR gRNA sequence
cagtttatcaagggaaaaca

SEQ ID NO: 286397 - DNA, 20 bp, Artificial
  CRISPR gRNA sequence
atcaagggaaaacaaatttg

SEQ ID NO: 286398 - DNA, 20 bp, Artificial
  CRISPR gRNA sequence
tcaagggaaaacaaatttgg

SEQ ID NO: 286399 - DNA, 20 bp, Artificial
  CRISPR gRNA sequence
ggtgagactacactaaaaag

SEQ ID NO: 286400 - DNA, 20 bp, Artificial
  CRISPR gRNA sequence
gtgagactacactaaaaaga

SEQ ID NO: 286401 - DNA, 20 bp, Artificial
  CRISPR gRNA sequence
cactaaaaagaatcatatgc

SEQ ID NO: 286402 - DNA, 20 bp, Artificial
  CRISPR gRNA sequence
aaaagaatcatatgcgcaat

SEQ ID NO: 286403 - DNA, 20 bp, Artificial
  CRISPR gRNA sequence
aattaatacatttgggcttt

SEQ ID NO: 286404 - DNA, 20 bp, Artificial
  CRISPR gRNA sequence
attaatacatttgggctttt

SEQ ID NO: 286405 - DNA, 20 bp, Artificial
  CRISPR gRNA sequence
atacatttgggctttttttt

SEQ ID NO: 286406 - DNA, 20 bp, Artificial
  CRISPR gRNA sequence
gggctttttttttttttcca

SEQ ID NO: 286407 - DNA, 20 bp, Artificial
  CRISPR gRNA sequence
ggctttttttttttttccaa

SEQ ID NO: 286408 - DNA, 20 bp, Artificial
  CRISPR gRNA sequence
tttttttttttccaaatcag

SEQ ID NO: 286409 - DNA, 20 bp, Artificial
  CRISPR gRNA sequence
ttttttttttccaaatcagt

SEQ ID NO: 286410 - DNA, 20 bp, Artificial
  CRISPR gRNA sequence
tttttttttccaaatcagtt

SEQ ID NO: 286411 - DNA, 20 bp, Artificial
  CRISPR gRNA sequence
ttttttttccaaatcagtta

SEQ ID NO: 286412 - DNA, 20 bp, Artificial
  CRISPR gRNA sequence
tttttttccaaatcagttat

SEQ ID NO: 286413 - DNA, 20 bp, Artificial
  CRISPR gRNA sequence
ttttttccaaatcagttatt

SEQ ID NO: 286414 - DNA, 20 bp, Artificial
  CRISPR gRNA sequence
tttttccaaatcagttattt

SEQ ID NO: 286415 - DNA, 20 bp, Artificial
  CRISPR gRNA sequence
ttttccaaatcagttattta

SEQ ID NO: 286416 - DNA, 20 bp, Artificial
  CRISPR gRNA sequence
tttccaaatcagttatttac

SEQ ID NO: 286417 - DNA, 20 bp, Artificial
  CRISPR gRNA sequence
ttccaaatcagttatttact

SEQ ID NO: 286418 - DNA, 20 bp, Artificial
  CRISPR gRNA sequence
tccaaatcagttatttactg

SEQ ID NO: 286419 - DNA, 20 bp, Artificial
  CRISPR gRNA sequence
ccaaatcagttatttactga

SEQ ID NO: 286420 - DNA, 20 bp, Artificial
  CRISPR gRNA sequence
caaatcagttatttactgat

SEQ ID NO: 286421 - DNA, 20 bp, Artificial
  CRISPR gRNA sequence
tttactgatatggtttggct

SEQ ID NO: 286422 - DNA, 20 bp, Artificial
  CRISPR gRNA sequence
actgatatggtttggctgtg

SEQ ID NO: 286423 - DNA, 20 bp, Artificial
  CRISPR gRNA sequence
ctgatatggtttggctgtgt

SEQ ID NO: 286424 - DNA, 20 bp, Artificial
  CRISPR gRNA sequence
atatggtttggctgtgtccc

SEQ ID NO: 286425 - DNA, 20 bp, Artificial
  CRISPR gRNA sequence
ggctgtgtccccacccaaat

SEQ ID NO: 286426 - DNA, 20 bp, Artificial
  CRISPR gRNA sequence
gctgtgtccccacccaaatc

SEQ ID NO: 286427 - DNA, 20 bp, Artificial
  CRISPR gRNA sequence
tgtccccacccaaatctcat

SEQ ID NO: 286428 - DNA, 20 bp, Artificial
  CRISPR gRNA sequence
atcttgaattataactccca

SEQ ID NO: 286429 - DNA, 20 bp, Artificial
  CRISPR gRNA sequence
gaattataactcccacagtt

SEQ ID NO: 286430 - DNA, 20 bp, Artificial
  CRISPR gRNA sequence
aattataactcccacagttg

SEQ ID NO: 286431 - DNA, 20 bp, Artificial
  CRISPR gRNA sequence
taactcccacagttgccaca

SEQ ID NO: 286432 - DNA, 20 bp, Artificial
  CRISPR gRNA sequence
ccacagttgccacatgtcat

SEQ ID NO: 286433 - DNA, 20 bp, Artificial
  CRISPR gRNA sequence
ccacatgtcatgggaggaac

SEQ ID NO: 286434 - DNA, 20 bp, Artificial
  CRISPR gRNA sequence
aattatgggggcgagtcttt

SEQ ID NO: 286435 - DNA, 20 bp, Artificial
  CRISPR gRNA sequence
tgggggcgagtctttcctgc

SEQ ID NO: 286436 - DNA, 20 bp, Artificial
  CRISPR gRNA sequence
tcctgcactgtccttgtgat

SEQ ID NO: 286437 - DNA, 20 bp, Artificial
  CRISPR gRNA sequence
cctgcactgtccttgtgata

SEQ ID NO: 286438 - DNA, 20 bp, Artificial
  CRISPR gRNA sequence
ctgcactgtccttgtgatag

SEQ ID NO: 286439 - DNA, 20 bp, Artificial
  CRISPR gRNA sequence
cactgtccttgtgatagtta

SEQ ID NO: 286440 - DNA, 20 bp, Artificial
  CRISPR gRNA sequence
tccttgtgatagttaatgag

SEQ ID NO: 286441 - DNA, 20 bp, Artificial
  CRISPR gRNA sequence
gtgatagttaatgagtctca

SEQ ID NO: 286442 - DNA, 20 bp, Artificial
  CRISPR gRNA sequence
tgatagttaatgagtctcac

SEQ ID NO: 286443 - DNA, 20 bp, Artificial
  CRISPR gRNA sequence
atgagtctcacgagatctga

SEQ ID NO: 286444 - DNA, 20 bp, Artificial
  CRISPR gRNA sequence
acgagatctgatagtttaaa

SEQ ID NO: 286445 - DNA, 20 bp, Artificial
  CRISPR gRNA sequence
atagtttaaaaacaggagtt

SEQ ID NO: 286446 - DNA, 20 bp, Artificial
  CRISPR gRNA sequence
aaaaacaggagtttccttat

SEQ ID NO: 286447 - DNA, 20 bp, Artificial
  CRISPR gRNA sequence
aaaacaggagtttccttata

SEQ ID NO: 286448 - DNA, 20 bp, Artificial
  CRISPR gRNA sequence
ccttataacaagctctcttt

SEQ ID NO: 286449 - DNA, 20 bp, Artificial
  CRISPR gRNA sequence
cttataacaagctctctttt

SEQ ID NO: 286450 - DNA, 20 bp, Artificial
  CRISPR gRNA sequence
ataacaagctctctttttgg

SEQ ID NO: 286451 - DNA, 20 bp, Artificial
  CRISPR gRNA sequence
taacaagctctctttttggc

SEQ ID NO: 286452 - DNA, 20 bp, Artificial
  CRISPR gRNA sequence
tctttttggctgctgccatc

SEQ ID NO: 286453 - DNA, 20 bp, Artificial
  CRISPR gRNA sequence
tttttggctgctgccatcca

SEQ ID NO: 286454 - DNA, 20 bp, Artificial
  CRISPR gRNA sequence
tttggctgctgccatccaca

SEQ ID NO: 286455 - DNA, 20 bp, Artificial
  CRISPR gRNA sequence
ttggctgctgccatccacat

SEQ ID NO: 286456 - DNA, 20 bp, Artificial
  CRISPR gRNA sequence
tggctgctgccatccacata

SEQ ID NO: 286457 - DNA, 20 bp, Artificial
  CRISPR gRNA sequence
ggctgctgccatccacataa

SEQ ID NO: 286458 - DNA, 20 bp, Artificial
  CRISPR gRNA sequence
gctgctgccatccacataag

SEQ ID NO: 286459 - DNA, 20 bp, Artificial
  CRISPR gRNA sequence
ctgccatccacataagacat

SEQ ID NO: 286460 - DNA, 20 bp, Artificial
  CRISPR gRNA sequence
ccatccacataagacatgac

SEQ ID NO: 286461 - DNA, 20 bp, Artificial
  CRISPR gRNA sequence
gctcctccttgccttctgcc

SEQ ID NO: 286462 - DNA, 20 bp, Artificial
  CRISPR gRNA sequence
ctcctccttgccttctgcca

SEQ ID NO: 286463 - DNA, 20 bp, Artificial
  CRISPR gRNA sequence
ctccttgccttctgccatga

SEQ ID NO: 286464 - DNA, 20 bp, Artificial
  CRISPR gRNA sequence
cttgccttctgccatgattt

SEQ ID NO: 286465 - DNA, 20 bp, Artificial
  CRISPR gRNA sequence
gccttctgccatgatttgtg

SEQ ID NO: 286466 - DNA, 20 bp, Artificial
  CRISPR gRNA sequence
ccttctgccatgatttgtga

SEQ ID NO: 286467 - DNA, 20 bp, Artificial
  CRISPR gRNA sequence
ctgccatgatttgtgaggcc

SEQ ID NO: 286468 - DNA, 20 bp, Artificial
  CRISPR gRNA sequence
tgccatgatttgtgaggcct

SEQ ID NO: 286469 - DNA, 20 bp, Artificial
  CRISPR gRNA sequence
ccatgatttgtgaggcctcc

SEQ ID NO: 286470 - DNA, 20 bp, Artificial
  CRISPR gRNA sequence
gtgaggcctccccagccacg

SEQ ID NO: 286471 - DNA, 20 bp, Artificial
  CRISPR gRNA sequence
tgaggcctccccagccacgt

SEQ ID NO: 286472 - DNA, 20 bp, Artificial
  CRISPR gRNA sequence
cccagccacgtggaactgtg

SEQ ID NO: 286473 - DNA, 20 bp, Artificial
  CRISPR gRNA sequence
tgagtctaattaaacctctt

SEQ ID NO: 286474 - DNA, 20 bp, Artificial
  CRISPR gRNA sequence
attaaacctctttattttgt

SEQ ID NO: 286475 - DNA, 20 bp, Artificial
  CRISPR gRNA sequence
aacctctttattttgtaagt

SEQ ID NO: 286476 - DNA, 20 bp, Artificial
  CRISPR gRNA sequence
tttattttgtaagttgccca

SEQ ID NO: 286477 - DNA, 20 bp, Artificial
  CRISPR gRNA sequence
tattttgtaagttgcccagt

SEQ ID NO: 286478 - DNA, 20 bp, Artificial
  CRISPR gRNA sequence
attttgtaagttgcccagtc

SEQ ID NO: 286479 - DNA, 20 bp, Artificial
  CRISPR gRNA sequence
ttttgtaagttgcccagtct

SEQ ID NO: 286480 - DNA, 20 bp, Artificial
  CRISPR gRNA sequence
tgtaagttgcccagtctcgg

SEQ ID NO: 286481 - DNA, 20 bp, Artificial
  CRISPR gRNA sequence
gtaagttgcccagtctcggg

SEQ ID NO: 286482 - DNA, 20 bp, Artificial
  CRISPR gRNA sequence
taagttgcccagtctcgggt

SEQ ID NO: 286483 - DNA, 20 bp, Artificial
  CRISPR gRNA sequence
cccagtctcgggtatgtctt

SEQ ID NO: 286484 - DNA, 20 bp, Artificial
  CRISPR gRNA sequence
gggtatgtctttatcagcag

SEQ ID NO: 286485 - DNA, 20 bp, Artificial
  CRISPR gRNA sequence
tatcagcagcatgaaaaggg

SEQ ID NO: 286486 - DNA, 20 bp, Artificial
  CRISPR gRNA sequence
atcagcagcatgaaaaggga

SEQ ID NO: 286487 - DNA, 20 bp, Artificial
  CRISPR gRNA sequence
tcagcagcatgaaaagggac

SEQ ID NO: 286488 - DNA, 20 bp, Artificial
  CRISPR gRNA sequence
atacattttcacctcaaagc

SEQ ID NO: 286489 - DNA, 20 bp, Artificial
  CRISPR gRNA sequence
tcacctcaaagctttactca

SEQ ID NO: 286490 - DNA, 20 bp, Artificial
  CRISPR gRNA sequence
cacctcaaagctttactcac

SEQ ID NO: 286491 - DNA, 20 bp, Artificial
  CRISPR gRNA sequence
acctcaaagctttactcacc

SEQ ID NO: 286492 - DNA, 20 bp, Artificial
  CRISPR gRNA sequence
aaagctttactcaccctgac

SEQ ID NO: 286493 - DNA, 20 bp, Artificial
  CRISPR gRNA sequence
tactcaccctgacctgtaac

SEQ ID NO: 286494 - DNA, 20 bp, Artificial
  CRISPR gRNA sequence
actcaccctgacctgtaaca

SEQ ID NO: 286495 - DNA, 20 bp, Artificial
  CRISPR gRNA sequence
ctcaccctgacctgtaacat

SEQ ID NO: 286496 - DNA, 20 bp, Artificial
  CRISPR gRNA sequence
accctgacctgtaacatttc

SEQ ID NO: 286497 - DNA, 20 bp, Artificial
  CRISPR gRNA sequence
acctgtaacatttctatgta

SEQ ID NO: 286498 - DNA, 20 bp, Artificial
  CRISPR gRNA sequence
taacatttctatgtactata

SEQ ID NO: 286499 - DNA, 20 bp, Artificial
  CRISPR gRNA sequence
ctatgtactatacacttaat

SEQ ID NO: 286500 - DNA, 20 bp, Artificial
  CRISPR gRNA sequence
tatgtactatacacttaatg

SEQ ID NO: 286501 - DNA, 20 bp, Artificial
  CRISPR gRNA sequence
tgtactatacacttaatgta

SEQ ID NO: 286502 - DNA, 20 bp, Artificial
  CRISPR gRNA sequence
tacacttaatgtatatttgt

SEQ ID NO: 286503 - DNA, 20 bp, Artificial
  CRISPR gRNA sequence
aatgtatatttgttagtgca

SEQ ID NO: 286504 - DNA, 20 bp, Artificial
  CRISPR gRNA sequence
atgtatatttgttagtgcag

SEQ ID NO: 286505 - DNA, 20 bp, Artificial
  CRISPR gRNA sequence
gttagtgcagtcagcccttg

SEQ ID NO: 286506 - DNA, 20 bp, Artificial
  CRISPR gRNA sequence
ttagtgcagtcagcccttga

SEQ ID NO: 286507 - DNA, 20 bp, Artificial
  CRISPR gRNA sequence
gtgcagtcagcccttgacct

SEQ ID NO: 286508 - DNA, 20 bp, Artificial
  CRISPR gRNA sequence
gacctcctataaatgcatta

SEQ ID NO: 286509 - DNA, 20 bp, Artificial
  CRISPR gRNA sequence
acctcctataaatgcattat

SEQ ID NO: 286510 - DNA, 20 bp, Artificial
  CRISPR gRNA sequence
ctataaatgcattatttgct

SEQ ID NO: 286511 - DNA, 20 bp, Artificial
  CRISPR gRNA sequence
taaatgcattatttgctttt

SEQ ID NO: 286512 - DNA, 20 bp, Artificial
  CRISPR gRNA sequence
tttgcttttgaatcttattc

SEQ ID NO: 286513 - DNA, 20 bp, Artificial
  CRISPR gRNA sequence
gcttttgaatcttattctaa

SEQ ID NO: 286514 - DNA, 20 bp, Artificial
  CRISPR gRNA sequence
cttttgaatcttattctaaa

SEQ ID NO: 286515 - DNA, 20 bp, Artificial
  CRISPR gRNA sequence
ttgaatcttattctaaagaa

SEQ ID NO: 286516 - DNA, 20 bp, Artificial
  CRISPR gRNA sequence
tgaatcttattctaaagaat

SEQ ID NO: 286517 - DNA, 20 bp, Artificial
  CRISPR gRNA sequence
gaatcttattctaaagaatc

SEQ ID NO: 286518 - DNA, 20 bp, Artificial
  CRISPR gRNA sequence
aatcttattctaaagaatcc

SEQ ID NO: 286519 - DNA, 20 bp, Artificial
  CRISPR gRNA sequence
attctaaagaatccccacac

SEQ ID NO: 286520 - DNA, 20 bp, Artificial
  CRISPR gRNA sequence
ttctaaagaatccccacaca

SEQ ID NO: 286521 - DNA, 20 bp, Artificial
  CRISPR gRNA sequence
taaagaatccccacacagtc

SEQ ID NO: 286522 - DNA, 20 bp, Artificial
  CRISPR gRNA sequence
aagaatccccacacagtcca

SEQ ID NO: 286523 - DNA, 20 bp, Artificial
  CRISPR gRNA sequence
atgagatttgagacatttat

SEQ ID NO: 286524 - DNA, 20 bp, Artificial
  CRISPR gRNA sequence
gagacatttataccctaaag

SEQ ID NO: 286525 - DNA, 20 bp, Artificial
  CRISPR gRNA sequence
agacatttataccctaaagc

SEQ ID NO: 286526 - DNA, 20 bp, Artificial
  CRISPR gRNA sequence
ataccctaaagctctccagc

SEQ ID NO: 286527 - DNA, 20 bp, Artificial
  CRISPR gRNA sequence
taccctaaagctctccagcc

SEQ ID NO: 286528 - DNA, 20 bp, Artificial
  CRISPR gRNA sequence
aagctctccagccacaaaga

SEQ ID NO: 286529 - DNA, 20 bp, Artificial
  CRISPR gRNA sequence
tccagccacaaagacaaaaa

SEQ ID NO: 286530 - DNA, 20 bp, Artificial
  CRISPR gRNA sequence
cagccacaaagacaaaaacc

SEQ ID NO: 286531 - DNA, 20 bp, Artificial
  CRISPR gRNA sequence
aagttagcaaactatagcac

SEQ ID NO: 286532 - DNA, 20 bp, Artificial
  CRISPR gRNA sequence
agttagcaaactatagcaca

SEQ ID NO: 286533 - DNA, 20 bp, Artificial
  CRISPR gRNA sequence
gcaaactatagcacatgggc

SEQ ID NO: 286534 - DNA, 20 bp, Artificial
  CRISPR gRNA sequence
tagcacatgggccaaacctg

SEQ ID NO: 286535 - DNA, 20 bp, Artificial
  CRISPR gRNA sequence
tcctgcacctgtttttaaaa

SEQ ID NO: 286536 - DNA, 20 bp, Artificial
  CRISPR gRNA sequence
cacctgtttttaaaaatgaa

SEQ ID NO: 286537 - DNA, 20 bp, Artificial
  CRISPR gRNA sequence
tttttaaaaatgaaattttg

SEQ ID NO: 286538 - DNA, 20 bp, Artificial
  CRISPR gRNA sequence
ttaaaaatgaaattttgtgg

SEQ ID NO: 286539 - DNA, 20 bp, Artificial
  CRISPR gRNA sequence
taaaaatgaaattttgtggc

SEQ ID NO: 286540 - DNA, 20 bp, Artificial
  CRISPR gRNA sequence
aaaaatgaaattttgtggct

SEQ ID NO: 286541 - DNA, 20 bp, Artificial
  CRISPR gRNA sequence
aaaatgaaattttgtggctg

SEQ ID NO: 286542 - DNA, 20 bp, Artificial
  CRISPR gRNA sequence
tgtggctgggtgtagtggct

SEQ ID NO: 286543 - DNA, 20 bp, Artificial
  CRISPR gRNA sequence
gtggctgggtgtagtggctc

SEQ ID NO: 286544 - DNA, 20 bp, Artificial
  CRISPR gRNA sequence
tggctgggtgtagtggctca

SEQ ID NO: 286545 - DNA, 20 bp, Artificial
  CRISPR gRNA sequence
ggtgtagtggctcacacctg

SEQ ID NO: 286546 - DNA, 20 bp, Artificial
  CRISPR gRNA sequence
acacctgtaatcacagcgct

SEQ ID NO: 286547 - DNA, 20 bp, Artificial
  CRISPR gRNA sequence
taatcacagcgctttgagag

SEQ ID NO: 286548 - DNA, 20 bp, Artificial
  CRISPR gRNA sequence
tgagaggctgaggcagatgg

SEQ ID NO: 286549 - DNA, 20 bp, Artificial
  CRISPR gRNA sequence
gagaggctgaggcagatgga

SEQ ID NO: 286550 - DNA, 20 bp, Artificial
  CRISPR gRNA sequence
agaggctgaggcagatggat

SEQ ID NO: 286551 - DNA, 20 bp, Artificial
  CRISPR gRNA sequence
aggcagatggatcacctgag

SEQ ID NO: 286552 - DNA, 20 bp, Artificial
  CRISPR gRNA sequence
agatcaggagttcgagacca

SEQ ID NO: 286553 - DNA, 20 bp, Artificial
  CRISPR gRNA sequence
gagaccagcctgaccaacat

SEQ ID NO: 286554 - DNA, 20 bp, Artificial
  CRISPR gRNA sequence
accaacatggtgaaacccca

SEQ ID NO: 286555 - DNA, 20 bp, Artificial
  CRISPR gRNA sequence
cactaagaaaatacataaat

SEQ ID NO: 286556 - DNA, 20 bp, Artificial
  CRISPR gRNA sequence
agaaaatacataaattagcc

SEQ ID NO: 286557 - DNA, 20 bp, Artificial
  CRISPR gRNA sequence
gccagttgtggaggcaggca

SEQ ID NO: 286558 - DNA, 20 bp, Artificial
  CRISPR gRNA sequence
tggaggcaggcacctgtaat

SEQ ID NO: 286559 - DNA, 20 bp, Artificial
  CRISPR gRNA sequence
taatcccagctacttgggag

SEQ ID NO: 286560 - DNA, 20 bp, Artificial
  CRISPR gRNA sequence
cttgggaggctgaggcagga

SEQ ID NO: 286561 - DNA, 20 bp, Artificial
  CRISPR gRNA sequence
gggaggctgaggcaggagaa

SEQ ID NO: 286562 - DNA, 20 bp, Artificial
  CRISPR gRNA sequence
ggaggctgaggcaggagaat

SEQ ID NO: 286563 - DNA, 20 bp, Artificial
  CRISPR gRNA sequence
aggcaggagaatcgtttgaa

SEQ ID NO: 286564 - DNA, 20 bp, Artificial
  CRISPR gRNA sequence
gaacctgggaggcagaggtt

SEQ ID NO: 286565 - DNA, 20 bp, Artificial
  CRISPR gRNA sequence
aacctgggaggcagaggttg

SEQ ID NO: 286566 - DNA, 20 bp, Artificial
  CRISPR gRNA sequence
ggaggcagaggttgcagtga

SEQ ID NO: 286567 - DNA, 20 bp, Artificial
  CRISPR gRNA sequence
cagtgagccgagaccacacc

SEQ ID NO: 286568 - DNA, 20 bp, Artificial
  CRISPR gRNA sequence
cactccagcctgggcaacaa

SEQ ID NO: 286569 - DNA, 20 bp, Artificial
  CRISPR gRNA sequence
cagcctgggcaacaagagtg

SEQ ID NO: 286570 - DNA, 20 bp, Artificial
  CRISPR gRNA sequence
ggcaacaagagtgaaactct

SEQ ID NO: 286571 - DNA, 20 bp, Artificial
  CRISPR gRNA sequence
tgtctcaaaaaaaaaaaaaa

SEQ ID NO: 286572 - DNA, 20 bp, Artificial
  CRISPR gRNA sequence
tctcaaaaaaaaaaaaaaga

SEQ ID NO: 286573 - DNA, 20 bp, Artificial
  CRISPR gRNA sequence
aaaaaaaaaaaaaagaaaaa

SEQ ID NO: 286574 - DNA, 20 bp, Artificial
  CRISPR gRNA sequence
tgttggaacatagccatgtc

SEQ ID NO: 286575 - DNA, 20 bp, Artificial
  CRISPR gRNA sequence
gttggaacatagccatgtca

SEQ ID NO: 286576 - DNA, 20 bp, Artificial
  CRISPR gRNA sequence
ttggaacatagccatgtcat

SEQ ID NO: 286577 - DNA, 20 bp, Artificial
  CRISPR gRNA sequence
gaacatagccatgtcattca

SEQ ID NO: 286578 - DNA, 20 bp, Artificial
  CRISPR gRNA sequence
atttatgtcttgtctgtggc

SEQ ID NO: 286579 - DNA, 20 bp, Artificial
  CRISPR gRNA sequence
atgtcttgtctgtggctgct

SEQ ID NO: 286580 - DNA, 20 bp, Artificial
  CRISPR gRNA sequence
tgtcttgtctgtggctgctt

SEQ ID NO: 286581 - DNA, 20 bp, Artificial
  CRISPR gRNA sequence
gtctgtggctgcttttgtgc

SEQ ID NO: 286582 - DNA, 20 bp, Artificial
  CRISPR gRNA sequence
tctgtggctgcttttgtgct

SEQ ID NO: 286583 - DNA, 20 bp, Artificial
  CRISPR gRNA sequence
tggctgcttttgtgctacaa

SEQ ID NO: 286584 - DNA, 20 bp, Artificial
  CRISPR gRNA sequence
cttttgtgctacaaccagca

SEQ ID NO: 286585 - DNA, 20 bp, Artificial
  CRISPR gRNA sequence
ttgtgctacaaccagcagaa

SEQ ID NO: 286586 - DNA, 20 bp, Artificial
  CRISPR gRNA sequence
tgtgctacaaccagcagaat

SEQ ID NO: 286587 - DNA, 20 bp, Artificial
  CRISPR gRNA sequence
gtgctacaaccagcagaatt

SEQ ID NO: 286588 - DNA, 20 bp, Artificial
  CRISPR gRNA sequence
tgctacaaccagcagaattg

SEQ ID NO: 286589 - DNA, 20 bp, Artificial
  CRISPR gRNA sequence
caaccagcagaattgagttg

SEQ ID NO: 286590 - DNA, 20 bp, Artificial
  CRISPR gRNA sequence
agttgttgcaacagagactg

SEQ ID NO: 286591 - DNA, 20 bp, Artificial
  CRISPR gRNA sequence
ttgcaacagagactgtgact

SEQ ID NO: 286592 - DNA, 20 bp, Artificial
  CRISPR gRNA sequence
caacagagactgtgactgca

SEQ ID NO: 286593 - DNA, 20 bp, Artificial
  CRISPR gRNA sequence
tgactgcaaagcttaaaata

SEQ ID NO: 286594 - DNA, 20 bp, Artificial
  CRISPR gRNA sequence
caaagcttaaaatatttact

SEQ ID NO: 286595 - DNA, 20 bp, Artificial
  CRISPR gRNA sequence
aaaatatttactatctggct

SEQ ID NO: 286596 - DNA, 20 bp, Artificial
  CRISPR gRNA sequence
aaatatttactatctggctc

SEQ ID NO: 286597 - DNA, 20 bp, Artificial
  CRISPR gRNA sequence
actatctggctctattcaga

SEQ ID NO: 286598 - DNA, 20 bp, Artificial
  CRISPR gRNA sequence
ctatctggctctattcagaa

SEQ ID NO: 286599 - DNA, 20 bp, Artificial
  CRISPR gRNA sequence
tctggctctattcagaaaaa

SEQ ID NO: 286600 - DNA, 20 bp, Artificial
  CRISPR gRNA sequence
gctctattcagaaaaaaatt

SEQ ID NO: 286601 - DNA, 20 bp, Artificial
  CRISPR gRNA sequence
tattcagaaaaaaatttgcc

SEQ ID NO: 286602 - DNA, 20 bp, Artificial
  CRISPR gRNA sequence
ttcagaaaaaaatttgccaa

SEQ ID NO: 286603 - DNA, 20 bp, Artificial
  CRISPR gRNA sequence
agaaaaaaatttgccaaccc

SEQ ID NO: 286604 - DNA, 20 bp, Artificial
  CRISPR gRNA sequence
gccaacccctgtcttagaat

SEQ ID NO: 286605 - DNA, 20 bp, Artificial
  CRISPR gRNA sequence
ccaacccctgtcttagaatg

SEQ ID NO: 286606 - DNA, 20 bp, Artificial
  CRISPR gRNA sequence
tcttagaatgtcacatatat

SEQ ID NO: 286607 - DNA, 20 bp, Artificial
  CRISPR gRNA sequence
agaatgtcacatatatccat

SEQ ID NO: 286608 - DNA, 20 bp, Artificial
  CRISPR gRNA sequence
gaatgtcacatatatccata

SEQ ID NO: 286609 - DNA, 20 bp, Artificial
  CRISPR gRNA sequence
caatataaataatgtccaaa

SEQ ID NO: 286610 - DNA, 20 bp, Artificial
  CRISPR gRNA sequence
gtattactgatttaataatc

SEQ ID NO: 286611 - DNA, 20 bp, Artificial
  CRISPR gRNA sequence
ctgatttaataatcagtact

SEQ ID NO: 286612 - DNA, 20 bp, Artificial
  CRISPR gRNA sequence
atttaataatcagtactcta

SEQ ID NO: 286613 - DNA, 20 bp, Artificial
  CRISPR gRNA sequence
aataatcagtactctactgt

SEQ ID NO: 286614 - DNA, 20 bp, Artificial
  CRISPR gRNA sequence
ataatcagtactctactgtt

SEQ ID NO: 286615 - DNA, 20 bp, Artificial
  CRISPR gRNA sequence
tactgttttctgccttcaat

SEQ ID NO: 286616 - DNA, 20 bp, Artificial
  CRISPR gRNA sequence
ctgttttctgccttcaatca

SEQ ID NO: 286617 - DNA, 20 bp, Artificial
  CRISPR gRNA sequence
ttttctgccttcaatcagaa

SEQ ID NO: 286618 - DNA, 20 bp, Artificial
  CRISPR gRNA sequence
tctgccttcaatcagaataa

SEQ ID NO: 286619 - DNA, 20 bp, Artificial
  CRISPR gRNA sequence
ctgccttcaatcagaataat

SEQ ID NO: 286620 - DNA, 20 bp, Artificial
  CRISPR gRNA sequence
tgccttcaatcagaataatg

SEQ ID NO: 286621 - DNA, 20 bp, Artificial
  CRISPR gRNA sequence
ccttcaatcagaataatgta

SEQ ID NO: 286622 - DNA, 20 bp, Artificial
  CRISPR gRNA sequence
caatcagaataatgtaaaat

SEQ ID NO: 286623 - DNA, 20 bp, Artificial
  CRISPR gRNA sequence
aatcagaataatgtaaaatt

SEQ ID NO: 286624 - DNA, 20 bp, Artificial
  CRISPR gRNA sequence
gttaaataatgctataacaa

SEQ ID NO: 286625 - DNA, 20 bp, Artificial
  CRISPR gRNA sequence
aataatgctataacaagaaa

SEQ ID NO: 286626 - DNA, 20 bp, Artificial
  CRISPR gRNA sequence
taacaagaaagtaaaaatag

SEQ ID NO: 286627 - DNA, 20 bp, Artificial
  CRISPR gRNA sequence
aataaactatatgattgaag

SEQ ID NO: 286628 - DNA, 20 bp, Artificial
  CRISPR gRNA sequence
ataaactatatgattgaagc

SEQ ID NO: 286629 - DNA, 20 bp, Artificial
  CRISPR gRNA sequence
tatgattgaagcctcatttt

SEQ ID NO: 286630 - DNA, 20 bp, Artificial
  CRISPR gRNA sequence
aagcctcattttaataaaat

SEQ ID NO: 286631 - DNA, 20 bp, Artificial
  CRISPR gRNA sequence
attttaataaaatttttaca

SEQ ID NO: 286632 - DNA, 20 bp, Artificial
  CRISPR gRNA sequence
taataaaatttttacaacac

SEQ ID NO: 286633 - DNA, 20 bp, Artificial
  CRISPR gRNA sequence
aataaaatttttacaacaca

SEQ ID NO: 286634 - DNA, 20 bp, Artificial
  CRISPR gRNA sequence
ataaaatttttacaacacat

SEQ ID NO: 286635 - DNA, 20 bp, Artificial
  CRISPR gRNA sequence
ttacaacacataaaagatga

SEQ ID NO: 286636 - DNA, 20 bp, Artificial
  CRISPR gRNA sequence
tacaacacataaaagatgac

SEQ ID NO: 286637 - DNA, 20 bp, Artificial
  CRISPR gRNA sequence
acaacacataaaagatgact

SEQ ID NO: 286638 - DNA, 20 bp, Artificial
  CRISPR gRNA sequence
caacacataaaagatgactg

SEQ ID NO: 286639 - DNA, 20 bp, Artificial
  CRISPR gRNA sequence
agactggtaagtttggagta

SEQ ID NO: 286640 - DNA, 20 bp, Artificial
  CRISPR gRNA sequence
gtaagtttggagtatcaata

SEQ ID NO: 286641 - DNA, 20 bp, Artificial
  CRISPR gRNA sequence
ggagtatcaatagtcatgtc

SEQ ID NO: 286642 - DNA, 20 bp, Artificial
  CRISPR gRNA sequence
gagtatcaatagtcatgtca

SEQ ID NO: 286643 - DNA, 20 bp, Artificial
  CRISPR gRNA sequence
ggtttatatttgaactaatt

SEQ ID NO: 286644 - DNA, 20 bp, Artificial
  CRISPR gRNA sequence
gtttatatttgaactaattt

SEQ ID NO: 286645 - DNA, 20 bp, Artificial
  CRISPR gRNA sequence
atatttgaactaattttccc

SEQ ID NO: 286646 - DNA, 20 bp, Artificial
  CRISPR gRNA sequence
tatttgaactaattttccca

SEQ ID NO: 286647 - DNA, 20 bp, Artificial
  CRISPR gRNA sequence
gaactaattttcccaggaaa

SEQ ID NO: 286648 - DNA, 20 bp, Artificial
  CRISPR gRNA sequence
aactaattttcccaggaaat

SEQ ID NO: 286649 - DNA, 20 bp, Artificial
  CRISPR gRNA sequence
attttcccaggaaattttgt

SEQ ID NO: 286650 - DNA, 20 bp, Artificial
  CRISPR gRNA sequence
tcccaggaaattttgtctca

SEQ ID NO: 286651 - DNA, 20 bp, Artificial
  CRISPR gRNA sequence
cccaggaaattttgtctcat

SEQ ID NO: 286652 - DNA, 20 bp, Artificial
  CRISPR gRNA sequence
ccaggaaattttgtctcatt

SEQ ID NO: 286653 - DNA, 20 bp, Artificial
  CRISPR gRNA sequence
tgtctcattgaggaaaataa

SEQ ID NO: 286654 - DNA, 20 bp, Artificial
  CRISPR gRNA sequence
gtctcattgaggaaaataaa

SEQ ID NO: 286655 - DNA, 20 bp, Artificial
  CRISPR gRNA sequence
tctcattgaggaaaataaag

SEQ ID NO: 286656 - DNA, 20 bp, Artificial
  CRISPR gRNA sequence
attgaggaaaataaagaatc

SEQ ID NO: 286657 - DNA, 20 bp, Artificial
  CRISPR gRNA sequence
aggaaaataaagaatctgct

SEQ ID NO: 286658 - DNA, 20 bp, Artificial
  CRISPR gRNA sequence
ctgtagccgggcatggtggc

SEQ ID NO: 286659 - DNA, 20 bp, Artificial
  CRISPR gRNA sequence
tagccgggcatggtggctca

SEQ ID NO: 286660 - DNA, 20 bp, Artificial
  CRISPR gRNA sequence
atgcctgtaatctccacact

SEQ ID NO: 286661 - DNA, 20 bp, Artificial
  CRISPR gRNA sequence
taatctccacactttgggag

SEQ ID NO: 286662 - DNA, 20 bp, Artificial
  CRISPR gRNA sequence
cacactttgggaggctgagg

SEQ ID NO: 286663 - DNA, 20 bp, Artificial
  CRISPR gRNA sequence
tgggaggctgaggcgggcag

SEQ ID NO: 286664 - DNA, 20 bp, Artificial
  CRISPR gRNA sequence
gggaggctgaggcgggcaga

SEQ ID NO: 286665 - DNA, 20 bp, Artificial
  CRISPR gRNA sequence
ggaggctgaggcgggcagat

SEQ ID NO: 286666 - DNA, 20 bp, Artificial
  CRISPR gRNA sequence
aggcgggcagatcacctaag

SEQ ID NO: 286667 - DNA, 20 bp, Artificial
  CRISPR gRNA sequence
aggtcgagagttcaagacca

SEQ ID NO: 286668 - DNA, 20 bp, Artificial
  CRISPR gRNA sequence
aagaccagcctgaccaacgt

SEQ ID NO: 286669 - DNA, 20 bp, Artificial
  CRISPR gRNA sequence
accaacgtggtgaaactcca

SEQ ID NO: 286670 - DNA, 20 bp, Artificial
  CRISPR gRNA sequence
catctctactaaaaatacaa

SEQ ID NO: 286671 - DNA, 20 bp, Artificial
  CRISPR gRNA sequence
tactaaaaatacaaaaatta

SEQ ID NO: 286672 - DNA, 20 bp, Artificial
  CRISPR gRNA sequence
ctaaaaatacaaaaattatc

SEQ ID NO: 286673 - DNA, 20 bp, Artificial
  CRISPR gRNA sequence
aaaatacaaaaattatctgt

SEQ ID NO: 286674 - DNA, 20 bp, Artificial
  CRISPR gRNA sequence
tctgtgtgtggtggctggca

SEQ ID NO: 286675 - DNA, 20 bp, Artificial
  CRISPR gRNA sequence
tgtgtggtggctggcacctg

SEQ ID NO: 286676 - DNA, 20 bp, Artificial
  CRISPR gRNA sequence
gcacctgtagtcccagctac

SEQ ID NO: 286677 - DNA, 20 bp, Artificial
  CRISPR gRNA sequence
tagtcccagctacacaggag

SEQ ID NO: 286678 - DNA, 20 bp, Artificial
  CRISPR gRNA sequence
cacaggaggctgagacagga

SEQ ID NO: 286679 - DNA, 20 bp, Artificial
  CRISPR gRNA sequence
agacaggagaattgcttcaa

SEQ ID NO: 286680 - DNA, 20 bp, Artificial
  CRISPR gRNA sequence
cttcaacctgggaggcggag

SEQ ID NO: 286681 - DNA, 20 bp, Artificial
  CRISPR gRNA sequence
caacctgggaggcggaggtt

SEQ ID NO: 286682 - DNA, 20 bp, Artificial
  CRISPR gRNA sequence
aacctgggaggcggaggtta

SEQ ID NO: 286683 - DNA, 20 bp, Artificial
  CRISPR gRNA sequence
ggaggcggaggttacagtga

SEQ ID NO: 286684 - DNA, 20 bp, Artificial
  CRISPR gRNA sequence
cagtgagccaagatcacgcc

SEQ ID NO: 286685 - DNA, 20 bp, Artificial
  CRISPR gRNA sequence
cactccagcctgggtgacag

SEQ ID NO: 286686 - DNA, 20 bp, Artificial
  CRISPR gRNA sequence
cagcctgggtgacagagcga

SEQ ID NO: 286687 - DNA, 20 bp, Artificial
  CRISPR gRNA sequence
ggtgacagagcgagactccg

SEQ ID NO: 286688 - DNA, 20 bp, Artificial
  CRISPR gRNA sequence
cgtctcaaaaaaaaaaaaaa

SEQ ID NO: 286689 - DNA, 20 bp, Artificial
  CRISPR gRNA sequence
aaaaaaaaaaaaaaaaatct

SEQ ID NO: 286690 - DNA, 20 bp, Artificial
  CRISPR gRNA sequence
ctgtaacactgaaagatcta

SEQ ID NO: 286691 - DNA, 20 bp, Artificial
  CRISPR gRNA sequence
taacactgaaagatctagag

SEQ ID NO: 286692 - DNA, 20 bp, Artificial
  CRISPR gRNA sequence
aaagatctagagtaaatcat

SEQ ID NO: 286693 - DNA, 20 bp, Artificial
  CRISPR gRNA sequence
gagtaaatcatacactagca

SEQ ID NO: 286694 - DNA, 20 bp, Artificial
  CRISPR gRNA sequence
gcatgaattactagaccatc

SEQ ID NO: 286695 - DNA, 20 bp, Artificial
  CRISPR gRNA sequence
ctagaccatctaaaataaat

SEQ ID NO: 286696 - DNA, 20 bp, Artificial
  CRISPR gRNA sequence
gaccatctaaaataaattat

SEQ ID NO: 286697 - DNA, 20 bp, Artificial
  CRISPR gRNA sequence
aaataaattatccacttcgc

SEQ ID NO: 286698 - DNA, 20 bp, Artificial
  CRISPR gRNA sequence
tccacttcgcaactacaagt

SEQ ID NO: 286699 - DNA, 20 bp, Artificial
  CRISPR gRNA sequence
cgcaactacaagtaaagaca

SEQ ID NO: 286700 - DNA, 20 bp, Artificial
  CRISPR gRNA sequence
gcaactacaagtaaagacat

SEQ ID NO: 286701 - DNA, 20 bp, Artificial
  CRISPR gRNA sequence
caagtaaagacatgaagaat

SEQ ID NO: 286702 - DNA, 20 bp, Artificial
  CRISPR gRNA sequence
agacatgccatatagtatat

SEQ ID NO: 286703 - DNA, 20 bp, Artificial
  CRISPR gRNA sequence
tgctatatacttatgtgcaa

SEQ ID NO: 286704 - DNA, 20 bp, Artificial
  CRISPR gRNA sequence
tatacttatgtgcaactgta

SEQ ID NO: 286705 - DNA, 20 bp, Artificial
  CRISPR gRNA sequence
atgtgcaactgtattatcaa

SEQ ID NO: 286706 - DNA, 20 bp, Artificial
  CRISPR gRNA sequence
tgtgcaactgtattatcaaa

SEQ ID NO: 286707 - DNA, 20 bp, Artificial
  CRISPR gRNA sequence
tattatcaaactcagtgttt

SEQ ID NO: 286708 - DNA, 20 bp, Artificial
  CRISPR gRNA sequence
tcaaactcagtgttttgttt

SEQ ID NO: 286709 - DNA, 20 bp, Artificial
  CRISPR gRNA sequence
agtgttttgtttcttactat

SEQ ID NO: 286710 - DNA, 20 bp, Artificial
  CRISPR gRNA sequence
tgtttcttactatacagtca

SEQ ID NO: 286711 - DNA, 20 bp, Artificial
  CRISPR gRNA sequence
gtttcttactatacagtcac

SEQ ID NO: 286712 - DNA, 20 bp, Artificial
  CRISPR gRNA sequence
tttcttactatacagtcaca

SEQ ID NO: 286713 - DNA, 20 bp, Artificial
  CRISPR gRNA sequence
cttactatacagtcacaaaa

SEQ ID NO: 286714 - DNA, 20 bp, Artificial
  CRISPR gRNA sequence
ttactatacagtcacaaaac

SEQ ID NO: 286715 - DNA, 20 bp, Artificial
  CRISPR gRNA sequence
actatacagtcacaaaacct

SEQ ID NO: 286716 - DNA, 20 bp, Artificial
  CRISPR gRNA sequence
ctatacagtcacaaaaccta

SEQ ID NO: 286717 - DNA, 20 bp, Artificial
  CRISPR gRNA sequence
tacagtcacaaaacctatcc

SEQ ID NO: 286718 - DNA, 20 bp, Artificial
  CRISPR gRNA sequence
tccttgggagtggggctagg

SEQ ID NO: 286719 - DNA, 20 bp, Artificial
  CRISPR gRNA sequence
gggagtggggctaggggtag

SEQ ID NO: 286720 - DNA, 20 bp, Artificial
  CRISPR gRNA sequence
ggagtggggctaggggtagg

SEQ ID NO: 286721 - DNA, 20 bp, Artificial
  CRISPR gRNA sequence
ggggtagggagagagacctg

SEQ ID NO: 286722 - DNA, 20 bp, Artificial
  CRISPR gRNA sequence
tggtcctctgtatgatcagc

SEQ ID NO: 286723 - DNA, 20 bp, Artificial
  CRISPR gRNA sequence
tgtatgatcagccgtacaat

SEQ ID NO: 286724 - DNA, 20 bp, Artificial
  CRISPR gRNA sequence
tatgatcagccgtacaattt

SEQ ID NO: 286725 - DNA, 20 bp, Artificial
  CRISPR gRNA sequence
aaacaagtattaatattttg

SEQ ID NO: 286726 - DNA, 20 bp, Artificial
  CRISPR gRNA sequence
aacaagtattaatattttga

SEQ ID NO: 286727 - DNA, 20 bp, Artificial
  CRISPR gRNA sequence
atattttgagcatctcagtt

SEQ ID NO: 286728 - DNA, 20 bp, Artificial
  CRISPR gRNA sequence
tgagcatctcagttcacctt

SEQ ID NO: 286729 - DNA, 20 bp, Artificial
  CRISPR gRNA sequence
gagcatctcagttcaccttg

SEQ ID NO: 286730 - DNA, 20 bp, Artificial
  CRISPR gRNA sequence
agcatctcagttcaccttgt

SEQ ID NO: 286731 - DNA, 20 bp, Artificial
  CRISPR gRNA sequence
agttcaccttgtaagccatc

SEQ ID NO: 286732 - DNA, 20 bp, Artificial
  CRISPR gRNA sequence
accttgtaagccatcttaag

SEQ ID NO: 286733 - DNA, 20 bp, Artificial
  CRISPR gRNA sequence
gtaagccatcttaagccatt

SEQ ID NO: 286734 - DNA, 20 bp, Artificial
  CRISPR gRNA sequence
taagccatcttaagccatta

SEQ ID NO: 286735 - DNA, 20 bp, Artificial
  CRISPR gRNA sequence
aagccattataggcctaaga

SEQ ID NO: 286736 - DNA, 20 bp, Artificial
  CRISPR gRNA sequence
agccattataggcctaagat

SEQ ID NO: 286737 - DNA, 20 bp, Artificial
  CRISPR gRNA sequence
taggcctaagatgtatatat

SEQ ID NO: 286738 - DNA, 20 bp, Artificial
  CRISPR gRNA sequence
agatgtatatattcatataa

SEQ ID NO: 286739 - DNA, 20 bp, Artificial
  CRISPR gRNA sequence
atataaacccatcgttttca

SEQ ID NO: 286740 - DNA, 20 bp, Artificial
  CRISPR gRNA sequence
tcattgtatattttcaaatg

SEQ ID NO: 286741 - DNA, 20 bp, Artificial
  CRISPR gRNA sequence
cattgtatattttcaaatga

SEQ ID NO: 286742 - DNA, 20 bp, Artificial
  CRISPR gRNA sequence
attgtatattttcaaatgat

SEQ ID NO: 286743 - DNA, 20 bp, Artificial
  CRISPR gRNA sequence
tatattttcaaatgatttca

SEQ ID NO: 286744 - DNA, 20 bp, Artificial
  CRISPR gRNA sequence
tcaaatgatttcacctcttg

SEQ ID NO: 286745 - DNA, 20 bp, Artificial
  CRISPR gRNA sequence
caaatgatttcacctcttgg

SEQ ID NO: 286746 - DNA, 20 bp, Artificial
  CRISPR gRNA sequence
aaatgatttcacctcttggg

SEQ ID NO: 286747 - DNA, 20 bp, Artificial
  CRISPR gRNA sequence
cacctcttggggaaagagaa

SEQ ID NO: 286748 - DNA, 20 bp, Artificial
  CRISPR gRNA sequence
acctcttggggaaagagaat

SEQ ID NO: 286749 - DNA, 20 bp, Artificial
  CRISPR gRNA sequence
ttggggaaagagaattctct

SEQ ID NO: 286750 - DNA, 20 bp, Artificial
  CRISPR gRNA sequence
ggggaaagagaattctctga

SEQ ID NO: 286751 - DNA, 20 bp, Artificial
  CRISPR gRNA sequence
gggaaagagaattctctgag

SEQ ID NO: 286752 - DNA, 20 bp, Artificial
  CRISPR gRNA sequence
tctgagtttactaccagtag

SEQ ID NO: 286753 - DNA, 20 bp, Artificial
  CRISPR gRNA sequence
tgagtttactaccagtaggg

SEQ ID NO: 286754 - DNA, 20 bp, Artificial
  CRISPR gRNA sequence
agtttactaccagtagggta

SEQ ID NO: 286755 - DNA, 20 bp, Artificial
  CRISPR gRNA sequence
actaccagtagggtaaaata

SEQ ID NO: 286756 - DNA, 20 bp, Artificial
  CRISPR gRNA sequence
ctaccagtagggtaaaatat

SEQ ID NO: 286757 - DNA, 20 bp, Artificial
  CRISPR gRNA sequence
ccagtagggtaaaatatttg

SEQ ID NO: 286758 - DNA, 20 bp, Artificial
  CRISPR gRNA sequence
gctccaaaatgacctctttt

SEQ ID NO: 286759 - DNA, 20 bp, Artificial
  CRISPR gRNA sequence
ctccaaaatgacctcttttc

SEQ ID NO: 286760 - DNA, 20 bp, Artificial
  CRISPR gRNA sequence
caaaatgacctcttttcagg

SEQ ID NO: 286761 - DNA, 20 bp, Artificial
  CRISPR gRNA sequence
ttttcaggcgttgtcttcaa

SEQ ID NO: 286762 - DNA, 20 bp, Artificial
  CRISPR gRNA sequence
ttcaggcgttgtcttcaagg

SEQ ID NO: 286763 - DNA, 20 bp, Artificial
  CRISPR gRNA sequence
tcaggcgttgtcttcaagga

SEQ ID NO: 286764 - DNA, 20 bp, Artificial
  CRISPR gRNA sequence
caggcgttgtcttcaaggag

SEQ ID NO: 286765 - DNA, 20 bp, Artificial
  CRISPR gRNA sequence
aggcgttgtcttcaaggagt

SEQ ID NO: 286766 - DNA, 20 bp, Artificial
  CRISPR gRNA sequence
tcttcaaggagtttgtcact

SEQ ID NO: 286767 - DNA, 20 bp, Artificial
  CRISPR gRNA sequence
caaggagtttgtcactcacc

SEQ ID NO: 286768 - DNA, 20 bp, Artificial
  CRISPR gRNA sequence
aaggagtttgtcactcacct

SEQ ID NO: 286769 - DNA, 20 bp, Artificial
  CRISPR gRNA sequence
gtcactcacctttcccagac

SEQ ID NO: 286770 - DNA, 20 bp, Artificial
  CRISPR gRNA sequence
tcactcacctttcccagact

SEQ ID NO: 286771 - DNA, 20 bp, Artificial
  CRISPR gRNA sequence
acctttcccagacttggttc

SEQ ID NO: 286772 - DNA, 20 bp, Artificial
  CRISPR gRNA sequence
tcccagacttggttcagaat

SEQ ID NO: 286773 - DNA, 20 bp, Artificial
  CRISPR gRNA sequence
cccagacttggttcagaatg

SEQ ID NO: 286774 - DNA, 20 bp, Artificial
  CRISPR gRNA sequence
ccagacttggttcagaatga

SEQ ID NO: 286775 - DNA, 20 bp, Artificial
  CRISPR gRNA sequence
ggttcagaatgaaccagtag

SEQ ID NO: 286776 - DNA, 20 bp, Artificial
  CRISPR gRNA sequence
gttcagaatgaaccagtagt

SEQ ID NO: 286777 - DNA, 20 bp, Artificial
  CRISPR gRNA sequence
agaatgaaccagtagttctt

SEQ ID NO: 286778 - DNA, 20 bp, Artificial
  CRISPR gRNA sequence
ttaaaaagcacattcgccca

SEQ ID NO: 286779 - DNA, 20 bp, Artificial
  CRISPR gRNA sequence
aaaaagcacattcgcccaca

SEQ ID NO: 286780 - DNA, 20 bp, Artificial
  CRISPR gRNA sequence
aaaagcacattcgcccacaa

SEQ ID NO: 286781 - DNA, 20 bp, Artificial
  CRISPR gRNA sequence
gcccacaaaaaaaaattgtt

SEQ ID NO: 286782 - DNA, 20 bp, Artificial
  CRISPR gRNA sequence
tttggcaccatggaaccgtg

SEQ ID NO: 286783 - DNA, 20 bp, Artificial
  CRISPR gRNA sequence
ggcaccatggaaccgtgtgg

SEQ ID NO: 286784 - DNA, 20 bp, Artificial
  CRISPR gRNA sequence
gcaccatggaaccgtgtggg

SEQ ID NO: 286785 - DNA, 20 bp, Artificial
  CRISPR gRNA sequence
aaagaaagcaccaaatccct

SEQ ID NO: 286786 - DNA, 20 bp, Artificial
  CRISPR gRNA sequence
agggcagttccaaagggcaa

SEQ ID NO: 286787 - DNA, 20 bp, Artificial
  CRISPR gRNA sequence
caaagggcaaattttaatgc

SEQ ID NO: 286788 - DNA, 20 bp, Artificial
  CRISPR gRNA sequence
taatgctttcaataatacta

SEQ ID NO: 286789 - DNA, 20 bp, Artificial
  CRISPR gRNA sequence
aatgctttcaataatactat

SEQ ID NO: 286790 - DNA, 20 bp, Artificial
  CRISPR gRNA sequence
atgctttcaataatactatt

SEQ ID NO: 286791 - DNA, 20 bp, Artificial
  CRISPR gRNA sequence
tcaataatactattgttaca

SEQ ID NO: 286792 - DNA, 20 bp, Artificial
  CRISPR gRNA sequence
caataatactattgttacaa

SEQ ID NO: 286793 - DNA, 20 bp, Artificial
  CRISPR gRNA sequence
aataatactattgttacaaa

SEQ ID NO: 286794 - DNA, 20 bp, Artificial
  CRISPR gRNA sequence
ttgttacaaaaactttttaa

SEQ ID NO: 286795 - DNA, 20 bp, Artificial
  CRISPR gRNA sequence
ttacaaaaactttttaagat

SEQ ID NO: 286796 - DNA, 20 bp, Artificial
  CRISPR gRNA sequence
caaaaactttttaagatgaa

SEQ ID NO: 286797 - DNA, 20 bp, Artificial
  CRISPR gRNA sequence
tttaagatgaatgcttgatg

SEQ ID NO: 286798 - DNA, 20 bp, Artificial
  CRISPR gRNA sequence
ttaagatgaatgcttgatgg

SEQ ID NO: 286799 - DNA, 20 bp, Artificial
  CRISPR gRNA sequence
taagatgaatgcttgatgga

SEQ ID NO: 286800 - DNA, 20 bp, Artificial
  CRISPR gRNA sequence
aagatgaatgcttgatggat

SEQ ID NO: 286801 - DNA, 20 bp, Artificial
  CRISPR gRNA sequence
agatgaatgcttgatggata

SEQ ID NO: 286802 - DNA, 20 bp, Artificial
  CRISPR gRNA sequence
gatggataatggtttttagt

SEQ ID NO: 286803 - DNA, 20 bp, Artificial
  CRISPR gRNA sequence
atggataatggtttttagta

SEQ ID NO: 286804 - DNA, 20 bp, Artificial
  CRISPR gRNA sequence
ttagtatatataaattttag

SEQ ID NO: 286805 - DNA, 20 bp, Artificial
  CRISPR gRNA sequence
tagtatatataaattttaga

SEQ ID NO: 286806 - DNA, 20 bp, Artificial
  CRISPR gRNA sequence
agtatatataaattttagaa

SEQ ID NO: 286807 - DNA, 20 bp, Artificial
  CRISPR gRNA sequence
gtatatataaattttagaat

SEQ ID NO: 286808 - DNA, 20 bp, Artificial
  CRISPR gRNA sequence
tagaatatttattacaagaa

SEQ ID NO: 286809 - DNA, 20 bp, Artificial
  CRISPR gRNA sequence
agaatatttattacaagaaa

SEQ ID NO: 286810 - DNA, 20 bp, Artificial
  CRISPR gRNA sequence
gaatatttattacaagaaaa

SEQ ID NO: 286811 - DNA, 20 bp, Artificial
  CRISPR gRNA sequence
attacaagaaaataaggccg

SEQ ID NO: 286812 - DNA, 20 bp, Artificial
  CRISPR gRNA sequence
ttacaagaaaataaggccgg

SEQ ID NO: 286813 - DNA, 20 bp, Artificial
  CRISPR gRNA sequence
caagaaaataaggccgggtg

SEQ ID NO: 286814 - DNA, 20 bp, Artificial
  CRISPR gRNA sequence
acacctgtaatcccagcact

SEQ ID NO: 286815 - DNA, 20 bp, Artificial
  CRISPR gRNA sequence
taatcccagcactttgggag

SEQ ID NO: 286816 - DNA, 20 bp, Artificial
  CRISPR gRNA sequence
tgggaggctgaggcgggcgg

SEQ ID NO: 286817 - DNA, 20 bp, Artificial
  CRISPR gRNA sequence
gggaggctgaggcgggcgga

SEQ ID NO: 286818 - DNA, 20 bp, Artificial
  CRISPR gRNA sequence
ggaggctgaggcgggcggat

SEQ ID NO: 286819 - DNA, 20 bp, Artificial
  CRISPR gRNA sequence
aggcgggcggatcacgaggt

SEQ ID NO: 286820 - DNA, 20 bp, Artificial
  CRISPR gRNA sequence
gagaccagcctgaccaacat

SEQ ID NO: 286821 - DNA, 20 bp, Artificial
  CRISPR gRNA sequence
accaacatggtgaaacccca

SEQ ID NO: 286822 - DNA, 20 bp, Artificial
  CRISPR gRNA sequence
cactaaagatagaaaaaatt

SEQ ID NO: 286823 - DNA, 20 bp, Artificial
  CRISPR gRNA sequence
aagatagaaaaaattagccg

SEQ ID NO: 286824 - DNA, 20 bp, Artificial
  CRISPR gRNA sequence
gccgagggtggtggctggcg

SEQ ID NO: 286825 - DNA, 20 bp, Artificial
  CRISPR gRNA sequence
gcgcctgtaatcccagctat

SEQ ID NO: 286826 - DNA, 20 bp, Artificial
  CRISPR gRNA sequence
taatcccagctattcgggag

SEQ ID NO: 286827 - DNA, 20 bp, Artificial
  CRISPR gRNA sequence
ttcgggaggctgaggcagaa

SEQ ID NO: 286828 - DNA, 20 bp, Artificial
  CRISPR gRNA sequence
gggaggctgaggcagaagaa

SEQ ID NO: 286829 - DNA, 20 bp, Artificial
  CRISPR gRNA sequence
aggcagaagaattgcttgaa

SEQ ID NO: 286830 - DNA, 20 bp, Artificial
  CRISPR gRNA sequence
cttgaacctggaaggtggag

SEQ ID NO: 286831 - DNA, 20 bp, Artificial
  CRISPR gRNA sequence
gaacctggaaggtggaggtt

SEQ ID NO: 286832 - DNA, 20 bp, Artificial
  CRISPR gRNA sequence
aacctggaaggtggaggttg

SEQ ID NO: 286833 - DNA, 20 bp, Artificial
  CRISPR gRNA sequence
gaaggtggaggttgcagtga

SEQ ID NO: 286834 - DNA, 20 bp, Artificial
  CRISPR gRNA sequence
cagtgagctgagattgtgcc

SEQ ID NO: 286835 - DNA, 20 bp, Artificial
  CRISPR gRNA sequence
agattgtgccactgcactcc

SEQ ID NO: 286836 - DNA, 20 bp, Artificial
  CRISPR gRNA sequence
tgccactgcactccagcctg

SEQ ID NO: 286837 - DNA, 20 bp, Artificial
  CRISPR gRNA sequence
cactccagcctgggcaacag

SEQ ID NO: 286838 - DNA, 20 bp, Artificial
  CRISPR gRNA sequence
cagcctgggcaacagggcga

SEQ ID NO: 286839 - DNA, 20 bp, Artificial
  CRISPR gRNA sequence
ggcaacagggcgagacactg

SEQ ID NO: 286840 - DNA, 20 bp, Artificial
  CRISPR gRNA sequence
tctcaaaaaaataaataaat

SEQ ID NO: 286841 - DNA, 20 bp, Artificial
  CRISPR gRNA sequence
aaaaaaataaataaataaat

SEQ ID NO: 286842 - DNA, 20 bp, Artificial
  CRISPR gRNA sequence
gtaacattatcacaccttgc

SEQ ID NO: 286843 - DNA, 20 bp, Artificial
  CRISPR gRNA sequence
tcacaccttgcacagtgact

SEQ ID NO: 286844 - DNA, 20 bp, Artificial
  CRISPR gRNA sequence
gcacagtgactttatttttt

SEQ ID NO: 286845 - DNA, 20 bp, Artificial
  CRISPR gRNA sequence
cacagtgactttatttttta

SEQ ID NO: 286846 - DNA, 20 bp, Artificial
  CRISPR gRNA sequence
tattttttaaatttattttt

SEQ ID NO: 286847 - DNA, 20 bp, Artificial
  CRISPR gRNA sequence
attttttaaatttatttttt

SEQ ID NO: 286848 - DNA, 20 bp, Artificial
  CRISPR gRNA sequence
ttttttaaatttatttttta

SEQ ID NO: 286849 - DNA, 20 bp, Artificial
  CRISPR gRNA sequence
tttaaatttattttttaaat

SEQ ID NO: 286850 - DNA, 20 bp, Artificial
  CRISPR gRNA sequence
ttaaatttattttttaaatt

SEQ ID NO: 286851 - DNA, 20 bp, Artificial
  CRISPR gRNA sequence
taaatttattttttaaatta

SEQ ID NO: 286852 - DNA, 20 bp, Artificial
  CRISPR gRNA sequence
aaatttattttttaaattat

SEQ ID NO: 286853 - DNA, 20 bp, Artificial
  CRISPR gRNA sequence
aatttattttttaaattatt

SEQ ID NO: 286854 - DNA, 20 bp, Artificial
  CRISPR gRNA sequence
attttttaaattattttatt

SEQ ID NO: 286855 - DNA, 20 bp, Artificial
  CRISPR gRNA sequence
ttttttaaattattttattt

SEQ ID NO: 286856 - DNA, 20 bp, Artificial
  CRISPR gRNA sequence
tttaaattattttatttatt

SEQ ID NO: 286857 - DNA, 20 bp, Artificial
  CRISPR gRNA sequence
ttaaattattttatttattt

SEQ ID NO: 286858 - DNA, 20 bp, Artificial
  CRISPR gRNA sequence
taaattattttatttatttc

SEQ ID NO: 286859 - DNA, 20 bp, Artificial
  CRISPR gRNA sequence
aaattattttatttatttct

SEQ ID NO: 286860 - DNA, 20 bp, Artificial
  CRISPR gRNA sequence
aattattttatttatttctt

SEQ ID NO: 286861 - DNA, 20 bp, Artificial
  CRISPR gRNA sequence
ttttatttatttcttttaga

SEQ ID NO: 286862 - DNA, 20 bp, Artificial
  CRISPR gRNA sequence
tatttatttcttttagagac

SEQ ID NO: 286863 - DNA, 20 bp, Artificial
  CRISPR gRNA sequence
atttatttcttttagagaca

SEQ ID NO: 286864 - DNA, 20 bp, Artificial
  CRISPR gRNA sequence
tttatttcttttagagacag

SEQ ID NO: 286865 - DNA, 20 bp, Artificial
  CRISPR gRNA sequence
atttcttttagagacagggt

SEQ ID NO: 286866 - DNA, 20 bp, Artificial
  CRISPR gRNA sequence
tttcttttagagacagggtc

SEQ ID NO: 286867 - DNA, 20 bp, Artificial
  CRISPR gRNA sequence
cttttagagacagggtctca

SEQ ID NO: 286868 - DNA, 20 bp, Artificial
  CRISPR gRNA sequence
ttttagagacagggtctcac

SEQ ID NO: 286869 - DNA, 20 bp, Artificial
  CRISPR gRNA sequence
ttagagacagggtctcactc

SEQ ID NO: 286870 - DNA, 20 bp, Artificial
  CRISPR gRNA sequence
tagagacagggtctcactct

SEQ ID NO: 286871 - DNA, 20 bp, Artificial
  CRISPR gRNA sequence
agagacagggtctcactctg

SEQ ID NO: 286872 - DNA, 20 bp, Artificial
  CRISPR gRNA sequence
gagacagggtctcactctgt

SEQ ID NO: 286873 - DNA, 20 bp, Artificial
  CRISPR gRNA sequence
actctgttgcccaggctgga

SEQ ID NO: 286874 - DNA, 20 bp, Artificial
  CRISPR gRNA sequence
tgttgcccaggctggagtct

SEQ ID NO: 286875 - DNA, 20 bp, Artificial
  CRISPR gRNA sequence
ttgcccaggctggagtctag

SEQ ID NO: 286876 - DNA, 20 bp, Artificial
  CRISPR gRNA sequence
cccaggctggagtctagtgg

SEQ ID NO: 286877 - DNA, 20 bp, Artificial
  CRISPR gRNA sequence
gagtctagtggcatgatcat

SEQ ID NO: 286878 - DNA, 20 bp, Artificial
  CRISPR gRNA sequence
gtggcatgatcatagctcac

SEQ ID NO: 286879 - DNA, 20 bp, Artificial
  CRISPR gRNA sequence
actgcaactttgaacacctg

SEQ ID NO: 286880 - DNA, 20 bp, Artificial
  CRISPR gRNA sequence
caactttgaacacctgggct

SEQ ID NO: 286881 - DNA, 20 bp, Artificial
  CRISPR gRNA sequence
tgaacacctgggctcaagta

SEQ ID NO: 286882 - DNA, 20 bp, Artificial
  CRISPR gRNA sequence
gaacacctgggctcaagtaa

SEQ ID NO: 286883 - DNA, 20 bp, Artificial
  CRISPR gRNA sequence
aacacctgggctcaagtaag

SEQ ID NO: 286884 - DNA, 20 bp, Artificial
  CRISPR gRNA sequence
ggctcaagtaagccacccac

SEQ ID NO: 286885 - DNA, 20 bp, Artificial
  CRISPR gRNA sequence
aagtaagccacccaccttac

SEQ ID NO: 286886 - DNA, 20 bp, Artificial
  CRISPR gRNA sequence
accctcccaagtacctagga

SEQ ID NO: 286887 - DNA, 20 bp, Artificial
  CRISPR gRNA sequence
ccctcccaagtacctaggac

SEQ ID NO: 286888 - DNA, 20 bp, Artificial
  CRISPR gRNA sequence
ccaagtacctaggactacac

SEQ ID NO: 286889 - DNA, 20 bp, Artificial
  CRISPR gRNA sequence
ggactacacatgtgtgtcac

SEQ ID NO: 286890 - DNA, 20 bp, Artificial
  CRISPR gRNA sequence
cacatgtgtgtcaccaagcc

SEQ ID NO: 286891 - DNA, 20 bp, Artificial
  CRISPR gRNA sequence
gctaattttttaaatgttct

SEQ ID NO: 286892 - DNA, 20 bp, Artificial
  CRISPR gRNA sequence
attttttaaatgttctgtag

SEQ ID NO: 286893 - DNA, 20 bp, Artificial
  CRISPR gRNA sequence
tttaaatgttctgtagagtc

SEQ ID NO: 286894 - DNA, 20 bp, Artificial
  CRISPR gRNA sequence
ttaaatgttctgtagagtca

SEQ ID NO: 286895 - DNA, 20 bp, Artificial
  CRISPR gRNA sequence
taaatgttctgtagagtcag

SEQ ID NO: 286896 - DNA, 20 bp, Artificial
  CRISPR gRNA sequence
aaatgttctgtagagtcaga

SEQ ID NO: 286897 - DNA, 20 bp, Artificial
  CRISPR gRNA sequence
aatgttctgtagagtcagag

SEQ ID NO: 286898 - DNA, 20 bp, Artificial
  CRISPR gRNA sequence
tgtagagtcagagtctcatg

SEQ ID NO: 286899 - DNA, 20 bp, Artificial
  CRISPR gRNA sequence
tagagtcagagtctcatgct

SEQ ID NO: 286900 - DNA, 20 bp, Artificial
  CRISPR gRNA sequence
atgcttcccagctggtcttg

SEQ ID NO: 286901 - DNA, 20 bp, Artificial
  CRISPR gRNA sequence
cccagctggtcttgaactcc

SEQ ID NO: 286902 - DNA, 20 bp, Artificial
  CRISPR gRNA sequence
ccagctggtcttgaactcct

SEQ ID NO: 286903 - DNA, 20 bp, Artificial
  CRISPR gRNA sequence
gtcttgaactcctgggctca

SEQ ID NO: 286904 - DNA, 20 bp, Artificial
  CRISPR gRNA sequence
gaactcctgggctcaagtga

SEQ ID NO: 286905 - DNA, 20 bp, Artificial
  CRISPR gRNA sequence
aactcctgggctcaagtgat

SEQ ID NO: 286906 - DNA, 20 bp, Artificial
  CRISPR gRNA sequence
ctgggctcaagtgatcctcc

SEQ ID NO: 286907 - DNA, 20 bp, Artificial
  CRISPR gRNA sequence
ggctcaagtgatcctcccac

SEQ ID NO: 286908 - DNA, 20 bp, Artificial
  CRISPR gRNA sequence
aagtgatcctcccacttcag

SEQ ID NO: 286909 - DNA, 20 bp, Artificial
  CRISPR gRNA sequence
ccacttcagcctcccaaagt

SEQ ID NO: 286910 - DNA, 20 bp, Artificial
  CRISPR gRNA sequence
cagcctcccaaagtgctggg

SEQ ID NO: 286911 - DNA, 20 bp, Artificial
  CRISPR gRNA sequence
agcctcccaaagtgctggga

SEQ ID NO: 286912 - DNA, 20 bp, Artificial
  CRISPR gRNA sequence
ccaaagtgctgggattacag

SEQ ID NO: 286913 - DNA, 20 bp, Artificial
  CRISPR gRNA sequence
ggattacaggcatgagccac

SEQ ID NO: 286914 - DNA, 20 bp, Artificial
  CRISPR gRNA sequence
caggcatgagccactgtgcc

SEQ ID NO: 286915 - DNA, 20 bp, Artificial
  CRISPR gRNA sequence
tgcccagtctcacagtgact

SEQ ID NO: 286916 - DNA, 20 bp, Artificial
  CRISPR gRNA sequence
acagtgactttaataagtca

SEQ ID NO: 286917 - DNA, 20 bp, Artificial
  CRISPR gRNA sequence
taataagtcataatagcaca

SEQ ID NO: 286918 - DNA, 20 bp, Artificial
  CRISPR gRNA sequence
aataagtcataatagcacat

SEQ ID NO: 286919 - DNA, 20 bp, Artificial
  CRISPR gRNA sequence
ataagtcataatagcacatg

SEQ ID NO: 286920 - DNA, 20 bp, Artificial
  CRISPR gRNA sequence
gtatatctaaaaacactata

SEQ ID NO: 286921 - DNA, 20 bp, Artificial
  CRISPR gRNA sequence
tatatctaaaaacactataa

SEQ ID NO: 286922 - DNA, 20 bp, Artificial
  CRISPR gRNA sequence
aaaacactataaaacactat

SEQ ID NO: 286923 - DNA, 20 bp, Artificial
  CRISPR gRNA sequence
taaaacactatcaaaataaa

SEQ ID NO: 286924 - DNA, 20 bp, Artificial
  CRISPR gRNA sequence
tcaaaataaatacgacaatt

SEQ ID NO: 286925 - DNA, 20 bp, Artificial
  CRISPR gRNA sequence
taaaatgtatctggctgagt

SEQ ID NO: 286926 - DNA, 20 bp, Artificial
  CRISPR gRNA sequence
aaatgtatctggctgagtta

SEQ ID NO: 286927 - DNA, 20 bp, Artificial
  CRISPR gRNA sequence
gctgagttacagtaatgtgc

SEQ ID NO: 286928 - DNA, 20 bp, Artificial
  CRISPR gRNA sequence
agttacagtaatgtgccatg

SEQ ID NO: 286929 - DNA, 20 bp, Artificial
  CRISPR gRNA sequence
cagtaatgtgccatgtaaca

SEQ ID NO: 286930 - DNA, 20 bp, Artificial
  CRISPR gRNA sequence
tcaatggcattctgcatata

SEQ ID NO: 286931 - DNA, 20 bp, Artificial
  CRISPR gRNA sequence
caatggcattctgcatatat

SEQ ID NO: 286932 - DNA, 20 bp, Artificial
  CRISPR gRNA sequence
aatggcattctgcatatatg

SEQ ID NO: 286933 - DNA, 20 bp, Artificial
  CRISPR gRNA sequence
tgcatatatgatggtagtcc

SEQ ID NO: 286934 - DNA, 20 bp, Artificial
  CRISPR gRNA sequence
catatatgatggtagtccca

SEQ ID NO: 286935 - DNA, 20 bp, Artificial
  CRISPR gRNA sequence
taataccgtatttttactgt

SEQ ID NO: 286936 - DNA, 20 bp, Artificial
  CRISPR gRNA sequence
ttactgtacctttcctatgt

SEQ ID NO: 286937 - DNA, 20 bp, Artificial
  CRISPR gRNA sequence
tactgtacctttcctatgtt

SEQ ID NO: 286938 - DNA, 20 bp, Artificial
  CRISPR gRNA sequence
actgtacctttcctatgttt

SEQ ID NO: 286939 - DNA, 20 bp, Artificial
  CRISPR gRNA sequence
ctgtacctttcctatgttta

SEQ ID NO: 286940 - DNA, 20 bp, Artificial
  CRISPR gRNA sequence
tacctttcctatgtttacat

SEQ ID NO: 286941 - DNA, 20 bp, Artificial
  CRISPR gRNA sequence
tcctatgtttacatacgctt

SEQ ID NO: 286942 - DNA, 20 bp, Artificial
  CRISPR gRNA sequence
cctatgtttacatacgctta

SEQ ID NO: 286943 - DNA, 20 bp, Artificial
  CRISPR gRNA sequence
ctatgtttacatacgcttag

SEQ ID NO: 286944 - DNA, 20 bp, Artificial
  CRISPR gRNA sequence
tgtttacatacgcttagata

SEQ ID NO: 286945 - DNA, 20 bp, Artificial
  CRISPR gRNA sequence
acatacgcttagatacacaa

SEQ ID NO: 286946 - DNA, 20 bp, Artificial
  CRISPR gRNA sequence
catacgcttagatacacaaa

SEQ ID NO: 286947 - DNA, 20 bp, Artificial
  CRISPR gRNA sequence
agatacacaaatacttattg

SEQ ID NO: 286948 - DNA, 20 bp, Artificial
  CRISPR gRNA sequence
gatacacaaatacttattgt

SEQ ID NO: 286949 - DNA, 20 bp, Artificial
  CRISPR gRNA sequence
attgtgttacaactgcctat

SEQ ID NO: 286950 - DNA, 20 bp, Artificial
  CRISPR gRNA sequence
ttgtgttacaactgcctatg

SEQ ID NO: 286951 - DNA, 20 bp, Artificial
  CRISPR gRNA sequence
tgttacaactgcctatgtgt

SEQ ID NO: 286952 - DNA, 20 bp, Artificial
  CRISPR gRNA sequence
caactgcctatgtgttcagt

SEQ ID NO: 286953 - DNA, 20 bp, Artificial
  CRISPR gRNA sequence
cctatgtgttcagtatggta

SEQ ID NO: 286954 - DNA, 20 bp, Artificial
  CRISPR gRNA sequence
tgtgttcagtatggtaacat

SEQ ID NO: 286955 - DNA, 20 bp, Artificial
  CRISPR gRNA sequence
agtatggtaacatgctgtac

SEQ ID NO: 286956 - DNA, 20 bp, Artificial
  CRISPR gRNA sequence
tacaggtgtgtagcctcaga

SEQ ID NO: 286957 - DNA, 20 bp, Artificial
  CRISPR gRNA sequence
agagcactgggctgtaccat

SEQ ID NO: 286958 - DNA, 20 bp, Artificial
  CRISPR gRNA sequence
ggctgtaccatgtagcctag

SEQ ID NO: 286959 - DNA, 20 bp, Artificial
  CRISPR gRNA sequence
taccatgtagcctaggtgtg

SEQ ID NO: 286960 - DNA, 20 bp, Artificial
  CRISPR gRNA sequence
ggtgtgcagtaggctgtacc

SEQ ID NO: 286961 - DNA, 20 bp, Artificial
  CRISPR gRNA sequence
taccatctaggtttatgtaa

SEQ ID NO: 286962 - DNA, 20 bp, Artificial
  CRISPR gRNA sequence
ggtttatgtaaatacactct

SEQ ID NO: 286963 - DNA, 20 bp, Artificial
  CRISPR gRNA sequence
atgtaaatacactctgatgt

SEQ ID NO: 286964 - DNA, 20 bp, Artificial
  CRISPR gRNA sequence
tgtaaatacactctgatgtt

SEQ ID NO: 286965 - DNA, 20 bp, Artificial
  CRISPR gRNA sequence
tgatgttcagacaatgacag

SEQ ID NO: 286966 - DNA, 20 bp, Artificial
  CRISPR gRNA sequence
atgttcagacaatgacagaa

SEQ ID NO: 286967 - DNA, 20 bp, Artificial
  CRISPR gRNA sequence
agacaatgacagaattgcct

SEQ ID NO: 286968 - DNA, 20 bp, Artificial
  CRISPR gRNA sequence
cctaatgatgcatttctcaa

SEQ ID NO: 286969 - DNA, 20 bp, Artificial
  CRISPR gRNA sequence
atgatgcatttctcaaaatg

SEQ ID NO: 286970 - DNA, 20 bp, Artificial
  CRISPR gRNA sequence
ctcaaaatgtatccacatca

SEQ ID NO: 286971 - DNA, 20 bp, Artificial
  CRISPR gRNA sequence
tcaaaatgtatccacatcat

SEQ ID NO: 286972 - DNA, 20 bp, Artificial
  CRISPR gRNA sequence
aaaatgtatccacatcatta

SEQ ID NO: 286973 - DNA, 20 bp, Artificial
  CRISPR gRNA sequence
aatgacacgactatattgtc

SEQ ID NO: 286974 - DNA, 20 bp, Artificial
  CRISPR gRNA sequence
tattgtctttttagattcga

SEQ ID NO: 286975 - DNA, 20 bp, Artificial
  CRISPR gRNA sequence
tctttttagattcgatatag

SEQ ID NO: 286976 - DNA, 20 bp, Artificial
  CRISPR gRNA sequence
tttagattcgatatagtaga

SEQ ID NO: 286977 - DNA, 20 bp, Artificial
  CRISPR gRNA sequence
ttagattcgatatagtagaa

SEQ ID NO: 286978 - DNA, 20 bp, Artificial
  CRISPR gRNA sequence
tagattcgatatagtagaaa

SEQ ID NO: 286979 - DNA, 20 bp, Artificial
  CRISPR gRNA sequence
agattcgatatagtagaaac

SEQ ID NO: 286980 - DNA, 20 bp, Artificial
  CRISPR gRNA sequence
gattcgatatagtagaaact

SEQ ID NO: 286981 - DNA, 20 bp, Artificial
  CRISPR gRNA sequence
gatatagtagaaactcccca

SEQ ID NO: 286982 - DNA, 20 bp, Artificial
  CRISPR gRNA sequence
cccagaacaatgtcacttac

SEQ ID NO: 286983 - DNA, 20 bp, Artificial
  CRISPR gRNA sequence
acttgtattccagttgaagg

SEQ ID NO: 286984 - DNA, 20 bp, Artificial
  CRISPR gRNA sequence
cttgtattccagttgaaggt

SEQ ID NO: 286985 - DNA, 20 bp, Artificial
  CRISPR gRNA sequence
gtattccagttgaaggtctg

SEQ ID NO: 286986 - DNA, 20 bp, Artificial
  CRISPR gRNA sequence
tattccagttgaaggtctga

SEQ ID NO: 286987 - DNA, 20 bp, Artificial
  CRISPR gRNA sequence
cagttgaaggtctgattcac

SEQ ID NO: 286988 - DNA, 20 bp, Artificial
  CRISPR gRNA sequence
aaggtctgattcactcttaa

SEQ ID NO: 286989 - DNA, 20 bp, Artificial
  CRISPR gRNA sequence
attcactcttaaatgtccat

SEQ ID NO: 286990 - DNA, 20 bp, Artificial
  CRISPR gRNA sequence
actcttaaatgtccatactt

SEQ ID NO: 286991 - DNA, 20 bp, Artificial
  CRISPR gRNA sequence
ttaaatgtccatacttgatg

SEQ ID NO: 286992 - DNA, 20 bp, Artificial
  CRISPR gRNA sequence
aaatgtccatacttgatgag

SEQ ID NO: 286993 - DNA, 20 bp, Artificial
  CRISPR gRNA sequence
aatgtccatacttgatgaga

SEQ ID NO: 286994 - DNA, 20 bp, Artificial
  CRISPR gRNA sequence
gatgagacacatgaagctgt

SEQ ID NO: 286995 - DNA, 20 bp, Artificial
  CRISPR gRNA sequence
atgagacacatgaagctgtg

SEQ ID NO: 286996 - DNA, 20 bp, Artificial
  CRISPR gRNA sequence
tggttggttgtcatattgaa

SEQ ID NO: 286997 - DNA, 20 bp, Artificial
  CRISPR gRNA sequence
gttgtcatattgaaatccag

SEQ ID NO: 286998 - DNA, 20 bp, Artificial
  CRISPR gRNA sequence
tcatattgaaatccagtttg

SEQ ID NO: 286999 - DNA, 20 bp, Artificial
  CRISPR gRNA sequence
aaatccagtttgctgctaac

SEQ ID NO: 287000 - DNA, 20 bp, Artificial
  CRISPR gRNA sequence
gctgctaacagcatagagct

SEQ ID NO: 287001 - DNA, 20 bp, Artificial
  CRISPR gRNA sequence
ctgctaacagcatagagctc

SEQ ID NO: 287002 - DNA, 20 bp, Artificial
  CRISPR gRNA sequence
ctaacagcatagagctcagt

SEQ ID NO: 287003 - DNA, 20 bp, Artificial
  CRISPR gRNA sequence
acagcatagagctcagtttc

SEQ ID NO: 287004 - DNA, 20 bp, Artificial
  CRISPR gRNA sequence
agtttcaggatcttgggaaa

SEQ ID NO: 287005 - DNA, 20 bp, Artificial
  CRISPR gRNA sequence
caggatcttgggaaactgtt

SEQ ID NO: 287006 - DNA, 20 bp, Artificial
  CRISPR gRNA sequence
aggatcttgggaaactgttg

SEQ ID NO: 287007 - DNA, 20 bp, Artificial
  CRISPR gRNA sequence
gggaaactgttgtgttgatg

SEQ ID NO: 287008 - DNA, 20 bp, Artificial
  CRISPR gRNA sequence
ggaaactgttgtgttgatgg

SEQ ID NO: 287009 - DNA, 20 bp, Artificial
  CRISPR gRNA sequence
ttgtgttgatggcatttaat

SEQ ID NO: 287010 - DNA, 20 bp, Artificial
  CRISPR gRNA sequence
tgttgatggcatttaattct

SEQ ID NO: 287011 - DNA, 20 bp, Artificial
  CRISPR gRNA sequence
atggcatttaattcttctcc

SEQ ID NO: 287012 - DNA, 20 bp, Artificial
  CRISPR gRNA sequence
aattcttctccattttccaa

SEQ ID NO: 287013 - DNA, 20 bp, Artificial
  CRISPR gRNA sequence
attcttctccattttccaac

SEQ ID NO: 287014 - DNA, 20 bp, Artificial
  CRISPR gRNA sequence
ttctccattttccaaccagg

SEQ ID NO: 287015 - DNA, 20 bp, Artificial
  CRISPR gRNA sequence
ctccattttccaaccaggag

SEQ ID NO: 287016 - DNA, 20 bp, Artificial
  CRISPR gRNA sequence
tccattttccaaccaggaga

SEQ ID NO: 287017 - DNA, 20 bp, Artificial
  CRISPR gRNA sequence
cattttccaaccaggagagg

SEQ ID NO: 287018 - DNA, 20 bp, Artificial
  CRISPR gRNA sequence
tccaaccaggagaggtgagg

SEQ ID NO: 287019 - DNA, 20 bp, Artificial
  CRISPR gRNA sequence
ccaaccaggagaggtgaggc

SEQ ID NO: 287020 - DNA, 20 bp, Artificial
  CRISPR gRNA sequence
caaccaggagaggtgaggct

SEQ ID NO: 287021 - DNA, 20 bp, Artificial
  CRISPR gRNA sequence
tggaaaacctccagaggttg

SEQ ID NO: 287022 - DNA, 20 bp, Artificial
  CRISPR gRNA sequence
gaaaacctccagaggttgag

SEQ ID NO: 287023 - DNA, 20 bp, Artificial
  CRISPR gRNA sequence
cagaggttgagcaaattatc

SEQ ID NO: 287024 - DNA, 20 bp, Artificial
  CRISPR gRNA sequence
agcaaattatccttctaata

SEQ ID NO: 287025 - DNA, 20 bp, Artificial
  CRISPR gRNA sequence
tccttctaatattagaagtt

SEQ ID NO: 287026 - DNA, 20 bp, Artificial
  CRISPR gRNA sequence
ctaatattagaagttggaat

SEQ ID NO: 287027 - DNA, 20 bp, Artificial
  CRISPR gRNA sequence
taatattagaagttggaatt

SEQ ID NO: 287028 - DNA, 20 bp, Artificial
  CRISPR gRNA sequence
atattagaagttggaatttc

SEQ ID NO: 287029 - DNA, 20 bp, Artificial
  CRISPR gRNA sequence
gaagttggaatttcaaagtc

SEQ ID NO: 287030 - DNA, 20 bp, Artificial
  CRISPR gRNA sequence
gaatttcaaagtcagatata

SEQ ID NO: 287031 - DNA, 20 bp, Artificial
  CRISPR gRNA sequence
caaagtcagatatactaggt

SEQ ID NO: 287032 - DNA, 20 bp, Artificial
  CRISPR gRNA sequence
aaagtcagatatactaggtg

SEQ ID NO: 287033 - DNA, 20 bp, Artificial
  CRISPR gRNA sequence
ggtgtagggaagtcagctaa

SEQ ID NO: 287034 - DNA, 20 bp, Artificial
  CRISPR gRNA sequence
aagaaagaacaagaatatat

SEQ ID NO: 287035 - DNA, 20 bp, Artificial
  CRISPR gRNA sequence
cgtatagttacaaacctatg

SEQ ID NO: 287036 - DNA, 20 bp, Artificial
  CRISPR gRNA sequence
caaacctatgtgtgtagagg

SEQ ID NO: 287037 - DNA, 20 bp, Artificial
  CRISPR gRNA sequence
tgtgtgtagaggtttatttt

SEQ ID NO: 287038 - DNA, 20 bp, Artificial
  CRISPR gRNA sequence
atttttaaataattttctag

SEQ ID NO: 287039 - DNA, 20 bp, Artificial
  CRISPR gRNA sequence
tttttaaataattttctagc

SEQ ID NO: 287040 - DNA, 20 bp, Artificial
  CRISPR gRNA sequence
ttaaataattttctagcttt

SEQ ID NO: 287041 - DNA, 20 bp, Artificial
  CRISPR gRNA sequence
taaataattttctagcttta

SEQ ID NO: 287042 - DNA, 20 bp, Artificial
  CRISPR gRNA sequence
aaataattttctagctttaa

SEQ ID NO: 287043 - DNA, 20 bp, Artificial
  CRISPR gRNA sequence
aataattttctagctttaat

SEQ ID NO: 287044 - DNA, 20 bp, Artificial
  CRISPR gRNA sequence
tctagctttaataagaattg

SEQ ID NO: 287045 - DNA, 20 bp, Artificial
  CRISPR gRNA sequence
ctagctttaataagaattga

SEQ ID NO: 287046 - DNA, 20 bp, Artificial
  CRISPR gRNA sequence
tagctttaataagaattgat

SEQ ID NO: 287047 - DNA, 20 bp, Artificial
  CRISPR gRNA sequence
gctttaataagaattgataa

SEQ ID NO: 287048 - DNA, 20 bp, Artificial
  CRISPR gRNA sequence
taataagaattgataaaggc

SEQ ID NO: 287049 - DNA, 20 bp, Artificial
  CRISPR gRNA sequence
aataagaattgataaaggcc

SEQ ID NO: 287050 - DNA, 20 bp, Artificial
  CRISPR gRNA sequence
ataagaattgataaaggcca

SEQ ID NO: 287051 - DNA, 20 bp, Artificial
  CRISPR gRNA sequence
ataaaggccaggtgcagtgg

SEQ ID NO: 287052 - DNA, 20 bp, Artificial
  CRISPR gRNA sequence
actcctgtaatcccagcact

SEQ ID NO: 287053 - DNA, 20 bp, Artificial
  CRISPR gRNA sequence
ctgtaatcccagcactttgg

SEQ ID NO: 287054 - DNA, 20 bp, Artificial
  CRISPR gRNA sequence
taatcccagcactttgggag

SEQ ID NO: 287055 - DNA, 20 bp, Artificial
  CRISPR gRNA sequence
tgggaggccgaggcaggtgg

SEQ ID NO: 287056 - DNA, 20 bp, Artificial
  CRISPR gRNA sequence
gggaggccgaggcaggtgga

SEQ ID NO: 287057 - DNA, 20 bp, Artificial
  CRISPR gRNA sequence
ggaggccgaggcaggtggaa

SEQ ID NO: 287058 - DNA, 20 bp, Artificial
  CRISPR gRNA sequence
aggtcaggagtttgagacca

SEQ ID NO: 287059 - DNA, 20 bp, Artificial
  CRISPR gRNA sequence
gagaccagcctggctaacat

SEQ ID NO: 287060 - DNA, 20 bp, Artificial
  CRISPR gRNA sequence
agaccagcctggctaacatg

SEQ ID NO: 287061 - DNA, 20 bp, Artificial
  CRISPR gRNA sequence
gctaacatggcaaaacccca

SEQ ID NO: 287062 - DNA, 20 bp, Artificial
  CRISPR gRNA sequence
acatggcaaaaccccatctc

SEQ ID NO: 287063 - DNA, 20 bp, Artificial
  CRISPR gRNA sequence
taccaaaaatacataaatta

SEQ ID NO: 287064 - DNA, 20 bp, Artificial
  CRISPR gRNA sequence
ccaaaaatacataaattaac

SEQ ID NO: 287065 - DNA, 20 bp, Artificial
  CRISPR gRNA sequence
accaggcgtggtggcaggcg

SEQ ID NO: 287066 - DNA, 20 bp, Artificial
  CRISPR gRNA sequence
taatcccagctactcgggag

SEQ ID NO: 287067 - DNA, 20 bp, Artificial
  CRISPR gRNA sequence
ctcgggaggctaaggcaaga

SEQ ID NO: 287068 - DNA, 20 bp, Artificial
  CRISPR gRNA sequence
gggaggctaaggcaagagaa

SEQ ID NO: 287069 - DNA, 20 bp, Artificial
  CRISPR gRNA sequence
aggcaagagaatggcttgaa

SEQ ID NO: 287070 - DNA, 20 bp, Artificial
  CRISPR gRNA sequence
gaacccagagggtggagatt

SEQ ID NO: 287071 - DNA, 20 bp, Artificial
  CRISPR gRNA sequence
aacccagagggtggagattg

SEQ ID NO: 287072 - DNA, 20 bp, Artificial
  CRISPR gRNA sequence
cagttagccgagatcgtacg

SEQ ID NO: 287073 - DNA, 20 bp, Artificial
  CRISPR gRNA sequence
gccgagatcgtacgacttca

SEQ ID NO: 287074 - DNA, 20 bp, Artificial
  CRISPR gRNA sequence
cactccagcctgggcaaaag

SEQ ID NO: 287075 - DNA, 20 bp, Artificial
  CRISPR gRNA sequence
actccagcctgggcaaaaga

SEQ ID NO: 287076 - DNA, 20 bp, Artificial
  CRISPR gRNA sequence
cagcctgggcaaaagagcaa

SEQ ID NO: 287077 - DNA, 20 bp, Artificial
  CRISPR gRNA sequence
ggcaaaagagcaaggcttca

SEQ ID NO: 287078 - DNA, 20 bp, Artificial
  CRISPR gRNA sequence
catctcaaaaacaacaaaac

SEQ ID NO: 287079 - DNA, 20 bp, Artificial
  CRISPR gRNA sequence
atctcaaaaacaacaaaaca

SEQ ID NO: 287080 - DNA, 20 bp, Artificial
  CRISPR gRNA sequence
aaaaacaacaaaacaaaaca

SEQ ID NO: 287081 - DNA, 20 bp, Artificial
  CRISPR gRNA sequence
gcaacttcccattactcatt

SEQ ID NO: 287082 - DNA, 20 bp, Artificial
  CRISPR gRNA sequence
caacttcccattactcatta

SEQ ID NO: 287083 - DNA, 20 bp, Artificial
  CRISPR gRNA sequence
cccattactcattaatagtt

SEQ ID NO: 287084 - DNA, 20 bp, Artificial
  CRISPR gRNA sequence
ccattactcattaatagtta

SEQ ID NO: 287085 - DNA, 20 bp, Artificial
  CRISPR gRNA sequence
ctcattaatagttatgtata

SEQ ID NO: 287086 - DNA, 20 bp, Artificial
  CRISPR gRNA sequence
attaatagttatgtataatc

SEQ ID NO: 287087 - DNA, 20 bp, Artificial
  CRISPR gRNA sequence
atagttatgtataatccaaa

SEQ ID NO: 287088 - DNA, 20 bp, Artificial
  CRISPR gRNA sequence
tgtataatccaaagactaac

SEQ ID NO: 287089 - DNA, 20 bp, Artificial
  CRISPR gRNA sequence
actttgatttgaattggtta

SEQ ID NO: 287090 - DNA, 20 bp, Artificial
  CRISPR gRNA sequence
tgatttgaattggttatatc

SEQ ID NO: 287091 - DNA, 20 bp, Artificial
  CRISPR gRNA sequence
gatttgaattggttatatca

SEQ ID NO: 287092 - DNA, 20 bp, Artificial
  CRISPR gRNA sequence
atttgaattggttatatcaa

SEQ ID NO: 287093 - DNA, 20 bp, Artificial
  CRISPR gRNA sequence
gaattggttatatcaattct

SEQ ID NO: 287094 - DNA, 20 bp, Artificial
  CRISPR gRNA sequence
aattggttatatcaattctt

SEQ ID NO: 287095 - DNA, 20 bp, Artificial
  CRISPR gRNA sequence
gttatatcaattctttgcca

SEQ ID NO: 287096 - DNA, 20 bp, Artificial
  CRISPR gRNA sequence
tatcaattctttgccacttt

SEQ ID NO: 287097 - DNA, 20 bp, Artificial
  CRISPR gRNA sequence
tttgccacttttgatggaga

SEQ ID NO: 287098 - DNA, 20 bp, Artificial
  CRISPR gRNA sequence
tgccacttttgatggagata

SEQ ID NO: 287099 - DNA, 20 bp, Artificial
  CRISPR gRNA sequence
gccacttttgatggagatag

SEQ ID NO: 287100 - DNA, 20 bp, Artificial
  CRISPR gRNA sequence
ccacttttgatggagatagg

SEQ ID NO: 287101 - DNA, 20 bp, Artificial
  CRISPR gRNA sequence
ttgatggagataggagggca

SEQ ID NO: 287102 - DNA, 20 bp, Artificial
  CRISPR gRNA sequence
tgatggagataggagggcac

SEQ ID NO: 287103 - DNA, 20 bp, Artificial
  CRISPR gRNA sequence
gatggagataggagggcact

SEQ ID NO: 287104 - DNA, 20 bp, Artificial
  CRISPR gRNA sequence
atggagataggagggcactt

SEQ ID NO: 287105 - DNA, 20 bp, Artificial
  CRISPR gRNA sequence
attacagaaaggagaagtag

SEQ ID NO: 287106 - DNA, 20 bp, Artificial
  CRISPR gRNA sequence
ttacagaaaggagaagtagg

SEQ ID NO: 287107 - DNA, 20 bp, Artificial
  CRISPR gRNA sequence
cagaaaggagaagtaggttc

SEQ ID NO: 287108 - DNA, 20 bp, Artificial
  CRISPR gRNA sequence
gtgtgaataaatgttgccag

SEQ ID NO: 287109 - DNA, 20 bp, Artificial
  CRISPR gRNA sequence
ccagagtacttgcaattgta

SEQ ID NO: 287110 - DNA, 20 bp, Artificial
  CRISPR gRNA sequence
gcaattgtaagagatgaaga

SEQ ID NO: 287111 - DNA, 20 bp, Artificial
  CRISPR gRNA sequence
caattgtaagagatgaagag

SEQ ID NO: 287112 - DNA, 20 bp, Artificial
  CRISPR gRNA sequence
taagagatgaagagaagaat

SEQ ID NO: 287113 - DNA, 20 bp, Artificial
  CRISPR gRNA sequence
actgaactcttgtttgttag

SEQ ID NO: 287114 - DNA, 20 bp, Artificial
  CRISPR gRNA sequence
ctgaactcttgtttgttagg

SEQ ID NO: 287115 - DNA, 20 bp, Artificial
  CRISPR gRNA sequence
aactcttgtttgttaggtct

SEQ ID NO: 287116 - DNA, 20 bp, Artificial
  CRISPR gRNA sequence
ttgtttgttaggtctggacc

SEQ ID NO: 287117 - DNA, 20 bp, Artificial
  CRISPR gRNA sequence
gtttgttaggtctggacctt

SEQ ID NO: 287118 - DNA, 20 bp, Artificial
  CRISPR gRNA sequence
tttgttaggtctggacctta

SEQ ID NO: 287119 - DNA, 20 bp, Artificial
  CRISPR gRNA sequence
gttaggtctggaccttacct

SEQ ID NO: 287120 - DNA, 20 bp, Artificial
  CRISPR gRNA sequence
ttaggtctggaccttacctc

SEQ ID NO: 287121 - DNA, 20 bp, Artificial
  CRISPR gRNA sequence
ggtctggaccttacctcatt

SEQ ID NO: 287122 - DNA, 20 bp, Artificial
  CRISPR gRNA sequence
gaccttacctcattttgtcc

SEQ ID NO: 287123 - DNA, 20 bp, Artificial
  CRISPR gRNA sequence
acctcattttgtcctcacag

SEQ ID NO: 287124 - DNA, 20 bp, Artificial
  CRISPR gRNA sequence
cctcattttgtcctcacaga

SEQ ID NO: 287125 - DNA, 20 bp, Artificial
  CRISPR gRNA sequence
attttgtcctcacagaaacc

SEQ ID NO: 287126 - DNA, 20 bp, Artificial
  CRISPR gRNA sequence
tgtcctcacagaaaccctag

SEQ ID NO: 287127 - DNA, 20 bp, Artificial
  CRISPR gRNA sequence
gtcctcacagaaaccctaga

SEQ ID NO: 287128 - DNA, 20 bp, Artificial
  CRISPR gRNA sequence
tcctcacagaaaccctagag

SEQ ID NO: 287129 - DNA, 20 bp, Artificial
  CRISPR gRNA sequence
acagaaaccctagagaggta

SEQ ID NO: 287130 - DNA, 20 bp, Artificial
  CRISPR gRNA sequence
gagaggtaggttgtagatct

SEQ ID NO: 287131 - DNA, 20 bp, Artificial
  CRISPR gRNA sequence
tagatctaaaaaggtcaaag

SEQ ID NO: 287132 - DNA, 20 bp, Artificial
  CRISPR gRNA sequence
aaaaggtcaaagatcagtaa

SEQ ID NO: 287133 - DNA, 20 bp, Artificial
  CRISPR gRNA sequence
catatgatttaacctaatat

SEQ ID NO: 287134 - DNA, 20 bp, Artificial
  CRISPR gRNA sequence
atatgatttaacctaatata

SEQ ID NO: 287135 - DNA, 20 bp, Artificial
  CRISPR gRNA sequence
aacctaatataatttccatt

SEQ ID NO: 287136 - DNA, 20 bp, Artificial
  CRISPR gRNA sequence
acctaatataatttccattt

SEQ ID NO: 287137 - DNA, 20 bp, Artificial
  CRISPR gRNA sequence
atataatttccattttataa

SEQ ID NO: 287138 - DNA, 20 bp, Artificial
  CRISPR gRNA sequence
ccattttataagtaatcaaa

SEQ ID NO: 287139 - DNA, 20 bp, Artificial
  CRISPR gRNA sequence
cattttataagtaatcaaac

SEQ ID NO: 287140 - DNA, 20 bp, Artificial
  CRISPR gRNA sequence
tataagtaatcaaactgagg

SEQ ID NO: 287141 - DNA, 20 bp, Artificial
  CRISPR gRNA sequence
ataagtaatcaaactgaggt

SEQ ID NO: 287142 - DNA, 20 bp, Artificial
  CRISPR gRNA sequence
taagtaatcaaactgaggtt

SEQ ID NO: 287143 - DNA, 20 bp, Artificial
  CRISPR gRNA sequence
aggtttagagaaattataac

SEQ ID NO: 287144 - DNA, 20 bp, Artificial
  CRISPR gRNA sequence
agagaaattataactaacca

SEQ ID NO: 287145 - DNA, 20 bp, Artificial
  CRISPR gRNA sequence
gagaaattataactaaccag

SEQ ID NO: 287146 - DNA, 20 bp, Artificial
  CRISPR gRNA sequence
taactaaccagtaatggcag

SEQ ID NO: 287147 - DNA, 20 bp, Artificial
  CRISPR gRNA sequence
accagtaatggcagaattca

SEQ ID NO: 287148 - DNA, 20 bp, Artificial
  CRISPR gRNA sequence
aaatctgtctgacaccagag

SEQ ID NO: 287149 - DNA, 20 bp, Artificial
  CRISPR gRNA sequence
tctgacaccagagcctatct

SEQ ID NO: 287150 - DNA, 20 bp, Artificial
  CRISPR gRNA sequence
acaccagagcctatcttttc

SEQ ID NO: 287151 - DNA, 20 bp, Artificial
  CRISPR gRNA sequence
tcttttcttgaccttgcctt

SEQ ID NO: 287152 - DNA, 20 bp, Artificial
  CRISPR gRNA sequence
ttcttgaccttgcctttctt

SEQ ID NO: 287153 - DNA, 20 bp, Artificial
  CRISPR gRNA sequence
tcttgaccttgcctttcttt

SEQ ID NO: 287154 - DNA, 20 bp, Artificial
  CRISPR gRNA sequence
cttgaccttgcctttctttc

SEQ ID NO: 287155 - DNA, 20 bp, Artificial
  CRISPR gRNA sequence
ttgaccttgcctttctttct

SEQ ID NO: 287156 - DNA, 20 bp, Artificial
  CRISPR gRNA sequence
gaccttgcctttctttcttt

SEQ ID NO: 287157 - DNA, 20 bp, Artificial
  CRISPR gRNA sequence
accttgcctttctttctttc

SEQ ID NO: 287158 - DNA, 20 bp, Artificial
  CRISPR gRNA sequence
gcctttctttctttcctttc

SEQ ID NO: 287159 - DNA, 20 bp, Artificial
  CRISPR gRNA sequence
cctttctttctttcctttcc

SEQ ID NO: 287160 - DNA, 20 bp, Artificial
  CRISPR gRNA sequence
tctttctttcctttcccttt

SEQ ID NO: 287161 - DNA, 20 bp, Artificial
  CRISPR gRNA sequence
ctttctttcctttccctttc

SEQ ID NO: 287162 - DNA, 20 bp, Artificial
  CRISPR gRNA sequence
tttctttcctttccctttct

SEQ ID NO: 287163 - DNA, 20 bp, Artificial
  CRISPR gRNA sequence
tctttcctttccctttcttc

SEQ ID NO: 287164 - DNA, 20 bp, Artificial
  CRISPR gRNA sequence
ctttcctttccctttcttct

SEQ ID NO: 287165 - DNA, 20 bp, Artificial
  CRISPR gRNA sequence
tttcctttccctttcttctc

SEQ ID NO: 287166 - DNA, 20 bp, Artificial
  CRISPR gRNA sequence
tcctttccctttcttctctt

SEQ ID NO: 287167 - DNA, 20 bp, Artificial
  CRISPR gRNA sequence
cctttccctttcttctcttc

SEQ ID NO: 287168 - DNA, 20 bp, Artificial
  CRISPR gRNA sequence
ctttccctttcttctcttct

SEQ ID NO: 287169 - DNA, 20 bp, Artificial
  CRISPR gRNA sequence
tccctttcttctcttctctt

SEQ ID NO: 287170 - DNA, 20 bp, Artificial
  CRISPR gRNA sequence
ccctttcttctcttctcttc

SEQ ID NO: 287171 - DNA, 20 bp, Artificial
  CRISPR gRNA sequence
cctttcttctcttctcttct

SEQ ID NO: 287172 - DNA, 20 bp, Artificial
  CRISPR gRNA sequence
tcttctcttctcttcttttc

SEQ ID NO: 287173 - DNA, 20 bp, Artificial
  CRISPR gRNA sequence
cttctcttctcttcttttct

SEQ ID NO: 287174 - DNA, 20 bp, Artificial
  CRISPR gRNA sequence
ttctcttctcttcttttctt

SEQ ID NO: 287175 - DNA, 20 bp, Artificial
  CRISPR gRNA sequence
ctcttctcttcttttcttcc

SEQ ID NO: 287176 - DNA, 20 bp, Artificial
  CRISPR gRNA sequence
tcttctcttcttttcttcct

SEQ ID NO: 287177 - DNA, 20 bp, Artificial
  CRISPR gRNA sequence
ttctcttcttttcttcctga

SEQ ID NO: 287178 - DNA, 20 bp, Artificial
  CRISPR gRNA sequence
ctcttcttttcttcctgatg

SEQ ID NO: 287179 - DNA, 20 bp, Artificial
  CRISPR gRNA sequence
tcttcttttcttcctgatgc

SEQ ID NO: 287180 - DNA, 20 bp, Artificial
  CRISPR gRNA sequence
ttcttttcttcctgatgctt

SEQ ID NO: 287181 - DNA, 20 bp, Artificial
  CRISPR gRNA sequence
cttttcttcctgatgcttga

SEQ ID NO: 287182 - DNA, 20 bp, Artificial
  CRISPR gRNA sequence
ttttcttcctgatgcttgaa

SEQ ID NO: 287183 - DNA, 20 bp, Artificial
  CRISPR gRNA sequence
ttcttcctgatgcttgaagt

SEQ ID NO: 287184 - DNA, 20 bp, Artificial
  CRISPR gRNA sequence
tcttcctgatgcttgaagta

SEQ ID NO: 287185 - DNA, 20 bp, Artificial
  CRISPR gRNA sequence
cttcctgatgcttgaagtac

SEQ ID NO: 287186 - DNA, 20 bp, Artificial
  CRISPR gRNA sequence
ttcctgatgcttgaagtacg

SEQ ID NO: 287187 - DNA, 20 bp, Artificial
  CRISPR gRNA sequence
cctgatgcttgaagtacgca

SEQ ID NO: 287188 - DNA, 20 bp, Artificial
  CRISPR gRNA sequence
ctgatgcttgaagtacgcaa

SEQ ID NO: 287189 - DNA, 20 bp, Artificial
  CRISPR gRNA sequence
atgcttgaagtacgcaagtg

SEQ ID NO: 287190 - DNA, 20 bp, Artificial
  CRISPR gRNA sequence
gaagtacgcaagtggctttc

SEQ ID NO: 287191 - DNA, 20 bp, Artificial
  CRISPR gRNA sequence
aagtacgcaagtggctttct

SEQ ID NO: 287192 - DNA, 20 bp, Artificial
  CRISPR gRNA sequence
tcttctatgttatctattta

SEQ ID NO: 287193 - DNA, 20 bp, Artificial
  CRISPR gRNA sequence
cttctatgttatctatttat

SEQ ID NO: 287194 - DNA, 20 bp, Artificial
  CRISPR gRNA sequence
ttctatgttatctatttatt

SEQ ID NO: 287195 - DNA, 20 bp, Artificial
  CRISPR gRNA sequence
ctatgttatctatttattta

SEQ ID NO: 287196 - DNA, 20 bp, Artificial
  CRISPR gRNA sequence
tatgttatctatttatttac

SEQ ID NO: 287197 - DNA, 20 bp, Artificial
  CRISPR gRNA sequence
tgttatctatttatttacta

SEQ ID NO: 287198 - DNA, 20 bp, Artificial
  CRISPR gRNA sequence
tctatttatttactaaacta

SEQ ID NO: 287199 - DNA, 20 bp, Artificial
  CRISPR gRNA sequence
tttatttactaaactatagc

SEQ ID NO: 287200 - DNA, 20 bp, Artificial
  CRISPR gRNA sequence
atttactaaactatagcgaa

SEQ ID NO: 287201 - DNA, 20 bp, Artificial
  CRISPR gRNA sequence
tttactaaactatagcgaac

SEQ ID NO: 287202 - DNA, 20 bp, Artificial
  CRISPR gRNA sequence
actaaactatagcgaacgcc

SEQ ID NO: 287203 - DNA, 20 bp, Artificial
  CRISPR gRNA sequence
ctaaactatagcgaacgcct

SEQ ID NO: 287204 - DNA, 20 bp, Artificial
  CRISPR gRNA sequence
aactatagcgaacgcctgaa

SEQ ID NO: 287205 - DNA, 20 bp, Artificial
  CRISPR gRNA sequence
tagcgaacgcctgaaaaccc

SEQ ID NO: 287206 - DNA, 20 bp, Artificial
  CRISPR gRNA sequence
aaaacccaccatccaacttg

SEQ ID NO: 287207 - DNA, 20 bp, Artificial
  CRISPR gRNA sequence
gagaccaaaaacactgacag

SEQ ID NO: 287208 - DNA, 20 bp, Artificial
  CRISPR gRNA sequence
agaccaaaaacactgacagt

SEQ ID NO: 287209 - DNA, 20 bp, Artificial
  CRISPR gRNA sequence
acagtaacttaggtaaatct

SEQ ID NO: 287210 - DNA, 20 bp, Artificial
  CRISPR gRNA sequence
aggtaaatctgctggtatga

SEQ ID NO: 287211 - DNA, 20 bp, Artificial
  CRISPR gRNA sequence
ggtaaatctgctggtatgat

SEQ ID NO: 287212 - DNA, 20 bp, Artificial
  CRISPR gRNA sequence
ctggtatgatgtcacctatc

SEQ ID NO: 287213 - DNA, 20 bp, Artificial
  CRISPR gRNA sequence
gtatgatgtcacctatcctg

SEQ ID NO: 287214 - DNA, 20 bp, Artificial
  CRISPR gRNA sequence
tcctgtccctctctttccct

SEQ ID NO: 287215 - DNA, 20 bp, Artificial
  CRISPR gRNA sequence
tccctctctttcccttacct

SEQ ID NO: 287216 - DNA, 20 bp, Artificial
  CRISPR gRNA sequence
tctttcccttacctaaggta

SEQ ID NO: 287217 - DNA, 20 bp, Artificial
  CRISPR gRNA sequence
tttcccttacctaaggtaat

SEQ ID NO: 287218 - DNA, 20 bp, Artificial
  CRISPR gRNA sequence
tcccttacctaaggtaatca

SEQ ID NO: 287219 - DNA, 20 bp, Artificial
  CRISPR gRNA sequence
cccttacctaaggtaatcac

SEQ ID NO: 287220 - DNA, 20 bp, Artificial
  CRISPR gRNA sequence
ccttacctaaggtaatcact

SEQ ID NO: 287221 - DNA, 20 bp, Artificial
  CRISPR gRNA sequence
acctaaggtaatcactatca

SEQ ID NO: 287222 - DNA, 20 bp, Artificial
  CRISPR gRNA sequence
cctaaggtaatcactatcac

SEQ ID NO: 287223 - DNA, 20 bp, Artificial
  CRISPR gRNA sequence
aggtaatcactatcactatc

SEQ ID NO: 287224 - DNA, 20 bp, Artificial
  CRISPR gRNA sequence
tcactatcctaaatttgtgg

SEQ ID NO: 287225 - DNA, 20 bp, Artificial
  CRISPR gRNA sequence
tcctaaatttgtggttagca

SEQ ID NO: 287226 - DNA, 20 bp, Artificial
  CRISPR gRNA sequence
aatttgtggttagcatttcc

SEQ ID NO: 287227 - DNA, 20 bp, Artificial
  CRISPR gRNA sequence
gtggttagcatttccttgct

SEQ ID NO: 287228 - DNA, 20 bp, Artificial
  CRISPR gRNA sequence
tggttagcatttccttgctt

SEQ ID NO: 287229 - DNA, 20 bp, Artificial
  CRISPR gRNA sequence
gcatttccttgctttttaaa

SEQ ID NO: 287230 - DNA, 20 bp, Artificial
  CRISPR gRNA sequence
ccttgctttttaaaaggtcg

SEQ ID NO: 287231 - DNA, 20 bp, Artificial
  CRISPR gRNA sequence
cttgctttttaaaaggtcgt

SEQ ID NO: 287232 - DNA, 20 bp, Artificial
  CRISPR gRNA sequence
gctttttaaaaggtcgtctt

SEQ ID NO: 287233 - DNA, 20 bp, Artificial
  CRISPR gRNA sequence
ctttttaaaaggtcgtcttt

SEQ ID NO: 287234 - DNA, 20 bp, Artificial
  CRISPR gRNA sequence
tttaaaaggtcgtcttttac

SEQ ID NO: 287235 - DNA, 20 bp, Artificial
  CRISPR gRNA sequence
ttaaaaggtcgtcttttaca

SEQ ID NO: 287236 - DNA, 20 bp, Artificial
  CRISPR gRNA sequence
taaaaggtcgtcttttacat

SEQ ID NO: 287237 - DNA, 20 bp, Artificial
  CRISPR gRNA sequence
aaaaggtcgtcttttacatg

SEQ ID NO: 287238 - DNA, 20 bp, Artificial
  CRISPR gRNA sequence
aaaggtcgtcttttacatga

SEQ ID NO: 287239 - DNA, 20 bp, Artificial
  CRISPR gRNA sequence
ttacatgaggggcctacccc

SEQ ID NO: 287240 - DNA, 20 bp, Artificial
  CRISPR gRNA sequence
tacatgaggggcctacccct

SEQ ID NO: 287241 - DNA, 20 bp, Artificial
  CRISPR gRNA sequence
acatgaggggcctacccctt

SEQ ID NO: 287242 - DNA, 20 bp, Artificial
  CRISPR gRNA sequence
catgaggggcctaccccttt

SEQ ID NO: 287243 - DNA, 20 bp, Artificial
  CRISPR gRNA sequence
cccctttgctcttgagaatg

SEQ ID NO: 287244 - DNA, 20 bp, Artificial
  CRISPR gRNA sequence
tgctcttgagaatggtttct

SEQ ID NO: 287245 - DNA, 20 bp, Artificial
  CRISPR gRNA sequence
gctcttgagaatggtttctc

SEQ ID NO: 287246 - DNA, 20 bp, Artificial
  CRISPR gRNA sequence
ctcttgagaatggtttctca

SEQ ID NO: 287247 - DNA, 20 bp, Artificial
  CRISPR gRNA sequence
ttgagaatggtttctcatgt

SEQ ID NO: 287248 - DNA, 20 bp, Artificial
  CRISPR gRNA sequence
gagaatggtttctcatgtcc

SEQ ID NO: 287249 - DNA, 20 bp, Artificial
  CRISPR gRNA sequence
agaatggtttctcatgtcct

SEQ ID NO: 287250 - DNA, 20 bp, Artificial
  CRISPR gRNA sequence
ctcatgtcctcctttctggc

SEQ ID NO: 287251 - DNA, 20 bp, Artificial
  CRISPR gRNA sequence
tcatgtcctcctttctggcc

SEQ ID NO: 287252 - DNA, 20 bp, Artificial
  CRISPR gRNA sequence
atgtcctcctttctggcctt

SEQ ID NO: 287253 - DNA, 20 bp, Artificial
  CRISPR gRNA sequence
ctttctggccttatcctttg

SEQ ID NO: 287254 - DNA, 20 bp, Artificial
  CRISPR gRNA sequence
tctggccttatcctttgaac

SEQ ID NO: 287255 - DNA, 20 bp, Artificial
  CRISPR gRNA sequence
ctggccttatcctttgaaca

SEQ ID NO: 287256 - DNA, 20 bp, Artificial
  CRISPR gRNA sequence
tggccttatcctttgaacat

SEQ ID NO: 287257 - DNA, 20 bp, Artificial
  CRISPR gRNA sequence
gccttatcctttgaacattg

SEQ ID NO: 287258 - DNA, 20 bp, Artificial
  CRISPR gRNA sequence
atcctttgaacattgactct

SEQ ID NO: 287259 - DNA, 20 bp, Artificial
  CRISPR gRNA sequence
tcctttgaacattgactctt

SEQ ID NO: 287260 - DNA, 20 bp, Artificial
  CRISPR gRNA sequence
tgaacattgactcttaagtc

SEQ ID NO: 287261 - DNA, 20 bp, Artificial
  CRISPR gRNA sequence
gaacattgactcttaagtct

SEQ ID NO: 287262 - DNA, 20 bp, Artificial
  CRISPR gRNA sequence
aacattgactcttaagtctg

SEQ ID NO: 287263 - DNA, 20 bp, Artificial
  CRISPR gRNA sequence
actcttaagtctgttacagg

SEQ ID NO: 287264 - DNA, 20 bp, Artificial
  CRISPR gRNA sequence
ttaagtctgttacaggtaag

SEQ ID NO: 287265 - DNA, 20 bp, Artificial
  CRISPR gRNA sequence
aagtctgttacaggtaaggg

SEQ ID NO: 287266 - DNA, 20 bp, Artificial
  CRISPR gRNA sequence
agtctgttacaggtaagggc

SEQ ID NO: 287267 - DNA, 20 bp, Artificial
  CRISPR gRNA sequence
ttacaggtaagggctccatg

SEQ ID NO: 287268 - DNA, 20 bp, Artificial
  CRISPR gRNA sequence
caggtaagggctccatgaag

SEQ ID NO: 287269 - DNA, 20 bp, Artificial
  CRISPR gRNA sequence
catgaagttgtgtttccctt

SEQ ID NO: 287270 - DNA, 20 bp, Artificial
  CRISPR gRNA sequence
tgtttcccttttctttctgg

SEQ ID NO: 287271 - DNA, 20 bp, Artificial
  CRISPR gRNA sequence
cccttttctttctggctacc

SEQ ID NO: 287272 - DNA, 20 bp, Artificial
  CRISPR gRNA sequence
ccttttctttctggctacct

SEQ ID NO: 287273 - DNA, 20 bp, Artificial
  CRISPR gRNA sequence
ttctttctggctacctaaac

SEQ ID NO: 287274 - DNA, 20 bp, Artificial
  CRISPR gRNA sequence
tctttctggctacctaaact

SEQ ID NO: 287275 - DNA, 20 bp, Artificial
  CRISPR gRNA sequence
ctttctggctacctaaactc

SEQ ID NO: 287276 - DNA, 20 bp, Artificial
  CRISPR gRNA sequence
tttctggctacctaaactca

SEQ ID NO: 287277 - DNA, 20 bp, Artificial
  CRISPR gRNA sequence
tctggctacctaaactcaat

SEQ ID NO: 287278 - DNA, 20 bp, Artificial
  CRISPR gRNA sequence
ctggctacctaaactcaata

SEQ ID NO: 287279 - DNA, 20 bp, Artificial
  CRISPR gRNA sequence
tggctacctaaactcaatac

SEQ ID NO: 287280 - DNA, 20 bp, Artificial
  CRISPR gRNA sequence
gctacctaaactcaatacat

SEQ ID NO: 287281 - DNA, 20 bp, Artificial
  CRISPR gRNA sequence
cctaaactcaatacataaat

SEQ ID NO: 287282 - DNA, 20 bp, Artificial
  CRISPR gRNA sequence
aactcaatacataaatagag

SEQ ID NO: 287283 - DNA, 20 bp, Artificial
  CRISPR gRNA sequence
aatacataaatagagaaggc

SEQ ID NO: 287284 - DNA, 20 bp, Artificial
  CRISPR gRNA sequence
tgcctaacatagaactttcg

SEQ ID NO: 287285 - DNA, 20 bp, Artificial
  CRISPR gRNA sequence
gcctaacatagaactttcgt

SEQ ID NO: 287286 - DNA, 20 bp, Artificial
  CRISPR gRNA sequence
cctaacatagaactttcgtt

SEQ ID NO: 287287 - DNA, 20 bp, Artificial
  CRISPR gRNA sequence
acatagaactttcgttggaa

SEQ ID NO: 287288 - DNA, 20 bp, Artificial
  CRISPR gRNA sequence
tcgttggaaagggtctagat

SEQ ID NO: 287289 - DNA, 20 bp, Artificial
  CRISPR gRNA sequence
cgttggaaagggtctagatg

SEQ ID NO: 287290 - DNA, 20 bp, Artificial
  CRISPR gRNA sequence
gttggaaagggtctagatgg

SEQ ID NO: 287291 - DNA, 20 bp, Artificial
  CRISPR gRNA sequence
gaaagggtctagatggggag

SEQ ID NO: 287292 - DNA, 20 bp, Artificial
  CRISPR gRNA sequence
gatggggagagagaaaacat

SEQ ID NO: 287293 - DNA, 20 bp, Artificial
  CRISPR gRNA sequence
gtcaaggagaggagatcttg

SEQ ID NO: 287294 - DNA, 20 bp, Artificial
  CRISPR gRNA sequence
ggagaaaggaaaatgctgcc

SEQ ID NO: 287295 - DNA, 20 bp, Artificial
  CRISPR gRNA sequence
gagaaaggaaaatgctgcct

SEQ ID NO: 287296 - DNA, 20 bp, Artificial
  CRISPR gRNA sequence
cctaatttacaaacctgtga

SEQ ID NO: 287297 - DNA, 20 bp, Artificial
  CRISPR gRNA sequence
atttacaaacctgtgacctg

SEQ ID NO: 287298 - DNA, 20 bp, Artificial
  CRISPR gRNA sequence
acaaacctgtgacctgcctt

SEQ ID NO: 287299 - DNA, 20 bp, Artificial
  CRISPR gRNA sequence
caaacctgtgacctgccttt

SEQ ID NO: 287300 - DNA, 20 bp, Artificial
  CRISPR gRNA sequence
tgacctgccttttgaggggg

SEQ ID NO: 287301 - DNA, 20 bp, Artificial
  CRISPR gRNA sequence
ccttttgagggggcattgtg

SEQ ID NO: 287302 - DNA, 20 bp, Artificial
  CRISPR gRNA sequence
ttgagggggcattgtgtgcg

SEQ ID NO: 287303 - DNA, 20 bp, Artificial
  CRISPR gRNA sequence
tgagggggcattgtgtgcgt

SEQ ID NO: 287304 - DNA, 20 bp, Artificial
  CRISPR gRNA sequence
gagggggcattgtgtgcgtg

SEQ ID NO: 287305 - DNA, 20 bp, Artificial
  CRISPR gRNA sequence
agggggcattgtgtgcgtgt

SEQ ID NO: 287306 - DNA, 20 bp, Artificial
  CRISPR gRNA sequence
tgtgcgtgtgagtggggggc

SEQ ID NO: 287307 - DNA, 20 bp, Artificial
  CRISPR gRNA sequence
aactatagtcatgagctttt

SEQ ID NO: 287308 - DNA, 20 bp, Artificial
  CRISPR gRNA sequence
tagtcatgagcttttgcttc

SEQ ID NO: 287309 - DNA, 20 bp, Artificial
  CRISPR gRNA sequence
ttgcttctactgagtctcac

SEQ ID NO: 287310 - DNA, 20 bp, Artificial
  CRISPR gRNA sequence
tgcttctactgagtctcacc

SEQ ID NO: 287311 - DNA, 20 bp, Artificial
  CRISPR gRNA sequence
gcttctactgagtctcacca

SEQ ID NO: 287312 - DNA, 20 bp, Artificial
  CRISPR gRNA sequence
cttctactgagtctcaccaa

SEQ ID NO: 287313 - DNA, 20 bp, Artificial
  CRISPR gRNA sequence
ctactgagtctcaccaacac

SEQ ID NO: 287314 - DNA, 20 bp, Artificial
  CRISPR gRNA sequence
tactgagtctcaccaacacc

SEQ ID NO: 287315 - DNA, 20 bp, Artificial
  CRISPR gRNA sequence
ctgagtctcaccaacacccc

SEQ ID NO: 287316 - DNA, 20 bp, Artificial
  CRISPR gRNA sequence
agtctcaccaacaccccata

SEQ ID NO: 287317 - DNA, 20 bp, Artificial
  CRISPR gRNA sequence
accaacaccccataccccaa

SEQ ID NO: 287318 - DNA, 20 bp, Artificial
  CRISPR gRNA sequence
tttaatttgcatatttattt

SEQ ID NO: 287319 - DNA, 20 bp, Artificial
  CRISPR gRNA sequence
ttaatttgcatatttatttc

SEQ ID NO: 287320 - DNA, 20 bp, Artificial
  CRISPR gRNA sequence
taatttgcatatttatttct

SEQ ID NO: 287321 - DNA, 20 bp, Artificial
  CRISPR gRNA sequence
aatttgcatatttatttctg

SEQ ID NO: 287322 - DNA, 20 bp, Artificial
  CRISPR gRNA sequence
atttgcatatttatttctgg

SEQ ID NO: 287323 - DNA, 20 bp, Artificial
  CRISPR gRNA sequence
gcatatttatttctggatgg

SEQ ID NO: 287324 - DNA, 20 bp, Artificial
  CRISPR gRNA sequence
catatttatttctggatggg

SEQ ID NO: 287325 - DNA, 20 bp, Artificial
  CRISPR gRNA sequence
atttctggatgggttttccc

SEQ ID NO: 287326 - DNA, 20 bp, Artificial
  CRISPR gRNA sequence
tttctggatgggttttcccc

SEQ ID NO: 287327 - DNA, 20 bp, Artificial
  CRISPR gRNA sequence
ctggatgggttttcccctct

SEQ ID NO: 287328 - DNA, 20 bp, Artificial
  CRISPR gRNA sequence
tggatgggttttcccctctt

SEQ ID NO: 287329 - DNA, 20 bp, Artificial
  CRISPR gRNA sequence
gatgggttttcccctcttta

SEQ ID NO: 287330 - DNA, 20 bp, Artificial
  CRISPR gRNA sequence
tcccctctttattctgtcct

SEQ ID NO: 287331 - DNA, 20 bp, Artificial
  CRISPR gRNA sequence
cccctctttattctgtcctc

SEQ ID NO: 287332 - DNA, 20 bp, Artificial
  CRISPR gRNA sequence
ccctctttattctgtcctca

SEQ ID NO: 287333 - DNA, 20 bp, Artificial
  CRISPR gRNA sequence
tttattctgtcctcatgaga

SEQ ID NO: 287334 - DNA, 20 bp, Artificial
  CRISPR gRNA sequence
tattctgtcctcatgagacc

SEQ ID NO: 287335 - DNA, 20 bp, Artificial
  CRISPR gRNA sequence
attctgtcctcatgagacca

SEQ ID NO: 287336 - DNA, 20 bp, Artificial
  CRISPR gRNA sequence
ttctgtcctcatgagaccat

SEQ ID NO: 287337 - DNA, 20 bp, Artificial
  CRISPR gRNA sequence
tgtcctcatgagaccatggg

SEQ ID NO: 287338 - DNA, 20 bp, Artificial
  CRISPR gRNA sequence
tcctcatgagaccatgggca

SEQ ID NO: 287339 - DNA, 20 bp, Artificial
  CRISPR gRNA sequence
atgagaccatgggcaaagct

SEQ ID NO: 287340 - DNA, 20 bp, Artificial
  CRISPR gRNA sequence
tttattttaggtgagaagaa

SEQ ID NO: 287341 - DNA, 20 bp, Artificial
  CRISPR gRNA sequence
tattttaggtgagaagaaaa

SEQ ID NO: 287342 - DNA, 20 bp, Artificial
  CRISPR gRNA sequence
attttaggtgagaagaaaaa

SEQ ID NO: 287343 - DNA, 20 bp, Artificial
  CRISPR gRNA sequence
ttttaggtgagaagaaaaac

SEQ ID NO: 287344 - DNA, 20 bp, Artificial
  CRISPR gRNA sequence
taggtgagaagaaaaactct

SEQ ID NO: 287345 - DNA, 20 bp, Artificial
  CRISPR gRNA sequence
aggtgagaagaaaaactctg

SEQ ID NO: 287346 - DNA, 20 bp, Artificial
  CRISPR gRNA sequence
ggtgagaagaaaaactctga

SEQ ID NO: 287347 - DNA, 20 bp, Artificial
  CRISPR gRNA sequence
tgaaccacatcagtaatgtt

SEQ ID NO: 287348 - DNA, 20 bp, Artificial
  CRISPR gRNA sequence
aaccacatcagtaatgtttt

SEQ ID NO: 287349 - DNA, 20 bp, Artificial
  CRISPR gRNA sequence
tcatttgaaaatatcattga

SEQ ID NO: 287350 - DNA, 20 bp, Artificial
  CRISPR gRNA sequence
catttgaaaatatcattgaa

SEQ ID NO: 287351 - DNA, 20 bp, Artificial
  CRISPR gRNA sequence
atttgaaaatatcattgaaa

SEQ ID NO: 287352 - DNA, 20 bp, Artificial
  CRISPR gRNA sequence
gaaaatatcattgaaatgta

SEQ ID NO: 287353 - DNA, 20 bp, Artificial
  CRISPR gRNA sequence
aaaatatcattgaaatgtat

SEQ ID NO: 287354 - DNA, 20 bp, Artificial
  CRISPR gRNA sequence
aaatgtatttgaataaattt

SEQ ID NO: 287355 - DNA, 20 bp, Artificial
  CRISPR gRNA sequence
gaataaatttatttgaattc

SEQ ID NO: 287356 - DNA, 20 bp, Artificial
  CRISPR gRNA sequence
aataaatttatttgaattca

SEQ ID NO: 287357 - DNA, 20 bp, Artificial
  CRISPR gRNA sequence
atttgaattcatttgaattt

SEQ ID NO: 287358 - DNA, 20 bp, Artificial
  CRISPR gRNA sequence
tttgaattcatttgaatttt

SEQ ID NO: 287359 - DNA, 20 bp, Artificial
  CRISPR gRNA sequence
gaattcatttgaatttttta

SEQ ID NO: 287360 - DNA, 20 bp, Artificial
  CRISPR gRNA sequence
aattcatttgaattttttaa

SEQ ID NO: 287361 - DNA, 20 bp, Artificial
  CRISPR gRNA sequence
atttgaattttttaattatt

SEQ ID NO: 287362 - DNA, 20 bp, Artificial
  CRISPR gRNA sequence
gaattttttaattattttga

SEQ ID NO: 287363 - DNA, 20 bp, Artificial
  CRISPR gRNA sequence
aattttttaattattttgat

SEQ ID NO: 287364 - DNA, 20 bp, Artificial
  CRISPR gRNA sequence
tttaattattttgatagtag

SEQ ID NO: 287365 - DNA, 20 bp, Artificial
  CRISPR gRNA sequence
ttaattattttgatagtaga

SEQ ID NO: 287366 - DNA, 20 bp, Artificial
  CRISPR gRNA sequence
taattattttgatagtagac

SEQ ID NO: 287367 - DNA, 20 bp, Artificial
  CRISPR gRNA sequence
aattattttgatagtagaca

SEQ ID NO: 287368 - DNA, 20 bp, Artificial
  CRISPR gRNA sequence
attattttgatagtagacat

SEQ ID NO: 287369 - DNA, 20 bp, Artificial
  CRISPR gRNA sequence
ttttgatagtagacatgctg

SEQ ID NO: 287370 - DNA, 20 bp, Artificial
  CRISPR gRNA sequence
tgatagtagacatgctgttt

SEQ ID NO: 287371 - DNA, 20 bp, Artificial
  CRISPR gRNA sequence
gatagtagacatgctgttta

SEQ ID NO: 287372 - DNA, 20 bp, Artificial
  CRISPR gRNA sequence
atagtagacatgctgtttat

SEQ ID NO: 287373 - DNA, 20 bp, Artificial
  CRISPR gRNA sequence
tttatttatttaatgtgcat

SEQ ID NO: 287374 - DNA, 20 bp, Artificial
  CRISPR gRNA sequence
atttatttaatgtgcatatg

SEQ ID NO: 287375 - DNA, 20 bp, Artificial
  CRISPR gRNA sequence
tttatttaatgtgcatatgg

SEQ ID NO: 287376 - DNA, 20 bp, Artificial
  CRISPR gRNA sequence
atttaatgtgcatatggaag

SEQ ID NO: 287377 - DNA, 20 bp, Artificial
  CRISPR gRNA sequence
tttaatgtgcatatggaagc

SEQ ID NO: 287378 - DNA, 20 bp, Artificial
  CRISPR gRNA sequence
aatgtgcatatggaagcctg

SEQ ID NO: 287379 - DNA, 20 bp, Artificial
  CRISPR gRNA sequence
atgtgcatatggaagcctga

SEQ ID NO: 287380 - DNA, 20 bp, Artificial
  CRISPR gRNA sequence
aaaaatagaaagctgtatag

SEQ ID NO: 287381 - DNA, 20 bp, Artificial
  CRISPR gRNA sequence
tatagactgagtttagttgt

SEQ ID NO: 287382 - DNA, 20 bp, Artificial
  CRISPR gRNA sequence
agtttagttgttaattggtt

SEQ ID NO: 287383 - DNA, 20 bp, Artificial
  CRISPR gRNA sequence
agttgttaattggtttggga

SEQ ID NO: 287384 - DNA, 20 bp, Artificial
  CRISPR gRNA sequence
gttgttaattggtttgggag

SEQ ID NO: 287385 - DNA, 20 bp, Artificial
  CRISPR gRNA sequence
ttaattggtttgggagtctt

SEQ ID NO: 287386 - DNA, 20 bp, Artificial
  CRISPR gRNA sequence
attggtttgggagtcttcca

SEQ ID NO: 287387 - DNA, 20 bp, Artificial
  CRISPR gRNA sequence
gtttgggagtcttccatgca

SEQ ID NO: 287388 - DNA, 20 bp, Artificial
  CRISPR gRNA sequence
gggagtcttccatgcataat

SEQ ID NO: 287389 - DNA, 20 bp, Artificial
  CRISPR gRNA sequence
ggagtcttccatgcataatt

SEQ ID NO: 287390 - DNA, 20 bp, Artificial
  CRISPR gRNA sequence
ccatgcataatttatgactt

SEQ ID NO: 287391 - DNA, 20 bp, Artificial
  CRISPR gRNA sequence
catgcataatttatgacttc

SEQ ID NO: 287392 - DNA, 20 bp, Artificial
  CRISPR gRNA sequence
atgacttcttggtgttctat

SEQ ID NO: 287393 - DNA, 20 bp, Artificial
  CRISPR gRNA sequence
tgacttcttggtgttctata

SEQ ID NO: 287394 - DNA, 20 bp, Artificial
  CRISPR gRNA sequence
cttggtgttctatatatttg

SEQ ID NO: 287395 - DNA, 20 bp, Artificial
  CRISPR gRNA sequence
ttggtgttctatatatttgt

SEQ ID NO: 287396 - DNA, 20 bp, Artificial
  CRISPR gRNA sequence
ggtgttctatatatttgtcc

SEQ ID NO: 287397 - DNA, 20 bp, Artificial
  CRISPR gRNA sequence
gtgttctatatatttgtccg

SEQ ID NO: 287398 - DNA, 20 bp, Artificial
  CRISPR gRNA sequence
tatatatttgtccgaattaa

SEQ ID NO: 287399 - DNA, 20 bp, Artificial
  CRISPR gRNA sequence
tatatttgtccgaattaatt

SEQ ID NO: 287400 - DNA, 20 bp, Artificial
  CRISPR gRNA sequence
gtccgaattaattactggga

SEQ ID NO: 287401 - DNA, 20 bp, Artificial
  CRISPR gRNA sequence
tccgaattaattactgggat

SEQ ID NO: 287402 - DNA, 20 bp, Artificial
  CRISPR gRNA sequence
attactgggatgaagctatg

SEQ ID NO: 287403 - DNA, 20 bp, Artificial
  CRISPR gRNA sequence
ctgggatgaagctatgctag

SEQ ID NO: 287404 - DNA, 20 bp, Artificial
  CRISPR gRNA sequence
ggatgaagctatgctagctt

SEQ ID NO: 287405 - DNA, 20 bp, Artificial
  CRISPR gRNA sequence
tgctagctttcaaacaggag

SEQ ID NO: 287406 - DNA, 20 bp, Artificial
  CRISPR gRNA sequence
gctttcaaacaggagatgcc

SEQ ID NO: 287407 - DNA, 20 bp, Artificial
  CRISPR gRNA sequence
tcaaacaggagatgcctttc

SEQ ID NO: 287408 - DNA, 20 bp, Artificial
  CRISPR gRNA sequence
caaacaggagatgcctttca

SEQ ID NO: 287409 - DNA, 20 bp, Artificial
  CRISPR gRNA sequence
aaacaggagatgcctttcag

SEQ ID NO: 287410 - DNA, 20 bp, Artificial
  CRISPR gRNA sequence
tcagaaatttgtatattgtg

SEQ ID NO: 287411 - DNA, 20 bp, Artificial
  CRISPR gRNA sequence
cagaaatttgtatattgtgc

SEQ ID NO: 287412 - DNA, 20 bp, Artificial
  CRISPR gRNA sequence
agaaatttgtatattgtgca

SEQ ID NO: 287413 - DNA, 20 bp, Artificial
  CRISPR gRNA sequence
gtatattgtgcagttgccag

SEQ ID NO: 287414 - DNA, 20 bp, Artificial
  CRISPR gRNA sequence
tatattgtgcagttgccaga

SEQ ID NO: 287415 - DNA, 20 bp, Artificial
  CRISPR gRNA sequence
tgcagttgccagaccaatta

SEQ ID NO: 287416 - DNA, 20 bp, Artificial
  CRISPR gRNA sequence
ccagaccaattaaatacctg

SEQ ID NO: 287417 - DNA, 20 bp, Artificial
  CRISPR gRNA sequence
aatacctggttgaaattaaa

SEQ ID NO: 287418 - DNA, 20 bp, Artificial
  CRISPR gRNA sequence
gttgaaattaaaaaaaaaaa

SEQ ID NO: 287419 - DNA, 20 bp, Artificial
  CRISPR gRNA sequence
aaattaaaaaaaaaaaaagt

SEQ ID NO: 287420 - DNA, 20 bp, Artificial
  CRISPR gRNA sequence
aaaaaaaaaaaagtagtctt

SEQ ID NO: 287421 - DNA, 20 bp, Artificial
  CRISPR gRNA sequence
ttactcagaaaaacctatat

SEQ ID NO: 287422 - DNA, 20 bp, Artificial
  CRISPR gRNA sequence
tactcagaaaaacctatatc

SEQ ID NO: 287423 - DNA, 20 bp, Artificial
  CRISPR gRNA sequence
actcagaaaaacctatatcc

SEQ ID NO: 287424 - DNA, 20 bp, Artificial
  CRISPR gRNA sequence
ctcagaaaaacctatatcca

SEQ ID NO: 287425 - DNA, 20 bp, Artificial
  CRISPR gRNA sequence
agaaaaacctatatccaaac

SEQ ID NO: 287426 - DNA, 20 bp, Artificial
  CRISPR gRNA sequence
tatccaaactacaacattga

SEQ ID NO: 287427 - DNA, 20 bp, Artificial
  CRISPR gRNA sequence
caacattgagcctataacct

SEQ ID NO: 287428 - DNA, 20 bp, Artificial
  CRISPR gRNA sequence
agcctataacctcattcacc

SEQ ID NO: 287429 - DNA, 20 bp, Artificial
  CRISPR gRNA sequence
taacctcattcaccacactt

SEQ ID NO: 287430 - DNA, 20 bp, Artificial
  CRISPR gRNA sequence
attcaccacactttattgtt

SEQ ID NO: 287431 - DNA, 20 bp, Artificial
  CRISPR gRNA sequence
accacactttattgtttttc

SEQ ID NO: 287432 - DNA, 20 bp, Artificial
  CRISPR gRNA sequence
tattgtttttcttactattt

SEQ ID NO: 287433 - DNA, 20 bp, Artificial
  CRISPR gRNA sequence
attgtttttcttactatttt

SEQ ID NO: 287434 - DNA, 20 bp, Artificial
  CRISPR gRNA sequence
ttgtttttcttactattttg

SEQ ID NO: 287435 - DNA, 20 bp, Artificial
  CRISPR gRNA sequence
tttttcttactattttgata

SEQ ID NO: 287436 - DNA, 20 bp, Artificial
  CRISPR gRNA sequence
ttcttactattttgatatgc

SEQ ID NO: 287437 - DNA, 20 bp, Artificial
  CRISPR gRNA sequence
tcttactattttgatatgcc

SEQ ID NO: 287438 - DNA, 20 bp, Artificial
  CRISPR gRNA sequence
cttactattttgatatgcct

SEQ ID NO: 287439 - DNA, 20 bp, Artificial
  CRISPR gRNA sequence
ttactattttgatatgcctt

SEQ ID NO: 287440 - DNA, 20 bp, Artificial
  CRISPR gRNA sequence
actattttgatatgccttaa

SEQ ID NO: 287441 - DNA, 20 bp, Artificial
  CRISPR gRNA sequence
ctattttgatatgccttaaa

SEQ ID NO: 287442 - DNA, 20 bp, Artificial
  CRISPR gRNA sequence
ttttgatatgccttaaaggg

SEQ ID NO: 287443 - DNA, 20 bp, Artificial
  CRISPR gRNA sequence
tgatatgccttaaagggaca

SEQ ID NO: 287444 - DNA, 20 bp, Artificial
  CRISPR gRNA sequence
gatatgccttaaagggacag

SEQ ID NO: 287445 - DNA, 20 bp, Artificial
  CRISPR gRNA sequence
atatgccttaaagggacagg

SEQ ID NO: 287446 - DNA, 20 bp, Artificial
  CRISPR gRNA sequence
aaagggacaggaaggccttc

SEQ ID NO: 287447 - DNA, 20 bp, Artificial
  CRISPR gRNA sequence
aagggacaggaaggccttcc

SEQ ID NO: 287448 - DNA, 20 bp, Artificial
  CRISPR gRNA sequence
cctagcattcctccaagacc

SEQ ID NO: 287449 - DNA, 20 bp, Artificial
  CRISPR gRNA sequence
ctagcattcctccaagaccc

SEQ ID NO: 287450 - DNA, 20 bp, Artificial
  CRISPR gRNA sequence
gcattcctccaagacccttg

SEQ ID NO: 287451 - DNA, 20 bp, Artificial
  CRISPR gRNA sequence
ctccaagacccttgaggcac

SEQ ID NO: 287452 - DNA, 20 bp, Artificial
  CRISPR gRNA sequence
caagacccttgaggcactgt

SEQ ID NO: 287453 - DNA, 20 bp, Artificial
  CRISPR gRNA sequence
gaggcactgtttcatttata

SEQ ID NO: 287454 - DNA, 20 bp, Artificial
  CRISPR gRNA sequence
aggcactgtttcatttatat

SEQ ID NO: 287455 - DNA, 20 bp, Artificial
  CRISPR gRNA sequence
tttcatttatatatttgatc

SEQ ID NO: 287456 - DNA, 20 bp, Artificial
  CRISPR gRNA sequence
catttatatatttgatcccc

SEQ ID NO: 287457 - DNA, 20 bp, Artificial
  CRISPR gRNA sequence
atttatatatttgatcccca

SEQ ID NO: 287458 - DNA, 20 bp, Artificial
  CRISPR gRNA sequence
atatatttgatccccataag

SEQ ID NO: 287459 - DNA, 20 bp, Artificial
  CRISPR gRNA sequence
tatatttgatccccataaga

SEQ ID NO: 287460 - DNA, 20 bp, Artificial
  CRISPR gRNA sequence
gatccccataagattctgaa

SEQ ID NO: 287461 - DNA, 20 bp, Artificial
  CRISPR gRNA sequence
atccccataagattctgaag

SEQ ID NO: 287462 - DNA, 20 bp, Artificial
  CRISPR gRNA sequence
tgaagtacaaagtacaggaa

SEQ ID NO: 287463 - DNA, 20 bp, Artificial
  CRISPR gRNA sequence
aagtacaaagtacaggaaaa

SEQ ID NO: 287464 - DNA, 20 bp, Artificial
  CRISPR gRNA sequence
gcggcttcgtcacttattct

SEQ ID NO: 287465 - DNA, 20 bp, Artificial
  CRISPR gRNA sequence
cgtcacttattcttacacat

SEQ ID NO: 287466 - DNA, 20 bp, Artificial
  CRISPR gRNA sequence
gtcacttattcttacacata

SEQ ID NO: 287467 - DNA, 20 bp, Artificial
  CRISPR gRNA sequence
attcttacacataaagagat

SEQ ID NO: 287468 - DNA, 20 bp, Artificial
  CRISPR gRNA sequence
ttcttacacataaagagatt

SEQ ID NO: 287469 - DNA, 20 bp, Artificial
  CRISPR gRNA sequence
ttacacataaagagattagc

SEQ ID NO: 287470 - DNA, 20 bp, Artificial
  CRISPR gRNA sequence
acacataaagagattagctt

SEQ ID NO: 287471 - DNA, 20 bp, Artificial
  CRISPR gRNA sequence
cacataaagagattagcttc

SEQ ID NO: 287472 - DNA, 20 bp, Artificial
  CRISPR gRNA sequence
gcttcttagcatgaatgtag

SEQ ID NO: 287473 - DNA, 20 bp, Artificial
  CRISPR gRNA sequence
cttagcatgaatgtagggat

SEQ ID NO: 287474 - DNA, 20 bp, Artificial
  CRISPR gRNA sequence
ttagcatgaatgtagggatt

SEQ ID NO: 287475 - DNA, 20 bp, Artificial
  CRISPR gRNA sequence
agcatgaatgtagggattca

SEQ ID NO: 287476 - DNA, 20 bp, Artificial
  CRISPR gRNA sequence
gcatgaatgtagggattcaa

SEQ ID NO: 287477 - DNA, 20 bp, Artificial
  CRISPR gRNA sequence
aatctcctcatagagttagc

SEQ ID NO: 287478 - DNA, 20 bp, Artificial
  CRISPR gRNA sequence
ctcatagagttagctttctt

SEQ ID NO: 287479 - DNA, 20 bp, Artificial
  CRISPR gRNA sequence
atagagttagctttcttttc

SEQ ID NO: 287480 - DNA, 20 bp, Artificial
  CRISPR gRNA sequence
gctttcttttcagaattctg

SEQ ID NO: 287481 - DNA, 20 bp, Artificial
  CRISPR gRNA sequence
tcttttcagaattctgagcc

SEQ ID NO: 287482 - DNA, 20 bp, Artificial
  CRISPR gRNA sequence
cttttcagaattctgagccc

SEQ ID NO: 287483 - DNA, 20 bp, Artificial
  CRISPR gRNA sequence
ttttcagaattctgagcccc

SEQ ID NO: 287484 - DNA, 20 bp, Artificial
  CRISPR gRNA sequence
ttcagaattctgagccccac

SEQ ID NO: 287485 - DNA, 20 bp, Artificial
  CRISPR gRNA sequence
tcagaattctgagccccaca

SEQ ID NO: 287486 - DNA, 20 bp, Artificial
  CRISPR gRNA sequence
cagaattctgagccccacag

SEQ ID NO: 287487 - DNA, 20 bp, Artificial
  CRISPR gRNA sequence
agaattctgagccccacaga

SEQ ID NO: 287488 - DNA, 20 bp, Artificial
  CRISPR gRNA sequence
tgagccccacagagatgtca

SEQ ID NO: 287489 - DNA, 20 bp, Artificial
  CRISPR gRNA sequence
agccccacagagatgtcatg

SEQ ID NO: 287490 - DNA, 20 bp, Artificial
  CRISPR gRNA sequence
taaaaccagttctgccttgt

SEQ ID NO: 287491 - DNA, 20 bp, Artificial
  CRISPR gRNA sequence
aaaaccagttctgccttgtg

SEQ ID NO: 287492 - DNA, 20 bp, Artificial
  CRISPR gRNA sequence
aaaccagttctgccttgtga

SEQ ID NO: 287493 - DNA, 20 bp, Artificial
  CRISPR gRNA sequence
tgccttgtgaccctgggtca

SEQ ID NO: 287494 - DNA, 20 bp, Artificial
  CRISPR gRNA sequence
ccttgtgaccctgggtcaat

SEQ ID NO: 287495 - DNA, 20 bp, Artificial
  CRISPR gRNA sequence
gtgaccctgggtcaataact

SEQ ID NO: 287496 - DNA, 20 bp, Artificial
  CRISPR gRNA sequence
tgaccctgggtcaataactt

SEQ ID NO: 287497 - DNA, 20 bp, Artificial
  CRISPR gRNA sequence
ggtcaataacttacccacct

SEQ ID NO: 287498 - DNA, 20 bp, Artificial
  CRISPR gRNA sequence
acccacctttagtcttagtt

SEQ ID NO: 287499 - DNA, 20 bp, Artificial
  CRISPR gRNA sequence
cccacctttagtcttagttt

SEQ ID NO: 287500 - DNA, 20 bp, Artificial
  CRISPR gRNA sequence
tagtcttagtttgctcatct

SEQ ID NO: 287501 - DNA, 20 bp, Artificial
  CRISPR gRNA sequence
agtcttagtttgctcatcta

SEQ ID NO: 287502 - DNA, 20 bp, Artificial
  CRISPR gRNA sequence
gtcttagtttgctcatctat

SEQ ID NO: 287503 - DNA, 20 bp, Artificial
  CRISPR gRNA sequence
agtttgctcatctataagat

SEQ ID NO: 287504 - DNA, 20 bp, Artificial
  CRISPR gRNA sequence
gtttgctcatctataagata

SEQ ID NO: 287505 - DNA, 20 bp, Artificial
  CRISPR gRNA sequence
gctcatctataagataggga

SEQ ID NO: 287506 - DNA, 20 bp, Artificial
  CRISPR gRNA sequence
ctcatctataagatagggac

SEQ ID NO: 287507 - DNA, 20 bp, Artificial
  CRISPR gRNA sequence
atctataagatagggacact

SEQ ID NO: 287508 - DNA, 20 bp, Artificial
  CRISPR gRNA sequence
taagatagggacactaatac

SEQ ID NO: 287509 - DNA, 20 bp, Artificial
  CRISPR gRNA sequence
atacccagggttgtaagaat

SEQ ID NO: 287510 - DNA, 20 bp, Artificial
  CRISPR gRNA sequence
taagaattaaatgacatcgt

SEQ ID NO: 287511 - DNA, 20 bp, Artificial
  CRISPR gRNA sequence
aatgacatcgttcatagaaa

SEQ ID NO: 287512 - DNA, 20 bp, Artificial
  CRISPR gRNA sequence
atagaaatcacttagcacag

SEQ ID NO: 287513 - DNA, 20 bp, Artificial
  CRISPR gRNA sequence
agcacagagcctgacacaca

SEQ ID NO: 287514 - DNA, 20 bp, Artificial
  CRISPR gRNA sequence
gcacagagcctgacacacag

SEQ ID NO: 287515 - DNA, 20 bp, Artificial
  CRISPR gRNA sequence
acacacaggaaactaaatag

SEQ ID NO: 287516 - DNA, 20 bp, Artificial
  CRISPR gRNA sequence
aatagtctcactctgttgcc

SEQ ID NO: 287517 - DNA, 20 bp, Artificial
  CRISPR gRNA sequence
actctgttgcccaggctgga

SEQ ID NO: 287518 - DNA, 20 bp, Artificial
  CRISPR gRNA sequence
tgttgcccaggctggagtgc

SEQ ID NO: 287519 - DNA, 20 bp, Artificial
  CRISPR gRNA sequence
ttgcccaggctggagtgcag

SEQ ID NO: 287520 - DNA, 20 bp, Artificial
  CRISPR gRNA sequence
cccaggctggagtgcagtgg

SEQ ID NO: 287521 - DNA, 20 bp, Artificial
  CRISPR gRNA sequence
gagtgcagtggcaccatctt

SEQ ID NO: 287522 - DNA, 20 bp, Artificial
  CRISPR gRNA sequence
ggcttactgcaacctccggg

SEQ ID NO: 287523 - DNA, 20 bp, Artificial
  CRISPR gRNA sequence
gcttactgcaacctccgggt

SEQ ID NO: 287524 - DNA, 20 bp, Artificial
  CRISPR gRNA sequence
actgcaacctccgggttcaa

SEQ ID NO: 287525 - DNA, 20 bp, Artificial
  CRISPR gRNA sequence
ctgcaacctccgggttcaag

SEQ ID NO: 287526 - DNA, 20 bp, Artificial
  CRISPR gRNA sequence
caacctccgggttcaagtga

SEQ ID NO: 287527 - DNA, 20 bp, Artificial
  CRISPR gRNA sequence
cgggttcaagtgattctcct

SEQ ID NO: 287528 - DNA, 20 bp, Artificial
  CRISPR gRNA sequence
aagtgattctcctgcctcag

SEQ ID NO: 287529 - DNA, 20 bp, Artificial
  CRISPR gRNA sequence
tcctgcctcagcctccagag

SEQ ID NO: 287530 - DNA, 20 bp, Artificial
  CRISPR gRNA sequence
ctgcctcagcctccagagta

SEQ ID NO: 287531 - DNA, 20 bp, Artificial
  CRISPR gRNA sequence
cctcagcctccagagtagct

SEQ ID NO: 287532 - DNA, 20 bp, Artificial
  CRISPR gRNA sequence
agcctccagagtagctggga

SEQ ID NO: 287533 - DNA, 20 bp, Artificial
  CRISPR gRNA sequence
cagagtagctgggactacag

SEQ ID NO: 287534 - DNA, 20 bp, Artificial
  CRISPR gRNA sequence
ggactacaggagcccaccac

SEQ ID NO: 287535 - DNA, 20 bp, Artificial
  CRISPR gRNA sequence
caggagcccaccactaccat

SEQ ID NO: 287536 - DNA, 20 bp, Artificial
  CRISPR gRNA sequence
ccatctaatttcttgtattt

SEQ ID NO: 287537 - DNA, 20 bp, Artificial
  CRISPR gRNA sequence
atttcttgtatttttaatag

SEQ ID NO: 287538 - DNA, 20 bp, Artificial
  CRISPR gRNA sequence
cttgtatttttaatagagat

SEQ ID NO: 287539 - DNA, 20 bp, Artificial
  CRISPR gRNA sequence
ttgtatttttaatagagatg

SEQ ID NO: 287540 - DNA, 20 bp, Artificial
  CRISPR gRNA sequence
gtatttttaatagagatggg

SEQ ID NO: 287541 - DNA, 20 bp, Artificial
  CRISPR gRNA sequence
tatttttaatagagatgggg

SEQ ID NO: 287542 - DNA, 20 bp, Artificial
  CRISPR gRNA sequence
ttaatagagatggggtttca

SEQ ID NO: 287543 - DNA, 20 bp, Artificial
  CRISPR gRNA sequence
taatagagatggggtttcac

SEQ ID NO: 287544 - DNA, 20 bp, Artificial
  CRISPR gRNA sequence
aatagagatggggtttcact

SEQ ID NO: 287545 - DNA, 20 bp, Artificial
  CRISPR gRNA sequence
atagagatggggtttcactg

SEQ ID NO: 287546 - DNA, 20 bp, Artificial
  CRISPR gRNA sequence
cactgtgttagccaggatgg

SEQ ID NO: 287547 - DNA, 20 bp, Artificial
  CRISPR gRNA sequence
actgtgttagccaggatggt

SEQ ID NO: 287548 - DNA, 20 bp, Artificial
  CRISPR gRNA sequence
tgttagccaggatggtctca

SEQ ID NO: 287549 - DNA, 20 bp, Artificial
  CRISPR gRNA sequence
gccaggatggtctcagtctc

SEQ ID NO: 287550 - DNA, 20 bp, Artificial
  CRISPR gRNA sequence
agtctcctgacctcgtgatc

SEQ ID NO: 287551 - DNA, 20 bp, Artificial
  CRISPR gRNA sequence
ctgacctcgtgatccaccag

SEQ ID NO: 287552 - DNA, 20 bp, Artificial
  CRISPR gRNA sequence
acctcgtgatccaccagcct

SEQ ID NO: 287553 - DNA, 20 bp, Artificial
  CRISPR gRNA sequence
gtgatccaccagcctcggcc

SEQ ID NO: 287554 - DNA, 20 bp, Artificial
  CRISPR gRNA sequence
ggcctcccaaagtgctggga

SEQ ID NO: 287555 - DNA, 20 bp, Artificial
  CRISPR gRNA sequence
ccaaagtgctgggattacag

SEQ ID NO: 287556 - DNA, 20 bp, Artificial
  CRISPR gRNA sequence
ggattacaggcgtgagccac

SEQ ID NO: 287557 - DNA, 20 bp, Artificial
  CRISPR gRNA sequence
caggcgtgagccaccacacc

SEQ ID NO: 287558 - DNA, 20 bp, Artificial
  CRISPR gRNA sequence
tatttaagtgggtcttgaat

SEQ ID NO: 287559 - DNA, 20 bp, Artificial
  CRISPR gRNA sequence
aagtgggtcttgaatttatc

SEQ ID NO: 287560 - DNA, 20 bp, Artificial
  CRISPR gRNA sequence
agtgggtcttgaatttatcc

SEQ ID NO: 287561 - DNA, 20 bp, Artificial
  CRISPR gRNA sequence
gaatttatcctctcttaggt

SEQ ID NO: 287562 - DNA, 20 bp, Artificial
  CRISPR gRNA sequence
aatttatcctctcttaggta

SEQ ID NO: 287563 - DNA, 20 bp, Artificial
  CRISPR gRNA sequence
atcctctcttaggtaagccc

SEQ ID NO: 287564 - DNA, 20 bp, Artificial
  CRISPR gRNA sequence
tcctctcttaggtaagcccc

SEQ ID NO: 287565 - DNA, 20 bp, Artificial
  CRISPR gRNA sequence
tcttaggtaagccccctcat

SEQ ID NO: 287566 - DNA, 20 bp, Artificial
  CRISPR gRNA sequence
ttaggtaagccccctcattt

SEQ ID NO: 287567 - DNA, 20 bp, Artificial
  CRISPR gRNA sequence
aggtaagccccctcatttaa

SEQ ID NO: 287568 - DNA, 20 bp, Artificial
  CRISPR gRNA sequence
ggtaagccccctcatttaaa

SEQ ID NO: 287569 - DNA, 20 bp, Artificial
  CRISPR gRNA sequence
atttaaatcaggttgccagg

SEQ ID NO: 287570 - DNA, 20 bp, Artificial
  CRISPR gRNA sequence
aaatcaggttgccaggcaaa

SEQ ID NO: 287571 - DNA, 20 bp, Artificial
  CRISPR gRNA sequence
aatcaggttgccaggcaaac

SEQ ID NO: 287572 - DNA, 20 bp, Artificial
  CRISPR gRNA sequence
ccaggcaaacacttccagga

SEQ ID NO: 287573 - DNA, 20 bp, Artificial
  CRISPR gRNA sequence
ccaggaatgccttgtggcac

SEQ ID NO: 287574 - DNA, 20 bp, Artificial
  CRISPR gRNA sequence
caggaatgccttgtggcacc

SEQ ID NO: 287575 - DNA, 20 bp, Artificial
  CRISPR gRNA sequence
gtggcacctacaataatgag

SEQ ID NO: 287576 - DNA, 20 bp, Artificial
  CRISPR gRNA sequence
tggcacctacaataatgagg

SEQ ID NO: 287577 - DNA, 20 bp, Artificial
  CRISPR gRNA sequence
caataatgaggataaaggga

SEQ ID NO: 287578 - DNA, 20 bp, Artificial
  CRISPR gRNA sequence
ccaggaaagaggaaaagttg

SEQ ID NO: 287579 - DNA, 20 bp, Artificial
  CRISPR gRNA sequence
gatttggttggaggtgaagt

SEQ ID NO: 287580 - DNA, 20 bp, Artificial
  CRISPR gRNA sequence
ggttggaggtgaagttacct

SEQ ID NO: 287581 - DNA, 20 bp, Artificial
  CRISPR gRNA sequence
gttggaggtgaagttacctt

SEQ ID NO: 287582 - DNA, 20 bp, Artificial
  CRISPR gRNA sequence
gaggtgaagttacctttttt

SEQ ID NO: 287583 - DNA, 20 bp, Artificial
  CRISPR gRNA sequence
ccttttttttttgtttgttt

SEQ ID NO: 287584 - DNA, 20 bp, Artificial
  CRISPR gRNA sequence
ttttttttgtttgtttcaat

SEQ ID NO: 287585 - DNA, 20 bp, Artificial
  CRISPR gRNA sequence
tttttttgtttgtttcaatg

SEQ ID NO: 287586 - DNA, 20 bp, Artificial
  CRISPR gRNA sequence
ttttttgtttgtttcaatga

SEQ ID NO: 287587 - DNA, 20 bp, Artificial
  CRISPR gRNA sequence
tttttgtttgtttcaatgaa

SEQ ID NO: 287588 - DNA, 20 bp, Artificial
  CRISPR gRNA sequence
ttttgtttgtttcaatgaac

SEQ ID NO: 287589 - DNA, 20 bp, Artificial
  CRISPR gRNA sequence
tttgtttgtttcaatgaacc

SEQ ID NO: 287590 - DNA, 20 bp, Artificial
  CRISPR gRNA sequence
ttgtttgtttcaatgaaccc

SEQ ID NO: 287591 - DNA, 20 bp, Artificial
  CRISPR gRNA sequence
tgtttgtttcaatgaaccct

SEQ ID NO: 287592 - DNA, 20 bp, Artificial
  CRISPR gRNA sequence
gtttgtttcaatgaaccctg

SEQ ID NO: 287593 - DNA, 20 bp, Artificial
  CRISPR gRNA sequence
tttgtttcaatgaaccctgt

SEQ ID NO: 287594 - DNA, 20 bp, Artificial
  CRISPR gRNA sequence
gtttcaatgaaccctgtccc

SEQ ID NO: 287595 - DNA, 20 bp, Artificial
  CRISPR gRNA sequence
tttcaatgaaccctgtccct

SEQ ID NO: 287596 - DNA, 20 bp, Artificial
  CRISPR gRNA sequence
caatgaaccctgtccctaaa

SEQ ID NO: 287597 - DNA, 20 bp, Artificial
  CRISPR gRNA sequence
aatgaaccctgtccctaaat

SEQ ID NO: 287598 - DNA, 20 bp, Artificial
  CRISPR gRNA sequence
tccctaaatgaagtttgata

SEQ ID NO: 287599 - DNA, 20 bp, Artificial
  CRISPR gRNA sequence
aatgaagtttgatatgttcc

SEQ ID NO: 287600 - DNA, 20 bp, Artificial
  CRISPR gRNA sequence
gatatgttcctgagccactt

SEQ ID NO: 287601 - DNA, 20 bp, Artificial
  CRISPR gRNA sequence
atatgttcctgagccacttt

SEQ ID NO: 287602 - DNA, 20 bp, Artificial
  CRISPR gRNA sequence
ctgagccacttttagttggc

SEQ ID NO: 287603 - DNA, 20 bp, Artificial
  CRISPR gRNA sequence
agccacttttagttggcatt

SEQ ID NO: 287604 - DNA, 20 bp, Artificial
  CRISPR gRNA sequence
ttagttggcattgttatttc

SEQ ID NO: 287605 - DNA, 20 bp, Artificial
  CRISPR gRNA sequence
tagttggcattgttatttcc

SEQ ID NO: 287606 - DNA, 20 bp, Artificial
  CRISPR gRNA sequence
agttggcattgttatttccc

SEQ ID NO: 287607 - DNA, 20 bp, Artificial
  CRISPR gRNA sequence
gttggcattgttatttccca

SEQ ID NO: 287608 - DNA, 20 bp, Artificial
  CRISPR gRNA sequence
gcattgttatttcccactta

SEQ ID NO: 287609 - DNA, 20 bp, Artificial
  CRISPR gRNA sequence
ttatttcccacttattaatt

SEQ ID NO: 287610 - DNA, 20 bp, Artificial
  CRISPR gRNA sequence
tttcccacttattaatttat

SEQ ID NO: 287611 - DNA, 20 bp, Artificial
  CRISPR gRNA sequence
cccacttattaatttatcct

SEQ ID NO: 287612 - DNA, 20 bp, Artificial
  CRISPR gRNA sequence
ccacttattaatttatccta

SEQ ID NO: 287613 - DNA, 20 bp, Artificial
  CRISPR gRNA sequence
attaatttatcctataagat

SEQ ID NO: 287614 - DNA, 20 bp, Artificial
  CRISPR gRNA sequence
ttaatttatcctataagatc

SEQ ID NO: 287615 - DNA, 20 bp, Artificial
  CRISPR gRNA sequence
atttatcctataagatcgac

SEQ ID NO: 287616 - DNA, 20 bp, Artificial
  CRISPR gRNA sequence
atcctataagatcgactcat

SEQ ID NO: 287617 - DNA, 20 bp, Artificial
  CRISPR gRNA sequence
tcctataagatcgactcatg

SEQ ID NO: 287618 - DNA, 20 bp, Artificial
  CRISPR gRNA sequence
taagatcgactcatgacaca

SEQ ID NO: 287619 - DNA, 20 bp, Artificial
  CRISPR gRNA sequence
atgacacaggcagctgatat

SEQ ID NO: 287620 - DNA, 20 bp, Artificial
  CRISPR gRNA sequence
atatctagaatattctgtgt

SEQ ID NO: 287621 - DNA, 20 bp, Artificial
  CRISPR gRNA sequence
gaatattctgtgtttcttat

SEQ ID NO: 287622 - DNA, 20 bp, Artificial
  CRISPR gRNA sequence
tgtgtttcttataacatcaa

SEQ ID NO: 287623 - DNA, 20 bp, Artificial
  CRISPR gRNA sequence
tgtttcttataacatcaata

SEQ ID NO: 287624 - DNA, 20 bp, Artificial
  CRISPR gRNA sequence
cttataacatcaatatgttt

SEQ ID NO: 287625 - DNA, 20 bp, Artificial
  CRISPR gRNA sequence
ttataacatcaatatgtttt

SEQ ID NO: 287626 - DNA, 20 bp, Artificial
  CRISPR gRNA sequence
ataacatcaatatgttttgt

SEQ ID NO: 287627 - DNA, 20 bp, Artificial
  CRISPR gRNA sequence
taacatcaatatgttttgtg

SEQ ID NO: 287628 - DNA, 20 bp, Artificial
  CRISPR gRNA sequence
tgtgttataactaggaataa

SEQ ID NO: 287629 - DNA, 20 bp, Artificial
  CRISPR gRNA sequence
gtgttataactaggaataat

SEQ ID NO: 287630 - DNA, 20 bp, Artificial
  CRISPR gRNA sequence
tgttataactaggaataata

SEQ ID NO: 287631 - DNA, 20 bp, Artificial
  CRISPR gRNA sequence
taactaggaataataaatcc

SEQ ID NO: 287632 - DNA, 20 bp, Artificial
  CRISPR gRNA sequence
ggaataataaatccaaaaac

SEQ ID NO: 287633 - DNA, 20 bp, Artificial
  CRISPR gRNA sequence
atatcctaaattattaatat

SEQ ID NO: 287634 - DNA, 20 bp, Artificial
  CRISPR gRNA sequence
aattattaatatgattcatg

SEQ ID NO: 287635 - DNA, 20 bp, Artificial
  CRISPR gRNA sequence
ttaatatgattcatgttcat

SEQ ID NO: 287636 - DNA, 20 bp, Artificial
  CRISPR gRNA sequence
atatgattcatgttcatttc

SEQ ID NO: 287637 - DNA, 20 bp, Artificial
  CRISPR gRNA sequence
atgttcatttctgtgctctg

SEQ ID NO: 287638 - DNA, 20 bp, Artificial
  CRISPR gRNA sequence
atttctgtgctctgcttttc

SEQ ID NO: 287639 - DNA, 20 bp, Artificial
  CRISPR gRNA sequence
ctgtgctctgcttttctggg

SEQ ID NO: 287640 - DNA, 20 bp, Artificial
  CRISPR gRNA sequence
tgtgctctgcttttctggga

SEQ ID NO: 287641 - DNA, 20 bp, Artificial
  CRISPR gRNA sequence
tgctctgcttttctgggaaa

SEQ ID NO: 287642 - DNA, 20 bp, Artificial
  CRISPR gRNA sequence
tgcttttctgggaaataaac

SEQ ID NO: 287643 - DNA, 20 bp, Artificial
  CRISPR gRNA sequence
cttttctgggaaataaacta

SEQ ID NO: 287644 - DNA, 20 bp, Artificial
  CRISPR gRNA sequence
ttctgggaaataaactacag

SEQ ID NO: 287645 - DNA, 20 bp, Artificial
  CRISPR gRNA sequence
tctgggaaataaactacagg

SEQ ID NO: 287646 - DNA, 20 bp, Artificial
  CRISPR gRNA sequence
ctgggaaataaactacagga

SEQ ID NO: 287647 - DNA, 20 bp, Artificial
  CRISPR gRNA sequence
tgggaaataaactacaggaa

SEQ ID NO: 287648 - DNA, 20 bp, Artificial
  CRISPR gRNA sequence
ggaaataaactacaggaatg

SEQ ID NO: 287649 - DNA, 20 bp, Artificial
  CRISPR gRNA sequence
caggaatgccactcatacca

SEQ ID NO: 287650 - DNA, 20 bp, Artificial
  CRISPR gRNA sequence
ataccaggaactgtattaaa

SEQ ID NO: 287651 - DNA, 20 bp, Artificial
  CRISPR gRNA sequence
tattaaaaatcttttcaagg

SEQ ID NO: 287652 - DNA, 20 bp, Artificial
  CRISPR gRNA sequence
aaaatcttttcaaggccagg

SEQ ID NO: 287653 - DNA, 20 bp, Artificial
  CRISPR gRNA sequence
ttcaaggccaggtgtgctgg

SEQ ID NO: 287654 - DNA, 20 bp, Artificial
  CRISPR gRNA sequence
tcaaggccaggtgtgctggc

SEQ ID NO: 287655 - DNA, 20 bp, Artificial
  CRISPR gRNA sequence
caaggccaggtgtgctggct

SEQ ID NO: 287656 - DNA, 20 bp, Artificial
  CRISPR gRNA sequence
aaggccaggtgtgctggctc

SEQ ID NO: 287657 - DNA, 20 bp, Artificial
  CRISPR gRNA sequence
gctcatgcctgtaatcctag

SEQ ID NO: 287658 - DNA, 20 bp, Artificial
  CRISPR gRNA sequence
atgcctgtaatcctagcact

SEQ ID NO: 287659 - DNA, 20 bp, Artificial
  CRISPR gRNA sequence
taatcctagcactttgggag

SEQ ID NO: 287660 - DNA, 20 bp, Artificial
  CRISPR gRNA sequence
gcactttgggaggtcaaggc

SEQ ID NO: 287661 - DNA, 20 bp, Artificial
  CRISPR gRNA sequence
tgggaggtcaaggcaggagg

SEQ ID NO: 287662 - DNA, 20 bp, Artificial
  CRISPR gRNA sequence
gggaggtcaaggcaggagga

SEQ ID NO: 287663 - DNA, 20 bp, Artificial
  CRISPR gRNA sequence
ggaggtcaaggcaggaggat

SEQ ID NO: 287664 - DNA, 20 bp, Artificial
  CRISPR gRNA sequence
gaggtcaggagtttgagacc

SEQ ID NO: 287665 - DNA, 20 bp, Artificial
  CRISPR gRNA sequence
aggtcaggagtttgagacca

SEQ ID NO: 287666 - DNA, 20 bp, Artificial
  CRISPR gRNA sequence
gagaccaccctggacaacat

SEQ ID NO: 287667 - DNA, 20 bp, Artificial
  CRISPR gRNA sequence
agaccaccctggacaacata

SEQ ID NO: 287668 - DNA, 20 bp, Artificial
  CRISPR gRNA sequence
gacaacatagtgaaaccttg

SEQ ID NO: 287669 - DNA, 20 bp, Artificial
  CRISPR gRNA sequence
gtctctactaaaaataaaaa

SEQ ID NO: 287670 - DNA, 20 bp, Artificial
  CRISPR gRNA sequence
tctctactaaaaataaaaaa

SEQ ID NO: 287671 - DNA, 20 bp, Artificial
  CRISPR gRNA sequence
tactaaaaataaaaaattag

SEQ ID NO: 287672 - DNA, 20 bp, Artificial
  CRISPR gRNA sequence
ctaaaaataaaaaattagcc

SEQ ID NO: 287673 - DNA, 20 bp, Artificial
  CRISPR gRNA sequence
aaaataaaaaattagccagg

SEQ ID NO: 287674 - DNA, 20 bp, Artificial
  CRISPR gRNA sequence
gccaggcatgatggcacatg

SEQ ID NO: 287675 - DNA, 20 bp, Artificial
  CRISPR gRNA sequence
tagtcccagctagtttggag

SEQ ID NO: 287676 - DNA, 20 bp, Artificial
  CRISPR gRNA sequence
gtttggaggctgagacagga

SEQ ID NO: 287677 - DNA, 20 bp, Artificial
  CRISPR gRNA sequence
ggaggctgagacaggagaat

SEQ ID NO: 287678 - DNA, 20 bp, Artificial
  CRISPR gRNA sequence
gaggctgagacaggagaatc

SEQ ID NO: 287679 - DNA, 20 bp, Artificial
  CRISPR gRNA sequence
agacaggagaatcgcttgaa

SEQ ID NO: 287680 - DNA, 20 bp, Artificial
  CRISPR gRNA sequence
gaacccaggaggcagaggct

SEQ ID NO: 287681 - DNA, 20 bp, Artificial
  CRISPR gRNA sequence
aacccaggaggcagaggctg

SEQ ID NO: 287682 - DNA, 20 bp, Artificial
  CRISPR gRNA sequence
cagagacccgagatcacgcc

SEQ ID NO: 287683 - DNA, 20 bp, Artificial
  CRISPR gRNA sequence
cactctagcctgggtgacag

SEQ ID NO: 287684 - DNA, 20 bp, Artificial
  CRISPR gRNA sequence
tagcctgggtgacagagtaa

SEQ ID NO: 287685 - DNA, 20 bp, Artificial
  CRISPR gRNA sequence
gcctgggtgacagagtaaga

SEQ ID NO: 287686 - DNA, 20 bp, Artificial
  CRISPR gRNA sequence
ggtgacagagtaagagactc

SEQ ID NO: 287687 - DNA, 20 bp, Artificial
  CRISPR gRNA sequence
catctcaaaaaaaaaaaaag

SEQ ID NO: 287688 - DNA, 20 bp, Artificial
  CRISPR gRNA sequence
aaaaaaaaaaaaagtttcaa

SEQ ID NO: 287689 - DNA, 20 bp, Artificial
  CRISPR gRNA sequence
caaaatctttcttggcttag

SEQ ID NO: 287690 - DNA, 20 bp, Artificial
  CRISPR gRNA sequence
aaaatctttcttggcttaga

SEQ ID NO: 287691 - DNA, 20 bp, Artificial
  CRISPR gRNA sequence
tcttggcttagaacagccta

SEQ ID NO: 287692 - DNA, 20 bp, Artificial
  CRISPR gRNA sequence
cttggcttagaacagcctaa

SEQ ID NO: 287693 - DNA, 20 bp, Artificial
  CRISPR gRNA sequence
ttggcttagaacagcctaaa

SEQ ID NO: 287694 - DNA, 20 bp, Artificial
  CRISPR gRNA sequence
ggcttagaacagcctaaact

SEQ ID NO: 287695 - DNA, 20 bp, Artificial
  CRISPR gRNA sequence
gcttagaacagcctaaactc

SEQ ID NO: 287696 - DNA, 20 bp, Artificial
  CRISPR gRNA sequence
agaacagcctaaactccatc

SEQ ID NO: 287697 - DNA, 20 bp, Artificial
  CRISPR gRNA sequence
gaacagcctaaactccatct

SEQ ID NO: 287698 - DNA, 20 bp, Artificial
  CRISPR gRNA sequence
aactccatctcccacctttt

SEQ ID NO: 287699 - DNA, 20 bp, Artificial
  CRISPR gRNA sequence
catctcccaccttttttcta

SEQ ID NO: 287700 - DNA, 20 bp, Artificial
  CRISPR gRNA sequence
ccaccttttttctaaggtga

SEQ ID NO: 287701 - DNA, 20 bp, Artificial
  CRISPR gRNA sequence
ttttctaaggtgatctgttt

SEQ ID NO: 287702 - DNA, 20 bp, Artificial
  CRISPR gRNA sequence
tttctaaggtgatctgttta

SEQ ID NO: 287703 - DNA, 20 bp, Artificial
  CRISPR gRNA sequence
ttctaaggtgatctgtttag

SEQ ID NO: 287704 - DNA, 20 bp, Artificial
  CRISPR gRNA sequence
tctaaggtgatctgtttagg

SEQ ID NO: 287705 - DNA, 20 bp, Artificial
  CRISPR gRNA sequence
ctaaggtgatctgtttaggg

SEQ ID NO: 287706 - DNA, 20 bp, Artificial
  CRISPR gRNA sequence
taaggtgatctgtttagggt

SEQ ID NO: 287707 - DNA, 20 bp, Artificial
  CRISPR gRNA sequence
aggtgatctgtttagggtaa

SEQ ID NO: 287708 - DNA, 20 bp, Artificial
  CRISPR gRNA sequence
tttagggtaactactcctga

SEQ ID NO: 287709 - DNA, 20 bp, Artificial
  CRISPR gRNA sequence
agggtaactactcctgaggt

SEQ ID NO: 287710 - DNA, 20 bp, Artificial
  CRISPR gRNA sequence
gggtaactactcctgaggtc

SEQ ID NO: 287711 - DNA, 20 bp, Artificial
  CRISPR gRNA sequence
ctcctgaggtcttgtgagat

SEQ ID NO: 287712 - DNA, 20 bp, Artificial
  CRISPR gRNA sequence
ctgaggtcttgtgagattgt

SEQ ID NO: 287713 - DNA, 20 bp, Artificial
  CRISPR gRNA sequence
aggtcttgtgagattgtgaa

SEQ ID NO: 287714 - DNA, 20 bp, Artificial
  CRISPR gRNA sequence
gtgagattgtgaacaatcaa

SEQ ID NO: 287715 - DNA, 20 bp, Artificial
  CRISPR gRNA sequence
tgagattgtgaacaatcaaa

SEQ ID NO: 287716 - DNA, 20 bp, Artificial
  CRISPR gRNA sequence
tgaacaatcaaagacgttgt

SEQ ID NO: 287717 - DNA, 20 bp, Artificial
  CRISPR gRNA sequence
taagactgtaacctttgtat

SEQ ID NO: 287718 - DNA, 20 bp, Artificial
  CRISPR gRNA sequence
taacctttgtatctcatttt

SEQ ID NO: 287719 - DNA, 20 bp, Artificial
  CRISPR gRNA sequence
tgtatctcattttaattagt

SEQ ID NO: 287720 - DNA, 20 bp, Artificial
  CRISPR gRNA sequence
gtatctcattttaattagtt

SEQ ID NO: 287721 - DNA, 20 bp, Artificial
  CRISPR gRNA sequence
tatctcattttaattagtta

SEQ ID NO: 287722 - DNA, 20 bp, Artificial
  CRISPR gRNA sequence
attttaattagttaacccaa

SEQ ID NO: 287723 - DNA, 20 bp, Artificial
  CRISPR gRNA sequence
taattagttaacccaatttt

SEQ ID NO: 287724 - DNA, 20 bp, Artificial
  CRISPR gRNA sequence
aattagttaacccaattttt

SEQ ID NO: 287725 - DNA, 20 bp, Artificial
  CRISPR gRNA sequence
attagttaacccaattttta

SEQ ID NO: 287726 - DNA, 20 bp, Artificial
  CRISPR gRNA sequence
gttaacccaatttttaccac

SEQ ID NO: 287727 - DNA, 20 bp, Artificial
  CRISPR gRNA sequence
acccaatttttaccactctt

SEQ ID NO: 287728 - DNA, 20 bp, Artificial
  CRISPR gRNA sequence
ttaccactcttaataggaaa

SEQ ID NO: 287729 - DNA, 20 bp, Artificial
  CRISPR gRNA sequence
taccactcttaataggaaag

SEQ ID NO: 287730 - DNA, 20 bp, Artificial
  CRISPR gRNA sequence
accactcttaataggaaagg

SEQ ID NO: 287731 - DNA, 20 bp, Artificial
  CRISPR gRNA sequence
ccactcttaataggaaaggg

SEQ ID NO: 287732 - DNA, 20 bp, Artificial
  CRISPR gRNA sequence
ttaataggaaagggtaggaa

SEQ ID NO: 287733 - DNA, 20 bp, Artificial
  CRISPR gRNA sequence
aataggaaagggtaggaatg

SEQ ID NO: 287734 - DNA, 20 bp, Artificial
  CRISPR gRNA sequence
ataggaaagggtaggaatgt

SEQ ID NO: 287735 - DNA, 20 bp, Artificial
  CRISPR gRNA sequence
acaaggaaaggaataggtgc

SEQ ID NO: 287736 - DNA, 20 bp, Artificial
  CRISPR gRNA sequence
caaggaaaggaataggtgca

SEQ ID NO: 287737 - DNA, 20 bp, Artificial
  CRISPR gRNA sequence
taggaggaaaaatccattaa

SEQ ID NO: 287738 - DNA, 20 bp, Artificial
  CRISPR gRNA sequence
aggaggaaaaatccattaac

SEQ ID NO: 287739 - DNA, 20 bp, Artificial
  CRISPR gRNA sequence
ggaggaaaaatccattaacc

SEQ ID NO: 287740 - DNA, 20 bp, Artificial
  CRISPR gRNA sequence
acctagttaagctgttaacg

SEQ ID NO: 287741 - DNA, 20 bp, Artificial
  CRISPR gRNA sequence
gttaagctgttaacgaatgt

SEQ ID NO: 287742 - DNA, 20 bp, Artificial
  CRISPR gRNA sequence
agctgttaacgaatgtagct

SEQ ID NO: 287743 - DNA, 20 bp, Artificial
  CRISPR gRNA sequence
ttaacgaatgtagctagttc

SEQ ID NO: 287744 - DNA, 20 bp, Artificial
  CRISPR gRNA sequence
acgaatgtagctagttctca

SEQ ID NO: 287745 - DNA, 20 bp, Artificial
  CRISPR gRNA sequence
gttctcaaacatgccagtta

SEQ ID NO: 287746 - DNA, 20 bp, Artificial
  CRISPR gRNA sequence
tcaaacatgccagttaatgg

SEQ ID NO: 287747 - DNA, 20 bp, Artificial
  CRISPR gRNA sequence
aaacatgccagttaatggag

SEQ ID NO: 287748 - DNA, 20 bp, Artificial
  CRISPR gRNA sequence
atggaggttttcatatggct

SEQ ID NO: 287749 - DNA, 20 bp, Artificial
  CRISPR gRNA sequence
tcatatggctatgctgatat

SEQ ID NO: 287750 - DNA, 20 bp, Artificial
  CRISPR gRNA sequence
catatggctatgctgatatt

SEQ ID NO: 287751 - DNA, 20 bp, Artificial
  CRISPR gRNA sequence
atatggctatgctgatatta

SEQ ID NO: 287752 - DNA, 20 bp, Artificial
  CRISPR gRNA sequence
tgctgatattatattaccat

SEQ ID NO: 287753 - DNA, 20 bp, Artificial
  CRISPR gRNA sequence
atattatattaccattttgc

SEQ ID NO: 287754 - DNA, 20 bp, Artificial
  CRISPR gRNA sequence
tattaccattttgcaatctt

SEQ ID NO: 287755 - DNA, 20 bp, Artificial
  CRISPR gRNA sequence
ccattttgcaatcttagaca

SEQ ID NO: 287756 - DNA, 20 bp, Artificial
  CRISPR gRNA sequence
tgcaatcttagacaaatata

SEQ ID NO: 287757 - DNA, 20 bp, Artificial
  CRISPR gRNA sequence
gcaatcttagacaaatatag

SEQ ID NO: 287758 - DNA, 20 bp, Artificial
  CRISPR gRNA sequence
caatcttagacaaatatagg

SEQ ID NO: 287759 - DNA, 20 bp, Artificial
  CRISPR gRNA sequence
agacaaatatagggtaacca

SEQ ID NO: 287760 - DNA, 20 bp, Artificial
  CRISPR gRNA sequence
gacaaatatagggtaaccaa

SEQ ID NO: 287761 - DNA, 20 bp, Artificial
  CRISPR gRNA sequence
tttgcctgagactttcccag

SEQ ID NO: 287762 - DNA, 20 bp, Artificial
  CRISPR gRNA sequence
gcctgagactttcccagttt

SEQ ID NO: 287763 - DNA, 20 bp, Artificial
  CRISPR gRNA sequence
cctgagactttcccagtttt

SEQ ID NO: 287764 - DNA, 20 bp, Artificial
  CRISPR gRNA sequence
agactttcccagttttagca

SEQ ID NO: 287765 - DNA, 20 bp, Artificial
  CRISPR gRNA sequence
tcccagttttagcaccaaaa

SEQ ID NO: 287766 - DNA, 20 bp, Artificial
  CRISPR gRNA sequence
cccagttttagcaccaaaaa

SEQ ID NO: 287767 - DNA, 20 bp, Artificial
  CRISPR gRNA sequence
ccagttttagcaccaaaaat

SEQ ID NO: 287768 - DNA, 20 bp, Artificial
  CRISPR gRNA sequence
tagcaccaaaaatcttgtgc

SEQ ID NO: 287769 - DNA, 20 bp, Artificial
  CRISPR gRNA sequence
agcaccaaaaatcttgtgcc

SEQ ID NO: 287770 - DNA, 20 bp, Artificial
  CRISPR gRNA sequence
gcaccaaaaatcttgtgccc

SEQ ID NO: 287771 - DNA, 20 bp, Artificial
  CRISPR gRNA sequence
gtgccccaaataaacccttt

SEQ ID NO: 287772 - DNA, 20 bp, Artificial
  CRISPR gRNA sequence
tgccccaaataaaccctttg

SEQ ID NO: 287773 - DNA, 20 bp, Artificial
  CRISPR gRNA sequence
tggttctgagcaaagaggat

SEQ ID NO: 287774 - DNA, 20 bp, Artificial
  CRISPR gRNA sequence
ggttctgagcaaagaggata

SEQ ID NO: 287775 - DNA, 20 bp, Artificial
  CRISPR gRNA sequence
gttctgagcaaagaggatac

SEQ ID NO: 287776 - DNA, 20 bp, Artificial
  CRISPR gRNA sequence
tgagcaaagaggatacctgg

SEQ ID NO: 287777 - DNA, 20 bp, Artificial
  CRISPR gRNA sequence
agcaaagaggatacctggtc

SEQ ID NO: 287778 - DNA, 20 bp, Artificial
  CRISPR gRNA sequence
gtcactctagccaaatgaga

SEQ ID NO: 287779 - DNA, 20 bp, Artificial
  CRISPR gRNA sequence
tagccaaatgagagcttaat

SEQ ID NO: 287780 - DNA, 20 bp, Artificial
  CRISPR gRNA sequence
gccaaatgagagcttaattc

SEQ ID NO: 287781 - DNA, 20 bp, Artificial
  CRISPR gRNA sequence
aattccttgcttctcaaatt

SEQ ID NO: 287782 - DNA, 20 bp, Artificial
  CRISPR gRNA sequence
attccttgcttctcaaattg

SEQ ID NO: 287783 - DNA, 20 bp, Artificial
  CRISPR gRNA sequence
cttgcttctcaaattgtggt

SEQ ID NO: 287784 - DNA, 20 bp, Artificial
  CRISPR gRNA sequence
gcttctcaaattgtggtcct

SEQ ID NO: 287785 - DNA, 20 bp, Artificial
  CRISPR gRNA sequence
cttctcaaattgtggtcctc

SEQ ID NO: 287786 - DNA, 20 bp, Artificial
  CRISPR gRNA sequence
ctcaaattgtggtcctccac

SEQ ID NO: 287787 - DNA, 20 bp, Artificial
  CRISPR gRNA sequence
tcaaattgtggtcctccaca

SEQ ID NO: 287788 - DNA, 20 bp, Artificial
  CRISPR gRNA sequence
aaattgtggtcctccacagc

SEQ ID NO: 287789 - DNA, 20 bp, Artificial
  CRISPR gRNA sequence
tggtcctccacagcagcaca

SEQ ID NO: 287790 - DNA, 20 bp, Artificial
  CRISPR gRNA sequence
cacagcagcacaggcatcac

SEQ ID NO: 287791 - DNA, 20 bp, Artificial
  CRISPR gRNA sequence
agagcttgttagaggtgcag

SEQ ID NO: 287792 - DNA, 20 bp, Artificial
  CRISPR gRNA sequence
gttagaggtgcagaatctca

SEQ ID NO: 287793 - DNA, 20 bp, Artificial
  CRISPR gRNA sequence
ttagaggtgcagaatctcag

SEQ ID NO: 287794 - DNA, 20 bp, Artificial
  CRISPR gRNA sequence
gaggtgcagaatctcagatc

SEQ ID NO: 287795 - DNA, 20 bp, Artificial
  CRISPR gRNA sequence
agatccaaaccccagaccta

SEQ ID NO: 287796 - DNA, 20 bp, Artificial
  CRISPR gRNA sequence
ctgaacttaaatctgcattt

SEQ ID NO: 287797 - DNA, 20 bp, Artificial
  CRISPR gRNA sequence
aacttaaatctgcattttta

SEQ ID NO: 287798 - DNA, 20 bp, Artificial
  CRISPR gRNA sequence
aaatctgcatttttaacaag

SEQ ID NO: 287799 - DNA, 20 bp, Artificial
  CRISPR gRNA sequence
aatctgcatttttaacaaga

SEQ ID NO: 287800 - DNA, 20 bp, Artificial
  CRISPR gRNA sequence
catttttaacaagaccctca

SEQ ID NO: 287801 - DNA, 20 bp, Artificial
  CRISPR gRNA sequence
ttaacaagaccctcaaatga

SEQ ID NO: 287802 - DNA, 20 bp, Artificial
  CRISPR gRNA sequence
taacaagaccctcaaatgac

SEQ ID NO: 287803 - DNA, 20 bp, Artificial
  CRISPR gRNA sequence
aacaagaccctcaaatgact

SEQ ID NO: 287804 - DNA, 20 bp, Artificial
  CRISPR gRNA sequence
acaagaccctcaaatgactc

SEQ ID NO: 287805 - DNA, 20 bp, Artificial
  CRISPR gRNA sequence
aaatgactcataggcttata

SEQ ID NO: 287806 - DNA, 20 bp, Artificial
  CRISPR gRNA sequence
ataggcttataagcatttga

SEQ ID NO: 287807 - DNA, 20 bp, Artificial
  CRISPR gRNA sequence
ataagcatttgagaaacact

SEQ ID NO: 287808 - DNA, 20 bp, Artificial
  CRISPR gRNA sequence
taagcatttgagaaacactg

SEQ ID NO: 287809 - DNA, 20 bp, Artificial
  CRISPR gRNA sequence
gagaaacactgctttgactc

SEQ ID NO: 287810 - DNA, 20 bp, Artificial
  CRISPR gRNA sequence
agaaacactgctttgactca

SEQ ID NO: 287811 - DNA, 20 bp, Artificial
  CRISPR gRNA sequence
ctttgactcaattggaaaat

SEQ ID NO: 287812 - DNA, 20 bp, Artificial
  CRISPR gRNA sequence
tgactcaattggaaaattca

SEQ ID NO: 287813 - DNA, 20 bp, Artificial
  CRISPR gRNA sequence
gactcaattggaaaattcag

SEQ ID NO: 287814 - DNA, 20 bp, Artificial
  CRISPR gRNA sequence
actcaattggaaaattcaga

SEQ ID NO: 287815 - DNA, 20 bp, Artificial
  CRISPR gRNA sequence
aattggaaaattcagaatgc

SEQ ID NO: 287816 - DNA, 20 bp, Artificial
  CRISPR gRNA sequence
gaaaattcagaatgcttctc

SEQ ID NO: 287817 - DNA, 20 bp, Artificial
  CRISPR gRNA sequence
agaatgcttctcagcaaaat

SEQ ID NO: 287818 - DNA, 20 bp, Artificial
  CRISPR gRNA sequence
ctcagcaaaattaagcgagt

SEQ ID NO: 287819 - DNA, 20 bp, Artificial
  CRISPR gRNA sequence
tcagcaaaattaagcgagtg

SEQ ID NO: 287820 - DNA, 20 bp, Artificial
  CRISPR gRNA sequence
agcaaaattaagcgagtgac

SEQ ID NO: 287821 - DNA, 20 bp, Artificial
  CRISPR gRNA sequence
agcgagtgacctttttgtct

SEQ ID NO: 287822 - DNA, 20 bp, Artificial
  CRISPR gRNA sequence
tttgtcttccctttactgga

SEQ ID NO: 287823 - DNA, 20 bp, Artificial
  CRISPR gRNA sequence
ttgtcttccctttactggat

SEQ ID NO: 287824 - DNA, 20 bp, Artificial
  CRISPR gRNA sequence
tgtcttccctttactggatt

SEQ ID NO: 287825 - DNA, 20 bp, Artificial
  CRISPR gRNA sequence
gtcttccctttactggattt

SEQ ID NO: 287826 - DNA, 20 bp, Artificial
  CRISPR gRNA sequence
tcttccctttactggatttt

SEQ ID NO: 287827 - DNA, 20 bp, Artificial
  CRISPR gRNA sequence
ccctttactggattttgtcc

SEQ ID NO: 287828 - DNA, 20 bp, Artificial
  CRISPR gRNA sequence
cctttactggattttgtcca

SEQ ID NO: 287829 - DNA, 20 bp, Artificial
  CRISPR gRNA sequence
tactggattttgtccaccca

SEQ ID NO: 287830 - DNA, 20 bp, Artificial
  CRISPR gRNA sequence
actggattttgtccacccac

SEQ ID NO: 287831 - DNA, 20 bp, Artificial
  CRISPR gRNA sequence
ctggattttgtccacccaca

SEQ ID NO: 287832 - DNA, 20 bp, Artificial
  CRISPR gRNA sequence
gattttgtccacccacacac

SEQ ID NO: 287833 - DNA, 20 bp, Artificial
  CRISPR gRNA sequence
tgtccacccacacaccctcg

SEQ ID NO: 287834 - DNA, 20 bp, Artificial
  CRISPR gRNA sequence
gtccacccacacaccctcgg

SEQ ID NO: 287835 - DNA, 20 bp, Artificial
  CRISPR gRNA sequence
tccacccacacaccctcggt

SEQ ID NO: 287836 - DNA, 20 bp, Artificial
  CRISPR gRNA sequence
ggttctgagtaccccagaaa

SEQ ID NO: 287837 - DNA, 20 bp, Artificial
  CRISPR gRNA sequence
tgagtaccccagaaatctca

SEQ ID NO: 287838 - DNA, 20 bp, Artificial
  CRISPR gRNA sequence
agtaccccagaaatctcaca

SEQ ID NO: 287839 - DNA, 20 bp, Artificial
  CRISPR gRNA sequence
acattgtccccttagctgtc

SEQ ID NO: 287840 - DNA, 20 bp, Artificial
  CRISPR gRNA sequence
tccccttagctgtccttggt

SEQ ID NO: 287841 - DNA, 20 bp, Artificial
  CRISPR gRNA sequence
agctgtccttggtctcttac

SEQ ID NO: 287842 - DNA, 20 bp, Artificial
  CRISPR gRNA sequence
gctgtccttggtctcttacg

SEQ ID NO: 287843 - DNA, 20 bp, Artificial
  CRISPR gRNA sequence
tccttggtctcttacggtaa

SEQ ID NO: 287844 - DNA, 20 bp, Artificial
  CRISPR gRNA sequence
ggtctcttacggtaatctgc

SEQ ID NO: 287845 - DNA, 20 bp, Artificial
  CRISPR gRNA sequence
gtctcttacggtaatctgct

SEQ ID NO: 287846 - DNA, 20 bp, Artificial
  CRISPR gRNA sequence
ttacggtaatctgctaatag

SEQ ID NO: 287847 - DNA, 20 bp, Artificial
  CRISPR gRNA sequence
acggtaatctgctaataggg

SEQ ID NO: 287848 - DNA, 20 bp, Artificial
  CRISPR gRNA sequence
cggtaatctgctaatagggc

SEQ ID NO: 287849 - DNA, 20 bp, Artificial
  CRISPR gRNA sequence
ctaatagggcctgcccccct

SEQ ID NO: 287850 - DNA, 20 bp, Artificial
  CRISPR gRNA sequence
atagggcctgccccccttga

SEQ ID NO: 287851 - DNA, 20 bp, Artificial
  CRISPR gRNA sequence
ccccccttgaaatgtttcct

SEQ ID NO: 287852 - DNA, 20 bp, Artificial
  CRISPR gRNA sequence
gaaatgtttccttttctcac

SEQ ID NO: 287853 - DNA, 20 bp, Artificial
  CRISPR gRNA sequence
aaatgtttccttttctcact

SEQ ID NO: 287854 - DNA, 20 bp, Artificial
  CRISPR gRNA sequence
ccttttctcactcttggatt

SEQ ID NO: 287855 - DNA, 20 bp, Artificial
  CRISPR gRNA sequence
cttttctcactcttggattt

SEQ ID NO: 287856 - DNA, 20 bp, Artificial
  CRISPR gRNA sequence
ttctcactcttggattttct

SEQ ID NO: 287857 - DNA, 20 bp, Artificial
  CRISPR gRNA sequence
tctcactcttggattttctt

SEQ ID NO: 287858 - DNA, 20 bp, Artificial
  CRISPR gRNA sequence
ctcactcttggattttcttc

SEQ ID NO: 287859 - DNA, 20 bp, Artificial
  CRISPR gRNA sequence
tcactcttggattttcttct

SEQ ID NO: 287860 - DNA, 20 bp, Artificial
  CRISPR gRNA sequence
actcttggattttcttcttt

SEQ ID NO: 287861 - DNA, 20 bp, Artificial
  CRISPR gRNA sequence
ttggattttcttctttatct

SEQ ID NO: 287862 - DNA, 20 bp, Artificial
  CRISPR gRNA sequence
ggattttcttctttatcttt

SEQ ID NO: 287863 - DNA, 20 bp, Artificial
  CRISPR gRNA sequence
gattttcttctttatctttc

SEQ ID NO: 287864 - DNA, 20 bp, Artificial
  CRISPR gRNA sequence
tcttctttatctttctatcc

SEQ ID NO: 287865 - DNA, 20 bp, Artificial
  CRISPR gRNA sequence
cttctttatctttctatcca

SEQ ID NO: 287866 - DNA, 20 bp, Artificial
  CRISPR gRNA sequence
ttctttatctttctatccaa

SEQ ID NO: 287867 - DNA, 20 bp, Artificial
  CRISPR gRNA sequence
ctttatctttctatccaaat

SEQ ID NO: 287868 - DNA, 20 bp, Artificial
  CRISPR gRNA sequence
tttatctttctatccaaatt

SEQ ID NO: 287869 - DNA, 20 bp, Artificial
  CRISPR gRNA sequence
tatctttctatccaaattca

SEQ ID NO: 287870 - DNA, 20 bp, Artificial
  CRISPR gRNA sequence
atctttctatccaaattcac

SEQ ID NO: 287871 - DNA, 20 bp, Artificial
  CRISPR gRNA sequence
tctttctatccaaattcacc

SEQ ID NO: 287872 - DNA, 20 bp, Artificial
  CRISPR gRNA sequence
tctatccaaattcacctgac

SEQ ID NO: 287873 - DNA, 20 bp, Artificial
  CRISPR gRNA sequence
ctatccaaattcacctgacc

SEQ ID NO: 287874 - DNA, 20 bp, Artificial
  CRISPR gRNA sequence
tatccaaattcacctgacct

SEQ ID NO: 287875 - DNA, 20 bp, Artificial
  CRISPR gRNA sequence
tccaaattcacctgacctga

SEQ ID NO: 287876 - DNA, 20 bp, Artificial
  CRISPR gRNA sequence
acctgacctgagtctacttc

SEQ ID NO: 287877 - DNA, 20 bp, Artificial
  CRISPR gRNA sequence
acctgagtctacttctctct

SEQ ID NO: 287878 - DNA, 20 bp, Artificial
  CRISPR gRNA sequence
agtctacttctctctcggta

SEQ ID NO: 287879 - DNA, 20 bp, Artificial
  CRISPR gRNA sequence
cttctctctcggtagtccat

SEQ ID NO: 287880 - DNA, 20 bp, Artificial
  CRISPR gRNA sequence
ctctctcggtagtccattag

SEQ ID NO: 287881 - DNA, 20 bp, Artificial
  CRISPR gRNA sequence
tctctcggtagtccattaga

SEQ ID NO: 287882 - DNA, 20 bp, Artificial
  CRISPR gRNA sequence
tctcggtagtccattagagg

SEQ ID NO: 287883 - DNA, 20 bp, Artificial
  CRISPR gRNA sequence
tcggtagtccattagaggac

SEQ ID NO: 287884 - DNA, 20 bp, Artificial
  CRISPR gRNA sequence
ggtagtccattagaggacta

SEQ ID NO: 287885 - DNA, 20 bp, Artificial
  CRISPR gRNA sequence
gaggactacgtacctaatgt

SEQ ID NO: 287886 - DNA, 20 bp, Artificial
  CRISPR gRNA sequence
cgtacctaatgtaattaact

SEQ ID NO: 287887 - DNA, 20 bp, Artificial
  CRISPR gRNA sequence
atgtaattaactaatacagg

SEQ ID NO: 287888 - DNA, 20 bp, Artificial
  CRISPR gRNA sequence
actaatacaggctaatatat

SEQ ID NO: 287889 - DNA, 20 bp, Artificial
  CRISPR gRNA sequence
atacaggctaatatatttgt

SEQ ID NO: 287890 - DNA, 20 bp, Artificial
  CRISPR gRNA sequence
atatatttgtggtgccaccc

SEQ ID NO: 287891 - DNA, 20 bp, Artificial
  CRISPR gRNA sequence
gtggtgccaccccccacccc

SEQ ID NO: 287892 - DNA, 20 bp, Artificial
  CRISPR gRNA sequence
tggtgccaccccccaccccc

SEQ ID NO: 287893 - DNA, 20 bp, Artificial
  CRISPR gRNA sequence
tcattttaacagggatcttt

SEQ ID NO: 287894 - DNA, 20 bp, Artificial
  CRISPR gRNA sequence
cattttaacagggatctttt

SEQ ID NO: 287895 - DNA, 20 bp, Artificial
  CRISPR gRNA sequence
attttaacagggatctttta

SEQ ID NO: 287896 - DNA, 20 bp, Artificial
  CRISPR gRNA sequence
taacagggatcttttaggag

SEQ ID NO: 287897 - DNA, 20 bp, Artificial
  CRISPR gRNA sequence
aacagggatcttttaggagg

SEQ ID NO: 287898 - DNA, 20 bp, Artificial
  CRISPR gRNA sequence
acagggatcttttaggagga

SEQ ID NO: 287899 - DNA, 20 bp, Artificial
  CRISPR gRNA sequence
ttaggaggaaaatggagaaa

SEQ ID NO: 287900 - DNA, 20 bp, Artificial
  CRISPR gRNA sequence
taggaggaaaatggagaaac

SEQ ID NO: 287901 - DNA, 20 bp, Artificial
  CRISPR gRNA sequence
aggaggaaaatggagaaact

SEQ ID NO: 287902 - DNA, 20 bp, Artificial
  CRISPR gRNA sequence
ggaggaaaatggagaaacta

SEQ ID NO: 287903 - DNA, 20 bp, Artificial
  CRISPR gRNA sequence
gcaggaatggctatgatgat

SEQ ID NO: 287904 - DNA, 20 bp, Artificial
  CRISPR gRNA sequence
tgatgatgagaatttcagga

SEQ ID NO: 287905 - DNA, 20 bp, Artificial
  CRISPR gRNA sequence
caggagtcaatgcaggtgaa

SEQ ID NO: 287906 - DNA, 20 bp, Artificial
  CRISPR gRNA sequence
aggagtcaatgcaggtgaaa

SEQ ID NO: 287907 - DNA, 20 bp, Artificial
  CRISPR gRNA sequence
cttagtacccctcaaatcac

SEQ ID NO: 287908 - DNA, 20 bp, Artificial
  CRISPR gRNA sequence
ttagtacccctcaaatcaca

SEQ ID NO: 287909 - DNA, 20 bp, Artificial
  CRISPR gRNA sequence
agtacccctcaaatcacatc

SEQ ID NO: 287910 - DNA, 20 bp, Artificial
  CRISPR gRNA sequence
gtacccctcaaatcacatca

SEQ ID NO: 287911 - DNA, 20 bp, Artificial
  CRISPR gRNA sequence
aaatcacatcaccatataat

SEQ ID NO: 287912 - DNA, 20 bp, Artificial
  CRISPR gRNA sequence
attctatccaagagcagaga

SEQ ID NO: 287913 - DNA, 20 bp, Artificial
  CRISPR gRNA sequence
ttctatccaagagcagagaa

SEQ ID NO: 287914 - DNA, 20 bp, Artificial
  CRISPR gRNA sequence
tatccaagagcagagaaaac

SEQ ID NO: 287915 - DNA, 20 bp, Artificial
  CRISPR gRNA sequence
tccaagagcagagaaaacac

SEQ ID NO: 287916 - DNA, 20 bp, Artificial
  CRISPR gRNA sequence
agtgaagtttaagatagttc

SEQ ID NO: 287917 - DNA, 20 bp, Artificial
  CRISPR gRNA sequence
aagatagttccatgtaactt

SEQ ID NO: 287918 - DNA, 20 bp, Artificial
  CRISPR gRNA sequence
agatagttccatgtaacttt

SEQ ID NO: 287919 - DNA, 20 bp, Artificial
  CRISPR gRNA sequence
catgtaactttggcttactc

SEQ ID NO: 287920 - DNA, 20 bp, Artificial
  CRISPR gRNA sequence
tggcttactccccacaactt

SEQ ID NO: 287921 - DNA, 20 bp, Artificial
  CRISPR gRNA sequence
ggcttactccccacaacttt

SEQ ID NO: 287922 - DNA, 20 bp, Artificial
  CRISPR gRNA sequence
gcttactccccacaacttta

SEQ ID NO: 287923 - DNA, 20 bp, Artificial
  CRISPR gRNA sequence
actccccacaactttaggtg

SEQ ID NO: 287924 - DNA, 20 bp, Artificial
  CRISPR gRNA sequence
ctccccacaactttaggtgt

SEQ ID NO: 287925 - DNA, 20 bp, Artificial
  CRISPR gRNA sequence
cccacaactttaggtgtgat

SEQ ID NO: 287926 - DNA, 20 bp, Artificial
  CRISPR gRNA sequence
taggtgtgatctggatgtca

SEQ ID NO: 287927 - DNA, 20 bp, Artificial
  CRISPR gRNA sequence
aggtgtgatctggatgtcac

SEQ ID NO: 287928 - DNA, 20 bp, Artificial
  CRISPR gRNA sequence
ggtgtgatctggatgtcaca

SEQ ID NO: 287929 - DNA, 20 bp, Artificial
  CRISPR gRNA sequence
gatgtcacaagtaaagattc

SEQ ID NO: 287930 - DNA, 20 bp, Artificial
  CRISPR gRNA sequence
atagctaatgattaaaacaa

SEQ ID NO: 287931 - DNA, 20 bp, Artificial
  CRISPR gRNA sequence
atgattaaaacaaagaacag

SEQ ID NO: 287932 - DNA, 20 bp, Artificial
  CRISPR gRNA sequence
aaacaaagaacagtaaggaa

SEQ ID NO: 287933 - DNA, 20 bp, Artificial
  CRISPR gRNA sequence
actacggatctgctgaagtt

SEQ ID NO: 287934 - DNA, 20 bp, Artificial
  CRISPR gRNA sequence
cggatctgctgaagttatct

SEQ ID NO: 287935 - DNA, 20 bp, Artificial
  CRISPR gRNA sequence
ctgaagttatctattatcaa

SEQ ID NO: 287936 - DNA, 20 bp, Artificial
  CRISPR gRNA sequence
aagttatctattatcaaggt

SEQ ID NO: 287937 - DNA, 20 bp, Artificial
  CRISPR gRNA sequence
tctattatcaaggttaatca

SEQ ID NO: 287938 - DNA, 20 bp, Artificial
  CRISPR gRNA sequence
ttatcaaggttaatcattat

SEQ ID NO: 287939 - DNA, 20 bp, Artificial
  CRISPR gRNA sequence
tcaaggttaatcattatgtt

SEQ ID NO: 287940 - DNA, 20 bp, Artificial
  CRISPR gRNA sequence
atcattatgttttattaagt

SEQ ID NO: 287941 - DNA, 20 bp, Artificial
  CRISPR gRNA sequence
tgttttattaagtaagaagt

SEQ ID NO: 287942 - DNA, 20 bp, Artificial
  CRISPR gRNA sequence
tattaagtaagaagtttggt

SEQ ID NO: 287943 - DNA, 20 bp, Artificial
  CRISPR gRNA sequence
attaagtaagaagtttggtt

SEQ ID NO: 287944 - DNA, 20 bp, Artificial
  CRISPR gRNA sequence
ttaagtaagaagtttggttt

SEQ ID NO: 287945 - DNA, 20 bp, Artificial
  CRISPR gRNA sequence
agtaagaagtttggttttca

SEQ ID NO: 287946 - DNA, 20 bp, Artificial
  CRISPR gRNA sequence
ggttttcactagaggctcaa

SEQ ID NO: 287947 - DNA, 20 bp, Artificial
  CRISPR gRNA sequence
gttttcactagaggctcaag

SEQ ID NO: 287948 - DNA, 20 bp, Artificial
  CRISPR gRNA sequence
tcactagaggctcaagtccc

SEQ ID NO: 287949 - DNA, 20 bp, Artificial
  CRISPR gRNA sequence
cactagaggctcaagtccca

SEQ ID NO: 287950 - DNA, 20 bp, Artificial
  CRISPR gRNA sequence
actagaggctcaagtcccag

SEQ ID NO: 287951 - DNA, 20 bp, Artificial
  CRISPR gRNA sequence
gaggctcaagtcccagggga

SEQ ID NO: 287952 - DNA, 20 bp, Artificial
  CRISPR gRNA sequence
aagtcccaggggaaaaagaa

SEQ ID NO: 287953 - DNA, 20 bp, Artificial
  CRISPR gRNA sequence
aaatttcaactgtgagaaaa

SEQ ID NO: 287954 - DNA, 20 bp, Artificial
  CRISPR gRNA sequence
caactgtgagaaaatggctc

SEQ ID NO: 287955 - DNA, 20 bp, Artificial
  CRISPR gRNA sequence
aactgtgagaaaatggctca

SEQ ID NO: 287956 - DNA, 20 bp, Artificial
  CRISPR gRNA sequence
tgagaaaatggctcagggat

SEQ ID NO: 287957 - DNA, 20 bp, Artificial
  CRISPR gRNA sequence
agggatataatttctcaaaa

SEQ ID NO: 287958 - DNA, 20 bp, Artificial
  CRISPR gRNA sequence
ctcaaaaagggctctggctc

SEQ ID NO: 287959 - DNA, 20 bp, Artificial
  CRISPR gRNA sequence
tcaaaaagggctctggctcc

SEQ ID NO: 287960 - DNA, 20 bp, Artificial
  CRISPR gRNA sequence
aaaaagggctctggctcctt

SEQ ID NO: 287961 - DNA, 20 bp, Artificial
  CRISPR gRNA sequence
tggctccttcagtatcctct

SEQ ID NO: 287962 - DNA, 20 bp, Artificial
  CRISPR gRNA sequence
gctccttcagtatcctctgt

SEQ ID NO: 287963 - DNA, 20 bp, Artificial
  CRISPR gRNA sequence
cttcagtatcctctgttata

SEQ ID NO: 287964 - DNA, 20 bp, Artificial
  CRISPR gRNA sequence
cagtatcctctgttatactg

SEQ ID NO: 287965 - DNA, 20 bp, Artificial
  CRISPR gRNA sequence
agtatcctctgttatactgt

SEQ ID NO: 287966 - DNA, 20 bp, Artificial
  CRISPR gRNA sequence
tgttatactgtaattaaagt

SEQ ID NO: 287967 - DNA, 20 bp, Artificial
  CRISPR gRNA sequence
ttatactgtaattaaagtga

SEQ ID NO: 287968 - DNA, 20 bp, Artificial
  CRISPR gRNA sequence
tactgtaattaaagtgaaac

SEQ ID NO: 287969 - DNA, 20 bp, Artificial
  CRISPR gRNA sequence
taattaaagtgaaaccccct

SEQ ID NO: 287970 - DNA, 20 bp, Artificial
  CRISPR gRNA sequence
aagtgaaaccccctttgcaa

SEQ ID NO: 287971 - DNA, 20 bp, Artificial
  CRISPR gRNA sequence
tgcaaaattatgactgagac

SEQ ID NO: 287972 - DNA, 20 bp, Artificial
  CRISPR gRNA sequence
gcaaaattatgactgagaca

SEQ ID NO: 287973 - DNA, 20 bp, Artificial
  CRISPR gRNA sequence
caaaattatgactgagacag

SEQ ID NO: 287974 - DNA, 20 bp, Artificial
  CRISPR gRNA sequence
tgactgagacagtgaaagag

SEQ ID NO: 287975 - DNA, 20 bp, Artificial
  CRISPR gRNA sequence
agacagtgaaagagatctaa

SEQ ID NO: 287976 - DNA, 20 bp, Artificial
  CRISPR gRNA sequence
acttaactgactccatcttg

SEQ ID NO: 287977 - DNA, 20 bp, Artificial
  CRISPR gRNA sequence
aactgactccatcttgcttc

SEQ ID NO: 287978 - DNA, 20 bp, Artificial
  CRISPR gRNA sequence
actgactccatcttgcttct

SEQ ID NO: 287979 - DNA, 20 bp, Artificial
  CRISPR gRNA sequence
actccatcttgcttctaacc

SEQ ID NO: 287980 - DNA, 20 bp, Artificial
  CRISPR gRNA sequence
catcttgcttctaacctcca

SEQ ID NO: 287981 - DNA, 20 bp, Artificial
  CRISPR gRNA sequence
gcttctaacctccaagctat

SEQ ID NO: 287982 - DNA, 20 bp, Artificial
  CRISPR gRNA sequence
cttctaacctccaagctatc

SEQ ID NO: 287983 - DNA, 20 bp, Artificial
  CRISPR gRNA sequence
ctaacctccaagctatcttt

SEQ ID NO: 287984 - DNA, 20 bp, Artificial
  CRISPR gRNA sequence
taacctccaagctatctttg

SEQ ID NO: 287985 - DNA, 20 bp, Artificial
  CRISPR gRNA sequence
acctccaagctatctttgtt

SEQ ID NO: 287986 - DNA, 20 bp, Artificial
  CRISPR gRNA sequence
caagctatctttgttcactc

SEQ ID NO: 287987 - DNA, 20 bp, Artificial
  CRISPR gRNA sequence
tctttgttcactcctgggtg

SEQ ID NO: 287988 - DNA, 20 bp, Artificial
  CRISPR gRNA sequence
tgttcactcctgggtgtagg

SEQ ID NO: 287989 - DNA, 20 bp, Artificial
  CRISPR gRNA sequence
gttcactcctgggtgtaggc

SEQ ID NO: 287990 - DNA, 20 bp, Artificial
  CRISPR gRNA sequence
ttcactcctgggtgtaggct

SEQ ID NO: 287991 - DNA, 20 bp, Artificial
  CRISPR gRNA sequence
actcctgggtgtaggctgaa

SEQ ID NO: 287992 - DNA, 20 bp, Artificial
  CRISPR gRNA sequence
ctgggtgtaggctgaactaa

SEQ ID NO: 287993 - DNA, 20 bp, Artificial
  CRISPR gRNA sequence
ggtgtaggctgaactaactt

SEQ ID NO: 287994 - DNA, 20 bp, Artificial
  CRISPR gRNA sequence
aactaactttggtagaaact

SEQ ID NO: 287995 - DNA, 20 bp, Artificial
  CRISPR gRNA sequence
actttggtagaaacttagtt

SEQ ID NO: 287996 - DNA, 20 bp, Artificial
  CRISPR gRNA sequence
tggtagaaacttagtttata

SEQ ID NO: 287997 - DNA, 20 bp, Artificial
  CRISPR gRNA sequence
ggtagaaacttagtttatag

SEQ ID NO: 287998 - DNA, 20 bp, Artificial
  CRISPR gRNA sequence
gtagaaacttagtttatagt

SEQ ID NO: 287999 - DNA, 20 bp, Artificial
  CRISPR gRNA sequence
agtttatagtttatagttta

SEQ ID NO: 288000 - DNA, 20 bp, Artificial
  CRISPR gRNA sequence
gtttatagtttatagtttaa

SEQ ID NO: 288001 - DNA, 20 bp, Artificial
  CRISPR gRNA sequence
atagtttatagtttaaacaa

SEQ ID NO: 288002 - DNA, 20 bp, Artificial
  CRISPR gRNA sequence
tagtttatagtttaaacaaa

SEQ ID NO: 288003 - DNA, 20 bp, Artificial
  CRISPR gRNA sequence
atagtttaaacaaagatggt

SEQ ID NO: 288004 - DNA, 20 bp, Artificial
  CRISPR gRNA sequence
tagtttaaacaaagatggta

SEQ ID NO: 288005 - DNA, 20 bp, Artificial
  CRISPR gRNA sequence
aaacaaagatggtaacagcc

SEQ ID NO: 288006 - DNA, 20 bp, Artificial
  CRISPR gRNA sequence
aacaaagatggtaacagccc

SEQ ID NO: 288007 - DNA, 20 bp, Artificial
  CRISPR gRNA sequence
tcccaaagcagacctccttc

SEQ ID NO: 288008 - DNA, 20 bp, Artificial
  CRISPR gRNA sequence
cccaaagcagacctccttct

SEQ ID NO: 288009 - DNA, 20 bp, Artificial
  CRISPR gRNA sequence
ccaaagcagacctccttctt

SEQ ID NO: 288010 - DNA, 20 bp, Artificial
  CRISPR gRNA sequence
cttcttgcctggggagtaga

SEQ ID NO: 288011 - DNA, 20 bp, Artificial
  CRISPR gRNA sequence
cttgcctggggagtagattg

SEQ ID NO: 288012 - DNA, 20 bp, Artificial
  CRISPR gRNA sequence
ttgcctggggagtagattgc

SEQ ID NO: 288013 - DNA, 20 bp, Artificial
  CRISPR gRNA sequence
gcctggggagtagattgcct

SEQ ID NO: 288014 - DNA, 20 bp, Artificial
  CRISPR gRNA sequence
cctggggagtagattgcctt

SEQ ID NO: 288015 - DNA, 20 bp, Artificial
  CRISPR gRNA sequence
gggagtagattgcctttgta

SEQ ID NO: 288016 - DNA, 20 bp, Artificial
  CRISPR gRNA sequence
cctttgtaggactaacatta

SEQ ID NO: 288017 - DNA, 20 bp, Artificial
  CRISPR gRNA sequence
tgtaggactaacattagcca

SEQ ID NO: 288018 - DNA, 20 bp, Artificial
  CRISPR gRNA sequence
gtaggactaacattagccac

SEQ ID NO: 288019 - DNA, 20 bp, Artificial
  CRISPR gRNA sequence
taggactaacattagccaca

SEQ ID NO: 288020 - DNA, 20 bp, Artificial
  CRISPR gRNA sequence
acattagccacaagattaga

SEQ ID NO: 288021 - DNA, 20 bp, Artificial
  CRISPR gRNA sequence
gccacaagattagaaattat

SEQ ID NO: 288022 - DNA, 20 bp, Artificial
  CRISPR gRNA sequence
gaaattatggtttaggagtc

SEQ ID NO: 288023 - DNA, 20 bp, Artificial
  CRISPR gRNA sequence
tggtttaggagtcataaagc

SEQ ID NO: 288024 - DNA, 20 bp, Artificial
  CRISPR gRNA sequence
aggagtcataaagctggatg

SEQ ID NO: 288025 - DNA, 20 bp, Artificial
  CRISPR gRNA sequence
ggagtcataaagctggatgc

SEQ ID NO: 288026 - DNA, 20 bp, Artificial
  CRISPR gRNA sequence
gatgctatgagattctgacc

SEQ ID NO: 288027 - DNA, 20 bp, Artificial
  CRISPR gRNA sequence
tgagattctgaccctcccta

SEQ ID NO: 288028 - DNA, 20 bp, Artificial
  CRISPR gRNA sequence
tgaccctccctaaactgctc

SEQ ID NO: 288029 - DNA, 20 bp, Artificial
  CRISPR gRNA sequence
accctccctaaactgctcct

SEQ ID NO: 288030 - DNA, 20 bp, Artificial
  CRISPR gRNA sequence
cctaaactgctcctaagatc

SEQ ID NO: 288031 - DNA, 20 bp, Artificial
  CRISPR gRNA sequence
aactgctcctaagatcagtg

SEQ ID NO: 288032 - DNA, 20 bp, Artificial
  CRISPR gRNA sequence
ctcctaagatcagtgcttga

SEQ ID NO: 288033 - DNA, 20 bp, Artificial
  CRISPR gRNA sequence
ctaagatcagtgcttgagct

SEQ ID NO: 288034 - DNA, 20 bp, Artificial
  CRISPR gRNA sequence
agatcagtgcttgagctatt

SEQ ID NO: 288035 - DNA, 20 bp, Artificial
  CRISPR gRNA sequence
gagctattttgcagcccctg

SEQ ID NO: 288036 - DNA, 20 bp, Artificial
  CRISPR gRNA sequence
agctattttgcagcccctgc

SEQ ID NO: 288037 - DNA, 20 bp, Artificial
  CRISPR gRNA sequence
ttttgcagcccctgcacttg

SEQ ID NO: 288038 - DNA, 20 bp, Artificial
  CRISPR gRNA sequence
tgcagcccctgcacttgatg

SEQ ID NO: 288039 - DNA, 20 bp, Artificial
  CRISPR gRNA sequence
gcagcccctgcacttgatgg

SEQ ID NO: 288040 - DNA, 20 bp, Artificial
  CRISPR gRNA sequence
cagcccctgcacttgatgga

SEQ ID NO: 288041 - DNA, 20 bp, Artificial
  CRISPR gRNA sequence
cacttgatggatcagctggc

SEQ ID NO: 288042 - DNA, 20 bp, Artificial
  CRISPR gRNA sequence
gatggatcagctggcaccac

SEQ ID NO: 288043 - DNA, 20 bp, Artificial
  CRISPR gRNA sequence
atggatcagctggcaccacc

SEQ ID NO: 288044 - DNA, 20 bp, Artificial
  CRISPR gRNA sequence
gcaccacccagatcaataaa

SEQ ID NO: 288045 - DNA, 20 bp, Artificial
  CRISPR gRNA sequence
actcatctgatcttgtggcc

SEQ ID NO: 288046 - DNA, 20 bp, Artificial
  CRISPR gRNA sequence
atctgatcttgtggcccccc

SEQ ID NO: 288047 - DNA, 20 bp, Artificial
  CRISPR gRNA sequence
atcttgtggccccccaaccc

SEQ ID NO: 288048 - DNA, 20 bp, Artificial
  CRISPR gRNA sequence
gtggccccccaacccagtgc

SEQ ID NO: 288049 - DNA, 20 bp, Artificial
  CRISPR gRNA sequence
tggccccccaacccagtgca

SEQ ID NO: 288050 - DNA, 20 bp, Artificial
  CRISPR gRNA sequence
caactccctatggtatcatc

SEQ ID NO: 288051 - DNA, 20 bp, Artificial
  CRISPR gRNA sequence
aactccctatggtatcatcc

SEQ ID NO: 288052 - DNA, 20 bp, Artificial
  CRISPR gRNA sequence
cctatggtatcatccctgac

SEQ ID NO: 288053 - DNA, 20 bp, Artificial
  CRISPR gRNA sequence
tggtatcatccctgaccaat

SEQ ID NO: 288054 - DNA, 20 bp, Artificial
  CRISPR gRNA sequence
accaatcagcactcccagct

SEQ ID NO: 288055 - DNA, 20 bp, Artificial
  CRISPR gRNA sequence
ccagctcactggcttccccc

SEQ ID NO: 288056 - DNA, 20 bp, Artificial
  CRISPR gRNA sequence
actggcttcccccgacccac

SEQ ID NO: 288057 - DNA, 20 bp, Artificial
  CRISPR gRNA sequence
gcttcccccgacccacctag

SEQ ID NO: 288058 - DNA, 20 bp, Artificial
  CRISPR gRNA sequence
cccccgacccacctagttat

SEQ ID NO: 288059 - DNA, 20 bp, Artificial
  CRISPR gRNA sequence
ccccgacccacctagttatc

SEQ ID NO: 288060 - DNA, 20 bp, Artificial
  CRISPR gRNA sequence
gttatccttaaaaactctgc

SEQ ID NO: 288061 - DNA, 20 bp, Artificial
  CRISPR gRNA sequence
tccttaaaaactctgctccc

SEQ ID NO: 288062 - DNA, 20 bp, Artificial
  CRISPR gRNA sequence
aaaaactctgctccccagat

SEQ ID NO: 288063 - DNA, 20 bp, Artificial
  CRISPR gRNA sequence
aaaactctgctccccagatg

SEQ ID NO: 288064 - DNA, 20 bp, Artificial
  CRISPR gRNA sequence
tgctccccagatgcttggag

SEQ ID NO: 288065 - DNA, 20 bp, Artificial
  CRISPR gRNA sequence
ctccccagatgcttggagag

SEQ ID NO: 288066 - DNA, 20 bp, Artificial
  CRISPR gRNA sequence
cccagatgcttggagagact

SEQ ID NO: 288067 - DNA, 20 bp, Artificial
  CRISPR gRNA sequence
ggagagactgatttgagtaa

SEQ ID NO: 288068 - DNA, 20 bp, Artificial
  CRISPR gRNA sequence
gagagactgatttgagtaat

SEQ ID NO: 288069 - DNA, 20 bp, Artificial
  CRISPR gRNA sequence
atttgagtaatgataaaact

SEQ ID NO: 288070 - DNA, 20 bp, Artificial
  CRISPR gRNA sequence
gagtaatgataaaactccgg

SEQ ID NO: 288071 - DNA, 20 bp, Artificial
  CRISPR gRNA sequence
agtaatgataaaactccggt

SEQ ID NO: 288072 - DNA, 20 bp, Artificial
  CRISPR gRNA sequence
cggtctcccgcacagccagt

SEQ ID NO: 288073 - DNA, 20 bp, Artificial
  CRISPR gRNA sequence
ccgcacagccagttgtgcgt

SEQ ID NO: 288074 - DNA, 20 bp, Artificial
  CRISPR gRNA sequence
tgcgtaaattactctctcta

SEQ ID NO: 288075 - DNA, 20 bp, Artificial
  CRISPR gRNA sequence
ctctctctattgcaattccc

SEQ ID NO: 288076 - DNA, 20 bp, Artificial
  CRISPR gRNA sequence
tctctattgcaattcccctg

SEQ ID NO: 288077 - DNA, 20 bp, Artificial
  CRISPR gRNA sequence
tctattgcaattcccctgtc

SEQ ID NO: 288078 - DNA, 20 bp, Artificial
  CRISPR gRNA sequence
tattgcaattcccctgtctt

SEQ ID NO: 288079 - DNA, 20 bp, Artificial
  CRISPR gRNA sequence
ttgcaattcccctgtcttga

SEQ ID NO: 288080 - DNA, 20 bp, Artificial
  CRISPR gRNA sequence
caattcccctgtcttgatga

SEQ ID NO: 288081 - DNA, 20 bp, Artificial
  CRISPR gRNA sequence
ccctgtcttgatgaattggc

SEQ ID NO: 288082 - DNA, 20 bp, Artificial
  CRISPR gRNA sequence
tcttgatgaattggctctat

SEQ ID NO: 288083 - DNA, 20 bp, Artificial
  CRISPR gRNA sequence
gatgaattggctctatctac

SEQ ID NO: 288084 - DNA, 20 bp, Artificial
  CRISPR gRNA sequence
atgaattggctctatctacg

SEQ ID NO: 288085 - DNA, 20 bp, Artificial
  CRISPR gRNA sequence
gctctatctacgcagcaggc

SEQ ID NO: 288086 - DNA, 20 bp, Artificial
  CRISPR gRNA sequence
tatctacgcagcaggcgagg

SEQ ID NO: 288087 - DNA, 20 bp, Artificial
  CRISPR gRNA sequence
tctacgcagcaggcgaggta

SEQ ID NO: 288088 - DNA, 20 bp, Artificial
  CRISPR gRNA sequence
cgcagcaggcgaggtaaacc

SEQ ID NO: 288089 - DNA, 20 bp, Artificial
  CRISPR gRNA sequence
ttgggtggttacaaaagcaa

SEQ ID NO: 288090 - DNA, 20 bp, Artificial
  CRISPR gRNA sequence
gggtggttacaaaagcaagg

SEQ ID NO: 288091 - DNA, 20 bp, Artificial
  CRISPR gRNA sequence
ggtggttacaaaagcaaggg

SEQ ID NO: 288092 - DNA, 20 bp, Artificial
  CRISPR gRNA sequence
caaaagcaagggtcctttct

SEQ ID NO: 288093 - DNA, 20 bp, Artificial
  CRISPR gRNA sequence
tctttccgagaccagaaatg

SEQ ID NO: 288094 - DNA, 20 bp, Artificial
  CRISPR gRNA sequence
ctttccgagaccagaaatgc

SEQ ID NO: 288095 - DNA, 20 bp, Artificial
  CRISPR gRNA sequence
tttccgagaccagaaatgct

SEQ ID NO: 288096 - DNA, 20 bp, Artificial
  CRISPR gRNA sequence
tccgagaccagaaatgcttg

SEQ ID NO: 288097 - DNA, 20 bp, Artificial
  CRISPR gRNA sequence
ccgagaccagaaatgcttgc

SEQ ID NO: 288098 - DNA, 20 bp, Artificial
  CRISPR gRNA sequence
cgagaccagaaatgcttgcc

SEQ ID NO: 288099 - DNA, 20 bp, Artificial
  CRISPR gRNA sequence
gccttccacagtaggtacat

SEQ ID NO: 288100 - DNA, 20 bp, Artificial
  CRISPR gRNA sequence
ccttccacagtaggtacata

SEQ ID NO: 288101 - DNA, 20 bp, Artificial
  CRISPR gRNA sequence
ccacagtaggtacataaaca

SEQ ID NO: 288102 - DNA, 20 bp, Artificial
  CRISPR gRNA sequence
cacagtaggtacataaacag

SEQ ID NO: 288103 - DNA, 20 bp, Artificial
  CRISPR gRNA sequence
tgattcataaattagttttt

SEQ ID NO: 288104 - DNA, 20 bp, Artificial
  CRISPR gRNA sequence
gattcataaattagtttttt

SEQ ID NO: 288105 - DNA, 20 bp, Artificial
  CRISPR gRNA sequence
attcataaattagttttttt

SEQ ID NO: 288106 - DNA, 20 bp, Artificial
  CRISPR gRNA sequence
ataaattagtttttttcctt

SEQ ID NO: 288107 - DNA, 20 bp, Artificial
  CRISPR gRNA sequence
gtttttttccttgtggcagg

SEQ ID NO: 288108 - DNA, 20 bp, Artificial
  CRISPR gRNA sequence
ttttccttgtggcaggaatt

SEQ ID NO: 288109 - DNA, 20 bp, Artificial
  CRISPR gRNA sequence
tttccttgtggcaggaatta

SEQ ID NO: 288110 - DNA, 20 bp, Artificial
  CRISPR gRNA sequence
ttccttgtggcaggaattaa

SEQ ID NO: 288111 - DNA, 20 bp, Artificial
  CRISPR gRNA sequence
tccttgtggcaggaattaat

SEQ ID NO: 288112 - DNA, 20 bp, Artificial
  CRISPR gRNA sequence
ccttgtggcaggaattaatt

SEQ ID NO: 288113 - DNA, 20 bp, Artificial
  CRISPR gRNA sequence
cttgtggcaggaattaatta

SEQ ID NO: 288114 - DNA, 20 bp, Artificial
  CRISPR gRNA sequence
gtggcaggaattaattatgc

SEQ ID NO: 288115 - DNA, 20 bp, Artificial
  CRISPR gRNA sequence
tggcaggaattaattatgca

SEQ ID NO: 288116 - DNA, 20 bp, Artificial
  CRISPR gRNA sequence
attatgcatccaattctcta

SEQ ID NO: 288117 - DNA, 20 bp, Artificial
  CRISPR gRNA sequence
tgcatccaattctctaactt

SEQ ID NO: 288118 - DNA, 20 bp, Artificial
  CRISPR gRNA sequence
tctaactttttttttttttt

SEQ ID NO: 288119 - DNA, 20 bp, Artificial
  CRISPR gRNA sequence
taacttttttttttttttaa

SEQ ID NO: 288120 - DNA, 20 bp, Artificial
  CRISPR gRNA sequence
acttttttttttttttaaga

SEQ ID NO: 288121 - DNA, 20 bp, Artificial
  CRISPR gRNA sequence
ttttttttttttaagacaga

SEQ ID NO: 288122 - DNA, 20 bp, Artificial
  CRISPR gRNA sequence
tttttttttttaagacagag

SEQ ID NO: 288123 - DNA, 20 bp, Artificial
  CRISPR gRNA sequence
ttttttttttaagacagagt

SEQ ID NO: 288124 - DNA, 20 bp, Artificial
  CRISPR gRNA sequence
tttttttttaagacagagtc

SEQ ID NO: 288125 - DNA, 20 bp, Artificial
  CRISPR gRNA sequence
ttttttttaagacagagtct

SEQ ID NO: 288126 - DNA, 20 bp, Artificial
  CRISPR gRNA sequence
tttttttaagacagagtctc

SEQ ID NO: 288127 - DNA, 20 bp, Artificial
  CRISPR gRNA sequence
ttttttaagacagagtctct

SEQ ID NO: 288128 - DNA, 20 bp, Artificial
  CRISPR gRNA sequence
tttttaagacagagtctcta

SEQ ID NO: 288129 - DNA, 20 bp, Artificial
  CRISPR gRNA sequence
ttttaagacagagtctctac

SEQ ID NO: 288130 - DNA, 20 bp, Artificial
  CRISPR gRNA sequence
tttaagacagagtctctacc

SEQ ID NO: 288131 - DNA, 20 bp, Artificial
  CRISPR gRNA sequence
ttaagacagagtctctacca

SEQ ID NO: 288132 - DNA, 20 bp, Artificial
  CRISPR gRNA sequence
taagacagagtctctaccag

SEQ ID NO: 288133 - DNA, 20 bp, Artificial
  CRISPR gRNA sequence
aagacagagtctctaccagt

SEQ ID NO: 288134 - DNA, 20 bp, Artificial
  CRISPR gRNA sequence
agacagagtctctaccagta

SEQ ID NO: 288135 - DNA, 20 bp, Artificial
  CRISPR gRNA sequence
taccagtagggaaatgctca

SEQ ID NO: 288136 - DNA, 20 bp, Artificial
  CRISPR gRNA sequence
ccagtagggaaatgctcacc

SEQ ID NO: 288137 - DNA, 20 bp, Artificial
  CRISPR gRNA sequence
accctcctctgtagtctact

SEQ ID NO: 288138 - DNA, 20 bp, Artificial
  CRISPR gRNA sequence
ctctgtagtctacttttttt

SEQ ID NO: 288139 - DNA, 20 bp, Artificial
  CRISPR gRNA sequence
tgtagtctactttttttttt

SEQ ID NO: 288140 - DNA, 20 bp, Artificial
  CRISPR gRNA sequence
tagtctactttttttttttt

SEQ ID NO: 288141 - DNA, 20 bp, Artificial
  CRISPR gRNA sequence
ctttttttttttttgaaaca

SEQ ID NO: 288142 - DNA, 20 bp, Artificial
  CRISPR gRNA sequence
tttttttttttgaaacagtc

SEQ ID NO: 288143 - DNA, 20 bp, Artificial
  CRISPR gRNA sequence
ttttttttttgaaacagtct

SEQ ID NO: 288144 - DNA, 20 bp, Artificial
  CRISPR gRNA sequence
tttttttttgaaacagtctt

SEQ ID NO: 288145 - DNA, 20 bp, Artificial
  CRISPR gRNA sequence
ttttttttgaaacagtcttt

SEQ ID NO: 288146 - DNA, 20 bp, Artificial
  CRISPR gRNA sequence
tttttttgaaacagtctttg

SEQ ID NO: 288147 - DNA, 20 bp, Artificial
  CRISPR gRNA sequence
ttttttgaaacagtctttgc

SEQ ID NO: 288148 - DNA, 20 bp, Artificial
  CRISPR gRNA sequence
tttttgaaacagtctttgct

SEQ ID NO: 288149 - DNA, 20 bp, Artificial
  CRISPR gRNA sequence
ttttgaaacagtctttgctc

SEQ ID NO: 288150 - DNA, 20 bp, Artificial
  CRISPR gRNA sequence
tttgaaacagtctttgctct

SEQ ID NO: 288151 - DNA, 20 bp, Artificial
  CRISPR gRNA sequence
ttgaaacagtctttgctctg

SEQ ID NO: 288152 - DNA, 20 bp, Artificial
  CRISPR gRNA sequence
tgaaacagtctttgctctgt

SEQ ID NO: 288153 - DNA, 20 bp, Artificial
  CRISPR gRNA sequence
gaaacagtctttgctctgtc

SEQ ID NO: 288154 - DNA, 20 bp, Artificial
  CRISPR gRNA sequence
aaacagtctttgctctgtca

SEQ ID NO: 288155 - DNA, 20 bp, Artificial
  CRISPR gRNA sequence
tgctctgtcaccaaggctgg

SEQ ID NO: 288156 - DNA, 20 bp, Artificial
  CRISPR gRNA sequence
gctctgtcaccaaggctgga

SEQ ID NO: 288157 - DNA, 20 bp, Artificial
  CRISPR gRNA sequence
ctctgtcaccaaggctggag

SEQ ID NO: 288158 - DNA, 20 bp, Artificial
  CRISPR gRNA sequence
tgtcaccaaggctggagtgc

SEQ ID NO: 288159 - DNA, 20 bp, Artificial
  CRISPR gRNA sequence
tcaccaaggctggagtgcag

SEQ ID NO: 288160 - DNA, 20 bp, Artificial
  CRISPR gRNA sequence
gagtgcagtggcaccatctc

SEQ ID NO: 288161 - DNA, 20 bp, Artificial
  CRISPR gRNA sequence
tgctcactgcaacctccgcc

SEQ ID NO: 288162 - DNA, 20 bp, Artificial
  CRISPR gRNA sequence
ctcactgcaacctccgcctc

SEQ ID NO: 288163 - DNA, 20 bp, Artificial
  CRISPR gRNA sequence
actgcaacctccgcctccca

SEQ ID NO: 288164 - DNA, 20 bp, Artificial
  CRISPR gRNA sequence
caacctccgcctcccaggtt

SEQ ID NO: 288165 - DNA, 20 bp, Artificial
  CRISPR gRNA sequence
cgcctcccaggttcaagtga

SEQ ID NO: 288166 - DNA, 20 bp, Artificial
  CRISPR gRNA sequence
ccaggttcaagtgattctcc

SEQ ID NO: 288167 - DNA, 20 bp, Artificial
  CRISPR gRNA sequence
aagtgattctcctgcctcag

SEQ ID NO: 288168 - DNA, 20 bp, Artificial
  CRISPR gRNA sequence
tcctgcctcagcctcctgag

SEQ ID NO: 288169 - DNA, 20 bp, Artificial
  CRISPR gRNA sequence
ctgcctcagcctcctgagta

SEQ ID NO: 288170 - DNA, 20 bp, Artificial
  CRISPR gRNA sequence
cctcagcctcctgagtagcc

SEQ ID NO: 288171 - DNA, 20 bp, Artificial
  CRISPR gRNA sequence
agcctcctgagtagccaaca

SEQ ID NO: 288172 - DNA, 20 bp, Artificial
  CRISPR gRNA sequence
ctgagtagccaacacgtccc

SEQ ID NO: 288173 - DNA, 20 bp, Artificial
  CRISPR gRNA sequence
agtagccaacacgtccctgg

SEQ ID NO: 288174 - DNA, 20 bp, Artificial
  CRISPR gRNA sequence
gctaatttttgtatttttag

SEQ ID NO: 288175 - DNA, 20 bp, Artificial
  CRISPR gRNA sequence
atttttgtatttttagtaga

SEQ ID NO: 288176 - DNA, 20 bp, Artificial
  CRISPR gRNA sequence
ttgtatttttagtagagatg

SEQ ID NO: 288177 - DNA, 20 bp, Artificial
  CRISPR gRNA sequence
tgtatttttagtagagatgg

SEQ ID NO: 288178 - DNA, 20 bp, Artificial
  CRISPR gRNA sequence
gtatttttagtagagatggg

SEQ ID NO: 288179 - DNA, 20 bp, Artificial
  CRISPR gRNA sequence
tatttttagtagagatgggg

SEQ ID NO: 288180 - DNA, 20 bp, Artificial
  CRISPR gRNA sequence
ttagtagagatggggtttca

SEQ ID NO: 288181 - DNA, 20 bp, Artificial
  CRISPR gRNA sequence
tagtagagatggggtttcac

SEQ ID NO: 288182 - DNA, 20 bp, Artificial
  CRISPR gRNA sequence
agtagagatggggtttcacc

SEQ ID NO: 288183 - DNA, 20 bp, Artificial
  CRISPR gRNA sequence
gtagagatggggtttcacca

SEQ ID NO: 288184 - DNA, 20 bp, Artificial
  CRISPR gRNA sequence
caccatgttgggcaggctgg

SEQ ID NO: 288185 - DNA, 20 bp, Artificial
  CRISPR gRNA sequence
accatgttgggcaggctggt

SEQ ID NO: 288186 - DNA, 20 bp, Artificial
  CRISPR gRNA sequence
ggcaggctggtctcaaactc

SEQ ID NO: 288187 - DNA, 20 bp, Artificial
  CRISPR gRNA sequence
gtctcaaactcctgagctca

SEQ ID NO: 288188 - DNA, 20 bp, Artificial
  CRISPR gRNA sequence
aaactcctgagctcaagcca

SEQ ID NO: 288189 - DNA, 20 bp, Artificial
  CRISPR gRNA sequence
ctgagctcaagccatccacc

SEQ ID NO: 288190 - DNA, 20 bp, Artificial
  CRISPR gRNA sequence
agctcaagccatccacccac

SEQ ID NO: 288191 - DNA, 20 bp, Artificial
  CRISPR gRNA sequence
aagccatccacccaccttgg

SEQ ID NO: 288192 - DNA, 20 bp, Artificial
  CRISPR gRNA sequence
ggcctcccaaagtgctgagc

SEQ ID NO: 288193 - DNA, 20 bp, Artificial
  CRISPR gRNA sequence
gcctcccaaagtgctgagcc

SEQ ID NO: 288194 - DNA, 20 bp, Artificial
  CRISPR gRNA sequence
ccaaagtgctgagccaccgc

SEQ ID NO: 288195 - DNA, 20 bp, Artificial
  CRISPR gRNA sequence
agccaccgcacctggcccaa

SEQ ID NO: 288196 - DNA, 20 bp, Artificial
  CRISPR gRNA sequence
gcccaattctctaacatcta

SEQ ID NO: 288197 - DNA, 20 bp, Artificial
  CRISPR gRNA sequence
tctaacatctaatttttcag

SEQ ID NO: 288198 - DNA, 20 bp, Artificial
  CRISPR gRNA sequence
taacatctaatttttcagga

SEQ ID NO: 288199 - DNA, 20 bp, Artificial
  CRISPR gRNA sequence
acatctaatttttcaggact

SEQ ID NO: 288200 - DNA, 20 bp, Artificial
  CRISPR gRNA sequence
atttttcaggactgactgct

SEQ ID NO: 288201 - DNA, 20 bp, Artificial
  CRISPR gRNA sequence
ttcaggactgactgctagat

SEQ ID NO: 288202 - DNA, 20 bp, Artificial
  CRISPR gRNA sequence
tcaggactgactgctagatt

SEQ ID NO: 288203 - DNA, 20 bp, Artificial
  CRISPR gRNA sequence
caggactgactgctagatta

SEQ ID NO: 288204 - DNA, 20 bp, Artificial
  CRISPR gRNA sequence
aggactgactgctagattag

SEQ ID NO: 288205 - DNA, 20 bp, Artificial
  CRISPR gRNA sequence
actgctagattagagcttca

SEQ ID NO: 288206 - DNA, 20 bp, Artificial
  CRISPR gRNA sequence
ctagattagagcttcaaata

SEQ ID NO: 288207 - DNA, 20 bp, Artificial
  CRISPR gRNA sequence
gattagagcttcaaatatgc

SEQ ID NO: 288208 - DNA, 20 bp, Artificial
  CRISPR gRNA sequence
gagcttcaaatatgcaataa

SEQ ID NO: 288209 - DNA, 20 bp, Artificial
  CRISPR gRNA sequence
caaatatgcaataagtaaat

SEQ ID NO: 288210 - DNA, 20 bp, Artificial
  CRISPR gRNA sequence
aaatatgcaataagtaaatt

SEQ ID NO: 288211 - DNA, 20 bp, Artificial
  CRISPR gRNA sequence
tcactttgaaaatattagaa

SEQ ID NO: 288212 - DNA, 20 bp, Artificial
  CRISPR gRNA sequence
tgaaaatattagaatataat

SEQ ID NO: 288213 - DNA, 20 bp, Artificial
  CRISPR gRNA sequence
gaaaatattagaatataata

SEQ ID NO: 288214 - DNA, 20 bp, Artificial
  CRISPR gRNA sequence
aaaatattagaatataatag

SEQ ID NO: 288215 - DNA, 20 bp, Artificial
  CRISPR gRNA sequence
gaatataatagtaagatagc

SEQ ID NO: 288216 - DNA, 20 bp, Artificial
  CRISPR gRNA sequence
acatactacctgaaaaagat

SEQ ID NO: 288217 - DNA, 20 bp, Artificial
  CRISPR gRNA sequence
cctgaaaaagatttatgcct

SEQ ID NO: 288218 - DNA, 20 bp, Artificial
  CRISPR gRNA sequence
aaaaagatttatgcctccat

SEQ ID NO: 288219 - DNA, 20 bp, Artificial
  CRISPR gRNA sequence
atgcctccattgttcttttt

SEQ ID NO: 288220 - DNA, 20 bp, Artificial
  CRISPR gRNA sequence
tgcctccattgttctttttt

SEQ ID NO: 288221 - DNA, 20 bp, Artificial
  CRISPR gRNA sequence
cattgttctttttttttttt

SEQ ID NO: 288222 - DNA, 20 bp, Artificial
  CRISPR gRNA sequence
ttcttttttttttttttttt

SEQ ID NO: 288223 - DNA, 20 bp, Artificial
  CRISPR gRNA sequence
tttttttttttttttttttg

SEQ ID NO: 288224 - DNA, 20 bp, Artificial
  CRISPR gRNA sequence
tttttttttttttttttgag

SEQ ID NO: 288225 - DNA, 20 bp, Artificial
  CRISPR gRNA sequence
ttttttttttttttttgaga

SEQ ID NO: 288226 - DNA, 20 bp, Artificial
  CRISPR gRNA sequence
tttttttttttttttgagat

SEQ ID NO: 288227 - DNA, 20 bp, Artificial
  CRISPR gRNA sequence
ttttttttttttttgagatg

SEQ ID NO: 288228 - DNA, 20 bp, Artificial
  CRISPR gRNA sequence
tttttttttttttgagatgg

SEQ ID NO: 288229 - DNA, 20 bp, Artificial
  CRISPR gRNA sequence
ttttttttttttgagatgga

SEQ ID NO: 288230 - DNA, 20 bp, Artificial
  CRISPR gRNA sequence
tttttttttttgagatggag

SEQ ID NO: 288231 - DNA, 20 bp, Artificial
  CRISPR gRNA sequence
ttttttttttgagatggagt

SEQ ID NO: 288232 - DNA, 20 bp, Artificial
  CRISPR gRNA sequence
tttttttttgagatggagtc

SEQ ID NO: 288233 - DNA, 20 bp, Artificial
  CRISPR gRNA sequence
ttttttttgagatggagtct

SEQ ID NO: 288234 - DNA, 20 bp, Artificial
  CRISPR gRNA sequence
tttttttgagatggagtctt

SEQ ID NO: 288235 - DNA, 20 bp, Artificial
  CRISPR gRNA sequence
ttttttgagatggagtcttg

SEQ ID NO: 288236 - DNA, 20 bp, Artificial
  CRISPR gRNA sequence
tttttgagatggagtcttgc

SEQ ID NO: 288237 - DNA, 20 bp, Artificial
  CRISPR gRNA sequence
ttttgagatggagtcttgct

SEQ ID NO: 288238 - DNA, 20 bp, Artificial
  CRISPR gRNA sequence
tttgagatggagtcttgcta

SEQ ID NO: 288239 - DNA, 20 bp, Artificial
  CRISPR gRNA sequence
ttgagatggagtcttgctat

SEQ ID NO: 288240 - DNA, 20 bp, Artificial
  CRISPR gRNA sequence
tgagatggagtcttgctatg

SEQ ID NO: 288241 - DNA, 20 bp, Artificial
  CRISPR gRNA sequence
gagatggagtcttgctatgt

SEQ ID NO: 288242 - DNA, 20 bp, Artificial
  CRISPR gRNA sequence
agatggagtcttgctatgtc

SEQ ID NO: 288243 - DNA, 20 bp, Artificial
  CRISPR gRNA sequence
gctatgtcacccaggctgga

SEQ ID NO: 288244 - DNA, 20 bp, Artificial
  CRISPR gRNA sequence
ctatgtcacccaggctggag

SEQ ID NO: 288245 - DNA, 20 bp, Artificial
  CRISPR gRNA sequence
tgtcacccaggctggagtgc

SEQ ID NO: 288246 - DNA, 20 bp, Artificial
  CRISPR gRNA sequence
gagtgcagtggtgcaatctc

SEQ ID NO: 288247 - DNA, 20 bp, Artificial
  CRISPR gRNA sequence
agctcattgcaacctccgcc

SEQ ID NO: 288248 - DNA, 20 bp, Artificial
  CRISPR gRNA sequence
attgcaacctccgcctccca

SEQ ID NO: 288249 - DNA, 20 bp, Artificial
  CRISPR gRNA sequence
caacctccgcctcccaggtt

SEQ ID NO: 288250 - DNA, 20 bp, Artificial
  CRISPR gRNA sequence
cgcctcccaggttcaagcga

SEQ ID NO: 288251 - DNA, 20 bp, Artificial
  CRISPR gRNA sequence
ccaggttcaagcgattctct

SEQ ID NO: 288252 - DNA, 20 bp, Artificial
  CRISPR gRNA sequence
aagcgattctctgcctcagc

SEQ ID NO: 288253 - DNA, 20 bp, Artificial
  CRISPR gRNA sequence
tctgcctcagcctccagagt

SEQ ID NO: 288254 - DNA, 20 bp, Artificial
  CRISPR gRNA sequence
tgcctcagcctccagagtag

SEQ ID NO: 288255 - DNA, 20 bp, Artificial
  CRISPR gRNA sequence
cctcagcctccagagtagct

SEQ ID NO: 288256 - DNA, 20 bp, Artificial
  CRISPR gRNA sequence
agcctccagagtagctggga

SEQ ID NO: 288257 - DNA, 20 bp, Artificial
  CRISPR gRNA sequence
cagagtagctgggattacag

SEQ ID NO: 288258 - DNA, 20 bp, Artificial
  CRISPR gRNA sequence
ggattacaggaatgcgccac

SEQ ID NO: 288259 - DNA, 20 bp, Artificial
  CRISPR gRNA sequence
caggaatgcgccaccacatc

SEQ ID NO: 288260 - DNA, 20 bp, Artificial
  CRISPR gRNA sequence
gctagtttttgtatttttag

SEQ ID NO: 288261 - DNA, 20 bp, Artificial
  CRISPR gRNA sequence
gtttttgtatttttagtagg

SEQ ID NO: 288262 - DNA, 20 bp, Artificial
  CRISPR gRNA sequence
ttgtatttttagtagggacg

SEQ ID NO: 288263 - DNA, 20 bp, Artificial
  CRISPR gRNA sequence
tgtatttttagtagggacgg

SEQ ID NO: 288264 - DNA, 20 bp, Artificial
  CRISPR gRNA sequence
gtatttttagtagggacgga

SEQ ID NO: 288265 - DNA, 20 bp, Artificial
  CRISPR gRNA sequence
tatttttagtagggacggag

SEQ ID NO: 288266 - DNA, 20 bp, Artificial
  CRISPR gRNA sequence
ttagtagggacggagtttcg

SEQ ID NO: 288267 - DNA, 20 bp, Artificial
  CRISPR gRNA sequence
tagtagggacggagtttcgc

SEQ ID NO: 288268 - DNA, 20 bp, Artificial
  CRISPR gRNA sequence
agtagggacggagtttcgct

SEQ ID NO: 288269 - DNA, 20 bp, Artificial
  CRISPR gRNA sequence
gtagggacggagtttcgcta

SEQ ID NO: 288270 - DNA, 20 bp, Artificial
  CRISPR gRNA sequence
cgctatgttggccaggctgg

SEQ ID NO: 288271 - DNA, 20 bp, Artificial
  CRISPR gRNA sequence
gctatgttggccaggctggt

SEQ ID NO: 288272 - DNA, 20 bp, Artificial
  CRISPR gRNA sequence
tgttggccaggctggtcttg

SEQ ID NO: 288273 - DNA, 20 bp, Artificial
  CRISPR gRNA sequence
gccaggctggtcttgaactc

SEQ ID NO: 288274 - DNA, 20 bp, Artificial
  CRISPR gRNA sequence
gtcttgaactcatgacctca

SEQ ID NO: 288275 - DNA, 20 bp, Artificial
  CRISPR gRNA sequence
gaactcatgacctcaagtga

SEQ ID NO: 288276 - DNA, 20 bp, Artificial
  CRISPR gRNA sequence
aactcatgacctcaagtgat

SEQ ID NO: 288277 - DNA, 20 bp, Artificial
  CRISPR gRNA sequence
atgacctcaagtgatccgcc

SEQ ID NO: 288278 - DNA, 20 bp, Artificial
  CRISPR gRNA sequence
aagtgatccgcctgccttgg

SEQ ID NO: 288279 - DNA, 20 bp, Artificial
  CRISPR gRNA sequence
ccttggcctcccaaagtgct

SEQ ID NO: 288280 - DNA, 20 bp, Artificial
  CRISPR gRNA sequence
ggcctcccaaagtgctgaga

SEQ ID NO: 288281 - DNA, 20 bp, Artificial
  CRISPR gRNA sequence
gcctcccaaagtgctgagat

SEQ ID NO: 288282 - DNA, 20 bp, Artificial
  CRISPR gRNA sequence
ccaaagtgctgagattacag

SEQ ID NO: 288283 - DNA, 20 bp, Artificial
  CRISPR gRNA sequence
agattacaggcataagccac

SEQ ID NO: 288284 - DNA, 20 bp, Artificial
  CRISPR gRNA sequence
caggcataagccaccatacc

SEQ ID NO: 288285 - DNA, 20 bp, Artificial
  CRISPR gRNA sequence
ccttttcagcatactttcac

SEQ ID NO: 288286 - DNA, 20 bp, Artificial
  CRISPR gRNA sequence
ttcagcatactttcacaggc

SEQ ID NO: 288287 - DNA, 20 bp, Artificial
  CRISPR gRNA sequence
tcagcatactttcacaggca

SEQ ID NO: 288288 - DNA, 20 bp, Artificial
  CRISPR gRNA sequence
cagcatactttcacaggcat

SEQ ID NO: 288289 - DNA, 20 bp, Artificial
  CRISPR gRNA sequence
agcatactttcacaggcata

SEQ ID NO: 288290 - DNA, 20 bp, Artificial
  CRISPR gRNA sequence
tcacaggcatatattgctgg

SEQ ID NO: 288291 - DNA, 20 bp, Artificial
  CRISPR gRNA sequence
cacaggcatatattgctggg

SEQ ID NO: 288292 - DNA, 20 bp, Artificial
  CRISPR gRNA sequence
acaggcatatattgctgggt

SEQ ID NO: 288293 - DNA, 20 bp, Artificial
  CRISPR gRNA sequence
ctgggtcaagtgcagttagt

SEQ ID NO: 288294 - DNA, 20 bp, Artificial
  CRISPR gRNA sequence
ggtcaagtgcagttagtagc

SEQ ID NO: 288295 - DNA, 20 bp, Artificial
  CRISPR gRNA sequence
gtagcaaggctacatcaaat

SEQ ID NO: 288296 - DNA, 20 bp, Artificial
  CRISPR gRNA sequence
catcaaatcaaagatgcccc

SEQ ID NO: 288297 - DNA, 20 bp, Artificial
  CRISPR gRNA sequence
ggtgattgagaggctcttta

SEQ ID NO: 288298 - DNA, 20 bp, Artificial
  CRISPR gRNA sequence
gtgattgagaggctctttag

SEQ ID NO: 288299 - DNA, 20 bp, Artificial
  CRISPR gRNA sequence
agaggctctttaggtcatta

SEQ ID NO: 288300 - DNA, 20 bp, Artificial
  CRISPR gRNA sequence
tttaggtcattatagtgccc

SEQ ID NO: 288301 - DNA, 20 bp, Artificial
  CRISPR gRNA sequence
taggtcattatagtgcccca

SEQ ID NO: 288302 - DNA, 20 bp, Artificial
  CRISPR gRNA sequence
aggtcattatagtgccccag

SEQ ID NO: 288303 - DNA, 20 bp, Artificial
  CRISPR gRNA sequence
ggtcattatagtgccccagg

SEQ ID NO: 288304 - DNA, 20 bp, Artificial
  CRISPR gRNA sequence
tagtgccccaggatgattgt

SEQ ID NO: 288305 - DNA, 20 bp, Artificial
  CRISPR gRNA sequence
tcatgaacttggattgtcaa

SEQ ID NO: 288306 - DNA, 20 bp, Artificial
  CRISPR gRNA sequence
ggattgtcaaagaacaagaa

SEQ ID NO: 288307 - DNA, 20 bp, Artificial
  CRISPR gRNA sequence
gattgtcaaagaacaagaaa

SEQ ID NO: 288308 - DNA, 20 bp, Artificial
  CRISPR gRNA sequence
tcaaagaacaagaaatgcac

SEQ ID NO: 288309 - DNA, 20 bp, Artificial
  CRISPR gRNA sequence
acagatatttccaggacatc

SEQ ID NO: 288310 - DNA, 20 bp, Artificial
  CRISPR gRNA sequence
ccaggacatctttagaaacc

SEQ ID NO: 288311 - DNA, 20 bp, Artificial
  CRISPR gRNA sequence
caggacatctttagaaacca

SEQ ID NO: 288312 - DNA, 20 bp, Artificial
  CRISPR gRNA sequence
tagaaaccagttagagttta

SEQ ID NO: 288313 - DNA, 20 bp, Artificial
  CRISPR gRNA sequence
agaaaccagttagagtttat

SEQ ID NO: 288314 - DNA, 20 bp, Artificial
  CRISPR gRNA sequence
gaaaccagttagagtttatt

SEQ ID NO: 288315 - DNA, 20 bp, Artificial
  CRISPR gRNA sequence
gagtttattgtacaactaga

SEQ ID NO: 288316 - DNA, 20 bp, Artificial
  CRISPR gRNA sequence
attgtacaactagagactta

SEQ ID NO: 288317 - DNA, 20 bp, Artificial
  CRISPR gRNA sequence
ttgtacaactagagacttaa

SEQ ID NO: 288318 - DNA, 20 bp, Artificial
  CRISPR gRNA sequence
tacaactagagacttaactc

SEQ ID NO: 288319 - DNA, 20 bp, Artificial
  CRISPR gRNA sequence
gagacttaactccaagaaat

SEQ ID NO: 288320 - DNA, 20 bp, Artificial
  CRISPR gRNA sequence
aactccaagaaatgaagtga

SEQ ID NO: 288321 - DNA, 20 bp, Artificial
  CRISPR gRNA sequence
actccaagaaatgaagtgag

SEQ ID NO: 288322 - DNA, 20 bp, Artificial
  CRISPR gRNA sequence
caagaaatgaagtgagatac

SEQ ID NO: 288323 - DNA, 20 bp, Artificial
  CRISPR gRNA sequence
tttggtaaaattttcaccta

SEQ ID NO: 288324 - DNA, 20 bp, Artificial
  CRISPR gRNA sequence
tggtaaaattttcacctaaa

SEQ ID NO: 288325 - DNA, 20 bp, Artificial
  CRISPR gRNA sequence
ggtaaaattttcacctaaat

SEQ ID NO: 288326 - DNA, 20 bp, Artificial
  CRISPR gRNA sequence
gtaaaattttcacctaaatc

SEQ ID NO: 288327 - DNA, 20 bp, Artificial
  CRISPR gRNA sequence
tcacctaaatcaatagccat

SEQ ID NO: 288328 - DNA, 20 bp, Artificial
  CRISPR gRNA sequence
cacctaaatcaatagccatg

SEQ ID NO: 288329 - DNA, 20 bp, Artificial
  CRISPR gRNA sequence
acctaaatcaatagccatgt

SEQ ID NO: 288330 - DNA, 20 bp, Artificial
  CRISPR gRNA sequence
aatcaatagccatgtgtctt

SEQ ID NO: 288331 - DNA, 20 bp, Artificial
  CRISPR gRNA sequence
taagggcattaagaatctgc

SEQ ID NO: 288332 - DNA, 20 bp, Artificial
  CRISPR gRNA sequence
aagggcattaagaatctgcc

SEQ ID NO: 288333 - DNA, 20 bp, Artificial
  CRISPR gRNA sequence
agggcattaagaatctgccg

SEQ ID NO: 288334 - DNA, 20 bp, Artificial
  CRISPR gRNA sequence
agaatctgccggcctagagt

SEQ ID NO: 288335 - DNA, 20 bp, Artificial
  CRISPR gRNA sequence
ccggcctagagtaaaatcag

SEQ ID NO: 288336 - DNA, 20 bp, Artificial
  CRISPR gRNA sequence
gagtaaaatcagaaaatccc

SEQ ID NO: 288337 - DNA, 20 bp, Artificial
  CRISPR gRNA sequence
tgactgataacgtcacttca

SEQ ID NO: 288338 - DNA, 20 bp, Artificial
  CRISPR gRNA sequence
gactgataacgtcacttcag

SEQ ID NO: 288339 - DNA, 20 bp, Artificial
  CRISPR gRNA sequence
actgataacgtcacttcagc

SEQ ID NO: 288340 - DNA, 20 bp, Artificial
  CRISPR gRNA sequence
ataacgtcacttcagccagg

SEQ ID NO: 288341 - DNA, 20 bp, Artificial
  CRISPR gRNA sequence
cagccaggtgttcccgcttg

SEQ ID NO: 288342 - DNA, 20 bp, Artificial
  CRISPR gRNA sequence
agccaggtgttcccgcttga

SEQ ID NO: 288343 - DNA, 20 bp, Artificial
  CRISPR gRNA sequence
ccgcttgaaagcgtcttttt

SEQ ID NO: 288344 - DNA, 20 bp, Artificial
  CRISPR gRNA sequence
gaaagcgtctttttcatact

SEQ ID NO: 288345 - DNA, 20 bp, Artificial
  CRISPR gRNA sequence
aaagcgtctttttcatactt

SEQ ID NO: 288346 - DNA, 20 bp, Artificial
  CRISPR gRNA sequence
tttcatacttcagaacaaca

SEQ ID NO: 288347 - DNA, 20 bp, Artificial
  CRISPR gRNA sequence
ttcatacttcagaacaacac

SEQ ID NO: 288348 - DNA, 20 bp, Artificial
  CRISPR gRNA sequence
tcatacttcagaacaacaca

SEQ ID NO: 288349 - DNA, 20 bp, Artificial
  CRISPR gRNA sequence
catacttcagaacaacacac

SEQ ID NO: 288350 - DNA, 20 bp, Artificial
  CRISPR gRNA sequence
atacttcagaacaacacact

SEQ ID NO: 288351 - DNA, 20 bp, Artificial
  CRISPR gRNA sequence
cagaacaacacactcgtatg

SEQ ID NO: 288352 - DNA, 20 bp, Artificial
  CRISPR gRNA sequence
agaacaacacactcgtatgt

SEQ ID NO: 288353 - DNA, 20 bp, Artificial
  CRISPR gRNA sequence
gtatgtgccctcgtcagatg

SEQ ID NO: 288354 - DNA, 20 bp, Artificial
  CRISPR gRNA sequence
gtcagatgggcgcagagcca

SEQ ID NO: 288355 - DNA, 20 bp, Artificial
  CRISPR gRNA sequence
ttagtgatatcaaagatggt

SEQ ID NO: 288356 - DNA, 20 bp, Artificial
  CRISPR gRNA sequence
gtgatatcaaagatggtccg

SEQ ID NO: 288357 - DNA, 20 bp, Artificial
  CRISPR gRNA sequence
ttgtactcgggccatatatt

SEQ ID NO: 288358 - DNA, 20 bp, Artificial
  CRISPR gRNA sequence
gtactcgggccatatattca

SEQ ID NO: 288359 - DNA, 20 bp, Artificial
  CRISPR gRNA sequence
tactcgggccatatattcat

SEQ ID NO: 288360 - DNA, 20 bp, Artificial
  CRISPR gRNA sequence
gggccatatattcatgtccc

SEQ ID NO: 288361 - DNA, 20 bp, Artificial
  CRISPR gRNA sequence
atgtccccagacatcatagt

SEQ ID NO: 288362 - DNA, 20 bp, Artificial
  CRISPR gRNA sequence
tcttctccttttgccagtag

SEQ ID NO: 288363 - DNA, 20 bp, Artificial
  CRISPR gRNA sequence
cttctccttttgccagtaga

SEQ ID NO: 288364 - DNA, 20 bp, Artificial
  CRISPR gRNA sequence
ttctccttttgccagtagat

SEQ ID NO: 288365 - DNA, 20 bp, Artificial
  CRISPR gRNA sequence
ctccttttgccagtagatgc

SEQ ID NO: 288366 - DNA, 20 bp, Artificial
  CRISPR gRNA sequence
tccttttgccagtagatgcg

SEQ ID NO: 288367 - DNA, 20 bp, Artificial
  CRISPR gRNA sequence
cttttgccagtagatgcgag

SEQ ID NO: 288368 - DNA, 20 bp, Artificial
  CRISPR gRNA sequence
ttgccagtagatgcgagttt

SEQ ID NO: 288369 - DNA, 20 bp, Artificial
  CRISPR gRNA sequence
tgccagtagatgcgagtttg

SEQ ID NO: 288370 - DNA, 20 bp, Artificial
  CRISPR gRNA sequence
gccagtagatgcgagtttgt

SEQ ID NO: 288371 - DNA, 20 bp, Artificial
  CRISPR gRNA sequence
ccagtagatgcgagtttgtg

SEQ ID NO: 288372 - DNA, 20 bp, Artificial
  CRISPR gRNA sequence
gtgccagctcttcaacagaa

SEQ ID NO: 288373 - DNA, 20 bp, Artificial
  CRISPR gRNA sequence
tgccagctcttcaacagaaa

SEQ ID NO: 288374 - DNA, 20 bp, Artificial
  CRISPR gRNA sequence
ttcaacagaaacattgtgac

SEQ ID NO: 288375 - DNA, 20 bp, Artificial
  CRISPR gRNA sequence
caacagaaacattgtgacca

SEQ ID NO: 288376 - DNA, 20 bp, Artificial
  CRISPR gRNA sequence
aacagaaacattgtgaccac

SEQ ID NO: 288377 - DNA, 20 bp, Artificial
  CRISPR gRNA sequence
tgaccacaggacagcgttgc

SEQ ID NO: 288378 - DNA, 20 bp, Artificial
  CRISPR gRNA sequence
ccacttctttcacttccttg

SEQ ID NO: 288379 - DNA, 20 bp, Artificial
  CRISPR gRNA sequence
ctttcacttccttggtcacg

SEQ ID NO: 288380 - DNA, 20 bp, Artificial
  CRISPR gRNA sequence
tttcacttccttggtcacgt

SEQ ID NO: 288381 - DNA, 20 bp, Artificial
  CRISPR gRNA sequence
tcacttccttggtcacgtgg

SEQ ID NO: 288382 - DNA, 20 bp, Artificial
  CRISPR gRNA sequence
cacttccttggtcacgtgga

SEQ ID NO: 288383 - DNA, 20 bp, Artificial
  CRISPR gRNA sequence
acttccttggtcacgtggat

SEQ ID NO: 288384 - DNA, 20 bp, Artificial
  CRISPR gRNA sequence
ccttggtcacgtggataaca

SEQ ID NO: 288385 - DNA, 20 bp, Artificial
  CRISPR gRNA sequence
cttggtcacgtggataacac

SEQ ID NO: 288386 - DNA, 20 bp, Artificial
  CRISPR gRNA sequence
ggtcacgtggataacaccta

SEQ ID NO: 288387 - DNA, 20 bp, Artificial
  CRISPR gRNA sequence
gtcacgtggataacacctat

SEQ ID NO: 288388 - DNA, 20 bp, Artificial
  CRISPR gRNA sequence
tggagaggcaaacagaacaa

SEQ ID NO: 288389 - DNA, 20 bp, Artificial
  CRISPR gRNA sequence
tatatttattaaatacagat

SEQ ID NO: 288390 - DNA, 20 bp, Artificial
  CRISPR gRNA sequence
attaaatacagattcctgca

SEQ ID NO: 288391 - DNA, 20 bp, Artificial
  CRISPR gRNA sequence
ttaaatacagattcctgcat

SEQ ID NO: 288392 - DNA, 20 bp, Artificial
  CRISPR gRNA sequence
aatacagattcctgcatggt

SEQ ID NO: 288393 - DNA, 20 bp, Artificial
  CRISPR gRNA sequence
ctgcatggtcaggaatccaa

SEQ ID NO: 288394 - DNA, 20 bp, Artificial
  CRISPR gRNA sequence
catggtcaggaatccaaagt

SEQ ID NO: 288395 - DNA, 20 bp, Artificial
  CRISPR gRNA sequence
agggtgttgtgtctagtgac

SEQ ID NO: 288396 - DNA, 20 bp, Artificial
  CRISPR gRNA sequence
gggtgttgtgtctagtgact

SEQ ID NO: 288397 - DNA, 20 bp, Artificial
  CRISPR gRNA sequence
tgtctagtgactaagtatca

SEQ ID NO: 288398 - DNA, 20 bp, Artificial
  CRISPR gRNA sequence
gtgactaagtatcaatccag

SEQ ID NO: 288399 - DNA, 20 bp, Artificial
  CRISPR gRNA sequence
agtatcaatccagtttgatt

SEQ ID NO: 288400 - DNA, 20 bp, Artificial
  CRISPR gRNA sequence
gatttttggggtccccaatg

SEQ ID NO: 288401 - DNA, 20 bp, Artificial
  CRISPR gRNA sequence
atttttggggtccccaatgc

SEQ ID NO: 288402 - DNA, 20 bp, Artificial
  CRISPR gRNA sequence
ttggggtccccaatgctttt

SEQ ID NO: 288403 - DNA, 20 bp, Artificial
  CRISPR gRNA sequence
tggggtccccaatgcttttt

SEQ ID NO: 288404 - DNA, 20 bp, Artificial
  CRISPR gRNA sequence
ggggtccccaatgctttttt

SEQ ID NO: 288405 - DNA, 20 bp, Artificial
  CRISPR gRNA sequence
gggtccccaatgcttttttt

SEQ ID NO: 288406 - DNA, 20 bp, Artificial
  CRISPR gRNA sequence
tttttctcttcattttttaa

SEQ ID NO: 288407 - DNA, 20 bp, Artificial
  CRISPR gRNA sequence
ttttctcttcattttttaaa

SEQ ID NO: 288408 - DNA, 20 bp, Artificial
  CRISPR gRNA sequence
tttctcttcattttttaaaa

SEQ ID NO: 288409 - DNA, 20 bp, Artificial
  CRISPR gRNA sequence
ttctcttcattttttaaaaa

SEQ ID NO: 288410 - DNA, 20 bp, Artificial
  CRISPR gRNA sequence
tctcttcattttttaaaaat

SEQ ID NO: 288411 - DNA, 20 bp, Artificial
  CRISPR gRNA sequence
ctcttcattttttaaaaatt

SEQ ID NO: 288412 - DNA, 20 bp, Artificial
  CRISPR gRNA sequence
tcttcattttttaaaaattg

SEQ ID NO: 288413 - DNA, 20 bp, Artificial
  CRISPR gRNA sequence
ttcattttttaaaaattgtg

SEQ ID NO: 288414 - DNA, 20 bp, Artificial
  CRISPR gRNA sequence
cattttttaaaaattgtggt

SEQ ID NO: 288415 - DNA, 20 bp, Artificial
  CRISPR gRNA sequence
attttttaaaaattgtggta

SEQ ID NO: 288416 - DNA, 20 bp, Artificial
  CRISPR gRNA sequence
tttaaaaattgtggtaaaaa

SEQ ID NO: 288417 - DNA, 20 bp, Artificial
  CRISPR gRNA sequence
ttaaaaattgtggtaaaaaa

SEQ ID NO: 288418 - DNA, 20 bp, Artificial
  CRISPR gRNA sequence
taaaaattgtggtaaaaaac

SEQ ID NO: 288419 - DNA, 20 bp, Artificial
  CRISPR gRNA sequence
aaaaattgtggtaaaaaaca

SEQ ID NO: 288420 - DNA, 20 bp, Artificial
  CRISPR gRNA sequence
aaaattgtggtaaaaaacac

SEQ ID NO: 288421 - DNA, 20 bp, Artificial
  CRISPR gRNA sequence
tggtaaaaaacacaacaggc

SEQ ID NO: 288422 - DNA, 20 bp, Artificial
  CRISPR gRNA sequence
ggcgtggtggctcacgcctg

SEQ ID NO: 288423 - DNA, 20 bp, Artificial
  CRISPR gRNA sequence
acgcctgtaatcccagcact

SEQ ID NO: 288424 - DNA, 20 bp, Artificial
  CRISPR gRNA sequence
taatcccagcactttgggag

SEQ ID NO: 288425 - DNA, 20 bp, Artificial
  CRISPR gRNA sequence
tgggaggccgaggcaggcag

SEQ ID NO: 288426 - DNA, 20 bp, Artificial
  CRISPR gRNA sequence
gggaggccgaggcaggcaga

SEQ ID NO: 288427 - DNA, 20 bp, Artificial
  CRISPR gRNA sequence
ggaggccgaggcaggcagat

SEQ ID NO: 288428 - DNA, 20 bp, Artificial
  CRISPR gRNA sequence
gaggtcaggagttcgagacc

SEQ ID NO: 288429 - DNA, 20 bp, Artificial
  CRISPR gRNA sequence
aggtcaggagttcgagacca

SEQ ID NO: 288430 - DNA, 20 bp, Artificial
  CRISPR gRNA sequence
gagaccagccgggccaacat

SEQ ID NO: 288431 - DNA, 20 bp, Artificial
  CRISPR gRNA sequence
tgtctctactaaaaatacaa

SEQ ID NO: 288432 - DNA, 20 bp, Artificial
  CRISPR gRNA sequence
tctctactaaaaatacaaaa

SEQ ID NO: 288433 - DNA, 20 bp, Artificial
  CRISPR gRNA sequence
tactaaaaatacaaaaaatt

SEQ ID NO: 288434 - DNA, 20 bp, Artificial
  CRISPR gRNA sequence
ctaaaaatacaaaaaattag

SEQ ID NO: 288435 - DNA, 20 bp, Artificial
  CRISPR gRNA sequence
aaaatacaaaaaattagccg

SEQ ID NO: 288436 - DNA, 20 bp, Artificial
  CRISPR gRNA sequence
gccgggtgtggtggcgggtg

SEQ ID NO: 288437 - DNA, 20 bp, Artificial
  CRISPR gRNA sequence
ctcgggaggctgaggcagga

SEQ ID NO: 288438 - DNA, 20 bp, Artificial
  CRISPR gRNA sequence
gggaggctgaggcaggagaa

SEQ ID NO: 288439 - DNA, 20 bp, Artificial
  CRISPR gRNA sequence
aggcaggagaatcacttgaa

SEQ ID NO: 288440 - DNA, 20 bp, Artificial
  CRISPR gRNA sequence
gaacccaggaggcggaggtt

SEQ ID NO: 288441 - DNA, 20 bp, Artificial
  CRISPR gRNA sequence
aacccaggaggcggaggttg

SEQ ID NO: 288442 - DNA, 20 bp, Artificial
  CRISPR gRNA sequence
cagtaagctgagattgcacc

SEQ ID NO: 288443 - DNA, 20 bp, Artificial
  CRISPR gRNA sequence
agattgcaccccagcctggg

SEQ ID NO: 288444 - DNA, 20 bp, Artificial
  CRISPR gRNA sequence
caccccagcctgggcaacaa

SEQ ID NO: 288445 - DNA, 20 bp, Artificial
  CRISPR gRNA sequence
ggcaacaagagcaaaactcc

SEQ ID NO: 288446 - DNA, 20 bp, Artificial
  CRISPR gRNA sequence
catctccaaacaaacaaaca

SEQ ID NO: 288447 - DNA, 20 bp, Artificial
  CRISPR gRNA sequence
caaacaaacaaacaaacaaa

SEQ ID NO: 288448 - DNA, 20 bp, Artificial
  CRISPR gRNA sequence
atcatcttattgatttttaa

SEQ ID NO: 288449 - DNA, 20 bp, Artificial
  CRISPR gRNA sequence
tcatcttattgatttttaag

SEQ ID NO: 288450 - DNA, 20 bp, Artificial
  CRISPR gRNA sequence
attgatttttaagtgtacag

SEQ ID NO: 288451 - DNA, 20 bp, Artificial
  CRISPR gRNA sequence
ttgatttttaagtgtacagt

SEQ ID NO: 288452 - DNA, 20 bp, Artificial
  CRISPR gRNA sequence
atttttaagtgtacagttca

SEQ ID NO: 288453 - DNA, 20 bp, Artificial
  CRISPR gRNA sequence
ttaagtgtacagttcagtaa

SEQ ID NO: 288454 - DNA, 20 bp, Artificial
  CRISPR gRNA sequence
taagtgtacagttcagtaat

SEQ ID NO: 288455 - DNA, 20 bp, Artificial
  CRISPR gRNA sequence
aagtgtacagttcagtaatg

SEQ ID NO: 288456 - DNA, 20 bp, Artificial
  CRISPR gRNA sequence
agtgtacagttcagtaatgt

SEQ ID NO: 288457 - DNA, 20 bp, Artificial
  CRISPR gRNA sequence
agtaatgttaagtatattca

SEQ ID NO: 288458 - DNA, 20 bp, Artificial
  CRISPR gRNA sequence
agtatattcacattgttgtg

SEQ ID NO: 288459 - DNA, 20 bp, Artificial
  CRISPR gRNA sequence
acattgttgtgaaacagatc

SEQ ID NO: 288460 - DNA, 20 bp, Artificial
  CRISPR gRNA sequence
ttgtgaaacagatctctaga

SEQ ID NO: 288461 - DNA, 20 bp, Artificial
  CRISPR gRNA sequence
tgaaacagatctctagaaat

SEQ ID NO: 288462 - DNA, 20 bp, Artificial
  CRISPR gRNA sequence
tagaaattttcattttgcaa

SEQ ID NO: 288463 - DNA, 20 bp, Artificial
  CRISPR gRNA sequence
gaaattttcattttgcaaat

SEQ ID NO: 288464 - DNA, 20 bp, Artificial
  CRISPR gRNA sequence
tcattttgcaaatctgaaac

SEQ ID NO: 288465 - DNA, 20 bp, Artificial
  CRISPR gRNA sequence
cattttgcaaatctgaaact

SEQ ID NO: 288466 - DNA, 20 bp, Artificial
  CRISPR gRNA sequence
attttgcaaatctgaaactc

SEQ ID NO: 288467 - DNA, 20 bp, Artificial
  CRISPR gRNA sequence
tgcaaatctgaaactctatg

SEQ ID NO: 288468 - DNA, 20 bp, Artificial
  CRISPR gRNA sequence
gcaaatctgaaactctatgc

SEQ ID NO: 288469 - DNA, 20 bp, Artificial
  CRISPR gRNA sequence
caaatctgaaactctatgcc

SEQ ID NO: 288470 - DNA, 20 bp, Artificial
  CRISPR gRNA sequence
aaactctatgcccattaaac

SEQ ID NO: 288471 - DNA, 20 bp, Artificial
  CRISPR gRNA sequence
tatgcccattaaacaactcc

SEQ ID NO: 288472 - DNA, 20 bp, Artificial
  CRISPR gRNA sequence
tgcccattaaacaactcccc

SEQ ID NO: 288473 - DNA, 20 bp, Artificial
  CRISPR gRNA sequence
aacaactcccctttccccct

SEQ ID NO: 288474 - DNA, 20 bp, Artificial
  CRISPR gRNA sequence
ccctttccccctctcccctc

SEQ ID NO: 288475 - DNA, 20 bp, Artificial
  CRISPR gRNA sequence
tccccctctcccctcagcct

SEQ ID NO: 288476 - DNA, 20 bp, Artificial
  CRISPR gRNA sequence
ccccctctcccctcagcctc

SEQ ID NO: 288477 - DNA, 20 bp, Artificial
  CRISPR gRNA sequence
cccctctcccctcagcctct

SEQ ID NO: 288478 - DNA, 20 bp, Artificial
  CRISPR gRNA sequence
tcccctcagcctctggcaat

SEQ ID NO: 288479 - DNA, 20 bp, Artificial
  CRISPR gRNA sequence
ccctcagcctctggcaattg

SEQ ID NO: 288480 - DNA, 20 bp, Artificial
  CRISPR gRNA sequence
agcctctggcaattgccatt

SEQ ID NO: 288481 - DNA, 20 bp, Artificial
  CRISPR gRNA sequence
tggcaattgccattctgttt

SEQ ID NO: 288482 - DNA, 20 bp, Artificial
  CRISPR gRNA sequence
gcaattgccattctgtttgt

SEQ ID NO: 288483 - DNA, 20 bp, Artificial
  CRISPR gRNA sequence
ccattctgtttgtttgtatg

SEQ ID NO: 288484 - DNA, 20 bp, Artificial
  CRISPR gRNA sequence
tgtttgtttgtatgaatttg

SEQ ID NO: 288485 - DNA, 20 bp, Artificial
  CRISPR gRNA sequence
tttgtttgtatgaatttggc

SEQ ID NO: 288486 - DNA, 20 bp, Artificial
  CRISPR gRNA sequence
gtttgtatgaatttggctac

SEQ ID NO: 288487 - DNA, 20 bp, Artificial
  CRISPR gRNA sequence
tttgtatgaatttggctact

SEQ ID NO: 288488 - DNA, 20 bp, Artificial
  CRISPR gRNA sequence
gtatgaatttggctacttta

SEQ ID NO: 288489 - DNA, 20 bp, Artificial
  CRISPR gRNA sequence
tatgaatttggctactttaa

SEQ ID NO: 288490 - DNA, 20 bp, Artificial
  CRISPR gRNA sequence
ggctactttaaatatctcat

SEQ ID NO: 288491 - DNA, 20 bp, Artificial
  CRISPR gRNA sequence
gctactttaaatatctcata

SEQ ID NO: 288492 - DNA, 20 bp, Artificial
  CRISPR gRNA sequence
ctttaaatatctcatagaaa

SEQ ID NO: 288493 - DNA, 20 bp, Artificial
  CRISPR gRNA sequence
taaatatctcatagaaatag

SEQ ID NO: 288494 - DNA, 20 bp, Artificial
  CRISPR gRNA sequence
aaatatctcatagaaataga

SEQ ID NO: 288495 - DNA, 20 bp, Artificial
  CRISPR gRNA sequence
aatatctcatagaaatagaa

SEQ ID NO: 288496 - DNA, 20 bp, Artificial
  CRISPR gRNA sequence
atagaaatagaatcatacag

SEQ ID NO: 288497 - DNA, 20 bp, Artificial
  CRISPR gRNA sequence
tttatgattggcttatttca

SEQ ID NO: 288498 - DNA, 20 bp, Artificial
  CRISPR gRNA sequence
atgattggcttatttcactt

SEQ ID NO: 288499 - DNA, 20 bp, Artificial
  CRISPR gRNA sequence
tgattggcttatttcactta

SEQ ID NO: 288500 - DNA, 20 bp, Artificial
  CRISPR gRNA sequence
gcttatttcacttagcatga

SEQ ID NO: 288501 - DNA, 20 bp, Artificial
  CRISPR gRNA sequence
atttcacttagcatgatgca

SEQ ID NO: 288502 - DNA, 20 bp, Artificial
  CRISPR gRNA sequence
tttcacttagcatgatgcac

SEQ ID NO: 288503 - DNA, 20 bp, Artificial
  CRISPR gRNA sequence
cacttagcatgatgcactca

SEQ ID NO: 288504 - DNA, 20 bp, Artificial
  CRISPR gRNA sequence
acttagcatgatgcactcaa

SEQ ID NO: 288505 - DNA, 20 bp, Artificial
  CRISPR gRNA sequence
agcatgatgcactcaaggtt

SEQ ID NO: 288506 - DNA, 20 bp, Artificial
  CRISPR gRNA sequence
gcatgatgcactcaaggttc

SEQ ID NO: 288507 - DNA, 20 bp, Artificial
  CRISPR gRNA sequence
aaggttcattcacgttgtag

SEQ ID NO: 288508 - DNA, 20 bp, Artificial
  CRISPR gRNA sequence
attcacgttgtagcatatga

SEQ ID NO: 288509 - DNA, 20 bp, Artificial
  CRISPR gRNA sequence
acgttgtagcatatgatagg

SEQ ID NO: 288510 - DNA, 20 bp, Artificial
  CRISPR gRNA sequence
tagcatatgataggatttcc

SEQ ID NO: 288511 - DNA, 20 bp, Artificial
  CRISPR gRNA sequence
ccttcctttggaatggtaat

SEQ ID NO: 288512 - DNA, 20 bp, Artificial
  CRISPR gRNA sequence
cttcctttggaatggtaatg

SEQ ID NO: 288513 - DNA, 20 bp, Artificial
  CRISPR gRNA sequence
cctttggaatggtaatgata

SEQ ID NO: 288514 - DNA, 20 bp, Artificial
  CRISPR gRNA sequence
ctttggaatggtaatgatat

SEQ ID NO: 288515 - DNA, 20 bp, Artificial
  CRISPR gRNA sequence
tggaatggtaatgatatgat

SEQ ID NO: 288516 - DNA, 20 bp, Artificial
  CRISPR gRNA sequence
ggaatggtaatgatatgatc

SEQ ID NO: 288517 - DNA, 20 bp, Artificial
  CRISPR gRNA sequence
gaatggtaatgatatgatca

SEQ ID NO: 288518 - DNA, 20 bp, Artificial
  CRISPR gRNA sequence
cacacacacccccccccaca

SEQ ID NO: 288519 - DNA, 20 bp, Artificial
  CRISPR gRNA sequence
tgtttgcccattcatctgta

SEQ ID NO: 288520 - DNA, 20 bp, Artificial
  CRISPR gRNA sequence
gtttgcccattcatctgtag

SEQ ID NO: 288521 - DNA, 20 bp, Artificial
  CRISPR gRNA sequence
tttgcccattcatctgtaga

SEQ ID NO: 288522 - DNA, 20 bp, Artificial
  CRISPR gRNA sequence
gcccattcatctgtagatgg

SEQ ID NO: 288523 - DNA, 20 bp, Artificial
  CRISPR gRNA sequence
cccattcatctgtagatgga

SEQ ID NO: 288524 - DNA, 20 bp, Artificial
  CRISPR gRNA sequence
atctgtagatggacatttgg

SEQ ID NO: 288525 - DNA, 20 bp, Artificial
  CRISPR gRNA sequence
tagatggacatttggcttgc

SEQ ID NO: 288526 - DNA, 20 bp, Artificial
  CRISPR gRNA sequence
ggcttgcttcccacctcctg

SEQ ID NO: 288527 - DNA, 20 bp, Artificial
  CRISPR gRNA sequence
gcttgcttcccacctcctgg

SEQ ID NO: 288528 - DNA, 20 bp, Artificial
  CRISPR gRNA sequence
gcttcccacctcctggctac

SEQ ID NO: 288529 - DNA, 20 bp, Artificial
  CRISPR gRNA sequence
cttcccacctcctggctact

SEQ ID NO: 288530 - DNA, 20 bp, Artificial
  CRISPR gRNA sequence
cccacctcctggctactgtg

SEQ ID NO: 288531 - DNA, 20 bp, Artificial
  CRISPR gRNA sequence
ccacctcctggctactgtgc

SEQ ID NO: 288532 - DNA, 20 bp, Artificial
  CRISPR gRNA sequence
ctggctactgtgctgctatg

SEQ ID NO: 288533 - DNA, 20 bp, Artificial
  CRISPR gRNA sequence
gctactgtgctgctatgaac

SEQ ID NO: 288534 - DNA, 20 bp, Artificial
  CRISPR gRNA sequence
ctgtgctgctatgaacatgg

SEQ ID NO: 288535 - DNA, 20 bp, Artificial
  CRISPR gRNA sequence
tgctgctatgaacatgggtg

SEQ ID NO: 288536 - DNA, 20 bp, Artificial
  CRISPR gRNA sequence
ctatgaacatgggtgtgcaa

SEQ ID NO: 288537 - DNA, 20 bp, Artificial
  CRISPR gRNA sequence
tgaacatgggtgtgcaaata

SEQ ID NO: 288538 - DNA, 20 bp, Artificial
  CRISPR gRNA sequence
ttcaagaccctgctttcaat

SEQ ID NO: 288539 - DNA, 20 bp, Artificial
  CRISPR gRNA sequence
caagaccctgctttcaattc

SEQ ID NO: 288540 - DNA, 20 bp, Artificial
  CRISPR gRNA sequence
aagaccctgctttcaattct

SEQ ID NO: 288541 - DNA, 20 bp, Artificial
  CRISPR gRNA sequence
ctttcaattcttatggatat

SEQ ID NO: 288542 - DNA, 20 bp, Artificial
  CRISPR gRNA sequence
tcaattcttatggatatatg

SEQ ID NO: 288543 - DNA, 20 bp, Artificial
  CRISPR gRNA sequence
caattcttatggatatatgg

SEQ ID NO: 288544 - DNA, 20 bp, Artificial
  CRISPR gRNA sequence
aattcttatggatatatgga

SEQ ID NO: 288545 - DNA, 20 bp, Artificial
  CRISPR gRNA sequence
ttatggatatatggaatttt

SEQ ID NO: 288546 - DNA, 20 bp, Artificial
  CRISPR gRNA sequence
atggatatatggaattttgg

SEQ ID NO: 288547 - DNA, 20 bp, Artificial
  CRISPR gRNA sequence
tggatatatggaattttggg

SEQ ID NO: 288548 - DNA, 20 bp, Artificial
  CRISPR gRNA sequence
tggggtcatatggtagttct

SEQ ID NO: 288549 - DNA, 20 bp, Artificial
  CRISPR gRNA sequence
ggggtcatatggtagttcta

SEQ ID NO: 288550 - DNA, 20 bp, Artificial
  CRISPR gRNA sequence
gggtcatatggtagttctat

SEQ ID NO: 288551 - DNA, 20 bp, Artificial
  CRISPR gRNA sequence
tatttttaattttctgagga

SEQ ID NO: 288552 - DNA, 20 bp, Artificial
  CRISPR gRNA sequence
tttttaattttctgaggaac

SEQ ID NO: 288553 - DNA, 20 bp, Artificial
  CRISPR gRNA sequence
ttaattttctgaggaacctc

SEQ ID NO: 288554 - DNA, 20 bp, Artificial
  CRISPR gRNA sequence
taattttctgaggaacctca

SEQ ID NO: 288555 - DNA, 20 bp, Artificial
  CRISPR gRNA sequence
aattttctgaggaacctcaa

SEQ ID NO: 288556 - DNA, 20 bp, Artificial
  CRISPR gRNA sequence
attttctgaggaacctcaat

SEQ ID NO: 288557 - DNA, 20 bp, Artificial
  CRISPR gRNA sequence
tctgaggaacctcaatagtg

SEQ ID NO: 288558 - DNA, 20 bp, Artificial
  CRISPR gRNA sequence
ctgaggaacctcaatagtgt

SEQ ID NO: 288559 - DNA, 20 bp, Artificial
  CRISPR gRNA sequence
tgaggaacctcaatagtgtt

SEQ ID NO: 288560 - DNA, 20 bp, Artificial
  CRISPR gRNA sequence
aggaacctcaatagtgtttt

SEQ ID NO: 288561 - DNA, 20 bp, Artificial
  CRISPR gRNA sequence
aatagtgttttctatagcag

SEQ ID NO: 288562 - DNA, 20 bp, Artificial
  CRISPR gRNA sequence
tctatagcagttgcacccgc

SEQ ID NO: 288563 - DNA, 20 bp, Artificial
  CRISPR gRNA sequence
ctatagcagttgcacccgca

SEQ ID NO: 288564 - DNA, 20 bp, Artificial
  CRISPR gRNA sequence
tatagcagttgcacccgcaa

SEQ ID NO: 288565 - DNA, 20 bp, Artificial
  CRISPR gRNA sequence
tagcagttgcacccgcaatg

SEQ ID NO: 288566 - DNA, 20 bp, Artificial
  CRISPR gRNA sequence
cacccgcaatgcttgttaaa

SEQ ID NO: 288567 - DNA, 20 bp, Artificial
  CRISPR gRNA sequence
gttaaaggttttggaagtca

SEQ ID NO: 288568 - DNA, 20 bp, Artificial
  CRISPR gRNA sequence
ttaaaggttttggaagtcac

SEQ ID NO: 288569 - DNA, 20 bp, Artificial
  CRISPR gRNA sequence
aaggttttggaagtcactat

SEQ ID NO: 288570 - DNA, 20 bp, Artificial
  CRISPR gRNA sequence
tggaagtcactatctagaaa

SEQ ID NO: 288571 - DNA, 20 bp, Artificial
  CRISPR gRNA sequence
ggaagtcactatctagaaaa

SEQ ID NO: 288572 - DNA, 20 bp, Artificial
  CRISPR gRNA sequence
gaagtcactatctagaaaaa

SEQ ID NO: 288573 - DNA, 20 bp, Artificial
  CRISPR gRNA sequence
tctagaaaaactaaatgtga

SEQ ID NO: 288574 - DNA, 20 bp, Artificial
  CRISPR gRNA sequence
gaaaaactaaatgtgattgc

SEQ ID NO: 288575 - DNA, 20 bp, Artificial
  CRISPR gRNA sequence
aatgtgattgcataaaaaac

SEQ ID NO: 288576 - DNA, 20 bp, Artificial
  CRISPR gRNA sequence
cataaaaaacaaatttggtt

SEQ ID NO: 288577 - DNA, 20 bp, Artificial
  CRISPR gRNA sequence
ggttttgaaaacaatgaaga

SEQ ID NO: 288578 - DNA, 20 bp, Artificial
  CRISPR gRNA sequence
gttttgaaaacaatgaagac

SEQ ID NO: 288579 - DNA, 20 bp, Artificial
  CRISPR gRNA sequence
tgaaaacaatgaagacaaat

SEQ ID NO: 288580 - DNA, 20 bp, Artificial
  CRISPR gRNA sequence
gaaaacaatgaagacaaatc

SEQ ID NO: 288581 - DNA, 20 bp, Artificial
  CRISPR gRNA sequence
aaaacaatgaagacaaatca

SEQ ID NO: 288582 - DNA, 20 bp, Artificial
  CRISPR gRNA sequence
aaatcagactcatggaccaa

SEQ ID NO: 288583 - DNA, 20 bp, Artificial
  CRISPR gRNA sequence
atggaccaatcattataaca

SEQ ID NO: 288584 - DNA, 20 bp, Artificial
  CRISPR gRNA sequence
taacataacctatccccttc

SEQ ID NO: 288585 - DNA, 20 bp, Artificial
  CRISPR gRNA sequence
tccccttcctttttcttgag

SEQ ID NO: 288586 - DNA, 20 bp, Artificial
  CRISPR gRNA sequence
cctttttcttgagaattttc

SEQ ID NO: 288587 - DNA, 20 bp, Artificial
  CRISPR gRNA sequence
ctttttcttgagaattttcc

SEQ ID NO: 288588 - DNA, 20 bp, Artificial
  CRISPR gRNA sequence
tttcttgagaattttccaat

SEQ ID NO: 288589 - DNA, 20 bp, Artificial
  CRISPR gRNA sequence
ttcttgagaattttccaatg

SEQ ID NO: 288590 - DNA, 20 bp, Artificial
  CRISPR gRNA sequence
tcttgagaattttccaatga

SEQ ID NO: 288591 - DNA, 20 bp, Artificial
  CRISPR gRNA sequence
cttgagaattttccaatgac

SEQ ID NO: 288592 - DNA, 20 bp, Artificial
  CRISPR gRNA sequence
ttgagaattttccaatgaca

SEQ ID NO: 288593 - DNA, 20 bp, Artificial
  CRISPR gRNA sequence
gagaattttccaatgacatg

SEQ ID NO: 288594 - DNA, 20 bp, Artificial
  CRISPR gRNA sequence
agaattttccaatgacatgc

SEQ ID NO: 288595 - DNA, 20 bp, Artificial
  CRISPR gRNA sequence
tccaatgacatgcaagattt

SEQ ID NO: 288596 - DNA, 20 bp, Artificial
  CRISPR gRNA sequence
ccaatgacatgcaagattta

SEQ ID NO: 288597 - DNA, 20 bp, Artificial
  CRISPR gRNA sequence
caatgacatgcaagatttag

SEQ ID NO: 288598 - DNA, 20 bp, Artificial
  CRISPR gRNA sequence
aggagcatatgagccttctc

SEQ ID NO: 288599 - DNA, 20 bp, Artificial
  CRISPR gRNA sequence
ggagcatatgagccttctct

SEQ ID NO: 288600 - DNA, 20 bp, Artificial
  CRISPR gRNA sequence
ctctcacagcaggcaatttt

SEQ ID NO: 288601 - DNA, 20 bp, Artificial
  CRISPR gRNA sequence
tctcacagcaggcaattttt

SEQ ID NO: 288602 - DNA, 20 bp, Artificial
  CRISPR gRNA sequence
tcacagcaggcaatttttag

SEQ ID NO: 288603 - DNA, 20 bp, Artificial
  CRISPR gRNA sequence
acagcaggcaatttttagtc

SEQ ID NO: 288604 - DNA, 20 bp, Artificial
  CRISPR gRNA sequence
ttagtcctattacttcttat

SEQ ID NO: 288605 - DNA, 20 bp, Artificial
  CRISPR gRNA sequence
tagtcctattacttcttatt

SEQ ID NO: 288606 - DNA, 20 bp, Artificial
  CRISPR gRNA sequence
agtcctattacttcttattt

SEQ ID NO: 288607 - DNA, 20 bp, Artificial
  CRISPR gRNA sequence
gtcctattacttcttatttg

SEQ ID NO: 288608 - DNA, 20 bp, Artificial
  CRISPR gRNA sequence
ttacttcttatttggtttac

SEQ ID NO: 288609 - DNA, 20 bp, Artificial
  CRISPR gRNA sequence
cttcttatttggtttaccta

SEQ ID NO: 288610 - DNA, 20 bp, Artificial
  CRISPR gRNA sequence
cttatttggtttacctaaca

SEQ ID NO: 288611 - DNA, 20 bp, Artificial
  CRISPR gRNA sequence
ttatttggtttacctaacac

SEQ ID NO: 288612 - DNA, 20 bp, Artificial
  CRISPR gRNA sequence
atttggtttacctaacacaa

SEQ ID NO: 288613 - DNA, 20 bp, Artificial
  CRISPR gRNA sequence
tttggtttacctaacacaat

SEQ ID NO: 288614 - DNA, 20 bp, Artificial
  CRISPR gRNA sequence
ggtttacctaacacaatacc

SEQ ID NO: 288615 - DNA, 20 bp, Artificial
  CRISPR gRNA sequence
gtttacctaacacaatacca

SEQ ID NO: 288616 - DNA, 20 bp, Artificial
  CRISPR gRNA sequence
acctaacacaataccacccc

SEQ ID NO: 288617 - DNA, 20 bp, Artificial
  CRISPR gRNA sequence
cctaacacaataccaccccc

SEQ ID NO: 288618 - DNA, 20 bp, Artificial
  CRISPR gRNA sequence
acacaataccacccccaaga

SEQ ID NO: 288619 - DNA, 20 bp, Artificial
  CRISPR gRNA sequence
actaaggttctgggtacagt

SEQ ID NO: 288620 - DNA, 20 bp, Artificial
  CRISPR gRNA sequence
aggttctgggtacagtggtg

SEQ ID NO: 288621 - DNA, 20 bp, Artificial
  CRISPR gRNA sequence
tgggtacagtggtggtggag

SEQ ID NO: 288622 - DNA, 20 bp, Artificial
  CRISPR gRNA sequence
ggtacagtggtggtggagga

SEQ ID NO: 288623 - DNA, 20 bp, Artificial
  CRISPR gRNA sequence
ttgcccacctctgtctagat

SEQ ID NO: 288624 - DNA, 20 bp, Artificial
  CRISPR gRNA sequence
cccacctctgtctagatagc

SEQ ID NO: 288625 - DNA, 20 bp, Artificial
  CRISPR gRNA sequence
tgtctagatagcctatattg

SEQ ID NO: 288626 - DNA, 20 bp, Artificial
  CRISPR gRNA sequence
tctagatagcctatattgaa

SEQ ID NO: 288627 - DNA, 20 bp, Artificial
  CRISPR gRNA sequence
gatagcctatattgaattac

SEQ ID NO: 288628 - DNA, 20 bp, Artificial
  CRISPR gRNA sequence
tattgaattactcttcatac

SEQ ID NO: 288629 - DNA, 20 bp, Artificial
  CRISPR gRNA sequence
aattactcttcatactattt

SEQ ID NO: 288630 - DNA, 20 bp, Artificial
  CRISPR gRNA sequence
ctcttcatactatttccttt

SEQ ID NO: 288631 - DNA, 20 bp, Artificial
  CRISPR gRNA sequence
ttcatactatttcctttttt

SEQ ID NO: 288632 - DNA, 20 bp, Artificial
  CRISPR gRNA sequence
catactatttcctttttttg

SEQ ID NO: 288633 - DNA, 20 bp, Artificial
  CRISPR gRNA sequence
atactatttcctttttttgc

SEQ ID NO: 288634 - DNA, 20 bp, Artificial
  CRISPR gRNA sequence
tttcctttttttgcttcctc

SEQ ID NO: 288635 - DNA, 20 bp, Artificial
  CRISPR gRNA sequence
cctttttttgcttcctctgt

SEQ ID NO: 288636 - DNA, 20 bp, Artificial
  CRISPR gRNA sequence
ctttttttgcttcctctgtg

SEQ ID NO: 288637 - DNA, 20 bp, Artificial
  CRISPR gRNA sequence
tttttgcttcctctgtggtg

SEQ ID NO: 288638 - DNA, 20 bp, Artificial
  CRISPR gRNA sequence
ttttgcttcctctgtggtgg

SEQ ID NO: 288639 - DNA, 20 bp, Artificial
  CRISPR gRNA sequence
tttgcttcctctgtggtggc

SEQ ID NO: 288640 - DNA, 20 bp, Artificial
  CRISPR gRNA sequence
ttgcttcctctgtggtggct

SEQ ID NO: 288641 - DNA, 20 bp, Artificial
  CRISPR gRNA sequence
tgcttcctctgtggtggctc

SEQ ID NO: 288642 - DNA, 20 bp, Artificial
  CRISPR gRNA sequence
gcttcctctgtggtggctct

SEQ ID NO: 288643 - DNA, 20 bp, Artificial
  CRISPR gRNA sequence
cttcctctgtggtggctcta

SEQ ID NO: 288644 - DNA, 20 bp, Artificial
  CRISPR gRNA sequence
cctctgtggtggctctatgg

SEQ ID NO: 288645 - DNA, 20 bp, Artificial
  CRISPR gRNA sequence
ctctgtggtggctctatgga

SEQ ID NO: 288646 - DNA, 20 bp, Artificial
  CRISPR gRNA sequence
tgtggtggctctatggaggg

SEQ ID NO: 288647 - DNA, 20 bp, Artificial
  CRISPR gRNA sequence
tggtggctctatggagggga

SEQ ID NO: 288648 - DNA, 20 bp, Artificial
  CRISPR gRNA sequence
tatggaggggacaggtgcta

SEQ ID NO: 288649 - DNA, 20 bp, Artificial
  CRISPR gRNA sequence
tggaggggacaggtgctatg

SEQ ID NO: 288650 - DNA, 20 bp, Artificial
  CRISPR gRNA sequence
tgtcatttaatcccccaaca

SEQ ID NO: 288651 - DNA, 20 bp, Artificial
  CRISPR gRNA sequence
aatcccccaacaaccccaca

SEQ ID NO: 288652 - DNA, 20 bp, Artificial
  CRISPR gRNA sequence
atcccccaacaaccccacaa

SEQ ID NO: 288653 - DNA, 20 bp, Artificial
  CRISPR gRNA sequence
ttttccccattttgcagctg

SEQ ID NO: 288654 - DNA, 20 bp, Artificial
  CRISPR gRNA sequence
tccccattttgcagctgaga

SEQ ID NO: 288655 - DNA, 20 bp, Artificial
  CRISPR gRNA sequence
ccccattttgcagctgagac

SEQ ID NO: 288656 - DNA, 20 bp, Artificial
  CRISPR gRNA sequence
cccattttgcagctgagaca

SEQ ID NO: 288657 - DNA, 20 bp, Artificial
  CRISPR gRNA sequence
tgcagctgagacaactgaga

SEQ ID NO: 288658 - DNA, 20 bp, Artificial
  CRISPR gRNA sequence
gcagctgagacaactgagag

SEQ ID NO: 288659 - DNA, 20 bp, Artificial
  CRISPR gRNA sequence
cagctgagacaactgagaga

SEQ ID NO: 288660 - DNA, 20 bp, Artificial
  CRISPR gRNA sequence
agacaactgagagattgaga

SEQ ID NO: 288661 - DNA, 20 bp, Artificial
  CRISPR gRNA sequence
agagattgagaggttcagga

SEQ ID NO: 288662 - DNA, 20 bp, Artificial
  CRISPR gRNA sequence
agaggttcaggaagtctagg

SEQ ID NO: 288663 - DNA, 20 bp, Artificial
  CRISPR gRNA sequence
aggaagtctaggacagggca

SEQ ID NO: 288664 - DNA, 20 bp, Artificial
  CRISPR gRNA sequence
ggacagggcaggtcagcctg

SEQ ID NO: 288665 - DNA, 20 bp, Artificial
  CRISPR gRNA sequence
agattccaagggcctatgat

SEQ ID NO: 288666 - DNA, 20 bp, Artificial
  CRISPR gRNA sequence
caagggcctatgattctgca

SEQ ID NO: 288667 - DNA, 20 bp, Artificial
  CRISPR gRNA sequence
tgattctgcagtcatgacga

SEQ ID NO: 288668 - DNA, 20 bp, Artificial
  CRISPR gRNA sequence
tgcagtcatgacgaagaata

SEQ ID NO: 288669 - DNA, 20 bp, Artificial
  CRISPR gRNA sequence
cagtcatgacgaagaataag

SEQ ID NO: 288670 - DNA, 20 bp, Artificial
  CRISPR gRNA sequence
agaagaaaaaagagggccat

SEQ ID NO: 288671 - DNA, 20 bp, Artificial
  CRISPR gRNA sequence
taaataggtagggaatataa

SEQ ID NO: 288672 - DNA, 20 bp, Artificial
  CRISPR gRNA sequence
aaataggtagggaatataat

SEQ ID NO: 288673 - DNA, 20 bp, Artificial
  CRISPR gRNA sequence
aataggtagggaatataatc

SEQ ID NO: 288674 - DNA, 20 bp, Artificial
  CRISPR gRNA sequence
cattattcatgaattctcac

SEQ ID NO: 288675 - DNA, 20 bp, Artificial
  CRISPR gRNA sequence
attattcatgaattctcact

SEQ ID NO: 288676 - DNA, 20 bp, Artificial
  CRISPR gRNA sequence
ttcatgaattctcacttaca

SEQ ID NO: 288677 - DNA, 20 bp, Artificial
  CRISPR gRNA sequence
atgaattctcacttacagaa

SEQ ID NO: 288678 - DNA, 20 bp, Artificial
  CRISPR gRNA sequence
tcacttacagaaggcctcct

SEQ ID NO: 288679 - DNA, 20 bp, Artificial
  CRISPR gRNA sequence
acttacagaaggcctccttc

SEQ ID NO: 288680 - DNA, 20 bp, Artificial
  CRISPR gRNA sequence
acagaaggcctccttcttgg

SEQ ID NO: 288681 - DNA, 20 bp, Artificial
  CRISPR gRNA sequence
cagaaggcctccttcttgga

SEQ ID NO: 288682 - DNA, 20 bp, Artificial
  CRISPR gRNA sequence
cttcttggatctgttgcctg

SEQ ID NO: 288683 - DNA, 20 bp, Artificial
  CRISPR gRNA sequence
cttggatctgttgcctggtc

SEQ ID NO: 288684 - DNA, 20 bp, Artificial
  CRISPR gRNA sequence
ttggatctgttgcctggtca

SEQ ID NO: 288685 - DNA, 20 bp, Artificial
  CRISPR gRNA sequence
ggatctgttgcctggtcact

SEQ ID NO: 288686 - DNA, 20 bp, Artificial
  CRISPR gRNA sequence
gatctgttgcctggtcactt

SEQ ID NO: 288687 - DNA, 20 bp, Artificial
  CRISPR gRNA sequence
ttgcctggtcacttgattag

SEQ ID NO: 288688 - DNA, 20 bp, Artificial
  CRISPR gRNA sequence
cctggtcacttgattaggta

SEQ ID NO: 288689 - DNA, 20 bp, Artificial
  CRISPR gRNA sequence
gtcacttgattaggtaattt

SEQ ID NO: 288690 - DNA, 20 bp, Artificial
  CRISPR gRNA sequence
gattaggtaattttcagcta

SEQ ID NO: 288691 - DNA, 20 bp, Artificial
  CRISPR gRNA sequence
attaggtaattttcagctac

SEQ ID NO: 288692 - DNA, 20 bp, Artificial
  CRISPR gRNA sequence
ggtaattttcagctactact

SEQ ID NO: 288693 - DNA, 20 bp, Artificial
  CRISPR gRNA sequence
tcagctactactgccttgag

SEQ ID NO: 288694 - DNA, 20 bp, Artificial
  CRISPR gRNA sequence
cagctactactgccttgaga

SEQ ID NO: 288695 - DNA, 20 bp, Artificial
  CRISPR gRNA sequence
agctactactgccttgagaa

SEQ ID NO: 288696 - DNA, 20 bp, Artificial
  CRISPR gRNA sequence
ctactgccttgagaaataag

SEQ ID NO: 288697 - DNA, 20 bp, Artificial
  CRISPR gRNA sequence
ctgccttgagaaataaggaa

SEQ ID NO: 288698 - DNA, 20 bp, Artificial
  CRISPR gRNA sequence
ccttgagaaataaggaagaa

SEQ ID NO: 288699 - DNA, 20 bp, Artificial
  CRISPR gRNA sequence
gagaaataaggaagaatttc

SEQ ID NO: 288700 - DNA, 20 bp, Artificial
  CRISPR gRNA sequence
agaaataaggaagaatttca

SEQ ID NO: 288701 - DNA, 20 bp, Artificial
  CRISPR gRNA sequence
cactgtaaagacctagtctc

SEQ ID NO: 288702 - DNA, 20 bp, Artificial
  CRISPR gRNA sequence
actgtaaagacctagtctct

SEQ ID NO: 288703 - DNA, 20 bp, Artificial
  CRISPR gRNA sequence
taaagacctagtctctgatg

SEQ ID NO: 288704 - DNA, 20 bp, Artificial
  CRISPR gRNA sequence
gtctctgatgctcactgcct

SEQ ID NO: 288705 - DNA, 20 bp, Artificial
  CRISPR gRNA sequence
tgatgctcactgccttttcc

SEQ ID NO: 288706 - DNA, 20 bp, Artificial
  CRISPR gRNA sequence
atgctcactgccttttccct

SEQ ID NO: 288707 - DNA, 20 bp, Artificial
  CRISPR gRNA sequence
actgccttttcccttgcgtt

SEQ ID NO: 288708 - DNA, 20 bp, Artificial
  CRISPR gRNA sequence
ccttttcccttgcgtttctc

SEQ ID NO: 288709 - DNA, 20 bp, Artificial
  CRISPR gRNA sequence
ttcccttgcgtttctcctac

SEQ ID NO: 288710 - DNA, 20 bp, Artificial
  CRISPR gRNA sequence
tcccttgcgtttctcctaca

SEQ ID NO: 288711 - DNA, 20 bp, Artificial
  CRISPR gRNA sequence
cccttgcgtttctcctacag

SEQ ID NO: 288712 - DNA, 20 bp, Artificial
  CRISPR gRNA sequence
ccttgcgtttctcctacagc

SEQ ID NO: 288713 - DNA, 20 bp, Artificial
  CRISPR gRNA sequence
gcgtttctcctacagcccct

SEQ ID NO: 288714 - DNA, 20 bp, Artificial
  CRISPR gRNA sequence
cgtttctcctacagcccctc

SEQ ID NO: 288715 - DNA, 20 bp, Artificial
  CRISPR gRNA sequence
ctcctacagcccctctcccc

SEQ ID NO: 288716 - DNA, 20 bp, Artificial
  CRISPR gRNA sequence
tcctacagcccctctcccca

SEQ ID NO: 288717 - DNA, 20 bp, Artificial
  CRISPR gRNA sequence
ctacagcccctctccccaca

SEQ ID NO: 288718 - DNA, 20 bp, Artificial
  CRISPR gRNA sequence
cagcccctctccccacaatc

SEQ ID NO: 288719 - DNA, 20 bp, Artificial
  CRISPR gRNA sequence
tccccacaatcacgtgatgc

SEQ ID NO: 288720 - DNA, 20 bp, Artificial
  CRISPR gRNA sequence
cccacaatcacgtgatgcaa

SEQ ID NO: 288721 - DNA, 20 bp, Artificial
  CRISPR gRNA sequence
atttaaactacagaactgca

SEQ ID NO: 288722 - DNA, 20 bp, Artificial
  CRISPR gRNA sequence
aaactacagaactgcattta

SEQ ID NO: 288723 - DNA, 20 bp, Artificial
  CRISPR gRNA sequence
aactacagaactgcatttaa

SEQ ID NO: 288724 - DNA, 20 bp, Artificial
  CRISPR gRNA sequence
cagaactgcatttaaccgtg

SEQ ID NO: 288725 - DNA, 20 bp, Artificial
  CRISPR gRNA sequence
catttaaccgtgggaaaaat

SEQ ID NO: 288726 - DNA, 20 bp, Artificial
  CRISPR gRNA sequence
aaccgtgggaaaaatctaag

SEQ ID NO: 288727 - DNA, 20 bp, Artificial
  CRISPR gRNA sequence
accgtgggaaaaatctaaga

SEQ ID NO: 288728 - DNA, 20 bp, Artificial
  CRISPR gRNA sequence
agaataaattttatccagat

SEQ ID NO: 288729 - DNA, 20 bp, Artificial
  CRISPR gRNA sequence
tatccagattaagtgagcta

SEQ ID NO: 288730 - DNA, 20 bp, Artificial
  CRISPR gRNA sequence
atccagattaagtgagctaa

SEQ ID NO: 288731 - DNA, 20 bp, Artificial
  CRISPR gRNA sequence
tccagattaagtgagctaaa

SEQ ID NO: 288732 - DNA, 20 bp, Artificial
  CRISPR gRNA sequence
agtgagctaaagacaatcca

SEQ ID NO: 288733 - DNA, 20 bp, Artificial
  CRISPR gRNA sequence
aagacaatccatttcatgtg

SEQ ID NO: 288734 - DNA, 20 bp, Artificial
  CRISPR gRNA sequence
catgtgacttcagtggcgtg

SEQ ID NO: 288735 - DNA, 20 bp, Artificial
  CRISPR gRNA sequence
atgtgacttcagtggcgtgg

SEQ ID NO: 288736 - DNA, 20 bp, Artificial
  CRISPR gRNA sequence
cagtggcgtggcacaggaat

SEQ ID NO: 288737 - DNA, 20 bp, Artificial
  CRISPR gRNA sequence
agtggcgtggcacaggaata

SEQ ID NO: 288738 - DNA, 20 bp, Artificial
  CRISPR gRNA sequence
catctgtcaccttaatacac

SEQ ID NO: 288739 - DNA, 20 bp, Artificial
  CRISPR gRNA sequence
atctgtcaccttaatacaca

SEQ ID NO: 288740 - DNA, 20 bp, Artificial
  CRISPR gRNA sequence
tcaccttaatacacatcctg

SEQ ID NO: 288741 - DNA, 20 bp, Artificial
  CRISPR gRNA sequence
aatacacatcctgattcctc

SEQ ID NO: 288742 - DNA, 20 bp, Artificial
  CRISPR gRNA sequence
atacacatcctgattcctcc

SEQ ID NO: 288743 - DNA, 20 bp, Artificial
  CRISPR gRNA sequence
attcctccccttttcacttg

SEQ ID NO: 288744 - DNA, 20 bp, Artificial
  CRISPR gRNA sequence
ctccccttttcacttgagtg

SEQ ID NO: 288745 - DNA, 20 bp, Artificial
  CRISPR gRNA sequence
cccttttcacttgagtgact

SEQ ID NO: 288746 - DNA, 20 bp, Artificial
  CRISPR gRNA sequence
ttcacttgagtgacttagga

SEQ ID NO: 288747 - DNA, 20 bp, Artificial
  CRISPR gRNA sequence
tcacttgagtgacttaggat

SEQ ID NO: 288748 - DNA, 20 bp, Artificial
  CRISPR gRNA sequence
cacttgagtgacttaggatt

SEQ ID NO: 288749 - DNA, 20 bp, Artificial
  CRISPR gRNA sequence
acttgagtgacttaggattt

SEQ ID NO: 288750 - DNA, 20 bp, Artificial
  CRISPR gRNA sequence
gagtgacttaggatttaaag

SEQ ID NO: 288751 - DNA, 20 bp, Artificial
  CRISPR gRNA sequence
agtgacttaggatttaaagc

SEQ ID NO: 288752 - DNA, 20 bp, Artificial
  CRISPR gRNA sequence
aggatttaaagctctcagga

SEQ ID NO: 288753 - DNA, 20 bp, Artificial
  CRISPR gRNA sequence
ggatttaaagctctcaggac

SEQ ID NO: 288754 - DNA, 20 bp, Artificial
  CRISPR gRNA sequence
aaagctctcaggactgccta

SEQ ID NO: 288755 - DNA, 20 bp, Artificial
  CRISPR gRNA sequence
aagctctcaggactgcctac

SEQ ID NO: 288756 - DNA, 20 bp, Artificial
  CRISPR gRNA sequence
tcaggactgcctacttccct

SEQ ID NO: 288757 - DNA, 20 bp, Artificial
  CRISPR gRNA sequence
aggactgcctacttccctac

SEQ ID NO: 288758 - DNA, 20 bp, Artificial
  CRISPR gRNA sequence
cctacttccctacctacctt

SEQ ID NO: 288759 - DNA, 20 bp, Artificial
  CRISPR gRNA sequence
cttccctacctaccttaaag

SEQ ID NO: 288760 - DNA, 20 bp, Artificial
  CRISPR gRNA sequence
ccctacctaccttaaaggca

SEQ ID NO: 288761 - DNA, 20 bp, Artificial
  CRISPR gRNA sequence
cctacctaccttaaaggcaa

SEQ ID NO: 288762 - DNA, 20 bp, Artificial
  CRISPR gRNA sequence
cctaccttaaaggcaaccat

SEQ ID NO: 288763 - DNA, 20 bp, Artificial
  CRISPR gRNA sequence
ccttaaaggcaaccatgact

SEQ ID NO: 288764 - DNA, 20 bp, Artificial
  CRISPR gRNA sequence
aaaggcaaccatgactaagt

SEQ ID NO: 288765 - DNA, 20 bp, Artificial
  CRISPR gRNA sequence
aaggcaaccatgactaagtg

SEQ ID NO: 288766 - DNA, 20 bp, Artificial
  CRISPR gRNA sequence
agtgcaccctgctaacatcc

SEQ ID NO: 288767 - DNA, 20 bp, Artificial
  CRISPR gRNA sequence
ctaacatccttgcctagagg

SEQ ID NO: 288768 - DNA, 20 bp, Artificial
  CRISPR gRNA sequence
acatccttgcctagaggctc

SEQ ID NO: 288769 - DNA, 20 bp, Artificial
  CRISPR gRNA sequence
gcctagaggctcctggttgt

SEQ ID NO: 288770 - DNA, 20 bp, Artificial
  CRISPR gRNA sequence
cctagaggctcctggttgtt

SEQ ID NO: 288771 - DNA, 20 bp, Artificial
  CRISPR gRNA sequence
gaggctcctggttgttggta

SEQ ID NO: 288772 - DNA, 20 bp, Artificial
  CRISPR gRNA sequence
ctggttgttggtatagaaag

SEQ ID NO: 288773 - DNA, 20 bp, Artificial
  CRISPR gRNA sequence
gttgttggtatagaaagaac

SEQ ID NO: 288774 - DNA, 20 bp, Artificial
  CRISPR gRNA sequence
ttggtatagaaagaacatgg

SEQ ID NO: 288775 - DNA, 20 bp, Artificial
  CRISPR gRNA sequence
gtatagaaagaacatgggct

SEQ ID NO: 288776 - DNA, 20 bp, Artificial
  CRISPR gRNA sequence
ttttcattcaataaaatcca

SEQ ID NO: 288777 - DNA, 20 bp, Artificial
  CRISPR gRNA sequence
tttcattcaataaaatccac

SEQ ID NO: 288778 - DNA, 20 bp, Artificial
  CRISPR gRNA sequence
ttcattcaataaaatccaca

SEQ ID NO: 288779 - DNA, 20 bp, Artificial
  CRISPR gRNA sequence
tcattcaataaaatccacag

SEQ ID NO: 288780 - DNA, 20 bp, Artificial
  CRISPR gRNA sequence
cattcaataaaatccacagt

SEQ ID NO: 288781 - DNA, 20 bp, Artificial
  CRISPR gRNA sequence
attcaataaaatccacagta

SEQ ID NO: 288782 - DNA, 20 bp, Artificial
  CRISPR gRNA sequence
aataaaatccacagtagttg

SEQ ID NO: 288783 - DNA, 20 bp, Artificial
  CRISPR gRNA sequence
tgtgaccttaagcaacttac

SEQ ID NO: 288784 - DNA, 20 bp, Artificial
  CRISPR gRNA sequence
aagcaacttactttacttct

SEQ ID NO: 288785 - DNA, 20 bp, Artificial
  CRISPR gRNA sequence
agcaacttactttacttctc

SEQ ID NO: 288786 - DNA, 20 bp, Artificial
  CRISPR gRNA sequence
actttacttctctgaacccc

SEQ ID NO: 288787 - DNA, 20 bp, Artificial
  CRISPR gRNA sequence
ctttacttctctgaacccca

SEQ ID NO: 288788 - DNA, 20 bp, Artificial
  CRISPR gRNA sequence
tacttctctgaaccccagtc

SEQ ID NO: 288789 - DNA, 20 bp, Artificial
  CRISPR gRNA sequence
acttctctgaaccccagtct

SEQ ID NO: 288790 - DNA, 20 bp, Artificial
  CRISPR gRNA sequence
cttctctgaaccccagtctt

SEQ ID NO: 288791 - DNA, 20 bp, Artificial
  CRISPR gRNA sequence
ctctgaaccccagtcttcac

SEQ ID NO: 288792 - DNA, 20 bp, Artificial
  CRISPR gRNA sequence
tctgaaccccagtcttcaca

SEQ ID NO: 288793 - DNA, 20 bp, Artificial
  CRISPR gRNA sequence
tgaaccccagtcttcacatt

SEQ ID NO: 288794 - DNA, 20 bp, Artificial
  CRISPR gRNA sequence
aaccccagtcttcacattgg

SEQ ID NO: 288795 - DNA, 20 bp, Artificial
  CRISPR gRNA sequence
cacattggttattatgaaga

SEQ ID NO: 288796 - DNA, 20 bp, Artificial
  CRISPR gRNA sequence
acattggttattatgaagat

SEQ ID NO: 288797 - DNA, 20 bp, Artificial
  CRISPR gRNA sequence
gttattatgaagattaaatg

SEQ ID NO: 288798 - DNA, 20 bp, Artificial
  CRISPR gRNA sequence
ttatgaagattaaatgagat

SEQ ID NO: 288799 - DNA, 20 bp, Artificial
  CRISPR gRNA sequence
tgaagattaaatgagataat

SEQ ID NO: 288800 - DNA, 20 bp, Artificial
  CRISPR gRNA sequence
aatgagataatttatggcaa

SEQ ID NO: 288801 - DNA, 20 bp, Artificial
  CRISPR gRNA sequence
atggcaagcacatactgtaa

SEQ ID NO: 288802 - DNA, 20 bp, Artificial
  CRISPR gRNA sequence
tggcaagcacatactgtaat

SEQ ID NO: 288803 - DNA, 20 bp, Artificial
  CRISPR gRNA sequence
taattcaatgcctagaccca

SEQ ID NO: 288804 - DNA, 20 bp, Artificial
  CRISPR gRNA sequence
aatgcctagacccacaccaa

SEQ ID NO: 288805 - DNA, 20 bp, Artificial
  CRISPR gRNA sequence
gacccacaccaaatatgaat

SEQ ID NO: 288806 - DNA, 20 bp, Artificial
  CRISPR gRNA sequence
tcctttctccaagggggtgg

SEQ ID NO: 288807 - DNA, 20 bp, Artificial
  CRISPR gRNA sequence
ctttctccaagggggtgggg

SEQ ID NO: 288808 - DNA, 20 bp, Artificial
  CRISPR gRNA sequence
tctccaagggggtggggaat

SEQ ID NO: 288809 - DNA, 20 bp, Artificial
  CRISPR gRNA sequence
ctccaagggggtggggaatt

SEQ ID NO: 288810 - DNA, 20 bp, Artificial
  CRISPR gRNA sequence
tccaagggggtggggaattt

SEQ ID NO: 288811 - DNA, 20 bp, Artificial
  CRISPR gRNA sequence
caagggggtggggaatttac

SEQ ID NO: 288812 - DNA, 20 bp, Artificial
  CRISPR gRNA sequence
accaacctctaaggcttttg

SEQ ID NO: 288813 - DNA, 20 bp, Artificial
  CRISPR gRNA sequence
ccaacctctaaggcttttga

SEQ ID NO: 288814 - DNA, 20 bp, Artificial
  CRISPR gRNA sequence
taaggcttttgatttcgtct

SEQ ID NO: 288815 - DNA, 20 bp, Artificial
  CRISPR gRNA sequence
aggcttttgatttcgtcttt

SEQ ID NO: 288816 - DNA, 20 bp, Artificial
  CRISPR gRNA sequence
ttgatttcgtctttggacaa

SEQ ID NO: 288817 - DNA, 20 bp, Artificial
  CRISPR gRNA sequence
tgatttcgtctttggacaat

SEQ ID NO: 288818 - DNA, 20 bp, Artificial
  CRISPR gRNA sequence
gatttcgtctttggacaatt

SEQ ID NO: 288819 - DNA, 20 bp, Artificial
  CRISPR gRNA sequence
atttcgtctttggacaattt

SEQ ID NO: 288820 - DNA, 20 bp, Artificial
  CRISPR gRNA sequence
cgtctttggacaatttgact

SEQ ID NO: 288821 - DNA, 20 bp, Artificial
  CRISPR gRNA sequence
gtctttggacaatttgactg

SEQ ID NO: 288822 - DNA, 20 bp, Artificial
  CRISPR gRNA sequence
tggacaatttgactgaggaa

SEQ ID NO: 288823 - DNA, 20 bp, Artificial
  CRISPR gRNA sequence
ggacaatttgactgaggaag

SEQ ID NO: 288824 - DNA, 20 bp, Artificial
  CRISPR gRNA sequence
gacaatttgactgaggaagt

SEQ ID NO: 288825 - DNA, 20 bp, Artificial
  CRISPR gRNA sequence
gactgaggaagttttgcttt

SEQ ID NO: 288826 - DNA, 20 bp, Artificial
  CRISPR gRNA sequence
actgaggaagttttgctttg

SEQ ID NO: 288827 - DNA, 20 bp, Artificial
  CRISPR gRNA sequence
aggaagttttgctttgcttt

SEQ ID NO: 288828 - DNA, 20 bp, Artificial
  CRISPR gRNA sequence
tgctttgctttatgttgaag

SEQ ID NO: 288829 - DNA, 20 bp, Artificial
  CRISPR gRNA sequence
gctttgctttatgttgaagt

SEQ ID NO: 288830 - DNA, 20 bp, Artificial
  CRISPR gRNA sequence
ctttgctttatgttgaagtc

SEQ ID NO: 288831 - DNA, 20 bp, Artificial
  CRISPR gRNA sequence
tgctttatgttgaagtctgt

SEQ ID NO: 288832 - DNA, 20 bp, Artificial
  CRISPR gRNA sequence
gctttatgttgaagtctgtt

SEQ ID NO: 288833 - DNA, 20 bp, Artificial
  CRISPR gRNA sequence
ctttatgttgaagtctgttt

SEQ ID NO: 288834 - DNA, 20 bp, Artificial
  CRISPR gRNA sequence
tatgttgaagtctgtttccc

SEQ ID NO: 288835 - DNA, 20 bp, Artificial
  CRISPR gRNA sequence
atgttgaagtctgtttccct

SEQ ID NO: 288836 - DNA, 20 bp, Artificial
  CRISPR gRNA sequence
tgttgaagtctgtttccctc

SEQ ID NO: 288837 - DNA, 20 bp, Artificial
  CRISPR gRNA sequence
aagtctgtttccctctagct

SEQ ID NO: 288838 - DNA, 20 bp, Artificial
  CRISPR gRNA sequence
tttccctctagcttctacat

SEQ ID NO: 288839 - DNA, 20 bp, Artificial
  CRISPR gRNA sequence
ccctctagcttctacatgca

SEQ ID NO: 288840 - DNA, 20 bp, Artificial
  CRISPR gRNA sequence
cctctagcttctacatgcat

SEQ ID NO: 288841 - DNA, 20 bp, Artificial
  CRISPR gRNA sequence
tagcttctacatgcattaca

SEQ ID NO: 288842 - DNA, 20 bp, Artificial
  CRISPR gRNA sequence
gcttctacatgcattacaaa

SEQ ID NO: 288843 - DNA, 20 bp, Artificial
  CRISPR gRNA sequence
ctacatgcattacaaaacac

SEQ ID NO: 288844 - DNA, 20 bp, Artificial
  CRISPR gRNA sequence
tacatgcattacaaaacaca

SEQ ID NO: 288845 - DNA, 20 bp, Artificial
  CRISPR gRNA sequence
catgcattacaaaacacatc

SEQ ID NO: 288846 - DNA, 20 bp, Artificial
  CRISPR gRNA sequence
caaaacacatctcattcttc

SEQ ID NO: 288847 - DNA, 20 bp, Artificial
  CRISPR gRNA sequence
attcttcttatgtaacaaga

SEQ ID NO: 288848 - DNA, 20 bp, Artificial
  CRISPR gRNA sequence
ttcttatgtaacaagacttg

SEQ ID NO: 288849 - DNA, 20 bp, Artificial
  CRISPR gRNA sequence
cttatgtaacaagacttgca

SEQ ID NO: 288850 - DNA, 20 bp, Artificial
  CRISPR gRNA sequence
ttatgtaacaagacttgcag

SEQ ID NO: 288851 - DNA, 20 bp, Artificial
  CRISPR gRNA sequence
atgtaacaagacttgcagat

SEQ ID NO: 288852 - DNA, 20 bp, Artificial
  CRISPR gRNA sequence
tgtaacaagacttgcagata

SEQ ID NO: 288853 - DNA, 20 bp, Artificial
  CRISPR gRNA sequence
gcagatatctgaggatactt

SEQ ID NO: 288854 - DNA, 20 bp, Artificial
  CRISPR gRNA sequence
cagatatctgaggatactta

SEQ ID NO: 288855 - DNA, 20 bp, Artificial
  CRISPR gRNA sequence
aggatacttatatcctctct

SEQ ID NO: 288856 - DNA, 20 bp, Artificial
  CRISPR gRNA sequence
atatcctctctcagacagtt

SEQ ID NO: 288857 - DNA, 20 bp, Artificial
  CRISPR gRNA sequence
tatcctctctcagacagttc

SEQ ID NO: 288858 - DNA, 20 bp, Artificial
  CRISPR gRNA sequence
tctcagacagttctgcaggt

SEQ ID NO: 288859 - DNA, 20 bp, Artificial
  CRISPR gRNA sequence
tcagacagttctgcaggttc

SEQ ID NO: 288860 - DNA, 20 bp, Artificial
  CRISPR gRNA sequence
agacagttctgcaggttccc

SEQ ID NO: 288861 - DNA, 20 bp, Artificial
  CRISPR gRNA sequence
tgcaggttcccatctgcccc

SEQ ID NO: 288862 - DNA, 20 bp, Artificial
  CRISPR gRNA sequence
caggttcccatctgcccctg

SEQ ID NO: 288863 - DNA, 20 bp, Artificial
  CRISPR gRNA sequence
ccatctgcccctgttcctta

SEQ ID NO: 288864 - DNA, 20 bp, Artificial
  CRISPR gRNA sequence
cccctgttccttattgatgt

SEQ ID NO: 288865 - DNA, 20 bp, Artificial
  CRISPR gRNA sequence
ttccttattgatgtactgaa

SEQ ID NO: 288866 - DNA, 20 bp, Artificial
  CRISPR gRNA sequence
cttattgatgtactgaaagt

SEQ ID NO: 288867 - DNA, 20 bp, Artificial
  CRISPR gRNA sequence
attgatgtactgaaagtgag

SEQ ID NO: 288868 - DNA, 20 bp, Artificial
  CRISPR gRNA sequence
ttgatgtactgaaagtgagt

SEQ ID NO: 288869 - DNA, 20 bp, Artificial
  CRISPR gRNA sequence
atgtactgaaagtgagtacc

SEQ ID NO: 288870 - DNA, 20 bp, Artificial
  CRISPR gRNA sequence
aaagtgagtaccctcacttt

SEQ ID NO: 288871 - DNA, 20 bp, Artificial
  CRISPR gRNA sequence
actttcctcactacacagtt

SEQ ID NO: 288872 - DNA, 20 bp, Artificial
  CRISPR gRNA sequence
tcctcactacacagtttgat

SEQ ID NO: 288873 - DNA, 20 bp, Artificial
  CRISPR gRNA sequence
cctcactacacagtttgatt

SEQ ID NO: 288874 - DNA, 20 bp, Artificial
  CRISPR gRNA sequence
ctcactacacagtttgattt

SEQ ID NO: 288875 - DNA, 20 bp, Artificial
  CRISPR gRNA sequence
actacacagtttgatttgtg

SEQ ID NO: 288876 - DNA, 20 bp, Artificial
  CRISPR gRNA sequence
cacagtttgatttgtgtgta

SEQ ID NO: 288877 - DNA, 20 bp, Artificial
  CRISPR gRNA sequence
gatttgtgtgtatatttttt

SEQ ID NO: 288878 - DNA, 20 bp, Artificial
  CRISPR gRNA sequence
atttgtgtgtatattttttt

SEQ ID NO: 288879 - DNA, 20 bp, Artificial
  CRISPR gRNA sequence
gtgtgtatatttttttgaga

SEQ ID NO: 288880 - DNA, 20 bp, Artificial
  CRISPR gRNA sequence
tgtgtatatttttttgagag

SEQ ID NO: 288881 - DNA, 20 bp, Artificial
  CRISPR gRNA sequence
ttttgagagagcgaagtcac

SEQ ID NO: 288882 - DNA, 20 bp, Artificial
  CRISPR gRNA sequence
tttgagagagcgaagtcact

SEQ ID NO: 288883 - DNA, 20 bp, Artificial
  CRISPR gRNA sequence
ttgagagagcgaagtcacta

SEQ ID NO: 288884 - DNA, 20 bp, Artificial
  CRISPR gRNA sequence
tgagagagcgaagtcactaa

SEQ ID NO: 288885 - DNA, 20 bp, Artificial
  CRISPR gRNA sequence
gagagagcgaagtcactaaa

SEQ ID NO: 288886 - DNA, 20 bp, Artificial
  CRISPR gRNA sequence
agagagcgaagtcactaaat

SEQ ID NO: 288887 - DNA, 20 bp, Artificial
  CRISPR gRNA sequence
aatctagcattccagacatc

SEQ ID NO: 288888 - DNA, 20 bp, Artificial
  CRISPR gRNA sequence
gcattccagacatccactgt

SEQ ID NO: 288889 - DNA, 20 bp, Artificial
  CRISPR gRNA sequence
cagacatccactgtgtgatt

SEQ ID NO: 288890 - DNA, 20 bp, Artificial
  CRISPR gRNA sequence
tgtgattggctcagagtaga

SEQ ID NO: 288891 - DNA, 20 bp, Artificial
  CRISPR gRNA sequence
gctcagagtagaaccgggtt

SEQ ID NO: 288892 - DNA, 20 bp, Artificial
  CRISPR gRNA sequence
agagtagaaccgggttgtca

SEQ ID NO: 288893 - DNA, 20 bp, Artificial
  CRISPR gRNA sequence
tcacttcctttacctaaatc

SEQ ID NO: 288894 - DNA, 20 bp, Artificial
  CRISPR gRNA sequence
cctttacctaaatctatgtt

SEQ ID NO: 288895 - DNA, 20 bp, Artificial
  CRISPR gRNA sequence
ctttacctaaatctatgttt

SEQ ID NO: 288896 - DNA, 20 bp, Artificial
  CRISPR gRNA sequence
tacctaaatctatgtttgca

SEQ ID NO: 288897 - DNA, 20 bp, Artificial
  CRISPR gRNA sequence
acctaaatctatgtttgcag

SEQ ID NO: 288898 - DNA, 20 bp, Artificial
  CRISPR gRNA sequence
cctaaatctatgtttgcagc

SEQ ID NO: 288899 - DNA, 20 bp, Artificial
  CRISPR gRNA sequence
aatctatgtttgcagcctaa

SEQ ID NO: 288900 - DNA, 20 bp, Artificial
  CRISPR gRNA sequence
tgtttgcagcctaaagttga

SEQ ID NO: 288901 - DNA, 20 bp, Artificial
  CRISPR gRNA sequence
gcagcctaaagttgaattca

SEQ ID NO: 288902 - DNA, 20 bp, Artificial
  CRISPR gRNA sequence
cagcctaaagttgaattcaa

SEQ ID NO: 288903 - DNA, 20 bp, Artificial
  CRISPR gRNA sequence
aagttgaattcaatatatta

SEQ ID NO: 288904 - DNA, 20 bp, Artificial
  CRISPR gRNA sequence
aattcaatatattagcagcc

SEQ ID NO: 288905 - DNA, 20 bp, Artificial
  CRISPR gRNA sequence
aatatattagcagccacctt

SEQ ID NO: 288906 - DNA, 20 bp, Artificial
  CRISPR gRNA sequence
gcagccaccttacacctttg

SEQ ID NO: 288907 - DNA, 20 bp, Artificial
  CRISPR gRNA sequence
acacctttgatataactatt

SEQ ID NO: 288908 - DNA, 20 bp, Artificial
  CRISPR gRNA sequence
cacctttgatataactattg

SEQ ID NO: 288909 - DNA, 20 bp, Artificial
  CRISPR gRNA sequence
tgatataactattgatatac

SEQ ID NO: 288910 - DNA, 20 bp, Artificial
  CRISPR gRNA sequence
gatataactattgatatact

SEQ ID NO: 288911 - DNA, 20 bp, Artificial
  CRISPR gRNA sequence
atataactattgatatactg

SEQ ID NO: 288912 - DNA, 20 bp, Artificial
  CRISPR gRNA sequence
ttgatatactgacaagcaaa

SEQ ID NO: 288913 - DNA, 20 bp, Artificial
  CRISPR gRNA sequence
atatactgacaagcaaattg

SEQ ID NO: 288914 - DNA, 20 bp, Artificial
  CRISPR gRNA sequence
acaagcaaattgccttattt

SEQ ID NO: 288915 - DNA, 20 bp, Artificial
  CRISPR gRNA sequence
ccttatttttccacctatac

SEQ ID NO: 288916 - DNA, 20 bp, Artificial
  CRISPR gRNA sequence
atttttccacctatacatac

SEQ ID NO: 288917 - DNA, 20 bp, Artificial
  CRISPR gRNA sequence
tttttccacctatacatacc

SEQ ID NO: 288918 - DNA, 20 bp, Artificial
  CRISPR gRNA sequence
ttccacctatacataccact

SEQ ID NO: 288919 - DNA, 20 bp, Artificial
  CRISPR gRNA sequence
tccacctatacataccactg

SEQ ID NO: 288920 - DNA, 20 bp, Artificial
  CRISPR gRNA sequence
ccacctatacataccactgt

SEQ ID NO: 288921 - DNA, 20 bp, Artificial
  CRISPR gRNA sequence
cacctatacataccactgtg

SEQ ID NO: 288922 - DNA, 20 bp, Artificial
  CRISPR gRNA sequence
tacataccactgtgtgctgc

SEQ ID NO: 288923 - DNA, 20 bp, Artificial
  CRISPR gRNA sequence
tgtgctgctcctacatccag

SEQ ID NO: 288924 - DNA, 20 bp, Artificial
  CRISPR gRNA sequence
ctcctacatccagttcaaca

SEQ ID NO: 288925 - DNA, 20 bp, Artificial
  CRISPR gRNA sequence
ctacatccagttcaacaccc

SEQ ID NO: 288926 - DNA, 20 bp, Artificial
  CRISPR gRNA sequence
catccagttcaacaccccac

SEQ ID NO: 288927 - DNA, 20 bp, Artificial
  CRISPR gRNA sequence
aacaccccaccaaatgggta

SEQ ID NO: 288928 - DNA, 20 bp, Artificial
  CRISPR gRNA sequence
ttccagtgacgttatctttc

SEQ ID NO: 288929 - DNA, 20 bp, Artificial
  CRISPR gRNA sequence
ccagtgacgttatctttcaa

SEQ ID NO: 288930 - DNA, 20 bp, Artificial
  CRISPR gRNA sequence
cagtgacgttatctttcaag

SEQ ID NO: 288931 - DNA, 20 bp, Artificial
  CRISPR gRNA sequence
tctttcaagagttatccaga

SEQ ID NO: 288932 - DNA, 20 bp, Artificial
  CRISPR gRNA sequence
tcaagagttatccagaatct

SEQ ID NO: 288933 - DNA, 20 bp, Artificial
  CRISPR gRNA sequence
caagagttatccagaatctt

SEQ ID NO: 288934 - DNA, 20 bp, Artificial
  CRISPR gRNA sequence
aagagttatccagaatcttc

SEQ ID NO: 288935 - DNA, 20 bp, Artificial
  CRISPR gRNA sequence
tccagaatcttccccttccc

SEQ ID NO: 288936 - DNA, 20 bp, Artificial
  CRISPR gRNA sequence
ccccttccctgaatctccat

SEQ ID NO: 288937 - DNA, 20 bp, Artificial
  CRISPR gRNA sequence
cccttccctgaatctccata

SEQ ID NO: 288938 - DNA, 20 bp, Artificial
  CRISPR gRNA sequence
ccctgaatctccataagacg

SEQ ID NO: 288939 - DNA, 20 bp, Artificial
  CRISPR gRNA sequence
cctgaatctccataagacga

SEQ ID NO: 288940 - DNA, 20 bp, Artificial
  CRISPR gRNA sequence
aatctccataagacgacaca

SEQ ID NO: 288941 - DNA, 20 bp, Artificial
  CRISPR gRNA sequence
cataagacgacacatctttc

SEQ ID NO: 288942 - DNA, 20 bp, Artificial
  CRISPR gRNA sequence
tctttcttttttctttttct

SEQ ID NO: 288943 - DNA, 20 bp, Artificial
  CRISPR gRNA sequence
ctttcttttttctttttctt

SEQ ID NO: 288944 - DNA, 20 bp, Artificial
  CRISPR gRNA sequence
tttcttttttctttttcttt

SEQ ID NO: 288945 - DNA, 20 bp, Artificial
  CRISPR gRNA sequence
tcttttttctttttcttttt

SEQ ID NO: 288946 - DNA, 20 bp, Artificial
  CRISPR gRNA sequence
cttttttctttttctttttt

SEQ ID NO: 288947 - DNA, 20 bp, Artificial
  CRISPR gRNA sequence
ttttttctttttcttttttt

SEQ ID NO: 288948 - DNA, 20 bp, Artificial
  CRISPR gRNA sequence
ttttctttttcttttttttt

SEQ ID NO: 288949 - DNA, 20 bp, Artificial
  CRISPR gRNA sequence
tttctttttctttttttttt

SEQ ID NO: 288950 - DNA, 20 bp, Artificial
  CRISPR gRNA sequence
ttctttttcttttttttttt

SEQ ID NO: 288951 - DNA, 20 bp, Artificial
  CRISPR gRNA sequence
tctttttctttttttttttg

SEQ ID NO: 288952 - DNA, 20 bp, Artificial
  CRISPR gRNA sequence
ctttttctttttttttttga

SEQ ID NO: 288953 - DNA, 20 bp, Artificial
  CRISPR gRNA sequence
tttttctttttttttttgag

SEQ ID NO: 288954 - DNA, 20 bp, Artificial
  CRISPR gRNA sequence
tttctttttttttttgagac

SEQ ID NO: 288955 - DNA, 20 bp, Artificial
  CRISPR gRNA sequence
ttctttttttttttgagacg

SEQ ID NO: 288956 - DNA, 20 bp, Artificial
  CRISPR gRNA sequence
tctttttttttttgagacgg

SEQ ID NO: 288957 - DNA, 20 bp, Artificial
  CRISPR gRNA sequence
ctttttttttttgagacgga

SEQ ID NO: 288958 - DNA, 20 bp, Artificial
  CRISPR gRNA sequence
tttttttttttgagacggag

SEQ ID NO: 288959 - DNA, 20 bp, Artificial
  CRISPR gRNA sequence
tttttttttgagacggagtc

SEQ ID NO: 288960 - DNA, 20 bp, Artificial
  CRISPR gRNA sequence
ttttttttgagacggagtct

SEQ ID NO: 288961 - DNA, 20 bp, Artificial
  CRISPR gRNA sequence
tttttttgagacggagtctt

SEQ ID NO: 288962 - DNA, 20 bp, Artificial
  CRISPR gRNA sequence
ttttttgagacggagtcttg

SEQ ID NO: 288963 - DNA, 20 bp, Artificial
  CRISPR gRNA sequence
tttttgagacggagtcttgt

SEQ ID NO: 288964 - DNA, 20 bp, Artificial
  CRISPR gRNA sequence
ttttgagacggagtcttgtt

SEQ ID NO: 288965 - DNA, 20 bp, Artificial
  CRISPR gRNA sequence
tttgagacggagtcttgttc

SEQ ID NO: 288966 - DNA, 20 bp, Artificial
  CRISPR gRNA sequence
ttgagacggagtcttgttct

SEQ ID NO: 288967 - DNA, 20 bp, Artificial
  CRISPR gRNA sequence
tgagacggagtcttgttctt

SEQ ID NO: 288968 - DNA, 20 bp, Artificial
  CRISPR gRNA sequence
gagacggagtcttgttcttt

SEQ ID NO: 288969 - DNA, 20 bp, Artificial
  CRISPR gRNA sequence
agacggagtcttgttctttt

SEQ ID NO: 288970 - DNA, 20 bp, Artificial
  CRISPR gRNA sequence
gttcttttgcccaggctgga

SEQ ID NO: 288971 - DNA, 20 bp, Artificial
  CRISPR gRNA sequence
ttcttttgcccaggctggag

SEQ ID NO: 288972 - DNA, 20 bp, Artificial
  CRISPR gRNA sequence
ttttgcccaggctggagtga

SEQ ID NO: 288973 - DNA, 20 bp, Artificial
  CRISPR gRNA sequence
ttgcccaggctggagtgaag

SEQ ID NO: 288974 - DNA, 20 bp, Artificial
  CRISPR gRNA sequence
tgcccaggctggagtgaagt

SEQ ID NO: 288975 - DNA, 20 bp, Artificial
  CRISPR gRNA sequence
gcccaggctggagtgaagtg

SEQ ID NO: 288976 - DNA, 20 bp, Artificial
  CRISPR gRNA sequence
cccaggctggagtgaagtgg

SEQ ID NO: 288977 - DNA, 20 bp, Artificial
  CRISPR gRNA sequence
gagtgaagtggcgcgatctc

SEQ ID NO: 288978 - DNA, 20 bp, Artificial
  CRISPR gRNA sequence
agctcactgcaacctccacc

SEQ ID NO: 288979 - DNA, 20 bp, Artificial
  CRISPR gRNA sequence
actgcaacctccacccccag

SEQ ID NO: 288980 - DNA, 20 bp, Artificial
  CRISPR gRNA sequence
caacctccacccccaggttc

SEQ ID NO: 288981 - DNA, 20 bp, Artificial
  CRISPR gRNA sequence
cacccccaggttcaagcagt

SEQ ID NO: 288982 - DNA, 20 bp, Artificial
  CRISPR gRNA sequence
aagcagttctcctgcctcag

SEQ ID NO: 288983 - DNA, 20 bp, Artificial
  CRISPR gRNA sequence
tcctgcctcagcctcctgag

SEQ ID NO: 288984 - DNA, 20 bp, Artificial
  CRISPR gRNA sequence
ctgcctcagcctcctgagta

SEQ ID NO: 288985 - DNA, 20 bp, Artificial
  CRISPR gRNA sequence
cctcagcctcctgagtagct

SEQ ID NO: 288986 - DNA, 20 bp, Artificial
  CRISPR gRNA sequence
agcctcctgagtagctggga

SEQ ID NO: 288987 - DNA, 20 bp, Artificial
  CRISPR gRNA sequence
ctgagtagctgggattacag

SEQ ID NO: 288988 - DNA, 20 bp, Artificial
  CRISPR gRNA sequence
agtagctgggattacaggcg

SEQ ID NO: 288989 - DNA, 20 bp, Artificial
  CRISPR gRNA sequence
ggattacaggcgcccgccat

SEQ ID NO: 288990 - DNA, 20 bp, Artificial
  CRISPR gRNA sequence
caggcgcccgccatcatgcc

SEQ ID NO: 288991 - DNA, 20 bp, Artificial
  CRISPR gRNA sequence
atttttgtatttttagtaga

SEQ ID NO: 288992 - DNA, 20 bp, Artificial
  CRISPR gRNA sequence
ttgtatttttagtagagaca

SEQ ID NO: 288993 - DNA, 20 bp, Artificial
  CRISPR gRNA sequence
tgtatttttagtagagacag

SEQ ID NO: 288994 - DNA, 20 bp, Artificial
  CRISPR gRNA sequence
gtatttttagtagagacagg

SEQ ID NO: 288995 - DNA, 20 bp, Artificial
  CRISPR gRNA sequence
tatttttagtagagacaggg

SEQ ID NO: 288996 - DNA, 20 bp, Artificial
  CRISPR gRNA sequence
ttagtagagacagggtttcc

SEQ ID NO: 288997 - DNA, 20 bp, Artificial
  CRISPR gRNA sequence
tagtagagacagggtttcca

SEQ ID NO: 288998 - DNA, 20 bp, Artificial
  CRISPR gRNA sequence
agtagagacagggtttccac

SEQ ID NO: 288999 - DNA, 20 bp, Artificial
  CRISPR gRNA sequence
gtagagacagggtttccacc

SEQ ID NO: 289000 - DNA, 20 bp, Artificial
  CRISPR gRNA sequence
ccaccatgtttgccaggctg

SEQ ID NO: 289001 - DNA, 20 bp, Artificial
  CRISPR gRNA sequence
caccatgtttgccaggctgg

SEQ ID NO: 289002 - DNA, 20 bp, Artificial
  CRISPR gRNA sequence
gccaggctggtctcaaactc

SEQ ID NO: 289003 - DNA, 20 bp, Artificial
  CRISPR gRNA sequence
ccaggctggtctcaaactcc

SEQ ID NO: 289004 - DNA, 20 bp, Artificial
  CRISPR gRNA sequence
gtctcaaactcctgatctca

SEQ ID NO: 289005 - DNA, 20 bp, Artificial
  CRISPR gRNA sequence
aaactcctgatctcaggtga

SEQ ID NO: 289006 - DNA, 20 bp, Artificial
  CRISPR gRNA sequence
ctgatctcaggtgatcctcc

SEQ ID NO: 289007 - DNA, 20 bp, Artificial
  CRISPR gRNA sequence
atctcaggtgatcctcccac

SEQ ID NO: 289008 - DNA, 20 bp, Artificial
  CRISPR gRNA sequence
aggtgatcctcccacctcag

SEQ ID NO: 289009 - DNA, 20 bp, Artificial
  CRISPR gRNA sequence
ccacctcagcctcccaaaat

SEQ ID NO: 289010 - DNA, 20 bp, Artificial
  CRISPR gRNA sequence
agcctcccaaaatgctggga

SEQ ID NO: 289011 - DNA, 20 bp, Artificial
  CRISPR gRNA sequence
ccaaaatgctgggattacaa

SEQ ID NO: 289012 - DNA, 20 bp, Artificial
  CRISPR gRNA sequence
ggattacaagtgtgagccac

SEQ ID NO: 289013 - DNA, 20 bp, Artificial
  CRISPR gRNA sequence
caagtgtgagccaccacgcc

SEQ ID NO: 289014 - DNA, 20 bp, Artificial
  CRISPR gRNA sequence
gcatgatgagacatcgtgag

SEQ ID NO: 289015 - DNA, 20 bp, Artificial
  CRISPR gRNA sequence
agaaatatggaaaggcacct

SEQ ID NO: 289016 - DNA, 20 bp, Artificial
  CRISPR gRNA sequence
cttgtcttatgtatatagcc

SEQ ID NO: 289017 - DNA, 20 bp, Artificial
  CRISPR gRNA sequence
gtcttatgtatatagccaga

SEQ ID NO: 289018 - DNA, 20 bp, Artificial
  CRISPR gRNA sequence
tcttatgtatatagccagat

SEQ ID NO: 289019 - DNA, 20 bp, Artificial
  CRISPR gRNA sequence
atgtatatagccagatgcct

SEQ ID NO: 289020 - DNA, 20 bp, Artificial
  CRISPR gRNA sequence
tgtatatagccagatgccta

SEQ ID NO: 289021 - DNA, 20 bp, Artificial
  CRISPR gRNA sequence
tgggccaggagttggggaca

SEQ ID NO: 289022 - DNA, 20 bp, Artificial
  CRISPR gRNA sequence
gggacagagacagggatccc

SEQ ID NO: 289023 - DNA, 20 bp, Artificial
  CRISPR gRNA sequence
gtgagtgagaaagtccactg

SEQ ID NO: 289024 - DNA, 20 bp, Artificial
  CRISPR gRNA sequence
gtcccctgagaagacctgaa

SEQ ID NO: 289025 - DNA, 20 bp, Artificial
  CRISPR gRNA sequence
agaagacctgaatataagtg

SEQ ID NO: 289026 - DNA, 20 bp, Artificial
  CRISPR gRNA sequence
aatataagtgccaaccatgg

SEQ ID NO: 289027 - DNA, 20 bp, Artificial
  CRISPR gRNA sequence
aacgatgtgctcagccccag

SEQ ID NO: 289028 - DNA, 20 bp, Artificial
  CRISPR gRNA sequence
agccccaggggatatgaaag

SEQ ID NO: 289029 - DNA, 20 bp, Artificial
  CRISPR gRNA sequence
gaagggacttccatgatcat

SEQ ID NO: 289030 - DNA, 20 bp, Artificial
  CRISPR gRNA sequence
ccatgatcattcattctcgt

SEQ ID NO: 289031 - DNA, 20 bp, Artificial
  CRISPR gRNA sequence
catgatcattcattctcgtg

SEQ ID NO: 289032 - DNA, 20 bp, Artificial
  CRISPR gRNA sequence
attctcgtggccttatctta

SEQ ID NO: 289033 - DNA, 20 bp, Artificial
  CRISPR gRNA sequence
tcgtggccttatcttacaaa

SEQ ID NO: 289034 - DNA, 20 bp, Artificial
  CRISPR gRNA sequence
gtggccttatcttacaaatg

SEQ ID NO: 289035 - DNA, 20 bp, Artificial
  CRISPR gRNA sequence
atcttacaaatgaggaaact

SEQ ID NO: 289036 - DNA, 20 bp, Artificial
  CRISPR gRNA sequence
tcttacaaatgaggaaactg

SEQ ID NO: 289037 - DNA, 20 bp, Artificial
  CRISPR gRNA sequence
acaaatgaggaaactgagct

SEQ ID NO: 289038 - DNA, 20 bp, Artificial
  CRISPR gRNA sequence
caaatgaggaaactgagctg

SEQ ID NO: 289039 - DNA, 20 bp, Artificial
  CRISPR gRNA sequence
agctgaggaaaagaaactgc

SEQ ID NO: 289040 - DNA, 20 bp, Artificial
  CRISPR gRNA sequence
aggaaaagaaactgccccag

SEQ ID NO: 289041 - DNA, 20 bp, Artificial
  CRISPR gRNA sequence
ccccagttttacacattttt

SEQ ID NO: 289042 - DNA, 20 bp, Artificial
  CRISPR gRNA sequence
tacacatttttttctttctg

SEQ ID NO: 289043 - DNA, 20 bp, Artificial
  CRISPR gRNA sequence
acacatttttttctttctgg

SEQ ID NO: 289044 - DNA, 20 bp, Artificial
  CRISPR gRNA sequence
cacatttttttctttctggc

SEQ ID NO: 289045 - DNA, 20 bp, Artificial
  CRISPR gRNA sequence
ttttctttctggcccaggct

SEQ ID NO: 289046 - DNA, 20 bp, Artificial
  CRISPR gRNA sequence
tttctttctggcccaggctt

SEQ ID NO: 289047 - DNA, 20 bp, Artificial
  CRISPR gRNA sequence
ttctttctggcccaggcttt

SEQ ID NO: 289048 - DNA, 20 bp, Artificial
  CRISPR gRNA sequence
tctttctggcccaggctttt

SEQ ID NO: 289049 - DNA, 20 bp, Artificial
  CRISPR gRNA sequence
ctttctggcccaggctttta

SEQ ID NO: 289050 - DNA, 20 bp, Artificial
  CRISPR gRNA sequence
tttctggcccaggcttttag

SEQ ID NO: 289051 - DNA, 20 bp, Artificial
  CRISPR gRNA sequence
tctggcccaggcttttaggg

SEQ ID NO: 289052 - DNA, 20 bp, Artificial
  CRISPR gRNA sequence
ctggcccaggcttttagggc

SEQ ID NO: 289053 - DNA, 20 bp, Artificial
  CRISPR gRNA sequence
tggcccaggcttttagggcc

SEQ ID NO: 289054 - DNA, 20 bp, Artificial
  CRISPR gRNA sequence
gcccaggcttttagggccat

SEQ ID NO: 289055 - DNA, 20 bp, Artificial
  CRISPR gRNA sequence
ttagggccattcttcttgtt

SEQ ID NO: 289056 - DNA, 20 bp, Artificial
  CRISPR gRNA sequence
tagggccattcttcttgttt

SEQ ID NO: 289057 - DNA, 20 bp, Artificial
  CRISPR gRNA sequence
agggccattcttcttgttta

SEQ ID NO: 289058 - DNA, 20 bp, Artificial
  CRISPR gRNA sequence
gggccattcttcttgtttac

SEQ ID NO: 289059 - DNA, 20 bp, Artificial
  CRISPR gRNA sequence
ttcttgtttaccgatttctt

SEQ ID NO: 289060 - DNA, 20 bp, Artificial
  CRISPR gRNA sequence
cttgtttaccgatttcttca

SEQ ID NO: 289061 - DNA, 20 bp, Artificial
  CRISPR gRNA sequence
ttgtttaccgatttcttcag

SEQ ID NO: 289062 - DNA, 20 bp, Artificial
  CRISPR gRNA sequence
gtttaccgatttcttcagtt

SEQ ID NO: 289063 - DNA, 20 bp, Artificial
  CRISPR gRNA sequence
tttaccgatttcttcagttt

SEQ ID NO: 289064 - DNA, 20 bp, Artificial
  CRISPR gRNA sequence
accgatttcttcagttttag

SEQ ID NO: 289065 - DNA, 20 bp, Artificial
  CRISPR gRNA sequence
ccgatttcttcagttttagg

SEQ ID NO: 289066 - DNA, 20 bp, Artificial
  CRISPR gRNA sequence
cttcagttttaggccacagt

SEQ ID NO: 289067 - DNA, 20 bp, Artificial
  CRISPR gRNA sequence
ttcagttttaggccacagtc

SEQ ID NO: 289068 - DNA, 20 bp, Artificial
  CRISPR gRNA sequence
cagttttaggccacagtcag

SEQ ID NO: 289069 - DNA, 20 bp, Artificial
  CRISPR gRNA sequence
agttttaggccacagtcagt

SEQ ID NO: 289070 - DNA, 20 bp, Artificial
  CRISPR gRNA sequence
taggccacagtcagtaagtt

SEQ ID NO: 289071 - DNA, 20 bp, Artificial
  CRISPR gRNA sequence
aggccacagtcagtaagtta

SEQ ID NO: 289072 - DNA, 20 bp, Artificial
  CRISPR gRNA sequence
ggccacagtcagtaagttaa

SEQ ID NO: 289073 - DNA, 20 bp, Artificial
  CRISPR gRNA sequence
agccaacactgtccccaccc

SEQ ID NO: 289074 - DNA, 20 bp, Artificial
  CRISPR gRNA sequence
tccccacccaccccaatcca

SEQ ID NO: 289075 - DNA, 20 bp, Artificial
  CRISPR gRNA sequence
ccactgagcccttttgctat

SEQ ID NO: 289076 - DNA, 20 bp, Artificial
  CRISPR gRNA sequence
agcccttttgctataagaaa

SEQ ID NO: 289077 - DNA, 20 bp, Artificial
  CRISPR gRNA sequence
ttgctataagaaacagagtc

SEQ ID NO: 289078 - DNA, 20 bp, Artificial
  CRISPR gRNA sequence
tgctataagaaacagagtcc

SEQ ID NO: 289079 - DNA, 20 bp, Artificial
  CRISPR gRNA sequence
gctataagaaacagagtccc

SEQ ID NO: 289080 - DNA, 20 bp, Artificial
  CRISPR gRNA sequence
ctataagaaacagagtccca

SEQ ID NO: 289081 - DNA, 20 bp, Artificial
  CRISPR gRNA sequence
taagaaacagagtcccaggc

SEQ ID NO: 289082 - DNA, 20 bp, Artificial
  CRISPR gRNA sequence
aagcctgtaatcccagcact

SEQ ID NO: 289083 - DNA, 20 bp, Artificial
  CRISPR gRNA sequence
taatcccagcactttgggag

SEQ ID NO: 289084 - DNA, 20 bp, Artificial
  CRISPR gRNA sequence
tgggaggctgaggtgggcag

SEQ ID NO: 289085 - DNA, 20 bp, Artificial
  CRISPR gRNA sequence
gggaggctgaggtgggcaga

SEQ ID NO: 289086 - DNA, 20 bp, Artificial
  CRISPR gRNA sequence
ggaggctgaggtgggcagat

SEQ ID NO: 289087 - DNA, 20 bp, Artificial
  CRISPR gRNA sequence
aggtgggcagatcacgaggt

SEQ ID NO: 289088 - DNA, 20 bp, Artificial
  CRISPR gRNA sequence
gagaccagcctggtcaacat

SEQ ID NO: 289089 - DNA, 20 bp, Artificial
  CRISPR gRNA sequence
agaccagcctggtcaacatg

SEQ ID NO: 289090 - DNA, 20 bp, Artificial
  CRISPR gRNA sequence
gtcaacatggtgaaacccca

SEQ ID NO: 289091 - DNA, 20 bp, Artificial
  CRISPR gRNA sequence
tactaaaaatacaaaaaaat

SEQ ID NO: 289092 - DNA, 20 bp, Artificial
  CRISPR gRNA sequence
ctaaaaatacaaaaaaatta

SEQ ID NO: 289093 - DNA, 20 bp, Artificial
  CRISPR gRNA sequence
aaaatacaaaaaaattagcc

SEQ ID NO: 289094 - DNA, 20 bp, Artificial
  CRISPR gRNA sequence
gccgggcatgttgggacaca

SEQ ID NO: 289095 - DNA, 20 bp, Artificial
  CRISPR gRNA sequence
ggacacacctgtaatcccag

SEQ ID NO: 289096 - DNA, 20 bp, Artificial
  CRISPR gRNA sequence
taatcccagctacttaggag

SEQ ID NO: 289097 - DNA, 20 bp, Artificial
  CRISPR gRNA sequence
cttaggaggctgaggcagga

SEQ ID NO: 289098 - DNA, 20 bp, Artificial
  CRISPR gRNA sequence
aggaggctgaggcaggagaa

SEQ ID NO: 289099 - DNA, 20 bp, Artificial
  CRISPR gRNA sequence
ggaggctgaggcaggagaat

SEQ ID NO: 289100 - DNA, 20 bp, Artificial
  CRISPR gRNA sequence
aggcaggagaatcacttgaa

SEQ ID NO: 289101 - DNA, 20 bp, Artificial
  CRISPR gRNA sequence
gaacctgggaggcagaggtt

SEQ ID NO: 289102 - DNA, 20 bp, Artificial
  CRISPR gRNA sequence
aacctgggaggcagaggttg

SEQ ID NO: 289103 - DNA, 20 bp, Artificial
  CRISPR gRNA sequence
ggaggcagaggttgcagtga

SEQ ID NO: 289104 - DNA, 20 bp, Artificial
  CRISPR gRNA sequence
cagtgagccaagatcacacc

SEQ ID NO: 289105 - DNA, 20 bp, Artificial
  CRISPR gRNA sequence
cactccagcttgggtgacag

SEQ ID NO: 289106 - DNA, 20 bp, Artificial
  CRISPR gRNA sequence
cagcttgggtgacagagtga

SEQ ID NO: 289107 - DNA, 20 bp, Artificial
  CRISPR gRNA sequence
gggtgacagagtgagactcc

SEQ ID NO: 289108 - DNA, 20 bp, Artificial
  CRISPR gRNA sequence
ggtgacagagtgagactccg

SEQ ID NO: 289109 - DNA, 20 bp, Artificial
  CRISPR gRNA sequence
cgtctcaaaataaataaata

SEQ ID NO: 289110 - DNA, 20 bp, Artificial
  CRISPR gRNA sequence
aaaataaataaataaataaa

SEQ ID NO: 289111 - DNA, 20 bp, Artificial
  CRISPR gRNA sequence
tctttccaggcctgattgat

SEQ ID NO: 289112 - DNA, 20 bp, Artificial
  CRISPR gRNA sequence
ctttccaggcctgattgatc

SEQ ID NO: 289113 - DNA, 20 bp, Artificial
  CRISPR gRNA sequence
tttccaggcctgattgatcc

SEQ ID NO: 289114 - DNA, 20 bp, Artificial
  CRISPR gRNA sequence
tccaggcctgattgatccca

SEQ ID NO: 289115 - DNA, 20 bp, Artificial
  CRISPR gRNA sequence
ccaggcctgattgatcccat

SEQ ID NO: 289116 - DNA, 20 bp, Artificial
  CRISPR gRNA sequence
caggcctgattgatcccatg

SEQ ID NO: 289117 - DNA, 20 bp, Artificial
  CRISPR gRNA sequence
attgatcccatggttccagg

SEQ ID NO: 289118 - DNA, 20 bp, Artificial
  CRISPR gRNA sequence
atcccatggttccaggctga

SEQ ID NO: 289119 - DNA, 20 bp, Artificial
  CRISPR gRNA sequence
caggctgaaatgactcccat

SEQ ID NO: 289120 - DNA, 20 bp, Artificial
  CRISPR gRNA sequence
aaatgactcccatgcttata

SEQ ID NO: 289121 - DNA, 20 bp, Artificial
  CRISPR gRNA sequence
ccatgcttatacctttggac

SEQ ID NO: 289122 - DNA, 20 bp, Artificial
  CRISPR gRNA sequence
atacctttggactatttcta

SEQ ID NO: 289123 - DNA, 20 bp, Artificial
  CRISPR gRNA sequence
tacctttggactatttctac

SEQ ID NO: 289124 - DNA, 20 bp, Artificial
  CRISPR gRNA sequence
tggactatttctaccatctt

SEQ ID NO: 289125 - DNA, 20 bp, Artificial
  CRISPR gRNA sequence
ggactatttctaccatcttc

SEQ ID NO: 289126 - DNA, 20 bp, Artificial
  CRISPR gRNA sequence
gactatttctaccatcttca

SEQ ID NO: 289127 - DNA, 20 bp, Artificial
  CRISPR gRNA sequence
tttctaccatcttcaggtac

SEQ ID NO: 289128 - DNA, 20 bp, Artificial
  CRISPR gRNA sequence
ctaccatcttcaggtaccct

SEQ ID NO: 289129 - DNA, 20 bp, Artificial
  CRISPR gRNA sequence
taccatcttcaggtacccta

SEQ ID NO: 289130 - DNA, 20 bp, Artificial
  CRISPR gRNA sequence
ccatcttcaggtaccctaaa

SEQ ID NO: 289131 - DNA, 20 bp, Artificial
  CRISPR gRNA sequence
caggtaccctaaatggatcc

SEQ ID NO: 289132 - DNA, 20 bp, Artificial
  CRISPR gRNA sequence
aggtaccctaaatggatcct

SEQ ID NO: 289133 - DNA, 20 bp, Artificial
  CRISPR gRNA sequence
aatggatcctatatcctgcc

SEQ ID NO: 289134 - DNA, 20 bp, Artificial
  CRISPR gRNA sequence
tatcctgcctttatctcttt

SEQ ID NO: 289135 - DNA, 20 bp, Artificial
  CRISPR gRNA sequence
cctttatctctttggctatc

SEQ ID NO: 289136 - DNA, 20 bp, Artificial
  CRISPR gRNA sequence
tatctctttggctatctgca

SEQ ID NO: 289137 - DNA, 20 bp, Artificial
  CRISPR gRNA sequence
atctctttggctatctgcag

SEQ ID NO: 289138 - DNA, 20 bp, Artificial
  CRISPR gRNA sequence
tctctttggctatctgcagt

SEQ ID NO: 289139 - DNA, 20 bp, Artificial
  CRISPR gRNA sequence
tttggctatctgcagtccat

SEQ ID NO: 289140 - DNA, 20 bp, Artificial
  CRISPR gRNA sequence
tggctatctgcagtccatgc

SEQ ID NO: 289141 - DNA, 20 bp, Artificial
  CRISPR gRNA sequence
ggctatctgcagtccatgcc

SEQ ID NO: 289142 - DNA, 20 bp, Artificial
  CRISPR gRNA sequence
gctatctgcagtccatgcca

SEQ ID NO: 289143 - DNA, 20 bp, Artificial
  CRISPR gRNA sequence
tctgcagtccatgccataca

SEQ ID NO: 289144 - DNA, 20 bp, Artificial
  CRISPR gRNA sequence
cagtccatgccatacaatta

SEQ ID NO: 289145 - DNA, 20 bp, Artificial
  CRISPR gRNA sequence
ccctccagcctggatttgct

SEQ ID NO: 289146 - DNA, 20 bp, Artificial
  CRISPR gRNA sequence
cagcctggatttgctaaaag

SEQ ID NO: 289147 - DNA, 20 bp, Artificial
  CRISPR gRNA sequence
gatttgctaaaagagttttt

SEQ ID NO: 289148 - DNA, 20 bp, Artificial
  CRISPR gRNA sequence
gctaaaagagtttttattta

SEQ ID NO: 289149 - DNA, 20 bp, Artificial
  CRISPR gRNA sequence
ctaaaagagtttttatttaa

SEQ ID NO: 289150 - DNA, 20 bp, Artificial
  CRISPR gRNA sequence
aaagagtttttatttaaaat

SEQ ID NO: 289151 - DNA, 20 bp, Artificial
  CRISPR gRNA sequence
ttatttaaaatattctgttc

SEQ ID NO: 289152 - DNA, 20 bp, Artificial
  CRISPR gRNA sequence
tatttaaaatattctgttca

SEQ ID NO: 289153 - DNA, 20 bp, Artificial
  CRISPR gRNA sequence
atttaaaatattctgttcat

SEQ ID NO: 289154 - DNA, 20 bp, Artificial
  CRISPR gRNA sequence
tttaaaatattctgttcatt

SEQ ID NO: 289155 - DNA, 20 bp, Artificial
  CRISPR gRNA sequence
aaaatattctgttcatttct

SEQ ID NO: 289156 - DNA, 20 bp, Artificial
  CRISPR gRNA sequence
aaatattctgttcatttctc

SEQ ID NO: 289157 - DNA, 20 bp, Artificial
  CRISPR gRNA sequence
tgttcatttctccatccaca

SEQ ID NO: 289158 - DNA, 20 bp, Artificial
  CRISPR gRNA sequence
ttcatttctccatccacata

SEQ ID NO: 289159 - DNA, 20 bp, Artificial
  CRISPR gRNA sequence
atttctccatccacatagcc

SEQ ID NO: 289160 - DNA, 20 bp, Artificial
  CRISPR gRNA sequence
ctccatccacatagccaaga

SEQ ID NO: 289161 - DNA, 20 bp, Artificial
  CRISPR gRNA sequence
tccatccacatagccaagaa

SEQ ID NO: 289162 - DNA, 20 bp, Artificial
  CRISPR gRNA sequence
catccacatagccaagaaat

SEQ ID NO: 289163 - DNA, 20 bp, Artificial
  CRISPR gRNA sequence
aactagtctctgtgtcaata

SEQ ID NO: 289164 - DNA, 20 bp, Artificial
  CRISPR gRNA sequence
gtctctgtgtcaatagcacc

SEQ ID NO: 289165 - DNA, 20 bp, Artificial
  CRISPR gRNA sequence
tgtgtcaatagcaccaaaat

SEQ ID NO: 289166 - DNA, 20 bp, Artificial
  CRISPR gRNA sequence
tgtcaatagcaccaaaattc

SEQ ID NO: 289167 - DNA, 20 bp, Artificial
  CRISPR gRNA sequence
cttagcaggctgtattttct

SEQ ID NO: 289168 - DNA, 20 bp, Artificial
  CRISPR gRNA sequence
agcaggctgtattttctgat

SEQ ID NO: 289169 - DNA, 20 bp, Artificial
  CRISPR gRNA sequence
gcaggctgtattttctgatt

SEQ ID NO: 289170 - DNA, 20 bp, Artificial
  CRISPR gRNA sequence
tattttctgatttttggttt

SEQ ID NO: 289171 - DNA, 20 bp, Artificial
  CRISPR gRNA sequence
tctgatttttggtttagaag

SEQ ID NO: 289172 - DNA, 20 bp, Artificial
  CRISPR gRNA sequence
ctgatttttggtttagaagg

SEQ ID NO: 289173 - DNA, 20 bp, Artificial
  CRISPR gRNA sequence
tgatttttggtttagaaggc

SEQ ID NO: 289174 - DNA, 20 bp, Artificial
  CRISPR gRNA sequence
atttttggtttagaaggcat

SEQ ID NO: 289175 - DNA, 20 bp, Artificial
  CRISPR gRNA sequence
ttggtttagaaggcatggtc

SEQ ID NO: 289176 - DNA, 20 bp, Artificial
  CRISPR gRNA sequence
tggtttagaaggcatggtca

SEQ ID NO: 289177 - DNA, 20 bp, Artificial
  CRISPR gRNA sequence
ggtttagaaggcatggtcat

SEQ ID NO: 289178 - DNA, 20 bp, Artificial
  CRISPR gRNA sequence
gtttagaaggcatggtcatt

SEQ ID NO: 289179 - DNA, 20 bp, Artificial
  CRISPR gRNA sequence
agaaggcatggtcattcttc

SEQ ID NO: 289180 - DNA, 20 bp, Artificial
  CRISPR gRNA sequence
gaaggcatggtcattcttcc

SEQ ID NO: 289181 - DNA, 20 bp, Artificial
  CRISPR gRNA sequence
ttcctaggctcttgtaggac

SEQ ID NO: 289182 - DNA, 20 bp, Artificial
  CRISPR gRNA sequence
cctaggctcttgtaggacct

SEQ ID NO: 289183 - DNA, 20 bp, Artificial
  CRISPR gRNA sequence
ctaggctcttgtaggaccta

SEQ ID NO: 289184 - DNA, 20 bp, Artificial
  CRISPR gRNA sequence
ggctcttgtaggacctaaaa

SEQ ID NO: 289185 - DNA, 20 bp, Artificial
  CRISPR gRNA sequence
ttgtaggacctaaaagcagc

SEQ ID NO: 289186 - DNA, 20 bp, Artificial
  CRISPR gRNA sequence
gtaggacctaaaagcagcat

SEQ ID NO: 289187 - DNA, 20 bp, Artificial
  CRISPR gRNA sequence
taggacctaaaagcagcatc

SEQ ID NO: 289188 - DNA, 20 bp, Artificial
  CRISPR gRNA sequence
aaagcagcatccctctaagg

SEQ ID NO: 289189 - DNA, 20 bp, Artificial
  CRISPR gRNA sequence
taaggccccagcgccccctg

SEQ ID NO: 289190 - DNA, 20 bp, Artificial
  CRISPR gRNA sequence
aggccccagcgccccctgcc

SEQ ID NO: 289191 - DNA, 20 bp, Artificial
  CRISPR gRNA sequence
cccagtgctgtcgtactgtg

SEQ ID NO: 289192 - DNA, 20 bp, Artificial
  CRISPR gRNA sequence
tcgtactgtgccttctgggc

SEQ ID NO: 289193 - DNA, 20 bp, Artificial
  CRISPR gRNA sequence
tgccttctgggccctgtatc

SEQ ID NO: 289194 - DNA, 20 bp, Artificial
  CRISPR gRNA sequence
ctgggccctgtatcccctgg

SEQ ID NO: 289195 - DNA, 20 bp, Artificial
  CRISPR gRNA sequence
tgggccctgtatcccctgga

SEQ ID NO: 289196 - DNA, 20 bp, Artificial
  CRISPR gRNA sequence
ggccctgtatcccctggagc

SEQ ID NO: 289197 - DNA, 20 bp, Artificial
  CRISPR gRNA sequence
tatcccctggagccacacag

SEQ ID NO: 289198 - DNA, 20 bp, Artificial
  CRISPR gRNA sequence
gagccacacagatcccctta

SEQ ID NO: 289199 - DNA, 20 bp, Artificial
  CRISPR gRNA sequence
agggagacccatgtctaggg

SEQ ID NO: 289200 - DNA, 20 bp, Artificial
  CRISPR gRNA sequence
gggagacccatgtctaggga

SEQ ID NO: 289201 - DNA, 20 bp, Artificial
  CRISPR gRNA sequence
gggacttcatttccaagccc

SEQ ID NO: 289202 - DNA, 20 bp, Artificial
  CRISPR gRNA sequence
catttccaagccctctcttt

SEQ ID NO: 289203 - DNA, 20 bp, Artificial
  CRISPR gRNA sequence
atttccaagccctctctttt

SEQ ID NO: 289204 - DNA, 20 bp, Artificial
  CRISPR gRNA sequence
ccaagccctctcttttctta

SEQ ID NO: 289205 - DNA, 20 bp, Artificial
  CRISPR gRNA sequence
caagccctctcttttcttag

SEQ ID NO: 289206 - DNA, 20 bp, Artificial
  CRISPR gRNA sequence
tcttttcttagatagcagga

SEQ ID NO: 289207 - DNA, 20 bp, Artificial
  CRISPR gRNA sequence
ttttcttagatagcaggatc

SEQ ID NO: 289208 - DNA, 20 bp, Artificial
  CRISPR gRNA sequence
ttcttagatagcaggatcat

SEQ ID NO: 289209 - DNA, 20 bp, Artificial
  CRISPR gRNA sequence
tcttagatagcaggatcatg

SEQ ID NO: 289210 - DNA, 20 bp, Artificial
  CRISPR gRNA sequence
cttagatagcaggatcatgg

SEQ ID NO: 289211 - DNA, 20 bp, Artificial
  CRISPR gRNA sequence
ttagatagcaggatcatggg

SEQ ID NO: 289212 - DNA, 20 bp, Artificial
  CRISPR gRNA sequence
agatagcaggatcatggggc

SEQ ID NO: 289213 - DNA, 20 bp, Artificial
  CRISPR gRNA sequence
gatagcaggatcatggggca

SEQ ID NO: 289214 - DNA, 20 bp, Artificial
  CRISPR gRNA sequence
gcacctttccatctcaccag

SEQ ID NO: 289215 - DNA, 20 bp, Artificial
  CRISPR gRNA sequence
tccatctcaccagccattct

SEQ ID NO: 289216 - DNA, 20 bp, Artificial
  CRISPR gRNA sequence
ccatctcaccagccattctc

SEQ ID NO: 289217 - DNA, 20 bp, Artificial
  CRISPR gRNA sequence
catctcaccagccattctca

SEQ ID NO: 289218 - DNA, 20 bp, Artificial
  CRISPR gRNA sequence
accagccattctcaggcctc

SEQ ID NO: 289219 - DNA, 20 bp, Artificial
  CRISPR gRNA sequence
tcaggcctctgtcagactgg

SEQ ID NO: 289220 - DNA, 20 bp, Artificial
  CRISPR gRNA sequence
aggcctctgtcagactggat

SEQ ID NO: 289221 - DNA, 20 bp, Artificial
  CRISPR gRNA sequence
tgtcagactggatacggccc

SEQ ID NO: 289222 - DNA, 20 bp, Artificial
  CRISPR gRNA sequence
tcagactggatacggcccca

SEQ ID NO: 289223 - DNA, 20 bp, Artificial
  CRISPR gRNA sequence
gatacggccccaccacagca

SEQ ID NO: 289224 - DNA, 20 bp, Artificial
  CRISPR gRNA sequence
aacaagagagttttgtgatg

SEQ ID NO: 289225 - DNA, 20 bp, Artificial
  CRISPR gRNA sequence
tgtgatggtgggtatttgca

SEQ ID NO: 289226 - DNA, 20 bp, Artificial
  CRISPR gRNA sequence
gtgatggtgggtatttgcat

SEQ ID NO: 289227 - DNA, 20 bp, Artificial
  CRISPR gRNA sequence
tgatggtgggtatttgcata

SEQ ID NO: 289228 - DNA, 20 bp, Artificial
  CRISPR gRNA sequence
gcatagcaaagtgaggtaat

SEQ ID NO: 289229 - DNA, 20 bp, Artificial
  CRISPR gRNA sequence
catagcaaagtgaggtaatg

SEQ ID NO: 289230 - DNA, 20 bp, Artificial
  CRISPR gRNA sequence
ttcagcaattgtgtggaatg

SEQ ID NO: 289231 - DNA, 20 bp, Artificial
  CRISPR gRNA sequence
cagcaattgtgtggaatgtt

SEQ ID NO: 289232 - DNA, 20 bp, Artificial
  CRISPR gRNA sequence
agcaattgtgtggaatgttg

SEQ ID NO: 289233 - DNA, 20 bp, Artificial
  CRISPR gRNA sequence
tgtggaatgttgccagtccc

SEQ ID NO: 289234 - DNA, 20 bp, Artificial
  CRISPR gRNA sequence
ccagtccctgctttagggaa

SEQ ID NO: 289235 - DNA, 20 bp, Artificial
  CRISPR gRNA sequence
ctttagggaatataactgaa

SEQ ID NO: 289236 - DNA, 20 bp, Artificial
  CRISPR gRNA sequence
tagggaatataactgaaaga

SEQ ID NO: 289237 - DNA, 20 bp, Artificial
  CRISPR gRNA sequence
agggaatataactgaaagaa

SEQ ID NO: 289238 - DNA, 20 bp, Artificial
  CRISPR gRNA sequence
gggaatataactgaaagaaa

SEQ ID NO: 289239 - DNA, 20 bp, Artificial
  CRISPR gRNA sequence
aaagaaaggaagaaataaaa

SEQ ID NO: 289240 - DNA, 20 bp, Artificial
  CRISPR gRNA sequence
gaagggagcatatttcaaag

SEQ ID NO: 289241 - DNA, 20 bp, Artificial
  CRISPR gRNA sequence
aagggagcatatttcaaagt

SEQ ID NO: 289242 - DNA, 20 bp, Artificial
  CRISPR gRNA sequence
caaagtgaagctatattagc

SEQ ID NO: 289243 - DNA, 20 bp, Artificial
  CRISPR gRNA sequence
aaagtgaagctatattagct

SEQ ID NO: 289244 - DNA, 20 bp, Artificial
  CRISPR gRNA sequence
tattagctaaagatcaaatg

SEQ ID NO: 289245 - DNA, 20 bp, Artificial
  CRISPR gRNA sequence
gctaaagatcaaatgacaac

SEQ ID NO: 289246 - DNA, 20 bp, Artificial
  CRISPR gRNA sequence
aagatcaaatgacaacccag

SEQ ID NO: 289247 - DNA, 20 bp, Artificial
  CRISPR gRNA sequence
ctagtgttgcaaggaaagca

SEQ ID NO: 289248 - DNA, 20 bp, Artificial
  CRISPR gRNA sequence
gtgttgcaaggaaagcaaaa

SEQ ID NO: 289249 - DNA, 20 bp, Artificial
  CRISPR gRNA sequence
caaggaaagcaaaatgagac

SEQ ID NO: 289250 - DNA, 20 bp, Artificial
  CRISPR gRNA sequence
tccatctccattgacttgga

SEQ ID NO: 289251 - DNA, 20 bp, Artificial
  CRISPR gRNA sequence
cattgacttggattctagtc

SEQ ID NO: 289252 - DNA, 20 bp, Artificial
  CRISPR gRNA sequence
acttggattctagtcccagc

SEQ ID NO: 289253 - DNA, 20 bp, Artificial
  CRISPR gRNA sequence
ggattctagtcccagctcag

SEQ ID NO: 289254 - DNA, 20 bp, Artificial
  CRISPR gRNA sequence
gattctagtcccagctcagc

SEQ ID NO: 289255 - DNA, 20 bp, Artificial
  CRISPR gRNA sequence
tagtcccagctcagccactt

SEQ ID NO: 289256 - DNA, 20 bp, Artificial
  CRISPR gRNA sequence
gtcccagctcagccacttgc

SEQ ID NO: 289257 - DNA, 20 bp, Artificial
  CRISPR gRNA sequence
agccacttgctgtttcatct

SEQ ID NO: 289258 - DNA, 20 bp, Artificial
  CRISPR gRNA sequence
gctgtttcatctgtttcttc

SEQ ID NO: 289259 - DNA, 20 bp, Artificial
  CRISPR gRNA sequence
ctgtttcatctgtttcttca

SEQ ID NO: 289260 - DNA, 20 bp, Artificial
  CRISPR gRNA sequence
tttcatctgtttcttcatct

SEQ ID NO: 289261 - DNA, 20 bp, Artificial
  CRISPR gRNA sequence
catctgtttcttcatctcta

SEQ ID NO: 289262 - DNA, 20 bp, Artificial
  CRISPR gRNA sequence
atctgtttcttcatctctaa

SEQ ID NO: 289263 - DNA, 20 bp, Artificial
  CRISPR gRNA sequence
tttcttcatctctaaatagg

SEQ ID NO: 289264 - DNA, 20 bp, Artificial
  CRISPR gRNA sequence
cttcatctctaaataggtat

SEQ ID NO: 289265 - DNA, 20 bp, Artificial
  CRISPR gRNA sequence
ttcatctctaaataggtatg

SEQ ID NO: 289266 - DNA, 20 bp, Artificial
  CRISPR gRNA sequence
catctctaaataggtatgac

SEQ ID NO: 289267 - DNA, 20 bp, Artificial
  CRISPR gRNA sequence
atctctaaataggtatgaca

SEQ ID NO: 289268 - DNA, 20 bp, Artificial
  CRISPR gRNA sequence
taaataggtatgacacctac

SEQ ID NO: 289269 - DNA, 20 bp, Artificial
  CRISPR gRNA sequence
aataggtatgacacctaccc

SEQ ID NO: 289270 - DNA, 20 bp, Artificial
  CRISPR gRNA sequence
ccccttgggatcactggaaa

SEQ ID NO: 289271 - DNA, 20 bp, Artificial
  CRISPR gRNA sequence
gggatcactggaaaattcag

SEQ ID NO: 289272 - DNA, 20 bp, Artificial
  CRISPR gRNA sequence
ggatcactggaaaattcagt

SEQ ID NO: 289273 - DNA, 20 bp, Artificial
  CRISPR gRNA sequence
gaaaattcagttcaattaaa

SEQ ID NO: 289274 - DNA, 20 bp, Artificial
  CRISPR gRNA sequence
agttcaattaaatgatataa

SEQ ID NO: 289275 - DNA, 20 bp, Artificial
  CRISPR gRNA sequence
aattaaatgatataaataaa

SEQ ID NO: 289276 - DNA, 20 bp, Artificial
  CRISPR gRNA sequence
aatgatataaataaaaagtc

SEQ ID NO: 289277 - DNA, 20 bp, Artificial
  CRISPR gRNA sequence
ctgtaagagtttccattttt

SEQ ID NO: 289278 - DNA, 20 bp, Artificial
  CRISPR gRNA sequence
tgtaagagtttccatttttc

SEQ ID NO: 289279 - DNA, 20 bp, Artificial
  CRISPR gRNA sequence
taagagtttccatttttctt

SEQ ID NO: 289280 - DNA, 20 bp, Artificial
  CRISPR gRNA sequence
ccatttttctttctccctcc

SEQ ID NO: 289281 - DNA, 20 bp, Artificial
  CRISPR gRNA sequence
catttttctttctccctcct

SEQ ID NO: 289282 - DNA, 20 bp, Artificial
  CRISPR gRNA sequence
ttctttctccctcctcccac

SEQ ID NO: 289283 - DNA, 20 bp, Artificial
  CRISPR gRNA sequence
tctttctccctcctcccact

SEQ ID NO: 289284 - DNA, 20 bp, Artificial
  CRISPR gRNA sequence
ctttctccctcctcccactg

SEQ ID NO: 289285 - DNA, 20 bp, Artificial
  CRISPR gRNA sequence
tttctccctcctcccactgc

SEQ ID NO: 289286 - DNA, 20 bp, Artificial
  CRISPR gRNA sequence
tctccctcctcccactgcca

SEQ ID NO: 289287 - DNA, 20 bp, Artificial
  CRISPR gRNA sequence
ctccctcctcccactgccaa

SEQ ID NO: 289288 - DNA, 20 bp, Artificial
  CRISPR gRNA sequence
tccctcctcccactgccaac

SEQ ID NO: 289289 - DNA, 20 bp, Artificial
  CRISPR gRNA sequence
cctcctcccactgccaactc

SEQ ID NO: 289290 - DNA, 20 bp, Artificial
  CRISPR gRNA sequence
ctcccactgccaactcttac

SEQ ID NO: 289291 - DNA, 20 bp, Artificial
  CRISPR gRNA sequence
ccactgccaactcttacctt

SEQ ID NO: 289292 - DNA, 20 bp, Artificial
  CRISPR gRNA sequence
ccaactcttacctttcattt

SEQ ID NO: 289293 - DNA, 20 bp, Artificial
  CRISPR gRNA sequence
ttacctttcatttcactcaa

SEQ ID NO: 289294 - DNA, 20 bp, Artificial
  CRISPR gRNA sequence
acctttcatttcactcaagg

SEQ ID NO: 289295 - DNA, 20 bp, Artificial
  CRISPR gRNA sequence
cctttcatttcactcaaggg

SEQ ID NO: 289296 - DNA, 20 bp, Artificial
  CRISPR gRNA sequence
tcatttcactcaagggttat

SEQ ID NO: 289297 - DNA, 20 bp, Artificial
  CRISPR gRNA sequence
catttcactcaagggttatg

SEQ ID NO: 289298 - DNA, 20 bp, Artificial
  CRISPR gRNA sequence
atttcactcaagggttatgt

SEQ ID NO: 289299 - DNA, 20 bp, Artificial
  CRISPR gRNA sequence
cactcaagggttatgtcaga

SEQ ID NO: 289300 - DNA, 20 bp, Artificial
  CRISPR gRNA sequence
actcaagggttatgtcagat

SEQ ID NO: 289301 - DNA, 20 bp, Artificial
  CRISPR gRNA sequence
aagggttatgtcagatatat

SEQ ID NO: 289302 - DNA, 20 bp, Artificial
  CRISPR gRNA sequence
tgtcagatatatagcactct

SEQ ID NO: 289303 - DNA, 20 bp, Artificial
  CRISPR gRNA sequence
tggtcttgctatgggccaga

SEQ ID NO: 289304 - DNA, 20 bp, Artificial
  CRISPR gRNA sequence
gtcttgctatgggccagaca

SEQ ID NO: 289305 - DNA, 20 bp, Artificial
  CRISPR gRNA sequence
gctatgggccagacagacag

SEQ ID NO: 289306 - DNA, 20 bp, Artificial
  CRISPR gRNA sequence
ctatgggccagacagacagc

SEQ ID NO: 289307 - DNA, 20 bp, Artificial
  CRISPR gRNA sequence
tgggccagacagacagcaac

SEQ ID NO: 289308 - DNA, 20 bp, Artificial
  CRISPR gRNA sequence
acttgtctgggcctcccaat

SEQ ID NO: 289309 - DNA, 20 bp, Artificial
  CRISPR gRNA sequence
gtctgggcctcccaataata

SEQ ID NO: 289310 - DNA, 20 bp, Artificial
  CRISPR gRNA sequence
tctgggcctcccaataatag

SEQ ID NO: 289311 - DNA, 20 bp, Artificial
  CRISPR gRNA sequence
ggcctcccaataatagggtc

SEQ ID NO: 289312 - DNA, 20 bp, Artificial
  CRISPR gRNA sequence
ccaataatagggtctttccc

SEQ ID NO: 289313 - DNA, 20 bp, Artificial
  CRISPR gRNA sequence
tccccaccgaactattcatt

SEQ ID NO: 289314 - DNA, 20 bp, Artificial
  CRISPR gRNA sequence
ccccaccgaactattcattc

SEQ ID NO: 289315 - DNA, 20 bp, Artificial
  CRISPR gRNA sequence
cccaccgaactattcattcc

SEQ ID NO: 289316 - DNA, 20 bp, Artificial
  CRISPR gRNA sequence
ttcattcccagccaaaaaga

SEQ ID NO: 289317 - DNA, 20 bp, Artificial
  CRISPR gRNA sequence
attcccagccaaaaagaatc

SEQ ID NO: 289318 - DNA, 20 bp, Artificial
  CRISPR gRNA sequence
ccagccaaaaagaatccaat

SEQ ID NO: 289319 - DNA, 20 bp, Artificial
  CRISPR gRNA sequence
ctcactgattttggtatgtg

SEQ ID NO: 289320 - DNA, 20 bp, Artificial
  CRISPR gRNA sequence
tcactgattttggtatgtgg

SEQ ID NO: 289321 - DNA, 20 bp, Artificial
  CRISPR gRNA sequence
actgattttggtatgtggtg

SEQ ID NO: 289322 - DNA, 20 bp, Artificial
  CRISPR gRNA sequence
attttggtatgtggtgatgt

SEQ ID NO: 289323 - DNA, 20 bp, Artificial
  CRISPR gRNA sequence
tggtatgtggtgatgttagc

SEQ ID NO: 289324 - DNA, 20 bp, Artificial
  CRISPR gRNA sequence
ggtatgtggtgatgttagca

SEQ ID NO: 289325 - DNA, 20 bp, Artificial
  CRISPR gRNA sequence
gtatgtggtgatgttagcaa

SEQ ID NO: 289326 - DNA, 20 bp, Artificial
  CRISPR gRNA sequence
gcaaaagtgaaagcatagct

SEQ ID NO: 289327 - DNA, 20 bp, Artificial
  CRISPR gRNA sequence
aaagagagactatctaattt

SEQ ID NO: 289328 - DNA, 20 bp, Artificial
  CRISPR gRNA sequence
tctaattttggtgatggctt

SEQ ID NO: 289329 - DNA, 20 bp, Artificial
  CRISPR gRNA sequence
attttggtgatggcttctga

SEQ ID NO: 289330 - DNA, 20 bp, Artificial
  CRISPR gRNA sequence
tggtgatggcttctgaggag

SEQ ID NO: 289331 - DNA, 20 bp, Artificial
  CRISPR gRNA sequence
ggtgatggcttctgaggagt

SEQ ID NO: 289332 - DNA, 20 bp, Artificial
  CRISPR gRNA sequence
gtgatggcttctgaggagtt

SEQ ID NO: 289333 - DNA, 20 bp, Artificial
  CRISPR gRNA sequence
ctgaggagtttttgtccagc

SEQ ID NO: 289334 - DNA, 20 bp, Artificial
  CRISPR gRNA sequence
tgaggagtttttgtccagcc

SEQ ID NO: 289335 - DNA, 20 bp, Artificial
  CRISPR gRNA sequence
aggagtttttgtccagcctt

SEQ ID NO: 289336 - DNA, 20 bp, Artificial
  CRISPR gRNA sequence
ttgtccagccttctgaggag

SEQ ID NO: 289337 - DNA, 20 bp, Artificial
  CRISPR gRNA sequence
tgtccagccttctgaggaga

SEQ ID NO: 289338 - DNA, 20 bp, Artificial
  CRISPR gRNA sequence
gtccagccttctgaggagaa

SEQ ID NO: 289339 - DNA, 20 bp, Artificial
  CRISPR gRNA sequence
tccagccttctgaggagaag

SEQ ID NO: 289340 - DNA, 20 bp, Artificial
  CRISPR gRNA sequence
ctgaggagaagagtgaagaa

SEQ ID NO: 289341 - DNA, 20 bp, Artificial
  CRISPR gRNA sequence
tgaggagaagagtgaagaag

SEQ ID NO: 289342 - DNA, 20 bp, Artificial
  CRISPR gRNA sequence
aggagaagagtgaagaagaa

SEQ ID NO: 289343 - DNA, 20 bp, Artificial
  CRISPR gRNA sequence
aaaagaggaacccaaaatct

SEQ ID NO: 289344 - DNA, 20 bp, Artificial
  CRISPR gRNA sequence
ccgaacaatttggaaattca

SEQ ID NO: 289345 - DNA, 20 bp, Artificial
  CRISPR gRNA sequence
cgaacaatttggaaattcac

SEQ ID NO: 289346 - DNA, 20 bp, Artificial
  CRISPR gRNA sequence
ggaaattcacacgggaaccc

SEQ ID NO: 289347 - DNA, 20 bp, Artificial
  CRISPR gRNA sequence
gaaattcacacgggaaccca

SEQ ID NO: 289348 - DNA, 20 bp, Artificial
  CRISPR gRNA sequence
acacgggaacccagttttcg

SEQ ID NO: 289349 - DNA, 20 bp, Artificial
  CRISPR gRNA sequence
tcgggattccaccacacaga

SEQ ID NO: 289350 - DNA, 20 bp, Artificial
  CRISPR gRNA sequence
cgggattccaccacacagag

SEQ ID NO: 289351 - DNA, 20 bp, Artificial
  CRISPR gRNA sequence
gggattccaccacacagaga

SEQ ID NO: 289352 - DNA, 20 bp, Artificial
  CRISPR gRNA sequence
caccacacagagacagaaaa

SEQ ID NO: 289353 - DNA, 20 bp, Artificial
  CRISPR gRNA sequence
taaatttgcccaaatttata

SEQ ID NO: 289354 - DNA, 20 bp, Artificial
  CRISPR gRNA sequence
gcccaaatttatatcagttt

SEQ ID NO: 289355 - DNA, 20 bp, Artificial
  CRISPR gRNA sequence
cccaaatttatatcagtttt

SEQ ID NO: 289356 - DNA, 20 bp, Artificial
  CRISPR gRNA sequence
atatcagttttgtctgtttt

SEQ ID NO: 289357 - DNA, 20 bp, Artificial
  CRISPR gRNA sequence
tatcagttttgtctgtttta

SEQ ID NO: 289358 - DNA, 20 bp, Artificial
  CRISPR gRNA sequence
tgtctgttttagggactcca

SEQ ID NO: 289359 - DNA, 20 bp, Artificial
  CRISPR gRNA sequence
gtctgttttagggactccat

SEQ ID NO: 289360 - DNA, 20 bp, Artificial
  CRISPR gRNA sequence
tctgttttagggactccatc

SEQ ID NO: 289361 - DNA, 20 bp, Artificial
  CRISPR gRNA sequence
ttttagggactccatcacac

SEQ ID NO: 289362 - DNA, 20 bp, Artificial
  CRISPR gRNA sequence
tagggactccatcacacacg

SEQ ID NO: 289363 - DNA, 20 bp, Artificial
  CRISPR gRNA sequence
agggactccatcacacacgg

SEQ ID NO: 289364 - DNA, 20 bp, Artificial
  CRISPR gRNA sequence
gggactccatcacacacgga

SEQ ID NO: 289365 - DNA, 20 bp, Artificial
  CRISPR gRNA sequence
catcacacacggacaaaaag

SEQ ID NO: 289366 - DNA, 20 bp, Artificial
  CRISPR gRNA sequence
aaacggaaatgtctctaacg

SEQ ID NO: 289367 - DNA, 20 bp, Artificial
  CRISPR gRNA sequence
taacgattttgtctgcttca

SEQ ID NO: 289368 - DNA, 20 bp, Artificial
  CRISPR gRNA sequence
acgattttgtctgcttcagt

SEQ ID NO: 289369 - DNA, 20 bp, Artificial
  CRISPR gRNA sequence
tgtctgcttcagtgactggc

SEQ ID NO: 289370 - DNA, 20 bp, Artificial
  CRISPR gRNA sequence
gtctgcttcagtgactggcg

SEQ ID NO: 289371 - DNA, 20 bp, Artificial
  CRISPR gRNA sequence
tctgcttcagtgactggcgg

SEQ ID NO: 289372 - DNA, 20 bp, Artificial
  CRISPR gRNA sequence
cttcagtgactggcggggaa

SEQ ID NO: 289373 - DNA, 20 bp, Artificial
  CRISPR gRNA sequence
cagtgactggcggggaaagt

SEQ ID NO: 289374 - DNA, 20 bp, Artificial
  CRISPR gRNA sequence
agtgactggcggggaaagtc

SEQ ID NO: 289375 - DNA, 20 bp, Artificial
  CRISPR gRNA sequence
gcggggaaagtcagcacctg

SEQ ID NO: 289376 - DNA, 20 bp, Artificial
  CRISPR gRNA sequence
gaaatctcaatattactgtc

SEQ ID NO: 289377 - DNA, 20 bp, Artificial
  CRISPR gRNA sequence
aatattactgtctcaaacct

SEQ ID NO: 289378 - DNA, 20 bp, Artificial
  CRISPR gRNA sequence
ctgtctcaaacctggttgaa

SEQ ID NO: 289379 - DNA, 20 bp, Artificial
  CRISPR gRNA sequence
tctcaaacctggttgaactt

SEQ ID NO: 289380 - DNA, 20 bp, Artificial
  CRISPR gRNA sequence
aaacctggttgaacttctga

SEQ ID NO: 289381 - DNA, 20 bp, Artificial
  CRISPR gRNA sequence
gttgaacttctgagcttgct

SEQ ID NO: 289382 - DNA, 20 bp, Artificial
  CRISPR gRNA sequence
aacttctgagcttgctttgc

SEQ ID NO: 289383 - DNA, 20 bp, Artificial
  CRISPR gRNA sequence
ctgagcttgctttgccattt

SEQ ID NO: 289384 - DNA, 20 bp, Artificial
  CRISPR gRNA sequence
tgagcttgctttgccatttt

SEQ ID NO: 289385 - DNA, 20 bp, Artificial
  CRISPR gRNA sequence
agcttgctttgccatttttg

SEQ ID NO: 289386 - DNA, 20 bp, Artificial
  CRISPR gRNA sequence
gctttgccatttttgaatgg

SEQ ID NO: 289387 - DNA, 20 bp, Artificial
  CRISPR gRNA sequence
ctttgccatttttgaatggg

SEQ ID NO: 289388 - DNA, 20 bp, Artificial
  CRISPR gRNA sequence
tgccatttttgaatgggcat

SEQ ID NO: 289389 - DNA, 20 bp, Artificial
  CRISPR gRNA sequence
gccatttttgaatgggcatt

SEQ ID NO: 289390 - DNA, 20 bp, Artificial
  CRISPR gRNA sequence
ccatttttgaatgggcattg

SEQ ID NO: 289391 - DNA, 20 bp, Artificial
  CRISPR gRNA sequence
ttgaatgggcattgtaacac

SEQ ID NO: 289392 - DNA, 20 bp, Artificial
  CRISPR gRNA sequence
tgaatgggcattgtaacacc

SEQ ID NO: 289393 - DNA, 20 bp, Artificial
  CRISPR gRNA sequence
gaatgggcattgtaacacct

SEQ ID NO: 289394 - DNA, 20 bp, Artificial
  CRISPR gRNA sequence
aatgggcattgtaacaccta

SEQ ID NO: 289395 - DNA, 20 bp, Artificial
  CRISPR gRNA sequence
taacacctacccaacccagt

SEQ ID NO: 289396 - DNA, 20 bp, Artificial
  CRISPR gRNA sequence
cccaacccagtgggtgcaag

SEQ ID NO: 289397 - DNA, 20 bp, Artificial
  CRISPR gRNA sequence
aaaatgagatactgctcata

SEQ ID NO: 289398 - DNA, 20 bp, Artificial
  CRISPR gRNA sequence
ctcataaaagtcctccacag

SEQ ID NO: 289399 - DNA, 20 bp, Artificial
  CRISPR gRNA sequence
ataaaagtcctccacagtac

SEQ ID NO: 289400 - DNA, 20 bp, Artificial
  CRISPR gRNA sequence
cacagtacctaggacattag

SEQ ID NO: 289401 - DNA, 20 bp, Artificial
  CRISPR gRNA sequence
ggacattagagggagccagt

SEQ ID NO: 289402 - DNA, 20 bp, Artificial
  CRISPR gRNA sequence
gagggagccagtgtcttccc

SEQ ID NO: 289403 - DNA, 20 bp, Artificial
  CRISPR gRNA sequence
ccccagagatccacacagtt

SEQ ID NO: 289404 - DNA, 20 bp, Artificial
  CRISPR gRNA sequence
cccagagatccacacagttc

SEQ ID NO: 289405 - DNA, 20 bp, Artificial
  CRISPR gRNA sequence
aggtcccactttgctcacat

SEQ ID NO: 289406 - DNA, 20 bp, Artificial
  CRISPR gRNA sequence
tgctcacatctactctcgtg

SEQ ID NO: 289407 - DNA, 20 bp, Artificial
  CRISPR gRNA sequence
gctcacatctactctcgtgg

SEQ ID NO: 289408 - DNA, 20 bp, Artificial
  CRISPR gRNA sequence
ctcacatctactctcgtggc

SEQ ID NO: 289409 - DNA, 20 bp, Artificial
  CRISPR gRNA sequence
acatctactctcgtggcccc

SEQ ID NO: 289410 - DNA, 20 bp, Artificial
  CRISPR gRNA sequence
ctctcgtggccccttgtcaa

SEQ ID NO: 289411 - DNA, 20 bp, Artificial
  CRISPR gRNA sequence
tcgtggccccttgtcaaaga

SEQ ID NO: 289412 - DNA, 20 bp, Artificial
  CRISPR gRNA sequence
gtggccccttgtcaaagagg

SEQ ID NO: 289413 - DNA, 20 bp, Artificial
  CRISPR gRNA sequence
gtcaaagaggccttccctga

SEQ ID NO: 289414 - DNA, 20 bp, Artificial
  CRISPR gRNA sequence
tcaaagaggccttccctgac

SEQ ID NO: 289415 - DNA, 20 bp, Artificial
  CRISPR gRNA sequence
ccctgactctccttgaacag

SEQ ID NO: 289416 - DNA, 20 bp, Artificial
  CRISPR gRNA sequence
cctgactctccttgaacagc

SEQ ID NO: 289417 - DNA, 20 bp, Artificial
  CRISPR gRNA sequence
actctccttgaacagcgcca

SEQ ID NO: 289418 - DNA, 20 bp, Artificial
  CRISPR gRNA sequence
tccttgaacagcgccatcct

SEQ ID NO: 289419 - DNA, 20 bp, Artificial
  CRISPR gRNA sequence
cttgaacagcgccatcctcc

SEQ ID NO: 289420 - DNA, 20 bp, Artificial
  CRISPR gRNA sequence
gaacagcgccatcctccctg

SEQ ID NO: 289421 - DNA, 20 bp, Artificial
  CRISPR gRNA sequence
aacagcgccatcctccctgc

SEQ ID NO: 289422 - DNA, 20 bp, Artificial
  CRISPR gRNA sequence
cctgcccccctccatcctgc

SEQ ID NO: 289423 - DNA, 20 bp, Artificial
  CRISPR gRNA sequence
cccccctccatcctgctact

SEQ ID NO: 289424 - DNA, 20 bp, Artificial
  CRISPR gRNA sequence
catcctgctactctttagtc

SEQ ID NO: 289425 - DNA, 20 bp, Artificial
  CRISPR gRNA sequence
ctactctttagtctctttgc

SEQ ID NO: 289426 - DNA, 20 bp, Artificial
  CRISPR gRNA sequence
ctctttagtctctttgcctg

SEQ ID NO: 289427 - DNA, 20 bp, Artificial
  CRISPR gRNA sequence
tttagtctctttgcctgatt

SEQ ID NO: 289428 - DNA, 20 bp, Artificial
  CRISPR gRNA sequence
tagtctctttgcctgatttg

SEQ ID NO: 289429 - DNA, 20 bp, Artificial
  CRISPR gRNA sequence
agtctctttgcctgatttgt

SEQ ID NO: 289430 - DNA, 20 bp, Artificial
  CRISPR gRNA sequence
gtctctttgcctgatttgtt

SEQ ID NO: 289431 - DNA, 20 bp, Artificial
  CRISPR gRNA sequence
tttgcctgatttgtttctct

SEQ ID NO: 289432 - DNA, 20 bp, Artificial
  CRISPR gRNA sequence
tgcctgatttgtttctcttc

SEQ ID NO: 289433 - DNA, 20 bp, Artificial
  CRISPR gRNA sequence
gcctgatttgtttctcttca

SEQ ID NO: 289434 - DNA, 20 bp, Artificial
  CRISPR gRNA sequence
cctgatttgtttctcttcag

SEQ ID NO: 289435 - DNA, 20 bp, Artificial
  CRISPR gRNA sequence
atttgtttctcttcaggctt

SEQ ID NO: 289436 - DNA, 20 bp, Artificial
  CRISPR gRNA sequence
gtttctcttcaggcttgtct

SEQ ID NO: 289437 - DNA, 20 bp, Artificial
  CRISPR gRNA sequence
tttctcttcaggcttgtctc

SEQ ID NO: 289438 - DNA, 20 bp, Artificial
  CRISPR gRNA sequence
ctcttcaggcttgtctccag

SEQ ID NO: 289439 - DNA, 20 bp, Artificial
  CRISPR gRNA sequence
tcttcaggcttgtctccagc

SEQ ID NO: 289440 - DNA, 20 bp, Artificial
  CRISPR gRNA sequence
ttcaggcttgtctccagctg

SEQ ID NO: 289441 - DNA, 20 bp, Artificial
  CRISPR gRNA sequence
caggcttgtctccagctgat

SEQ ID NO: 289442 - DNA, 20 bp, Artificial
  CRISPR gRNA sequence
aggcttgtctccagctgata

SEQ ID NO: 289443 - DNA, 20 bp, Artificial
  CRISPR gRNA sequence
gtctccagctgatatatatt

SEQ ID NO: 289444 - DNA, 20 bp, Artificial
  CRISPR gRNA sequence
tctccagctgatatatattt

SEQ ID NO: 289445 - DNA, 20 bp, Artificial
  CRISPR gRNA sequence
cagctgatatatatttttac

SEQ ID NO: 289446 - DNA, 20 bp, Artificial
  CRISPR gRNA sequence
atatatatttttacaactgt

SEQ ID NO: 289447 - DNA, 20 bp, Artificial
  CRISPR gRNA sequence
ttacaactgtgatgtatatt

SEQ ID NO: 289448 - DNA, 20 bp, Artificial
  CRISPR gRNA sequence
tacaactgtgatgtatattt

SEQ ID NO: 289449 - DNA, 20 bp, Artificial
  CRISPR gRNA sequence
acaactgtgatgtatattta

SEQ ID NO: 289450 - DNA, 20 bp, Artificial
  CRISPR gRNA sequence
caactgtgatgtatatttac

SEQ ID NO: 289451 - DNA, 20 bp, Artificial
  CRISPR gRNA sequence
tgatgtatatttacaggtat

SEQ ID NO: 289452 - DNA, 20 bp, Artificial
  CRISPR gRNA sequence
acaggtatatgtgatacata

SEQ ID NO: 289453 - DNA, 20 bp, Artificial
  CRISPR gRNA sequence
caggtatatgtgatacataa

SEQ ID NO: 289454 - DNA, 20 bp, Artificial
  CRISPR gRNA sequence
cgtatggagctatggagcag

SEQ ID NO: 289455 - DNA, 20 bp, Artificial
  CRISPR gRNA sequence
tggagcagaggcttcctcct

SEQ ID NO: 289456 - DNA, 20 bp, Artificial
  CRISPR gRNA sequence
cctcctttgttcactgccat

SEQ ID NO: 289457 - DNA, 20 bp, Artificial
  CRISPR gRNA sequence
ctcctttgttcactgccata

SEQ ID NO: 289458 - DNA, 20 bp, Artificial
  CRISPR gRNA sequence
ctttgttcactgccatatct

SEQ ID NO: 289459 - DNA, 20 bp, Artificial
  CRISPR gRNA sequence
tgttcactgccatatctgca

SEQ ID NO: 289460 - DNA, 20 bp, Artificial
  CRISPR gRNA sequence
gttcactgccatatctgcag

SEQ ID NO: 289461 - DNA, 20 bp, Artificial
  CRISPR gRNA sequence
ttcactgccatatctgcagt

SEQ ID NO: 289462 - DNA, 20 bp, Artificial
  CRISPR gRNA sequence
actgccatatctgcagtgtc

SEQ ID NO: 289463 - DNA, 20 bp, Artificial
  CRISPR gRNA sequence
ccatatctgcagtgtctaga

SEQ ID NO: 289464 - DNA, 20 bp, Artificial
  CRISPR gRNA sequence
cagtgtctagaacagggcct

SEQ ID NO: 289465 - DNA, 20 bp, Artificial
  CRISPR gRNA sequence
gaacagggcctggcccatag

SEQ ID NO: 289466 - DNA, 20 bp, Artificial
  CRISPR gRNA sequence
gcccatagtaggtgctcagt

SEQ ID NO: 289467 - DNA, 20 bp, Artificial
  CRISPR gRNA sequence
agtaaatacttgctgaatgc

SEQ ID NO: 289468 - DNA, 20 bp, Artificial
  CRISPR gRNA sequence
gctgaatgcatgtctaggca

SEQ ID NO: 289469 - DNA, 20 bp, Artificial
  CRISPR gRNA sequence
ctgaatgcatgtctaggcat

SEQ ID NO: 289470 - DNA, 20 bp, Artificial
  CRISPR gRNA sequence
aatgcatgtctaggcatgag

SEQ ID NO: 289471 - DNA, 20 bp, Artificial
  CRISPR gRNA sequence
ggcatgaggaaatgaggtct

SEQ ID NO: 289472 - DNA, 20 bp, Artificial
  CRISPR gRNA sequence
gctccatccactgtgtatta

SEQ ID NO: 289473 - DNA, 20 bp, Artificial
  CRISPR gRNA sequence
catccactgtgtattagaat

SEQ ID NO: 289474 - DNA, 20 bp, Artificial
  CRISPR gRNA sequence
tgtattagaatcataacctt

SEQ ID NO: 289475 - DNA, 20 bp, Artificial
  CRISPR gRNA sequence
gaatcataaccttgagcaag

SEQ ID NO: 289476 - DNA, 20 bp, Artificial
  CRISPR gRNA sequence
gagcaagctgggtaacctct

SEQ ID NO: 289477 - DNA, 20 bp, Artificial
  CRISPR gRNA sequence
agcaagctgggtaacctctc

SEQ ID NO: 289478 - DNA, 20 bp, Artificial
  CRISPR gRNA sequence
ggtaacctctctgggcttca

SEQ ID NO: 289479 - DNA, 20 bp, Artificial
  CRISPR gRNA sequence
tctgggcttcaggttccatc

SEQ ID NO: 289480 - DNA, 20 bp, Artificial
  CRISPR gRNA sequence
tgggcttcaggttccatctc

SEQ ID NO: 289481 - DNA, 20 bp, Artificial
  CRISPR gRNA sequence
ggcttcaggttccatctctg

SEQ ID NO: 289482 - DNA, 20 bp, Artificial
  CRISPR gRNA sequence
caggttccatctctgtaaaa

SEQ ID NO: 289483 - DNA, 20 bp, Artificial
  CRISPR gRNA sequence
aggttccatctctgtaaaac

SEQ ID NO: 289484 - DNA, 20 bp, Artificial
  CRISPR gRNA sequence
catctctgtaaaacagtcat

SEQ ID NO: 289485 - DNA, 20 bp, Artificial
  CRISPR gRNA sequence
tgtaaaacagtcataatact

SEQ ID NO: 289486 - DNA, 20 bp, Artificial
  CRISPR gRNA sequence
taaaacagtcataatactat

SEQ ID NO: 289487 - DNA, 20 bp, Artificial
  CRISPR gRNA sequence
ttgctatgatttgaatgtgt

SEQ ID NO: 289488 - DNA, 20 bp, Artificial
  CRISPR gRNA sequence
ctatgatttgaatgtgtccc

SEQ ID NO: 289489 - DNA, 20 bp, Artificial
  CRISPR gRNA sequence
tgatttgaatgtgtccccta

SEQ ID NO: 289490 - DNA, 20 bp, Artificial
  CRISPR gRNA sequence
gaatgtgtcccctaaaggtt

SEQ ID NO: 289491 - DNA, 20 bp, Artificial
  CRISPR gRNA sequence
aatgtgtcccctaaaggttt

SEQ ID NO: 289492 - DNA, 20 bp, Artificial
  CRISPR gRNA sequence
aaggttttgtgttggaaatt

SEQ ID NO: 289493 - DNA, 20 bp, Artificial
  CRISPR gRNA sequence
tgtgttggaaatttaattcc

SEQ ID NO: 289494 - DNA, 20 bp, Artificial
  CRISPR gRNA sequence
gtgttggaaatttaattccg

SEQ ID NO: 289495 - DNA, 20 bp, Artificial
  CRISPR gRNA sequence
tgttggaaatttaattccgg

SEQ ID NO: 289496 - DNA, 20 bp, Artificial
  CRISPR gRNA sequence
gaaatttaattccgggtgca

SEQ ID NO: 289497 - DNA, 20 bp, Artificial
  CRISPR gRNA sequence
aattccgggtgcaacagtgt

SEQ ID NO: 289498 - DNA, 20 bp, Artificial
  CRISPR gRNA sequence
attccgggtgcaacagtgtt

SEQ ID NO: 289499 - DNA, 20 bp, Artificial
  CRISPR gRNA sequence
cgggtgcaacagtgttgaga

SEQ ID NO: 289500 - DNA, 20 bp, Artificial
  CRISPR gRNA sequence
agaattgggactgttaaaag

SEQ ID NO: 289501 - DNA, 20 bp, Artificial
  CRISPR gRNA sequence
ggactgttaaaaggtgatta

SEQ ID NO: 289502 - DNA, 20 bp, Artificial
  CRISPR gRNA sequence
ttaaaaggtgattaggtcat

SEQ ID NO: 289503 - DNA, 20 bp, Artificial
  CRISPR gRNA sequence
aaaggtgattaggtcatgga

SEQ ID NO: 289504 - DNA, 20 bp, Artificial
  CRISPR gRNA sequence
ggtcatggagactctgccat

SEQ ID NO: 289505 - DNA, 20 bp, Artificial
  CRISPR gRNA sequence
tgccatcatggatggattaa

SEQ ID NO: 289506 - DNA, 20 bp, Artificial
  CRISPR gRNA sequence
ccatcatggatggattaatg

SEQ ID NO: 289507 - DNA, 20 bp, Artificial
  CRISPR gRNA sequence
atgccatttttttgggagtg

SEQ ID NO: 289508 - DNA, 20 bp, Artificial
  CRISPR gRNA sequence
ttttgggagtgggttcacta

SEQ ID NO: 289509 - DNA, 20 bp, Artificial
  CRISPR gRNA sequence
tttgggagtgggttcactac

SEQ ID NO: 289510 - DNA, 20 bp, Artificial
  CRISPR gRNA sequence
ttgggagtgggttcactaca

SEQ ID NO: 289511 - DNA, 20 bp, Artificial
  CRISPR gRNA sequence
tgggagtgggttcactacag

SEQ ID NO: 289512 - DNA, 20 bp, Artificial
  CRISPR gRNA sequence
gggagtgggttcactacagc

SEQ ID NO: 289513 - DNA, 20 bp, Artificial
  CRISPR gRNA sequence
ggagtgggttcactacagca

SEQ ID NO: 289514 - DNA, 20 bp, Artificial
  CRISPR gRNA sequence
actacagcaggagtggcttc

SEQ ID NO: 289515 - DNA, 20 bp, Artificial
  CRISPR gRNA sequence
cagcaggagtggcttcctta

SEQ ID NO: 289516 - DNA, 20 bp, Artificial
  CRISPR gRNA sequence
ccttataaaggatggttttg

SEQ ID NO: 289517 - DNA, 20 bp, Artificial
  CRISPR gRNA sequence
cttataaaggatggttttgg

SEQ ID NO: 289518 - DNA, 20 bp, Artificial
  CRISPR gRNA sequence
ataaaggatggttttggcct

SEQ ID NO: 289519 - DNA, 20 bp, Artificial
  CRISPR gRNA sequence
taaaggatggttttggcctc

SEQ ID NO: 289520 - DNA, 20 bp, Artificial
  CRISPR gRNA sequence
tggcctccttcctactctgc

SEQ ID NO: 289521 - DNA, 20 bp, Artificial
  CRISPR gRNA sequence
ggcctccttcctactctgcc

SEQ ID NO: 289522 - DNA, 20 bp, Artificial
  CRISPR gRNA sequence
gcctccttcctactctgcct

SEQ ID NO: 289523 - DNA, 20 bp, Artificial
  CRISPR gRNA sequence
cttcctactctgccttgggc

SEQ ID NO: 289524 - DNA, 20 bp, Artificial
  CRISPR gRNA sequence
cctactctgccttgggcgtg

SEQ ID NO: 289525 - DNA, 20 bp, Artificial
  CRISPR gRNA sequence
ctactctgccttgggcgtgc

SEQ ID NO: 289526 - DNA, 20 bp, Artificial
  CRISPR gRNA sequence
ctctgccttgggcgtgctct

SEQ ID NO: 289527 - DNA, 20 bp, Artificial
  CRISPR gRNA sequence
tgccttgggcgtgctctcct

SEQ ID NO: 289528 - DNA, 20 bp, Artificial
  CRISPR gRNA sequence
ccttgggcgtgctctcctgc

SEQ ID NO: 289529 - DNA, 20 bp, Artificial
  CRISPR gRNA sequence
gggcgtgctctcctgccttt

SEQ ID NO: 289530 - DNA, 20 bp, Artificial
  CRISPR gRNA sequence
ggcgtgctctcctgcctttc

SEQ ID NO: 289531 - DNA, 20 bp, Artificial
  CRISPR gRNA sequence
tcctgcctttctatcctctg

SEQ ID NO: 289532 - DNA, 20 bp, Artificial
  CRISPR gRNA sequence
ctgcctttctatcctctgcc

SEQ ID NO: 289533 - DNA, 20 bp, Artificial
  CRISPR gRNA sequence
cctttctatcctctgccatg

SEQ ID NO: 289534 - DNA, 20 bp, Artificial
  CRISPR gRNA sequence
tctatcctctgccatgggat

SEQ ID NO: 289535 - DNA, 20 bp, Artificial
  CRISPR gRNA sequence
ctatcctctgccatgggatg

SEQ ID NO: 289536 - DNA, 20 bp, Artificial
  CRISPR gRNA sequence
tatcctctgccatgggatga

SEQ ID NO: 289537 - DNA, 20 bp, Artificial
  CRISPR gRNA sequence
tcctctgccatgggatgatg

SEQ ID NO: 289538 - DNA, 20 bp, Artificial
  CRISPR gRNA sequence
tgccatgggatgatgcagca

SEQ ID NO: 289539 - DNA, 20 bp, Artificial
  CRISPR gRNA sequence
ccatgggatgatgcagcaag

SEQ ID NO: 289540 - DNA, 20 bp, Artificial
  CRISPR gRNA sequence
atcagatgtgagccccttga

SEQ ID NO: 289541 - DNA, 20 bp, Artificial
  CRISPR gRNA sequence
gaccttggacttcccagcct

SEQ ID NO: 289542 - DNA, 20 bp, Artificial
  CRISPR gRNA sequence
accttggacttcccagcctc

SEQ ID NO: 289543 - DNA, 20 bp, Artificial
  CRISPR gRNA sequence
ggacttcccagcctccagaa

SEQ ID NO: 289544 - DNA, 20 bp, Artificial
  CRISPR gRNA sequence
gacttcccagcctccagaac

SEQ ID NO: 289545 - DNA, 20 bp, Artificial
  CRISPR gRNA sequence
cccagcctccagaacagtaa

SEQ ID NO: 289546 - DNA, 20 bp, Artificial
  CRISPR gRNA sequence
ccagcctccagaacagtaag

SEQ ID NO: 289547 - DNA, 20 bp, Artificial
  CRISPR gRNA sequence
cagaacagtaagaaataaat

SEQ ID NO: 289548 - DNA, 20 bp, Artificial
  CRISPR gRNA sequence
tgttctttctaaattaccca

SEQ ID NO: 289549 - DNA, 20 bp, Artificial
  CRISPR gRNA sequence
ttctttctaaattacccaat

SEQ ID NO: 289550 - DNA, 20 bp, Artificial
  CRISPR gRNA sequence
tttctaaattacccaatgtc

SEQ ID NO: 289551 - DNA, 20 bp, Artificial
  CRISPR gRNA sequence
tctaaattacccaatgtcag

SEQ ID NO: 289552 - DNA, 20 bp, Artificial
  CRISPR gRNA sequence
ctaaattacccaatgtcagg

SEQ ID NO: 289553 - DNA, 20 bp, Artificial
  CRISPR gRNA sequence
taaattacccaatgtcaggt

SEQ ID NO: 289554 - DNA, 20 bp, Artificial
  CRISPR gRNA sequence
aattacccaatgtcaggtat

SEQ ID NO: 289555 - DNA, 20 bp, Artificial
  CRISPR gRNA sequence
cccaatgtcaggtattctgt

SEQ ID NO: 289556 - DNA, 20 bp, Artificial
  CRISPR gRNA sequence
tgttatagcagcacaaacca

SEQ ID NO: 289557 - DNA, 20 bp, Artificial
  CRISPR gRNA sequence
ttatagcagcacaaaccaga

SEQ ID NO: 289558 - DNA, 20 bp, Artificial
  CRISPR gRNA sequence
tagcagcacaaaccagaccg

SEQ ID NO: 289559 - DNA, 20 bp, Artificial
  CRISPR gRNA sequence
tcttccctgcttcacataat

SEQ ID NO: 289560 - DNA, 20 bp, Artificial
  CRISPR gRNA sequence
ccctgcttcacataattatc

SEQ ID NO: 289561 - DNA, 20 bp, Artificial
  CRISPR gRNA sequence
cctgcttcacataattatca

SEQ ID NO: 289562 - DNA, 20 bp, Artificial
  CRISPR gRNA sequence
cttcacataattatcacagc

SEQ ID NO: 289563 - DNA, 20 bp, Artificial
  CRISPR gRNA sequence
cacataattatcacagcgat

SEQ ID NO: 289564 - DNA, 20 bp, Artificial
  CRISPR gRNA sequence
acataattatcacagcgatc

SEQ ID NO: 289565 - DNA, 20 bp, Artificial
  CRISPR gRNA sequence
tcacagcgatcacaggatac

SEQ ID NO: 289566 - DNA, 20 bp, Artificial
  CRISPR gRNA sequence
tcttaactttagaatgctct

SEQ ID NO: 289567 - DNA, 20 bp, Artificial
  CRISPR gRNA sequence
cttaactttagaatgctcta

SEQ ID NO: 289568 - DNA, 20 bp, Artificial
  CRISPR gRNA sequence
ttaactttagaatgctctac

SEQ ID NO: 289569 - DNA, 20 bp, Artificial
  CRISPR gRNA sequence
aactttagaatgctctacag

SEQ ID NO: 289570 - DNA, 20 bp, Artificial
  CRISPR gRNA sequence
actttagaatgctctacaga

SEQ ID NO: 289571 - DNA, 20 bp, Artificial
  CRISPR gRNA sequence
tagaatgctctacagatttt

SEQ ID NO: 289572 - DNA, 20 bp, Artificial
  CRISPR gRNA sequence
agaatgctctacagatttta

SEQ ID NO: 289573 - DNA, 20 bp, Artificial
  CRISPR gRNA sequence
gaatgctctacagattttaa

SEQ ID NO: 289574 - DNA, 20 bp, Artificial
  CRISPR gRNA sequence
tacagattttaaatggggct

SEQ ID NO: 289575 - DNA, 20 bp, Artificial
  CRISPR gRNA sequence
cagattttaaatggggctgt

SEQ ID NO: 289576 - DNA, 20 bp, Artificial
  CRISPR gRNA sequence
taaatggggctgttctttct

SEQ ID NO: 289577 - DNA, 20 bp, Artificial
  CRISPR gRNA sequence
aaatggggctgttctttctc

SEQ ID NO: 289578 - DNA, 20 bp, Artificial
  CRISPR gRNA sequence
aatggggctgttctttctca

SEQ ID NO: 289579 - DNA, 20 bp, Artificial
  CRISPR gRNA sequence
ttctttctcatgcacaacag

SEQ ID NO: 289580 - DNA, 20 bp, Artificial
  CRISPR gRNA sequence
tttctcatgcacaacagcct

SEQ ID NO: 289581 - DNA, 20 bp, Artificial
  CRISPR gRNA sequence
tctcatgcacaacagcctgc

SEQ ID NO: 289582 - DNA, 20 bp, Artificial
  CRISPR gRNA sequence
ctcatgcacaacagcctgct

SEQ ID NO: 289583 - DNA, 20 bp, Artificial
  CRISPR gRNA sequence
tcatgcacaacagcctgctt

SEQ ID NO: 289584 - DNA, 20 bp, Artificial
  CRISPR gRNA sequence
atgcacaacagcctgctttg

SEQ ID NO: 289585 - DNA, 20 bp, Artificial
  CRISPR gRNA sequence
ctttgctgaaccacaccccc

SEQ ID NO: 289586 - DNA, 20 bp, Artificial
  CRISPR gRNA sequence
tgctgaaccacacccccata

SEQ ID NO: 289587 - DNA, 20 bp, Artificial
  CRISPR gRNA sequence
gctgaaccacacccccatag

SEQ ID NO: 289588 - DNA, 20 bp, Artificial
  CRISPR gRNA sequence
ctgaaccacacccccatagg

SEQ ID NO: 289589 - DNA, 20 bp, Artificial
  CRISPR gRNA sequence
aaccacacccccataggacc

SEQ ID NO: 289590 - DNA, 20 bp, Artificial
  CRISPR gRNA sequence
gctgattcttgaactgagtt

SEQ ID NO: 289591 - DNA, 20 bp, Artificial
  CRISPR gRNA sequence
attcttgaactgagttcagt

SEQ ID NO: 289592 - DNA, 20 bp, Artificial
  CRISPR gRNA sequence
ttgaactgagttcagtgccc

SEQ ID NO: 289593 - DNA, 20 bp, Artificial
  CRISPR gRNA sequence
gaactgagttcagtgcccat

SEQ ID NO: 289594 - DNA, 20 bp, Artificial
  CRISPR gRNA sequence
aactgagttcagtgcccata

SEQ ID NO: 289595 - DNA, 20 bp, Artificial
  CRISPR gRNA sequence
agttcagtgcccatagctgg

SEQ ID NO: 289596 - DNA, 20 bp, Artificial
  CRISPR gRNA sequence
agtgcccatagctggcatgg

SEQ ID NO: 289597 - DNA, 20 bp, Artificial
  CRISPR gRNA sequence
gcatggggagcccctcctgc

SEQ ID NO: 289598 - DNA, 20 bp, Artificial
  CRISPR gRNA sequence
ctgcacctctacccagcagc

SEQ ID NO: 289599 - DNA, 20 bp, Artificial
  CRISPR gRNA sequence
cacctctacccagcagcagt

SEQ ID NO: 289600 - DNA, 20 bp, Artificial
  CRISPR gRNA sequence
tacccagcagcagtcagaaa

SEQ ID NO: 289601 - DNA, 20 bp, Artificial
  CRISPR gRNA sequence
cccagcagcagtcagaaagg

SEQ ID NO: 289602 - DNA, 20 bp, Artificial
  CRISPR gRNA sequence
tgaaaggaggcggagagaag

SEQ ID NO: 289603 - DNA, 20 bp, Artificial
  CRISPR gRNA sequence
ctcgccttctggcgaatgca

SEQ ID NO: 289604 - DNA, 20 bp, Artificial
  CRISPR gRNA sequence
gccttctggcgaatgcatgg

SEQ ID NO: 289605 - DNA, 20 bp, Artificial
  CRISPR gRNA sequence
ctggcgaatgcatggaaact

SEQ ID NO: 289606 - DNA, 20 bp, Artificial
  CRISPR gRNA sequence
tggcgaatgcatggaaactg

SEQ ID NO: 289607 - DNA, 20 bp, Artificial
  CRISPR gRNA sequence
gcgaatgcatggaaactgcc

SEQ ID NO: 289608 - DNA, 20 bp, Artificial
  CRISPR gRNA sequence
cccacctgtagggcacaata

SEQ ID NO: 289609 - DNA, 20 bp, Artificial
  CRISPR gRNA sequence
tagggcacaatagggacact

SEQ ID NO: 289610 - DNA, 20 bp, Artificial
  CRISPR gRNA sequence
aacactgctggcctcagcct

SEQ ID NO: 289611 - DNA, 20 bp, Artificial
  CRISPR gRNA sequence
ctggcctcagcctctgcctc

SEQ ID NO: 289612 - DNA, 20 bp, Artificial
  CRISPR gRNA sequence
gcctcagcctctgcctctcc

SEQ ID NO: 289613 - DNA, 20 bp, Artificial
  CRISPR gRNA sequence
agcctctgcctctcctgacc

SEQ ID NO: 289614 - DNA, 20 bp, Artificial
  CRISPR gRNA sequence
tgcctctcctgaccccttgg

SEQ ID NO: 289615 - DNA, 20 bp, Artificial
  CRISPR gRNA sequence
cctctcctgaccccttggcc

SEQ ID NO: 289616 - DNA, 20 bp, Artificial
  CRISPR gRNA sequence
tcctgaccccttggccaccc

SEQ ID NO: 289617 - DNA, 20 bp, Artificial
  CRISPR gRNA sequence
ctgaccccttggccaccctc

SEQ ID NO: 289618 - DNA, 20 bp, Artificial
  CRISPR gRNA sequence
accccttggccaccctcctg

SEQ ID NO: 289619 - DNA, 20 bp, Artificial
  CRISPR gRNA sequence
ggccaccctcctgctctgac

SEQ ID NO: 289620 - DNA, 20 bp, Artificial
  CRISPR gRNA sequence
gccaccctcctgctctgacc

SEQ ID NO: 289621 - DNA, 20 bp, Artificial
  CRISPR gRNA sequence
ctgctctgaccacttcaact

SEQ ID NO: 289622 - DNA, 20 bp, Artificial
  CRISPR gRNA sequence
ctctgaccacttcaactctg

SEQ ID NO: 289623 - DNA, 20 bp, Artificial
  CRISPR gRNA sequence
tgaccacttcaactctggac

SEQ ID NO: 289624 - DNA, 20 bp, Artificial
  CRISPR gRNA sequence
accacttcaactctggactg

SEQ ID NO: 289625 - DNA, 20 bp, Artificial
  CRISPR gRNA sequence
caactctggactgctagcca

SEQ ID NO: 289626 - DNA, 20 bp, Artificial
  CRISPR gRNA sequence
aactctggactgctagccac

SEQ ID NO: 289627 - DNA, 20 bp, Artificial
  CRISPR gRNA sequence
tggactgctagccacacagg

SEQ ID NO: 289628 - DNA, 20 bp, Artificial
  CRISPR gRNA sequence
gactgctagccacacaggag

SEQ ID NO: 289629 - DNA, 20 bp, Artificial
  CRISPR gRNA sequence
ctagccacacaggagaggaa

SEQ ID NO: 289630 - DNA, 20 bp, Artificial
  CRISPR gRNA sequence
gccacacaggagaggaagct

SEQ ID NO: 289631 - DNA, 20 bp, Artificial
  CRISPR gRNA sequence
tttgccaacaagagtagaga

SEQ ID NO: 289632 - DNA, 20 bp, Artificial
  CRISPR gRNA sequence
gccaacaagagtagagacca

SEQ ID NO: 289633 - DNA, 20 bp, Artificial
  CRISPR gRNA sequence
ccaacaagagtagagaccaa

SEQ ID NO: 289634 - DNA, 20 bp, Artificial
  CRISPR gRNA sequence
tagacaaataatggacctct

SEQ ID NO: 289635 - DNA, 20 bp, Artificial
  CRISPR gRNA sequence
agacaaataatggacctctc

SEQ ID NO: 289636 - DNA, 20 bp, Artificial
  CRISPR gRNA sequence
gacaaataatggacctctcg

SEQ ID NO: 289637 - DNA, 20 bp, Artificial
  CRISPR gRNA sequence
tcggccgggcgtggtggctc

SEQ ID NO: 289638 - DNA, 20 bp, Artificial
  CRISPR gRNA sequence
ggccgggcgtggtggctcac

SEQ ID NO: 289639 - DNA, 20 bp, Artificial
  CRISPR gRNA sequence
acgcctgtaatcccagcact

SEQ ID NO: 289640 - DNA, 20 bp, Artificial
  CRISPR gRNA sequence
taatcccagcactttgggag

SEQ ID NO: 289641 - DNA, 20 bp, Artificial
  CRISPR gRNA sequence
tgggaggccgaggcaggcgg

SEQ ID NO: 289642 - DNA, 20 bp, Artificial
  CRISPR gRNA sequence
gggaggccgaggcaggcgga

SEQ ID NO: 289643 - DNA, 20 bp, Artificial
  CRISPR gRNA sequence
ggaggccgaggcaggcggat

SEQ ID NO: 289644 - DNA, 20 bp, Artificial
  CRISPR gRNA sequence
gaagatcatcctggctaata

SEQ ID NO: 289645 - DNA, 20 bp, Artificial
  CRISPR gRNA sequence
gctaatacggtgaaaccccg

SEQ ID NO: 289646 - DNA, 20 bp, Artificial
  CRISPR gRNA sequence
atacggtgaaaccccgtctc

SEQ ID NO: 289647 - DNA, 20 bp, Artificial
  CRISPR gRNA sequence
tactaaaaatacaaaaaaaa

SEQ ID NO: 289648 - DNA, 20 bp, Artificial
  CRISPR gRNA sequence
ctaaaaatacaaaaaaaata

SEQ ID NO: 289649 - DNA, 20 bp, Artificial
  CRISPR gRNA sequence
aaaatacaaaaaaaataaat

SEQ ID NO: 289650 - DNA, 20 bp, Artificial
  CRISPR gRNA sequence
gccaggcgtggtggcgggct

SEQ ID NO: 289651 - DNA, 20 bp, Artificial
  CRISPR gRNA sequence
atttttgtgtggaggacttt

SEQ ID NO: 289652 - DNA, 20 bp, Artificial
  CRISPR gRNA sequence
ttgtgtggaggacttttacg

SEQ ID NO: 289653 - DNA, 20 bp, Artificial
  CRISPR gRNA sequence
tgtgtggaggacttttacga

SEQ ID NO: 289654 - DNA, 20 bp, Artificial
  CRISPR gRNA sequence
gtgtggaggacttttacgag

SEQ ID NO: 289655 - DNA, 20 bp, Artificial
  CRISPR gRNA sequence
tgtggaggacttttacgagc

SEQ ID NO: 289656 - DNA, 20 bp, Artificial
  CRISPR gRNA sequence
ttacgagctgtagtcccagc

SEQ ID NO: 289657 - DNA, 20 bp, Artificial
  CRISPR gRNA sequence
tacgagctgtagtcccagct

SEQ ID NO: 289658 - DNA, 20 bp, Artificial
  CRISPR gRNA sequence
acgagctgtagtcccagcta

SEQ ID NO: 289659 - DNA, 20 bp, Artificial
  CRISPR gRNA sequence
cgagctgtagtcccagctac

SEQ ID NO: 289660 - DNA, 20 bp, Artificial
  CRISPR gRNA sequence
tagtcccagctactcgggag

SEQ ID NO: 289661 - DNA, 20 bp, Artificial
  CRISPR gRNA sequence
ctcgggaggctgaggcagga

SEQ ID NO: 289662 - DNA, 20 bp, Artificial
  CRISPR gRNA sequence
gggaggctgaggcaggagaa

SEQ ID NO: 289663 - DNA, 20 bp, Artificial
  CRISPR gRNA sequence
aggcaggagaatggcgtgaa

SEQ ID NO: 289664 - DNA, 20 bp, Artificial
  CRISPR gRNA sequence
gctgtgagccagagattgtg

SEQ ID NO: 289665 - DNA, 20 bp, Artificial
  CRISPR gRNA sequence
ctgtgagccagagattgtgc

SEQ ID NO: 289666 - DNA, 20 bp, Artificial
  CRISPR gRNA sequence
tgagccagagattgtgccac

SEQ ID NO: 289667 - DNA, 20 bp, Artificial
  CRISPR gRNA sequence
tgccactgcactccagcttg

SEQ ID NO: 289668 - DNA, 20 bp, Artificial
  CRISPR gRNA sequence
cactccagcttgggcgacag

SEQ ID NO: 289669 - DNA, 20 bp, Artificial
  CRISPR gRNA sequence
cagcttgggcgacagagcaa

SEQ ID NO: 289670 - DNA, 20 bp, Artificial
  CRISPR gRNA sequence
gggcgacagagcaagactct

SEQ ID NO: 289671 - DNA, 20 bp, Artificial
  CRISPR gRNA sequence
ggcgacagagcaagactctg

SEQ ID NO: 289672 - DNA, 20 bp, Artificial
  CRISPR gRNA sequence
tgtctcaaaaaaaaaaaaaa

SEQ ID NO: 289673 - DNA, 20 bp, Artificial
  CRISPR gRNA sequence
tctcaaaaaaaaaaaaaaaa

SEQ ID NO: 289674 - DNA, 20 bp, Artificial
  CRISPR gRNA sequence
aaaaaaaaaaaaaaaaaaaa

SEQ ID NO: 289675 - DNA, 20 bp, Artificial
  CRISPR gRNA sequence
tcaagggctcaatctaggcc

SEQ ID NO: 289676 - DNA, 20 bp, Artificial
  CRISPR gRNA sequence
aagggctcaatctaggccag

SEQ ID NO: 289677 - DNA, 20 bp, Artificial
  CRISPR gRNA sequence
aatctaggccaggcacccgt

SEQ ID NO: 289678 - DNA, 20 bp, Artificial
  CRISPR gRNA sequence
ggccaggcacccgtaatccc

SEQ ID NO: 289679 - DNA, 20 bp, Artificial
  CRISPR gRNA sequence
tgggagctggccaaggcggg

SEQ ID NO: 289680 - DNA, 20 bp, Artificial
  CRISPR gRNA sequence
gggagctggccaaggcgggt

SEQ ID NO: 289681 - DNA, 20 bp, Artificial
  CRISPR gRNA sequence
ggagctggccaaggcgggtg

SEQ ID NO: 289682 - DNA, 20 bp, Artificial
  CRISPR gRNA sequence
gccaaggcgggtggattgct

SEQ ID NO: 289683 - DNA, 20 bp, Artificial
  CRISPR gRNA sequence
cttgagcccaggaaatcgag

SEQ ID NO: 289684 - DNA, 20 bp, Artificial
  CRISPR gRNA sequence
gagcccaggaaatcgagacc

SEQ ID NO: 289685 - DNA, 20 bp, Artificial
  CRISPR gRNA sequence
agcccaggaaatcgagacca

SEQ ID NO: 289686 - DNA, 20 bp, Artificial
  CRISPR gRNA sequence
ggcaacatagcaaaaacccc

SEQ ID NO: 289687 - DNA, 20 bp, Artificial
  CRISPR gRNA sequence
caaaaagaaaaaatagatct

SEQ ID NO: 289688 - DNA, 20 bp, Artificial
  CRISPR gRNA sequence
aatctacaacagaatattat

SEQ ID NO: 289689 - DNA, 20 bp, Artificial
  CRISPR gRNA sequence
caacagaatattatttcaga

SEQ ID NO: 289690 - DNA, 20 bp, Artificial
  CRISPR gRNA sequence
tttcagaatattatttggcc

SEQ ID NO: 289691 - DNA, 20 bp, Artificial
  CRISPR gRNA sequence
cagaatattatttggccgta

SEQ ID NO: 289692 - DNA, 20 bp, Artificial
  CRISPR gRNA sequence
agaatattatttggccgtaa

SEQ ID NO: 289693 - DNA, 20 bp, Artificial
  CRISPR gRNA sequence
tttggccgtaaaagcgaatg

SEQ ID NO: 289694 - DNA, 20 bp, Artificial
  CRISPR gRNA sequence
ggccgtaaaagcgaatggag

SEQ ID NO: 289695 - DNA, 20 bp, Artificial
  CRISPR gRNA sequence
gccgtaaaagcgaatggagt

SEQ ID NO: 289696 - DNA, 20 bp, Artificial
  CRISPR gRNA sequence
agacatacgcaacatggatg

SEQ ID NO: 289697 - DNA, 20 bp, Artificial
  CRISPR gRNA sequence
aaagacataatgctcagtga

SEQ ID NO: 289698 - DNA, 20 bp, Artificial
  CRISPR gRNA sequence
agtgaaagaaaatagtcacg

SEQ ID NO: 289699 - DNA, 20 bp, Artificial
  CRISPR gRNA sequence
taagaaatgtccagaatatt

SEQ ID NO: 289700 - DNA, 20 bp, Artificial
  CRISPR gRNA sequence
tttcttacctggattctgga

SEQ ID NO: 289701 - DNA, 20 bp, Artificial
  CRISPR gRNA sequence
tcttacctggattctggaaa

SEQ ID NO: 289702 - DNA, 20 bp, Artificial
  CRISPR gRNA sequence
cttacctggattctggaaaa

SEQ ID NO: 289703 - DNA, 20 bp, Artificial
  CRISPR gRNA sequence
ttacctggattctggaaaaa

SEQ ID NO: 289704 - DNA, 20 bp, Artificial
  CRISPR gRNA sequence
acctggattctggaaaaaaa

SEQ ID NO: 289705 - DNA, 20 bp, Artificial
  CRISPR gRNA sequence
cctggattctggaaaaaaag

SEQ ID NO: 289706 - DNA, 20 bp, Artificial
  CRISPR gRNA sequence
gattctggaaaaaaaggaag

SEQ ID NO: 289707 - DNA, 20 bp, Artificial
  CRISPR gRNA sequence
tggaaaaaaaggaagagaaa

SEQ ID NO: 289708 - DNA, 20 bp, Artificial
  CRISPR gRNA sequence
gaaaaaaaggaagagaaaag

SEQ ID NO: 289709 - DNA, 20 bp, Artificial
  CRISPR gRNA sequence
gaacaggcaaattcatagag

SEQ ID NO: 289710 - DNA, 20 bp, Artificial
  CRISPR gRNA sequence
atagagacagagagtaaatt

SEQ ID NO: 289711 - DNA, 20 bp, Artificial
  CRISPR gRNA sequence
gtggttacgaggagatgggg

SEQ ID NO: 289712 - DNA, 20 bp, Artificial
  CRISPR gRNA sequence
cgaggagatggggtacaggg

SEQ ID NO: 289713 - DNA, 20 bp, Artificial
  CRISPR gRNA sequence
caaataggcgcaggtttctt

SEQ ID NO: 289714 - DNA, 20 bp, Artificial
  CRISPR gRNA sequence
ctttctgggatgatgatttc

SEQ ID NO: 289715 - DNA, 20 bp, Artificial
  CRISPR gRNA sequence
tttctgggatgatgatttcc

SEQ ID NO: 289716 - DNA, 20 bp, Artificial
  CRISPR gRNA sequence
tctgggatgatgatttccat

SEQ ID NO: 289717 - DNA, 20 bp, Artificial
  CRISPR gRNA sequence
ctgggatgatgatttccatc

SEQ ID NO: 289718 - DNA, 20 bp, Artificial
  CRISPR gRNA sequence
tgggatgatgatttccatca

SEQ ID NO: 289719 - DNA, 20 bp, Artificial
  CRISPR gRNA sequence
ggatgatgatttccatcatc

SEQ ID NO: 289720 - DNA, 20 bp, Artificial
  CRISPR gRNA sequence
ccatcatcatccagaacatt

SEQ ID NO: 289721 - DNA, 20 bp, Artificial
  CRISPR gRNA sequence
catcatcatccagaacattt

SEQ ID NO: 289722 - DNA, 20 bp, Artificial
  CRISPR gRNA sequence
ccttctggaattcgatagtg

SEQ ID NO: 289723 - DNA, 20 bp, Artificial
  CRISPR gRNA sequence
cttctggaattcgatagtga

SEQ ID NO: 289724 - DNA, 20 bp, Artificial
  CRISPR gRNA sequence
ctggaattcgatagtgatgg

SEQ ID NO: 289725 - DNA, 20 bp, Artificial
  CRISPR gRNA sequence
tggaattcgatagtgatggt

SEQ ID NO: 289726 - DNA, 20 bp, Artificial
  CRISPR gRNA sequence
gaattcgatagtgatggtgg

SEQ ID NO: 289727 - DNA, 20 bp, Artificial
  CRISPR gRNA sequence
gatagtgatggtggtttcac

SEQ ID NO: 289728 - DNA, 20 bp, Artificial
  CRISPR gRNA sequence
cacaacattgcaaatatact

SEQ ID NO: 289729 - DNA, 20 bp, Artificial
  CRISPR gRNA sequence
acaacattgcaaatatacta

SEQ ID NO: 289730 - DNA, 20 bp, Artificial
  CRISPR gRNA sequence
caaatatactaaaacccact

SEQ ID NO: 289731 - DNA, 20 bp, Artificial
  CRISPR gRNA sequence
aaacccactgaattgtacac

SEQ ID NO: 289732 - DNA, 20 bp, Artificial
  CRISPR gRNA sequence
aattgtacactttatttatt

SEQ ID NO: 289733 - DNA, 20 bp, Artificial
  CRISPR gRNA sequence
tacactttatttatttattt

SEQ ID NO: 289734 - DNA, 20 bp, Artificial
  CRISPR gRNA sequence
tatttatttatttatttatt

SEQ ID NO: 289735 - DNA, 20 bp, Artificial
  CRISPR gRNA sequence
atttatttatttatttattt

SEQ ID NO: 289736 - DNA, 20 bp, Artificial
  CRISPR gRNA sequence
tttatttatttatttattta

SEQ ID NO: 289737 - DNA, 20 bp, Artificial
  CRISPR gRNA sequence
atttatttatttatttattt

SEQ ID NO: 289738 - DNA, 20 bp, Artificial
  CRISPR gRNA sequence
tttatttatttatttattta

SEQ ID NO: 289739 - DNA, 20 bp, Artificial
  CRISPR gRNA sequence
atttatttatttatttattt

SEQ ID NO: 289740 - DNA, 20 bp, Artificial
  CRISPR gRNA sequence
tttatttatttatttattta

SEQ ID NO: 289741 - DNA, 20 bp, Artificial
  CRISPR gRNA sequence
atttatttatttatttattt

SEQ ID NO: 289742 - DNA, 20 bp, Artificial
  CRISPR gRNA sequence
tttatttatttatttattta

SEQ ID NO: 289743 - DNA, 20 bp, Artificial
  CRISPR gRNA sequence
atttatttatttatttattt

SEQ ID NO: 289744 - DNA, 20 bp, Artificial
  CRISPR gRNA sequence
tttatttatttatttattta

SEQ ID NO: 289745 - DNA, 20 bp, Artificial
  CRISPR gRNA sequence
atttatttatttatttattt

SEQ ID NO: 289746 - DNA, 20 bp, Artificial
  CRISPR gRNA sequence
tttatttatttatttattta

SEQ ID NO: 289747 - DNA, 20 bp, Artificial
  CRISPR gRNA sequence
atttatttatttatttattt

SEQ ID NO: 289748 - DNA, 20 bp, Artificial
  CRISPR gRNA sequence
tttatttatttatttattta

SEQ ID NO: 289749 - DNA, 20 bp, Artificial
  CRISPR gRNA sequence
atttatttatttatttattt

SEQ ID NO: 289750 - DNA, 20 bp, Artificial
  CRISPR gRNA sequence
tttatttatttatttattta

SEQ ID NO: 289751 - DNA, 20 bp, Artificial
  CRISPR gRNA sequence
atttatttatttatttactg

SEQ ID NO: 289752 - DNA, 20 bp, Artificial
  CRISPR gRNA sequence
tttatttatttatttactga

SEQ ID NO: 289753 - DNA, 20 bp, Artificial
  CRISPR gRNA sequence
atttatttatttactgaggc

SEQ ID NO: 289754 - DNA, 20 bp, Artificial
  CRISPR gRNA sequence
tttatttatttactgaggca

SEQ ID NO: 289755 - DNA, 20 bp, Artificial
  CRISPR gRNA sequence
atttatttactgaggcagag

SEQ ID NO: 289756 - DNA, 20 bp, Artificial
  CRISPR gRNA sequence
tttatttactgaggcagagt

SEQ ID NO: 289757 - DNA, 20 bp, Artificial
  CRISPR gRNA sequence
atttactgaggcagagtctc

SEQ ID NO: 289758 - DNA, 20 bp, Artificial
  CRISPR gRNA sequence
tttactgaggcagagtctcg

SEQ ID NO: 289759 - DNA, 20 bp, Artificial
  CRISPR gRNA sequence
actgaggcagagtctcgctc

SEQ ID NO: 289760 - DNA, 20 bp, Artificial
  CRISPR gRNA sequence
ctgaggcagagtctcgctct

SEQ ID NO: 289761 - DNA, 20 bp, Artificial
  CRISPR gRNA sequence
aggcagagtctcgctctgtt

SEQ ID NO: 289762 - DNA, 20 bp, Artificial
  CRISPR gRNA sequence
gctctgttgcccatgctgga

SEQ ID NO: 289763 - DNA, 20 bp, Artificial
  CRISPR gRNA sequence
tgttgcccatgctggagtgc

SEQ ID NO: 289764 - DNA, 20 bp, Artificial
  CRISPR gRNA sequence
ttgcccatgctggagtgcag

SEQ ID NO: 289765 - DNA, 20 bp, Artificial
  CRISPR gRNA sequence
cccatgctggagtgcagtgg

SEQ ID NO: 289766 - DNA, 20 bp, Artificial
  CRISPR gRNA sequence
gagtgcagtggcatgatctt

SEQ ID NO: 289767 - DNA, 20 bp, Artificial
  CRISPR gRNA sequence
ggctcacagcaacccccgcc

SEQ ID NO: 289768 - DNA, 20 bp, Artificial
  CRISPR gRNA sequence
gctcacagcaacccccgcct

SEQ ID NO: 289769 - DNA, 20 bp, Artificial
  CRISPR gRNA sequence
acagcaacccccgcctccag

SEQ ID NO: 289770 - DNA, 20 bp, Artificial
  CRISPR gRNA sequence
cagggttcaaaagattctcc

SEQ ID NO: 289771 - DNA, 20 bp, Artificial
  CRISPR gRNA sequence
aaaagattctcctgcctcag

SEQ ID NO: 289772 - DNA, 20 bp, Artificial
  CRISPR gRNA sequence
tcctgcctcagcctcctgag

SEQ ID NO: 289773 - DNA, 20 bp, Artificial
  CRISPR gRNA sequence
ctgcctcagcctcctgagta

SEQ ID NO: 289774 - DNA, 20 bp, Artificial
  CRISPR gRNA sequence
cctcagcctcctgagtagct

SEQ ID NO: 289775 - DNA, 20 bp, Artificial
  CRISPR gRNA sequence
agcctcctgagtagctagga

SEQ ID NO: 289776 - DNA, 20 bp, Artificial
  CRISPR gRNA sequence
ctgagtagctaggattaaag

SEQ ID NO: 289777 - DNA, 20 bp, Artificial
  CRISPR gRNA sequence
agtagctaggattaaaggca

SEQ ID NO: 289778 - DNA, 20 bp, Artificial
  CRISPR gRNA sequence
ggattaaaggcacgggccac

SEQ ID NO: 289779 - DNA, 20 bp, Artificial
  CRISPR gRNA sequence
aaggcacgggccaccttgtg

SEQ ID NO: 289780 - DNA, 20 bp, Artificial
  CRISPR gRNA sequence
gtgtggttaatttttgcatt

SEQ ID NO: 289781 - DNA, 20 bp, Artificial
  CRISPR gRNA sequence
tgtggttaatttttgcattt

SEQ ID NO: 289782 - DNA, 20 bp, Artificial
  CRISPR gRNA sequence
atttttgcatttttagtaga

SEQ ID NO: 289783 - DNA, 20 bp, Artificial
  CRISPR gRNA sequence
ttgcatttttagtagagaca

SEQ ID NO: 289784 - DNA, 20 bp, Artificial
  CRISPR gRNA sequence
tgcatttttagtagagacag

SEQ ID NO: 289785 - DNA, 20 bp, Artificial
  CRISPR gRNA sequence
gcatttttagtagagacagg

SEQ ID NO: 289786 - DNA, 20 bp, Artificial
  CRISPR gRNA sequence
catttttagtagagacaggg

SEQ ID NO: 289787 - DNA, 20 bp, Artificial
  CRISPR gRNA sequence
ttagtagagacagggtttta

SEQ ID NO: 289788 - DNA, 20 bp, Artificial
  CRISPR gRNA sequence
tagtagagacagggttttac

SEQ ID NO: 289789 - DNA, 20 bp, Artificial
  CRISPR gRNA sequence
agtagagacagggttttacc

SEQ ID NO: 289790 - DNA, 20 bp, Artificial
  CRISPR gRNA sequence
gtagagacagggttttacca

SEQ ID NO: 289791 - DNA, 20 bp, Artificial
  CRISPR gRNA sequence
taccatgttggccaggctgg

SEQ ID NO: 289792 - DNA, 20 bp, Artificial
  CRISPR gRNA sequence
accatgttggccaggctggt

SEQ ID NO: 289793 - DNA, 20 bp, Artificial
  CRISPR gRNA sequence
ccatgttggccaggctggtc

SEQ ID NO: 289794 - DNA, 20 bp, Artificial
  CRISPR gRNA sequence
gccaggctggtctcaaactc

SEQ ID NO: 289795 - DNA, 20 bp, Artificial
  CRISPR gRNA sequence
gtctcaaactcctgacctca

SEQ ID NO: 289796 - DNA, 20 bp, Artificial
  CRISPR gRNA sequence
aaactcctgacctcaggtga

SEQ ID NO: 289797 - DNA, 20 bp, Artificial
  CRISPR gRNA sequence
ctgacctcaggtgatccacc

SEQ ID NO: 289798 - DNA, 20 bp, Artificial
  CRISPR gRNA sequence
acctcaggtgatccacccat

SEQ ID NO: 289799 - DNA, 20 bp, Artificial
  CRISPR gRNA sequence
aggtgatccacccatctcgg

SEQ ID NO: 289800 - DNA, 20 bp, Artificial
  CRISPR gRNA sequence
ggcctcccaaaatgctggga

SEQ ID NO: 289801 - DNA, 20 bp, Artificial
  CRISPR gRNA sequence
ccaaaatgctgggattgcag

SEQ ID NO: 289802 - DNA, 20 bp, Artificial
  CRISPR gRNA sequence
ggattgcaggagtgagccac

SEQ ID NO: 289803 - DNA, 20 bp, Artificial
  CRISPR gRNA sequence
caggagtgagccaccgtgcc

SEQ ID NO: 289804 - DNA, 20 bp, Artificial
  CRISPR gRNA sequence
gctgaattgtatactttaaa

SEQ ID NO: 289805 - DNA, 20 bp, Artificial
  CRISPR gRNA sequence
aattgtatactttaaaacgt

SEQ ID NO: 289806 - DNA, 20 bp, Artificial
  CRISPR gRNA sequence
tatactttaaaacgttgaat

SEQ ID NO: 289807 - DNA, 20 bp, Artificial
  CRISPR gRNA sequence
taaaacgttgaattttatgt

SEQ ID NO: 289808 - DNA, 20 bp, Artificial
  CRISPR gRNA sequence
aaaacgttgaattttatgtc

SEQ ID NO: 289809 - DNA, 20 bp, Artificial
  CRISPR gRNA sequence
aaacgttgaattttatgtca

SEQ ID NO: 289810 - DNA, 20 bp, Artificial
  CRISPR gRNA sequence
aattttatgtcattgcaaat

SEQ ID NO: 289811 - DNA, 20 bp, Artificial
  CRISPR gRNA sequence
tatgtcattgcaaataaaac

SEQ ID NO: 289812 - DNA, 20 bp, Artificial
  CRISPR gRNA sequence
atgtcattgcaaataaaaca

SEQ ID NO: 289813 - DNA, 20 bp, Artificial
  CRISPR gRNA sequence
tgtcattgcaaataaaacat

SEQ ID NO: 289814 - DNA, 20 bp, Artificial
  CRISPR gRNA sequence
caaataaaacatgaagggaa

SEQ ID NO: 289815 - DNA, 20 bp, Artificial
  CRISPR gRNA sequence
ggaagacctgagtcttcccc

SEQ ID NO: 289816 - DNA, 20 bp, Artificial
  CRISPR gRNA sequence
agtcttccccaccctctccg

SEQ ID NO: 289817 - DNA, 20 bp, Artificial
  CRISPR gRNA sequence
ccccaccctctccgtgcagc

SEQ ID NO: 289818 - DNA, 20 bp, Artificial
  CRISPR gRNA sequence
cccaccctctccgtgcagcc

SEQ ID NO: 289819 - DNA, 20 bp, Artificial
  CRISPR gRNA sequence
tccgtgcagcctggaggcct

SEQ ID NO: 289820 - DNA, 20 bp, Artificial
  CRISPR gRNA sequence
cgtgcagcctggaggcctgg

SEQ ID NO: 289821 - DNA, 20 bp, Artificial
  CRISPR gRNA sequence
gaggcctggaggatgcagtg

SEQ ID NO: 289822 - DNA, 20 bp, Artificial
  CRISPR gRNA sequence
gaggatgcagtggccagtct

SEQ ID NO: 289823 - DNA, 20 bp, Artificial
  CRISPR gRNA sequence
cagtgcccctcccagggagt

SEQ ID NO: 289824 - DNA, 20 bp, Artificial
  CRISPR gRNA sequence
ccagggagttcaacctcagc

SEQ ID NO: 289825 - DNA, 20 bp, Artificial
  CRISPR gRNA sequence
aacctcagcagccgttagag

SEQ ID NO: 289826 - DNA, 20 bp, Artificial
  CRISPR gRNA sequence
agcagccgttagagaggctg

SEQ ID NO: 289827 - DNA, 20 bp, Artificial
  CRISPR gRNA sequence
gagaggctgccctcgcaggg

SEQ ID NO: 289828 - DNA, 20 bp, Artificial
  CRISPR gRNA sequence
ccctcgcaggggtctgggag

SEQ ID NO: 289829 - DNA, 20 bp, Artificial
  CRISPR gRNA sequence
gcaggggtctgggagctgca

SEQ ID NO: 289830 - DNA, 20 bp, Artificial
  CRISPR gRNA sequence
ggagctgcatcaccactgct

SEQ ID NO: 289831 - DNA, 20 bp, Artificial
  CRISPR gRNA sequence
catcaccactgctagtggag

SEQ ID NO: 289832 - DNA, 20 bp, Artificial
  CRISPR gRNA sequence
ctagtggagaagggagagaa

SEQ ID NO: 289833 - DNA, 20 bp, Artificial
  CRISPR gRNA sequence
gtggagaagggagagaagca

SEQ ID NO: 289834 - DNA, 20 bp, Artificial
  CRISPR gRNA sequence
acacaacatcttttaactca

SEQ ID NO: 289835 - DNA, 20 bp, Artificial
  CRISPR gRNA sequence
ttaactcaccaaatgacggg

SEQ ID NO: 289836 - DNA, 20 bp, Artificial
  CRISPR gRNA sequence
taactcaccaaatgacggga

SEQ ID NO: 289837 - DNA, 20 bp, Artificial
  CRISPR gRNA sequence
aactcaccaaatgacgggac

SEQ ID NO: 289838 - DNA, 20 bp, Artificial
  CRISPR gRNA sequence
actcaccaaatgacgggaca

SEQ ID NO: 289839 - DNA, 20 bp, Artificial
  CRISPR gRNA sequence
accaaatgacgggacataca

SEQ ID NO: 289840 - DNA, 20 bp, Artificial
  CRISPR gRNA sequence
cctggaaacacaagtgtgct

SEQ ID NO: 289841 - DNA, 20 bp, Artificial
  CRISPR gRNA sequence
gaaacacaagtgtgcttttt

SEQ ID NO: 289842 - DNA, 20 bp, Artificial
  CRISPR gRNA sequence
tttaaataaacattttccct

SEQ ID NO: 289843 - DNA, 20 bp, Artificial
  CRISPR gRNA sequence
ttaaataaacattttccctg

SEQ ID NO: 289844 - DNA, 20 bp, Artificial
  CRISPR gRNA sequence
taaataaacattttccctga

SEQ ID NO: 289845 - DNA, 20 bp, Artificial
  CRISPR gRNA sequence
aaataaacattttccctgac

SEQ ID NO: 289846 - DNA, 20 bp, Artificial
  CRISPR gRNA sequence
aataaacattttccctgact

SEQ ID NO: 289847 - DNA, 20 bp, Artificial
  CRISPR gRNA sequence
tccctgactatgaaataaac

SEQ ID NO: 289848 - DNA, 20 bp, Artificial
  CRISPR gRNA sequence
ccctgactatgaaataaaca

SEQ ID NO: 289849 - DNA, 20 bp, Artificial
  CRISPR gRNA sequence
cctgactatgaaataaacat

SEQ ID NO: 289850 - DNA, 20 bp, Artificial
  CRISPR gRNA sequence
actatgaaataaacattctt

SEQ ID NO: 289851 - DNA, 20 bp, Artificial
  CRISPR gRNA sequence
tgaaataaacattcttagaa

SEQ ID NO: 289852 - DNA, 20 bp, Artificial
  CRISPR gRNA sequence
ttagaaagaatggaagatat

SEQ ID NO: 289853 - DNA, 20 bp, Artificial
  CRISPR gRNA sequence
agaaagaatggaagatatag

SEQ ID NO: 289854 - DNA, 20 bp, Artificial
  CRISPR gRNA sequence
gaaagaatggaagatataga

SEQ ID NO: 289855 - DNA, 20 bp, Artificial
  CRISPR gRNA sequence
ttgtctcaccacctggagat

SEQ ID NO: 289856 - DNA, 20 bp, Artificial
  CRISPR gRNA sequence
tctcaccacctggagatttt

SEQ ID NO: 289857 - DNA, 20 bp, Artificial
  CRISPR gRNA sequence
accacctggagattttaccg

SEQ ID NO: 289858 - DNA, 20 bp, Artificial
  CRISPR gRNA sequence
gagattttaccgttcctggt

SEQ ID NO: 289859 - DNA, 20 bp, Artificial
  CRISPR gRNA sequence
taccgttcctggtttgtgca

SEQ ID NO: 289860 - DNA, 20 bp, Artificial
  CRISPR gRNA sequence
accgttcctggtttgtgcac

SEQ ID NO: 289861 - DNA, 20 bp, Artificial
  CRISPR gRNA sequence
ccgttcctggtttgtgcaca

SEQ ID NO: 289862 - DNA, 20 bp, Artificial
  CRISPR gRNA sequence
ctggtttgtgcacactcttc

SEQ ID NO: 289863 - DNA, 20 bp, Artificial
  CRISPR gRNA sequence
gtttgtgcacactcttccaa

SEQ ID NO: 289864 - DNA, 20 bp, Artificial
  CRISPR gRNA sequence
gtgcacactcttccaacagg

SEQ ID NO: 289865 - DNA, 20 bp, Artificial
  CRISPR gRNA sequence
tgcacactcttccaacagga

SEQ ID NO: 289866 - DNA, 20 bp, Artificial
  CRISPR gRNA sequence
ttccaacaggagtgaccccc

SEQ ID NO: 289867 - DNA, 20 bp, Artificial
  CRISPR gRNA sequence
ccaacaggagtgacccccct

SEQ ID NO: 289868 - DNA, 20 bp, Artificial
  CRISPR gRNA sequence
caacaggagtgacccccctc

SEQ ID NO: 289869 - DNA, 20 bp, Artificial
  CRISPR gRNA sequence
taaatgtttgattaggtgaa

SEQ ID NO: 289870 - DNA, 20 bp, Artificial
  CRISPR gRNA sequence
aatgtttgattaggtgaact

SEQ ID NO: 289871 - DNA, 20 bp, Artificial
  CRISPR gRNA sequence
gattaggtgaactagcaccg

SEQ ID NO: 289872 - DNA, 20 bp, Artificial
  CRISPR gRNA sequence
attaggtgaactagcaccga

SEQ ID NO: 289873 - DNA, 20 bp, Artificial
  CRISPR gRNA sequence
ggtgaactagcaccgacagg

SEQ ID NO: 289874 - DNA, 20 bp, Artificial
  CRISPR gRNA sequence
gcaccgacagggctggtgtc

SEQ ID NO: 289875 - DNA, 20 bp, Artificial
  CRISPR gRNA sequence
gtgtcagccctgggctaggt

SEQ ID NO: 289876 - DNA, 20 bp, Artificial
  CRISPR gRNA sequence
ggctaggtgctagccacaca

SEQ ID NO: 289877 - DNA, 20 bp, Artificial
  CRISPR gRNA sequence
ggtgctagccacacaaagga

SEQ ID NO: 289878 - DNA, 20 bp, Artificial
  CRISPR gRNA sequence
gccacacaaaggagacaggc

SEQ ID NO: 289879 - DNA, 20 bp, Artificial
  CRISPR gRNA sequence
cctctggcagccacaggctt

SEQ ID NO: 289880 - DNA, 20 bp, Artificial
  CRISPR gRNA sequence
tggcagccacaggcttgaga

SEQ ID NO: 289881 - DNA, 20 bp, Artificial
  CRISPR gRNA sequence
gcagccacaggcttgagacc

SEQ ID NO: 289882 - DNA, 20 bp, Artificial
  CRISPR gRNA sequence
gagacctgtgtctcctcgtg

SEQ ID NO: 289883 - DNA, 20 bp, Artificial
  CRISPR gRNA sequence
agacctgtgtctcctcgtgt

SEQ ID NO: 289884 - DNA, 20 bp, Artificial
  CRISPR gRNA sequence
tgtctcctcgtgttcacact

SEQ ID NO: 289885 - DNA, 20 bp, Artificial
  CRISPR gRNA sequence
ctcgtgttcacactgttcct

SEQ ID NO: 289886 - DNA, 20 bp, Artificial
  CRISPR gRNA sequence
gtgttcacactgttcctgac

SEQ ID NO: 289887 - DNA, 20 bp, Artificial
  CRISPR gRNA sequence
acactgttcctgacttttcc

SEQ ID NO: 289888 - DNA, 20 bp, Artificial
  CRISPR gRNA sequence
ttcctgacttttccccctgt

SEQ ID NO: 289889 - DNA, 20 bp, Artificial
  CRISPR gRNA sequence
ctgacttttccccctgttta

SEQ ID NO: 289890 - DNA, 20 bp, Artificial
  CRISPR gRNA sequence
acttttccccctgtttagac

SEQ ID NO: 289891 - DNA, 20 bp, Artificial
  CRISPR gRNA sequence
ttccccctgtttagaccctg

SEQ ID NO: 289892 - DNA, 20 bp, Artificial
  CRISPR gRNA sequence
tccccctgtttagaccctgc

SEQ ID NO: 289893 - DNA, 20 bp, Artificial
  CRISPR gRNA sequence
ccccctgtttagaccctgct

SEQ ID NO: 289894 - DNA, 20 bp, Artificial
  CRISPR gRNA sequence
cccctgtttagaccctgctc

SEQ ID NO: 289895 - DNA, 20 bp, Artificial
  CRISPR gRNA sequence
tttagaccctgctcatatac

SEQ ID NO: 289896 - DNA, 20 bp, Artificial
  CRISPR gRNA sequence
agaccctgctcatatactct

SEQ ID NO: 289897 - DNA, 20 bp, Artificial
  CRISPR gRNA sequence
gaccctgctcatatactctg

SEQ ID NO: 289898 - DNA, 20 bp, Artificial
  CRISPR gRNA sequence
ctcatatactctgtaccatc

SEQ ID NO: 289899 - DNA, 20 bp, Artificial
  CRISPR gRNA sequence
atatactctgtaccatctga

SEQ ID NO: 289900 - DNA, 20 bp, Artificial
  CRISPR gRNA sequence
tgtaccatctgatccttact

SEQ ID NO: 289901 - DNA, 20 bp, Artificial
  CRISPR gRNA sequence
taccatctgatccttacttt

SEQ ID NO: 289902 - DNA, 20 bp, Artificial
  CRISPR gRNA sequence
atccttactttttctctttc

SEQ ID NO: 289903 - DNA, 20 bp, Artificial
  CRISPR gRNA sequence
actttttctctttctaaaca

SEQ ID NO: 289904 - DNA, 20 bp, Artificial
  CRISPR gRNA sequence
ctttttctctttctaaacag

SEQ ID NO: 289905 - DNA, 20 bp, Artificial
  CRISPR gRNA sequence
tttctctttctaaacagtat

SEQ ID NO: 289906 - DNA, 20 bp, Artificial
  CRISPR gRNA sequence
ttctctttctaaacagtatt

SEQ ID NO: 289907 - DNA, 20 bp, Artificial
  CRISPR gRNA sequence
tctctttctaaacagtattt

SEQ ID NO: 289908 - DNA, 20 bp, Artificial
  CRISPR gRNA sequence
ctctttctaaacagtattta

SEQ ID NO: 289909 - DNA, 20 bp, Artificial
  CRISPR gRNA sequence
tctttctaaacagtatttat

SEQ ID NO: 289910 - DNA, 20 bp, Artificial
  CRISPR gRNA sequence
tttctaaacagtatttatat

SEQ ID NO: 289911 - DNA, 20 bp, Artificial
  CRISPR gRNA sequence
tctaaacagtatttatatcc

SEQ ID NO: 289912 - DNA, 20 bp, Artificial
  CRISPR gRNA sequence
ctaaacagtatttatatcct

SEQ ID NO: 289913 - DNA, 20 bp, Artificial
  CRISPR gRNA sequence
taaacagtatttatatcctt

SEQ ID NO: 289914 - DNA, 20 bp, Artificial
  CRISPR gRNA sequence
aacagtatttatatccttaa

SEQ ID NO: 289915 - DNA, 20 bp, Artificial
  CRISPR gRNA sequence
atatccttaaaatgcacagg

SEQ ID NO: 289916 - DNA, 20 bp, Artificial
  CRISPR gRNA sequence
tatccttaaaatgcacaggg

SEQ ID NO: 289917 - DNA, 20 bp, Artificial
  CRISPR gRNA sequence
aaaatgcacagggacttgaa

SEQ ID NO: 289918 - DNA, 20 bp, Artificial
  CRISPR gRNA sequence
aaatgcacagggacttgaac

SEQ ID NO: 289919 - DNA, 20 bp, Artificial
  CRISPR gRNA sequence
gaacagctgttgtcagggtg

SEQ ID NO: 289920 - DNA, 20 bp, Artificial
  CRISPR gRNA sequence
aacagctgttgtcagggtga

SEQ ID NO: 289921 - DNA, 20 bp, Artificial
  CRISPR gRNA sequence
ttgtcagggtgatgatggca

SEQ ID NO: 289922 - DNA, 20 bp, Artificial
  CRISPR gRNA sequence
tcagggtgatgatggcaaca

SEQ ID NO: 289923 - DNA, 20 bp, Artificial
  CRISPR gRNA sequence
ctcatgggacccctgggcca

SEQ ID NO: 289924 - DNA, 20 bp, Artificial
  CRISPR gRNA sequence
atgggacccctgggccagca

SEQ ID NO: 289925 - DNA, 20 bp, Artificial
  CRISPR gRNA sequence
ggccagcagcatagcggtgt

SEQ ID NO: 289926 - DNA, 20 bp, Artificial
  CRISPR gRNA sequence
cagggagaggaggatgtgtt

SEQ ID NO: 289927 - DNA, 20 bp, Artificial
  CRISPR gRNA sequence
tgtgaatggtggcactttgg

SEQ ID NO: 289928 - DNA, 20 bp, Artificial
  CRISPR gRNA sequence
tgaatggtggcactttgggg

SEQ ID NO: 289929 - DNA, 20 bp, Artificial
  CRISPR gRNA sequence
tggggtattctcttttctcc

SEQ ID NO: 289930 - DNA, 20 bp, Artificial
  CRISPR gRNA sequence
ggggtattctcttttctcct

SEQ ID NO: 289931 - DNA, 20 bp, Artificial
  CRISPR gRNA sequence
gggtattctcttttctccta

SEQ ID NO: 289932 - DNA, 20 bp, Artificial
  CRISPR gRNA sequence
tcttttctcctagctctgag

SEQ ID NO: 289933 - DNA, 20 bp, Artificial
  CRISPR gRNA sequence
ttttctcctagctctgagtt

SEQ ID NO: 289934 - DNA, 20 bp, Artificial
  CRISPR gRNA sequence
ttctcctagctctgagttct

SEQ ID NO: 289935 - DNA, 20 bp, Artificial
  CRISPR gRNA sequence
tctcctagctctgagttctc

SEQ ID NO: 289936 - DNA, 20 bp, Artificial
  CRISPR gRNA sequence
ctcctagctctgagttctca

SEQ ID NO: 289937 - DNA, 20 bp, Artificial
  CRISPR gRNA sequence
tcctagctctgagttctcag

SEQ ID NO: 289938 - DNA, 20 bp, Artificial
  CRISPR gRNA sequence
ctagctctgagttctcagac

SEQ ID NO: 289939 - DNA, 20 bp, Artificial
  CRISPR gRNA sequence
gctctgagttctcagactat

SEQ ID NO: 289940 - DNA, 20 bp, Artificial
  CRISPR gRNA sequence
tgagttctcagactataaac

SEQ ID NO: 289941 - DNA, 20 bp, Artificial
  CRISPR gRNA sequence
agttctcagactataaactt

SEQ ID NO: 289942 - DNA, 20 bp, Artificial
  CRISPR gRNA sequence
tcagactataaacttatagg

SEQ ID NO: 289943 - DNA, 20 bp, Artificial
  CRISPR gRNA sequence
agactataaacttataggca

SEQ ID NO: 289944 - DNA, 20 bp, Artificial
  CRISPR gRNA sequence
taaacttataggcaatgctt

SEQ ID NO: 289945 - DNA, 20 bp, Artificial
  CRISPR gRNA sequence
ataggcaatgcttttcctac

SEQ ID NO: 289946 - DNA, 20 bp, Artificial
  CRISPR gRNA sequence
taggcaatgcttttcctaca

SEQ ID NO: 289947 - DNA, 20 bp, Artificial
  CRISPR gRNA sequence
ttcctacatctcttgcctcc

SEQ ID NO: 289948 - DNA, 20 bp, Artificial
  CRISPR gRNA sequence
tcctacatctcttgcctcct

SEQ ID NO: 289949 - DNA, 20 bp, Artificial
  CRISPR gRNA sequence
cctacatctcttgcctcctc

SEQ ID NO: 289950 - DNA, 20 bp, Artificial
  CRISPR gRNA sequence
ctacatctcttgcctcctcc

SEQ ID NO: 289951 - DNA, 20 bp, Artificial
  CRISPR gRNA sequence
catctcttgcctcctcctac

SEQ ID NO: 289952 - DNA, 20 bp, Artificial
  CRISPR gRNA sequence
ttgcctcctcctacaggagg

SEQ ID NO: 289953 - DNA, 20 bp, Artificial
  CRISPR gRNA sequence
gcctcctcctacaggaggcc

SEQ ID NO: 289954 - DNA, 20 bp, Artificial
  CRISPR gRNA sequence
cctcctcctacaggaggcct

SEQ ID NO: 289955 - DNA, 20 bp, Artificial
  CRISPR gRNA sequence
ctcctacaggaggcctttcc

SEQ ID NO: 289956 - DNA, 20 bp, Artificial
  CRISPR gRNA sequence
ctacaggaggcctttcccct

SEQ ID NO: 289957 - DNA, 20 bp, Artificial
  CRISPR gRNA sequence
caggaggcctttcccctctc

SEQ ID NO: 289958 - DNA, 20 bp, Artificial
  CRISPR gRNA sequence
tcccctctccttagacctga

SEQ ID NO: 289959 - DNA, 20 bp, Artificial
  CRISPR gRNA sequence
cccctctccttagacctgac

SEQ ID NO: 289960 - DNA, 20 bp, Artificial
  CRISPR gRNA sequence
ccctctccttagacctgacc

SEQ ID NO: 289961 - DNA, 20 bp, Artificial
  CRISPR gRNA sequence
tccttagacctgaccctctc

SEQ ID NO: 289962 - DNA, 20 bp, Artificial
  CRISPR gRNA sequence
cttagacctgaccctctctt

SEQ ID NO: 289963 - DNA, 20 bp, Artificial
  CRISPR gRNA sequence
agacctgaccctctcttaaa

SEQ ID NO: 289964 - DNA, 20 bp, Artificial
  CRISPR gRNA sequence
gacctgaccctctcttaaag

SEQ ID NO: 289965 - DNA, 20 bp, Artificial
  CRISPR gRNA sequence
accctctcttaaaggactcc

SEQ ID NO: 289966 - DNA, 20 bp, Artificial
  CRISPR gRNA sequence
tcttaaaggactccagctct

SEQ ID NO: 289967 - DNA, 20 bp, Artificial
  CRISPR gRNA sequence
ttaaaggactccagctctga

SEQ ID NO: 289968 - DNA, 20 bp, Artificial
  CRISPR gRNA sequence
aaaggactccagctctgaag

SEQ ID NO: 289969 - DNA, 20 bp, Artificial
  CRISPR gRNA sequence
aaggactccagctctgaagg

SEQ ID NO: 289970 - DNA, 20 bp, Artificial
  CRISPR gRNA sequence
cagctctgaaggaaaagctg

SEQ ID NO: 289971 - DNA, 20 bp, Artificial
  CRISPR gRNA sequence
tgaaggaaaagctgcccaca

SEQ ID NO: 289972 - DNA, 20 bp, Artificial
  CRISPR gRNA sequence
aaggaaaagctgcccacatt

SEQ ID NO: 289973 - DNA, 20 bp, Artificial
  CRISPR gRNA sequence
cccacattggtccctctgag

SEQ ID NO: 289974 - DNA, 20 bp, Artificial
  CRISPR gRNA sequence
gtccctctgagggctgccct

SEQ ID NO: 289975 - DNA, 20 bp, Artificial
  CRISPR gRNA sequence
tgagggctgccctgttagag

SEQ ID NO: 289976 - DNA, 20 bp, Artificial
  CRISPR gRNA sequence
agggctgccctgttagagcc

SEQ ID NO: 289977 - DNA, 20 bp, Artificial
  CRISPR gRNA sequence
ccctgttagagcctctgcct

SEQ ID NO: 289978 - DNA, 20 bp, Artificial
  CRISPR gRNA sequence
ttagagcctctgccttactg

SEQ ID NO: 289979 - DNA, 20 bp, Artificial
  CRISPR gRNA sequence
gagcctctgccttactgcca

SEQ ID NO: 289980 - DNA, 20 bp, Artificial
  CRISPR gRNA sequence
tgccttactgccaccagttg

SEQ ID NO: 289981 - DNA, 20 bp, Artificial
  CRISPR gRNA sequence
ccttactgccaccagttgct

SEQ ID NO: 289982 - DNA, 20 bp, Artificial
  CRISPR gRNA sequence
actgccaccagttgctggac

SEQ ID NO: 289983 - DNA, 20 bp, Artificial
  CRISPR gRNA sequence
ctgccaccagttgctggact

SEQ ID NO: 289984 - DNA, 20 bp, Artificial
  CRISPR gRNA sequence
ccaccagttgctggactata

SEQ ID NO: 289985 - DNA, 20 bp, Artificial
  CRISPR gRNA sequence
ctggactataaagtcaggcg

SEQ ID NO: 289986 - DNA, 20 bp, Artificial
  CRISPR gRNA sequence
gactataaagtcaggcgttt

SEQ ID NO: 289987 - DNA, 20 bp, Artificial
  CRISPR gRNA sequence
taaagtcaggcgtttctgcc

SEQ ID NO: 289988 - DNA, 20 bp, Artificial
  CRISPR gRNA sequence
ctgcctccatagacagtgcc

SEQ ID NO: 289989 - DNA, 20 bp, Artificial
  CRISPR gRNA sequence
tgcctccatagacagtgcct

SEQ ID NO: 289990 - DNA, 20 bp, Artificial
  CRISPR gRNA sequence
cctccatagacagtgcctgc

SEQ ID NO: 289991 - DNA, 20 bp, Artificial
  CRISPR gRNA sequence
catagacagtgcctgcaggc

SEQ ID NO: 289992 - DNA, 20 bp, Artificial
  CRISPR gRNA sequence
caggcctagagggggagagg

SEQ ID NO: 289993 - DNA, 20 bp, Artificial
  CRISPR gRNA sequence
gagggggagaggagcctggc

SEQ ID NO: 289994 - DNA, 20 bp, Artificial
  CRISPR gRNA sequence
gctggttccaccctgtgcat

SEQ ID NO: 289995 - DNA, 20 bp, Artificial
  CRISPR gRNA sequence
gttccaccctgtgcatgaaa

SEQ ID NO: 289996 - DNA, 20 bp, Artificial
  CRISPR gRNA sequence
caccctgtgcatgaaagagg

SEQ ID NO: 289997 - DNA, 20 bp, Artificial
  CRISPR gRNA sequence
tgcatgaaagaggagtccct

SEQ ID NO: 289998 - DNA, 20 bp, Artificial
  CRISPR gRNA sequence
cccctgggcatcagtggctg

SEQ ID NO: 289999 - DNA, 20 bp, Artificial
  CRISPR gRNA sequence
ccctgggcatcagtggctgg

SEQ ID NO: 290000 - DNA, 20 bp, Artificial
  CRISPR gRNA sequence
ggcatcagtggctgggcagg

SEQ ID NO: 290001 - DNA, 20 bp, Artificial
  CRISPR gRNA sequence
ggcaggaggagagggggaac

SEQ ID NO: 290002 - DNA, 20 bp, Artificial
  CRISPR gRNA sequence
tgccatggtgtggcaggaga

SEQ ID NO: 290003 - DNA, 20 bp, Artificial
  CRISPR gRNA sequence
ccatggtgtggcaggagagg

SEQ ID NO: 290004 - DNA, 20 bp, Artificial
  CRISPR gRNA sequence
gtgtggcaaatctctgccct

SEQ ID NO: 290005 - DNA, 20 bp, Artificial
  CRISPR gRNA sequence
tgccctgaataaagccctct

SEQ ID NO: 290006 - DNA, 20 bp, Artificial
  CRISPR gRNA sequence
ccctgaataaagccctctat

SEQ ID NO: 290007 - DNA, 20 bp, Artificial
  CRISPR gRNA sequence
aataaagccctctataatcc

SEQ ID NO: 290008 - DNA, 20 bp, Artificial
  CRISPR gRNA sequence
tataatcctactccactgta

SEQ ID NO: 290009 - DNA, 20 bp, Artificial
  CRISPR gRNA sequence
taatcctactccactgtatt

SEQ ID NO: 290010 - DNA, 20 bp, Artificial
  CRISPR gRNA sequence
ctccactgtattcactgaat

SEQ ID NO: 290011 - DNA, 20 bp, Artificial
  CRISPR gRNA sequence
cactgtattcactgaatctc

SEQ ID NO: 290012 - DNA, 20 bp, Artificial
  CRISPR gRNA sequence
tattcactgaatctcacctc

SEQ ID NO: 290013 - DNA, 20 bp, Artificial
  CRISPR gRNA sequence
actgaatctcacctcccaca

SEQ ID NO: 290014 - DNA, 20 bp, Artificial
  CRISPR gRNA sequence
aatctcacctcccacagacc

SEQ ID NO: 290015 - DNA, 20 bp, Artificial
  CRISPR gRNA sequence
acctcccacagaccatgcac

SEQ ID NO: 290016 - DNA, 20 bp, Artificial
  CRISPR gRNA sequence
ccacagaccatgcacactca

SEQ ID NO: 290017 - DNA, 20 bp, Artificial
  CRISPR gRNA sequence
acacctacactcccgttgag

SEQ ID NO: 290018 - DNA, 20 bp, Artificial
  CRISPR gRNA sequence
cactcccgttgagcagtcct

SEQ ID NO: 290019 - DNA, 20 bp, Artificial
  CRISPR gRNA sequence
ccgttgagcagtcctcacta

SEQ ID NO: 290020 - DNA, 20 bp, Artificial
  CRISPR gRNA sequence
agcagtcctcactaatttta

SEQ ID NO: 290021 - DNA, 20 bp, Artificial
  CRISPR gRNA sequence
actaattttacatggtacac

SEQ ID NO: 290022 - DNA, 20 bp, Artificial
  CRISPR gRNA sequence
attttacatggtacacactc

SEQ ID NO: 290023 - DNA, 20 bp, Artificial
  CRISPR gRNA sequence
tacatggtacacactctcca

SEQ ID NO: 290024 - DNA, 20 bp, Artificial
  CRISPR gRNA sequence
acatggtacacactctccaa

SEQ ID NO: 290025 - DNA, 20 bp, Artificial
  CRISPR gRNA sequence
catggtacacactctccaac

SEQ ID NO: 290026 - DNA, 20 bp, Artificial
  CRISPR gRNA sequence
tccaacccatcaacttcctt

SEQ ID NO: 290027 - DNA, 20 bp, Artificial
  CRISPR gRNA sequence
caacccatcaacttccttct

SEQ ID NO: 290028 - DNA, 20 bp, Artificial
  CRISPR gRNA sequence
ccttctgatccaattctttt

SEQ ID NO: 290029 - DNA, 20 bp, Artificial
  CRISPR gRNA sequence
cttctgatccaattcttttc

SEQ ID NO: 290030 - DNA, 20 bp, Artificial
  CRISPR gRNA sequence
ctgatccaattcttttcatt

SEQ ID NO: 290031 - DNA, 20 bp, Artificial
  CRISPR gRNA sequence
tgatccaattcttttcatta

SEQ ID NO: 290032 - DNA, 20 bp, Artificial
  CRISPR gRNA sequence
atccaattcttttcattaaa

SEQ ID NO: 290033 - DNA, 20 bp, Artificial
  CRISPR gRNA sequence
ttttcattaaagacatcatc

SEQ ID NO: 290034 - DNA, 20 bp, Artificial
  CRISPR gRNA sequence
ttcattaaagacatcatcag

SEQ ID NO: 290035 - DNA, 20 bp, Artificial
  CRISPR gRNA sequence
tcattaaagacatcatcagt

SEQ ID NO: 290036 - DNA, 20 bp, Artificial
  CRISPR gRNA sequence
cattaaagacatcatcagtt

SEQ ID NO: 290037 - DNA, 20 bp, Artificial
  CRISPR gRNA sequence
attaaagacatcatcagtta

SEQ ID NO: 290038 - DNA, 20 bp, Artificial
  CRISPR gRNA sequence
aagacatcatcagttactgt

SEQ ID NO: 290039 - DNA, 20 bp, Artificial
  CRISPR gRNA sequence
ctgtaagttactgaaataac

SEQ ID NO: 290040 - DNA, 20 bp, Artificial
  CRISPR gRNA sequence
taagttactgaaataacctc

SEQ ID NO: 290041 - DNA, 20 bp, Artificial
  CRISPR gRNA sequence
ctgaaataacctcctaatag

SEQ ID NO: 290042 - DNA, 20 bp, Artificial
  CRISPR gRNA sequence
aaataacctcctaataggtt

SEQ ID NO: 290043 - DNA, 20 bp, Artificial
  CRISPR gRNA sequence
ctaataggttttgcacagtc

SEQ ID NO: 290044 - DNA, 20 bp, Artificial
  CRISPR gRNA sequence
ataggttttgcacagtcact

SEQ ID NO: 290045 - DNA, 20 bp, Artificial
  CRISPR gRNA sequence
tgcacagtcactgtggctgc

SEQ ID NO: 290046 - DNA, 20 bp, Artificial
  CRISPR gRNA sequence
gcacagtcactgtggctgcc

SEQ ID NO: 290047 - DNA, 20 bp, Artificial
  CRISPR gRNA sequence
cacagtcactgtggctgccc

SEQ ID NO: 290048 - DNA, 20 bp, Artificial
  CRISPR gRNA sequence
tggctgccctacaagccact

SEQ ID NO: 290049 - DNA, 20 bp, Artificial
  CRISPR gRNA sequence
ccctacaagccactctgttc

SEQ ID NO: 290050 - DNA, 20 bp, Artificial
  CRISPR gRNA sequence
caagccactctgttcttcag

SEQ ID NO: 290051 - DNA, 20 bp, Artificial
  CRISPR gRNA sequence
tgttcttcagtaacactttt

SEQ ID NO: 290052 - DNA, 20 bp, Artificial
  CRISPR gRNA sequence
ttcttcagtaacactttttt

SEQ ID NO: 290053 - DNA, 20 bp, Artificial
  CRISPR gRNA sequence
ttcagtaacacttttttcct

SEQ ID NO: 290054 - DNA, 20 bp, Artificial
  CRISPR gRNA sequence
cagtaacacttttttccttt

SEQ ID NO: 290055 - DNA, 20 bp, Artificial
  CRISPR gRNA sequence
agtaacacttttttcctttt

SEQ ID NO: 290056 - DNA, 20 bp, Artificial
  CRISPR gRNA sequence
ttttccttttaaagttattt

SEQ ID NO: 290057 - DNA, 20 bp, Artificial
  CRISPR gRNA sequence
tttccttttaaagttattta

SEQ ID NO: 290058 - DNA, 20 bp, Artificial
  CRISPR gRNA sequence
ttccttttaaagttatttac

SEQ ID NO: 290059 - DNA, 20 bp, Artificial
  CRISPR gRNA sequence
tccttttaaagttatttaca

SEQ ID NO: 290060 - DNA, 20 bp, Artificial
  CRISPR gRNA sequence
ccttttaaagttatttacac

SEQ ID NO: 290061 - DNA, 20 bp, Artificial
  CRISPR gRNA sequence
cttttaaagttatttacacc

SEQ ID NO: 290062 - DNA, 20 bp, Artificial
  CRISPR gRNA sequence
ttaaagttatttacaccttt

SEQ ID NO: 290063 - DNA, 20 bp, Artificial
  CRISPR gRNA sequence
taaagttatttacaccttta

SEQ ID NO: 290064 - DNA, 20 bp, Artificial
  CRISPR gRNA sequence
aaagttatttacacctttac

SEQ ID NO: 290065 - DNA, 20 bp, Artificial
  CRISPR gRNA sequence
aagttatttacacctttact

SEQ ID NO: 290066 - DNA, 20 bp, Artificial
  CRISPR gRNA sequence
tttacacctttactactgaa

SEQ ID NO: 290067 - DNA, 20 bp, Artificial
  CRISPR gRNA sequence
acacctttactactgaaact

SEQ ID NO: 290068 - DNA, 20 bp, Artificial
  CRISPR gRNA sequence
cacctttactactgaaactc

SEQ ID NO: 290069 - DNA, 20 bp, Artificial
  CRISPR gRNA sequence
tactactgaaactcaaagtg

SEQ ID NO: 290070 - DNA, 20 bp, Artificial
  CRISPR gRNA sequence
actactgaaactcaaagtgt

SEQ ID NO: 290071 - DNA, 20 bp, Artificial
  CRISPR gRNA sequence
ctactgaaactcaaagtgta

SEQ ID NO: 290072 - DNA, 20 bp, Artificial
  CRISPR gRNA sequence
ctgaaactcaaagtgtatgg

SEQ ID NO: 290073 - DNA, 20 bp, Artificial
  CRISPR gRNA sequence
aaactcaaagtgtatggtgg

SEQ ID NO: 290074 - DNA, 20 bp, Artificial
  CRISPR gRNA sequence
aaagtgtatggtggagcagc

SEQ ID NO: 290075 - DNA, 20 bp, Artificial
  CRISPR gRNA sequence
ggtgcttcttagaaatgcag

SEQ ID NO: 290076 - DNA, 20 bp, Artificial
  CRISPR gRNA sequence
cttagaaatgcagaatctca

SEQ ID NO: 290077 - DNA, 20 bp, Artificial
  CRISPR gRNA sequence
ttagaaatgcagaatctcag

SEQ ID NO: 290078 - DNA, 20 bp, Artificial
  CRISPR gRNA sequence
agaaatgcagaatctcaggc

SEQ ID NO: 290079 - DNA, 20 bp, Artificial
  CRISPR gRNA sequence
gaaatgcagaatctcaggcc

SEQ ID NO: 290080 - DNA, 20 bp, Artificial
  CRISPR gRNA sequence
aggccccatcccagacccac

SEQ ID NO: 290081 - DNA, 20 bp, Artificial
  CRISPR gRNA sequence
agcagaaacagcatttaaaa

SEQ ID NO: 290082 - DNA, 20 bp, Artificial
  CRISPR gRNA sequence
aaaaaactatatagacttta

SEQ ID NO: 290083 - DNA, 20 bp, Artificial
  CRISPR gRNA sequence
aaaaactatatagactttat

SEQ ID NO: 290084 - DNA, 20 bp, Artificial
  CRISPR gRNA sequence
tatagactttattttttaga

SEQ ID NO: 290085 - DNA, 20 bp, Artificial
  CRISPR gRNA sequence
tattttttagagctgcttta

SEQ ID NO: 290086 - DNA, 20 bp, Artificial
  CRISPR gRNA sequence
attttttagagctgctttag

SEQ ID NO: 290087 - DNA, 20 bp, Artificial
  CRISPR gRNA sequence
ttttttagagctgctttagg

SEQ ID NO: 290088 - DNA, 20 bp, Artificial
  CRISPR gRNA sequence
tttagagctgctttaggttc

SEQ ID NO: 290089 - DNA, 20 bp, Artificial
  CRISPR gRNA sequence
ttagagctgctttaggttca

SEQ ID NO: 290090 - DNA, 20 bp, Artificial
  CRISPR gRNA sequence
tagagctgctttaggttcat

SEQ ID NO: 290091 - DNA, 20 bp, Artificial
  CRISPR gRNA sequence
agagctgctttaggttcatc

SEQ ID NO: 290092 - DNA, 20 bp, Artificial
  CRISPR gRNA sequence
gagctgctttaggttcatcg

SEQ ID NO: 290093 - DNA, 20 bp, Artificial
  CRISPR gRNA sequence
ctttaggttcatcgaaaaat

SEQ ID NO: 290094 - DNA, 20 bp, Artificial
  CRISPR gRNA sequence
taggttcatcgaaaaattga

SEQ ID NO: 290095 - DNA, 20 bp, Artificial
  CRISPR gRNA sequence
aggttcatcgaaaaattgaa

SEQ ID NO: 290096 - DNA, 20 bp, Artificial
  CRISPR gRNA sequence
ggttcatcgaaaaattgaat

SEQ ID NO: 290097 - DNA, 20 bp, Artificial
  CRISPR gRNA sequence
atcgaaaaattgaatgtaaa

SEQ ID NO: 290098 - DNA, 20 bp, Artificial
  CRISPR gRNA sequence
aatgtaaagtaaccccctcc

SEQ ID NO: 290099 - DNA, 20 bp, Artificial
  CRISPR gRNA sequence
cccacatattcacagcttcc

SEQ ID NO: 290100 - DNA, 20 bp, Artificial
  CRISPR gRNA sequence
acagcttccgccactgtcta

SEQ ID NO: 290101 - DNA, 20 bp, Artificial
  CRISPR gRNA sequence
ccgccactgtctacatcctg

SEQ ID NO: 290102 - DNA, 20 bp, Artificial
  CRISPR gRNA sequence
cgccactgtctacatcctgc

SEQ ID NO: 290103 - DNA, 20 bp, Artificial
  CRISPR gRNA sequence
tctacatcctgcgccagggc

SEQ ID NO: 290104 - DNA, 20 bp, Artificial
  CRISPR gRNA sequence
catcctgcgccagggcagta

SEQ ID NO: 290105 - DNA, 20 bp, Artificial
  CRISPR gRNA sequence
cgccagggcagtacacttgt

SEQ ID NO: 290106 - DNA, 20 bp, Artificial
  CRISPR gRNA sequence
gttacaatcaatgaacctac

SEQ ID NO: 290107 - DNA, 20 bp, Artificial
  CRISPR gRNA sequence
ttacaatcaatgaacctaca

SEQ ID NO: 290108 - DNA, 20 bp, Artificial
  CRISPR gRNA sequence
caatcaatgaacctacatta

SEQ ID NO: 290109 - DNA, 20 bp, Artificial
  CRISPR gRNA sequence
cattaacacatcattaccac

SEQ ID NO: 290110 - DNA, 20 bp, Artificial
  CRISPR gRNA sequence
acacatcattaccaccccaa

SEQ ID NO: 290111 - DNA, 20 bp, Artificial
  CRISPR gRNA sequence
ccaccccaaatctagagttc

SEQ ID NO: 290112 - DNA, 20 bp, Artificial
  CRISPR gRNA sequence
gagttcacgataggggtcac

SEQ ID NO: 290113 - DNA, 20 bp, Artificial
  CRISPR gRNA sequence
acgataggggtcactcctgg

SEQ ID NO: 290114 - DNA, 20 bp, Artificial
  CRISPR gRNA sequence
ctggtattgcatattctatg

SEQ ID NO: 290115 - DNA, 20 bp, Artificial
  CRISPR gRNA sequence
gtattgcatattctatggat

SEQ ID NO: 290116 - DNA, 20 bp, Artificial
  CRISPR gRNA sequence
catattctatggatttgggc

SEQ ID NO: 290117 - DNA, 20 bp, Artificial
  CRISPR gRNA sequence
tatggatttgggcaaattta

SEQ ID NO: 290118 - DNA, 20 bp, Artificial
  CRISPR gRNA sequence
tggatttgggcaaatttata

SEQ ID NO: 290119 - DNA, 20 bp, Artificial
  CRISPR gRNA sequence
gggcaaatttataatgactt

SEQ ID NO: 290120 - DNA, 20 bp, Artificial
  CRISPR gRNA sequence
ggcaaatttataatgactta

SEQ ID NO: 290121 - DNA, 20 bp, Artificial
  CRISPR gRNA sequence
ataatgacttatatctatca

SEQ ID NO: 290122 - DNA, 20 bp, Artificial
  CRISPR gRNA sequence
taatgacttatatctatcat

SEQ ID NO: 290123 - DNA, 20 bp, Artificial
  CRISPR gRNA sequence
atatctatcattacagtatt

SEQ ID NO: 290124 - DNA, 20 bp, Artificial
  CRISPR gRNA sequence
tatctatcattacagtatta

SEQ ID NO: 290125 - DNA, 20 bp, Artificial
  CRISPR gRNA sequence
tcattacagtattatgcaaa

SEQ ID NO: 290126 - DNA, 20 bp, Artificial
  CRISPR gRNA sequence
cagtattatgcaaaatagat

SEQ ID NO: 290127 - DNA, 20 bp, Artificial
  CRISPR gRNA sequence
tgcaaaatagattcacttct

SEQ ID NO: 290128 - DNA, 20 bp, Artificial
  CRISPR gRNA sequence
acttctctaaaaaattccct

SEQ ID NO: 290129 - DNA, 20 bp, Artificial
  CRISPR gRNA sequence
ctctaaaaaattccctgtgc

SEQ ID NO: 290130 - DNA, 20 bp, Artificial
  CRISPR gRNA sequence
tctaaaaaattccctgtgct

SEQ ID NO: 290131 - DNA, 20 bp, Artificial
  CRISPR gRNA sequence
taaaaaattccctgtgctag

SEQ ID NO: 290132 - DNA, 20 bp, Artificial
  CRISPR gRNA sequence
aaaaattccctgtgctagaa

SEQ ID NO: 290133 - DNA, 20 bp, Artificial
  CRISPR gRNA sequence
cctgtgctagaaactgcaat

SEQ ID NO: 290134 - DNA, 20 bp, Artificial
  CRISPR gRNA sequence
tgctagaaactgcaatttag

SEQ ID NO: 290135 - DNA, 20 bp, Artificial
  CRISPR gRNA sequence
gaaactgcaatttagcaaaa

SEQ ID NO: 290136 - DNA, 20 bp, Artificial
  CRISPR gRNA sequence
caatttagcaaaacccccag

SEQ ID NO: 290137 - DNA, 20 bp, Artificial
  CRISPR gRNA sequence
agcaaaacccccaggctatt

SEQ ID NO: 290138 - DNA, 20 bp, Artificial
  CRISPR gRNA sequence
gcaaaacccccaggctattg

SEQ ID NO: 290139 - DNA, 20 bp, Artificial
  CRISPR gRNA sequence
ttggtatgtgtaaagagtga

SEQ ID NO: 290140 - DNA, 20 bp, Artificial
  CRISPR gRNA sequence
gtatgtgtaaagagtgaaca

SEQ ID NO: 290141 - DNA, 20 bp, Artificial
  CRISPR gRNA sequence
gggtagaccacgccactctc

SEQ ID NO: 290142 - DNA, 20 bp, Artificial
  CRISPR gRNA sequence
tcctgggtaaagcccttcca

SEQ ID NO: 290143 - DNA, 20 bp, Artificial
  CRISPR gRNA sequence
ctgggtaaagcccttccagc

SEQ ID NO: 290144 - DNA, 20 bp, Artificial
  CRISPR gRNA sequence
ggtaaagcccttccagcttc

SEQ ID NO: 290145 - DNA, 20 bp, Artificial
  CRISPR gRNA sequence
ccagcttcctgaataacatg

SEQ ID NO: 290146 - DNA, 20 bp, Artificial
  CRISPR gRNA sequence
cagcttcctgaataacatgc

SEQ ID NO: 290147 - DNA, 20 bp, Artificial
  CRISPR gRNA sequence
cctgaataacatgcggattc

SEQ ID NO: 290148 - DNA, 20 bp, Artificial
  CRISPR gRNA sequence
ctgaataacatgcggattca

SEQ ID NO: 290149 - DNA, 20 bp, Artificial
  CRISPR gRNA sequence
aataacatgcggattcatga

SEQ ID NO: 290150 - DNA, 20 bp, Artificial
  CRISPR gRNA sequence
atgattataactcacaagtg

SEQ ID NO: 290151 - DNA, 20 bp, Artificial
  CRISPR gRNA sequence
taactcacaagtgctgcagg

SEQ ID NO: 290152 - DNA, 20 bp, Artificial
  CRISPR gRNA sequence
acaagtgctgcagggtccgg

SEQ ID NO: 290153 - DNA, 20 bp, Artificial
  CRISPR gRNA sequence
cagggtccggttcttgctca

SEQ ID NO: 290154 - DNA, 20 bp, Artificial
  CRISPR gRNA sequence
ttgctcactgggccagtccc

SEQ ID NO: 290155 - DNA, 20 bp, Artificial
  CRISPR gRNA sequence
gctcactgggccagtccctc

SEQ ID NO: 290156 - DNA, 20 bp, Artificial
  CRISPR gRNA sequence
ctcactgggccagtccctcc

SEQ ID NO: 290157 - DNA, 20 bp, Artificial
  CRISPR gRNA sequence
actgggccagtccctcctct

SEQ ID NO: 290158 - DNA, 20 bp, Artificial
  CRISPR gRNA sequence
ggccagtccctcctctgcta

SEQ ID NO: 290159 - DNA, 20 bp, Artificial
  CRISPR gRNA sequence
ctctgctacttcccagctca

SEQ ID NO: 290160 - DNA, 20 bp, Artificial
  CRISPR gRNA sequence
tgctacttcccagctcactg

SEQ ID NO: 290161 - DNA, 20 bp, Artificial
  CRISPR gRNA sequence
ctacttcccagctcactgcc

SEQ ID NO: 290162 - DNA, 20 bp, Artificial
  CRISPR gRNA sequence
cttcccagctcactgcccct

SEQ ID NO: 290163 - DNA, 20 bp, Artificial
  CRISPR gRNA sequence
cccagctcactgccccttct

SEQ ID NO: 290164 - DNA, 20 bp, Artificial
  CRISPR gRNA sequence
ccagctcactgccccttctt

SEQ ID NO: 290165 - DNA, 20 bp, Artificial
  CRISPR gRNA sequence
actgccccttcttgctggca

SEQ ID NO: 290166 - DNA, 20 bp, Artificial
  CRISPR gRNA sequence
ccccttcttgctggcagagg

SEQ ID NO: 290167 - DNA, 20 bp, Artificial
  CRISPR gRNA sequence
cttgctggcagaggaagaca

SEQ ID NO: 290168 - DNA, 20 bp, Artificial
  CRISPR gRNA sequence
ttgctggcagaggaagacag

SEQ ID NO: 290169 - DNA, 20 bp, Artificial
  CRISPR gRNA sequence
gctggcagaggaagacagca

SEQ ID NO: 290170 - DNA, 20 bp, Artificial
  CRISPR gRNA sequence
ctggcagaggaagacagcac

SEQ ID NO: 290171 - DNA, 20 bp, Artificial
  CRISPR gRNA sequence
gcagaggaagacagcacttc

SEQ ID NO: 290172 - DNA, 20 bp, Artificial
  CRISPR gRNA sequence
cctcaggcagtgcctgtgcc

SEQ ID NO: 290173 - DNA, 20 bp, Artificial
  CRISPR gRNA sequence
ctcaggcagtgcctgtgccc

SEQ ID NO: 290174 - DNA, 20 bp, Artificial
  CRISPR gRNA sequence
aggcagtgcctgtgccctgc

SEQ ID NO: 290175 - DNA, 20 bp, Artificial
  CRISPR gRNA sequence
tgccctgccttcaaagcacg

SEQ ID NO: 290176 - DNA, 20 bp, Artificial
  CRISPR gRNA sequence
ccttcaaagcacgtggcttt

SEQ ID NO: 290177 - DNA, 20 bp, Artificial
  CRISPR gRNA sequence
caaagcacgtggctttgttt

SEQ ID NO: 290178 - DNA, 20 bp, Artificial
  CRISPR gRNA sequence
aaagcacgtggctttgtttg

SEQ ID NO: 290179 - DNA, 20 bp, Artificial
  CRISPR gRNA sequence
tgtttgttggccacacttta

SEQ ID NO: 290180 - DNA, 20 bp, Artificial
  CRISPR gRNA sequence
gtttgttggccacactttaa

SEQ ID NO: 290181 - DNA, 20 bp, Artificial
  CRISPR gRNA sequence
tttgttggccacactttaac

SEQ ID NO: 290182 - DNA, 20 bp, Artificial
  CRISPR gRNA sequence
gttggccacactttaacaca

SEQ ID NO: 290183 - DNA, 20 bp, Artificial
  CRISPR gRNA sequence
ttggccacactttaacacat

SEQ ID NO: 290184 - DNA, 20 bp, Artificial
  CRISPR gRNA sequence
gccacactttaacacattca

SEQ ID NO: 290185 - DNA, 20 bp, Artificial
  CRISPR gRNA sequence
taacacattcatttgagtgg

SEQ ID NO: 290186 - DNA, 20 bp, Artificial
  CRISPR gRNA sequence
aacacattcatttgagtggc

SEQ ID NO: 290187 - DNA, 20 bp, Artificial
  CRISPR gRNA sequence
acacattcatttgagtggct

SEQ ID NO: 290188 - DNA, 20 bp, Artificial
  CRISPR gRNA sequence
atttgagtggctattggatt

SEQ ID NO: 290189 - DNA, 20 bp, Artificial
  CRISPR gRNA sequence
gagtggctattggattactt

SEQ ID NO: 290190 - DNA, 20 bp, Artificial
  CRISPR gRNA sequence
agtggctattggattacttt

SEQ ID NO: 290191 - DNA, 20 bp, Artificial
  CRISPR gRNA sequence
ttggattacttttcctcttt

SEQ ID NO: 290192 - DNA, 20 bp, Artificial
  CRISPR gRNA sequence
gattacttttcctctttcca

SEQ ID NO: 290193 - DNA, 20 bp, Artificial
  CRISPR gRNA sequence
cttttcctctttccaatgat

SEQ ID NO: 290194 - DNA, 20 bp, Artificial
  CRISPR gRNA sequence
ttcctctttccaatgatagt

SEQ ID NO: 290195 - DNA, 20 bp, Artificial
  CRISPR gRNA sequence
tcctctttccaatgatagta

SEQ ID NO: 290196 - DNA, 20 bp, Artificial
  CRISPR gRNA sequence
cctctttccaatgatagtaa

SEQ ID NO: 290197 - DNA, 20 bp, Artificial
  CRISPR gRNA sequence
ctctttccaatgatagtaaa

SEQ ID NO: 290198 - DNA, 20 bp, Artificial
  CRISPR gRNA sequence
tttccaatgatagtaaattt

SEQ ID NO: 290199 - DNA, 20 bp, Artificial
  CRISPR gRNA sequence
tccaatgatagtaaatttca

SEQ ID NO: 290200 - DNA, 20 bp, Artificial
  CRISPR gRNA sequence
ccaatgatagtaaatttcac

SEQ ID NO: 290201 - DNA, 20 bp, Artificial
  CRISPR gRNA sequence
caatgatagtaaatttcaca

SEQ ID NO: 290202 - DNA, 20 bp, Artificial
  CRISPR gRNA sequence
cacaaatgcaagagccatgt

SEQ ID NO: 290203 - DNA, 20 bp, Artificial
  CRISPR gRNA sequence
acaaatgcaagagccatgtc

SEQ ID NO: 290204 - DNA, 20 bp, Artificial
  CRISPR gRNA sequence
ttggttttaggagatgctca

SEQ ID NO: 290205 - DNA, 20 bp, Artificial
  CRISPR gRNA sequence
ggttttaggagatgctcatg

SEQ ID NO: 290206 - DNA, 20 bp, Artificial
  CRISPR gRNA sequence
gttttaggagatgctcatgt

SEQ ID NO: 290207 - DNA, 20 bp, Artificial
  CRISPR gRNA sequence
taggagatgctcatgtttgt

SEQ ID NO: 290208 - DNA, 20 bp, Artificial
  CRISPR gRNA sequence
aggagatgctcatgtttgtt

SEQ ID NO: 290209 - DNA, 20 bp, Artificial
  CRISPR gRNA sequence
ggagatgctcatgtttgttg

SEQ ID NO: 290210 - DNA, 20 bp, Artificial
  CRISPR gRNA sequence
atgtttgttgaattaataaa

SEQ ID NO: 290211 - DNA, 20 bp, Artificial
  CRISPR gRNA sequence
gttgaattaataaatgatta

SEQ ID NO: 290212 - DNA, 20 bp, Artificial
  CRISPR gRNA sequence
ttgaattaataaatgattaa

SEQ ID NO: 290213 - DNA, 20 bp, Artificial
  CRISPR gRNA sequence
aattaataaatgattaaaca

SEQ ID NO: 290214 - DNA, 20 bp, Artificial
  CRISPR gRNA sequence
ataaatgattaaacaaaaga

SEQ ID NO: 290215 - DNA, 20 bp, Artificial
  CRISPR gRNA sequence
aacaaaagaatgaacacctg

SEQ ID NO: 290216 - DNA, 20 bp, Artificial
  CRISPR gRNA sequence
tgccagcctcatccttacct

SEQ ID NO: 290217 - DNA, 20 bp, Artificial
  CRISPR gRNA sequence
atccttacctttgtgccttt

SEQ ID NO: 290218 - DNA, 20 bp, Artificial
  CRISPR gRNA sequence
acctttgtgcctttgtccag

SEQ ID NO: 290219 - DNA, 20 bp, Artificial
  CRISPR gRNA sequence
cctttgtgcctttgtccagg

SEQ ID NO: 290220 - DNA, 20 bp, Artificial
  CRISPR gRNA sequence
tgtgcctttgtccaggctgt

SEQ ID NO: 290221 - DNA, 20 bp, Artificial
  CRISPR gRNA sequence
gtgcctttgtccaggctgtt

SEQ ID NO: 290222 - DNA, 20 bp, Artificial
  CRISPR gRNA sequence
tgcctttgtccaggctgttg

SEQ ID NO: 290223 - DNA, 20 bp, Artificial
  CRISPR gRNA sequence
tgtccaggctgttgccctga

SEQ ID NO: 290224 - DNA, 20 bp, Artificial
  CRISPR gRNA sequence
gtccaggctgttgccctgac

SEQ ID NO: 290225 - DNA, 20 bp, Artificial
  CRISPR gRNA sequence
tccaggctgttgccctgacc

SEQ ID NO: 290226 - DNA, 20 bp, Artificial
  CRISPR gRNA sequence
ttgccctgaccagaattctc

SEQ ID NO: 290227 - DNA, 20 bp, Artificial
  CRISPR gRNA sequence
ccctgaccagaattctctct

SEQ ID NO: 290228 - DNA, 20 bp, Artificial
  CRISPR gRNA sequence
accagaattctctctccatc

SEQ ID NO: 290229 - DNA, 20 bp, Artificial
  CRISPR gRNA sequence
tctctccatcatccatctgc

SEQ ID NO: 290230 - DNA, 20 bp, Artificial
  CRISPR gRNA sequence
tctccatcatccatctgcct

SEQ ID NO: 290231 - DNA, 20 bp, Artificial
  CRISPR gRNA sequence
tccatcatccatctgcctct

SEQ ID NO: 290232 - DNA, 20 bp, Artificial
  CRISPR gRNA sequence
catcatccatctgcctctgt

SEQ ID NO: 290233 - DNA, 20 bp, Artificial
  CRISPR gRNA sequence
cctctgtaaagcctgccctc

SEQ ID NO: 290234 - DNA, 20 bp, Artificial
  CRISPR gRNA sequence
tgtaaagcctgccctccttc

SEQ ID NO: 290235 - DNA, 20 bp, Artificial
  CRISPR gRNA sequence
taaagcctgccctccttcct

SEQ ID NO: 290236 - DNA, 20 bp, Artificial
  CRISPR gRNA sequence
ccctccttcctgcagcccag

SEQ ID NO: 290237 - DNA, 20 bp, Artificial
  CRISPR gRNA sequence
cttcctgcagcccagtctgt

SEQ ID NO: 290238 - DNA, 20 bp, Artificial
  CRISPR gRNA sequence
cctgcagcccagtctgttac

SEQ ID NO: 290239 - DNA, 20 bp, Artificial
  CRISPR gRNA sequence
ctgcagcccagtctgttacc

SEQ ID NO: 290240 - DNA, 20 bp, Artificial
  CRISPR gRNA sequence
cagcccagtctgttacccac

SEQ ID NO: 290241 - DNA, 20 bp, Artificial
  CRISPR gRNA sequence
ttacccactttcccagatct

SEQ ID NO: 290242 - DNA, 20 bp, Artificial
  CRISPR gRNA sequence
cccactttcccagatcttgg

SEQ ID NO: 290243 - DNA, 20 bp, Artificial
  CRISPR gRNA sequence
tcccagatcttgggctccta

SEQ ID NO: 290244 - DNA, 20 bp, Artificial
  CRISPR gRNA sequence
cccagatcttgggctcctac

SEQ ID NO: 290245 - DNA, 20 bp, Artificial
  CRISPR gRNA sequence
ccagatcttgggctcctaca

SEQ ID NO: 290246 - DNA, 20 bp, Artificial
  CRISPR gRNA sequence
gggctcctacaatcagggca

SEQ ID NO: 290247 - DNA, 20 bp, Artificial
  CRISPR gRNA sequence
ggctcctacaatcagggcaa

SEQ ID NO: 290248 - DNA, 20 bp, Artificial
  CRISPR gRNA sequence
ctacaatcagggcaaagcat

SEQ ID NO: 290249 - DNA, 20 bp, Artificial
  CRISPR gRNA sequence
caatcagggcaaagcatttc

SEQ ID NO: 290250 - DNA, 20 bp, Artificial
  CRISPR gRNA sequence
cattgctctttgcttgttct

SEQ ID NO: 290251 - DNA, 20 bp, Artificial
  CRISPR gRNA sequence
attgctctttgcttgttcta

SEQ ID NO: 290252 - DNA, 20 bp, Artificial
  CRISPR gRNA sequence
ctctttgcttgttctacatg

SEQ ID NO: 290253 - DNA, 20 bp, Artificial
  CRISPR gRNA sequence
tttgcttgttctacatgggt

SEQ ID NO: 290254 - DNA, 20 bp, Artificial
  CRISPR gRNA sequence
tgcttgttctacatgggtta

SEQ ID NO: 290255 - DNA, 20 bp, Artificial
  CRISPR gRNA sequence
gcttgttctacatgggttag

SEQ ID NO: 290256 - DNA, 20 bp, Artificial
  CRISPR gRNA sequence
cttgttctacatgggttagc

SEQ ID NO: 290257 - DNA, 20 bp, Artificial
  CRISPR gRNA sequence
gttctacatgggttagcttt

SEQ ID NO: 290258 - DNA, 20 bp, Artificial
  CRISPR gRNA sequence
ttctacatgggttagctttg

SEQ ID NO: 290259 - DNA, 20 bp, Artificial
  CRISPR gRNA sequence
tacatgggttagctttgcat

SEQ ID NO: 290260 - DNA, 20 bp, Artificial
  CRISPR gRNA sequence
catgggttagctttgcattt

SEQ ID NO: 290261 - DNA, 20 bp, Artificial
  CRISPR gRNA sequence
gctttgcatttccgcaacta

SEQ ID NO: 290262 - DNA, 20 bp, Artificial
  CRISPR gRNA sequence
tgcatttccgcaactaacat

SEQ ID NO: 290263 - DNA, 20 bp, Artificial
  CRISPR gRNA sequence
gcatttccgcaactaacata

SEQ ID NO: 290264 - DNA, 20 bp, Artificial
  CRISPR gRNA sequence
catttccgcaactaacatat

SEQ ID NO: 290265 - DNA, 20 bp, Artificial
  CRISPR gRNA sequence
ccgcaactaacatatgcaga

SEQ ID NO: 290266 - DNA, 20 bp, Artificial
  CRISPR gRNA sequence
cgcaactaacatatgcagac

SEQ ID NO: 290267 - DNA, 20 bp, Artificial
  CRISPR gRNA sequence
acatatgcagacctctttga

SEQ ID NO: 290268 - DNA, 20 bp, Artificial
  CRISPR gRNA sequence
tttgagtgcaggaatcctag

SEQ ID NO: 290269 - DNA, 20 bp, Artificial
  CRISPR gRNA sequence
tgagtgcaggaatcctagcc

SEQ ID NO: 290270 - DNA, 20 bp, Artificial
  CRISPR gRNA sequence
gagtgcaggaatcctagcct

SEQ ID NO: 290271 - DNA, 20 bp, Artificial
  CRISPR gRNA sequence
agtgcaggaatcctagcctc

SEQ ID NO: 290272 - DNA, 20 bp, Artificial
  CRISPR gRNA sequence
gcctcaacttttatggccca

SEQ ID NO: 290273 - DNA, 20 bp, Artificial
  CRISPR gRNA sequence
aacttttatggcccacctgg

SEQ ID NO: 290274 - DNA, 20 bp, Artificial
  CRISPR gRNA sequence
ttatggcccacctggcacac

SEQ ID NO: 290275 - DNA, 20 bp, Artificial
  CRISPR gRNA sequence
tatggcccacctggcacaca

SEQ ID NO: 290276 - DNA, 20 bp, Artificial
  CRISPR gRNA sequence
atggcccacctggcacacag

SEQ ID NO: 290277 - DNA, 20 bp, Artificial
  CRISPR gRNA sequence
tggcccacctggcacacagt

SEQ ID NO: 290278 - DNA, 20 bp, Artificial
  CRISPR gRNA sequence
gcacacagtaggtgcttcat

SEQ ID NO: 290279 - DNA, 20 bp, Artificial
  CRISPR gRNA sequence
cattgactcagtcacagcag

SEQ ID NO: 290280 - DNA, 20 bp, Artificial
  CRISPR gRNA sequence
attgactcagtcacagcagc

SEQ ID NO: 290281 - DNA, 20 bp, Artificial
  CRISPR gRNA sequence
actcagtcacagcagcagta

SEQ ID NO: 290282 - DNA, 20 bp, Artificial
  CRISPR gRNA sequence
agtcacagcagcagtaaaac

SEQ ID NO: 290283 - DNA, 20 bp, Artificial
  CRISPR gRNA sequence
gagaacaaggtgctttccta

SEQ ID NO: 290284 - DNA, 20 bp, Artificial
  CRISPR gRNA sequence
tcctaaacatctttctttag

SEQ ID NO: 290285 - DNA, 20 bp, Artificial
  CRISPR gRNA sequence
cctaaacatctttctttagc

SEQ ID NO: 290286 - DNA, 20 bp, Artificial
  CRISPR gRNA sequence
ctaaacatctttctttagct

SEQ ID NO: 290287 - DNA, 20 bp, Artificial
  CRISPR gRNA sequence
aacatctttctttagctcaa

SEQ ID NO: 290288 - DNA, 20 bp, Artificial
  CRISPR gRNA sequence
tctttagctcaaagatctct

SEQ ID NO: 290289 - DNA, 20 bp, Artificial
  CRISPR gRNA sequence
ctttagctcaaagatctctt

SEQ ID NO: 290290 - DNA, 20 bp, Artificial
  CRISPR gRNA sequence
tttagctcaaagatctcttt

SEQ ID NO: 290291 - DNA, 20 bp, Artificial
  CRISPR gRNA sequence
tagctcaaagatctctttcc

SEQ ID NO: 290292 - DNA, 20 bp, Artificial
  CRISPR gRNA sequence
agctcaaagatctctttcca

SEQ ID NO: 290293 - DNA, 20 bp, Artificial
  CRISPR gRNA sequence
gctcaaagatctctttccac

SEQ ID NO: 290294 - DNA, 20 bp, Artificial
  CRISPR gRNA sequence
aaagatctctttccacttac

SEQ ID NO: 290295 - DNA, 20 bp, Artificial
  CRISPR gRNA sequence
tttccacttacctctgaccc

SEQ ID NO: 290296 - DNA, 20 bp, Artificial
  CRISPR gRNA sequence
tccacttacctctgacccta

SEQ ID NO: 290297 - DNA, 20 bp, Artificial
  CRISPR gRNA sequence
ccacttacctctgaccctaa

SEQ ID NO: 290298 - DNA, 20 bp, Artificial
  CRISPR gRNA sequence
cacttacctctgaccctaat

SEQ ID NO: 290299 - DNA, 20 bp, Artificial
  CRISPR gRNA sequence
acctctgaccctaattttcc

SEQ ID NO: 290300 - DNA, 20 bp, Artificial
  CRISPR gRNA sequence
cctctgaccctaattttcct

SEQ ID NO: 290301 - DNA, 20 bp, Artificial
  CRISPR gRNA sequence
tgaccctaattttccttgta

SEQ ID NO: 290302 - DNA, 20 bp, Artificial
  CRISPR gRNA sequence
accctaattttccttgtaca

SEQ ID NO: 290303 - DNA, 20 bp, Artificial
  CRISPR gRNA sequence
attttccttgtacaatttct

SEQ ID NO: 290304 - DNA, 20 bp, Artificial
  CRISPR gRNA sequence
tccttgtacaatttctaaag

SEQ ID NO: 290305 - DNA, 20 bp, Artificial
  CRISPR gRNA sequence
ccttgtacaatttctaaagt

SEQ ID NO: 290306 - DNA, 20 bp, Artificial
  CRISPR gRNA sequence
cttgtacaatttctaaagtc

SEQ ID NO: 290307 - DNA, 20 bp, Artificial
  CRISPR gRNA sequence
gtacaatttctaaagtctgg

SEQ ID NO: 290308 - DNA, 20 bp, Artificial
  CRISPR gRNA sequence
tacaatttctaaagtctggg

SEQ ID NO: 290309 - DNA, 20 bp, Artificial
  CRISPR gRNA sequence
ctaaagtctgggttttaatt

SEQ ID NO: 290310 - DNA, 20 bp, Artificial
  CRISPR gRNA sequence
aaacccagactttagaaatt

SEQ ID NO: 290311 - DNA, 20 bp, Artificial
  CRISPR gRNA sequence
tagaaattgtacaaggaaaa

SEQ ID NO: 290312 - DNA, 20 bp, Artificial
  CRISPR gRNA sequence
agaaattgtacaaggaaaat

SEQ ID NO: 290313 - DNA, 20 bp, Artificial
  CRISPR gRNA sequence
gaaattgtacaaggaaaatt

SEQ ID NO: 290314 - DNA, 20 bp, Artificial
  CRISPR gRNA sequence
tacaaggaaaattagggtca

SEQ ID NO: 290315 - DNA, 20 bp, Artificial
  CRISPR gRNA sequence
gggtcagaggtaagtggaaa

SEQ ID NO: 290316 - DNA, 20 bp, Artificial
  CRISPR gRNA sequence
tgagctaaagaaagatgttt

SEQ ID NO: 290317 - DNA, 20 bp, Artificial
  CRISPR gRNA sequence
gagctaaagaaagatgttta

SEQ ID NO: 290318 - DNA, 20 bp, Artificial
  CRISPR gRNA sequence
agctaaagaaagatgtttag

SEQ ID NO: 290319 - DNA, 20 bp, Artificial
  CRISPR gRNA sequence
aagaaagatgtttaggaaag

SEQ ID NO: 290320 - DNA, 20 bp, Artificial
  CRISPR gRNA sequence
aggaaagcaccttgttctct

SEQ ID NO: 290321 - DNA, 20 bp, Artificial
  CRISPR gRNA sequence
ggaaagcaccttgttctcta

SEQ ID NO: 290322 - DNA, 20 bp, Artificial
  CRISPR gRNA sequence
gttctctagctacatcctgg

SEQ ID NO: 290323 - DNA, 20 bp, Artificial
  CRISPR gRNA sequence
ttctctagctacatcctggt

SEQ ID NO: 290324 - DNA, 20 bp, Artificial
  CRISPR gRNA sequence
tctagctacatcctggtttt

SEQ ID NO: 290325 - DNA, 20 bp, Artificial
  CRISPR gRNA sequence
tagctacatcctggttttac

SEQ ID NO: 290326 - DNA, 20 bp, Artificial
  CRISPR gRNA sequence
gctacatcctggttttactg

SEQ ID NO: 290327 - DNA, 20 bp, Artificial
  CRISPR gRNA sequence
catcctggttttactgctgc

SEQ ID NO: 290328 - DNA, 20 bp, Artificial
  CRISPR gRNA sequence
gttttactgctgctgtgact

SEQ ID NO: 290329 - DNA, 20 bp, Artificial
  CRISPR gRNA sequence
tactgctgctgtgactgagt

SEQ ID NO: 290330 - DNA, 20 bp, Artificial
  CRISPR gRNA sequence
actgctgctgtgactgagtc

SEQ ID NO: 290331 - DNA, 20 bp, Artificial
  CRISPR gRNA sequence
ctgctgctgtgactgagtca

SEQ ID NO: 290332 - DNA, 20 bp, Artificial
  CRISPR gRNA sequence
ctgctgtgactgagtcaatg

SEQ ID NO: 290333 - DNA, 20 bp, Artificial
  CRISPR gRNA sequence
ctgtgactgagtcaatgaag

SEQ ID NO: 290334 - DNA, 20 bp, Artificial
  CRISPR gRNA sequence
tgactgagtcaatgaagcac

SEQ ID NO: 290335 - DNA, 20 bp, Artificial
  CRISPR gRNA sequence
agtcaatgaagcacctactg

SEQ ID NO: 290336 - DNA, 20 bp, Artificial
  CRISPR gRNA sequence
ctgtgtgccaggtgggccat

SEQ ID NO: 290337 - DNA, 20 bp, Artificial
  CRISPR gRNA sequence
tgtgccaggtgggccataaa

SEQ ID NO: 290338 - DNA, 20 bp, Artificial
  CRISPR gRNA sequence
aggctaggattcctgcactc

SEQ ID NO: 290339 - DNA, 20 bp, Artificial
  CRISPR gRNA sequence
ggattcctgcactcaaagag

SEQ ID NO: 290340 - DNA, 20 bp, Artificial
  CRISPR gRNA sequence
ctgcactcaaagaggtctgc

SEQ ID NO: 290341 - DNA, 20 bp, Artificial
  CRISPR gRNA sequence
cactcaaagaggtctgcata

SEQ ID NO: 290342 - DNA, 20 bp, Artificial
  CRISPR gRNA sequence
aaagaggtctgcatatgtta

SEQ ID NO: 290343 - DNA, 20 bp, Artificial
  CRISPR gRNA sequence
catatgttagttgcggaaat

SEQ ID NO: 290344 - DNA, 20 bp, Artificial
  CRISPR gRNA sequence
gttgcggaaatgcaaagcta

SEQ ID NO: 290345 - DNA, 20 bp, Artificial
  CRISPR gRNA sequence
cggaaatgcaaagctaaccc

SEQ ID NO: 290346 - DNA, 20 bp, Artificial
  CRISPR gRNA sequence
acccatgtagaacaagcaaa

SEQ ID NO: 290347 - DNA, 20 bp, Artificial
  CRISPR gRNA sequence
tgccctgattgtaggagccc

SEQ ID NO: 290348 - DNA, 20 bp, Artificial
  CRISPR gRNA sequence
gccctgattgtaggagccca

SEQ ID NO: 290349 - DNA, 20 bp, Artificial
  CRISPR gRNA sequence
ccctgattgtaggagcccaa

SEQ ID NO: 290350 - DNA, 20 bp, Artificial
  CRISPR gRNA sequence
attgtaggagcccaagatct

SEQ ID NO: 290351 - DNA, 20 bp, Artificial
  CRISPR gRNA sequence
taggagcccaagatctggga

SEQ ID NO: 290352 - DNA, 20 bp, Artificial
  CRISPR gRNA sequence
ggaaagtgggtaacagactg

SEQ ID NO: 290353 - DNA, 20 bp, Artificial
  CRISPR gRNA sequence
ggctgcaggaaggagggcag

SEQ ID NO: 290354 - DNA, 20 bp, Artificial
  CRISPR gRNA sequence
caggaaggagggcaggcttt

SEQ ID NO: 290355 - DNA, 20 bp, Artificial
  CRISPR gRNA sequence
tacagaggcagatggatgat

SEQ ID NO: 290356 - DNA, 20 bp, Artificial
  CRISPR gRNA sequence
acagaggcagatggatgatg

SEQ ID NO: 290357 - DNA, 20 bp, Artificial
  CRISPR gRNA sequence
cagaggcagatggatgatgg

SEQ ID NO: 290358 - DNA, 20 bp, Artificial
  CRISPR gRNA sequence
tggtcagggcaacagcctgg

SEQ ID NO: 290359 - DNA, 20 bp, Artificial
  CRISPR gRNA sequence
gtcagggcaacagcctggac

SEQ ID NO: 290360 - DNA, 20 bp, Artificial
  CRISPR gRNA sequence
gacaaaggcacaaaggtaag

SEQ ID NO: 290361 - DNA, 20 bp, Artificial
  CRISPR gRNA sequence
gcacaggtgttcattctttt

SEQ ID NO: 290362 - DNA, 20 bp, Artificial
  CRISPR gRNA sequence
attcttttgtttaatcattt

SEQ ID NO: 290363 - DNA, 20 bp, Artificial
  CRISPR gRNA sequence
ttttgtttaatcatttatta

SEQ ID NO: 290364 - DNA, 20 bp, Artificial
  CRISPR gRNA sequence
ttgtttaatcatttattaat

SEQ ID NO: 290365 - DNA, 20 bp, Artificial
  CRISPR gRNA sequence
tgtttaatcatttattaatt

SEQ ID NO: 290366 - DNA, 20 bp, Artificial
  CRISPR gRNA sequence
gtttaatcatttattaattc

SEQ ID NO: 290367 - DNA, 20 bp, Artificial
  CRISPR gRNA sequence
tttaatcatttattaattca

SEQ ID NO: 290368 - DNA, 20 bp, Artificial
  CRISPR gRNA sequence
aatcatttattaattcaaca

SEQ ID NO: 290369 - DNA, 20 bp, Artificial
  CRISPR gRNA sequence
atcatttattaattcaacaa

SEQ ID NO: 290370 - DNA, 20 bp, Artificial
  CRISPR gRNA sequence
attaattcaacaaacatgag

SEQ ID NO: 290371 - DNA, 20 bp, Artificial
  CRISPR gRNA sequence
ttaattcaacaaacatgagc

SEQ ID NO: 290372 - DNA, 20 bp, Artificial
  CRISPR gRNA sequence
attcaacaaacatgagcatc

SEQ ID NO: 290373 - DNA, 20 bp, Artificial
  CRISPR gRNA sequence
aacaaacatgagcatctcct

SEQ ID NO: 290374 - DNA, 20 bp, Artificial
  CRISPR gRNA sequence
ctaaaaccaagagacttttc

SEQ ID NO: 290375 - DNA, 20 bp, Artificial
  CRISPR gRNA sequence
aaaccaagagacttttcttg

SEQ ID NO: 290376 - DNA, 20 bp, Artificial
  CRISPR gRNA sequence
ttcttggtcctggggacatg

SEQ ID NO: 290377 - DNA, 20 bp, Artificial
  CRISPR gRNA sequence
tcttggtcctggggacatgg

SEQ ID NO: 290378 - DNA, 20 bp, Artificial
  CRISPR gRNA sequence
cttggtcctggggacatggc

SEQ ID NO: 290379 - DNA, 20 bp, Artificial
  CRISPR gRNA sequence
ttggtcctggggacatggct

SEQ ID NO: 290380 - DNA, 20 bp, Artificial
  CRISPR gRNA sequence
ggtcctggggacatggctct

SEQ ID NO: 290381 - DNA, 20 bp, Artificial
  CRISPR gRNA sequence
gtcctggggacatggctctt

SEQ ID NO: 290382 - DNA, 20 bp, Artificial
  CRISPR gRNA sequence
gggacatggctcttgcattt

SEQ ID NO: 290383 - DNA, 20 bp, Artificial
  CRISPR gRNA sequence
ttgcatttgtgaaatttact

SEQ ID NO: 290384 - DNA, 20 bp, Artificial
  CRISPR gRNA sequence
gcatttgtgaaatttactat

SEQ ID NO: 290385 - DNA, 20 bp, Artificial
  CRISPR gRNA sequence
catttgtgaaatttactatc

SEQ ID NO: 290386 - DNA, 20 bp, Artificial
  CRISPR gRNA sequence
gtgaaatttactatcattgg

SEQ ID NO: 290387 - DNA, 20 bp, Artificial
  CRISPR gRNA sequence
tgaaatttactatcattgga

SEQ ID NO: 290388 - DNA, 20 bp, Artificial
  CRISPR gRNA sequence
actatcattggaaagaggaa

SEQ ID NO: 290389 - DNA, 20 bp, Artificial
  CRISPR gRNA sequence
ctatcattggaaagaggaaa

SEQ ID NO: 290390 - DNA, 20 bp, Artificial
  CRISPR gRNA sequence
tcattggaaagaggaaaagt

SEQ ID NO: 290391 - DNA, 20 bp, Artificial
  CRISPR gRNA sequence
gaaagaggaaaagtaatcca

SEQ ID NO: 290392 - DNA, 20 bp, Artificial
  CRISPR gRNA sequence
aaatgaatgtgttaaagtgt

SEQ ID NO: 290393 - DNA, 20 bp, Artificial
  CRISPR gRNA sequence
aagtgtggccaacaaacaaa

SEQ ID NO: 290394 - DNA, 20 bp, Artificial
  CRISPR gRNA sequence
tgaaggcagggcacaggcac

SEQ ID NO: 290395 - DNA, 20 bp, Artificial
  CRISPR gRNA sequence
gaaggcagggcacaggcact

SEQ ID NO: 290396 - DNA, 20 bp, Artificial
  CRISPR gRNA sequence
aaggcagggcacaggcactg

SEQ ID NO: 290397 - DNA, 20 bp, Artificial
  CRISPR gRNA sequence
cctgaggaagtgctgtcttc

SEQ ID NO: 290398 - DNA, 20 bp, Artificial
  CRISPR gRNA sequence
aggaagtgctgtcttcctct

SEQ ID NO: 290399 - DNA, 20 bp, Artificial
  CRISPR gRNA sequence
tcttcctctgccagcaagaa

SEQ ID NO: 290400 - DNA, 20 bp, Artificial
  CRISPR gRNA sequence
cctctgccagcaagaagggg

SEQ ID NO: 290401 - DNA, 20 bp, Artificial
  CRISPR gRNA sequence
ctctgccagcaagaaggggc

SEQ ID NO: 290402 - DNA, 20 bp, Artificial
  CRISPR gRNA sequence
tgccagcaagaaggggcagt

SEQ ID NO: 290403 - DNA, 20 bp, Artificial
  CRISPR gRNA sequence
ccagcaagaaggggcagtga

SEQ ID NO: 290404 - DNA, 20 bp, Artificial
  CRISPR gRNA sequence
ggaagtagcagaggagggac

SEQ ID NO: 290405 - DNA, 20 bp, Artificial
  CRISPR gRNA sequence
gcccagtgagcaagaaccgg

SEQ ID NO: 290406 - DNA, 20 bp, Artificial
  CRISPR gRNA sequence
cagcacttgtgagttataat

SEQ ID NO: 290407 - DNA, 20 bp, Artificial
  CRISPR gRNA sequence
gtgagttataatcatgaatc

SEQ ID NO: 290408 - DNA, 20 bp, Artificial
  CRISPR gRNA sequence
tgagttataatcatgaatcc

SEQ ID NO: 290409 - DNA, 20 bp, Artificial
  CRISPR gRNA sequence
taatcatgaatccgcatgtt

SEQ ID NO: 290410 - DNA, 20 bp, Artificial
  CRISPR gRNA sequence
ttcaggaagctggaagggct

SEQ ID NO: 290411 - DNA, 20 bp, Artificial
  CRISPR gRNA sequence
aggaagctggaagggcttta

SEQ ID NO: 290412 - DNA, 20 bp, Artificial
  CRISPR gRNA sequence
gaagggctttacccaggaga

SEQ ID NO: 290413 - DNA, 20 bp, Artificial
  CRISPR gRNA sequence
tacccaggagagtggcgtgg

SEQ ID NO: 290414 - DNA, 20 bp, Artificial
  CRISPR gRNA sequence
acccaggagagtggcgtggt

SEQ ID NO: 290415 - DNA, 20 bp, Artificial
  CRISPR gRNA sequence
cccaggagagtggcgtggtc

SEQ ID NO: 290416 - DNA, 20 bp, Artificial
  CRISPR gRNA sequence
ccccagctctgttcactctt

SEQ ID NO: 290417 - DNA, 20 bp, Artificial
  CRISPR gRNA sequence
tgttcactctttacacatac

SEQ ID NO: 290418 - DNA, 20 bp, Artificial
  CRISPR gRNA sequence
ttcactctttacacatacca

SEQ ID NO: 290419 - DNA, 20 bp, Artificial
  CRISPR gRNA sequence
actctttacacataccaata

SEQ ID NO: 290420 - DNA, 20 bp, Artificial
  CRISPR gRNA sequence
tttacacataccaatagcct

SEQ ID NO: 290421 - DNA, 20 bp, Artificial
  CRISPR gRNA sequence
tacacataccaatagcctgg

SEQ ID NO: 290422 - DNA, 20 bp, Artificial
  CRISPR gRNA sequence
acacataccaatagcctggg

SEQ ID NO: 290423 - DNA, 20 bp, Artificial
  CRISPR gRNA sequence
cacataccaatagcctgggg

SEQ ID NO: 290424 - DNA, 20 bp, Artificial
  CRISPR gRNA sequence
ggggttttgctaaattgcag

SEQ ID NO: 290425 - DNA, 20 bp, Artificial
  CRISPR gRNA sequence
tgctaaattgcagtttctag

SEQ ID NO: 290426 - DNA, 20 bp, Artificial
  CRISPR gRNA sequence
gctaaattgcagtttctagc

SEQ ID NO: 290427 - DNA, 20 bp, Artificial
  CRISPR gRNA sequence
ctaaattgcagtttctagca

SEQ ID NO: 290428 - DNA, 20 bp, Artificial
  CRISPR gRNA sequence
aattgcagtttctagcacag

SEQ ID NO: 290429 - DNA, 20 bp, Artificial
  CRISPR gRNA sequence
cagtttctagcacagggaat

SEQ ID NO: 290430 - DNA, 20 bp, Artificial
  CRISPR gRNA sequence
ctagcacagggaatttttta

SEQ ID NO: 290431 - DNA, 20 bp, Artificial
  CRISPR gRNA sequence
tagcacagggaattttttag

SEQ ID NO: 290432 - DNA, 20 bp, Artificial
  CRISPR gRNA sequence
gcacagggaattttttagag

SEQ ID NO: 290433 - DNA, 20 bp, Artificial
  CRISPR gRNA sequence
tttagagaagtgaatctatt

SEQ ID NO: 290434 - DNA, 20 bp, Artificial
  CRISPR gRNA sequence
ttagagaagtgaatctattt

SEQ ID NO: 290435 - DNA, 20 bp, Artificial
  CRISPR gRNA sequence
tagagaagtgaatctatttt

SEQ ID NO: 290436 - DNA, 20 bp, Artificial
  CRISPR gRNA sequence
agagaagtgaatctattttg

SEQ ID NO: 290437 - DNA, 20 bp, Artificial
  CRISPR gRNA sequence
gagaagtgaatctattttgc

SEQ ID NO: 290438 - DNA, 20 bp, Artificial
  CRISPR gRNA sequence
ttttgcataatactgtaatg

SEQ ID NO: 290439 - DNA, 20 bp, Artificial
  CRISPR gRNA sequence
tgcataatactgtaatgata

SEQ ID NO: 290440 - DNA, 20 bp, Artificial
  CRISPR gRNA sequence
gcataatactgtaatgatag

SEQ ID NO: 290441 - DNA, 20 bp, Artificial
  CRISPR gRNA sequence
cataatactgtaatgataga

SEQ ID NO: 290442 - DNA, 20 bp, Artificial
  CRISPR gRNA sequence
taatgatagatataagtcat

SEQ ID NO: 290443 - DNA, 20 bp, Artificial
  CRISPR gRNA sequence
taaatttgcccaaatccata

SEQ ID NO: 290444 - DNA, 20 bp, Artificial
  CRISPR gRNA sequence
gcccaaatccatagaatatg

SEQ ID NO: 290445 - DNA, 20 bp, Artificial
  CRISPR gRNA sequence
cccaaatccatagaatatgc

SEQ ID NO: 290446 - DNA, 20 bp, Artificial
  CRISPR gRNA sequence
tcgtgaactctagatttggg

SEQ ID NO: 290447 - DNA, 20 bp, Artificial
  CRISPR gRNA sequence
tagatttggggtggtaatga

SEQ ID NO: 290448 - DNA, 20 bp, Artificial
  CRISPR gRNA sequence
gatttggggtggtaatgatg

SEQ ID NO: 290449 - DNA, 20 bp, Artificial
  CRISPR gRNA sequence
ggggtggtaatgatgtgtta

SEQ ID NO: 290450 - DNA, 20 bp, Artificial
  CRISPR gRNA sequence
gggtggtaatgatgtgttaa

SEQ ID NO: 290451 - DNA, 20 bp, Artificial
  CRISPR gRNA sequence
atgtaggttcattgattgta

SEQ ID NO: 290452 - DNA, 20 bp, Artificial
  CRISPR gRNA sequence
attgattgtaacaagtgtac

SEQ ID NO: 290453 - DNA, 20 bp, Artificial
  CRISPR gRNA sequence
attgtaacaagtgtactgcc

SEQ ID NO: 290454 - DNA, 20 bp, Artificial
  CRISPR gRNA sequence
taacaagtgtactgccctgg

SEQ ID NO: 290455 - DNA, 20 bp, Artificial
  CRISPR gRNA sequence
ccctggcgcaggatgtagac

SEQ ID NO: 290456 - DNA, 20 bp, Artificial
  CRISPR gRNA sequence
gcgcaggatgtagacagtgg

SEQ ID NO: 290457 - DNA, 20 bp, Artificial
  CRISPR gRNA sequence
tgaatatgtggggagggggt

SEQ ID NO: 290458 - DNA, 20 bp, Artificial
  CRISPR gRNA sequence
ctttacattcaatttttcga

SEQ ID NO: 290459 - DNA, 20 bp, Artificial
  CRISPR gRNA sequence
tacattcaatttttcgatga

SEQ ID NO: 290460 - DNA, 20 bp, Artificial
  CRISPR gRNA sequence
acattcaatttttcgatgaa

SEQ ID NO: 290461 - DNA, 20 bp, Artificial
  CRISPR gRNA sequence
cattcaatttttcgatgaac

SEQ ID NO: 290462 - DNA, 20 bp, Artificial
  CRISPR gRNA sequence
aatttttcgatgaacctaaa

SEQ ID NO: 290463 - DNA, 20 bp, Artificial
  CRISPR gRNA sequence
ttcgatgaacctaaagcagc

SEQ ID NO: 290464 - DNA, 20 bp, Artificial
  CRISPR gRNA sequence
tcgatgaacctaaagcagct

SEQ ID NO: 290465 - DNA, 20 bp, Artificial
  CRISPR gRNA sequence
cgatgaacctaaagcagctc

SEQ ID NO: 290466 - DNA, 20 bp, Artificial
  CRISPR gRNA sequence
gatgaacctaaagcagctct

SEQ ID NO: 290467 - DNA, 20 bp, Artificial
  CRISPR gRNA sequence
aagcagctctaaaaaataaa

SEQ ID NO: 290468 - DNA, 20 bp, Artificial
  CRISPR gRNA sequence
taaaaaataaagtctatata

SEQ ID NO: 290469 - DNA, 20 bp, Artificial
  CRISPR gRNA sequence
aaaaataaagtctatatagt

SEQ ID NO: 290470 - DNA, 20 bp, Artificial
  CRISPR gRNA sequence
tatagttttttaaatgctgt

SEQ ID NO: 290471 - DNA, 20 bp, Artificial
  CRISPR gRNA sequence
tttaaatgctgtttctgctt

SEQ ID NO: 290472 - DNA, 20 bp, Artificial
  CRISPR gRNA sequence
ttaaatgctgtttctgctta

SEQ ID NO: 290473 - DNA, 20 bp, Artificial
  CRISPR gRNA sequence
taaatgctgtttctgcttag

SEQ ID NO: 290474 - DNA, 20 bp, Artificial
  CRISPR gRNA sequence
aaatgctgtttctgcttagg

SEQ ID NO: 290475 - DNA, 20 bp, Artificial
  CRISPR gRNA sequence
aatgctgtttctgcttaggt

SEQ ID NO: 290476 - DNA, 20 bp, Artificial
  CRISPR gRNA sequence
tttctgcttaggtgggtctg

SEQ ID NO: 290477 - DNA, 20 bp, Artificial
  CRISPR gRNA sequence
ctgcttaggtgggtctggga

SEQ ID NO: 290478 - DNA, 20 bp, Artificial
  CRISPR gRNA sequence
tgcttaggtgggtctgggat

SEQ ID NO: 290479 - DNA, 20 bp, Artificial
  CRISPR gRNA sequence
cttaggtgggtctgggatgg

SEQ ID NO: 290480 - DNA, 20 bp, Artificial
  CRISPR gRNA sequence
aggtgggtctgggatggggc

SEQ ID NO: 290481 - DNA, 20 bp, Artificial
  CRISPR gRNA sequence
ggtgggtctgggatggggcc

SEQ ID NO: 290482 - DNA, 20 bp, Artificial
  CRISPR gRNA sequence
ggatggggcctgagattctg

SEQ ID NO: 290483 - DNA, 20 bp, Artificial
  CRISPR gRNA sequence
agattctgcatttctaagaa

SEQ ID NO: 290484 - DNA, 20 bp, Artificial
  CRISPR gRNA sequence
tgcatttctaagaagcacct

SEQ ID NO: 290485 - DNA, 20 bp, Artificial
  CRISPR gRNA sequence
catttctaagaagcacctag

SEQ ID NO: 290486 - DNA, 20 bp, Artificial
  CRISPR gRNA sequence
ctaagaagcacctaggtgat

SEQ ID NO: 290487 - DNA, 20 bp, Artificial
  CRISPR gRNA sequence
taagaagcacctaggtgatg

SEQ ID NO: 290488 - DNA, 20 bp, Artificial
  CRISPR gRNA sequence
agaagcacctaggtgatgct

SEQ ID NO: 290489 - DNA, 20 bp, Artificial
  CRISPR gRNA sequence
ggtgatgctgatgctgctcc

SEQ ID NO: 290490 - DNA, 20 bp, Artificial
  CRISPR gRNA sequence
atgctgctccaccatacact

SEQ ID NO: 290491 - DNA, 20 bp, Artificial
  CRISPR gRNA sequence
ctccaccatacactttgagt

SEQ ID NO: 290492 - DNA, 20 bp, Artificial
  CRISPR gRNA sequence
caccatacactttgagtttc

SEQ ID NO: 290493 - DNA, 20 bp, Artificial
  CRISPR gRNA sequence
tgagtttcagtagtaaaggt

SEQ ID NO: 290494 - DNA, 20 bp, Artificial
  CRISPR gRNA sequence
gagtttcagtagtaaaggtg

SEQ ID NO: 290495 - DNA, 20 bp, Artificial
  CRISPR gRNA sequence
agtttcagtagtaaaggtgt

SEQ ID NO: 290496 - DNA, 20 bp, Artificial
  CRISPR gRNA sequence
cagtagtaaaggtgtaaata

SEQ ID NO: 290497 - DNA, 20 bp, Artificial
  CRISPR gRNA sequence
agtagtaaaggtgtaaataa

SEQ ID NO: 290498 - DNA, 20 bp, Artificial
  CRISPR gRNA sequence
taaaaggaaaaaagtgttac

SEQ ID NO: 290499 - DNA, 20 bp, Artificial
  CRISPR gRNA sequence
aaaaggaaaaaagtgttact

SEQ ID NO: 290500 - DNA, 20 bp, Artificial
  CRISPR gRNA sequence
aaaggaaaaaagtgttactg

SEQ ID NO: 290501 - DNA, 20 bp, Artificial
  CRISPR gRNA sequence
ctgaagaacagagtggcttg

SEQ ID NO: 290502 - DNA, 20 bp, Artificial
  CRISPR gRNA sequence
aagaacagagtggcttgtag

SEQ ID NO: 290503 - DNA, 20 bp, Artificial
  CRISPR gRNA sequence
gtagggcagccacagtgact

SEQ ID NO: 290504 - DNA, 20 bp, Artificial
  CRISPR gRNA sequence
tagggcagccacagtgactg

SEQ ID NO: 290505 - DNA, 20 bp, Artificial
  CRISPR gRNA sequence
tgcaaaacctattaggaggt

SEQ ID NO: 290506 - DNA, 20 bp, Artificial
  CRISPR gRNA sequence
ttaggaggttatttcagtaa

SEQ ID NO: 290507 - DNA, 20 bp, Artificial
  CRISPR gRNA sequence
ggaggttatttcagtaactt

SEQ ID NO: 290508 - DNA, 20 bp, Artificial
  CRISPR gRNA sequence
tttcagtaacttacagtaac

SEQ ID NO: 290509 - DNA, 20 bp, Artificial
  CRISPR gRNA sequence
cagtaacttacagtaactga

SEQ ID NO: 290510 - DNA, 20 bp, Artificial
  CRISPR gRNA sequence
agtaacttacagtaactgat

SEQ ID NO: 290511 - DNA, 20 bp, Artificial
  CRISPR gRNA sequence
acagtaactgatgatgtctt

SEQ ID NO: 290512 - DNA, 20 bp, Artificial
  CRISPR gRNA sequence
cagtaactgatgatgtcttt

SEQ ID NO: 290513 - DNA, 20 bp, Artificial
  CRISPR gRNA sequence
atgatgtctttaatgaaaag

SEQ ID NO: 290514 - DNA, 20 bp, Artificial
  CRISPR gRNA sequence
taatgaaaagaattggatca

SEQ ID NO: 290515 - DNA, 20 bp, Artificial
  CRISPR gRNA sequence
aatgaaaagaattggatcag

SEQ ID NO: 290516 - DNA, 20 bp, Artificial
  CRISPR gRNA sequence
atgaaaagaattggatcaga

SEQ ID NO: 290517 - DNA, 20 bp, Artificial
  CRISPR gRNA sequence
gatcagaaggaagttgatgg

SEQ ID NO: 290518 - DNA, 20 bp, Artificial
  CRISPR gRNA sequence
atgggttggagagtgtgtac

SEQ ID NO: 290519 - DNA, 20 bp, Artificial
  CRISPR gRNA sequence
gagagtgtgtaccatgtaaa

SEQ ID NO: 290520 - DNA, 20 bp, Artificial
  CRISPR gRNA sequence
gtgaggactgctcaacggga

SEQ ID NO: 290521 - DNA, 20 bp, Artificial
  CRISPR gRNA sequence
ctcaacgggagtgtaggtgt

SEQ ID NO: 290522 - DNA, 20 bp, Artificial
  CRISPR gRNA sequence
aacgggagtgtaggtgtgag

SEQ ID NO: 290523 - DNA, 20 bp, Artificial
  CRISPR gRNA sequence
tgggaggtgagattcagtga

SEQ ID NO: 290524 - DNA, 20 bp, Artificial
  CRISPR gRNA sequence
agtgaatacagtggagtagg

SEQ ID NO: 290525 - DNA, 20 bp, Artificial
  CRISPR gRNA sequence
tagagggctttattcagggc

SEQ ID NO: 290526 - DNA, 20 bp, Artificial
  CRISPR gRNA sequence
tattcagggcagagatttgc

SEQ ID NO: 290527 - DNA, 20 bp, Artificial
  CRISPR gRNA sequence
attcagggcagagatttgcc

SEQ ID NO: 290528 - DNA, 20 bp, Artificial
  CRISPR gRNA sequence
ttcagggcagagatttgcca

SEQ ID NO: 290529 - DNA, 20 bp, Artificial
  CRISPR gRNA sequence
agggcagagatttgccacac

SEQ ID NO: 290530 - DNA, 20 bp, Artificial
  CRISPR gRNA sequence
gccacactaggccttcctct

SEQ ID NO: 290531 - DNA, 20 bp, Artificial
  CRISPR gRNA sequence
ccacactaggccttcctctc

SEQ ID NO: 290532 - DNA, 20 bp, Artificial
  CRISPR gRNA sequence
ggccttcctctcctgccaca

SEQ ID NO: 290533 - DNA, 20 bp, Artificial
  CRISPR gRNA sequence
cctctcctgccacaccatgg

SEQ ID NO: 290534 - DNA, 20 bp, Artificial
  CRISPR gRNA sequence
ctctcctgccacaccatggc

SEQ ID NO: 290535 - DNA, 20 bp, Artificial
  CRISPR gRNA sequence
tcctgccacaccatggcaga

SEQ ID NO: 290536 - DNA, 20 bp, Artificial
  CRISPR gRNA sequence
ctgccacaccatggcagagg

SEQ ID NO: 290537 - DNA, 20 bp, Artificial
  CRISPR gRNA sequence
ccacaccatggcagaggtgt

SEQ ID NO: 290538 - DNA, 20 bp, Artificial
  CRISPR gRNA sequence
cccctctcctcctgcccagc

SEQ ID NO: 290539 - DNA, 20 bp, Artificial
  CRISPR gRNA sequence
tcctcctgcccagccactga

SEQ ID NO: 290540 - DNA, 20 bp, Artificial
  CRISPR gRNA sequence
ctcctgcccagccactgatg

SEQ ID NO: 290541 - DNA, 20 bp, Artificial
  CRISPR gRNA sequence
ctgcccagccactgatgccc

SEQ ID NO: 290542 - DNA, 20 bp, Artificial
  CRISPR gRNA sequence
cccagccactgatgcccagg

SEQ ID NO: 290543 - DNA, 20 bp, Artificial
  CRISPR gRNA sequence
atgcccaggggaagggactc

SEQ ID NO: 290544 - DNA, 20 bp, Artificial
  CRISPR gRNA sequence
ctctttcatgcacagggtgg

SEQ ID NO: 290545 - DNA, 20 bp, Artificial
  CRISPR gRNA sequence
tttcatgcacagggtggaac

SEQ ID NO: 290546 - DNA, 20 bp, Artificial
  CRISPR gRNA sequence
tcatgcacagggtggaacca

SEQ ID NO: 290547 - DNA, 20 bp, Artificial
  CRISPR gRNA sequence
catgcacagggtggaaccag

SEQ ID NO: 290548 - DNA, 20 bp, Artificial
  CRISPR gRNA sequence
atgcacagggtggaaccagc

SEQ ID NO: 290549 - DNA, 20 bp, Artificial
  CRISPR gRNA sequence
ctctccccctctaggcctgc

SEQ ID NO: 290550 - DNA, 20 bp, Artificial
  CRISPR gRNA sequence
tccccctctaggcctgcagg

SEQ ID NO: 290551 - DNA, 20 bp, Artificial
  CRISPR gRNA sequence
cccctctaggcctgcaggca

SEQ ID NO: 290552 - DNA, 20 bp, Artificial
  CRISPR gRNA sequence
taggcctgcaggcactgtct

SEQ ID NO: 290553 - DNA, 20 bp, Artificial
  CRISPR gRNA sequence
ggcctgcaggcactgtctat

SEQ ID NO: 290554 - DNA, 20 bp, Artificial
  CRISPR gRNA sequence
caggcactgtctatggaggc

SEQ ID NO: 290555 - DNA, 20 bp, Artificial
  CRISPR gRNA sequence
tctatggaggcagaaacgcc

SEQ ID NO: 290556 - DNA, 20 bp, Artificial
  CRISPR gRNA sequence
tggaggcagaaacgcctgac

SEQ ID NO: 290557 - DNA, 20 bp, Artificial
  CRISPR gRNA sequence
actttatagtccagcaactg

SEQ ID NO: 290558 - DNA, 20 bp, Artificial
  CRISPR gRNA sequence
tatagtccagcaactggtgg

SEQ ID NO: 290559 - DNA, 20 bp, Artificial
  CRISPR gRNA sequence
atagtccagcaactggtggc

SEQ ID NO: 290560 - DNA, 20 bp, Artificial
  CRISPR gRNA sequence
tagtccagcaactggtggca

SEQ ID NO: 290561 - DNA, 20 bp, Artificial
  CRISPR gRNA sequence
gtggcagtaaggcagaggct

SEQ ID NO: 290562 - DNA, 20 bp, Artificial
  CRISPR gRNA sequence
taacagggcagccctcagag

SEQ ID NO: 290563 - DNA, 20 bp, Artificial
  CRISPR gRNA sequence
acagggcagccctcagaggg

SEQ ID NO: 290564 - DNA, 20 bp, Artificial
  CRISPR gRNA sequence
agagggaccaatgtgggcag

SEQ ID NO: 290565 - DNA, 20 bp, Artificial
  CRISPR gRNA sequence
ttccttcagagctggagtcc

SEQ ID NO: 290566 - DNA, 20 bp, Artificial
  CRISPR gRNA sequence
tccttcagagctggagtcct

SEQ ID NO: 290567 - DNA, 20 bp, Artificial
  CRISPR gRNA sequence
ccttcagagctggagtcctt

SEQ ID NO: 290568 - DNA, 20 bp, Artificial
  CRISPR gRNA sequence
cttcagagctggagtccttt

SEQ ID NO: 290569 - DNA, 20 bp, Artificial
  CRISPR gRNA sequence
cagagctggagtcctttaag

SEQ ID NO: 290570 - DNA, 20 bp, Artificial
  CRISPR gRNA sequence
agagctggagtcctttaaga

SEQ ID NO: 290571 - DNA, 20 bp, Artificial
  CRISPR gRNA sequence
gagtcctttaagagagggtc

SEQ ID NO: 290572 - DNA, 20 bp, Artificial
  CRISPR gRNA sequence
taagagagggtcaggtctaa

SEQ ID NO: 290573 - DNA, 20 bp, Artificial
  CRISPR gRNA sequence
aagagagggtcaggtctaag

SEQ ID NO: 290574 - DNA, 20 bp, Artificial
  CRISPR gRNA sequence
agagagggtcaggtctaagg

SEQ ID NO: 290575 - DNA, 20 bp, Artificial
  CRISPR gRNA sequence
aggagaggggaaaggcctcc

SEQ ID NO: 290576 - DNA, 20 bp, Artificial
  CRISPR gRNA sequence
ctgtaggaggaggcaagaga

SEQ ID NO: 290577 - DNA, 20 bp, Artificial
  CRISPR gRNA sequence
taggaggaggcaagagatgt

SEQ ID NO: 290578 - DNA, 20 bp, Artificial
  CRISPR gRNA sequence
cctataagtttatagtctga

SEQ ID NO: 290579 - DNA, 20 bp, Artificial
  CRISPR gRNA sequence
taagtttatagtctgagaac

SEQ ID NO: 290580 - DNA, 20 bp, Artificial
  CRISPR gRNA sequence
atagtctgagaactcagagc

SEQ ID NO: 290581 - DNA, 20 bp, Artificial
  CRISPR gRNA sequence
tagtctgagaactcagagct

SEQ ID NO: 290582 - DNA, 20 bp, Artificial
  CRISPR gRNA sequence
agaactcagagctaggagaa

SEQ ID NO: 290583 - DNA, 20 bp, Artificial
  CRISPR gRNA sequence
agagctaggagaaaagagaa

SEQ ID NO: 290584 - DNA, 20 bp, Artificial
  CRISPR gRNA sequence
ggagaaaagagaatacccca

SEQ ID NO: 290585 - DNA, 20 bp, Artificial
  CRISPR gRNA sequence
acagaacacatcctcctctc

SEQ ID NO: 290586 - DNA, 20 bp, Artificial
  CRISPR gRNA sequence
ctctccctgcaacacacacc

SEQ ID NO: 290587 - DNA, 20 bp, Artificial
  CRISPR gRNA sequence
tccctgcaacacacaccgct

SEQ ID NO: 290588 - DNA, 20 bp, Artificial
  CRISPR gRNA sequence
cctgcaacacacaccgctat

SEQ ID NO: 290589 - DNA, 20 bp, Artificial
  CRISPR gRNA sequence
caacacacaccgctatgctg

SEQ ID NO: 290590 - DNA, 20 bp, Artificial
  CRISPR gRNA sequence
tgctgctggcccaggggtcc

SEQ ID NO: 290591 - DNA, 20 bp, Artificial
  CRISPR gRNA sequence
ctggcccaggggtcccatga

SEQ ID NO: 290592 - DNA, 20 bp, Artificial
  CRISPR gRNA sequence
gcccaggggtcccatgagca

SEQ ID NO: 290593 - DNA, 20 bp, Artificial
  CRISPR gRNA sequence
ttgccatcatcaccctgaca

SEQ ID NO: 290594 - DNA, 20 bp, Artificial
  CRISPR gRNA sequence
ccatcatcaccctgacaaca

SEQ ID NO: 290595 - DNA, 20 bp, Artificial
  CRISPR gRNA sequence
acaacagctgttcaagtccc

SEQ ID NO: 290596 - DNA, 20 bp, Artificial
  CRISPR gRNA sequence
ttcaagtccctgtgcatttt

SEQ ID NO: 290597 - DNA, 20 bp, Artificial
  CRISPR gRNA sequence
aagtccctgtgcattttaag

SEQ ID NO: 290598 - DNA, 20 bp, Artificial
  CRISPR gRNA sequence
tgcattttaaggatataaat

SEQ ID NO: 290599 - DNA, 20 bp, Artificial
  CRISPR gRNA sequence
taaggatataaatactgttt

SEQ ID NO: 290600 - DNA, 20 bp, Artificial
  CRISPR gRNA sequence
aaggatataaatactgttta

SEQ ID NO: 290601 - DNA, 20 bp, Artificial
  CRISPR gRNA sequence
aggatataaatactgtttag

SEQ ID NO: 290602 - DNA, 20 bp, Artificial
  CRISPR gRNA sequence
tttagaaagagaaaaagtaa

SEQ ID NO: 290603 - DNA, 20 bp, Artificial
  CRISPR gRNA sequence
agaaagagaaaaagtaagga

SEQ ID NO: 290604 - DNA, 20 bp, Artificial
  CRISPR gRNA sequence
gaaagagaaaaagtaaggat

SEQ ID NO: 290605 - DNA, 20 bp, Artificial
  CRISPR gRNA sequence
aacagggggaaaagtcagga

SEQ ID NO: 290606 - DNA, 20 bp, Artificial
  CRISPR gRNA sequence
aagcctgtggctgccagagg

SEQ ID NO: 290607 - DNA, 20 bp, Artificial
  CRISPR gRNA sequence
tggctgccagaggcagctct

SEQ ID NO: 290608 - DNA, 20 bp, Artificial
  CRISPR gRNA sequence
ccagaggcagctctgcctgt

SEQ ID NO: 290609 - DNA, 20 bp, Artificial
  CRISPR gRNA sequence
tgcctgtctcctttgtgtgg

SEQ ID NO: 290610 - DNA, 20 bp, Artificial
  CRISPR gRNA sequence
cctgtctcctttgtgtggct

SEQ ID NO: 290611 - DNA, 20 bp, Artificial
  CRISPR gRNA sequence
tctcctttgtgtggctagca

SEQ ID NO: 290612 - DNA, 20 bp, Artificial
  CRISPR gRNA sequence
ctttgtgtggctagcaccta

SEQ ID NO: 290613 - DNA, 20 bp, Artificial
  CRISPR gRNA sequence
tgtgtggctagcacctagcc

SEQ ID NO: 290614 - DNA, 20 bp, Artificial
  CRISPR gRNA sequence
gtgtggctagcacctagccc

SEQ ID NO: 290615 - DNA, 20 bp, Artificial
  CRISPR gRNA sequence
tgtggctagcacctagccca

SEQ ID NO: 290616 - DNA, 20 bp, Artificial
  CRISPR gRNA sequence
gcacctagcccagggctgac

SEQ ID NO: 290617 - DNA, 20 bp, Artificial
  CRISPR gRNA sequence
gcccagggctgacaccagcc

SEQ ID NO: 290618 - DNA, 20 bp, Artificial
  CRISPR gRNA sequence
acaccagccctgtcggtgct

SEQ ID NO: 290619 - DNA, 20 bp, Artificial
  CRISPR gRNA sequence
tcggtgctagttcacctaat

SEQ ID NO: 290620 - DNA, 20 bp, Artificial
  CRISPR gRNA sequence
gttcacctaatcaaacattt

SEQ ID NO: 290621 - DNA, 20 bp, Artificial
  CRISPR gRNA sequence
acctaatcaaacatttagag

SEQ ID NO: 290622 - DNA, 20 bp, Artificial
  CRISPR gRNA sequence
atcaaacatttagagggggg

SEQ ID NO: 290623 - DNA, 20 bp, Artificial
  CRISPR gRNA sequence
agaggggggtcactcctgtt

SEQ ID NO: 290624 - DNA, 20 bp, Artificial
  CRISPR gRNA sequence
gaggggggtcactcctgttg

SEQ ID NO: 290625 - DNA, 20 bp, Artificial
  CRISPR gRNA sequence
ctgttggaagagtgtgcaca

SEQ ID NO: 290626 - DNA, 20 bp, Artificial
  CRISPR gRNA sequence
ttggaagagtgtgcacaaac

SEQ ID NO: 290627 - DNA, 20 bp, Artificial
  CRISPR gRNA sequence
gaagagtgtgcacaaaccag

SEQ ID NO: 290628 - DNA, 20 bp, Artificial
  CRISPR gRNA sequence
caggtggtgagacaataggt

SEQ ID NO: 290629 - DNA, 20 bp, Artificial
  CRISPR gRNA sequence
tcacgcttttctatatcttc

SEQ ID NO: 290630 - DNA, 20 bp, Artificial
  CRISPR gRNA sequence
cacgcttttctatatcttcc

SEQ ID NO: 290631 - DNA, 20 bp, Artificial
  CRISPR gRNA sequence
acgcttttctatatcttcca

SEQ ID NO: 290632 - DNA, 20 bp, Artificial
  CRISPR gRNA sequence
ttctatatcttccattcttt

SEQ ID NO: 290633 - DNA, 20 bp, Artificial
  CRISPR gRNA sequence
tctatatcttccattctttc

SEQ ID NO: 290634 - DNA, 20 bp, Artificial
  CRISPR gRNA sequence
ctatatcttccattctttct

SEQ ID NO: 290635 - DNA, 20 bp, Artificial
  CRISPR gRNA sequence
tatatcttccattctttcta

SEQ ID NO: 290636 - DNA, 20 bp, Artificial
  CRISPR gRNA sequence
tatcttccattctttctaag

SEQ ID NO: 290637 - DNA, 20 bp, Artificial
  CRISPR gRNA sequence
ccattctttctaagaatgtt

SEQ ID NO: 290638 - DNA, 20 bp, Artificial
  CRISPR gRNA sequence
cattctttctaagaatgttt

SEQ ID NO: 290639 - DNA, 20 bp, Artificial
  CRISPR gRNA sequence
tttctaagaatgtttatttc

SEQ ID NO: 290640 - DNA, 20 bp, Artificial
  CRISPR gRNA sequence
tctaagaatgtttatttcat

SEQ ID NO: 290641 - DNA, 20 bp, Artificial
  CRISPR gRNA sequence
ctaagaatgtttatttcata

SEQ ID NO: 290642 - DNA, 20 bp, Artificial
  CRISPR gRNA sequence
taagaatgtttatttcatag

SEQ ID NO: 290643 - DNA, 20 bp, Artificial
  CRISPR gRNA sequence
agaatgtttatttcatagtc

SEQ ID NO: 290644 - DNA, 20 bp, Artificial
  CRISPR gRNA sequence
atttcatagtcagggaaaat

SEQ ID NO: 290645 - DNA, 20 bp, Artificial
  CRISPR gRNA sequence
tttcatagtcagggaaaatg

SEQ ID NO: 290646 - DNA, 20 bp, Artificial
  CRISPR gRNA sequence
catagtcagggaaaatgttt

SEQ ID NO: 290647 - DNA, 20 bp, Artificial
  CRISPR gRNA sequence
atagtcagggaaaatgttta

SEQ ID NO: 290648 - DNA, 20 bp, Artificial
  CRISPR gRNA sequence
atttaaaaagcacacttgtg

SEQ ID NO: 290649 - DNA, 20 bp, Artificial
  CRISPR gRNA sequence
tttaaaaagcacacttgtgt

SEQ ID NO: 290650 - DNA, 20 bp, Artificial
  CRISPR gRNA sequence
aaaaagcacacttgtgtttc

SEQ ID NO: 290651 - DNA, 20 bp, Artificial
  CRISPR gRNA sequence
aaaagcacacttgtgtttcc

SEQ ID NO: 290652 - DNA, 20 bp, Artificial
  CRISPR gRNA sequence
gtgtttccagggagatcatg

SEQ ID NO: 290653 - DNA, 20 bp, Artificial
  CRISPR gRNA sequence
tgtttccagggagatcatgt

SEQ ID NO: 290654 - DNA, 20 bp, Artificial
  CRISPR gRNA sequence
ccagggagatcatgtatgtc

SEQ ID NO: 290655 - DNA, 20 bp, Artificial
  CRISPR gRNA sequence
cagggagatcatgtatgtcc

SEQ ID NO: 290656 - DNA, 20 bp, Artificial
  CRISPR gRNA sequence
ggtgagttaaaagatgttgt

SEQ ID NO: 290657 - DNA, 20 bp, Artificial
  CRISPR gRNA sequence
gtgagttaaaagatgttgtg

SEQ ID NO: 290658 - DNA, 20 bp, Artificial
  CRISPR gRNA sequence
aaagatgttgtgtcaactgc

SEQ ID NO: 290659 - DNA, 20 bp, Artificial
  CRISPR gRNA sequence
tgtcaactgcttctctccct

SEQ ID NO: 290660 - DNA, 20 bp, Artificial
  CRISPR gRNA sequence
cttctctcccttctccacta

SEQ ID NO: 290661 - DNA, 20 bp, Artificial
  CRISPR gRNA sequence
ctctcccttctccactagca

SEQ ID NO: 290662 - DNA, 20 bp, Artificial
  CRISPR gRNA sequence
tctcccttctccactagcag

SEQ ID NO: 290663 - DNA, 20 bp, Artificial
  CRISPR gRNA sequence
tcccttctccactagcagtg

SEQ ID NO: 290664 - DNA, 20 bp, Artificial
  CRISPR gRNA sequence
ccttctccactagcagtggt

SEQ ID NO: 290665 - DNA, 20 bp, Artificial
  CRISPR gRNA sequence
ctccactagcagtggtgatg

SEQ ID NO: 290666 - DNA, 20 bp, Artificial
  CRISPR gRNA sequence
tccactagcagtggtgatgc

SEQ ID NO: 290667 - DNA, 20 bp, Artificial
  CRISPR gRNA sequence
cactagcagtggtgatgcag

SEQ ID NO: 290668 - DNA, 20 bp, Artificial
  CRISPR gRNA sequence
gcagtggtgatgcagctccc

SEQ ID NO: 290669 - DNA, 20 bp, Artificial
  CRISPR gRNA sequence
ccagacccctgcgagggcag

SEQ ID NO: 290670 - DNA, 20 bp, Artificial
  CRISPR gRNA sequence
cgagggcagcctctctaacg

SEQ ID NO: 290671 - DNA, 20 bp, Artificial
  CRISPR gRNA sequence
tctaacggctgctgaggttg

SEQ ID NO: 290672 - DNA, 20 bp, Artificial
  CRISPR gRNA sequence
taacggctgctgaggttgaa

SEQ ID NO: 290673 - DNA, 20 bp, Artificial
  CRISPR gRNA sequence
acggctgctgaggttgaact

SEQ ID NO: 290674 - DNA, 20 bp, Artificial
  CRISPR gRNA sequence
ctgaggttgaactccctggg

SEQ ID NO: 290675 - DNA, 20 bp, Artificial
  CRISPR gRNA sequence
aggttgaactccctgggagg

SEQ ID NO: 290676 - DNA, 20 bp, Artificial
  CRISPR gRNA sequence
aactccctgggaggggcact

SEQ ID NO: 290677 - DNA, 20 bp, Artificial
  CRISPR gRNA sequence
cctgggaggggcactgcaga

SEQ ID NO: 290678 - DNA, 20 bp, Artificial
  CRISPR gRNA sequence
ggaggggcactgcagactgg

SEQ ID NO: 290679 - DNA, 20 bp, Artificial
  CRISPR gRNA sequence
cagactggccactgcatcct

SEQ ID NO: 290680 - DNA, 20 bp, Artificial
  CRISPR gRNA sequence
gccactgcatcctccaggcc

SEQ ID NO: 290681 - DNA, 20 bp, Artificial
  CRISPR gRNA sequence
catcctccaggcctccaggc

SEQ ID NO: 290682 - DNA, 20 bp, Artificial
  CRISPR gRNA sequence
caggcctccaggctgcacgg

SEQ ID NO: 290683 - DNA, 20 bp, Artificial
  CRISPR gRNA sequence
caggctgcacggagagggtg

SEQ ID NO: 290684 - DNA, 20 bp, Artificial
  CRISPR gRNA sequence
cacggagagggtggggaaga

SEQ ID NO: 290685 - DNA, 20 bp, Artificial
  CRISPR gRNA sequence
aggtcttcctagtatggatt

SEQ ID NO: 290686 - DNA, 20 bp, Artificial
  CRISPR gRNA sequence
cctagtatggattcttcttt

SEQ ID NO: 290687 - DNA, 20 bp, Artificial
  CRISPR gRNA sequence
ctagtatggattcttctttt

SEQ ID NO: 290688 - DNA, 20 bp, Artificial
  CRISPR gRNA sequence
gtatggattcttcttttccc

SEQ ID NO: 290689 - DNA, 20 bp, Artificial
  CRISPR gRNA sequence
ttcttttcccttcatgtttt

SEQ ID NO: 290690 - DNA, 20 bp, Artificial
  CRISPR gRNA sequence
cttttcccttcatgttttat

SEQ ID NO: 290691 - DNA, 20 bp, Artificial
  CRISPR gRNA sequence
ttttcccttcatgttttatt

SEQ ID NO: 290692 - DNA, 20 bp, Artificial
  CRISPR gRNA sequence
ttcccttcatgttttatttg

SEQ ID NO: 290693 - DNA, 20 bp, Artificial
  CRISPR gRNA sequence
tcccttcatgttttatttgc

SEQ ID NO: 290694 - DNA, 20 bp, Artificial
  CRISPR gRNA sequence
cccttcatgttttatttgca

SEQ ID NO: 290695 - DNA, 20 bp, Artificial
  CRISPR gRNA sequence
ccttcatgttttatttgcaa

SEQ ID NO: 290696 - DNA, 20 bp, Artificial
  CRISPR gRNA sequence
catgttttatttgcaatgac

SEQ ID NO: 290697 - DNA, 20 bp, Artificial
  CRISPR gRNA sequence
atgttttatttgcaatgaca

SEQ ID NO: 290698 - DNA, 20 bp, Artificial
  CRISPR gRNA sequence
tatttgcaatgacataaaat

SEQ ID NO: 290699 - DNA, 20 bp, Artificial
  CRISPR gRNA sequence
atttgcaatgacataaaatt

SEQ ID NO: 290700 - DNA, 20 bp, Artificial
  CRISPR gRNA sequence
tttgcaatgacataaaattc

SEQ ID NO: 290701 - DNA, 20 bp, Artificial
  CRISPR gRNA sequence
gcaatgacataaaattcaac

SEQ ID NO: 290702 - DNA, 20 bp, Artificial
  CRISPR gRNA sequence
caatgacataaaattcaacg

SEQ ID NO: 290703 - DNA, 20 bp, Artificial
  CRISPR gRNA sequence
aacgttttaaagtatacaat

SEQ ID NO: 290704 - DNA, 20 bp, Artificial
  CRISPR gRNA sequence
taaagtatacaattcagcca

SEQ ID NO: 290705 - DNA, 20 bp, Artificial
  CRISPR gRNA sequence
aaagtatacaattcagccag

SEQ ID NO: 290706 - DNA, 20 bp, Artificial
  CRISPR gRNA sequence
aagtatacaattcagccagg

SEQ ID NO: 290707 - DNA, 20 bp, Artificial
  CRISPR gRNA sequence
agccaggcacggtggctcac

SEQ ID NO: 290708 - DNA, 20 bp, Artificial
  CRISPR gRNA sequence
actcctgcaatcccagcatt

SEQ ID NO: 290709 - DNA, 20 bp, Artificial
  CRISPR gRNA sequence
ctgcaatcccagcattttgg

SEQ ID NO: 290710 - DNA, 20 bp, Artificial
  CRISPR gRNA sequence
caatcccagcattttgggag

SEQ ID NO: 290711 - DNA, 20 bp, Artificial
  CRISPR gRNA sequence
tgggaggccgagatgggtgg

SEQ ID NO: 290712 - DNA, 20 bp, Artificial
  CRISPR gRNA sequence
gggaggccgagatgggtgga

SEQ ID NO: 290713 - DNA, 20 bp, Artificial
  CRISPR gRNA sequence
ggaggccgagatgggtggat

SEQ ID NO: 290714 - DNA, 20 bp, Artificial
  CRISPR gRNA sequence
aggtcaggagtttgagacca

SEQ ID NO: 290715 - DNA, 20 bp, Artificial
  CRISPR gRNA sequence
gagaccagcctggccaacat

SEQ ID NO: 290716 - DNA, 20 bp, Artificial
  CRISPR gRNA sequence
agaccagcctggccaacatg

SEQ ID NO: 290717 - DNA, 20 bp, Artificial
  CRISPR gRNA sequence
gccaacatggtaaaaccctg

SEQ ID NO: 290718 - DNA, 20 bp, Artificial
  CRISPR gRNA sequence
tctctactaaaaatgcaaaa

SEQ ID NO: 290719 - DNA, 20 bp, Artificial
  CRISPR gRNA sequence
tactaaaaatgcaaaaatta

SEQ ID NO: 290720 - DNA, 20 bp, Artificial
  CRISPR gRNA sequence
ctaaaaatgcaaaaattaac

SEQ ID NO: 290721 - DNA, 20 bp, Artificial
  CRISPR gRNA sequence
aaaatgcaaaaattaaccac

SEQ ID NO: 290722 - DNA, 20 bp, Artificial
  CRISPR gRNA sequence
accacacaaggtggcccgtg

SEQ ID NO: 290723 - DNA, 20 bp, Artificial
  CRISPR gRNA sequence
taatcctagctactcaggag

SEQ ID NO: 290724 - DNA, 20 bp, Artificial
  CRISPR gRNA sequence
aatcctagctactcaggagg

SEQ ID NO: 290725 - DNA, 20 bp, Artificial
  CRISPR gRNA sequence
atcctagctactcaggaggc

SEQ ID NO: 290726 - DNA, 20 bp, Artificial
  CRISPR gRNA sequence
gctactcaggaggctgaggc

SEQ ID NO: 290727 - DNA, 20 bp, Artificial
  CRISPR gRNA sequence
ctcaggaggctgaggcagga

SEQ ID NO: 290728 - DNA, 20 bp, Artificial
  CRISPR gRNA sequence
aggaggctgaggcaggagaa

SEQ ID NO: 290729 - DNA, 20 bp, Artificial
  CRISPR gRNA sequence
aggcaggagaatcttttgaa

SEQ ID NO: 290730 - DNA, 20 bp, Artificial
  CRISPR gRNA sequence
ttgaaccctggaggcggggg

SEQ ID NO: 290731 - DNA, 20 bp, Artificial
  CRISPR gRNA sequence
tgaaccctggaggcgggggt

SEQ ID NO: 290732 - DNA, 20 bp, Artificial
  CRISPR gRNA sequence
gaaccctggaggcgggggtt

SEQ ID NO: 290733 - DNA, 20 bp, Artificial
  CRISPR gRNA sequence
aaccctggaggcgggggttg

SEQ ID NO: 290734 - DNA, 20 bp, Artificial
  CRISPR gRNA sequence
gaggcgggggttgctgtgag

SEQ ID NO: 290735 - DNA, 20 bp, Artificial
  CRISPR gRNA sequence
ctgtgagccaagatcatgcc

SEQ ID NO: 290736 - DNA, 20 bp, Artificial
  CRISPR gRNA sequence
tgagccaagatcatgccact

SEQ ID NO: 290737 - DNA, 20 bp, Artificial
  CRISPR gRNA sequence
cactccagcatgggcaacag

SEQ ID NO: 290738 - DNA, 20 bp, Artificial
  CRISPR gRNA sequence
cagcatgggcaacagagcga

SEQ ID NO: 290739 - DNA, 20 bp, Artificial
  CRISPR gRNA sequence
tgcctcagtaaataaataaa

SEQ ID NO: 290740 - DNA, 20 bp, Artificial
  CRISPR gRNA sequence
cctcagtaaataaataaata

SEQ ID NO: 290741 - DNA, 20 bp, Artificial
  CRISPR gRNA sequence
agtaaataaataaataaata

SEQ ID NO: 290742 - DNA, 20 bp, Artificial
  CRISPR gRNA sequence
agtgggttttagtatatttg

SEQ ID NO: 290743 - DNA, 20 bp, Artificial
  CRISPR gRNA sequence
tagtatatttgcaatgttgt

SEQ ID NO: 290744 - DNA, 20 bp, Artificial
  CRISPR gRNA sequence
agtatatttgcaatgttgtg

SEQ ID NO: 290745 - DNA, 20 bp, Artificial
  CRISPR gRNA sequence
gtatatttgcaatgttgtga

SEQ ID NO: 290746 - DNA, 20 bp, Artificial
  CRISPR gRNA sequence
gcaatgttgtgaaaccacca

SEQ ID NO: 290747 - DNA, 20 bp, Artificial
  CRISPR gRNA sequence
caatgttgtgaaaccaccat

SEQ ID NO: 290748 - DNA, 20 bp, Artificial
  CRISPR gRNA sequence
tgaaaccaccatcactatcg

SEQ ID NO: 290749 - DNA, 20 bp, Artificial
  CRISPR gRNA sequence
tcgaattccagaaggaaatg

SEQ ID NO: 290750 - DNA, 20 bp, Artificial
  CRISPR gRNA sequence
cagaaggaaatgttctggat

SEQ ID NO: 290751 - DNA, 20 bp, Artificial
  CRISPR gRNA sequence
tggatgatgatggaaatcat

SEQ ID NO: 290752 - DNA, 20 bp, Artificial
  CRISPR gRNA sequence
gatgatgatggaaatcatca

SEQ ID NO: 290753 - DNA, 20 bp, Artificial
  CRISPR gRNA sequence
cgcctatttgcagctactcc

SEQ ID NO: 290754 - DNA, 20 bp, Artificial
  CRISPR gRNA sequence
tttgcagctactcctcattc

SEQ ID NO: 290755 - DNA, 20 bp, Artificial
  CRISPR gRNA sequence
gcagctactcctcattcccc

SEQ ID NO: 290756 - DNA, 20 bp, Artificial
  CRISPR gRNA sequence
cagctactcctcattcccct

SEQ ID NO: 290757 - DNA, 20 bp, Artificial
  CRISPR gRNA sequence
ctcctcattcccctgtaccc

SEQ ID NO: 290758 - DNA, 20 bp, Artificial
  CRISPR gRNA sequence
ctcattcccctgtaccccat

SEQ ID NO: 290759 - DNA, 20 bp, Artificial
  CRISPR gRNA sequence
attcccctgtaccccatctc

SEQ ID NO: 290760 - DNA, 20 bp, Artificial
  CRISPR gRNA sequence
ccctgtaccccatctcctcg

SEQ ID NO: 290761 - DNA, 20 bp, Artificial
  CRISPR gRNA sequence
taccccatctcctcgtaacc

SEQ ID NO: 290762 - DNA, 20 bp, Artificial
  CRISPR gRNA sequence
ctcgtaaccactaatttact

SEQ ID NO: 290763 - DNA, 20 bp, Artificial
  CRISPR gRNA sequence
gtaaccactaatttactctc

SEQ ID NO: 290764 - DNA, 20 bp, Artificial
  CRISPR gRNA sequence
atttactctctgtctctatg

SEQ ID NO: 290765 - DNA, 20 bp, Artificial
  CRISPR gRNA sequence
actctctgtctctatgaatt

SEQ ID NO: 290766 - DNA, 20 bp, Artificial
  CRISPR gRNA sequence
ctctctgtctctatgaattt

SEQ ID NO: 290767 - DNA, 20 bp, Artificial
  CRISPR gRNA sequence
tctgtctctatgaatttgcc

SEQ ID NO: 290768 - DNA, 20 bp, Artificial
  CRISPR gRNA sequence
tgtctctatgaatttgcctg

SEQ ID NO: 290769 - DNA, 20 bp, Artificial
  CRISPR gRNA sequence
tctctatgaatttgcctgtt

SEQ ID NO: 290770 - DNA, 20 bp, Artificial
  CRISPR gRNA sequence
tatgaatttgcctgttctag

SEQ ID NO: 290771 - DNA, 20 bp, Artificial
  CRISPR gRNA sequence
tgaatttgcctgttctagac

SEQ ID NO: 290772 - DNA, 20 bp, Artificial
  CRISPR gRNA sequence
gcctgttctagacatttctt

SEQ ID NO: 290773 - DNA, 20 bp, Artificial
  CRISPR gRNA sequence
cctgttctagacatttcttt

SEQ ID NO: 290774 - DNA, 20 bp, Artificial
  CRISPR gRNA sequence
ttctagacatttcttttctc

SEQ ID NO: 290775 - DNA, 20 bp, Artificial
  CRISPR gRNA sequence
tagacatttcttttctcttc

SEQ ID NO: 290776 - DNA, 20 bp, Artificial
  CRISPR gRNA sequence
gacatttcttttctcttcct

SEQ ID NO: 290777 - DNA, 20 bp, Artificial
  CRISPR gRNA sequence
cttttctcttcctttttttc

SEQ ID NO: 290778 - DNA, 20 bp, Artificial
  CRISPR gRNA sequence
ttttctcttcctttttttcc

SEQ ID NO: 290779 - DNA, 20 bp, Artificial
  CRISPR gRNA sequence
ttctcttcctttttttccag

SEQ ID NO: 290780 - DNA, 20 bp, Artificial
  CRISPR gRNA sequence
tctcttcctttttttccaga

SEQ ID NO: 290781 - DNA, 20 bp, Artificial
  CRISPR gRNA sequence
ctcttcctttttttccagaa

SEQ ID NO: 290782 - DNA, 20 bp, Artificial
  CRISPR gRNA sequence
tcttcctttttttccagaat

SEQ ID NO: 290783 - DNA, 20 bp, Artificial
  CRISPR gRNA sequence
ttcctttttttccagaatcc

SEQ ID NO: 290784 - DNA, 20 bp, Artificial
  CRISPR gRNA sequence
cctttttttccagaatccag

SEQ ID NO: 290785 - DNA, 20 bp, Artificial
  CRISPR gRNA sequence
ctttttttccagaatccagg

SEQ ID NO: 290786 - DNA, 20 bp, Artificial
  CRISPR gRNA sequence
tttttccagaatccaggtaa

SEQ ID NO: 290787 - DNA, 20 bp, Artificial
  CRISPR gRNA sequence
ttttccagaatccaggtaag

SEQ ID NO: 290788 - DNA, 20 bp, Artificial
  CRISPR gRNA sequence
tttccagaatccaggtaaga

SEQ ID NO: 290789 - DNA, 20 bp, Artificial
  CRISPR gRNA sequence
ttccagaatccaggtaagaa

SEQ ID NO: 290790 - DNA, 20 bp, Artificial
  CRISPR gRNA sequence
tccagaatccaggtaagaaa

SEQ ID NO: 290791 - DNA, 20 bp, Artificial
  CRISPR gRNA sequence
ccagaatccaggtaagaaag

SEQ ID NO: 290792 - DNA, 20 bp, Artificial
  CRISPR gRNA sequence
cagaatccaggtaagaaaga

SEQ ID NO: 290793 - DNA, 20 bp, Artificial
  CRISPR gRNA sequence
tggacatttcttacaatatg

SEQ ID NO: 290794 - DNA, 20 bp, Artificial
  CRISPR gRNA sequence
gacatttcttacaatatgtg

SEQ ID NO: 290795 - DNA, 20 bp, Artificial
  CRISPR gRNA sequence
cttacaatatgtggcgtttc

SEQ ID NO: 290796 - DNA, 20 bp, Artificial
  CRISPR gRNA sequence
ttacaatatgtggcgtttcg

SEQ ID NO: 290797 - DNA, 20 bp, Artificial
  CRISPR gRNA sequence
acaatatgtggcgtttcgtg

SEQ ID NO: 290798 - DNA, 20 bp, Artificial
  CRISPR gRNA sequence
caatatgtggcgtttcgtga

SEQ ID NO: 290799 - DNA, 20 bp, Artificial
  CRISPR gRNA sequence
cgtgactattttctttcact

SEQ ID NO: 290800 - DNA, 20 bp, Artificial
  CRISPR gRNA sequence
gtgactattttctttcactg

SEQ ID NO: 290801 - DNA, 20 bp, Artificial
  CRISPR gRNA sequence
ttttctttcactgagcatta

SEQ ID NO: 290802 - DNA, 20 bp, Artificial
  CRISPR gRNA sequence
tctttcactgagcattatgt

SEQ ID NO: 290803 - DNA, 20 bp, Artificial
  CRISPR gRNA sequence
ctttcactgagcattatgtc

SEQ ID NO: 290804 - DNA, 20 bp, Artificial
  CRISPR gRNA sequence
tttcactgagcattatgtct

SEQ ID NO: 290805 - DNA, 20 bp, Artificial
  CRISPR gRNA sequence
tcactgagcattatgtcttt

SEQ ID NO: 290806 - DNA, 20 bp, Artificial
  CRISPR gRNA sequence
cactgagcattatgtctttc

SEQ ID NO: 290807 - DNA, 20 bp, Artificial
  CRISPR gRNA sequence
actgagcattatgtctttca

SEQ ID NO: 290808 - DNA, 20 bp, Artificial
  CRISPR gRNA sequence
agcattatgtctttcaggtt

SEQ ID NO: 290809 - DNA, 20 bp, Artificial
  CRISPR gRNA sequence
tgtctttcaggttcatccat

SEQ ID NO: 290810 - DNA, 20 bp, Artificial
  CRISPR gRNA sequence
tcaggttcatccatgttgcg

SEQ ID NO: 290811 - DNA, 20 bp, Artificial
  CRISPR gRNA sequence
caggttcatccatgttgcgt

SEQ ID NO: 290812 - DNA, 20 bp, Artificial
  CRISPR gRNA sequence
aggttcatccatgttgcgta

SEQ ID NO: 290813 - DNA, 20 bp, Artificial
  CRISPR gRNA sequence
atccatgttgcgtatgtctt

SEQ ID NO: 290814 - DNA, 20 bp, Artificial
  CRISPR gRNA sequence
cgtatgtcttagtactccat

SEQ ID NO: 290815 - DNA, 20 bp, Artificial
  CRISPR gRNA sequence
agtactccattcgcttttac

SEQ ID NO: 290816 - DNA, 20 bp, Artificial
  CRISPR gRNA sequence
gtactccattcgcttttacg

SEQ ID NO: 290817 - DNA, 20 bp, Artificial
  CRISPR gRNA sequence
cattcgcttttacggccaaa

SEQ ID NO: 290818 - DNA, 20 bp, Artificial
  CRISPR gRNA sequence
gcttttacggccaaataata

SEQ ID NO: 290819 - DNA, 20 bp, Artificial
  CRISPR gRNA sequence
ttacggccaaataatattct

SEQ ID NO: 290820 - DNA, 20 bp, Artificial
  CRISPR gRNA sequence
tacggccaaataatattctg

SEQ ID NO: 290821 - DNA, 20 bp, Artificial
  CRISPR gRNA sequence
acggccaaataatattctga

SEQ ID NO: 290822 - DNA, 20 bp, Artificial
  CRISPR gRNA sequence
cggccaaataatattctgaa

SEQ ID NO: 290823 - DNA, 20 bp, Artificial
  CRISPR gRNA sequence
tgaaataatattctgttgta

SEQ ID NO: 290824 - DNA, 20 bp, Artificial
  CRISPR gRNA sequence
aaataatattctgttgtaga

SEQ ID NO: 290825 - DNA, 20 bp, Artificial
  CRISPR gRNA sequence
tgttgtagattgagatctat

SEQ ID NO: 290826 - DNA, 20 bp, Artificial
  CRISPR gRNA sequence
ttgtagattgagatctattt

SEQ ID NO: 290827 - DNA, 20 bp, Artificial
  CRISPR gRNA sequence
tagattgagatctatttttt

SEQ ID NO: 290828 - DNA, 20 bp, Artificial
  CRISPR gRNA sequence
agatctattttttctttttg

SEQ ID NO: 290829 - DNA, 20 bp, Artificial
  CRISPR gRNA sequence
ttttttctttttgtagcgat

SEQ ID NO: 290830 - DNA, 20 bp, Artificial
  CRISPR gRNA sequence
tttctttttgtagcgatggg

SEQ ID NO: 290831 - DNA, 20 bp, Artificial
  CRISPR gRNA sequence
ttctttttgtagcgatgggg

SEQ ID NO: 290832 - DNA, 20 bp, Artificial
  CRISPR gRNA sequence
tctttttgtagcgatggggt

SEQ ID NO: 290833 - DNA, 20 bp, Artificial
  CRISPR gRNA sequence
ctttttgtagcgatggggtt

SEQ ID NO: 290834 - DNA, 20 bp, Artificial
  CRISPR gRNA sequence
tttttgtagcgatggggttt

SEQ ID NO: 290835 - DNA, 20 bp, Artificial
  CRISPR gRNA sequence
tttgtagcgatggggttttt

SEQ ID NO: 290836 - DNA, 20 bp, Artificial
  CRISPR gRNA sequence
ttgtagcgatggggtttttg

SEQ ID NO: 290837 - DNA, 20 bp, Artificial
  CRISPR gRNA sequence
tgtagcgatggggtttttgc

SEQ ID NO: 290838 - DNA, 20 bp, Artificial
  CRISPR gRNA sequence
gtagcgatggggtttttgct

SEQ ID NO: 290839 - DNA, 20 bp, Artificial
  CRISPR gRNA sequence
tagcgatggggtttttgcta

SEQ ID NO: 290840 - DNA, 20 bp, Artificial
  CRISPR gRNA sequence
ttgctatgttgcctaggctg

SEQ ID NO: 290841 - DNA, 20 bp, Artificial
  CRISPR gRNA sequence
tgctatgttgcctaggctgg

SEQ ID NO: 290842 - DNA, 20 bp, Artificial
  CRISPR gRNA sequence
gctatgttgcctaggctggt

SEQ ID NO: 290843 - DNA, 20 bp, Artificial
  CRISPR gRNA sequence
ctatgttgcctaggctggtc

SEQ ID NO: 290844 - DNA, 20 bp, Artificial
  CRISPR gRNA sequence
tgttgcctaggctggtctcg

SEQ ID NO: 290845 - DNA, 20 bp, Artificial
  CRISPR gRNA sequence
cctaggctggtctcgatttc

SEQ ID NO: 290846 - DNA, 20 bp, Artificial
  CRISPR gRNA sequence
ggctggtctcgatttcctgg

SEQ ID NO: 290847 - DNA, 20 bp, Artificial
  CRISPR gRNA sequence
gtctcgatttcctgggctca

SEQ ID NO: 290848 - DNA, 20 bp, Artificial
  CRISPR gRNA sequence
gatttcctgggctcaagcaa

SEQ ID NO: 290849 - DNA, 20 bp, Artificial
  CRISPR gRNA sequence
cctgggctcaagcaatccac

SEQ ID NO: 290850 - DNA, 20 bp, Artificial
  CRISPR gRNA sequence
ctgggctcaagcaatccacc

SEQ ID NO: 290851 - DNA, 20 bp, Artificial
  CRISPR gRNA sequence
ggctcaagcaatccacccgc

SEQ ID NO: 290852 - DNA, 20 bp, Artificial
  CRISPR gRNA sequence
aagcaatccacccgccttgg

SEQ ID NO: 290853 - DNA, 20 bp, Artificial
  CRISPR gRNA sequence
ggccagctcccaaagtgctg

SEQ ID NO: 290854 - DNA, 20 bp, Artificial
  CRISPR gRNA sequence
gccagctcccaaagtgctgg

SEQ ID NO: 290855 - DNA, 20 bp, Artificial
  CRISPR gRNA sequence
ccaaagtgctgggattacgg

SEQ ID NO: 290856 - DNA, 20 bp, Artificial
  CRISPR gRNA sequence
ggattacgggtgcctggcct

SEQ ID NO: 290857 - DNA, 20 bp, Artificial
  CRISPR gRNA sequence
cgggtgcctggcctagattg

SEQ ID NO: 290858 - DNA, 20 bp, Artificial
  CRISPR gRNA sequence
gcctagattgagcccttgag

SEQ ID NO: 290859 - DNA, 20 bp, Artificial
  CRISPR gRNA sequence
gattgagcccttgagaggtc

SEQ ID NO: 290860 - DNA, 20 bp, Artificial
  CRISPR gRNA sequence
agcccttgagaggtcctttt

SEQ ID NO: 290861 - DNA, 20 bp, Artificial
  CRISPR gRNA sequence
gagaggtccttttttttttt

SEQ ID NO: 290862 - DNA, 20 bp, Artificial
  CRISPR gRNA sequence
agaggtcctttttttttttt

SEQ ID NO: 290863 - DNA, 20 bp, Artificial
  CRISPR gRNA sequence
tttttttttttttttttttt

SEQ ID NO: 290864 - DNA, 20 bp, Artificial
  CRISPR gRNA sequence
tttttttttttttttttttt

SEQ ID NO: 290865 - DNA, 20 bp, Artificial
  CRISPR gRNA sequence
tttttttttttttttttttt

SEQ ID NO: 290866 - DNA, 20 bp, Artificial
  CRISPR gRNA sequence
tttttttttttttttttttt

SEQ ID NO: 290867 - DNA, 20 bp, Artificial
  CRISPR gRNA sequence
tttttttttttttttttttt

SEQ ID NO: 290868 - DNA, 20 bp, Artificial
  CRISPR gRNA sequence
tttttttttttttttttttg

SEQ ID NO: 290869 - DNA, 20 bp, Artificial
  CRISPR gRNA sequence
ttttttttttttttttttga

SEQ ID NO: 290870 - DNA, 20 bp, Artificial
  CRISPR gRNA sequence
tttttttttttttttttgag

SEQ ID NO: 290871 - DNA, 20 bp, Artificial
  CRISPR gRNA sequence
ttttttttttttttttgaga

SEQ ID NO: 290872 - DNA, 20 bp, Artificial
  CRISPR gRNA sequence
tttttttttttttttgagac

SEQ ID NO: 290873 - DNA, 20 bp, Artificial
  CRISPR gRNA sequence
ttttttttttttttgagaca

SEQ ID NO: 290874 - DNA, 20 bp, Artificial
  CRISPR gRNA sequence
tttttttttttttgagacag

SEQ ID NO: 290875 - DNA, 20 bp, Artificial
  CRISPR gRNA sequence
ttttttttttttgagacaga

SEQ ID NO: 290876 - DNA, 20 bp, Artificial
  CRISPR gRNA sequence
tttttttttttgagacagag

SEQ ID NO: 290877 - DNA, 20 bp, Artificial
  CRISPR gRNA sequence
ttttttttttgagacagagt

SEQ ID NO: 290878 - DNA, 20 bp, Artificial
  CRISPR gRNA sequence
tttttttttgagacagagtc

SEQ ID NO: 290879 - DNA, 20 bp, Artificial
  CRISPR gRNA sequence
ttttttttgagacagagtct

SEQ ID NO: 290880 - DNA, 20 bp, Artificial
  CRISPR gRNA sequence
tttttttgagacagagtctt

SEQ ID NO: 290881 - DNA, 20 bp, Artificial
  CRISPR gRNA sequence
ttttttgagacagagtcttg

SEQ ID NO: 290882 - DNA, 20 bp, Artificial
  CRISPR gRNA sequence
tttttgagacagagtcttgc

SEQ ID NO: 290883 - DNA, 20 bp, Artificial
  CRISPR gRNA sequence
ttttgagacagagtcttgct

SEQ ID NO: 290884 - DNA, 20 bp, Artificial
  CRISPR gRNA sequence
tttgagacagagtcttgctc

SEQ ID NO: 290885 - DNA, 20 bp, Artificial
  CRISPR gRNA sequence
ttgagacagagtcttgctct

SEQ ID NO: 290886 - DNA, 20 bp, Artificial
  CRISPR gRNA sequence
tgagacagagtcttgctctg

SEQ ID NO: 290887 - DNA, 20 bp, Artificial
  CRISPR gRNA sequence
gagacagagtcttgctctgt

SEQ ID NO: 290888 - DNA, 20 bp, Artificial
  CRISPR gRNA sequence
agacagagtcttgctctgtc

SEQ ID NO: 290889 - DNA, 20 bp, Artificial
  CRISPR gRNA sequence
gctctgtcgcccaagctgga

SEQ ID NO: 290890 - DNA, 20 bp, Artificial
  CRISPR gRNA sequence
ctctgtcgcccaagctggag

SEQ ID NO: 290891 - DNA, 20 bp, Artificial
  CRISPR gRNA sequence
tgtcgcccaagctggagtgc

SEQ ID NO: 290892 - DNA, 20 bp, Artificial
  CRISPR gRNA sequence
tcgcccaagctggagtgcag

SEQ ID NO: 290893 - DNA, 20 bp, Artificial
  CRISPR gRNA sequence
gagtgcagtggcacaatctc

SEQ ID NO: 290894 - DNA, 20 bp, Artificial
  CRISPR gRNA sequence
tggctcacagcaagctccgc

SEQ ID NO: 290895 - DNA, 20 bp, Artificial
  CRISPR gRNA sequence
gctcacagcaagctccgcct

SEQ ID NO: 290896 - DNA, 20 bp, Artificial
  CRISPR gRNA sequence
acagcaagctccgcctcccg

SEQ ID NO: 290897 - DNA, 20 bp, Artificial
  CRISPR gRNA sequence
cgcctcccggcttcacgcca

SEQ ID NO: 290898 - DNA, 20 bp, Artificial
  CRISPR gRNA sequence
ccggcttcacgccattctcc

SEQ ID NO: 290899 - DNA, 20 bp, Artificial
  CRISPR gRNA sequence
cacgccattctcctgcctca

SEQ ID NO: 290900 - DNA, 20 bp, Artificial
  CRISPR gRNA sequence
acgccattctcctgcctcag

SEQ ID NO: 290901 - DNA, 20 bp, Artificial
  CRISPR gRNA sequence
tcctgcctcagcctcccgag

SEQ ID NO: 290902 - DNA, 20 bp, Artificial
  CRISPR gRNA sequence
ctgcctcagcctcccgagta

SEQ ID NO: 290903 - DNA, 20 bp, Artificial
  CRISPR gRNA sequence
cctcagcctcccgagtagct

SEQ ID NO: 290904 - DNA, 20 bp, Artificial
  CRISPR gRNA sequence
agcctcccgagtagctggga

SEQ ID NO: 290905 - DNA, 20 bp, Artificial
  CRISPR gRNA sequence
ccgagtagctgggactacag

SEQ ID NO: 290906 - DNA, 20 bp, Artificial
  CRISPR gRNA sequence
ggactacagctcgtaaaagt

SEQ ID NO: 290907 - DNA, 20 bp, Artificial
  CRISPR gRNA sequence
cagctcgtaaaagtcctcca

SEQ ID NO: 290908 - DNA, 20 bp, Artificial
  CRISPR gRNA sequence
gtaaaagtcctccacacaaa

SEQ ID NO: 290909 - DNA, 20 bp, Artificial
  CRISPR gRNA sequence
cacacaaaaatcagcccgcc

SEQ ID NO: 290910 - DNA, 20 bp, Artificial
  CRISPR gRNA sequence
gctaatttattttttttgta

SEQ ID NO: 290911 - DNA, 20 bp, Artificial
  CRISPR gRNA sequence
atttattttttttgtatttt

SEQ ID NO: 290912 - DNA, 20 bp, Artificial
  CRISPR gRNA sequence
attttttttgtatttttagt

SEQ ID NO: 290913 - DNA, 20 bp, Artificial
  CRISPR gRNA sequence
ttttttttgtatttttagta

SEQ ID NO: 290914 - DNA, 20 bp, Artificial
  CRISPR gRNA sequence
tttttgtatttttagtagag

SEQ ID NO: 290915 - DNA, 20 bp, Artificial
  CRISPR gRNA sequence
ttttgtatttttagtagaga

SEQ ID NO: 290916 - DNA, 20 bp, Artificial
  CRISPR gRNA sequence
tttgtatttttagtagagac

SEQ ID NO: 290917 - DNA, 20 bp, Artificial
  CRISPR gRNA sequence
ttgtatttttagtagagacg

SEQ ID NO: 290918 - DNA, 20 bp, Artificial
  CRISPR gRNA sequence
tgtatttttagtagagacgg

SEQ ID NO: 290919 - DNA, 20 bp, Artificial
  CRISPR gRNA sequence
gtatttttagtagagacggg

SEQ ID NO: 290920 - DNA, 20 bp, Artificial
  CRISPR gRNA sequence
tatttttagtagagacgggg

SEQ ID NO: 290921 - DNA, 20 bp, Artificial
  CRISPR gRNA sequence
ttagtagagacggggtttca

SEQ ID NO: 290922 - DNA, 20 bp, Artificial
  CRISPR gRNA sequence
tagtagagacggggtttcac

SEQ ID NO: 290923 - DNA, 20 bp, Artificial
  CRISPR gRNA sequence
agtagagacggggtttcacc

SEQ ID NO: 290924 - DNA, 20 bp, Artificial
  CRISPR gRNA sequence
gtagagacggggtttcaccg

SEQ ID NO: 290925 - DNA, 20 bp, Artificial
  CRISPR gRNA sequence
caccgtattagccaggatga

SEQ ID NO: 290926 - DNA, 20 bp, Artificial
  CRISPR gRNA sequence
accgtattagccaggatgat

SEQ ID NO: 290927 - DNA, 20 bp, Artificial
  CRISPR gRNA sequence
gccaggatgatcttcgagct

SEQ ID NO: 290928 - DNA, 20 bp, Artificial
  CRISPR gRNA sequence
cgagctcctgatccgcctgc

SEQ ID NO: 290929 - DNA, 20 bp, Artificial
  CRISPR gRNA sequence
gagctcctgatccgcctgcc

SEQ ID NO: 290930 - DNA, 20 bp, Artificial
  CRISPR gRNA sequence
ctgatccgcctgcctcggcc

SEQ ID NO: 290931 - DNA, 20 bp, Artificial
  CRISPR gRNA sequence
atccgcctgcctcggcctcc

SEQ ID NO: 290932 - DNA, 20 bp, Artificial
  CRISPR gRNA sequence
cctcggcctcccaaagtgct

SEQ ID NO: 290933 - DNA, 20 bp, Artificial
  CRISPR gRNA sequence
ggcctcccaaagtgctggga

SEQ ID NO: 290934 - DNA, 20 bp, Artificial
  CRISPR gRNA sequence
ccaaagtgctgggattacag

SEQ ID NO: 290935 - DNA, 20 bp, Artificial
  CRISPR gRNA sequence
ggattacaggcgtgagccac

SEQ ID NO: 290936 - DNA, 20 bp, Artificial
  CRISPR gRNA sequence
caggcgtgagccaccacgcc

SEQ ID NO: 290937 - DNA, 20 bp, Artificial
  CRISPR gRNA sequence
tttgtctaaaattcttggtc

SEQ ID NO: 290938 - DNA, 20 bp, Artificial
  CRISPR gRNA sequence
gtctaaaattcttggtctct

SEQ ID NO: 290939 - DNA, 20 bp, Artificial
  CRISPR gRNA sequence
tctaaaattcttggtctcta

SEQ ID NO: 290940 - DNA, 20 bp, Artificial
  CRISPR gRNA sequence
aaattcttggtctctactct

SEQ ID NO: 290941 - DNA, 20 bp, Artificial
  CRISPR gRNA sequence
ttggtctctactcttgttgg

SEQ ID NO: 290942 - DNA, 20 bp, Artificial
  CRISPR gRNA sequence
ggtctctactcttgttggca

SEQ ID NO: 290943 - DNA, 20 bp, Artificial
  CRISPR gRNA sequence
gtctctactcttgttggcaa

SEQ ID NO: 290944 - DNA, 20 bp, Artificial
  CRISPR gRNA sequence
tactcttgttggcaaatagc

SEQ ID NO: 290945 - DNA, 20 bp, Artificial
  CRISPR gRNA sequence
ctcttgttggcaaatagctt

SEQ ID NO: 290946 - DNA, 20 bp, Artificial
  CRISPR gRNA sequence
ttgttggcaaatagcttcct

SEQ ID NO: 290947 - DNA, 20 bp, Artificial
  CRISPR gRNA sequence
gttggcaaatagcttcctct

SEQ ID NO: 290948 - DNA, 20 bp, Artificial
  CRISPR gRNA sequence
ttggcaaatagcttcctctc

SEQ ID NO: 290949 - DNA, 20 bp, Artificial
  CRISPR gRNA sequence
gcaaatagcttcctctcctg

SEQ ID NO: 290950 - DNA, 20 bp, Artificial
  CRISPR gRNA sequence
cctctcctgtgtggctagca

SEQ ID NO: 290951 - DNA, 20 bp, Artificial
  CRISPR gRNA sequence
ctctcctgtgtggctagcag

SEQ ID NO: 290952 - DNA, 20 bp, Artificial
  CRISPR gRNA sequence
tcctgtgtggctagcagtcc

SEQ ID NO: 290953 - DNA, 20 bp, Artificial
  CRISPR gRNA sequence
ctgtgtggctagcagtccag

SEQ ID NO: 290954 - DNA, 20 bp, Artificial
  CRISPR gRNA sequence
tgtggctagcagtccagagt

SEQ ID NO: 290955 - DNA, 20 bp, Artificial
  CRISPR gRNA sequence
gcagtccagagttgaagtgg

SEQ ID NO: 290956 - DNA, 20 bp, Artificial
  CRISPR gRNA sequence
aagtggtcagagcaggaggg

SEQ ID NO: 290957 - DNA, 20 bp, Artificial
  CRISPR gRNA sequence
aggccagcagtgttgagtgt

SEQ ID NO: 290958 - DNA, 20 bp, Artificial
  CRISPR gRNA sequence
agtgtccctattgtgcccta

SEQ ID NO: 290959 - DNA, 20 bp, Artificial
  CRISPR gRNA sequence
ttgtgccctacaggtgggca

SEQ ID NO: 290960 - DNA, 20 bp, Artificial
  CRISPR gRNA sequence
tgccctacaggtgggcagtt

SEQ ID NO: 290961 - DNA, 20 bp, Artificial
  CRISPR gRNA sequence
caggtgggcagtttccatgc

SEQ ID NO: 290962 - DNA, 20 bp, Artificial
  CRISPR gRNA sequence
ccatgcattcgccagaaggc

SEQ ID NO: 290963 - DNA, 20 bp, Artificial
  CRISPR gRNA sequence
catgcattcgccagaaggcg

SEQ ID NO: 290964 - DNA, 20 bp, Artificial
  CRISPR gRNA sequence
gccagaaggcgagcagcgtt

SEQ ID NO: 290965 - DNA, 20 bp, Artificial
  CRISPR gRNA sequence
ccgtccatctctgccttctc

SEQ ID NO: 290966 - DNA, 20 bp, Artificial
  CRISPR gRNA sequence
tgccttctctccgcctcctt

SEQ ID NO: 290967 - DNA, 20 bp, Artificial
  CRISPR gRNA sequence
ccttctctccgcctcctttc

SEQ ID NO: 290968 - DNA, 20 bp, Artificial
  CRISPR gRNA sequence
ctctccgcctcctttcacag

SEQ ID NO: 290969 - DNA, 20 bp, Artificial
  CRISPR gRNA sequence
tctccgcctcctttcacagc

SEQ ID NO: 290970 - DNA, 20 bp, Artificial
  CRISPR gRNA sequence
tccgcctcctttcacagcct

SEQ ID NO: 290971 - DNA, 20 bp, Artificial
  CRISPR gRNA sequence
cgcctcctttcacagcctct

SEQ ID NO: 290972 - DNA, 20 bp, Artificial
  CRISPR gRNA sequence
ctttcacagcctctggccct

SEQ ID NO: 290973 - DNA, 20 bp, Artificial
  CRISPR gRNA sequence
tcacagcctctggccctttc

SEQ ID NO: 290974 - DNA, 20 bp, Artificial
  CRISPR gRNA sequence
cacagcctctggccctttct

SEQ ID NO: 290975 - DNA, 20 bp, Artificial
  CRISPR gRNA sequence
acagcctctggccctttctg

SEQ ID NO: 290976 - DNA, 20 bp, Artificial
  CRISPR gRNA sequence
tggccctttctgactgctgc

SEQ ID NO: 290977 - DNA, 20 bp, Artificial
  CRISPR gRNA sequence
gccctttctgactgctgctg

SEQ ID NO: 290978 - DNA, 20 bp, Artificial
  CRISPR gRNA sequence
tctgactgctgctgggtaga

SEQ ID NO: 290979 - DNA, 20 bp, Artificial
  CRISPR gRNA sequence
ctgactgctgctgggtagag

SEQ ID NO: 290980 - DNA, 20 bp, Artificial
  CRISPR gRNA sequence
tgactgctgctgggtagagg

SEQ ID NO: 290981 - DNA, 20 bp, Artificial
  CRISPR gRNA sequence
actgctgctgggtagaggtg

SEQ ID NO: 290982 - DNA, 20 bp, Artificial
  CRISPR gRNA sequence
ctgctgggtagaggtgcagg

SEQ ID NO: 290983 - DNA, 20 bp, Artificial
  CRISPR gRNA sequence
ctgggtagaggtgcaggagg

SEQ ID NO: 290984 - DNA, 20 bp, Artificial
  CRISPR gRNA sequence
ggtagaggtgcaggaggggc

SEQ ID NO: 290985 - DNA, 20 bp, Artificial
  CRISPR gRNA sequence
cccatgccagctatgggcac

SEQ ID NO: 290986 - DNA, 20 bp, Artificial
  CRISPR gRNA sequence
tgggcactgaactcagttca

SEQ ID NO: 290987 - DNA, 20 bp, Artificial
  CRISPR gRNA sequence
aactcagttcaagaatcagc

SEQ ID NO: 290988 - DNA, 20 bp, Artificial
  CRISPR gRNA sequence
agttcaagaatcagccagtt

SEQ ID NO: 290989 - DNA, 20 bp, Artificial
  CRISPR gRNA sequence
aagaatcagccagttaccat

SEQ ID NO: 290990 - DNA, 20 bp, Artificial
  CRISPR gRNA sequence
ccatggtgatgctggtccta

SEQ ID NO: 290991 - DNA, 20 bp, Artificial
  CRISPR gRNA sequence
gtcctatgggggtgtggttc

SEQ ID NO: 290992 - DNA, 20 bp, Artificial
  CRISPR gRNA sequence
tgggggtgtggttcagcaaa

SEQ ID NO: 290993 - DNA, 20 bp, Artificial
  CRISPR gRNA sequence
agcaaagcaggctgttgtgc

SEQ ID NO: 290994 - DNA, 20 bp, Artificial
  CRISPR gRNA sequence
ttgtgcatgagaaagaacag

SEQ ID NO: 290995 - DNA, 20 bp, Artificial
  CRISPR gRNA sequence
tgcatgagaaagaacagccc

SEQ ID NO: 290996 - DNA, 20 bp, Artificial
  CRISPR gRNA sequence
aaaatctgtagagcattcta

SEQ ID NO: 290997 - DNA, 20 bp, Artificial
  CRISPR gRNA sequence
aaatctgtagagcattctaa

SEQ ID NO: 290998 - DNA, 20 bp, Artificial
  CRISPR gRNA sequence
tagagcattctaaagttaag

SEQ ID NO: 290999 - DNA, 20 bp, Artificial
  CRISPR gRNA sequence
taaagttaagaaagcacttt

SEQ ID NO: 291000 - DNA, 20 bp, Artificial
  CRISPR gRNA sequence
aagttaagaaagcactttac

SEQ ID NO: 291001 - DNA, 20 bp, Artificial
  CRISPR gRNA sequence
agaaagcactttacatctgg

SEQ ID NO: 291002 - DNA, 20 bp, Artificial
  CRISPR gRNA sequence
tacatctggtatcctgtgat

SEQ ID NO: 291003 - DNA, 20 bp, Artificial
  CRISPR gRNA sequence
acatctggtatcctgtgatc

SEQ ID NO: 291004 - DNA, 20 bp, Artificial
  CRISPR gRNA sequence
catctggtatcctgtgatcg

SEQ ID NO: 291005 - DNA, 20 bp, Artificial
  CRISPR gRNA sequence
gtatcctgtgatcgctgtga

SEQ ID NO: 291006 - DNA, 20 bp, Artificial
  CRISPR gRNA sequence
tgatcgctgtgataattatg

SEQ ID NO: 291007 - DNA, 20 bp, Artificial
  CRISPR gRNA sequence
tgataattatgtgaagcagg

SEQ ID NO: 291008 - DNA, 20 bp, Artificial
  CRISPR gRNA sequence
tgtgaagcagggaagatagt

SEQ ID NO: 291009 - DNA, 20 bp, Artificial
  CRISPR gRNA sequence
tctcggtctggtttgtgctg

SEQ ID NO: 291010 - DNA, 20 bp, Artificial
  CRISPR gRNA sequence
ggtctggtttgtgctgctat

SEQ ID NO: 291011 - DNA, 20 bp, Artificial
  CRISPR gRNA sequence
gtttgtgctgctataacaga

SEQ ID NO: 291012 - DNA, 20 bp, Artificial
  CRISPR gRNA sequence
gtgctgctataacagaatac

SEQ ID NO: 291013 - DNA, 20 bp, Artificial
  CRISPR gRNA sequence
tgctgctataacagaatacc

SEQ ID NO: 291014 - DNA, 20 bp, Artificial
  CRISPR gRNA sequence
ctataacagaatacctgaca

SEQ ID NO: 291015 - DNA, 20 bp, Artificial
  CRISPR gRNA sequence
taacagaatacctgacattg

SEQ ID NO: 291016 - DNA, 20 bp, Artificial
  CRISPR gRNA sequence
acattgggtaatttagaaag

SEQ ID NO: 291017 - DNA, 20 bp, Artificial
  CRISPR gRNA sequence
ggtaatttagaaagaacaga

SEQ ID NO: 291018 - DNA, 20 bp, Artificial
  CRISPR gRNA sequence
agaaagaacagagatttatt

SEQ ID NO: 291019 - DNA, 20 bp, Artificial
  CRISPR gRNA sequence
gaaagaacagagatttattt

SEQ ID NO: 291020 - DNA, 20 bp, Artificial
  CRISPR gRNA sequence
atttcttactgttctggagg

SEQ ID NO: 291021 - DNA, 20 bp, Artificial
  CRISPR gRNA sequence
tttcttactgttctggaggc

SEQ ID NO: 291022 - DNA, 20 bp, Artificial
  CRISPR gRNA sequence
cttactgttctggaggctgg

SEQ ID NO: 291023 - DNA, 20 bp, Artificial
  CRISPR gRNA sequence
ttactgttctggaggctggg

SEQ ID NO: 291024 - DNA, 20 bp, Artificial
  CRISPR gRNA sequence
actgttctggaggctgggaa

SEQ ID NO: 291025 - DNA, 20 bp, Artificial
  CRISPR gRNA sequence
ctgttctggaggctgggaag

SEQ ID NO: 291026 - DNA, 20 bp, Artificial
  CRISPR gRNA sequence
ttctggaggctgggaagtcc

SEQ ID NO: 291027 - DNA, 20 bp, Artificial
  CRISPR gRNA sequence
tggaggctgggaagtccaag

SEQ ID NO: 291028 - DNA, 20 bp, Artificial
  CRISPR gRNA sequence
gaggctgggaagtccaaggt

SEQ ID NO: 291029 - DNA, 20 bp, Artificial
  CRISPR gRNA sequence
ggaagtccaaggtcaagggg

SEQ ID NO: 291030 - DNA, 20 bp, Artificial
  CRISPR gRNA sequence
acatctgatgaggaccttct

SEQ ID NO: 291031 - DNA, 20 bp, Artificial
  CRISPR gRNA sequence
atgaggaccttcttgctgca

SEQ ID NO: 291032 - DNA, 20 bp, Artificial
  CRISPR gRNA sequence
cttgctgcatcatcccatgg

SEQ ID NO: 291033 - DNA, 20 bp, Artificial
  CRISPR gRNA sequence
ttgctgcatcatcccatggc

SEQ ID NO: 291034 - DNA, 20 bp, Artificial
  CRISPR gRNA sequence
gctgcatcatcccatggcag

SEQ ID NO: 291035 - DNA, 20 bp, Artificial
  CRISPR gRNA sequence
ctgcatcatcccatggcaga

SEQ ID NO: 291036 - DNA, 20 bp, Artificial
  CRISPR gRNA sequence
catcatcccatggcagagga

SEQ ID NO: 291037 - DNA, 20 bp, Artificial
  CRISPR gRNA sequence
tataaggaagccactcctgc

SEQ ID NO: 291038 - DNA, 20 bp, Artificial
  CRISPR gRNA sequence
ataaggaagccactcctgct

SEQ ID NO: 291039 - DNA, 20 bp, Artificial
  CRISPR gRNA sequence
taaggaagccactcctgctg

SEQ ID NO: 291040 - DNA, 20 bp, Artificial
  CRISPR gRNA sequence
ctgctgtagtgaacccactc

SEQ ID NO: 291041 - DNA, 20 bp, Artificial
  CRISPR gRNA sequence
ctgtagtgaacccactccca

SEQ ID NO: 291042 - DNA, 20 bp, Artificial
  CRISPR gRNA sequence
tagtgaacccactcccaaaa

SEQ ID NO: 291043 - DNA, 20 bp, Artificial
  CRISPR gRNA sequence
ccaaaaaaatggcattaatc

SEQ ID NO: 291044 - DNA, 20 bp, Artificial
  CRISPR gRNA sequence
atccatccatgatggcagag

SEQ ID NO: 291045 - DNA, 20 bp, Artificial
  CRISPR gRNA sequence
catgacctaatcacctttta

SEQ ID NO: 291046 - DNA, 20 bp, Artificial
  CRISPR gRNA sequence
atcaccttttaacagtccca

SEQ ID NO: 291047 - DNA, 20 bp, Artificial
  CRISPR gRNA sequence
ttaacagtcccaattctcaa

SEQ ID NO: 291048 - DNA, 20 bp, Artificial
  CRISPR gRNA sequence
taacagtcccaattctcaac

SEQ ID NO: 291049 - DNA, 20 bp, Artificial
  CRISPR gRNA sequence
aacagtcccaattctcaaca

SEQ ID NO: 291050 - DNA, 20 bp, Artificial
  CRISPR gRNA sequence
acagtcccaattctcaacac

SEQ ID NO: 291051 - DNA, 20 bp, Artificial
  CRISPR gRNA sequence
tcaacactgttgcacccgga

SEQ ID NO: 291052 - DNA, 20 bp, Artificial
  CRISPR gRNA sequence
aacactgttgcacccggaat

SEQ ID NO: 291053 - DNA, 20 bp, Artificial
  CRISPR gRNA sequence
ttgcacccggaattaaattt

SEQ ID NO: 291054 - DNA, 20 bp, Artificial
  CRISPR gRNA sequence
cacccggaattaaatttcca

SEQ ID NO: 291055 - DNA, 20 bp, Artificial
  CRISPR gRNA sequence
aatttccaacacaaaacctt

SEQ ID NO: 291056 - DNA, 20 bp, Artificial
  CRISPR gRNA sequence
ccaacacaaaacctttaggg

SEQ ID NO: 291057 - DNA, 20 bp, Artificial
  CRISPR gRNA sequence
caacacaaaacctttagggg

SEQ ID NO: 291058 - DNA, 20 bp, Artificial
  CRISPR gRNA sequence
taggggacacattcaaatca

SEQ ID NO: 291059 - DNA, 20 bp, Artificial
  CRISPR gRNA sequence
aggggacacattcaaatcat

SEQ ID NO: 291060 - DNA, 20 bp, Artificial
  CRISPR gRNA sequence
ggggacacattcaaatcata

SEQ ID NO: 291061 - DNA, 20 bp, Artificial
  CRISPR gRNA sequence
aaatcatagcaatagtatta

SEQ ID NO: 291062 - DNA, 20 bp, Artificial
  CRISPR gRNA sequence
tgactgttttacagagatgg

SEQ ID NO: 291063 - DNA, 20 bp, Artificial
  CRISPR gRNA sequence
ttttacagagatggaacctg

SEQ ID NO: 291064 - DNA, 20 bp, Artificial
  CRISPR gRNA sequence
tacagagatggaacctgaag

SEQ ID NO: 291065 - DNA, 20 bp, Artificial
  CRISPR gRNA sequence
acagagatggaacctgaagc

SEQ ID NO: 291066 - DNA, 20 bp, Artificial
  CRISPR gRNA sequence
cagagatggaacctgaagcc

SEQ ID NO: 291067 - DNA, 20 bp, Artificial
  CRISPR gRNA sequence
aagcccagagaggttaccca

SEQ ID NO: 291068 - DNA, 20 bp, Artificial
  CRISPR gRNA sequence
cccagcttgctcaaggttat

SEQ ID NO: 291069 - DNA, 20 bp, Artificial
  CRISPR gRNA sequence
gctcaaggttatgattctaa

SEQ ID NO: 291070 - DNA, 20 bp, Artificial
  CRISPR gRNA sequence
ctcaaggttatgattctaat

SEQ ID NO: 291071 - DNA, 20 bp, Artificial
  CRISPR gRNA sequence
aaggttatgattctaataca

SEQ ID NO: 291072 - DNA, 20 bp, Artificial
  CRISPR gRNA sequence
tgattctaatacacagtgga

SEQ ID NO: 291073 - DNA, 20 bp, Artificial
  CRISPR gRNA sequence
taatacacagtggatggagc

SEQ ID NO: 291074 - DNA, 20 bp, Artificial
  CRISPR gRNA sequence
atacacagtggatggagcca

SEQ ID NO: 291075 - DNA, 20 bp, Artificial
  CRISPR gRNA sequence
atttcctcatgcctagacat

SEQ ID NO: 291076 - DNA, 20 bp, Artificial
  CRISPR gRNA sequence
cctcatgcctagacatgcat

SEQ ID NO: 291077 - DNA, 20 bp, Artificial
  CRISPR gRNA sequence
ctcatgcctagacatgcatt

SEQ ID NO: 291078 - DNA, 20 bp, Artificial
  CRISPR gRNA sequence
atgcctagacatgcattcag

SEQ ID NO: 291079 - DNA, 20 bp, Artificial
  CRISPR gRNA sequence
gacatgcattcagcaagtat

SEQ ID NO: 291080 - DNA, 20 bp, Artificial
  CRISPR gRNA sequence
agcaagtatttactgagcac

SEQ ID NO: 291081 - DNA, 20 bp, Artificial
  CRISPR gRNA sequence
actgagcacctactatgggc

SEQ ID NO: 291082 - DNA, 20 bp, Artificial
  CRISPR gRNA sequence
ctgagcacctactatgggcc

SEQ ID NO: 291083 - DNA, 20 bp, Artificial
  CRISPR gRNA sequence
agcacctactatgggccagg

SEQ ID NO: 291084 - DNA, 20 bp, Artificial
  CRISPR gRNA sequence
ctatgggccaggccctgttc

SEQ ID NO: 291085 - DNA, 20 bp, Artificial
  CRISPR gRNA sequence
tgggccaggccctgttctag

SEQ ID NO: 291086 - DNA, 20 bp, Artificial
  CRISPR gRNA sequence
ttctagacactgcagatatg

SEQ ID NO: 291087 - DNA, 20 bp, Artificial
  CRISPR gRNA sequence
tagacactgcagatatggca

SEQ ID NO: 291088 - DNA, 20 bp, Artificial
  CRISPR gRNA sequence
gacactgcagatatggcagt

SEQ ID NO: 291089 - DNA, 20 bp, Artificial
  CRISPR gRNA sequence
cagatatggcagtgaacaaa

SEQ ID NO: 291090 - DNA, 20 bp, Artificial
  CRISPR gRNA sequence
tgctccatagctccatacgt

SEQ ID NO: 291091 - DNA, 20 bp, Artificial
  CRISPR gRNA sequence
ctccatagctccatacgtaa

SEQ ID NO: 291092 - DNA, 20 bp, Artificial
  CRISPR gRNA sequence
catagctccatacgtaatta

SEQ ID NO: 291093 - DNA, 20 bp, Artificial
  CRISPR gRNA sequence
catacgtaattatgtatcac

SEQ ID NO: 291094 - DNA, 20 bp, Artificial
  CRISPR gRNA sequence
tgtatcacatatacctgtaa

SEQ ID NO: 291095 - DNA, 20 bp, Artificial
  CRISPR gRNA sequence
taaatatacatcacagttgt

SEQ ID NO: 291096 - DNA, 20 bp, Artificial
  CRISPR gRNA sequence
taaaaatatatatcagctgg

SEQ ID NO: 291097 - DNA, 20 bp, Artificial
  CRISPR gRNA sequence
gagacaagcctgaagagaaa

SEQ ID NO: 291098 - DNA, 20 bp, Artificial
  CRISPR gRNA sequence
aagagaaacaaatcaggcaa

SEQ ID NO: 291099 - DNA, 20 bp, Artificial
  CRISPR gRNA sequence
aagagtagcaggatggaggg

SEQ ID NO: 291100 - DNA, 20 bp, Artificial
  CRISPR gRNA sequence
ttcaaggagagtcagggaag

SEQ ID NO: 291101 - DNA, 20 bp, Artificial
  CRISPR gRNA sequence
aaggagagtcagggaaggcc

SEQ ID NO: 291102 - DNA, 20 bp, Artificial
  CRISPR gRNA sequence
tttgacaaggggccacgaga

SEQ ID NO: 291103 - DNA, 20 bp, Artificial
  CRISPR gRNA sequence
tgacaaggggccacgagagt

SEQ ID NO: 291104 - DNA, 20 bp, Artificial
  CRISPR gRNA sequence
gacaaggggccacgagagta

SEQ ID NO: 291105 - DNA, 20 bp, Artificial
  CRISPR gRNA sequence
acaaggggccacgagagtag

SEQ ID NO: 291106 - DNA, 20 bp, Artificial
  CRISPR gRNA sequence
aactgtgtggatctctgggg

SEQ ID NO: 291107 - DNA, 20 bp, Artificial
  CRISPR gRNA sequence
tgtggatctctggggaagac

SEQ ID NO: 291108 - DNA, 20 bp, Artificial
  CRISPR gRNA sequence
tggggaagacactggctccc

SEQ ID NO: 291109 - DNA, 20 bp, Artificial
  CRISPR gRNA sequence
gggaagacactggctccctc

SEQ ID NO: 291110 - DNA, 20 bp, Artificial
  CRISPR gRNA sequence
gctccctctaatgtcctagg

SEQ ID NO: 291111 - DNA, 20 bp, Artificial
  CRISPR gRNA sequence
cctctaatgtcctaggtact

SEQ ID NO: 291112 - DNA, 20 bp, Artificial
  CRISPR gRNA sequence
taatgtcctaggtactgtgg

SEQ ID NO: 291113 - DNA, 20 bp, Artificial
  CRISPR gRNA sequence
atgtcctaggtactgtggag

SEQ ID NO: 291114 - DNA, 20 bp, Artificial
  CRISPR gRNA sequence
ggtactgtggaggactttta

SEQ ID NO: 291115 - DNA, 20 bp, Artificial
  CRISPR gRNA sequence
tggaggacttttatgagcag

SEQ ID NO: 291116 - DNA, 20 bp, Artificial
  CRISPR gRNA sequence
ttatgagcagtatctcattt

SEQ ID NO: 291117 - DNA, 20 bp, Artificial
  CRISPR gRNA sequence
tatgagcagtatctcatttt

SEQ ID NO: 291118 - DNA, 20 bp, Artificial
  CRISPR gRNA sequence
atgagcagtatctcattttg

SEQ ID NO: 291119 - DNA, 20 bp, Artificial
  CRISPR gRNA sequence
tgagcagtatctcattttga

SEQ ID NO: 291120 - DNA, 20 bp, Artificial
  CRISPR gRNA sequence
attttgaatccttgcaccca

SEQ ID NO: 291121 - DNA, 20 bp, Artificial
  CRISPR gRNA sequence
tgaatccttgcacccactgg

SEQ ID NO: 291122 - DNA, 20 bp, Artificial
  CRISPR gRNA sequence
gaatccttgcacccactggg

SEQ ID NO: 291123 - DNA, 20 bp, Artificial
  CRISPR gRNA sequence
aatccttgcacccactgggt

SEQ ID NO: 291124 - DNA, 20 bp, Artificial
  CRISPR gRNA sequence
gcacccactgggttgggtag

SEQ ID NO: 291125 - DNA, 20 bp, Artificial
  CRISPR gRNA sequence
cacccactgggttgggtagg

SEQ ID NO: 291126 - DNA, 20 bp, Artificial
  CRISPR gRNA sequence
ggttgggtaggtgttacaat

SEQ ID NO: 291127 - DNA, 20 bp, Artificial
  CRISPR gRNA sequence
ggtaggtgttacaatgccca

SEQ ID NO: 291128 - DNA, 20 bp, Artificial
  CRISPR gRNA sequence
caatgcccattcaaaaatgg

SEQ ID NO: 291129 - DNA, 20 bp, Artificial
  CRISPR gRNA sequence
aaaaatggcaaagcaagctc

SEQ ID NO: 291130 - DNA, 20 bp, Artificial
  CRISPR gRNA sequence
agaagttcaaccaggtttga

SEQ ID NO: 291131 - DNA, 20 bp, Artificial
  CRISPR gRNA sequence
aaccaggtttgagacagtaa

SEQ ID NO: 291132 - DNA, 20 bp, Artificial
  CRISPR gRNA sequence
gagacagtaatattgagatt

SEQ ID NO: 291133 - DNA, 20 bp, Artificial
  CRISPR gRNA sequence
agacagtaatattgagattt

SEQ ID NO: 291134 - DNA, 20 bp, Artificial
  CRISPR gRNA sequence
agatttccaggtgctgactt

SEQ ID NO: 291135 - DNA, 20 bp, Artificial
  CRISPR gRNA sequence
ccaggtgctgactttccccg

SEQ ID NO: 291136 - DNA, 20 bp, Artificial
  CRISPR gRNA sequence
caggtgctgactttccccgc

SEQ ID NO: 291137 - DNA, 20 bp, Artificial
  CRISPR gRNA sequence
actttccccgccagtcactg

SEQ ID NO: 291138 - DNA, 20 bp, Artificial
  CRISPR gRNA sequence
tccccgccagtcactgaagc

SEQ ID NO: 291139 - DNA, 20 bp, Artificial
  CRISPR gRNA sequence
ccccgccagtcactgaagca

SEQ ID NO: 291140 - DNA, 20 bp, Artificial
  CRISPR gRNA sequence
cccgccagtcactgaagcag

SEQ ID NO: 291141 - DNA, 20 bp, Artificial
  CRISPR gRNA sequence
aagcagacaaaatcgttaga

SEQ ID NO: 291142 - DNA, 20 bp, Artificial
  CRISPR gRNA sequence
gagacatttccgtttcaact

SEQ ID NO: 291143 - DNA, 20 bp, Artificial
  CRISPR gRNA sequence
ccgtttcaactgctttttgt

SEQ ID NO: 291144 - DNA, 20 bp, Artificial
  CRISPR gRNA sequence
cgtttcaactgctttttgtc

SEQ ID NO: 291145 - DNA, 20 bp, Artificial
  CRISPR gRNA sequence
caactgctttttgtccgtgt

SEQ ID NO: 291146 - DNA, 20 bp, Artificial
  CRISPR gRNA sequence
aactgctttttgtccgtgtg

SEQ ID NO: 291147 - DNA, 20 bp, Artificial
  CRISPR gRNA sequence
ctttttgtccgtgtgtgatg

SEQ ID NO: 291148 - DNA, 20 bp, Artificial
  CRISPR gRNA sequence
tttgtccgtgtgtgatggag

SEQ ID NO: 291149 - DNA, 20 bp, Artificial
  CRISPR gRNA sequence
ttgtccgtgtgtgatggagt

SEQ ID NO: 291150 - DNA, 20 bp, Artificial
  CRISPR gRNA sequence
tgtccgtgtgtgatggagtc

SEQ ID NO: 291151 - DNA, 20 bp, Artificial
  CRISPR gRNA sequence
gtccgtgtgtgatggagtcc

SEQ ID NO: 291152 - DNA, 20 bp, Artificial
  CRISPR gRNA sequence
tccgtgtgtgatggagtccc

SEQ ID NO: 291153 - DNA, 20 bp, Artificial
  CRISPR gRNA sequence
aaacagacaaaactgatata

SEQ ID NO: 291154 - DNA, 20 bp, Artificial
  CRISPR gRNA sequence
atataaatttgggcaaattt

SEQ ID NO: 291155 - DNA, 20 bp, Artificial
  CRISPR gRNA sequence
gggcaaatttataatgactg

SEQ ID NO: 291156 - DNA, 20 bp, Artificial
  CRISPR gRNA sequence
ggcaaatttataatgactgt

SEQ ID NO: 291157 - DNA, 20 bp, Artificial
  CRISPR gRNA sequence
ataatgactgttttctgtct

SEQ ID NO: 291158 - DNA, 20 bp, Artificial
  CRISPR gRNA sequence
taatgactgttttctgtctc

SEQ ID NO: 291159 - DNA, 20 bp, Artificial
  CRISPR gRNA sequence
ttttctgtctctgtgtggtg

SEQ ID NO: 291160 - DNA, 20 bp, Artificial
  CRISPR gRNA sequence
tctgtctctgtgtggtggaa

SEQ ID NO: 291161 - DNA, 20 bp, Artificial
  CRISPR gRNA sequence
ctgtctctgtgtggtggaat

SEQ ID NO: 291162 - DNA, 20 bp, Artificial
  CRISPR gRNA sequence
tgtctctgtgtggtggaatc

SEQ ID NO: 291163 - DNA, 20 bp, Artificial
  CRISPR gRNA sequence
tctctgtgtggtggaatccc

SEQ ID NO: 291164 - DNA, 20 bp, Artificial
  CRISPR gRNA sequence
tgtgtggtggaatcccgaaa

SEQ ID NO: 291165 - DNA, 20 bp, Artificial
  CRISPR gRNA sequence
tgtggtggaatcccgaaaac

SEQ ID NO: 291166 - DNA, 20 bp, Artificial
  CRISPR gRNA sequence
ggttcccgtgtgaatttcca

SEQ ID NO: 291167 - DNA, 20 bp, Artificial
  CRISPR gRNA sequence
ccgtgtgaatttccaaattg

SEQ ID NO: 291168 - DNA, 20 bp, Artificial
  CRISPR gRNA sequence
ccaaattgttcggaagattt

SEQ ID NO: 291169 - DNA, 20 bp, Artificial
  CRISPR gRNA sequence
caaattgttcggaagatttt

SEQ ID NO: 291170 - DNA, 20 bp, Artificial
  CRISPR gRNA sequence
ttcggaagattttgggttcc

SEQ ID NO: 291171 - DNA, 20 bp, Artificial
  CRISPR gRNA sequence
ggaagattttgggttcctct

SEQ ID NO: 291172 - DNA, 20 bp, Artificial
  CRISPR gRNA sequence
tgggttcctctttttagtcc

SEQ ID NO: 291173 - DNA, 20 bp, Artificial
  CRISPR gRNA sequence
gggttcctctttttagtcct

SEQ ID NO: 291174 - DNA, 20 bp, Artificial
  CRISPR gRNA sequence
ggttcctctttttagtcctg

SEQ ID NO: 291175 - DNA, 20 bp, Artificial
  CRISPR gRNA sequence
ctctttttagtcctgttctt

SEQ ID NO: 291176 - DNA, 20 bp, Artificial
  CRISPR gRNA sequence
tttttagtcctgttcttctt

SEQ ID NO: 291177 - DNA, 20 bp, Artificial
  CRISPR gRNA sequence
tttagtcctgttcttcttca

SEQ ID NO: 291178 - DNA, 20 bp, Artificial
  CRISPR gRNA sequence
ttagtcctgttcttcttcac

SEQ ID NO: 291179 - DNA, 20 bp, Artificial
  CRISPR gRNA sequence
tagtcctgttcttcttcact

SEQ ID NO: 291180 - DNA, 20 bp, Artificial
  CRISPR gRNA sequence
agtcctgttcttcttcactc

SEQ ID NO: 291181 - DNA, 20 bp, Artificial
  CRISPR gRNA sequence
gtcctgttcttcttcactct

SEQ ID NO: 291182 - DNA, 20 bp, Artificial
  CRISPR gRNA sequence
ttcttcttcactcttctcct

SEQ ID NO: 291183 - DNA, 20 bp, Artificial
  CRISPR gRNA sequence
ttcttcactcttctcctcag

SEQ ID NO: 291184 - DNA, 20 bp, Artificial
  CRISPR gRNA sequence
cttcactcttctcctcagaa

SEQ ID NO: 291185 - DNA, 20 bp, Artificial
  CRISPR gRNA sequence
ttcactcttctcctcagaag

SEQ ID NO: 291186 - DNA, 20 bp, Artificial
  CRISPR gRNA sequence
cactcttctcctcagaaggc

SEQ ID NO: 291187 - DNA, 20 bp, Artificial
  CRISPR gRNA sequence
actcttctcctcagaaggct

SEQ ID NO: 291188 - DNA, 20 bp, Artificial
  CRISPR gRNA sequence
ttctcctcagaaggctggac

SEQ ID NO: 291189 - DNA, 20 bp, Artificial
  CRISPR gRNA sequence
ctcctcagaaggctggacaa

SEQ ID NO: 291190 - DNA, 20 bp, Artificial
  CRISPR gRNA sequence
tcctcagaaggctggacaaa

SEQ ID NO: 291191 - DNA, 20 bp, Artificial
  CRISPR gRNA sequence
ctcagaaggctggacaaaaa

SEQ ID NO: 291192 - DNA, 20 bp, Artificial
  CRISPR gRNA sequence
agaaggctggacaaaaactc

SEQ ID NO: 291193 - DNA, 20 bp, Artificial
  CRISPR gRNA sequence
gacaaaaactcctcagaagc

SEQ ID NO: 291194 - DNA, 20 bp, Artificial
  CRISPR gRNA sequence
ctcagaagccatcaccaaaa

SEQ ID NO: 291195 - DNA, 20 bp, Artificial
  CRISPR gRNA sequence
agaagccatcaccaaaatta

SEQ ID NO: 291196 - DNA, 20 bp, Artificial
  CRISPR gRNA sequence
gatagtctctctttcagcta

SEQ ID NO: 291197 - DNA, 20 bp, Artificial
  CRISPR gRNA sequence
tctttcagctatgctttcac

SEQ ID NO: 291198 - DNA, 20 bp, Artificial
  CRISPR gRNA sequence
tttcagctatgctttcactt

SEQ ID NO: 291199 - DNA, 20 bp, Artificial
  CRISPR gRNA sequence
tcagctatgctttcactttt

SEQ ID NO: 291200 - DNA, 20 bp, Artificial
  CRISPR gRNA sequence
cagctatgctttcacttttg

SEQ ID NO: 291201 - DNA, 20 bp, Artificial
  CRISPR gRNA sequence
agctatgctttcacttttgc

SEQ ID NO: 291202 - DNA, 20 bp, Artificial
  CRISPR gRNA sequence
tgctttcacttttgctaaca

SEQ ID NO: 291203 - DNA, 20 bp, Artificial
  CRISPR gRNA sequence
tcacttttgctaacatcacc

SEQ ID NO: 291204 - DNA, 20 bp, Artificial
  CRISPR gRNA sequence
cacttttgctaacatcacca

SEQ ID NO: 291205 - DNA, 20 bp, Artificial
  CRISPR gRNA sequence
acttttgctaacatcaccac

SEQ ID NO: 291206 - DNA, 20 bp, Artificial
  CRISPR gRNA sequence
ttgctaacatcaccacatac

SEQ ID NO: 291207 - DNA, 20 bp, Artificial
  CRISPR gRNA sequence
tgctaacatcaccacatacc

SEQ ID NO: 291208 - DNA, 20 bp, Artificial
  CRISPR gRNA sequence
gctaacatcaccacatacca

SEQ ID NO: 291209 - DNA, 20 bp, Artificial
  CRISPR gRNA sequence
ctaacatcaccacataccaa

SEQ ID NO: 291210 - DNA, 20 bp, Artificial
  CRISPR gRNA sequence
acatcaccacataccaaaat

SEQ ID NO: 291211 - DNA, 20 bp, Artificial
  CRISPR gRNA sequence
gattctttttggctgggaat

SEQ ID NO: 291212 - DNA, 20 bp, Artificial
  CRISPR gRNA sequence
tttttggctgggaatgaata

SEQ ID NO: 291213 - DNA, 20 bp, Artificial
  CRISPR gRNA sequence
tttggctgggaatgaatagt

SEQ ID NO: 291214 - DNA, 20 bp, Artificial
  CRISPR gRNA sequence
ttggctgggaatgaatagtt

SEQ ID NO: 291215 - DNA, 20 bp, Artificial
  CRISPR gRNA sequence
tggctgggaatgaatagttc

SEQ ID NO: 291216 - DNA, 20 bp, Artificial
  CRISPR gRNA sequence
ggctgggaatgaatagttcg

SEQ ID NO: 291217 - DNA, 20 bp, Artificial
  CRISPR gRNA sequence
gctgggaatgaatagttcgg

SEQ ID NO: 291218 - DNA, 20 bp, Artificial
  CRISPR gRNA sequence
ggaatgaatagttcggtggg

SEQ ID NO: 291219 - DNA, 20 bp, Artificial
  CRISPR gRNA sequence
ggtggggaaagaccctatta

SEQ ID NO: 291220 - DNA, 20 bp, Artificial
  CRISPR gRNA sequence
ttattgggaggcccagacaa

SEQ ID NO: 291221 - DNA, 20 bp, Artificial
  CRISPR gRNA sequence
ttgggaggcccagacaagtg

SEQ ID NO: 291222 - DNA, 20 bp, Artificial
  CRISPR gRNA sequence
ggaggcccagacaagtgagt

SEQ ID NO: 291223 - DNA, 20 bp, Artificial
  CRISPR gRNA sequence
ctgtctgtctggcccatagc

SEQ ID NO: 291224 - DNA, 20 bp, Artificial
  CRISPR gRNA sequence
tctgtctggcccatagcaag

SEQ ID NO: 291225 - DNA, 20 bp, Artificial
  CRISPR gRNA sequence
tctggcccatagcaagacca

SEQ ID NO: 291226 - DNA, 20 bp, Artificial
  CRISPR gRNA sequence
gcccatagcaagaccagagt

SEQ ID NO: 291227 - DNA, 20 bp, Artificial
  CRISPR gRNA sequence
tatatctgacataacccttg

SEQ ID NO: 291228 - DNA, 20 bp, Artificial
  CRISPR gRNA sequence
acataacccttgagtgaaat

SEQ ID NO: 291229 - DNA, 20 bp, Artificial
  CRISPR gRNA sequence
gagtgaaatgaaaggtaaga

SEQ ID NO: 291230 - DNA, 20 bp, Artificial
  CRISPR gRNA sequence
agtgaaatgaaaggtaagag

SEQ ID NO: 291231 - DNA, 20 bp, Artificial
  CRISPR gRNA sequence
gcagtgggaggagggagaaa

SEQ ID NO: 291232 - DNA, 20 bp, Artificial
  CRISPR gRNA sequence
ttacagaagacctgctatgt

SEQ ID NO: 291233 - DNA, 20 bp, Artificial
  CRISPR gRNA sequence
acagaagacctgctatgtcc

SEQ ID NO: 291234 - DNA, 20 bp, Artificial
  CRISPR gRNA sequence
cagaagacctgctatgtcct

SEQ ID NO: 291235 - DNA, 20 bp, Artificial
  CRISPR gRNA sequence
ctatgtccttgggacttttt

SEQ ID NO: 291236 - DNA, 20 bp, Artificial
  CRISPR gRNA sequence
tgtccttgggactttttatt

SEQ ID NO: 291237 - DNA, 20 bp, Artificial
  CRISPR gRNA sequence
gggactttttatttatatca

SEQ ID NO: 291238 - DNA, 20 bp, Artificial
  CRISPR gRNA sequence
ggactttttatttatatcat

SEQ ID NO: 291239 - DNA, 20 bp, Artificial
  CRISPR gRNA sequence
tttatttatatcatttaatt

SEQ ID NO: 291240 - DNA, 20 bp, Artificial
  CRISPR gRNA sequence
ttatttatatcatttaattg

SEQ ID NO: 291241 - DNA, 20 bp, Artificial
  CRISPR gRNA sequence
tatttatatcatttaattga

SEQ ID NO: 291242 - DNA, 20 bp, Artificial
  CRISPR gRNA sequence
atttatatcatttaattgaa

SEQ ID NO: 291243 - DNA, 20 bp, Artificial
  CRISPR gRNA sequence
tttatatcatttaattgaac

SEQ ID NO: 291244 - DNA, 20 bp, Artificial
  CRISPR gRNA sequence
atatcatttaattgaactga

SEQ ID NO: 291245 - DNA, 20 bp, Artificial
  CRISPR gRNA sequence
tatcatttaattgaactgaa

SEQ ID NO: 291246 - DNA, 20 bp, Artificial
  CRISPR gRNA sequence
aattgaactgaattttccag

SEQ ID NO: 291247 - DNA, 20 bp, Artificial
  CRISPR gRNA sequence
attgaactgaattttccagt

SEQ ID NO: 291248 - DNA, 20 bp, Artificial
  CRISPR gRNA sequence
aactgaattttccagtgatc

SEQ ID NO: 291249 - DNA, 20 bp, Artificial
  CRISPR gRNA sequence
aattttccagtgatcccaag

SEQ ID NO: 291250 - DNA, 20 bp, Artificial
  CRISPR gRNA sequence
tccagtgatcccaaggggta

SEQ ID NO: 291251 - DNA, 20 bp, Artificial
  CRISPR gRNA sequence
ccagtgatcccaaggggtag

SEQ ID NO: 291252 - DNA, 20 bp, Artificial
  CRISPR gRNA sequence
cagtgatcccaaggggtagg

SEQ ID NO: 291253 - DNA, 20 bp, Artificial
  CRISPR gRNA sequence
tttagagatgaagaaacaga

SEQ ID NO: 291254 - DNA, 20 bp, Artificial
  CRISPR gRNA sequence
agagatgaagaaacagatga

SEQ ID NO: 291255 - DNA, 20 bp, Artificial
  CRISPR gRNA sequence
gagatgaagaaacagatgaa

SEQ ID NO: 291256 - DNA, 20 bp, Artificial
  CRISPR gRNA sequence
agctgggactagaatccaag

SEQ ID NO: 291257 - DNA, 20 bp, Artificial
  CRISPR gRNA sequence
ggactagaatccaagtcaat

SEQ ID NO: 291258 - DNA, 20 bp, Artificial
  CRISPR gRNA sequence
gaatccaagtcaatggagat

SEQ ID NO: 291259 - DNA, 20 bp, Artificial
  CRISPR gRNA sequence
cttctacgtctcattttgct

SEQ ID NO: 291260 - DNA, 20 bp, Artificial
  CRISPR gRNA sequence
ctacgtctcattttgctttc

SEQ ID NO: 291261 - DNA, 20 bp, Artificial
  CRISPR gRNA sequence
tacgtctcattttgctttcc

SEQ ID NO: 291262 - DNA, 20 bp, Artificial
  CRISPR gRNA sequence
cgtctcattttgctttcctt

SEQ ID NO: 291263 - DNA, 20 bp, Artificial
  CRISPR gRNA sequence
attttgctttccttgcaaca

SEQ ID NO: 291264 - DNA, 20 bp, Artificial
  CRISPR gRNA sequence
tgctttccttgcaacactag

SEQ ID NO: 291265 - DNA, 20 bp, Artificial
  CRISPR gRNA sequence
gctttccttgcaacactagg

SEQ ID NO: 291266 - DNA, 20 bp, Artificial
  CRISPR gRNA sequence
ctttccttgcaacactagga

SEQ ID NO: 291267 - DNA, 20 bp, Artificial
  CRISPR gRNA sequence
tccttgcaacactaggagtg

SEQ ID NO: 291268 - DNA, 20 bp, Artificial
  CRISPR gRNA sequence
ccttgcaacactaggagtgt

SEQ ID NO: 291269 - DNA, 20 bp, Artificial
  CRISPR gRNA sequence
cttgcaacactaggagtgtc

SEQ ID NO: 291270 - DNA, 20 bp, Artificial
  CRISPR gRNA sequence
gcaacactaggagtgtctgg

SEQ ID NO: 291271 - DNA, 20 bp, Artificial
  CRISPR gRNA sequence
caacactaggagtgtctggg

SEQ ID NO: 291272 - DNA, 20 bp, Artificial
  CRISPR gRNA sequence
ggagtgtctgggttgtcatt

SEQ ID NO: 291273 - DNA, 20 bp, Artificial
  CRISPR gRNA sequence
ggttgtcatttgatctttag

SEQ ID NO: 291274 - DNA, 20 bp, Artificial
  CRISPR gRNA sequence
tcatttgatctttagctaat

SEQ ID NO: 291275 - DNA, 20 bp, Artificial
  CRISPR gRNA sequence
gatctttagctaatatagct

SEQ ID NO: 291276 - DNA, 20 bp, Artificial
  CRISPR gRNA sequence
atctttagctaatatagctt

SEQ ID NO: 291277 - DNA, 20 bp, Artificial
  CRISPR gRNA sequence
tagctaatatagcttcactt

SEQ ID NO: 291278 - DNA, 20 bp, Artificial
  CRISPR gRNA sequence
agctaatatagcttcacttt

SEQ ID NO: 291279 - DNA, 20 bp, Artificial
  CRISPR gRNA sequence
gctaatatagcttcactttg

SEQ ID NO: 291280 - DNA, 20 bp, Artificial
  CRISPR gRNA sequence
atatagcttcactttgaaat

SEQ ID NO: 291281 - DNA, 20 bp, Artificial
  CRISPR gRNA sequence
cactttgaaatatgctccct

SEQ ID NO: 291282 - DNA, 20 bp, Artificial
  CRISPR gRNA sequence
actttgaaatatgctccctt

SEQ ID NO: 291283 - DNA, 20 bp, Artificial
  CRISPR gRNA sequence
tgaaatatgctcccttcaag

SEQ ID NO: 291284 - DNA, 20 bp, Artificial
  CRISPR gRNA sequence
gaaatatgctcccttcaagt

SEQ ID NO: 291285 - DNA, 20 bp, Artificial
  CRISPR gRNA sequence
aaatatgctcccttcaagta

SEQ ID NO: 291286 - DNA, 20 bp, Artificial
  CRISPR gRNA sequence
ccttcaagtatgtcttttta

SEQ ID NO: 291287 - DNA, 20 bp, Artificial
  CRISPR gRNA sequence
caagtatgtctttttatttc

SEQ ID NO: 291288 - DNA, 20 bp, Artificial
  CRISPR gRNA sequence
aagtatgtctttttatttct

SEQ ID NO: 291289 - DNA, 20 bp, Artificial
  CRISPR gRNA sequence
tttatttcttcctttctttc

SEQ ID NO: 291290 - DNA, 20 bp, Artificial
  CRISPR gRNA sequence
ttatttcttcctttctttca

SEQ ID NO: 291291 - DNA, 20 bp, Artificial
  CRISPR gRNA sequence
tatttcttcctttctttcag

SEQ ID NO: 291292 - DNA, 20 bp, Artificial
  CRISPR gRNA sequence
atttcttcctttctttcagt

SEQ ID NO: 291293 - DNA, 20 bp, Artificial
  CRISPR gRNA sequence
tttcttcctttctttcagtt

SEQ ID NO: 291294 - DNA, 20 bp, Artificial
  CRISPR gRNA sequence
cttcctttctttcagttata

SEQ ID NO: 291295 - DNA, 20 bp, Artificial
  CRISPR gRNA sequence
ttcctttctttcagttatat

SEQ ID NO: 291296 - DNA, 20 bp, Artificial
  CRISPR gRNA sequence
cctttctttcagttatattc

SEQ ID NO: 291297 - DNA, 20 bp, Artificial
  CRISPR gRNA sequence
ctttctttcagttatattcc

SEQ ID NO: 291298 - DNA, 20 bp, Artificial
  CRISPR gRNA sequence
tctttcagttatattcccta

SEQ ID NO: 291299 - DNA, 20 bp, Artificial
  CRISPR gRNA sequence
ctttcagttatattccctaa

SEQ ID NO: 291300 - DNA, 20 bp, Artificial
  CRISPR gRNA sequence
tttcagttatattccctaaa

SEQ ID NO: 291301 - DNA, 20 bp, Artificial
  CRISPR gRNA sequence
tcagttatattccctaaagc

SEQ ID NO: 291302 - DNA, 20 bp, Artificial
  CRISPR gRNA sequence
cagttatattccctaaagca

SEQ ID NO: 291303 - DNA, 20 bp, Artificial
  CRISPR gRNA sequence
agttatattccctaaagcag

SEQ ID NO: 291304 - DNA, 20 bp, Artificial
  CRISPR gRNA sequence
tattccctaaagcagggact

SEQ ID NO: 291305 - DNA, 20 bp, Artificial
  CRISPR gRNA sequence
cctaaagcagggactggcaa

SEQ ID NO: 291306 - DNA, 20 bp, Artificial
  CRISPR gRNA sequence
aagcagggactggcaacatt

SEQ ID NO: 291307 - DNA, 20 bp, Artificial
  CRISPR gRNA sequence
gcaacattccacacaattgc

SEQ ID NO: 291308 - DNA, 20 bp, Artificial
  CRISPR gRNA sequence
cacacaattgctgaagaggt

SEQ ID NO: 291309 - DNA, 20 bp, Artificial
  CRISPR gRNA sequence
ctgaagaggtgcctggacct

SEQ ID NO: 291310 - DNA, 20 bp, Artificial
  CRISPR gRNA sequence
aagaggtgcctggacctttc

SEQ ID NO: 291311 - DNA, 20 bp, Artificial
  CRISPR gRNA sequence
gacctttctgcattacctca

SEQ ID NO: 291312 - DNA, 20 bp, Artificial
  CRISPR gRNA sequence
tctgcattacctcactttgc

SEQ ID NO: 291313 - DNA, 20 bp, Artificial
  CRISPR gRNA sequence
ctgcattacctcactttgct

SEQ ID NO: 291314 - DNA, 20 bp, Artificial
  CRISPR gRNA sequence
tgcattacctcactttgcta

SEQ ID NO: 291315 - DNA, 20 bp, Artificial
  CRISPR gRNA sequence
cattacctcactttgctatg

SEQ ID NO: 291316 - DNA, 20 bp, Artificial
  CRISPR gRNA sequence
cctcactttgctatgcaaat

SEQ ID NO: 291317 - DNA, 20 bp, Artificial
  CRISPR gRNA sequence
actttgctatgcaaataccc

SEQ ID NO: 291318 - DNA, 20 bp, Artificial
  CRISPR gRNA sequence
tgctatgcaaatacccacca

SEQ ID NO: 291319 - DNA, 20 bp, Artificial
  CRISPR gRNA sequence
gctatgcaaatacccaccat

SEQ ID NO: 291320 - DNA, 20 bp, Artificial
  CRISPR gRNA sequence
ctatgcaaatacccaccatc

SEQ ID NO: 291321 - DNA, 20 bp, Artificial
  CRISPR gRNA sequence
tgcaaatacccaccatcaca

SEQ ID NO: 291322 - DNA, 20 bp, Artificial
  CRISPR gRNA sequence
tcttgttcagtgctgtggtg

SEQ ID NO: 291323 - DNA, 20 bp, Artificial
  CRISPR gRNA sequence
ttgttcagtgctgtggtggg

SEQ ID NO: 291324 - DNA, 20 bp, Artificial
  CRISPR gRNA sequence
gttcagtgctgtggtggggc

SEQ ID NO: 291325 - DNA, 20 bp, Artificial
  CRISPR gRNA sequence
ttcagtgctgtggtggggcc

SEQ ID NO: 291326 - DNA, 20 bp, Artificial
  CRISPR gRNA sequence
agtgctgtggtggggccgta

SEQ ID NO: 291327 - DNA, 20 bp, Artificial
  CRISPR gRNA sequence
tggtggggccgtatccagtc

SEQ ID NO: 291328 - DNA, 20 bp, Artificial
  CRISPR gRNA sequence
acagaggcctgagaatggct

SEQ ID NO: 291329 - DNA, 20 bp, Artificial
  CRISPR gRNA sequence
agaatggctggtgagatgga

SEQ ID NO: 291330 - DNA, 20 bp, Artificial
  CRISPR gRNA sequence
gtgagatggaaaggtgctag

SEQ ID NO: 291331 - DNA, 20 bp, Artificial
  CRISPR gRNA sequence
gtgccccatgatcctgctat

SEQ ID NO: 291332 - DNA, 20 bp, Artificial
  CRISPR gRNA sequence
ctatctaagaaaagagaggg

SEQ ID NO: 291333 - DNA, 20 bp, Artificial
  CRISPR gRNA sequence
tctaagaaaagagagggctt

SEQ ID NO: 291334 - DNA, 20 bp, Artificial
  CRISPR gRNA sequence
agaaaagagagggcttggaa

SEQ ID NO: 291335 - DNA, 20 bp, Artificial
  CRISPR gRNA sequence
ggaaatgaagtccctagaca

SEQ ID NO: 291336 - DNA, 20 bp, Artificial
  CRISPR gRNA sequence
gaaatgaagtccctagacat

SEQ ID NO: 291337 - DNA, 20 bp, Artificial
  CRISPR gRNA sequence
gacatgggtctccctaaggg

SEQ ID NO: 291338 - DNA, 20 bp, Artificial
  CRISPR gRNA sequence
cctaaggggatctgtgtggc

SEQ ID NO: 291339 - DNA, 20 bp, Artificial
  CRISPR gRNA sequence
aggggatctgtgtggctcca

SEQ ID NO: 291340 - DNA, 20 bp, Artificial
  CRISPR gRNA sequence
tgtggctccaggggatacag

SEQ ID NO: 291341 - DNA, 20 bp, Artificial
  CRISPR gRNA sequence
caggggatacagggcccaga

SEQ ID NO: 291342 - DNA, 20 bp, Artificial
  CRISPR gRNA sequence
ggcagggggcgctggggcct

SEQ ID NO: 291343 - DNA, 20 bp, Artificial
  CRISPR gRNA sequence
gggccttagagggatgctgc

SEQ ID NO: 291344 - DNA, 20 bp, Artificial
  CRISPR gRNA sequence
agagggatgctgcttttagg

SEQ ID NO: 291345 - DNA, 20 bp, Artificial
  CRISPR gRNA sequence
gagggatgctgcttttaggt

SEQ ID NO: 291346 - DNA, 20 bp, Artificial
  CRISPR gRNA sequence
cttttaggtcctacaagagc

SEQ ID NO: 291347 - DNA, 20 bp, Artificial
  CRISPR gRNA sequence
ttaggtcctacaagagccta

SEQ ID NO: 291348 - DNA, 20 bp, Artificial
  CRISPR gRNA sequence
taggtcctacaagagcctag

SEQ ID NO: 291349 - DNA, 20 bp, Artificial
  CRISPR gRNA sequence
aggtcctacaagagcctagg

SEQ ID NO: 291350 - DNA, 20 bp, Artificial
  CRISPR gRNA sequence
ggtcctacaagagcctagga

SEQ ID NO: 291351 - DNA, 20 bp, Artificial
  CRISPR gRNA sequence
caagagcctaggaagaatga

SEQ ID NO: 291352 - DNA, 20 bp, Artificial
  CRISPR gRNA sequence
ggaagaatgaccatgccttc

SEQ ID NO: 291353 - DNA, 20 bp, Artificial
  CRISPR gRNA sequence
ctaaaccaaaaatcagaaaa

SEQ ID NO: 291354 - DNA, 20 bp, Artificial
  CRISPR gRNA sequence
taaaccaaaaatcagaaaat

SEQ ID NO: 291355 - DNA, 20 bp, Artificial
  CRISPR gRNA sequence
aaccaaaaatcagaaaatac

SEQ ID NO: 291356 - DNA, 20 bp, Artificial
  CRISPR gRNA sequence
ctaaggaattttggtgctat

SEQ ID NO: 291357 - DNA, 20 bp, Artificial
  CRISPR gRNA sequence
aggaattttggtgctattga

SEQ ID NO: 291358 - DNA, 20 bp, Artificial
  CRISPR gRNA sequence
tggtgctattgacacagaga

SEQ ID NO: 291359 - DNA, 20 bp, Artificial
  CRISPR gRNA sequence
ggtgctattgacacagagac

SEQ ID NO: 291360 - DNA, 20 bp, Artificial
  CRISPR gRNA sequence
gtgctattgacacagagact

SEQ ID NO: 291361 - DNA, 20 bp, Artificial
  CRISPR gRNA sequence
ttgacacagagactagttta

SEQ ID NO: 291362 - DNA, 20 bp, Artificial
  CRISPR gRNA sequence
acacagagactagtttagat

SEQ ID NO: 291363 - DNA, 20 bp, Artificial
  CRISPR gRNA sequence
gtttagatattgatatgctg

SEQ ID NO: 291364 - DNA, 20 bp, Artificial
  CRISPR gRNA sequence
agatattgatatgctgatat

SEQ ID NO: 291365 - DNA, 20 bp, Artificial
  CRISPR gRNA sequence
gatattgatatgctgatatt

SEQ ID NO: 291366 - DNA, 20 bp, Artificial
  CRISPR gRNA sequence
atatgctgatatttcttggc

SEQ ID NO: 291367 - DNA, 20 bp, Artificial
  CRISPR gRNA sequence
atatttcttggctatgtgga

SEQ ID NO: 291368 - DNA, 20 bp, Artificial
  CRISPR gRNA sequence
cttggctatgtggatggaga

SEQ ID NO: 291369 - DNA, 20 bp, Artificial
  CRISPR gRNA sequence
ttggctatgtggatggagaa

SEQ ID NO: 291370 - DNA, 20 bp, Artificial
  CRISPR gRNA sequence
ggctatgtggatggagaaat

SEQ ID NO: 291371 - DNA, 20 bp, Artificial
  CRISPR gRNA sequence
gctatgtggatggagaaatg

SEQ ID NO: 291372 - DNA, 20 bp, Artificial
  CRISPR gRNA sequence
tgtggatggagaaatgaaca

SEQ ID NO: 291373 - DNA, 20 bp, Artificial
  CRISPR gRNA sequence
taaataaaaactcttttagc

SEQ ID NO: 291374 - DNA, 20 bp, Artificial
  CRISPR gRNA sequence
aaataaaaactcttttagca

SEQ ID NO: 291375 - DNA, 20 bp, Artificial
  CRISPR gRNA sequence
aataaaaactcttttagcaa

SEQ ID NO: 291376 - DNA, 20 bp, Artificial
  CRISPR gRNA sequence
ttttagcaaatccaggctgg

SEQ ID NO: 291377 - DNA, 20 bp, Artificial
  CRISPR gRNA sequence
ttagcaaatccaggctggag

SEQ ID NO: 291378 - DNA, 20 bp, Artificial
  CRISPR gRNA sequence
tagcaaatccaggctggagg

SEQ ID NO: 291379 - DNA, 20 bp, Artificial
  CRISPR gRNA sequence
agcaaatccaggctggaggg

SEQ ID NO: 291380 - DNA, 20 bp, Artificial
  CRISPR gRNA sequence
gcaaatccaggctggagggt

SEQ ID NO: 291381 - DNA, 20 bp, Artificial
  CRISPR gRNA sequence
gagggtaattgtatggcatg

SEQ ID NO: 291382 - DNA, 20 bp, Artificial
  CRISPR gRNA sequence
tatggcatggactgcagata

SEQ ID NO: 291383 - DNA, 20 bp, Artificial
  CRISPR gRNA sequence
cagatagccaaagagataaa

SEQ ID NO: 291384 - DNA, 20 bp, Artificial
  CRISPR gRNA sequence
agggtacctgaagatggtag

SEQ ID NO: 291385 - DNA, 20 bp, Artificial
  CRISPR gRNA sequence
gggtacctgaagatggtaga

SEQ ID NO: 291386 - DNA, 20 bp, Artificial
  CRISPR gRNA sequence
aagatggtagaaatagtcca

SEQ ID NO: 291387 - DNA, 20 bp, Artificial
  CRISPR gRNA sequence
cagcctggaaccatgggatc

SEQ ID NO: 291388 - DNA, 20 bp, Artificial
  CRISPR gRNA sequence
agcctggaaccatgggatca

SEQ ID NO: 291389 - DNA, 20 bp, Artificial
  CRISPR gRNA sequence
gaaccatgggatcaatcagg

SEQ ID NO: 291390 - DNA, 20 bp, Artificial
  CRISPR gRNA sequence
gaaagaaagggactctgttt

SEQ ID NO: 291391 - DNA, 20 bp, Artificial
  CRISPR gRNA sequence
tgtttcttatttatttattt

SEQ ID NO: 291392 - DNA, 20 bp, Artificial
  CRISPR gRNA sequence
tttcttatttatttatttat

SEQ ID NO: 291393 - DNA, 20 bp, Artificial
  CRISPR gRNA sequence
cttatttatttatttattta

SEQ ID NO: 291394 - DNA, 20 bp, Artificial
  CRISPR gRNA sequence
ttatttatttatttatttat

SEQ ID NO: 291395 - DNA, 20 bp, Artificial
  CRISPR gRNA sequence
atttatttatttatttattt

SEQ ID NO: 291396 - DNA, 20 bp, Artificial
  CRISPR gRNA sequence
tttatttatttatttattta

SEQ ID NO: 291397 - DNA, 20 bp, Artificial
  CRISPR gRNA sequence
atttatttatttatttattt

SEQ ID NO: 291398 - DNA, 20 bp, Artificial
  CRISPR gRNA sequence
tttatttatttatttatttt

SEQ ID NO: 291399 - DNA, 20 bp, Artificial
  CRISPR gRNA sequence
atttatttatttattttgag

SEQ ID NO: 291400 - DNA, 20 bp, Artificial
  CRISPR gRNA sequence
tttatttatttattttgaga

SEQ ID NO: 291401 - DNA, 20 bp, Artificial
  CRISPR gRNA sequence
atttatttattttgagacgg

SEQ ID NO: 291402 - DNA, 20 bp, Artificial
  CRISPR gRNA sequence
tttatttattttgagacgga

SEQ ID NO: 291403 - DNA, 20 bp, Artificial
  CRISPR gRNA sequence
atttattttgagacggagtc

SEQ ID NO: 291404 - DNA, 20 bp, Artificial
  CRISPR gRNA sequence
tttattttgagacggagtct

SEQ ID NO: 291405 - DNA, 20 bp, Artificial
  CRISPR gRNA sequence
attttgagacggagtctcac

SEQ ID NO: 291406 - DNA, 20 bp, Artificial
  CRISPR gRNA sequence
ttttgagacggagtctcact

SEQ ID NO: 291407 - DNA, 20 bp, Artificial
  CRISPR gRNA sequence
tgagacggagtctcactctg

SEQ ID NO: 291408 - DNA, 20 bp, Artificial
  CRISPR gRNA sequence
gagacggagtctcactctgt

SEQ ID NO: 291409 - DNA, 20 bp, Artificial
  CRISPR gRNA sequence
agacggagtctcactctgtc

SEQ ID NO: 291410 - DNA, 20 bp, Artificial
  CRISPR gRNA sequence
actctgtcacccaagctgga

SEQ ID NO: 291411 - DNA, 20 bp, Artificial
  CRISPR gRNA sequence
tgtcacccaagctggagtgc

SEQ ID NO: 291412 - DNA, 20 bp, Artificial
  CRISPR gRNA sequence
tcacccaagctggagtgcag

SEQ ID NO: 291413 - DNA, 20 bp, Artificial
  CRISPR gRNA sequence
gagtgcagtggtgtgatctt

SEQ ID NO: 291414 - DNA, 20 bp, Artificial
  CRISPR gRNA sequence
ggctcactgcaacctctgcc

SEQ ID NO: 291415 - DNA, 20 bp, Artificial
  CRISPR gRNA sequence
gctcactgcaacctctgcct

SEQ ID NO: 291416 - DNA, 20 bp, Artificial
  CRISPR gRNA sequence
actgcaacctctgcctccca

SEQ ID NO: 291417 - DNA, 20 bp, Artificial
  CRISPR gRNA sequence
caacctctgcctcccaggtt

SEQ ID NO: 291418 - DNA, 20 bp, Artificial
  CRISPR gRNA sequence
tgcctcccaggttcaagtga

SEQ ID NO: 291419 - DNA, 20 bp, Artificial
  CRISPR gRNA sequence
cctcccaggttcaagtgatt

SEQ ID NO: 291420 - DNA, 20 bp, Artificial
  CRISPR gRNA sequence
ccaggttcaagtgattctcc

SEQ ID NO: 291421 - DNA, 20 bp, Artificial
  CRISPR gRNA sequence
aagtgattctcctgcctcag

SEQ ID NO: 291422 - DNA, 20 bp, Artificial
  CRISPR gRNA sequence
tcctgcctcagcctcctaag

SEQ ID NO: 291423 - DNA, 20 bp, Artificial
  CRISPR gRNA sequence
ctgcctcagcctcctaagta

SEQ ID NO: 291424 - DNA, 20 bp, Artificial
  CRISPR gRNA sequence
cctcagcctcctaagtagct

SEQ ID NO: 291425 - DNA, 20 bp, Artificial
  CRISPR gRNA sequence
agcctcctaagtagctggga

SEQ ID NO: 291426 - DNA, 20 bp, Artificial
  CRISPR gRNA sequence
ctaagtagctgggattacag

SEQ ID NO: 291427 - DNA, 20 bp, Artificial
  CRISPR gRNA sequence
agtagctgggattacaggtg

SEQ ID NO: 291428 - DNA, 20 bp, Artificial
  CRISPR gRNA sequence
ggattacaggtgtgtcccaa

SEQ ID NO: 291429 - DNA, 20 bp, Artificial
  CRISPR gRNA sequence
caggtgtgtcccaacatgcc

SEQ ID NO: 291430 - DNA, 20 bp, Artificial
  CRISPR gRNA sequence
atttttttgtatttttagta

SEQ ID NO: 291431 - DNA, 20 bp, Artificial
  CRISPR gRNA sequence
ttttgtatttttagtagaga

SEQ ID NO: 291432 - DNA, 20 bp, Artificial
  CRISPR gRNA sequence
tttgtatttttagtagagat

SEQ ID NO: 291433 - DNA, 20 bp, Artificial
  CRISPR gRNA sequence
ttgtatttttagtagagatg

SEQ ID NO: 291434 - DNA, 20 bp, Artificial
  CRISPR gRNA sequence
tgtatttttagtagagatgg

SEQ ID NO: 291435 - DNA, 20 bp, Artificial
  CRISPR gRNA sequence
gtatttttagtagagatggg

SEQ ID NO: 291436 - DNA, 20 bp, Artificial
  CRISPR gRNA sequence
tatttttagtagagatgggg

SEQ ID NO: 291437 - DNA, 20 bp, Artificial
  CRISPR gRNA sequence
ttagtagagatggggtttca

SEQ ID NO: 291438 - DNA, 20 bp, Artificial
  CRISPR gRNA sequence
tagtagagatggggtttcac

SEQ ID NO: 291439 - DNA, 20 bp, Artificial
  CRISPR gRNA sequence
agtagagatggggtttcacc

SEQ ID NO: 291440 - DNA, 20 bp, Artificial
  CRISPR gRNA sequence
gtagagatggggtttcacca

SEQ ID NO: 291441 - DNA, 20 bp, Artificial
  CRISPR gRNA sequence
caccatgttgaccaggctgg

SEQ ID NO: 291442 - DNA, 20 bp, Artificial
  CRISPR gRNA sequence
accatgttgaccaggctggt

SEQ ID NO: 291443 - DNA, 20 bp, Artificial
  CRISPR gRNA sequence
accaggctggtctcaaactc

SEQ ID NO: 291444 - DNA, 20 bp, Artificial
  CRISPR gRNA sequence
gtctcaaactcctgacctcg

SEQ ID NO: 291445 - DNA, 20 bp, Artificial
  CRISPR gRNA sequence
aaactcctgacctcgtgatc

SEQ ID NO: 291446 - DNA, 20 bp, Artificial
  CRISPR gRNA sequence
ctgacctcgtgatctgccca

SEQ ID NO: 291447 - DNA, 20 bp, Artificial
  CRISPR gRNA sequence
acctcgtgatctgcccacct

SEQ ID NO: 291448 - DNA, 20 bp, Artificial
  CRISPR gRNA sequence
gtgatctgcccacctcagcc

SEQ ID NO: 291449 - DNA, 20 bp, Artificial
  CRISPR gRNA sequence
cccacctcagcctcccaaag

SEQ ID NO: 291450 - DNA, 20 bp, Artificial
  CRISPR gRNA sequence
agcctcccaaagtgctggga

SEQ ID NO: 291451 - DNA, 20 bp, Artificial
  CRISPR gRNA sequence
ccaaagtgctgggattacag

SEQ ID NO: 291452 - DNA, 20 bp, Artificial
  CRISPR gRNA sequence
ggattacaggcttgagccat

SEQ ID NO: 291453 - DNA, 20 bp, Artificial
  CRISPR gRNA sequence
caggcttgagccatgatgcc

SEQ ID NO: 291454 - DNA, 20 bp, Artificial
  CRISPR gRNA sequence
gagccatgatgcccggcctg

SEQ ID NO: 291455 - DNA, 20 bp, Artificial
  CRISPR gRNA sequence
agccatgatgcccggcctgg

SEQ ID NO: 291456 - DNA, 20 bp, Artificial
  CRISPR gRNA sequence
ggactctgtttcttatagca

SEQ ID NO: 291457 - DNA, 20 bp, Artificial
  CRISPR gRNA sequence
tgtttcttatagcaaaaggg

SEQ ID NO: 291458 - DNA, 20 bp, Artificial
  CRISPR gRNA sequence
tttcttatagcaaaagggct

SEQ ID NO: 291459 - DNA, 20 bp, Artificial
  CRISPR gRNA sequence
cttatagcaaaagggctcag

SEQ ID NO: 291460 - DNA, 20 bp, Artificial
  CRISPR gRNA sequence
ttatagcaaaagggctcagt

SEQ ID NO: 291461 - DNA, 20 bp, Artificial
  CRISPR gRNA sequence
atagcaaaagggctcagtgg

SEQ ID NO: 291462 - DNA, 20 bp, Artificial
  CRISPR gRNA sequence
tagcaaaagggctcagtggt

SEQ ID NO: 291463 - DNA, 20 bp, Artificial
  CRISPR gRNA sequence
agtggtagggctggattggg

SEQ ID NO: 291464 - DNA, 20 bp, Artificial
  CRISPR gRNA sequence
gattggggtgggtggggaca

SEQ ID NO: 291465 - DNA, 20 bp, Artificial
  CRISPR gRNA sequence
gggtgggtggggacagtgtt

SEQ ID NO: 291466 - DNA, 20 bp, Artificial
  CRISPR gRNA sequence
gcttaacttactgactgtgg

SEQ ID NO: 291467 - DNA, 20 bp, Artificial
  CRISPR gRNA sequence
aacttactgactgtggccta

SEQ ID NO: 291468 - DNA, 20 bp, Artificial
  CRISPR gRNA sequence
acttactgactgtggcctaa

SEQ ID NO: 291469 - DNA, 20 bp, Artificial
  CRISPR gRNA sequence
actgactgtggcctaaaact

SEQ ID NO: 291470 - DNA, 20 bp, Artificial
  CRISPR gRNA sequence
ctgactgtggcctaaaactg

SEQ ID NO: 291471 - DNA, 20 bp, Artificial
  CRISPR gRNA sequence
actgtggcctaaaactgaag

SEQ ID NO: 291472 - DNA, 20 bp, Artificial
  CRISPR gRNA sequence
tggcctaaaactgaagaaat

SEQ ID NO: 291473 - DNA, 20 bp, Artificial
  CRISPR gRNA sequence
aaactgaagaaatcggtaaa

SEQ ID NO: 291474 - DNA, 20 bp, Artificial
  CRISPR gRNA sequence
aagaaatcggtaaacaagaa

SEQ ID NO: 291475 - DNA, 20 bp, Artificial
  CRISPR gRNA sequence
aaagcctgggccagaaagaa

SEQ ID NO: 291476 - DNA, 20 bp, Artificial
  CRISPR gRNA sequence
ggccagaaagaaaaaaatgt

SEQ ID NO: 291477 - DNA, 20 bp, Artificial
  CRISPR gRNA sequence
gggcagtttcttttcctcag

SEQ ID NO: 291478 - DNA, 20 bp, Artificial
  CRISPR gRNA sequence
cttttcctcagctcagtttc

SEQ ID NO: 291479 - DNA, 20 bp, Artificial
  CRISPR gRNA sequence
ttttcctcagctcagtttcc

SEQ ID NO: 291480 - DNA, 20 bp, Artificial
  CRISPR gRNA sequence
ttcctcagctcagtttcctc

SEQ ID NO: 291481 - DNA, 20 bp, Artificial
  CRISPR gRNA sequence
tcctcagctcagtttcctca

SEQ ID NO: 291482 - DNA, 20 bp, Artificial
  CRISPR gRNA sequence
cctcagctcagtttcctcat

SEQ ID NO: 291483 - DNA, 20 bp, Artificial
  CRISPR gRNA sequence
ctcagctcagtttcctcatt

SEQ ID NO: 291484 - DNA, 20 bp, Artificial
  CRISPR gRNA sequence
agctcagtttcctcatttgt

SEQ ID NO: 291485 - DNA, 20 bp, Artificial
  CRISPR gRNA sequence
agtttcctcatttgtaagat

SEQ ID NO: 291486 - DNA, 20 bp, Artificial
  CRISPR gRNA sequence
cctcatttgtaagataaggc

SEQ ID NO: 291487 - DNA, 20 bp, Artificial
  CRISPR gRNA sequence
ctcatttgtaagataaggcc

SEQ ID NO: 291488 - DNA, 20 bp, Artificial
  CRISPR gRNA sequence
atttgtaagataaggccacg

SEQ ID NO: 291489 - DNA, 20 bp, Artificial
  CRISPR gRNA sequence
gtaagataaggccacgagaa

SEQ ID NO: 291490 - DNA, 20 bp, Artificial
  CRISPR gRNA sequence
taagataaggccacgagaat

SEQ ID NO: 291491 - DNA, 20 bp, Artificial
  CRISPR gRNA sequence
ccagatctcacattccttac

SEQ ID NO: 291492 - DNA, 20 bp, Artificial
  CRISPR gRNA sequence
cagatctcacattccttact

SEQ ID NO: 291493 - DNA, 20 bp, Artificial
  CRISPR gRNA sequence
acattccttactatgacttt

SEQ ID NO: 291494 - DNA, 20 bp, Artificial
  CRISPR gRNA sequence
cttactatgactttcatatc

SEQ ID NO: 291495 - DNA, 20 bp, Artificial
  CRISPR gRNA sequence
actatgactttcatatcccc

SEQ ID NO: 291496 - DNA, 20 bp, Artificial
  CRISPR gRNA sequence
ctatgactttcatatcccct

SEQ ID NO: 291497 - DNA, 20 bp, Artificial
  CRISPR gRNA sequence
tgactttcatatcccctggg

SEQ ID NO: 291498 - DNA, 20 bp, Artificial
  CRISPR gRNA sequence
tcatatcccctggggctgag

SEQ ID NO: 291499 - DNA, 20 bp, Artificial
  CRISPR gRNA sequence
catatcccctggggctgagc

SEQ ID NO: 291500 - DNA, 20 bp, Artificial
  CRISPR gRNA sequence
atatcccctggggctgagca

SEQ ID NO: 291501 - DNA, 20 bp, Artificial
  CRISPR gRNA sequence
gggctgagcacatcgtttaa

SEQ ID NO: 291502 - DNA, 20 bp, Artificial
  CRISPR gRNA sequence
agcacatcgtttaacccatg

SEQ ID NO: 291503 - DNA, 20 bp, Artificial
  CRISPR gRNA sequence
aacccatggttggcacttat

SEQ ID NO: 291504 - DNA, 20 bp, Artificial
  CRISPR gRNA sequence
acccatggttggcacttata

SEQ ID NO: 291505 - DNA, 20 bp, Artificial
  CRISPR gRNA sequence
gcacttatattcaggtcttc

SEQ ID NO: 291506 - DNA, 20 bp, Artificial
  CRISPR gRNA sequence
atattcaggtcttctcaggg

SEQ ID NO: 291507 - DNA, 20 bp, Artificial
  CRISPR gRNA sequence
tattcaggtcttctcagggg

SEQ ID NO: 291508 - DNA, 20 bp, Artificial
  CRISPR gRNA sequence
aggtcttctcaggggaccag

SEQ ID NO: 291509 - DNA, 20 bp, Artificial
  CRISPR gRNA sequence
ctcaggggaccagtggactt

SEQ ID NO: 291510 - DNA, 20 bp, Artificial
  CRISPR gRNA sequence
tcaggggaccagtggacttt

SEQ ID NO: 291511 - DNA, 20 bp, Artificial
  CRISPR gRNA sequence
aggggaccagtggactttct

SEQ ID NO: 291512 - DNA, 20 bp, Artificial
  CRISPR gRNA sequence
tctcactcactagggatccc

SEQ ID NO: 291513 - DNA, 20 bp, Artificial
  CRISPR gRNA sequence
ctcactcactagggatccct

SEQ ID NO: 291514 - DNA, 20 bp, Artificial
  CRISPR gRNA sequence
tcactcactagggatccctg

SEQ ID NO: 291515 - DNA, 20 bp, Artificial
  CRISPR gRNA sequence
actcactagggatccctgtc

SEQ ID NO: 291516 - DNA, 20 bp, Artificial
  CRISPR gRNA sequence
actagggatccctgtctctg

SEQ ID NO: 291517 - DNA, 20 bp, Artificial
  CRISPR gRNA sequence
gggatccctgtctctgtccc

SEQ ID NO: 291518 - DNA, 20 bp, Artificial
  CRISPR gRNA sequence
tctctgtccccaactcctgg

SEQ ID NO: 291519 - DNA, 20 bp, Artificial
  CRISPR gRNA sequence
tgtccccaactcctggccca

SEQ ID NO: 291520 - DNA, 20 bp, Artificial
  CRISPR gRNA sequence
tccccaactcctggcccata

SEQ ID NO: 291521 - DNA, 20 bp, Artificial
  CRISPR gRNA sequence
ctggcccataggcatctggc

SEQ ID NO: 291522 - DNA, 20 bp, Artificial
  CRISPR gRNA sequence
gcccataggcatctggctat

SEQ ID NO: 291523 - DNA, 20 bp, Artificial
  CRISPR gRNA sequence
gctatatacataagacaagc

SEQ ID NO: 291524 - DNA, 20 bp, Artificial
  CRISPR gRNA sequence
tatacataagacaagcaggt

SEQ ID NO: 291525 - DNA, 20 bp, Artificial
  CRISPR gRNA sequence
tccatatttctgaatgctca

SEQ ID NO: 291526 - DNA, 20 bp, Artificial
  CRISPR gRNA sequence
ccatatttctgaatgctcac

SEQ ID NO: 291527 - DNA, 20 bp, Artificial
  CRISPR gRNA sequence
catatttctgaatgctcacg

SEQ ID NO: 291528 - DNA, 20 bp, Artificial
  CRISPR gRNA sequence
ctgaatgctcacgatgtctc

SEQ ID NO: 291529 - DNA, 20 bp, Artificial
  CRISPR gRNA sequence
tgaatgctcacgatgtctca

SEQ ID NO: 291530 - DNA, 20 bp, Artificial
  CRISPR gRNA sequence
aatgctcacgatgtctcatc

SEQ ID NO: 291531 - DNA, 20 bp, Artificial
  CRISPR gRNA sequence
acgatgtctcatcatgctag

SEQ ID NO: 291532 - DNA, 20 bp, Artificial
  CRISPR gRNA sequence
atcatgctaggcgtggtggc

SEQ ID NO: 291533 - DNA, 20 bp, Artificial
  CRISPR gRNA sequence
ggcgtggtggctcacacttg

SEQ ID NO: 291534 - DNA, 20 bp, Artificial
  CRISPR gRNA sequence
acacttgtaatcccagcatt

SEQ ID NO: 291535 - DNA, 20 bp, Artificial
  CRISPR gRNA sequence
gtaatcccagcattttggga

SEQ ID NO: 291536 - DNA, 20 bp, Artificial
  CRISPR gRNA sequence
taatcccagcattttgggag

SEQ ID NO: 291537 - DNA, 20 bp, Artificial
  CRISPR gRNA sequence
tgggaggctgaggtgggagg

SEQ ID NO: 291538 - DNA, 20 bp, Artificial
  CRISPR gRNA sequence
gggaggctgaggtgggagga

SEQ ID NO: 291539 - DNA, 20 bp, Artificial
  CRISPR gRNA sequence
ggaggctgaggtgggaggat

SEQ ID NO: 291540 - DNA, 20 bp, Artificial
  CRISPR gRNA sequence
aggtgggaggatcacctgag

SEQ ID NO: 291541 - DNA, 20 bp, Artificial
  CRISPR gRNA sequence
agatcaggagtttgagacca

SEQ ID NO: 291542 - DNA, 20 bp, Artificial
  CRISPR gRNA sequence
gagaccagcctggcaaacat

SEQ ID NO: 291543 - DNA, 20 bp, Artificial
  CRISPR gRNA sequence
agaccagcctggcaaacatg

SEQ ID NO: 291544 - DNA, 20 bp, Artificial
  CRISPR gRNA sequence
gcaaacatggtggaaaccct

SEQ ID NO: 291545 - DNA, 20 bp, Artificial
  CRISPR gRNA sequence
tctctactaaaaatacaaaa

SEQ ID NO: 291546 - DNA, 20 bp, Artificial
  CRISPR gRNA sequence
tactaaaaatacaaaaatta

SEQ ID NO: 291547 - DNA, 20 bp, Artificial
  CRISPR gRNA sequence
ctaaaaatacaaaaattagc

SEQ ID NO: 291548 - DNA, 20 bp, Artificial
  CRISPR gRNA sequence
aaaatacaaaaattagctgg

SEQ ID NO: 291549 - DNA, 20 bp, Artificial
  CRISPR gRNA sequence
gctgggcatgatggcgggcg

SEQ ID NO: 291550 - DNA, 20 bp, Artificial
  CRISPR gRNA sequence
ggcatgatggcgggcgcctg

SEQ ID NO: 291551 - DNA, 20 bp, Artificial
  CRISPR gRNA sequence
taatcccagctactcaggag

SEQ ID NO: 291552 - DNA, 20 bp, Artificial
  CRISPR gRNA sequence
ctcaggaggctgaggcagga

SEQ ID NO: 291553 - DNA, 20 bp, Artificial
  CRISPR gRNA sequence
aggaggctgaggcaggagaa

SEQ ID NO: 291554 - DNA, 20 bp, Artificial
  CRISPR gRNA sequence
aggcaggagaactgcttgaa

SEQ ID NO: 291555 - DNA, 20 bp, Artificial
  CRISPR gRNA sequence
cttgaacctgggggtggagg

SEQ ID NO: 291556 - DNA, 20 bp, Artificial
  CRISPR gRNA sequence
gaacctgggggtggaggttg

SEQ ID NO: 291557 - DNA, 20 bp, Artificial
  CRISPR gRNA sequence
aacctgggggtggaggttgc

SEQ ID NO: 291558 - DNA, 20 bp, Artificial
  CRISPR gRNA sequence
ggggtggaggttgcagtgag

SEQ ID NO: 291559 - DNA, 20 bp, Artificial
  CRISPR gRNA sequence
cagtgagctgagatcgcgcc

SEQ ID NO: 291560 - DNA, 20 bp, Artificial
  CRISPR gRNA sequence
agatcgcgccacttcactcc

SEQ ID NO: 291561 - DNA, 20 bp, Artificial
  CRISPR gRNA sequence
cactccagcctgggcaaaag

SEQ ID NO: 291562 - DNA, 20 bp, Artificial
  CRISPR gRNA sequence
actccagcctgggcaaaaga

SEQ ID NO: 291563 - DNA, 20 bp, Artificial
  CRISPR gRNA sequence
cagcctgggcaaaagaacaa

SEQ ID NO: 291564 - DNA, 20 bp, Artificial
  CRISPR gRNA sequence
ggcaaaagaacaagactccg

SEQ ID NO: 291565 - DNA, 20 bp, Artificial
  CRISPR gRNA sequence
cgtctcaaaaaaaaaaagaa

SEQ ID NO: 291566 - DNA, 20 bp, Artificial
  CRISPR gRNA sequence
aaaaaaaaaaagaaaaagaa

SEQ ID NO: 291567 - DNA, 20 bp, Artificial
  CRISPR gRNA sequence
atggagattcagggaagggg

SEQ ID NO: 291568 - DNA, 20 bp, Artificial
  CRISPR gRNA sequence
tggagattcagggaagggga

SEQ ID NO: 291569 - DNA, 20 bp, Artificial
  CRISPR gRNA sequence
agggaaggggaagattctgg

SEQ ID NO: 291570 - DNA, 20 bp, Artificial
  CRISPR gRNA sequence
tggataactcttgaaagata

SEQ ID NO: 291571 - DNA, 20 bp, Artificial
  CRISPR gRNA sequence
gataactcttgaaagataac

SEQ ID NO: 291572 - DNA, 20 bp, Artificial
  CRISPR gRNA sequence
ttgaaagataacgtcactgg

SEQ ID NO: 291573 - DNA, 20 bp, Artificial
  CRISPR gRNA sequence
gaaagataacgtcactggaa

SEQ ID NO: 291574 - DNA, 20 bp, Artificial
  CRISPR gRNA sequence
aaagataacgtcactggaag

SEQ ID NO: 291575 - DNA, 20 bp, Artificial
  CRISPR gRNA sequence
gaagagctttacccatttgg

SEQ ID NO: 291576 - DNA, 20 bp, Artificial
  CRISPR gRNA sequence
tacccatttggtggggtgtt

SEQ ID NO: 291577 - DNA, 20 bp, Artificial
  CRISPR gRNA sequence
acccatttggtggggtgttg

SEQ ID NO: 291578 - DNA, 20 bp, Artificial
  CRISPR gRNA sequence
cccatttggtggggtgttga

SEQ ID NO: 291579 - DNA, 20 bp, Artificial
  CRISPR gRNA sequence
ggtggggtgttgaactggat

SEQ ID NO: 291580 - DNA, 20 bp, Artificial
  CRISPR gRNA sequence
gtggggtgttgaactggatg

SEQ ID NO: 291581 - DNA, 20 bp, Artificial
  CRISPR gRNA sequence
aactggatgtaggagcagca

SEQ ID NO: 291582 - DNA, 20 bp, Artificial
  CRISPR gRNA sequence
gatgtaggagcagcacacag

SEQ ID NO: 291583 - DNA, 20 bp, Artificial
  CRISPR gRNA sequence
gcttgtcagtatatcaatag

SEQ ID NO: 291584 - DNA, 20 bp, Artificial
  CRISPR gRNA sequence
cttgtcagtatatcaatagt

SEQ ID NO: 291585 - DNA, 20 bp, Artificial
  CRISPR gRNA sequence
gtcagtatatcaatagttat

SEQ ID NO: 291586 - DNA, 20 bp, Artificial
  CRISPR gRNA sequence
tcagtatatcaatagttata

SEQ ID NO: 291587 - DNA, 20 bp, Artificial
  CRISPR gRNA sequence
tatcaaaggtgtaaggtggc

SEQ ID NO: 291588 - DNA, 20 bp, Artificial
  CRISPR gRNA sequence
ctaatatattgaattcaact

SEQ ID NO: 291589 - DNA, 20 bp, Artificial
  CRISPR gRNA sequence
atatattgaattcaacttta

SEQ ID NO: 291590 - DNA, 20 bp, Artificial
  CRISPR gRNA sequence
aattcaactttaggctgcaa

SEQ ID NO: 291591 - DNA, 20 bp, Artificial
  CRISPR gRNA sequence
aactttaggctgcaaacata

SEQ ID NO: 291592 - DNA, 20 bp, Artificial
  CRISPR gRNA sequence
taggctgcaaacatagattt

SEQ ID NO: 291593 - DNA, 20 bp, Artificial
  CRISPR gRNA sequence
aggctgcaaacatagattta

SEQ ID NO: 291594 - DNA, 20 bp, Artificial
  CRISPR gRNA sequence
ggctgcaaacatagatttag

SEQ ID NO: 291595 - DNA, 20 bp, Artificial
  CRISPR gRNA sequence
caaacatagatttaggtaaa

SEQ ID NO: 291596 - DNA, 20 bp, Artificial
  CRISPR gRNA sequence
aggtaaaggaagtgacaacc

SEQ ID NO: 291597 - DNA, 20 bp, Artificial
  CRISPR gRNA sequence
ggtaaaggaagtgacaaccc

SEQ ID NO: 291598 - DNA, 20 bp, Artificial
  CRISPR gRNA sequence
tactctgagccaatcacaca

SEQ ID NO: 291599 - DNA, 20 bp, Artificial
  CRISPR gRNA sequence
ctctgagccaatcacacagt

SEQ ID NO: 291600 - DNA, 20 bp, Artificial
  CRISPR gRNA sequence
tgagccaatcacacagtgga

SEQ ID NO: 291601 - DNA, 20 bp, Artificial
  CRISPR gRNA sequence
agccaatcacacagtggatg

SEQ ID NO: 291602 - DNA, 20 bp, Artificial
  CRISPR gRNA sequence
gaatgctagatttagtgact

SEQ ID NO: 291603 - DNA, 20 bp, Artificial
  CRISPR gRNA sequence
gatttagtgacttcgctctc

SEQ ID NO: 291604 - DNA, 20 bp, Artificial
  CRISPR gRNA sequence
agtgacttcgctctctcaaa

SEQ ID NO: 291605 - DNA, 20 bp, Artificial
  CRISPR gRNA sequence
gtgacttcgctctctcaaaa

SEQ ID NO: 291606 - DNA, 20 bp, Artificial
  CRISPR gRNA sequence
cgctctctcaaaaaaatata

SEQ ID NO: 291607 - DNA, 20 bp, Artificial
  CRISPR gRNA sequence
gctctctcaaaaaaatatac

SEQ ID NO: 291608 - DNA, 20 bp, Artificial
  CRISPR gRNA sequence
tctcaaaaaaatatacacac

SEQ ID NO: 291609 - DNA, 20 bp, Artificial
  CRISPR gRNA sequence
tcaaaaaaatatacacacaa

SEQ ID NO: 291610 - DNA, 20 bp, Artificial
  CRISPR gRNA sequence
aaaaaaatatacacacaaat

SEQ ID NO: 291611 - DNA, 20 bp, Artificial
  CRISPR gRNA sequence
tgtagtgaggaaagtgaggg

SEQ ID NO: 291612 - DNA, 20 bp, Artificial
  CRISPR gRNA sequence
actttcagtacatcaataag

SEQ ID NO: 291613 - DNA, 20 bp, Artificial
  CRISPR gRNA sequence
tcagtacatcaataaggaac

SEQ ID NO: 291614 - DNA, 20 bp, Artificial
  CRISPR gRNA sequence
cagtacatcaataaggaaca

SEQ ID NO: 291615 - DNA, 20 bp, Artificial
  CRISPR gRNA sequence
agtacatcaataaggaacag

SEQ ID NO: 291616 - DNA, 20 bp, Artificial
  CRISPR gRNA sequence
cagaactgtctgagagagga

SEQ ID NO: 291617 - DNA, 20 bp, Artificial
  CRISPR gRNA sequence
tctgagagaggatataagta

SEQ ID NO: 291618 - DNA, 20 bp, Artificial
  CRISPR gRNA sequence
agagaggatataagtatcct

SEQ ID NO: 291619 - DNA, 20 bp, Artificial
  CRISPR gRNA sequence
agatatctgcaagtcttgtt

SEQ ID NO: 291620 - DNA, 20 bp, Artificial
  CRISPR gRNA sequence
caagtcttgttacataagaa

SEQ ID NO: 291621 - DNA, 20 bp, Artificial
  CRISPR gRNA sequence
gttacataagaagaatgaga

SEQ ID NO: 291622 - DNA, 20 bp, Artificial
  CRISPR gRNA sequence
ttacataagaagaatgagat

SEQ ID NO: 291623 - DNA, 20 bp, Artificial
  CRISPR gRNA sequence
cataagaagaatgagatgtg

SEQ ID NO: 291624 - DNA, 20 bp, Artificial
  CRISPR gRNA sequence
tgtaatgcatgtagaagcta

SEQ ID NO: 291625 - DNA, 20 bp, Artificial
  CRISPR gRNA sequence
gtaatgcatgtagaagctag

SEQ ID NO: 291626 - DNA, 20 bp, Artificial
  CRISPR gRNA sequence
taatgcatgtagaagctaga

SEQ ID NO: 291627 - DNA, 20 bp, Artificial
  CRISPR gRNA sequence
gagggaaacagacttcaaca

SEQ ID NO: 291628 - DNA, 20 bp, Artificial
  CRISPR gRNA sequence
caacataaagcaaagcaaaa

SEQ ID NO: 291629 - DNA, 20 bp, Artificial
  CRISPR gRNA sequence
aacataaagcaaagcaaaac

SEQ ID NO: 291630 - DNA, 20 bp, Artificial
  CRISPR gRNA sequence
cctcagtcaaattgtccaaa

SEQ ID NO: 291631 - DNA, 20 bp, Artificial
  CRISPR gRNA sequence
ctcagtcaaattgtccaaag

SEQ ID NO: 291632 - DNA, 20 bp, Artificial
  CRISPR gRNA sequence
agtcaaattgtccaaagacg

SEQ ID NO: 291633 - DNA, 20 bp, Artificial
  CRISPR gRNA sequence
tccaaagacgaaatcaaaag

SEQ ID NO: 291634 - DNA, 20 bp, Artificial
  CRISPR gRNA sequence
agaggttggtaaattcccca

SEQ ID NO: 291635 - DNA, 20 bp, Artificial
  CRISPR gRNA sequence
gaggttggtaaattccccac

SEQ ID NO: 291636 - DNA, 20 bp, Artificial
  CRISPR gRNA sequence
gtaaattccccacccccttg

SEQ ID NO: 291637 - DNA, 20 bp, Artificial
  CRISPR gRNA sequence
cccacccccttggagaaagg

SEQ ID NO: 291638 - DNA, 20 bp, Artificial
  CRISPR gRNA sequence
ggagaaaggagaatgggatt

SEQ ID NO: 291639 - DNA, 20 bp, Artificial
  CRISPR gRNA sequence
gagaaaggagaatgggattc

SEQ ID NO: 291640 - DNA, 20 bp, Artificial
  CRISPR gRNA sequence
atatttggtgtgggtctagg

SEQ ID NO: 291641 - DNA, 20 bp, Artificial
  CRISPR gRNA sequence
ggtgtgggtctaggcattga

SEQ ID NO: 291642 - DNA, 20 bp, Artificial
  CRISPR gRNA sequence
gtgtgggtctaggcattgaa

SEQ ID NO: 291643 - DNA, 20 bp, Artificial
  CRISPR gRNA sequence
ggcattgaattacagtatgt

SEQ ID NO: 291644 - DNA, 20 bp, Artificial
  CRISPR gRNA sequence
aattacagtatgtgcttgcc

SEQ ID NO: 291645 - DNA, 20 bp, Artificial
  CRISPR gRNA sequence
cagtatgtgcttgccataaa

SEQ ID NO: 291646 - DNA, 20 bp, Artificial
  CRISPR gRNA sequence
gccataaattatctcattta

SEQ ID NO: 291647 - DNA, 20 bp, Artificial
  CRISPR gRNA sequence
ccataaattatctcatttaa

SEQ ID NO: 291648 - DNA, 20 bp, Artificial
  CRISPR gRNA sequence
tctcatttaatcttcataat

SEQ ID NO: 291649 - DNA, 20 bp, Artificial
  CRISPR gRNA sequence
atttaatcttcataataacc

SEQ ID NO: 291650 - DNA, 20 bp, Artificial
  CRISPR gRNA sequence
aatcttcataataaccaatg

SEQ ID NO: 291651 - DNA, 20 bp, Artificial
  CRISPR gRNA sequence
atcttcataataaccaatgt

SEQ ID NO: 291652 - DNA, 20 bp, Artificial
  CRISPR gRNA sequence
cataataaccaatgtgaaga

SEQ ID NO: 291653 - DNA, 20 bp, Artificial
  CRISPR gRNA sequence
ataataaccaatgtgaagac

SEQ ID NO: 291654 - DNA, 20 bp, Artificial
  CRISPR gRNA sequence
gggttcagagaagtaaagta

SEQ ID NO: 291655 - DNA, 20 bp, Artificial
  CRISPR gRNA sequence
agagaagtaaagtaagttgc

SEQ ID NO: 291656 - DNA, 20 bp, Artificial
  CRISPR gRNA sequence
cttaaggtcacacaactact

SEQ ID NO: 291657 - DNA, 20 bp, Artificial
  CRISPR gRNA sequence
aaggtcacacaactactgtg

SEQ ID NO: 291658 - DNA, 20 bp, Artificial
  CRISPR gRNA sequence
aggtcacacaactactgtgg

SEQ ID NO: 291659 - DNA, 20 bp, Artificial
  CRISPR gRNA sequence
ctgtggattttattgaatga

SEQ ID NO: 291660 - DNA, 20 bp, Artificial
  CRISPR gRNA sequence
tggattttattgaatgaaaa

SEQ ID NO: 291661 - DNA, 20 bp, Artificial
  CRISPR gRNA sequence
tattgaatgaaaaaagccca

SEQ ID NO: 291662 - DNA, 20 bp, Artificial
  CRISPR gRNA sequence
attgaatgaaaaaagcccat

SEQ ID NO: 291663 - DNA, 20 bp, Artificial
  CRISPR gRNA sequence
ttgaatgaaaaaagcccatg

SEQ ID NO: 291664 - DNA, 20 bp, Artificial
  CRISPR gRNA sequence
aatgaaaaaagcccatgttc

SEQ ID NO: 291665 - DNA, 20 bp, Artificial
  CRISPR gRNA sequence
tttctataccaacaaccagg

SEQ ID NO: 291666 - DNA, 20 bp, Artificial
  CRISPR gRNA sequence
tctataccaacaaccaggag

SEQ ID NO: 291667 - DNA, 20 bp, Artificial
  CRISPR gRNA sequence
ctataccaacaaccaggagc

SEQ ID NO: 291668 - DNA, 20 bp, Artificial
  CRISPR gRNA sequence
tataccaacaaccaggagcc

SEQ ID NO: 291669 - DNA, 20 bp, Artificial
  CRISPR gRNA sequence
taccaacaaccaggagcctc

SEQ ID NO: 291670 - DNA, 20 bp, Artificial
  CRISPR gRNA sequence
taggcaaggatgttagcagg

SEQ ID NO: 291671 - DNA, 20 bp, Artificial
  CRISPR gRNA sequence
ggcaaggatgttagcagggt

SEQ ID NO: 291672 - DNA, 20 bp, Artificial
  CRISPR gRNA sequence
gcagggtgcacttagtcatg

SEQ ID NO: 291673 - DNA, 20 bp, Artificial
  CRISPR gRNA sequence
agtcatggttgcctttaagg

SEQ ID NO: 291674 - DNA, 20 bp, Artificial
  CRISPR gRNA sequence
gtcatggttgcctttaaggt

SEQ ID NO: 291675 - DNA, 20 bp, Artificial
  CRISPR gRNA sequence
cctttaaggtaggtagggaa

SEQ ID NO: 291676 - DNA, 20 bp, Artificial
  CRISPR gRNA sequence
taaggtaggtagggaagtag

SEQ ID NO: 291677 - DNA, 20 bp, Artificial
  CRISPR gRNA sequence
aaggtaggtagggaagtagg

SEQ ID NO: 291678 - DNA, 20 bp, Artificial
  CRISPR gRNA sequence
aggtaggtagggaagtaggc

SEQ ID NO: 291679 - DNA, 20 bp, Artificial
  CRISPR gRNA sequence
agagctttaaatcctaagtc

SEQ ID NO: 291680 - DNA, 20 bp, Artificial
  CRISPR gRNA sequence
taaatcctaagtcactcaag

SEQ ID NO: 291681 - DNA, 20 bp, Artificial
  CRISPR gRNA sequence
aaatcctaagtcactcaagt

SEQ ID NO: 291682 - DNA, 20 bp, Artificial
  CRISPR gRNA sequence
aatcctaagtcactcaagtg

SEQ ID NO: 291683 - DNA, 20 bp, Artificial
  CRISPR gRNA sequence
agtcactcaagtgaaaaggg

SEQ ID NO: 291684 - DNA, 20 bp, Artificial
  CRISPR gRNA sequence
aagtgaaaaggggaggaatc

SEQ ID NO: 291685 - DNA, 20 bp, Artificial
  CRISPR gRNA sequence
aggtgacagatgaaggtttt

SEQ ID NO: 291686 - DNA, 20 bp, Artificial
  CRISPR gRNA sequence
tattcctgtgccacgccact

SEQ ID NO: 291687 - DNA, 20 bp, Artificial
  CRISPR gRNA sequence
attcctgtgccacgccactg

SEQ ID NO: 291688 - DNA, 20 bp, Artificial
  CRISPR gRNA sequence
ttcctgtgccacgccactga

SEQ ID NO: 291689 - DNA, 20 bp, Artificial
  CRISPR gRNA sequence
ctgtgccacgccactgaagt

SEQ ID NO: 291690 - DNA, 20 bp, Artificial
  CRISPR gRNA sequence
tgccacgccactgaagtcac

SEQ ID NO: 291691 - DNA, 20 bp, Artificial
  CRISPR gRNA sequence
aagtcacatgaaatggattg

SEQ ID NO: 291692 - DNA, 20 bp, Artificial
  CRISPR gRNA sequence
tctttagctcacttaatctg

SEQ ID NO: 291693 - DNA, 20 bp, Artificial
  CRISPR gRNA sequence
tagctcacttaatctggata

SEQ ID NO: 291694 - DNA, 20 bp, Artificial
  CRISPR gRNA sequence
agctcacttaatctggataa

SEQ ID NO: 291695 - DNA, 20 bp, Artificial
  CRISPR gRNA sequence
gctcacttaatctggataaa

SEQ ID NO: 291696 - DNA, 20 bp, Artificial
  CRISPR gRNA sequence
acttaatctggataaaattt

SEQ ID NO: 291697 - DNA, 20 bp, Artificial
  CRISPR gRNA sequence
aatctggataaaatttattc

SEQ ID NO: 291698 - DNA, 20 bp, Artificial
  CRISPR gRNA sequence
atctggataaaatttattct

SEQ ID NO: 291699 - DNA, 20 bp, Artificial
  CRISPR gRNA sequence
gataaaatttattcttagat

SEQ ID NO: 291700 - DNA, 20 bp, Artificial
  CRISPR gRNA sequence
attcttagatttttcccacg

SEQ ID NO: 291701 - DNA, 20 bp, Artificial
  CRISPR gRNA sequence
ttcttagatttttcccacgg

SEQ ID NO: 291702 - DNA, 20 bp, Artificial
  CRISPR gRNA sequence
ttagatttttcccacggtta

SEQ ID NO: 291703 - DNA, 20 bp, Artificial
  CRISPR gRNA sequence
agatttttcccacggttaaa

SEQ ID NO: 291704 - DNA, 20 bp, Artificial
  CRISPR gRNA sequence
gatttttcccacggttaaat

SEQ ID NO: 291705 - DNA, 20 bp, Artificial
  CRISPR gRNA sequence
ttcccacggttaaatgcagt

SEQ ID NO: 291706 - DNA, 20 bp, Artificial
  CRISPR gRNA sequence
tcccacggttaaatgcagtt

SEQ ID NO: 291707 - DNA, 20 bp, Artificial
  CRISPR gRNA sequence
cccacggttaaatgcagttc

SEQ ID NO: 291708 - DNA, 20 bp, Artificial
  CRISPR gRNA sequence
ccacggttaaatgcagttct

SEQ ID NO: 291709 - DNA, 20 bp, Artificial
  CRISPR gRNA sequence
aatgcagttctgtagtttaa

SEQ ID NO: 291710 - DNA, 20 bp, Artificial
  CRISPR gRNA sequence
tgtagtttaaatgaatgcgt

SEQ ID NO: 291711 - DNA, 20 bp, Artificial
  CRISPR gRNA sequence
tagtttaaatgaatgcgtgt

SEQ ID NO: 291712 - DNA, 20 bp, Artificial
  CRISPR gRNA sequence
aaatgaatgcgtgtacatgt

SEQ ID NO: 291713 - DNA, 20 bp, Artificial
  CRISPR gRNA sequence
aatgaatgcgtgtacatgtg

SEQ ID NO: 291714 - DNA, 20 bp, Artificial
  CRISPR gRNA sequence
tgtgtgtgtgtgtgtgtgtg

SEQ ID NO: 291715 - DNA, 20 bp, Artificial
  CRISPR gRNA sequence
ttgcatcacgtgattgtggg

SEQ ID NO: 291716 - DNA, 20 bp, Artificial
  CRISPR gRNA sequence
catcacgtgattgtggggag

SEQ ID NO: 291717 - DNA, 20 bp, Artificial
  CRISPR gRNA sequence
tggggagaggggctgtagga

SEQ ID NO: 291718 - DNA, 20 bp, Artificial
  CRISPR gRNA sequence
taggagaaacgcaagggaaa

SEQ ID NO: 291719 - DNA, 20 bp, Artificial
  CRISPR gRNA sequence
ggtctttacagtgaaattct

SEQ ID NO: 291720 - DNA, 20 bp, Artificial
  CRISPR gRNA sequence
tacagtgaaattcttcctta

SEQ ID NO: 291721 - DNA, 20 bp, Artificial
  CRISPR gRNA sequence
acagtgaaattcttccttat

SEQ ID NO: 291722 - DNA, 20 bp, Artificial
  CRISPR gRNA sequence
cagtgaaattcttccttatt

SEQ ID NO: 291723 - DNA, 20 bp, Artificial
  CRISPR gRNA sequence
ttccttatttctcaaggcag

SEQ ID NO: 291724 - DNA, 20 bp, Artificial
  CRISPR gRNA sequence
ccttatttctcaaggcagta

SEQ ID NO: 291725 - DNA, 20 bp, Artificial
  CRISPR gRNA sequence
cttatttctcaaggcagtag

SEQ ID NO: 291726 - DNA, 20 bp, Artificial
  CRISPR gRNA sequence
atttctcaaggcagtagtag

SEQ ID NO: 291727 - DNA, 20 bp, Artificial
  CRISPR gRNA sequence
tttctcaaggcagtagtagc

SEQ ID NO: 291728 - DNA, 20 bp, Artificial
  CRISPR gRNA sequence
ctcaaggcagtagtagctga

SEQ ID NO: 291729 - DNA, 20 bp, Artificial
  CRISPR gRNA sequence
tcaaggcagtagtagctgaa

SEQ ID NO: 291730 - DNA, 20 bp, Artificial
  CRISPR gRNA sequence
aaggcagtagtagctgaaaa

SEQ ID NO: 291731 - DNA, 20 bp, Artificial
  CRISPR gRNA sequence
aaaattacctaatcaagtga

SEQ ID NO: 291732 - DNA, 20 bp, Artificial
  CRISPR gRNA sequence
cctaatcaagtgaccaggca

SEQ ID NO: 291733 - DNA, 20 bp, Artificial
  CRISPR gRNA sequence
atcaagtgaccaggcaacag

SEQ ID NO: 291734 - DNA, 20 bp, Artificial
  CRISPR gRNA sequence
ctgtaagtgagaattcatga

SEQ ID NO: 291735 - DNA, 20 bp, Artificial
  CRISPR gRNA sequence
tgtaagtgagaattcatgaa

SEQ ID NO: 291736 - DNA, 20 bp, Artificial
  CRISPR gRNA sequence
taagtgagaattcatgaata

SEQ ID NO: 291737 - DNA, 20 bp, Artificial
  CRISPR gRNA sequence
atgaataatgaagattgatt

SEQ ID NO: 291738 - DNA, 20 bp, Artificial
  CRISPR gRNA sequence
attatattccctacctattt

SEQ ID NO: 291739 - DNA, 20 bp, Artificial
  CRISPR gRNA sequence
tattccctacctatttaaag

SEQ ID NO: 291740 - DNA, 20 bp, Artificial
  CRISPR gRNA sequence
cctacctatttaaagtatgg

SEQ ID NO: 291741 - DNA, 20 bp, Artificial
  CRISPR gRNA sequence
cctatttaaagtatggccct

SEQ ID NO: 291742 - DNA, 20 bp, Artificial
  CRISPR gRNA sequence
tttaaagtatggccctcttt

SEQ ID NO: 291743 - DNA, 20 bp, Artificial
  CRISPR gRNA sequence
aaagtatggccctctttttt

SEQ ID NO: 291744 - DNA, 20 bp, Artificial
  CRISPR gRNA sequence
aagtatggccctcttttttc

SEQ ID NO: 291745 - DNA, 20 bp, Artificial
  CRISPR gRNA sequence
ttttttcttcttagttgacc

SEQ ID NO: 291746 - DNA, 20 bp, Artificial
  CRISPR gRNA sequence
ttttcttcttagttgacctc

SEQ ID NO: 291747 - DNA, 20 bp, Artificial
  CRISPR gRNA sequence
tttcttcttagttgacctca

SEQ ID NO: 291748 - DNA, 20 bp, Artificial
  CRISPR gRNA sequence
ttcttcttagttgacctcat

SEQ ID NO: 291749 - DNA, 20 bp, Artificial
  CRISPR gRNA sequence
tcttcttagttgacctcatc

SEQ ID NO: 291750 - DNA, 20 bp, Artificial
  CRISPR gRNA sequence
cttcttagttgacctcatct

SEQ ID NO: 291751 - DNA, 20 bp, Artificial
  CRISPR gRNA sequence
ttcttagttgacctcatctc

SEQ ID NO: 291752 - DNA, 20 bp, Artificial
  CRISPR gRNA sequence
cttagttgacctcatctccc

SEQ ID NO: 291753 - DNA, 20 bp, Artificial
  CRISPR gRNA sequence
ttagttgacctcatctccct

SEQ ID NO: 291754 - DNA, 20 bp, Artificial
  CRISPR gRNA sequence
agttgacctcatctccctcc

SEQ ID NO: 291755 - DNA, 20 bp, Artificial
  CRISPR gRNA sequence
gttgacctcatctccctccc

SEQ ID NO: 291756 - DNA, 20 bp, Artificial
  CRISPR gRNA sequence
acctcatctccctcccttat

SEQ ID NO: 291757 - DNA, 20 bp, Artificial
  CRISPR gRNA sequence
atctccctcccttattcttc

SEQ ID NO: 291758 - DNA, 20 bp, Artificial
  CRISPR gRNA sequence
cctcccttattcttcgtcat

SEQ ID NO: 291759 - DNA, 20 bp, Artificial
  CRISPR gRNA sequence
ccttattcttcgtcatgact

SEQ ID NO: 291760 - DNA, 20 bp, Artificial
  CRISPR gRNA sequence
attcttcgtcatgactgcag

SEQ ID NO: 291761 - DNA, 20 bp, Artificial
  CRISPR gRNA sequence
ttcttcgtcatgactgcaga

SEQ ID NO: 291762 - DNA, 20 bp, Artificial
  CRISPR gRNA sequence
ttcgtcatgactgcagaatc

SEQ ID NO: 291763 - DNA, 20 bp, Artificial
  CRISPR gRNA sequence
cgtcatgactgcagaatcat

SEQ ID NO: 291764 - DNA, 20 bp, Artificial
  CRISPR gRNA sequence
gtcatgactgcagaatcata

SEQ ID NO: 291765 - DNA, 20 bp, Artificial
  CRISPR gRNA sequence
cagaatcataggcccttgga

SEQ ID NO: 291766 - DNA, 20 bp, Artificial
  CRISPR gRNA sequence
ggaatctcaggctgacctgc

SEQ ID NO: 291767 - DNA, 20 bp, Artificial
  CRISPR gRNA sequence
gaatctcaggctgacctgcc

SEQ ID NO: 291768 - DNA, 20 bp, Artificial
  CRISPR gRNA sequence
aggctgacctgccctgtcct

SEQ ID NO: 291769 - DNA, 20 bp, Artificial
  CRISPR gRNA sequence
acctgccctgtcctagactt

SEQ ID NO: 291770 - DNA, 20 bp, Artificial
  CRISPR gRNA sequence
ccctgtcctagacttcctga

SEQ ID NO: 291771 - DNA, 20 bp, Artificial
  CRISPR gRNA sequence
tcctagacttcctgaacctc

SEQ ID NO: 291772 - DNA, 20 bp, Artificial
  CRISPR gRNA sequence
gacttcctgaacctctcaat

SEQ ID NO: 291773 - DNA, 20 bp, Artificial
  CRISPR gRNA sequence
cctgaacctctcaatctctc

SEQ ID NO: 291774 - DNA, 20 bp, Artificial
  CRISPR gRNA sequence
ctgaacctctcaatctctca

SEQ ID NO: 291775 - DNA, 20 bp, Artificial
  CRISPR gRNA sequence
aacctctcaatctctcagtt

SEQ ID NO: 291776 - DNA, 20 bp, Artificial
  CRISPR gRNA sequence
tcaatctctcagttgtctca

SEQ ID NO: 291777 - DNA, 20 bp, Artificial
  CRISPR gRNA sequence
aatctctcagttgtctcagc

SEQ ID NO: 291778 - DNA, 20 bp, Artificial
  CRISPR gRNA sequence
tcagttgtctcagctgcaaa

SEQ ID NO: 291779 - DNA, 20 bp, Artificial
  CRISPR gRNA sequence
agttgtctcagctgcaaaat

SEQ ID NO: 291780 - DNA, 20 bp, Artificial
  CRISPR gRNA sequence
tctcagctgcaaaatgggga

SEQ ID NO: 291781 - DNA, 20 bp, Artificial
  CRISPR gRNA sequence
agctgcaaaatggggaaaat

SEQ ID NO: 291782 - DNA, 20 bp, Artificial
  CRISPR gRNA sequence
caaaatggggaaaataatac

SEQ ID NO: 291783 - DNA, 20 bp, Artificial
  CRISPR gRNA sequence
gtggggttgttgggggatta

SEQ ID NO: 291784 - DNA, 20 bp, Artificial
  CRISPR gRNA sequence
tggggttgttgggggattaa

SEQ ID NO: 291785 - DNA, 20 bp, Artificial
  CRISPR gRNA sequence
ttgggggattaaatgacata

SEQ ID NO: 291786 - DNA, 20 bp, Artificial
  CRISPR gRNA sequence
ggggattaaatgacatagca

SEQ ID NO: 291787 - DNA, 20 bp, Artificial
  CRISPR gRNA sequence
aatgacatagcacctgtccc

SEQ ID NO: 291788 - DNA, 20 bp, Artificial
  CRISPR gRNA sequence
tcccctccatagagccacca

SEQ ID NO: 291789 - DNA, 20 bp, Artificial
  CRISPR gRNA sequence
catagagccaccacagagga

SEQ ID NO: 291790 - DNA, 20 bp, Artificial
  CRISPR gRNA sequence
aatataggctatctagacag

SEQ ID NO: 291791 - DNA, 20 bp, Artificial
  CRISPR gRNA sequence
tctagacagaggtgggcaac

SEQ ID NO: 291792 - DNA, 20 bp, Artificial
  CRISPR gRNA sequence
gacagaggtgggcaacagca

SEQ ID NO: 291793 - DNA, 20 bp, Artificial
  CRISPR gRNA sequence
gccctcctccaccaccactg

SEQ ID NO: 291794 - DNA, 20 bp, Artificial
  CRISPR gRNA sequence
ccctcctccaccaccactgt

SEQ ID NO: 291795 - DNA, 20 bp, Artificial
  CRISPR gRNA sequence
ctccaccaccactgtaccca

SEQ ID NO: 291796 - DNA, 20 bp, Artificial
  CRISPR gRNA sequence
caccaccactgtacccagaa

SEQ ID NO: 291797 - DNA, 20 bp, Artificial
  CRISPR gRNA sequence
tacccagaaccttagtcagg

SEQ ID NO: 291798 - DNA, 20 bp, Artificial
  CRISPR gRNA sequence
agtcaggactgacttctctt

SEQ ID NO: 291799 - DNA, 20 bp, Artificial
  CRISPR gRNA sequence
gtcaggactgacttctcttg

SEQ ID NO: 291800 - DNA, 20 bp, Artificial
  CRISPR gRNA sequence
acttctcttgggggtggtat

SEQ ID NO: 291801 - DNA, 20 bp, Artificial
  CRISPR gRNA sequence
ctcttgggggtggtattgtg

SEQ ID NO: 291802 - DNA, 20 bp, Artificial
  CRISPR gRNA sequence
tcttgggggtggtattgtgt

SEQ ID NO: 291803 - DNA, 20 bp, Artificial
  CRISPR gRNA sequence
ttgggggtggtattgtgtta

SEQ ID NO: 291804 - DNA, 20 bp, Artificial
  CRISPR gRNA sequence
gggggtggtattgtgttagg

SEQ ID NO: 291805 - DNA, 20 bp, Artificial
  CRISPR gRNA sequence
ggggtggtattgtgttaggt

SEQ ID NO: 291806 - DNA, 20 bp, Artificial
  CRISPR gRNA sequence
tgttaggtaaaccaaataag

SEQ ID NO: 291807 - DNA, 20 bp, Artificial
  CRISPR gRNA sequence
ggtaaaccaaataagaagta

SEQ ID NO: 291808 - DNA, 20 bp, Artificial
  CRISPR gRNA sequence
aaaattgcctgctgtgagag

SEQ ID NO: 291809 - DNA, 20 bp, Artificial
  CRISPR gRNA sequence
cctgctgtgagagaaggctc

SEQ ID NO: 291810 - DNA, 20 bp, Artificial
  CRISPR gRNA sequence
ctgtgagagaaggctcatat

SEQ ID NO: 291811 - DNA, 20 bp, Artificial
  CRISPR gRNA sequence
tgagagaaggctcatatgct

SEQ ID NO: 291812 - DNA, 20 bp, Artificial
  CRISPR gRNA sequence
atatgctcctaaatcttgca

SEQ ID NO: 291813 - DNA, 20 bp, Artificial
  CRISPR gRNA sequence
ctaaatcttgcatgtcattg

SEQ ID NO: 291814 - DNA, 20 bp, Artificial
  CRISPR gRNA sequence
aatcttgcatgtcattggaa

SEQ ID NO: 291815 - DNA, 20 bp, Artificial
  CRISPR gRNA sequence
gcatgtcattggaaaattct

SEQ ID NO: 291816 - DNA, 20 bp, Artificial
  CRISPR gRNA sequence
catgtcattggaaaattctc

SEQ ID NO: 291817 - DNA, 20 bp, Artificial
  CRISPR gRNA sequence
gaaaattctcaagaaaaagg

SEQ ID NO: 291818 - DNA, 20 bp, Artificial
  CRISPR gRNA sequence
tcaagaaaaaggaaggggat

SEQ ID NO: 291819 - DNA, 20 bp, Artificial
  CRISPR gRNA sequence
aagaaaaaggaaggggatag

SEQ ID NO: 291820 - DNA, 20 bp, Artificial
  CRISPR gRNA sequence
tgttataatgattggtccat

SEQ ID NO: 291821 - DNA, 20 bp, Artificial
  CRISPR gRNA sequence
taatgattggtccatgagtc

SEQ ID NO: 291822 - DNA, 20 bp, Artificial
  CRISPR gRNA sequence
gtccatgagtctgattttag

SEQ ID NO: 291823 - DNA, 20 bp, Artificial
  CRISPR gRNA sequence
attttagtgatttgtcttca

SEQ ID NO: 291824 - DNA, 20 bp, Artificial
  CRISPR gRNA sequence
tagtgatttgtcttcattgt

SEQ ID NO: 291825 - DNA, 20 bp, Artificial
  CRISPR gRNA sequence
agtgatttgtcttcattgtt

SEQ ID NO: 291826 - DNA, 20 bp, Artificial
  CRISPR gRNA sequence
gtgatttgtcttcattgttt

SEQ ID NO: 291827 - DNA, 20 bp, Artificial
  CRISPR gRNA sequence
gtcttcattgttttcaaaac

SEQ ID NO: 291828 - DNA, 20 bp, Artificial
  CRISPR gRNA sequence
tcttcattgttttcaaaacc

SEQ ID NO: 291829 - DNA, 20 bp, Artificial
  CRISPR gRNA sequence
cattgttttcaaaaccaaat

SEQ ID NO: 291830 - DNA, 20 bp, Artificial
  CRISPR gRNA sequence
attgttttcaaaaccaaatt

SEQ ID NO: 291831 - DNA, 20 bp, Artificial
  CRISPR gRNA sequence
ttttcaaaaccaaatttgtt

SEQ ID NO: 291832 - DNA, 20 bp, Artificial
  CRISPR gRNA sequence
tcaaaaccaaatttgttttt

SEQ ID NO: 291833 - DNA, 20 bp, Artificial
  CRISPR gRNA sequence
caaaaccaaatttgtttttt

SEQ ID NO: 291834 - DNA, 20 bp, Artificial
  CRISPR gRNA sequence
aaaaccaaatttgtttttta

SEQ ID NO: 291835 - DNA, 20 bp, Artificial
  CRISPR gRNA sequence
gttttttatgcaatcacatt

SEQ ID NO: 291836 - DNA, 20 bp, Artificial
  CRISPR gRNA sequence
ttttttatgcaatcacattt

SEQ ID NO: 291837 - DNA, 20 bp, Artificial
  CRISPR gRNA sequence
tttatgcaatcacatttagt

SEQ ID NO: 291838 - DNA, 20 bp, Artificial
  CRISPR gRNA sequence
ttatgcaatcacatttagtt

SEQ ID NO: 291839 - DNA, 20 bp, Artificial
  CRISPR gRNA sequence
tatgcaatcacatttagttt

SEQ ID NO: 291840 - DNA, 20 bp, Artificial
  CRISPR gRNA sequence
atgcaatcacatttagtttt

SEQ ID NO: 291841 - DNA, 20 bp, Artificial
  CRISPR gRNA sequence
tgcaatcacatttagttttt

SEQ ID NO: 291842 - DNA, 20 bp, Artificial
  CRISPR gRNA sequence
agtttttctagatagtgact

SEQ ID NO: 291843 - DNA, 20 bp, Artificial
  CRISPR gRNA sequence
gtttttctagatagtgactt

SEQ ID NO: 291844 - DNA, 20 bp, Artificial
  CRISPR gRNA sequence
ttctagatagtgacttccaa

SEQ ID NO: 291845 - DNA, 20 bp, Artificial
  CRISPR gRNA sequence
tctagatagtgacttccaaa

SEQ ID NO: 291846 - DNA, 20 bp, Artificial
  CRISPR gRNA sequence
ctagatagtgacttccaaaa

SEQ ID NO: 291847 - DNA, 20 bp, Artificial
  CRISPR gRNA sequence
tagatagtgacttccaaaac

SEQ ID NO: 291848 - DNA, 20 bp, Artificial
  CRISPR gRNA sequence
gatagtgacttccaaaacct

SEQ ID NO: 291849 - DNA, 20 bp, Artificial
  CRISPR gRNA sequence
ccaaaacctttaacaagcat

SEQ ID NO: 291850 - DNA, 20 bp, Artificial
  CRISPR gRNA sequence
caaaacctttaacaagcatt

SEQ ID NO: 291851 - DNA, 20 bp, Artificial
  CRISPR gRNA sequence
taacaagcattgcgggtgca

SEQ ID NO: 291852 - DNA, 20 bp, Artificial
  CRISPR gRNA sequence
aacaagcattgcgggtgcaa

SEQ ID NO: 291853 - DNA, 20 bp, Artificial
  CRISPR gRNA sequence
acaagcattgcgggtgcaac

SEQ ID NO: 291854 - DNA, 20 bp, Artificial
  CRISPR gRNA sequence
cgggtgcaactgctatagaa

SEQ ID NO: 291855 - DNA, 20 bp, Artificial
  CRISPR gRNA sequence
ctatagaaaacactattgag

SEQ ID NO: 291856 - DNA, 20 bp, Artificial
  CRISPR gRNA sequence
tagaaaacactattgaggtt

SEQ ID NO: 291857 - DNA, 20 bp, Artificial
  CRISPR gRNA sequence
ttgaggttcctcagaaaatt

SEQ ID NO: 291858 - DNA, 20 bp, Artificial
  CRISPR gRNA sequence
aggttcctcagaaaattaaa

SEQ ID NO: 291859 - DNA, 20 bp, Artificial
  CRISPR gRNA sequence
ctcagaaaattaaaaataga

SEQ ID NO: 291860 - DNA, 20 bp, Artificial
  CRISPR gRNA sequence
agaaaattaaaaatagaact

SEQ ID NO: 291861 - DNA, 20 bp, Artificial
  CRISPR gRNA sequence
aaaatagaactaccatatga

SEQ ID NO: 291862 - DNA, 20 bp, Artificial
  CRISPR gRNA sequence
ccatatgaccccaaaattcc

SEQ ID NO: 291863 - DNA, 20 bp, Artificial
  CRISPR gRNA sequence
catatatccataagaattga

SEQ ID NO: 291864 - DNA, 20 bp, Artificial
  CRISPR gRNA sequence
aaagcagggtcttgaagaga

SEQ ID NO: 291865 - DNA, 20 bp, Artificial
  CRISPR gRNA sequence
gaagagatatttgcacaccc

SEQ ID NO: 291866 - DNA, 20 bp, Artificial
  CRISPR gRNA sequence
aagagatatttgcacaccca

SEQ ID NO: 291867 - DNA, 20 bp, Artificial
  CRISPR gRNA sequence
gcacacccatgttcatagca

SEQ ID NO: 291868 - DNA, 20 bp, Artificial
  CRISPR gRNA sequence
cacacccatgttcatagcag

SEQ ID NO: 291869 - DNA, 20 bp, Artificial
  CRISPR gRNA sequence
atagcagcacagtagccagg

SEQ ID NO: 291870 - DNA, 20 bp, Artificial
  CRISPR gRNA sequence
cagatgaatgggcaaacaaa

SEQ ID NO: 291871 - DNA, 20 bp, Artificial
  CRISPR gRNA sequence
ttcattatccttatgatcat

SEQ ID NO: 291872 - DNA, 20 bp, Artificial
  CRISPR gRNA sequence
attatccttatgatcatatc

SEQ ID NO: 291873 - DNA, 20 bp, Artificial
  CRISPR gRNA sequence
tccttatgatcatatcatta

SEQ ID NO: 291874 - DNA, 20 bp, Artificial
  CRISPR gRNA sequence
atgatcatatcattaccatt

SEQ ID NO: 291875 - DNA, 20 bp, Artificial
  CRISPR gRNA sequence
tgatcatatcattaccattc

SEQ ID NO: 291876 - DNA, 20 bp, Artificial
  CRISPR gRNA sequence
ccattccaaaggaaggaaat

SEQ ID NO: 291877 - DNA, 20 bp, Artificial
  CRISPR gRNA sequence
caaaggaaggaaatcctatc

SEQ ID NO: 291878 - DNA, 20 bp, Artificial
  CRISPR gRNA sequence
tcatatgctacaacgtgaat

SEQ ID NO: 291879 - DNA, 20 bp, Artificial
  CRISPR gRNA sequence
caacgtgaatgaaccttgag

SEQ ID NO: 291880 - DNA, 20 bp, Artificial
  CRISPR gRNA sequence
gagtgcatcatgctaagtga

SEQ ID NO: 291881 - DNA, 20 bp, Artificial
  CRISPR gRNA sequence
agtgcatcatgctaagtgaa

SEQ ID NO: 291882 - DNA, 20 bp, Artificial
  CRISPR gRNA sequence
agtgaaataagccaatcata

SEQ ID NO: 291883 - DNA, 20 bp, Artificial
  CRISPR gRNA sequence
ttactgtatgattctatttc

SEQ ID NO: 291884 - DNA, 20 bp, Artificial
  CRISPR gRNA sequence
ctgtatgattctatttctat

SEQ ID NO: 291885 - DNA, 20 bp, Artificial
  CRISPR gRNA sequence
tatgattctatttctatgag

SEQ ID NO: 291886 - DNA, 20 bp, Artificial
  CRISPR gRNA sequence
tatttctatgagatatttaa

SEQ ID NO: 291887 - DNA, 20 bp, Artificial
  CRISPR gRNA sequence
tttctatgagatatttaaag

SEQ ID NO: 291888 - DNA, 20 bp, Artificial
  CRISPR gRNA sequence
ctatgagatatttaaagtag

SEQ ID NO: 291889 - DNA, 20 bp, Artificial
  CRISPR gRNA sequence
tatgagatatttaaagtagc

SEQ ID NO: 291890 - DNA, 20 bp, Artificial
  CRISPR gRNA sequence
tgagatatttaaagtagcca

SEQ ID NO: 291891 - DNA, 20 bp, Artificial
  CRISPR gRNA sequence
aaagtagccaaattcataca

SEQ ID NO: 291892 - DNA, 20 bp, Artificial
  CRISPR gRNA sequence
aagtagccaaattcatacaa

SEQ ID NO: 291893 - DNA, 20 bp, Artificial
  CRISPR gRNA sequence
atacaaacaaacagaatggc

SEQ ID NO: 291894 - DNA, 20 bp, Artificial
  CRISPR gRNA sequence
ccagaggctgaggggagagg

SEQ ID NO: 291895 - DNA, 20 bp, Artificial
  CRISPR gRNA sequence
aggggagagggggaaagggg

SEQ ID NO: 291896 - DNA, 20 bp, Artificial
  CRISPR gRNA sequence
tttaatgggcatagagtttc

SEQ ID NO: 291897 - DNA, 20 bp, Artificial
  CRISPR gRNA sequence
aatgggcatagagtttcaga

SEQ ID NO: 291898 - DNA, 20 bp, Artificial
  CRISPR gRNA sequence
atgggcatagagtttcagat

SEQ ID NO: 291899 - DNA, 20 bp, Artificial
  CRISPR gRNA sequence
cagatttgcaaaatgaaaat

SEQ ID NO: 291900 - DNA, 20 bp, Artificial
  CRISPR gRNA sequence
agatttgcaaaatgaaaatt

SEQ ID NO: 291901 - DNA, 20 bp, Artificial
  CRISPR gRNA sequence
gcaaaatgaaaatttctaga

SEQ ID NO: 291902 - DNA, 20 bp, Artificial
  CRISPR gRNA sequence
caaaatgaaaatttctagag

SEQ ID NO: 291903 - DNA, 20 bp, Artificial
  CRISPR gRNA sequence
ctagagatctgtttcacaac

SEQ ID NO: 291904 - DNA, 20 bp, Artificial
  CRISPR gRNA sequence
tagagatctgtttcacaaca

SEQ ID NO: 291905 - DNA, 20 bp, Artificial
  CRISPR gRNA sequence
gagatctgtttcacaacaat

SEQ ID NO: 291906 - DNA, 20 bp, Artificial
  CRISPR gRNA sequence
tttcacaacaatgtgaatat

SEQ ID NO: 291907 - DNA, 20 bp, Artificial
  CRISPR gRNA sequence
cacaacaatgtgaatatact

SEQ ID NO: 291908 - DNA, 20 bp, Artificial
  CRISPR gRNA sequence
acaacaatgtgaatatactt

SEQ ID NO: 291909 - DNA, 20 bp, Artificial
  CRISPR gRNA sequence
aacattactgaactgtacac

SEQ ID NO: 291910 - DNA, 20 bp, Artificial
  CRISPR gRNA sequence
acattactgaactgtacact

SEQ ID NO: 291911 - DNA, 20 bp, Artificial
  CRISPR gRNA sequence
ctgaactgtacacttaaaaa

SEQ ID NO: 291912 - DNA, 20 bp, Artificial
  CRISPR gRNA sequence
aactgtacacttaaaaatca

SEQ ID NO: 291913 - DNA, 20 bp, Artificial
  CRISPR gRNA sequence
tacacttaaaaatcaataag

SEQ ID NO: 291914 - DNA, 20 bp, Artificial
  CRISPR gRNA sequence
aaaaatcaataagatgataa

SEQ ID NO: 291915 - DNA, 20 bp, Artificial
  CRISPR gRNA sequence
aaaatcaataagatgataaa

SEQ ID NO: 291916 - DNA, 20 bp, Artificial
  CRISPR gRNA sequence
tatgttatgtgtttgtttgt

SEQ ID NO: 291917 - DNA, 20 bp, Artificial
  CRISPR gRNA sequence
atgttatgtgtttgtttgtt

SEQ ID NO: 291918 - DNA, 20 bp, Artificial
  CRISPR gRNA sequence
tgttatgtgtttgtttgttt

SEQ ID NO: 291919 - DNA, 20 bp, Artificial
  CRISPR gRNA sequence
tgtgtttgtttgtttgtttg

SEQ ID NO: 291920 - DNA, 20 bp, Artificial
  CRISPR gRNA sequence
gtttgtttgtttgtttgttt

SEQ ID NO: 291921 - DNA, 20 bp, Artificial
  CRISPR gRNA sequence
tttgtttgtttgtttgtttg

SEQ ID NO: 291922 - DNA, 20 bp, Artificial
  CRISPR gRNA sequence
gtttgtttgtttgtttggag

SEQ ID NO: 291923 - DNA, 20 bp, Artificial
  CRISPR gRNA sequence
tttgtttgtttgtttggaga

SEQ ID NO: 291924 - DNA, 20 bp, Artificial
  CRISPR gRNA sequence
gtttgtttgtttggagatgg

SEQ ID NO: 291925 - DNA, 20 bp, Artificial
  CRISPR gRNA sequence
tttgtttgtttggagatgga

SEQ ID NO: 291926 - DNA, 20 bp, Artificial
  CRISPR gRNA sequence
gtttgtttggagatggagtt

SEQ ID NO: 291927 - DNA, 20 bp, Artificial
  CRISPR gRNA sequence
tttgtttggagatggagttt

SEQ ID NO: 291928 - DNA, 20 bp, Artificial
  CRISPR gRNA sequence
gtttggagatggagttttgc

SEQ ID NO: 291929 - DNA, 20 bp, Artificial
  CRISPR gRNA sequence
tttggagatggagttttgct

SEQ ID NO: 291930 - DNA, 20 bp, Artificial
  CRISPR gRNA sequence
ggagatggagttttgctctt

SEQ ID NO: 291931 - DNA, 20 bp, Artificial
  CRISPR gRNA sequence
gagatggagttttgctcttg

SEQ ID NO: 291932 - DNA, 20 bp, Artificial
  CRISPR gRNA sequence
tgctcttgttgcccaggctg

SEQ ID NO: 291933 - DNA, 20 bp, Artificial
  CRISPR gRNA sequence
gctcttgttgcccaggctgg

SEQ ID NO: 291934 - DNA, 20 bp, Artificial
  CRISPR gRNA sequence
ctcttgttgcccaggctggg

SEQ ID NO: 291935 - DNA, 20 bp, Artificial
  CRISPR gRNA sequence
ttgttgcccaggctggggtg

SEQ ID NO: 291936 - DNA, 20 bp, Artificial
  CRISPR gRNA sequence
gttgcccaggctggggtgca

SEQ ID NO: 291937 - DNA, 20 bp, Artificial
  CRISPR gRNA sequence
ttgcccaggctggggtgcaa

SEQ ID NO: 291938 - DNA, 20 bp, Artificial
  CRISPR gRNA sequence
cccaggctggggtgcaatct

SEQ ID NO: 291939 - DNA, 20 bp, Artificial
  CRISPR gRNA sequence
gggtgcaatctcagcttact

SEQ ID NO: 291940 - DNA, 20 bp, Artificial
  CRISPR gRNA sequence
agcttactgcaacctccgcc

SEQ ID NO: 291941 - DNA, 20 bp, Artificial
  CRISPR gRNA sequence
actgcaacctccgcctcctg

SEQ ID NO: 291942 - DNA, 20 bp, Artificial
  CRISPR gRNA sequence
ctgcaacctccgcctcctgg

SEQ ID NO: 291943 - DNA, 20 bp, Artificial
  CRISPR gRNA sequence
caacctccgcctcctgggtt

SEQ ID NO: 291944 - DNA, 20 bp, Artificial
  CRISPR gRNA sequence
cgcctcctgggttcaagtga

SEQ ID NO: 291945 - DNA, 20 bp, Artificial
  CRISPR gRNA sequence
ctgggttcaagtgattctcc

SEQ ID NO: 291946 - DNA, 20 bp, Artificial
  CRISPR gRNA sequence
ggttcaagtgattctcctgc

SEQ ID NO: 291947 - DNA, 20 bp, Artificial
  CRISPR gRNA sequence
aagtgattctcctgcctcag

SEQ ID NO: 291948 - DNA, 20 bp, Artificial
  CRISPR gRNA sequence
tcctgcctcagcctcccgag

SEQ ID NO: 291949 - DNA, 20 bp, Artificial
  CRISPR gRNA sequence
ctgcctcagcctcccgagta

SEQ ID NO: 291950 - DNA, 20 bp, Artificial
  CRISPR gRNA sequence
cctcagcctcccgagtagct

SEQ ID NO: 291951 - DNA, 20 bp, Artificial
  CRISPR gRNA sequence
agcctcccgagtagctggga

SEQ ID NO: 291952 - DNA, 20 bp, Artificial
  CRISPR gRNA sequence
ccgagtagctgggattacta

SEQ ID NO: 291953 - DNA, 20 bp, Artificial
  CRISPR gRNA sequence
ggattactacacccgccacc

SEQ ID NO: 291954 - DNA, 20 bp, Artificial
  CRISPR gRNA sequence
ctacacccgccaccacaccc

SEQ ID NO: 291955 - DNA, 20 bp, Artificial
  CRISPR gRNA sequence
cacccgccaccacacccggc

SEQ ID NO: 291956 - DNA, 20 bp, Artificial
  CRISPR gRNA sequence
attttttgtatttttagtag

SEQ ID NO: 291957 - DNA, 20 bp, Artificial
  CRISPR gRNA sequence
tttgtatttttagtagagac

SEQ ID NO: 291958 - DNA, 20 bp, Artificial
  CRISPR gRNA sequence
ttgtatttttagtagagaca

SEQ ID NO: 291959 - DNA, 20 bp, Artificial
  CRISPR gRNA sequence
tgtatttttagtagagacag

SEQ ID NO: 291960 - DNA, 20 bp, Artificial
  CRISPR gRNA sequence
gtatttttagtagagacaga

SEQ ID NO: 291961 - DNA, 20 bp, Artificial
  CRISPR gRNA sequence
tatttttagtagagacagag

SEQ ID NO: 291962 - DNA, 20 bp, Artificial
  CRISPR gRNA sequence
ttagtagagacagagtttca

SEQ ID NO: 291963 - DNA, 20 bp, Artificial
  CRISPR gRNA sequence
tagtagagacagagtttcac

SEQ ID NO: 291964 - DNA, 20 bp, Artificial
  CRISPR gRNA sequence
agtagagacagagtttcacc

SEQ ID NO: 291965 - DNA, 20 bp, Artificial
  CRISPR gRNA sequence
gtagagacagagtttcacca

SEQ ID NO: 291966 - DNA, 20 bp, Artificial
  CRISPR gRNA sequence
caccatgttggcccggctgg

SEQ ID NO: 291967 - DNA, 20 bp, Artificial
  CRISPR gRNA sequence
accatgttggcccggctggt

SEQ ID NO: 291968 - DNA, 20 bp, Artificial
  CRISPR gRNA sequence
gcccggctggtctcgaactc

SEQ ID NO: 291969 - DNA, 20 bp, Artificial
  CRISPR gRNA sequence
gtctcgaactcctgacctca

SEQ ID NO: 291970 - DNA, 20 bp, Artificial
  CRISPR gRNA sequence
gaactcctgacctcaagtga

SEQ ID NO: 291971 - DNA, 20 bp, Artificial
  CRISPR gRNA sequence
ctgacctcaagtgatctgcc

SEQ ID NO: 291972 - DNA, 20 bp, Artificial
  CRISPR gRNA sequence
acctcaagtgatctgcctgc

SEQ ID NO: 291973 - DNA, 20 bp, Artificial
  CRISPR gRNA sequence
aagtgatctgcctgcctcgg

SEQ ID NO: 291974 - DNA, 20 bp, Artificial
  CRISPR gRNA sequence
cctgcctcggcctcccaaag

SEQ ID NO: 291975 - DNA, 20 bp, Artificial
  CRISPR gRNA sequence
cctcggcctcccaaagtgct

SEQ ID NO: 291976 - DNA, 20 bp, Artificial
  CRISPR gRNA sequence
ggcctcccaaagtgctggga

SEQ ID NO: 291977 - DNA, 20 bp, Artificial
  CRISPR gRNA sequence
ccaaagtgctgggattacag

SEQ ID NO: 291978 - DNA, 20 bp, Artificial
  CRISPR gRNA sequence
ggattacaggcgtgagccac

SEQ ID NO: 291979 - DNA, 20 bp, Artificial
  CRISPR gRNA sequence
caggcgtgagccaccacgcc

SEQ ID NO: 291980 - DNA, 20 bp, Artificial
  CRISPR gRNA sequence
ttgtgttttttaccacaatt

SEQ ID NO: 291981 - DNA, 20 bp, Artificial
  CRISPR gRNA sequence
tgttttttaccacaattttt

SEQ ID NO: 291982 - DNA, 20 bp, Artificial
  CRISPR gRNA sequence
tttaccacaatttttaaaaa

SEQ ID NO: 291983 - DNA, 20 bp, Artificial
  CRISPR gRNA sequence
ttaccacaatttttaaaaaa

SEQ ID NO: 291984 - DNA, 20 bp, Artificial
  CRISPR gRNA sequence
taccacaatttttaaaaaat

SEQ ID NO: 291985 - DNA, 20 bp, Artificial
  CRISPR gRNA sequence
accacaatttttaaaaaatg

SEQ ID NO: 291986 - DNA, 20 bp, Artificial
  CRISPR gRNA sequence
ccacaatttttaaaaaatga

SEQ ID NO: 291987 - DNA, 20 bp, Artificial
  CRISPR gRNA sequence
ttaaaaaatgaagagaaaaa

SEQ ID NO: 291988 - DNA, 20 bp, Artificial
  CRISPR gRNA sequence
taaaaaatgaagagaaaaaa

SEQ ID NO: 291989 - DNA, 20 bp, Artificial
  CRISPR gRNA sequence
aaaaaatgaagagaaaaaaa

SEQ ID NO: 291990 - DNA, 20 bp, Artificial
  CRISPR gRNA sequence
aaaaatgaagagaaaaaaag

SEQ ID NO: 291991 - DNA, 20 bp, Artificial
  CRISPR gRNA sequence
gggaccccaaaaatcaaact

SEQ ID NO: 291992 - DNA, 20 bp, Artificial
  CRISPR gRNA sequence
gattgatacttagtcactag

SEQ ID NO: 291993 - DNA, 20 bp, Artificial
  CRISPR gRNA sequence
atacttagtcactagacaca

SEQ ID NO: 291994 - DNA, 20 bp, Artificial
  CRISPR gRNA sequence
agtcactagacacaacaccc

SEQ ID NO: 291995 - DNA, 20 bp, Artificial
  CRISPR gRNA sequence
gtcactagacacaacaccct

SEQ ID NO: 291996 - DNA, 20 bp, Artificial
  CRISPR gRNA sequence
gacacaacaccctaagttct

SEQ ID NO: 291997 - DNA, 20 bp, Artificial
  CRISPR gRNA sequence
agttctgttactgccgactt

SEQ ID NO: 291998 - DNA, 20 bp, Artificial
  CRISPR gRNA sequence
tgttactgccgactttggat

SEQ ID NO: 291999 - DNA, 20 bp, Artificial
  CRISPR gRNA sequence
ttactgccgactttggattc

SEQ ID NO: 292000 - DNA, 20 bp, Artificial
  CRISPR gRNA sequence
ctgccgactttggattcctg

SEQ ID NO: 292001 - DNA, 20 bp, Artificial
  CRISPR gRNA sequence
ccgactttggattcctgacc

SEQ ID NO: 292002 - DNA, 20 bp, Artificial
  CRISPR gRNA sequence
tggattcctgaccatgcagg

SEQ ID NO: 292003 - DNA, 20 bp, Artificial
  CRISPR gRNA sequence
ggattcctgaccatgcagga

SEQ ID NO: 292004 - DNA, 20 bp, Artificial
  CRISPR gRNA sequence
gattcctgaccatgcaggaa

SEQ ID NO: 292005 - DNA, 20 bp, Artificial
  CRISPR gRNA sequence
ctgaccatgcaggaatctgt

SEQ ID NO: 292006 - DNA, 20 bp, Artificial
  CRISPR gRNA sequence
accatgcaggaatctgtatt

SEQ ID NO: 292007 - DNA, 20 bp, Artificial
  CRISPR gRNA sequence
tatttaataaatatacaatc

SEQ ID NO: 292008 - DNA, 20 bp, Artificial
  CRISPR gRNA sequence
aataaatatacaatcttgtt

SEQ ID NO: 292009 - DNA, 20 bp, Artificial
  CRISPR gRNA sequence
ataaatatacaatcttgttc

SEQ ID NO: 292010 - DNA, 20 bp, Artificial
  CRISPR gRNA sequence
gttctgtttgcctctccata

SEQ ID NO: 292011 - DNA, 20 bp, Artificial
  CRISPR gRNA sequence
ttctgtttgcctctccatag

SEQ ID NO: 292012 - DNA, 20 bp, Artificial
  CRISPR gRNA sequence
tgtttgcctctccataggtg

SEQ ID NO: 292013 - DNA, 20 bp, Artificial
  CRISPR gRNA sequence
tttgcctctccataggtgtt

SEQ ID NO: 292014 - DNA, 20 bp, Artificial
  CRISPR gRNA sequence
gcctctccataggtgttatc

SEQ ID NO: 292015 - DNA, 20 bp, Artificial
  CRISPR gRNA sequence
cctctccataggtgttatcc

SEQ ID NO: 292016 - DNA, 20 bp, Artificial
  CRISPR gRNA sequence
tccataggtgttatccacgt

SEQ ID NO: 292017 - DNA, 20 bp, Artificial
  CRISPR gRNA sequence
cataggtgttatccacgtga

SEQ ID NO: 292018 - DNA, 20 bp, Artificial
  CRISPR gRNA sequence
tccacgtgaccaaggaagtg

SEQ ID NO: 292019 - DNA, 20 bp, Artificial
  CRISPR gRNA sequence
tcctgtggtcacaatgtttc

SEQ ID NO: 292020 - DNA, 20 bp, Artificial
  CRISPR gRNA sequence
tggtcacaatgtttctgttg

SEQ ID NO: 292021 - DNA, 20 bp, Artificial
  CRISPR gRNA sequence
ctgttgaagagctggcacaa

SEQ ID NO: 292022 - DNA, 20 bp, Artificial
  CRISPR gRNA sequence
tgttgaagagctggcacaaa

SEQ ID NO: 292023 - DNA, 20 bp, Artificial
  CRISPR gRNA sequence
ttgaagagctggcacaaact

SEQ ID NO: 292024 - DNA, 20 bp, Artificial
  CRISPR gRNA sequence
aagagctggcacaaactcgc

SEQ ID NO: 292025 - DNA, 20 bp, Artificial
  CRISPR gRNA sequence
gcacaaactcgcatctactg

SEQ ID NO: 292026 - DNA, 20 bp, Artificial
  CRISPR gRNA sequence
gcatctactggcaaaaggag

SEQ ID NO: 292027 - DNA, 20 bp, Artificial
  CRISPR gRNA sequence
ctggcaaaaggagaagaaaa

SEQ ID NO: 292028 - DNA, 20 bp, Artificial
  CRISPR gRNA sequence
gcaaaaggagaagaaaatgg

SEQ ID NO: 292029 - DNA, 20 bp, Artificial
  CRISPR gRNA sequence
actatgatgtctggggacat

SEQ ID NO: 292030 - DNA, 20 bp, Artificial
  CRISPR gRNA sequence
tgatgtctggggacatgaat

SEQ ID NO: 292031 - DNA, 20 bp, Artificial
  CRISPR gRNA sequence
gggacatgaatatatggccc

SEQ ID NO: 292032 - DNA, 20 bp, Artificial
  CRISPR gRNA sequence
tgatatcactaataacctct

SEQ ID NO: 292033 - DNA, 20 bp, Artificial
  CRISPR gRNA sequence
gatatcactaataacctctc

SEQ ID NO: 292034 - DNA, 20 bp, Artificial
  CRISPR gRNA sequence
atatcactaataacctctcc

SEQ ID NO: 292035 - DNA, 20 bp, Artificial
  CRISPR gRNA sequence
ataacctctccattgtgatc

SEQ ID NO: 292036 - DNA, 20 bp, Artificial
  CRISPR gRNA sequence
tccattgtgatcctggctct

SEQ ID NO: 292037 - DNA, 20 bp, Artificial
  CRISPR gRNA sequence
cattgtgatcctggctctgc

SEQ ID NO: 292038 - DNA, 20 bp, Artificial
  CRISPR gRNA sequence
tgatcctggctctgcgccca

SEQ ID NO: 292039 - DNA, 20 bp, Artificial
  CRISPR gRNA sequence
gctctgcgcccatctgacga

SEQ ID NO: 292040 - DNA, 20 bp, Artificial
  CRISPR gRNA sequence
tgcgcccatctgacgagggc

SEQ ID NO: 292041 - DNA, 20 bp, Artificial
  CRISPR gRNA sequence
cgcccatctgacgagggcac

SEQ ID NO: 292042 - DNA, 20 bp, Artificial
  CRISPR gRNA sequence
acgagggcacatacgagtgt

SEQ ID NO: 292043 - DNA, 20 bp, Artificial
  CRISPR gRNA sequence
ttctgaagtatgaaaaagac

SEQ ID NO: 292044 - DNA, 20 bp, Artificial
  CRISPR gRNA sequence
tgaagtatgaaaaagacgct

SEQ ID NO: 292045 - DNA, 20 bp, Artificial
  CRISPR gRNA sequence
aagtatgaaaaagacgcttt

SEQ ID NO: 292046 - DNA, 20 bp, Artificial
  CRISPR gRNA sequence
tcaagcgggaacacctggct

SEQ ID NO: 292047 - DNA, 20 bp, Artificial
  CRISPR gRNA sequence
caagcgggaacacctggctg

SEQ ID NO: 292048 - DNA, 20 bp, Artificial
  CRISPR gRNA sequence
aagcgggaacacctggctga

SEQ ID NO: 292049 - DNA, 20 bp, Artificial
  CRISPR gRNA sequence
gctgaagtgacgttatcagt

SEQ ID NO: 292050 - DNA, 20 bp, Artificial
  CRISPR gRNA sequence
aagtgacgttatcagtcaaa

SEQ ID NO: 292051 - DNA, 20 bp, Artificial
  CRISPR gRNA sequence
tcagtcaaaggttggtggga

SEQ ID NO: 292052 - DNA, 20 bp, Artificial
  CRISPR gRNA sequence
gtgggattttctgattttac

SEQ ID NO: 292053 - DNA, 20 bp, Artificial
  CRISPR gRNA sequence
tctgattttactctaggccg

SEQ ID NO: 292054 - DNA, 20 bp, Artificial
  CRISPR gRNA sequence
ctgattttactctaggccgg

SEQ ID NO: 292055 - DNA, 20 bp, Artificial
  CRISPR gRNA sequence
tgattttactctaggccggc

SEQ ID NO: 292056 - DNA, 20 bp, Artificial
  CRISPR gRNA sequence
attttactctaggccggcag

SEQ ID NO: 292057 - DNA, 20 bp, Artificial
  CRISPR gRNA sequence
tactctaggccggcagattc

SEQ ID NO: 292058 - DNA, 20 bp, Artificial
  CRISPR gRNA sequence
actctaggccggcagattct

SEQ ID NO: 292059 - DNA, 20 bp, Artificial
  CRISPR gRNA sequence
ctctaggccggcagattctt

SEQ ID NO: 292060 - DNA, 20 bp, Artificial
  CRISPR gRNA sequence
taggccggcagattcttaat

SEQ ID NO: 292061 - DNA, 20 bp, Artificial
  CRISPR gRNA sequence
ggccggcagattcttaatgc

SEQ ID NO: 292062 - DNA, 20 bp, Artificial
  CRISPR gRNA sequence
ttaatgcccttaaagacaca

SEQ ID NO: 292063 - DNA, 20 bp, Artificial
  CRISPR gRNA sequence
aatgcccttaaagacacatg

SEQ ID NO: 292064 - DNA, 20 bp, Artificial
  CRISPR gRNA sequence
atgcccttaaagacacatgg

SEQ ID NO: 292065 - DNA, 20 bp, Artificial
  CRISPR gRNA sequence
aaagacacatggctattgat

SEQ ID NO: 292066 - DNA, 20 bp, Artificial
  CRISPR gRNA sequence
aagacacatggctattgatt

SEQ ID NO: 292067 - DNA, 20 bp, Artificial
  CRISPR gRNA sequence
ttgatttaggtgaaaatttt

SEQ ID NO: 292068 - DNA, 20 bp, Artificial
  CRISPR gRNA sequence
atttaggtgaaaattttacc

SEQ ID NO: 292069 - DNA, 20 bp, Artificial
  CRISPR gRNA sequence
aggtgaaaattttaccaaag

SEQ ID NO: 292070 - DNA, 20 bp, Artificial
  CRISPR gRNA sequence
ggtgaaaattttaccaaaga

SEQ ID NO: 292071 - DNA, 20 bp, Artificial
  CRISPR gRNA sequence
taccaaagagggatgtatct

SEQ ID NO: 292072 - DNA, 20 bp, Artificial
  CRISPR gRNA sequence
accaaagagggatgtatctc

SEQ ID NO: 292073 - DNA, 20 bp, Artificial
  CRISPR gRNA sequence
ccaaagagggatgtatctca

SEQ ID NO: 292074 - DNA, 20 bp, Artificial
  CRISPR gRNA sequence
acttcatttcttggagttaa

SEQ ID NO: 292075 - DNA, 20 bp, Artificial
  CRISPR gRNA sequence
catttcttggagttaagtct

SEQ ID NO: 292076 - DNA, 20 bp, Artificial
  CRISPR gRNA sequence
atttcttggagttaagtctc

SEQ ID NO: 292077 - DNA, 20 bp, Artificial
  CRISPR gRNA sequence
cttggagttaagtctctagt

SEQ ID NO: 292078 - DNA, 20 bp, Artificial
  CRISPR gRNA sequence
ttggagttaagtctctagtt

SEQ ID NO: 292079 - DNA, 20 bp, Artificial
  CRISPR gRNA sequence
ggagttaagtctctagttgt

SEQ ID NO: 292080 - DNA, 20 bp, Artificial
  CRISPR gRNA sequence
gagttaagtctctagttgta

SEQ ID NO: 292081 - DNA, 20 bp, Artificial
  CRISPR gRNA sequence
agtctctagttgtacaataa

SEQ ID NO: 292082 - DNA, 20 bp, Artificial
  CRISPR gRNA sequence
tagttgtacaataaactcta

SEQ ID NO: 292083 - DNA, 20 bp, Artificial
  CRISPR gRNA sequence
gttgtacaataaactctaac

SEQ ID NO: 292084 - DNA, 20 bp, Artificial
  CRISPR gRNA sequence
tacaataaactctaactggt

SEQ ID NO: 292085 - DNA, 20 bp, Artificial
  CRISPR gRNA sequence
taactggtttctaaagatgt

SEQ ID NO: 292086 - DNA, 20 bp, Artificial
  CRISPR gRNA sequence
actggtttctaaagatgtcc

SEQ ID NO: 292087 - DNA, 20 bp, Artificial
  CRISPR gRNA sequence
gtttctaaagatgtcctgga

SEQ ID NO: 292088 - DNA, 20 bp, Artificial
  CRISPR gRNA sequence
ctaaagatgtcctggaaata

SEQ ID NO: 292089 - DNA, 20 bp, Artificial
  CRISPR gRNA sequence
taaagatgtcctggaaatat

SEQ ID NO: 292090 - DNA, 20 bp, Artificial
  CRISPR gRNA sequence
aagatgtcctggaaatatct

SEQ ID NO: 292091 - DNA, 20 bp, Artificial
  CRISPR gRNA sequence
gaaatatctgttaatgtgca

SEQ ID NO: 292092 - DNA, 20 bp, Artificial
  CRISPR gRNA sequence
ttaatgtgcatttcttgttc

SEQ ID NO: 292093 - DNA, 20 bp, Artificial
  CRISPR gRNA sequence
atgtgcatttcttgttcttt

SEQ ID NO: 292094 - DNA, 20 bp, Artificial
  CRISPR gRNA sequence
cttgttctttgacaatccaa

SEQ ID NO: 292095 - DNA, 20 bp, Artificial
  CRISPR gRNA sequence
ttgttctttgacaatccaag

SEQ ID NO: 292096 - DNA, 20 bp, Artificial
  CRISPR gRNA sequence
gttctttgacaatccaagtt

SEQ ID NO: 292097 - DNA, 20 bp, Artificial
  CRISPR gRNA sequence
ttctttgacaatccaagttc

SEQ ID NO: 292098 - DNA, 20 bp, Artificial
  CRISPR gRNA sequence
tttgacaatccaagttcatg

SEQ ID NO: 292099 - DNA, 20 bp, Artificial
  CRISPR gRNA sequence
tgacaatccaagttcatgac

SEQ ID NO: 292100 - DNA, 20 bp, Artificial
  CRISPR gRNA sequence
gacaatccaagttcatgaca

SEQ ID NO: 292101 - DNA, 20 bp, Artificial
  CRISPR gRNA sequence
acaatccaagttcatgacaa

SEQ ID NO: 292102 - DNA, 20 bp, Artificial
  CRISPR gRNA sequence
atgacaatcatcctggggca

SEQ ID NO: 292103 - DNA, 20 bp, Artificial
  CRISPR gRNA sequence
gggcactataatgacctaaa

SEQ ID NO: 292104 - DNA, 20 bp, Artificial
  CRISPR gRNA sequence
taatgacctaaagagcctct

SEQ ID NO: 292105 - DNA, 20 bp, Artificial
  CRISPR gRNA sequence
aagagcctctcaatcaccaa

SEQ ID NO: 292106 - DNA, 20 bp, Artificial
  CRISPR gRNA sequence
tcaatcaccaaggggcatct

SEQ ID NO: 292107 - DNA, 20 bp, Artificial
  CRISPR gRNA sequence
aatcaccaaggggcatcttt

SEQ ID NO: 292108 - DNA, 20 bp, Artificial
  CRISPR gRNA sequence
tgatttgatgtagccttgct

SEQ ID NO: 292109 - DNA, 20 bp, Artificial
  CRISPR gRNA sequence
gatttgatgtagccttgcta

SEQ ID NO: 292110 - DNA, 20 bp, Artificial
  CRISPR gRNA sequence
atttgatgtagccttgctac

SEQ ID NO: 292111 - DNA, 20 bp, Artificial
  CRISPR gRNA sequence
gatgtagccttgctactaac

SEQ ID NO: 292112 - DNA, 20 bp, Artificial
  CRISPR gRNA sequence
atgtagccttgctactaact

SEQ ID NO: 292113 - DNA, 20 bp, Artificial
  CRISPR gRNA sequence
gctactaactgcacttgacc

SEQ ID NO: 292114 - DNA, 20 bp, Artificial
  CRISPR gRNA sequence
ctactaactgcacttgaccc

SEQ ID NO: 292115 - DNA, 20 bp, Artificial
  CRISPR gRNA sequence
ctaactgcacttgacccagc

SEQ ID NO: 292116 - DNA, 20 bp, Artificial
  CRISPR gRNA sequence
actgcacttgacccagcaat

SEQ ID NO: 292117 - DNA, 20 bp, Artificial
  CRISPR gRNA sequence
cacttgacccagcaatatat

SEQ ID NO: 292118 - DNA, 20 bp, Artificial
  CRISPR gRNA sequence
gacccagcaatatatgcctg

SEQ ID NO: 292119 - DNA, 20 bp, Artificial
  CRISPR gRNA sequence
acccagcaatatatgcctgt

SEQ ID NO: 292120 - DNA, 20 bp, Artificial
  CRISPR gRNA sequence
tgaaagtatgctgaaaaggt

SEQ ID NO: 292121 - DNA, 20 bp, Artificial
  CRISPR gRNA sequence
aaaaggtaacggggctgggt

SEQ ID NO: 292122 - DNA, 20 bp, Artificial
  CRISPR gRNA sequence
ggtatggtggcttatgcctg

SEQ ID NO: 292123 - DNA, 20 bp, Artificial
  CRISPR gRNA sequence
atgcctgtaatctcagcact

SEQ ID NO: 292124 - DNA, 20 bp, Artificial
  CRISPR gRNA sequence
tgcctgtaatctcagcactt

SEQ ID NO: 292125 - DNA, 20 bp, Artificial
  CRISPR gRNA sequence
taatctcagcactttgggag

SEQ ID NO: 292126 - DNA, 20 bp, Artificial
  CRISPR gRNA sequence
agcactttgggaggccaagg

SEQ ID NO: 292127 - DNA, 20 bp, Artificial
  CRISPR gRNA sequence
tgggaggccaaggcaggcgg

SEQ ID NO: 292128 - DNA, 20 bp, Artificial
  CRISPR gRNA sequence
gggaggccaaggcaggcgga

SEQ ID NO: 292129 - DNA, 20 bp, Artificial
  CRISPR gRNA sequence
ggaggccaaggcaggcggat

SEQ ID NO: 292130 - DNA, 20 bp, Artificial
  CRISPR gRNA sequence
gaggtcatgagttcaagacc

SEQ ID NO: 292131 - DNA, 20 bp, Artificial
  CRISPR gRNA sequence
aggtcatgagttcaagacca

SEQ ID NO: 292132 - DNA, 20 bp, Artificial
  CRISPR gRNA sequence
aagaccagcctggccaacat

SEQ ID NO: 292133 - DNA, 20 bp, Artificial
  CRISPR gRNA sequence
gccaacatagcgaaactccg

SEQ ID NO: 292134 - DNA, 20 bp, Artificial
  CRISPR gRNA sequence
cgtccctactaaaaatacaa

SEQ ID NO: 292135 - DNA, 20 bp, Artificial
  CRISPR gRNA sequence
ctaaaaatacaaaaactagc

SEQ ID NO: 292136 - DNA, 20 bp, Artificial
  CRISPR gRNA sequence
aaaatacaaaaactagccag

SEQ ID NO: 292137 - DNA, 20 bp, Artificial
  CRISPR gRNA sequence
gccagatgtggtggcgcatt

SEQ ID NO: 292138 - DNA, 20 bp, Artificial
  CRISPR gRNA sequence
ctgtaatcccagctactctg

SEQ ID NO: 292139 - DNA, 20 bp, Artificial
  CRISPR gRNA sequence
taatcccagctactctggag

SEQ ID NO: 292140 - DNA, 20 bp, Artificial
  CRISPR gRNA sequence
ctctggaggctgaggcagag

SEQ ID NO: 292141 - DNA, 20 bp, Artificial
  CRISPR gRNA sequence
tggaggctgaggcagagaat

SEQ ID NO: 292142 - DNA, 20 bp, Artificial
  CRISPR gRNA sequence
gaggctgaggcagagaatcg

SEQ ID NO: 292143 - DNA, 20 bp, Artificial
  CRISPR gRNA sequence
aggcagagaatcgcttgaac

SEQ ID NO: 292144 - DNA, 20 bp, Artificial
  CRISPR gRNA sequence
gaacctgggaggcggaggtt

SEQ ID NO: 292145 - DNA, 20 bp, Artificial
  CRISPR gRNA sequence
aacctgggaggcggaggttg

SEQ ID NO: 292146 - DNA, 20 bp, Artificial
  CRISPR gRNA sequence
ggaggcggaggttgcaatga

SEQ ID NO: 292147 - DNA, 20 bp, Artificial
  CRISPR gRNA sequence
caatgagctgagattgcacc

SEQ ID NO: 292148 - DNA, 20 bp, Artificial
  CRISPR gRNA sequence
agattgcaccactgcactcc

SEQ ID NO: 292149 - DNA, 20 bp, Artificial
  CRISPR gRNA sequence
caccactgcactccagcctg

SEQ ID NO: 292150 - DNA, 20 bp, Artificial
  CRISPR gRNA sequence
cactccagcctgggtgacat

SEQ ID NO: 292151 - DNA, 20 bp, Artificial
  CRISPR gRNA sequence
cagcctgggtgacatagcaa

SEQ ID NO: 292152 - DNA, 20 bp, Artificial
  CRISPR gRNA sequence
ggtgacatagcaagactcca

SEQ ID NO: 292153 - DNA, 20 bp, Artificial
  CRISPR gRNA sequence
catctcaaaaaaaaaaaaaa

SEQ ID NO: 292154 - DNA, 20 bp, Artificial
  CRISPR gRNA sequence
aaaaaaaaaaaaaaaaaaag

SEQ ID NO: 292155 - DNA, 20 bp, Artificial
  CRISPR gRNA sequence
tttcaggtagtatgtgaacg

SEQ ID NO: 292156 - DNA, 20 bp, Artificial
  CRISPR gRNA sequence
ttcaggtagtatgtgaacgt

SEQ ID NO: 292157 - DNA, 20 bp, Artificial
  CRISPR gRNA sequence
tcaggtagtatgtgaacgtc

SEQ ID NO: 292158 - DNA, 20 bp, Artificial
  CRISPR gRNA sequence
caggtagtatgtgaacgtct

SEQ ID NO: 292159 - DNA, 20 bp, Artificial
  CRISPR gRNA sequence
aggtagtatgtgaacgtcta

SEQ ID NO: 292160 - DNA, 20 bp, Artificial
  CRISPR gRNA sequence
ttactatggctatcttacta

SEQ ID NO: 292161 - DNA, 20 bp, Artificial
  CRISPR gRNA sequence
ctatggctatcttactatta

SEQ ID NO: 292162 - DNA, 20 bp, Artificial
  CRISPR gRNA sequence
tggctatcttactattatat

SEQ ID NO: 292163 - DNA, 20 bp, Artificial
  CRISPR gRNA sequence
tcttactattatattctaat

SEQ ID NO: 292164 - DNA, 20 bp, Artificial
  CRISPR gRNA sequence
actattatattctaatattt

SEQ ID NO: 292165 - DNA, 20 bp, Artificial
  CRISPR gRNA sequence
ctattatattctaatatttt

SEQ ID NO: 292166 - DNA, 20 bp, Artificial
  CRISPR gRNA sequence
ttatattctaatattttcaa

SEQ ID NO: 292167 - DNA, 20 bp, Artificial
  CRISPR gRNA sequence
tattctaatattttcaaagt

SEQ ID NO: 292168 - DNA, 20 bp, Artificial
  CRISPR gRNA sequence
taatattttcaaagtgataa

SEQ ID NO: 292169 - DNA, 20 bp, Artificial
  CRISPR gRNA sequence
atattttcaaagtgataatt

SEQ ID NO: 292170 - DNA, 20 bp, Artificial
  CRISPR gRNA sequence
tcaaagtgataatttactta

SEQ ID NO: 292171 - DNA, 20 bp, Artificial
  CRISPR gRNA sequence
caaagtgataatttacttat

SEQ ID NO: 292172 - DNA, 20 bp, Artificial
  CRISPR gRNA sequence
aaagtgataatttacttatt

SEQ ID NO: 292173 - DNA, 20 bp, Artificial
  CRISPR gRNA sequence
acttattgcatatttgaagc

SEQ ID NO: 292174 - DNA, 20 bp, Artificial
  CRISPR gRNA sequence
cttattgcatatttgaagct

SEQ ID NO: 292175 - DNA, 20 bp, Artificial
  CRISPR gRNA sequence
attgcatatttgaagctcta

SEQ ID NO: 292176 - DNA, 20 bp, Artificial
  CRISPR gRNA sequence
ttgcatatttgaagctctaa

SEQ ID NO: 292177 - DNA, 20 bp, Artificial
  CRISPR gRNA sequence
catatttgaagctctaatct

SEQ ID NO: 292178 - DNA, 20 bp, Artificial
  CRISPR gRNA sequence
gaagctctaatctagcagtc

SEQ ID NO: 292179 - DNA, 20 bp, Artificial
  CRISPR gRNA sequence
aagctctaatctagcagtca

SEQ ID NO: 292180 - DNA, 20 bp, Artificial
  CRISPR gRNA sequence
taatctagcagtcagtcctg

SEQ ID NO: 292181 - DNA, 20 bp, Artificial
  CRISPR gRNA sequence
atctagcagtcagtcctgaa

SEQ ID NO: 292182 - DNA, 20 bp, Artificial
  CRISPR gRNA sequence
gcagtcagtcctgaaaaatt

SEQ ID NO: 292183 - DNA, 20 bp, Artificial
  CRISPR gRNA sequence
aaaaattagatgttagagaa

SEQ ID NO: 292184 - DNA, 20 bp, Artificial
  CRISPR gRNA sequence
gatgttagagaattgggcca

SEQ ID NO: 292185 - DNA, 20 bp, Artificial
  CRISPR gRNA sequence
gagaattgggccaggtgcgg

SEQ ID NO: 292186 - DNA, 20 bp, Artificial
  CRISPR gRNA sequence
ggccaggtgcggtggctcag

SEQ ID NO: 292187 - DNA, 20 bp, Artificial
  CRISPR gRNA sequence
agcactttgggaggccaagg

SEQ ID NO: 292188 - DNA, 20 bp, Artificial
  CRISPR gRNA sequence
tgggaggccaaggtgggtgg

SEQ ID NO: 292189 - DNA, 20 bp, Artificial
  CRISPR gRNA sequence
gggaggccaaggtgggtgga

SEQ ID NO: 292190 - DNA, 20 bp, Artificial
  CRISPR gRNA sequence
ggaggccaaggtgggtggat

SEQ ID NO: 292191 - DNA, 20 bp, Artificial
  CRISPR gRNA sequence
gagctcaggagtttgagacc

SEQ ID NO: 292192 - DNA, 20 bp, Artificial
  CRISPR gRNA sequence
agctcaggagtttgagacca

SEQ ID NO: 292193 - DNA, 20 bp, Artificial
  CRISPR gRNA sequence
aggagtttgagaccagcctg

SEQ ID NO: 292194 - DNA, 20 bp, Artificial
  CRISPR gRNA sequence
gagaccagcctgcccaacat

SEQ ID NO: 292195 - DNA, 20 bp, Artificial
  CRISPR gRNA sequence
agaccagcctgcccaacatg

SEQ ID NO: 292196 - DNA, 20 bp, Artificial
  CRISPR gRNA sequence
cccaacatggtgaaacccca

SEQ ID NO: 292197 - DNA, 20 bp, Artificial
  CRISPR gRNA sequence
tactaaaaatacaaaaatta

SEQ ID NO: 292198 - DNA, 20 bp, Artificial
  CRISPR gRNA sequence
ctaaaaatacaaaaattagc

SEQ ID NO: 292199 - DNA, 20 bp, Artificial
  CRISPR gRNA sequence
aaaatacaaaaattagccag

SEQ ID NO: 292200 - DNA, 20 bp, Artificial
  CRISPR gRNA sequence
gccagggacgtgttggctac

SEQ ID NO: 292201 - DNA, 20 bp, Artificial
  CRISPR gRNA sequence
gctactcaggaggctgaggc

SEQ ID NO: 292202 - DNA, 20 bp, Artificial
  CRISPR gRNA sequence
ctcaggaggctgaggcagga

SEQ ID NO: 292203 - DNA, 20 bp, Artificial
  CRISPR gRNA sequence
aggaggctgaggcaggagaa

SEQ ID NO: 292204 - DNA, 20 bp, Artificial
  CRISPR gRNA sequence
aggcaggagaatcacttgaa

SEQ ID NO: 292205 - DNA, 20 bp, Artificial
  CRISPR gRNA sequence
gaacctgggaggcggaggtt

SEQ ID NO: 292206 - DNA, 20 bp, Artificial
  CRISPR gRNA sequence
aacctgggaggcggaggttg

SEQ ID NO: 292207 - DNA, 20 bp, Artificial
  CRISPR gRNA sequence
ggaggcggaggttgcagtga

SEQ ID NO: 292208 - DNA, 20 bp, Artificial
  CRISPR gRNA sequence
cagtgagcagagatggtgcc

SEQ ID NO: 292209 - DNA, 20 bp, Artificial
  CRISPR gRNA sequence
cactccagccttggtgacag

SEQ ID NO: 292210 - DNA, 20 bp, Artificial
  CRISPR gRNA sequence
cagccttggtgacagagcaa

SEQ ID NO: 292211 - DNA, 20 bp, Artificial
  CRISPR gRNA sequence
ggtgacagagcaaagactgt

SEQ ID NO: 292212 - DNA, 20 bp, Artificial
  CRISPR gRNA sequence
gtgacagagcaaagactgtt

SEQ ID NO: 292213 - DNA, 20 bp, Artificial
  CRISPR gRNA sequence
tttcaaaaaaaaaaaaagta

SEQ ID NO: 292214 - DNA, 20 bp, Artificial
  CRISPR gRNA sequence
caaaaaaaaaaaaagtagac

SEQ ID NO: 292215 - DNA, 20 bp, Artificial
  CRISPR gRNA sequence
aaaaaaaaaaaaagtagact

SEQ ID NO: 292216 - DNA, 20 bp, Artificial
  CRISPR gRNA sequence
cagaggagggtgagcatttc

SEQ ID NO: 292217 - DNA, 20 bp, Artificial
  CRISPR gRNA sequence
ccctactggtagagactctg

SEQ ID NO: 292218 - DNA, 20 bp, Artificial
  CRISPR gRNA sequence
cctactggtagagactctgt

SEQ ID NO: 292219 - DNA, 20 bp, Artificial
  CRISPR gRNA sequence
ctggtagagactctgtctta

SEQ ID NO: 292220 - DNA, 20 bp, Artificial
  CRISPR gRNA sequence
gtagagactctgtcttaaaa

SEQ ID NO: 292221 - DNA, 20 bp, Artificial
  CRISPR gRNA sequence
tgtcttaaaaaaaaaaaaaa

SEQ ID NO: 292222 - DNA, 20 bp, Artificial
  CRISPR gRNA sequence
tcttaaaaaaaaaaaaaagt

SEQ ID NO: 292223 - DNA, 20 bp, Artificial
  CRISPR gRNA sequence
aaaaaaaaaaaaaagttaga

SEQ ID NO: 292224 - DNA, 20 bp, Artificial
  CRISPR gRNA sequence
aaaaaaaaaaaaagttagag

SEQ ID NO: 292225 - DNA, 20 bp, Artificial
  CRISPR gRNA sequence
gagaattggatgcataatta

SEQ ID NO: 292226 - DNA, 20 bp, Artificial
  CRISPR gRNA sequence
gatgcataattaattcctgc

SEQ ID NO: 292227 - DNA, 20 bp, Artificial
  CRISPR gRNA sequence
attcctgccacaaggaaaaa

SEQ ID NO: 292228 - DNA, 20 bp, Artificial
  CRISPR gRNA sequence
ctgccacaaggaaaaaaact

SEQ ID NO: 292229 - DNA, 20 bp, Artificial
  CRISPR gRNA sequence
ccacaaggaaaaaaactaat

SEQ ID NO: 292230 - DNA, 20 bp, Artificial
  CRISPR gRNA sequence
atttatgaatcaaagccctg

SEQ ID NO: 292231 - DNA, 20 bp, Artificial
  CRISPR gRNA sequence
atgaatcaaagccctgttta

SEQ ID NO: 292232 - DNA, 20 bp, Artificial
  CRISPR gRNA sequence
tgaatcaaagccctgtttat

SEQ ID NO: 292233 - DNA, 20 bp, Artificial
  CRISPR gRNA sequence
tttatgtacctactgtggaa

SEQ ID NO: 292234 - DNA, 20 bp, Artificial
  CRISPR gRNA sequence
atgtacctactgtggaaggc

SEQ ID NO: 292235 - DNA, 20 bp, Artificial
  CRISPR gRNA sequence
tgtacctactgtggaaggca

SEQ ID NO: 292236 - DNA, 20 bp, Artificial
  CRISPR gRNA sequence
ctgtggaaggcaagcatttc

SEQ ID NO: 292237 - DNA, 20 bp, Artificial
  CRISPR gRNA sequence
tggaaggcaagcatttctgg

SEQ ID NO: 292238 - DNA, 20 bp, Artificial
  CRISPR gRNA sequence
ctggtctcggaaagaaagga

SEQ ID NO: 292239 - DNA, 20 bp, Artificial
  CRISPR gRNA sequence
tggtctcggaaagaaaggac

SEQ ID NO: 292240 - DNA, 20 bp, Artificial
  CRISPR gRNA sequence
gtctcggaaagaaaggaccc

SEQ ID NO: 292241 - DNA, 20 bp, Artificial
  CRISPR gRNA sequence
ggaaagaaaggacccttgct

SEQ ID NO: 292242 - DNA, 20 bp, Artificial
  CRISPR gRNA sequence
gcttttgtaaccacccaaga

SEQ ID NO: 292243 - DNA, 20 bp, Artificial
  CRISPR gRNA sequence
cttttgtaaccacccaagag

SEQ ID NO: 292244 - DNA, 20 bp, Artificial
  CRISPR gRNA sequence
ttgtaaccacccaagaggtt

SEQ ID NO: 292245 - DNA, 20 bp, Artificial
  CRISPR gRNA sequence
tgtaaccacccaagaggttt

SEQ ID NO: 292246 - DNA, 20 bp, Artificial
  CRISPR gRNA sequence
gtaaccacccaagaggttta

SEQ ID NO: 292247 - DNA, 20 bp, Artificial
  CRISPR gRNA sequence
taaccacccaagaggtttac

SEQ ID NO: 292248 - DNA, 20 bp, Artificial
  CRISPR gRNA sequence
acctcgcctgctgcgtagat

SEQ ID NO: 292249 - DNA, 20 bp, Artificial
  CRISPR gRNA sequence
cctcgcctgctgcgtagata

SEQ ID NO: 292250 - DNA, 20 bp, Artificial
  CRISPR gRNA sequence
gcctgctgcgtagatagagc

SEQ ID NO: 292251 - DNA, 20 bp, Artificial
  CRISPR gRNA sequence
ctgcgtagatagagccaatt

SEQ ID NO: 292252 - DNA, 20 bp, Artificial
  CRISPR gRNA sequence
cgtagatagagccaattcat

SEQ ID NO: 292253 - DNA, 20 bp, Artificial
  CRISPR gRNA sequence
atcaagacaggggaattgca

SEQ ID NO: 292254 - DNA, 20 bp, Artificial
  CRISPR gRNA sequence
caatagagagagtaatttac

SEQ ID NO: 292255 - DNA, 20 bp, Artificial
  CRISPR gRNA sequence
acgcacaactggctgtgcgg

SEQ ID NO: 292256 - DNA, 20 bp, Artificial
  CRISPR gRNA sequence
cgcacaactggctgtgcggg

SEQ ID NO: 292257 - DNA, 20 bp, Artificial
  CRISPR gRNA sequence
gctgtgcgggagaccggagt

SEQ ID NO: 292258 - DNA, 20 bp, Artificial
  CRISPR gRNA sequence
tgcgggagaccggagtttta

SEQ ID NO: 292259 - DNA, 20 bp, Artificial
  CRISPR gRNA sequence
tatcattactcaaatcagtc

SEQ ID NO: 292260 - DNA, 20 bp, Artificial
  CRISPR gRNA sequence
atcattactcaaatcagtct

SEQ ID NO: 292261 - DNA, 20 bp, Artificial
  CRISPR gRNA sequence
tcattactcaaatcagtctc

SEQ ID NO: 292262 - DNA, 20 bp, Artificial
  CRISPR gRNA sequence
ctcaaatcagtctctccaag

SEQ ID NO: 292263 - DNA, 20 bp, Artificial
  CRISPR gRNA sequence
aaatcagtctctccaagcat

SEQ ID NO: 292264 - DNA, 20 bp, Artificial
  CRISPR gRNA sequence
tccaagcatctggggagcag

SEQ ID NO: 292265 - DNA, 20 bp, Artificial
  CRISPR gRNA sequence
caagcatctggggagcagag

SEQ ID NO: 292266 - DNA, 20 bp, Artificial
  CRISPR gRNA sequence
gggagcagagtttttaagga

SEQ ID NO: 292267 - DNA, 20 bp, Artificial
  CRISPR gRNA sequence
ttaaggataactaggtgggt

SEQ ID NO: 292268 - DNA, 20 bp, Artificial
  CRISPR gRNA sequence
taaggataactaggtgggtc

SEQ ID NO: 292269 - DNA, 20 bp, Artificial
  CRISPR gRNA sequence
aaggataactaggtgggtcg

SEQ ID NO: 292270 - DNA, 20 bp, Artificial
  CRISPR gRNA sequence
aggataactaggtgggtcgg

SEQ ID NO: 292271 - DNA, 20 bp, Artificial
  CRISPR gRNA sequence
ggtgggtcgggggaagccag

SEQ ID NO: 292272 - DNA, 20 bp, Artificial
  CRISPR gRNA sequence
ggagtgctgattggtcaggg

SEQ ID NO: 292273 - DNA, 20 bp, Artificial
  CRISPR gRNA sequence
attggtcagggatgatacca

SEQ ID NO: 292274 - DNA, 20 bp, Artificial
  CRISPR gRNA sequence
gtcagggatgataccatagg

SEQ ID NO: 292275 - DNA, 20 bp, Artificial
  CRISPR gRNA sequence
aagctgtcttcttgcactgg

SEQ ID NO: 292276 - DNA, 20 bp, Artificial
  CRISPR gRNA sequence
tcttcttgcactgggttggg

SEQ ID NO: 292277 - DNA, 20 bp, Artificial
  CRISPR gRNA sequence
cttgcactgggttggggggc

SEQ ID NO: 292278 - DNA, 20 bp, Artificial
  CRISPR gRNA sequence
ttgcactgggttggggggcc

SEQ ID NO: 292279 - DNA, 20 bp, Artificial
  CRISPR gRNA sequence
gcactgggttggggggccac

SEQ ID NO: 292280 - DNA, 20 bp, Artificial
  CRISPR gRNA sequence
cactgggttggggggccaca

SEQ ID NO: 292281 - DNA, 20 bp, Artificial
  CRISPR gRNA sequence
ggttggggggccacaagatc

SEQ ID NO: 292282 - DNA, 20 bp, Artificial
  CRISPR gRNA sequence
gggggccacaagatcagatg

SEQ ID NO: 292283 - DNA, 20 bp, Artificial
  CRISPR gRNA sequence
attgatctgggtggtgccag

SEQ ID NO: 292284 - DNA, 20 bp, Artificial
  CRISPR gRNA sequence
ttgatctgggtggtgccagc

SEQ ID NO: 292285 - DNA, 20 bp, Artificial
  CRISPR gRNA sequence
atctgggtggtgccagctga

SEQ ID NO: 292286 - DNA, 20 bp, Artificial
  CRISPR gRNA sequence
ggtggtgccagctgatccat

SEQ ID NO: 292287 - DNA, 20 bp, Artificial
  CRISPR gRNA sequence
atccatcaagtgcaggggct

SEQ ID NO: 292288 - DNA, 20 bp, Artificial
  CRISPR gRNA sequence
caaaatagctcaagcactga

SEQ ID NO: 292289 - DNA, 20 bp, Artificial
  CRISPR gRNA sequence
aagcactgatcttaggagca

SEQ ID NO: 292290 - DNA, 20 bp, Artificial
  CRISPR gRNA sequence
atcttaggagcagtttaggg

SEQ ID NO: 292291 - DNA, 20 bp, Artificial
  CRISPR gRNA sequence
aggagcagtttagggagggt

SEQ ID NO: 292292 - DNA, 20 bp, Artificial
  CRISPR gRNA sequence
ggagcagtttagggagggtc

SEQ ID NO: 292293 - DNA, 20 bp, Artificial
  CRISPR gRNA sequence
agggagggtcagaatctcat

SEQ ID NO: 292294 - DNA, 20 bp, Artificial
  CRISPR gRNA sequence
gggagggtcagaatctcata

SEQ ID NO: 292295 - DNA, 20 bp, Artificial
  CRISPR gRNA sequence
atagcatccagctttatgac

SEQ ID NO: 292296 - DNA, 20 bp, Artificial
  CRISPR gRNA sequence
tatgactcctaaaccataat

SEQ ID NO: 292297 - DNA, 20 bp, Artificial
  CRISPR gRNA sequence
atgactcctaaaccataatt

SEQ ID NO: 292298 - DNA, 20 bp, Artificial
  CRISPR gRNA sequence
tgactcctaaaccataattt

SEQ ID NO: 292299 - DNA, 20 bp, Artificial
  CRISPR gRNA sequence
ctaaaccataatttctaatc

SEQ ID NO: 292300 - DNA, 20 bp, Artificial
  CRISPR gRNA sequence
aaccataatttctaatcttg

SEQ ID NO: 292301 - DNA, 20 bp, Artificial
  CRISPR gRNA sequence
ctaatcttgtggctaatgtt

SEQ ID NO: 292302 - DNA, 20 bp, Artificial
  CRISPR gRNA sequence
taatcttgtggctaatgtta

SEQ ID NO: 292303 - DNA, 20 bp, Artificial
  CRISPR gRNA sequence
atcttgtggctaatgttagt

SEQ ID NO: 292304 - DNA, 20 bp, Artificial
  CRISPR gRNA sequence
gtggctaatgttagtcctac

SEQ ID NO: 292305 - DNA, 20 bp, Artificial
  CRISPR gRNA sequence
tggctaatgttagtcctaca

SEQ ID NO: 292306 - DNA, 20 bp, Artificial
  CRISPR gRNA sequence
atgttagtcctacaaaggca

SEQ ID NO: 292307 - DNA, 20 bp, Artificial
  CRISPR gRNA sequence
gtcctacaaaggcaatctac

SEQ ID NO: 292308 - DNA, 20 bp, Artificial
  CRISPR gRNA sequence
caaaggcaatctactcccca

SEQ ID NO: 292309 - DNA, 20 bp, Artificial
  CRISPR gRNA sequence
ctccccaggcaagaaggagg

SEQ ID NO: 292310 - DNA, 20 bp, Artificial
  CRISPR gRNA sequence
cccaggcaagaaggaggtct

SEQ ID NO: 292311 - DNA, 20 bp, Artificial
  CRISPR gRNA sequence
ctttgggaaagggctgttac

SEQ ID NO: 292312 - DNA, 20 bp, Artificial
  CRISPR gRNA sequence
tgggaaagggctgttaccat

SEQ ID NO: 292313 - DNA, 20 bp, Artificial
  CRISPR gRNA sequence
gggaaagggctgttaccatc

SEQ ID NO: 292314 - DNA, 20 bp, Artificial
  CRISPR gRNA sequence
ggaaagggctgttaccatct

SEQ ID NO: 292315 - DNA, 20 bp, Artificial
  CRISPR gRNA sequence
ttaccatctttgtttaaact

SEQ ID NO: 292316 - DNA, 20 bp, Artificial
  CRISPR gRNA sequence
ccatctttgtttaaactata

SEQ ID NO: 292317 - DNA, 20 bp, Artificial
  CRISPR gRNA sequence
tgtttaaactataaactata

SEQ ID NO: 292318 - DNA, 20 bp, Artificial
  CRISPR gRNA sequence
gtttaaactataaactataa

SEQ ID NO: 292319 - DNA, 20 bp, Artificial
  CRISPR gRNA sequence
tttaaactataaactataaa

SEQ ID NO: 292320 - DNA, 20 bp, Artificial
  CRISPR gRNA sequence
aaactataaactataaacta

SEQ ID NO: 292321 - DNA, 20 bp, Artificial
  CRISPR gRNA sequence
aactataaactataaactaa

SEQ ID NO: 292322 - DNA, 20 bp, Artificial
  CRISPR gRNA sequence
taaactataaactaagtttc

SEQ ID NO: 292323 - DNA, 20 bp, Artificial
  CRISPR gRNA sequence
taaactaagtttctaccaaa

SEQ ID NO: 292324 - DNA, 20 bp, Artificial
  CRISPR gRNA sequence
agtttctaccaaagttagtt

SEQ ID NO: 292325 - DNA, 20 bp, Artificial
  CRISPR gRNA sequence
ctaccaaagttagttcagcc

SEQ ID NO: 292326 - DNA, 20 bp, Artificial
  CRISPR gRNA sequence
taccaaagttagttcagcct

SEQ ID NO: 292327 - DNA, 20 bp, Artificial
  CRISPR gRNA sequence
ccaaagttagttcagcctac

SEQ ID NO: 292328 - DNA, 20 bp, Artificial
  CRISPR gRNA sequence
gttcagcctacacccaggag

SEQ ID NO: 292329 - DNA, 20 bp, Artificial
  CRISPR gRNA sequence
agcctacacccaggagtgaa

SEQ ID NO: 292330 - DNA, 20 bp, Artificial
  CRISPR gRNA sequence
cacccaggagtgaacaaaga

SEQ ID NO: 292331 - DNA, 20 bp, Artificial
  CRISPR gRNA sequence
ggaggttagaagcaagatgg

SEQ ID NO: 292332 - DNA, 20 bp, Artificial
  CRISPR gRNA sequence
gaggttagaagcaagatgga

SEQ ID NO: 292333 - DNA, 20 bp, Artificial
  CRISPR gRNA sequence
gaagcaagatggagtcagtt

SEQ ID NO: 292334 - DNA, 20 bp, Artificial
  CRISPR gRNA sequence
agttagatctctttcactgt

SEQ ID NO: 292335 - DNA, 20 bp, Artificial
  CRISPR gRNA sequence
gatctctttcactgtctcag

SEQ ID NO: 292336 - DNA, 20 bp, Artificial
  CRISPR gRNA sequence
tttcactgtctcagtcataa

SEQ ID NO: 292337 - DNA, 20 bp, Artificial
  CRISPR gRNA sequence
tcactgtctcagtcataatt

SEQ ID NO: 292338 - DNA, 20 bp, Artificial
  CRISPR gRNA sequence
cactgtctcagtcataattt

SEQ ID NO: 292339 - DNA, 20 bp, Artificial
  CRISPR gRNA sequence
actgtctcagtcataatttt

SEQ ID NO: 292340 - DNA, 20 bp, Artificial
  CRISPR gRNA sequence
tctcagtcataattttgcaa

SEQ ID NO: 292341 - DNA, 20 bp, Artificial
  CRISPR gRNA sequence
agtcataattttgcaaaggg

SEQ ID NO: 292342 - DNA, 20 bp, Artificial
  CRISPR gRNA sequence
tgcaaagggggtttcacttt

SEQ ID NO: 292343 - DNA, 20 bp, Artificial
  CRISPR gRNA sequence
gcaaagggggtttcacttta

SEQ ID NO: 292344 - DNA, 20 bp, Artificial
  CRISPR gRNA sequence
caaagggggtttcactttaa

SEQ ID NO: 292345 - DNA, 20 bp, Artificial
  CRISPR gRNA sequence
cactttaattacagtataac

SEQ ID NO: 292346 - DNA, 20 bp, Artificial
  CRISPR gRNA sequence
actttaattacagtataaca

SEQ ID NO: 292347 - DNA, 20 bp, Artificial
  CRISPR gRNA sequence
taattacagtataacagagg

SEQ ID NO: 292348 - DNA, 20 bp, Artificial
  CRISPR gRNA sequence
aattacagtataacagagga

SEQ ID NO: 292349 - DNA, 20 bp, Artificial
  CRISPR gRNA sequence
attacagtataacagaggat

SEQ ID NO: 292350 - DNA, 20 bp, Artificial
  CRISPR gRNA sequence
cagtataacagaggatactg

SEQ ID NO: 292351 - DNA, 20 bp, Artificial
  CRISPR gRNA sequence
aaggagccagagcccttttt

SEQ ID NO: 292352 - DNA, 20 bp, Artificial
  CRISPR gRNA sequence
tttgagaaattatatccctg

SEQ ID NO: 292353 - DNA, 20 bp, Artificial
  CRISPR gRNA sequence
ttgagaaattatatccctga

SEQ ID NO: 292354 - DNA, 20 bp, Artificial
  CRISPR gRNA sequence
tgagaaattatatccctgag

SEQ ID NO: 292355 - DNA, 20 bp, Artificial
  CRISPR gRNA sequence
gagaaattatatccctgagc

SEQ ID NO: 292356 - DNA, 20 bp, Artificial
  CRISPR gRNA sequence
agaaattatatccctgagcc

SEQ ID NO: 292357 - DNA, 20 bp, Artificial
  CRISPR gRNA sequence
tatccctgagccattttctc

SEQ ID NO: 292358 - DNA, 20 bp, Artificial
  CRISPR gRNA sequence
agccattttctcacagttga

SEQ ID NO: 292359 - DNA, 20 bp, Artificial
  CRISPR gRNA sequence
tctcacagttgaaatttgaa

SEQ ID NO: 292360 - DNA, 20 bp, Artificial
  CRISPR gRNA sequence
ctcacagttgaaatttgaac

SEQ ID NO: 292361 - DNA, 20 bp, Artificial
  CRISPR gRNA sequence
tcacagttgaaatttgaaca

SEQ ID NO: 292362 - DNA, 20 bp, Artificial
  CRISPR gRNA sequence
acagttgaaatttgaacata

SEQ ID NO: 292363 - DNA, 20 bp, Artificial
  CRISPR gRNA sequence
aaatttgaacatatttcttt

SEQ ID NO: 292364 - DNA, 20 bp, Artificial
  CRISPR gRNA sequence
gaacatatttctttttcccc

SEQ ID NO: 292365 - DNA, 20 bp, Artificial
  CRISPR gRNA sequence
aacatatttctttttcccct

SEQ ID NO: 292366 - DNA, 20 bp, Artificial
  CRISPR gRNA sequence
ctttttcccctgggacttga

SEQ ID NO: 292367 - DNA, 20 bp, Artificial
  CRISPR gRNA sequence
tttttcccctgggacttgag

SEQ ID NO: 292368 - DNA, 20 bp, Artificial
  CRISPR gRNA sequence
tttcccctgggacttgagcc

SEQ ID NO: 292369 - DNA, 20 bp, Artificial
  CRISPR gRNA sequence
ttcccctgggacttgagcct

SEQ ID NO: 292370 - DNA, 20 bp, Artificial
  CRISPR gRNA sequence
tcccctgggacttgagcctc

SEQ ID NO: 292371 - DNA, 20 bp, Artificial
  CRISPR gRNA sequence
cccctgggacttgagcctct

SEQ ID NO: 292372 - DNA, 20 bp, Artificial
  CRISPR gRNA sequence
ccctgggacttgagcctcta

SEQ ID NO: 292373 - DNA, 20 bp, Artificial
  CRISPR gRNA sequence
ggacttgagcctctagtgaa

SEQ ID NO: 292374 - DNA, 20 bp, Artificial
  CRISPR gRNA sequence
gagcctctagtgaaaaccaa

SEQ ID NO: 292375 - DNA, 20 bp, Artificial
  CRISPR gRNA sequence
agcctctagtgaaaaccaaa

SEQ ID NO: 292376 - DNA, 20 bp, Artificial
  CRISPR gRNA sequence
tagtgaaaaccaaacttctt

SEQ ID NO: 292377 - DNA, 20 bp, Artificial
  CRISPR gRNA sequence
gtgaaaaccaaacttcttac

SEQ ID NO: 292378 - DNA, 20 bp, Artificial
  CRISPR gRNA sequence
cttacttaataaaacataat

SEQ ID NO: 292379 - DNA, 20 bp, Artificial
  CRISPR gRNA sequence
ttacttaataaaacataatg

SEQ ID NO: 292380 - DNA, 20 bp, Artificial
  CRISPR gRNA sequence
acttaataaaacataatgat

SEQ ID NO: 292381 - DNA, 20 bp, Artificial
  CRISPR gRNA sequence
cttaataaaacataatgatt

SEQ ID NO: 292382 - DNA, 20 bp, Artificial
  CRISPR gRNA sequence
aataaaacataatgattaac

SEQ ID NO: 292383 - DNA, 20 bp, Artificial
  CRISPR gRNA sequence
ataaaacataatgattaacc

SEQ ID NO: 292384 - DNA, 20 bp, Artificial
  CRISPR gRNA sequence
accttgataatagataactt

SEQ ID NO: 292385 - DNA, 20 bp, Artificial
  CRISPR gRNA sequence
gataatagataacttcagca

SEQ ID NO: 292386 - DNA, 20 bp, Artificial
  CRISPR gRNA sequence
ataatagataacttcagcag

SEQ ID NO: 292387 - DNA, 20 bp, Artificial
  CRISPR gRNA sequence
cagcagatccgtagtgaatt

SEQ ID NO: 292388 - DNA, 20 bp, Artificial
  CRISPR gRNA sequence
agcagatccgtagtgaattc

SEQ ID NO: 292389 - DNA, 20 bp, Artificial
  CRISPR gRNA sequence
cttactgttctttgttttaa

SEQ ID NO: 292390 - DNA, 20 bp, Artificial
  CRISPR gRNA sequence
actgttctttgttttaatca

SEQ ID NO: 292391 - DNA, 20 bp, Artificial
  CRISPR gRNA sequence
ctgttctttgttttaatcat

SEQ ID NO: 292392 - DNA, 20 bp, Artificial
  CRISPR gRNA sequence
ttctttgttttaatcattag

SEQ ID NO: 292393 - DNA, 20 bp, Artificial
  CRISPR gRNA sequence
tttgttttaatcattagcta

SEQ ID NO: 292394 - DNA, 20 bp, Artificial
  CRISPR gRNA sequence
tgttttaatcattagctatg

SEQ ID NO: 292395 - DNA, 20 bp, Artificial
  CRISPR gRNA sequence
gttttaatcattagctatga

SEQ ID NO: 292396 - DNA, 20 bp, Artificial
  CRISPR gRNA sequence
ttttaatcattagctatgaa

SEQ ID NO: 292397 - DNA, 20 bp, Artificial
  CRISPR gRNA sequence
taatcattagctatgaatct

SEQ ID NO: 292398 - DNA, 20 bp, Artificial
  CRISPR gRNA sequence
aatcattagctatgaatctt

SEQ ID NO: 292399 - DNA, 20 bp, Artificial
  CRISPR gRNA sequence
atcattagctatgaatcttt

SEQ ID NO: 292400 - DNA, 20 bp, Artificial
  CRISPR gRNA sequence
gctatgaatctttacttgtg

SEQ ID NO: 292401 - DNA, 20 bp, Artificial
  CRISPR gRNA sequence
tgaatctttacttgtgacat

SEQ ID NO: 292402 - DNA, 20 bp, Artificial
  CRISPR gRNA sequence
tacttgtgacatccagatca

SEQ ID NO: 292403 - DNA, 20 bp, Artificial
  CRISPR gRNA sequence
acttgtgacatccagatcac

SEQ ID NO: 292404 - DNA, 20 bp, Artificial
  CRISPR gRNA sequence
cttgtgacatccagatcaca

SEQ ID NO: 292405 - DNA, 20 bp, Artificial
  CRISPR gRNA sequence
gtgacatccagatcacacct

SEQ ID NO: 292406 - DNA, 20 bp, Artificial
  CRISPR gRNA sequence
tgacatccagatcacaccta

SEQ ID NO: 292407 - DNA, 20 bp, Artificial
  CRISPR gRNA sequence
aagttgtggggagtaagcca

SEQ ID NO: 292408 - DNA, 20 bp, Artificial
  CRISPR gRNA sequence
tggggagtaagccaaagtta

SEQ ID NO: 292409 - DNA, 20 bp, Artificial
  CRISPR gRNA sequence
catggaactatcttaaactt

SEQ ID NO: 292410 - DNA, 20 bp, Artificial
  CRISPR gRNA sequence
tcttaaacttcactcagtgt

SEQ ID NO: 292411 - DNA, 20 bp, Artificial
  CRISPR gRNA sequence
aaacttcactcagtgttttc

SEQ ID NO: 292412 - DNA, 20 bp, Artificial
  CRISPR gRNA sequence
aacttcactcagtgttttct

SEQ ID NO: 292413 - DNA, 20 bp, Artificial
  CRISPR gRNA sequence
cactcagtgttttctctgct

SEQ ID NO: 292414 - DNA, 20 bp, Artificial
  CRISPR gRNA sequence
actcagtgttttctctgctc

SEQ ID NO: 292415 - DNA, 20 bp, Artificial
  CRISPR gRNA sequence
agtgttttctctgctcttgg

SEQ ID NO: 292416 - DNA, 20 bp, Artificial
  CRISPR gRNA sequence
tctctgctcttggatagaat

SEQ ID NO: 292417 - DNA, 20 bp, Artificial
  CRISPR gRNA sequence
ctctgctcttggatagaata

SEQ ID NO: 292418 - DNA, 20 bp, Artificial
  CRISPR gRNA sequence
tctgctcttggatagaataa

SEQ ID NO: 292419 - DNA, 20 bp, Artificial
  CRISPR gRNA sequence
tgctcttggatagaataaat

SEQ ID NO: 292420 - DNA, 20 bp, Artificial
  CRISPR gRNA sequence
ctcttggatagaataaatta

SEQ ID NO: 292421 - DNA, 20 bp, Artificial
  CRISPR gRNA sequence
ttggatagaataaattatta

SEQ ID NO: 292422 - DNA, 20 bp, Artificial
  CRISPR gRNA sequence
ggatagaataaattattata

SEQ ID NO: 292423 - DNA, 20 bp, Artificial
  CRISPR gRNA sequence
gatagaataaattattatat

SEQ ID NO: 292424 - DNA, 20 bp, Artificial
  CRISPR gRNA sequence
ttatatggtgatgtgatttg

SEQ ID NO: 292425 - DNA, 20 bp, Artificial
  CRISPR gRNA sequence
tatggtgatgtgatttgagg

SEQ ID NO: 292426 - DNA, 20 bp, Artificial
  CRISPR gRNA sequence
gaggggtactaagaagccta

SEQ ID NO: 292427 - DNA, 20 bp, Artificial
  CRISPR gRNA sequence
aggggtactaagaagcctac

SEQ ID NO: 292428 - DNA, 20 bp, Artificial
  CRISPR gRNA sequence
agaagcctacctcttccacg

SEQ ID NO: 292429 - DNA, 20 bp, Artificial
  CRISPR gRNA sequence
cctcttccacgattttcacc

SEQ ID NO: 292430 - DNA, 20 bp, Artificial
  CRISPR gRNA sequence
ttccacgattttcacctgca

SEQ ID NO: 292431 - DNA, 20 bp, Artificial
  CRISPR gRNA sequence
ccacgattttcacctgcatt

SEQ ID NO: 292432 - DNA, 20 bp, Artificial
  CRISPR gRNA sequence
cacgattttcacctgcattg

SEQ ID NO: 292433 - DNA, 20 bp, Artificial
  CRISPR gRNA sequence
tcacctgcattgactcctga

SEQ ID NO: 292434 - DNA, 20 bp, Artificial
  CRISPR gRNA sequence
cacctgcattgactcctgaa

SEQ ID NO: 292435 - DNA, 20 bp, Artificial
  CRISPR gRNA sequence
acctgcattgactcctgaaa

SEQ ID NO: 292436 - DNA, 20 bp, Artificial
  CRISPR gRNA sequence
cattgactcctgaaattctc

SEQ ID NO: 292437 - DNA, 20 bp, Artificial
  CRISPR gRNA sequence
actcctgaaattctcatcat

SEQ ID NO: 292438 - DNA, 20 bp, Artificial
  CRISPR gRNA sequence
ctgaaattctcatcatcata

SEQ ID NO: 292439 - DNA, 20 bp, Artificial
  CRISPR gRNA sequence
aaattctcatcatcatagcc

SEQ ID NO: 292440 - DNA, 20 bp, Artificial
  CRISPR gRNA sequence
tcatcatcatagccattcct

SEQ ID NO: 292441 - DNA, 20 bp, Artificial
  CRISPR gRNA sequence
atcatcatagccattcctgc

SEQ ID NO: 292442 - DNA, 20 bp, Artificial
  CRISPR gRNA sequence
ctgctagtttctccattttc

SEQ ID NO: 292443 - DNA, 20 bp, Artificial
  CRISPR gRNA sequence
ctagtttctccattttcctc

SEQ ID NO: 292444 - DNA, 20 bp, Artificial
  CRISPR gRNA sequence
gtttctccattttcctccta

SEQ ID NO: 292445 - DNA, 20 bp, Artificial
  CRISPR gRNA sequence
ctccattttcctcctaaaag

SEQ ID NO: 292446 - DNA, 20 bp, Artificial
  CRISPR gRNA sequence
tccattttcctcctaaaaga

SEQ ID NO: 292447 - DNA, 20 bp, Artificial
  CRISPR gRNA sequence
cattttcctcctaaaagatc

SEQ ID NO: 292448 - DNA, 20 bp, Artificial
  CRISPR gRNA sequence
tcctcctaaaagatccctgt

SEQ ID NO: 292449 - DNA, 20 bp, Artificial
  CRISPR gRNA sequence
cctcctaaaagatccctgtt

SEQ ID NO: 292450 - DNA, 20 bp, Artificial
  CRISPR gRNA sequence
ctcctaaaagatccctgtta

SEQ ID NO: 292451 - DNA, 20 bp, Artificial
  CRISPR gRNA sequence
ctaaaagatccctgttaaaa

SEQ ID NO: 292452 - DNA, 20 bp, Artificial
  CRISPR gRNA sequence
aaagatccctgttaaaatga

SEQ ID NO: 292453 - DNA, 20 bp, Artificial
  CRISPR gRNA sequence
ttaaaatgaaaatgtgtttc

SEQ ID NO: 292454 - DNA, 20 bp, Artificial
  CRISPR gRNA sequence
aaatgaaaatgtgtttcctg

SEQ ID NO: 292455 - DNA, 20 bp, Artificial
  CRISPR gRNA sequence
cctggggtggggggtggggg

SEQ ID NO: 292456 - DNA, 20 bp, Artificial
  CRISPR gRNA sequence
ctggggtggggggtgggggg

SEQ ID NO: 292457 - DNA, 20 bp, Artificial
  CRISPR gRNA sequence
gggtggggggtggggggtgg

SEQ ID NO: 292458 - DNA, 20 bp, Artificial
  CRISPR gRNA sequence
gcctgtattagttaattaca

SEQ ID NO: 292459 - DNA, 20 bp, Artificial
  CRISPR gRNA sequence
tattagttaattacattagg

SEQ ID NO: 292460 - DNA, 20 bp, Artificial
  CRISPR gRNA sequence
gttaattacattaggtacgt

SEQ ID NO: 292461 - DNA, 20 bp, Artificial
  CRISPR gRNA sequence
attacattaggtacgtagtc

SEQ ID NO: 292462 - DNA, 20 bp, Artificial
  CRISPR gRNA sequence
cattaggtacgtagtcctct

SEQ ID NO: 292463 - DNA, 20 bp, Artificial
  CRISPR gRNA sequence
ggtacgtagtcctctaatgg

SEQ ID NO: 292464 - DNA, 20 bp, Artificial
  CRISPR gRNA sequence
taatggactaccgagagaga

SEQ ID NO: 292465 - DNA, 20 bp, Artificial
  CRISPR gRNA sequence
atggactaccgagagagaag

SEQ ID NO: 292466 - DNA, 20 bp, Artificial
  CRISPR gRNA sequence
ccgagagagaagtagactca

SEQ ID NO: 292467 - DNA, 20 bp, Artificial
  CRISPR gRNA sequence
aggtcaggtgaatttggata

SEQ ID NO: 292468 - DNA, 20 bp, Artificial
  CRISPR gRNA sequence
ggatagaaagataaagaaga

SEQ ID NO: 292469 - DNA, 20 bp, Artificial
  CRISPR gRNA sequence
gatagaaagataaagaagaa

SEQ ID NO: 292470 - DNA, 20 bp, Artificial
  CRISPR gRNA sequence
caaggggggcaggccctatt

SEQ ID NO: 292471 - DNA, 20 bp, Artificial
  CRISPR gRNA sequence
aaggggggcaggccctatta

SEQ ID NO: 292472 - DNA, 20 bp, Artificial
  CRISPR gRNA sequence
ttagcagattaccgtaagag

SEQ ID NO: 292473 - DNA, 20 bp, Artificial
  CRISPR gRNA sequence
gcagattaccgtaagagacc

SEQ ID NO: 292474 - DNA, 20 bp, Artificial
  CRISPR gRNA sequence
ccgtaagagaccaaggacag

SEQ ID NO: 292475 - DNA, 20 bp, Artificial
  CRISPR gRNA sequence
aggggacaatgtgagatttc

SEQ ID NO: 292476 - DNA, 20 bp, Artificial
  CRISPR gRNA sequence
ctggggtactcagaaccgag

SEQ ID NO: 292477 - DNA, 20 bp, Artificial
  CRISPR gRNA sequence
tggggtactcagaaccgagg

SEQ ID NO: 292478 - DNA, 20 bp, Artificial
  CRISPR gRNA sequence
gggtactcagaaccgagggt

SEQ ID NO: 292479 - DNA, 20 bp, Artificial
  CRISPR gRNA sequence
agaaccgagggtgtgtgggt

SEQ ID NO: 292480 - DNA, 20 bp, Artificial
  CRISPR gRNA sequence
gcttaattttgctgagaagc

SEQ ID NO: 292481 - DNA, 20 bp, Artificial
  CRISPR gRNA sequence
aattttgctgagaagcattc

SEQ ID NO: 292482 - DNA, 20 bp, Artificial
  CRISPR gRNA sequence
attttgctgagaagcattct

SEQ ID NO: 292483 - DNA, 20 bp, Artificial
  CRISPR gRNA sequence
tgctgagaagcattctgaat

SEQ ID NO: 292484 - DNA, 20 bp, Artificial
  CRISPR gRNA sequence
gctgagaagcattctgaatt

SEQ ID NO: 292485 - DNA, 20 bp, Artificial
  CRISPR gRNA sequence
ctgagaagcattctgaattt

SEQ ID NO: 292486 - DNA, 20 bp, Artificial
  CRISPR gRNA sequence
agaagcattctgaattttcc

SEQ ID NO: 292487 - DNA, 20 bp, Artificial
  CRISPR gRNA sequence
tgaattttccaattgagtca

SEQ ID NO: 292488 - DNA, 20 bp, Artificial
  CRISPR gRNA sequence
aattttccaattgagtcaaa

SEQ ID NO: 292489 - DNA, 20 bp, Artificial
  CRISPR gRNA sequence
tccaattgagtcaaagcagt

SEQ ID NO: 292490 - DNA, 20 bp, Artificial
  CRISPR gRNA sequence
ccaattgagtcaaagcagtg

SEQ ID NO: 292491 - DNA, 20 bp, Artificial
  CRISPR gRNA sequence
caattgagtcaaagcagtgt

SEQ ID NO: 292492 - DNA, 20 bp, Artificial
  CRISPR gRNA sequence
agtcaaagcagtgtttctca

SEQ ID NO: 292493 - DNA, 20 bp, Artificial
  CRISPR gRNA sequence
ctcaaatgcttataagccta

SEQ ID NO: 292494 - DNA, 20 bp, Artificial
  CRISPR gRNA sequence
tcaaatgcttataagcctat

SEQ ID NO: 292495 - DNA, 20 bp, Artificial
  CRISPR gRNA sequence
aaatgcttataagcctatga

SEQ ID NO: 292496 - DNA, 20 bp, Artificial
  CRISPR gRNA sequence
ataagcctatgagtcatttg

SEQ ID NO: 292497 - DNA, 20 bp, Artificial
  CRISPR gRNA sequence
taagcctatgagtcatttga

SEQ ID NO: 292498 - DNA, 20 bp, Artificial
  CRISPR gRNA sequence
tgagtcatttgagggtcttg

SEQ ID NO: 292499 - DNA, 20 bp, Artificial
  CRISPR gRNA sequence
gagggtcttgttaaaaatgc

SEQ ID NO: 292500 - DNA, 20 bp, Artificial
  CRISPR gRNA sequence
agggtcttgttaaaaatgca

SEQ ID NO: 292501 - DNA, 20 bp, Artificial
  CRISPR gRNA sequence
gttaaaaatgcagatttaag

SEQ ID NO: 292502 - DNA, 20 bp, Artificial
  CRISPR gRNA sequence
ttaaaaatgcagatttaagt

SEQ ID NO: 292503 - DNA, 20 bp, Artificial
  CRISPR gRNA sequence
aaaatgcagatttaagttca

SEQ ID NO: 292504 - DNA, 20 bp, Artificial
  CRISPR gRNA sequence
aagttcagtaggtctggggt

SEQ ID NO: 292505 - DNA, 20 bp, Artificial
  CRISPR gRNA sequence
agttcagtaggtctggggtt

SEQ ID NO: 292506 - DNA, 20 bp, Artificial
  CRISPR gRNA sequence
agtaggtctggggtttggat

SEQ ID NO: 292507 - DNA, 20 bp, Artificial
  CRISPR gRNA sequence
gggtttggatctgagattct

SEQ ID NO: 292508 - DNA, 20 bp, Artificial
  CRISPR gRNA sequence
ggatctgagattctgcacct

SEQ ID NO: 292509 - DNA, 20 bp, Artificial
  CRISPR gRNA sequence
gatctgagattctgcacctc

SEQ ID NO: 292510 - DNA, 20 bp, Artificial
  CRISPR gRNA sequence
agattctgcacctctaacaa

SEQ ID NO: 292511 - DNA, 20 bp, Artificial
  CRISPR gRNA sequence
tgcacctctaacaagctctc

SEQ ID NO: 292512 - DNA, 20 bp, Artificial
  CRISPR gRNA sequence
cacctctaacaagctctcag

SEQ ID NO: 292513 - DNA, 20 bp, Artificial
  CRISPR gRNA sequence
taacaagctctcaggtgatg

SEQ ID NO: 292514 - DNA, 20 bp, Artificial
  CRISPR gRNA sequence
acaagctctcaggtgatgcc

SEQ ID NO: 292515 - DNA, 20 bp, Artificial
  CRISPR gRNA sequence
tcaggtgatgcctgtgctgc

SEQ ID NO: 292516 - DNA, 20 bp, Artificial
  CRISPR gRNA sequence
aggtgatgcctgtgctgctg

SEQ ID NO: 292517 - DNA, 20 bp, Artificial
  CRISPR gRNA sequence
tgctgctgtggaggaccaca

SEQ ID NO: 292518 - DNA, 20 bp, Artificial
  CRISPR gRNA sequence
ctgtggaggaccacaatttg

SEQ ID NO: 292519 - DNA, 20 bp, Artificial
  CRISPR gRNA sequence
tggaggaccacaatttgaga

SEQ ID NO: 292520 - DNA, 20 bp, Artificial
  CRISPR gRNA sequence
gagaagcaaggaattaagct

SEQ ID NO: 292521 - DNA, 20 bp, Artificial
  CRISPR gRNA sequence
agaagcaaggaattaagctc

SEQ ID NO: 292522 - DNA, 20 bp, Artificial
  CRISPR gRNA sequence
agctctcatttggctagagt

SEQ ID NO: 292523 - DNA, 20 bp, Artificial
  CRISPR gRNA sequence
tcatttggctagagtgacca

SEQ ID NO: 292524 - DNA, 20 bp, Artificial
  CRISPR gRNA sequence
atttggctagagtgaccagg

SEQ ID NO: 292525 - DNA, 20 bp, Artificial
  CRISPR gRNA sequence
ggctagagtgaccaggtatc

SEQ ID NO: 292526 - DNA, 20 bp, Artificial
  CRISPR gRNA sequence
gctagagtgaccaggtatcc

SEQ ID NO: 292527 - DNA, 20 bp, Artificial
  CRISPR gRNA sequence
gagtgaccaggtatcctctt

SEQ ID NO: 292528 - DNA, 20 bp, Artificial
  CRISPR gRNA sequence
tttgctcagaaccaaagggt

SEQ ID NO: 292529 - DNA, 20 bp, Artificial
  CRISPR gRNA sequence
tgctcagaaccaaagggttt

SEQ ID NO: 292530 - DNA, 20 bp, Artificial
  CRISPR gRNA sequence
gctcagaaccaaagggttta

SEQ ID NO: 292531 - DNA, 20 bp, Artificial
  CRISPR gRNA sequence
ctcagaaccaaagggtttat

SEQ ID NO: 292532 - DNA, 20 bp, Artificial
  CRISPR gRNA sequence
agaaccaaagggtttatttg

SEQ ID NO: 292533 - DNA, 20 bp, Artificial
  CRISPR gRNA sequence
atttggggcacaagattttt

SEQ ID NO: 292534 - DNA, 20 bp, Artificial
  CRISPR gRNA sequence
tttggggcacaagatttttg

SEQ ID NO: 292535 - DNA, 20 bp, Artificial
  CRISPR gRNA sequence
ggggcacaagatttttggtg

SEQ ID NO: 292536 - DNA, 20 bp, Artificial
  CRISPR gRNA sequence
gggcacaagatttttggtgc

SEQ ID NO: 292537 - DNA, 20 bp, Artificial
  CRISPR gRNA sequence
ttggtgctaaaactgggaaa

SEQ ID NO: 292538 - DNA, 20 bp, Artificial
  CRISPR gRNA sequence
tggtgctaaaactgggaaag

SEQ ID NO: 292539 - DNA, 20 bp, Artificial
  CRISPR gRNA sequence
ggtgctaaaactgggaaagt

SEQ ID NO: 292540 - DNA, 20 bp, Artificial
  CRISPR gRNA sequence
gtgctaaaactgggaaagtc

SEQ ID NO: 292541 - DNA, 20 bp, Artificial
  CRISPR gRNA sequence
aaactgggaaagtctcaggc

SEQ ID NO: 292542 - DNA, 20 bp, Artificial
  CRISPR gRNA sequence
ggaaagtctcaggcaaatag

SEQ ID NO: 292543 - DNA, 20 bp, Artificial
  CRISPR gRNA sequence
aggcaaataggacacgttgg

SEQ ID NO: 292544 - DNA, 20 bp, Artificial
  CRISPR gRNA sequence
gttaccctatatttgtctaa

SEQ ID NO: 292545 - DNA, 20 bp, Artificial
  CRISPR gRNA sequence
ccctatatttgtctaagatt

SEQ ID NO: 292546 - DNA, 20 bp, Artificial
  CRISPR gRNA sequence
tatttgtctaagattgcaaa

SEQ ID NO: 292547 - DNA, 20 bp, Artificial
  CRISPR gRNA sequence
gtctaagattgcaaaatggt

SEQ ID NO: 292548 - DNA, 20 bp, Artificial
  CRISPR gRNA sequence
tctaagattgcaaaatggta

SEQ ID NO: 292549 - DNA, 20 bp, Artificial
  CRISPR gRNA sequence
agattgcaaaatggtaatat

SEQ ID NO: 292550 - DNA, 20 bp, Artificial
  CRISPR gRNA sequence
caaaatggtaatataatatc

SEQ ID NO: 292551 - DNA, 20 bp, Artificial
  CRISPR gRNA sequence
cattaactggcatgtttgag

SEQ ID NO: 292552 - DNA, 20 bp, Artificial
  CRISPR gRNA sequence
actggcatgtttgagaacta

SEQ ID NO: 292553 - DNA, 20 bp, Artificial
  CRISPR gRNA sequence
gcatgtttgagaactagcta

SEQ ID NO: 292554 - DNA, 20 bp, Artificial
  CRISPR gRNA sequence
gagaactagctacattcgtt

SEQ ID NO: 292555 - DNA, 20 bp, Artificial
  CRISPR gRNA sequence
agaactagctacattcgtta

SEQ ID NO: 292556 - DNA, 20 bp, Artificial
  CRISPR gRNA sequence
gctacattcgttaacagctt

SEQ ID NO: 292557 - DNA, 20 bp, Artificial
  CRISPR gRNA sequence
cattcgttaacagcttaact

SEQ ID NO: 292558 - DNA, 20 bp, Artificial
  CRISPR gRNA sequence
gttaacagcttaactaggtt

SEQ ID NO: 292559 - DNA, 20 bp, Artificial
  CRISPR gRNA sequence
acagcttaactaggttaatg

SEQ ID NO: 292560 - DNA, 20 bp, Artificial
  CRISPR gRNA sequence
aactaggttaatggattttt

SEQ ID NO: 292561 - DNA, 20 bp, Artificial
  CRISPR gRNA sequence
actaggttaatggatttttc

SEQ ID NO: 292562 - DNA, 20 bp, Artificial
  CRISPR gRNA sequence
ggttaatggatttttcctcc

SEQ ID NO: 292563 - DNA, 20 bp, Artificial
  CRISPR gRNA sequence
atggatttttcctcctaaaa

SEQ ID NO: 292564 - DNA, 20 bp, Artificial
  CRISPR gRNA sequence
ttcctcctaaaacatgtgca

SEQ ID NO: 292565 - DNA, 20 bp, Artificial
  CRISPR gRNA sequence
tcctcctaaaacatgtgcac

SEQ ID NO: 292566 - DNA, 20 bp, Artificial
  CRISPR gRNA sequence
cctcctaaaacatgtgcacc

SEQ ID NO: 292567 - DNA, 20 bp, Artificial
  CRISPR gRNA sequence
ctcctaaaacatgtgcacct

SEQ ID NO: 292568 - DNA, 20 bp, Artificial
  CRISPR gRNA sequence
ctaaaacatgtgcacctatt

SEQ ID NO: 292569 - DNA, 20 bp, Artificial
  CRISPR gRNA sequence
aaacatgtgcacctattcct

SEQ ID NO: 292570 - DNA, 20 bp, Artificial
  CRISPR gRNA sequence
ttcctttccttgtaagacat

SEQ ID NO: 292571 - DNA, 20 bp, Artificial
  CRISPR gRNA sequence
ctttccttgtaagacattcc

SEQ ID NO: 292572 - DNA, 20 bp, Artificial
  CRISPR gRNA sequence
tccttgtaagacattcctac

SEQ ID NO: 292573 - DNA, 20 bp, Artificial
  CRISPR gRNA sequence
ccttgtaagacattcctacc

SEQ ID NO: 292574 - DNA, 20 bp, Artificial
  CRISPR gRNA sequence
cttgtaagacattcctaccc

SEQ ID NO: 292575 - DNA, 20 bp, Artificial
  CRISPR gRNA sequence
gtaagacattcctacccttt

SEQ ID NO: 292576 - DNA, 20 bp, Artificial
  CRISPR gRNA sequence
taagacattcctaccctttc

SEQ ID NO: 292577 - DNA, 20 bp, Artificial
  CRISPR gRNA sequence
ctaccctttcctattaagag

SEQ ID NO: 292578 - DNA, 20 bp, Artificial
  CRISPR gRNA sequence
ccctttcctattaagagtgg

SEQ ID NO: 292579 - DNA, 20 bp, Artificial
  CRISPR gRNA sequence
tcctattaagagtggtaaaa

SEQ ID NO: 292580 - DNA, 20 bp, Artificial
  CRISPR gRNA sequence
cctattaagagtggtaaaaa

SEQ ID NO: 292581 - DNA, 20 bp, Artificial
  CRISPR gRNA sequence
ctattaagagtggtaaaaat

SEQ ID NO: 292582 - DNA, 20 bp, Artificial
  CRISPR gRNA sequence
ttaagagtggtaaaaattgg

SEQ ID NO: 292583 - DNA, 20 bp, Artificial
  CRISPR gRNA sequence
agagtggtaaaaattgggtt

SEQ ID NO: 292584 - DNA, 20 bp, Artificial
  CRISPR gRNA sequence
ggttaactaattaaaatgag

SEQ ID NO: 292585 - DNA, 20 bp, Artificial
  CRISPR gRNA sequence
actaattaaaatgagataca

SEQ ID NO: 292586 - DNA, 20 bp, Artificial
  CRISPR gRNA sequence
attaaaatgagatacaaagg

SEQ ID NO: 292587 - DNA, 20 bp, Artificial
  CRISPR gRNA sequence
aaatgagatacaaaggttac

SEQ ID NO: 292588 - DNA, 20 bp, Artificial
  CRISPR gRNA sequence
cagtcttacaacgtctttga

SEQ ID NO: 292589 - DNA, 20 bp, Artificial
  CRISPR gRNA sequence
acaacgtctttgattgttca

SEQ ID NO: 292590 - DNA, 20 bp, Artificial
  CRISPR gRNA sequence
caacgtctttgattgttcac

SEQ ID NO: 292591 - DNA, 20 bp, Artificial
  CRISPR gRNA sequence
tgattgttcacaatctcaca

SEQ ID NO: 292592 - DNA, 20 bp, Artificial
  CRISPR gRNA sequence
gattgttcacaatctcacaa

SEQ ID NO: 292593 - DNA, 20 bp, Artificial
  CRISPR gRNA sequence
attgttcacaatctcacaag

SEQ ID NO: 292594 - DNA, 20 bp, Artificial
  CRISPR gRNA sequence
ttcacaatctcacaagacct

SEQ ID NO: 292595 - DNA, 20 bp, Artificial
  CRISPR gRNA sequence
acaatctcacaagacctcag

SEQ ID NO: 292596 - DNA, 20 bp, Artificial
  CRISPR gRNA sequence
acaagacctcaggagtagtt

SEQ ID NO: 292597 - DNA, 20 bp, Artificial
  CRISPR gRNA sequence
aggagtagttaccctaaaca

SEQ ID NO: 292598 - DNA, 20 bp, Artificial
  CRISPR gRNA sequence
ccctaaacagatcaccttag

SEQ ID NO: 292599 - DNA, 20 bp, Artificial
  CRISPR gRNA sequence
aacagatcaccttagaaaaa

SEQ ID NO: 292600 - DNA, 20 bp, Artificial
  CRISPR gRNA sequence
agaaaaaaggtgggagatgg

SEQ ID NO: 292601 - DNA, 20 bp, Artificial
  CRISPR gRNA sequence
gaaaaaaggtgggagatgga

SEQ ID NO: 292602 - DNA, 20 bp, Artificial
  CRISPR gRNA sequence
aggctgttctaagccaagaa

SEQ ID NO: 292603 - DNA, 20 bp, Artificial
  CRISPR gRNA sequence
ggctgttctaagccaagaaa

SEQ ID NO: 292604 - DNA, 20 bp, Artificial
  CRISPR gRNA sequence
ttctaagccaagaaagattt

SEQ ID NO: 292605 - DNA, 20 bp, Artificial
  CRISPR gRNA sequence
taagccaagaaagattttga

SEQ ID NO: 292606 - DNA, 20 bp, Artificial
  CRISPR gRNA sequence
agccaagaaagattttgaaa

SEQ ID NO: 292607 - DNA, 20 bp, Artificial
  CRISPR gRNA sequence
tgaaactttttttttttttg

SEQ ID NO: 292608 - DNA, 20 bp, Artificial
  CRISPR gRNA sequence
gaaactttttttttttttga

SEQ ID NO: 292609 - DNA, 20 bp, Artificial
  CRISPR gRNA sequence
aaactttttttttttttgag

SEQ ID NO: 292610 - DNA, 20 bp, Artificial
  CRISPR gRNA sequence
tttttttttttgagatggag

SEQ ID NO: 292611 - DNA, 20 bp, Artificial
  CRISPR gRNA sequence
ttttttttttgagatggagt

SEQ ID NO: 292612 - DNA, 20 bp, Artificial
  CRISPR gRNA sequence
tttttttttgagatggagtc

SEQ ID NO: 292613 - DNA, 20 bp, Artificial
  CRISPR gRNA sequence
ttttttttgagatggagtct

SEQ ID NO: 292614 - DNA, 20 bp, Artificial
  CRISPR gRNA sequence
tttttttgagatggagtctc

SEQ ID NO: 292615 - DNA, 20 bp, Artificial
  CRISPR gRNA sequence
ttttttgagatggagtctct

SEQ ID NO: 292616 - DNA, 20 bp, Artificial
  CRISPR gRNA sequence
tttttgagatggagtctctt

SEQ ID NO: 292617 - DNA, 20 bp, Artificial
  CRISPR gRNA sequence
ttttgagatggagtctctta

SEQ ID NO: 292618 - DNA, 20 bp, Artificial
  CRISPR gRNA sequence
tttgagatggagtctcttac

SEQ ID NO: 292619 - DNA, 20 bp, Artificial
  CRISPR gRNA sequence
ttgagatggagtctcttact

SEQ ID NO: 292620 - DNA, 20 bp, Artificial
  CRISPR gRNA sequence
tgagatggagtctcttactc

SEQ ID NO: 292621 - DNA, 20 bp, Artificial
  CRISPR gRNA sequence
gagatggagtctcttactct

SEQ ID NO: 292622 - DNA, 20 bp, Artificial
  CRISPR gRNA sequence
agatggagtctcttactctg

SEQ ID NO: 292623 - DNA, 20 bp, Artificial
  CRISPR gRNA sequence
ttactctgtcacccaggcta

SEQ ID NO: 292624 - DNA, 20 bp, Artificial
  CRISPR gRNA sequence
actctgtcacccaggctaga

SEQ ID NO: 292625 - DNA, 20 bp, Artificial
  CRISPR gRNA sequence
ctctgtcacccaggctagag

SEQ ID NO: 292626 - DNA, 20 bp, Artificial
  CRISPR gRNA sequence
tgtcacccaggctagagtgc

SEQ ID NO: 292627 - DNA, 20 bp, Artificial
  CRISPR gRNA sequence
tcacccaggctagagtgcag

SEQ ID NO: 292628 - DNA, 20 bp, Artificial
  CRISPR gRNA sequence
gagtgcagtggcgtgatctc

SEQ ID NO: 292629 - DNA, 20 bp, Artificial
  CRISPR gRNA sequence
gggtctctgcagcctctgcc

SEQ ID NO: 292630 - DNA, 20 bp, Artificial
  CRISPR gRNA sequence
tgcagcctctgcctcctggg

SEQ ID NO: 292631 - DNA, 20 bp, Artificial
  CRISPR gRNA sequence
cagcctctgcctcctgggtt

SEQ ID NO: 292632 - DNA, 20 bp, Artificial
  CRISPR gRNA sequence
tgcctcctgggttcaagcga

SEQ ID NO: 292633 - DNA, 20 bp, Artificial
  CRISPR gRNA sequence
cctcctgggttcaagcgatt

SEQ ID NO: 292634 - DNA, 20 bp, Artificial
  CRISPR gRNA sequence
ctgggttcaagcgattctcc

SEQ ID NO: 292635 - DNA, 20 bp, Artificial
  CRISPR gRNA sequence
ggttcaagcgattctcctgt

SEQ ID NO: 292636 - DNA, 20 bp, Artificial
  CRISPR gRNA sequence
aagcgattctcctgtctcag

SEQ ID NO: 292637 - DNA, 20 bp, Artificial
  CRISPR gRNA sequence
tcctgtctcagcctccaaac

SEQ ID NO: 292638 - DNA, 20 bp, Artificial
  CRISPR gRNA sequence
ctgtctcagcctccaaacta

SEQ ID NO: 292639 - DNA, 20 bp, Artificial
  CRISPR gRNA sequence
tctcagcctccaaactagct

SEQ ID NO: 292640 - DNA, 20 bp, Artificial
  CRISPR gRNA sequence
agcctccaaactagctggga

SEQ ID NO: 292641 - DNA, 20 bp, Artificial
  CRISPR gRNA sequence
caaactagctgggactacag

SEQ ID NO: 292642 - DNA, 20 bp, Artificial
  CRISPR gRNA sequence
gctgggactacaggcatgtg

SEQ ID NO: 292643 - DNA, 20 bp, Artificial
  CRISPR gRNA sequence
ggactacaggcatgtgccat

SEQ ID NO: 292644 - DNA, 20 bp, Artificial
  CRISPR gRNA sequence
caggcatgtgccatcatgcc

SEQ ID NO: 292645 - DNA, 20 bp, Artificial
  CRISPR gRNA sequence
gctaattttttatttttagt

SEQ ID NO: 292646 - DNA, 20 bp, Artificial
  CRISPR gRNA sequence
attttttatttttagtagag

SEQ ID NO: 292647 - DNA, 20 bp, Artificial
  CRISPR gRNA sequence
tttatttttagtagagacaa

SEQ ID NO: 292648 - DNA, 20 bp, Artificial
  CRISPR gRNA sequence
ttatttttagtagagacaag

SEQ ID NO: 292649 - DNA, 20 bp, Artificial
  CRISPR gRNA sequence
tatttttagtagagacaagg

SEQ ID NO: 292650 - DNA, 20 bp, Artificial
  CRISPR gRNA sequence
atttttagtagagacaaggt

SEQ ID NO: 292651 - DNA, 20 bp, Artificial
  CRISPR gRNA sequence
tttttagtagagacaaggtt

SEQ ID NO: 292652 - DNA, 20 bp, Artificial
  CRISPR gRNA sequence
ttagtagagacaaggtttca

SEQ ID NO: 292653 - DNA, 20 bp, Artificial
  CRISPR gRNA sequence
tagtagagacaaggtttcac

SEQ ID NO: 292654 - DNA, 20 bp, Artificial
  CRISPR gRNA sequence
agtagagacaaggtttcact

SEQ ID NO: 292655 - DNA, 20 bp, Artificial
  CRISPR gRNA sequence
gtagagacaaggtttcacta

SEQ ID NO: 292656 - DNA, 20 bp, Artificial
  CRISPR gRNA sequence
cactatgttgtccagggtgg

SEQ ID NO: 292657 - DNA, 20 bp, Artificial
  CRISPR gRNA sequence
actatgttgtccagggtggt

SEQ ID NO: 292658 - DNA, 20 bp, Artificial
  CRISPR gRNA sequence
tgttgtccagggtggtctca

SEQ ID NO: 292659 - DNA, 20 bp, Artificial
  CRISPR gRNA sequence
tccagggtggtctcaaactc

SEQ ID NO: 292660 - DNA, 20 bp, Artificial
  CRISPR gRNA sequence
aaactcctgacctcaagcga

SEQ ID NO: 292661 - DNA, 20 bp, Artificial
  CRISPR gRNA sequence
ctgacctcaagcgatcctcc

SEQ ID NO: 292662 - DNA, 20 bp, Artificial
  CRISPR gRNA sequence
acctcaagcgatcctcctgc

SEQ ID NO: 292663 - DNA, 20 bp, Artificial
  CRISPR gRNA sequence
aagcgatcctcctgccttga

SEQ ID NO: 292664 - DNA, 20 bp, Artificial
  CRISPR gRNA sequence
ctgccttgacctcccaaagt

SEQ ID NO: 292665 - DNA, 20 bp, Artificial
  CRISPR gRNA sequence
ccttgacctcccaaagtgct

SEQ ID NO: 292666 - DNA, 20 bp, Artificial
  CRISPR gRNA sequence
gacctcccaaagtgctagga

SEQ ID NO: 292667 - DNA, 20 bp, Artificial
  CRISPR gRNA sequence
acctcccaaagtgctaggat

SEQ ID NO: 292668 - DNA, 20 bp, Artificial
  CRISPR gRNA sequence
ccaaagtgctaggattacag

SEQ ID NO: 292669 - DNA, 20 bp, Artificial
  CRISPR gRNA sequence
ggattacaggcatgagccag

SEQ ID NO: 292670 - DNA, 20 bp, Artificial
  CRISPR gRNA sequence
caggcatgagccagcacacc

SEQ ID NO: 292671 - DNA, 20 bp, Artificial
  CRISPR gRNA sequence
gccttgaaaagatttttaat

SEQ ID NO: 292672 - DNA, 20 bp, Artificial
  CRISPR gRNA sequence
gaaaagatttttaatacagt

SEQ ID NO: 292673 - DNA, 20 bp, Artificial
  CRISPR gRNA sequence
aaaagatttttaatacagtt

SEQ ID NO: 292674 - DNA, 20 bp, Artificial
  CRISPR gRNA sequence
ttaatacagttcctggtatg

SEQ ID NO: 292675 - DNA, 20 bp, Artificial
  CRISPR gRNA sequence
taatacagttcctggtatga

SEQ ID NO: 292676 - DNA, 20 bp, Artificial
  CRISPR gRNA sequence
aatacagttcctggtatgag

SEQ ID NO: 292677 - DNA, 20 bp, Artificial
  CRISPR gRNA sequence
atacagttcctggtatgagt

SEQ ID NO: 292678 - DNA, 20 bp, Artificial
  CRISPR gRNA sequence
ctggtatgagtggcattcct

SEQ ID NO: 292679 - DNA, 20 bp, Artificial
  CRISPR gRNA sequence
gtatgagtggcattcctgta

SEQ ID NO: 292680 - DNA, 20 bp, Artificial
  CRISPR gRNA sequence
ctgtagtttatttcccagaa

SEQ ID NO: 292681 - DNA, 20 bp, Artificial
  CRISPR gRNA sequence
tagtttatttcccagaaaag

SEQ ID NO: 292682 - DNA, 20 bp, Artificial
  CRISPR gRNA sequence
atttcccagaaaagcagagc

SEQ ID NO: 292683 - DNA, 20 bp, Artificial
  CRISPR gRNA sequence
tttcccagaaaagcagagca

SEQ ID NO: 292684 - DNA, 20 bp, Artificial
  CRISPR gRNA sequence
cccagaaaagcagagcacag

SEQ ID NO: 292685 - DNA, 20 bp, Artificial
  CRISPR gRNA sequence
ccagaaaagcagagcacaga

SEQ ID NO: 292686 - DNA, 20 bp, Artificial
  CRISPR gRNA sequence
ataatttaggatatgagttt

SEQ ID NO: 292687 - DNA, 20 bp, Artificial
  CRISPR gRNA sequence
aggatatgagtttttggatt

SEQ ID NO: 292688 - DNA, 20 bp, Artificial
  CRISPR gRNA sequence
ggatatgagtttttggattt

SEQ ID NO: 292689 - DNA, 20 bp, Artificial
  CRISPR gRNA sequence
ttggatttattattcctagt

SEQ ID NO: 292690 - DNA, 20 bp, Artificial
  CRISPR gRNA sequence
tggatttattattcctagtt

SEQ ID NO: 292691 - DNA, 20 bp, Artificial
  CRISPR gRNA sequence
ggatttattattcctagtta

SEQ ID NO: 292692 - DNA, 20 bp, Artificial
  CRISPR gRNA sequence
gatttattattcctagttat

SEQ ID NO: 292693 - DNA, 20 bp, Artificial
  CRISPR gRNA sequence
attattcctagttataacac

SEQ ID NO: 292694 - DNA, 20 bp, Artificial
  CRISPR gRNA sequence
ttattcctagttataacaca

SEQ ID NO: 292695 - DNA, 20 bp, Artificial
  CRISPR gRNA sequence
ttcctagttataacacaaaa

SEQ ID NO: 292696 - DNA, 20 bp, Artificial
  CRISPR gRNA sequence
ctagttataacacaaaacat

SEQ ID NO: 292697 - DNA, 20 bp, Artificial
  CRISPR gRNA sequence
gttataacacaaaacatatt

SEQ ID NO: 292698 - DNA, 20 bp, Artificial
  CRISPR gRNA sequence
taacacaaaacatattgatg

SEQ ID NO: 292699 - DNA, 20 bp, Artificial
  CRISPR gRNA sequence
atgttataagaaacacagaa

SEQ ID NO: 292700 - DNA, 20 bp, Artificial
  CRISPR gRNA sequence
taagaaacacagaatattct

SEQ ID NO: 292701 - DNA, 20 bp, Artificial
  CRISPR gRNA sequence
tagatatcagctgcctgtgt

SEQ ID NO: 292702 - DNA, 20 bp, Artificial
  CRISPR gRNA sequence
gatatcagctgcctgtgtca

SEQ ID NO: 292703 - DNA, 20 bp, Artificial
  CRISPR gRNA sequence
cctgtgtcatgagtcgatct

SEQ ID NO: 292704 - DNA, 20 bp, Artificial
  CRISPR gRNA sequence
tgtcatgagtcgatcttata

SEQ ID NO: 292705 - DNA, 20 bp, Artificial
  CRISPR gRNA sequence
ataggataaattaataagtg

SEQ ID NO: 292706 - DNA, 20 bp, Artificial
  CRISPR gRNA sequence
taggataaattaataagtgg

SEQ ID NO: 292707 - DNA, 20 bp, Artificial
  CRISPR gRNA sequence
ataagtgggaaataacaatg

SEQ ID NO: 292708 - DNA, 20 bp, Artificial
  CRISPR gRNA sequence
aaagtggctcaggaacatat

SEQ ID NO: 292709 - DNA, 20 bp, Artificial
  CRISPR gRNA sequence
aggaacatatcaaacttcat

SEQ ID NO: 292710 - DNA, 20 bp, Artificial
  CRISPR gRNA sequence
catttagggacagggttcat

SEQ ID NO: 292711 - DNA, 20 bp, Artificial
  CRISPR gRNA sequence
atttagggacagggttcatt

SEQ ID NO: 292712 - DNA, 20 bp, Artificial
  CRISPR gRNA sequence
agggacagggttcattgaaa

SEQ ID NO: 292713 - DNA, 20 bp, Artificial
  CRISPR gRNA sequence
gggacagggttcattgaaac

SEQ ID NO: 292714 - DNA, 20 bp, Artificial
  CRISPR gRNA sequence
attgaaacaaacaaaaaaaa

SEQ ID NO: 292715 - DNA, 20 bp, Artificial
  CRISPR gRNA sequence
aaacaaacaaaaaaaaaagg

SEQ ID NO: 292716 - DNA, 20 bp, Artificial
  CRISPR gRNA sequence
cacctccaaccaaatccaac

SEQ ID NO: 292717 - DNA, 20 bp, Artificial
  CRISPR gRNA sequence
acctccaaccaaatccaact

SEQ ID NO: 292718 - DNA, 20 bp, Artificial
  CRISPR gRNA sequence
caaccaaatccaacttttcc

SEQ ID NO: 292719 - DNA, 20 bp, Artificial
  CRISPR gRNA sequence
ttcctctttcctggcaatta

SEQ ID NO: 292720 - DNA, 20 bp, Artificial
  CRISPR gRNA sequence
tcctctttcctggcaattat

SEQ ID NO: 292721 - DNA, 20 bp, Artificial
  CRISPR gRNA sequence
cctctttcctggcaattatc

SEQ ID NO: 292722 - DNA, 20 bp, Artificial
  CRISPR gRNA sequence
ctctttcctggcaattatca

SEQ ID NO: 292723 - DNA, 20 bp, Artificial
  CRISPR gRNA sequence
tttcctggcaattatcatca

SEQ ID NO: 292724 - DNA, 20 bp, Artificial
  CRISPR gRNA sequence
tcctggcaattatcatcatt

SEQ ID NO: 292725 - DNA, 20 bp, Artificial
  CRISPR gRNA sequence
cctggcaattatcatcattt

SEQ ID NO: 292726 - DNA, 20 bp, Artificial
  CRISPR gRNA sequence
ctggcaattatcatcatttg

SEQ ID NO: 292727 - DNA, 20 bp, Artificial
  CRISPR gRNA sequence
gcaattatcatcatttgtca

SEQ ID NO: 292728 - DNA, 20 bp, Artificial
  CRISPR gRNA sequence
tcatcatttgtcatggcttc

SEQ ID NO: 292729 - DNA, 20 bp, Artificial
  CRISPR gRNA sequence
gtcatggcttccctttatcc

SEQ ID NO: 292730 - DNA, 20 bp, Artificial
  CRISPR gRNA sequence
tcatggcttccctttatcct

SEQ ID NO: 292731 - DNA, 20 bp, Artificial
  CRISPR gRNA sequence
ccctttatcctcattattgt

SEQ ID NO: 292732 - DNA, 20 bp, Artificial
  CRISPR gRNA sequence
cctttatcctcattattgta

SEQ ID NO: 292733 - DNA, 20 bp, Artificial
  CRISPR gRNA sequence
tatcctcattattgtaggtg

SEQ ID NO: 292734 - DNA, 20 bp, Artificial
  CRISPR gRNA sequence
atcctcattattgtaggtgc

SEQ ID NO: 292735 - DNA, 20 bp, Artificial
  CRISPR gRNA sequence
tcctcattattgtaggtgcc

SEQ ID NO: 292736 - DNA, 20 bp, Artificial
  CRISPR gRNA sequence
attattgtaggtgccacaag

SEQ ID NO: 292737 - DNA, 20 bp, Artificial
  CRISPR gRNA sequence
ttgtaggtgccacaaggcat

SEQ ID NO: 292738 - DNA, 20 bp, Artificial
  CRISPR gRNA sequence
taggtgccacaaggcattcc

SEQ ID NO: 292739 - DNA, 20 bp, Artificial
  CRISPR gRNA sequence
ctggaagtgtttgcctggca

SEQ ID NO: 292740 - DNA, 20 bp, Artificial
  CRISPR gRNA sequence
gaagtgtttgcctggcaacc

SEQ ID NO: 292741 - DNA, 20 bp, Artificial
  CRISPR gRNA sequence
gcctggcaacctgatttaaa

SEQ ID NO: 292742 - DNA, 20 bp, Artificial
  CRISPR gRNA sequence
cctggcaacctgatttaaat

SEQ ID NO: 292743 - DNA, 20 bp, Artificial
  CRISPR gRNA sequence
gcaacctgatttaaatgagg

SEQ ID NO: 292744 - DNA, 20 bp, Artificial
  CRISPR gRNA sequence
atttaaatgagggggcttac

SEQ ID NO: 292745 - DNA, 20 bp, Artificial
  CRISPR gRNA sequence
aaatgagggggcttacctaa

SEQ ID NO: 292746 - DNA, 20 bp, Artificial
  CRISPR gRNA sequence
aatgagggggcttacctaag

SEQ ID NO: 292747 - DNA, 20 bp, Artificial
  CRISPR gRNA sequence
acctaagagaggataaattc

SEQ ID NO: 292748 - DNA, 20 bp, Artificial
  CRISPR gRNA sequence
cctaagagaggataaattca

SEQ ID NO: 292749 - DNA, 20 bp, Artificial
  CRISPR gRNA sequence
agagaggataaattcaagac

SEQ ID NO: 292750 - DNA, 20 bp, Artificial
  CRISPR gRNA sequence
aagacccacttaaatatagc

SEQ ID NO: 292751 - DNA, 20 bp, Artificial
  CRISPR gRNA sequence
aaatatagctatcattggct

SEQ ID NO: 292752 - DNA, 20 bp, Artificial
  CRISPR gRNA sequence
aatatagctatcattggctg

SEQ ID NO: 292753 - DNA, 20 bp, Artificial
  CRISPR gRNA sequence
tcattggctgggtgtggtgg

SEQ ID NO: 292754 - DNA, 20 bp, Artificial
  CRISPR gRNA sequence
gctgggtgtggtggctcacg

SEQ ID NO: 292755 - DNA, 20 bp, Artificial
  CRISPR gRNA sequence
ggtgtggtggctcacgcctg

SEQ ID NO: 292756 - DNA, 20 bp, Artificial
  CRISPR gRNA sequence
acgcctgtaatcccagcact

SEQ ID NO: 292757 - DNA, 20 bp, Artificial
  CRISPR gRNA sequence
taatcccagcactttgggag

SEQ ID NO: 292758 - DNA, 20 bp, Artificial
  CRISPR gRNA sequence
tgggaggccgaggctggtgg

SEQ ID NO: 292759 - DNA, 20 bp, Artificial
  CRISPR gRNA sequence
gggaggccgaggctggtgga

SEQ ID NO: 292760 - DNA, 20 bp, Artificial
  CRISPR gRNA sequence
ggaggccgaggctggtggat

SEQ ID NO: 292761 - DNA, 20 bp, Artificial
  CRISPR gRNA sequence
gtggatcacgaggtcaggag

SEQ ID NO: 292762 - DNA, 20 bp, Artificial
  CRISPR gRNA sequence
agaccatcctggctaacaca

SEQ ID NO: 292763 - DNA, 20 bp, Artificial
  CRISPR gRNA sequence
gctaacacagtgaaacccca

SEQ ID NO: 292764 - DNA, 20 bp, Artificial
  CRISPR gRNA sequence
acacagtgaaaccccatctc

SEQ ID NO: 292765 - DNA, 20 bp, Artificial
  CRISPR gRNA sequence
tattaaaaatacaagaaatt

SEQ ID NO: 292766 - DNA, 20 bp, Artificial
  CRISPR gRNA sequence
ttaaaaatacaagaaattag

SEQ ID NO: 292767 - DNA, 20 bp, Artificial
  CRISPR gRNA sequence
aaaatacaagaaattagatg

SEQ ID NO: 292768 - DNA, 20 bp, Artificial
  CRISPR gRNA sequence
gatggtagtggtgggctcct

SEQ ID NO: 292769 - DNA, 20 bp, Artificial
  CRISPR gRNA sequence
ctgtagtcccagctactctg

SEQ ID NO: 292770 - DNA, 20 bp, Artificial
  CRISPR gRNA sequence
tagtcccagctactctggag

SEQ ID NO: 292771 - DNA, 20 bp, Artificial
  CRISPR gRNA sequence
ctctggaggctgaggcagga

SEQ ID NO: 292772 - DNA, 20 bp, Artificial
  CRISPR gRNA sequence
tggaggctgaggcaggagaa

SEQ ID NO: 292773 - DNA, 20 bp, Artificial
  CRISPR gRNA sequence
gaggctgaggcaggagaatc

SEQ ID NO: 292774 - DNA, 20 bp, Artificial
  CRISPR gRNA sequence
aggcaggagaatcacttgaa

SEQ ID NO: 292775 - DNA, 20 bp, Artificial
  CRISPR gRNA sequence
gaacccggaggttgcagtaa

SEQ ID NO: 292776 - DNA, 20 bp, Artificial
  CRISPR gRNA sequence
aacccggaggttgcagtaag

SEQ ID NO: 292777 - DNA, 20 bp, Artificial
  CRISPR gRNA sequence
cagtaagccaagatggtgcc

SEQ ID NO: 292778 - DNA, 20 bp, Artificial
  CRISPR gRNA sequence
cactccagcctgggcaacag

SEQ ID NO: 292779 - DNA, 20 bp, Artificial
  CRISPR gRNA sequence
cagcctgggcaacagagtga

SEQ ID NO: 292780 - DNA, 20 bp, Artificial
  CRISPR gRNA sequence
ggcaacagagtgagactatt

SEQ ID NO: 292781 - DNA, 20 bp, Artificial
  CRISPR gRNA sequence
tttagtttcctgtgtgtcag

SEQ ID NO: 292782 - DNA, 20 bp, Artificial
  CRISPR gRNA sequence
agtttcctgtgtgtcaggct

SEQ ID NO: 292783 - DNA, 20 bp, Artificial
  CRISPR gRNA sequence
gtttcctgtgtgtcaggctc

SEQ ID NO: 292784 - DNA, 20 bp, Artificial
  CRISPR gRNA sequence
cctgtgtgtcaggctctgtg

SEQ ID NO: 292785 - DNA, 20 bp, Artificial
  CRISPR gRNA sequence
ctgtgtgtcaggctctgtgc

SEQ ID NO: 292786 - DNA, 20 bp, Artificial
  CRISPR gRNA sequence
tgtgtcaggctctgtgctaa

SEQ ID NO: 292787 - DNA, 20 bp, Artificial
  CRISPR gRNA sequence
tgtgctaagtgatttctatg

SEQ ID NO: 292788 - DNA, 20 bp, Artificial
  CRISPR gRNA sequence
tgctaagtgatttctatgaa

SEQ ID NO: 292789 - DNA, 20 bp, Artificial
  CRISPR gRNA sequence
agtgatttctatgaacgatg

SEQ ID NO: 292790 - DNA, 20 bp, Artificial
  CRISPR gRNA sequence
ctatgaacgatgtcatttaa

SEQ ID NO: 292791 - DNA, 20 bp, Artificial
  CRISPR gRNA sequence
tatgaacgatgtcatttaat

SEQ ID NO: 292792 - DNA, 20 bp, Artificial
  CRISPR gRNA sequence
tgaacgatgtcatttaattc

SEQ ID NO: 292793 - DNA, 20 bp, Artificial
  CRISPR gRNA sequence
aattcttacaaccctgggta

SEQ ID NO: 292794 - DNA, 20 bp, Artificial
  CRISPR gRNA sequence
attcttacaaccctgggtat

SEQ ID NO: 292795 - DNA, 20 bp, Artificial
  CRISPR gRNA sequence
ttacaaccctgggtattagt

SEQ ID NO: 292796 - DNA, 20 bp, Artificial
  CRISPR gRNA sequence
acaaccctgggtattagtgt

SEQ ID NO: 292797 - DNA, 20 bp, Artificial
  CRISPR gRNA sequence
caaccctgggtattagtgtc

SEQ ID NO: 292798 - DNA, 20 bp, Artificial
  CRISPR gRNA sequence
ggtattagtgtccctatctt

SEQ ID NO: 292799 - DNA, 20 bp, Artificial
  CRISPR gRNA sequence
gtgtccctatcttatagatg

SEQ ID NO: 292800 - DNA, 20 bp, Artificial
  CRISPR gRNA sequence
tcttatagatgagcaaacta

SEQ ID NO: 292801 - DNA, 20 bp, Artificial
  CRISPR gRNA sequence
atagatgagcaaactaagac

SEQ ID NO: 292802 - DNA, 20 bp, Artificial
  CRISPR gRNA sequence
tagatgagcaaactaagact

SEQ ID NO: 292803 - DNA, 20 bp, Artificial
  CRISPR gRNA sequence
agactaaaggtgggtaagtt

SEQ ID NO: 292804 - DNA, 20 bp, Artificial
  CRISPR gRNA sequence
aaggtgggtaagttattgac

SEQ ID NO: 292805 - DNA, 20 bp, Artificial
  CRISPR gRNA sequence
ttgacccagggtcacaaggc

SEQ ID NO: 292806 - DNA, 20 bp, Artificial
  CRISPR gRNA sequence
acccagggtcacaaggcaga

SEQ ID NO: 292807 - DNA, 20 bp, Artificial
  CRISPR gRNA sequence
gttttaaaacctgcttttga

SEQ ID NO: 292808 - DNA, 20 bp, Artificial
  CRISPR gRNA sequence
taaaacctgcttttgatgac

SEQ ID NO: 292809 - DNA, 20 bp, Artificial
  CRISPR gRNA sequence
aaaacctgcttttgatgacc

SEQ ID NO: 292810 - DNA, 20 bp, Artificial
  CRISPR gRNA sequence
aaacctgcttttgatgacca

SEQ ID NO: 292811 - DNA, 20 bp, Artificial
  CRISPR gRNA sequence
cttttgatgaccatatgcta

SEQ ID NO: 292812 - DNA, 20 bp, Artificial
  CRISPR gRNA sequence
ttgatgaccatatgctacat

SEQ ID NO: 292813 - DNA, 20 bp, Artificial
  CRISPR gRNA sequence
tgatgaccatatgctacatg

SEQ ID NO: 292814 - DNA, 20 bp, Artificial
  CRISPR gRNA sequence
gatgaccatatgctacatga

SEQ ID NO: 292815 - DNA, 20 bp, Artificial
  CRISPR gRNA sequence
atgaccatatgctacatgac

SEQ ID NO: 292816 - DNA, 20 bp, Artificial
  CRISPR gRNA sequence
catgacatctctgtggggct

SEQ ID NO: 292817 - DNA, 20 bp, Artificial
  CRISPR gRNA sequence
tgtggggctcagaattctga

SEQ ID NO: 292818 - DNA, 20 bp, Artificial
  CRISPR gRNA sequence
tggggctcagaattctgaaa

SEQ ID NO: 292819 - DNA, 20 bp, Artificial
  CRISPR gRNA sequence
agaattctgaaaagaaagct

SEQ ID NO: 292820 - DNA, 20 bp, Artificial
  CRISPR gRNA sequence
tgaaaagaaagctaactcta

SEQ ID NO: 292821 - DNA, 20 bp, Artificial
  CRISPR gRNA sequence
aaaagaaagctaactctatg

SEQ ID NO: 292822 - DNA, 20 bp, Artificial
  CRISPR gRNA sequence
actctatgaggagattgaat

SEQ ID NO: 292823 - DNA, 20 bp, Artificial
  CRISPR gRNA sequence
tatgaggagattgaatccct

SEQ ID NO: 292824 - DNA, 20 bp, Artificial
  CRISPR gRNA sequence
tgaggagattgaatccctac

SEQ ID NO: 292825 - DNA, 20 bp, Artificial
  CRISPR gRNA sequence
aatccctacattcatgctaa

SEQ ID NO: 292826 - DNA, 20 bp, Artificial
  CRISPR gRNA sequence
cattcatgctaagaagctaa

SEQ ID NO: 292827 - DNA, 20 bp, Artificial
  CRISPR gRNA sequence
atgctaagaagctaatctct

SEQ ID NO: 292828 - DNA, 20 bp, Artificial
  CRISPR gRNA sequence
agaagctaatctctttatgt

SEQ ID NO: 292829 - DNA, 20 bp, Artificial
  CRISPR gRNA sequence
atctctttatgtgtaagaat

SEQ ID NO: 292830 - DNA, 20 bp, Artificial
  CRISPR gRNA sequence
tttatgtgtaagaataagtg

SEQ ID NO: 292831 - DNA, 20 bp, Artificial
  CRISPR gRNA sequence
tatgtgtaagaataagtgac

SEQ ID NO: 292832 - DNA, 20 bp, Artificial
  CRISPR gRNA sequence
atgtgtaagaataagtgacg

SEQ ID NO: 292833 - DNA, 20 bp, Artificial
  CRISPR gRNA sequence
tgtgtaagaataagtgacga

SEQ ID NO: 292834 - DNA, 20 bp, Artificial
  CRISPR gRNA sequence
ggtatctttctcctatgttc

SEQ ID NO: 292835 - DNA, 20 bp, Artificial
  CRISPR gRNA sequence
tctcctatgttctctgcatt

SEQ ID NO: 292836 - DNA, 20 bp, Artificial
  CRISPR gRNA sequence
ctcctatgttctctgcattt

SEQ ID NO: 292837 - DNA, 20 bp, Artificial
  CRISPR gRNA sequence
tcctatgttctctgcattta

SEQ ID NO: 292838 - DNA, 20 bp, Artificial
  CRISPR gRNA sequence
ctatgttctctgcatttatt

SEQ ID NO: 292839 - DNA, 20 bp, Artificial
  CRISPR gRNA sequence
tgttctctgcatttattttc

SEQ ID NO: 292840 - DNA, 20 bp, Artificial
  CRISPR gRNA sequence
tctgcatttattttcctgta

SEQ ID NO: 292841 - DNA, 20 bp, Artificial
  CRISPR gRNA sequence
tgcatttattttcctgtact

SEQ ID NO: 292842 - DNA, 20 bp, Artificial
  CRISPR gRNA sequence
catttattttcctgtacttt

SEQ ID NO: 292843 - DNA, 20 bp, Artificial
  CRISPR gRNA sequence
attttcctgtactttgtact

SEQ ID NO: 292844 - DNA, 20 bp, Artificial
  CRISPR gRNA sequence
ttttcctgtactttgtactt

SEQ ID NO: 292845 - DNA, 20 bp, Artificial
  CRISPR gRNA sequence
tcctgtactttgtacttcag

SEQ ID NO: 292846 - DNA, 20 bp, Artificial
  CRISPR gRNA sequence
cctgtactttgtacttcaga

SEQ ID NO: 292847 - DNA, 20 bp, Artificial
  CRISPR gRNA sequence
ctgtactttgtacttcagaa

SEQ ID NO: 292848 - DNA, 20 bp, Artificial
  CRISPR gRNA sequence
tactttgtacttcagaatct

SEQ ID NO: 292849 - DNA, 20 bp, Artificial
  CRISPR gRNA sequence
tgtacttcagaatcttatgg

SEQ ID NO: 292850 - DNA, 20 bp, Artificial
  CRISPR gRNA sequence
gtacttcagaatcttatggg

SEQ ID NO: 292851 - DNA, 20 bp, Artificial
  CRISPR gRNA sequence
tacttcagaatcttatgggg

SEQ ID NO: 292852 - DNA, 20 bp, Artificial
  CRISPR gRNA sequence
cagaatcttatggggatcaa

SEQ ID NO: 292853 - DNA, 20 bp, Artificial
  CRISPR gRNA sequence
agaatcttatggggatcaaa

SEQ ID NO: 292854 - DNA, 20 bp, Artificial
  CRISPR gRNA sequence
atggggatcaaatatataaa

SEQ ID NO: 292855 - DNA, 20 bp, Artificial
  CRISPR gRNA sequence
tggggatcaaatatataaat

SEQ ID NO: 292856 - DNA, 20 bp, Artificial
  CRISPR gRNA sequence
aagggtcttggaggaatgct

SEQ ID NO: 292857 - DNA, 20 bp, Artificial
  CRISPR gRNA sequence
ggaggaatgctaggaaggcc

SEQ ID NO: 292858 - DNA, 20 bp, Artificial
  CRISPR gRNA sequence
gaggaatgctaggaaggcct

SEQ ID NO: 292859 - DNA, 20 bp, Artificial
  CRISPR gRNA sequence
ggaaggccttcctgtccctt

SEQ ID NO: 292860 - DNA, 20 bp, Artificial
  CRISPR gRNA sequence
cctgtccctttaaggcatat

SEQ ID NO: 292861 - DNA, 20 bp, Artificial
  CRISPR gRNA sequence
ctgtccctttaaggcatatc

SEQ ID NO: 292862 - DNA, 20 bp, Artificial
  CRISPR gRNA sequence
tccctttaaggcatatcaaa

SEQ ID NO: 292863 - DNA, 20 bp, Artificial
  CRISPR gRNA sequence
taaggcatatcaaaatagta

SEQ ID NO: 292864 - DNA, 20 bp, Artificial
  CRISPR gRNA sequence
aaggcatatcaaaatagtaa

SEQ ID NO: 292865 - DNA, 20 bp, Artificial
  CRISPR gRNA sequence
aggcatatcaaaatagtaag

SEQ ID NO: 292866 - DNA, 20 bp, Artificial
  CRISPR gRNA sequence
taggctcaatgttgtagttt

SEQ ID NO: 292867 - DNA, 20 bp, Artificial
  CRISPR gRNA sequence
aatgttgtagtttggatata

SEQ ID NO: 292868 - DNA, 20 bp, Artificial
  CRISPR gRNA sequence
tagtttggatataggttttt

SEQ ID NO: 292869 - DNA, 20 bp, Artificial
  CRISPR gRNA sequence
ggatataggtttttctgagt

SEQ ID NO: 292870 - DNA, 20 bp, Artificial
  CRISPR gRNA sequence
gatataggtttttctgagta

SEQ ID NO: 292871 - DNA, 20 bp, Artificial
  CRISPR gRNA sequence
ttctgagtaaaagactactt

SEQ ID NO: 292872 - DNA, 20 bp, Artificial
  CRISPR gRNA sequence
tctgagtaaaagactacttt

SEQ ID NO: 292873 - DNA, 20 bp, Artificial
  CRISPR gRNA sequence
ctgagtaaaagactactttt

SEQ ID NO: 292874 - DNA, 20 bp, Artificial
  CRISPR gRNA sequence
tgagtaaaagactacttttt

SEQ ID NO: 292875 - DNA, 20 bp, Artificial
  CRISPR gRNA sequence
agtaaaagactacttttttt

SEQ ID NO: 292876 - DNA, 20 bp, Artificial
  CRISPR gRNA sequence
ctttttttttttttaatttc

SEQ ID NO: 292877 - DNA, 20 bp, Artificial
  CRISPR gRNA sequence
tttttttttttaatttcaac

SEQ ID NO: 292878 - DNA, 20 bp, Artificial
  CRISPR gRNA sequence
ttttttttttaatttcaacc

SEQ ID NO: 292879 - DNA, 20 bp, Artificial
  CRISPR gRNA sequence
tttttttttaatttcaacca

SEQ ID NO: 292880 - DNA, 20 bp, Artificial
  CRISPR gRNA sequence
ttttttttaatttcaaccag

SEQ ID NO: 292881 - DNA, 20 bp, Artificial
  CRISPR gRNA sequence
tttttttaatttcaaccagg

SEQ ID NO: 292882 - DNA, 20 bp, Artificial
  CRISPR gRNA sequence
ttttttaatttcaaccaggt

SEQ ID NO: 292883 - DNA, 20 bp, Artificial
  CRISPR gRNA sequence
tttttaatttcaaccaggta

SEQ ID NO: 292884 - DNA, 20 bp, Artificial
  CRISPR gRNA sequence
ttttaatttcaaccaggtat

SEQ ID NO: 292885 - DNA, 20 bp, Artificial
  CRISPR gRNA sequence
tttaatttcaaccaggtatt

SEQ ID NO: 292886 - DNA, 20 bp, Artificial
  CRISPR gRNA sequence
ttaatttcaaccaggtattt

SEQ ID NO: 292887 - DNA, 20 bp, Artificial
  CRISPR gRNA sequence
taatttcaaccaggtattta

SEQ ID NO: 292888 - DNA, 20 bp, Artificial
  CRISPR gRNA sequence
aatttcaaccaggtatttaa

SEQ ID NO: 292889 - DNA, 20 bp, Artificial
  CRISPR gRNA sequence
atttcaaccaggtatttaat

SEQ ID NO: 292890 - DNA, 20 bp, Artificial
  CRISPR gRNA sequence
caaccaggtatttaattggt

SEQ ID NO: 292891 - DNA, 20 bp, Artificial
  CRISPR gRNA sequence
aaccaggtatttaattggtc

SEQ ID NO: 292892 - DNA, 20 bp, Artificial
  CRISPR gRNA sequence
aattggtctggcaactgcac

SEQ ID NO: 292893 - DNA, 20 bp, Artificial
  CRISPR gRNA sequence
attggtctggcaactgcaca

SEQ ID NO: 292894 - DNA, 20 bp, Artificial
  CRISPR gRNA sequence
gtctggcaactgcacaatat

SEQ ID NO: 292895 - DNA, 20 bp, Artificial
  CRISPR gRNA sequence
gcaactgcacaatatacaaa

SEQ ID NO: 292896 - DNA, 20 bp, Artificial
  CRISPR gRNA sequence
cacaatatacaaatttctga

SEQ ID NO: 292897 - DNA, 20 bp, Artificial
  CRISPR gRNA sequence
ctgaaaggcatctcctgttt

SEQ ID NO: 292898 - DNA, 20 bp, Artificial
  CRISPR gRNA sequence
tgaaaggcatctcctgtttg

SEQ ID NO: 292899 - DNA, 20 bp, Artificial
  CRISPR gRNA sequence
aaaggcatctcctgtttgaa

SEQ ID NO: 292900 - DNA, 20 bp, Artificial
  CRISPR gRNA sequence
ctgtttgaaagctagcatag

SEQ ID NO: 292901 - DNA, 20 bp, Artificial
  CRISPR gRNA sequence
tttgaaagctagcatagctt

SEQ ID NO: 292902 - DNA, 20 bp, Artificial
  CRISPR gRNA sequence
gaaagctagcatagcttcat

SEQ ID NO: 292903 - DNA, 20 bp, Artificial
  CRISPR gRNA sequence
aaagctagcatagcttcatc

SEQ ID NO: 292904 - DNA, 20 bp, Artificial
  CRISPR gRNA sequence
gcatagcttcatcccagtaa

SEQ ID NO: 292905 - DNA, 20 bp, Artificial
  CRISPR gRNA sequence
catcccagtaattaattcgg

SEQ ID NO: 292906 - DNA, 20 bp, Artificial
  CRISPR gRNA sequence
atcccagtaattaattcgga

SEQ ID NO: 292907 - DNA, 20 bp, Artificial
  CRISPR gRNA sequence
attcggacaaatatatagaa

SEQ ID NO: 292908 - DNA, 20 bp, Artificial
  CRISPR gRNA sequence
ggacaaatatatagaacacc

SEQ ID NO: 292909 - DNA, 20 bp, Artificial
  CRISPR gRNA sequence
tgcatggaagactcccaaac

SEQ ID NO: 292910 - DNA, 20 bp, Artificial
  CRISPR gRNA sequence
ccaaaccaattaacaactaa

SEQ ID NO: 292911 - DNA, 20 bp, Artificial
  CRISPR gRNA sequence
acaactaaactcagtctata

SEQ ID NO: 292912 - DNA, 20 bp, Artificial
  CRISPR gRNA sequence
aactcagtctatacagcttt

SEQ ID NO: 292913 - DNA, 20 bp, Artificial
  CRISPR gRNA sequence
agtctatacagctttctatt

SEQ ID NO: 292914 - DNA, 20 bp, Artificial
  CRISPR gRNA sequence
tacagctttctatttttcag

SEQ ID NO: 292915 - DNA, 20 bp, Artificial
  CRISPR gRNA sequence
tctatttttcaggcttccat

SEQ ID NO: 292916 - DNA, 20 bp, Artificial
  CRISPR gRNA sequence
ctatttttcaggcttccata

SEQ ID NO: 292917 - DNA, 20 bp, Artificial
  CRISPR gRNA sequence
tatttttcaggcttccatat

SEQ ID NO: 292918 - DNA, 20 bp, Artificial
  CRISPR gRNA sequence
tttttcaggcttccatatgc

SEQ ID NO: 292919 - DNA, 20 bp, Artificial
  CRISPR gRNA sequence
ttcaggcttccatatgcaca

SEQ ID NO: 292920 - DNA, 20 bp, Artificial
  CRISPR gRNA sequence
tcaggcttccatatgcacat

SEQ ID NO: 292921 - DNA, 20 bp, Artificial
  CRISPR gRNA sequence
caggcttccatatgcacatt

SEQ ID NO: 292922 - DNA, 20 bp, Artificial
  CRISPR gRNA sequence
aggcttccatatgcacatta

SEQ ID NO: 292923 - DNA, 20 bp, Artificial
  CRISPR gRNA sequence
ccatatgcacattaaataaa

SEQ ID NO: 292924 - DNA, 20 bp, Artificial
  CRISPR gRNA sequence
catatgcacattaaataaat

SEQ ID NO: 292925 - DNA, 20 bp, Artificial
  CRISPR gRNA sequence
aataaataaacagcatgtct

SEQ ID NO: 292926 - DNA, 20 bp, Artificial
  CRISPR gRNA sequence
ctatcaaaataattaaaaaa

SEQ ID NO: 292927 - DNA, 20 bp, Artificial
  CRISPR gRNA sequence
tcaaaataattaaaaaattc

SEQ ID NO: 292928 - DNA, 20 bp, Artificial
  CRISPR gRNA sequence
aaaaattcaaatgaattcaa

SEQ ID NO: 292929 - DNA, 20 bp, Artificial
  CRISPR gRNA sequence
aaatgaattcaaataaattt

SEQ ID NO: 292930 - DNA, 20 bp, Artificial
  CRISPR gRNA sequence
aaataaatttattcaaatac

SEQ ID NO: 292931 - DNA, 20 bp, Artificial
  CRISPR gRNA sequence
attcaaatacatttcaatga

SEQ ID NO: 292932 - DNA, 20 bp, Artificial
  CRISPR gRNA sequence
ttcaaatacatttcaatgat

SEQ ID NO: 292933 - DNA, 20 bp, Artificial
  CRISPR gRNA sequence
aaatacatttcaatgatatt

SEQ ID NO: 292934 - DNA, 20 bp, Artificial
  CRISPR gRNA sequence
caatgatattttcaaatgaa

SEQ ID NO: 292935 - DNA, 20 bp, Artificial
  CRISPR gRNA sequence
aatgatattttcaaatgaaa

SEQ ID NO: 292936 - DNA, 20 bp, Artificial
  CRISPR gRNA sequence
tcaaatgaaaacattactga

SEQ ID NO: 292937 - DNA, 20 bp, Artificial
  CRISPR gRNA sequence
caaatgaaaacattactgat

SEQ ID NO: 292938 - DNA, 20 bp, Artificial
  CRISPR gRNA sequence
aaatgaaaacattactgatg

SEQ ID NO: 292939 - DNA, 20 bp, Artificial
  CRISPR gRNA sequence
ctgatgtggttcagagtttt

SEQ ID NO: 292940 - DNA, 20 bp, Artificial
  CRISPR gRNA sequence
atgtggttcagagtttttct

SEQ ID NO: 292941 - DNA, 20 bp, Artificial
  CRISPR gRNA sequence
agagtttttcttctcaccta

SEQ ID NO: 292942 - DNA, 20 bp, Artificial
  CRISPR gRNA sequence
ttcttctcacctaaaataaa

SEQ ID NO: 292943 - DNA, 20 bp, Artificial
  CRISPR gRNA sequence
tcttctcacctaaaataaag

SEQ ID NO: 292944 - DNA, 20 bp, Artificial
  CRISPR gRNA sequence
cttctcacctaaaataaaga

SEQ ID NO: 292945 - DNA, 20 bp, Artificial
  CRISPR gRNA sequence
ttctcacctaaaataaagag

SEQ ID NO: 292946 - DNA, 20 bp, Artificial
  CRISPR gRNA sequence
ctcacctaaaataaagagct

SEQ ID NO: 292947 - DNA, 20 bp, Artificial
  CRISPR gRNA sequence
tcacctaaaataaagagctt

SEQ ID NO: 292948 - DNA, 20 bp, Artificial
  CRISPR gRNA sequence
acctaaaataaagagctttg

SEQ ID NO: 292949 - DNA, 20 bp, Artificial
  CRISPR gRNA sequence
aaataaagagctttgcccat

SEQ ID NO: 292950 - DNA, 20 bp, Artificial
  CRISPR gRNA sequence
tgcccatggtctcatgagga

SEQ ID NO: 292951 - DNA, 20 bp, Artificial
  CRISPR gRNA sequence
gcccatggtctcatgaggac

SEQ ID NO: 292952 - DNA, 20 bp, Artificial
  CRISPR gRNA sequence
cccatggtctcatgaggaca

SEQ ID NO: 292953 - DNA, 20 bp, Artificial
  CRISPR gRNA sequence
atgaggacagaataaagagg

SEQ ID NO: 292954 - DNA, 20 bp, Artificial
  CRISPR gRNA sequence
aaaaatactggtcatgggtg

SEQ ID NO: 292955 - DNA, 20 bp, Artificial
  CRISPR gRNA sequence
gtcatgggtgtttttttggg

SEQ ID NO: 292956 - DNA, 20 bp, Artificial
  CRISPR gRNA sequence
ttttggggtatggggtgttg

SEQ ID NO: 292957 - DNA, 20 bp, Artificial
  CRISPR gRNA sequence
tttggggtatggggtgttgg

SEQ ID NO: 292958 - DNA, 20 bp, Artificial
  CRISPR gRNA sequence
ttggggtatggggtgttggt

SEQ ID NO: 292959 - DNA, 20 bp, Artificial
  CRISPR gRNA sequence
tggggtatggggtgttggtg

SEQ ID NO: 292960 - DNA, 20 bp, Artificial
  CRISPR gRNA sequence
ggggtatggggtgttggtga

SEQ ID NO: 292961 - DNA, 20 bp, Artificial
  CRISPR gRNA sequence
gggtatggggtgttggtgag

SEQ ID NO: 292962 - DNA, 20 bp, Artificial
  CRISPR gRNA sequence
gtgagactcagtagaagcaa

SEQ ID NO: 292963 - DNA, 20 bp, Artificial
  CRISPR gRNA sequence
agtagaagcaaaagctcatg

SEQ ID NO: 292964 - DNA, 20 bp, Artificial
  CRISPR gRNA sequence
atgactatagttcaatgcct

SEQ ID NO: 292965 - DNA, 20 bp, Artificial
  CRISPR gRNA sequence
tagttcaatgcctgcccccc

SEQ ID NO: 292966 - DNA, 20 bp, Artificial
  CRISPR gRNA sequence
aatgcctgccccccactcac

SEQ ID NO: 292967 - DNA, 20 bp, Artificial
  CRISPR gRNA sequence
ccccccactcacacgcacac

SEQ ID NO: 292968 - DNA, 20 bp, Artificial
  CRISPR gRNA sequence
acacgcacacaatgccccct

SEQ ID NO: 292969 - DNA, 20 bp, Artificial
  CRISPR gRNA sequence
aaaaggcaggtcacaggttt

SEQ ID NO: 292970 - DNA, 20 bp, Artificial
  CRISPR gRNA sequence
gtaaattaggcagcattttc

SEQ ID NO: 292971 - DNA, 20 bp, Artificial
  CRISPR gRNA sequence
taaattaggcagcattttcc

SEQ ID NO: 292972 - DNA, 20 bp, Artificial
  CRISPR gRNA sequence
ggcagcattttcctttctcc

SEQ ID NO: 292973 - DNA, 20 bp, Artificial
  CRISPR gRNA sequence
tcctttctccaagatctcct

SEQ ID NO: 292974 - DNA, 20 bp, Artificial
  CRISPR gRNA sequence
cctttctccaagatctcctc

SEQ ID NO: 292975 - DNA, 20 bp, Artificial
  CRISPR gRNA sequence
ctttctccaagatctcctct

SEQ ID NO: 292976 - DNA, 20 bp, Artificial
  CRISPR gRNA sequence
tctccaagatctcctctcct

SEQ ID NO: 292977 - DNA, 20 bp, Artificial
  CRISPR gRNA sequence
ctccaagatctcctctcctt

SEQ ID NO: 292978 - DNA, 20 bp, Artificial
  CRISPR gRNA sequence
tccaagatctcctctccttg

SEQ ID NO: 292979 - DNA, 20 bp, Artificial
  CRISPR gRNA sequence
caagatctcctctccttgac

SEQ ID NO: 292980 - DNA, 20 bp, Artificial
  CRISPR gRNA sequence
ctctccttgaccagatttat

SEQ ID NO: 292981 - DNA, 20 bp, Artificial
  CRISPR gRNA sequence
tccttgaccagatttatgtt

SEQ ID NO: 292982 - DNA, 20 bp, Artificial
  CRISPR gRNA sequence
cttgaccagatttatgtttt

SEQ ID NO: 292983 - DNA, 20 bp, Artificial
  CRISPR gRNA sequence
gaccagatttatgttttctc

SEQ ID NO: 292984 - DNA, 20 bp, Artificial
  CRISPR gRNA sequence
accagatttatgttttctct

SEQ ID NO: 292985 - DNA, 20 bp, Artificial
  CRISPR gRNA sequence
atgttttctctctccccatc

SEQ ID NO: 292986 - DNA, 20 bp, Artificial
  CRISPR gRNA sequence
tgttttctctctccccatct

SEQ ID NO: 292987 - DNA, 20 bp, Artificial
  CRISPR gRNA sequence
tctctctccccatctagacc

SEQ ID NO: 292988 - DNA, 20 bp, Artificial
  CRISPR gRNA sequence
ctctctccccatctagaccc

SEQ ID NO: 292989 - DNA, 20 bp, Artificial
  CRISPR gRNA sequence
tctctccccatctagaccct

SEQ ID NO: 292990 - DNA, 20 bp, Artificial
  CRISPR gRNA sequence
tctccccatctagacccttt

SEQ ID NO: 292991 - DNA, 20 bp, Artificial
  CRISPR gRNA sequence
tccccatctagaccctttcc

SEQ ID NO: 292992 - DNA, 20 bp, Artificial
  CRISPR gRNA sequence
cccatctagaccctttccaa

SEQ ID NO: 292993 - DNA, 20 bp, Artificial
  CRISPR gRNA sequence
gaccctttccaacgaaagtt

SEQ ID NO: 292994 - DNA, 20 bp, Artificial
  CRISPR gRNA sequence
tccaacgaaagttctatgtt

SEQ ID NO: 292995 - DNA, 20 bp, Artificial
  CRISPR gRNA sequence
ccaacgaaagttctatgtta

SEQ ID NO: 292996 - DNA, 20 bp, Artificial
  CRISPR gRNA sequence
caacgaaagttctatgttag

SEQ ID NO: 292997 - DNA, 20 bp, Artificial
  CRISPR gRNA sequence
tatgttaggcaaagccttct

SEQ ID NO: 292998 - DNA, 20 bp, Artificial
  CRISPR gRNA sequence
tgttaggcaaagccttctct

SEQ ID NO: 292999 - DNA, 20 bp, Artificial
  CRISPR gRNA sequence
ggcaaagccttctctattta

SEQ ID NO: 293000 - DNA, 20 bp, Artificial
  CRISPR gRNA sequence
ctctatttatgtattgagtt

SEQ ID NO: 293001 - DNA, 20 bp, Artificial
  CRISPR gRNA sequence
tctatttatgtattgagttt

SEQ ID NO: 293002 - DNA, 20 bp, Artificial
  CRISPR gRNA sequence
tatttatgtattgagtttag

SEQ ID NO: 293003 - DNA, 20 bp, Artificial
  CRISPR gRNA sequence
tttatgtattgagtttaggt

SEQ ID NO: 293004 - DNA, 20 bp, Artificial
  CRISPR gRNA sequence
atgtattgagtttaggtagc

SEQ ID NO: 293005 - DNA, 20 bp, Artificial
  CRISPR gRNA sequence
tgtattgagtttaggtagcc

SEQ ID NO: 293006 - DNA, 20 bp, Artificial
  CRISPR gRNA sequence
agtttaggtagccagaaaga

SEQ ID NO: 293007 - DNA, 20 bp, Artificial
  CRISPR gRNA sequence
aggtagccagaaagaaaagg

SEQ ID NO: 293008 - DNA, 20 bp, Artificial
  CRISPR gRNA sequence
ggtagccagaaagaaaaggg

SEQ ID NO: 293009 - DNA, 20 bp, Artificial
  CRISPR gRNA sequence
catggagcccttacctgtaa

SEQ ID NO: 293010 - DNA, 20 bp, Artificial
  CRISPR gRNA sequence
atggagcccttacctgtaac

SEQ ID NO: 293011 - DNA, 20 bp, Artificial
  CRISPR gRNA sequence
acctgtaacagacttaagag

SEQ ID NO: 293012 - DNA, 20 bp, Artificial
  CRISPR gRNA sequence
cctgtaacagacttaagagt

SEQ ID NO: 293013 - DNA, 20 bp, Artificial
  CRISPR gRNA sequence
taacagacttaagagtcaat

SEQ ID NO: 293014 - DNA, 20 bp, Artificial
  CRISPR gRNA sequence
aagagtcaatgttcaaagga

SEQ ID NO: 293015 - DNA, 20 bp, Artificial
  CRISPR gRNA sequence
agagtcaatgttcaaaggat

SEQ ID NO: 293016 - DNA, 20 bp, Artificial
  CRISPR gRNA sequence
aaaggataaggccagaaagg

SEQ ID NO: 293017 - DNA, 20 bp, Artificial
  CRISPR gRNA sequence
tcaagagcaaaggggtaggc

SEQ ID NO: 293018 - DNA, 20 bp, Artificial
  CRISPR gRNA sequence
aagagcaaaggggtaggccc

SEQ ID NO: 293019 - DNA, 20 bp, Artificial
  CRISPR gRNA sequence
atgtaaaagacgacctttta

SEQ ID NO: 293020 - DNA, 20 bp, Artificial
  CRISPR gRNA sequence
ttaaaaagcaaggaaatgct

SEQ ID NO: 293021 - DNA, 20 bp, Artificial
  CRISPR gRNA sequence
taaaaagcaaggaaatgcta

SEQ ID NO: 293022 - DNA, 20 bp, Artificial
  CRISPR gRNA sequence
aaaaagcaaggaaatgctaa

SEQ ID NO: 293023 - DNA, 20 bp, Artificial
  CRISPR gRNA sequence
aaaagcaaggaaatgctaac

SEQ ID NO: 293024 - DNA, 20 bp, Artificial
  CRISPR gRNA sequence
accacaaatttaggatagtg

SEQ ID NO: 293025 - DNA, 20 bp, Artificial
  CRISPR gRNA sequence
aggatagtgatagtgattac

SEQ ID NO: 293026 - DNA, 20 bp, Artificial
  CRISPR gRNA sequence
ggatagtgatagtgattacc

SEQ ID NO: 293027 - DNA, 20 bp, Artificial
  CRISPR gRNA sequence
ccttaggtaagggaaagaga

SEQ ID NO: 293028 - DNA, 20 bp, Artificial
  CRISPR gRNA sequence
aggtaagggaaagagaggga

SEQ ID NO: 293029 - DNA, 20 bp, Artificial
  CRISPR gRNA sequence
ggtaagggaaagagagggac

SEQ ID NO: 293030 - DNA, 20 bp, Artificial
  CRISPR gRNA sequence
acctaagttactgtcagtgt

SEQ ID NO: 293031 - DNA, 20 bp, Artificial
  CRISPR gRNA sequence
cctaagttactgtcagtgtt

SEQ ID NO: 293032 - DNA, 20 bp, Artificial
  CRISPR gRNA sequence
agttactgtcagtgtttttg

SEQ ID NO: 293033 - DNA, 20 bp, Artificial
  CRISPR gRNA sequence
ctgtcagtgtttttggtctc

SEQ ID NO: 293034 - DNA, 20 bp, Artificial
  CRISPR gRNA sequence
tcagtgtttttggtctcaag

SEQ ID NO: 293035 - DNA, 20 bp, Artificial
  CRISPR gRNA sequence
ttggtctcaagttggatggt

SEQ ID NO: 293036 - DNA, 20 bp, Artificial
  CRISPR gRNA sequence
tggtctcaagttggatggtg

SEQ ID NO: 293037 - DNA, 20 bp, Artificial
  CRISPR gRNA sequence
ggtctcaagttggatggtgg

SEQ ID NO: 293038 - DNA, 20 bp, Artificial
  CRISPR gRNA sequence
gtctcaagttggatggtggg

SEQ ID NO: 293039 - DNA, 20 bp, Artificial
  CRISPR gRNA sequence
aagttggatggtgggttttc

SEQ ID NO: 293040 - DNA, 20 bp, Artificial
  CRISPR gRNA sequence
gatggtgggttttcaggcgt

SEQ ID NO: 293041 - DNA, 20 bp, Artificial
  CRISPR gRNA sequence
tcaggcgttcgctatagttt

SEQ ID NO: 293042 - DNA, 20 bp, Artificial
  CRISPR gRNA sequence
caggcgttcgctatagttta

SEQ ID NO: 293043 - DNA, 20 bp, Artificial
  CRISPR gRNA sequence
aggcgttcgctatagtttag

SEQ ID NO: 293044 - DNA, 20 bp, Artificial
  CRISPR gRNA sequence
gctatagtttagtaaataaa

SEQ ID NO: 293045 - DNA, 20 bp, Artificial
  CRISPR gRNA sequence
tagtttagtaaataaataga

SEQ ID NO: 293046 - DNA, 20 bp, Artificial
  CRISPR gRNA sequence
agtaaataaatagataacat

SEQ ID NO: 293047 - DNA, 20 bp, Artificial
  CRISPR gRNA sequence
gtaaataaatagataacata

SEQ ID NO: 293048 - DNA, 20 bp, Artificial
  CRISPR gRNA sequence
gcgtacttcaagcatcagga

SEQ ID NO: 293049 - DNA, 20 bp, Artificial
  CRISPR gRNA sequence
cgtacttcaagcatcaggaa

SEQ ID NO: 293050 - DNA, 20 bp, Artificial
  CRISPR gRNA sequence
caagcatcaggaagaaaaga

SEQ ID NO: 293051 - DNA, 20 bp, Artificial
  CRISPR gRNA sequence
aagcatcaggaagaaaagaa

SEQ ID NO: 293052 - DNA, 20 bp, Artificial
  CRISPR gRNA sequence
tggtgtcagacagatttgaa

SEQ ID NO: 293053 - DNA, 20 bp, Artificial
  CRISPR gRNA sequence
gtgtcagacagatttgaatt

SEQ ID NO: 293054 - DNA, 20 bp, Artificial
  CRISPR gRNA sequence
gaattctgccattactggtt

SEQ ID NO: 293055 - DNA, 20 bp, Artificial
  CRISPR gRNA sequence
aattctgccattactggtta

SEQ ID NO: 293056 - DNA, 20 bp, Artificial
  CRISPR gRNA sequence
tgccattactggttagttat

SEQ ID NO: 293057 - DNA, 20 bp, Artificial
  CRISPR gRNA sequence
ccattactggttagttataa

SEQ ID NO: 293058 - DNA, 20 bp, Artificial
  CRISPR gRNA sequence
ctggttagttataatttctc

SEQ ID NO: 293059 - DNA, 20 bp, Artificial
  CRISPR gRNA sequence
gttagttataatttctctaa

SEQ ID NO: 293060 - DNA, 20 bp, Artificial
  CRISPR gRNA sequence
gttataatttctctaaacct

SEQ ID NO: 293061 - DNA, 20 bp, Artificial
  CRISPR gRNA sequence
taatttctctaaacctcagt

SEQ ID NO: 293062 - DNA, 20 bp, Artificial
  CRISPR gRNA sequence
ctctaaacctcagtttgatt

SEQ ID NO: 293063 - DNA, 20 bp, Artificial
  CRISPR gRNA sequence
tctaaacctcagtttgatta

SEQ ID NO: 293064 - DNA, 20 bp, Artificial
  CRISPR gRNA sequence
taaacctcagtttgattact

SEQ ID NO: 293065 - DNA, 20 bp, Artificial
  CRISPR gRNA sequence
aacctcagtttgattactta

SEQ ID NO: 293066 - DNA, 20 bp, Artificial
  CRISPR gRNA sequence
agtttgattacttataaaat

SEQ ID NO: 293067 - DNA, 20 bp, Artificial
  CRISPR gRNA sequence
gattacttataaaatggaaa

SEQ ID NO: 293068 - DNA, 20 bp, Artificial
  CRISPR gRNA sequence
attacttataaaatggaaat

SEQ ID NO: 293069 - DNA, 20 bp, Artificial
  CRISPR gRNA sequence
cttataaaatggaaattata

SEQ ID NO: 293070 - DNA, 20 bp, Artificial
  CRISPR gRNA sequence
ataaaatggaaattatatta

SEQ ID NO: 293071 - DNA, 20 bp, Artificial
  CRISPR gRNA sequence
taaaatggaaattatattag

SEQ ID NO: 293072 - DNA, 20 bp, Artificial
  CRISPR gRNA sequence
tattaggttaaatcatatga

SEQ ID NO: 293073 - DNA, 20 bp, Artificial
  CRISPR gRNA sequence
ggttaaatcatatgaaatta

SEQ ID NO: 293074 - DNA, 20 bp, Artificial
  CRISPR gRNA sequence
aatcatatgaaattactgat

SEQ ID NO: 293075 - DNA, 20 bp, Artificial
  CRISPR gRNA sequence
ctgatctttgacctttttag

SEQ ID NO: 293076 - DNA, 20 bp, Artificial
  CRISPR gRNA sequence
atctttgacctttttagatc

SEQ ID NO: 293077 - DNA, 20 bp, Artificial
  CRISPR gRNA sequence
tgacctttttagatctacaa

SEQ ID NO: 293078 - DNA, 20 bp, Artificial
  CRISPR gRNA sequence
gacctttttagatctacaac

SEQ ID NO: 293079 - DNA, 20 bp, Artificial
  CRISPR gRNA sequence
acctttttagatctacaacc

SEQ ID NO: 293080 - DNA, 20 bp, Artificial
  CRISPR gRNA sequence
tttagatctacaacctacct

SEQ ID NO: 293081 - DNA, 20 bp, Artificial
  CRISPR gRNA sequence
ttagatctacaacctacctc

SEQ ID NO: 293082 - DNA, 20 bp, Artificial
  CRISPR gRNA sequence
tagatctacaacctacctct

SEQ ID NO: 293083 - DNA, 20 bp, Artificial
  CRISPR gRNA sequence
agatctacaacctacctctc

SEQ ID NO: 293084 - DNA, 20 bp, Artificial
  CRISPR gRNA sequence
gatctacaacctacctctct

SEQ ID NO: 293085 - DNA, 20 bp, Artificial
  CRISPR gRNA sequence
caacctacctctctagggtt

SEQ ID NO: 293086 - DNA, 20 bp, Artificial
  CRISPR gRNA sequence
cctctctagggtttctgtga

SEQ ID NO: 293087 - DNA, 20 bp, Artificial
  CRISPR gRNA sequence
tctagggtttctgtgaggac

SEQ ID NO: 293088 - DNA, 20 bp, Artificial
  CRISPR gRNA sequence
tagggtttctgtgaggacaa

SEQ ID NO: 293089 - DNA, 20 bp, Artificial
  CRISPR gRNA sequence
gggtttctgtgaggacaaaa

SEQ ID NO: 293090 - DNA, 20 bp, Artificial
  CRISPR gRNA sequence
ctgtgaggacaaaatgaggt

SEQ ID NO: 293091 - DNA, 20 bp, Artificial
  CRISPR gRNA sequence
tgtgaggacaaaatgaggta

SEQ ID NO: 293092 - DNA, 20 bp, Artificial
  CRISPR gRNA sequence
tgaggacaaaatgaggtaag

SEQ ID NO: 293093 - DNA, 20 bp, Artificial
  CRISPR gRNA sequence
acaaacaagagttcagtaaa

SEQ ID NO: 293094 - DNA, 20 bp, Artificial
  CRISPR gRNA sequence
agtaaacgttgtctattatt

SEQ ID NO: 293095 - DNA, 20 bp, Artificial
  CRISPR gRNA sequence
tctattattcttctcttcat

SEQ ID NO: 293096 - DNA, 20 bp, Artificial
  CRISPR gRNA sequence
ttattcttctcttcatctct

SEQ ID NO: 293097 - DNA, 20 bp, Artificial
  CRISPR gRNA sequence
ttcttctcttcatctcttac

SEQ ID NO: 293098 - DNA, 20 bp, Artificial
  CRISPR gRNA sequence
ttctcttcatctcttacaat

SEQ ID NO: 293099 - DNA, 20 bp, Artificial
  CRISPR gRNA sequence
ctcttcatctcttacaattg

SEQ ID NO: 293100 - DNA, 20 bp, Artificial
  CRISPR gRNA sequence
tcttcatctcttacaattgc

SEQ ID NO: 293101 - DNA, 20 bp, Artificial
  CRISPR gRNA sequence
ttcatctcttacaattgcaa

SEQ ID NO: 293102 - DNA, 20 bp, Artificial
  CRISPR gRNA sequence
catctcttacaattgcaagt

SEQ ID NO: 293103 - DNA, 20 bp, Artificial
  CRISPR gRNA sequence
atctcttacaattgcaagta

SEQ ID NO: 293104 - DNA, 20 bp, Artificial
  CRISPR gRNA sequence
ttacaattgcaagtactctg

SEQ ID NO: 293105 - DNA, 20 bp, Artificial
  CRISPR gRNA sequence
acaattgcaagtactctggc

SEQ ID NO: 293106 - DNA, 20 bp, Artificial
  CRISPR gRNA sequence
caattgcaagtactctggca

SEQ ID NO: 293107 - DNA, 20 bp, Artificial
  CRISPR gRNA sequence
caagtactctggcaacattt

SEQ ID NO: 293108 - DNA, 20 bp, Artificial
  CRISPR gRNA sequence
tggcaacatttattcacacg

SEQ ID NO: 293109 - DNA, 20 bp, Artificial
  CRISPR gRNA sequence
gcaacatttattcacacgaa

SEQ ID NO: 293110 - DNA, 20 bp, Artificial
  CRISPR gRNA sequence
attcacacgaacctacttct

SEQ ID NO: 293111 - DNA, 20 bp, Artificial
  CRISPR gRNA sequence
ttcacacgaacctacttctc

SEQ ID NO: 293112 - DNA, 20 bp, Artificial
  CRISPR gRNA sequence
acacgaacctacttctcctt

SEQ ID NO: 293113 - DNA, 20 bp, Artificial
  CRISPR gRNA sequence
cttctcctttctgtaataag

SEQ ID NO: 293114 - DNA, 20 bp, Artificial
  CRISPR gRNA sequence
ctcctttctgtaataagtgc

SEQ ID NO: 293115 - DNA, 20 bp, Artificial
  CRISPR gRNA sequence
tcctttctgtaataagtgcc

SEQ ID NO: 293116 - DNA, 20 bp, Artificial
  CRISPR gRNA sequence
ctttctgtaataagtgccct

SEQ ID NO: 293117 - DNA, 20 bp, Artificial
  CRISPR gRNA sequence
tctgtaataagtgccctcct

SEQ ID NO: 293118 - DNA, 20 bp, Artificial
  CRISPR gRNA sequence
ctgtaataagtgccctccta

SEQ ID NO: 293119 - DNA, 20 bp, Artificial
  CRISPR gRNA sequence
tgtaataagtgccctcctat

SEQ ID NO: 293120 - DNA, 20 bp, Artificial
  CRISPR gRNA sequence
taataagtgccctcctatct

SEQ ID NO: 293121 - DNA, 20 bp, Artificial
  CRISPR gRNA sequence
ctatctccatcaaaagtggc

SEQ ID NO: 293122 - DNA, 20 bp, Artificial
  CRISPR gRNA sequence
tctccatcaaaagtggcaaa

SEQ ID NO: 293123 - DNA, 20 bp, Artificial
  CRISPR gRNA sequence
catcaaaagtggcaaagaat

SEQ ID NO: 293124 - DNA, 20 bp, Artificial
  CRISPR gRNA sequence
atataaccaattcaaatcaa

SEQ ID NO: 293125 - DNA, 20 bp, Artificial
  CRISPR gRNA sequence
aaatcaaagttagtctttgg

SEQ ID NO: 293126 - DNA, 20 bp, Artificial
  CRISPR gRNA sequence
gtctttggattatacataac

SEQ ID NO: 293127 - DNA, 20 bp, Artificial
  CRISPR gRNA sequence
tggattatacataactatta

SEQ ID NO: 293128 - DNA, 20 bp, Artificial
  CRISPR gRNA sequence
ggattatacataactattaa

SEQ ID NO: 293129 - DNA, 20 bp, Artificial
  CRISPR gRNA sequence
gattatacataactattaat

SEQ ID NO: 293130 - DNA, 20 bp, Artificial
  CRISPR gRNA sequence
tacataactattaatgagta

SEQ ID NO: 293131 - DNA, 20 bp, Artificial
  CRISPR gRNA sequence
ttaatgagtaatgggaagtt

SEQ ID NO: 293132 - DNA, 20 bp, Artificial
  CRISPR gRNA sequence
atgagtaatgggaagttgca

SEQ ID NO: 293133 - DNA, 20 bp, Artificial
  CRISPR gRNA sequence
caaattatatctcattttat

SEQ ID NO: 293134 - DNA, 20 bp, Artificial
  CRISPR gRNA sequence
tatctcattttatcattctt

SEQ ID NO: 293135 - DNA, 20 bp, Artificial
  CRISPR gRNA sequence
attttatcattcttgttttg

SEQ ID NO: 293136 - DNA, 20 bp, Artificial
  CRISPR gRNA sequence
tatcattcttgttttgtttt

SEQ ID NO: 293137 - DNA, 20 bp, Artificial
  CRISPR gRNA sequence
atcattcttgttttgttttg

SEQ ID NO: 293138 - DNA, 20 bp, Artificial
  CRISPR gRNA sequence
tcattcttgttttgttttgt

SEQ ID NO: 293139 - DNA, 20 bp, Artificial
  CRISPR gRNA sequence
ttgttttgttttgttgtttt

SEQ ID NO: 293140 - DNA, 20 bp, Artificial
  CRISPR gRNA sequence
gttttgttttgttgtttttg

SEQ ID NO: 293141 - DNA, 20 bp, Artificial
  CRISPR gRNA sequence
ttttgttttgttgtttttga

SEQ ID NO: 293142 - DNA, 20 bp, Artificial
  CRISPR gRNA sequence
tgttttgttgtttttgagat

SEQ ID NO: 293143 - DNA, 20 bp, Artificial
  CRISPR gRNA sequence
gttttgttgtttttgagatg

SEQ ID NO: 293144 - DNA, 20 bp, Artificial
  CRISPR gRNA sequence
ttttgttgtttttgagatga

SEQ ID NO: 293145 - DNA, 20 bp, Artificial
  CRISPR gRNA sequence
tgttgtttttgagatgaagc

SEQ ID NO: 293146 - DNA, 20 bp, Artificial
  CRISPR gRNA sequence
gttgtttttgagatgaagcc

SEQ ID NO: 293147 - DNA, 20 bp, Artificial
  CRISPR gRNA sequence
ttgtttttgagatgaagcct

SEQ ID NO: 293148 - DNA, 20 bp, Artificial
  CRISPR gRNA sequence
tttttgagatgaagccttgc

SEQ ID NO: 293149 - DNA, 20 bp, Artificial
  CRISPR gRNA sequence
ttgagatgaagccttgctct

SEQ ID NO: 293150 - DNA, 20 bp, Artificial
  CRISPR gRNA sequence
tgagatgaagccttgctctt

SEQ ID NO: 293151 - DNA, 20 bp, Artificial
  CRISPR gRNA sequence
gagatgaagccttgctcttt

SEQ ID NO: 293152 - DNA, 20 bp, Artificial
  CRISPR gRNA sequence
agatgaagccttgctctttt

SEQ ID NO: 293153 - DNA, 20 bp, Artificial
  CRISPR gRNA sequence
gctcttttgcccaggctgga

SEQ ID NO: 293154 - DNA, 20 bp, Artificial
  CRISPR gRNA sequence
ctcttttgcccaggctggag

SEQ ID NO: 293155 - DNA, 20 bp, Artificial
  CRISPR gRNA sequence
ttttgcccaggctggagtga

SEQ ID NO: 293156 - DNA, 20 bp, Artificial
  CRISPR gRNA sequence
ttgcccaggctggagtgaag

SEQ ID NO: 293157 - DNA, 20 bp, Artificial
  CRISPR gRNA sequence
tgcccaggctggagtgaagt

SEQ ID NO: 293158 - DNA, 20 bp, Artificial
  CRISPR gRNA sequence
gcccaggctggagtgaagtc

SEQ ID NO: 293159 - DNA, 20 bp, Artificial
  CRISPR gRNA sequence
cccaggctggagtgaagtcg

SEQ ID NO: 293160 - DNA, 20 bp, Artificial
  CRISPR gRNA sequence
gagtgaagtcgtacgatctc

SEQ ID NO: 293161 - DNA, 20 bp, Artificial
  CRISPR gRNA sequence
ggctaactgcaatctccacc

SEQ ID NO: 293162 - DNA, 20 bp, Artificial
  CRISPR gRNA sequence
actgcaatctccaccctctg

SEQ ID NO: 293163 - DNA, 20 bp, Artificial
  CRISPR gRNA sequence
caatctccaccctctgggtt

SEQ ID NO: 293164 - DNA, 20 bp, Artificial
  CRISPR gRNA sequence
caccctctgggttcaagcca

SEQ ID NO: 293165 - DNA, 20 bp, Artificial
  CRISPR gRNA sequence
tgggttcaagccattctctt

SEQ ID NO: 293166 - DNA, 20 bp, Artificial
  CRISPR gRNA sequence
ggttcaagccattctcttgc

SEQ ID NO: 293167 - DNA, 20 bp, Artificial
  CRISPR gRNA sequence
aagccattctcttgccttag

SEQ ID NO: 293168 - DNA, 20 bp, Artificial
  CRISPR gRNA sequence
tcttgccttagcctcccgag

SEQ ID NO: 293169 - DNA, 20 bp, Artificial
  CRISPR gRNA sequence
ttgccttagcctcccgagta

SEQ ID NO: 293170 - DNA, 20 bp, Artificial
  CRISPR gRNA sequence
gccttagcctcccgagtagc

SEQ ID NO: 293171 - DNA, 20 bp, Artificial
  CRISPR gRNA sequence
ccttagcctcccgagtagct

SEQ ID NO: 293172 - DNA, 20 bp, Artificial
  CRISPR gRNA sequence
agcctcccgagtagctggga

SEQ ID NO: 293173 - DNA, 20 bp, Artificial
  CRISPR gRNA sequence
gcctcccgagtagctgggat

SEQ ID NO: 293174 - DNA, 20 bp, Artificial
  CRISPR gRNA sequence
ccgagtagctgggattatag

SEQ ID NO: 293175 - DNA, 20 bp, Artificial
  CRISPR gRNA sequence
ggattataggcgcctgccac

SEQ ID NO: 293176 - DNA, 20 bp, Artificial
  CRISPR gRNA sequence
taggcgcctgccaccacgcc

SEQ ID NO: 293177 - DNA, 20 bp, Artificial
  CRISPR gRNA sequence
ccaccacgcctggttaattt

SEQ ID NO: 293178 - DNA, 20 bp, Artificial
  CRISPR gRNA sequence
gttaatttatgtatttttgg

SEQ ID NO: 293179 - DNA, 20 bp, Artificial
  CRISPR gRNA sequence
atttatgtatttttggtaga

SEQ ID NO: 293180 - DNA, 20 bp, Artificial
  CRISPR gRNA sequence
atgtatttttggtagagatg

SEQ ID NO: 293181 - DNA, 20 bp, Artificial
  CRISPR gRNA sequence
tgtatttttggtagagatgg

SEQ ID NO: 293182 - DNA, 20 bp, Artificial
  CRISPR gRNA sequence
ttggtagagatggggttttg

SEQ ID NO: 293183 - DNA, 20 bp, Artificial
  CRISPR gRNA sequence
tggtagagatggggttttgc

SEQ ID NO: 293184 - DNA, 20 bp, Artificial
  CRISPR gRNA sequence
ggtagagatggggttttgcc

SEQ ID NO: 293185 - DNA, 20 bp, Artificial
  CRISPR gRNA sequence
gtagagatggggttttgcca

SEQ ID NO: 293186 - DNA, 20 bp, Artificial
  CRISPR gRNA sequence
tgccatgttagccaggctgg

SEQ ID NO: 293187 - DNA, 20 bp, Artificial
  CRISPR gRNA sequence
gccatgttagccaggctggt

SEQ ID NO: 293188 - DNA, 20 bp, Artificial
  CRISPR gRNA sequence
ccatgttagccaggctggtc

SEQ ID NO: 293189 - DNA, 20 bp, Artificial
  CRISPR gRNA sequence
gccaggctggtctcaaactc

SEQ ID NO: 293190 - DNA, 20 bp, Artificial
  CRISPR gRNA sequence
gtctcaaactcctgacctca

SEQ ID NO: 293191 - DNA, 20 bp, Artificial
  CRISPR gRNA sequence
aaactcctgacctcaggtgt

SEQ ID NO: 293192 - DNA, 20 bp, Artificial
  CRISPR gRNA sequence
ctgacctcaggtgttccacc

SEQ ID NO: 293193 - DNA, 20 bp, Artificial
  CRISPR gRNA sequence
acctcaggtgttccacctgc

SEQ ID NO: 293194 - DNA, 20 bp, Artificial
  CRISPR gRNA sequence
aggtgttccacctgcctcgg

SEQ ID NO: 293195 - DNA, 20 bp, Artificial
  CRISPR gRNA sequence
cacctgcctcggcctcccaa

SEQ ID NO: 293196 - DNA, 20 bp, Artificial
  CRISPR gRNA sequence
cctcggcctcccaaagtgct

SEQ ID NO: 293197 - DNA, 20 bp, Artificial
  CRISPR gRNA sequence
ggcctcccaaagtgctggga

SEQ ID NO: 293198 - DNA, 20 bp, Artificial
  CRISPR gRNA sequence
ccaaagtgctgggattacag

SEQ ID NO: 293199 - DNA, 20 bp, Artificial
  CRISPR gRNA sequence
ggattacaggagtgagccac

SEQ ID NO: 293200 - DNA, 20 bp, Artificial
  CRISPR gRNA sequence
caggagtgagccactgcacc

SEQ ID NO: 293201 - DNA, 20 bp, Artificial
  CRISPR gRNA sequence
cacctggcctttatcaattc

SEQ ID NO: 293202 - DNA, 20 bp, Artificial
  CRISPR gRNA sequence
gcctttatcaattcttatta

SEQ ID NO: 293203 - DNA, 20 bp, Artificial
  CRISPR gRNA sequence
tatcaattcttattaaagct

SEQ ID NO: 293204 - DNA, 20 bp, Artificial
  CRISPR gRNA sequence
atcaattcttattaaagcta

SEQ ID NO: 293205 - DNA, 20 bp, Artificial
  CRISPR gRNA sequence
tcaattcttattaaagctag

SEQ ID NO: 293206 - DNA, 20 bp, Artificial
  CRISPR gRNA sequence
ttattaaagctagaaaatta

SEQ ID NO: 293207 - DNA, 20 bp, Artificial
  CRISPR gRNA sequence
attaaagctagaaaattatt

SEQ ID NO: 293208 - DNA, 20 bp, Artificial
  CRISPR gRNA sequence
ttaaagctagaaaattattt

SEQ ID NO: 293209 - DNA, 20 bp, Artificial
  CRISPR gRNA sequence
aagctagaaaattatttaaa

SEQ ID NO: 293210 - DNA, 20 bp, Artificial
  CRISPR gRNA sequence
gaaaattatttaaaaataaa

SEQ ID NO: 293211 - DNA, 20 bp, Artificial
  CRISPR gRNA sequence
tttaaaaataaacctctaca

SEQ ID NO: 293212 - DNA, 20 bp, Artificial
  CRISPR gRNA sequence
aaaaataaacctctacacac

SEQ ID NO: 293213 - DNA, 20 bp, Artificial
  CRISPR gRNA sequence
aaaataaacctctacacaca

SEQ ID NO: 293214 - DNA, 20 bp, Artificial
  CRISPR gRNA sequence
tacacacataggtttgtaac

SEQ ID NO: 293215 - DNA, 20 bp, Artificial
  CRISPR gRNA sequence
cacacataggtttgtaacta

SEQ ID NO: 293216 - DNA, 20 bp, Artificial
  CRISPR gRNA sequence
gtaactatacgtaattatat

SEQ ID NO: 293217 - DNA, 20 bp, Artificial
  CRISPR gRNA sequence
taactatacgtaattatata

SEQ ID NO: 293218 - DNA, 20 bp, Artificial
  CRISPR gRNA sequence
tacgtaattatatattcttg

SEQ ID NO: 293219 - DNA, 20 bp, Artificial
  CRISPR gRNA sequence
tatattcttgttctttcttt

SEQ ID NO: 293220 - DNA, 20 bp, Artificial
  CRISPR gRNA sequence
ttgttctttctttagctgac

SEQ ID NO: 293221 - DNA, 20 bp, Artificial
  CRISPR gRNA sequence
gttctttctttagctgactt

SEQ ID NO: 293222 - DNA, 20 bp, Artificial
  CRISPR gRNA sequence
ttctttctttagctgacttc

SEQ ID NO: 293223 - DNA, 20 bp, Artificial
  CRISPR gRNA sequence
tttctttagctgacttccct

SEQ ID NO: 293224 - DNA, 20 bp, Artificial
  CRISPR gRNA sequence
tctttagctgacttccctac

SEQ ID NO: 293225 - DNA, 20 bp, Artificial
  CRISPR gRNA sequence
ctttagctgacttccctaca

SEQ ID NO: 293226 - DNA, 20 bp, Artificial
  CRISPR gRNA sequence
tttagctgacttccctacac

SEQ ID NO: 293227 - DNA, 20 bp, Artificial
  CRISPR gRNA sequence
tagctgacttccctacacct

SEQ ID NO: 293228 - DNA, 20 bp, Artificial
  CRISPR gRNA sequence
agctgacttccctacaccta

SEQ ID NO: 293229 - DNA, 20 bp, Artificial
  CRISPR gRNA sequence
gctgacttccctacacctag

SEQ ID NO: 293230 - DNA, 20 bp, Artificial
  CRISPR gRNA sequence
acttccctacacctagtata

SEQ ID NO: 293231 - DNA, 20 bp, Artificial
  CRISPR gRNA sequence
ccctacacctagtatatctg

SEQ ID NO: 293232 - DNA, 20 bp, Artificial
  CRISPR gRNA sequence
cctacacctagtatatctga

SEQ ID NO: 293233 - DNA, 20 bp, Artificial
  CRISPR gRNA sequence
cacctagtatatctgacttt

SEQ ID NO: 293234 - DNA, 20 bp, Artificial
  CRISPR gRNA sequence
gtatatctgactttgaaatt

SEQ ID NO: 293235 - DNA, 20 bp, Artificial
  CRISPR gRNA sequence
actttgaaattccaacttct

SEQ ID NO: 293236 - DNA, 20 bp, Artificial
  CRISPR gRNA sequence
tgaaattccaacttctaata

SEQ ID NO: 293237 - DNA, 20 bp, Artificial
  CRISPR gRNA sequence
gaaattccaacttctaatat

SEQ ID NO: 293238 - DNA, 20 bp, Artificial
  CRISPR gRNA sequence
aaattccaacttctaatatt

SEQ ID NO: 293239 - DNA, 20 bp, Artificial
  CRISPR gRNA sequence
caacttctaatattagaagg

SEQ ID NO: 293240 - DNA, 20 bp, Artificial
  CRISPR gRNA sequence
ctaatattagaaggataatt

SEQ ID NO: 293241 - DNA, 20 bp, Artificial
  CRISPR gRNA sequence
taatattagaaggataattt

SEQ ID NO: 293242 - DNA, 20 bp, Artificial
  CRISPR gRNA sequence
atattagaaggataatttgc

SEQ ID NO: 293243 - DNA, 20 bp, Artificial
  CRISPR gRNA sequence
gaaggataatttgctcaacc

SEQ ID NO: 293244 - DNA, 20 bp, Artificial
  CRISPR gRNA sequence
gctcaacctctggaggtttt

SEQ ID NO: 293245 - DNA, 20 bp, Artificial
  CRISPR gRNA sequence
ctcaacctctggaggttttc

SEQ ID NO: 293246 - DNA, 20 bp, Artificial
  CRISPR gRNA sequence
aacctctggaggttttccag

SEQ ID NO: 293247 - DNA, 20 bp, Artificial
  CRISPR gRNA sequence
tggaggttttccagagcctc

SEQ ID NO: 293248 - DNA, 20 bp, Artificial
  CRISPR gRNA sequence
gaggttttccagagcctcac

SEQ ID NO: 293249 - DNA, 20 bp, Artificial
  CRISPR gRNA sequence
tccagagcctcacctctcct

SEQ ID NO: 293250 - DNA, 20 bp, Artificial
  CRISPR gRNA sequence
ccagagcctcacctctcctg

SEQ ID NO: 293251 - DNA, 20 bp, Artificial
  CRISPR gRNA sequence
cagagcctcacctctcctgg

SEQ ID NO: 293252 - DNA, 20 bp, Artificial
  CRISPR gRNA sequence
acctctcctggttggaaaat

SEQ ID NO: 293253 - DNA, 20 bp, Artificial
  CRISPR gRNA sequence
tcctggttggaaaatggaga

SEQ ID NO: 293254 - DNA, 20 bp, Artificial
  CRISPR gRNA sequence
ctggttggaaaatggagaag

SEQ ID NO: 293255 - DNA, 20 bp, Artificial
  CRISPR gRNA sequence
gttggaaaatggagaagaat

SEQ ID NO: 293256 - DNA, 20 bp, Artificial
  CRISPR gRNA sequence
gaaaatggagaagaattaaa

SEQ ID NO: 293257 - DNA, 20 bp, Artificial
  CRISPR gRNA sequence
aatgccatcaacacaacagt

SEQ ID NO: 293258 - DNA, 20 bp, Artificial
  CRISPR gRNA sequence
cccaagatcctgaaactgag

SEQ ID NO: 293259 - DNA, 20 bp, Artificial
  CRISPR gRNA sequence
ccaagatcctgaaactgagc

SEQ ID NO: 293260 - DNA, 20 bp, Artificial
  CRISPR gRNA sequence
aaactgagctctatgctgtt

SEQ ID NO: 293261 - DNA, 20 bp, Artificial
  CRISPR gRNA sequence
agctctatgctgttagcagc

SEQ ID NO: 293262 - DNA, 20 bp, Artificial
  CRISPR gRNA sequence
tatgctgttagcagcaaact

SEQ ID NO: 293263 - DNA, 20 bp, Artificial
  CRISPR gRNA sequence
tgctgttagcagcaaactgg

SEQ ID NO: 293264 - DNA, 20 bp, Artificial
  CRISPR gRNA sequence
ttagcagcaaactggatttc

SEQ ID NO: 293265 - DNA, 20 bp, Artificial
  CRISPR gRNA sequence
gcagcaaactggatttcaat

SEQ ID NO: 293266 - DNA, 20 bp, Artificial
  CRISPR gRNA sequence
gatttcaatatgacaaccaa

SEQ ID NO: 293267 - DNA, 20 bp, Artificial
  CRISPR gRNA sequence
caatatgacaaccaaccaca

SEQ ID NO: 293268 - DNA, 20 bp, Artificial
  CRISPR gRNA sequence
aatatgacaaccaaccacag

SEQ ID NO: 293269 - DNA, 20 bp, Artificial
  CRISPR gRNA sequence
catgtgtctcatcaagtatg

SEQ ID NO: 293270 - DNA, 20 bp, Artificial
  CRISPR gRNA sequence
atgtgtctcatcaagtatgg

SEQ ID NO: 293271 - DNA, 20 bp, Artificial
  CRISPR gRNA sequence
atcaagtatggacatttaag

SEQ ID NO: 293272 - DNA, 20 bp, Artificial
  CRISPR gRNA sequence
aagagtgaatcagaccttca

SEQ ID NO: 293273 - DNA, 20 bp, Artificial
  CRISPR gRNA sequence
agagtgaatcagaccttcaa

SEQ ID NO: 293274 - DNA, 20 bp, Artificial
  CRISPR gRNA sequence
caactggaatacaagtaagt

SEQ ID NO: 293275 - DNA, 20 bp, Artificial
  CRISPR gRNA sequence
aactggaatacaagtaagtg

SEQ ID NO: 293276 - DNA, 20 bp, Artificial
  CRISPR gRNA sequence
gaatacaagtaagtgacatt

SEQ ID NO: 293277 - DNA, 20 bp, Artificial
  CRISPR gRNA sequence
ttctggggagtttctactat

SEQ ID NO: 293278 - DNA, 20 bp, Artificial
  CRISPR gRNA sequence
tggggagtttctactatatc

SEQ ID NO: 293279 - DNA, 20 bp, Artificial
  CRISPR gRNA sequence
gggagtttctactatatcga

SEQ ID NO: 293280 - DNA, 20 bp, Artificial
  CRISPR gRNA sequence
ctactatatcgaatctaaaa

SEQ ID NO: 293281 - DNA, 20 bp, Artificial
  CRISPR gRNA sequence
tactatatcgaatctaaaaa

SEQ ID NO: 293282 - DNA, 20 bp, Artificial
  CRISPR gRNA sequence
ctatatcgaatctaaaaaga

SEQ ID NO: 293283 - DNA, 20 bp, Artificial
  CRISPR gRNA sequence
tatcgaatctaaaaagacaa

SEQ ID NO: 293284 - DNA, 20 bp, Artificial
  CRISPR gRNA sequence
aaaagacaatatagtcgtgt

SEQ ID NO: 293285 - DNA, 20 bp, Artificial
  CRISPR gRNA sequence
aatgatgtggatacattttg

SEQ ID NO: 293286 - DNA, 20 bp, Artificial
  CRISPR gRNA sequence
atgatgtggatacattttga

SEQ ID NO: 293287 - DNA, 20 bp, Artificial
  CRISPR gRNA sequence
tgagaaatgcatcattaggc

SEQ ID NO: 293288 - DNA, 20 bp, Artificial
  CRISPR gRNA sequence
gagaaatgcatcattaggca

SEQ ID NO: 293289 - DNA, 20 bp, Artificial
  CRISPR gRNA sequence
agaaatgcatcattaggcaa

SEQ ID NO: 293290 - DNA, 20 bp, Artificial
  CRISPR gRNA sequence
ggcaattctgtcattgtctg

SEQ ID NO: 293291 - DNA, 20 bp, Artificial
  CRISPR gRNA sequence
tgtcattgtctgaacatcag

SEQ ID NO: 293292 - DNA, 20 bp, Artificial
  CRISPR gRNA sequence
tcattgtctgaacatcagag

SEQ ID NO: 293293 - DNA, 20 bp, Artificial
  CRISPR gRNA sequence
tctgaacatcagagtgtatt

SEQ ID NO: 293294 - DNA, 20 bp, Artificial
  CRISPR gRNA sequence
aacatcagagtgtatttaca

SEQ ID NO: 293295 - DNA, 20 bp, Artificial
  CRISPR gRNA sequence
acataaacctagatggtaca

SEQ ID NO: 293296 - DNA, 20 bp, Artificial
  CRISPR gRNA sequence
cataaacctagatggtacag

SEQ ID NO: 293297 - DNA, 20 bp, Artificial
  CRISPR gRNA sequence
gatggtacagcctactgcac

SEQ ID NO: 293298 - DNA, 20 bp, Artificial
  CRISPR gRNA sequence
ctgcacacctaggctacatg

SEQ ID NO: 293299 - DNA, 20 bp, Artificial
  CRISPR gRNA sequence
cacacctaggctacatggta

SEQ ID NO: 293300 - DNA, 20 bp, Artificial
  CRISPR gRNA sequence
ggctacatggtacagcccag

SEQ ID NO: 293301 - DNA, 20 bp, Artificial
  CRISPR gRNA sequence
catggtacagcccagtgctc

SEQ ID NO: 293302 - DNA, 20 bp, Artificial
  CRISPR gRNA sequence
tgaggctacacacctgtaca

SEQ ID NO: 293303 - DNA, 20 bp, Artificial
  CRISPR gRNA sequence
aggctacacacctgtacagc

SEQ ID NO: 293304 - DNA, 20 bp, Artificial
  CRISPR gRNA sequence
cacacctgtacagcatgtta

SEQ ID NO: 293305 - DNA, 20 bp, Artificial
  CRISPR gRNA sequence
tacagcatgttaccatactg

SEQ ID NO: 293306 - DNA, 20 bp, Artificial
  CRISPR gRNA sequence
ccatactgaacacataggca

SEQ ID NO: 293307 - DNA, 20 bp, Artificial
  CRISPR gRNA sequence
aacacataggcagttgtaac

SEQ ID NO: 293308 - DNA, 20 bp, Artificial
  CRISPR gRNA sequence
taacacaataagtatttgtg

SEQ ID NO: 293309 - DNA, 20 bp, Artificial
  CRISPR gRNA sequence
gtgtatctaagcgtatgtaa

SEQ ID NO: 293310 - DNA, 20 bp, Artificial
  CRISPR gRNA sequence
tgtatctaagcgtatgtaaa

SEQ ID NO: 293311 - DNA, 20 bp, Artificial
  CRISPR gRNA sequence
agcgtatgtaaacataggaa

SEQ ID NO: 293312 - DNA, 20 bp, Artificial
  CRISPR gRNA sequence
taattttatgggactaccat

SEQ ID NO: 293313 - DNA, 20 bp, Artificial
  CRISPR gRNA sequence
tatgggactaccatcatata

SEQ ID NO: 293314 - DNA, 20 bp, Artificial
  CRISPR gRNA sequence
atgggactaccatcatatat

SEQ ID NO: 293315 - DNA, 20 bp, Artificial
  CRISPR gRNA sequence
tgggactaccatcatatatg

SEQ ID NO: 293316 - DNA, 20 bp, Artificial
  CRISPR gRNA sequence
ccatcatatatgcagaatgc

SEQ ID NO: 293317 - DNA, 20 bp, Artificial
  CRISPR gRNA sequence
aaaatgttacatggcacatt

SEQ ID NO: 293318 - DNA, 20 bp, Artificial
  CRISPR gRNA sequence
catggcacattactgtaact

SEQ ID NO: 293319 - DNA, 20 bp, Artificial
  CRISPR gRNA sequence
ctgtaactcagccagataca

SEQ ID NO: 293320 - DNA, 20 bp, Artificial
  CRISPR gRNA sequence
taactcagccagatacattt

SEQ ID NO: 293321 - DNA, 20 bp, Artificial
  CRISPR gRNA sequence
agccagatacattttagaat

SEQ ID NO: 293322 - DNA, 20 bp, Artificial
  CRISPR gRNA sequence
tagaattgtcgtatttattt

SEQ ID NO: 293323 - DNA, 20 bp, Artificial
  CRISPR gRNA sequence
agaattgtcgtatttatttt

SEQ ID NO: 293324 - DNA, 20 bp, Artificial
  CRISPR gRNA sequence
gaattgtcgtatttattttg

SEQ ID NO: 293325 - DNA, 20 bp, Artificial
  CRISPR gRNA sequence
tcgtatttattttgatagtg

SEQ ID NO: 293326 - DNA, 20 bp, Artificial
  CRISPR gRNA sequence
attttgatagtgttttatag

SEQ ID NO: 293327 - DNA, 20 bp, Artificial
  CRISPR gRNA sequence
ttttgatagtgttttatagt

SEQ ID NO: 293328 - DNA, 20 bp, Artificial
  CRISPR gRNA sequence
tgatagtgttttatagtgtt

SEQ ID NO: 293329 - DNA, 20 bp, Artificial
  CRISPR gRNA sequence
gatagtgttttatagtgttt

SEQ ID NO: 293330 - DNA, 20 bp, Artificial
  CRISPR gRNA sequence
atagtgttttatagtgtttt

SEQ ID NO: 293331 - DNA, 20 bp, Artificial
  CRISPR gRNA sequence
tatagtgtttttagatatac

SEQ ID NO: 293332 - DNA, 20 bp, Artificial
  CRISPR gRNA sequence
atagtgtttttagatataca

SEQ ID NO: 293333 - DNA, 20 bp, Artificial
  CRISPR gRNA sequence
tagtgtttttagatatacaa

SEQ ID NO: 293334 - DNA, 20 bp, Artificial
  CRISPR gRNA sequence
ttagatatacaaatgacatg

SEQ ID NO: 293335 - DNA, 20 bp, Artificial
  CRISPR gRNA sequence
tagatatacaaatgacatgt

SEQ ID NO: 293336 - DNA, 20 bp, Artificial
  CRISPR gRNA sequence
agatatacaaatgacatgtg

SEQ ID NO: 293337 - DNA, 20 bp, Artificial
  CRISPR gRNA sequence
gatatacaaatgacatgtgc

SEQ ID NO: 293338 - DNA, 20 bp, Artificial
  CRISPR gRNA sequence
ttatgacttattaaagtcac

SEQ ID NO: 293339 - DNA, 20 bp, Artificial
  CRISPR gRNA sequence
tgacttattaaagtcactgt

SEQ ID NO: 293340 - DNA, 20 bp, Artificial
  CRISPR gRNA sequence
attaaagtcactgtgagact

SEQ ID NO: 293341 - DNA, 20 bp, Artificial
  CRISPR gRNA sequence
ttaaagtcactgtgagactg

SEQ ID NO: 293342 - DNA, 20 bp, Artificial
  CRISPR gRNA sequence
aagtcactgtgagactgggc

SEQ ID NO: 293343 - DNA, 20 bp, Artificial
  CRISPR gRNA sequence
tgagactgggcacagtggct

SEQ ID NO: 293344 - DNA, 20 bp, Artificial
  CRISPR gRNA sequence
ggcacagtggctcatgcctg

SEQ ID NO: 293345 - DNA, 20 bp, Artificial
  CRISPR gRNA sequence
atgcctgtaatcccagcact

SEQ ID NO: 293346 - DNA, 20 bp, Artificial
  CRISPR gRNA sequence
taatcccagcactttgggag

SEQ ID NO: 293347 - DNA, 20 bp, Artificial
  CRISPR gRNA sequence
tgggaggctgaagtgggagg

SEQ ID NO: 293348 - DNA, 20 bp, Artificial
  CRISPR gRNA sequence
gggaggctgaagtgggagga

SEQ ID NO: 293349 - DNA, 20 bp, Artificial
  CRISPR gRNA sequence
ggaggctgaagtgggaggat

SEQ ID NO: 293350 - DNA, 20 bp, Artificial
  CRISPR gRNA sequence
aagtgggaggatcacttgag

SEQ ID NO: 293351 - DNA, 20 bp, Artificial
  CRISPR gRNA sequence
gagcccaggagttcaagacc

SEQ ID NO: 293352 - DNA, 20 bp, Artificial
  CRISPR gRNA sequence
agcccaggagttcaagacca

SEQ ID NO: 293353 - DNA, 20 bp, Artificial
  CRISPR gRNA sequence
aagaccagctgggaagcatg

SEQ ID NO: 293354 - DNA, 20 bp, Artificial
  CRISPR gRNA sequence
ggaagcatgagactctgact

SEQ ID NO: 293355 - DNA, 20 bp, Artificial
  CRISPR gRNA sequence
tgactctacagaacatttaa

SEQ ID NO: 293356 - DNA, 20 bp, Artificial
  CRISPR gRNA sequence
actctacagaacatttaaaa

SEQ ID NO: 293357 - DNA, 20 bp, Artificial
  CRISPR gRNA sequence
tacagaacatttaaaaaatt

SEQ ID NO: 293358 - DNA, 20 bp, Artificial
  CRISPR gRNA sequence
cagaacatttaaaaaattag

SEQ ID NO: 293359 - DNA, 20 bp, Artificial
  CRISPR gRNA sequence
aaaaaattagccaggcttgg

SEQ ID NO: 293360 - DNA, 20 bp, Artificial
  CRISPR gRNA sequence
aaaaattagccaggcttggt

SEQ ID NO: 293361 - DNA, 20 bp, Artificial
  CRISPR gRNA sequence
gccaggcttggtgacacaca

SEQ ID NO: 293362 - DNA, 20 bp, Artificial
  CRISPR gRNA sequence
ggtgacacacatgtgtagtc

SEQ ID NO: 293363 - DNA, 20 bp, Artificial
  CRISPR gRNA sequence
gtgacacacatgtgtagtcc

SEQ ID NO: 293364 - DNA, 20 bp, Artificial
  CRISPR gRNA sequence
ggtacttgggagggtaaggt

SEQ ID NO: 293365 - DNA, 20 bp, Artificial
  CRISPR gRNA sequence
gggagggtaaggtgggtggc

SEQ ID NO: 293366 - DNA, 20 bp, Artificial
  CRISPR gRNA sequence
ggagggtaaggtgggtggct

SEQ ID NO: 293367 - DNA, 20 bp, Artificial
  CRISPR gRNA sequence
acttgagcccaggtgttcaa

SEQ ID NO: 293368 - DNA, 20 bp, Artificial
  CRISPR gRNA sequence
cttgagcccaggtgttcaaa

SEQ ID NO: 293369 - DNA, 20 bp, Artificial
  CRISPR gRNA sequence
gagcccaggtgttcaaagtt

SEQ ID NO: 293370 - DNA, 20 bp, Artificial
  CRISPR gRNA sequence
agcccaggtgttcaaagttg

SEQ ID NO: 293371 - DNA, 20 bp, Artificial
  CRISPR gRNA sequence
aaagttgcagtgagctatga

SEQ ID NO: 293372 - DNA, 20 bp, Artificial
  CRISPR gRNA sequence
cagtgagctatgatcatgcc

SEQ ID NO: 293373 - DNA, 20 bp, Artificial
  CRISPR gRNA sequence
tgatcatgccactagactcc

SEQ ID NO: 293374 - DNA, 20 bp, Artificial
  CRISPR gRNA sequence
gactccagcctgggcaacag

SEQ ID NO: 293375 - DNA, 20 bp, Artificial
  CRISPR gRNA sequence
cagcctgggcaacagagtga

SEQ ID NO: 293376 - DNA, 20 bp, Artificial
  CRISPR gRNA sequence
ggcaacagagtgagaccctg

SEQ ID NO: 293377 - DNA, 20 bp, Artificial
  CRISPR gRNA sequence
tctctaaaagaaataaataa

SEQ ID NO: 293378 - DNA, 20 bp, Artificial
  CRISPR gRNA sequence
taaaagaaataaataaaata

SEQ ID NO: 293379 - DNA, 20 bp, Artificial
  CRISPR gRNA sequence
aaagaaataaataaaataat

SEQ ID NO: 293380 - DNA, 20 bp, Artificial
  CRISPR gRNA sequence
aaaaaataaatttaaaaaat

SEQ ID NO: 293381 - DNA, 20 bp, Artificial
  CRISPR gRNA sequence
aaaaataaatttaaaaaata

SEQ ID NO: 293382 - DNA, 20 bp, Artificial
  CRISPR gRNA sequence
aaaaaataaagtcactgtgc

SEQ ID NO: 293383 - DNA, 20 bp, Artificial
  CRISPR gRNA sequence
aaaaataaagtcactgtgca

SEQ ID NO: 293384 - DNA, 20 bp, Artificial
  CRISPR gRNA sequence
tgcaaggtgtgataatgtta

SEQ ID NO: 293385 - DNA, 20 bp, Artificial
  CRISPR gRNA sequence
ctaattttctttttatttat

SEQ ID NO: 293386 - DNA, 20 bp, Artificial
  CRISPR gRNA sequence
attttctttttatttattta

SEQ ID NO: 293387 - DNA, 20 bp, Artificial
  CRISPR gRNA sequence
tctttttatttatttattta

SEQ ID NO: 293388 - DNA, 20 bp, Artificial
  CRISPR gRNA sequence
ctttttatttatttatttat

SEQ ID NO: 293389 - DNA, 20 bp, Artificial
  CRISPR gRNA sequence
tttttatttatttatttatt

SEQ ID NO: 293390 - DNA, 20 bp, Artificial
  CRISPR gRNA sequence
tttatttatttatttatttt

SEQ ID NO: 293391 - DNA, 20 bp, Artificial
  CRISPR gRNA sequence
ttatttatttatttattttt

SEQ ID NO: 293392 - DNA, 20 bp, Artificial
  CRISPR gRNA sequence
tatttatttatttatttttt

SEQ ID NO: 293393 - DNA, 20 bp, Artificial
  CRISPR gRNA sequence
atttatttatttattttttt

SEQ ID NO: 293394 - DNA, 20 bp, Artificial
  CRISPR gRNA sequence
tttatttatttatttttttg

SEQ ID NO: 293395 - DNA, 20 bp, Artificial
  CRISPR gRNA sequence
atttatttatttttttgaga

SEQ ID NO: 293396 - DNA, 20 bp, Artificial
  CRISPR gRNA sequence
tttatttatttttttgagac

SEQ ID NO: 293397 - DNA, 20 bp, Artificial
  CRISPR gRNA sequence
atttatttttttgagacagt

SEQ ID NO: 293398 - DNA, 20 bp, Artificial
  CRISPR gRNA sequence
tttatttttttgagacagtg

SEQ ID NO: 293399 - DNA, 20 bp, Artificial
  CRISPR gRNA sequence
atttttttgagacagtgtct

SEQ ID NO: 293400 - DNA, 20 bp, Artificial
  CRISPR gRNA sequence
tttttttgagacagtgtctc

SEQ ID NO: 293401 - DNA, 20 bp, Artificial
  CRISPR gRNA sequence
ttttgagacagtgtctcgcc

SEQ ID NO: 293402 - DNA, 20 bp, Artificial
  CRISPR gRNA sequence
tttgagacagtgtctcgccc

SEQ ID NO: 293403 - DNA, 20 bp, Artificial
  CRISPR gRNA sequence
ttgagacagtgtctcgccct

SEQ ID NO: 293404 - DNA, 20 bp, Artificial
  CRISPR gRNA sequence
tgagacagtgtctcgccctg

SEQ ID NO: 293405 - DNA, 20 bp, Artificial
  CRISPR gRNA sequence
gagacagtgtctcgccctgt

SEQ ID NO: 293406 - DNA, 20 bp, Artificial
  CRISPR gRNA sequence
agacagtgtctcgccctgtt

SEQ ID NO: 293407 - DNA, 20 bp, Artificial
  CRISPR gRNA sequence
gccctgttgcccaggctgga

SEQ ID NO: 293408 - DNA, 20 bp, Artificial
  CRISPR gRNA sequence
ttgcccaggctggagtgcag

SEQ ID NO: 293409 - DNA, 20 bp, Artificial
  CRISPR gRNA sequence
cccaggctggagtgcagtgg

SEQ ID NO: 293410 - DNA, 20 bp, Artificial
  CRISPR gRNA sequence
gagtgcagtggcacaatctc

SEQ ID NO: 293411 - DNA, 20 bp, Artificial
  CRISPR gRNA sequence
agctcactgcaacctccacc

SEQ ID NO: 293412 - DNA, 20 bp, Artificial
  CRISPR gRNA sequence
actgcaacctccaccttcca

SEQ ID NO: 293413 - DNA, 20 bp, Artificial
  CRISPR gRNA sequence
caacctccaccttccaggtt

SEQ ID NO: 293414 - DNA, 20 bp, Artificial
  CRISPR gRNA sequence
caccttccaggttcaagcaa

SEQ ID NO: 293415 - DNA, 20 bp, Artificial
  CRISPR gRNA sequence
ccaggttcaagcaattcttc

SEQ ID NO: 293416 - DNA, 20 bp, Artificial
  CRISPR gRNA sequence
caggttcaagcaattcttct

SEQ ID NO: 293417 - DNA, 20 bp, Artificial
  CRISPR gRNA sequence
aagcaattcttctgcctcag

SEQ ID NO: 293418 - DNA, 20 bp, Artificial
  CRISPR gRNA sequence
ttctgcctcagcctcccgaa

SEQ ID NO: 293419 - DNA, 20 bp, Artificial
  CRISPR gRNA sequence
ctgcctcagcctcccgaata

SEQ ID NO: 293420 - DNA, 20 bp, Artificial
  CRISPR gRNA sequence
tgcctcagcctcccgaatag

SEQ ID NO: 293421 - DNA, 20 bp, Artificial
  CRISPR gRNA sequence
cctcagcctcccgaatagct

SEQ ID NO: 293422 - DNA, 20 bp, Artificial
  CRISPR gRNA sequence
agcctcccgaatagctggga

SEQ ID NO: 293423 - DNA, 20 bp, Artificial
  CRISPR gRNA sequence
ccgaatagctgggattacag

SEQ ID NO: 293424 - DNA, 20 bp, Artificial
  CRISPR gRNA sequence
ggattacaggcgccagccac

SEQ ID NO: 293425 - DNA, 20 bp, Artificial
  CRISPR gRNA sequence
caggcgccagccaccaccct

SEQ ID NO: 293426 - DNA, 20 bp, Artificial
  CRISPR gRNA sequence
ggctaattttttctatcttt

SEQ ID NO: 293427 - DNA, 20 bp, Artificial
  CRISPR gRNA sequence
attttttctatctttagtgg

SEQ ID NO: 293428 - DNA, 20 bp, Artificial
  CRISPR gRNA sequence
tttctatctttagtggagat

SEQ ID NO: 293429 - DNA, 20 bp, Artificial
  CRISPR gRNA sequence
ttctatctttagtggagatg

SEQ ID NO: 293430 - DNA, 20 bp, Artificial
  CRISPR gRNA sequence
tctatctttagtggagatgg

SEQ ID NO: 293431 - DNA, 20 bp, Artificial
  CRISPR gRNA sequence
ctatctttagtggagatggg

SEQ ID NO: 293432 - DNA, 20 bp, Artificial
  CRISPR gRNA sequence
tatctttagtggagatgggg

SEQ ID NO: 293433 - DNA, 20 bp, Artificial
  CRISPR gRNA sequence
tctttagtggagatggggtt

SEQ ID NO: 293434 - DNA, 20 bp, Artificial
  CRISPR gRNA sequence
tagtggagatggggtttcac

SEQ ID NO: 293435 - DNA, 20 bp, Artificial
  CRISPR gRNA sequence
agtggagatggggtttcacc

SEQ ID NO: 293436 - DNA, 20 bp, Artificial
  CRISPR gRNA sequence
gtggagatggggtttcacca

SEQ ID NO: 293437 - DNA, 20 bp, Artificial
  CRISPR gRNA sequence
caccatgttggtcaggctgg

SEQ ID NO: 293438 - DNA, 20 bp, Artificial
  CRISPR gRNA sequence
accatgttggtcaggctggt

SEQ ID NO: 293439 - DNA, 20 bp, Artificial
  CRISPR gRNA sequence
gtcaggctggtctcgaactc

SEQ ID NO: 293440 - DNA, 20 bp, Artificial
  CRISPR gRNA sequence
gtctcgaactcctgacctcg

SEQ ID NO: 293441 - DNA, 20 bp, Artificial
  CRISPR gRNA sequence
gaactcctgacctcgtgatc

SEQ ID NO: 293442 - DNA, 20 bp, Artificial
  CRISPR gRNA sequence
ctgacctcgtgatccgcccg

SEQ ID NO: 293443 - DNA, 20 bp, Artificial
  CRISPR gRNA sequence
acctcgtgatccgcccgcct

SEQ ID NO: 293444 - DNA, 20 bp, Artificial
  CRISPR gRNA sequence
gtgatccgcccgcctcagcc

SEQ ID NO: 293445 - DNA, 20 bp, Artificial
  CRISPR gRNA sequence
agcctcccaaagtgctggga

SEQ ID NO: 293446 - DNA, 20 bp, Artificial
  CRISPR gRNA sequence
ccaaagtgctgggattacag

SEQ ID NO: 293447 - DNA, 20 bp, Artificial
  CRISPR gRNA sequence
ggattacaggtgtgagccac

SEQ ID NO: 293448 - DNA, 20 bp, Artificial
  CRISPR gRNA sequence
caggtgtgagccactgcacc

SEQ ID NO: 293449 - DNA, 20 bp, Artificial
  CRISPR gRNA sequence
cacccggccttattttcttg

SEQ ID NO: 293450 - DNA, 20 bp, Artificial
  CRISPR gRNA sequence
attttcttgtaataaatatt

SEQ ID NO: 293451 - DNA, 20 bp, Artificial
  CRISPR gRNA sequence
ttttcttgtaataaatattc

SEQ ID NO: 293452 - DNA, 20 bp, Artificial
  CRISPR gRNA sequence
tcttgtaataaatattctaa

SEQ ID NO: 293453 - DNA, 20 bp, Artificial
  CRISPR gRNA sequence
cttgtaataaatattctaaa

SEQ ID NO: 293454 - DNA, 20 bp, Artificial
  CRISPR gRNA sequence
ttgtaataaatattctaaaa

SEQ ID NO: 293455 - DNA, 20 bp, Artificial
  CRISPR gRNA sequence
gtaataaatattctaaaatt

SEQ ID NO: 293456 - DNA, 20 bp, Artificial
  CRISPR gRNA sequence
taataaatattctaaaattt

SEQ ID NO: 293457 - DNA, 20 bp, Artificial
  CRISPR gRNA sequence
taaaatttatatatactaaa

SEQ ID NO: 293458 - DNA, 20 bp, Artificial
  CRISPR gRNA sequence
aaatttatatatactaaaaa

SEQ ID NO: 293459 - DNA, 20 bp, Artificial
  CRISPR gRNA sequence
atatatactaaaaaccatta

SEQ ID NO: 293460 - DNA, 20 bp, Artificial
  CRISPR gRNA sequence
tatatactaaaaaccattat

SEQ ID NO: 293461 - DNA, 20 bp, Artificial
  CRISPR gRNA sequence
aaaaccattatccatcaagc

SEQ ID NO: 293462 - DNA, 20 bp, Artificial
  CRISPR gRNA sequence
tccatcaagcattcatctta

SEQ ID NO: 293463 - DNA, 20 bp, Artificial
  CRISPR gRNA sequence
atcttaaaaagtttttgtaa

SEQ ID NO: 293464 - DNA, 20 bp, Artificial
  CRISPR gRNA sequence
aaaaagtttttgtaacaata

SEQ ID NO: 293465 - DNA, 20 bp, Artificial
  CRISPR gRNA sequence
aaaagtttttgtaacaatag

SEQ ID NO: 293466 - DNA, 20 bp, Artificial
  CRISPR gRNA sequence
ttgtaacaatagtattattg

SEQ ID NO: 293467 - DNA, 20 bp, Artificial
  CRISPR gRNA sequence
tgtaacaatagtattattga

SEQ ID NO: 293468 - DNA, 20 bp, Artificial
  CRISPR gRNA sequence
gtaacaatagtattattgaa

SEQ ID NO: 293469 - DNA, 20 bp, Artificial
  CRISPR gRNA sequence
taacaatagtattattgaaa

SEQ ID NO: 293470 - DNA, 20 bp, Artificial
  CRISPR gRNA sequence
ttgaaagcattaaaatttgc

SEQ ID NO: 293471 - DNA, 20 bp, Artificial
  CRISPR gRNA sequence
aaagcattaaaatttgccct

SEQ ID NO: 293472 - DNA, 20 bp, Artificial
  CRISPR gRNA sequence
aaatttgccctttggaactg

SEQ ID NO: 293473 - DNA, 20 bp, Artificial
  CRISPR gRNA sequence
gccctttggaactgccctta

SEQ ID NO: 293474 - DNA, 20 bp, Artificial
  CRISPR gRNA sequence
ccctttggaactgcccttag

SEQ ID NO: 293475 - DNA, 20 bp, Artificial
  CRISPR gRNA sequence
tggaactgcccttagggatt

SEQ ID NO: 293476 - DNA, 20 bp, Artificial
  CRISPR gRNA sequence
ggaactgcccttagggattt

SEQ ID NO: 293477 - DNA, 20 bp, Artificial
  CRISPR gRNA sequence
gaactgcccttagggatttg

SEQ ID NO: 293478 - DNA, 20 bp, Artificial
  CRISPR gRNA sequence
cccttagggatttggtgctt

SEQ ID NO: 293479 - DNA, 20 bp, Artificial
  CRISPR gRNA sequence
agggatttggtgctttcttt

SEQ ID NO: 293480 - DNA, 20 bp, Artificial
  CRISPR gRNA sequence
gggatttggtgctttctttt

SEQ ID NO: 293481 - DNA, 20 bp, Artificial
  CRISPR gRNA sequence
ggtgctttcttttagggcat

SEQ ID NO: 293482 - DNA, 20 bp, Artificial
  CRISPR gRNA sequence
gtgctttcttttagggcatg

SEQ ID NO: 293483 - DNA, 20 bp, Artificial
  CRISPR gRNA sequence
tcttttagggcatgccaccc

SEQ ID NO: 293484 - DNA, 20 bp, Artificial
  CRISPR gRNA sequence
cttttagggcatgccaccca

SEQ ID NO: 293485 - DNA, 20 bp, Artificial
  CRISPR gRNA sequence
ttttagggcatgccacccac

SEQ ID NO: 293486 - DNA, 20 bp, Artificial
  CRISPR gRNA sequence
ttagggcatgccacccacac

SEQ ID NO: 293487 - DNA, 20 bp, Artificial
  CRISPR gRNA sequence
tagggcatgccacccacacg

SEQ ID NO: 293488 - DNA, 20 bp, Artificial
  CRISPR gRNA sequence
agggcatgccacccacacgg

SEQ ID NO: 293489 - DNA, 20 bp, Artificial
  CRISPR gRNA sequence
gggcatgccacccacacggt

SEQ ID NO: 293490 - DNA, 20 bp, Artificial
  CRISPR gRNA sequence
catggtgccaaacaattttt

SEQ ID NO: 293491 - DNA, 20 bp, Artificial
  CRISPR gRNA sequence
ttttttgtgggcgaatgtgc

SEQ ID NO: 293492 - DNA, 20 bp, Artificial
  CRISPR gRNA sequence
tttttgtgggcgaatgtgct

SEQ ID NO: 293493 - DNA, 20 bp, Artificial
  CRISPR gRNA sequence
ttttgtgggcgaatgtgctt

SEQ ID NO: 293494 - DNA, 20 bp, Artificial
  CRISPR gRNA sequence
tttgtgggcgaatgtgcttt

SEQ ID NO: 293495 - DNA, 20 bp, Artificial
  CRISPR gRNA sequence
ttgtgggcgaatgtgctttt

SEQ ID NO: 293496 - DNA, 20 bp, Artificial
  CRISPR gRNA sequence
tgtgggcgaatgtgcttttt

SEQ ID NO: 293497 - DNA, 20 bp, Artificial
  CRISPR gRNA sequence
gtgggcgaatgtgcttttta

SEQ ID NO: 293498 - DNA, 20 bp, Artificial
  CRISPR gRNA sequence
tgggcgaatgtgctttttaa

SEQ ID NO: 293499 - DNA, 20 bp, Artificial
  CRISPR gRNA sequence
tttaagaactactggttcat

SEQ ID NO: 293500 - DNA, 20 bp, Artificial
  CRISPR gRNA sequence
ttaagaactactggttcatt

SEQ ID NO: 293501 - DNA, 20 bp, Artificial
  CRISPR gRNA sequence
taagaactactggttcattc

SEQ ID NO: 293502 - DNA, 20 bp, Artificial
  CRISPR gRNA sequence
aagaactactggttcattct

SEQ ID NO: 293503 - DNA, 20 bp, Artificial
  CRISPR gRNA sequence
agaactactggttcattctg

SEQ ID NO: 293504 - DNA, 20 bp, Artificial
  CRISPR gRNA sequence
ctggttcattctgaaccaag

SEQ ID NO: 293505 - DNA, 20 bp, Artificial
  CRISPR gRNA sequence
gttcattctgaaccaagtct

SEQ ID NO: 293506 - DNA, 20 bp, Artificial
  CRISPR gRNA sequence
attctgaaccaagtctggga

SEQ ID NO: 293507 - DNA, 20 bp, Artificial
  CRISPR gRNA sequence
tgaaccaagtctgggaaagg

SEQ ID NO: 293508 - DNA, 20 bp, Artificial
  CRISPR gRNA sequence
aaccaagtctgggaaaggtg

SEQ ID NO: 293509 - DNA, 20 bp, Artificial
  CRISPR gRNA sequence
ggaaaggtgagtgacaaact

SEQ ID NO: 293510 - DNA, 20 bp, Artificial
  CRISPR gRNA sequence
cttgaagacaacgcctgaaa

SEQ ID NO: 293511 - DNA, 20 bp, Artificial
  CRISPR gRNA sequence
gaagacaacgcctgaaaaga

SEQ ID NO: 293512 - DNA, 20 bp, Artificial
  CRISPR gRNA sequence
aagacaacgcctgaaaagag

SEQ ID NO: 293513 - DNA, 20 bp, Artificial
  CRISPR gRNA sequence
aaaagaggtcattttggagc

SEQ ID NO: 293514 - DNA, 20 bp, Artificial
  CRISPR gRNA sequence
tggagcaaatattttaccct

SEQ ID NO: 293515 - DNA, 20 bp, Artificial
  CRISPR gRNA sequence
ggagcaaatattttacccta

SEQ ID NO: 293516 - DNA, 20 bp, Artificial
  CRISPR gRNA sequence
gagcaaatattttaccctac

SEQ ID NO: 293517 - DNA, 20 bp, Artificial
  CRISPR gRNA sequence
taccctactggtagtaaact

SEQ ID NO: 293518 - DNA, 20 bp, Artificial
  CRISPR gRNA sequence
accctactggtagtaaactc

SEQ ID NO: 293519 - DNA, 20 bp, Artificial
  CRISPR gRNA sequence
ccctactggtagtaaactca

SEQ ID NO: 293520 - DNA, 20 bp, Artificial
  CRISPR gRNA sequence
ctggtagtaaactcagagaa

SEQ ID NO: 293521 - DNA, 20 bp, Artificial
  CRISPR gRNA sequence
gtagtaaactcagagaattc

SEQ ID NO: 293522 - DNA, 20 bp, Artificial
  CRISPR gRNA sequence
agagaattctctttccccaa

SEQ ID NO: 293523 - DNA, 20 bp, Artificial
  CRISPR gRNA sequence
tctttccccaagaggtgaaa

SEQ ID NO: 293524 - DNA, 20 bp, Artificial
  CRISPR gRNA sequence
tttccccaagaggtgaaatc

SEQ ID NO: 293525 - DNA, 20 bp, Artificial
  CRISPR gRNA sequence
tccccaagaggtgaaatcat

SEQ ID NO: 293526 - DNA, 20 bp, Artificial
  CRISPR gRNA sequence
ccccaagaggtgaaatcatt

SEQ ID NO: 293527 - DNA, 20 bp, Artificial
  CRISPR gRNA sequence
cccaagaggtgaaatcattt

SEQ ID NO: 293528 - DNA, 20 bp, Artificial
  CRISPR gRNA sequence
gaaaatatacaatgaaaacg

SEQ ID NO: 293529 - DNA, 20 bp, Artificial
  CRISPR gRNA sequence
aaaatatacaatgaaaacga

SEQ ID NO: 293530 - DNA, 20 bp, Artificial
  CRISPR gRNA sequence
atatgaatatatacatctta

SEQ ID NO: 293531 - DNA, 20 bp, Artificial
  CRISPR gRNA sequence
tatgaatatatacatcttag

SEQ ID NO: 293532 - DNA, 20 bp, Artificial
  CRISPR gRNA sequence
aggcctataatggcttaaga

SEQ ID NO: 293533 - DNA, 20 bp, Artificial
  CRISPR gRNA sequence
ggcctataatggcttaagat

SEQ ID NO: 293534 - DNA, 20 bp, Artificial
  CRISPR gRNA sequence
taatggcttaagatggctta

SEQ ID NO: 293535 - DNA, 20 bp, Artificial
  CRISPR gRNA sequence
aagatggcttacaaggtgaa

SEQ ID NO: 293536 - DNA, 20 bp, Artificial
  CRISPR gRNA sequence
agatggcttacaaggtgaac

SEQ ID NO: 293537 - DNA, 20 bp, Artificial
  CRISPR gRNA sequence
acaaggtgaactgagatgct

SEQ ID NO: 293538 - DNA, 20 bp, Artificial
  CRISPR gRNA sequence
caaggtgaactgagatgctc

SEQ ID NO: 293539 - DNA, 20 bp, Artificial
  CRISPR gRNA sequence
agatgctcaaaatattaata

SEQ ID NO: 293540 - DNA, 20 bp, Artificial
  CRISPR gRNA sequence
aaaatattaatacttgttta

SEQ ID NO: 293541 - DNA, 20 bp, Artificial
  CRISPR gRNA sequence
atacttgtttaaattgtacg

SEQ ID NO: 293542 - DNA, 20 bp, Artificial
  CRISPR gRNA sequence
gtttaaattgtacggctgat

SEQ ID NO: 293543 - DNA, 20 bp, Artificial
  CRISPR gRNA sequence
tttaaattgtacggctgatc

SEQ ID NO: 293544 - DNA, 20 bp, Artificial
  CRISPR gRNA sequence
aaattgtacggctgatcata

SEQ ID NO: 293545 - DNA, 20 bp, Artificial
  CRISPR gRNA sequence
aattgtacggctgatcatac

SEQ ID NO: 293546 - DNA, 20 bp, Artificial
  CRISPR gRNA sequence
tacggctgatcatacagagg

SEQ ID NO: 293547 - DNA, 20 bp, Artificial
  CRISPR gRNA sequence
atcatacagaggaccacagg

SEQ ID NO: 293548 - DNA, 20 bp, Artificial
  CRISPR gRNA sequence
tctccctacccctagcccca

SEQ ID NO: 293549 - DNA, 20 bp, Artificial
  CRISPR gRNA sequence
tccctacccctagccccact

SEQ ID NO: 293550 - DNA, 20 bp, Artificial
  CRISPR gRNA sequence
cctacccctagccccactcc

SEQ ID NO: 293551 - DNA, 20 bp, Artificial
  CRISPR gRNA sequence
cccctagccccactcccaag

SEQ ID NO: 293552 - DNA, 20 bp, Artificial
  CRISPR gRNA sequence
gccccactcccaaggatagg

SEQ ID NO: 293553 - DNA, 20 bp, Artificial
  CRISPR gRNA sequence
ccaaggataggttttgtgac

SEQ ID NO: 293554 - DNA, 20 bp, Artificial
  CRISPR gRNA sequence
tgtgactgtatagtaagaaa

SEQ ID NO: 293555 - DNA, 20 bp, Artificial
  CRISPR gRNA sequence
gtgactgtatagtaagaaac

SEQ ID NO: 293556 - DNA, 20 bp, Artificial
  CRISPR gRNA sequence
tgactgtatagtaagaaaca

SEQ ID NO: 293557 - DNA, 20 bp, Artificial
  CRISPR gRNA sequence
tatagtaagaaacaaaacac

SEQ ID NO: 293558 - DNA, 20 bp, Artificial
  CRISPR gRNA sequence
agtttgataatacagttgca

SEQ ID NO: 293559 - DNA, 20 bp, Artificial
  CRISPR gRNA sequence
gataatacagttgcacataa

SEQ ID NO: 293560 - DNA, 20 bp, Artificial
  CRISPR gRNA sequence
ataatacagttgcacataag

SEQ ID NO: 293561 - DNA, 20 bp, Artificial
  CRISPR gRNA sequence
cacataagtatatagcacaa

SEQ ID NO: 293562 - DNA, 20 bp, Artificial
  CRISPR gRNA sequence
tatggcatgtcttaattctt

SEQ ID NO: 293563 - DNA, 20 bp, Artificial
  CRISPR gRNA sequence
aattcttcatgtctttactt

SEQ ID NO: 293564 - DNA, 20 bp, Artificial
  CRISPR gRNA sequence
attcttcatgtctttacttg

SEQ ID NO: 293565 - DNA, 20 bp, Artificial
  CRISPR gRNA sequence
ttcatgtctttacttgtagt

SEQ ID NO: 293566 - DNA, 20 bp, Artificial
  CRISPR gRNA sequence
catgtctttacttgtagttg

SEQ ID NO: 293567 - DNA, 20 bp, Artificial
  CRISPR gRNA sequence
atgtctttacttgtagttgc

SEQ ID NO: 293568 - DNA, 20 bp, Artificial
  CRISPR gRNA sequence
tacttgtagttgcgaagtgg

SEQ ID NO: 293569 - DNA, 20 bp, Artificial
  CRISPR gRNA sequence
acttgtagttgcgaagtgga

SEQ ID NO: 293570 - DNA, 20 bp, Artificial
  CRISPR gRNA sequence
cttgtagttgcgaagtggat

SEQ ID NO: 293571 - DNA, 20 bp, Artificial
  CRISPR gRNA sequence
gtagttgcgaagtggataat

SEQ ID NO: 293572 - DNA, 20 bp, Artificial
  CRISPR gRNA sequence
tagttgcgaagtggataatt

SEQ ID NO: 293573 - DNA, 20 bp, Artificial
  CRISPR gRNA sequence
cgaagtggataatttatttt

SEQ ID NO: 293574 - DNA, 20 bp, Artificial
  CRISPR gRNA sequence
attttagatggtctagtaat

SEQ ID NO: 293575 - DNA, 20 bp, Artificial
  CRISPR gRNA sequence
ttttagatggtctagtaatt

SEQ ID NO: 293576 - DNA, 20 bp, Artificial
  CRISPR gRNA sequence
tagatggtctagtaattcat

SEQ ID NO: 293577 - DNA, 20 bp, Artificial
  CRISPR gRNA sequence
agatggtctagtaattcatg

SEQ ID NO: 293578 - DNA, 20 bp, Artificial
  CRISPR gRNA sequence
gatggtctagtaattcatgc

SEQ ID NO: 293579 - DNA, 20 bp, Artificial
  CRISPR gRNA sequence
gtaattcatgctagtgtatg

SEQ ID NO: 293580 - DNA, 20 bp, Artificial
  CRISPR gRNA sequence
atgctagtgtatgatttact

SEQ ID NO: 293581 - DNA, 20 bp, Artificial
  CRISPR gRNA sequence
gtgtatgatttactctagat

SEQ ID NO: 293582 - DNA, 20 bp, Artificial
  CRISPR gRNA sequence
actctagatctttcagtgtt

SEQ ID NO: 293583 - DNA, 20 bp, Artificial
  CRISPR gRNA sequence
ctctagatctttcagtgtta

SEQ ID NO: 293584 - DNA, 20 bp, Artificial
  CRISPR gRNA sequence
tagatctttcagtgttacag

SEQ ID NO: 293585 - DNA, 20 bp, Artificial
  CRISPR gRNA sequence
gatctttcagtgttacagca

SEQ ID NO: 293586 - DNA, 20 bp, Artificial
  CRISPR gRNA sequence
tcagtgttacagcagatttt

SEQ ID NO: 293587 - DNA, 20 bp, Artificial
  CRISPR gRNA sequence
cagtgttacagcagattttt

SEQ ID NO: 293588 - DNA, 20 bp, Artificial
  CRISPR gRNA sequence
agtgttacagcagatttttt

SEQ ID NO: 293589 - DNA, 20 bp, Artificial
  CRISPR gRNA sequence
cagcagattttttttttttt

SEQ ID NO: 293590 - DNA, 20 bp, Artificial
  CRISPR gRNA sequence
ttttttttttttttgagacg

SEQ ID NO: 293591 - DNA, 20 bp, Artificial
  CRISPR gRNA sequence
tttttttttttttgagacgg

SEQ ID NO: 293592 - DNA, 20 bp, Artificial
  CRISPR gRNA sequence
ttttttttttttgagacgga

SEQ ID NO: 293593 - DNA, 20 bp, Artificial
  CRISPR gRNA sequence
tttttttttttgagacggag

SEQ ID NO: 293594 - DNA, 20 bp, Artificial
  CRISPR gRNA sequence
ttttttttttgagacggagt

SEQ ID NO: 293595 - DNA, 20 bp, Artificial
  CRISPR gRNA sequence
tttttttttgagacggagtc

SEQ ID NO: 293596 - DNA, 20 bp, Artificial
  CRISPR gRNA sequence
ttttttttgagacggagtct

SEQ ID NO: 293597 - DNA, 20 bp, Artificial
  CRISPR gRNA sequence
tttttttgagacggagtctc

SEQ ID NO: 293598 - DNA, 20 bp, Artificial
  CRISPR gRNA sequence
ttttttgagacggagtctcg

SEQ ID NO: 293599 - DNA, 20 bp, Artificial
  CRISPR gRNA sequence
tttttgagacggagtctcgc

SEQ ID NO: 293600 - DNA, 20 bp, Artificial
  CRISPR gRNA sequence
ttttgagacggagtctcgct

SEQ ID NO: 293601 - DNA, 20 bp, Artificial
  CRISPR gRNA sequence
tttgagacggagtctcgctc

SEQ ID NO: 293602 - DNA, 20 bp, Artificial
  CRISPR gRNA sequence
ttgagacggagtctcgctct

SEQ ID NO: 293603 - DNA, 20 bp, Artificial
  CRISPR gRNA sequence
tgagacggagtctcgctctg

SEQ ID NO: 293604 - DNA, 20 bp, Artificial
  CRISPR gRNA sequence
gagacggagtctcgctctgt

SEQ ID NO: 293605 - DNA, 20 bp, Artificial
  CRISPR gRNA sequence
agacggagtctcgctctgtc

SEQ ID NO: 293606 - DNA, 20 bp, Artificial
  CRISPR gRNA sequence
gctctgtcacccaggctgga

SEQ ID NO: 293607 - DNA, 20 bp, Artificial
  CRISPR gRNA sequence
tgtcacccaggctggagtgc

SEQ ID NO: 293608 - DNA, 20 bp, Artificial
  CRISPR gRNA sequence
tcacccaggctggagtgcag

SEQ ID NO: 293609 - DNA, 20 bp, Artificial
  CRISPR gRNA sequence
gagtgcagtggcgtgatctt

SEQ ID NO: 293610 - DNA, 20 bp, Artificial
  CRISPR gRNA sequence
ggctcactgtaacctccgcc

SEQ ID NO: 293611 - DNA, 20 bp, Artificial
  CRISPR gRNA sequence
gctcactgtaacctccgcct

SEQ ID NO: 293612 - DNA, 20 bp, Artificial
  CRISPR gRNA sequence
actgtaacctccgcctccca

SEQ ID NO: 293613 - DNA, 20 bp, Artificial
  CRISPR gRNA sequence
taacctccgcctcccaggtt

SEQ ID NO: 293614 - DNA, 20 bp, Artificial
  CRISPR gRNA sequence
cgcctcccaggttgaagcaa

SEQ ID NO: 293615 - DNA, 20 bp, Artificial
  CRISPR gRNA sequence
ccaggttgaagcaattctcc

SEQ ID NO: 293616 - DNA, 20 bp, Artificial
  CRISPR gRNA sequence
aagcaattctcctgtctcag

SEQ ID NO: 293617 - DNA, 20 bp, Artificial
  CRISPR gRNA sequence
tcctgtctcagcctcctgtg

SEQ ID NO: 293618 - DNA, 20 bp, Artificial
  CRISPR gRNA sequence
ctgtctcagcctcctgtgta

SEQ ID NO: 293619 - DNA, 20 bp, Artificial
  CRISPR gRNA sequence
tctcagcctcctgtgtagct

SEQ ID NO: 293620 - DNA, 20 bp, Artificial
  CRISPR gRNA sequence
agcctcctgtgtagctggga

SEQ ID NO: 293621 - DNA, 20 bp, Artificial
  CRISPR gRNA sequence
ctgtgtagctgggactacag

SEQ ID NO: 293622 - DNA, 20 bp, Artificial
  CRISPR gRNA sequence
tgtagctgggactacaggtg

SEQ ID NO: 293623 - DNA, 20 bp, Artificial
  CRISPR gRNA sequence
ggactacaggtgccagccac

SEQ ID NO: 293624 - DNA, 20 bp, Artificial
  CRISPR gRNA sequence
caggtgccagccaccacaca

SEQ ID NO: 293625 - DNA, 20 bp, Artificial
  CRISPR gRNA sequence
ttgtatttttagtagagatg

SEQ ID NO: 293626 - DNA, 20 bp, Artificial
  CRISPR gRNA sequence
tgtatttttagtagagatgg

SEQ ID NO: 293627 - DNA, 20 bp, Artificial
  CRISPR gRNA sequence
gtatttttagtagagatgga

SEQ ID NO: 293628 - DNA, 20 bp, Artificial
  CRISPR gRNA sequence
tatttttagtagagatggag

SEQ ID NO: 293629 - DNA, 20 bp, Artificial
  CRISPR gRNA sequence
ttagtagagatggagtttca

SEQ ID NO: 293630 - DNA, 20 bp, Artificial
  CRISPR gRNA sequence
tagtagagatggagtttcac

SEQ ID NO: 293631 - DNA, 20 bp, Artificial
  CRISPR gRNA sequence
agtagagatggagtttcacc

SEQ ID NO: 293632 - DNA, 20 bp, Artificial
  CRISPR gRNA sequence
gtagagatggagtttcacca

SEQ ID NO: 293633 - DNA, 20 bp, Artificial
  CRISPR gRNA sequence
caccacgttggtcaggctgg

SEQ ID NO: 293634 - DNA, 20 bp, Artificial
  CRISPR gRNA sequence
accacgttggtcaggctggt

SEQ ID NO: 293635 - DNA, 20 bp, Artificial
  CRISPR gRNA sequence
gtcaggctggtcttgaactc

SEQ ID NO: 293636 - DNA, 20 bp, Artificial
  CRISPR gRNA sequence
gtcttgaactctcgacctta

SEQ ID NO: 293637 - DNA, 20 bp, Artificial
  CRISPR gRNA sequence
gaactctcgaccttaggtga

SEQ ID NO: 293638 - DNA, 20 bp, Artificial
  CRISPR gRNA sequence
aactctcgaccttaggtgat

SEQ ID NO: 293639 - DNA, 20 bp, Artificial
  CRISPR gRNA sequence
tcgaccttaggtgatctgcc

SEQ ID NO: 293640 - DNA, 20 bp, Artificial
  CRISPR gRNA sequence
gaccttaggtgatctgcccg

SEQ ID NO: 293641 - DNA, 20 bp, Artificial
  CRISPR gRNA sequence
aggtgatctgcccgcctcag

SEQ ID NO: 293642 - DNA, 20 bp, Artificial
  CRISPR gRNA sequence
ggtgatctgcccgcctcagc

SEQ ID NO: 293643 - DNA, 20 bp, Artificial
  CRISPR gRNA sequence
cccgcctcagcctcccaaag

SEQ ID NO: 293644 - DNA, 20 bp, Artificial
  CRISPR gRNA sequence
agcctcccaaagtgtggaga

SEQ ID NO: 293645 - DNA, 20 bp, Artificial
  CRISPR gRNA sequence
ccaaagtgtggagattacag

SEQ ID NO: 293646 - DNA, 20 bp, Artificial
  CRISPR gRNA sequence
caggcatgagccaccatgcc

SEQ ID NO: 293647 - DNA, 20 bp, Artificial
  CRISPR gRNA sequence
cagcagattctttattttcc

SEQ ID NO: 293648 - DNA, 20 bp, Artificial
  CRISPR gRNA sequence
tttattttcctcaatgagac

SEQ ID NO: 293649 - DNA, 20 bp, Artificial
  CRISPR gRNA sequence
tattttcctcaatgagacaa

SEQ ID NO: 293650 - DNA, 20 bp, Artificial
  CRISPR gRNA sequence
attttcctcaatgagacaaa

SEQ ID NO: 293651 - DNA, 20 bp, Artificial
  CRISPR gRNA sequence
ttttcctcaatgagacaaaa

SEQ ID NO: 293652 - DNA, 20 bp, Artificial
  CRISPR gRNA sequence
tcctcaatgagacaaaattt

SEQ ID NO: 293653 - DNA, 20 bp, Artificial
  CRISPR gRNA sequence
cctcaatgagacaaaatttc

SEQ ID NO: 293654 - DNA, 20 bp, Artificial
  CRISPR gRNA sequence
ctcaatgagacaaaatttcc

SEQ ID NO: 293655 - DNA, 20 bp, Artificial
  CRISPR gRNA sequence
aatgagacaaaatttcctgg

SEQ ID NO: 293656 - DNA, 20 bp, Artificial
  CRISPR gRNA sequence
cctgggaaaattagttcaaa

SEQ ID NO: 293657 - DNA, 20 bp, Artificial
  CRISPR gRNA sequence
ctgggaaaattagttcaaat

SEQ ID NO: 293658 - DNA, 20 bp, Artificial
  CRISPR gRNA sequence
ggaaaattagttcaaatata

SEQ ID NO: 293659 - DNA, 20 bp, Artificial
  CRISPR gRNA sequence
gttcaaatataaaccaaact

SEQ ID NO: 293660 - DNA, 20 bp, Artificial
  CRISPR gRNA sequence
aaatataaaccaaactttga

SEQ ID NO: 293661 - DNA, 20 bp, Artificial
  CRISPR gRNA sequence
tgacatgactattgatactc

SEQ ID NO: 293662 - DNA, 20 bp, Artificial
  CRISPR gRNA sequence
gacatgactattgatactcc

SEQ ID NO: 293663 - DNA, 20 bp, Artificial
  CRISPR gRNA sequence
acatgactattgatactcca

SEQ ID NO: 293664 - DNA, 20 bp, Artificial
  CRISPR gRNA sequence
ttgatactccaaacttacca

SEQ ID NO: 293665 - DNA, 20 bp, Artificial
  CRISPR gRNA sequence
atactccaaacttaccagtc

SEQ ID NO: 293666 - DNA, 20 bp, Artificial
  CRISPR gRNA sequence
caaacttaccagtctcagtc

SEQ ID NO: 293667 - DNA, 20 bp, Artificial
  CRISPR gRNA sequence
accagtctcagtcatctttt

SEQ ID NO: 293668 - DNA, 20 bp, Artificial
  CRISPR gRNA sequence
ccagtctcagtcatctttta

SEQ ID NO: 293669 - DNA, 20 bp, Artificial
  CRISPR gRNA sequence
agtcatcttttatgtgttgt

SEQ ID NO: 293670 - DNA, 20 bp, Artificial
  CRISPR gRNA sequence
ttatgtgttgtaaaaatttt

SEQ ID NO: 293671 - DNA, 20 bp, Artificial
  CRISPR gRNA sequence
tatgtgttgtaaaaatttta

SEQ ID NO: 293672 - DNA, 20 bp, Artificial
  CRISPR gRNA sequence
atgtgttgtaaaaattttat

SEQ ID NO: 293673 - DNA, 20 bp, Artificial
  CRISPR gRNA sequence
tgtgttgtaaaaattttatt

SEQ ID NO: 293674 - DNA, 20 bp, Artificial
  CRISPR gRNA sequence
taaaaattttattaaaatga

SEQ ID NO: 293675 - DNA, 20 bp, Artificial
  CRISPR gRNA sequence
tattaaaatgaggcttcaat

SEQ ID NO: 293676 - DNA, 20 bp, Artificial
  CRISPR gRNA sequence
attaaaatgaggcttcaatc

SEQ ID NO: 293677 - DNA, 20 bp, Artificial
  CRISPR gRNA sequence
ttaaaatgaggcttcaatca

SEQ ID NO: 293678 - DNA, 20 bp, Artificial
  CRISPR gRNA sequence
aaatgaggcttcaatcatat

SEQ ID NO: 293679 - DNA, 20 bp, Artificial
  CRISPR gRNA sequence
caatcatatagtttattaag

SEQ ID NO: 293680 - DNA, 20 bp, Artificial
  CRISPR gRNA sequence
aatcatatagtttattaagt

SEQ ID NO: 293681 - DNA, 20 bp, Artificial
  CRISPR gRNA sequence
attaagtctctatttttact

SEQ ID NO: 293682 - DNA, 20 bp, Artificial
  CRISPR gRNA sequence
ttaagtctctatttttactt

SEQ ID NO: 293683 - DNA, 20 bp, Artificial
  CRISPR gRNA sequence
agtctctatttttactttct

SEQ ID NO: 293684 - DNA, 20 bp, Artificial
  CRISPR gRNA sequence
tatttttactttcttgttat

SEQ ID NO: 293685 - DNA, 20 bp, Artificial
  CRISPR gRNA sequence
tttttactttcttgttatag

SEQ ID NO: 293686 - DNA, 20 bp, Artificial
  CRISPR gRNA sequence
ttactttcttgttatagcat

SEQ ID NO: 293687 - DNA, 20 bp, Artificial
  CRISPR gRNA sequence
tactttcttgttatagcatt

SEQ ID NO: 293688 - DNA, 20 bp, Artificial
  CRISPR gRNA sequence
actttcttgttatagcatta

SEQ ID NO: 293689 - DNA, 20 bp, Artificial
  CRISPR gRNA sequence
ctttcttgttatagcattat

SEQ ID NO: 293690 - DNA, 20 bp, Artificial
  CRISPR gRNA sequence
tcttgttatagcattattta

SEQ ID NO: 293691 - DNA, 20 bp, Artificial
  CRISPR gRNA sequence
cttgttatagcattatttaa

SEQ ID NO: 293692 - DNA, 20 bp, Artificial
  CRISPR gRNA sequence
ttgttatagcattatttaac

SEQ ID NO: 293693 - DNA, 20 bp, Artificial
  CRISPR gRNA sequence
gttatagcattatttaacca

SEQ ID NO: 293694 - DNA, 20 bp, Artificial
  CRISPR gRNA sequence
ttatagcattatttaaccaa

SEQ ID NO: 293695 - DNA, 20 bp, Artificial
  CRISPR gRNA sequence
tagcattatttaaccaattt

SEQ ID NO: 293696 - DNA, 20 bp, Artificial
  CRISPR gRNA sequence
tttaaccaattttacattat

SEQ ID NO: 293697 - DNA, 20 bp, Artificial
  CRISPR gRNA sequence
aaccaattttacattattct

SEQ ID NO: 293698 - DNA, 20 bp, Artificial
  CRISPR gRNA sequence
accaattttacattattctg

SEQ ID NO: 293699 - DNA, 20 bp, Artificial
  CRISPR gRNA sequence
tacattattctgattgaagg

SEQ ID NO: 293700 - DNA, 20 bp, Artificial
  CRISPR gRNA sequence
acattattctgattgaaggc

SEQ ID NO: 293701 - DNA, 20 bp, Artificial
  CRISPR gRNA sequence
cattattctgattgaaggca

SEQ ID NO: 293702 - DNA, 20 bp, Artificial
  CRISPR gRNA sequence
ttctgattgaaggcagaaaa

SEQ ID NO: 293703 - DNA, 20 bp, Artificial
  CRISPR gRNA sequence
tgattgaaggcagaaaacag

SEQ ID NO: 293704 - DNA, 20 bp, Artificial
  CRISPR gRNA sequence
attgaaggcagaaaacagta

SEQ ID NO: 293705 - DNA, 20 bp, Artificial
  CRISPR gRNA sequence
aaggcagaaaacagtagagt

SEQ ID NO: 293706 - DNA, 20 bp, Artificial
  CRISPR gRNA sequence
attattaaatcagtaatact

SEQ ID NO: 293707 - DNA, 20 bp, Artificial
  CRISPR gRNA sequence
ttaaatcagtaatactagct

SEQ ID NO: 293708 - DNA, 20 bp, Artificial
  CRISPR gRNA sequence
aatcagtaatactagcttgg

SEQ ID NO: 293709 - DNA, 20 bp, Artificial
  CRISPR gRNA sequence
gcttggattgcattttgatt

SEQ ID NO: 293710 - DNA, 20 bp, Artificial
  CRISPR gRNA sequence
ggattgcattttgatttgga

SEQ ID NO: 293711 - DNA, 20 bp, Artificial
  CRISPR gRNA sequence
gattgcattttgatttggac

SEQ ID NO: 293712 - DNA, 20 bp, Artificial
  CRISPR gRNA sequence
cattttgatttggacattat

SEQ ID NO: 293713 - DNA, 20 bp, Artificial
  CRISPR gRNA sequence
tgatttggacattatttata

SEQ ID NO: 293714 - DNA, 20 bp, Artificial
  CRISPR gRNA sequence
gatttggacattatttatat

SEQ ID NO: 293715 - DNA, 20 bp, Artificial
  CRISPR gRNA sequence
atttggacattatttatatt

SEQ ID NO: 293716 - DNA, 20 bp, Artificial
  CRISPR gRNA sequence
ggacattatttatattggaa

SEQ ID NO: 293717 - DNA, 20 bp, Artificial
  CRISPR gRNA sequence
gacattatttatattggaat

SEQ ID NO: 293718 - DNA, 20 bp, Artificial
  CRISPR gRNA sequence
tttatattggaatatggata

SEQ ID NO: 293719 - DNA, 20 bp, Artificial
  CRISPR gRNA sequence
atattggaatatggatatat

SEQ ID NO: 293720 - DNA, 20 bp, Artificial
  CRISPR gRNA sequence
tattggaatatggatatatg

SEQ ID NO: 293721 - DNA, 20 bp, Artificial
  CRISPR gRNA sequence
gaatatggatatatgtgaca

SEQ ID NO: 293722 - DNA, 20 bp, Artificial
  CRISPR gRNA sequence
taagacaggggttggcaaat

SEQ ID NO: 293723 - DNA, 20 bp, Artificial
  CRISPR gRNA sequence
agacaggggttggcaaattt

SEQ ID NO: 293724 - DNA, 20 bp, Artificial
  CRISPR gRNA sequence
gcaaatttttttctgaatag

SEQ ID NO: 293725 - DNA, 20 bp, Artificial
  CRISPR gRNA sequence
ttttctgaatagagccagat

SEQ ID NO: 293726 - DNA, 20 bp, Artificial
  CRISPR gRNA sequence
tttctgaatagagccagata

SEQ ID NO: 293727 - DNA, 20 bp, Artificial
  CRISPR gRNA sequence
ttctgaatagagccagatag

SEQ ID NO: 293728 - DNA, 20 bp, Artificial
  CRISPR gRNA sequence
tctgaatagagccagatagt

SEQ ID NO: 293729 - DNA, 20 bp, Artificial
  CRISPR gRNA sequence
ctgaatagagccagatagta

SEQ ID NO: 293730 - DNA, 20 bp, Artificial
  CRISPR gRNA sequence
tgaatagagccagatagtaa

SEQ ID NO: 293731 - DNA, 20 bp, Artificial
  CRISPR gRNA sequence
aatagagccagatagtaaat

SEQ ID NO: 293732 - DNA, 20 bp, Artificial
  CRISPR gRNA sequence
taagctttgcagtcacagtc

SEQ ID NO: 293733 - DNA, 20 bp, Artificial
  CRISPR gRNA sequence
aagctttgcagtcacagtct

SEQ ID NO: 293734 - DNA, 20 bp, Artificial
  CRISPR gRNA sequence
agctttgcagtcacagtctc

SEQ ID NO: 293735 - DNA, 20 bp, Artificial
  CRISPR gRNA sequence
tgcagtcacagtctctgttg

SEQ ID NO: 293736 - DNA, 20 bp, Artificial
  CRISPR gRNA sequence
gcagtcacagtctctgttgc

SEQ ID NO: 293737 - DNA, 20 bp, Artificial
  CRISPR gRNA sequence
cagtcacagtctctgttgca

SEQ ID NO: 293738 - DNA, 20 bp, Artificial
  CRISPR gRNA sequence
tgttgcaacaactcaattct

SEQ ID NO: 293739 - DNA, 20 bp, Artificial
  CRISPR gRNA sequence
ttgcaacaactcaattctgc

SEQ ID NO: 293740 - DNA, 20 bp, Artificial
  CRISPR gRNA sequence
caacaactcaattctgctgg

SEQ ID NO: 293741 - DNA, 20 bp, Artificial
  CRISPR gRNA sequence
aattctgctggttgtagcac

SEQ ID NO: 293742 - DNA, 20 bp, Artificial
  CRISPR gRNA sequence
tgctggttgtagcacaaaag

SEQ ID NO: 293743 - DNA, 20 bp, Artificial
  CRISPR gRNA sequence
ctggttgtagcacaaaagca

SEQ ID NO: 293744 - DNA, 20 bp, Artificial
  CRISPR gRNA sequence
gttgtagcacaaaagcagcc

SEQ ID NO: 293745 - DNA, 20 bp, Artificial
  CRISPR gRNA sequence
tagcacaaaagcagccacag

SEQ ID NO: 293746 - DNA, 20 bp, Artificial
  CRISPR gRNA sequence
tgttccaacaaaatttttct

SEQ ID NO: 293747 - DNA, 20 bp, Artificial
  CRISPR gRNA sequence
caacaaaatttttctttttt

SEQ ID NO: 293748 - DNA, 20 bp, Artificial
  CRISPR gRNA sequence
ttcttttttttttctttttc

SEQ ID NO: 293749 - DNA, 20 bp, Artificial
  CRISPR gRNA sequence
tcttttttttttctttttct

SEQ ID NO: 293750 - DNA, 20 bp, Artificial
  CRISPR gRNA sequence
cttttttttttctttttctt

SEQ ID NO: 293751 - DNA, 20 bp, Artificial
  CRISPR gRNA sequence
ttttttttttctttttcttt

SEQ ID NO: 293752 - DNA, 20 bp, Artificial
  CRISPR gRNA sequence
ttttttttctttttcttttt

SEQ ID NO: 293753 - DNA, 20 bp, Artificial
  CRISPR gRNA sequence
tttttttctttttctttttt

SEQ ID NO: 293754 - DNA, 20 bp, Artificial
  CRISPR gRNA sequence
ttttttctttttcttttttt

SEQ ID NO: 293755 - DNA, 20 bp, Artificial
  CRISPR gRNA sequence
tttttctttttctttttttt

SEQ ID NO: 293756 - DNA, 20 bp, Artificial
  CRISPR gRNA sequence
ttttctttttcttttttttt

SEQ ID NO: 293757 - DNA, 20 bp, Artificial
  CRISPR gRNA sequence
tttctttttctttttttttt

SEQ ID NO: 293758 - DNA, 20 bp, Artificial
  CRISPR gRNA sequence
ttctttttcttttttttttt

SEQ ID NO: 293759 - DNA, 20 bp, Artificial
  CRISPR gRNA sequence
tctttttctttttttttttt

SEQ ID NO: 293760 - DNA, 20 bp, Artificial
  CRISPR gRNA sequence
ctttttcttttttttttttt

SEQ ID NO: 293761 - DNA, 20 bp, Artificial
  CRISPR gRNA sequence
tttttctttttttttttttt

SEQ ID NO: 293762 - DNA, 20 bp, Artificial
  CRISPR gRNA sequence
tttcttttttttttttttga

SEQ ID NO: 293763 - DNA, 20 bp, Artificial
  CRISPR gRNA sequence
ttcttttttttttttttgag

SEQ ID NO: 293764 - DNA, 20 bp, Artificial
  CRISPR gRNA sequence
tcttttttttttttttgaga

SEQ ID NO: 293765 - DNA, 20 bp, Artificial
  CRISPR gRNA sequence
cttttttttttttttgagac

SEQ ID NO: 293766 - DNA, 20 bp, Artificial
  CRISPR gRNA sequence
ttttttttttttttgagaca

SEQ ID NO: 293767 - DNA, 20 bp, Artificial
  CRISPR gRNA sequence
ttttttttttttgagacaga

SEQ ID NO: 293768 - DNA, 20 bp, Artificial
  CRISPR gRNA sequence
tttttttttttgagacagag

SEQ ID NO: 293769 - DNA, 20 bp, Artificial
  CRISPR gRNA sequence
ttttttttttgagacagagt

SEQ ID NO: 293770 - DNA, 20 bp, Artificial
  CRISPR gRNA sequence
tttttttttgagacagagtt

SEQ ID NO: 293771 - DNA, 20 bp, Artificial
  CRISPR gRNA sequence
ttttttttgagacagagttt

SEQ ID NO: 293772 - DNA, 20 bp, Artificial
  CRISPR gRNA sequence
tttttttgagacagagtttc

SEQ ID NO: 293773 - DNA, 20 bp, Artificial
  CRISPR gRNA sequence
ttttttgagacagagtttca

SEQ ID NO: 293774 - DNA, 20 bp, Artificial
  CRISPR gRNA sequence
tttttgagacagagtttcac

SEQ ID NO: 293775 - DNA, 20 bp, Artificial
  CRISPR gRNA sequence
ttttgagacagagtttcact

SEQ ID NO: 293776 - DNA, 20 bp, Artificial
  CRISPR gRNA sequence
tttgagacagagtttcactc

SEQ ID NO: 293777 - DNA, 20 bp, Artificial
  CRISPR gRNA sequence
ttgagacagagtttcactct

SEQ ID NO: 293778 - DNA, 20 bp, Artificial
  CRISPR gRNA sequence
tgagacagagtttcactctt

SEQ ID NO: 293779 - DNA, 20 bp, Artificial
  CRISPR gRNA sequence
gagacagagtttcactcttg

SEQ ID NO: 293780 - DNA, 20 bp, Artificial
  CRISPR gRNA sequence
agacagagtttcactcttgt

SEQ ID NO: 293781 - DNA, 20 bp, Artificial
  CRISPR gRNA sequence
cactcttgttgcccaggctg

SEQ ID NO: 293782 - DNA, 20 bp, Artificial
  CRISPR gRNA sequence
actcttgttgcccaggctgg

SEQ ID NO: 293783 - DNA, 20 bp, Artificial
  CRISPR gRNA sequence
ttgttgcccaggctggagtg

SEQ ID NO: 293784 - DNA, 20 bp, Artificial
  CRISPR gRNA sequence
gttgcccaggctggagtgca

SEQ ID NO: 293785 - DNA, 20 bp, Artificial
  CRISPR gRNA sequence
ttgcccaggctggagtgcaa

SEQ ID NO: 293786 - DNA, 20 bp, Artificial
  CRISPR gRNA sequence
cccaggctggagtgcaatgg

SEQ ID NO: 293787 - DNA, 20 bp, Artificial
  CRISPR gRNA sequence
gagtgcaatggtgtggtctc

SEQ ID NO: 293788 - DNA, 20 bp, Artificial
  CRISPR gRNA sequence
ggctcactgcaacctctgcc

SEQ ID NO: 293789 - DNA, 20 bp, Artificial
  CRISPR gRNA sequence
actgcaacctctgcctccca

SEQ ID NO: 293790 - DNA, 20 bp, Artificial
  CRISPR gRNA sequence
caacctctgcctcccaggtt

SEQ ID NO: 293791 - DNA, 20 bp, Artificial
  CRISPR gRNA sequence
tgcctcccaggttcaaacga

SEQ ID NO: 293792 - DNA, 20 bp, Artificial
  CRISPR gRNA sequence
cctcccaggttcaaacgatt

SEQ ID NO: 293793 - DNA, 20 bp, Artificial
  CRISPR gRNA sequence
ccaggttcaaacgattctcc

SEQ ID NO: 293794 - DNA, 20 bp, Artificial
  CRISPR gRNA sequence
aaacgattctcctgcctcag

SEQ ID NO: 293795 - DNA, 20 bp, Artificial
  CRISPR gRNA sequence
tcctgcctcagcctcccaag

SEQ ID NO: 293796 - DNA, 20 bp, Artificial
  CRISPR gRNA sequence
ctgcctcagcctcccaagta

SEQ ID NO: 293797 - DNA, 20 bp, Artificial
  CRISPR gRNA sequence
cctcagcctcccaagtagct

SEQ ID NO: 293798 - DNA, 20 bp, Artificial
  CRISPR gRNA sequence
agcctcccaagtagctggga

SEQ ID NO: 293799 - DNA, 20 bp, Artificial
  CRISPR gRNA sequence
ccaagtagctgggattacag

SEQ ID NO: 293800 - DNA, 20 bp, Artificial
  CRISPR gRNA sequence
ggattacaggtgcctgcctc

SEQ ID NO: 293801 - DNA, 20 bp, Artificial
  CRISPR gRNA sequence
caggtgcctgcctccacaac

SEQ ID NO: 293802 - DNA, 20 bp, Artificial
  CRISPR gRNA sequence
cctccacaactggctaattt

SEQ ID NO: 293803 - DNA, 20 bp, Artificial
  CRISPR gRNA sequence
cacaactggctaatttatgt

SEQ ID NO: 293804 - DNA, 20 bp, Artificial
  CRISPR gRNA sequence
gctaatttatgtattttctt

SEQ ID NO: 293805 - DNA, 20 bp, Artificial
  CRISPR gRNA sequence
atttatgtattttcttagtg

SEQ ID NO: 293806 - DNA, 20 bp, Artificial
  CRISPR gRNA sequence
atgtattttcttagtggaga

SEQ ID NO: 293807 - DNA, 20 bp, Artificial
  CRISPR gRNA sequence
tgtattttcttagtggagat

SEQ ID NO: 293808 - DNA, 20 bp, Artificial
  CRISPR gRNA sequence
tcttagtggagatggggttt

SEQ ID NO: 293809 - DNA, 20 bp, Artificial
  CRISPR gRNA sequence
cttagtggagatggggtttc

SEQ ID NO: 293810 - DNA, 20 bp, Artificial
  CRISPR gRNA sequence
ttagtggagatggggtttca

SEQ ID NO: 293811 - DNA, 20 bp, Artificial
  CRISPR gRNA sequence
agtggagatggggtttcacc

SEQ ID NO: 293812 - DNA, 20 bp, Artificial
  CRISPR gRNA sequence
gtggagatggggtttcacca

SEQ ID NO: 293813 - DNA, 20 bp, Artificial
  CRISPR gRNA sequence
caccatgttggtcaggctgg

SEQ ID NO: 293814 - DNA, 20 bp, Artificial
  CRISPR gRNA sequence
accatgttggtcaggctggt

SEQ ID NO: 293815 - DNA, 20 bp, Artificial
  CRISPR gRNA sequence
gtcaggctggtctcgaactc

SEQ ID NO: 293816 - DNA, 20 bp, Artificial
  CRISPR gRNA sequence
gtctcgaactcctgatctca

SEQ ID NO: 293817 - DNA, 20 bp, Artificial
  CRISPR gRNA sequence
gaactcctgatctcaggtga

SEQ ID NO: 293818 - DNA, 20 bp, Artificial
  CRISPR gRNA sequence
ctgatctcaggtgatccatc

SEQ ID NO: 293819 - DNA, 20 bp, Artificial
  CRISPR gRNA sequence
atctcaggtgatccatctgc

SEQ ID NO: 293820 - DNA, 20 bp, Artificial
  CRISPR gRNA sequence
aggtgatccatctgcctcag

SEQ ID NO: 293821 - DNA, 20 bp, Artificial
  CRISPR gRNA sequence
cctcagcctctcaaagcgct

SEQ ID NO: 293822 - DNA, 20 bp, Artificial
  CRISPR gRNA sequence
agcctctcaaagcgctgtga

SEQ ID NO: 293823 - DNA, 20 bp, Artificial
  CRISPR gRNA sequence
tcaaagcgctgtgattacag

SEQ ID NO: 293824 - DNA, 20 bp, Artificial
  CRISPR gRNA sequence
aaagcgctgtgattacaggt

SEQ ID NO: 293825 - DNA, 20 bp, Artificial
  CRISPR gRNA sequence
tgattacaggtgtgagccac

SEQ ID NO: 293826 - DNA, 20 bp, Artificial
  CRISPR gRNA sequence
caggtgtgagccactacacc

SEQ ID NO: 293827 - DNA, 20 bp, Artificial
  CRISPR gRNA sequence
cacccagccacaaaatttca

SEQ ID NO: 293828 - DNA, 20 bp, Artificial
  CRISPR gRNA sequence
catttttaaaaacaggtgca

SEQ ID NO: 293829 - DNA, 20 bp, Artificial
  CRISPR gRNA sequence
atttttaaaaacaggtgcag

SEQ ID NO: 293830 - DNA, 20 bp, Artificial
  CRISPR gRNA sequence
ttaaaaacaggtgcaggaca

SEQ ID NO: 293831 - DNA, 20 bp, Artificial
  CRISPR gRNA sequence
taaaaacaggtgcaggacag

SEQ ID NO: 293832 - DNA, 20 bp, Artificial
  CRISPR gRNA sequence
aaaaacaggtgcaggacagg

SEQ ID NO: 293833 - DNA, 20 bp, Artificial
  CRISPR gRNA sequence
aaaacaggtgcaggacaggt

SEQ ID NO: 293834 - DNA, 20 bp, Artificial
  CRISPR gRNA sequence
ggcccatgtgctatagtttg

SEQ ID NO: 293835 - DNA, 20 bp, Artificial
  CRISPR gRNA sequence
gcccatgtgctatagtttgc

SEQ ID NO: 293836 - DNA, 20 bp, Artificial
  CRISPR gRNA sequence
tagtttgctaacttaaggtt

SEQ ID NO: 293837 - DNA, 20 bp, Artificial
  CRISPR gRNA sequence
gctaacttaaggtttttgtc

SEQ ID NO: 293838 - DNA, 20 bp, Artificial
  CRISPR gRNA sequence
ctaacttaaggtttttgtct

SEQ ID NO: 293839 - DNA, 20 bp, Artificial
  CRISPR gRNA sequence
acttaaggtttttgtctttg

SEQ ID NO: 293840 - DNA, 20 bp, Artificial
  CRISPR gRNA sequence
aaggtttttgtctttgtggc

SEQ ID NO: 293841 - DNA, 20 bp, Artificial
  CRISPR gRNA sequence
aggtttttgtctttgtggct

SEQ ID NO: 293842 - DNA, 20 bp, Artificial
  CRISPR gRNA sequence
ttgtctttgtggctggagag

SEQ ID NO: 293843 - DNA, 20 bp, Artificial
  CRISPR gRNA sequence
tgtctttgtggctggagagc

SEQ ID NO: 293844 - DNA, 20 bp, Artificial
  CRISPR gRNA sequence
gtctttgtggctggagagct

SEQ ID NO: 293845 - DNA, 20 bp, Artificial
  CRISPR gRNA sequence
tctttgtggctggagagctt

SEQ ID NO: 293846 - DNA, 20 bp, Artificial
  CRISPR gRNA sequence
tgtggctggagagctttagg

SEQ ID NO: 293847 - DNA, 20 bp, Artificial
  CRISPR gRNA sequence
gtggctggagagctttaggg

SEQ ID NO: 293848 - DNA, 20 bp, Artificial
  CRISPR gRNA sequence
tggctggagagctttagggt

SEQ ID NO: 293849 - DNA, 20 bp, Artificial
  CRISPR gRNA sequence
gagagctttagggtataaat

SEQ ID NO: 293850 - DNA, 20 bp, Artificial
  CRISPR gRNA sequence
tagggtataaatgtctcaaa

SEQ ID NO: 293851 - DNA, 20 bp, Artificial
  CRISPR gRNA sequence
agggtataaatgtctcaaat

SEQ ID NO: 293852 - DNA, 20 bp, Artificial
  CRISPR gRNA sequence
gggtataaatgtctcaaatc

SEQ ID NO: 293853 - DNA, 20 bp, Artificial
  CRISPR gRNA sequence
aaatctcattaattggactg

SEQ ID NO: 293854 - DNA, 20 bp, Artificial
  CRISPR gRNA sequence
attaattggactgtgtgggg

SEQ ID NO: 293855 - DNA, 20 bp, Artificial
  CRISPR gRNA sequence
attggactgtgtggggattc

SEQ ID NO: 293856 - DNA, 20 bp, Artificial
  CRISPR gRNA sequence
gactgtgtggggattcttta

SEQ ID NO: 293857 - DNA, 20 bp, Artificial
  CRISPR gRNA sequence
tgtggggattctttagaata

SEQ ID NO: 293858 - DNA, 20 bp, Artificial
  CRISPR gRNA sequence
tttagaataagattcaaaag

SEQ ID NO: 293859 - DNA, 20 bp, Artificial
  CRISPR gRNA sequence
tagaataagattcaaaagca

SEQ ID NO: 293860 - DNA, 20 bp, Artificial
  CRISPR gRNA sequence
agaataagattcaaaagcaa

SEQ ID NO: 293861 - DNA, 20 bp, Artificial
  CRISPR gRNA sequence
gaataagattcaaaagcaaa

SEQ ID NO: 293862 - DNA, 20 bp, Artificial
  CRISPR gRNA sequence
aaaagcaaataatgcattta

SEQ ID NO: 293863 - DNA, 20 bp, Artificial
  CRISPR gRNA sequence
ataggaggtcaagggctgac

SEQ ID NO: 293864 - DNA, 20 bp, Artificial
  CRISPR gRNA sequence
taggaggtcaagggctgact

SEQ ID NO: 293865 - DNA, 20 bp, Artificial
  CRISPR gRNA sequence
actgcactaacaaatataca

SEQ ID NO: 293866 - DNA, 20 bp, Artificial
  CRISPR gRNA sequence
cactaacaaatatacattaa

SEQ ID NO: 293867 - DNA, 20 bp, Artificial
  CRISPR gRNA sequence
acaaatatacattaagtgta

SEQ ID NO: 293868 - DNA, 20 bp, Artificial
  CRISPR gRNA sequence
agtgtatagtacatagaaat

SEQ ID NO: 293869 - DNA, 20 bp, Artificial
  CRISPR gRNA sequence
caggtcagggtgagtaaagc

SEQ ID NO: 293870 - DNA, 20 bp, Artificial
  CRISPR gRNA sequence
tgaggtgaaaatgtattagt

SEQ ID NO: 293871 - DNA, 20 bp, Artificial
  CRISPR gRNA sequence
gaggtgaaaatgtattagtc

SEQ ID NO: 293872 - DNA, 20 bp, Artificial
  CRISPR gRNA sequence
aggtgaaaatgtattagtcc

SEQ ID NO: 293873 - DNA, 20 bp, Artificial
  CRISPR gRNA sequence
gtcccttttcatgctgctga

SEQ ID NO: 293874 - DNA, 20 bp, Artificial
  CRISPR gRNA sequence
ttcatgctgctgataaagac

SEQ ID NO: 293875 - DNA, 20 bp, Artificial
  CRISPR gRNA sequence
tcatgctgctgataaagaca

SEQ ID NO: 293876 - DNA, 20 bp, Artificial
  CRISPR gRNA sequence
catgctgctgataaagacat

SEQ ID NO: 293877 - DNA, 20 bp, Artificial
  CRISPR gRNA sequence
atgctgctgataaagacata

SEQ ID NO: 293878 - DNA, 20 bp, Artificial
  CRISPR gRNA sequence
ctgataaagacatacccgag

SEQ ID NO: 293879 - DNA, 20 bp, Artificial
  CRISPR gRNA sequence
ataaagacatacccgagact

SEQ ID NO: 293880 - DNA, 20 bp, Artificial
  CRISPR gRNA sequence
ggcaacttacaaaataaaga

SEQ ID NO: 293881 - DNA, 20 bp, Artificial
  CRISPR gRNA sequence
acaaaataaagaggtttaat

SEQ ID NO: 293882 - DNA, 20 bp, Artificial
  CRISPR gRNA sequence
caaaataaagaggtttaatt

SEQ ID NO: 293883 - DNA, 20 bp, Artificial
  CRISPR gRNA sequence
aattagactcacagttccac

SEQ ID NO: 293884 - DNA, 20 bp, Artificial
  CRISPR gRNA sequence
attagactcacagttccacg

SEQ ID NO: 293885 - DNA, 20 bp, Artificial
  CRISPR gRNA sequence
gactcacagttccacgtggc

SEQ ID NO: 293886 - DNA, 20 bp, Artificial
  CRISPR gRNA sequence
acagttccacgtggctgggg

SEQ ID NO: 293887 - DNA, 20 bp, Artificial
  CRISPR gRNA sequence
cacgtggctggggaggcctc

SEQ ID NO: 293888 - DNA, 20 bp, Artificial
  CRISPR gRNA sequence
gggaggcctcacaaatcatg

SEQ ID NO: 293889 - DNA, 20 bp, Artificial
  CRISPR gRNA sequence
acaaatcatggcagaaggca

SEQ ID NO: 293890 - DNA, 20 bp, Artificial
  CRISPR gRNA sequence
atgtggatggcagcagccaa

SEQ ID NO: 293891 - DNA, 20 bp, Artificial
  CRISPR gRNA sequence
tgtggatggcagcagccaaa

SEQ ID NO: 293892 - DNA, 20 bp, Artificial
  CRISPR gRNA sequence
gttataaggaaactcctgtt

SEQ ID NO: 293893 - DNA, 20 bp, Artificial
  CRISPR gRNA sequence
ttataaggaaactcctgttt

SEQ ID NO: 293894 - DNA, 20 bp, Artificial
  CRISPR gRNA sequence
taaggaaactcctgttttta

SEQ ID NO: 293895 - DNA, 20 bp, Artificial
  CRISPR gRNA sequence
ctgtttttaaactatcagat

SEQ ID NO: 293896 - DNA, 20 bp, Artificial
  CRISPR gRNA sequence
tttttaaactatcagatctc

SEQ ID NO: 293897 - DNA, 20 bp, Artificial
  CRISPR gRNA sequence
ttaaactatcagatctcgtg

SEQ ID NO: 293898 - DNA, 20 bp, Artificial
  CRISPR gRNA sequence
taaactatcagatctcgtga

SEQ ID NO: 293899 - DNA, 20 bp, Artificial
  CRISPR gRNA sequence
aaactatcagatctcgtgag

SEQ ID NO: 293900 - DNA, 20 bp, Artificial
  CRISPR gRNA sequence
aactatcagatctcgtgaga

SEQ ID NO: 293901 - DNA, 20 bp, Artificial
  CRISPR gRNA sequence
tcagatctcgtgagactcat

SEQ ID NO: 293902 - DNA, 20 bp, Artificial
  CRISPR gRNA sequence
gtgagactcattaactatca

SEQ ID NO: 293903 - DNA, 20 bp, Artificial
  CRISPR gRNA sequence
attaactatcacaaggacag

SEQ ID NO: 293904 - DNA, 20 bp, Artificial
  CRISPR gRNA sequence
actatcacaaggacagtgca

SEQ ID NO: 293905 - DNA, 20 bp, Artificial
  CRISPR gRNA sequence
tcacaaggacagtgcaggaa

SEQ ID NO: 293906 - DNA, 20 bp, Artificial
  CRISPR gRNA sequence
gcccccataattcagtcacc

SEQ ID NO: 293907 - DNA, 20 bp, Artificial
  CRISPR gRNA sequence
agtcacctcccactgggttc

SEQ ID NO: 293908 - DNA, 20 bp, Artificial
  CRISPR gRNA sequence
ccactgggttcctcccatga

SEQ ID NO: 293909 - DNA, 20 bp, Artificial
  CRISPR gRNA sequence
ggttcctcccatgacatgtg

SEQ ID NO: 293910 - DNA, 20 bp, Artificial
  CRISPR gRNA sequence
ctcccatgacatgtggcaac

SEQ ID NO: 293911 - DNA, 20 bp, Artificial
  CRISPR gRNA sequence
ccatgacatgtggcaactgt

SEQ ID NO: 293912 - DNA, 20 bp, Artificial
  CRISPR gRNA sequence
tgggagttataattcaagat

SEQ ID NO: 293913 - DNA, 20 bp, Artificial
  CRISPR gRNA sequence
taattcaagatgagatttgg

SEQ ID NO: 293914 - DNA, 20 bp, Artificial
  CRISPR gRNA sequence
aagatgagatttgggtgggg

SEQ ID NO: 293915 - DNA, 20 bp, Artificial
  CRISPR gRNA sequence
gggtggggacacagccaaac

SEQ ID NO: 293916 - DNA, 20 bp, Artificial
  CRISPR gRNA sequence
ggtggggacacagccaaacc

SEQ ID NO: 293917 - DNA, 20 bp, Artificial
  CRISPR gRNA sequence
atttggaaaaaaaaaaaaag

SEQ ID NO: 293918 - DNA, 20 bp, Artificial
  CRISPR gRNA sequence
ggaaaaaaaaaaaaagccca

SEQ ID NO: 293919 - DNA, 20 bp, Artificial
  CRISPR gRNA sequence
gaaaaaaaaaaaaagcccaa

SEQ ID NO: 293920 - DNA, 20 bp, Artificial
  CRISPR gRNA sequence
attaagcggattgcgcatat

SEQ ID NO: 293921 - DNA, 20 bp, Artificial
  CRISPR gRNA sequence
agcggattgcgcatatgatt

SEQ ID NO: 293922 - DNA, 20 bp, Artificial
  CRISPR gRNA sequence
cgcatatgattctttttagt

SEQ ID NO: 293923 - DNA, 20 bp, Artificial
  CRISPR gRNA sequence
tttttagtgtagtctcacca

SEQ ID NO: 293924 - DNA, 20 bp, Artificial
  CRISPR gRNA sequence
tttagtgtagtctcaccaaa

SEQ ID NO: 293925 - DNA, 20 bp, Artificial
  CRISPR gRNA sequence
ttagtgtagtctcaccaaat

SEQ ID NO: 293926 - DNA, 20 bp, Artificial
  CRISPR gRNA sequence
tagtgtagtctcaccaaatt

SEQ ID NO: 293927 - DNA, 20 bp, Artificial
  CRISPR gRNA sequence
agtgtagtctcaccaaattt

SEQ ID NO: 293928 - DNA, 20 bp, Artificial
  CRISPR gRNA sequence
gtgtagtctcaccaaatttg

SEQ ID NO: 293929 - DNA, 20 bp, Artificial
  CRISPR gRNA sequence
accaaatttgttttcccttg

SEQ ID NO: 293930 - DNA, 20 bp, Artificial
  CRISPR gRNA sequence
gttttcccttgataaactgg

SEQ ID NO: 293931 - DNA, 20 bp, Artificial
  CRISPR gRNA sequence
ttttcccttgataaactgga

SEQ ID NO: 293932 - DNA, 20 bp, Artificial
  CRISPR gRNA sequence
tcccttgataaactggaagg

SEQ ID NO: 293933 - DNA, 20 bp, Artificial
  CRISPR gRNA sequence
cccttgataaactggaagga

SEQ ID NO: 293934 - DNA, 20 bp, Artificial
  CRISPR gRNA sequence
ccttgataaactggaaggag

SEQ ID NO: 293935 - DNA, 20 bp, Artificial
  CRISPR gRNA sequence
gataaactggaaggagatac

SEQ ID NO: 293936 - DNA, 20 bp, Artificial
  CRISPR gRNA sequence
ataaactggaaggagataca

SEQ ID NO: 293937 - DNA, 20 bp, Artificial
  CRISPR gRNA sequence
gaaggagatacatctgagag

SEQ ID NO: 293938 - DNA, 20 bp, Artificial
  CRISPR gRNA sequence
agagagtcatactcatggta

SEQ ID NO: 293939 - DNA, 20 bp, Artificial
  CRISPR gRNA sequence
atggtatctaataagctaca

SEQ ID NO: 293940 - DNA, 20 bp, Artificial
  CRISPR gRNA sequence
ataagctacatgtgcagatg

SEQ ID NO: 293941 - DNA, 20 bp, Artificial
  CRISPR gRNA sequence
catgtgcagatgccctcaca

SEQ ID NO: 293942 - DNA, 20 bp, Artificial
  CRISPR gRNA sequence
acaccgctctgtaccttgga

SEQ ID NO: 293943 - DNA, 20 bp, Artificial
  CRISPR gRNA sequence
tgtaccttggattctgggtc

SEQ ID NO: 293944 - DNA, 20 bp, Artificial
  CRISPR gRNA sequence
taccttggattctgggtctg

SEQ ID NO: 293945 - DNA, 20 bp, Artificial
  CRISPR gRNA sequence
ggattctgggtctgcccctg

SEQ ID NO: 293946 - DNA, 20 bp, Artificial
  CRISPR gRNA sequence
gattctgggtctgcccctgt

SEQ ID NO: 293947 - DNA, 20 bp, Artificial
  CRISPR gRNA sequence
tgggtctgcccctgtgggat

SEQ ID NO: 293948 - DNA, 20 bp, Artificial
  CRISPR gRNA sequence
ggtctgcccctgtgggatgt

SEQ ID NO: 293949 - DNA, 20 bp, Artificial
  CRISPR gRNA sequence
cccctgtgggatgttaccag

SEQ ID NO: 293950 - DNA, 20 bp, Artificial
  CRISPR gRNA sequence
tgggatgttaccaggtttct

SEQ ID NO: 293951 - DNA, 20 bp, Artificial
  CRISPR gRNA sequence
ccaggtttctaacaggtgtc

SEQ ID NO: 293952 - DNA, 20 bp, Artificial
  CRISPR gRNA sequence
ctaacaggtgtcacaataga

SEQ ID NO: 293953 - DNA, 20 bp, Artificial
  CRISPR gRNA sequence
taacaggtgtcacaatagac

SEQ ID NO: 293954 - DNA, 20 bp, Artificial
  CRISPR gRNA sequence
acaggtgtcacaatagacct

SEQ ID NO: 293955 - DNA, 20 bp, Artificial
  CRISPR gRNA sequence
gcttgctgctactgaggcct

SEQ ID NO: 293956 - DNA, 20 bp, Artificial
  CRISPR gRNA sequence
gctgctactgaggcctccct

SEQ ID NO: 293957 - DNA, 20 bp, Artificial
  CRISPR gRNA sequence
ctgctactgaggcctccctc

SEQ ID NO: 293958 - DNA, 20 bp, Artificial
  CRISPR gRNA sequence
ctactgaggcctccctcttt

SEQ ID NO: 293959 - DNA, 20 bp, Artificial
  CRISPR gRNA sequence
ctgaggcctccctctttccc

SEQ ID NO: 293960 - DNA, 20 bp, Artificial
  CRISPR gRNA sequence
aggcctccctctttccctca

SEQ ID NO: 293961 - DNA, 20 bp, Artificial
  CRISPR gRNA sequence
cctctttccctcacacacat

SEQ ID NO: 293962 - DNA, 20 bp, Artificial
  CRISPR gRNA sequence
tttccctcacacacatactc

SEQ ID NO: 293963 - DNA, 20 bp, Artificial
  CRISPR gRNA sequence
tccctcacacacatactctc

SEQ ID NO: 293964 - DNA, 20 bp, Artificial
  CRISPR gRNA sequence
ccctcacacacatactctct

SEQ ID NO: 293965 - DNA, 20 bp, Artificial
  CRISPR gRNA sequence
cctcacacacatactctctc

SEQ ID NO: 293966 - DNA, 20 bp, Artificial
  CRISPR gRNA sequence
acacacatactctctctagg

SEQ ID NO: 293967 - DNA, 20 bp, Artificial
  CRISPR gRNA sequence
tctctaggttgaatgaggct

SEQ ID NO: 293968 - DNA, 20 bp, Artificial
  CRISPR gRNA sequence
tctaggttgaatgaggcttg

SEQ ID NO: 293969 - DNA, 20 bp, Artificial
  CRISPR gRNA sequence
taggttgaatgaggcttgtg

SEQ ID NO: 293970 - DNA, 20 bp, Artificial
  CRISPR gRNA sequence
ggttgaatgaggcttgtgga

SEQ ID NO: 293971 - DNA, 20 bp, Artificial
  CRISPR gRNA sequence
aatgaggcttgtggatgggt

SEQ ID NO: 293972 - DNA, 20 bp, Artificial
  CRISPR gRNA sequence
gtggatgggtgtggagtgga

SEQ ID NO: 293973 - DNA, 20 bp, Artificial
  CRISPR gRNA sequence
tggatgggtgtggagtggaa

SEQ ID NO: 293974 - DNA, 20 bp, Artificial
  CRISPR gRNA sequence
aagcctgtgaaacttctaga

SEQ ID NO: 293975 - DNA, 20 bp, Artificial
  CRISPR gRNA sequence
tgaaacttctagactcccag

SEQ ID NO: 293976 - DNA, 20 bp, Artificial
  CRISPR gRNA sequence
ctagactcccaggataacag

SEQ ID NO: 293977 - DNA, 20 bp, Artificial
  CRISPR gRNA sequence
tagactcccaggataacagc

SEQ ID NO: 293978 - DNA, 20 bp, Artificial
  CRISPR gRNA sequence
gactcccaggataacagcaa

SEQ ID NO: 293979 - DNA, 20 bp, Artificial
  CRISPR gRNA sequence
ccaggataacagcaatggct

SEQ ID NO: 293980 - DNA, 20 bp, Artificial
  CRISPR gRNA sequence
gttattttttgtgtcattct

SEQ ID NO: 293981 - DNA, 20 bp, Artificial
  CRISPR gRNA sequence
ttattttttgtgtcattcta

SEQ ID NO: 293982 - DNA, 20 bp, Artificial
  CRISPR gRNA sequence
ttttttgtgtcattctaatc

SEQ ID NO: 293983 - DNA, 20 bp, Artificial
  CRISPR gRNA sequence
tttgtgtcattctaatctgt

SEQ ID NO: 293984 - DNA, 20 bp, Artificial
  CRISPR gRNA sequence
ttgtgtcattctaatctgta

SEQ ID NO: 293985 - DNA, 20 bp, Artificial
  CRISPR gRNA sequence
tgtgtcattctaatctgtag

SEQ ID NO: 293986 - DNA, 20 bp, Artificial
  CRISPR gRNA sequence
gtgtcattctaatctgtaga

SEQ ID NO: 293987 - DNA, 20 bp, Artificial
  CRISPR gRNA sequence
tgtcattctaatctgtagag

SEQ ID NO: 293988 - DNA, 20 bp, Artificial
  CRISPR gRNA sequence
taatctgtagaggtcaactc

SEQ ID NO: 293989 - DNA, 20 bp, Artificial
  CRISPR gRNA sequence
atctgtagaggtcaactctg

SEQ ID NO: 293990 - DNA, 20 bp, Artificial
  CRISPR gRNA sequence
tagaggtcaactctggtaat

SEQ ID NO: 293991 - DNA, 20 bp, Artificial
  CRISPR gRNA sequence
tggtaatcacttgatgtctc

SEQ ID NO: 293992 - DNA, 20 bp, Artificial
  CRISPR gRNA sequence
gtaatcacttgatgtctcca

SEQ ID NO: 293993 - DNA, 20 bp, Artificial
  CRISPR gRNA sequence
gatgtctccattcaatctgg

SEQ ID NO: 293994 - DNA, 20 bp, Artificial
  CRISPR gRNA sequence
atgtctccattcaatctggt

SEQ ID NO: 293995 - DNA, 20 bp, Artificial
  CRISPR gRNA sequence
cattcaatctggtgttttag

SEQ ID NO: 293996 - DNA, 20 bp, Artificial
  CRISPR gRNA sequence
aatctggtgttttagagaaa

SEQ ID NO: 293997 - DNA, 20 bp, Artificial
  CRISPR gRNA sequence
gtgttttagagaaaaaagaa

SEQ ID NO: 293998 - DNA, 20 bp, Artificial
  CRISPR gRNA sequence
tagagaaaaaagaaaaacca

SEQ ID NO: 293999 - DNA, 20 bp, Artificial
  CRISPR gRNA sequence
agagaaaaaagaaaaaccaa

SEQ ID NO: 294000 - DNA, 20 bp, Artificial
  CRISPR gRNA sequence
gagaaaaaagaaaaaccaac

SEQ ID NO: 294001 - DNA, 20 bp, Artificial
  CRISPR gRNA sequence
tcctgtctttaagtggtagg

SEQ ID NO: 294002 - DNA, 20 bp, Artificial
  CRISPR gRNA sequence
tctttaagtggtaggtacac

SEQ ID NO: 294003 - DNA, 20 bp, Artificial
  CRISPR gRNA sequence
taagtggtaggtacactatg

SEQ ID NO: 294004 - DNA, 20 bp, Artificial
  CRISPR gRNA sequence
aagtggtaggtacactatga

SEQ ID NO: 294005 - DNA, 20 bp, Artificial
  CRISPR gRNA sequence
agtggtaggtacactatgat

SEQ ID NO: 294006 - DNA, 20 bp, Artificial
  CRISPR gRNA sequence
tgattaaataggtgtttcag

SEQ ID NO: 294007 - DNA, 20 bp, Artificial
  CRISPR gRNA sequence
aataggtgtttcagaatgat

SEQ ID NO: 294008 - DNA, 20 bp, Artificial
  CRISPR gRNA sequence
cagaatgattactgtgacag

SEQ ID NO: 294009 - DNA, 20 bp, Artificial
  CRISPR gRNA sequence
agaatgattactgtgacagc

SEQ ID NO: 294010 - DNA, 20 bp, Artificial
  CRISPR gRNA sequence
ctgtgacagcaatgtgcagg

SEQ ID NO: 294011 - DNA, 20 bp, Artificial
  CRISPR gRNA sequence
tgacagcaatgtgcaggagt

SEQ ID NO: 294012 - DNA, 20 bp, Artificial
  CRISPR gRNA sequence
ttagagcctaggaaacctga

SEQ ID NO: 294013 - DNA, 20 bp, Artificial
  CRISPR gRNA sequence
gagcctaggaaacctgaggc

SEQ ID NO: 294014 - DNA, 20 bp, Artificial
  CRISPR gRNA sequence
ggaaacctgaggcaaagaga

SEQ ID NO: 294015 - DNA, 20 bp, Artificial
  CRISPR gRNA sequence
aggcaaagagaccggtttgc

SEQ ID NO: 294016 - DNA, 20 bp, Artificial
  CRISPR gRNA sequence
gcaggctactaggtgggaga

SEQ ID NO: 294017 - DNA, 20 bp, Artificial
  CRISPR gRNA sequence
caggctactaggtgggagat

SEQ ID NO: 294018 - DNA, 20 bp, Artificial
  CRISPR gRNA sequence
ctaggtgggagatgagaaaa

SEQ ID NO: 294019 - DNA, 20 bp, Artificial
  CRISPR gRNA sequence
ggtgggagatgagaaaaatc

SEQ ID NO: 294020 - DNA, 20 bp, Artificial
  CRISPR gRNA sequence
agctaaggcagttgctgcaa

SEQ ID NO: 294021 - DNA, 20 bp, Artificial
  CRISPR gRNA sequence
aggcagttgctgcaagagat

SEQ ID NO: 294022 - DNA, 20 bp, Artificial
  CRISPR gRNA sequence
ctgcaagagatttgggaaaa

SEQ ID NO: 294023 - DNA, 20 bp, Artificial
  CRISPR gRNA sequence
caagagatttgggaaaaagc

SEQ ID NO: 294024 - DNA, 20 bp, Artificial
  CRISPR gRNA sequence
gggaaaaagcagtaagttcc

SEQ ID NO: 294025 - DNA, 20 bp, Artificial
  CRISPR gRNA sequence
ggaaaaagcagtaagttcca

SEQ ID NO: 294026 - DNA, 20 bp, Artificial
  CRISPR gRNA sequence
cagagatattctgaatatag

SEQ ID NO: 294027 - DNA, 20 bp, Artificial
  CRISPR gRNA sequence
tgaatatagaacagaaaata

SEQ ID NO: 294028 - DNA, 20 bp, Artificial
  CRISPR gRNA sequence
aatatagaacagaaaataca

SEQ ID NO: 294029 - DNA, 20 bp, Artificial
  CRISPR gRNA sequence
ctgggaagtgagcacaaaga

SEQ ID NO: 294030 - DNA, 20 bp, Artificial
  CRISPR gRNA sequence
ggaagtgagcacaaagaaaa

SEQ ID NO: 294031 - DNA, 20 bp, Artificial
  CRISPR gRNA sequence
ttatttgggtaactaaatgg

SEQ ID NO: 294032 - DNA, 20 bp, Artificial
  CRISPR gRNA sequence
atttgggtaactaaatggta

SEQ ID NO: 294033 - DNA, 20 bp, Artificial
  CRISPR gRNA sequence
tttgggtaactaaatggtat

SEQ ID NO: 294034 - DNA, 20 bp, Artificial
  CRISPR gRNA sequence
gggtaactaaatggtattgt

SEQ ID NO: 294035 - DNA, 20 bp, Artificial
  CRISPR gRNA sequence
ggtaactaaatggtattgtt

SEQ ID NO: 294036 - DNA, 20 bp, Artificial
  CRISPR gRNA sequence
aatggtattgttattcactg

SEQ ID NO: 294037 - DNA, 20 bp, Artificial
  CRISPR gRNA sequence
ttattcactgaaatgggaga

SEQ ID NO: 294038 - DNA, 20 bp, Artificial
  CRISPR gRNA sequence
ttcactgaaatgggagaata

SEQ ID NO: 294039 - DNA, 20 bp, Artificial
  CRISPR gRNA sequence
actgaaatgggagaatacag

SEQ ID NO: 294040 - DNA, 20 bp, Artificial
  CRISPR gRNA sequence
aaatgggagaatacagctgg

SEQ ID NO: 294041 - DNA, 20 bp, Artificial
  CRISPR gRNA sequence
gtagatatgatttggaaagc

SEQ ID NO: 294042 - DNA, 20 bp, Artificial
  CRISPR gRNA sequence
ggaaagcaggtagtaaattc

SEQ ID NO: 294043 - DNA, 20 bp, Artificial
  CRISPR gRNA sequence
gaaagcaggtagtaaattca

SEQ ID NO: 294044 - DNA, 20 bp, Artificial
  CRISPR gRNA sequence
agttttaatcaggtggagat

SEQ ID NO: 294045 - DNA, 20 bp, Artificial
  CRISPR gRNA sequence
taatcaggtggagatgctgg

SEQ ID NO: 294046 - DNA, 20 bp, Artificial
  CRISPR gRNA sequence
aatcaggtggagatgctggc

SEQ ID NO: 294047 - DNA, 20 bp, Artificial
  CRISPR gRNA sequence
atcaggtggagatgctggca

SEQ ID NO: 294048 - DNA, 20 bp, Artificial
  CRISPR gRNA sequence
gcatccatccaatatacaaa

SEQ ID NO: 294049 - DNA, 20 bp, Artificial
  CRISPR gRNA sequence
agaaatcagatggcacttct

SEQ ID NO: 294050 - DNA, 20 bp, Artificial
  CRISPR gRNA sequence
gaaatcagatggcacttctt

SEQ ID NO: 294051 - DNA, 20 bp, Artificial
  CRISPR gRNA sequence
cttttttttttttttctttg

SEQ ID NO: 294052 - DNA, 20 bp, Artificial
  CRISPR gRNA sequence
ttttttttttttttctttgt

SEQ ID NO: 294053 - DNA, 20 bp, Artificial
  CRISPR gRNA sequence
ttttttttttttctttgtct

SEQ ID NO: 294054 - DNA, 20 bp, Artificial
  CRISPR gRNA sequence
tttttttttttctttgtctt

SEQ ID NO: 294055 - DNA, 20 bp, Artificial
  CRISPR gRNA sequence
ttttttttttctttgtcttt

SEQ ID NO: 294056 - DNA, 20 bp, Artificial
  CRISPR gRNA sequence
tttttttttctttgtctttt

SEQ ID NO: 294057 - DNA, 20 bp, Artificial
  CRISPR gRNA sequence
ttttttttctttgtcttttt

SEQ ID NO: 294058 - DNA, 20 bp, Artificial
  CRISPR gRNA sequence
tttttttctttgtctttttc

SEQ ID NO: 294059 - DNA, 20 bp, Artificial
  CRISPR gRNA sequence
ttttttctttgtctttttct

SEQ ID NO: 294060 - DNA, 20 bp, Artificial
  CRISPR gRNA sequence
tttttctttgtctttttctg

SEQ ID NO: 294061 - DNA, 20 bp, Artificial
  CRISPR gRNA sequence
ttttctttgtctttttctga

SEQ ID NO: 294062 - DNA, 20 bp, Artificial
  CRISPR gRNA sequence
tttctttgtctttttctgag

SEQ ID NO: 294063 - DNA, 20 bp, Artificial
  CRISPR gRNA sequence
ttctttgtctttttctgaga

SEQ ID NO: 294064 - DNA, 20 bp, Artificial
  CRISPR gRNA sequence
tctttgtctttttctgagat

SEQ ID NO: 294065 - DNA, 20 bp, Artificial
  CRISPR gRNA sequence
ctttgtctttttctgagata

SEQ ID NO: 294066 - DNA, 20 bp, Artificial
  CRISPR gRNA sequence
tttgtctttttctgagatag

SEQ ID NO: 294067 - DNA, 20 bp, Artificial
  CRISPR gRNA sequence
tgtctttttctgagatagat

SEQ ID NO: 294068 - DNA, 20 bp, Artificial
  CRISPR gRNA sequence
gtctttttctgagatagatt

SEQ ID NO: 294069 - DNA, 20 bp, Artificial
  CRISPR gRNA sequence
tctttttctgagatagattc

SEQ ID NO: 294070 - DNA, 20 bp, Artificial
  CRISPR gRNA sequence
tttctgagatagattctcac

SEQ ID NO: 294071 - DNA, 20 bp, Artificial
  CRISPR gRNA sequence
ttctgagatagattctcact

SEQ ID NO: 294072 - DNA, 20 bp, Artificial
  CRISPR gRNA sequence
tctgagatagattctcactc

SEQ ID NO: 294073 - DNA, 20 bp, Artificial
  CRISPR gRNA sequence
ctgagatagattctcactct

SEQ ID NO: 294074 - DNA, 20 bp, Artificial
  CRISPR gRNA sequence
tgagatagattctcactctg

SEQ ID NO: 294075 - DNA, 20 bp, Artificial
  CRISPR gRNA sequence
agatagattctcactctgtc

SEQ ID NO: 294076 - DNA, 20 bp, Artificial
  CRISPR gRNA sequence
tcactctgtcacccaggctg

SEQ ID NO: 294077 - DNA, 20 bp, Artificial
  CRISPR gRNA sequence
actctgtcacccaggctgga

SEQ ID NO: 294078 - DNA, 20 bp, Artificial
  CRISPR gRNA sequence
tgtcacccaggctggagtgc

SEQ ID NO: 294079 - DNA, 20 bp, Artificial
  CRISPR gRNA sequence
tcacccaggctggagtgcaa

SEQ ID NO: 294080 - DNA, 20 bp, Artificial
  CRISPR gRNA sequence
gagtgcaatcttggctcatt

SEQ ID NO: 294081 - DNA, 20 bp, Artificial
  CRISPR gRNA sequence
ggctcattgcaacctctgtc

SEQ ID NO: 294082 - DNA, 20 bp, Artificial
  CRISPR gRNA sequence
gctcattgcaacctctgtct

SEQ ID NO: 294083 - DNA, 20 bp, Artificial
  CRISPR gRNA sequence
attgcaacctctgtctccct

SEQ ID NO: 294084 - DNA, 20 bp, Artificial
  CRISPR gRNA sequence
caacctctgtctccctggtt

SEQ ID NO: 294085 - DNA, 20 bp, Artificial
  CRISPR gRNA sequence
tgtctccctggttcaagcaa

SEQ ID NO: 294086 - DNA, 20 bp, Artificial
  CRISPR gRNA sequence
tctccctggttcaagcaatt

SEQ ID NO: 294087 - DNA, 20 bp, Artificial
  CRISPR gRNA sequence
cctggttcaagcaattctct

SEQ ID NO: 294088 - DNA, 20 bp, Artificial
  CRISPR gRNA sequence
gttcaagcaattctcttgct

SEQ ID NO: 294089 - DNA, 20 bp, Artificial
  CRISPR gRNA sequence
aagcaattctcttgcttcag

SEQ ID NO: 294090 - DNA, 20 bp, Artificial
  CRISPR gRNA sequence
tcttgcttcagcctcctgag

SEQ ID NO: 294091 - DNA, 20 bp, Artificial
  CRISPR gRNA sequence
ttgcttcagcctcctgagta

SEQ ID NO: 294092 - DNA, 20 bp, Artificial
  CRISPR gRNA sequence
gcttcagcctcctgagtacc

SEQ ID NO: 294093 - DNA, 20 bp, Artificial
  CRISPR gRNA sequence
cttcagcctcctgagtacct

SEQ ID NO: 294094 - DNA, 20 bp, Artificial
  CRISPR gRNA sequence
cagcctcctgagtacctggg

SEQ ID NO: 294095 - DNA, 20 bp, Artificial
  CRISPR gRNA sequence
agcctcctgagtacctggga

SEQ ID NO: 294096 - DNA, 20 bp, Artificial
  CRISPR gRNA sequence
ctgagtacctgggattggta

SEQ ID NO: 294097 - DNA, 20 bp, Artificial
  CRISPR gRNA sequence
agtacctgggattggtactc

SEQ ID NO: 294098 - DNA, 20 bp, Artificial
  CRISPR gRNA sequence
ggattggtactcgccaccga

SEQ ID NO: 294099 - DNA, 20 bp, Artificial
  CRISPR gRNA sequence
gtactcgccaccgataattt

SEQ ID NO: 294100 - DNA, 20 bp, Artificial
  CRISPR gRNA sequence
gccaccgataattttttgta

SEQ ID NO: 294101 - DNA, 20 bp, Artificial
  CRISPR gRNA sequence
tttgtacttttagtagagac

SEQ ID NO: 294102 - DNA, 20 bp, Artificial
  CRISPR gRNA sequence
ttgtacttttagtagagaca

SEQ ID NO: 294103 - DNA, 20 bp, Artificial
  CRISPR gRNA sequence
tgtacttttagtagagacag

SEQ ID NO: 294104 - DNA, 20 bp, Artificial
  CRISPR gRNA sequence
gtacttttagtagagacagg

SEQ ID NO: 294105 - DNA, 20 bp, Artificial
  CRISPR gRNA sequence
tacttttagtagagacaggg

SEQ ID NO: 294106 - DNA, 20 bp, Artificial
  CRISPR gRNA sequence
ttagtagagacagggtttca

SEQ ID NO: 294107 - DNA, 20 bp, Artificial
  CRISPR gRNA sequence
tagtagagacagggtttcac

SEQ ID NO: 294108 - DNA, 20 bp, Artificial
  CRISPR gRNA sequence
agtagagacagggtttcact

SEQ ID NO: 294109 - DNA, 20 bp, Artificial
  CRISPR gRNA sequence
gtagagacagggtttcacta

SEQ ID NO: 294110 - DNA, 20 bp, Artificial
  CRISPR gRNA sequence
cactatgttggccaggctgg

SEQ ID NO: 294111 - DNA, 20 bp, Artificial
  CRISPR gRNA sequence
actatgttggccaggctggt

SEQ ID NO: 294112 - DNA, 20 bp, Artificial
  CRISPR gRNA sequence
tgttggccaggctggtctcg

SEQ ID NO: 294113 - DNA, 20 bp, Artificial
  CRISPR gRNA sequence
gccaggctggtctcgaactc

SEQ ID NO: 294114 - DNA, 20 bp, Artificial
  CRISPR gRNA sequence
gtctcgaactcctgacctca

SEQ ID NO: 294115 - DNA, 20 bp, Artificial
  CRISPR gRNA sequence
gaactcctgacctcaggtga

SEQ ID NO: 294116 - DNA, 20 bp, Artificial
  CRISPR gRNA sequence
ctgacctcaggtgatctgcc

SEQ ID NO: 294117 - DNA, 20 bp, Artificial
  CRISPR gRNA sequence
acctcaggtgatctgcccac

SEQ ID NO: 294118 - DNA, 20 bp, Artificial
  CRISPR gRNA sequence
aggtgatctgcccaccttgg

SEQ ID NO: 294119 - DNA, 20 bp, Artificial
  CRISPR gRNA sequence
cccaccttggcctcccaaag

SEQ ID NO: 294120 - DNA, 20 bp, Artificial
  CRISPR gRNA sequence
ggcctcccaaagtgccagaa

SEQ ID NO: 294121 - DNA, 20 bp, Artificial
  CRISPR gRNA sequence
gcctcccaaagtgccagaat

SEQ ID NO: 294122 - DNA, 20 bp, Artificial
  CRISPR gRNA sequence
ccaaagtgccagaattacag

SEQ ID NO: 294123 - DNA, 20 bp, Artificial
  CRISPR gRNA sequence
caggtgtgagccactgtgcc

SEQ ID NO: 294124 - DNA, 20 bp, Artificial
  CRISPR gRNA sequence
tgcccagcctcagatggcat

SEQ ID NO: 294125 - DNA, 20 bp, Artificial
  CRISPR gRNA sequence
agatggcatttcaaatctca

SEQ ID NO: 294126 - DNA, 20 bp, Artificial
  CRISPR gRNA sequence
caaatctcaggtgtggagga

SEQ ID NO: 294127 - DNA, 20 bp, Artificial
  CRISPR gRNA sequence
aaatctcaggtgtggaggat

SEQ ID NO: 294128 - DNA, 20 bp, Artificial
  CRISPR gRNA sequence
aggtgtggaggatattaccc

SEQ ID NO: 294129 - DNA, 20 bp, Artificial
  CRISPR gRNA sequence
cccaggaagactggggccag

SEQ ID NO: 294130 - DNA, 20 bp, Artificial
  CRISPR gRNA sequence
gggccagtaagggcaaaatg

SEQ ID NO: 294131 - DNA, 20 bp, Artificial
  CRISPR gRNA sequence
gaggacaagaagaggaagaa

SEQ ID NO: 294132 - DNA, 20 bp, Artificial
  CRISPR gRNA sequence
cagagaaaacggagtgcaac

SEQ ID NO: 294133 - DNA, 20 bp, Artificial
  CRISPR gRNA sequence
agagaaaacggagtgcaaca

SEQ ID NO: 294134 - DNA, 20 bp, Artificial
  CRISPR gRNA sequence
caactggctaaatgctgatg

SEQ ID NO: 294135 - DNA, 20 bp, Artificial
  CRISPR gRNA sequence
gctaaatgctgatgagaagt

SEQ ID NO: 294136 - DNA, 20 bp, Artificial
  CRISPR gRNA sequence
aatgctgatgagaagtccaa

SEQ ID NO: 294137 - DNA, 20 bp, Artificial
  CRISPR gRNA sequence
atgagaagtccaataagcaa

SEQ ID NO: 294138 - DNA, 20 bp, Artificial
  CRISPR gRNA sequence
ggccaggcgcagtggctcat

SEQ ID NO: 294139 - DNA, 20 bp, Artificial
  CRISPR gRNA sequence
atgcctgtaatcccagcact

SEQ ID NO: 294140 - DNA, 20 bp, Artificial
  CRISPR gRNA sequence
taatcccagcactgtgggag

SEQ ID NO: 294141 - DNA, 20 bp, Artificial
  CRISPR gRNA sequence
tgggaggccaagacaggaga

SEQ ID NO: 294142 - DNA, 20 bp, Artificial
  CRISPR gRNA sequence
aggtcaggagttcgagacca

SEQ ID NO: 294143 - DNA, 20 bp, Artificial
  CRISPR gRNA sequence
gagaccagtctggccaacat

SEQ ID NO: 294144 - DNA, 20 bp, Artificial
  CRISPR gRNA sequence
gccaacatggggaaacccca

SEQ ID NO: 294145 - DNA, 20 bp, Artificial
  CRISPR gRNA sequence
tactgaaaatacaaaaatta

SEQ ID NO: 294146 - DNA, 20 bp, Artificial
  CRISPR gRNA sequence
ctgaaaatacaaaaattagc

SEQ ID NO: 294147 - DNA, 20 bp, Artificial
  CRISPR gRNA sequence
aaaatacaaaaattagctgg

SEQ ID NO: 294148 - DNA, 20 bp, Artificial
  CRISPR gRNA sequence
gctgggtgtggtggcacgcc

SEQ ID NO: 294149 - DNA, 20 bp, Artificial
  CRISPR gRNA sequence
ggtgtggtggcacgcccctg

SEQ ID NO: 294150 - DNA, 20 bp, Artificial
  CRISPR gRNA sequence
taatcccagctactcgggag

SEQ ID NO: 294151 - DNA, 20 bp, Artificial
  CRISPR gRNA sequence
ctcgggaggctgaggcagga

SEQ ID NO: 294152 - DNA, 20 bp, Artificial
  CRISPR gRNA sequence
gggaggctgaggcaggagaa

SEQ ID NO: 294153 - DNA, 20 bp, Artificial
  CRISPR gRNA sequence
aggcaggagaattccttgaa

SEQ ID NO: 294154 - DNA, 20 bp, Artificial
  CRISPR gRNA sequence
cttgaactcgggaggcagag

SEQ ID NO: 294155 - DNA, 20 bp, Artificial
  CRISPR gRNA sequence
gaactcgggaggcagagatt

SEQ ID NO: 294156 - DNA, 20 bp, Artificial
  CRISPR gRNA sequence
aactcgggaggcagagattg

SEQ ID NO: 294157 - DNA, 20 bp, Artificial
  CRISPR gRNA sequence
gggaggcagagattgcagtg

SEQ ID NO: 294158 - DNA, 20 bp, Artificial
  CRISPR gRNA sequence
cagtgagctgagatcacatc

SEQ ID NO: 294159 - DNA, 20 bp, Artificial
  CRISPR gRNA sequence
agatcacatcactgcactcc

SEQ ID NO: 294160 - DNA, 20 bp, Artificial
  CRISPR gRNA sequence
cactccagcctggcctggga

SEQ ID NO: 294161 - DNA, 20 bp, Artificial
  CRISPR gRNA sequence
cagcctggcctgggaaacac

SEQ ID NO: 294162 - DNA, 20 bp, Artificial
  CRISPR gRNA sequence
gcctgggaaacacagtgaaa

SEQ ID NO: 294163 - DNA, 20 bp, Artificial
  CRISPR gRNA sequence
ggaaacacagtgaaagtccg

SEQ ID NO: 294164 - DNA, 20 bp, Artificial
  CRISPR gRNA sequence
aaataaataaataaataaat

SEQ ID NO: 294165 - DNA, 20 bp, Artificial
  CRISPR gRNA sequence
aataaataaataaataaata

SEQ ID NO: 294166 - DNA, 20 bp, Artificial
  CRISPR gRNA sequence
accactgggtttggtaatca

SEQ ID NO: 294167 - DNA, 20 bp, Artificial
  CRISPR gRNA sequence
ccactgggtttggtaatcag

SEQ ID NO: 294168 - DNA, 20 bp, Artificial
  CRISPR gRNA sequence
ggtttggtaatcagaaaagt

SEQ ID NO: 294169 - DNA, 20 bp, Artificial
  CRISPR gRNA sequence
ggtaatcagaaaagtaaaaa

SEQ ID NO: 294170 - DNA, 20 bp, Artificial
  CRISPR gRNA sequence
gtaatcagaaaagtaaaaac

SEQ ID NO: 294171 - DNA, 20 bp, Artificial
  CRISPR gRNA sequence
ggactccctggaccctctct

SEQ ID NO: 294172 - DNA, 20 bp, Artificial
  CRISPR gRNA sequence
gactccctggaccctctctc

SEQ ID NO: 294173 - DNA, 20 bp, Artificial
  CRISPR gRNA sequence
cctggaccctctctccagcc

SEQ ID NO: 294174 - DNA, 20 bp, Artificial
  CRISPR gRNA sequence
gaccctctctccagcccagc

SEQ ID NO: 294175 - DNA, 20 bp, Artificial
  CRISPR gRNA sequence
tctccagcccagccttgcta

SEQ ID NO: 294176 - DNA, 20 bp, Artificial
  CRISPR gRNA sequence
tccagcccagccttgctagc

SEQ ID NO: 294177 - DNA, 20 bp, Artificial
  CRISPR gRNA sequence
cagcccagccttgctagctc

SEQ ID NO: 294178 - DNA, 20 bp, Artificial
  CRISPR gRNA sequence
gctagctccgcctgtggtgc

SEQ ID NO: 294179 - DNA, 20 bp, Artificial
  CRISPR gRNA sequence
ctagctccgcctgtggtgca

SEQ ID NO: 294180 - DNA, 20 bp, Artificial
  CRISPR gRNA sequence
gctccgcctgtggtgcatgc

SEQ ID NO: 294181 - DNA, 20 bp, Artificial
  CRISPR gRNA sequence
cgcctgtggtgcatgctcct

SEQ ID NO: 294182 - DNA, 20 bp, Artificial
  CRISPR gRNA sequence
tggtgcatgctcctgcctcc

SEQ ID NO: 294183 - DNA, 20 bp, Artificial
  CRISPR gRNA sequence
ctgcctccgactcaatggtt

SEQ ID NO: 294184 - DNA, 20 bp, Artificial
  CRISPR gRNA sequence
cctccgactcaatggtttgc

SEQ ID NO: 294185 - DNA, 20 bp, Artificial
  CRISPR gRNA sequence
cgactcaatggtttgcagga

SEQ ID NO: 294186 - DNA, 20 bp, Artificial
  CRISPR gRNA sequence
aatggtttgcaggaaaaatt

SEQ ID NO: 294187 - DNA, 20 bp, Artificial
  CRISPR gRNA sequence
gcaggaaaaatttagatagc

SEQ ID NO: 294188 - DNA, 20 bp, Artificial
  CRISPR gRNA sequence
caggaaaaatttagatagca

SEQ ID NO: 294189 - DNA, 20 bp, Artificial
  CRISPR gRNA sequence
agatagcacaacagtggcaa

SEQ ID NO: 294190 - DNA, 20 bp, Artificial
  CRISPR gRNA sequence
gatagcacaacagtggcaat

SEQ ID NO: 294191 - DNA, 20 bp, Artificial
  CRISPR gRNA sequence
acaatgaagagatctactgc

SEQ ID NO: 294192 - DNA, 20 bp, Artificial
  CRISPR gRNA sequence
ctgcaaatcctactatggaa

SEQ ID NO: 294193 - DNA, 20 bp, Artificial
  CRISPR gRNA sequence
caaatcctactatggaaaga

SEQ ID NO: 294194 - DNA, 20 bp, Artificial
  CRISPR gRNA sequence
ctatggaaagaaatatggga

SEQ ID NO: 294195 - DNA, 20 bp, Artificial
  CRISPR gRNA sequence
tggaaagaaatatgggacaa

SEQ ID NO: 294196 - DNA, 20 bp, Artificial
  CRISPR gRNA sequence
tggttatggccagggtgctg

SEQ ID NO: 294197 - DNA, 20 bp, Artificial
  CRISPR gRNA sequence
tggccagggtgctggcacgc

SEQ ID NO: 294198 - DNA, 20 bp, Artificial
  CRISPR gRNA sequence
gcacgcttaacatggcgaga

SEQ ID NO: 294199 - DNA, 20 bp, Artificial
  CRISPR gRNA sequence
aacatggcgagaggctgggc

SEQ ID NO: 294200 - DNA, 20 bp, Artificial
  CRISPR gRNA sequence
acatggcgagaggctgggca

SEQ ID NO: 294201 - DNA, 20 bp, Artificial
  CRISPR gRNA sequence
ggcatcaagccagagagtgt

SEQ ID NO: 294202 - DNA, 20 bp, Artificial
  CRISPR gRNA sequence
agcctcacaggcctacaaga

SEQ ID NO: 294203 - DNA, 20 bp, Artificial
  CRISPR gRNA sequence
acaggcctacaagaaatcca

SEQ ID NO: 294204 - DNA, 20 bp, Artificial
  CRISPR gRNA sequence
caagaaatccaaatgcttct

SEQ ID NO: 294205 - DNA, 20 bp, Artificial
  CRISPR gRNA sequence
ctaaatttgctcagaaatat

SEQ ID NO: 294206 - DNA, 20 bp, Artificial
  CRISPR gRNA sequence
taaatttgctcagaaatatg

SEQ ID NO: 294207 - DNA, 20 bp, Artificial
  CRISPR gRNA sequence
aatttgctcagaaatatgga

SEQ ID NO: 294208 - DNA, 20 bp, Artificial
  CRISPR gRNA sequence
gctcagaaatatggaggtgc

SEQ ID NO: 294209 - DNA, 20 bp, Artificial
  CRISPR gRNA sequence
ctcagaaatatggaggtgct

SEQ ID NO: 294210 - DNA, 20 bp, Artificial
  CRISPR gRNA sequence
agaaatatggaggtgctgag

SEQ ID NO: 294211 - DNA, 20 bp, Artificial
  CRISPR gRNA sequence
agaaatgttccagatgtggg

SEQ ID NO: 294212 - DNA, 20 bp, Artificial
  CRISPR gRNA sequence
cagatgtggggattctgtat

SEQ ID NO: 294213 - DNA, 20 bp, Artificial
  CRISPR gRNA sequence
tgtatatgctgccgagaaga

SEQ ID NO: 294214 - DNA, 20 bp, Artificial
  CRISPR gRNA sequence
tatatgctgccgagaagata

SEQ ID NO: 294215 - DNA, 20 bp, Artificial
  CRISPR gRNA sequence
ccgagaagataattggagct

SEQ ID NO: 294216 - DNA, 20 bp, Artificial
  CRISPR gRNA sequence
gagctggaaagccctggcac

SEQ ID NO: 294217 - DNA, 20 bp, Artificial
  CRISPR gRNA sequence
gaaagccctggcacaaaaac

SEQ ID NO: 294218 - DNA, 20 bp, Artificial
  CRISPR gRNA sequence
gcacaaaaactgtttctgat

SEQ ID NO: 294219 - DNA, 20 bp, Artificial
  CRISPR gRNA sequence
tttctgatgtgcaaagtgtg

SEQ ID NO: 294220 - DNA, 20 bp, Artificial
  CRISPR gRNA sequence
ctgatgtgcaaagtgtggga

SEQ ID NO: 294221 - DNA, 20 bp, Artificial
  CRISPR gRNA sequence
tgatgtgcaaagtgtgggaa

SEQ ID NO: 294222 - DNA, 20 bp, Artificial
  CRISPR gRNA sequence
atgtgcaaagtgtgggaaga

SEQ ID NO: 294223 - DNA, 20 bp, Artificial
  CRISPR gRNA sequence
gaatcaacaactctgactga

SEQ ID NO: 294224 - DNA, 20 bp, Artificial
  CRISPR gRNA sequence
aatcaacaactctgactgaa

SEQ ID NO: 294225 - DNA, 20 bp, Artificial
  CRISPR gRNA sequence
tgactgaaaaagaaggtgaa

SEQ ID NO: 294226 - DNA, 20 bp, Artificial
  CRISPR gRNA sequence
actgaaaaagaaggtgaaat

SEQ ID NO: 294227 - DNA, 20 bp, Artificial
  CRISPR gRNA sequence
aaaaagaaggtgaaatctat

SEQ ID NO: 294228 - DNA, 20 bp, Artificial
  CRISPR gRNA sequence
ttgtaatggtgctatgcaaa

SEQ ID NO: 294229 - DNA, 20 bp, Artificial
  CRISPR gRNA sequence
taatggtgctatgcaaagaa

SEQ ID NO: 294230 - DNA, 20 bp, Artificial
  CRISPR gRNA sequence
tgcaaagaactttgggccca

SEQ ID NO: 294231 - DNA, 20 bp, Artificial
  CRISPR gRNA sequence
tgggcccaagggatttggct

SEQ ID NO: 294232 - DNA, 20 bp, Artificial
  CRISPR gRNA sequence
gggcccaagggatttggcta

SEQ ID NO: 294233 - DNA, 20 bp, Artificial
  CRISPR gRNA sequence
ggcccaagggatttggctat

SEQ ID NO: 294234 - DNA, 20 bp, Artificial
  CRISPR gRNA sequence
ggctatggccaaggagcagg

SEQ ID NO: 294235 - DNA, 20 bp, Artificial
  CRISPR gRNA sequence
gctatggccaaggagcaggg

SEQ ID NO: 294236 - DNA, 20 bp, Artificial
  CRISPR gRNA sequence
tggccaaggagcaggggctc

SEQ ID NO: 294237 - DNA, 20 bp, Artificial
  CRISPR gRNA sequence
ttgttcatgcccagtaaggt

SEQ ID NO: 294238 - DNA, 20 bp, Artificial
  CRISPR gRNA sequence
gttcatgcccagtaaggtgt

SEQ ID NO: 294239 - DNA, 20 bp, Artificial
  CRISPR gRNA sequence
ttcatgcccagtaaggtgta

SEQ ID NO: 294240 - DNA, 20 bp, Artificial
  CRISPR gRNA sequence
atgcccagtaaggtgtaaac

SEQ ID NO: 294241 - DNA, 20 bp, Artificial
  CRISPR gRNA sequence
agcatcacacattgagaatc

SEQ ID NO: 294242 - DNA, 20 bp, Artificial
  CRISPR gRNA sequence
agaatctcttcataatctag

SEQ ID NO: 294243 - DNA, 20 bp, Artificial
  CRISPR gRNA sequence
ttcataatctaggcacagat

SEQ ID NO: 294244 - DNA, 20 bp, Artificial
  CRISPR gRNA sequence
cataatctaggcacagataa

SEQ ID NO: 294245 - DNA, 20 bp, Artificial
  CRISPR gRNA sequence
ataatctaggcacagataat

SEQ ID NO: 294246 - DNA, 20 bp, Artificial
  CRISPR gRNA sequence
ggcacagataatctttaaca

SEQ ID NO: 294247 - DNA, 20 bp, Artificial
  CRISPR gRNA sequence
taacactaaactactgtgaa

SEQ ID NO: 294248 - DNA, 20 bp, Artificial
  CRISPR gRNA sequence
aacactaaactactgtgaaa

SEQ ID NO: 294249 - DNA, 20 bp, Artificial
  CRISPR gRNA sequence
acactaaactactgtgaaat

SEQ ID NO: 294250 - DNA, 20 bp, Artificial
  CRISPR gRNA sequence
aactactgtgaaattctacc

SEQ ID NO: 294251 - DNA, 20 bp, Artificial
  CRISPR gRNA sequence
ctgtgaaattctaccagcat

SEQ ID NO: 294252 - DNA, 20 bp, Artificial
  CRISPR gRNA sequence
tgaaattctaccagcattga

SEQ ID NO: 294253 - DNA, 20 bp, Artificial
  CRISPR gRNA sequence
taccagcattgagtactgta

SEQ ID NO: 294254 - DNA, 20 bp, Artificial
  CRISPR gRNA sequence
ccagcattgagtactgtata

SEQ ID NO: 294255 - DNA, 20 bp, Artificial
  CRISPR gRNA sequence
agtactgtatattaccctgt

SEQ ID NO: 294256 - DNA, 20 bp, Artificial
  CRISPR gRNA sequence
tatattaccctgtacttgga

SEQ ID NO: 294257 - DNA, 20 bp, Artificial
  CRISPR gRNA sequence
ccctgtacttggataggctg

SEQ ID NO: 294258 - DNA, 20 bp, Artificial
  CRISPR gRNA sequence
tacttggataggctggctaa

SEQ ID NO: 294259 - DNA, 20 bp, Artificial
  CRISPR gRNA sequence
ggataggctggctaactcat

SEQ ID NO: 294260 - DNA, 20 bp, Artificial
  CRISPR gRNA sequence
gataggctggctaactcata

SEQ ID NO: 294261 - DNA, 20 bp, Artificial
  CRISPR gRNA sequence
gctaactcatagtgagagag

SEQ ID NO: 294262 - DNA, 20 bp, Artificial
  CRISPR gRNA sequence
actcatagtgagagagcact

SEQ ID NO: 294263 - DNA, 20 bp, Artificial
  CRISPR gRNA sequence
atagtgagagagcactgtgt

SEQ ID NO: 294264 - DNA, 20 bp, Artificial
  CRISPR gRNA sequence
tgtcgtatccttttgcttta

SEQ ID NO: 294265 - DNA, 20 bp, Artificial
  CRISPR gRNA sequence
ttgctttattcactagcatt

SEQ ID NO: 294266 - DNA, 20 bp, Artificial
  CRISPR gRNA sequence
tgctttattcactagcattt

SEQ ID NO: 294267 - DNA, 20 bp, Artificial
  CRISPR gRNA sequence
gctttattcactagcatttt

SEQ ID NO: 294268 - DNA, 20 bp, Artificial
  CRISPR gRNA sequence
ctttattcactagcattttg

SEQ ID NO: 294269 - DNA, 20 bp, Artificial
  CRISPR gRNA sequence
tattcactagcattttgggg

SEQ ID NO: 294270 - DNA, 20 bp, Artificial
  CRISPR gRNA sequence
attcactagcattttggggg

SEQ ID NO: 294271 - DNA, 20 bp, Artificial
  CRISPR gRNA sequence
ttcactagcattttggggga

SEQ ID NO: 294272 - DNA, 20 bp, Artificial
  CRISPR gRNA sequence
actagcattttgggggaaca

SEQ ID NO: 294273 - DNA, 20 bp, Artificial
  CRISPR gRNA sequence
gcattttgggggaacatttc

SEQ ID NO: 294274 - DNA, 20 bp, Artificial
  CRISPR gRNA sequence
tgggggaacatttcttttat

SEQ ID NO: 294275 - DNA, 20 bp, Artificial
  CRISPR gRNA sequence
gggggaacatttcttttatg

SEQ ID NO: 294276 - DNA, 20 bp, Artificial
  CRISPR gRNA sequence
ggggaacatttcttttatgt

SEQ ID NO: 294277 - DNA, 20 bp, Artificial
  CRISPR gRNA sequence
cttttatgttttaaataaaa

SEQ ID NO: 294278 - DNA, 20 bp, Artificial
  CRISPR gRNA sequence
ttttatgttttaaataaaac

SEQ ID NO: 294279 - DNA, 20 bp, Artificial
  CRISPR gRNA sequence
ttatgttttaaataaaactt

SEQ ID NO: 294280 - DNA, 20 bp, Artificial
  CRISPR gRNA sequence
tatgttttaaataaaacttc

SEQ ID NO: 294281 - DNA, 20 bp, Artificial
  CRISPR gRNA sequence
atgttttaaataaaacttca

SEQ ID NO: 294282 - DNA, 20 bp, Artificial
  CRISPR gRNA sequence
tgttttaaataaaacttcag

SEQ ID NO: 294283 - DNA, 20 bp, Artificial
  CRISPR gRNA sequence
taaataaaacttcagcatga

SEQ ID NO: 294284 - DNA, 20 bp, Artificial
  CRISPR gRNA sequence
aaataaaacttcagcatgaa

SEQ ID NO: 294285 - DNA, 20 bp, Artificial
  CRISPR gRNA sequence
aataaaacttcagcatgaag

SEQ ID NO: 294286 - DNA, 20 bp, Artificial
  CRISPR gRNA sequence
cagcatgaagaaaaaaagta

SEQ ID NO: 294287 - DNA, 20 bp, Artificial
  CRISPR gRNA sequence
agcatgaagaaaaaaagtaa

SEQ ID NO: 294288 - DNA, 20 bp, Artificial
  CRISPR gRNA sequence
gtaaatattcatttatttgt

SEQ ID NO: 294289 - DNA, 20 bp, Artificial
  CRISPR gRNA sequence
atttatttgtaagccatttc

SEQ ID NO: 294290 - DNA, 20 bp, Artificial
  CRISPR gRNA sequence
atttgtaagccatttcagag

SEQ ID NO: 294291 - DNA, 20 bp, Artificial
  CRISPR gRNA sequence
tttgtaagccatttcagaga

SEQ ID NO: 294292 - DNA, 20 bp, Artificial
  CRISPR gRNA sequence
gtaagccatttcagagaaac

SEQ ID NO: 294293 - DNA, 20 bp, Artificial
  CRISPR gRNA sequence
taagccatttcagagaaacc

SEQ ID NO: 294294 - DNA, 20 bp, Artificial
  CRISPR gRNA sequence
cagagaaaccagaaaatgag

SEQ ID NO: 294295 - DNA, 20 bp, Artificial
  CRISPR gRNA sequence
agagaaaccagaaaatgagc

SEQ ID NO: 294296 - DNA, 20 bp, Artificial
  CRISPR gRNA sequence
ctataatttgtgtccctgcc

SEQ ID NO: 294297 - DNA, 20 bp, Artificial
  CRISPR gRNA sequence
taatttgtgtccctgccgtt

SEQ ID NO: 294298 - DNA, 20 bp, Artificial
  CRISPR gRNA sequence
gtgtccctgccgtttttcca

SEQ ID NO: 294299 - DNA, 20 bp, Artificial
  CRISPR gRNA sequence
tgtccctgccgtttttccag

SEQ ID NO: 294300 - DNA, 20 bp, Artificial
  CRISPR gRNA sequence
ccgtttttccagatgttgct

SEQ ID NO: 294301 - DNA, 20 bp, Artificial
  CRISPR gRNA sequence
ttccagatgttgctaatgat

SEQ ID NO: 294302 - DNA, 20 bp, Artificial
  CRISPR gRNA sequence
tccagatgttgctaatgatt

SEQ ID NO: 294303 - DNA, 20 bp, Artificial
  CRISPR gRNA sequence
ccagatgttgctaatgattc

SEQ ID NO: 294304 - DNA, 20 bp, Artificial
  CRISPR gRNA sequence
cagatgttgctaatgattcc

SEQ ID NO: 294305 - DNA, 20 bp, Artificial
  CRISPR gRNA sequence
ctaatgattcctcaaagcag

SEQ ID NO: 294306 - DNA, 20 bp, Artificial
  CRISPR gRNA sequence
atgattcctcaaagcagctg

SEQ ID NO: 294307 - DNA, 20 bp, Artificial
  CRISPR gRNA sequence
ctcaaagcagctgaagaata

SEQ ID NO: 294308 - DNA, 20 bp, Artificial
  CRISPR gRNA sequence
aaagcagctgaagaataaat

SEQ ID NO: 294309 - DNA, 20 bp, Artificial
  CRISPR gRNA sequence
aagaataaatactgcagctg

SEQ ID NO: 294310 - DNA, 20 bp, Artificial
  CRISPR gRNA sequence
cagctgctgctcctgatctg

SEQ ID NO: 294311 - DNA, 20 bp, Artificial
  CRISPR gRNA sequence
ctgctcctgatctggaggga

SEQ ID NO: 294312 - DNA, 20 bp, Artificial
  CRISPR gRNA sequence
ctcctgatctggagggatgg

SEQ ID NO: 294313 - DNA, 20 bp, Artificial
  CRISPR gRNA sequence
ctgatctggagggatggacc

SEQ ID NO: 294314 - DNA, 20 bp, Artificial
  CRISPR gRNA sequence
atctggagggatggacccgc

SEQ ID NO: 294315 - DNA, 20 bp, Artificial
  CRISPR gRNA sequence
gagggatggacccgcagcac

SEQ ID NO: 294316 - DNA, 20 bp, Artificial
  CRISPR gRNA sequence
tctcctccccaccctcattt

SEQ ID NO: 294317 - DNA, 20 bp, Artificial
  CRISPR gRNA sequence
ctcctccccaccctcatttc

SEQ ID NO: 294318 - DNA, 20 bp, Artificial
  CRISPR gRNA sequence
tcctccccaccctcatttcc

SEQ ID NO: 294319 - DNA, 20 bp, Artificial
  CRISPR gRNA sequence
ctccccaccctcatttcctt

SEQ ID NO: 294320 - DNA, 20 bp, Artificial
  CRISPR gRNA sequence
cccaccctcatttccttgtg

SEQ ID NO: 294321 - DNA, 20 bp, Artificial
  CRISPR gRNA sequence
atttccttgtgtacttcttg

SEQ ID NO: 294322 - DNA, 20 bp, Artificial
  CRISPR gRNA sequence
ccttgtgtacttcttgtgct

SEQ ID NO: 294323 - DNA, 20 bp, Artificial
  CRISPR gRNA sequence
cttgtgtacttcttgtgctc

SEQ ID NO: 294324 - DNA, 20 bp, Artificial
  CRISPR gRNA sequence
gtgtacttcttgtgctctct

SEQ ID NO: 294325 - DNA, 20 bp, Artificial
  CRISPR gRNA sequence
tgtacttcttgtgctctctg

SEQ ID NO: 294326 - DNA, 20 bp, Artificial
  CRISPR gRNA sequence
cttgtgctctctgtgggact

SEQ ID NO: 294327 - DNA, 20 bp, Artificial
  CRISPR gRNA sequence
ttgtgctctctgtgggactg

SEQ ID NO: 294328 - DNA, 20 bp, Artificial
  CRISPR gRNA sequence
gtgctctctgtgggactgaa

SEQ ID NO: 294329 - DNA, 20 bp, Artificial
  CRISPR gRNA sequence
tgctctctgtgggactgaaa

SEQ ID NO: 294330 - DNA, 20 bp, Artificial
  CRISPR gRNA sequence
tctgtgggactgaaactaca

SEQ ID NO: 294331 - DNA, 20 bp, Artificial
  CRISPR gRNA sequence
tgtgggactgaaactacagc

SEQ ID NO: 294332 - DNA, 20 bp, Artificial
  CRISPR gRNA sequence
tgggactgaaactacagctg

SEQ ID NO: 294333 - DNA, 20 bp, Artificial
  CRISPR gRNA sequence
aaactacagctgataacctt

SEQ ID NO: 294334 - DNA, 20 bp, Artificial
  CRISPR gRNA sequence
cagctgataaccttcagtgc

SEQ ID NO: 294335 - DNA, 20 bp, Artificial
  CRISPR gRNA sequence
ataaccttcagtgctctctt

SEQ ID NO: 294336 - DNA, 20 bp, Artificial
  CRISPR gRNA sequence
cagtgctctcttctaggatg

SEQ ID NO: 294337 - DNA, 20 bp, Artificial
  CRISPR gRNA sequence
agtgctctcttctaggatgg

SEQ ID NO: 294338 - DNA, 20 bp, Artificial
  CRISPR gRNA sequence
tcttctaggatggtcccacc

SEQ ID NO: 294339 - DNA, 20 bp, Artificial
  CRISPR gRNA sequence
ttctaggatggtcccaccta

SEQ ID NO: 294340 - DNA, 20 bp, Artificial
  CRISPR gRNA sequence
ctaggatggtcccacctaat

SEQ ID NO: 294341 - DNA, 20 bp, Artificial
  CRISPR gRNA sequence
taggatggtcccacctaata

SEQ ID NO: 294342 - DNA, 20 bp, Artificial
  CRISPR gRNA sequence
ggatggtcccacctaatacc

SEQ ID NO: 294343 - DNA, 20 bp, Artificial
  CRISPR gRNA sequence
ataccaagccatatccacac

SEQ ID NO: 294344 - DNA, 20 bp, Artificial
  CRISPR gRNA sequence
agttctttgccagacttgtt

SEQ ID NO: 294345 - DNA, 20 bp, Artificial
  CRISPR gRNA sequence
gttctttgccagacttgttc

SEQ ID NO: 294346 - DNA, 20 bp, Artificial
  CRISPR gRNA sequence
tttgccagacttgttctgtg

SEQ ID NO: 294347 - DNA, 20 bp, Artificial
  CRISPR gRNA sequence
tgccagacttgttctgtgtt

SEQ ID NO: 294348 - DNA, 20 bp, Artificial
  CRISPR gRNA sequence
gccagacttgttctgtgttt

SEQ ID NO: 294349 - DNA, 20 bp, Artificial
  CRISPR gRNA sequence
ccagacttgttctgtgtttc

SEQ ID NO: 294350 - DNA, 20 bp, Artificial
  CRISPR gRNA sequence
gttctgtgtttccagtagct

SEQ ID NO: 294351 - DNA, 20 bp, Artificial
  CRISPR gRNA sequence
ttctgtgtttccagtagcta

SEQ ID NO: 294352 - DNA, 20 bp, Artificial
  CRISPR gRNA sequence
tgtgtttccagtagctagag

SEQ ID NO: 294353 - DNA, 20 bp, Artificial
  CRISPR gRNA sequence
tgtttccagtagctagaggg

SEQ ID NO: 294354 - DNA, 20 bp, Artificial
  CRISPR gRNA sequence
ccagtagctagagggtgaaa

SEQ ID NO: 294355 - DNA, 20 bp, Artificial
  CRISPR gRNA sequence
cagtagctagagggtgaaaa

SEQ ID NO: 294356 - DNA, 20 bp, Artificial
  CRISPR gRNA sequence
gagggtgaaaaacctgtatc

SEQ ID NO: 294357 - DNA, 20 bp, Artificial
  CRISPR gRNA sequence
tatccgaaagtgaatgcaaa

SEQ ID NO: 294358 - DNA, 20 bp, Artificial
  CRISPR gRNA sequence
ctgtagctttagggcagcta

SEQ ID NO: 294359 - DNA, 20 bp, Artificial
  CRISPR gRNA sequence
tagctttagggcagctactg

SEQ ID NO: 294360 - DNA, 20 bp, Artificial
  CRISPR gRNA sequence
tagggcagctactgtgaggt

SEQ ID NO: 294361 - DNA, 20 bp, Artificial
  CRISPR gRNA sequence
agggcagctactgtgaggta

SEQ ID NO: 294362 - DNA, 20 bp, Artificial
  CRISPR gRNA sequence
gggcagctactgtgaggtaa

SEQ ID NO: 294363 - DNA, 20 bp, Artificial
  CRISPR gRNA sequence
ctgtgaggtaagggtgtgtg

SEQ ID NO: 294364 - DNA, 20 bp, Artificial
  CRISPR gRNA sequence
tgaggtaagggtgtgtgtga

SEQ ID NO: 294365 - DNA, 20 bp, Artificial
  CRISPR gRNA sequence
agagagaatatggtaggaga

SEQ ID NO: 294366 - DNA, 20 bp, Artificial
  CRISPR gRNA sequence
gagaaggaaaaataaagtat

SEQ ID NO: 294367 - DNA, 20 bp, Artificial
  CRISPR gRNA sequence
gaacacaacatcaaccagtt

SEQ ID NO: 294368 - DNA, 20 bp, Artificial
  CRISPR gRNA sequence
gtagtaacacatagttataa

SEQ ID NO: 294369 - DNA, 20 bp, Artificial
  CRISPR gRNA sequence
taatcagctataaaagtgag

SEQ ID NO: 294370 - DNA, 20 bp, Artificial
  CRISPR gRNA sequence
taaaagtgagatactgcaag

SEQ ID NO: 294371 - DNA, 20 bp, Artificial
  CRISPR gRNA sequence
caagatggcttgtaaaagat

SEQ ID NO: 294372 - DNA, 20 bp, Artificial
  CRISPR gRNA sequence
gtaaaagatttccttagaat

SEQ ID NO: 294373 - DNA, 20 bp, Artificial
  CRISPR gRNA sequence
taaaagatttccttagaatc

SEQ ID NO: 294374 - DNA, 20 bp, Artificial
  CRISPR gRNA sequence
ccttagaatcttccttatgt

SEQ ID NO: 294375 - DNA, 20 bp, Artificial
  CRISPR gRNA sequence
cttagaatcttccttatgtc

SEQ ID NO: 294376 - DNA, 20 bp, Artificial
  CRISPR gRNA sequence
agaatcttccttatgtcaac

SEQ ID NO: 294377 - DNA, 20 bp, Artificial
  CRISPR gRNA sequence
gaatcttccttatgtcaact

SEQ ID NO: 294378 - DNA, 20 bp, Artificial
  CRISPR gRNA sequence
ccttatgtcaacttaactca

SEQ ID NO: 294379 - DNA, 20 bp, Artificial
  CRISPR gRNA sequence
cttatgtcaacttaactcag

SEQ ID NO: 294380 - DNA, 20 bp, Artificial
  CRISPR gRNA sequence
atgtcaacttaactcagtaa

SEQ ID NO: 294381 - DNA, 20 bp, Artificial
  CRISPR gRNA sequence
tgtcaacttaactcagtaaa

SEQ ID NO: 294382 - DNA, 20 bp, Artificial
  CRISPR gRNA sequence
aactcagtaaatgcagacat

SEQ ID NO: 294383 - DNA, 20 bp, Artificial
  CRISPR gRNA sequence
actcagtaaatgcagacatt

SEQ ID NO: 294384 - DNA, 20 bp, Artificial
  CRISPR gRNA sequence
agtaaatgcagacattcaaa

SEQ ID NO: 294385 - DNA, 20 bp, Artificial
  CRISPR gRNA sequence
aaagtatctttttcactttt

SEQ ID NO: 294386 - DNA, 20 bp, Artificial
  CRISPR gRNA sequence
tttcacttttaatatgtgac

SEQ ID NO: 294387 - DNA, 20 bp, Artificial
  CRISPR gRNA sequence
ttcacttttaatatgtgaca

SEQ ID NO: 294388 - DNA, 20 bp, Artificial
  CRISPR gRNA sequence
tcacttttaatatgtgacat

SEQ ID NO: 294389 - DNA, 20 bp, Artificial
  CRISPR gRNA sequence
cacttttaatatgtgacatc

SEQ ID NO: 294390 - DNA, 20 bp, Artificial
  CRISPR gRNA sequence
acttttaatatgtgacatct

SEQ ID NO: 294391 - DNA, 20 bp, Artificial
  CRISPR gRNA sequence
ttaatatgtgacatctgact

SEQ ID NO: 294392 - DNA, 20 bp, Artificial
  CRISPR gRNA sequence
taatatgtgacatctgacta

SEQ ID NO: 294393 - DNA, 20 bp, Artificial
  CRISPR gRNA sequence
aatatgtgacatctgactat

SEQ ID NO: 294394 - DNA, 20 bp, Artificial
  CRISPR gRNA sequence
atatgtgacatctgactatt

SEQ ID NO: 294395 - DNA, 20 bp, Artificial
  CRISPR gRNA sequence
actattagttgcccacaagt

SEQ ID NO: 294396 - DNA, 20 bp, Artificial
  CRISPR gRNA sequence
ttagttgcccacaagtatgt

SEQ ID NO: 294397 - DNA, 20 bp, Artificial
  CRISPR gRNA sequence
gttgcccacaagtatgtgcc

SEQ ID NO: 294398 - DNA, 20 bp, Artificial
  CRISPR gRNA sequence
cccacaagtatgtgcctgat

SEQ ID NO: 294399 - DNA, 20 bp, Artificial
  CRISPR gRNA sequence
attgaagaattatgcaagaa

SEQ ID NO: 294400 - DNA, 20 bp, Artificial
  CRISPR gRNA sequence
aagaattatgcaagaaaaat

SEQ ID NO: 294401 - DNA, 20 bp, Artificial
  CRISPR gRNA sequence
tgcaagaaaaatgctagcag

SEQ ID NO: 294402 - DNA, 20 bp, Artificial
  CRISPR gRNA sequence
gcagctgcatactggagagc

SEQ ID NO: 294403 - DNA, 20 bp, Artificial
  CRISPR gRNA sequence
catactggagagctgaccag

SEQ ID NO: 294404 - DNA, 20 bp, Artificial
  CRISPR gRNA sequence
gagagctgaccaggcaaaga

SEQ ID NO: 294405 - DNA, 20 bp, Artificial
  CRISPR gRNA sequence
accaggcaaagaatactcca

SEQ ID NO: 294406 - DNA, 20 bp, Artificial
  CRISPR gRNA sequence
cacagttgcatcaatagaaa

SEQ ID NO: 294407 - DNA, 20 bp, Artificial
  CRISPR gRNA sequence
catcaatagaaaaggcacag

SEQ ID NO: 294408 - DNA, 20 bp, Artificial
  CRISPR gRNA sequence
cagctgacattattcttttc

SEQ ID NO: 294409 - DNA, 20 bp, Artificial
  CRISPR gRNA sequence
acattattcttttccctcca

SEQ ID NO: 294410 - DNA, 20 bp, Artificial
  CRISPR gRNA sequence
ttcttttccctccatagcca

SEQ ID NO: 294411 - DNA, 20 bp, Artificial
  CRISPR gRNA sequence
ttttccctccatagccaagc

SEQ ID NO: 294412 - DNA, 20 bp, Artificial
  CRISPR gRNA sequence
ttccctccatagccaagcaa

SEQ ID NO: 294413 - DNA, 20 bp, Artificial
  CRISPR gRNA sequence
tccctccatagccaagcaag

SEQ ID NO: 294414 - DNA, 20 bp, Artificial
  CRISPR gRNA sequence
ccctccatagccaagcaaga

SEQ ID NO: 294415 - DNA, 20 bp, Artificial
  CRISPR gRNA sequence
cctccatagccaagcaagag

SEQ ID NO: 294416 - DNA, 20 bp, Artificial
  CRISPR gRNA sequence
catagccaagcaagagcatt

SEQ ID NO: 294417 - DNA, 20 bp, Artificial
  CRISPR gRNA sequence
tcctgataacctgctcccat

SEQ ID NO: 294418 - DNA, 20 bp, Artificial
  CRISPR gRNA sequence
cctgataacctgctcccatc

SEQ ID NO: 294419 - DNA, 20 bp, Artificial
  CRISPR gRNA sequence
ctgataacctgctcccatcc

SEQ ID NO: 294420 - DNA, 20 bp, Artificial
  CRISPR gRNA sequence
ataacctgctcccatcctgg

SEQ ID NO: 294421 - DNA, 20 bp, Artificial
  CRISPR gRNA sequence
ctcccatcctgggccattac

SEQ ID NO: 294422 - DNA, 20 bp, Artificial
  CRISPR gRNA sequence
ccatcctgggccattacctt

SEQ ID NO: 294423 - DNA, 20 bp, Artificial
  CRISPR gRNA sequence
ggccattaccttaatctcag

SEQ ID NO: 294424 - DNA, 20 bp, Artificial
  CRISPR gRNA sequence
ccttaatctcagtaaatgga

SEQ ID NO: 294425 - DNA, 20 bp, Artificial
  CRISPR gRNA sequence
aatctcagtaaatggaattt

SEQ ID NO: 294426 - DNA, 20 bp, Artificial
  CRISPR gRNA sequence
atctcagtaaatggaatttt

SEQ ID NO: 294427 - DNA, 20 bp, Artificial
  CRISPR gRNA sequence
agtaaatggaatttttgtga

SEQ ID NO: 294428 - DNA, 20 bp, Artificial
  CRISPR gRNA sequence
ttgtgatatgctgcctgacc

SEQ ID NO: 294429 - DNA, 20 bp, Artificial
  CRISPR gRNA sequence
tgtgatatgctgcctgacct

SEQ ID NO: 294430 - DNA, 20 bp, Artificial
  CRISPR gRNA sequence
gtgatatgctgcctgaccta

SEQ ID NO: 294431 - DNA, 20 bp, Artificial
  CRISPR gRNA sequence
tgatatgctgcctgacctac

SEQ ID NO: 294432 - DNA, 20 bp, Artificial
  CRISPR gRNA sequence
cctgacctactgtaagtact

SEQ ID NO: 294433 - DNA, 20 bp, Artificial
  CRISPR gRNA sequence
acctactgtaagtactatca

SEQ ID NO: 294434 - DNA, 20 bp, Artificial
  CRISPR gRNA sequence
ctgtaagtactatcatacca

SEQ ID NO: 294435 - DNA, 20 bp, Artificial
  CRISPR gRNA sequence
taagtactatcataccatca

SEQ ID NO: 294436 - DNA, 20 bp, Artificial
  CRISPR gRNA sequence
tcataccatcatcctgatct

SEQ ID NO: 294437 - DNA, 20 bp, Artificial
  CRISPR gRNA sequence
atctcaattctggaagatca

SEQ ID NO: 294438 - DNA, 20 bp, Artificial
  CRISPR gRNA sequence
aattctggaagatcaaactt

SEQ ID NO: 294439 - DNA, 20 bp, Artificial
  CRISPR gRNA sequence
tggaagatcaaactttatta

SEQ ID NO: 294440 - DNA, 20 bp, Artificial
  CRISPR gRNA sequence
gaagatcaaactttattacc

SEQ ID NO: 294441 - DNA, 20 bp, Artificial
  CRISPR gRNA sequence
tattaccatggttcggcatc

SEQ ID NO: 294442 - DNA, 20 bp, Artificial
  CRISPR gRNA sequence
attaccatggttcggcatct

SEQ ID NO: 294443 - DNA, 20 bp, Artificial
  CRISPR gRNA sequence
ttaccatggttcggcatctc

SEQ ID NO: 294444 - DNA, 20 bp, Artificial
  CRISPR gRNA sequence
ccatggttcggcatctctct

SEQ ID NO: 294445 - DNA, 20 bp, Artificial
  CRISPR gRNA sequence
ggcatctctctgaggtttta

SEQ ID NO: 294446 - DNA, 20 bp, Artificial
  CRISPR gRNA sequence
tctgaggttttagcctattc

SEQ ID NO: 294447 - DNA, 20 bp, Artificial
  CRISPR gRNA sequence
tgaggttttagcctattcgc

SEQ ID NO: 294448 - DNA, 20 bp, Artificial
  CRISPR gRNA sequence
aggttttagcctattcgctt

SEQ ID NO: 294449 - DNA, 20 bp, Artificial
  CRISPR gRNA sequence
tagcctattcgcttctcatg

SEQ ID NO: 294450 - DNA, 20 bp, Artificial
  CRISPR gRNA sequence
agcctattcgcttctcatgt

SEQ ID NO: 294451 - DNA, 20 bp, Artificial
  CRISPR gRNA sequence
gcctattcgcttctcatgtt

SEQ ID NO: 294452 - DNA, 20 bp, Artificial
  CRISPR gRNA sequence
ttcgcttctcatgtttacag

SEQ ID NO: 294453 - DNA, 20 bp, Artificial
  CRISPR gRNA sequence
gcttctcatgtttacagcaa

SEQ ID NO: 294454 - DNA, 20 bp, Artificial
  CRISPR gRNA sequence
ctcatgtttacagcaagcct

SEQ ID NO: 294455 - DNA, 20 bp, Artificial
  CRISPR gRNA sequence
tcatgtttacagcaagccta

SEQ ID NO: 294456 - DNA, 20 bp, Artificial
  CRISPR gRNA sequence
atgtttacagcaagcctatg

SEQ ID NO: 294457 - DNA, 20 bp, Artificial
  CRISPR gRNA sequence
acagcaagcctatggaaaca

SEQ ID NO: 294458 - DNA, 20 bp, Artificial
  CRISPR gRNA sequence
cagcaagcctatggaaacat

SEQ ID NO: 294459 - DNA, 20 bp, Artificial
  CRISPR gRNA sequence
tggaaacatgagcatctcct

SEQ ID NO: 294460 - DNA, 20 bp, Artificial
  CRISPR gRNA sequence
ctttacttgtctcaacaagt

SEQ ID NO: 294461 - DNA, 20 bp, Artificial
  CRISPR gRNA sequence
tacttgtctcaacaagttct

SEQ ID NO: 294462 - DNA, 20 bp, Artificial
  CRISPR gRNA sequence
acttgtctcaacaagttctg

SEQ ID NO: 294463 - DNA, 20 bp, Artificial
  CRISPR gRNA sequence
cttgtctcaacaagttctgt

SEQ ID NO: 294464 - DNA, 20 bp, Artificial
  CRISPR gRNA sequence
gtctcaacaagttctgttca

SEQ ID NO: 294465 - DNA, 20 bp, Artificial
  CRISPR gRNA sequence
tctcaacaagttctgttcat

SEQ ID NO: 294466 - DNA, 20 bp, Artificial
  CRISPR gRNA sequence
aacaagttctgttcattcac

SEQ ID NO: 294467 - DNA, 20 bp, Artificial
  CRISPR gRNA sequence
tgttcattcactggacattt

SEQ ID NO: 294468 - DNA, 20 bp, Artificial
  CRISPR gRNA sequence
ttcattcactggacattttc

SEQ ID NO: 294469 - DNA, 20 bp, Artificial
  CRISPR gRNA sequence
attcactggacattttccgg

SEQ ID NO: 294470 - DNA, 20 bp, Artificial
  CRISPR gRNA sequence
actggacattttccggacac

SEQ ID NO: 294471 - DNA, 20 bp, Artificial
  CRISPR gRNA sequence
gacattttccggacacctcc

SEQ ID NO: 294472 - DNA, 20 bp, Artificial
  CRISPR gRNA sequence
tccggacacctcctacgtgt

SEQ ID NO: 294473 - DNA, 20 bp, Artificial
  CRISPR gRNA sequence
ccggacacctcctacgtgtg

SEQ ID NO: 294474 - DNA, 20 bp, Artificial
  CRISPR gRNA sequence
cggacacctcctacgtgtgt

SEQ ID NO: 294475 - DNA, 20 bp, Artificial
  CRISPR gRNA sequence
ctacgtgtgtggcactctac

SEQ ID NO: 294476 - DNA, 20 bp, Artificial
  CRISPR gRNA sequence
cgtgtgtggcactctactag

SEQ ID NO: 294477 - DNA, 20 bp, Artificial
  CRISPR gRNA sequence
tactaggcactggaattaca

SEQ ID NO: 294478 - DNA, 20 bp, Artificial
  CRISPR gRNA sequence
ctaggcactggaattacaat

SEQ ID NO: 294479 - DNA, 20 bp, Artificial
  CRISPR gRNA sequence
ggcactggaattacaatgac

SEQ ID NO: 294480 - DNA, 20 bp, Artificial
  CRISPR gRNA sequence
gaattacaatgacaagaagt

SEQ ID NO: 294481 - DNA, 20 bp, Artificial
  CRISPR gRNA sequence
caatgacaagaagtcactgc

SEQ ID NO: 294482 - DNA, 20 bp, Artificial
  CRISPR gRNA sequence
ccctcaagacacattctagt

SEQ ID NO: 294483 - DNA, 20 bp, Artificial
  CRISPR gRNA sequence
aagacacattctagtttagt

SEQ ID NO: 294484 - DNA, 20 bp, Artificial
  CRISPR gRNA sequence
tagtttagtctgtttatttt

SEQ ID NO: 294485 - DNA, 20 bp, Artificial
  CRISPR gRNA sequence
gtttagtctgtttatttttt

SEQ ID NO: 294486 - DNA, 20 bp, Artificial
  CRISPR gRNA sequence
agtctgtttattttttccct

SEQ ID NO: 294487 - DNA, 20 bp, Artificial
  CRISPR gRNA sequence
gtctgtttattttttccctg

SEQ ID NO: 294488 - DNA, 20 bp, Artificial
  CRISPR gRNA sequence
tttattttttccctgacttt

SEQ ID NO: 294489 - DNA, 20 bp, Artificial
  CRISPR gRNA sequence
attttttccctgactttata

SEQ ID NO: 294490 - DNA, 20 bp, Artificial
  CRISPR gRNA sequence
ttttttccctgactttatat

SEQ ID NO: 294491 - DNA, 20 bp, Artificial
  CRISPR gRNA sequence
tttccctgactttatatatt

SEQ ID NO: 294492 - DNA, 20 bp, Artificial
  CRISPR gRNA sequence
ttccctgactttatatattt

SEQ ID NO: 294493 - DNA, 20 bp, Artificial
  CRISPR gRNA sequence
tccctgactttatatatttt

SEQ ID NO: 294494 - DNA, 20 bp, Artificial
  CRISPR gRNA sequence
ccctgactttatatattttt

SEQ ID NO: 294495 - DNA, 20 bp, Artificial
  CRISPR gRNA sequence
cctgactttatatatttttg

SEQ ID NO: 294496 - DNA, 20 bp, Artificial
  CRISPR gRNA sequence
actttatatatttttggaga

SEQ ID NO: 294497 - DNA, 20 bp, Artificial
  CRISPR gRNA sequence
tatatatttttggagactgg

SEQ ID NO: 294498 - DNA, 20 bp, Artificial
  CRISPR gRNA sequence
atatatttttggagactggg

SEQ ID NO: 294499 - DNA, 20 bp, Artificial
  CRISPR gRNA sequence
tatatttttggagactgggg

SEQ ID NO: 294500 - DNA, 20 bp, Artificial
  CRISPR gRNA sequence
ttggagactggggtttgcta

SEQ ID NO: 294501 - DNA, 20 bp, Artificial
  CRISPR gRNA sequence
tggagactggggtttgctaa

SEQ ID NO: 294502 - DNA, 20 bp, Artificial
  CRISPR gRNA sequence
ggagactggggtttgctaac

SEQ ID NO: 294503 - DNA, 20 bp, Artificial
  CRISPR gRNA sequence
gagactggggtttgctaact

SEQ ID NO: 294504 - DNA, 20 bp, Artificial
  CRISPR gRNA sequence
gggtttgctaactaatttga

SEQ ID NO: 294505 - DNA, 20 bp, Artificial
  CRISPR gRNA sequence
gctaactaatttgaaaacgt

SEQ ID NO: 294506 - DNA, 20 bp, Artificial
  CRISPR gRNA sequence
ctaactaatttgaaaacgtt

SEQ ID NO: 294507 - DNA, 20 bp, Artificial
  CRISPR gRNA sequence
actaatttgaaaacgtttct

SEQ ID NO: 294508 - DNA, 20 bp, Artificial
  CRISPR gRNA sequence
atttgaaaacgtttctgatg

SEQ ID NO: 294509 - DNA, 20 bp, Artificial
  CRISPR gRNA sequence
gaaaacgtttctgatgctaa

SEQ ID NO: 294510 - DNA, 20 bp, Artificial
  CRISPR gRNA sequence
aaaacgtttctgatgctaaa

SEQ ID NO: 294511 - DNA, 20 bp, Artificial
  CRISPR gRNA sequence
ctgatgctaaatgatattct

SEQ ID NO: 294512 - DNA, 20 bp, Artificial
  CRISPR gRNA sequence
tgatgctaaatgatattcta

SEQ ID NO: 294513 - DNA, 20 bp, Artificial
  CRISPR gRNA sequence
atgctaaatgatattctaat

SEQ ID NO: 294514 - DNA, 20 bp, Artificial
  CRISPR gRNA sequence
aatgatattctaattttttt

SEQ ID NO: 294515 - DNA, 20 bp, Artificial
  CRISPR gRNA sequence
taatttttttttaagggcta

SEQ ID NO: 294516 - DNA, 20 bp, Artificial
  CRISPR gRNA sequence
atttttttttaagggctagt

SEQ ID NO: 294517 - DNA, 20 bp, Artificial
  CRISPR gRNA sequence
ttttttaagggctagtcgat

SEQ ID NO: 294518 - DNA, 20 bp, Artificial
  CRISPR gRNA sequence
tttttaagggctagtcgatt

SEQ ID NO: 294519 - DNA, 20 bp, Artificial
  CRISPR gRNA sequence
ttttaagggctagtcgattt

SEQ ID NO: 294520 - DNA, 20 bp, Artificial
  CRISPR gRNA sequence
tttaagggctagtcgatttg

SEQ ID NO: 294521 - DNA, 20 bp, Artificial
  CRISPR gRNA sequence
ttaagggctagtcgatttgg

SEQ ID NO: 294522 - DNA, 20 bp, Artificial
  CRISPR gRNA sequence
taagggctagtcgatttggc

SEQ ID NO: 294523 - DNA, 20 bp, Artificial
  CRISPR gRNA sequence
aagggctagtcgatttggca

SEQ ID NO: 294524 - DNA, 20 bp, Artificial
  CRISPR gRNA sequence
agggctagtcgatttggcag

SEQ ID NO: 294525 - DNA, 20 bp, Artificial
  CRISPR gRNA sequence
gtcgatttggcaggtgagtt

SEQ ID NO: 294526 - DNA, 20 bp, Artificial
  CRISPR gRNA sequence
ggcaggtgagttgttacaca

SEQ ID NO: 294527 - DNA, 20 bp, Artificial
  CRISPR gRNA sequence
gcaggtgagttgttacacac

SEQ ID NO: 294528 - DNA, 20 bp, Artificial
  CRISPR gRNA sequence
ttacacactccttagtgaat

SEQ ID NO: 294529 - DNA, 20 bp, Artificial
  CRISPR gRNA sequence
cacactccttagtgaattcc

SEQ ID NO: 294530 - DNA, 20 bp, Artificial
  CRISPR gRNA sequence
cttagtgaattccaacttcc

SEQ ID NO: 294531 - DNA, 20 bp, Artificial
  CRISPR gRNA sequence
agtgaattccaacttccatg

SEQ ID NO: 294532 - DNA, 20 bp, Artificial
  CRISPR gRNA sequence
gtgaattccaacttccatgg

SEQ ID NO: 294533 - DNA, 20 bp, Artificial
  CRISPR gRNA sequence
caacttccatggccaccatc

SEQ ID NO: 294534 - DNA, 20 bp, Artificial
  CRISPR gRNA sequence
ccatggccaccatcctgctg

SEQ ID NO: 294535 - DNA, 20 bp, Artificial
  CRISPR gRNA sequence
catggccaccatcctgctga

SEQ ID NO: 294536 - DNA, 20 bp, Artificial
  CRISPR gRNA sequence
ctgatattctaattttgatt

SEQ ID NO: 294537 - DNA, 20 bp, Artificial
  CRISPR gRNA sequence
atattctaattttgatttgg

SEQ ID NO: 294538 - DNA, 20 bp, Artificial
  CRISPR gRNA sequence
taattttgatttggagttag

SEQ ID NO: 294539 - DNA, 20 bp, Artificial
  CRISPR gRNA sequence
attttgatttggagttagag

SEQ ID NO: 294540 - DNA, 20 bp, Artificial
  CRISPR gRNA sequence
tgatttggagttagagaaaa

SEQ ID NO: 294541 - DNA, 20 bp, Artificial
  CRISPR gRNA sequence
gatttggagttagagaaaag

SEQ ID NO: 294542 - DNA, 20 bp, Artificial
  CRISPR gRNA sequence
atttggagttagagaaaagg

SEQ ID NO: 294543 - DNA, 20 bp, Artificial
  CRISPR gRNA sequence
ggagttagagaaaaggcaaa

SEQ ID NO: 294544 - DNA, 20 bp, Artificial
  CRISPR gRNA sequence
gagttagagaaaaggcaaat

SEQ ID NO: 294545 - DNA, 20 bp, Artificial
  CRISPR gRNA sequence
gagaaaaggcaaattgacaa

SEQ ID NO: 294546 - DNA, 20 bp, Artificial
  CRISPR gRNA sequence
acaaattttggtgccaagaa

SEQ ID NO: 294547 - DNA, 20 bp, Artificial
  CRISPR gRNA sequence
tggtgccaagaatcattttc

SEQ ID NO: 294548 - DNA, 20 bp, Artificial
  CRISPR gRNA sequence
ggtgccaagaatcattttct

SEQ ID NO: 294549 - DNA, 20 bp, Artificial
  CRISPR gRNA sequence
gtgccaagaatcattttctt

SEQ ID NO: 294550 - DNA, 20 bp, Artificial
  CRISPR gRNA sequence
tcttggaggagggcaagatg

SEQ ID NO: 294551 - DNA, 20 bp, Artificial
  CRISPR gRNA sequence
cttggaggagggcaagatgc

SEQ ID NO: 294552 - DNA, 20 bp, Artificial
  CRISPR gRNA sequence
ttggaggagggcaagatgca

SEQ ID NO: 294553 - DNA, 20 bp, Artificial
  CRISPR gRNA sequence
ggaggagggcaagatgcact

SEQ ID NO: 294554 - DNA, 20 bp, Artificial
  CRISPR gRNA sequence
gaggagggcaagatgcacta

SEQ ID NO: 294555 - DNA, 20 bp, Artificial
  CRISPR gRNA sequence
atacagttgagaaactacat

SEQ ID NO: 294556 - DNA, 20 bp, Artificial
  CRISPR gRNA sequence
agaaactacatggctacagg

SEQ ID NO: 294557 - DNA, 20 bp, Artificial
  CRISPR gRNA sequence
catggctacaggtgatctca

SEQ ID NO: 294558 - DNA, 20 bp, Artificial
  CRISPR gRNA sequence
caggtgatctcaccaattct

SEQ ID NO: 294559 - DNA, 20 bp, Artificial
  CRISPR gRNA sequence
accaattctcagttcttggg

SEQ ID NO: 294560 - DNA, 20 bp, Artificial
  CRISPR gRNA sequence
tcagttcttgggctgggtgg

SEQ ID NO: 294561 - DNA, 20 bp, Artificial
  CRISPR gRNA sequence
agttcttgggctgggtgggg

SEQ ID NO: 294562 - DNA, 20 bp, Artificial
  CRISPR gRNA sequence
ttgggctgggtggggtggct

SEQ ID NO: 294563 - DNA, 20 bp, Artificial
  CRISPR gRNA sequence
gggctgggtggggtggctca

SEQ ID NO: 294564 - DNA, 20 bp, Artificial
  CRISPR gRNA sequence
ggctgggtggggtggctcat

SEQ ID NO: 294565 - DNA, 20 bp, Artificial
  CRISPR gRNA sequence
ggtggggtggctcatgcctg

SEQ ID NO: 294566 - DNA, 20 bp, Artificial
  CRISPR gRNA sequence
atgcctgtaatcccagcact

SEQ ID NO: 294567 - DNA, 20 bp, Artificial
  CRISPR gRNA sequence
taatcccagcactttgggag

SEQ ID NO: 294568 - DNA, 20 bp, Artificial
  CRISPR gRNA sequence
tgggaggccaaggcaggtgg

SEQ ID NO: 294569 - DNA, 20 bp, Artificial
  CRISPR gRNA sequence
gggaggccaaggcaggtgga

SEQ ID NO: 294570 - DNA, 20 bp, Artificial
  CRISPR gRNA sequence
ggaggccaaggcaggtggat

SEQ ID NO: 294571 - DNA, 20 bp, Artificial
  CRISPR gRNA sequence
aaggtcaggagttcgagacc

SEQ ID NO: 294572 - DNA, 20 bp, Artificial
  CRISPR gRNA sequence
aggtcaggagttcgagaccg

SEQ ID NO: 294573 - DNA, 20 bp, Artificial
  CRISPR gRNA sequence
gagaccggcctggccaacat

SEQ ID NO: 294574 - DNA, 20 bp, Artificial
  CRISPR gRNA sequence
gccaacatggtgaaactctg

SEQ ID NO: 294575 - DNA, 20 bp, Artificial
  CRISPR gRNA sequence
tgtctctactaaaaatacaa

SEQ ID NO: 294576 - DNA, 20 bp, Artificial
  CRISPR gRNA sequence
tctctactaaaaatacaaaa

SEQ ID NO: 294577 - DNA, 20 bp, Artificial
  CRISPR gRNA sequence
tactaaaaatacaaaaatta

SEQ ID NO: 294578 - DNA, 20 bp, Artificial
  CRISPR gRNA sequence
ctaaaaatacaaaaattagc

SEQ ID NO: 294579 - DNA, 20 bp, Artificial
  CRISPR gRNA sequence
aaaatacaaaaattagccag

SEQ ID NO: 294580 - DNA, 20 bp, Artificial
  CRISPR gRNA sequence
gccaggcatggtggcgtgca

SEQ ID NO: 294581 - DNA, 20 bp, Artificial
  CRISPR gRNA sequence
tagtcctagctactcaggag

SEQ ID NO: 294582 - DNA, 20 bp, Artificial
  CRISPR gRNA sequence
gctactcaggaggctgaagc

SEQ ID NO: 294583 - DNA, 20 bp, Artificial
  CRISPR gRNA sequence
ctcaggaggctgaagcagga

SEQ ID NO: 294584 - DNA, 20 bp, Artificial
  CRISPR gRNA sequence
aggaggctgaagcaggagaa

SEQ ID NO: 294585 - DNA, 20 bp, Artificial
  CRISPR gRNA sequence
aagcaggagaattgcttgaa

SEQ ID NO: 294586 - DNA, 20 bp, Artificial
  CRISPR gRNA sequence
cttgaacccaggaacccagg

SEQ ID NO: 294587 - DNA, 20 bp, Artificial
  CRISPR gRNA sequence
gaacccaggaacccaggagg

SEQ ID NO: 294588 - DNA, 20 bp, Artificial
  CRISPR gRNA sequence
aacccaggaacccaggaggc

SEQ ID NO: 294589 - DNA, 20 bp, Artificial
  CRISPR gRNA sequence
cagtgagccaagatcatgcc

SEQ ID NO: 294590 - DNA, 20 bp, Artificial
  CRISPR gRNA sequence
cactccagcctgggtgacag

SEQ ID NO: 294591 - DNA, 20 bp, Artificial
  CRISPR gRNA sequence
cagcctgggtgacagagtga

SEQ ID NO: 294592 - DNA, 20 bp, Artificial
  CRISPR gRNA sequence
ggtgacagagtgagactcca

SEQ ID NO: 294593 - DNA, 20 bp, Artificial
  CRISPR gRNA sequence
catctcaaaacacaaaccaa

SEQ ID NO: 294594 - DNA, 20 bp, Artificial
  CRISPR gRNA sequence
aaaacacaaaccaattctta

SEQ ID NO: 294595 - DNA, 20 bp, Artificial
  CRISPR gRNA sequence
ttagttcttttttttttttg

SEQ ID NO: 294596 - DNA, 20 bp, Artificial
  CRISPR gRNA sequence
agttcttttttttttttgag

SEQ ID NO: 294597 - DNA, 20 bp, Artificial
  CRISPR gRNA sequence
gttcttttttttttttgaga

SEQ ID NO: 294598 - DNA, 20 bp, Artificial
  CRISPR gRNA sequence
ttttttttttttgagatgga

SEQ ID NO: 294599 - DNA, 20 bp, Artificial
  CRISPR gRNA sequence
ttttttttttgagatggagt

SEQ ID NO: 294600 - DNA, 20 bp, Artificial
  CRISPR gRNA sequence
tttttttttgagatggagtc

SEQ ID NO: 294601 - DNA, 20 bp, Artificial
  CRISPR gRNA sequence
ttttttttgagatggagtct

SEQ ID NO: 294602 - DNA, 20 bp, Artificial
  CRISPR gRNA sequence
tttttttgagatggagtctc

SEQ ID NO: 294603 - DNA, 20 bp, Artificial
  CRISPR gRNA sequence
ttttttgagatggagtctca

SEQ ID NO: 294604 - DNA, 20 bp, Artificial
  CRISPR gRNA sequence
tttttgagatggagtctcac

SEQ ID NO: 294605 - DNA, 20 bp, Artificial
  CRISPR gRNA sequence
ttttgagatggagtctcact

SEQ ID NO: 294606 - DNA, 20 bp, Artificial
  CRISPR gRNA sequence
tttgagatggagtctcactc

SEQ ID NO: 294607 - DNA, 20 bp, Artificial
  CRISPR gRNA sequence
ttgagatggagtctcactct

SEQ ID NO: 294608 - DNA, 20 bp, Artificial
  CRISPR gRNA sequence
tgagatggagtctcactctg

SEQ ID NO: 294609 - DNA, 20 bp, Artificial
  CRISPR gRNA sequence
gagatggagtctcactctgc

SEQ ID NO: 294610 - DNA, 20 bp, Artificial
  CRISPR gRNA sequence
agatggagtctcactctgcc

SEQ ID NO: 294611 - DNA, 20 bp, Artificial
  CRISPR gRNA sequence
actctgccacccaggctgga

SEQ ID NO: 294612 - DNA, 20 bp, Artificial
  CRISPR gRNA sequence
tgccacccaggctggagtgt

SEQ ID NO: 294613 - DNA, 20 bp, Artificial
  CRISPR gRNA sequence
ccacccaggctggagtgtat

SEQ ID NO: 294614 - DNA, 20 bp, Artificial
  CRISPR gRNA sequence
gagtgtatgccccgatctca

SEQ ID NO: 294615 - DNA, 20 bp, Artificial
  CRISPR gRNA sequence
agctcactgcacctccgcct

SEQ ID NO: 294616 - DNA, 20 bp, Artificial
  CRISPR gRNA sequence
actgcacctccgcctcccag

SEQ ID NO: 294617 - DNA, 20 bp, Artificial
  CRISPR gRNA sequence
cacctccgcctcccaggttc

SEQ ID NO: 294618 - DNA, 20 bp, Artificial
  CRISPR gRNA sequence
cgcctcccaggttcaagcaa

SEQ ID NO: 294619 - DNA, 20 bp, Artificial
  CRISPR gRNA sequence
ccaggttcaagcaattatcc

SEQ ID NO: 294620 - DNA, 20 bp, Artificial
  CRISPR gRNA sequence
aagcaattatccggcctcag

SEQ ID NO: 294621 - DNA, 20 bp, Artificial
  CRISPR gRNA sequence
tccggcctcagcctcctgag

SEQ ID NO: 294622 - DNA, 20 bp, Artificial
  CRISPR gRNA sequence
agcctcctgagtagctggga

SEQ ID NO: 294623 - DNA, 20 bp, Artificial
  CRISPR gRNA sequence
ctgagtagctgggactacag

SEQ ID NO: 294624 - DNA, 20 bp, Artificial
  CRISPR gRNA sequence
agtagctgggactacaggtg

SEQ ID NO: 294625 - DNA, 20 bp, Artificial
  CRISPR gRNA sequence
ggactacaggtgcgtgctgc

SEQ ID NO: 294626 - DNA, 20 bp, Artificial
  CRISPR gRNA sequence
caggtgcgtgctgccacgcc

SEQ ID NO: 294627 - DNA, 20 bp, Artificial
  CRISPR gRNA sequence
ccacgcctgactaatttttt

SEQ ID NO: 294628 - DNA, 20 bp, Artificial
  CRISPR gRNA sequence
actaatttttttttgtattt

SEQ ID NO: 294629 - DNA, 20 bp, Artificial
  CRISPR gRNA sequence
atttttttttgtatttttag

SEQ ID NO: 294630 - DNA, 20 bp, Artificial
  CRISPR gRNA sequence
ttttttgtatttttagtaga

SEQ ID NO: 294631 - DNA, 20 bp, Artificial
  CRISPR gRNA sequence
tttttgtatttttagtagag

SEQ ID NO: 294632 - DNA, 20 bp, Artificial
  CRISPR gRNA sequence
ttttgtatttttagtagaga

SEQ ID NO: 294633 - DNA, 20 bp, Artificial
  CRISPR gRNA sequence
tttgtatttttagtagagac

SEQ ID NO: 294634 - DNA, 20 bp, Artificial
  CRISPR gRNA sequence
ttgtatttttagtagagacg

SEQ ID NO: 294635 - DNA, 20 bp, Artificial
  CRISPR gRNA sequence
tgtatttttagtagagacgg

SEQ ID NO: 294636 - DNA, 20 bp, Artificial
  CRISPR gRNA sequence
gtatttttagtagagacggg

SEQ ID NO: 294637 - DNA, 20 bp, Artificial
  CRISPR gRNA sequence
tatttttagtagagacgggg

SEQ ID NO: 294638 - DNA, 20 bp, Artificial
  CRISPR gRNA sequence
ttagtagagacggggtttca

SEQ ID NO: 294639 - DNA, 20 bp, Artificial
  CRISPR gRNA sequence
tagtagagacggggtttcac

SEQ ID NO: 294640 - DNA, 20 bp, Artificial
  CRISPR gRNA sequence
agtagagacggggtttcacc

SEQ ID NO: 294641 - DNA, 20 bp, Artificial
  CRISPR gRNA sequence
gtagagacggggtttcacca

SEQ ID NO: 294642 - DNA, 20 bp, Artificial
  CRISPR gRNA sequence
caccatgttggccaggatgg

SEQ ID NO: 294643 - DNA, 20 bp, Artificial
  CRISPR gRNA sequence
accatgttggccaggatggt

SEQ ID NO: 294644 - DNA, 20 bp, Artificial
  CRISPR gRNA sequence
gccaggatggtcttgatctc

SEQ ID NO: 294645 - DNA, 20 bp, Artificial
  CRISPR gRNA sequence
gatctcctgacctcgtgatc

SEQ ID NO: 294646 - DNA, 20 bp, Artificial
  CRISPR gRNA sequence
atctcctgacctcgtgatcc

SEQ ID NO: 294647 - DNA, 20 bp, Artificial
  CRISPR gRNA sequence
ctgacctcgtgatccgcctg

SEQ ID NO: 294648 - DNA, 20 bp, Artificial
  CRISPR gRNA sequence
acctcgtgatccgcctgcct

SEQ ID NO: 294649 - DNA, 20 bp, Artificial
  CRISPR gRNA sequence
gtgatccgcctgccttggct

SEQ ID NO: 294650 - DNA, 20 bp, Artificial
  CRISPR gRNA sequence
ccttggcttcccaaagtgct

SEQ ID NO: 294651 - DNA, 20 bp, Artificial
  CRISPR gRNA sequence
ggcttcccaaagtgctggga

SEQ ID NO: 294652 - DNA, 20 bp, Artificial
  CRISPR gRNA sequence
gcttcccaaagtgctgggac

SEQ ID NO: 294653 - DNA, 20 bp, Artificial
  CRISPR gRNA sequence
cccaaagtgctgggacttct

SEQ ID NO: 294654 - DNA, 20 bp, Artificial
  CRISPR gRNA sequence
ccaaagtgctgggacttctt

SEQ ID NO: 294655 - DNA, 20 bp, Artificial
  CRISPR gRNA sequence
ggacttcttgtctttggaat

SEQ ID NO: 294656 - DNA, 20 bp, Artificial
  CRISPR gRNA sequence
cttgtctttggaattccagt

SEQ ID NO: 294657 - DNA, 20 bp, Artificial
  CRISPR gRNA sequence
ttgtctttggaattccagtg

SEQ ID NO: 294658 - DNA, 20 bp, Artificial
  CRISPR gRNA sequence
gtctttggaattccagtgcc

SEQ ID NO: 294659 - DNA, 20 bp, Artificial
  CRISPR gRNA sequence
tctttggaattccagtgcct

SEQ ID NO: 294660 - DNA, 20 bp, Artificial
  CRISPR gRNA sequence
tggaattccagtgcctagta

SEQ ID NO: 294661 - DNA, 20 bp, Artificial
  CRISPR gRNA sequence
ggaattccagtgcctagtag

SEQ ID NO: 294662 - DNA, 20 bp, Artificial
  CRISPR gRNA sequence
gaattccagtgcctagtaga

SEQ ID NO: 294663 - DNA, 20 bp, Artificial
  CRISPR gRNA sequence
cagtgcctagtagagtgcca

SEQ ID NO: 294664 - DNA, 20 bp, Artificial
  CRISPR gRNA sequence
gtagagtgccacacacatag

SEQ ID NO: 294665 - DNA, 20 bp, Artificial
  CRISPR gRNA sequence
gaaaatgtccattttctcag

SEQ ID NO: 294666 - DNA, 20 bp, Artificial
  CRISPR gRNA sequence
tctcagttctttagaataca

SEQ ID NO: 294667 - DNA, 20 bp, Artificial
  CRISPR gRNA sequence
ctcagttctttagaatacat

SEQ ID NO: 294668 - DNA, 20 bp, Artificial
  CRISPR gRNA sequence
tcagttctttagaatacatt

SEQ ID NO: 294669 - DNA, 20 bp, Artificial
  CRISPR gRNA sequence
agttctttagaatacatttt

SEQ ID NO: 294670 - DNA, 20 bp, Artificial
  CRISPR gRNA sequence
tttagaatacatttttggat

SEQ ID NO: 294671 - DNA, 20 bp, Artificial
  CRISPR gRNA sequence
tagaatacatttttggatga

SEQ ID NO: 294672 - DNA, 20 bp, Artificial
  CRISPR gRNA sequence
agaatacatttttggatgaa

SEQ ID NO: 294673 - DNA, 20 bp, Artificial
  CRISPR gRNA sequence
gaatacatttttggatgaaa

SEQ ID NO: 294674 - DNA, 20 bp, Artificial
  CRISPR gRNA sequence
ttggatgaaagatcaggagt

SEQ ID NO: 294675 - DNA, 20 bp, Artificial
  CRISPR gRNA sequence
tggatgaaagatcaggagtg

SEQ ID NO: 294676 - DNA, 20 bp, Artificial
  CRISPR gRNA sequence
ggatgaaagatcaggagtgg

SEQ ID NO: 294677 - DNA, 20 bp, Artificial
  CRISPR gRNA sequence
gatgaaagatcaggagtggc

SEQ ID NO: 294678 - DNA, 20 bp, Artificial
  CRISPR gRNA sequence
atgaaagaagagatttctaa

SEQ ID NO: 294679 - DNA, 20 bp, Artificial
  CRISPR gRNA sequence
ctaagatattttaccctatg

SEQ ID NO: 294680 - DNA, 20 bp, Artificial
  CRISPR gRNA sequence
taagatattttaccctatga

SEQ ID NO: 294681 - DNA, 20 bp, Artificial
  CRISPR gRNA sequence
agatattttaccctatgaat

SEQ ID NO: 294682 - DNA, 20 bp, Artificial
  CRISPR gRNA sequence
taccctatgaatttacactt

SEQ ID NO: 294683 - DNA, 20 bp, Artificial
  CRISPR gRNA sequence
accctatgaatttacacttt

SEQ ID NO: 294684 - DNA, 20 bp, Artificial
  CRISPR gRNA sequence
ccctatgaatttacactttg

SEQ ID NO: 294685 - DNA, 20 bp, Artificial
  CRISPR gRNA sequence
tgaatttacactttgggtgt

SEQ ID NO: 294686 - DNA, 20 bp, Artificial
  CRISPR gRNA sequence
acactttgggtgttagacat

SEQ ID NO: 294687 - DNA, 20 bp, Artificial
  CRISPR gRNA sequence
cactttgggtgttagacata

SEQ ID NO: 294688 - DNA, 20 bp, Artificial
  CRISPR gRNA sequence
tgggtgttagacatatgctg

SEQ ID NO: 294689 - DNA, 20 bp, Artificial
  CRISPR gRNA sequence
gggtgttagacatatgctgc

SEQ ID NO: 294690 - DNA, 20 bp, Artificial
  CRISPR gRNA sequence
ggtgttagacatatgctgcc

SEQ ID NO: 294691 - DNA, 20 bp, Artificial
  CRISPR gRNA sequence
gacatatgctgccctcaatc

SEQ ID NO: 294692 - DNA, 20 bp, Artificial
  CRISPR gRNA sequence
ccctcaatctctatgattaa

SEQ ID NO: 294693 - DNA, 20 bp, Artificial
  CRISPR gRNA sequence
aatctctatgattaaatgaa

SEQ ID NO: 294694 - DNA, 20 bp, Artificial
  CRISPR gRNA sequence
tatgattaaatgaagaggaa

SEQ ID NO: 294695 - DNA, 20 bp, Artificial
  CRISPR gRNA sequence
tgattaaatgaagaggaact

SEQ ID NO: 294696 - DNA, 20 bp, Artificial
  CRISPR gRNA sequence
aatgaagaggaactgctagt

SEQ ID NO: 294697 - DNA, 20 bp, Artificial
  CRISPR gRNA sequence
ctagttctatggtccgaaat

SEQ ID NO: 294698 - DNA, 20 bp, Artificial
  CRISPR gRNA sequence
gttctatggtccgaaataag

SEQ ID NO: 294699 - DNA, 20 bp, Artificial
  CRISPR gRNA sequence
tatggtccgaaataaggcca

SEQ ID NO: 294700 - DNA, 20 bp, Artificial
  CRISPR gRNA sequence
tggtccgaaataaggccata

SEQ ID NO: 294701 - DNA, 20 bp, Artificial
  CRISPR gRNA sequence
tgaaggggtaccaacccttc

SEQ ID NO: 294702 - DNA, 20 bp, Artificial
  CRISPR gRNA sequence
ctttgagtagaaatcatgta

SEQ ID NO: 294703 - DNA, 20 bp, Artificial
  CRISPR gRNA sequence
tttgagtagaaatcatgtac

SEQ ID NO: 294704 - DNA, 20 bp, Artificial
  CRISPR gRNA sequence
tgagtagaaatcatgtacac

SEQ ID NO: 294705 - DNA, 20 bp, Artificial
  CRISPR gRNA sequence
gagtagaaatcatgtacact

SEQ ID NO: 294706 - DNA, 20 bp, Artificial
  CRISPR gRNA sequence
agtagaaatcatgtacactg

SEQ ID NO: 294707 - DNA, 20 bp, Artificial
  CRISPR gRNA sequence
atcaaataaaatcggaagat

SEQ ID NO: 294708 - DNA, 20 bp, Artificial
  CRISPR gRNA sequence
ctgattttcccaggctttag

SEQ ID NO: 294709 - DNA, 20 bp, Artificial
  CRISPR gRNA sequence
attttcccaggctttagcac

SEQ ID NO: 294710 - DNA, 20 bp, Artificial
  CRISPR gRNA sequence
tcccaggctttagcaccaaa

SEQ ID NO: 294711 - DNA, 20 bp, Artificial
  CRISPR gRNA sequence
cccaggctttagcaccaaaa

SEQ ID NO: 294712 - DNA, 20 bp, Artificial
  CRISPR gRNA sequence
ccaggctttagcaccaaaaa

SEQ ID NO: 294713 - DNA, 20 bp, Artificial
  CRISPR gRNA sequence
tagcaccaaaaaaacccaaa

SEQ ID NO: 294714 - DNA, 20 bp, Artificial
  CRISPR gRNA sequence
agcaccaaaaaaacccaaag

SEQ ID NO: 294715 - DNA, 20 bp, Artificial
  CRISPR gRNA sequence
gcaccaaaaaaacccaaagc

SEQ ID NO: 294716 - DNA, 20 bp, Artificial
  CRISPR gRNA sequence
agtgaattctttagagagta

SEQ ID NO: 294717 - DNA, 20 bp, Artificial
  CRISPR gRNA sequence
tttagagagtatgtgctgtt

SEQ ID NO: 294718 - DNA, 20 bp, Artificial
  CRISPR gRNA sequence
tagagagtatgtgctgttaa

SEQ ID NO: 294719 - DNA, 20 bp, Artificial
  CRISPR gRNA sequence
agagagtatgtgctgttaac

SEQ ID NO: 294720 - DNA, 20 bp, Artificial
  CRISPR gRNA sequence
gagagtatgtgctgttaaca

SEQ ID NO: 294721 - DNA, 20 bp, Artificial
  CRISPR gRNA sequence
ttaacaacttatcccaaggg

SEQ ID NO: 294722 - DNA, 20 bp, Artificial
  CRISPR gRNA sequence
acaacttatcccaagggtag

SEQ ID NO: 294723 - DNA, 20 bp, Artificial
  CRISPR gRNA sequence
atcccaagggtaggataaag

SEQ ID NO: 294724 - DNA, 20 bp, Artificial
  CRISPR gRNA sequence
tcccaagggtaggataaaga

SEQ ID NO: 294725 - DNA, 20 bp, Artificial
  CRISPR gRNA sequence
gtgggctcaaggatgtttct

SEQ ID NO: 294726 - DNA, 20 bp, Artificial
  CRISPR gRNA sequence
aaggatgtttctaataccaa

SEQ ID NO: 294727 - DNA, 20 bp, Artificial
  CRISPR gRNA sequence
ctaataccaactatccagtg

SEQ ID NO: 294728 - DNA, 20 bp, Artificial
  CRISPR gRNA sequence
taataccaactatccagtgt

SEQ ID NO: 294729 - DNA, 20 bp, Artificial
  CRISPR gRNA sequence
ataccaactatccagtgtta

SEQ ID NO: 294730 - DNA, 20 bp, Artificial
  CRISPR gRNA sequence
tccagtgttacccctttaat

SEQ ID NO: 294731 - DNA, 20 bp, Artificial
  CRISPR gRNA sequence
cccctttaattcaggggctc

SEQ ID NO: 294732 - DNA, 20 bp, Artificial
  CRISPR gRNA sequence
taattcaggggctctcatcc

SEQ ID NO: 294733 - DNA, 20 bp, Artificial
  CRISPR gRNA sequence
aattcaggggctctcatcct

SEQ ID NO: 294734 - DNA, 20 bp, Artificial
  CRISPR gRNA sequence
attcaggggctctcatcctc

SEQ ID NO: 294735 - DNA, 20 bp, Artificial
  CRISPR gRNA sequence
aggggctctcatcctcaaca

SEQ ID NO: 294736 - DNA, 20 bp, Artificial
  CRISPR gRNA sequence
tcatcctcaacattattggc

SEQ ID NO: 294737 - DNA, 20 bp, Artificial
  CRISPR gRNA sequence
atcctcaacattattggcat

SEQ ID NO: 294738 - DNA, 20 bp, Artificial
  CRISPR gRNA sequence
aacattattggcattttggg

SEQ ID NO: 294739 - DNA, 20 bp, Artificial
  CRISPR gRNA sequence
ttggcattttgggcaagata

SEQ ID NO: 294740 - DNA, 20 bp, Artificial
  CRISPR gRNA sequence
gcattttgggcaagataatt

SEQ ID NO: 294741 - DNA, 20 bp, Artificial
  CRISPR gRNA sequence
tgggcaagataattctttgt

SEQ ID NO: 294742 - DNA, 20 bp, Artificial
  CRISPR gRNA sequence
gggcaagataattctttgtt

SEQ ID NO: 294743 - DNA, 20 bp, Artificial
  CRISPR gRNA sequence
ggcaagataattctttgttt

SEQ ID NO: 294744 - DNA, 20 bp, Artificial
  CRISPR gRNA sequence
tttgttttggagtgctgttc

SEQ ID NO: 294745 - DNA, 20 bp, Artificial
  CRISPR gRNA sequence
tgttttggagtgctgttctg

SEQ ID NO: 294746 - DNA, 20 bp, Artificial
  CRISPR gRNA sequence
gttttggagtgctgttctgt

SEQ ID NO: 294747 - DNA, 20 bp, Artificial
  CRISPR gRNA sequence
ttttggagtgctgttctgtg

SEQ ID NO: 294748 - DNA, 20 bp, Artificial
  CRISPR gRNA sequence
tggagtgctgttctgtgcac

SEQ ID NO: 294749 - DNA, 20 bp, Artificial
  CRISPR gRNA sequence
ggagtgctgttctgtgcact

SEQ ID NO: 294750 - DNA, 20 bp, Artificial
  CRISPR gRNA sequence
gagtgctgttctgtgcactg

SEQ ID NO: 294751 - DNA, 20 bp, Artificial
  CRISPR gRNA sequence
ttctgtgcactgtaggatgt

SEQ ID NO: 294752 - DNA, 20 bp, Artificial
  CRISPR gRNA sequence
tgtgcactgtaggatgttta

SEQ ID NO: 294753 - DNA, 20 bp, Artificial
  CRISPR gRNA sequence
tgcactgtaggatgtttagc

SEQ ID NO: 294754 - DNA, 20 bp, Artificial
  CRISPR gRNA sequence
taggatgtttagcagcttcc

SEQ ID NO: 294755 - DNA, 20 bp, Artificial
  CRISPR gRNA sequence
agcagcttccttagcctcta

SEQ ID NO: 294756 - DNA, 20 bp, Artificial
  CRISPR gRNA sequence
gcagcttccttagcctctac

SEQ ID NO: 294757 - DNA, 20 bp, Artificial
  CRISPR gRNA sequence
ccttagcctctactcactac

SEQ ID NO: 294758 - DNA, 20 bp, Artificial
  CRISPR gRNA sequence
cttagcctctactcactaca

SEQ ID NO: 294759 - DNA, 20 bp, Artificial
  CRISPR gRNA sequence
agcctctactcactacatgc

SEQ ID NO: 294760 - DNA, 20 bp, Artificial
  CRISPR gRNA sequence
gcctctactcactacatgcc

SEQ ID NO: 294761 - DNA, 20 bp, Artificial
  CRISPR gRNA sequence
tactcactacatgccagtag

SEQ ID NO: 294762 - DNA, 20 bp, Artificial
  CRISPR gRNA sequence
ctcactacatgccagtagca

SEQ ID NO: 294763 - DNA, 20 bp, Artificial
  CRISPR gRNA sequence
actacatgccagtagcaccc

SEQ ID NO: 294764 - DNA, 20 bp, Artificial
  CRISPR gRNA sequence
catgccagtagcaccccttg

SEQ ID NO: 294765 - DNA, 20 bp, Artificial
  CRISPR gRNA sequence
gcccgttgcgacaatcaaaa

SEQ ID NO: 294766 - DNA, 20 bp, Artificial
  CRISPR gRNA sequence
cccgttgcgacaatcaaaaa

SEQ ID NO: 294767 - DNA, 20 bp, Artificial
  CRISPR gRNA sequence
cgacaatcaaaaatatcccc

SEQ ID NO: 294768 - DNA, 20 bp, Artificial
  CRISPR gRNA sequence
ccaaatgtccccttggcaaa

SEQ ID NO: 294769 - DNA, 20 bp, Artificial
  CRISPR gRNA sequence
ggcaaagaggtaaagaggga

SEQ ID NO: 294770 - DNA, 20 bp, Artificial
  CRISPR gRNA sequence
gcaaagaggtaaagagggag

SEQ ID NO: 294771 - DNA, 20 bp, Artificial
  CRISPR gRNA sequence
taaatcacccctggtataag

SEQ ID NO: 294772 - DNA, 20 bp, Artificial
  CRISPR gRNA sequence
gtataagaacaactgctcca

SEQ ID NO: 294773 - DNA, 20 bp, Artificial
  CRISPR gRNA sequence
ctccagttctaagccagtct

SEQ ID NO: 294774 - DNA, 20 bp, Artificial
  CRISPR gRNA sequence
cagttctaagccagtctgaa

SEQ ID NO: 294775 - DNA, 20 bp, Artificial
  CRISPR gRNA sequence
taagccagtctgaagccttg

SEQ ID NO: 294776 - DNA, 20 bp, Artificial
  CRISPR gRNA sequence
agccagtctgaagccttgct

SEQ ID NO: 294777 - DNA, 20 bp, Artificial
  CRISPR gRNA sequence
aagccttgctaaagtaaata

SEQ ID NO: 294778 - DNA, 20 bp, Artificial
  CRISPR gRNA sequence
gctaaagtaaatattaacat

SEQ ID NO: 294779 - DNA, 20 bp, Artificial
  CRISPR gRNA sequence
ctaaagtaaatattaacata

SEQ ID NO: 294780 - DNA, 20 bp, Artificial
  CRISPR gRNA sequence
aagtaaatattaacatatgg

SEQ ID NO: 294781 - DNA, 20 bp, Artificial
  CRISPR gRNA sequence
acatatgggcacaattcaag

SEQ ID NO: 294782 - DNA, 20 bp, Artificial
  CRISPR gRNA sequence
aagggaaacttacttatcat

SEQ ID NO: 294783 - DNA, 20 bp, Artificial
  CRISPR gRNA sequence
acttatcatttttattgttt

SEQ ID NO: 294784 - DNA, 20 bp, Artificial
  CRISPR gRNA sequence
cttatcatttttattgtttg

SEQ ID NO: 294785 - DNA, 20 bp, Artificial
  CRISPR gRNA sequence
atcatttttattgtttgttc

SEQ ID NO: 294786 - DNA, 20 bp, Artificial
  CRISPR gRNA sequence
tcatttttattgtttgttct

SEQ ID NO: 294787 - DNA, 20 bp, Artificial
  CRISPR gRNA sequence
ttattgtttgttcttgtctc

SEQ ID NO: 294788 - DNA, 20 bp, Artificial
  CRISPR gRNA sequence
tattgtttgttcttgtctcc

SEQ ID NO: 294789 - DNA, 20 bp, Artificial
  CRISPR gRNA sequence
attgtttgttcttgtctcca

SEQ ID NO: 294790 - DNA, 20 bp, Artificial
  CRISPR gRNA sequence
ttgtttgttcttgtctccaa

SEQ ID NO: 294791 - DNA, 20 bp, Artificial
  CRISPR gRNA sequence
tttgttcttgtctccaaggc

SEQ ID NO: 294792 - DNA, 20 bp, Artificial
  CRISPR gRNA sequence
gttcttgtctccaaggcttt

SEQ ID NO: 294793 - DNA, 20 bp, Artificial
  CRISPR gRNA sequence
ttcttgtctccaaggctttg

SEQ ID NO: 294794 - DNA, 20 bp, Artificial
  CRISPR gRNA sequence
ttgtctccaaggctttgccc

SEQ ID NO: 294795 - DNA, 20 bp, Artificial
  CRISPR gRNA sequence
gtctccaaggctttgcccca

SEQ ID NO: 294796 - DNA, 20 bp, Artificial
  CRISPR gRNA sequence
tctccaaggctttgccccaa

SEQ ID NO: 294797 - DNA, 20 bp, Artificial
  CRISPR gRNA sequence
caaggctttgccccaagatg

SEQ ID NO: 294798 - DNA, 20 bp, Artificial
  CRISPR gRNA sequence
tgccccaagatgcagagaga

SEQ ID NO: 294799 - DNA, 20 bp, Artificial
  CRISPR gRNA sequence
gccccaagatgcagagagag

SEQ ID NO: 294800 - DNA, 20 bp, Artificial
  CRISPR gRNA sequence
ccccaagatgcagagagaga

SEQ ID NO: 294801 - DNA, 20 bp, Artificial
  CRISPR gRNA sequence
agaagggaaagtgtacgccc

SEQ ID NO: 294802 - DNA, 20 bp, Artificial
  CRISPR gRNA sequence
tataacagtgtccgcagaag

SEQ ID NO: 294803 - DNA, 20 bp, Artificial
  CRISPR gRNA sequence
aaaagatctgaaggtagcct

SEQ ID NO: 294804 - DNA, 20 bp, Artificial
  CRISPR gRNA sequence
aaggtagcctccgtcatctc

SEQ ID NO: 294805 - DNA, 20 bp, Artificial
  CRISPR gRNA sequence
cgtcatctcttctgggatac

SEQ ID NO: 294806 - DNA, 20 bp, Artificial
  CRISPR gRNA sequence
ttctgggatacatggatcgt

SEQ ID NO: 294807 - DNA, 20 bp, Artificial
  CRISPR gRNA sequence
ctgggatacatggatcgtgg

SEQ ID NO: 294808 - DNA, 20 bp, Artificial
  CRISPR gRNA sequence
tgggatacatggatcgtggg

SEQ ID NO: 294809 - DNA, 20 bp, Artificial
  CRISPR gRNA sequence
ggatacatggatcgtgggga

SEQ ID NO: 294810 - DNA, 20 bp, Artificial
  CRISPR gRNA sequence
ttcccttaacaaatttaagc

SEQ ID NO: 294811 - DNA, 20 bp, Artificial
  CRISPR gRNA sequence
cccttaacaaatttaagctg

SEQ ID NO: 294812 - DNA, 20 bp, Artificial
  CRISPR gRNA sequence
ccttaacaaatttaagctgt

SEQ ID NO: 294813 - DNA, 20 bp, Artificial
  CRISPR gRNA sequence
aacaaatttaagctgtttta

SEQ ID NO: 294814 - DNA, 20 bp, Artificial
  CRISPR gRNA sequence
acaaatttaagctgttttac

SEQ ID NO: 294815 - DNA, 20 bp, Artificial
  CRISPR gRNA sequence
aagctgttttacccactacc

SEQ ID NO: 294816 - DNA, 20 bp, Artificial
  CRISPR gRNA sequence
agctgttttacccactacct

SEQ ID NO: 294817 - DNA, 20 bp, Artificial
  CRISPR gRNA sequence
ttttacccactacctcacct

SEQ ID NO: 294818 - DNA, 20 bp, Artificial
  CRISPR gRNA sequence
tacccactacctcaccttct

SEQ ID NO: 294819 - DNA, 20 bp, Artificial
  CRISPR gRNA sequence
acccactacctcaccttctt

SEQ ID NO: 294820 - DNA, 20 bp, Artificial
  CRISPR gRNA sequence
cccactacctcaccttctta

SEQ ID NO: 294821 - DNA, 20 bp, Artificial
  CRISPR gRNA sequence
cctcaccttcttaaaaacct

SEQ ID NO: 294822 - DNA, 20 bp, Artificial
  CRISPR gRNA sequence
accttcttaaaaacctcttt

SEQ ID NO: 294823 - DNA, 20 bp, Artificial
  CRISPR gRNA sequence
cttaaaaacctctttcagat

SEQ ID NO: 294824 - DNA, 20 bp, Artificial
  CRISPR gRNA sequence
ttaaaaacctctttcagatt

SEQ ID NO: 294825 - DNA, 20 bp, Artificial
  CRISPR gRNA sequence
aaaaacctctttcagattaa

SEQ ID NO: 294826 - DNA, 20 bp, Artificial
  CRISPR gRNA sequence
aaaacctctttcagattaag

SEQ ID NO: 294827 - DNA, 20 bp, Artificial
  CRISPR gRNA sequence
tttcagattaagctgaacag

SEQ ID NO: 294828 - DNA, 20 bp, Artificial
  CRISPR gRNA sequence
tcagattaagctgaacagtt

SEQ ID NO: 294829 - DNA, 20 bp, Artificial
  CRISPR gRNA sequence
cagattaagctgaacagtta

SEQ ID NO: 294830 - DNA, 20 bp, Artificial
  CRISPR gRNA sequence
agattaagctgaacagttac

SEQ ID NO: 294831 - DNA, 20 bp, Artificial
  CRISPR gRNA sequence
agctgaacagttacaagatg

SEQ ID NO: 294832 - DNA, 20 bp, Artificial
  CRISPR gRNA sequence
aacagttacaagatggctgg

SEQ ID NO: 294833 - DNA, 20 bp, Artificial
  CRISPR gRNA sequence
caagatggctggcatccctc

SEQ ID NO: 294834 - DNA, 20 bp, Artificial
  CRISPR gRNA sequence
gcatccctctcctttctccc

SEQ ID NO: 294835 - DNA, 20 bp, Artificial
  CRISPR gRNA sequence
tcctttctccccatatgcaa

SEQ ID NO: 294836 - DNA, 20 bp, Artificial
  CRISPR gRNA sequence
ctttctccccatatgcaatt

SEQ ID NO: 294837 - DNA, 20 bp, Artificial
  CRISPR gRNA sequence
tctccccatatgcaatttgc

SEQ ID NO: 294838 - DNA, 20 bp, Artificial
  CRISPR gRNA sequence
ctccccatatgcaatttgct

SEQ ID NO: 294839 - DNA, 20 bp, Artificial
  CRISPR gRNA sequence
tccccatatgcaatttgctt

SEQ ID NO: 294840 - DNA, 20 bp, Artificial
  CRISPR gRNA sequence
cccatatgcaatttgcttaa

SEQ ID NO: 294841 - DNA, 20 bp, Artificial
  CRISPR gRNA sequence
gcttaatgtaacctcttctt

SEQ ID NO: 294842 - DNA, 20 bp, Artificial
  CRISPR gRNA sequence
cttaatgtaacctcttcttt

SEQ ID NO: 294843 - DNA, 20 bp, Artificial
  CRISPR gRNA sequence
aatgtaacctcttcttttgc

SEQ ID NO: 294844 - DNA, 20 bp, Artificial
  CRISPR gRNA sequence
atgtaacctcttcttttgcc

SEQ ID NO: 294845 - DNA, 20 bp, Artificial
  CRISPR gRNA sequence
ttcttttgccatgtttccat

SEQ ID NO: 294846 - DNA, 20 bp, Artificial
  CRISPR gRNA sequence
cttttgccatgtttccattc

SEQ ID NO: 294847 - DNA, 20 bp, Artificial
  CRISPR gRNA sequence
ttttgccatgtttccattct

SEQ ID NO: 294848 - DNA, 20 bp, Artificial
  CRISPR gRNA sequence
ttgccatgtttccattctgc

SEQ ID NO: 294849 - DNA, 20 bp, Artificial
  CRISPR gRNA sequence
tgccatgtttccattctgcc

SEQ ID NO: 294850 - DNA, 20 bp, Artificial
  CRISPR gRNA sequence
gccatgtttccattctgcca

SEQ ID NO: 294851 - DNA, 20 bp, Artificial
  CRISPR gRNA sequence
ccatgtttccattctgccat

SEQ ID NO: 294852 - DNA, 20 bp, Artificial
  CRISPR gRNA sequence
ccattctgccatcttgaatt

SEQ ID NO: 294853 - DNA, 20 bp, Artificial
  CRISPR gRNA sequence
cattctgccatcttgaattg

SEQ ID NO: 294854 - DNA, 20 bp, Artificial
  CRISPR gRNA sequence
tgccatcttgaattgtcttg

SEQ ID NO: 294855 - DNA, 20 bp, Artificial
  CRISPR gRNA sequence
ccatcttgaattgtcttgtc

SEQ ID NO: 294856 - DNA, 20 bp, Artificial
  CRISPR gRNA sequence
gaattgtcttgtcagccaat

SEQ ID NO: 294857 - DNA, 20 bp, Artificial
  CRISPR gRNA sequence
aattgtcttgtcagccaatt

SEQ ID NO: 294858 - DNA, 20 bp, Artificial
  CRISPR gRNA sequence
tcttgtcagccaattcatta

SEQ ID NO: 294859 - DNA, 20 bp, Artificial
  CRISPR gRNA sequence
gtcagccaattcattatcta

SEQ ID NO: 294860 - DNA, 20 bp, Artificial
  CRISPR gRNA sequence
tcagccaattcattatctat

SEQ ID NO: 294861 - DNA, 20 bp, Artificial
  CRISPR gRNA sequence
attatctattaaacactaat

SEQ ID NO: 294862 - DNA, 20 bp, Artificial
  CRISPR gRNA sequence
tctattaaacactaatttga

SEQ ID NO: 294863 - DNA, 20 bp, Artificial
  CRISPR gRNA sequence
ttaaacactaatttgagttc

SEQ ID NO: 294864 - DNA, 20 bp, Artificial
  CRISPR gRNA sequence
aacactaatttgagttcatc

SEQ ID NO: 294865 - DNA, 20 bp, Artificial
  CRISPR gRNA sequence
atttgagttcatcttgaata

SEQ ID NO: 294866 - DNA, 20 bp, Artificial
  CRISPR gRNA sequence
gagttcatcttgaatattcc

SEQ ID NO: 294867 - DNA, 20 bp, Artificial
  CRISPR gRNA sequence
agttcatcttgaatattcct

SEQ ID NO: 294868 - DNA, 20 bp, Artificial
  CRISPR gRNA sequence
atcttgaatattcctgtggt

SEQ ID NO: 294869 - DNA, 20 bp, Artificial
  CRISPR gRNA sequence
gaatattcctgtggtaactt

SEQ ID NO: 294870 - DNA, 20 bp, Artificial
  CRISPR gRNA sequence
aatattcctgtggtaacttc

SEQ ID NO: 294871 - DNA, 20 bp, Artificial
  CRISPR gRNA sequence
ctgtggtaacttcttattct

SEQ ID NO: 294872 - DNA, 20 bp, Artificial
  CRISPR gRNA sequence
tggtaacttcttattctgat

SEQ ID NO: 294873 - DNA, 20 bp, Artificial
  CRISPR gRNA sequence
cttattctgatcattcattt

SEQ ID NO: 294874 - DNA, 20 bp, Artificial
  CRISPR gRNA sequence
ttattctgatcattcatttt

SEQ ID NO: 294875 - DNA, 20 bp, Artificial
  CRISPR gRNA sequence
attctgatcattcatttttc

SEQ ID NO: 294876 - DNA, 20 bp, Artificial
  CRISPR gRNA sequence
ttctgatcattcatttttcc

SEQ ID NO: 294877 - DNA, 20 bp, Artificial
  CRISPR gRNA sequence
tgatcattcatttttccctc

SEQ ID NO: 294878 - DNA, 20 bp, Artificial
  CRISPR gRNA sequence
atcattcatttttccctcta

SEQ ID NO: 294879 - DNA, 20 bp, Artificial
  CRISPR gRNA sequence
atttttccctctatctctca

SEQ ID NO: 294880 - DNA, 20 bp, Artificial
  CRISPR gRNA sequence
ttccctctatctctcagtat

SEQ ID NO: 294881 - DNA, 20 bp, Artificial
  CRISPR gRNA sequence
tccctctatctctcagtatt

SEQ ID NO: 294882 - DNA, 20 bp, Artificial
  CRISPR gRNA sequence
ccctctatctctcagtattg

SEQ ID NO: 294883 - DNA, 20 bp, Artificial
  CRISPR gRNA sequence
cctctatctctcagtattga

SEQ ID NO: 294884 - DNA, 20 bp, Artificial
  CRISPR gRNA sequence
tatctctcagtattgatgga

SEQ ID NO: 294885 - DNA, 20 bp, Artificial
  CRISPR gRNA sequence
tctctcagtattgatggaca

SEQ ID NO: 294886 - DNA, 20 bp, Artificial
  CRISPR gRNA sequence
tcagtattgatggacatggg

SEQ ID NO: 294887 - DNA, 20 bp, Artificial
  CRISPR gRNA sequence
agtattgatggacatgggtt

SEQ ID NO: 294888 - DNA, 20 bp, Artificial
  CRISPR gRNA sequence
atggacatgggttggggtca

SEQ ID NO: 294889 - DNA, 20 bp, Artificial
  CRISPR gRNA sequence
gggtcactttgtattaacac

SEQ ID NO: 294890 - DNA, 20 bp, Artificial
  CRISPR gRNA sequence
tgtattaacacggtaacatt

SEQ ID NO: 294891 - DNA, 20 bp, Artificial
  CRISPR gRNA sequence
gtattaacacggtaacattt

SEQ ID NO: 294892 - DNA, 20 bp, Artificial
  CRISPR gRNA sequence
tattaacacggtaacatttt

SEQ ID NO: 294893 - DNA, 20 bp, Artificial
  CRISPR gRNA sequence
acacggtaacattttcattg

SEQ ID NO: 294894 - DNA, 20 bp, Artificial
  CRISPR gRNA sequence
tcattggtttctctgcctct

SEQ ID NO: 294895 - DNA, 20 bp, Artificial
  CRISPR gRNA sequence
cattggtttctctgcctctt

SEQ ID NO: 294896 - DNA, 20 bp, Artificial
  CRISPR gRNA sequence
attggtttctctgcctctta

SEQ ID NO: 294897 - DNA, 20 bp, Artificial
  CRISPR gRNA sequence
gtttctctgcctcttactaa

SEQ ID NO: 294898 - DNA, 20 bp, Artificial
  CRISPR gRNA sequence
ctctgcctcttactaacaga

SEQ ID NO: 294899 - DNA, 20 bp, Artificial
  CRISPR gRNA sequence
tctgcctcttactaacagac

SEQ ID NO: 294900 - DNA, 20 bp, Artificial
  CRISPR gRNA sequence
tgcctcttactaacagactc

SEQ ID NO: 294901 - DNA, 20 bp, Artificial
  CRISPR gRNA sequence
cctcttactaacagactcat

SEQ ID NO: 294902 - DNA, 20 bp, Artificial
  CRISPR gRNA sequence
ttactaacagactcatccta

SEQ ID NO: 294903 - DNA, 20 bp, Artificial
  CRISPR gRNA sequence
actaacagactcatcctact

SEQ ID NO: 294904 - DNA, 20 bp, Artificial
  CRISPR gRNA sequence
ctaacagactcatcctactg

SEQ ID NO: 294905 - DNA, 20 bp, Artificial
  CRISPR gRNA sequence
acagactcatcctactgacg

SEQ ID NO: 294906 - DNA, 20 bp, Artificial
  CRISPR gRNA sequence
atcctactgacgaatcatgg

SEQ ID NO: 294907 - DNA, 20 bp, Artificial
  CRISPR gRNA sequence
ctgacgaatcatggagccaa

SEQ ID NO: 294908 - DNA, 20 bp, Artificial
  CRISPR gRNA sequence
acgaatcatggagccaaatt

SEQ ID NO: 294909 - DNA, 20 bp, Artificial
  CRISPR gRNA sequence
cacaaagaattactctgtca

SEQ ID NO: 294910 - DNA, 20 bp, Artificial
  CRISPR gRNA sequence
acaaagaattactctgtcat

SEQ ID NO: 294911 - DNA, 20 bp, Artificial
  CRISPR gRNA sequence
ctctgtcatgtcattttccc

SEQ ID NO: 294912 - DNA, 20 bp, Artificial
  CRISPR gRNA sequence
tgtcatgtcattttcccact

SEQ ID NO: 294913 - DNA, 20 bp, Artificial
  CRISPR gRNA sequence
tcatgtcattttcccactca

SEQ ID NO: 294914 - DNA, 20 bp, Artificial
  CRISPR gRNA sequence
tcccactcaaaaactcagaa

SEQ ID NO: 294915 - DNA, 20 bp, Artificial
  CRISPR gRNA sequence
cccactcaaaaactcagaag

SEQ ID NO: 294916 - DNA, 20 bp, Artificial
  CRISPR gRNA sequence
ccactcaaaaactcagaaga

SEQ ID NO: 294917 - DNA, 20 bp, Artificial
  CRISPR gRNA sequence
aaaaactcagaagagacccc

SEQ ID NO: 294918 - DNA, 20 bp, Artificial
  CRISPR gRNA sequence
agaagagaccccactgccta

SEQ ID NO: 294919 - DNA, 20 bp, Artificial
  CRISPR gRNA sequence
cctacagaaaaagcttcaaa

SEQ ID NO: 294920 - DNA, 20 bp, Artificial
  CRISPR gRNA sequence
cagaaaaagcttcaaagctt

SEQ ID NO: 294921 - DNA, 20 bp, Artificial
  CRISPR gRNA sequence
caaagctttttaactttcca

SEQ ID NO: 294922 - DNA, 20 bp, Artificial
  CRISPR gRNA sequence
aaagctttttaactttccac

SEQ ID NO: 294923 - DNA, 20 bp, Artificial
  CRISPR gRNA sequence
tttaactttccacattccag

SEQ ID NO: 294924 - DNA, 20 bp, Artificial
  CRISPR gRNA sequence
ttaactttccacattccagc

SEQ ID NO: 294925 - DNA, 20 bp, Artificial
  CRISPR gRNA sequence
taactttccacattccagct

SEQ ID NO: 294926 - DNA, 20 bp, Artificial
  CRISPR gRNA sequence
aactttccacattccagctg

SEQ ID NO: 294927 - DNA, 20 bp, Artificial
  CRISPR gRNA sequence
actttccacattccagctga

SEQ ID NO: 294928 - DNA, 20 bp, Artificial
  CRISPR gRNA sequence
tccacattccagctgatctc

SEQ ID NO: 294929 - DNA, 20 bp, Artificial
  CRISPR gRNA sequence
ccacattccagctgatctct

SEQ ID NO: 294930 - DNA, 20 bp, Artificial
  CRISPR gRNA sequence
cacattccagctgatctctt

SEQ ID NO: 294931 - DNA, 20 bp, Artificial
  CRISPR gRNA sequence
cagctgatctcttcagtcta

SEQ ID NO: 294932 - DNA, 20 bp, Artificial
  CRISPR gRNA sequence
atctcttcagtctaaatacc

SEQ ID NO: 294933 - DNA, 20 bp, Artificial
  CRISPR gRNA sequence
ttcagtctaaatacccttga

SEQ ID NO: 294934 - DNA, 20 bp, Artificial
  CRISPR gRNA sequence
cagtctaaatacccttgagt

SEQ ID NO: 294935 - DNA, 20 bp, Artificial
  CRISPR gRNA sequence
agtctaaatacccttgagtt

SEQ ID NO: 294936 - DNA, 20 bp, Artificial
  CRISPR gRNA sequence
aatacccttgagttctgtca

SEQ ID NO: 294937 - DNA, 20 bp, Artificial
  CRISPR gRNA sequence
gagttctgtcaattgttcct

SEQ ID NO: 294938 - DNA, 20 bp, Artificial
  CRISPR gRNA sequence
agttctgtcaattgttcctc

SEQ ID NO: 294939 - DNA, 20 bp, Artificial
  CRISPR gRNA sequence
tgtcaattgttcctcacatg

SEQ ID NO: 294940 - DNA, 20 bp, Artificial
  CRISPR gRNA sequence
tcaattgttcctcacatggc

SEQ ID NO: 294941 - DNA, 20 bp, Artificial
  CRISPR gRNA sequence
ttcctcacatggcatggttt

SEQ ID NO: 294942 - DNA, 20 bp, Artificial
  CRISPR gRNA sequence
ctcacatggcatggtttcca

SEQ ID NO: 294943 - DNA, 20 bp, Artificial
  CRISPR gRNA sequence
acatggcatggtttccagtg

SEQ ID NO: 294944 - DNA, 20 bp, Artificial
  CRISPR gRNA sequence
ccagtgcctcacatgaatgg

SEQ ID NO: 294945 - DNA, 20 bp, Artificial
  CRISPR gRNA sequence
cagtgcctcacatgaatggg

SEQ ID NO: 294946 - DNA, 20 bp, Artificial
  CRISPR gRNA sequence
acatgaatggggtaaacgga

SEQ ID NO: 294947 - DNA, 20 bp, Artificial
  CRISPR gRNA sequence
tagatttggtcttaatgact

SEQ ID NO: 294948 - DNA, 20 bp, Artificial
  CRISPR gRNA sequence
agatttggtcttaatgactc

SEQ ID NO: 294949 - DNA, 20 bp, Artificial
  CRISPR gRNA sequence
gatttggtcttaatgactct

SEQ ID NO: 294950 - DNA, 20 bp, Artificial
  CRISPR gRNA sequence
ggtcttaatgactctacata

SEQ ID NO: 294951 - DNA, 20 bp, Artificial
  CRISPR gRNA sequence
gtcttaatgactctacatac

SEQ ID NO: 294952 - DNA, 20 bp, Artificial
  CRISPR gRNA sequence
aatgactctacatacaatga

SEQ ID NO: 294953 - DNA, 20 bp, Artificial
  CRISPR gRNA sequence
atgactctacatacaatgag

SEQ ID NO: 294954 - DNA, 20 bp, Artificial
  CRISPR gRNA sequence
tacatacaatgagataatta

SEQ ID NO: 294955 - DNA, 20 bp, Artificial
  CRISPR gRNA sequence
catacaatgagataattatt

SEQ ID NO: 294956 - DNA, 20 bp, Artificial
  CRISPR gRNA sequence
ttatctggggtctggaatgt

SEQ ID NO: 294957 - DNA, 20 bp, Artificial
  CRISPR gRNA sequence
tctggggtctggaatgtcca

SEQ ID NO: 294958 - DNA, 20 bp, Artificial
  CRISPR gRNA sequence
gggtctggaatgtccatcct

SEQ ID NO: 294959 - DNA, 20 bp, Artificial
  CRISPR gRNA sequence
gaatgtccatcctgttaaga

SEQ ID NO: 294960 - DNA, 20 bp, Artificial
  CRISPR gRNA sequence
ttaagagagcctaacacagc

SEQ ID NO: 294961 - DNA, 20 bp, Artificial
  CRISPR gRNA sequence
agagagcctaacacagcact

SEQ ID NO: 294962 - DNA, 20 bp, Artificial
  CRISPR gRNA sequence
acacagcactagctttagtg

SEQ ID NO: 294963 - DNA, 20 bp, Artificial
  CRISPR gRNA sequence
gctttagtgagtcacaaatc

SEQ ID NO: 294964 - DNA, 20 bp, Artificial
  CRISPR gRNA sequence
tagtgagtcacaaatcccca

SEQ ID NO: 294965 - DNA, 20 bp, Artificial
  CRISPR gRNA sequence
agtgagtcacaaatccccag

SEQ ID NO: 294966 - DNA, 20 bp, Artificial
  CRISPR gRNA sequence
gtgagtcacaaatccccagg

SEQ ID NO: 294967 - DNA, 20 bp, Artificial
  CRISPR gRNA sequence
tcatgcaagagaaacttaca

SEQ ID NO: 294968 - DNA, 20 bp, Artificial
  CRISPR gRNA sequence
catgcaagagaaacttacat

SEQ ID NO: 294969 - DNA, 20 bp, Artificial
  CRISPR gRNA sequence
atgcaagagaaacttacatg

SEQ ID NO: 294970 - DNA, 20 bp, Artificial
  CRISPR gRNA sequence
acatgggacattagaatcca

SEQ ID NO: 294971 - DNA, 20 bp, Artificial
  CRISPR gRNA sequence
catgggacattagaatccaa

SEQ ID NO: 294972 - DNA, 20 bp, Artificial
  CRISPR gRNA sequence
gaatccaagagactgatatc

SEQ ID NO: 294973 - DNA, 20 bp, Artificial
  CRISPR gRNA sequence
atatcaggtcccaggtagtt

SEQ ID NO: 294974 - DNA, 20 bp, Artificial
  CRISPR gRNA sequence
taagcctccctaaacagttc

SEQ ID NO: 294975 - DNA, 20 bp, Artificial
  CRISPR gRNA sequence
cctaaacagttcagctttga

SEQ ID NO: 294976 - DNA, 20 bp, Artificial
  CRISPR gRNA sequence
aacagttcagctttgacttg

SEQ ID NO: 294977 - DNA, 20 bp, Artificial
  CRISPR gRNA sequence
agctttgacttgtgaaggtt

SEQ ID NO: 294978 - DNA, 20 bp, Artificial
  CRISPR gRNA sequence
tgacttgtgaaggttagagt

SEQ ID NO: 294979 - DNA, 20 bp, Artificial
  CRISPR gRNA sequence
gacttgtgaaggttagagta

SEQ ID NO: 294980 - DNA, 20 bp, Artificial
  CRISPR gRNA sequence
acttgtgaaggttagagtaa

SEQ ID NO: 294981 - DNA, 20 bp, Artificial
  CRISPR gRNA sequence
gtgaaggttagagtaacacc

SEQ ID NO: 294982 - DNA, 20 bp, Artificial
  CRISPR gRNA sequence
tgaaggttagagtaacacca

SEQ ID NO: 294983 - DNA, 20 bp, Artificial
  CRISPR gRNA sequence
gagtaacaccagtataggaa

SEQ ID NO: 294984 - DNA, 20 bp, Artificial
  CRISPR gRNA sequence
gtctacaaaattatctttaa

SEQ ID NO: 294985 - DNA, 20 bp, Artificial
  CRISPR gRNA sequence
caaaattatctttaaaaata

SEQ ID NO: 294986 - DNA, 20 bp, Artificial
  CRISPR gRNA sequence
tctttaaaaataaaggaaag

SEQ ID NO: 294987 - DNA, 20 bp, Artificial
  CRISPR gRNA sequence
taaaaataaaggaaagcaag

SEQ ID NO: 294988 - DNA, 20 bp, Artificial
  CRISPR gRNA sequence
aaaaataaaggaaagcaaga

SEQ ID NO: 294989 - DNA, 20 bp, Artificial
  CRISPR gRNA sequence
aaaataaaggaaagcaagaa

SEQ ID NO: 294990 - DNA, 20 bp, Artificial
  CRISPR gRNA sequence
tcctgggcaggagggggaaa

SEQ ID NO: 294991 - DNA, 20 bp, Artificial
  CRISPR gRNA sequence
ggcaggagggggaaatataa

SEQ ID NO: 294992 - DNA, 20 bp, Artificial
  CRISPR gRNA sequence
acgcttatacaacaggttgt

SEQ ID NO: 294993 - DNA, 20 bp, Artificial
  CRISPR gRNA sequence
atacaacaggttgttttgca

SEQ ID NO: 294994 - DNA, 20 bp, Artificial
  CRISPR gRNA sequence
tacaacaggttgttttgcaa

SEQ ID NO: 294995 - DNA, 20 bp, Artificial
  CRISPR gRNA sequence
ttttgcaaaaacactatttc

SEQ ID NO: 294996 - DNA, 20 bp, Artificial
  CRISPR gRNA sequence
tgcaaaaacactatttcatc

SEQ ID NO: 294997 - DNA, 20 bp, Artificial
  CRISPR gRNA sequence
gcaaaaacactatttcatct

SEQ ID NO: 294998 - DNA, 20 bp, Artificial
  CRISPR gRNA sequence
caaaaacactatttcatctt

SEQ ID NO: 294999 - DNA, 20 bp, Artificial
  CRISPR gRNA sequence
tttcatcttagtcttataaa

SEQ ID NO: 295000 - DNA, 20 bp, Artificial
  CRISPR gRNA sequence
catcttagtcttataaaaat

SEQ ID NO: 295001 - DNA, 20 bp, Artificial
  CRISPR gRNA sequence
atcttagtcttataaaaatc

SEQ ID NO: 295002 - DNA, 20 bp, Artificial
  CRISPR gRNA sequence
agtcttataaaaatctctat

SEQ ID NO: 295003 - DNA, 20 bp, Artificial
  CRISPR gRNA sequence
gtcttataaaaatctctatg

SEQ ID NO: 295004 - DNA, 20 bp, Artificial
  CRISPR gRNA sequence
ataaaaatctctatgagcaa

SEQ ID NO: 295005 - DNA, 20 bp, Artificial
  CRISPR gRNA sequence
taaaaatctctatgagcaag

SEQ ID NO: 295006 - DNA, 20 bp, Artificial
  CRISPR gRNA sequence
tatgagcaagatctatttcc

SEQ ID NO: 295007 - DNA, 20 bp, Artificial
  CRISPR gRNA sequence
tgagcaagatctatttccat

SEQ ID NO: 295008 - DNA, 20 bp, Artificial
  CRISPR gRNA sequence
tttccatgttatgggagaga

SEQ ID NO: 295009 - DNA, 20 bp, Artificial
  CRISPR gRNA sequence
ccatgttatgggagagaaac

SEQ ID NO: 295010 - DNA, 20 bp, Artificial
  CRISPR gRNA sequence
catgttatgggagagaaacc

SEQ ID NO: 295011 - DNA, 20 bp, Artificial
  CRISPR gRNA sequence
tgggagagaaaccagaggct

SEQ ID NO: 295012 - DNA, 20 bp, Artificial
  CRISPR gRNA sequence
ccagaggttaagagatttgc

SEQ ID NO: 295013 - DNA, 20 bp, Artificial
  CRISPR gRNA sequence
agagatttgcttgaggtacg

SEQ ID NO: 295014 - DNA, 20 bp, Artificial
  CRISPR gRNA sequence
gcttgaggtacggtcataca

SEQ ID NO: 295015 - DNA, 20 bp, Artificial
  CRISPR gRNA sequence
cttgaggtacggtcatacag

SEQ ID NO: 295016 - DNA, 20 bp, Artificial
  CRISPR gRNA sequence
gaggtacggtcatacagatg

SEQ ID NO: 295017 - DNA, 20 bp, Artificial
  CRISPR gRNA sequence
aggtacggtcatacagatga

SEQ ID NO: 295018 - DNA, 20 bp, Artificial
  CRISPR gRNA sequence
aaactggacatcaagttcag

SEQ ID NO: 295019 - DNA, 20 bp, Artificial
  CRISPR gRNA sequence
gacatcaagttcaggctcct

SEQ ID NO: 295020 - DNA, 20 bp, Artificial
  CRISPR gRNA sequence
aggctcctttccctacaacc

SEQ ID NO: 295021 - DNA, 20 bp, Artificial
  CRISPR gRNA sequence
ctttccctacaacctggcag

SEQ ID NO: 295022 - DNA, 20 bp, Artificial
  CRISPR gRNA sequence
tccctacaacctggcagcct

SEQ ID NO: 295023 - DNA, 20 bp, Artificial
  CRISPR gRNA sequence
ccctacaacctggcagccta

SEQ ID NO: 295024 - DNA, 20 bp, Artificial
  CRISPR gRNA sequence
cctacaacctggcagcctac

SEQ ID NO: 295025 - DNA, 20 bp, Artificial
  CRISPR gRNA sequence
caacctggcagcctacacat

SEQ ID NO: 295026 - DNA, 20 bp, Artificial
  CRISPR gRNA sequence
gcagcctacacatattttcc

SEQ ID NO: 295027 - DNA, 20 bp, Artificial
  CRISPR gRNA sequence
cacatattttcccccaaggc

SEQ ID NO: 295028 - DNA, 20 bp, Artificial
  CRISPR gRNA sequence
tcccccaaggcagtgtctca

SEQ ID NO: 295029 - DNA, 20 bp, Artificial
  CRISPR gRNA sequence
cccccaaggcagtgtctcaa

SEQ ID NO: 295030 - DNA, 20 bp, Artificial
  CRISPR gRNA sequence
ccccaaggcagtgtctcaac

SEQ ID NO: 295031 - DNA, 20 bp, Artificial
  CRISPR gRNA sequence
aacttcctatcctgtttttt

SEQ ID NO: 295032 - DNA, 20 bp, Artificial
  CRISPR gRNA sequence
cctatcctgttttttcattt

SEQ ID NO: 295033 - DNA, 20 bp, Artificial
  CRISPR gRNA sequence
ctatcctgttttttcatttc

SEQ ID NO: 295034 - DNA, 20 bp, Artificial
  CRISPR gRNA sequence
tcctgttttttcatttccac

SEQ ID NO: 295035 - DNA, 20 bp, Artificial
  CRISPR gRNA sequence
ttttttcatttccactgaat

SEQ ID NO: 295036 - DNA, 20 bp, Artificial
  CRISPR gRNA sequence
tttcatttccactgaatgct

SEQ ID NO: 295037 - DNA, 20 bp, Artificial
  CRISPR gRNA sequence
ttcatttccactgaatgctt

SEQ ID NO: 295038 - DNA, 20 bp, Artificial
  CRISPR gRNA sequence
tcatttccactgaatgcttg

SEQ ID NO: 295039 - DNA, 20 bp, Artificial
  CRISPR gRNA sequence
catttccactgaatgcttgc

SEQ ID NO: 295040 - DNA, 20 bp, Artificial
  CRISPR gRNA sequence
atttccactgaatgcttgct

SEQ ID NO: 295041 - DNA, 20 bp, Artificial
  CRISPR gRNA sequence
ccactgaatgcttgctcact

SEQ ID NO: 295042 - DNA, 20 bp, Artificial
  CRISPR gRNA sequence
cactgaatgcttgctcactc

SEQ ID NO: 295043 - DNA, 20 bp, Artificial
  CRISPR gRNA sequence
aatgcttgctcactcctcag

SEQ ID NO: 295044 - DNA, 20 bp, Artificial
  CRISPR gRNA sequence
gctcactcctcagaatgtct

SEQ ID NO: 295045 - DNA, 20 bp, Artificial
  CRISPR gRNA sequence
ctcactcctcagaatgtctt

SEQ ID NO: 295046 - DNA, 20 bp, Artificial
  CRISPR gRNA sequence
actcctcagaatgtcttttc

SEQ ID NO: 295047 - DNA, 20 bp, Artificial
  CRISPR gRNA sequence
ctcagaatgtcttttccagg

SEQ ID NO: 295048 - DNA, 20 bp, Artificial
  CRISPR gRNA sequence
agaatgtcttttccaggatg

SEQ ID NO: 295049 - DNA, 20 bp, Artificial
  CRISPR gRNA sequence
ttccaggatgttgctctggc

SEQ ID NO: 295050 - DNA, 20 bp, Artificial
  CRISPR gRNA sequence
tccaggatgttgctctggct

SEQ ID NO: 295051 - DNA, 20 bp, Artificial
  CRISPR gRNA sequence
ccaggatgttgctctggctc

SEQ ID NO: 295052 - DNA, 20 bp, Artificial
  CRISPR gRNA sequence
caggatgttgctctggctca

SEQ ID NO: 295053 - DNA, 20 bp, Artificial
  CRISPR gRNA sequence
ctctggctcagttctgtcat

SEQ ID NO: 295054 - DNA, 20 bp, Artificial
  CRISPR gRNA sequence
tggctcagttctgtcattat

SEQ ID NO: 295055 - DNA, 20 bp, Artificial
  CRISPR gRNA sequence
gctcagttctgtcattatct

SEQ ID NO: 295056 - DNA, 20 bp, Artificial
  CRISPR gRNA sequence
agttctgtcattatctacaa

SEQ ID NO: 295057 - DNA, 20 bp, Artificial
  CRISPR gRNA sequence
tgtcattatctacaattttc

SEQ ID NO: 295058 - DNA, 20 bp, Artificial
  CRISPR gRNA sequence
tcattatctacaattttctt

SEQ ID NO: 295059 - DNA, 20 bp, Artificial
  CRISPR gRNA sequence
tctacaattttcttgacttt

SEQ ID NO: 295060 - DNA, 20 bp, Artificial
  CRISPR gRNA sequence
caattttcttgactttctat

SEQ ID NO: 295061 - DNA, 20 bp, Artificial
  CRISPR gRNA sequence
tcttgactttctatctaaaa

SEQ ID NO: 295062 - DNA, 20 bp, Artificial
  CRISPR gRNA sequence
cttgactttctatctaaaaa

SEQ ID NO: 295063 - DNA, 20 bp, Artificial
  CRISPR gRNA sequence
ttgactttctatctaaaaag

SEQ ID NO: 295064 - DNA, 20 bp, Artificial
  CRISPR gRNA sequence
gactttctatctaaaaagtc

SEQ ID NO: 295065 - DNA, 20 bp, Artificial
  CRISPR gRNA sequence
actttctatctaaaaagtct

SEQ ID NO: 295066 - DNA, 20 bp, Artificial
  CRISPR gRNA sequence
tctatctaaaaagtcttctg

SEQ ID NO: 295067 - DNA, 20 bp, Artificial
  CRISPR gRNA sequence
ctatctaaaaagtcttctgc

SEQ ID NO: 295068 - DNA, 20 bp, Artificial
  CRISPR gRNA sequence
tatctaaaaagtcttctgct

SEQ ID NO: 295069 - DNA, 20 bp, Artificial
  CRISPR gRNA sequence
tctaaaaagtcttctgctca

SEQ ID NO: 295070 - DNA, 20 bp, Artificial
  CRISPR gRNA sequence
aaaagtcttctgctcagtct

SEQ ID NO: 295071 - DNA, 20 bp, Artificial
  CRISPR gRNA sequence
ctgctcagtctgctgatact

SEQ ID NO: 295072 - DNA, 20 bp, Artificial
  CRISPR gRNA sequence
tgctcagtctgctgatactt

SEQ ID NO: 295073 - DNA, 20 bp, Artificial
  CRISPR gRNA sequence
ctcagtctgctgatacttca

SEQ ID NO: 295074 - DNA, 20 bp, Artificial
  CRISPR gRNA sequence
agtctgctgatacttcaaaa

SEQ ID NO: 295075 - DNA, 20 bp, Artificial
  CRISPR gRNA sequence
ctgatacttcaaaatgaagc

SEQ ID NO: 295076 - DNA, 20 bp, Artificial
  CRISPR gRNA sequence
atacttcaaaatgaagccgt

SEQ ID NO: 295077 - DNA, 20 bp, Artificial
  CRISPR gRNA sequence
caaaatgaagccgtgtaccc

SEQ ID NO: 295078 - DNA, 20 bp, Artificial
  CRISPR gRNA sequence
aaaatgaagccgtgtaccca

SEQ ID NO: 295079 - DNA, 20 bp, Artificial
  CRISPR gRNA sequence
ctacacaaggccttctgtgg

SEQ ID NO: 295080 - DNA, 20 bp, Artificial
  CRISPR gRNA sequence
tacacaaggccttctgtggt

SEQ ID NO: 295081 - DNA, 20 bp, Artificial
  CRISPR gRNA sequence
cacaaggccttctgtggtca

SEQ ID NO: 295082 - DNA, 20 bp, Artificial
  CRISPR gRNA sequence
ctgtggtcatcttgtctagc

SEQ ID NO: 295083 - DNA, 20 bp, Artificial
  CRISPR gRNA sequence
tgtggtcatcttgtctagct

SEQ ID NO: 295084 - DNA, 20 bp, Artificial
  CRISPR gRNA sequence
tggtcatcttgtctagctca

SEQ ID NO: 295085 - DNA, 20 bp, Artificial
  CRISPR gRNA sequence
gtctagctcaagcagttcca

SEQ ID NO: 295086 - DNA, 20 bp, Artificial
  CRISPR gRNA sequence
tctagctcaagcagttccac

SEQ ID NO: 295087 - DNA, 20 bp, Artificial
  CRISPR gRNA sequence
gctcaagcagttccacctct

SEQ ID NO: 295088 - DNA, 20 bp, Artificial
  CRISPR gRNA sequence
aagcagttccacctctatag

SEQ ID NO: 295089 - DNA, 20 bp, Artificial
  CRISPR gRNA sequence
cacctctatagcacatctca

SEQ ID NO: 295090 - DNA, 20 bp, Artificial
  CRISPR gRNA sequence
tatagcacatctcataccac

SEQ ID NO: 295091 - DNA, 20 bp, Artificial
  CRISPR gRNA sequence
tagcacatctcataccacca

SEQ ID NO: 295092 - DNA, 20 bp, Artificial
  CRISPR gRNA sequence
ataccaccagcataggttga

SEQ ID NO: 295093 - DNA, 20 bp, Artificial
  CRISPR gRNA sequence
attttcatgtaccacatctt

SEQ ID NO: 295094 - DNA, 20 bp, Artificial
  CRISPR gRNA sequence
tcatgtaccacatcttcctt

SEQ ID NO: 295095 - DNA, 20 bp, Artificial
  CRISPR gRNA sequence
catgtaccacatcttccttc

SEQ ID NO: 295096 - DNA, 20 bp, Artificial
  CRISPR gRNA sequence
atgtaccacatcttccttct

SEQ ID NO: 295097 - DNA, 20 bp, Artificial
  CRISPR gRNA sequence
ccttctatcctttactggac

SEQ ID NO: 295098 - DNA, 20 bp, Artificial
  CRISPR gRNA sequence
cttctatcctttactggact

SEQ ID NO: 295099 - DNA, 20 bp, Artificial
  CRISPR gRNA sequence
ctatcctttactggactgta

SEQ ID NO: 295100 - DNA, 20 bp, Artificial
  CRISPR gRNA sequence
tatcctttactggactgtat

SEQ ID NO: 295101 - DNA, 20 bp, Artificial
  CRISPR gRNA sequence
tcctttactggactgtatgt

SEQ ID NO: 295102 - DNA, 20 bp, Artificial
  CRISPR gRNA sequence
tactggactgtatgtaggtt

SEQ ID NO: 295103 - DNA, 20 bp, Artificial
  CRISPR gRNA sequence
actggactgtatgtaggttt

SEQ ID NO: 295104 - DNA, 20 bp, Artificial
  CRISPR gRNA sequence
ctggactgtatgtaggttta

SEQ ID NO: 295105 - DNA, 20 bp, Artificial
  CRISPR gRNA sequence
gactgtatgtaggtttattg

SEQ ID NO: 295106 - DNA, 20 bp, Artificial
  CRISPR gRNA sequence
tatgtaggtttattgagaaa

SEQ ID NO: 295107 - DNA, 20 bp, Artificial
  CRISPR gRNA sequence
attgagaaaagcaaccatgc

SEQ ID NO: 295108 - DNA, 20 bp, Artificial
  CRISPR gRNA sequence
ttgagaaaagcaaccatgcc

SEQ ID NO: 295109 - DNA, 20 bp, Artificial
  CRISPR gRNA sequence
agaaaagcaaccatgcctga

SEQ ID NO: 295110 - DNA, 20 bp, Artificial
  CRISPR gRNA sequence
agagccccacacatagaaga

SEQ ID NO: 295111 - DNA, 20 bp, Artificial
  CRISPR gRNA sequence
gatcaagcatttggtcgttt

SEQ ID NO: 295112 - DNA, 20 bp, Artificial
  CRISPR gRNA sequence
atcaagcatttggtcgtttg

SEQ ID NO: 295113 - DNA, 20 bp, Artificial
  CRISPR gRNA sequence
ggtcgtttggtaatagctgg

SEQ ID NO: 295114 - DNA, 20 bp, Artificial
  CRISPR gRNA sequence
gtcgtttggtaatagctggt

SEQ ID NO: 295115 - DNA, 20 bp, Artificial
  CRISPR gRNA sequence
ggtaatagctggtaataact

SEQ ID NO: 295116 - DNA, 20 bp, Artificial
  CRISPR gRNA sequence
gtaatagctggtaataacta

SEQ ID NO: 295117 - DNA, 20 bp, Artificial
  CRISPR gRNA sequence
gtaataactaaacatttgcc

SEQ ID NO: 295118 - DNA, 20 bp, Artificial
  CRISPR gRNA sequence
aacatttgcctgatcgatat

SEQ ID NO: 295119 - DNA, 20 bp, Artificial
  CRISPR gRNA sequence
gcctgatcgatatttcatgt

SEQ ID NO: 295120 - DNA, 20 bp, Artificial
  CRISPR gRNA sequence
cctgatcgatatttcatgtg

SEQ ID NO: 295121 - DNA, 20 bp, Artificial
  CRISPR gRNA sequence
atcgatatttcatgtgacaa

SEQ ID NO: 295122 - DNA, 20 bp, Artificial
  CRISPR gRNA sequence
catgtgacaaaaattgccag

SEQ ID NO: 295123 - DNA, 20 bp, Artificial
  CRISPR gRNA sequence
atgtgacaaaaattgccaga

SEQ ID NO: 295124 - DNA, 20 bp, Artificial
  CRISPR gRNA sequence
ccagagtagttttaagttct

SEQ ID NO: 295125 - DNA, 20 bp, Artificial
  CRISPR gRNA sequence
taagttctctcataattcag

SEQ ID NO: 295126 - DNA, 20 bp, Artificial
  CRISPR gRNA sequence
aagttctctcataattcagc

SEQ ID NO: 295127 - DNA, 20 bp, Artificial
  CRISPR gRNA sequence
agttctctcataattcagct

SEQ ID NO: 295128 - DNA, 20 bp, Artificial
  CRISPR gRNA sequence
tctcataattcagctttccc

SEQ ID NO: 295129 - DNA, 20 bp, Artificial
  CRISPR gRNA sequence
tcataattcagctttccctt

SEQ ID NO: 295130 - DNA, 20 bp, Artificial
  CRISPR gRNA sequence
ataattcagctttcccttca

SEQ ID NO: 295131 - DNA, 20 bp, Artificial
  CRISPR gRNA sequence
agctttcccttcatattctt

SEQ ID NO: 295132 - DNA, 20 bp, Artificial
  CRISPR gRNA sequence
tcccttcatattcttcagct

SEQ ID NO: 295133 - DNA, 20 bp, Artificial
  CRISPR gRNA sequence
cccttcatattcttcagcta

SEQ ID NO: 295134 - DNA, 20 bp, Artificial
  CRISPR gRNA sequence
ccttcatattcttcagctat

SEQ ID NO: 295135 - DNA, 20 bp, Artificial
  CRISPR gRNA sequence
catattcttcagctatcaag

SEQ ID NO: 295136 - DNA, 20 bp, Artificial
  CRISPR gRNA sequence
atattcttcagctatcaagg

SEQ ID NO: 295137 - DNA, 20 bp, Artificial
  CRISPR gRNA sequence
ttcagctatcaaggttactg

SEQ ID NO: 295138 - DNA, 20 bp, Artificial
  CRISPR gRNA sequence
cagctatcaaggttactgtg

SEQ ID NO: 295139 - DNA, 20 bp, Artificial
  CRISPR gRNA sequence
agctatcaaggttactgtgt

SEQ ID NO: 295140 - DNA, 20 bp, Artificial
  CRISPR gRNA sequence
tcaaggttactgtgtacaag

SEQ ID NO: 295141 - DNA, 20 bp, Artificial
  CRISPR gRNA sequence
ctgtgtacaagctgggaata

SEQ ID NO: 295142 - DNA, 20 bp, Artificial
  CRISPR gRNA sequence
tgtacaagctgggaataccc

SEQ ID NO: 295143 - DNA, 20 bp, Artificial
  CRISPR gRNA sequence
ggaatacccttgatcttgag

SEQ ID NO: 295144 - DNA, 20 bp, Artificial
  CRISPR gRNA sequence
gatcttgagattaaaatgta

SEQ ID NO: 295145 - DNA, 20 bp, Artificial
  CRISPR gRNA sequence
atcttgagattaaaatgtaa

SEQ ID NO: 295146 - DNA, 20 bp, Artificial
  CRISPR gRNA sequence
gagattaaaatgtaaattaa

SEQ ID NO: 295147 - DNA, 20 bp, Artificial
  CRISPR gRNA sequence
agattaaaatgtaaattaag

SEQ ID NO: 295148 - DNA, 20 bp, Artificial
  CRISPR gRNA sequence
aaatgtaaattaagagatta

SEQ ID NO: 295149 - DNA, 20 bp, Artificial
  CRISPR gRNA sequence
agagattaaaattaagatct

SEQ ID NO: 295150 - DNA, 20 bp, Artificial
  CRISPR gRNA sequence
aaattaagatcttatattta

SEQ ID NO: 295151 - DNA, 20 bp, Artificial
  CRISPR gRNA sequence
agatcttatatttaaaatat

SEQ ID NO: 295152 - DNA, 20 bp, Artificial
  CRISPR gRNA sequence
atatttaaaatatatatata

SEQ ID NO: 295153 - DNA, 20 bp, Artificial
  CRISPR gRNA sequence
tatttaaaatatatatatat

SEQ ID NO: 295154 - DNA, 20 bp, Artificial
  CRISPR gRNA sequence
aaaatatatatatatacata

SEQ ID NO: 295155 - DNA, 20 bp, Artificial
  CRISPR gRNA sequence
aaatatatatatatacatat

SEQ ID NO: 295156 - DNA, 20 bp, Artificial
  CRISPR gRNA sequence
aattatatatacatatatac

SEQ ID NO: 295157 - DNA, 20 bp, Artificial
  CRISPR gRNA sequence
tatatacatatatacatata

SEQ ID NO: 295158 - DNA, 20 bp, Artificial
  CRISPR gRNA sequence
aaaaattatatatgtataat

SEQ ID NO: 295159 - DNA, 20 bp, Artificial
  CRISPR gRNA sequence
aaaattatatatgtataatt

SEQ ID NO: 295160 - DNA, 20 bp, Artificial
  CRISPR gRNA sequence
tatatgtataatttaatata

SEQ ID NO: 295161 - DNA, 20 bp, Artificial
  CRISPR gRNA sequence
aatatataaataaatttaag

SEQ ID NO: 295162 - DNA, 20 bp, Artificial
  CRISPR gRNA sequence
atatataaataaatttaaga

SEQ ID NO: 295163 - DNA, 20 bp, Artificial
  CRISPR gRNA sequence
aagatgttttcctcctttgc

SEQ ID NO: 295164 - DNA, 20 bp, Artificial
  CRISPR gRNA sequence
agatgttttcctcctttgcc

SEQ ID NO: 295165 - DNA, 20 bp, Artificial
  CRISPR gRNA sequence
tcctcctttgccaatatagg

SEQ ID NO: 295166 - DNA, 20 bp, Artificial
  CRISPR gRNA sequence
cctcctttgccaatataggg

SEQ ID NO: 295167 - DNA, 20 bp, Artificial
  CRISPR gRNA sequence
ctcctttgccaatatagggt

SEQ ID NO: 295168 - DNA, 20 bp, Artificial
  CRISPR gRNA sequence
ctttgccaatatagggtttg

SEQ ID NO: 295169 - DNA, 20 bp, Artificial
  CRISPR gRNA sequence
tgccaatatagggtttgatg

SEQ ID NO: 295170 - DNA, 20 bp, Artificial
  CRISPR gRNA sequence
gccaatatagggtttgatgt

SEQ ID NO: 295171 - DNA, 20 bp, Artificial
  CRISPR gRNA sequence
ccaatatagggtttgatgta

SEQ ID NO: 295172 - DNA, 20 bp, Artificial
  CRISPR gRNA sequence
gatgtaatcatttctttgtt

SEQ ID NO: 295173 - DNA, 20 bp, Artificial
  CRISPR gRNA sequence
atgtaatcatttctttgttt

SEQ ID NO: 295174 - DNA, 20 bp, Artificial
  CRISPR gRNA sequence
ctttgttttctcaggtccca

SEQ ID NO: 295175 - DNA, 20 bp, Artificial
  CRISPR gRNA sequence
tttgttttctcaggtcccac

SEQ ID NO: 295176 - DNA, 20 bp, Artificial
  CRISPR gRNA sequence
tgttttctcaggtcccacct

SEQ ID NO: 295177 - DNA, 20 bp, Artificial
  CRISPR gRNA sequence
gttttctcaggtcccacctc

SEQ ID NO: 295178 - DNA, 20 bp, Artificial
  CRISPR gRNA sequence
ttttctcaggtcccacctcc

SEQ ID NO: 295179 - DNA, 20 bp, Artificial
  CRISPR gRNA sequence
tctcaggtcccacctccatt

SEQ ID NO: 295180 - DNA, 20 bp, Artificial
  CRISPR gRNA sequence
ctcaggtcccacctccattt

SEQ ID NO: 295181 - DNA, 20 bp, Artificial
  CRISPR gRNA sequence
tcaggtcccacctccatttg

SEQ ID NO: 295182 - DNA, 20 bp, Artificial
  CRISPR gRNA sequence
aggtcccacctccatttgca

SEQ ID NO: 295183 - DNA, 20 bp, Artificial
  CRISPR gRNA sequence
catttgcaattgacctcttc

SEQ ID NO: 295184 - DNA, 20 bp, Artificial
  CRISPR gRNA sequence
gcaattgacctcttctggga

SEQ ID NO: 295185 - DNA, 20 bp, Artificial
  CRISPR gRNA sequence
caattgacctcttctgggaa

SEQ ID NO: 295186 - DNA, 20 bp, Artificial
  CRISPR gRNA sequence
acctcttctgggaacttcct

SEQ ID NO: 295187 - DNA, 20 bp, Artificial
  CRISPR gRNA sequence
ttctgggaacttcctcagat

SEQ ID NO: 295188 - DNA, 20 bp, Artificial
  CRISPR gRNA sequence
ctgggaacttcctcagatgg

SEQ ID NO: 295189 - DNA, 20 bp, Artificial
  CRISPR gRNA sequence
tgggaacttcctcagatgga

SEQ ID NO: 295190 - DNA, 20 bp, Artificial
  CRISPR gRNA sequence
ggaacttcctcagatggaca

SEQ ID NO: 295191 - DNA, 20 bp, Artificial
  CRISPR gRNA sequence
cctcagatggacaagattac

SEQ ID NO: 295192 - DNA, 20 bp, Artificial
  CRISPR gRNA sequence
ctcagatggacaagattacc

SEQ ID NO: 295193 - DNA, 20 bp, Artificial
  CRISPR gRNA sequence
agatggacaagattacccca

SEQ ID NO: 295194 - DNA, 20 bp, Artificial
  CRISPR gRNA sequence
ccccaccttgccctttacgt

SEQ ID NO: 295195 - DNA, 20 bp, Artificial
  CRISPR gRNA sequence
gccctttacgtatctgctct

SEQ ID NO: 295196 - DNA, 20 bp, Artificial
  CRISPR gRNA sequence
ccctttacgtatctgctctt

SEQ ID NO: 295197 - DNA, 20 bp, Artificial
  CRISPR gRNA sequence
tacgtatctgctcttaggtg

SEQ ID NO: 295198 - DNA, 20 bp, Artificial
  CRISPR gRNA sequence
acgtatctgctcttaggtgc

SEQ ID NO: 295199 - DNA, 20 bp, Artificial
  CRISPR gRNA sequence
cgtatctgctcttaggtgct

SEQ ID NO: 295200 - DNA, 20 bp, Artificial
  CRISPR gRNA sequence
ctcttaggtgcttcttcact

SEQ ID NO: 295201 - DNA, 20 bp, Artificial
  CRISPR gRNA sequence
ttaggtgcttcttcacttca

SEQ ID NO: 295202 - DNA, 20 bp, Artificial
  CRISPR gRNA sequence
aggtgcttcttcacttcagt

SEQ ID NO: 295203 - DNA, 20 bp, Artificial
  CRISPR gRNA sequence
ggtgcttcttcacttcagtt

SEQ ID NO: 295204 - DNA, 20 bp, Artificial
  CRISPR gRNA sequence
cttcacttcagttgctttgc

SEQ ID NO: 295205 - DNA, 20 bp, Artificial
  CRISPR gRNA sequence
ttcacttcagttgctttgca

SEQ ID NO: 295206 - DNA, 20 bp, Artificial
  CRISPR gRNA sequence
cacttcagttgctttgcagg

SEQ ID NO: 295207 - DNA, 20 bp, Artificial
  CRISPR gRNA sequence
acttcagttgctttgcagga

SEQ ID NO: 295208 - DNA, 20 bp, Artificial
  CRISPR gRNA sequence
cagttgctttgcaggaagtg

SEQ ID NO: 295209 - DNA, 20 bp, Artificial
  CRISPR gRNA sequence
agttgctttgcaggaagtgt

SEQ ID NO: 295210 - DNA, 20 bp, Artificial
  CRISPR gRNA sequence
ctttgcaggaagtgtctaga

SEQ ID NO: 295211 - DNA, 20 bp, Artificial
  CRISPR gRNA sequence
tgcaggaagtgtctagagga

SEQ ID NO: 295212 - DNA, 20 bp, Artificial
  CRISPR gRNA sequence
gcaggaagtgtctagaggaa

SEQ ID NO: 295213 - DNA, 20 bp, Artificial
  CRISPR gRNA sequence
caggaagtgtctagaggaat

SEQ ID NO: 295214 - DNA, 20 bp, Artificial
  CRISPR gRNA sequence
gaggaatatggtgggcacag

SEQ ID NO: 295215 - DNA, 20 bp, Artificial
  CRISPR gRNA sequence
tggtgaccttgatcaaggtg

SEQ ID NO: 295216 - DNA, 20 bp, Artificial
  CRISPR gRNA sequence
gtgaccttgatcaaggtgtt

SEQ ID NO: 295217 - DNA, 20 bp, Artificial
  CRISPR gRNA sequence
gatcaaggtgttttgaaatg

SEQ ID NO: 295218 - DNA, 20 bp, Artificial
  CRISPR gRNA sequence
atcaaggtgttttgaaatgc

SEQ ID NO: 295219 - DNA, 20 bp, Artificial
  CRISPR gRNA sequence
tgaaatgcagaattcttgag

SEQ ID NO: 295220 - DNA, 20 bp, Artificial
  CRISPR gRNA sequence
gaaatgcagaattcttgagt

SEQ ID NO: 295221 - DNA, 20 bp, Artificial
  CRISPR gRNA sequence
aaatgcagaattcttgagtt

SEQ ID NO: 295222 - DNA, 20 bp, Artificial
  CRISPR gRNA sequence
ttgagttctggaagggactt

SEQ ID NO: 295223 - DNA, 20 bp, Artificial
  CRISPR gRNA sequence
gagttctggaagggacttta

SEQ ID NO: 295224 - DNA, 20 bp, Artificial
  CRISPR gRNA sequence
agttctggaagggactttag

SEQ ID NO: 295225 - DNA, 20 bp, Artificial
  CRISPR gRNA sequence
tggaagggactttagagaat

SEQ ID NO: 295226 - DNA, 20 bp, Artificial
  CRISPR gRNA sequence
gaagggactttagagaatac

SEQ ID NO: 295227 - DNA, 20 bp, Artificial
  CRISPR gRNA sequence
tagagaataccagtgttatt

SEQ ID NO: 295228 - DNA, 20 bp, Artificial
  CRISPR gRNA sequence
agagaataccagtgttatta

SEQ ID NO: 295229 - DNA, 20 bp, Artificial
  CRISPR gRNA sequence
gagaataccagtgttattaa

SEQ ID NO: 295230 - DNA, 20 bp, Artificial
  CRISPR gRNA sequence
ttaatgacaaaggcactgag

SEQ ID NO: 295231 - DNA, 20 bp, Artificial
  CRISPR gRNA sequence
atgacaaaggcactgaggcc

SEQ ID NO: 295232 - DNA, 20 bp, Artificial
  CRISPR gRNA sequence
aggcccagggaggtgacccg

SEQ ID NO: 295233 - DNA, 20 bp, Artificial
  CRISPR gRNA sequence
taaaggccagcgccagaacc

SEQ ID NO: 295234 - DNA, 20 bp, Artificial
  CRISPR gRNA sequence
cctaactctggtgctctttc

SEQ ID NO: 295235 - DNA, 20 bp, Artificial
  CRISPR gRNA sequence
ctaactctggtgctctttcc

SEQ ID NO: 295236 - DNA, 20 bp, Artificial
  CRISPR gRNA sequence
actctggtgctctttccctt

SEQ ID NO: 295237 - DNA, 20 bp, Artificial
  CRISPR gRNA sequence
tggtgctctttccctttatc

SEQ ID NO: 295238 - DNA, 20 bp, Artificial
  CRISPR gRNA sequence
gtgctctttccctttatcag

SEQ ID NO: 295239 - DNA, 20 bp, Artificial
  CRISPR gRNA sequence
tttccctttatcagtttgac

SEQ ID NO: 295240 - DNA, 20 bp, Artificial
  CRISPR gRNA sequence
tccctttatcagtttgactg

SEQ ID NO: 295241 - DNA, 20 bp, Artificial
  CRISPR gRNA sequence
ccctttatcagtttgactgt

SEQ ID NO: 295242 - DNA, 20 bp, Artificial
  CRISPR gRNA sequence
cctttatcagtttgactgtg

SEQ ID NO: 295243 - DNA, 20 bp, Artificial
  CRISPR gRNA sequence
tatcagtttgactgtggcct

SEQ ID NO: 295244 - DNA, 20 bp, Artificial
  CRISPR gRNA sequence
atcagtttgactgtggcctg

SEQ ID NO: 295245 - DNA, 20 bp, Artificial
  CRISPR gRNA sequence
tcagtttgactgtggcctgt

SEQ ID NO: 295246 - DNA, 20 bp, Artificial
  CRISPR gRNA sequence
gactgtggcctgttaactgg

SEQ ID NO: 295247 - DNA, 20 bp, Artificial
  CRISPR gRNA sequence
actgtggcctgttaactggt

SEQ ID NO: 295248 - DNA, 20 bp, Artificial
  CRISPR gRNA sequence
tggcctgttaactggtatat

SEQ ID NO: 295249 - DNA, 20 bp, Artificial
  CRISPR gRNA sequence
ttaactggtatatacatata

SEQ ID NO: 295250 - DNA, 20 bp, Artificial
  CRISPR gRNA sequence
actggtatatacatatatat

SEQ ID NO: 295251 - DNA, 20 bp, Artificial
  CRISPR gRNA sequence
gtatatacatatatatgtca

SEQ ID NO: 295252 - DNA, 20 bp, Artificial
  CRISPR gRNA sequence
ctggaagtagaatttgtcca

SEQ ID NO: 295253 - DNA, 20 bp, Artificial
  CRISPR gRNA sequence
gaagtagaatttgtccaata

SEQ ID NO: 295254 - DNA, 20 bp, Artificial
  CRISPR gRNA sequence
gtccaataacaggtcaactt

SEQ ID NO: 295255 - DNA, 20 bp, Artificial
  CRISPR gRNA sequence
tccaataacaggtcaacttc

SEQ ID NO: 295256 - DNA, 20 bp, Artificial
  CRISPR gRNA sequence
cagagactatctgatttcct

SEQ ID NO: 295257 - DNA, 20 bp, Artificial
  CRISPR gRNA sequence
agagactatctgatttccta

SEQ ID NO: 295258 - DNA, 20 bp, Artificial
  CRISPR gRNA sequence
tctgatttcctaatgtcaga

SEQ ID NO: 295259 - DNA, 20 bp, Artificial
  CRISPR gRNA sequence
atttcctaatgtcagagtag

SEQ ID NO: 295260 - DNA, 20 bp, Artificial
  CRISPR gRNA sequence
cctaatgtcagagtagaaga

SEQ ID NO: 295261 - DNA, 20 bp, Artificial
  CRISPR gRNA sequence
ctaatgtcagagtagaagat

SEQ ID NO: 295262 - DNA, 20 bp, Artificial
  CRISPR gRNA sequence
atgtcagagtagaagatttt

SEQ ID NO: 295263 - DNA, 20 bp, Artificial
  CRISPR gRNA sequence
tatgctgctgtttacaaaag

SEQ ID NO: 295264 - DNA, 20 bp, Artificial
  CRISPR gRNA sequence
atgctgctgtttacaaaagc

SEQ ID NO: 295265 - DNA, 20 bp, Artificial
  CRISPR gRNA sequence
tgctgctgtttacaaaagcc

SEQ ID NO: 295266 - DNA, 20 bp, Artificial
  CRISPR gRNA sequence
ctgtttacaaaagcccaatg

SEQ ID NO: 295267 - DNA, 20 bp, Artificial
  CRISPR gRNA sequence
tttacaaaagcccaatgtaa

SEQ ID NO: 295268 - DNA, 20 bp, Artificial
  CRISPR gRNA sequence
acaaaagcccaatgtaatgc

SEQ ID NO: 295269 - DNA, 20 bp, Artificial
  CRISPR gRNA sequence
caaaagcccaatgtaatgca

SEQ ID NO: 295270 - DNA, 20 bp, Artificial
  CRISPR gRNA sequence
taggagactaatggaaatat

SEQ ID NO: 295271 - DNA, 20 bp, Artificial
  CRISPR gRNA sequence
aggagactaatggaaatatt

SEQ ID NO: 295272 - DNA, 20 bp, Artificial
  CRISPR gRNA sequence
ggagactaatggaaatatta

SEQ ID NO: 295273 - DNA, 20 bp, Artificial
  CRISPR gRNA sequence
atggaaatattattggtgtt

SEQ ID NO: 295274 - DNA, 20 bp, Artificial
  CRISPR gRNA sequence
ttggtgtttacccagtattc

SEQ ID NO: 295275 - DNA, 20 bp, Artificial
  CRISPR gRNA sequence
gtgtttacccagtattccat

SEQ ID NO: 295276 - DNA, 20 bp, Artificial
  CRISPR gRNA sequence
acccagtattccattttttt

SEQ ID NO: 295277 - DNA, 20 bp, Artificial
  CRISPR gRNA sequence
cccagtattccatttttttc

SEQ ID NO: 295278 - DNA, 20 bp, Artificial
  CRISPR gRNA sequence
catttttttcattgtgttct

SEQ ID NO: 295279 - DNA, 20 bp, Artificial
  CRISPR gRNA sequence
ttttcattgtgttctctatt

SEQ ID NO: 295280 - DNA, 20 bp, Artificial
  CRISPR gRNA sequence
tttcattgtgttctctattg

SEQ ID NO: 295281 - DNA, 20 bp, Artificial
  CRISPR gRNA sequence
ttcattgtgttctctattgc

SEQ ID NO: 295282 - DNA, 20 bp, Artificial
  CRISPR gRNA sequence
tcattgtgttctctattgct

SEQ ID NO: 295283 - DNA, 20 bp, Artificial
  CRISPR gRNA sequence
cattgtgttctctattgctg

SEQ ID NO: 295284 - DNA, 20 bp, Artificial
  CRISPR gRNA sequence
attgtgttctctattgctgc

SEQ ID NO: 295285 - DNA, 20 bp, Artificial
  CRISPR gRNA sequence
tgttctctattgctgctctc

SEQ ID NO: 295286 - DNA, 20 bp, Artificial
  CRISPR gRNA sequence
tctattgctgctctctcact

SEQ ID NO: 295287 - DNA, 20 bp, Artificial
  CRISPR gRNA sequence
tattgctgctctctcactcc

SEQ ID NO: 295288 - DNA, 20 bp, Artificial
  CRISPR gRNA sequence
ttgctgctctctcactcccc

SEQ ID NO: 295289 - DNA, 20 bp, Artificial
  CRISPR gRNA sequence
ctgctctctcactcccccat

SEQ ID NO: 295290 - DNA, 20 bp, Artificial
  CRISPR gRNA sequence
ctctctcactcccccatgag

SEQ ID NO: 295291 - DNA, 20 bp, Artificial
  CRISPR gRNA sequence
tctcactcccccatgaggta

SEQ ID NO: 295292 - DNA, 20 bp, Artificial
  CRISPR gRNA sequence
tcactcccccatgaggtaca

SEQ ID NO: 295293 - DNA, 20 bp, Artificial
  CRISPR gRNA sequence
actcccccatgaggtacagc

SEQ ID NO: 295294 - DNA, 20 bp, Artificial
  CRISPR gRNA sequence
ccccatgaggtacagcagaa

SEQ ID NO: 295295 - DNA, 20 bp, Artificial
  CRISPR gRNA sequence
tccaaaactaatttcctctg

SEQ ID NO: 295296 - DNA, 20 bp, Artificial
  CRISPR gRNA sequence
atttcctctgacatgtaaga

SEQ ID NO: 295297 - DNA, 20 bp, Artificial
  CRISPR gRNA sequence
cctctgacatgtaagacgaa

SEQ ID NO: 295298 - DNA, 20 bp, Artificial
  CRISPR gRNA sequence
ctctgacatgtaagacgaat

SEQ ID NO: 295299 - DNA, 20 bp, Artificial
  CRISPR gRNA sequence
tgacatgtaagacgaatgat

SEQ ID NO: 295300 - DNA, 20 bp, Artificial
  CRISPR gRNA sequence
acatgtaagacgaatgattt

SEQ ID NO: 295301 - DNA, 20 bp, Artificial
  CRISPR gRNA sequence
aggtacgtcaaagcagtagt

SEQ ID NO: 295302 - DNA, 20 bp, Artificial
  CRISPR gRNA sequence
ggtacgtcaaagcagtagtc

SEQ ID NO: 295303 - DNA, 20 bp, Artificial
  CRISPR gRNA sequence
aactggttcatattggactg

SEQ ID NO: 295304 - DNA, 20 bp, Artificial
  CRISPR gRNA sequence
actggttcatattggactga

SEQ ID NO: 295305 - DNA, 20 bp, Artificial
  CRISPR gRNA sequence
gttcatattggactgataat

SEQ ID NO: 295306 - DNA, 20 bp, Artificial
  CRISPR gRNA sequence
atattggactgataatctct

SEQ ID NO: 295307 - DNA, 20 bp, Artificial
  CRISPR gRNA sequence
gactgataatctctttaaat

SEQ ID NO: 295308 - DNA, 20 bp, Artificial
  CRISPR gRNA sequence
ataatctctttaaatggctt

SEQ ID NO: 295309 - DNA, 20 bp, Artificial
  CRISPR gRNA sequence
tttaaatggctttatgctag

SEQ ID NO: 295310 - DNA, 20 bp, Artificial
  CRISPR gRNA sequence
taaatggctttatgctagtt

SEQ ID NO: 295311 - DNA, 20 bp, Artificial
  CRISPR gRNA sequence
aaatggctttatgctagttt

SEQ ID NO: 295312 - DNA, 20 bp, Artificial
  CRISPR gRNA sequence
aatggctttatgctagtttg

SEQ ID NO: 295313 - DNA, 20 bp, Artificial
  CRISPR gRNA sequence
tatgctagtttgacctcatt

SEQ ID NO: 295314 - DNA, 20 bp, Artificial
  CRISPR gRNA sequence
atgctagtttgacctcattt

SEQ ID NO: 295315 - DNA, 20 bp, Artificial
  CRISPR gRNA sequence
tgctagtttgacctcatttg

SEQ ID NO: 295316 - DNA, 20 bp, Artificial
  CRISPR gRNA sequence
gtttgacctcatttgtaaaa

SEQ ID NO: 295317 - DNA, 20 bp, Artificial
  CRISPR gRNA sequence
gacctcatttgtaaaatatt

SEQ ID NO: 295318 - DNA, 20 bp, Artificial
  CRISPR gRNA sequence
acctcatttgtaaaatattt

SEQ ID NO: 295319 - DNA, 20 bp, Artificial
  CRISPR gRNA sequence
atttgtaaaatatttatgag

SEQ ID NO: 295320 - DNA, 20 bp, Artificial
  CRISPR gRNA sequence
gtaaaatatttatgagaaag

SEQ ID NO: 295321 - DNA, 20 bp, Artificial
  CRISPR gRNA sequence
taaaatatttatgagaaagt

SEQ ID NO: 295322 - DNA, 20 bp, Artificial
  CRISPR gRNA sequence
atgagaaagttctcatttaa

SEQ ID NO: 295323 - DNA, 20 bp, Artificial
  CRISPR gRNA sequence
tgagaaagttctcatttaaa

SEQ ID NO: 295324 - DNA, 20 bp, Artificial
  CRISPR gRNA sequence
tcatttaaaatgagatcgtt

SEQ ID NO: 295325 - DNA, 20 bp, Artificial
  CRISPR gRNA sequence
atttaaaatgagatcgttgt

SEQ ID NO: 295326 - DNA, 20 bp, Artificial
  CRISPR gRNA sequence
aaaatgagatcgttgtttac

SEQ ID NO: 295327 - DNA, 20 bp, Artificial
  CRISPR gRNA sequence
aaatgagatcgttgtttaca

SEQ ID NO: 295328 - DNA, 20 bp, Artificial
  CRISPR gRNA sequence
tttacagtgtatgtactaag

SEQ ID NO: 295329 - DNA, 20 bp, Artificial
  CRISPR gRNA sequence
acagtgtatgtactaagcag

SEQ ID NO: 295330 - DNA, 20 bp, Artificial
  CRISPR gRNA sequence
cagtgtatgtactaagcagt

SEQ ID NO: 295331 - DNA, 20 bp, Artificial
  CRISPR gRNA sequence
agcagtaagctatcttcaaa

SEQ ID NO: 295332 - DNA, 20 bp, Artificial
  CRISPR gRNA sequence
tcttcaaatgtctaaggtag

SEQ ID NO: 295333 - DNA, 20 bp, Artificial
  CRISPR gRNA sequence
caaatgtctaaggtagtaac

SEQ ID NO: 295334 - DNA, 20 bp, Artificial
  CRISPR gRNA sequence
aaatgtctaaggtagtaact

SEQ ID NO: 295335 - DNA, 20 bp, Artificial
  CRISPR gRNA sequence
aggtagtaactttccatagg

SEQ ID NO: 295336 - DNA, 20 bp, Artificial
  CRISPR gRNA sequence
tccatagggcctccttagat

SEQ ID NO: 295337 - DNA, 20 bp, Artificial
  CRISPR gRNA sequence
ccatagggcctccttagatc

SEQ ID NO: 295338 - DNA, 20 bp, Artificial
  CRISPR gRNA sequence
catagggcctccttagatcc

SEQ ID NO: 295339 - DNA, 20 bp, Artificial
  CRISPR gRNA sequence
cttagatccctaagatggct

SEQ ID NO: 295340 - DNA, 20 bp, Artificial
  CRISPR gRNA sequence
agatccctaagatggctttt

SEQ ID NO: 295341 - DNA, 20 bp, Artificial
  CRISPR gRNA sequence
gatccctaagatggcttttt

SEQ ID NO: 295342 - DNA, 20 bp, Artificial
  CRISPR gRNA sequence
agatggctttttctccttgg

SEQ ID NO: 295343 - DNA, 20 bp, Artificial
  CRISPR gRNA sequence
tttctccttggtatttctgg

SEQ ID NO: 295344 - DNA, 20 bp, Artificial
  CRISPR gRNA sequence
ttctccttggtatttctggg

SEQ ID NO: 295345 - DNA, 20 bp, Artificial
  CRISPR gRNA sequence
tctccttggtatttctgggt

SEQ ID NO: 295346 - DNA, 20 bp, Artificial
  CRISPR gRNA sequence
ctccttggtatttctgggtc

SEQ ID NO: 295347 - DNA, 20 bp, Artificial
  CRISPR gRNA sequence
tccttggtatttctgggtct

SEQ ID NO: 295348 - DNA, 20 bp, Artificial
  CRISPR gRNA sequence
cttggtatttctgggtcttt

SEQ ID NO: 295349 - DNA, 20 bp, Artificial
  CRISPR gRNA sequence
ggtatttctgggtctttctg

SEQ ID NO: 295350 - DNA, 20 bp, Artificial
  CRISPR gRNA sequence
gtatttctgggtctttctga

SEQ ID NO: 295351 - DNA, 20 bp, Artificial
  CRISPR gRNA sequence
ctgggtctttctgacatcag

SEQ ID NO: 295352 - DNA, 20 bp, Artificial
  CRISPR gRNA sequence
tgggtctttctgacatcagc

SEQ ID NO: 295353 - DNA, 20 bp, Artificial
  CRISPR gRNA sequence
ggtctttctgacatcagcag

SEQ ID NO: 295354 - DNA, 20 bp, Artificial
  CRISPR gRNA sequence
tctgacatcagcagagaact

SEQ ID NO: 295355 - DNA, 20 bp, Artificial
  CRISPR gRNA sequence
ctgacatcagcagagaactg

SEQ ID NO: 295356 - DNA, 20 bp, Artificial
  CRISPR gRNA sequence
tgacatcagcagagaactgg

SEQ ID NO: 295357 - DNA, 20 bp, Artificial
  CRISPR gRNA sequence
acatcagcagagaactggaa

SEQ ID NO: 295358 - DNA, 20 bp, Artificial
  CRISPR gRNA sequence
gaaagacatagccaactgct

SEQ ID NO: 295359 - DNA, 20 bp, Artificial
  CRISPR gRNA sequence
ctgttcatgttactcatgac

SEQ ID NO: 295360 - DNA, 20 bp, Artificial
  CRISPR gRNA sequence
ttcatgttactcatgactcc

SEQ ID NO: 295361 - DNA, 20 bp, Artificial
  CRISPR gRNA sequence
atgttactcatgactccttt

SEQ ID NO: 295362 - DNA, 20 bp, Artificial
  CRISPR gRNA sequence
ctcatgactcctttctctaa

SEQ ID NO: 295363 - DNA, 20 bp, Artificial
  CRISPR gRNA sequence
atgactcctttctctaaaac

SEQ ID NO: 295364 - DNA, 20 bp, Artificial
  CRISPR gRNA sequence
ctttctctaaaactgccttc

SEQ ID NO: 295365 - DNA, 20 bp, Artificial
  CRISPR gRNA sequence
tctctaaaactgccttccac

SEQ ID NO: 295366 - DNA, 20 bp, Artificial
  CRISPR gRNA sequence
ctctaaaactgccttccaca

SEQ ID NO: 295367 - DNA, 20 bp, Artificial
  CRISPR gRNA sequence
tctaaaactgccttccacaa

SEQ ID NO: 295368 - DNA, 20 bp, Artificial
  CRISPR gRNA sequence
taaaactgccttccacaatt

SEQ ID NO: 295369 - DNA, 20 bp, Artificial
  CRISPR gRNA sequence
aaactgccttccacaattca

SEQ ID NO: 295370 - DNA, 20 bp, Artificial
  CRISPR gRNA sequence
ccttccacaattcactagac

SEQ ID NO: 295371 - DNA, 20 bp, Artificial
  CRISPR gRNA sequence
ccacaattcactagaccaga

SEQ ID NO: 295372 - DNA, 20 bp, Artificial
  CRISPR gRNA sequence
cacaattcactagaccagaa

SEQ ID NO: 295373 - DNA, 20 bp, Artificial
  CRISPR gRNA sequence
actagaccagaagtggacgc

SEQ ID NO: 295374 - DNA, 20 bp, Artificial
  CRISPR gRNA sequence
gaccagaagtggacgcaact

SEQ ID NO: 295375 - DNA, 20 bp, Artificial
  CRISPR gRNA sequence
aagctgggataatcacatta

SEQ ID NO: 295376 - DNA, 20 bp, Artificial
  CRISPR gRNA sequence
agctgggataatcacattat

SEQ ID NO: 295377 - DNA, 20 bp, Artificial
  CRISPR gRNA sequence
ggataatcacattatcatct

SEQ ID NO: 295378 - DNA, 20 bp, Artificial
  CRISPR gRNA sequence
tcatctgaaaatctggagtt

SEQ ID NO: 295379 - DNA, 20 bp, Artificial
  CRISPR gRNA sequence
aaaatctggagttgaacagc

SEQ ID NO: 295380 - DNA, 20 bp, Artificial
  CRISPR gRNA sequence
gagttgaacagcaaaagaag

SEQ ID NO: 295381 - DNA, 20 bp, Artificial
  CRISPR gRNA sequence
aacagcaaaagaagacaaca

SEQ ID NO: 295382 - DNA, 20 bp, Artificial
  CRISPR gRNA sequence
ctcaaatgcacatctcatgg

SEQ ID NO: 295383 - DNA, 20 bp, Artificial
  CRISPR gRNA sequence
tcaaatgcacatctcatggc

SEQ ID NO: 295384 - DNA, 20 bp, Artificial
  CRISPR gRNA sequence
aaatgcacatctcatggcag

SEQ ID NO: 295385 - DNA, 20 bp, Artificial
  CRISPR gRNA sequence
atggcagctaagccacatgg

SEQ ID NO: 295386 - DNA, 20 bp, Artificial
  CRISPR gRNA sequence
agccacatggctgggattta

SEQ ID NO: 295387 - DNA, 20 bp, Artificial
  CRISPR gRNA sequence
ggatttaaagcctttagagc

SEQ ID NO: 295388 - DNA, 20 bp, Artificial
  CRISPR gRNA sequence
aaagcctttagagccagccc

SEQ ID NO: 295389 - DNA, 20 bp, Artificial
  CRISPR gRNA sequence
aagcctttagagccagccca

SEQ ID NO: 295390 - DNA, 20 bp, Artificial
  CRISPR gRNA sequence
tagagccagcccatggcttt

SEQ ID NO: 295391 - DNA, 20 bp, Artificial
  CRISPR gRNA sequence
agagccagcccatggcttta

SEQ ID NO: 295392 - DNA, 20 bp, Artificial
  CRISPR gRNA sequence
gagccagcccatggctttag

SEQ ID NO: 295393 - DNA, 20 bp, Artificial
  CRISPR gRNA sequence
tagctacctcactatgctgc

SEQ ID NO: 295394 - DNA, 20 bp, Artificial
  CRISPR gRNA sequence
agctacctcactatgctgct

SEQ ID NO: 295395 - DNA, 20 bp, Artificial
  CRISPR gRNA sequence
gctacctcactatgctgctt

SEQ ID NO: 295396 - DNA, 20 bp, Artificial
  CRISPR gRNA sequence
cctcactatgctgcttcaca

SEQ ID NO: 295397 - DNA, 20 bp, Artificial
  CRISPR gRNA sequence
actatgctgcttcacaaacc

SEQ ID NO: 295398 - DNA, 20 bp, Artificial
  CRISPR gRNA sequence
tgctgcttcacaaaccttgc

SEQ ID NO: 295399 - DNA, 20 bp, Artificial
  CRISPR gRNA sequence
cttcacaaaccttgctcctg

SEQ ID NO: 295400 - DNA, 20 bp, Artificial
  CRISPR gRNA sequence
cacaaaccttgctcctgtgt

SEQ ID NO: 295401 - DNA, 20 bp, Artificial
  CRISPR gRNA sequence
acaaaccttgctcctgtgta

SEQ ID NO: 295402 - DNA, 20 bp, Artificial
  CRISPR gRNA sequence
gctcctgtgtaaaactatat

SEQ ID NO: 295403 - DNA, 20 bp, Artificial
  CRISPR gRNA sequence
ctcctgtgtaaaactatatt

SEQ ID NO: 295404 - DNA, 20 bp, Artificial
  CRISPR gRNA sequence
ctgtgtaaaactatattctc

SEQ ID NO: 295405 - DNA, 20 bp, Artificial
  CRISPR gRNA sequence
tgtaaaactatattctcagt

SEQ ID NO: 295406 - DNA, 20 bp, Artificial
  CRISPR gRNA sequence
tattctcagtgtagggcaga

SEQ ID NO: 295407 - DNA, 20 bp, Artificial
  CRISPR gRNA sequence
tcagtgtagggcagagaggt

SEQ ID NO: 295408 - DNA, 20 bp, Artificial
  CRISPR gRNA sequence
agtgtagggcagagaggtct

SEQ ID NO: 295409 - DNA, 20 bp, Artificial
  CRISPR gRNA sequence
acaccaacataaggtactag

SEQ ID NO: 295410 - DNA, 20 bp, Artificial
  CRISPR gRNA sequence
gcagtgtttcccgtattgac

SEQ ID NO: 295411 - DNA, 20 bp, Artificial
  CRISPR gRNA sequence
cccgtattgacaggaatact

SEQ ID NO: 295412 - DNA, 20 bp, Artificial
  CRISPR gRNA sequence
ccgtattgacaggaatactt

SEQ ID NO: 295413 - DNA, 20 bp, Artificial
  CRISPR gRNA sequence
acaggaatacttaactcaat

SEQ ID NO: 295414 - DNA, 20 bp, Artificial
  CRISPR gRNA sequence
aactcaataattcttttctt

SEQ ID NO: 295415 - DNA, 20 bp, Artificial
  CRISPR gRNA sequence
actcaataattcttttcttt

SEQ ID NO: 295416 - DNA, 20 bp, Artificial
  CRISPR gRNA sequence
aataattcttttcttttcca

SEQ ID NO: 295417 - DNA, 20 bp, Artificial
  CRISPR gRNA sequence
ttttcttttccatttagtaa

SEQ ID NO: 295418 - DNA, 20 bp, Artificial
  CRISPR gRNA sequence
ttcttttccatttagtaaca

SEQ ID NO: 295419 - DNA, 20 bp, Artificial
  CRISPR gRNA sequence
tcttttccatttagtaacag

SEQ ID NO: 295420 - DNA, 20 bp, Artificial
  CRISPR gRNA sequence
cttttccatttagtaacagt

SEQ ID NO: 295421 - DNA, 20 bp, Artificial
  CRISPR gRNA sequence
ttttccatttagtaacagtt

SEQ ID NO: 295422 - DNA, 20 bp, Artificial
  CRISPR gRNA sequence
ttccatttagtaacagttgt

SEQ ID NO: 295423 - DNA, 20 bp, Artificial
  CRISPR gRNA sequence
tccatttagtaacagttgtg

SEQ ID NO: 295424 - DNA, 20 bp, Artificial
  CRISPR gRNA sequence
ccatttagtaacagttgtga

SEQ ID NO: 295425 - DNA, 20 bp, Artificial
  CRISPR gRNA sequence
catttagtaacagttgtgat

SEQ ID NO: 295426 - DNA, 20 bp, Artificial
  CRISPR gRNA sequence
agtaacagttgtgatgacta

SEQ ID NO: 295427 - DNA, 20 bp, Artificial
  CRISPR gRNA sequence
gtaacagttgtgatgactat

SEQ ID NO: 295428 - DNA, 20 bp, Artificial
  CRISPR gRNA sequence
tgatgactatgtttctattc

SEQ ID NO: 295429 - DNA, 20 bp, Artificial
  CRISPR gRNA sequence
tgtttctattctaagtaatt

SEQ ID NO: 295430 - DNA, 20 bp, Artificial
  CRISPR gRNA sequence
ctattctaagtaattcctgt

SEQ ID NO: 295431 - DNA, 20 bp, Artificial
  CRISPR gRNA sequence
tattctaagtaattcctgta

SEQ ID NO: 295432 - DNA, 20 bp, Artificial
  CRISPR gRNA sequence
ttctaagtaattcctgtatt

SEQ ID NO: 295433 - DNA, 20 bp, Artificial
  CRISPR gRNA sequence
taagtaattcctgtattcta

SEQ ID NO: 295434 - DNA, 20 bp, Artificial
  CRISPR gRNA sequence
agtaattcctgtattctaca

SEQ ID NO: 295435 - DNA, 20 bp, Artificial
  CRISPR gRNA sequence
ctgtattctacagcagatac

SEQ ID NO: 295436 - DNA, 20 bp, Artificial
  CRISPR gRNA sequence
tattctacagcagatacttt

SEQ ID NO: 295437 - DNA, 20 bp, Artificial
  CRISPR gRNA sequence
tacagcagatactttgtcag

SEQ ID NO: 295438 - DNA, 20 bp, Artificial
  CRISPR gRNA sequence
cagcagatactttgtcagca

SEQ ID NO: 295439 - DNA, 20 bp, Artificial
  CRISPR gRNA sequence
tgtcagcaatactaagggaa

SEQ ID NO: 295440 - DNA, 20 bp, Artificial
  CRISPR gRNA sequence
gtcagcaatactaagggaag

SEQ ID NO: 295441 - DNA, 20 bp, Artificial
  CRISPR gRNA sequence
tcagcaatactaagggaaga

SEQ ID NO: 295442 - DNA, 20 bp, Artificial
  CRISPR gRNA sequence
agggaagaaacaaagttgaa

SEQ ID NO: 295443 - DNA, 20 bp, Artificial
  CRISPR gRNA sequence
aaccgtttctttaataatgc

SEQ ID NO: 295444 - DNA, 20 bp, Artificial
  CRISPR gRNA sequence
ctttaataatgctgatctac

SEQ ID NO: 295445 - DNA, 20 bp, Artificial
  CRISPR gRNA sequence
tttaataatgctgatctact

SEQ ID NO: 295446 - DNA, 20 bp, Artificial
  CRISPR gRNA sequence
taataatgctgatctacttt

SEQ ID NO: 295447 - DNA, 20 bp, Artificial
  CRISPR gRNA sequence
aataatgctgatctactttt

SEQ ID NO: 295448 - DNA, 20 bp, Artificial
  CRISPR gRNA sequence
ataatgctgatctacttttt

SEQ ID NO: 295449 - DNA, 20 bp, Artificial
  CRISPR gRNA sequence
atctactttttgttgaattt

SEQ ID NO: 295450 - DNA, 20 bp, Artificial
  CRISPR gRNA sequence
ctttttgttgaatttgtatt

SEQ ID NO: 295451 - DNA, 20 bp, Artificial
  CRISPR gRNA sequence
tttgttgaatttgtatttta

SEQ ID NO: 295452 - DNA, 20 bp, Artificial
  CRISPR gRNA sequence
ttgttgaatttgtattttat

SEQ ID NO: 295453 - DNA, 20 bp, Artificial
  CRISPR gRNA sequence
tgttgaatttgtattttatt

SEQ ID NO: 295454 - DNA, 20 bp, Artificial
  CRISPR gRNA sequence
gttgaatttgtattttattt

SEQ ID NO: 295455 - DNA, 20 bp, Artificial
  CRISPR gRNA sequence
ttgaatttgtattttatttc

SEQ ID NO: 295456 - DNA, 20 bp, Artificial
  CRISPR gRNA sequence
aatttgtattttatttcaag

SEQ ID NO: 295457 - DNA, 20 bp, Artificial
  CRISPR gRNA sequence
gtattttatttcaagtgtca

SEQ ID NO: 295458 - DNA, 20 bp, Artificial
  CRISPR gRNA sequence
tattttatttcaagtgtcaa

SEQ ID NO: 295459 - DNA, 20 bp, Artificial
  CRISPR gRNA sequence
tatttcaagtgtcaaagaaa

SEQ ID NO: 295460 - DNA, 20 bp, Artificial
  CRISPR gRNA sequence
atttcaagtgtcaaagaaat

SEQ ID NO: 295461 - DNA, 20 bp, Artificial
  CRISPR gRNA sequence
tttcaagtgtcaaagaaatc

SEQ ID NO: 295462 - DNA, 20 bp, Artificial
  CRISPR gRNA sequence
caagtgtcaaagaaatcatc

SEQ ID NO: 295463 - DNA, 20 bp, Artificial
  CRISPR gRNA sequence
aagtgtcaaagaaatcatct

SEQ ID NO: 295464 - DNA, 20 bp, Artificial
  CRISPR gRNA sequence
tgtttatttagatgaaacca

SEQ ID NO: 295465 - DNA, 20 bp, Artificial
  CRISPR gRNA sequence
gtttatttagatgaaaccaa

SEQ ID NO: 295466 - DNA, 20 bp, Artificial
  CRISPR gRNA sequence
tttatttagatgaaaccaaa

SEQ ID NO: 295467 - DNA, 20 bp, Artificial
  CRISPR gRNA sequence
atttagatgaaaccaaacac

SEQ ID NO: 295468 - DNA, 20 bp, Artificial
  CRISPR gRNA sequence
tttagatgaaaccaaacact

SEQ ID NO: 295469 - DNA, 20 bp, Artificial
  CRISPR gRNA sequence
agatgaaaccaaacactaca

SEQ ID NO: 295470 - DNA, 20 bp, Artificial
  CRISPR gRNA sequence
gatgaaaccaaacactacac

SEQ ID NO: 295471 - DNA, 20 bp, Artificial
  CRISPR gRNA sequence
cacatttacactcacactgc

SEQ ID NO: 295472 - DNA, 20 bp, Artificial
  CRISPR gRNA sequence
acactcacactgcttccagg

SEQ ID NO: 295473 - DNA, 20 bp, Artificial
  CRISPR gRNA sequence
cactcacactgcttccagga

SEQ ID NO: 295474 - DNA, 20 bp, Artificial
  CRISPR gRNA sequence
acactgcttccaggacccaa

SEQ ID NO: 295475 - DNA, 20 bp, Artificial
  CRISPR gRNA sequence
cttccaggacccaagggttt

SEQ ID NO: 295476 - DNA, 20 bp, Artificial
  CRISPR gRNA sequence
ccaggacccaagggtttcac

SEQ ID NO: 295477 - DNA, 20 bp, Artificial
  CRISPR gRNA sequence
caggacccaagggtttcaca

SEQ ID NO: 295478 - DNA, 20 bp, Artificial
  CRISPR gRNA sequence
cacagaccatttgcctacct

SEQ ID NO: 295479 - DNA, 20 bp, Artificial
  CRISPR gRNA sequence
acagaccatttgcctacctg

SEQ ID NO: 295480 - DNA, 20 bp, Artificial
  CRISPR gRNA sequence
gcctacctggttctttcctc

SEQ ID NO: 295481 - DNA, 20 bp, Artificial
  CRISPR gRNA sequence
cctacctggttctttcctct

SEQ ID NO: 295482 - DNA, 20 bp, Artificial
  CRISPR gRNA sequence
cctggttctttcctctcctc

SEQ ID NO: 295483 - DNA, 20 bp, Artificial
  CRISPR gRNA sequence
gttctttcctctcctctttc

SEQ ID NO: 295484 - DNA, 20 bp, Artificial
  CRISPR gRNA sequence
tttcctctcctctttccagt

SEQ ID NO: 295485 - DNA, 20 bp, Artificial
  CRISPR gRNA sequence
tcctctcctctttccagtga

SEQ ID NO: 295486 - DNA, 20 bp, Artificial
  CRISPR gRNA sequence
cctctcctctttccagtgat

SEQ ID NO: 295487 - DNA, 20 bp, Artificial
  CRISPR gRNA sequence
ctctcctctttccagtgatt

SEQ ID NO: 295488 - DNA, 20 bp, Artificial
  CRISPR gRNA sequence
tcctctttccagtgatttct

SEQ ID NO: 295489 - DNA, 20 bp, Artificial
  CRISPR gRNA sequence
ctctttccagtgatttctag

SEQ ID NO: 295490 - DNA, 20 bp, Artificial
  CRISPR gRNA sequence
tttccagtgatttctagaat

SEQ ID NO: 295491 - DNA, 20 bp, Artificial
  CRISPR gRNA sequence
tccagtgatttctagaatac

SEQ ID NO: 295492 - DNA, 20 bp, Artificial
  CRISPR gRNA sequence
ccagtgatttctagaatacc

SEQ ID NO: 295493 - DNA, 20 bp, Artificial
  CRISPR gRNA sequence
cagtgatttctagaataccc

SEQ ID NO: 295494 - DNA, 20 bp, Artificial
  CRISPR gRNA sequence
ctagaataccctttcaaagg

SEQ ID NO: 295495 - DNA, 20 bp, Artificial
  CRISPR gRNA sequence
tagaataccctttcaaagga

SEQ ID NO: 295496 - DNA, 20 bp, Artificial
  CRISPR gRNA sequence
gaataccctttcaaaggacc

SEQ ID NO: 295497 - DNA, 20 bp, Artificial
  CRISPR gRNA sequence
tcaaaggaccacatgaatat

SEQ ID NO: 295498 - DNA, 20 bp, Artificial
  CRISPR gRNA sequence
caaaggaccacatgaatata

SEQ ID NO: 295499 - DNA, 20 bp, Artificial
  CRISPR gRNA sequence
aaaggaccacatgaatatac

SEQ ID NO: 295500 - DNA, 20 bp, Artificial
  CRISPR gRNA sequence
taaaattcaactttaatctt

SEQ ID NO: 295501 - DNA, 20 bp, Artificial
  CRISPR gRNA sequence
aactttaatcttttgcgaaa

SEQ ID NO: 295502 - DNA, 20 bp, Artificial
  CRISPR gRNA sequence
taatcttttgcgaaatgttt

SEQ ID NO: 295503 - DNA, 20 bp, Artificial
  CRISPR gRNA sequence
aatcttttgcgaaatgtttt

SEQ ID NO: 295504 - DNA, 20 bp, Artificial
  CRISPR gRNA sequence
atcttttgcgaaatgtttta

SEQ ID NO: 295505 - DNA, 20 bp, Artificial
  CRISPR gRNA sequence
ttgcgaaatgttttatttac

SEQ ID NO: 295506 - DNA, 20 bp, Artificial
  CRISPR gRNA sequence
tgcgaaatgttttatttact

SEQ ID NO: 295507 - DNA, 20 bp, Artificial
  CRISPR gRNA sequence
gcgaaatgttttatttactg

SEQ ID NO: 295508 - DNA, 20 bp, Artificial
  CRISPR gRNA sequence
cgaaatgttttatttactgc

SEQ ID NO: 295509 - DNA, 20 bp, Artificial
  CRISPR gRNA sequence
tatttactgcttaaaatcta

SEQ ID NO: 295510 - DNA, 20 bp, Artificial
  CRISPR gRNA sequence
atttactgcttaaaatctag

SEQ ID NO: 295511 - DNA, 20 bp, Artificial
  CRISPR gRNA sequence
tttactgcttaaaatctagg

SEQ ID NO: 295512 - DNA, 20 bp, Artificial
  CRISPR gRNA sequence
actgcttaaaatctaggtgg

SEQ ID NO: 295513 - DNA, 20 bp, Artificial
  CRISPR gRNA sequence
ctgcttaaaatctaggtggg

SEQ ID NO: 295514 - DNA, 20 bp, Artificial
  CRISPR gRNA sequence
cttaaaatctaggtgggtgg

SEQ ID NO: 295515 - DNA, 20 bp, Artificial
  CRISPR gRNA sequence
aaaatctaggtgggtggata

SEQ ID NO: 295516 - DNA, 20 bp, Artificial
  CRISPR gRNA sequence
aaatctaggtgggtggatat

SEQ ID NO: 295517 - DNA, 20 bp, Artificial
  CRISPR gRNA sequence
ggtgggtggatatattcatg

SEQ ID NO: 295518 - DNA, 20 bp, Artificial
  CRISPR gRNA sequence
atgtatgcatatattgatag

SEQ ID NO: 295519 - DNA, 20 bp, Artificial
  CRISPR gRNA sequence
atagattaatacaaacataa

SEQ ID NO: 295520 - DNA, 20 bp, Artificial
  CRISPR gRNA sequence
atacaaacataagtatgtat

SEQ ID NO: 295521 - DNA, 20 bp, Artificial
  CRISPR gRNA sequence
aaatttaaggataagtaaag

SEQ ID NO: 295522 - DNA, 20 bp, Artificial
  CRISPR gRNA sequence
aatttaaggataagtaaagt

SEQ ID NO: 295523 - DNA, 20 bp, Artificial
  CRISPR gRNA sequence
aaggataagtaaagtgagag

SEQ ID NO: 295524 - DNA, 20 bp, Artificial
  CRISPR gRNA sequence
aggataagtaaagtgagagt

SEQ ID NO: 295525 - DNA, 20 bp, Artificial
  CRISPR gRNA sequence
ttagttaaaaagaaaagaaa

SEQ ID NO: 295526 - DNA, 20 bp, Artificial
  CRISPR gRNA sequence
agttaaaaagaaaagaaaaa

SEQ ID NO: 295527 - DNA, 20 bp, Artificial
  CRISPR gRNA sequence
gttaaaaagaaaagaaaaag

SEQ ID NO: 295528 - DNA, 20 bp, Artificial
  CRISPR gRNA sequence
aaaagaaaagaaaaagacaa

SEQ ID NO: 295529 - DNA, 20 bp, Artificial
  CRISPR gRNA sequence
ccaccacaggtaccagcact

SEQ ID NO: 295530 - DNA, 20 bp, Artificial
  CRISPR gRNA sequence
cagtggaaatgcccacctgc

SEQ ID NO: 295531 - DNA, 20 bp, Artificial
  CRISPR gRNA sequence
tggaaatgcccacctgccgg

SEQ ID NO: 295532 - DNA, 20 bp, Artificial
  CRISPR gRNA sequence
aaatgcccacctgccggcag

SEQ ID NO: 295533 - DNA, 20 bp, Artificial
  CRISPR gRNA sequence
acctgccggcagaagttatt

SEQ ID NO: 295534 - DNA, 20 bp, Artificial
  CRISPR gRNA sequence
ggcagaagttatttggaacc

SEQ ID NO: 295535 - DNA, 20 bp, Artificial
  CRISPR gRNA sequence
gaagttatttggaaccaagc

SEQ ID NO: 295536 - DNA, 20 bp, Artificial
  CRISPR gRNA sequence
agttatttggaaccaagcaa

SEQ ID NO: 295537 - DNA, 20 bp, Artificial
  CRISPR gRNA sequence
ccaagcaagagcactgtccc

SEQ ID NO: 295538 - DNA, 20 bp, Artificial
  CRISPR gRNA sequence
aagagcactgtccctggctg

SEQ ID NO: 295539 - DNA, 20 bp, Artificial
  CRISPR gRNA sequence
tggctgtggtgttgtttctc

SEQ ID NO: 295540 - DNA, 20 bp, Artificial
  CRISPR gRNA sequence
tgtggtgttgtttctctagt

SEQ ID NO: 295541 - DNA, 20 bp, Artificial
  CRISPR gRNA sequence
cagttcccctttctgtattt

SEQ ID NO: 295542 - DNA, 20 bp, Artificial
  CRISPR gRNA sequence
ctgtatttgagttctaccgt

SEQ ID NO: 295543 - DNA, 20 bp, Artificial
  CRISPR gRNA sequence
ttgagttctaccgtcagtcc

SEQ ID NO: 295544 - DNA, 20 bp, Artificial
  CRISPR gRNA sequence
ggcattatttctctctctac

SEQ ID NO: 295545 - DNA, 20 bp, Artificial
  CRISPR gRNA sequence
gcattatttctctctctaca

SEQ ID NO: 295546 - DNA, 20 bp, Artificial
  CRISPR gRNA sequence
attatttctctctctacaag

SEQ ID NO: 295547 - DNA, 20 bp, Artificial
  CRISPR gRNA sequence
tctctctctacaaggagcct

SEQ ID NO: 295548 - DNA, 20 bp, Artificial
  CRISPR gRNA sequence
ctctctctacaaggagcctt

SEQ ID NO: 295549 - DNA, 20 bp, Artificial
  CRISPR gRNA sequence
ctctctacaaggagccttag

SEQ ID NO: 295550 - DNA, 20 bp, Artificial
  CRISPR gRNA sequence
tctctacaaggagccttagg

SEQ ID NO: 295551 - DNA, 20 bp, Artificial
  CRISPR gRNA sequence
acaaggagccttaggaggta

SEQ ID NO: 295552 - DNA, 20 bp, Artificial
  CRISPR gRNA sequence
caaggagccttaggaggtac

SEQ ID NO: 295553 - DNA, 20 bp, Artificial
  CRISPR gRNA sequence
aaggagccttaggaggtacg

SEQ ID NO: 295554 - DNA, 20 bp, Artificial
  CRISPR gRNA sequence
ggagccttaggaggtacggg

SEQ ID NO: 295555 - DNA, 20 bp, Artificial
  CRISPR gRNA sequence
gagctcgcaaatactccttt

SEQ ID NO: 295556 - DNA, 20 bp, Artificial
  CRISPR gRNA sequence
caccttgcttctgtgttcct

SEQ ID NO: 295557 - DNA, 20 bp, Artificial
  CRISPR gRNA sequence
accttgcttctgtgttcctt

SEQ ID NO: 295558 - DNA, 20 bp, Artificial
  CRISPR gRNA sequence
tgctgctgtgcttatgcatc

SEQ ID NO: 295559 - DNA, 20 bp, Artificial
  CRISPR gRNA sequence
ttatgcatctggtctctttt

SEQ ID NO: 295560 - DNA, 20 bp, Artificial
  CRISPR gRNA sequence
atgcatctggtctctttttg

SEQ ID NO: 295561 - DNA, 20 bp, Artificial
  CRISPR gRNA sequence
ctggtctctttttggagcta

SEQ ID NO: 295562 - DNA, 20 bp, Artificial
  CRISPR gRNA sequence
gtctctttttggagctacag

SEQ ID NO: 295563 - DNA, 20 bp, Artificial
  CRISPR gRNA sequence
ctttttggagctacagtgga

SEQ ID NO: 295564 - DNA, 20 bp, Artificial
  CRISPR gRNA sequence
tttttggagctacagtggac

SEQ ID NO: 295565 - DNA, 20 bp, Artificial
  CRISPR gRNA sequence
cagtggacaggcatttgtga

SEQ ID NO: 295566 - DNA, 20 bp, Artificial
  CRISPR gRNA sequence
agtggacaggcatttgtgac

SEQ ID NO: 295567 - DNA, 20 bp, Artificial
  CRISPR gRNA sequence
atttgtgacaggtatgtttg

SEQ ID NO: 295568 - DNA, 20 bp, Artificial
  CRISPR gRNA sequence
ttgtgacaggtatgtttgtg

SEQ ID NO: 295569 - DNA, 20 bp, Artificial
  CRISPR gRNA sequence
tgtgacaggtatgtttgtgg

SEQ ID NO: 295570 - DNA, 20 bp, Artificial
  CRISPR gRNA sequence
caggtatgtttgtggaggct

SEQ ID NO: 295571 - DNA, 20 bp, Artificial
  CRISPR gRNA sequence
tttgtggaggctcagacgcc

SEQ ID NO: 295572 - DNA, 20 bp, Artificial
  CRISPR gRNA sequence
ttgtggaggctcagacgcct

SEQ ID NO: 295573 - DNA, 20 bp, Artificial
  CRISPR gRNA sequence
tgtggaggctcagacgccta

SEQ ID NO: 295574 - DNA, 20 bp, Artificial
  CRISPR gRNA sequence
tggaggctcagacgcctagg

SEQ ID NO: 295575 - DNA, 20 bp, Artificial
  CRISPR gRNA sequence
aggctcagacgcctagggag

SEQ ID NO: 295576 - DNA, 20 bp, Artificial
  CRISPR gRNA sequence
agacgcctagggagtggcat

SEQ ID NO: 295577 - DNA, 20 bp, Artificial
  CRISPR gRNA sequence
ctagggagtggcatgagata

SEQ ID NO: 295578 - DNA, 20 bp, Artificial
  CRISPR gRNA sequence
gtggcatgagataaagctgc

SEQ ID NO: 295579 - DNA, 20 bp, Artificial
  CRISPR gRNA sequence
ataaagctgcaagctgcatc

SEQ ID NO: 295580 - DNA, 20 bp, Artificial
  CRISPR gRNA sequence
taaagctgcaagctgcatct

SEQ ID NO: 295581 - DNA, 20 bp, Artificial
  CRISPR gRNA sequence
aaagctgcaagctgcatctg

SEQ ID NO: 295582 - DNA, 20 bp, Artificial
  CRISPR gRNA sequence
gctgcaagctgcatctgggg

SEQ ID NO: 295583 - DNA, 20 bp, Artificial
  CRISPR gRNA sequence
cagaaatgctgatgtgctaa

SEQ ID NO: 295584 - DNA, 20 bp, Artificial
  CRISPR gRNA sequence
aatgctgatgtgctaatggc

SEQ ID NO: 295585 - DNA, 20 bp, Artificial
  CRISPR gRNA sequence
ctgatgtgctaatggccggc

SEQ ID NO: 295586 - DNA, 20 bp, Artificial
  CRISPR gRNA sequence
gatgtgctaatggccggcca

SEQ ID NO: 295587 - DNA, 20 bp, Artificial
  CRISPR gRNA sequence
ctaatggccggccagagaat

SEQ ID NO: 295588 - DNA, 20 bp, Artificial
  CRISPR gRNA sequence
gccggccagagaatgagtaa

SEQ ID NO: 295589 - DNA, 20 bp, Artificial
  CRISPR gRNA sequence
ccggccagagaatgagtaaa

SEQ ID NO: 295590 - DNA, 20 bp, Artificial
  CRISPR gRNA sequence
cggccagagaatgagtaaaa

SEQ ID NO: 295591 - DNA, 20 bp, Artificial
  CRISPR gRNA sequence
agaatgagtaaaagggattg

SEQ ID NO: 295592 - DNA, 20 bp, Artificial
  CRISPR gRNA sequence
aatgagtaaaagggattgca

SEQ ID NO: 295593 - DNA, 20 bp, Artificial
  CRISPR gRNA sequence
tgagtaaaagggattgcaga

SEQ ID NO: 295594 - DNA, 20 bp, Artificial
  CRISPR gRNA sequence
tgcttaaaacctctgaccat

SEQ ID NO: 295595 - DNA, 20 bp, Artificial
  CRISPR gRNA sequence
gcttaaaacctctgaccatc

SEQ ID NO: 295596 - DNA, 20 bp, Artificial
  CRISPR gRNA sequence
tgaccatcaggtttgcttct

SEQ ID NO: 295597 - DNA, 20 bp, Artificial
  CRISPR gRNA sequence
gcttctcagattgactacat

SEQ ID NO: 295598 - DNA, 20 bp, Artificial
  CRISPR gRNA sequence
ttctcagattgactacattg

SEQ ID NO: 295599 - DNA, 20 bp, Artificial
  CRISPR gRNA sequence
tctcagattgactacattgg

SEQ ID NO: 295600 - DNA, 20 bp, Artificial
  CRISPR gRNA sequence
cagattgactacattggagg

SEQ ID NO: 295601 - DNA, 20 bp, Artificial
  CRISPR gRNA sequence
agattgactacattggaggt

SEQ ID NO: 295602 - DNA, 20 bp, Artificial
  CRISPR gRNA sequence
aaaaatctgtctcttcctgc

SEQ ID NO: 295603 - DNA, 20 bp, Artificial
  CRISPR gRNA sequence
tcccttcatctgtttttcgt

SEQ ID NO: 295604 - DNA, 20 bp, Artificial
  CRISPR gRNA sequence
tcatctgtttttcgtgagct

SEQ ID NO: 295605 - DNA, 20 bp, Artificial
  CRISPR gRNA sequence
atctgtttttcgtgagctaa

SEQ ID NO: 295606 - DNA, 20 bp, Artificial
  CRISPR gRNA sequence
tcgtgagctaagagacaaaa

SEQ ID NO: 295607 - DNA, 20 bp, Artificial
  CRISPR gRNA sequence
cgtgagctaagagacaaaat

SEQ ID NO: 295608 - DNA, 20 bp, Artificial
  CRISPR gRNA sequence
gagctaagagacaaaatagg

SEQ ID NO: 295609 - DNA, 20 bp, Artificial
  CRISPR gRNA sequence
agctaagagacaaaataggc

SEQ ID NO: 295610 - DNA, 20 bp, Artificial
  CRISPR gRNA sequence
gagacaaaataggcaggaaa

SEQ ID NO: 295611 - DNA, 20 bp, Artificial
  CRISPR gRNA sequence
acaaaataggcaggaaatag

SEQ ID NO: 295612 - DNA, 20 bp, Artificial
  CRISPR gRNA sequence
caaaataggcaggaaataga

SEQ ID NO: 295613 - DNA, 20 bp, Artificial
  CRISPR gRNA sequence
ggtgccacttaccaaataat

SEQ ID NO: 295614 - DNA, 20 bp, Artificial
  CRISPR gRNA sequence
gccacttaccaaataattgg

SEQ ID NO: 295615 - DNA, 20 bp, Artificial
  CRISPR gRNA sequence
aaataattggcagctgttct

SEQ ID NO: 295616 - DNA, 20 bp, Artificial
  CRISPR gRNA sequence
ttggcagctgttcttggctt

SEQ ID NO: 295617 - DNA, 20 bp, Artificial
  CRISPR gRNA sequence
tggcagctgttcttggcttt

SEQ ID NO: 295618 - DNA, 20 bp, Artificial
  CRISPR gRNA sequence
ggcagctgttcttggctttg

SEQ ID NO: 295619 - DNA, 20 bp, Artificial
  CRISPR gRNA sequence
tgttcttggctttggggtgc

SEQ ID NO: 295620 - DNA, 20 bp, Artificial
  CRISPR gRNA sequence
gttcttggctttggggtgct

SEQ ID NO: 295621 - DNA, 20 bp, Artificial
  CRISPR gRNA sequence
ttcttggctttggggtgctg

SEQ ID NO: 295622 - DNA, 20 bp, Artificial
  CRISPR gRNA sequence
tttggggtgctggggtctcc

SEQ ID NO: 295623 - DNA, 20 bp, Artificial
  CRISPR gRNA sequence
ggggtgctggggtctccgag

SEQ ID NO: 295624 - DNA, 20 bp, Artificial
  CRISPR gRNA sequence
tctccgagcagcctctgctc

SEQ ID NO: 295625 - DNA, 20 bp, Artificial
  CRISPR gRNA sequence
ccgagcagcctctgctctag

SEQ ID NO: 295626 - DNA, 20 bp, Artificial
  CRISPR gRNA sequence
agcagcctctgctctagaag

SEQ ID NO: 295627 - DNA, 20 bp, Artificial
  CRISPR gRNA sequence
agcctctgctctagaagaag

SEQ ID NO: 295628 - DNA, 20 bp, Artificial
  CRISPR gRNA sequence
gctctagaagaagcagtcca

SEQ ID NO: 295629 - DNA, 20 bp, Artificial
  CRISPR gRNA sequence
aagaagcagtccaaagatgt

SEQ ID NO: 295630 - DNA, 20 bp, Artificial
  CRISPR gRNA sequence
gatgtcagctcgcctcgcct

SEQ ID NO: 295631 - DNA, 20 bp, Artificial
  CRISPR gRNA sequence
ctcgcctgagtcccctgtgc

SEQ ID NO: 295632 - DNA, 20 bp, Artificial
  CRISPR gRNA sequence
gcctgagtcccctgtgccag

SEQ ID NO: 295633 - DNA, 20 bp, Artificial
  CRISPR gRNA sequence
cctgagtcccctgtgccagt

SEQ ID NO: 295634 - DNA, 20 bp, Artificial
  CRISPR gRNA sequence
ccctgtgccagtgggaaatc

SEQ ID NO: 295635 - DNA, 20 bp, Artificial
  CRISPR gRNA sequence
ctgtgccagtgggaaatcca

SEQ ID NO: 295636 - DNA, 20 bp, Artificial
  CRISPR gRNA sequence
tgccagtgggaaatccagag

SEQ ID NO: 295637 - DNA, 20 bp, Artificial
  CRISPR gRNA sequence
gccagtgggaaatccagaga

SEQ ID NO: 295638 - DNA, 20 bp, Artificial
  CRISPR gRNA sequence
ccagtgggaaatccagagaa

SEQ ID NO: 295639 - DNA, 20 bp, Artificial
  CRISPR gRNA sequence
cagtgggaaatccagagaag

SEQ ID NO: 295640 - DNA, 20 bp, Artificial
  CRISPR gRNA sequence
agtgggaaatccagagaagg

SEQ ID NO: 295641 - DNA, 20 bp, Artificial
  CRISPR gRNA sequence
agggggatttcctcctcttg

SEQ ID NO: 295642 - DNA, 20 bp, Artificial
  CRISPR gRNA sequence
ctcttgcagcctctctgcaa

SEQ ID NO: 295643 - DNA, 20 bp, Artificial
  CRISPR gRNA sequence
ctctctgcaatggacttact

SEQ ID NO: 295644 - DNA, 20 bp, Artificial
  CRISPR gRNA sequence
tgtttgacctttcccttctc

SEQ ID NO: 295645 - DNA, 20 bp, Artificial
  CRISPR gRNA sequence
gacctttcccttctctggtc

SEQ ID NO: 295646 - DNA, 20 bp, Artificial
  CRISPR gRNA sequence
cctttcccttctctggtcca

SEQ ID NO: 295647 - DNA, 20 bp, Artificial
  CRISPR gRNA sequence
cccaatatttcttcccatcc

SEQ ID NO: 295648 - DNA, 20 bp, Artificial
  CRISPR gRNA sequence
caagtgccccatcccaatat

SEQ ID NO: 295649 - DNA, 20 bp, Artificial
  CRISPR gRNA sequence
atcccaatattagccccact

SEQ ID NO: 295650 - DNA, 20 bp, Artificial
  CRISPR gRNA sequence
atattagccccacttggcac

SEQ ID NO: 295651 - DNA, 20 bp, Artificial
  CRISPR gRNA sequence
attagccccacttggcacca

SEQ ID NO: 295652 - DNA, 20 bp, Artificial
  CRISPR gRNA sequence
cccacttggcaccagagacc

SEQ ID NO: 295653 - DNA, 20 bp, Artificial
  CRISPR gRNA sequence
agaccaagatctaatttaaa

SEQ ID NO: 295654 - DNA, 20 bp, Artificial
  CRISPR gRNA sequence
aatttaaaaagaaatattct

SEQ ID NO: 295655 - DNA, 20 bp, Artificial
  CRISPR gRNA sequence
atttaaaaagaaatattctt

SEQ ID NO: 295656 - DNA, 20 bp, Artificial
  CRISPR gRNA sequence
gaaatattcttgggtcaaaa

SEQ ID NO: 295657 - DNA, 20 bp, Artificial
  CRISPR gRNA sequence
aatattcttgggtcaaaaaa

SEQ ID NO: 295658 - DNA, 20 bp, Artificial
  CRISPR gRNA sequence
cttgggtcaaaaaagagccc

SEQ ID NO: 295659 - DNA, 20 bp, Artificial
  CRISPR gRNA sequence
ggtcaaaaaagagcccaagc

SEQ ID NO: 295660 - DNA, 20 bp, Artificial
  CRISPR gRNA sequence
aacataatgtgtttcacata

SEQ ID NO: 295661 - DNA, 20 bp, Artificial
  CRISPR gRNA sequence
tttgcatttgcatttgcaaa

SEQ ID NO: 295662 - DNA, 20 bp, Artificial
  CRISPR gRNA sequence
ttgcatttgcatttgcaaac

SEQ ID NO: 295663 - DNA, 20 bp, Artificial
  CRISPR gRNA sequence
taaaatatcatctctattaa

SEQ ID NO: 295664 - DNA, 20 bp, Artificial
  CRISPR gRNA sequence
atctctattaatagcaattt

SEQ ID NO: 295665 - DNA, 20 bp, Artificial
  CRISPR gRNA sequence
tctctattaatagcaattta

SEQ ID NO: 295666 - DNA, 20 bp, Artificial
  CRISPR gRNA sequence
ttaatagcaatttaaggttc

SEQ ID NO: 295667 - DNA, 20 bp, Artificial
  CRISPR gRNA sequence
aatagcaatttaaggttctg

SEQ ID NO: 295668 - DNA, 20 bp, Artificial
  CRISPR gRNA sequence
tagcaatttaaggttctgga

SEQ ID NO: 295669 - DNA, 20 bp, Artificial
  CRISPR gRNA sequence
aatttaaggttctggagagc

SEQ ID NO: 295670 - DNA, 20 bp, Artificial
  CRISPR gRNA sequence
atttaaggttctggagagcc

SEQ ID NO: 295671 - DNA, 20 bp, Artificial
  CRISPR gRNA sequence
tctggagagccaggtgaaaa

SEQ ID NO: 295672 - DNA, 20 bp, Artificial
  CRISPR gRNA sequence
ggtgaaaatagtttttgaca

SEQ ID NO: 295673 - DNA, 20 bp, Artificial
  CRISPR gRNA sequence
gtgaaaatagtttttgacaa

SEQ ID NO: 295674 - DNA, 20 bp, Artificial
  CRISPR gRNA sequence
tgaaaatagtttttgacaaa

SEQ ID NO: 295675 - DNA, 20 bp, Artificial
  CRISPR gRNA sequence
ccccttaaactgtaataatg

SEQ ID NO: 295676 - DNA, 20 bp, Artificial
  CRISPR gRNA sequence
cccttaaactgtaataatga

SEQ ID NO: 295677 - DNA, 20 bp, Artificial
  CRISPR gRNA sequence
cttacatgtaacctcaatct

SEQ ID NO: 295678 - DNA, 20 bp, Artificial
  CRISPR gRNA sequence
ttacatgtaacctcaatctt

SEQ ID NO: 295679 - DNA, 20 bp, Artificial
  CRISPR gRNA sequence
gtaacctcaatcttgggact

SEQ ID NO: 295680 - DNA, 20 bp, Artificial
  CRISPR gRNA sequence
taacctcaatcttgggacta

SEQ ID NO: 295681 - DNA, 20 bp, Artificial
  CRISPR gRNA sequence
aatgcgtctatttatgtgct

SEQ ID NO: 295682 - DNA, 20 bp, Artificial
  CRISPR gRNA sequence
tatttatgtgctcagacttg

SEQ ID NO: 295683 - DNA, 20 bp, Artificial
  CRISPR gRNA sequence
tcgtgttatgtctgctgctg

SEQ ID NO: 295684 - DNA, 20 bp, Artificial
  CRISPR gRNA sequence
accgttaatattatttatgt

SEQ ID NO: 295685 - DNA, 20 bp, Artificial
  CRISPR gRNA sequence
gtgagctatcctgtgtataa

SEQ ID NO: 295686 - DNA, 20 bp, Artificial
  CRISPR gRNA sequence
agctatcctgtgtataatgg

SEQ ID NO: 295687 - DNA, 20 bp, Artificial
  CRISPR gRNA sequence
ctatttatttattcctaata

SEQ ID NO: 295688 - DNA, 20 bp, Artificial
  CRISPR gRNA sequence
ttattcctaatatagttatt

SEQ ID NO: 295689 - DNA, 20 bp, Artificial
  CRISPR gRNA sequence
attaagtgcttgctatgttc

SEQ ID NO: 295690 - DNA, 20 bp, Artificial
  CRISPR gRNA sequence
ttaagtgcttgctatgttcc

SEQ ID NO: 295691 - DNA, 20 bp, Artificial
  CRISPR gRNA sequence
gcttgctatgttccaggtac

SEQ ID NO: 295692 - DNA, 20 bp, Artificial
  CRISPR gRNA sequence
cttgctatgttccaggtact

SEQ ID NO: 295693 - DNA, 20 bp, Artificial
  CRISPR gRNA sequence
ttgctatgttccaggtacta

SEQ ID NO: 295694 - DNA, 20 bp, Artificial
  CRISPR gRNA sequence
tccaggtactagggacttaa

SEQ ID NO: 295695 - DNA, 20 bp, Artificial
  CRISPR gRNA sequence
ccaggtactagggacttaac

SEQ ID NO: 295696 - DNA, 20 bp, Artificial
  CRISPR gRNA sequence
ggtactagggacttaacagg

SEQ ID NO: 295697 - DNA, 20 bp, Artificial
  CRISPR gRNA sequence
ggacttaacaggtagcataa

SEQ ID NO: 295698 - DNA, 20 bp, Artificial
  CRISPR gRNA sequence
acaggtagcataaaagacat

SEQ ID NO: 295699 - DNA, 20 bp, Artificial
  CRISPR gRNA sequence
caggtagcataaaagacata

SEQ ID NO: 295700 - DNA, 20 bp, Artificial
  CRISPR gRNA sequence
agcataaaagacataaggaa

SEQ ID NO: 295701 - DNA, 20 bp, Artificial
  CRISPR gRNA sequence
aaagctgcactcttgttttc

SEQ ID NO: 295702 - DNA, 20 bp, Artificial
  CRISPR gRNA sequence
tgcactcttgttttctagcc

SEQ ID NO: 295703 - DNA, 20 bp, Artificial
  CRISPR gRNA sequence
actcttgttttctagcctag

SEQ ID NO: 295704 - DNA, 20 bp, Artificial
  CRISPR gRNA sequence
ctcttgttttctagcctagt

SEQ ID NO: 295705 - DNA, 20 bp, Artificial
  CRISPR gRNA sequence
tcttgttttctagcctagtg

SEQ ID NO: 295706 - DNA, 20 bp, Artificial
  CRISPR gRNA sequence
tcacactaaacatgactaca

SEQ ID NO: 295707 - DNA, 20 bp, Artificial
  CRISPR gRNA sequence
taaacatgactacatagcaa

SEQ ID NO: 295708 - DNA, 20 bp, Artificial
  CRISPR gRNA sequence
tacatagcaatagtgcttta

SEQ ID NO: 295709 - DNA, 20 bp, Artificial
  CRISPR gRNA sequence
acatagcaatagtgctttaa

SEQ ID NO: 295710 - DNA, 20 bp, Artificial
  CRISPR gRNA sequence
catagcaatagtgctttaaa

SEQ ID NO: 295711 - DNA, 20 bp, Artificial
  CRISPR gRNA sequence
agcaatagtgctttaaaggg

SEQ ID NO: 295712 - DNA, 20 bp, Artificial
  CRISPR gRNA sequence
gcaatagtgctttaaaggga

SEQ ID NO: 295713 - DNA, 20 bp, Artificial
  CRISPR gRNA sequence
attgttctatgtgactatat

SEQ ID NO: 295714 - DNA, 20 bp, Artificial
  CRISPR gRNA sequence
atatcagctgattaattacc

SEQ ID NO: 295715 - DNA, 20 bp, Artificial
  CRISPR gRNA sequence
agcctttgcatttgatattt

SEQ ID NO: 295716 - DNA, 20 bp, Artificial
  CRISPR gRNA sequence
tttgcatttgatattttggt

SEQ ID NO: 295717 - DNA, 20 bp, Artificial
  CRISPR gRNA sequence
gaatttcatatgcctcttcc

SEQ ID NO: 295718 - DNA, 20 bp, Artificial
  CRISPR gRNA sequence
aatttcatatgcctcttcct

SEQ ID NO: 295719 - DNA, 20 bp, Artificial
  CRISPR gRNA sequence
ttcatatgcctcttcctggg

SEQ ID NO: 295720 - DNA, 20 bp, Artificial
  CRISPR gRNA sequence
tcatatgcctcttcctgggt

SEQ ID NO: 295721 - DNA, 20 bp, Artificial
  CRISPR gRNA sequence
catatgcctcttcctgggtg

SEQ ID NO: 295722 - DNA, 20 bp, Artificial
  CRISPR gRNA sequence
atatgcctcttcctgggtgg

SEQ ID NO: 295723 - DNA, 20 bp, Artificial
  CRISPR gRNA sequence
gcctcttcctgggtgggggt

SEQ ID NO: 295724 - DNA, 20 bp, Artificial
  CRISPR gRNA sequence
cctcttcctgggtgggggtg

SEQ ID NO: 295725 - DNA, 20 bp, Artificial
  CRISPR gRNA sequence
ttcctgggtgggggtgagga

SEQ ID NO: 295726 - DNA, 20 bp, Artificial
  CRISPR gRNA sequence
tcctgggtgggggtgaggat

SEQ ID NO: 295727 - DNA, 20 bp, Artificial
  CRISPR gRNA sequence
ggggtgaggatgggatttta

SEQ ID NO: 295728 - DNA, 20 bp, Artificial
  CRISPR gRNA sequence
ggtgaggatgggattttatg

SEQ ID NO: 295729 - DNA, 20 bp, Artificial
  CRISPR gRNA sequence
ggatgggattttatggagtt

SEQ ID NO: 295730 - DNA, 20 bp, Artificial
  CRISPR gRNA sequence
gatgggattttatggagttg

SEQ ID NO: 295731 - DNA, 20 bp, Artificial
  CRISPR gRNA sequence
ggattttatggagttgaggc

SEQ ID NO: 295732 - DNA, 20 bp, Artificial
  CRISPR gRNA sequence
gattttatggagttgaggct

SEQ ID NO: 295733 - DNA, 20 bp, Artificial
  CRISPR gRNA sequence
attttatggagttgaggcta

SEQ ID NO: 295734 - DNA, 20 bp, Artificial
  CRISPR gRNA sequence
ttatggagttgaggctaggg

SEQ ID NO: 295735 - DNA, 20 bp, Artificial
  CRISPR gRNA sequence
tatggagttgaggctagggc

SEQ ID NO: 295736 - DNA, 20 bp, Artificial
  CRISPR gRNA sequence
ggagttgaggctagggcagg

SEQ ID NO: 295737 - DNA, 20 bp, Artificial
  CRISPR gRNA sequence
gagttgaggctagggcaggt

SEQ ID NO: 295738 - DNA, 20 bp, Artificial
  CRISPR gRNA sequence
agttgaggctagggcaggta

SEQ ID NO: 295739 - DNA, 20 bp, Artificial
  CRISPR gRNA sequence
ttgaggctagggcaggtagg

SEQ ID NO: 295740 - DNA, 20 bp, Artificial
  CRISPR gRNA sequence
ggcaggtagggagaaaacat

SEQ ID NO: 295741 - DNA, 20 bp, Artificial
  CRISPR gRNA sequence
ggtagggagaaaacatgaga

SEQ ID NO: 295742 - DNA, 20 bp, Artificial
  CRISPR gRNA sequence
gagaaaacatgagaaagatg

SEQ ID NO: 295743 - DNA, 20 bp, Artificial
  CRISPR gRNA sequence
gaaaacatgagaaagatgaa

SEQ ID NO: 295744 - DNA, 20 bp, Artificial
  CRISPR gRNA sequence
catgagaaagatgaagagat

SEQ ID NO: 295745 - DNA, 20 bp, Artificial
  CRISPR gRNA sequence
gaaagatgaagagataagcc

SEQ ID NO: 295746 - DNA, 20 bp, Artificial
  CRISPR gRNA sequence
gatgaagagataagccaagc

SEQ ID NO: 295747 - DNA, 20 bp, Artificial
  CRISPR gRNA sequence
ataagccaagccagattctt

SEQ ID NO: 295748 - DNA, 20 bp, Artificial
  CRISPR gRNA sequence
agccaagccagattcttcag

SEQ ID NO: 295749 - DNA, 20 bp, Artificial
  CRISPR gRNA sequence
gattcttcagcagaaaaatc

SEQ ID NO: 295750 - DNA, 20 bp, Artificial
  CRISPR gRNA sequence
attcttcagcagaaaaatca

SEQ ID NO: 295751 - DNA, 20 bp, Artificial
  CRISPR gRNA sequence
aaataccatgtttcaaaaat

SEQ ID NO: 295752 - DNA, 20 bp, Artificial
  CRISPR gRNA sequence
catgtttcaaaaatcagact

SEQ ID NO: 295753 - DNA, 20 bp, Artificial
  CRISPR gRNA sequence
atgtttcaaaaatcagactg

SEQ ID NO: 295754 - DNA, 20 bp, Artificial
  CRISPR gRNA sequence
tttcaaaaatcagactgagg

SEQ ID NO: 295755 - DNA, 20 bp, Artificial
  CRISPR gRNA sequence
ttcaaaaatcagactgaggt

SEQ ID NO: 295756 - DNA, 20 bp, Artificial
  CRISPR gRNA sequence
caaaaatcagactgaggtgg

SEQ ID NO: 295757 - DNA, 20 bp, Artificial
  CRISPR gRNA sequence
atcagactgaggtgggagtt

SEQ ID NO: 295758 - DNA, 20 bp, Artificial
  CRISPR gRNA sequence
tcagactgaggtgggagttg

SEQ ID NO: 295759 - DNA, 20 bp, Artificial
  CRISPR gRNA sequence
actgaggtgggagttgaggt

SEQ ID NO: 295760 - DNA, 20 bp, Artificial
  CRISPR gRNA sequence
ctgaggtgggagttgaggtt

SEQ ID NO: 295761 - DNA, 20 bp, Artificial
  CRISPR gRNA sequence
tgaggtgggagttgaggtta

SEQ ID NO: 295762 - DNA, 20 bp, Artificial
  CRISPR gRNA sequence
gaggtgggagttgaggttag

SEQ ID NO: 295763 - DNA, 20 bp, Artificial
  CRISPR gRNA sequence
gagttgaggttaggggtccc

SEQ ID NO: 295764 - DNA, 20 bp, Artificial
  CRISPR gRNA sequence
agttgaggttaggggtccct

SEQ ID NO: 295765 - DNA, 20 bp, Artificial
  CRISPR gRNA sequence
gaggttaggggtccctaggc

SEQ ID NO: 295766 - DNA, 20 bp, Artificial
  CRISPR gRNA sequence
aggttaggggtccctaggcc

SEQ ID NO: 295767 - DNA, 20 bp, Artificial
  CRISPR gRNA sequence
ggttaggggtccctaggcca

SEQ ID NO: 295768 - DNA, 20 bp, Artificial
  CRISPR gRNA sequence
gttaggggtccctaggccag

SEQ ID NO: 295769 - DNA, 20 bp, Artificial
  CRISPR gRNA sequence
gtccctaggccaggggattg

SEQ ID NO: 295770 - DNA, 20 bp, Artificial
  CRISPR gRNA sequence
gccaggggattgaagcttca

SEQ ID NO: 295771 - DNA, 20 bp, Artificial
  CRISPR gRNA sequence
caggggattgaagcttcaaa

SEQ ID NO: 295772 - DNA, 20 bp, Artificial
  CRISPR gRNA sequence
aagcttcaaagagataaaac

SEQ ID NO: 295773 - DNA, 20 bp, Artificial
  CRISPR gRNA sequence
gcttcaaagagataaaacta

SEQ ID NO: 295774 - DNA, 20 bp, Artificial
  CRISPR gRNA sequence
aagagataaaactagagcaa

SEQ ID NO: 295775 - DNA, 20 bp, Artificial
  CRISPR gRNA sequence
gataaaactagagcaaaagc

SEQ ID NO: 295776 - DNA, 20 bp, Artificial
  CRISPR gRNA sequence
aactagagcaaaagcaagca

SEQ ID NO: 295777 - DNA, 20 bp, Artificial
  CRISPR gRNA sequence
ctagagcaaaagcaagcaca

SEQ ID NO: 295778 - DNA, 20 bp, Artificial
  CRISPR gRNA sequence
agagcaaaagcaagcacaga

SEQ ID NO: 295779 - DNA, 20 bp, Artificial
  CRISPR gRNA sequence
gcaaaagcaagcacagagag

SEQ ID NO: 295780 - DNA, 20 bp, Artificial
  CRISPR gRNA sequence
aaagcaagcacagagagtgg

SEQ ID NO: 295781 - DNA, 20 bp, Artificial
  CRISPR gRNA sequence
agcaagcacagagagtggca

SEQ ID NO: 295782 - DNA, 20 bp, Artificial
  CRISPR gRNA sequence
caagcacagagagtggcaga

SEQ ID NO: 295783 - DNA, 20 bp, Artificial
  CRISPR gRNA sequence
aagcacagagagtggcagag

SEQ ID NO: 295784 - DNA, 20 bp, Artificial
  CRISPR gRNA sequence
gagagtggcagagaggtccc

SEQ ID NO: 295785 - DNA, 20 bp, Artificial
  CRISPR gRNA sequence
agagtggcagagaggtccct

SEQ ID NO: 295786 - DNA, 20 bp, Artificial
  CRISPR gRNA sequence
ggtccctgggcatttttcca

SEQ ID NO: 295787 - DNA, 20 bp, Artificial
  CRISPR gRNA sequence
catttttccacagtccattc

SEQ ID NO: 295788 - DNA, 20 bp, Artificial
  CRISPR gRNA sequence
tccacagtccattctagtgc

SEQ ID NO: 295789 - DNA, 20 bp, Artificial
  CRISPR gRNA sequence
tgctggcaatccacctttca

SEQ ID NO: 295790 - DNA, 20 bp, Artificial
  CRISPR gRNA sequence
ggcaatccacctttcatggc

SEQ ID NO: 295791 - DNA, 20 bp, Artificial
  CRISPR gRNA sequence
gcaatccacctttcatggcc

SEQ ID NO: 295792 - DNA, 20 bp, Artificial
  CRISPR gRNA sequence
atccacctttcatggccagg

SEQ ID NO: 295793 - DNA, 20 bp, Artificial
  CRISPR gRNA sequence
tccacctttcatggccaggc

SEQ ID NO: 295794 - DNA, 20 bp, Artificial
  CRISPR gRNA sequence
cctttcatggccaggcaggt

SEQ ID NO: 295795 - DNA, 20 bp, Artificial
  CRISPR gRNA sequence
tttcatggccaggcaggtaa

SEQ ID NO: 295796 - DNA, 20 bp, Artificial
  CRISPR gRNA sequence
caggcaggtaagagtatttg

SEQ ID NO: 295797 - DNA, 20 bp, Artificial
  CRISPR gRNA sequence
aggcaggtaagagtatttgt

SEQ ID NO: 295798 - DNA, 20 bp, Artificial
  CRISPR gRNA sequence
ggcaggtaagagtatttgtg

SEQ ID NO: 295799 - DNA, 20 bp, Artificial
  CRISPR gRNA sequence
aggtaagagtatttgtgggg

SEQ ID NO: 295800 - DNA, 20 bp, Artificial
  CRISPR gRNA sequence
ggtaagagtatttgtggggt

SEQ ID NO: 295801 - DNA, 20 bp, Artificial
  CRISPR gRNA sequence
taagagtatttgtggggtgg

SEQ ID NO: 295802 - DNA, 20 bp, Artificial
  CRISPR gRNA sequence
agtatttgtggggtgggaga

SEQ ID NO: 295803 - DNA, 20 bp, Artificial
  CRISPR gRNA sequence
gtatttgtggggtgggagaa

SEQ ID NO: 295804 - DNA, 20 bp, Artificial
  CRISPR gRNA sequence
ttgtggggtgggagaaagga

SEQ ID NO: 295805 - DNA, 20 bp, Artificial
  CRISPR gRNA sequence
tgtggggtgggagaaaggac

SEQ ID NO: 295806 - DNA, 20 bp, Artificial
  CRISPR gRNA sequence
gtggggtgggagaaaggaca

SEQ ID NO: 295807 - DNA, 20 bp, Artificial
  CRISPR gRNA sequence
tgggagaaaggacagggcca

SEQ ID NO: 295808 - DNA, 20 bp, Artificial
  CRISPR gRNA sequence
gggagaaaggacagggccat

SEQ ID NO: 295809 - DNA, 20 bp, Artificial
  CRISPR gRNA sequence
gaaaggacagggccataggc

SEQ ID NO: 295810 - DNA, 20 bp, Artificial
  CRISPR gRNA sequence
aaaggacagggccataggct

SEQ ID NO: 295811 - DNA, 20 bp, Artificial
  CRISPR gRNA sequence
agggccataggctgggcaca

SEQ ID NO: 295812 - DNA, 20 bp, Artificial
  CRISPR gRNA sequence
ctgggcacacagccctttac

SEQ ID NO: 295813 - DNA, 20 bp, Artificial
  CRISPR gRNA sequence
ctctcctctcttctcctata

SEQ ID NO: 295814 - DNA, 20 bp, Artificial
  CRISPR gRNA sequence
gctgtttccgaactgtacat

SEQ ID NO: 295815 - DNA, 20 bp, Artificial
  CRISPR gRNA sequence
actgtacattggcttacact

SEQ ID NO: 295816 - DNA, 20 bp, Artificial
  CRISPR gRNA sequence
ctgtacattggcttacactc

SEQ ID NO: 295817 - DNA, 20 bp, Artificial
  CRISPR gRNA sequence
cattggcttacactcgggct

SEQ ID NO: 295818 - DNA, 20 bp, Artificial
  CRISPR gRNA sequence
attggcttacactcgggctg

SEQ ID NO: 295819 - DNA, 20 bp, Artificial
  CRISPR gRNA sequence
cttacactcgggctgaggtt

SEQ ID NO: 295820 - DNA, 20 bp, Artificial
  CRISPR gRNA sequence
ttacactcgggctgaggttt

SEQ ID NO: 295821 - DNA, 20 bp, Artificial
  CRISPR gRNA sequence
tcgggctgaggtttgggaaa

SEQ ID NO: 295822 - DNA, 20 bp, Artificial
  CRISPR gRNA sequence
cgggctgaggtttgggaaat

SEQ ID NO: 295823 - DNA, 20 bp, Artificial
  CRISPR gRNA sequence
ggcgccattttgaatatgtg

SEQ ID NO: 295824 - DNA, 20 bp, Artificial
  CRISPR gRNA sequence
cgccattttgaatatgtgtg

SEQ ID NO: 295825 - DNA, 20 bp, Artificial
  CRISPR gRNA sequence
gccattttgaatatgtgtgg

SEQ ID NO: 295826 - DNA, 20 bp, Artificial
  CRISPR gRNA sequence
attttgaatatgtgtggagg

SEQ ID NO: 295827 - DNA, 20 bp, Artificial
  CRISPR gRNA sequence
gaatatgtgtggaggaagaa

SEQ ID NO: 295828 - DNA, 20 bp, Artificial
  CRISPR gRNA sequence
gaggaagaaaagtgtgtctt

SEQ ID NO: 295829 - DNA, 20 bp, Artificial
  CRISPR gRNA sequence
cactttccacctccccatca

SEQ ID NO: 295830 - DNA, 20 bp, Artificial
  CRISPR gRNA sequence
cacctccccatcacggccct

SEQ ID NO: 295831 - DNA, 20 bp, Artificial
  CRISPR gRNA sequence
cggccctgagacctcaacac

SEQ ID NO: 295832 - DNA, 20 bp, Artificial
  CRISPR gRNA sequence
ggccctgagacctcaacacc

SEQ ID NO: 295833 - DNA, 20 bp, Artificial
  CRISPR gRNA sequence
cctgagacctcaacaccggg

SEQ ID NO: 295834 - DNA, 20 bp, Artificial
  CRISPR gRNA sequence
ggaagcatctcgttccctat

SEQ ID NO: 295835 - DNA, 20 bp, Artificial
  CRISPR gRNA sequence
tatcggtcctcctttattca

SEQ ID NO: 295836 - DNA, 20 bp, Artificial
  CRISPR gRNA sequence
ggtcctcctttattcatgga

SEQ ID NO: 295837 - DNA, 20 bp, Artificial
  CRISPR gRNA sequence
gacggatatgattcctttct

SEQ ID NO: 295838 - DNA, 20 bp, Artificial
  CRISPR gRNA sequence
tctaagttccatgtcctttt

SEQ ID NO: 295839 - DNA, 20 bp, Artificial
  CRISPR gRNA sequence
aacttgaacctaatgcctaa

SEQ ID NO: 295840 - DNA, 20 bp, Artificial
  CRISPR gRNA sequence
aaaaaaaaccctcttccttc

SEQ ID NO: 295841 - DNA, 20 bp, Artificial
  CRISPR gRNA sequence
aaaaccctcttccttccagc

SEQ ID NO: 295842 - DNA, 20 bp, Artificial
  CRISPR gRNA sequence
agctagcatttgcattttaa

SEQ ID NO: 295843 - DNA, 20 bp, Artificial
  CRISPR gRNA sequence
gctagcatttgcattttaac

SEQ ID NO: 295844 - DNA, 20 bp, Artificial
  CRISPR gRNA sequence
ctagcatttgcattttaaca

SEQ ID NO: 295845 - DNA, 20 bp, Artificial
  CRISPR gRNA sequence
tagcatttgcattttaacag

SEQ ID NO: 295846 - DNA, 20 bp, Artificial
  CRISPR gRNA sequence
ggggctttcaaaaaatgcct

SEQ ID NO: 295847 - DNA, 20 bp, Artificial
  CRISPR gRNA sequence
ttcaaaaaatgccttagccc

SEQ ID NO: 295848 - DNA, 20 bp, Artificial
  CRISPR gRNA sequence
tcaaaaaatgccttagccca

SEQ ID NO: 295849 - DNA, 20 bp, Artificial
  CRISPR gRNA sequence
aatgccttagcccaaggaat

SEQ ID NO: 295850 - DNA, 20 bp, Artificial
  CRISPR gRNA sequence
agcccaaggaatgagtaatg

SEQ ID NO: 295851 - DNA, 20 bp, Artificial
  CRISPR gRNA sequence
gcccaaggaatgagtaatgt

SEQ ID NO: 295852 - DNA, 20 bp, Artificial
  CRISPR gRNA sequence
atgagtaatgtgggaattcc

SEQ ID NO: 295853 - DNA, 20 bp, Artificial
  CRISPR gRNA sequence
agtaatgtgggaattccaag

SEQ ID NO: 295854 - DNA, 20 bp, Artificial
  CRISPR gRNA sequence
aatgtgggaattccaagcag

SEQ ID NO: 295855 - DNA, 20 bp, Artificial
  CRISPR gRNA sequence
atgtgggaattccaagcagc

SEQ ID NO: 295856 - DNA, 20 bp, Artificial
  CRISPR gRNA sequence
tgtgggaattccaagcagca

SEQ ID NO: 295857 - DNA, 20 bp, Artificial
  CRISPR gRNA sequence
gggaattccaagcagcaggg

SEQ ID NO: 295858 - DNA, 20 bp, Artificial
  CRISPR gRNA sequence
ggaattccaagcagcagggt

SEQ ID NO: 295859 - DNA, 20 bp, Artificial
  CRISPR gRNA sequence
tccaagcagcagggtaggac

SEQ ID NO: 295860 - DNA, 20 bp, Artificial
  CRISPR gRNA sequence
agcagggtaggactggtgca

SEQ ID NO: 295861 - DNA, 20 bp, Artificial
  CRISPR gRNA sequence
ggtaggactggtgcacagta

SEQ ID NO: 295862 - DNA, 20 bp, Artificial
  CRISPR gRNA sequence
gtaggactggtgcacagtat

SEQ ID NO: 295863 - DNA, 20 bp, Artificial
  CRISPR gRNA sequence
taggactggtgcacagtatg

SEQ ID NO: 295864 - DNA, 20 bp, Artificial
  CRISPR gRNA sequence
ggactggtgcacagtatggg

SEQ ID NO: 295865 - DNA, 20 bp, Artificial
  CRISPR gRNA sequence
actggtgcacagtatgggga

SEQ ID NO: 295866 - DNA, 20 bp, Artificial
  CRISPR gRNA sequence
ggtgcacagtatggggagag

SEQ ID NO: 295867 - DNA, 20 bp, Artificial
  CRISPR gRNA sequence
gtgcacagtatggggagaga

SEQ ID NO: 295868 - DNA, 20 bp, Artificial
  CRISPR gRNA sequence
atggggagagaaggcccctc

SEQ ID NO: 295869 - DNA, 20 bp, Artificial
  CRISPR gRNA sequence
agagaaggcccctcaagttg

SEQ ID NO: 295870 - DNA, 20 bp, Artificial
  CRISPR gRNA sequence
aagttgtggccctgaaatgt

SEQ ID NO: 295871 - DNA, 20 bp, Artificial
  CRISPR gRNA sequence
ttgaccatgatgctgtttct

SEQ ID NO: 295872 - DNA, 20 bp, Artificial
  CRISPR gRNA sequence
gatgctgtttctgagaaaac

SEQ ID NO: 295873 - DNA, 20 bp, Artificial
  CRISPR gRNA sequence
gtttctgagaaaacaagaat

SEQ ID NO: 295874 - DNA, 20 bp, Artificial
  CRISPR gRNA sequence
tttctgagaaaacaagaatc

SEQ ID NO: 295875 - DNA, 20 bp, Artificial
  CRISPR gRNA sequence
aaacaagaatcaggctacct

SEQ ID NO: 295876 - DNA, 20 bp, Artificial
  CRISPR gRNA sequence
aacaagaatcaggctacctt

SEQ ID NO: 295877 - DNA, 20 bp, Artificial
  CRISPR gRNA sequence
acaagaatcaggctacctta

SEQ ID NO: 295878 - DNA, 20 bp, Artificial
  CRISPR gRNA sequence
caagaatcaggctaccttag

SEQ ID NO: 295879 - DNA, 20 bp, Artificial
  CRISPR gRNA sequence
atcaggctaccttaggggac

SEQ ID NO: 295880 - DNA, 20 bp, Artificial
  CRISPR gRNA sequence
tcaggctaccttaggggacc

SEQ ID NO: 295881 - DNA, 20 bp, Artificial
  CRISPR gRNA sequence
gctaccttaggggaccagga

SEQ ID NO: 295882 - DNA, 20 bp, Artificial
  CRISPR gRNA sequence
ctaccttaggggaccaggat

SEQ ID NO: 295883 - DNA, 20 bp, Artificial
  CRISPR gRNA sequence
ttaggggaccaggatgggca

SEQ ID NO: 295884 - DNA, 20 bp, Artificial
  CRISPR gRNA sequence
ggatgggcatggctcccttt

SEQ ID NO: 295885 - DNA, 20 bp, Artificial
  CRISPR gRNA sequence
gggcatggctcccttttagt

SEQ ID NO: 295886 - DNA, 20 bp, Artificial
  CRISPR gRNA sequence
tcccttttagtgagttctat

SEQ ID NO: 295887 - DNA, 20 bp, Artificial
  CRISPR gRNA sequence
tctatgagcctcatacctga

SEQ ID NO: 295888 - DNA, 20 bp, Artificial
  CRISPR gRNA sequence
tgagcctcatacctgacagt

SEQ ID NO: 295889 - DNA, 20 bp, Artificial
  CRISPR gRNA sequence
agcctcatacctgacagtca

SEQ ID NO: 295890 - DNA, 20 bp, Artificial
  CRISPR gRNA sequence
acctgacagtcagagccctc

SEQ ID NO: 295891 - DNA, 20 bp, Artificial
  CRISPR gRNA sequence
tgacagtcagagccctcgag

SEQ ID NO: 295892 - DNA, 20 bp, Artificial
  CRISPR gRNA sequence
gtcagagccctcgagtggat

SEQ ID NO: 295893 - DNA, 20 bp, Artificial
  CRISPR gRNA sequence
agccctcgagtggatgagca

SEQ ID NO: 295894 - DNA, 20 bp, Artificial
  CRISPR gRNA sequence
tcgagtggatgagcacagac

SEQ ID NO: 295895 - DNA, 20 bp, Artificial
  CRISPR gRNA sequence
agtggatgagcacagactag

SEQ ID NO: 295896 - DNA, 20 bp, Artificial
  CRISPR gRNA sequence
ggatgagcacagactagaag

SEQ ID NO: 295897 - DNA, 20 bp, Artificial
  CRISPR gRNA sequence
ttgcatgatccttacctttt

SEQ ID NO: 295898 - DNA, 20 bp, Artificial
  CRISPR gRNA sequence
atccttacctttttggcaaa

SEQ ID NO: 295899 - DNA, 20 bp, Artificial
  CRISPR gRNA sequence
tccttacctttttggcaaaa

SEQ ID NO: 295900 - DNA, 20 bp, Artificial
  CRISPR gRNA sequence
atcgttctcaaattcatcaa

SEQ ID NO: 295901 - DNA, 20 bp, Artificial
  CRISPR gRNA sequence
aattcatcaatagtttgaaa

SEQ ID NO: 295902 - DNA, 20 bp, Artificial
  CRISPR gRNA sequence
attcatcaatagtttgaaat

SEQ ID NO: 295903 - DNA, 20 bp, Artificial
  CRISPR gRNA sequence
ttcatcaatagtttgaaata

SEQ ID NO: 295904 - DNA, 20 bp, Artificial
  CRISPR gRNA sequence
aaatagggtgtgccttgatt

SEQ ID NO: 295905 - DNA, 20 bp, Artificial
  CRISPR gRNA sequence
agggtgtgccttgattcaga

SEQ ID NO: 295906 - DNA, 20 bp, Artificial
  CRISPR gRNA sequence
gattcagaaagtttcgattc

SEQ ID NO: 295907 - DNA, 20 bp, Artificial
  CRISPR gRNA sequence
tttcgattctagatacaact

SEQ ID NO: 295908 - DNA, 20 bp, Artificial
  CRISPR gRNA sequence
tcgattctagatacaactcg

SEQ ID NO: 295909 - DNA, 20 bp, Artificial
  CRISPR gRNA sequence
ctagatacaactcggagaac

SEQ ID NO: 295910 - DNA, 20 bp, Artificial
  CRISPR gRNA sequence
tagatacaactcggagaact

SEQ ID NO: 295911 - DNA, 20 bp, Artificial
  CRISPR gRNA sequence
aactaggcgtgtcttgtaca

SEQ ID NO: 295912 - DNA, 20 bp, Artificial
  CRISPR gRNA sequence
cttgtacacagatttgctct

SEQ ID NO: 295913 - DNA, 20 bp, Artificial
  CRISPR gRNA sequence
ttgtacacagatttgctctt

SEQ ID NO: 295914 - DNA, 20 bp, Artificial
  CRISPR gRNA sequence
tgtacacagatttgctcttg

SEQ ID NO: 295915 - DNA, 20 bp, Artificial
  CRISPR gRNA sequence
gtacacagatttgctcttgg

SEQ ID NO: 295916 - DNA, 20 bp, Artificial
  CRISPR gRNA sequence
cagatttgctcttgggggac

SEQ ID NO: 295917 - DNA, 20 bp, Artificial
  CRISPR gRNA sequence
ttgctcttgggggaccggaa

SEQ ID NO: 295918 - DNA, 20 bp, Artificial
  CRISPR gRNA sequence
ccatgctatgctccttcttc

SEQ ID NO: 295919 - DNA, 20 bp, Artificial
  CRISPR gRNA sequence
catgctatgctccttcttct

SEQ ID NO: 295920 - DNA, 20 bp, Artificial
  CRISPR gRNA sequence
ctatgctccttcttctaggc

SEQ ID NO: 295921 - DNA, 20 bp, Artificial
  CRISPR gRNA sequence
gctccttcttctaggccagt

SEQ ID NO: 295922 - DNA, 20 bp, Artificial
  CRISPR gRNA sequence
ctccttcttctaggccagtg

SEQ ID NO: 295923 - DNA, 20 bp, Artificial
  CRISPR gRNA sequence
tccttcttctaggccagtga

SEQ ID NO: 295924 - DNA, 20 bp, Artificial
  CRISPR gRNA sequence
ccttcttctaggccagtgag

SEQ ID NO: 295925 - DNA, 20 bp, Artificial
  CRISPR gRNA sequence
cattcttcattttaatattt

SEQ ID NO: 295926 - DNA, 20 bp, Artificial
  CRISPR gRNA sequence
atttcagttgcctacaatat

SEQ ID NO: 295927 - DNA, 20 bp, Artificial
  CRISPR gRNA sequence
tcagttgcctacaatattgg

SEQ ID NO: 295928 - DNA, 20 bp, Artificial
  CRISPR gRNA sequence
cagttgcctacaatattgga

SEQ ID NO: 295929 - DNA, 20 bp, Artificial
  CRISPR gRNA sequence
ttgcctacaatattggaagg

SEQ ID NO: 295930 - DNA, 20 bp, Artificial
  CRISPR gRNA sequence
caatattggaaggtggataa

SEQ ID NO: 295931 - DNA, 20 bp, Artificial
  CRISPR gRNA sequence
ctgctccttctaaatctgcg

SEQ ID NO: 295932 - DNA, 20 bp, Artificial
  CRISPR gRNA sequence
gcacctactcatccttgatg

SEQ ID NO: 295933 - DNA, 20 bp, Artificial
  CRISPR gRNA sequence
cagctctcctcatgtctgta

SEQ ID NO: 295934 - DNA, 20 bp, Artificial
  CRISPR gRNA sequence
gaaacactgtgctctcaaat

SEQ ID NO: 295935 - DNA, 20 bp, Artificial
  CRISPR gRNA sequence
ctgtgctctcaaatgagttt

SEQ ID NO: 295936 - DNA, 20 bp, Artificial
  CRISPR gRNA sequence
gctctcaaatgagtttcaga

SEQ ID NO: 295937 - DNA, 20 bp, Artificial
  CRISPR gRNA sequence
tcagaaagaacaactcacga

SEQ ID NO: 295938 - DNA, 20 bp, Artificial
  CRISPR gRNA sequence
aacaactcacgaaagaaaac

SEQ ID NO: 295939 - DNA, 20 bp, Artificial
  CRISPR gRNA sequence
cacgaaagaaaacaagcatt

SEQ ID NO: 295940 - DNA, 20 bp, Artificial
  CRISPR gRNA sequence
aaagaaaacaagcattcggt

SEQ ID NO: 295941 - DNA, 20 bp, Artificial
  CRISPR gRNA sequence
gtcagaaaaatctccacaaa

SEQ ID NO: 295942 - DNA, 20 bp, Artificial
  CRISPR gRNA sequence
tcagaaaaatctccacaaat

SEQ ID NO: 295943 - DNA, 20 bp, Artificial
  CRISPR gRNA sequence
cagaaaaatctccacaaatg

SEQ ID NO: 295944 - DNA, 20 bp, Artificial
  CRISPR gRNA sequence
aatctccacaaatggggaat

SEQ ID NO: 295945 - DNA, 20 bp, Artificial
  CRISPR gRNA sequence
atctccacaaatggggaata

SEQ ID NO: 295946 - DNA, 20 bp, Artificial
  CRISPR gRNA sequence
tctccacaaatggggaataa

SEQ ID NO: 295947 - DNA, 20 bp, Artificial
  CRISPR gRNA sequence
ctccacaaatggggaataag

SEQ ID NO: 295948 - DNA, 20 bp, Artificial
  CRISPR gRNA sequence
tccacaaatggggaataagg

SEQ ID NO: 295949 - DNA, 20 bp, Artificial
  CRISPR gRNA sequence
gaataagggggatttgctcc

SEQ ID NO: 295950 - DNA, 20 bp, Artificial
  CRISPR gRNA sequence
aataagggggatttgctcca

SEQ ID NO: 295951 - DNA, 20 bp, Artificial
  CRISPR gRNA sequence
taagggggatttgctccaag

SEQ ID NO: 295952 - DNA, 20 bp, Artificial
  CRISPR gRNA sequence
agggggatttgctccaagga

SEQ ID NO: 295953 - DNA, 20 bp, Artificial
  CRISPR gRNA sequence
gatttgctccaaggagagac

SEQ ID NO: 295954 - DNA, 20 bp, Artificial
  CRISPR gRNA sequence
ccaaggagagactggaaacc

SEQ ID NO: 295955 - DNA, 20 bp, Artificial
  CRISPR gRNA sequence
ggagagactggaaaccaagt

SEQ ID NO: 295956 - DNA, 20 bp, Artificial
  CRISPR gRNA sequence
accaagtcagacataaaatc

SEQ ID NO: 295957 - DNA, 20 bp, Artificial
  CRISPR gRNA sequence
tcagacataaaatccagcct

SEQ ID NO: 295958 - DNA, 20 bp, Artificial
  CRISPR gRNA sequence
acataaaatccagcctaagc

SEQ ID NO: 295959 - DNA, 20 bp, Artificial
  CRISPR gRNA sequence
taaaatccagcctaagctag

SEQ ID NO: 295960 - DNA, 20 bp, Artificial
  CRISPR gRNA sequence
aaaatccagcctaagctaga

SEQ ID NO: 295961 - DNA, 20 bp, Artificial
  CRISPR gRNA sequence
aatccagcctaagctagaag

SEQ ID NO: 295962 - DNA, 20 bp, Artificial
  CRISPR gRNA sequence
gcctaagctagaaggagaca

SEQ ID NO: 295963 - DNA, 20 bp, Artificial
  CRISPR gRNA sequence
aagctagaaggagacatggc

SEQ ID NO: 295964 - DNA, 20 bp, Artificial
  CRISPR gRNA sequence
ctagaaggagacatggctgg

SEQ ID NO: 295965 - DNA, 20 bp, Artificial
  CRISPR gRNA sequence
tagaaggagacatggctggt

SEQ ID NO: 295966 - DNA, 20 bp, Artificial
  CRISPR gRNA sequence
gaaggagacatggctggtgg

SEQ ID NO: 295967 - DNA, 20 bp, Artificial
  CRISPR gRNA sequence
gacatggctggtgggagctt

SEQ ID NO: 295968 - DNA, 20 bp, Artificial
  CRISPR gRNA sequence
acatggctggtgggagcttg

SEQ ID NO: 295969 - DNA, 20 bp, Artificial
  CRISPR gRNA sequence
tggtgggagcttgaggaaaa

SEQ ID NO: 295970 - DNA, 20 bp, Artificial
  CRISPR gRNA sequence
gtgggagcttgaggaaaaca

SEQ ID NO: 295971 - DNA, 20 bp, Artificial
  CRISPR gRNA sequence
agcttgaggaaaacagagct

SEQ ID NO: 295972 - DNA, 20 bp, Artificial
  CRISPR gRNA sequence
gcttgaggaaaacagagctc

SEQ ID NO: 295973 - DNA, 20 bp, Artificial
  CRISPR gRNA sequence
gaggaaaacagagctcagga

SEQ ID NO: 295974 - DNA, 20 bp, Artificial
  CRISPR gRNA sequence
ggaaaacagagctcaggatg

SEQ ID NO: 295975 - DNA, 20 bp, Artificial
  CRISPR gRNA sequence
gaaaacagagctcaggatgg

SEQ ID NO: 295976 - DNA, 20 bp, Artificial
  CRISPR gRNA sequence
atggaggacgtctccacctc

SEQ ID NO: 295977 - DNA, 20 bp, Artificial
  CRISPR gRNA sequence
cagtcatgtcctctgtccac

SEQ ID NO: 295978 - DNA, 20 bp, Artificial
  CRISPR gRNA sequence
tcctctgtccaccagacacc

SEQ ID NO: 295979 - DNA, 20 bp, Artificial
  CRISPR gRNA sequence
tctgtccaccagacaccaag

SEQ ID NO: 295980 - DNA, 20 bp, Artificial
  CRISPR gRNA sequence
agaagtgttcatgttccatc

SEQ ID NO: 295981 - DNA, 20 bp, Artificial
  CRISPR gRNA sequence
gaagtgttcatgttccatcg

SEQ ID NO: 295982 - DNA, 20 bp, Artificial
  CRISPR gRNA sequence
gtgttcatgttccatcgagg

SEQ ID NO: 295983 - DNA, 20 bp, Artificial
  CRISPR gRNA sequence
cgactgcctctttactgctt

SEQ ID NO: 295984 - DNA, 20 bp, Artificial
  CRISPR gRNA sequence
gactgcctctttactgcttc

SEQ ID NO: 295985 - DNA, 20 bp, Artificial
  CRISPR gRNA sequence
tgcttcaggctcaccatctc

SEQ ID NO: 295986 - DNA, 20 bp, Artificial
  CRISPR gRNA sequence
gctcaccatctcaagtcgac

SEQ ID NO: 295987 - DNA, 20 bp, Artificial
  CRISPR gRNA sequence
agtcgacgagcctgtaatac

SEQ ID NO: 295988 - DNA, 20 bp, Artificial
  CRISPR gRNA sequence
tttcttgatcaccctgatac

SEQ ID NO: 295989 - DNA, 20 bp, Artificial
  CRISPR gRNA sequence
taccagccgtcacctcttga

SEQ ID NO: 295990 - DNA, 20 bp, Artificial
  CRISPR gRNA sequence
accagccgtcacctcttgac

SEQ ID NO: 295991 - DNA, 20 bp, Artificial
  CRISPR gRNA sequence
ttgacaggcttattttcttt

SEQ ID NO: 295992 - DNA, 20 bp, Artificial
  CRISPR gRNA sequence
tttgactttccatgccctat

SEQ ID NO: 295993 - DNA, 20 bp, Artificial
  CRISPR gRNA sequence
ttgactttccatgccctatt

SEQ ID NO: 295994 - DNA, 20 bp, Artificial
  CRISPR gRNA sequence
cttgctccttgctttactta

SEQ ID NO: 295995 - DNA, 20 bp, Artificial
  CRISPR gRNA sequence
aatctcccattatttatcca

SEQ ID NO: 295996 - DNA, 20 bp, Artificial
  CRISPR gRNA sequence
tccaaagacaacctctgctg

SEQ ID NO: 295997 - DNA, 20 bp, Artificial
  CRISPR gRNA sequence
ccaaagacaacctctgctgc

SEQ ID NO: 295998 - DNA, 20 bp, Artificial
  CRISPR gRNA sequence
agacaacctctgctgcaggc

SEQ ID NO: 295999 - DNA, 20 bp, Artificial
  CRISPR gRNA sequence
aacctctgctgcaggccagt

SEQ ID NO: 296000 - DNA, 20 bp, Artificial
  CRISPR gRNA sequence
actgtcctgtaaaaattcca

SEQ ID NO: 296001 - DNA, 20 bp, Artificial
  CRISPR gRNA sequence
actgttatttgattgtgtct

SEQ ID NO: 296002 - DNA, 20 bp, Artificial
  CRISPR gRNA sequence
ttatttgattgtgtctcaga

SEQ ID NO: 296003 - DNA, 20 bp, Artificial
  CRISPR gRNA sequence
tgtgtctcagaaagtcgtca

SEQ ID NO: 296004 - DNA, 20 bp, Artificial
  CRISPR gRNA sequence
aaagaatatataccaatgaa

SEQ ID NO: 296005 - DNA, 20 bp, Artificial
  CRISPR gRNA sequence
taccaatgaaaagcatcaaa

SEQ ID NO: 296006 - DNA, 20 bp, Artificial
  CRISPR gRNA sequence
accaatgaaaagcatcaaaa

SEQ ID NO: 296007 - DNA, 20 bp, Artificial
  CRISPR gRNA sequence
ttatgtgtgtatcaaaaata

SEQ ID NO: 296008 - DNA, 20 bp, Artificial
  CRISPR gRNA sequence
atatggctgaaatatttatc

SEQ ID NO: 296009 - DNA, 20 bp, Artificial
  CRISPR gRNA sequence
gaaactcaatcaacactaaa

SEQ ID NO: 296010 - DNA, 20 bp, Artificial
  CRISPR gRNA sequence
actcaatcaacactaaaaag

SEQ ID NO: 296011 - DNA, 20 bp, Artificial
  CRISPR gRNA sequence
acactaaaaagtggttcttt

SEQ ID NO: 296012 - DNA, 20 bp, Artificial
  CRISPR gRNA sequence
ctaaaaagtggttctttcgg

SEQ ID NO: 296013 - DNA, 20 bp, Artificial
  CRISPR gRNA sequence
agtggttctttcggaagcat

SEQ ID NO: 296014 - DNA, 20 bp, Artificial
  CRISPR gRNA sequence
ttcggaagcatcagttcttt

SEQ ID NO: 296015 - DNA, 20 bp, Artificial
  CRISPR gRNA sequence
gttctttgagacccattaaa

SEQ ID NO: 296016 - DNA, 20 bp, Artificial
  CRISPR gRNA sequence
gacccattaaacagatgcct

SEQ ID NO: 296017 - DNA, 20 bp, Artificial
  CRISPR gRNA sequence
ttaaacagatgcctcggatg

SEQ ID NO: 296018 - DNA, 20 bp, Artificial
  CRISPR gRNA sequence
taaacagatgcctcggatgc

SEQ ID NO: 296019 - DNA, 20 bp, Artificial
  CRISPR gRNA sequence
aaacagatgcctcggatgca

SEQ ID NO: 296020 - DNA, 20 bp, Artificial
  CRISPR gRNA sequence
gatgcagggttatatattat

SEQ ID NO: 296021 - DNA, 20 bp, Artificial
  CRISPR gRNA sequence
atgcagggttatatattatc

SEQ ID NO: 296022 - DNA, 20 bp, Artificial
  CRISPR gRNA sequence
tatattatcaggaatctgtc

SEQ ID NO: 296023 - DNA, 20 bp, Artificial
  CRISPR gRNA sequence
atattatcaggaatctgtct

SEQ ID NO: 296024 - DNA, 20 bp, Artificial
  CRISPR gRNA sequence
tattatcaggaatctgtcta

SEQ ID NO: 296025 - DNA, 20 bp, Artificial
  CRISPR gRNA sequence
tatcaggaatctgtctaggg

SEQ ID NO: 296026 - DNA, 20 bp, Artificial
  CRISPR gRNA sequence
tctgtctagggaagaattat

SEQ ID NO: 296027 - DNA, 20 bp, Artificial
  CRISPR gRNA sequence
gtctagggaagaattattgg

SEQ ID NO: 296028 - DNA, 20 bp, Artificial
  CRISPR gRNA sequence
agaattattggaagcttgca

SEQ ID NO: 296029 - DNA, 20 bp, Artificial
  CRISPR gRNA sequence
ggaagcttgcaaagcctttc

SEQ ID NO: 296030 - DNA, 20 bp, Artificial
  CRISPR gRNA sequence
gaagcttgcaaagcctttca

SEQ ID NO: 296031 - DNA, 20 bp, Artificial
  CRISPR gRNA sequence
cttgcaaagcctttcaagga

SEQ ID NO: 296032 - DNA, 20 bp, Artificial
  CRISPR gRNA sequence
tgcaaagcctttcaaggaca

SEQ ID NO: 296033 - DNA, 20 bp, Artificial
  CRISPR gRNA sequence
gcaaagcctttcaaggacag

SEQ ID NO: 296034 - DNA, 20 bp, Artificial
  CRISPR gRNA sequence
ctttcaaggacagaggacga

SEQ ID NO: 296035 - DNA, 20 bp, Artificial
  CRISPR gRNA sequence
aggacgatagctaccacgtt

SEQ ID NO: 296036 - DNA, 20 bp, Artificial
  CRISPR gRNA sequence
atagctaccacgttgagttc

SEQ ID NO: 296037 - DNA, 20 bp, Artificial
  CRISPR gRNA sequence
tagctaccacgttgagttct

SEQ ID NO: 296038 - DNA, 20 bp, Artificial
  CRISPR gRNA sequence
attaaccattgttattgtta

SEQ ID NO: 296039 - DNA, 20 bp, Artificial
  CRISPR gRNA sequence
ttaaccattgttattgttaa

SEQ ID NO: 296040 - DNA, 20 bp, Artificial
  CRISPR gRNA sequence
accattgttattgttaaagg

SEQ ID NO: 296041 - DNA, 20 bp, Artificial
  CRISPR gRNA sequence
ttgttattgttaaaggaaga

SEQ ID NO: 296042 - DNA, 20 bp, Artificial
  CRISPR gRNA sequence
taaaggaagacagcgtttct

SEQ ID NO: 296043 - DNA, 20 bp, Artificial
  CRISPR gRNA sequence
aaggaagacagcgtttctca

SEQ ID NO: 296044 - DNA, 20 bp, Artificial
  CRISPR gRNA sequence
aggaagacagcgtttctcag

SEQ ID NO: 296045 - DNA, 20 bp, Artificial
  CRISPR gRNA sequence
aagacagcgtttctcagagg

SEQ ID NO: 296046 - DNA, 20 bp, Artificial
  CRISPR gRNA sequence
ctcagaggaagactgttaaa

SEQ ID NO: 296047 - DNA, 20 bp, Artificial
  CRISPR gRNA sequence
aggaagactgttaaacagtg

SEQ ID NO: 296048 - DNA, 20 bp, Artificial
  CRISPR gRNA sequence
aagactgttaaacagtgcag

SEQ ID NO: 296049 - DNA, 20 bp, Artificial
  CRISPR gRNA sequence
tgttaaacagtgcagtggcc

SEQ ID NO: 296050 - DNA, 20 bp, Artificial
  CRISPR gRNA sequence
gttaaacagtgcagtggccc

SEQ ID NO: 296051 - DNA, 20 bp, Artificial
  CRISPR gRNA sequence
agtgcagtggcccaggctaa

SEQ ID NO: 296052 - DNA, 20 bp, Artificial
  CRISPR gRNA sequence
cccaggctaacagccctcat

SEQ ID NO: 296053 - DNA, 20 bp, Artificial
  CRISPR gRNA sequence
aggctaacagccctcataag

SEQ ID NO: 296054 - DNA, 20 bp, Artificial
  CRISPR gRNA sequence
ggctaacagccctcataagt

SEQ ID NO: 296055 - DNA, 20 bp, Artificial
  CRISPR gRNA sequence
ctaacagccctcataagtgg

SEQ ID NO: 296056 - DNA, 20 bp, Artificial
  CRISPR gRNA sequence
gccctcataagtgggagtat

SEQ ID NO: 296057 - DNA, 20 bp, Artificial
  CRISPR gRNA sequence
ataagtgggagtatcagaat

SEQ ID NO: 296058 - DNA, 20 bp, Artificial
  CRISPR gRNA sequence
agtgggagtatcagaatgag

SEQ ID NO: 296059 - DNA, 20 bp, Artificial
  CRISPR gRNA sequence
ttaattacttaaaaccaata

SEQ ID NO: 296060 - DNA, 20 bp, Artificial
  CRISPR gRNA sequence
taattacttaaaaccaatac

SEQ ID NO: 296061 - DNA, 20 bp, Artificial
  CRISPR gRNA sequence
aattacttaaaaccaataca

SEQ ID NO: 296062 - DNA, 20 bp, Artificial
  CRISPR gRNA sequence
tacttaaaaccaatacaggg

SEQ ID NO: 296063 - DNA, 20 bp, Artificial
  CRISPR gRNA sequence
tggaacttcatctgctataa

SEQ ID NO: 296064 - DNA, 20 bp, Artificial
  CRISPR gRNA sequence
taacagaaatcaactcgtgc

SEQ ID NO: 296065 - DNA, 20 bp, Artificial
  CRISPR gRNA sequence
ctcgtgcaagttctaacatg

SEQ ID NO: 296066 - DNA, 20 bp, Artificial
  CRISPR gRNA sequence
tcgtgcaagttctaacatgc

SEQ ID NO: 296067 - DNA, 20 bp, Artificial
  CRISPR gRNA sequence
cgtgcaagttctaacatgca

SEQ ID NO: 296068 - DNA, 20 bp, Artificial
  CRISPR gRNA sequence
aagttctaacatgcagggta

SEQ ID NO: 296069 - DNA, 20 bp, Artificial
  CRISPR gRNA sequence
aacatgcagggtacagttct

SEQ ID NO: 296070 - DNA, 20 bp, Artificial
  CRISPR gRNA sequence
cagggtacagttctgagacc

SEQ ID NO: 296071 - DNA, 20 bp, Artificial
  CRISPR gRNA sequence
caagtctgactcacctgtca

SEQ ID NO: 296072 - DNA, 20 bp, Artificial
  CRISPR gRNA sequence
ctgactcacctgtcaaagct

SEQ ID NO: 296073 - DNA, 20 bp, Artificial
  CRISPR gRNA sequence
cacctttacaccacccttcc

SEQ ID NO: 296074 - DNA, 20 bp, Artificial
  CRISPR gRNA sequence
tacaccacccttccaagctg

SEQ ID NO: 296075 - DNA, 20 bp, Artificial
  CRISPR gRNA sequence
acaccacccttccaagctgt

SEQ ID NO: 296076 - DNA, 20 bp, Artificial
  CRISPR gRNA sequence
accacccttccaagctgtag

SEQ ID NO: 296077 - DNA, 20 bp, Artificial
  CRISPR gRNA sequence
gctgttctccatgtcttctg

SEQ ID NO: 296078 - DNA, 20 bp, Artificial
  CRISPR gRNA sequence
ctccatgtcttctgaagccc

SEQ ID NO: 296079 - DNA, 20 bp, Artificial
  CRISPR gRNA sequence
ctgaagccctggatcacttg

SEQ ID NO: 296080 - DNA, 20 bp, Artificial
  CRISPR gRNA sequence
agccctggatcacttgtagc

SEQ ID NO: 296081 - DNA, 20 bp, Artificial
  CRISPR gRNA sequence
tggatcacttgtagccagct

SEQ ID NO: 296082 - DNA, 20 bp, Artificial
  CRISPR gRNA sequence
atcacttgtagccagctcag

SEQ ID NO: 296083 - DNA, 20 bp, Artificial
  CRISPR gRNA sequence
ccagctcagcagactctacc

SEQ ID NO: 296084 - DNA, 20 bp, Artificial
  CRISPR gRNA sequence
ctcagcagactctacccaga

SEQ ID NO: 296085 - DNA, 20 bp, Artificial
  CRISPR gRNA sequence
tcagcagactctacccagac

SEQ ID NO: 296086 - DNA, 20 bp, Artificial
  CRISPR gRNA sequence
cagcagactctacccagaca

SEQ ID NO: 296087 - DNA, 20 bp, Artificial
  CRISPR gRNA sequence
ttgtctactgtgttaaaaat

SEQ ID NO: 296088 - DNA, 20 bp, Artificial
  CRISPR gRNA sequence
gtctactgtgttaaaaatga

SEQ ID NO: 296089 - DNA, 20 bp, Artificial
  CRISPR gRNA sequence
tctactgtgttaaaaatgag

SEQ ID NO: 296090 - DNA, 20 bp, Artificial
  CRISPR gRNA sequence
aaaaatgagaggaactgact

SEQ ID NO: 296091 - DNA, 20 bp, Artificial
  CRISPR gRNA sequence
aaaatgagaggaactgactc

SEQ ID NO: 296092 - DNA, 20 bp, Artificial
  CRISPR gRNA sequence
aaatgagaggaactgactca

SEQ ID NO: 296093 - DNA, 20 bp, Artificial
  CRISPR gRNA sequence
gagaggaactgactcagggt

SEQ ID NO: 296094 - DNA, 20 bp, Artificial
  CRISPR gRNA sequence
gaggaactgactcagggtga

SEQ ID NO: 296095 - DNA, 20 bp, Artificial
  CRISPR gRNA sequence
ctgactcagggtgagagcga

SEQ ID NO: 296096 - DNA, 20 bp, Artificial
  CRISPR gRNA sequence
gactcagggtgagagcgatg

SEQ ID NO: 296097 - DNA, 20 bp, Artificial
  CRISPR gRNA sequence
ggtgagagcgatggagtgtc

SEQ ID NO: 296098 - DNA, 20 bp, Artificial
  CRISPR gRNA sequence
cctttatttctccttattcc

SEQ ID NO: 296099 - DNA, 20 bp, Artificial
  CRISPR gRNA sequence
cttattcctggaaatgtaat

SEQ ID NO: 296100 - DNA, 20 bp, Artificial
  CRISPR gRNA sequence
tggaaatgtaatgagaatct

SEQ ID NO: 296101 - DNA, 20 bp, Artificial
  CRISPR gRNA sequence
gaaatgtaatgagaatctta

SEQ ID NO: 296102 - DNA, 20 bp, Artificial
  CRISPR gRNA sequence
aaatgtaatgagaatcttag

SEQ ID NO: 296103 - DNA, 20 bp, Artificial
  CRISPR gRNA sequence
aatcttagaggtgaactgaa

SEQ ID NO: 296104 - DNA, 20 bp, Artificial
  CRISPR gRNA sequence
gaggtgaactgaaaagttat

SEQ ID NO: 296105 - DNA, 20 bp, Artificial
  CRISPR gRNA sequence
ttcaaccacttactcaattc

SEQ ID NO: 296106 - DNA, 20 bp, Artificial
  CRISPR gRNA sequence
ctgtgttatcacccccactt

SEQ ID NO: 296107 - DNA, 20 bp, Artificial
  CRISPR gRNA sequence
cacccccactttggtttgaa

SEQ ID NO: 296108 - DNA, 20 bp, Artificial
  CRISPR gRNA sequence
ggtttgaatagtacttgtga

SEQ ID NO: 296109 - DNA, 20 bp, Artificial
  CRISPR gRNA sequence
gtttgaatagtacttgtgac

SEQ ID NO: 296110 - DNA, 20 bp, Artificial
  CRISPR gRNA sequence
tttgaatagtacttgtgaca

SEQ ID NO: 296111 - DNA, 20 bp, Artificial
  CRISPR gRNA sequence
tgaatagtacttgtgacagg

SEQ ID NO: 296112 - DNA, 20 bp, Artificial
  CRISPR gRNA sequence
cagggagcttatcacctcac

SEQ ID NO: 296113 - DNA, 20 bp, Artificial
  CRISPR gRNA sequence
tatcacctcacaagaaaatc

SEQ ID NO: 296114 - DNA, 20 bp, Artificial
  CRISPR gRNA sequence
gaaaatccagtcattgcttg

SEQ ID NO: 296115 - DNA, 20 bp, Artificial
  CRISPR gRNA sequence
tgcttgtagctctctattaa

SEQ ID NO: 296116 - DNA, 20 bp, Artificial
  CRISPR gRNA sequence
attaaaagttttccatcatc

SEQ ID NO: 296117 - DNA, 20 bp, Artificial
  CRISPR gRNA sequence
catcatctggaactgaaatc

SEQ ID NO: 296118 - DNA, 20 bp, Artificial
  CRISPR gRNA sequence
atctggctccctgtaacttt

SEQ ID NO: 296119 - DNA, 20 bp, Artificial
  CRISPR gRNA sequence
tccctgtaacttttagttat

SEQ ID NO: 296120 - DNA, 20 bp, Artificial
  CRISPR gRNA sequence
tattggaactacttgccctt

SEQ ID NO: 296121 - DNA, 20 bp, Artificial
  CRISPR gRNA sequence
aactacttgcccttcagcaa

SEQ ID NO: 296122 - DNA, 20 bp, Artificial
  CRISPR gRNA sequence
acagtgtatgtatcctccca

SEQ ID NO: 296123 - DNA, 20 bp, Artificial
  CRISPR gRNA sequence
gtgtatgtatcctcccatgg

SEQ ID NO: 296124 - DNA, 20 bp, Artificial
  CRISPR gRNA sequence
tgtatgtatcctcccatgga

SEQ ID NO: 296125 - DNA, 20 bp, Artificial
  CRISPR gRNA sequence
gtatgtatcctcccatggaa

SEQ ID NO: 296126 - DNA, 20 bp, Artificial
  CRISPR gRNA sequence
gaagggcccttacatatttg

SEQ ID NO: 296127 - DNA, 20 bp, Artificial
  CRISPR gRNA sequence
cttacatatttgcagacacc

SEQ ID NO: 296128 - DNA, 20 bp, Artificial
  CRISPR gRNA sequence
acttgcaatcttttcttctt

SEQ ID NO: 296129 - DNA, 20 bp, Artificial
  CRISPR gRNA sequence
cttgcaatcttttcttcttc

SEQ ID NO: 296130 - DNA, 20 bp, Artificial
  CRISPR gRNA sequence
cttcttcaggttcattaccc

SEQ ID NO: 296131 - DNA, 20 bp, Artificial
  CRISPR gRNA sequence
gttcattaccctagtccttt

SEQ ID NO: 296132 - DNA, 20 bp, Artificial
  CRISPR gRNA sequence
gacataatttcattattcac

SEQ ID NO: 296133 - DNA, 20 bp, Artificial
  CRISPR gRNA sequence
ccttgataaaccgaatttgt

SEQ ID NO: 296134 - DNA, 20 bp, Artificial
  CRISPR gRNA sequence
cgaatttgtcagtgtcattc

SEQ ID NO: 296135 - DNA, 20 bp, Artificial
  CRISPR gRNA sequence
ttcaagtataactgacctca

SEQ ID NO: 296136 - DNA, 20 bp, Artificial
  CRISPR gRNA sequence
ctcacagaacgtgataccac

SEQ ID NO: 296137 - DNA, 20 bp, Artificial
  CRISPR gRNA sequence
acgtgataccacaagcgatg

SEQ ID NO: 296138 - DNA, 20 bp, Artificial
  CRISPR gRNA sequence
cacaagcgatgtggtctgat

SEQ ID NO: 296139 - DNA, 20 bp, Artificial
  CRISPR gRNA sequence
gcgatgtggtctgattagca

SEQ ID NO: 296140 - DNA, 20 bp, Artificial
  CRISPR gRNA sequence
gatgtggtctgattagcaca

SEQ ID NO: 296141 - DNA, 20 bp, Artificial
  CRISPR gRNA sequence
ggtctgattagcacagagtt

SEQ ID NO: 296142 - DNA, 20 bp, Artificial
  CRISPR gRNA sequence
tcagtgaatgaatcctacac

SEQ ID NO: 296143 - DNA, 20 bp, Artificial
  CRISPR gRNA sequence
cagtgaatgaatcctacact

SEQ ID NO: 296144 - DNA, 20 bp, Artificial
  CRISPR gRNA sequence
aatgaatcctacactaggat

SEQ ID NO: 296145 - DNA, 20 bp, Artificial
  CRISPR gRNA sequence
aggattggatgaaatttact

SEQ ID NO: 296146 - DNA, 20 bp, Artificial
  CRISPR gRNA sequence
tgtgatttttatgtttacta

SEQ ID NO: 296147 - DNA, 20 bp, Artificial
  CRISPR gRNA sequence
atttttatgtttactatgga

SEQ ID NO: 296148 - DNA, 20 bp, Artificial
  CRISPR gRNA sequence
gtccacttcttcctcttaca

SEQ ID NO: 296149 - DNA, 20 bp, Artificial
  CRISPR gRNA sequence
cagttgttatttcaaaactg

SEQ ID NO: 296150 - DNA, 20 bp, Artificial
  CRISPR gRNA sequence
gttatttcaaaactgaagta

SEQ ID NO: 296151 - DNA, 20 bp, Artificial
  CRISPR gRNA sequence
cagattcttacacttaccct

SEQ ID NO: 296152 - DNA, 20 bp, Artificial
  CRISPR gRNA sequence
agattcttacacttaccctc

SEQ ID NO: 296153 - DNA, 20 bp, Artificial
  CRISPR gRNA sequence
attcttacacttaccctcag

SEQ ID NO: 296154 - DNA, 20 bp, Artificial
  CRISPR gRNA sequence
cctcaggagattcatcatgt

SEQ ID NO: 296155 - DNA, 20 bp, Artificial
  CRISPR gRNA sequence
gagattcatcatgttagtat

SEQ ID NO: 296156 - DNA, 20 bp, Artificial
  CRISPR gRNA sequence
ttagtattagtctctctttt

SEQ ID NO: 296157 - DNA, 20 bp, Artificial
  CRISPR gRNA sequence
tagtattagtctctcttttc

SEQ ID NO: 296158 - DNA, 20 bp, Artificial
  CRISPR gRNA sequence
aggctttatgaatgttaatt

SEQ ID NO: 296159 - DNA, 20 bp, Artificial
  CRISPR gRNA sequence
aattcagctaactcattttt

SEQ ID NO: 296160 - DNA, 20 bp, Artificial
  CRISPR gRNA sequence
ctcattttgtgccatctgca

SEQ ID NO: 296161 - DNA, 20 bp, Artificial
  CRISPR gRNA sequence
ttgtgccatctgcacagcat

SEQ ID NO: 296162 - DNA, 20 bp, Artificial
  CRISPR gRNA sequence
ttgatttctgttgcttttat

SEQ ID NO: 296163 - DNA, 20 bp, Artificial
  CRISPR gRNA sequence
atttctgttgcttttattag

SEQ ID NO: 296164 - DNA, 20 bp, Artificial
  CRISPR gRNA sequence
tagttttactaaatacataa

SEQ ID NO: 296165 - DNA, 20 bp, Artificial
  CRISPR gRNA sequence
ctaaatacataaaagtgaaa

SEQ ID NO: 296166 - DNA, 20 bp, Artificial
  CRISPR gRNA sequence
aaaagtgaaatagtgaaaca

SEQ ID NO: 296167 - DNA, 20 bp, Artificial
  CRISPR gRNA sequence
aagtgaaatagtgaaacaca

SEQ ID NO: 296168 - DNA, 20 bp, Artificial
  CRISPR gRNA sequence
tagtgaaacacagagtcttg

SEQ ID NO: 296169 - DNA, 20 bp, Artificial
  CRISPR gRNA sequence
gagtcttgtagcatccactg

SEQ ID NO: 296170 - DNA, 20 bp, Artificial
  CRISPR gRNA sequence
agtcttgtagcatccactgt

SEQ ID NO: 296171 - DNA, 20 bp, Artificial
  CRISPR gRNA sequence
tgtagcatccactgtgggat

SEQ ID NO: 296172 - DNA, 20 bp, Artificial
  CRISPR gRNA sequence
ccactgtgggatcagtcttt

SEQ ID NO: 296173 - DNA, 20 bp, Artificial
  CRISPR gRNA sequence
gtgggatcagtcttttagac

SEQ ID NO: 296174 - DNA, 20 bp, Artificial
  CRISPR gRNA sequence
tcttttagacaagaatgatg

SEQ ID NO: 296175 - DNA, 20 bp, Artificial
  CRISPR gRNA sequence
acaagaatgatgcagttgct

SEQ ID NO: 296176 - DNA, 20 bp, Artificial
  CRISPR gRNA sequence
tacttcacctgctactatcc

SEQ ID NO: 296177 - DNA, 20 bp, Artificial
  CRISPR gRNA sequence
tgctactatcccagaccaaa

SEQ ID NO: 296178 - DNA, 20 bp, Artificial
  CRISPR gRNA sequence
ttctttcactcaaacaattg

SEQ ID NO: 296179 - DNA, 20 bp, Artificial
  CRISPR gRNA sequence
tttcactcaaacaattgcag

SEQ ID NO: 296180 - DNA, 20 bp, Artificial
  CRISPR gRNA sequence
aattgcagtagccaactgat

SEQ ID NO: 296181 - DNA, 20 bp, Artificial
  CRISPR gRNA sequence
tggtcttcctgcatctgtcc

SEQ ID NO: 296182 - DNA, 20 bp, Artificial
  CRISPR gRNA sequence
cctatcatccatttgctaca

SEQ ID NO: 296183 - DNA, 20 bp, Artificial
  CRISPR gRNA sequence
catttgctacacagaaacca

SEQ ID NO: 296184 - DNA, 20 bp, Artificial
  CRISPR gRNA sequence
aaatgcaaatctgatgatat

SEQ ID NO: 296185 - DNA, 20 bp, Artificial
  CRISPR gRNA sequence
aaatctgatgatatcagtct

SEQ ID NO: 296186 - DNA, 20 bp, Artificial
  CRISPR gRNA sequence
agtctcagctctaatttctt

SEQ ID NO: 296187 - DNA, 20 bp, Artificial
  CRISPR gRNA sequence
ctcagctctaatttctttgg

SEQ ID NO: 296188 - DNA, 20 bp, Artificial
  CRISPR gRNA sequence
tctttggtggttcacatata

SEQ ID NO: 296189 - DNA, 20 bp, Artificial
  CRISPR gRNA sequence
ccaataacacacgtgtgatc

SEQ ID NO: 296190 - DNA, 20 bp, Artificial
  CRISPR gRNA sequence
ctggcccctgctcacctctt

SEQ ID NO: 296191 - DNA, 20 bp, Artificial
  CRISPR gRNA sequence
tttcacctgtctcttcattt

SEQ ID NO: 296192 - DNA, 20 bp, Artificial
  CRISPR gRNA sequence
ctgtctcttcattttggcca

SEQ ID NO: 296193 - DNA, 20 bp, Artificial
  CRISPR gRNA sequence
tgtctcttcattttggccac

SEQ ID NO: 296194 - DNA, 20 bp, Artificial
  CRISPR gRNA sequence
gtctcttcattttggccaca

SEQ ID NO: 296195 - DNA, 20 bp, Artificial
  CRISPR gRNA sequence
tctcacgtgccctcctgcct

SEQ ID NO: 296196 - DNA, 20 bp, Artificial
  CRISPR gRNA sequence
catatgctgttccctttgcc

SEQ ID NO: 296197 - DNA, 20 bp, Artificial
  CRISPR gRNA sequence
aactcttcctgtcaactccc

SEQ ID NO: 296198 - DNA, 20 bp, Artificial
  CRISPR gRNA sequence
tcccaagcccttcacctact

SEQ ID NO: 296199 - DNA, 20 bp, Artificial
  CRISPR gRNA sequence
aatctgttctgtttgcctct

SEQ ID NO: 296200 - DNA, 20 bp, Artificial
  CRISPR gRNA sequence
ttacaaactgtctccaaact

SEQ ID NO: 296201 - DNA, 20 bp, Artificial
  CRISPR gRNA sequence
caaactgtctccaaacttag

SEQ ID NO: 296202 - DNA, 20 bp, Artificial
  CRISPR gRNA sequence
tgtctccaaacttagcagct

SEQ ID NO: 296203 - DNA, 20 bp, Artificial
  CRISPR gRNA sequence
ttaccctctctcacaatgtt

SEQ ID NO: 296204 - DNA, 20 bp, Artificial
  CRISPR gRNA sequence
taccctctctcacaatgttt

SEQ ID NO: 296205 - DNA, 20 bp, Artificial
  CRISPR gRNA sequence
accctctctcacaatgtttg

SEQ ID NO: 296206 - DNA, 20 bp, Artificial
  CRISPR gRNA sequence
tctctcacaatgtttggggt

SEQ ID NO: 296207 - DNA, 20 bp, Artificial
  CRISPR gRNA sequence
ctctcacaatgtttggggtc

SEQ ID NO: 296208 - DNA, 20 bp, Artificial
  CRISPR gRNA sequence
atgtttggggtcaggaattt

SEQ ID NO: 296209 - DNA, 20 bp, Artificial
  CRISPR gRNA sequence
tttggggtcaggaatttgag

SEQ ID NO: 296210 - DNA, 20 bp, Artificial
  CRISPR gRNA sequence
ttggggtcaggaatttgagc

SEQ ID NO: 296211 - DNA, 20 bp, Artificial
  CRISPR gRNA sequence
tcaggaatttgagcgggcct

SEQ ID NO: 296212 - DNA, 20 bp, Artificial
  CRISPR gRNA sequence
tgatatcacctgatgttatt

SEQ ID NO: 296213 - DNA, 20 bp, Artificial
  CRISPR gRNA sequence
acctgatgttattaagctga

SEQ ID NO: 296214 - DNA, 20 bp, Artificial
  CRISPR gRNA sequence
gatgttattaagctgatgga

SEQ ID NO: 296215 - DNA, 20 bp, Artificial
  CRISPR gRNA sequence
atgttattaagctgatggat

SEQ ID NO: 296216 - DNA, 20 bp, Artificial
  CRISPR gRNA sequence
agctgatggatgggctgatc

SEQ ID NO: 296217 - DNA, 20 bp, Artificial
  CRISPR gRNA sequence
ctgatggatgggctgatctg

SEQ ID NO: 296218 - DNA, 20 bp, Artificial
  CRISPR gRNA sequence
tgatctggagatgcactgtc

SEQ ID NO: 296219 - DNA, 20 bp, Artificial
  CRISPR gRNA sequence
tggagatgcactgtccagtt

SEQ ID NO: 296220 - DNA, 20 bp, Artificial
  CRISPR gRNA sequence
agatgcactgtccagtttgg

SEQ ID NO: 296221 - DNA, 20 bp, Artificial
  CRISPR gRNA sequence
ctgtccagtttggtagccac

SEQ ID NO: 296222 - DNA, 20 bp, Artificial
  CRISPR gRNA sequence
gccactggttacctgaaatg

SEQ ID NO: 296223 - DNA, 20 bp, Artificial
  CRISPR gRNA sequence
ctggttacctgaaatgcagc

SEQ ID NO: 296224 - DNA, 20 bp, Artificial
  CRISPR gRNA sequence
aaatgcagccagtcctaatt

SEQ ID NO: 296225 - DNA, 20 bp, Artificial
  CRISPR gRNA sequence
aaacacccacatgattattg

SEQ ID NO: 296226 - DNA, 20 bp, Artificial
  CRISPR gRNA sequence
ccacatgattattgaagatt

SEQ ID NO: 296227 - DNA, 20 bp, Artificial
  CRISPR gRNA sequence
ttgtattctgattacatgtt

SEQ ID NO: 296228 - DNA, 20 bp, Artificial
  CRISPR gRNA sequence
ttataatatttcacatacat

SEQ ID NO: 296229 - DNA, 20 bp, Artificial
  CRISPR gRNA sequence
ttctttaatgtgactactac

SEQ ID NO: 296230 - DNA, 20 bp, Artificial
  CRISPR gRNA sequence
aagttttcaaattatatctg

SEQ ID NO: 296231 - DNA, 20 bp, Artificial
  CRISPR gRNA sequence
atatctgtggcttgtaattg

SEQ ID NO: 296232 - DNA, 20 bp, Artificial
  CRISPR gRNA sequence
gtattgtattctttttttct

SEQ ID NO: 296233 - DNA, 20 bp, Artificial
  CRISPR gRNA sequence
tgtattctttttttctgaga

SEQ ID NO: 296234 - DNA, 20 bp, Artificial
  CRISPR gRNA sequence
tattctttttttctgagatg

SEQ ID NO: 296235 - DNA, 20 bp, Artificial
  CRISPR gRNA sequence
tggagtcttactctgttgcc

SEQ ID NO: 296236 - DNA, 20 bp, Artificial
  CRISPR gRNA sequence
ggagtcttactctgttgccc

SEQ ID NO: 296237 - DNA, 20 bp, Artificial
  CRISPR gRNA sequence
tcttactctgttgcccaggc

SEQ ID NO: 296238 - DNA, 20 bp, Artificial
  CRISPR gRNA sequence
ttactctgttgcccaggctg

SEQ ID NO: 296239 - DNA, 20 bp, Artificial
  CRISPR gRNA sequence
ctgttgcccaggctggagtg

SEQ ID NO: 296240 - DNA, 20 bp, Artificial
  CRISPR gRNA sequence
ttgcccaggctggagtgcag

SEQ ID NO: 296241 - DNA, 20 bp, Artificial
  CRISPR gRNA sequence
ccaggctggagtgcagtggc

SEQ ID NO: 296242 - DNA, 20 bp, Artificial
  CRISPR gRNA sequence
gcgagatctctgctcatcgc

SEQ ID NO: 296243 - DNA, 20 bp, Artificial
  CRISPR gRNA sequence
tcatcgcaagctctgcctcc

SEQ ID NO: 296244 - DNA, 20 bp, Artificial
  CRISPR gRNA sequence
catcgcaagctctgcctccc

SEQ ID NO: 296245 - DNA, 20 bp, Artificial
  CRISPR gRNA sequence
aagctctgcctcccaggttc

SEQ ID NO: 296246 - DNA, 20 bp, Artificial
  CRISPR gRNA sequence
ttcaagtgattctcctgcct

SEQ ID NO: 296247 - DNA, 20 bp, Artificial
  CRISPR gRNA sequence
ttctcctgcctcagcctcct

SEQ ID NO: 296248 - DNA, 20 bp, Artificial
  CRISPR gRNA sequence
tcctgcctcagcctcctgag

SEQ ID NO: 296249 - DNA, 20 bp, Artificial
  CRISPR gRNA sequence
ctcctgagtagctgaaatta

SEQ ID NO: 296250 - DNA, 20 bp, Artificial
  CRISPR gRNA sequence
tcctgagtagctgaaattac

SEQ ID NO: 296251 - DNA, 20 bp, Artificial
  CRISPR gRNA sequence
caggtgcccgccactatgcc

SEQ ID NO: 296252 - DNA, 20 bp, Artificial
  CRISPR gRNA sequence
ccagctaatttttgtatttt

SEQ ID NO: 296253 - DNA, 20 bp, Artificial
  CRISPR gRNA sequence
gctaatttttgtatttttag

SEQ ID NO: 296254 - DNA, 20 bp, Artificial
  CRISPR gRNA sequence
taatttttgtatttttagta

SEQ ID NO: 296255 - DNA, 20 bp, Artificial
  CRISPR gRNA sequence
ttttgtatttttagtagaga

SEQ ID NO: 296256 - DNA, 20 bp, Artificial
  CRISPR gRNA sequence
tttgtatttttagtagagac

SEQ ID NO: 296257 - DNA, 20 bp, Artificial
  CRISPR gRNA sequence
ttgtatttttagtagagacg

SEQ ID NO: 296258 - DNA, 20 bp, Artificial
  CRISPR gRNA sequence
gagacggggtttccccataa

SEQ ID NO: 296259 - DNA, 20 bp, Artificial
  CRISPR gRNA sequence
cggggtttccccataatggc

SEQ ID NO: 296260 - DNA, 20 bp, Artificial
  CRISPR gRNA sequence
ggggtttccccataatggcc

SEQ ID NO: 296261 - DNA, 20 bp, Artificial
  CRISPR gRNA sequence
tttccccataatggccaggc

SEQ ID NO: 296262 - DNA, 20 bp, Artificial
  CRISPR gRNA sequence
tggtctcaaactcctgacct

SEQ ID NO: 296263 - DNA, 20 bp, Artificial
  CRISPR gRNA sequence
ggtctcaaactcctgacctc

SEQ ID NO: 296264 - DNA, 20 bp, Artificial
  CRISPR gRNA sequence
ctcaggtaatctgcccacct

SEQ ID NO: 296265 - DNA, 20 bp, Artificial
  CRISPR gRNA sequence
ctgcccacctcggcctccca

SEQ ID NO: 296266 - DNA, 20 bp, Artificial
  CRISPR gRNA sequence
acctcggcctcccaaagtgc

SEQ ID NO: 296267 - DNA, 20 bp, Artificial
  CRISPR gRNA sequence
cctcggcctcccaaagtgct

SEQ ID NO: 296268 - DNA, 20 bp, Artificial
  CRISPR gRNA sequence
tcccaaagtgctgggattac

SEQ ID NO: 296269 - DNA, 20 bp, Artificial
  CRISPR gRNA sequence
agtgctgggattacaagcat

SEQ ID NO: 296270 - DNA, 20 bp, Artificial
  CRISPR gRNA sequence
caagcatgagccaccacacc

SEQ ID NO: 296271 - DNA, 20 bp, Artificial
  CRISPR gRNA sequence
ggcctgttttatattcttac

SEQ ID NO: 296272 - DNA, 20 bp, Artificial
  CRISPR gRNA sequence
tgttttatattcttactgga

SEQ ID NO: 296273 - DNA, 20 bp, Artificial
  CRISPR gRNA sequence
cttactggacagtgctgatc

SEQ ID NO: 296274 - DNA, 20 bp, Artificial
  CRISPR gRNA sequence
tactggacagtgctgatcta

SEQ ID NO: 296275 - DNA, 20 bp, Artificial
  CRISPR gRNA sequence
tggacagtgctgatctagag

SEQ ID NO: 296276 - DNA, 20 bp, Artificial
  CRISPR gRNA sequence
ggacagtgctgatctagagc

SEQ ID NO: 296277 - DNA, 20 bp, Artificial
  CRISPR gRNA sequence
acagtgctgatctagagcag

SEQ ID NO: 296278 - DNA, 20 bp, Artificial
  CRISPR gRNA sequence
gctgatctagagcaggagtc

SEQ ID NO: 296279 - DNA, 20 bp, Artificial
  CRISPR gRNA sequence
gatctagagcaggagtcaag

SEQ ID NO: 296280 - DNA, 20 bp, Artificial
  CRISPR gRNA sequence
tcaagcagttttttctatga

SEQ ID NO: 296281 - DNA, 20 bp, Artificial
  CRISPR gRNA sequence
caagcagttttttctatgaa

SEQ ID NO: 296282 - DNA, 20 bp, Artificial
  CRISPR gRNA sequence
tttttctatgaaaggccaca

SEQ ID NO: 296283 - DNA, 20 bp, Artificial
  CRISPR gRNA sequence
ggccacatagaaaatgtttt

SEQ ID NO: 296284 - DNA, 20 bp, Artificial
  CRISPR gRNA sequence
agaaaatgttttcagctttg

SEQ ID NO: 296285 - DNA, 20 bp, Artificial
  CRISPR gRNA sequence
gaaaatgttttcagctttgc

SEQ ID NO: 296286 - DNA, 20 bp, Artificial
  CRISPR gRNA sequence
tttcagctttgcaggccatg

SEQ ID NO: 296287 - DNA, 20 bp, Artificial
  CRISPR gRNA sequence
aggccatgcagtctccatca

SEQ ID NO: 296288 - DNA, 20 bp, Artificial
  CRISPR gRNA sequence
actcttccattgcactgcaa

SEQ ID NO: 296289 - DNA, 20 bp, Artificial
  CRISPR gRNA sequence
cttccattgcactgcaaaag

SEQ ID NO: 296290 - DNA, 20 bp, Artificial
  CRISPR gRNA sequence
ttgcactgcaaaagcagcca

SEQ ID NO: 296291 - DNA, 20 bp, Artificial
  CRISPR gRNA sequence
ccatagataataatttacaa

SEQ ID NO: 296292 - DNA, 20 bp, Artificial
  CRISPR gRNA sequence
ataataatttacaatagaca

SEQ ID NO: 296293 - DNA, 20 bp, Artificial
  CRISPR gRNA sequence
ataatttacaatagacatag

SEQ ID NO: 296294 - DNA, 20 bp, Artificial
  CRISPR gRNA sequence
caatagacatagcagtgttc

SEQ ID NO: 296295 - DNA, 20 bp, Artificial
  CRISPR gRNA sequence
agtacaactattaataaaaa

SEQ ID NO: 296296 - DNA, 20 bp, Artificial
  CRISPR gRNA sequence
gtacaactattaataaaaat

SEQ ID NO: 296297 - DNA, 20 bp, Artificial
  CRISPR gRNA sequence
caactattaataaaaatagg

SEQ ID NO: 296298 - DNA, 20 bp, Artificial
  CRISPR gRNA sequence
ctattaataaaaataggtgg

SEQ ID NO: 296299 - DNA, 20 bp, Artificial
  CRISPR gRNA sequence
taataaaaataggtggtagc

SEQ ID NO: 296300 - DNA, 20 bp, Artificial
  CRISPR gRNA sequence
aaataggtggtagccagatt

SEQ ID NO: 296301 - DNA, 20 bp, Artificial
  CRISPR gRNA sequence
tggtagccagatttggccta

SEQ ID NO: 296302 - DNA, 20 bp, Artificial
  CRISPR gRNA sequence
ggtagccagatttggcctac

SEQ ID NO: 296303 - DNA, 20 bp, Artificial
  CRISPR gRNA sequence
cagatttggcctacaggctg

SEQ ID NO: 296304 - DNA, 20 bp, Artificial
  CRISPR gRNA sequence
tagtttgctgacccctgatc

SEQ ID NO: 296305 - DNA, 20 bp, Artificial
  CRISPR gRNA sequence
tttgctgacccctgatctag

SEQ ID NO: 296306 - DNA, 20 bp, Artificial
  CRISPR gRNA sequence
acccctgatctagaagatcc

SEQ ID NO: 296307 - DNA, 20 bp, Artificial
  CRISPR gRNA sequence
caagattttattcatatgtc

SEQ ID NO: 296308 - DNA, 20 bp, Artificial
  CRISPR gRNA sequence
gattttattcatatgtctgg

SEQ ID NO: 296309 - DNA, 20 bp, Artificial
  CRISPR gRNA sequence
tattcatatgtctggtggct

SEQ ID NO: 296310 - DNA, 20 bp, Artificial
  CRISPR gRNA sequence
tcatatgtctggtggcttgg

SEQ ID NO: 296311 - DNA, 20 bp, Artificial
  CRISPR gRNA sequence
catatgtctggtggcttggc

SEQ ID NO: 296312 - DNA, 20 bp, Artificial
  CRISPR gRNA sequence
atatgtctggtggcttggca

SEQ ID NO: 296313 - DNA, 20 bp, Artificial
  CRISPR gRNA sequence
gtctggtggcttggcaggga

SEQ ID NO: 296314 - DNA, 20 bp, Artificial
  CRISPR gRNA sequence
tctggtggcttggcagggat

SEQ ID NO: 296315 - DNA, 20 bp, Artificial
  CRISPR gRNA sequence
ggtggcttggcagggatagg

SEQ ID NO: 296316 - DNA, 20 bp, Artificial
  CRISPR gRNA sequence
ggcttggcagggataggtgg

SEQ ID NO: 296317 - DNA, 20 bp, Artificial
  CRISPR gRNA sequence
gcttggcagggataggtgga

SEQ ID NO: 296318 - DNA, 20 bp, Artificial
  CRISPR gRNA sequence
gcagggataggtggaaggct

SEQ ID NO: 296319 - DNA, 20 bp, Artificial
  CRISPR gRNA sequence
ggataggtggaaggctcagc

SEQ ID NO: 296320 - DNA, 20 bp, Artificial
  CRISPR gRNA sequence
gataggtggaaggctcagct

SEQ ID NO: 296321 - DNA, 20 bp, Artificial
  CRISPR gRNA sequence
gctgggaccattgacccaaa

SEQ ID NO: 296322 - DNA, 20 bp, Artificial
  CRISPR gRNA sequence
cattgacccaaacagctata

SEQ ID NO: 296323 - DNA, 20 bp, Artificial
  CRISPR gRNA sequence
aacagctatacagtcctctc

SEQ ID NO: 296324 - DNA, 20 bp, Artificial
  CRISPR gRNA sequence
tacagtcctctccagcatga

SEQ ID NO: 296325 - DNA, 20 bp, Artificial
  CRISPR gRNA sequence
cctctccagcatgatggtct

SEQ ID NO: 296326 - DNA, 20 bp, Artificial
  CRISPR gRNA sequence
ctctccagcatgatggtctc

SEQ ID NO: 296327 - DNA, 20 bp, Artificial
  CRISPR gRNA sequence
tctccagcatgatggtctcg

SEQ ID NO: 296328 - DNA, 20 bp, Artificial
  CRISPR gRNA sequence
ccagcatgatggtctcgggg

SEQ ID NO: 296329 - DNA, 20 bp, Artificial
  CRISPR gRNA sequence
gcatgatggtctcggggtag

SEQ ID NO: 296330 - DNA, 20 bp, Artificial
  CRISPR gRNA sequence
catgatggtctcggggtagt

SEQ ID NO: 296331 - DNA, 20 bp, Artificial
  CRISPR gRNA sequence
gggtagtgggacatcttacg

SEQ ID NO: 296332 - DNA, 20 bp, Artificial
  CRISPR gRNA sequence
tagtgggacatcttacgtgg

SEQ ID NO: 296333 - DNA, 20 bp, Artificial
  CRISPR gRNA sequence
ggacatcttacgtggtggct

SEQ ID NO: 296334 - DNA, 20 bp, Artificial
  CRISPR gRNA sequence
tacgtggtggctcagaactc

SEQ ID NO: 296335 - DNA, 20 bp, Artificial
  CRISPR gRNA sequence
ggtggctcagaactccagat

SEQ ID NO: 296336 - DNA, 20 bp, Artificial
  CRISPR gRNA sequence
gtggctcagaactccagata

SEQ ID NO: 296337 - DNA, 20 bp, Artificial
  CRISPR gRNA sequence
aactccagataaggtactcc

SEQ ID NO: 296338 - DNA, 20 bp, Artificial
  CRISPR gRNA sequence
ctccagataaggtactccca

SEQ ID NO: 296339 - DNA, 20 bp, Artificial
  CRISPR gRNA sequence
ccagataaggtactcccaga

SEQ ID NO: 296340 - DNA, 20 bp, Artificial
  CRISPR gRNA sequence
ataaggtactcccagagaga

SEQ ID NO: 296341 - DNA, 20 bp, Artificial
  CRISPR gRNA sequence
taaggtactcccagagagac

SEQ ID NO: 296342 - DNA, 20 bp, Artificial
  CRISPR gRNA sequence
ggtactcccagagagacagg

SEQ ID NO: 296343 - DNA, 20 bp, Artificial
  CRISPR gRNA sequence
actcccagagagacaggtag

SEQ ID NO: 296344 - DNA, 20 bp, Artificial
  CRISPR gRNA sequence
gagagacaggtagaagctgt

SEQ ID NO: 296345 - DNA, 20 bp, Artificial
  CRISPR gRNA sequence
agagacaggtagaagctgtg

SEQ ID NO: 296346 - DNA, 20 bp, Artificial
  CRISPR gRNA sequence
ctgtgaggcttcttatgacc

SEQ ID NO: 296347 - DNA, 20 bp, Artificial
  CRISPR gRNA sequence
ttcttatgaccaagctctcg

SEQ ID NO: 296348 - DNA, 20 bp, Artificial
  CRISPR gRNA sequence
tgaccaagctctcgaagtcc

SEQ ID NO: 296349 - DNA, 20 bp, Artificial
  CRISPR gRNA sequence
atcccttgtactgtattcta

SEQ ID NO: 296350 - DNA, 20 bp, Artificial
  CRISPR gRNA sequence
tactgtattctatggtcaaa

SEQ ID NO: 296351 - DNA, 20 bp, Artificial
  CRISPR gRNA sequence
actgtattctatggtcaaac

SEQ ID NO: 296352 - DNA, 20 bp, Artificial
  CRISPR gRNA sequence
ctatggtcaaacaggtcact

SEQ ID NO: 296353 - DNA, 20 bp, Artificial
  CRISPR gRNA sequence
tatggtcaaacaggtcactc

SEQ ID NO: 296354 - DNA, 20 bp, Artificial
  CRISPR gRNA sequence
gtcaaacaggtcactcaggc

SEQ ID NO: 296355 - DNA, 20 bp, Artificial
  CRISPR gRNA sequence
acaggtcactcaggctagcc

SEQ ID NO: 296356 - DNA, 20 bp, Artificial
  CRISPR gRNA sequence
ctcaggctagcccagattca

SEQ ID NO: 296357 - DNA, 20 bp, Artificial
  CRISPR gRNA sequence
caggctagcccagattcaaa

SEQ ID NO: 296358 - DNA, 20 bp, Artificial
  CRISPR gRNA sequence
ggctagcccagattcaaaga

SEQ ID NO: 296359 - DNA, 20 bp, Artificial
  CRISPR gRNA sequence
gctagcccagattcaaagag

SEQ ID NO: 296360 - DNA, 20 bp, Artificial
  CRISPR gRNA sequence
tagcccagattcaaagagag

SEQ ID NO: 296361 - DNA, 20 bp, Artificial
  CRISPR gRNA sequence
gatccaactctacctcttca

SEQ ID NO: 296362 - DNA, 20 bp, Artificial
  CRISPR gRNA sequence
atccaactctacctcttcat

SEQ ID NO: 296363 - DNA, 20 bp, Artificial
  CRISPR gRNA sequence
ccaactctacctcttcatgg

SEQ ID NO: 296364 - DNA, 20 bp, Artificial
  CRISPR gRNA sequence
caactctacctcttcatggg

SEQ ID NO: 296365 - DNA, 20 bp, Artificial
  CRISPR gRNA sequence
actctacctcttcatgggag

SEQ ID NO: 296366 - DNA, 20 bp, Artificial
  CRISPR gRNA sequence
ctctacctcttcatgggagg

SEQ ID NO: 296367 - DNA, 20 bp, Artificial
  CRISPR gRNA sequence
ctacctcttcatgggaggag

SEQ ID NO: 296368 - DNA, 20 bp, Artificial
  CRISPR gRNA sequence
cctcttcatgggaggaggag

SEQ ID NO: 296369 - DNA, 20 bp, Artificial
  CRISPR gRNA sequence
tcatgggaggaggagtagcc

SEQ ID NO: 296370 - DNA, 20 bp, Artificial
  CRISPR gRNA sequence
catgggaggaggagtagcca

SEQ ID NO: 296371 - DNA, 20 bp, Artificial
  CRISPR gRNA sequence
taatctattatatcattctt

SEQ ID NO: 296372 - DNA, 20 bp, Artificial
  CRISPR gRNA sequence
ttatatcattcttcagatct

SEQ ID NO: 296373 - DNA, 20 bp, Artificial
  CRISPR gRNA sequence
tcattcttcagatctcagtt

SEQ ID NO: 296374 - DNA, 20 bp, Artificial
  CRISPR gRNA sequence
cattcttcagatctcagttt

SEQ ID NO: 296375 - DNA, 20 bp, Artificial
  CRISPR gRNA sequence
cttcagatctcagtttaggc

SEQ ID NO: 296376 - DNA, 20 bp, Artificial
  CRISPR gRNA sequence
agtttaggctggtcctgtta

SEQ ID NO: 296377 - DNA, 20 bp, Artificial
  CRISPR gRNA sequence
gtttaggctggtcctgttat

SEQ ID NO: 296378 - DNA, 20 bp, Artificial
  CRISPR gRNA sequence
ggtcctgttatgggctctca

SEQ ID NO: 296379 - DNA, 20 bp, Artificial
  CRISPR gRNA sequence
taccatgaacctctcttttg

SEQ ID NO: 296380 - DNA, 20 bp, Artificial
  CRISPR gRNA sequence
ctcttttgtagcacttgtca

SEQ ID NO: 296381 - DNA, 20 bp, Artificial
  CRISPR gRNA sequence
tttgtagcacttgtcatagc

SEQ ID NO: 296382 - DNA, 20 bp, Artificial
  CRISPR gRNA sequence
cttgcttttctactaaactg

SEQ ID NO: 296383 - DNA, 20 bp, Artificial
  CRISPR gRNA sequence
ttgcttttctactaaactgt

SEQ ID NO: 296384 - DNA, 20 bp, Artificial
  CRISPR gRNA sequence
aaactgtaggcaaccacgtg

SEQ ID NO: 296385 - DNA, 20 bp, Artificial
  CRISPR gRNA sequence
actgtaggcaaccacgtgaa

SEQ ID NO: 296386 - DNA, 20 bp, Artificial
  CRISPR gRNA sequence
ctgtaggcaaccacgtgaag

SEQ ID NO: 296387 - DNA, 20 bp, Artificial
  CRISPR gRNA sequence
acgtgaagaggaactgtttc

SEQ ID NO: 296388 - DNA, 20 bp, Artificial
  CRISPR gRNA sequence
ggttttgctcattatattcc

SEQ ID NO: 296389 - DNA, 20 bp, Artificial
  CRISPR gRNA sequence
ctagcaccaaacacaatgct

SEQ ID NO: 296390 - DNA, 20 bp, Artificial
  CRISPR gRNA sequence
cttggttcaataaatatttg

SEQ ID NO: 296391 - DNA, 20 bp, Artificial
  CRISPR gRNA sequence
ggttcaataaatatttgtgg

SEQ ID NO: 296392 - DNA, 20 bp, Artificial
  CRISPR gRNA sequence
cgaatgaatgaatgaaccaa

SEQ ID NO: 296393 - DNA, 20 bp, Artificial
  CRISPR gRNA sequence
ccaatagcaaatgaatgaat

SEQ ID NO: 296394 - DNA, 20 bp, Artificial
  CRISPR gRNA sequence
attgctgtcacgtatatcat

SEQ ID NO: 296395 - DNA, 20 bp, Artificial
  CRISPR gRNA sequence
tatatcataagatactctgt

SEQ ID NO: 296396 - DNA, 20 bp, Artificial
  CRISPR gRNA sequence
atcataagatactctgtcag

SEQ ID NO: 296397 - DNA, 20 bp, Artificial
  CRISPR gRNA sequence
attcaaatatatttgattcc

SEQ ID NO: 296398 - DNA, 20 bp, Artificial
  CRISPR gRNA sequence
ccagtaaccttcttattttg

SEQ ID NO: 296399 - DNA, 20 bp, Artificial
  CRISPR gRNA sequence
aaccttcttattttgtagtt

SEQ ID NO: 296400 - DNA, 20 bp, Artificial
  CRISPR gRNA sequence
tgtagttcagaaactttata

SEQ ID NO: 296401 - DNA, 20 bp, Artificial
  CRISPR gRNA sequence
agttcagaaactttataaag

SEQ ID NO: 296402 - DNA, 20 bp, Artificial
  CRISPR gRNA sequence
gttcagaaactttataaaga

SEQ ID NO: 296403 - DNA, 20 bp, Artificial
  CRISPR gRNA sequence
aactttataaagaaggaaat

SEQ ID NO: 296404 - DNA, 20 bp, Artificial
  CRISPR gRNA sequence
taagcctatcttactcttcc

SEQ ID NO: 296405 - DNA, 20 bp, Artificial
  CRISPR gRNA sequence
ttactcttcccagtatctca

SEQ ID NO: 296406 - DNA, 20 bp, Artificial
  CRISPR gRNA sequence
actcttcccagtatctcaaa

SEQ ID NO: 296407 - DNA, 20 bp, Artificial
  CRISPR gRNA sequence
ctcttcccagtatctcaaag

SEQ ID NO: 296408 - DNA, 20 bp, Artificial
  CRISPR gRNA sequence
tcttcccagtatctcaaaga

SEQ ID NO: 296409 - DNA, 20 bp, Artificial
  CRISPR gRNA sequence
tcaaagagggtttctgccct

SEQ ID NO: 296410 - DNA, 20 bp, Artificial
  CRISPR gRNA sequence
gtttctgccctgagctgctc

SEQ ID NO: 296411 - DNA, 20 bp, Artificial
  CRISPR gRNA sequence
ttctgccctgagctgctcaa

SEQ ID NO: 296412 - DNA, 20 bp, Artificial
  CRISPR gRNA sequence
tctgccctgagctgctcaag

SEQ ID NO: 296413 - DNA, 20 bp, Artificial
  CRISPR gRNA sequence
ctgccctgagctgctcaaga

SEQ ID NO: 296414 - DNA, 20 bp, Artificial
  CRISPR gRNA sequence
ctcaagagggtttctgccct

SEQ ID NO: 296415 - DNA, 20 bp, Artificial
  CRISPR gRNA sequence
ctcgaatacccactgtgtgc

SEQ ID NO: 296416 - DNA, 20 bp, Artificial
  CRISPR gRNA sequence
tcgaatacccactgtgtgcc

SEQ ID NO: 296417 - DNA, 20 bp, Artificial
  CRISPR gRNA sequence
tacccactgtgtgccaggta

SEQ ID NO: 296418 - DNA, 20 bp, Artificial
  CRISPR gRNA sequence
cccactgtgtgccaggtaca

SEQ ID NO: 296419 - DNA, 20 bp, Artificial
  CRISPR gRNA sequence
cactgtgtgccaggtacaga

SEQ ID NO: 296420 - DNA, 20 bp, Artificial
  CRISPR gRNA sequence
agttcttctctgctgtaatc

SEQ ID NO: 296421 - DNA, 20 bp, Artificial
  CRISPR gRNA sequence
cttctctgctgtaatctgga

SEQ ID NO: 296422 - DNA, 20 bp, Artificial
  CRISPR gRNA sequence
ttctctgctgtaatctggac

SEQ ID NO: 296423 - DNA, 20 bp, Artificial
  CRISPR gRNA sequence
gctgtaatctggacaggcac

SEQ ID NO: 296424 - DNA, 20 bp, Artificial
  CRISPR gRNA sequence
ctggacaggcaccagcttcc

SEQ ID NO: 296425 - DNA, 20 bp, Artificial
  CRISPR gRNA sequence
caggcaccagcttcccagcg

SEQ ID NO: 296426 - DNA, 20 bp, Artificial
  CRISPR gRNA sequence
aggcaccagcttcccagcgt

SEQ ID NO: 296427 - DNA, 20 bp, Artificial
  CRISPR gRNA sequence
ccagcttcccagcgtgggtt

SEQ ID NO: 296428 - DNA, 20 bp, Artificial
  CRISPR gRNA sequence
cagcttcccagcgtgggttt

SEQ ID NO: 296429 - DNA, 20 bp, Artificial
  CRISPR gRNA sequence
cccagcgtgggtttaggctt

SEQ ID NO: 296430 - DNA, 20 bp, Artificial
  CRISPR gRNA sequence
ccagcgtgggtttaggcttc

SEQ ID NO: 296431 - DNA, 20 bp, Artificial
  CRISPR gRNA sequence
cacactactgtgtaccgtct

SEQ ID NO: 296432 - DNA, 20 bp, Artificial
  CRISPR gRNA sequence
tgtaccgtctaagccacacc

SEQ ID NO: 296433 - DNA, 20 bp, Artificial
  CRISPR gRNA sequence
accgtctaagccacacctag

SEQ ID NO: 296434 - DNA, 20 bp, Artificial
  CRISPR gRNA sequence
cgtctaagccacacctagaa

SEQ ID NO: 296435 - DNA, 20 bp, Artificial
  CRISPR gRNA sequence
agccacacctagaagagctc

SEQ ID NO: 296436 - DNA, 20 bp, Artificial
  CRISPR gRNA sequence
gccacacctagaagagctct

SEQ ID NO: 296437 - DNA, 20 bp, Artificial
  CRISPR gRNA sequence
ccacacctagaagagctctg

SEQ ID NO: 296438 - DNA, 20 bp, Artificial
  CRISPR gRNA sequence
tctggggaaatatgactact

SEQ ID NO: 296439 - DNA, 20 bp, Artificial
  CRISPR gRNA sequence
ctggggaaatatgactactt

SEQ ID NO: 296440 - DNA, 20 bp, Artificial
  CRISPR gRNA sequence
gggaaatatgactacttggg

SEQ ID NO: 296441 - DNA, 20 bp, Artificial
  CRISPR gRNA sequence
atatgactacttgggcagaa

SEQ ID NO: 296442 - DNA, 20 bp, Artificial
  CRISPR gRNA sequence
tatgactacttgggcagaaa

SEQ ID NO: 296443 - DNA, 20 bp, Artificial
  CRISPR gRNA sequence
gactacttgggcagaaaagg

SEQ ID NO: 296444 - DNA, 20 bp, Artificial
  CRISPR gRNA sequence
actacttgggcagaaaagga

SEQ ID NO: 296445 - DNA, 20 bp, Artificial
  CRISPR gRNA sequence
gggcagaaaaggaaggaact

SEQ ID NO: 296446 - DNA, 20 bp, Artificial
  CRISPR gRNA sequence
cagaaaaggaaggaactaag

SEQ ID NO: 296447 - DNA, 20 bp, Artificial
  CRISPR gRNA sequence
gaaaaggaaggaactaagaa

SEQ ID NO: 296448 - DNA, 20 bp, Artificial
  CRISPR gRNA sequence
aaaaggaaggaactaagaag

SEQ ID NO: 296449 - DNA, 20 bp, Artificial
  CRISPR gRNA sequence
gaagaggtatctttgtgtct

SEQ ID NO: 296450 - DNA, 20 bp, Artificial
  CRISPR gRNA sequence
aagaggtatctttgtgtctg

SEQ ID NO: 296451 - DNA, 20 bp, Artificial
  CRISPR gRNA sequence
atctttgtgtctgaggtctg

SEQ ID NO: 296452 - DNA, 20 bp, Artificial
  CRISPR gRNA sequence
tctttgtgtctgaggtctga

SEQ ID NO: 296453 - DNA, 20 bp, Artificial
  CRISPR gRNA sequence
tttgtgtctgaggtctgaag

SEQ ID NO: 296454 - DNA, 20 bp, Artificial
  CRISPR gRNA sequence
ctgaggtctgaaggagcgtg

SEQ ID NO: 296455 - DNA, 20 bp, Artificial
  CRISPR gRNA sequence
tgaggtctgaaggagcgtgt

SEQ ID NO: 296456 - DNA, 20 bp, Artificial
  CRISPR gRNA sequence
ggagcgtgtgggctcttgtt

SEQ ID NO: 296457 - DNA, 20 bp, Artificial
  CRISPR gRNA sequence
gagcgtgtgggctcttgttc

SEQ ID NO: 296458 - DNA, 20 bp, Artificial
  CRISPR gRNA sequence
tgtgggctcttgttcaggca

SEQ ID NO: 296459 - DNA, 20 bp, Artificial
  CRISPR gRNA sequence
gtgggctcttgttcaggcaa

SEQ ID NO: 296460 - DNA, 20 bp, Artificial
  CRISPR gRNA sequence
tgggctcttgttcaggcaaa

SEQ ID NO: 296461 - DNA, 20 bp, Artificial
  CRISPR gRNA sequence
gctcttgttcaggcaaaggg

SEQ ID NO: 296462 - DNA, 20 bp, Artificial
  CRISPR gRNA sequence
ctcttgttcaggcaaagggc

SEQ ID NO: 296463 - DNA, 20 bp, Artificial
  CRISPR gRNA sequence
gttcaggcaaagggcaggat

SEQ ID NO: 296464 - DNA, 20 bp, Artificial
  CRISPR gRNA sequence
ttcaggcaaagggcaggatg

SEQ ID NO: 296465 - DNA, 20 bp, Artificial
  CRISPR gRNA sequence
tcaggcaaagggcaggatga

SEQ ID NO: 296466 - DNA, 20 bp, Artificial
  CRISPR gRNA sequence
caggcaaagggcaggatgag

SEQ ID NO: 296467 - DNA, 20 bp, Artificial
  CRISPR gRNA sequence
ggcaaagggcaggatgaggg

SEQ ID NO: 296468 - DNA, 20 bp, Artificial
  CRISPR gRNA sequence
gcaaagggcaggatgagggg

SEQ ID NO: 296469 - DNA, 20 bp, Artificial
  CRISPR gRNA sequence
aagggcaggatgaggggagg

SEQ ID NO: 296470 - DNA, 20 bp, Artificial
  CRISPR gRNA sequence
agggcaggatgaggggaggt

SEQ ID NO: 296471 - DNA, 20 bp, Artificial
  CRISPR gRNA sequence
gggcaggatgaggggaggtg

SEQ ID NO: 296472 - DNA, 20 bp, Artificial
  CRISPR gRNA sequence
caggatgaggggaggtgggg

SEQ ID NO: 296473 - DNA, 20 bp, Artificial
  CRISPR gRNA sequence
gatgaggggaggtggggtgg

SEQ ID NO: 296474 - DNA, 20 bp, Artificial
  CRISPR gRNA sequence
gaggggaggtggggtggcag

SEQ ID NO: 296475 - DNA, 20 bp, Artificial
  CRISPR gRNA sequence
ggaggtggggtggcagcagc

SEQ ID NO: 296476 - DNA, 20 bp, Artificial
  CRISPR gRNA sequence
ggggtggcagcagccagtaa

SEQ ID NO: 296477 - DNA, 20 bp, Artificial
  CRISPR gRNA sequence
gggtggcagcagccagtaat

SEQ ID NO: 296478 - DNA, 20 bp, Artificial
  CRISPR gRNA sequence
ggtggcagcagccagtaatg

SEQ ID NO: 296479 - DNA, 20 bp, Artificial
  CRISPR gRNA sequence
ggcagcagccagtaatgggg

SEQ ID NO: 296480 - DNA, 20 bp, Artificial
  CRISPR gRNA sequence
gcagcagccagtaatggggt

SEQ ID NO: 296481 - DNA, 20 bp, Artificial
  CRISPR gRNA sequence
cagccagtaatggggtggga

SEQ ID NO: 296482 - DNA, 20 bp, Artificial
  CRISPR gRNA sequence
ccagtaatggggtgggacag

SEQ ID NO: 296483 - DNA, 20 bp, Artificial
  CRISPR gRNA sequence
tggggtgggacagcggaatg

SEQ ID NO: 296484 - DNA, 20 bp, Artificial
  CRISPR gRNA sequence
gggtgggacagcggaatgca

SEQ ID NO: 296485 - DNA, 20 bp, Artificial
  CRISPR gRNA sequence
ggtgggacagcggaatgcag

SEQ ID NO: 296486 - DNA, 20 bp, Artificial
  CRISPR gRNA sequence
gaatgcagaggatgaaactt

SEQ ID NO: 296487 - DNA, 20 bp, Artificial
  CRISPR gRNA sequence
aatgcagaggatgaaacttc

SEQ ID NO: 296488 - DNA, 20 bp, Artificial
  CRISPR gRNA sequence
gaggatgaaacttcaggtcc

SEQ ID NO: 296489 - DNA, 20 bp, Artificial
  CRISPR gRNA sequence
acttcaggtcctggtgctct

SEQ ID NO: 296490 - DNA, 20 bp, Artificial
  CRISPR gRNA sequence
tcaggtcctggtgctctgag

SEQ ID NO: 296491 - DNA, 20 bp, Artificial
  CRISPR gRNA sequence
ctctgagaagtaacgctgtg

SEQ ID NO: 296492 - DNA, 20 bp, Artificial
  CRISPR gRNA sequence
gctgtgcagcatgtcacacc

SEQ ID NO: 296493 - DNA, 20 bp, Artificial
  CRISPR gRNA sequence
tgtgcagcatgtcacaccca

SEQ ID NO: 296494 - DNA, 20 bp, Artificial
  CRISPR gRNA sequence
gtgcagcatgtcacacccag

SEQ ID NO: 296495 - DNA, 20 bp, Artificial
  CRISPR gRNA sequence
gtcacacccagaggcaaacc

SEQ ID NO: 296496 - DNA, 20 bp, Artificial
  CRISPR gRNA sequence
tcacacccagaggcaaacca

SEQ ID NO: 296497 - DNA, 20 bp, Artificial
  CRISPR gRNA sequence
ccagaggcaaaccaaggccc

SEQ ID NO: 296498 - DNA, 20 bp, Artificial
  CRISPR gRNA sequence
cagaggcaaaccaaggcccc

SEQ ID NO: 296499 - DNA, 20 bp, Artificial
  CRISPR gRNA sequence
agaggcaaaccaaggcccca

SEQ ID NO: 296500 - DNA, 20 bp, Artificial
  CRISPR gRNA sequence
aggcaaaccaaggccccagg

SEQ ID NO: 296501 - DNA, 20 bp, Artificial
  CRISPR gRNA sequence
ccagggagctgatgttgcac

SEQ ID NO: 296502 - DNA, 20 bp, Artificial
  CRISPR gRNA sequence
agggagctgatgttgcactg

SEQ ID NO: 296503 - DNA, 20 bp, Artificial
  CRISPR gRNA sequence
ctggagctctactctcctct

SEQ ID NO: 296504 - DNA, 20 bp, Artificial
  CRISPR gRNA sequence
agctctactctcctctcagc

SEQ ID NO: 296505 - DNA, 20 bp, Artificial
  CRISPR gRNA sequence
ctactctcctctcagcgagc

SEQ ID NO: 296506 - DNA, 20 bp, Artificial
  CRISPR gRNA sequence
tcagcgagctggtgacgtgc

SEQ ID NO: 296507 - DNA, 20 bp, Artificial
  CRISPR gRNA sequence
gagctggtgacgtgccagtc

SEQ ID NO: 296508 - DNA, 20 bp, Artificial
  CRISPR gRNA sequence
ctggtgacgtgccagtccag

SEQ ID NO: 296509 - DNA, 20 bp, Artificial
  CRISPR gRNA sequence
tggtgacgtgccagtccagc

SEQ ID NO: 296510 - DNA, 20 bp, Artificial
  CRISPR gRNA sequence
acgtgccagtccagcaggcc

SEQ ID NO: 296511 - DNA, 20 bp, Artificial
  CRISPR gRNA sequence
ggcctggcttatccaaccac

SEQ ID NO: 296512 - DNA, 20 bp, Artificial
  CRISPR gRNA sequence
atccaaccacaagtatgaat

SEQ ID NO: 296513 - DNA, 20 bp, Artificial
  CRISPR gRNA sequence
caaccacaagtatgaatcgg

SEQ ID NO: 296514 - DNA, 20 bp, Artificial
  CRISPR gRNA sequence
ccacaagtatgaatcggcag

SEQ ID NO: 296515 - DNA, 20 bp, Artificial
  CRISPR gRNA sequence
cacaagtatgaatcggcaga

SEQ ID NO: 296516 - DNA, 20 bp, Artificial
  CRISPR gRNA sequence
atgaatcggcagaaggcaat

SEQ ID NO: 296517 - DNA, 20 bp, Artificial
  CRISPR gRNA sequence
atcggcagaaggcaatgagc

SEQ ID NO: 296518 - DNA, 20 bp, Artificial
  CRISPR gRNA sequence
tcggcagaaggcaatgagct

SEQ ID NO: 296519 - DNA, 20 bp, Artificial
  CRISPR gRNA sequence
aaggcaatgagctgggccct

SEQ ID NO: 296520 - DNA, 20 bp, Artificial
  CRISPR gRNA sequence
agctgggccctgagtgctgc

SEQ ID NO: 296521 - DNA, 20 bp, Artificial
  CRISPR gRNA sequence
gctgggccctgagtgctgct

SEQ ID NO: 296522 - DNA, 20 bp, Artificial
  CRISPR gRNA sequence
gccctgagtgctgctgggct

SEQ ID NO: 296523 - DNA, 20 bp, Artificial
  CRISPR gRNA sequence
ccctgagtgctgctgggctg

SEQ ID NO: 296524 - DNA, 20 bp, Artificial
  CRISPR gRNA sequence
ccgacctaatccttcctcca

SEQ ID NO: 296525 - DNA, 20 bp, Artificial
  CRISPR gRNA sequence
gacctaatccttcctccaca

SEQ ID NO: 296526 - DNA, 20 bp, Artificial
  CRISPR gRNA sequence
tccttcctccacagagactg

SEQ ID NO: 296527 - DNA, 20 bp, Artificial
  CRISPR gRNA sequence
gtggtgtcccctgctttgct

SEQ ID NO: 296528 - DNA, 20 bp, Artificial
  CRISPR gRNA sequence
tggtgtcccctgctttgctc

SEQ ID NO: 296529 - DNA, 20 bp, Artificial
  CRISPR gRNA sequence
ggtgtcccctgctttgctca

SEQ ID NO: 296530 - DNA, 20 bp, Artificial
  CRISPR gRNA sequence
tcccctgctttgctcagggt

SEQ ID NO: 296531 - DNA, 20 bp, Artificial
  CRISPR gRNA sequence
agaactcttgtatacctcac

SEQ ID NO: 296532 - DNA, 20 bp, Artificial
  CRISPR gRNA sequence
actcttgtatacctcacaag

SEQ ID NO: 296533 - DNA, 20 bp, Artificial
  CRISPR gRNA sequence
tgtatacctcacaagaagcc

SEQ ID NO: 296534 - DNA, 20 bp, Artificial
  CRISPR gRNA sequence
gtatacctcacaagaagcca

SEQ ID NO: 296535 - DNA, 20 bp, Artificial
  CRISPR gRNA sequence
ctacctaccaccttccacac

SEQ ID NO: 296536 - DNA, 20 bp, Artificial
  CRISPR gRNA sequence
accaccttccacactggccc

SEQ ID NO: 296537 - DNA, 20 bp, Artificial
  CRISPR gRNA sequence
caccttccacactggccctg

SEQ ID NO: 296538 - DNA, 20 bp, Artificial
  CRISPR gRNA sequence
tggccctggagcctgcattg

SEQ ID NO: 296539 - DNA, 20 bp, Artificial
  CRISPR gRNA sequence
gcctgcattgtagttatttg

SEQ ID NO: 296540 - DNA, 20 bp, Artificial
  CRISPR gRNA sequence
tggacactttttcttctctt

SEQ ID NO: 296541 - DNA, 20 bp, Artificial
  CRISPR gRNA sequence
ctttttcttctctttagtgc

SEQ ID NO: 296542 - DNA, 20 bp, Artificial
  CRISPR gRNA sequence
tttttcttctctttagtgcc

SEQ ID NO: 296543 - DNA, 20 bp, Artificial
  CRISPR gRNA sequence
ttcttctctttagtgccagg

SEQ ID NO: 296544 - DNA, 20 bp, Artificial
  CRISPR gRNA sequence
tcttctctttagtgccaggt

SEQ ID NO: 296545 - DNA, 20 bp, Artificial
  CRISPR gRNA sequence
cttctctttagtgccaggtg

SEQ ID NO: 296546 - DNA, 20 bp, Artificial
  CRISPR gRNA sequence
ttctctttagtgccaggtgg

SEQ ID NO: 296547 - DNA, 20 bp, Artificial
  CRISPR gRNA sequence
ttagtgccaggtgggggacc

SEQ ID NO: 296548 - DNA, 20 bp, Artificial
  CRISPR gRNA sequence
tagtgccaggtgggggacca

SEQ ID NO: 296549 - DNA, 20 bp, Artificial
  CRISPR gRNA sequence
ctttacaacccctcaatctc

SEQ ID NO: 296550 - DNA, 20 bp, Artificial
  CRISPR gRNA sequence
aacccctcaatctctagaac

SEQ ID NO: 296551 - DNA, 20 bp, Artificial
  CRISPR gRNA sequence
tctagaacaagtctgacact

SEQ ID NO: 296552 - DNA, 20 bp, Artificial
  CRISPR gRNA sequence
agaacaagtctgacactgag

SEQ ID NO: 296553 - DNA, 20 bp, Artificial
  CRISPR gRNA sequence
agtctgacactgagtagatg

SEQ ID NO: 296554 - DNA, 20 bp, Artificial
  CRISPR gRNA sequence
tgtagcaaatgtttgcctga

SEQ ID NO: 296555 - DNA, 20 bp, Artificial
  CRISPR gRNA sequence
acctcaataaataaccttct

SEQ ID NO: 296556 - DNA, 20 bp, Artificial
  CRISPR gRNA sequence
cctcaataaataaccttctg

SEQ ID NO: 296557 - DNA, 20 bp, Artificial
  CRISPR gRNA sequence
taaataaccttctgaggcac

SEQ ID NO: 296558 - DNA, 20 bp, Artificial
  CRISPR gRNA sequence
tgaggcaccagcaaacttct

SEQ ID NO: 296559 - DNA, 20 bp, Artificial
  CRISPR gRNA sequence
cagcatttttcctgatactc

SEQ ID NO: 296560 - DNA, 20 bp, Artificial
  CRISPR gRNA sequence
taccactaacattctacaca

SEQ ID NO: 296561 - DNA, 20 bp, Artificial
  CRISPR gRNA sequence
tctacacaaagttgtgaaat

SEQ ID NO: 296562 - DNA, 20 bp, Artificial
  CRISPR gRNA sequence
ttgctctccaacatctactg

SEQ ID NO: 296563 - DNA, 20 bp, Artificial
  CRISPR gRNA sequence
cccctgtcccaccccattac

SEQ ID NO: 296564 - DNA, 20 bp, Artificial
  CRISPR gRNA sequence
atcctgccctttgcctgaat

SEQ ID NO: 296565 - DNA, 20 bp, Artificial
  CRISPR gRNA sequence
cctgccctttgcctgaatga

SEQ ID NO: 296566 - DNA, 20 bp, Artificial
  CRISPR gRNA sequence
tgagagcccacatgctcctt

SEQ ID NO: 296567 - DNA, 20 bp, Artificial
  CRISPR gRNA sequence
ccacatgctccttcagacct

SEQ ID NO: 296568 - DNA, 20 bp, Artificial
  CRISPR gRNA sequence
tccttcagacctcagataca

SEQ ID NO: 296569 - DNA, 20 bp, Artificial
  CRISPR gRNA sequence
gatacaaagataccccttct

SEQ ID NO: 296570 - DNA, 20 bp, Artificial
  CRISPR gRNA sequence
agttccttccttttctgccc

SEQ ID NO: 296571 - DNA, 20 bp, Artificial
  CRISPR gRNA sequence
tccttccttttctgcccaag

SEQ ID NO: 296572 - DNA, 20 bp, Artificial
  CRISPR gRNA sequence
cccaagtagtcatatttccc

SEQ ID NO: 296573 - DNA, 20 bp, Artificial
  CRISPR gRNA sequence
caagtagtcatatttcccca

SEQ ID NO: 296574 - DNA, 20 bp, Artificial
  CRISPR gRNA sequence
atatttccccagagctcttc

SEQ ID NO: 296575 - DNA, 20 bp, Artificial
  CRISPR gRNA sequence
ccccagagctcttctagata

SEQ ID NO: 296576 - DNA, 20 bp, Artificial
  CRISPR gRNA sequence
gagctcttctagatatggct

SEQ ID NO: 296577 - DNA, 20 bp, Artificial
  CRISPR gRNA sequence
tcttctagatatggcttaga

SEQ ID NO: 296578 - DNA, 20 bp, Artificial
  CRISPR gRNA sequence
gatatggcttagatggtcca

SEQ ID NO: 296579 - DNA, 20 bp, Artificial
  CRISPR gRNA sequence
atggcttagatggtccacag

SEQ ID NO: 296580 - DNA, 20 bp, Artificial
  CRISPR gRNA sequence
tccacagtagtgtgcacctg

SEQ ID NO: 296581 - DNA, 20 bp, Artificial
  CRISPR gRNA sequence
cctgaagcctaaatccacgc

SEQ ID NO: 296582 - DNA, 20 bp, Artificial
  CRISPR gRNA sequence
ctgaagcctaaatccacgct

SEQ ID NO: 296583 - DNA, 20 bp, Artificial
  CRISPR gRNA sequence
aagcctaaatccacgctggg

SEQ ID NO: 296584 - DNA, 20 bp, Artificial
  CRISPR gRNA sequence
ctaaatccacgctgggaagc

SEQ ID NO: 296585 - DNA, 20 bp, Artificial
  CRISPR gRNA sequence
ctgggaagctggtgcctgtc

SEQ ID NO: 296586 - DNA, 20 bp, Artificial
  CRISPR gRNA sequence
tgggaagctggtgcctgtcc

SEQ ID NO: 296587 - DNA, 20 bp, Artificial
  CRISPR gRNA sequence
gctggtgcctgtccaggtta

SEQ ID NO: 296588 - DNA, 20 bp, Artificial
  CRISPR gRNA sequence
ggtgcctgtccaggttaaag

SEQ ID NO: 296589 - DNA, 20 bp, Artificial
  CRISPR gRNA sequence
tgcctgtccaggttaaagtg

SEQ ID NO: 296590 - DNA, 20 bp, Artificial
  CRISPR gRNA sequence
ctgtccaggttaaagtggag

SEQ ID NO: 296591 - DNA, 20 bp, Artificial
  CRISPR gRNA sequence
ggagaagtactctctgtacc

SEQ ID NO: 296592 - DNA, 20 bp, Artificial
  CRISPR gRNA sequence
tactctctgtacctggcaca

SEQ ID NO: 296593 - DNA, 20 bp, Artificial
  CRISPR gRNA sequence
tctctgtacctggcacacag

SEQ ID NO: 296594 - DNA, 20 bp, Artificial
  CRISPR gRNA sequence
ctctgtacctggcacacagt

SEQ ID NO: 296595 - DNA, 20 bp, Artificial
  CRISPR gRNA sequence
ctggcacacagtgggtattc

SEQ ID NO: 296596 - DNA, 20 bp, Artificial
  CRISPR gRNA sequence
gcacacagtgggtattcgag

SEQ ID NO: 296597 - DNA, 20 bp, Artificial
  CRISPR gRNA sequence
gggtattcgagcagtgtttg

SEQ ID NO: 296598 - DNA, 20 bp, Artificial
  CRISPR gRNA sequence
agcagtgtttgcagaatgaa

SEQ ID NO: 296599 - DNA, 20 bp, Artificial
  CRISPR gRNA sequence
agtgtttgcagaatgaacag

SEQ ID NO: 296600 - DNA, 20 bp, Artificial
  CRISPR gRNA sequence
ttgcagaatgaacagcagct

SEQ ID NO: 296601 - DNA, 20 bp, Artificial
  CRISPR gRNA sequence
tgcagaatgaacagcagctc

SEQ ID NO: 296602 - DNA, 20 bp, Artificial
  CRISPR gRNA sequence
gcagaatgaacagcagctca

SEQ ID NO: 296603 - DNA, 20 bp, Artificial
  CRISPR gRNA sequence
gaatgaacagcagctcaggg

SEQ ID NO: 296604 - DNA, 20 bp, Artificial
  CRISPR gRNA sequence
gcagaaaccctcttgatgca

SEQ ID NO: 296605 - DNA, 20 bp, Artificial
  CRISPR gRNA sequence
cagaaaccctcttgatgcaa

SEQ ID NO: 296606 - DNA, 20 bp, Artificial
  CRISPR gRNA sequence
agaaaccctcttgatgcaaa

SEQ ID NO: 296607 - DNA, 20 bp, Artificial
  CRISPR gRNA sequence
cttgatgcaaagggatactt

SEQ ID NO: 296608 - DNA, 20 bp, Artificial
  CRISPR gRNA sequence
ttgatgcaaagggatacttt

SEQ ID NO: 296609 - DNA, 20 bp, Artificial
  CRISPR gRNA sequence
tgatgcaaagggatactttg

SEQ ID NO: 296610 - DNA, 20 bp, Artificial
  CRISPR gRNA sequence
ggccccttcttctcccaccc

SEQ ID NO: 296611 - DNA, 20 bp, Artificial
  CRISPR gRNA sequence
ccaccccagtctgtctctct

SEQ ID NO: 296612 - DNA, 20 bp, Artificial
  CRISPR gRNA sequence
accccagtctgtctctctga

SEQ ID NO: 296613 - DNA, 20 bp, Artificial
  CRISPR gRNA sequence
tctgagagtcctctcgattc

SEQ ID NO: 296614 - DNA, 20 bp, Artificial
  CRISPR gRNA sequence
ctgagagtcctctcgattcc

SEQ ID NO: 296615 - DNA, 20 bp, Artificial
  CRISPR gRNA sequence
gagagtcctctcgattccag

SEQ ID NO: 296616 - DNA, 20 bp, Artificial
  CRISPR gRNA sequence
ccaggagccaccatcacacc

SEQ ID NO: 296617 - DNA, 20 bp, Artificial
  CRISPR gRNA sequence
gccaccatcacacctggccc

SEQ ID NO: 296618 - DNA, 20 bp, Artificial
  CRISPR gRNA sequence
ccaccatcacacctggccct

SEQ ID NO: 296619 - DNA, 20 bp, Artificial
  CRISPR gRNA sequence
tgtgctgctcccgtctgtct

SEQ ID NO: 296620 - DNA, 20 bp, Artificial
  CRISPR gRNA sequence
tgctgctcccgtctgtctca

SEQ ID NO: 296621 - DNA, 20 bp, Artificial
  CRISPR gRNA sequence
gctgctcccgtctgtctcag

SEQ ID NO: 296622 - DNA, 20 bp, Artificial
  CRISPR gRNA sequence
ctcccgtctgtctcagaggc

SEQ ID NO: 296623 - DNA, 20 bp, Artificial
  CRISPR gRNA sequence
tctcagaggctagataacat

SEQ ID NO: 296624 - DNA, 20 bp, Artificial
  CRISPR gRNA sequence
tcagaggctagataacatca

SEQ ID NO: 296625 - DNA, 20 bp, Artificial
  CRISPR gRNA sequence
aacatcagagtcctttccac

SEQ ID NO: 296626 - DNA, 20 bp, Artificial
  CRISPR gRNA sequence
gtcctttccactggctcctg

SEQ ID NO: 296627 - DNA, 20 bp, Artificial
  CRISPR gRNA sequence
ctttccactggctcctgtgg

SEQ ID NO: 296628 - DNA, 20 bp, Artificial
  CRISPR gRNA sequence
ttccactggctcctgtggca

SEQ ID NO: 296629 - DNA, 20 bp, Artificial
  CRISPR gRNA sequence
tcctgtggcagagcaaaaac

SEQ ID NO: 296630 - DNA, 20 bp, Artificial
  CRISPR gRNA sequence
gtggcagagcaaaaactggt

SEQ ID NO: 296631 - DNA, 20 bp, Artificial
  CRISPR gRNA sequence
catttttaaacgtgctacac

SEQ ID NO: 296632 - DNA, 20 bp, Artificial
  CRISPR gRNA sequence
cgtgctacaccagtgtgtga

SEQ ID NO: 296633 - DNA, 20 bp, Artificial
  CRISPR gRNA sequence
accagtgtgtgaaagaaaca

SEQ ID NO: 296634 - DNA, 20 bp, Artificial
  CRISPR gRNA sequence
ccagtgtgtgaaagaaacac

SEQ ID NO: 296635 - DNA, 20 bp, Artificial
  CRISPR gRNA sequence
tgaaagaaacacaggctgca

SEQ ID NO: 296636 - DNA, 20 bp, Artificial
  CRISPR gRNA sequence
gaaagaaacacaggctgcat

SEQ ID NO: 296637 - DNA, 20 bp, Artificial
  CRISPR gRNA sequence
ggctgcatgggtttaaatct

SEQ ID NO: 296638 - DNA, 20 bp, Artificial
  CRISPR gRNA sequence
atctcagctgtaccatttac

SEQ ID NO: 296639 - DNA, 20 bp, Artificial
  CRISPR gRNA sequence
cagctgtaccatttactagc

SEQ ID NO: 296640 - DNA, 20 bp, Artificial
  CRISPR gRNA sequence
agctgtaccatttactagct

SEQ ID NO: 296641 - DNA, 20 bp, Artificial
  CRISPR gRNA sequence
tgtaccatttactagctggg

SEQ ID NO: 296642 - DNA, 20 bp, Artificial
  CRISPR gRNA sequence
catttactagctgggcagcc

SEQ ID NO: 296643 - DNA, 20 bp, Artificial
  CRISPR gRNA sequence
atttactagctgggcagcct

SEQ ID NO: 296644 - DNA, 20 bp, Artificial
  CRISPR gRNA sequence
tttactagctgggcagccta

SEQ ID NO: 296645 - DNA, 20 bp, Artificial
  CRISPR gRNA sequence
ctagctgggcagcctagggc

SEQ ID NO: 296646 - DNA, 20 bp, Artificial
  CRISPR gRNA sequence
gcaagtactgtgacctctct

SEQ ID NO: 296647 - DNA, 20 bp, Artificial
  CRISPR gRNA sequence
ccattccttcatctgtaaca

SEQ ID NO: 296648 - DNA, 20 bp, Artificial
  CRISPR gRNA sequence
cattccttcatctgtaacat

SEQ ID NO: 296649 - DNA, 20 bp, Artificial
  CRISPR gRNA sequence
attccttcatctgtaacatg

SEQ ID NO: 296650 - DNA, 20 bp, Artificial
  CRISPR gRNA sequence
aaataatctcaccctgttgt

SEQ ID NO: 296651 - DNA, 20 bp, Artificial
  CRISPR gRNA sequence
taatctcaccctgttgtgag

SEQ ID NO: 296652 - DNA, 20 bp, Artificial
  CRISPR gRNA sequence
taataatatgattaatcatt

SEQ ID NO: 296653 - DNA, 20 bp, Artificial
  CRISPR gRNA sequence
ctcttattcatgttctctga

SEQ ID NO: 296654 - DNA, 20 bp, Artificial
  CRISPR gRNA sequence
tcttattcatgttctctgat

SEQ ID NO: 296655 - DNA, 20 bp, Artificial
  CRISPR gRNA sequence
attcatgttctctgatgggc

SEQ ID NO: 296656 - DNA, 20 bp, Artificial
  CRISPR gRNA sequence
tctgatgggccagacataca

SEQ ID NO: 296657 - DNA, 20 bp, Artificial
  CRISPR gRNA sequence
atgggccagacatacaaagt

SEQ ID NO: 296658 - DNA, 20 bp, Artificial
  CRISPR gRNA sequence
cagacatacaaagtaagtga

SEQ ID NO: 296659 - DNA, 20 bp, Artificial
  CRISPR gRNA sequence
acatacaaagtaagtgaaag

SEQ ID NO: 296660 - DNA, 20 bp, Artificial
  CRISPR gRNA sequence
aagtaagtgaaagtggatta

SEQ ID NO: 296661 - DNA, 20 bp, Artificial
  CRISPR gRNA sequence
taagtgaaagtggattacgg

SEQ ID NO: 296662 - DNA, 20 bp, Artificial
  CRISPR gRNA sequence
aagtgaaagtggattacggc

SEQ ID NO: 296663 - DNA, 20 bp, Artificial
  CRISPR gRNA sequence
attacggcaggtgctcttct

SEQ ID NO: 296664 - DNA, 20 bp, Artificial
  CRISPR gRNA sequence
caggtgctcttcttggtttc

SEQ ID NO: 296665 - DNA, 20 bp, Artificial
  CRISPR gRNA sequence
ggtgctcttcttggtttctg

SEQ ID NO: 296666 - DNA, 20 bp, Artificial
  CRISPR gRNA sequence
ggagtgaacctccatttaca

SEQ ID NO: 296667 - DNA, 20 bp, Artificial
  CRISPR gRNA sequence
agtgaacctccatttacatg

SEQ ID NO: 296668 - DNA, 20 bp, Artificial
  CRISPR gRNA sequence
gtgaacctccatttacatgg

SEQ ID NO: 296669 - DNA, 20 bp, Artificial
  CRISPR gRNA sequence
tacatggaggctcctctttt

SEQ ID NO: 296670 - DNA, 20 bp, Artificial
  CRISPR gRNA sequence
cctctttttagatttctgac

SEQ ID NO: 296671 - DNA, 20 bp, Artificial
  CRISPR gRNA sequence
tagttcacccaccttattca

SEQ ID NO: 296672 - DNA, 20 bp, Artificial
  CRISPR gRNA sequence
catagaccttattctgtgct

SEQ ID NO: 296673 - DNA, 20 bp, Artificial
  CRISPR gRNA sequence
cttattctgtgcttagctga

SEQ ID NO: 296674 - DNA, 20 bp, Artificial
  CRISPR gRNA sequence
agctgacagaaatctcctct

SEQ ID NO: 296675 - DNA, 20 bp, Artificial
  CRISPR gRNA sequence
ctgacagaaatctcctctca

SEQ ID NO: 296676 - DNA, 20 bp, Artificial
  CRISPR gRNA sequence
ctcctctcagagaatccccc

SEQ ID NO: 296677 - DNA, 20 bp, Artificial
  CRISPR gRNA sequence
gaatccccccggtaaattct

SEQ ID NO: 296678 - DNA, 20 bp, Artificial
  CRISPR gRNA sequence
aatccccccggtaaattctt

SEQ ID NO: 296679 - DNA, 20 bp, Artificial
  CRISPR gRNA sequence
ctttttgctctctccctccg

SEQ ID NO: 296680 - DNA, 20 bp, Artificial
  CRISPR gRNA sequence
tttttgctctctccctccga

SEQ ID NO: 296681 - DNA, 20 bp, Artificial
  CRISPR gRNA sequence
tgctctctccctccgaaggc

SEQ ID NO: 296682 - DNA, 20 bp, Artificial
  CRISPR gRNA sequence
ctctctccctccgaaggcaa

SEQ ID NO: 296683 - DNA, 20 bp, Artificial
  CRISPR gRNA sequence
aggcaagagtttccacttta

SEQ ID NO: 296684 - DNA, 20 bp, Artificial
  CRISPR gRNA sequence
ggcaagagtttccactttac

SEQ ID NO: 296685 - DNA, 20 bp, Artificial
  CRISPR gRNA sequence
tttccactttacaggcccac

SEQ ID NO: 296686 - DNA, 20 bp, Artificial
  CRISPR gRNA sequence
tccactttacaggcccactg

SEQ ID NO: 296687 - DNA, 20 bp, Artificial
  CRISPR gRNA sequence
ctttacaggcccactggaga

SEQ ID NO: 296688 - DNA, 20 bp, Artificial
  CRISPR gRNA sequence
aggcccactggagaaagtta

SEQ ID NO: 296689 - DNA, 20 bp, Artificial
  CRISPR gRNA sequence
ctggagaaagttatggcttc

SEQ ID NO: 296690 - DNA, 20 bp, Artificial
  CRISPR gRNA sequence
aaagttatggcttctggttg

SEQ ID NO: 296691 - DNA, 20 bp, Artificial
  CRISPR gRNA sequence
ttatggcttctggttgtggt

SEQ ID NO: 296692 - DNA, 20 bp, Artificial
  CRISPR gRNA sequence
atggcttctggttgtggttg

SEQ ID NO: 296693 - DNA, 20 bp, Artificial
  CRISPR gRNA sequence
tggcttctggttgtggttgg

SEQ ID NO: 296694 - DNA, 20 bp, Artificial
  CRISPR gRNA sequence
gtggttggaggttcattcct

SEQ ID NO: 296695 - DNA, 20 bp, Artificial
  CRISPR gRNA sequence
tggttggaggttcattcctg

SEQ ID NO: 296696 - DNA, 20 bp, Artificial
  CRISPR gRNA sequence
ggttggaggttcattcctga

SEQ ID NO: 296697 - DNA, 20 bp, Artificial
  CRISPR gRNA sequence
ttggaggttcattcctgagg

SEQ ID NO: 296698 - DNA, 20 bp, Artificial
  CRISPR gRNA sequence
gaggttcattcctgagggag

SEQ ID NO: 296699 - DNA, 20 bp, Artificial
  CRISPR gRNA sequence
aggttcattcctgagggagt

SEQ ID NO: 296700 - DNA, 20 bp, Artificial
  CRISPR gRNA sequence
ggttcattcctgagggagtg

SEQ ID NO: 296701 - DNA, 20 bp, Artificial
  CRISPR gRNA sequence
gacatttctacacttcttca

SEQ ID NO: 296702 - DNA, 20 bp, Artificial
  CRISPR gRNA sequence
ttcttcacggccaatgacat

SEQ ID NO: 296703 - DNA, 20 bp, Artificial
  CRISPR gRNA sequence
cttcacggccaatgacattg

SEQ ID NO: 296704 - DNA, 20 bp, Artificial
  CRISPR gRNA sequence
gccaatgacattggagaaac

SEQ ID NO: 296705 - DNA, 20 bp, Artificial
  CRISPR gRNA sequence
gagaaactggcttcctaacc

SEQ ID NO: 296706 - DNA, 20 bp, Artificial
  CRISPR gRNA sequence
cacacacacatcacacatca

SEQ ID NO: 296707 - DNA, 20 bp, Artificial
  CRISPR gRNA sequence
cacacatcacacatcatggc

SEQ ID NO: 296708 - DNA, 20 bp, Artificial
  CRISPR gRNA sequence
atcacacatcatggctagaa

SEQ ID NO: 296709 - DNA, 20 bp, Artificial
  CRISPR gRNA sequence
cacacatcatggctagaatg

SEQ ID NO: 296710 - DNA, 20 bp, Artificial
  CRISPR gRNA sequence
cacatcatggctagaatgga

SEQ ID NO: 296711 - DNA, 20 bp, Artificial
  CRISPR gRNA sequence
atggagagaaattcttcata

SEQ ID NO: 296712 - DNA, 20 bp, Artificial
  CRISPR gRNA sequence
tggagagaaattcttcatat

SEQ ID NO: 296713 - DNA, 20 bp, Artificial
  CRISPR gRNA sequence
ggagagaaattcttcatatg

SEQ ID NO: 296714 - DNA, 20 bp, Artificial
  CRISPR gRNA sequence
ggggcacttgtacttcatga

SEQ ID NO: 296715 - DNA, 20 bp, Artificial
  CRISPR gRNA sequence
aagaaaatcatatcaatctt

SEQ ID NO: 296716 - DNA, 20 bp, Artificial
  CRISPR gRNA sequence
agtattttaacatcctatta

SEQ ID NO: 296717 - DNA, 20 bp, Artificial
  CRISPR gRNA sequence
attttaacatcctattacag

SEQ ID NO: 296718 - DNA, 20 bp, Artificial
  CRISPR gRNA sequence
ttttaacatcctattacagc

SEQ ID NO: 296719 - DNA, 20 bp, Artificial
  CRISPR gRNA sequence
tttaacatcctattacagca

SEQ ID NO: 296720 - DNA, 20 bp, Artificial
  CRISPR gRNA sequence
agcagggtcactgataaact

SEQ ID NO: 296721 - DNA, 20 bp, Artificial
  CRISPR gRNA sequence
tcactgataaactaagtgtc

SEQ ID NO: 296722 - DNA, 20 bp, Artificial
  CRISPR gRNA sequence
actgataaactaagtgtcca

SEQ ID NO: 296723 - DNA, 20 bp, Artificial
  CRISPR gRNA sequence
taagtgtccagagtgttttc

SEQ ID NO: 296724 - DNA, 20 bp, Artificial
  CRISPR gRNA sequence
aagtgtccagagtgttttct

SEQ ID NO: 296725 - DNA, 20 bp, Artificial
  CRISPR gRNA sequence
gtccagagtgttttctagga

SEQ ID NO: 296726 - DNA, 20 bp, Artificial
  CRISPR gRNA sequence
gtgttttctaggatggtgtg

SEQ ID NO: 296727 - DNA, 20 bp, Artificial
  CRISPR gRNA sequence
tgtggtctccaaattaacat

SEQ ID NO: 296728 - DNA, 20 bp, Artificial
  CRISPR gRNA sequence
tctccaaattaacattagtg

SEQ ID NO: 296729 - DNA, 20 bp, Artificial
  CRISPR gRNA sequence
ttaacattagtgaagcttac

SEQ ID NO: 296730 - DNA, 20 bp, Artificial
  CRISPR gRNA sequence
acattagtgaagcttactgg

SEQ ID NO: 296731 - DNA, 20 bp, Artificial
  CRISPR gRNA sequence
cattagtgaagcttactgga

SEQ ID NO: 296732 - DNA, 20 bp, Artificial
  CRISPR gRNA sequence
actggaaggattgttactcc

SEQ ID NO: 296733 - DNA, 20 bp, Artificial
  CRISPR gRNA sequence
ctggaaggattgttactcct

SEQ ID NO: 296734 - DNA, 20 bp, Artificial
  CRISPR gRNA sequence
aaggattgttactcctgggc

SEQ ID NO: 296735 - DNA, 20 bp, Artificial
  CRISPR gRNA sequence
aggattgttactcctgggcc

SEQ ID NO: 296736 - DNA, 20 bp, Artificial
  CRISPR gRNA sequence
ttgttactcctgggccaggc

SEQ ID NO: 296737 - DNA, 20 bp, Artificial
  CRISPR gRNA sequence
tgttactcctgggccaggcc

SEQ ID NO: 296738 - DNA, 20 bp, Artificial
  CRISPR gRNA sequence
ctgggccaggccaggatttt

SEQ ID NO: 296739 - DNA, 20 bp, Artificial
  CRISPR gRNA sequence
tgggccaggccaggattttg

SEQ ID NO: 296740 - DNA, 20 bp, Artificial
  CRISPR gRNA sequence
ggccaggccaggattttgag

SEQ ID NO: 296741 - DNA, 20 bp, Artificial
  CRISPR gRNA sequence
ccaggccaggattttgagga

SEQ ID NO: 296742 - DNA, 20 bp, Artificial
  CRISPR gRNA sequence
tgctgtcaccaaatccttga

SEQ ID NO: 296743 - DNA, 20 bp, Artificial
  CRISPR gRNA sequence
accaaatccttgacagactt

SEQ ID NO: 296744 - DNA, 20 bp, Artificial
  CRISPR gRNA sequence
aaatccttgacagactttgg

SEQ ID NO: 296745 - DNA, 20 bp, Artificial
  CRISPR gRNA sequence
tccttgacagactttggcag

SEQ ID NO: 296746 - DNA, 20 bp, Artificial
  CRISPR gRNA sequence
agactttggcagaagtgtgt

SEQ ID NO: 296747 - DNA, 20 bp, Artificial
  CRISPR gRNA sequence
gactttggcagaagtgtgtt

SEQ ID NO: 296748 - DNA, 20 bp, Artificial
  CRISPR gRNA sequence
gaagtgtgttaggcttactc

SEQ ID NO: 296749 - DNA, 20 bp, Artificial
  CRISPR gRNA sequence
tgtgttaggcttactctgga

SEQ ID NO: 296750 - DNA, 20 bp, Artificial
  CRISPR gRNA sequence
aggcttactctggatagctt

SEQ ID NO: 296751 - DNA, 20 bp, Artificial
  CRISPR gRNA sequence
gcttactctggatagcttca

SEQ ID NO: 296752 - DNA, 20 bp, Artificial
  CRISPR gRNA sequence
cttactctggatagcttcag

SEQ ID NO: 296753 - DNA, 20 bp, Artificial
  CRISPR gRNA sequence
atagcttcagaggacaaaac

SEQ ID NO: 296754 - DNA, 20 bp, Artificial
  CRISPR gRNA sequence
gaggacaaaactagtattga

SEQ ID NO: 296755 - DNA, 20 bp, Artificial
  CRISPR gRNA sequence
gacaaaactagtattgacgg

SEQ ID NO: 296756 - DNA, 20 bp, Artificial
  CRISPR gRNA sequence
acaaaactagtattgacgga

SEQ ID NO: 296757 - DNA, 20 bp, Artificial
  CRISPR gRNA sequence
aaactagtattgacggaagg

SEQ ID NO: 296758 - DNA, 20 bp, Artificial
  CRISPR gRNA sequence
aactagtattgacggaagga

SEQ ID NO: 296759 - DNA, 20 bp, Artificial
  CRISPR gRNA sequence
agtattgacggaaggaaggt

SEQ ID NO: 296760 - DNA, 20 bp, Artificial
  CRISPR gRNA sequence
gtattgacggaaggaaggta

SEQ ID NO: 296761 - DNA, 20 bp, Artificial
  CRISPR gRNA sequence
attgacggaaggaaggtaag

SEQ ID NO: 296762 - DNA, 20 bp, Artificial
  CRISPR gRNA sequence
gacggaaggaaggtaaggag

SEQ ID NO: 296763 - DNA, 20 bp, Artificial
  CRISPR gRNA sequence
ggaaggaaggtaaggagaag

SEQ ID NO: 296764 - DNA, 20 bp, Artificial
  CRISPR gRNA sequence
aggagaagcagcttctaacc

SEQ ID NO: 296765 - DNA, 20 bp, Artificial
  CRISPR gRNA sequence
ggagaagcagcttctaaccc

SEQ ID NO: 296766 - DNA, 20 bp, Artificial
  CRISPR gRNA sequence
gagaagcagcttctaaccca

SEQ ID NO: 296767 - DNA, 20 bp, Artificial
  CRISPR gRNA sequence
agaagcagcttctaacccag

SEQ ID NO: 296768 - DNA, 20 bp, Artificial
  CRISPR gRNA sequence
agcagcttctaacccagggg

SEQ ID NO: 296769 - DNA, 20 bp, Artificial
  CRISPR gRNA sequence
cagcttctaacccaggggaa

SEQ ID NO: 296770 - DNA, 20 bp, Artificial
  CRISPR gRNA sequence
gcttctaacccaggggaaga

SEQ ID NO: 296771 - DNA, 20 bp, Artificial
  CRISPR gRNA sequence
ttctaacccaggggaagaga

SEQ ID NO: 296772 - DNA, 20 bp, Artificial
  CRISPR gRNA sequence
gaagagagagtttccaaact

SEQ ID NO: 296773 - DNA, 20 bp, Artificial
  CRISPR gRNA sequence
ccaaactgagaaatcaaaaa

SEQ ID NO: 296774 - DNA, 20 bp, Artificial
  CRISPR gRNA sequence
aaatggtactgattccttgt

SEQ ID NO: 296775 - DNA, 20 bp, Artificial
  CRISPR gRNA sequence
aatggtactgattccttgtc

SEQ ID NO: 296776 - DNA, 20 bp, Artificial
  CRISPR gRNA sequence
atggtactgattccttgtca

SEQ ID NO: 296777 - DNA, 20 bp, Artificial
  CRISPR gRNA sequence
tactgattccttgtcagggt

SEQ ID NO: 296778 - DNA, 20 bp, Artificial
  CRISPR gRNA sequence
tctccccactgtgtgaatta

SEQ ID NO: 296779 - DNA, 20 bp, Artificial
  CRISPR gRNA sequence
ctccccactgtgtgaattac

SEQ ID NO: 296780 - DNA, 20 bp, Artificial
  CRISPR gRNA sequence
tccccactgtgtgaattaca

SEQ ID NO: 296781 - DNA, 20 bp, Artificial
  CRISPR gRNA sequence
ccccactgtgtgaattacag

SEQ ID NO: 296782 - DNA, 20 bp, Artificial
  CRISPR gRNA sequence
attacaggggccatttgtcc

SEQ ID NO: 296783 - DNA, 20 bp, Artificial
  CRISPR gRNA sequence
gccatttgtccaagattcct

SEQ ID NO: 296784 - DNA, 20 bp, Artificial
  CRISPR gRNA sequence
catttgtccaagattcctta

SEQ ID NO: 296785 - DNA, 20 bp, Artificial
  CRISPR gRNA sequence
tcatgtaattatttgaatga

SEQ ID NO: 296786 - DNA, 20 bp, Artificial
  CRISPR gRNA sequence
catgtaattatttgaatgaa

SEQ ID NO: 296787 - DNA, 20 bp, Artificial
  CRISPR gRNA sequence
aaggtgatttgttaaattta

SEQ ID NO: 296788 - DNA, 20 bp, Artificial
  CRISPR gRNA sequence
ccctgtttgtcatgccaccc

SEQ ID NO: 296789 - DNA, 20 bp, Artificial
  CRISPR gRNA sequence
tgtttgtcatgccaccccag

SEQ ID NO: 296790 - DNA, 20 bp, Artificial
  CRISPR gRNA sequence
cccagaagaaaaattgtctt

SEQ ID NO: 296791 - DNA, 20 bp, Artificial
  CRISPR gRNA sequence
gaagaaaaattgtctttggt

SEQ ID NO: 296792 - DNA, 20 bp, Artificial
  CRISPR gRNA sequence
aagaaaaattgtctttggtt

SEQ ID NO: 296793 - DNA, 20 bp, Artificial
  CRISPR gRNA sequence
tttggttaggtcgaacataa

SEQ ID NO: 296794 - DNA, 20 bp, Artificial
  CRISPR gRNA sequence
ggtcgaacataatggttttt

SEQ ID NO: 296795 - DNA, 20 bp, Artificial
  CRISPR gRNA sequence
ttttttggtttgcaaaccat

SEQ ID NO: 296796 - DNA, 20 bp, Artificial
  CRISPR gRNA sequence
accatgagcgattcccatat

SEQ ID NO: 296797 - DNA, 20 bp, Artificial
  CRISPR gRNA sequence
ccatgagcgattcccatatt

SEQ ID NO: 296798 - DNA, 20 bp, Artificial
  CRISPR gRNA sequence
tgagcgattcccatattagg

SEQ ID NO: 296799 - DNA, 20 bp, Artificial
  CRISPR gRNA sequence
gagcgattcccatattaggt

SEQ ID NO: 296800 - DNA, 20 bp, Artificial
  CRISPR gRNA sequence
gcgattcccatattaggtgg

SEQ ID NO: 296801 - DNA, 20 bp, Artificial
  CRISPR gRNA sequence
tcccatattaggtgggagtt

SEQ ID NO: 296802 - DNA, 20 bp, Artificial
  CRISPR gRNA sequence
taggtgggagttcagattca

SEQ ID NO: 296803 - DNA, 20 bp, Artificial
  CRISPR gRNA sequence
aggtgggagttcagattcaa

SEQ ID NO: 296804 - DNA, 20 bp, Artificial
  CRISPR gRNA sequence
ggtgggagttcagattcaaa

SEQ ID NO: 296805 - DNA, 20 bp, Artificial
  CRISPR gRNA sequence
tttttttttttttttttttg

SEQ ID NO: 296806 - DNA, 20 bp, Artificial
  CRISPR gRNA sequence
ttttttttttttttttgtag

SEQ ID NO: 296807 - DNA, 20 bp, Artificial
  CRISPR gRNA sequence
ttttttttttttgtagtagc

SEQ ID NO: 296808 - DNA, 20 bp, Artificial
  CRISPR gRNA sequence
tttgtagtagccagcctaat

SEQ ID NO: 296809 - DNA, 20 bp, Artificial
  CRISPR gRNA sequence
gtagtagccagcctaatgag

SEQ ID NO: 296810 - DNA, 20 bp, Artificial
  CRISPR gRNA sequence
tagtagccagcctaatgagt

SEQ ID NO: 296811 - DNA, 20 bp, Artificial
  CRISPR gRNA sequence
tagccagcctaatgagtagg

SEQ ID NO: 296812 - DNA, 20 bp, Artificial
  CRISPR gRNA sequence
tattgaatttcttttatttt

SEQ ID NO: 296813 - DNA, 20 bp, Artificial
  CRISPR gRNA sequence
gaccatcttttcaaatgtat

SEQ ID NO: 296814 - DNA, 20 bp, Artificial
  CRISPR gRNA sequence
atcttttcaaatgtatgaga

SEQ ID NO: 296815 - DNA, 20 bp, Artificial
  CRISPR gRNA sequence
atgtatgagatagttatttc

SEQ ID NO: 296816 - DNA, 20 bp, Artificial
  CRISPR gRNA sequence
acatttcttttgcccgcttt

SEQ ID NO: 296817 - DNA, 20 bp, Artificial
  CRISPR gRNA sequence
tcttttgcccgcttttagtt

SEQ ID NO: 296818 - DNA, 20 bp, Artificial
  CRISPR gRNA sequence
cttttgcccgcttttagttt

SEQ ID NO: 296819 - DNA, 20 bp, Artificial
  CRISPR gRNA sequence
ccgcttttagtttgggtctt

SEQ ID NO: 296820 - DNA, 20 bp, Artificial
  CRISPR gRNA sequence
gcctttttcttattgattta

SEQ ID NO: 296821 - DNA, 20 bp, Artificial
  CRISPR gRNA sequence
tttttcttattgatttatag

SEQ ID NO: 296822 - DNA, 20 bp, Artificial
  CRISPR gRNA sequence
tatagaagctcttttataca

SEQ ID NO: 296823 - DNA, 20 bp, Artificial
  CRISPR gRNA sequence
gaaaattaatactttgtgac

SEQ ID NO: 296824 - DNA, 20 bp, Artificial
  CRISPR gRNA sequence
tgactagttgcaaatatttt

SEQ ID NO: 296825 - DNA, 20 bp, Artificial
  CRISPR gRNA sequence
ttttcagttgctgaaataca

SEQ ID NO: 296826 - DNA, 20 bp, Artificial
  CRISPR gRNA sequence
tcagttgctgaaatacacag

SEQ ID NO: 296827 - DNA, 20 bp, Artificial
  CRISPR gRNA sequence
cagttgctgaaatacacagt

SEQ ID NO: 296828 - DNA, 20 bp, Artificial
  CRISPR gRNA sequence
acacagtaggtgttccatgt

SEQ ID NO: 296829 - DNA, 20 bp, Artificial
  CRISPR gRNA sequence
acagtaggtgttccatgtaa

SEQ ID NO: 296830 - DNA, 20 bp, Artificial
  CRISPR gRNA sequence
tgttccatgtaagagctgaa

SEQ ID NO: 296831 - DNA, 20 bp, Artificial
  CRISPR gRNA sequence
ccatgtaagagctgaacagc

SEQ ID NO: 296832 - DNA, 20 bp, Artificial
  CRISPR gRNA sequence
attgctgtctccctcccttc

SEQ ID NO: 296833 - DNA, 20 bp, Artificial
  CRISPR gRNA sequence
tctccctcccttccagccaa

SEQ ID NO: 296834 - DNA, 20 bp, Artificial
  CRISPR gRNA sequence
cccttccagccaatagattt

SEQ ID NO: 296835 - DNA, 20 bp, Artificial
  CRISPR gRNA sequence
cttccagccaatagatttca

SEQ ID NO: 296836 - DNA, 20 bp, Artificial
  CRISPR gRNA sequence
agccaatagatttcagagtt

SEQ ID NO: 296837 - DNA, 20 bp, Artificial
  CRISPR gRNA sequence
gccaatagatttcagagttt

SEQ ID NO: 296838 - DNA, 20 bp, Artificial
  CRISPR gRNA sequence
gagtttgggcattacctatt

SEQ ID NO: 296839 - DNA, 20 bp, Artificial
  CRISPR gRNA sequence
gggcattacctattgagcca

SEQ ID NO: 296840 - DNA, 20 bp, Artificial
  CRISPR gRNA sequence
agccaaagctgacaccacac

SEQ ID NO: 296841 - DNA, 20 bp, Artificial
  CRISPR gRNA sequence
aagctgacaccacacaagcg

SEQ ID NO: 296842 - DNA, 20 bp, Artificial
  CRISPR gRNA sequence
gctgacaccacacaagcgca

SEQ ID NO: 296843 - DNA, 20 bp, Artificial
  CRISPR gRNA sequence
caccacacaagcgcagagta

SEQ ID NO: 296844 - DNA, 20 bp, Artificial
  CRISPR gRNA sequence
accacacaagcgcagagtat

SEQ ID NO: 296845 - DNA, 20 bp, Artificial
  CRISPR gRNA sequence
acaagcgcagagtatgggaa

SEQ ID NO: 296846 - DNA, 20 bp, Artificial
  CRISPR gRNA sequence
aagcgcagagtatgggaaca

SEQ ID NO: 296847 - DNA, 20 bp, Artificial
  CRISPR gRNA sequence
gttctctgtctgattcctgt

SEQ ID NO: 296848 - DNA, 20 bp, Artificial
  CRISPR gRNA sequence
tcctcatactaaatcaccaa

SEQ ID NO: 296849 - DNA, 20 bp, Artificial
  CRISPR gRNA sequence
caacagcaacctacttatca

SEQ ID NO: 296850 - DNA, 20 bp, Artificial
  CRISPR gRNA sequence
acctacttatcacagaatat

SEQ ID NO: 296851 - DNA, 20 bp, Artificial
  CRISPR gRNA sequence
acagaatatgagaattgaac

SEQ ID NO: 296852 - DNA, 20 bp, Artificial
  CRISPR gRNA sequence
tatgagaattgaacaagtgt

SEQ ID NO: 296853 - DNA, 20 bp, Artificial
  CRISPR gRNA sequence
agaattgaacaagtgttggc

SEQ ID NO: 296854 - DNA, 20 bp, Artificial
  CRISPR gRNA sequence
gaattgaacaagtgttggca

SEQ ID NO: 296855 - DNA, 20 bp, Artificial
  CRISPR gRNA sequence
aacaagtgttggcaaggatg

SEQ ID NO: 296856 - DNA, 20 bp, Artificial
  CRISPR gRNA sequence
caagtgttggcaaggatgtg

SEQ ID NO: 296857 - DNA, 20 bp, Artificial
  CRISPR gRNA sequence
tggcaaggatgtggagaaat

SEQ ID NO: 296858 - DNA, 20 bp, Artificial
  CRISPR gRNA sequence
gcaaggatgtggagaaattg

SEQ ID NO: 296859 - DNA, 20 bp, Artificial
  CRISPR gRNA sequence
agaaattggagctcttgttc

SEQ ID NO: 296860 - DNA, 20 bp, Artificial
  CRISPR gRNA sequence
gctcttgttccagttgtcga

SEQ ID NO: 296861 - DNA, 20 bp, Artificial
  CRISPR gRNA sequence
ctcttgttccagttgtcgat

SEQ ID NO: 296862 - DNA, 20 bp, Artificial
  CRISPR gRNA sequence
cagttgtcgatgggaatgta

SEQ ID NO: 296863 - DNA, 20 bp, Artificial
  CRISPR gRNA sequence
gtaaagtgatgtcgctgcta

SEQ ID NO: 296864 - DNA, 20 bp, Artificial
  CRISPR gRNA sequence
gatgtcgctgctatggaaaa

SEQ ID NO: 296865 - DNA, 20 bp, Artificial
  CRISPR gRNA sequence
cgctgctatggaaaatagtg

SEQ ID NO: 296866 - DNA, 20 bp, Artificial
  CRISPR gRNA sequence
tgctatggaaaatagtgtag

SEQ ID NO: 296867 - DNA, 20 bp, Artificial
  CRISPR gRNA sequence
aaaatagtgtagcagttcct

SEQ ID NO: 296868 - DNA, 20 bp, Artificial
  CRISPR gRNA sequence
gttcctcagaaaattaaaaa

SEQ ID NO: 296869 - DNA, 20 bp, Artificial
  CRISPR gRNA sequence
aatagaatgaccacatgatc

SEQ ID NO: 296870 - DNA, 20 bp, Artificial
  CRISPR gRNA sequence
tgatctagcaattccccttc

SEQ ID NO: 296871 - DNA, 20 bp, Artificial
  CRISPR gRNA sequence
gatctagcaattccccttct

SEQ ID NO: 296872 - DNA, 20 bp, Artificial
  CRISPR gRNA sequence
ccttctgggtatatacccaa

SEQ ID NO: 296873 - DNA, 20 bp, Artificial
  CRISPR gRNA sequence
tatatacccaaaagaactga

SEQ ID NO: 296874 - DNA, 20 bp, Artificial
  CRISPR gRNA sequence
atacccaaaagaactgaaag

SEQ ID NO: 296875 - DNA, 20 bp, Artificial
  CRISPR gRNA sequence
acccaaaagaactgaaagca

SEQ ID NO: 296876 - DNA, 20 bp, Artificial
  CRISPR gRNA sequence
gaactgaaagcagagtctta

SEQ ID NO: 296877 - DNA, 20 bp, Artificial
  CRISPR gRNA sequence
actgaaagcagagtcttaaa

SEQ ID NO: 296878 - DNA, 20 bp, Artificial
  CRISPR gRNA sequence
gtcttaaagagatattcata

SEQ ID NO: 296879 - DNA, 20 bp, Artificial
  CRISPR gRNA sequence
tcatacagccttgttcatac

SEQ ID NO: 296880 - DNA, 20 bp, Artificial
  CRISPR gRNA sequence
cataccagcattatgcacaa

SEQ ID NO: 296881 - DNA, 20 bp, Artificial
  CRISPR gRNA sequence
gcattatgcacaatagccaa

SEQ ID NO: 296882 - DNA, 20 bp, Artificial
  CRISPR gRNA sequence
cattatgcacaatagccaaa

SEQ ID NO: 296883 - DNA, 20 bp, Artificial
  CRISPR gRNA sequence
tatgcacaatagccaaaagg

SEQ ID NO: 296884 - DNA, 20 bp, Artificial
  CRISPR gRNA sequence
gcacaatagccaaaaggtgg

SEQ ID NO: 296885 - DNA, 20 bp, Artificial
  CRISPR gRNA sequence
aaatgtccatcaaaaatgaa

SEQ ID NO: 296886 - DNA, 20 bp, Artificial
  CRISPR gRNA sequence
atgaatggataaacaaaatg

SEQ ID NO: 296887 - DNA, 20 bp, Artificial
  CRISPR gRNA sequence
caaaatgtagtatgtacata

SEQ ID NO: 296888 - DNA, 20 bp, Artificial
  CRISPR gRNA sequence
aatgtagtatgtacatacag

SEQ ID NO: 296889 - DNA, 20 bp, Artificial
  CRISPR gRNA sequence
acatacagtggaatatcatt

SEQ ID NO: 296890 - DNA, 20 bp, Artificial
  CRISPR gRNA sequence
agtggaatatcatttagtct

SEQ ID NO: 296891 - DNA, 20 bp, Artificial
  CRISPR gRNA sequence
gaatatcatttagtcttaga

SEQ ID NO: 296892 - DNA, 20 bp, Artificial
  CRISPR gRNA sequence
atcatttagtcttagaaaga

SEQ ID NO: 296893 - DNA, 20 bp, Artificial
  CRISPR gRNA sequence
tcatttagtcttagaaagaa

SEQ ID NO: 296894 - DNA, 20 bp, Artificial
  CRISPR gRNA sequence
ttcaaacacatgctacaatg

SEQ ID NO: 296895 - DNA, 20 bp, Artificial
  CRISPR gRNA sequence
aacacatgctacaatgtgga

SEQ ID NO: 296896 - DNA, 20 bp, Artificial
  CRISPR gRNA sequence
gcccttgaatacattatact

SEQ ID NO: 296897 - DNA, 20 bp, Artificial
  CRISPR gRNA sequence
tacattatactaagtgaaat

SEQ ID NO: 296898 - DNA, 20 bp, Artificial
  CRISPR gRNA sequence
ttatactaagtgaaataagc

SEQ ID NO: 296899 - DNA, 20 bp, Artificial
  CRISPR gRNA sequence
tgaaataagccagtcacaaa

SEQ ID NO: 296900 - DNA, 20 bp, Artificial
  CRISPR gRNA sequence
caaaaagacaaatactgtat

SEQ ID NO: 296901 - DNA, 20 bp, Artificial
  CRISPR gRNA sequence
tatgagtttacttataccct

SEQ ID NO: 296902 - DNA, 20 bp, Artificial
  CRISPR gRNA sequence
gagtttacttataccctaag

SEQ ID NO: 296903 - DNA, 20 bp, Artificial
  CRISPR gRNA sequence
accctaagcagtcaaattca

SEQ ID NO: 296904 - DNA, 20 bp, Artificial
  CRISPR gRNA sequence
agcagtcaaattcatggaaa

SEQ ID NO: 296905 - DNA, 20 bp, Artificial
  CRISPR gRNA sequence
agtcaaattcatggaaacag

SEQ ID NO: 296906 - DNA, 20 bp, Artificial
  CRISPR gRNA sequence
gtcaaattcatggaaacaga

SEQ ID NO: 296907 - DNA, 20 bp, Artificial
  CRISPR gRNA sequence
aaattcatggaaacagaagg

SEQ ID NO: 296908 - DNA, 20 bp, Artificial
  CRISPR gRNA sequence
catggaaacagaaggtggaa

SEQ ID NO: 296909 - DNA, 20 bp, Artificial
  CRISPR gRNA sequence
ggaaacagaaggtggaatgg

SEQ ID NO: 296910 - DNA, 20 bp, Artificial
  CRISPR gRNA sequence
acagaaggtggaatggtggt

SEQ ID NO: 296911 - DNA, 20 bp, Artificial
  CRISPR gRNA sequence
aaggtggaatggtggttggc

SEQ ID NO: 296912 - DNA, 20 bp, Artificial
  CRISPR gRNA sequence
ggtggaatggtggttggcaa

SEQ ID NO: 296913 - DNA, 20 bp, Artificial
  CRISPR gRNA sequence
aatggtggttggcaagagct

SEQ ID NO: 296914 - DNA, 20 bp, Artificial
  CRISPR gRNA sequence
tggtggttggcaagagctga

SEQ ID NO: 296915 - DNA, 20 bp, Artificial
  CRISPR gRNA sequence
ggtggttggcaagagctgag

SEQ ID NO: 296916 - DNA, 20 bp, Artificial
  CRISPR gRNA sequence
tggttggcaagagctgagag

SEQ ID NO: 296917 - DNA, 20 bp, Artificial
  CRISPR gRNA sequence
ggttggcaagagctgagagg

SEQ ID NO: 296918 - DNA, 20 bp, Artificial
  CRISPR gRNA sequence
ttggcaagagctgagaggag

SEQ ID NO: 296919 - DNA, 20 bp, Artificial
  CRISPR gRNA sequence
ggcaagagctgagaggagga

SEQ ID NO: 296920 - DNA, 20 bp, Artificial
  CRISPR gRNA sequence
agagctgagaggaggagaga

SEQ ID NO: 296921 - DNA, 20 bp, Artificial
  CRISPR gRNA sequence
gctgagaggaggagagaaag

SEQ ID NO: 296922 - DNA, 20 bp, Artificial
  CRISPR gRNA sequence
tgagaggaggagagaaagaa

SEQ ID NO: 296923 - DNA, 20 bp, Artificial
  CRISPR gRNA sequence
aaagaagagttattgtttaa

SEQ ID NO: 296924 - DNA, 20 bp, Artificial
  CRISPR gRNA sequence
aagaagagttattgtttaat

SEQ ID NO: 296925 - DNA, 20 bp, Artificial
  CRISPR gRNA sequence
gagttattgtttaataggta

SEQ ID NO: 296926 - DNA, 20 bp, Artificial
  CRISPR gRNA sequence
gttattgtttaataggtata

SEQ ID NO: 296927 - DNA, 20 bp, Artificial
  CRISPR gRNA sequence
ttattgtttaataggtatag

SEQ ID NO: 296928 - DNA, 20 bp, Artificial
  CRISPR gRNA sequence
gtttaataggtatagaggct

SEQ ID NO: 296929 - DNA, 20 bp, Artificial
  CRISPR gRNA sequence
gtatagaggcttagttttgc

SEQ ID NO: 296930 - DNA, 20 bp, Artificial
  CRISPR gRNA sequence
ggcttagttttgcaagatga

SEQ ID NO: 296931 - DNA, 20 bp, Artificial
  CRISPR gRNA sequence
cttagttttgcaagatgaaa

SEQ ID NO: 296932 - DNA, 20 bp, Artificial
  CRISPR gRNA sequence
tgcaagatgaaagagttctg

SEQ ID NO: 296933 - DNA, 20 bp, Artificial
  CRISPR gRNA sequence
agatgaaagagttctgaaga

SEQ ID NO: 296934 - DNA, 20 bp, Artificial
  CRISPR gRNA sequence
aagagttctgaagatggatg

SEQ ID NO: 296935 - DNA, 20 bp, Artificial
  CRISPR gRNA sequence
tcataccactgtacactcaa

SEQ ID NO: 296936 - DNA, 20 bp, Artificial
  CRISPR gRNA sequence
cataccactgtacactcaaa

SEQ ID NO: 296937 - DNA, 20 bp, Artificial
  CRISPR gRNA sequence
cactgtacactcaaaaggtg

SEQ ID NO: 296938 - DNA, 20 bp, Artificial
  CRISPR gRNA sequence
gtacactcaaaaggtgaaga

SEQ ID NO: 296939 - DNA, 20 bp, Artificial
  CRISPR gRNA sequence
gtattatgccacaactaata

SEQ ID NO: 296940 - DNA, 20 bp, Artificial
  CRISPR gRNA sequence
taaagatttctaaaacttat

SEQ ID NO: 296941 - DNA, 20 bp, Artificial
  CRISPR gRNA sequence
ttcaccgtttcctattgcta

SEQ ID NO: 296942 - DNA, 20 bp, Artificial
  CRISPR gRNA sequence
tattgctaaagatcacaaat

SEQ ID NO: 296943 - DNA, 20 bp, Artificial
  CRISPR gRNA sequence
tcacaaattagaaaacacgt

SEQ ID NO: 296944 - DNA, 20 bp, Artificial
  CRISPR gRNA sequence
attagaaaacacgttggcaa

SEQ ID NO: 296945 - DNA, 20 bp, Artificial
  CRISPR gRNA sequence
ttagaaaacacgttggcaaa

SEQ ID NO: 296946 - DNA, 20 bp, Artificial
  CRISPR gRNA sequence
ggcaaaaggtacatgaaaat

SEQ ID NO: 296947 - DNA, 20 bp, Artificial
  CRISPR gRNA sequence
ataagcactcttgtgttgat

SEQ ID NO: 296948 - DNA, 20 bp, Artificial
  CRISPR gRNA sequence
aagcactcttgtgttgatca

SEQ ID NO: 296949 - DNA, 20 bp, Artificial
  CRISPR gRNA sequence
tataatctcataaactaata

SEQ ID NO: 296950 - DNA, 20 bp, Artificial
  CRISPR gRNA sequence
ataaagatttctaaataaca

SEQ ID NO: 296951 - DNA, 20 bp, Artificial
  CRISPR gRNA sequence
caaagatttctaaaacttat

SEQ ID NO: 296952 - DNA, 20 bp, Artificial
  CRISPR gRNA sequence
ttcaccatttcctattgcta

SEQ ID NO: 296953 - DNA, 20 bp, Artificial
  CRISPR gRNA sequence
tattgctaaagatcacaaat

SEQ ID NO: 296954 - DNA, 20 bp, Artificial
  CRISPR gRNA sequence
tcacaaattagaaaacatgt

SEQ ID NO: 296955 - DNA, 20 bp, Artificial
  CRISPR gRNA sequence
attagaaaacatgttggcaa

SEQ ID NO: 296956 - DNA, 20 bp, Artificial
  CRISPR gRNA sequence
ttagaaaacatgttggcaaa

SEQ ID NO: 296957 - DNA, 20 bp, Artificial
  CRISPR gRNA sequence
ggcaaaaggtacatgaaaat

SEQ ID NO: 296958 - DNA, 20 bp, Artificial
  CRISPR gRNA sequence
ataagcactcttgtgttgat

SEQ ID NO: 296959 - DNA, 20 bp, Artificial
  CRISPR gRNA sequence
aagcactcttgtgttgatca

SEQ ID NO: 296960 - DNA, 20 bp, Artificial
  CRISPR gRNA sequence
agagcataaacgtataatct

SEQ ID NO: 296961 - DNA, 20 bp, Artificial
  CRISPR gRNA sequence
gagcataaacgtataatctc

SEQ ID NO: 296962 - DNA, 20 bp, Artificial
  CRISPR gRNA sequence
agcataaacgtataatctca

SEQ ID NO: 296963 - DNA, 20 bp, Artificial
  CRISPR gRNA sequence
gcataaacgtataatctcag

SEQ ID NO: 296964 - DNA, 20 bp, Artificial
  CRISPR gRNA sequence
ataaacgtataatctcaggg

SEQ ID NO: 296965 - DNA, 20 bp, Artificial
  CRISPR gRNA sequence
gcaactattcttcaaccctt

SEQ ID NO: 296966 - DNA, 20 bp, Artificial
  CRISPR gRNA sequence
tggtcaaacgattctgcttc

SEQ ID NO: 296967 - DNA, 20 bp, Artificial
  CRISPR gRNA sequence
ggtcaaacgattctgcttct

SEQ ID NO: 296968 - DNA, 20 bp, Artificial
  CRISPR gRNA sequence
cgattctgcttctaggaata

SEQ ID NO: 296969 - DNA, 20 bp, Artificial
  CRISPR gRNA sequence
ttactcccacctgtgtgata

SEQ ID NO: 296970 - DNA, 20 bp, Artificial
  CRISPR gRNA sequence
gtgtgatatggcatataatc

SEQ ID NO: 296971 - DNA, 20 bp, Artificial
  CRISPR gRNA sequence
tgtgatatggcatataatca

SEQ ID NO: 296972 - DNA, 20 bp, Artificial
  CRISPR gRNA sequence
aaggttttccattgcaacaa

SEQ ID NO: 296973 - DNA, 20 bp, Artificial
  CRISPR gRNA sequence
tttccattgcaacaaaagat

SEQ ID NO: 296974 - DNA, 20 bp, Artificial
  CRISPR gRNA sequence
aaaagattggaaacaacgtt

SEQ ID NO: 296975 - DNA, 20 bp, Artificial
  CRISPR gRNA sequence
caacgttaagtatccatcac

SEQ ID NO: 296976 - DNA, 20 bp, Artificial
  CRISPR gRNA sequence
cgttaagtatccatcactag

SEQ ID NO: 296977 - DNA, 20 bp, Artificial
  CRISPR gRNA sequence
agtatccatcactagtggtc

SEQ ID NO: 296978 - DNA, 20 bp, Artificial
  CRISPR gRNA sequence
tatatattattgtcatccaa

SEQ ID NO: 296979 - DNA, 20 bp, Artificial
  CRISPR gRNA sequence
tgtcatccaatagaatacaa

SEQ ID NO: 296980 - DNA, 20 bp, Artificial
  CRISPR gRNA sequence
atagactaatatgcaacttt

SEQ ID NO: 296981 - DNA, 20 bp, Artificial
  CRISPR gRNA sequence
taatatgcaacttttagcat

SEQ ID NO: 296982 - DNA, 20 bp, Artificial
  CRISPR gRNA sequence
aatatgcaacttttagcatg

SEQ ID NO: 296983 - DNA, 20 bp, Artificial
  CRISPR gRNA sequence
atactcgttacatgctgata

SEQ ID NO: 296984 - DNA, 20 bp, Artificial
  CRISPR gRNA sequence
gctgatacagaataatctcc

SEQ ID NO: 296985 - DNA, 20 bp, Artificial
  CRISPR gRNA sequence
ctgatacagaataatctcca

SEQ ID NO: 296986 - DNA, 20 bp, Artificial
  CRISPR gRNA sequence
atacagaataatctccaagg

SEQ ID NO: 296987 - DNA, 20 bp, Artificial
  CRISPR gRNA sequence
tatgtgtgcaaaaccgtaca

SEQ ID NO: 296988 - DNA, 20 bp, Artificial
  CRISPR gRNA sequence
catttgtgcttaaaaataaa

SEQ ID NO: 296989 - DNA, 20 bp, Artificial
  CRISPR gRNA sequence
gcttaaaaataaaaagaaaa

SEQ ID NO: 296990 - DNA, 20 bp, Artificial
  CRISPR gRNA sequence
aataaaaagaaaacagaata

SEQ ID NO: 296991 - DNA, 20 bp, Artificial
  CRISPR gRNA sequence
ataaaaagaaaacagaatat

SEQ ID NO: 296992 - DNA, 20 bp, Artificial
  CRISPR gRNA sequence
tatgggtcaatgtttttgtt

SEQ ID NO: 296993 - DNA, 20 bp, Artificial
  CRISPR gRNA sequence
tttttgtttagttttgtcta

SEQ ID NO: 296994 - DNA, 20 bp, Artificial
  CRISPR gRNA sequence
gttttgtctaaagtaacttt

SEQ ID NO: 296995 - DNA, 20 bp, Artificial
  CRISPR gRNA sequence
ttgtctaaagtaactttaag

SEQ ID NO: 296996 - DNA, 20 bp, Artificial
  CRISPR gRNA sequence
gtctaaagtaactttaagta

SEQ ID NO: 296997 - DNA, 20 bp, Artificial
  CRISPR gRNA sequence
tctaaagtaactttaagtag

SEQ ID NO: 296998 - DNA, 20 bp, Artificial
  CRISPR gRNA sequence
aagtaactttaagtagaggc

SEQ ID NO: 296999 - DNA, 20 bp, Artificial
  CRISPR gRNA sequence
tttaagtagaggcaagaaac

SEQ ID NO: 297000 - DNA, 20 bp, Artificial
  CRISPR gRNA sequence
aagaaactggtaacatgtaa

SEQ ID NO: 297001 - DNA, 20 bp, Artificial
  CRISPR gRNA sequence
gatcacccctgttacctctg

SEQ ID NO: 297002 - DNA, 20 bp, Artificial
  CRISPR gRNA sequence
cacccctgttacctctgtgg

SEQ ID NO: 297003 - DNA, 20 bp, Artificial
  CRISPR gRNA sequence
ttacctctgtggaagaaaac

SEQ ID NO: 297004 - DNA, 20 bp, Artificial
  CRISPR gRNA sequence
ctctgtggaagaaaactaga

SEQ ID NO: 297005 - DNA, 20 bp, Artificial
  CRISPR gRNA sequence
tggaagaaaactagacagct

SEQ ID NO: 297006 - DNA, 20 bp, Artificial
  CRISPR gRNA sequence
ggaagaaaactagacagcta

SEQ ID NO: 297007 - DNA, 20 bp, Artificial
  CRISPR gRNA sequence
gaagaaaactagacagctaa

SEQ ID NO: 297008 - DNA, 20 bp, Artificial
  CRISPR gRNA sequence
aaactagacagctaagggac

SEQ ID NO: 297009 - DNA, 20 bp, Artificial
  CRISPR gRNA sequence
aactagacagctaagggaca

SEQ ID NO: 297010 - DNA, 20 bp, Artificial
  CRISPR gRNA sequence
agacagctaagggacaaggc

SEQ ID NO: 297011 - DNA, 20 bp, Artificial
  CRISPR gRNA sequence
gacagctaagggacaaggct

SEQ ID NO: 297012 - DNA, 20 bp, Artificial
  CRISPR gRNA sequence
cagctaagggacaaggctgg

SEQ ID NO: 297013 - DNA, 20 bp, Artificial
  CRISPR gRNA sequence
agctaagggacaaggctggg

SEQ ID NO: 297014 - DNA, 20 bp, Artificial
  CRISPR gRNA sequence
taagggacaaggctgggagg

SEQ ID NO: 297015 - DNA, 20 bp, Artificial
  CRISPR gRNA sequence
tcacctttatctttcaaatt

SEQ ID NO: 297016 - DNA, 20 bp, Artificial
  CRISPR gRNA sequence
aatttagtaccatctacatt

SEQ ID NO: 297017 - DNA, 20 bp, Artificial
  CRISPR gRNA sequence
tcaaaaatatttattaaaaa

SEQ ID NO: 297018 - DNA, 20 bp, Artificial
  CRISPR gRNA sequence
aatatttattaaaaaaagaa

SEQ ID NO: 297019 - DNA, 20 bp, Artificial
  CRISPR gRNA sequence
atatttattaaaaaaagaaa

SEQ ID NO: 297020 - DNA, 20 bp, Artificial
  CRISPR gRNA sequence
tattaaaaaaagaaaaggta

SEQ ID NO: 297021 - DNA, 20 bp, Artificial
  CRISPR gRNA sequence
aaaaaagaaaaggtatagtc

SEQ ID NO: 297022 - DNA, 20 bp, Artificial
  CRISPR gRNA sequence
aaagaaaaggtatagtctag

SEQ ID NO: 297023 - DNA, 20 bp, Artificial
  CRISPR gRNA sequence
aagaaaaggtatagtctaga

SEQ ID NO: 297024 - DNA, 20 bp, Artificial
  CRISPR gRNA sequence
tagaaggaaaaaaaacataa

SEQ ID NO: 297025 - DNA, 20 bp, Artificial
  CRISPR gRNA sequence
aaaaacataacagacacttc

SEQ ID NO: 297026 - DNA, 20 bp, Artificial
  CRISPR gRNA sequence
tctagcccaatgtcctgcac

SEQ ID NO: 297027 - DNA, 20 bp, Artificial
  CRISPR gRNA sequence
ctagcccaatgtcctgcact

SEQ ID NO: 297028 - DNA, 20 bp, Artificial
  CRISPR gRNA sequence
tgtcctgcactgggtgctat

SEQ ID NO: 297029 - DNA, 20 bp, Artificial
  CRISPR gRNA sequence
tcctgcactgggtgctatga

SEQ ID NO: 297030 - DNA, 20 bp, Artificial
  CRISPR gRNA sequence
tgcactgggtgctatgagag

SEQ ID NO: 297031 - DNA, 20 bp, Artificial
  CRISPR gRNA sequence
cactgggtgctatgagagca

SEQ ID NO: 297032 - DNA, 20 bp, Artificial
  CRISPR gRNA sequence
actgggtgctatgagagcag

SEQ ID NO: 297033 - DNA, 20 bp, Artificial
  CRISPR gRNA sequence
ggtgctatgagagcagagga

SEQ ID NO: 297034 - DNA, 20 bp, Artificial
  CRISPR gRNA sequence
gcagaggaaagaaacacata

SEQ ID NO: 297035 - DNA, 20 bp, Artificial
  CRISPR gRNA sequence
aaagaaacacatatggcttc

SEQ ID NO: 297036 - DNA, 20 bp, Artificial
  CRISPR gRNA sequence
ggcttctagacaacaccgtc

SEQ ID NO: 297037 - DNA, 20 bp, Artificial
  CRISPR gRNA sequence
gcttctagacaacaccgtct

SEQ ID NO: 297038 - DNA, 20 bp, Artificial
  CRISPR gRNA sequence
cttctagacaacaccgtctg

SEQ ID NO: 297039 - DNA, 20 bp, Artificial
  CRISPR gRNA sequence
tacatttctgctattcgatc

SEQ ID NO: 297040 - DNA, 20 bp, Artificial
  CRISPR gRNA sequence
ttctgctattcgatcaagaa

SEQ ID NO: 297041 - DNA, 20 bp, Artificial
  CRISPR gRNA sequence
aatagttgtgcatcttttcc

SEQ ID NO: 297042 - DNA, 20 bp, Artificial
  CRISPR gRNA sequence
gttgtgcatcttttcctgga

SEQ ID NO: 297043 - DNA, 20 bp, Artificial
  CRISPR gRNA sequence
aattgatttgtttttatcaa

SEQ ID NO: 297044 - DNA, 20 bp, Artificial
  CRISPR gRNA sequence
tatcaacagacctatgaatt

SEQ ID NO: 297045 - DNA, 20 bp, Artificial
  CRISPR gRNA sequence
caacagacctatgaatttag

SEQ ID NO: 297046 - DNA, 20 bp, Artificial
  CRISPR gRNA sequence
agacctatgaatttagtgga

SEQ ID NO: 297047 - DNA, 20 bp, Artificial
  CRISPR gRNA sequence
agacctgtgaattaattcac

SEQ ID NO: 297048 - DNA, 20 bp, Artificial
  CRISPR gRNA sequence
ctgtgaattaattcactggt

SEQ ID NO: 297049 - DNA, 20 bp, Artificial
  CRISPR gRNA sequence
tgtgaattaattcactggtt

SEQ ID NO: 297050 - DNA, 20 bp, Artificial
  CRISPR gRNA sequence
ttaggttttcctttttacat

SEQ ID NO: 297051 - DNA, 20 bp, Artificial
  CRISPR gRNA sequence
tttttacattggctgttaaa

SEQ ID NO: 297052 - DNA, 20 bp, Artificial
  CRISPR gRNA sequence
attggctgttaaaaagctat

SEQ ID NO: 297053 - DNA, 20 bp, Artificial
  CRISPR gRNA sequence
agccaaatttatgtccccct

SEQ ID NO: 297054 - DNA, 20 bp, Artificial
  CRISPR gRNA sequence
atgtccccctcagtgcaaat

SEQ ID NO: 297055 - DNA, 20 bp, Artificial
  CRISPR gRNA sequence
tgtccccctcagtgcaaatt

SEQ ID NO: 297056 - DNA, 20 bp, Artificial
  CRISPR gRNA sequence
ccccctcagtgcaaattggg

SEQ ID NO: 297057 - DNA, 20 bp, Artificial
  CRISPR gRNA sequence
gtgcaaattgggcagatttc

SEQ ID NO: 297058 - DNA, 20 bp, Artificial
  CRISPR gRNA sequence
tgcaaattgggcagatttct

SEQ ID NO: 297059 - DNA, 20 bp, Artificial
  CRISPR gRNA sequence
gcaaattgggcagatttcta

SEQ ID NO: 297060 - DNA, 20 bp, Artificial
  CRISPR gRNA sequence
attgggcagatttctagggc

SEQ ID NO: 297061 - DNA, 20 bp, Artificial
  CRISPR gRNA sequence
agatttctagggcaagcatt

SEQ ID NO: 297062 - DNA, 20 bp, Artificial
  CRISPR gRNA sequence
ctagggcaagcatttagcac

SEQ ID NO: 297063 - DNA, 20 bp, Artificial
  CRISPR gRNA sequence
tttagcactggccttgtcct

SEQ ID NO: 297064 - DNA, 20 bp, Artificial
  CRISPR gRNA sequence
ctgtatcatattcctgtatt

SEQ ID NO: 297065 - DNA, 20 bp, Artificial
  CRISPR gRNA sequence
tttccacctgtttctcatgt

SEQ ID NO: 297066 - DNA, 20 bp, Artificial
  CRISPR gRNA sequence
ttggtcatctttcctgtgta

SEQ ID NO: 297067 - DNA, 20 bp, Artificial
  CRISPR gRNA sequence
tgcctgatcgcatctaatgt

SEQ ID NO: 297068 - DNA, 20 bp, Artificial
  CRISPR gRNA sequence
cttattctttgcttccttat

SEQ ID NO: 297069 - DNA, 20 bp, Artificial
  CRISPR gRNA sequence
ttgcttccttataagccact

SEQ ID NO: 297070 - DNA, 20 bp, Artificial
  CRISPR gRNA sequence
cttccttataagccactaag

SEQ ID NO: 297071 - DNA, 20 bp, Artificial
  CRISPR gRNA sequence
aagccactaagcagcctttt

SEQ ID NO: 297072 - DNA, 20 bp, Artificial
  CRISPR gRNA sequence
ctaagcagcctttttggtgc

SEQ ID NO: 297073 - DNA, 20 bp, Artificial
  CRISPR gRNA sequence
gcagcctttttggtgctagt

SEQ ID NO: 297074 - DNA, 20 bp, Artificial
  CRISPR gRNA sequence
cagcctttttggtgctagtt

SEQ ID NO: 297075 - DNA, 20 bp, Artificial
  CRISPR gRNA sequence
agcctttttggtgctagtta

SEQ ID NO: 297076 - DNA, 20 bp, Artificial
  CRISPR gRNA sequence
tttttggtgctagttagggt

SEQ ID NO: 297077 - DNA, 20 bp, Artificial
  CRISPR gRNA sequence
tgctagttagggtaagtgcg

SEQ ID NO: 297078 - DNA, 20 bp, Artificial
  CRISPR gRNA sequence
gctagttagggtaagtgcgt

SEQ ID NO: 297079 - DNA, 20 bp, Artificial
  CRISPR gRNA sequence
agttagggtaagtgcgtggg

SEQ ID NO: 297080 - DNA, 20 bp, Artificial
  CRISPR gRNA sequence
gggtaagtgcgtgggtagtg

SEQ ID NO: 297081 - DNA, 20 bp, Artificial
  CRISPR gRNA sequence
ggtaagtgcgtgggtagtga

SEQ ID NO: 297082 - DNA, 20 bp, Artificial
  CRISPR gRNA sequence
taagtgcgtgggtagtgaag

SEQ ID NO: 297083 - DNA, 20 bp, Artificial
  CRISPR gRNA sequence
aagtgcgtgggtagtgaagg

SEQ ID NO: 297084 - DNA, 20 bp, Artificial
  CRISPR gRNA sequence
agtgcgtgggtagtgaagga

SEQ ID NO: 297085 - DNA, 20 bp, Artificial
  CRISPR gRNA sequence
tgcgtgggtagtgaaggagg

SEQ ID NO: 297086 - DNA, 20 bp, Artificial
  CRISPR gRNA sequence
gcgtgggtagtgaaggaggg

SEQ ID NO: 297087 - DNA, 20 bp, Artificial
  CRISPR gRNA sequence
gtgggtagtgaaggagggag

SEQ ID NO: 297088 - DNA, 20 bp, Artificial
  CRISPR gRNA sequence
tgggtagtgaaggagggagg

SEQ ID NO: 297089 - DNA, 20 bp, Artificial
  CRISPR gRNA sequence
gggtagtgaaggagggagga

SEQ ID NO: 297090 - DNA, 20 bp, Artificial
  CRISPR gRNA sequence
gtagtgaaggagggaggagg

SEQ ID NO: 297091 - DNA, 20 bp, Artificial
  CRISPR gRNA sequence
agtgaaggagggaggaggga

SEQ ID NO: 297092 - DNA, 20 bp, Artificial
  CRISPR gRNA sequence
gtgaaggagggaggagggag

SEQ ID NO: 297093 - DNA, 20 bp, Artificial
  CRISPR gRNA sequence
aaggagggaggagggagagg

SEQ ID NO: 297094 - DNA, 20 bp, Artificial
  CRISPR gRNA sequence
agggaggagggagaggaaga

SEQ ID NO: 297095 - DNA, 20 bp, Artificial
  CRISPR gRNA sequence
gaggagggagaggaagaaag

SEQ ID NO: 297096 - DNA, 20 bp, Artificial
  CRISPR gRNA sequence
agggagaggaagaaagaaga

SEQ ID NO: 297097 - DNA, 20 bp, Artificial
  CRISPR gRNA sequence
ggagaggaagaaagaagata

SEQ ID NO: 297098 - DNA, 20 bp, Artificial
  CRISPR gRNA sequence
gagaggaagaaagaagatag

SEQ ID NO: 297099 - DNA, 20 bp, Artificial
  CRISPR gRNA sequence
gaaagaagatagaggttata

SEQ ID NO: 297100 - DNA, 20 bp, Artificial
  CRISPR gRNA sequence
aagatagaggttataaagca

SEQ ID NO: 297101 - DNA, 20 bp, Artificial
  CRISPR gRNA sequence
gcaaagcatatcctttttct

SEQ ID NO: 297102 - DNA, 20 bp, Artificial
  CRISPR gRNA sequence
tttttcttggcttcatcatg

SEQ ID NO: 297103 - DNA, 20 bp, Artificial
  CRISPR gRNA sequence
ttggcttcatcatgtagatt

SEQ ID NO: 297104 - DNA, 20 bp, Artificial
  CRISPR gRNA sequence
gattaagtgaattgctctca

SEQ ID NO: 297105 - DNA, 20 bp, Artificial
  CRISPR gRNA sequence
agtgaattgctctcaaagcg

SEQ ID NO: 297106 - DNA, 20 bp, Artificial
  CRISPR gRNA sequence
tgctctcaaagcgtggtcct

SEQ ID NO: 297107 - DNA, 20 bp, Artificial
  CRISPR gRNA sequence
gctctcaaagcgtggtcctt

SEQ ID NO: 297108 - DNA, 20 bp, Artificial
  CRISPR gRNA sequence
tcaaagcgtggtccttaggc

SEQ ID NO: 297109 - DNA, 20 bp, Artificial
  CRISPR gRNA sequence
aagcgtggtccttaggccgg

SEQ ID NO: 297110 - DNA, 20 bp, Artificial
  CRISPR gRNA sequence
ttgttaaacataaaaattca

SEQ ID NO: 297111 - DNA, 20 bp, Artificial
  CRISPR gRNA sequence
tgttaaacataaaaattcat

SEQ ID NO: 297112 - DNA, 20 bp, Artificial
  CRISPR gRNA sequence
gggtttcatcccaacttact

SEQ ID NO: 297113 - DNA, 20 bp, Artificial
  CRISPR gRNA sequence
ttcatcccaacttactaagc

SEQ ID NO: 297114 - DNA, 20 bp, Artificial
  CRISPR gRNA sequence
ttactaagccagactttctg

SEQ ID NO: 297115 - DNA, 20 bp, Artificial
  CRISPR gRNA sequence
aagccagactttctgtggtt

SEQ ID NO: 297116 - DNA, 20 bp, Artificial
  CRISPR gRNA sequence
agccagactttctgtggttg

SEQ ID NO: 297117 - DNA, 20 bp, Artificial
  CRISPR gRNA sequence
gactttctgtggttgaggcc

SEQ ID NO: 297118 - DNA, 20 bp, Artificial
  CRISPR gRNA sequence
actttctgtggttgaggccc

SEQ ID NO: 297119 - DNA, 20 bp, Artificial
  CRISPR gRNA sequence
ttgaggcccaggaaactctc

SEQ ID NO: 297120 - DNA, 20 bp, Artificial
  CRISPR gRNA sequence
tgaggcccaggaaactctcc

SEQ ID NO: 297121 - DNA, 20 bp, Artificial
  CRISPR gRNA sequence
ggtgatttttactcacattc

SEQ ID NO: 297122 - DNA, 20 bp, Artificial
  CRISPR gRNA sequence
ttttactcacattcaagttt

SEQ ID NO: 297123 - DNA, 20 bp, Artificial
  CRISPR gRNA sequence
acattcaagtttgagaacca

SEQ ID NO: 297124 - DNA, 20 bp, Artificial
  CRISPR gRNA sequence
cattcaagtttgagaaccac

SEQ ID NO: 297125 - DNA, 20 bp, Artificial
  CRISPR gRNA sequence
tgagaaccacaggaaaacaa

SEQ ID NO: 297126 - DNA, 20 bp, Artificial
  CRISPR gRNA sequence
gagaaccacaggaaaacaaa

SEQ ID NO: 297127 - DNA, 20 bp, Artificial
  CRISPR gRNA sequence
aaccacaggaaaacaaaagg

SEQ ID NO: 297128 - DNA, 20 bp, Artificial
  CRISPR gRNA sequence
accacaggaaaacaaaagga

SEQ ID NO: 297129 - DNA, 20 bp, Artificial
  CRISPR gRNA sequence
acaggaaaacaaaaggaagg

SEQ ID NO: 297130 - DNA, 20 bp, Artificial
  CRISPR gRNA sequence
caaaaggaaggcagatttct

SEQ ID NO: 297131 - DNA, 20 bp, Artificial
  CRISPR gRNA sequence
ccccatcatgcctgttatgt

SEQ ID NO: 297132 - DNA, 20 bp, Artificial
  CRISPR gRNA sequence
tcatgcctgttatgttggtc

SEQ ID NO: 297133 - DNA, 20 bp, Artificial
  CRISPR gRNA sequence
ttggtcaagataaataatac

SEQ ID NO: 297134 - DNA, 20 bp, Artificial
  CRISPR gRNA sequence
gccaatatcacaatccattg

SEQ ID NO: 297135 - DNA, 20 bp, Artificial
  CRISPR gRNA sequence
tatcacaatccattgtagat

SEQ ID NO: 297136 - DNA, 20 bp, Artificial
  CRISPR gRNA sequence
aatccattgtagatcagttg

SEQ ID NO: 297137 - DNA, 20 bp, Artificial
  CRISPR gRNA sequence
atccattgtagatcagttgt

SEQ ID NO: 297138 - DNA, 20 bp, Artificial
  CRISPR gRNA sequence
ccattgtagatcagttgtgg

SEQ ID NO: 297139 - DNA, 20 bp, Artificial
  CRISPR gRNA sequence
attgtagatcagttgtggga

SEQ ID NO: 297140 - DNA, 20 bp, Artificial
  CRISPR gRNA sequence
ttgtagatcagttgtgggag

SEQ ID NO: 297141 - DNA, 20 bp, Artificial
  CRISPR gRNA sequence
tcagttgtgggagaggtgta

SEQ ID NO: 297142 - DNA, 20 bp, Artificial
  CRISPR gRNA sequence
agttgtgggagaggtgtaaa

SEQ ID NO: 297143 - DNA, 20 bp, Artificial
  CRISPR gRNA sequence
ttgtgggagaggtgtaaaga

SEQ ID NO: 297144 - DNA, 20 bp, Artificial
  CRISPR gRNA sequence
tgtaaagagagctgctttat

SEQ ID NO: 297145 - DNA, 20 bp, Artificial
  CRISPR gRNA sequence
agctgctttattagtttatt

SEQ ID NO: 297146 - DNA, 20 bp, Artificial
  CRISPR gRNA sequence
tattagtttattaagcaaac

SEQ ID NO: 297147 - DNA, 20 bp, Artificial
  CRISPR gRNA sequence
aaccagatctcttccattgt

SEQ ID NO: 297148 - DNA, 20 bp, Artificial
  CRISPR gRNA sequence
tgtgagactttgcgattttc

SEQ ID NO: 297149 - DNA, 20 bp, Artificial
  CRISPR gRNA sequence
gtgagactttgcgattttct

SEQ ID NO: 297150 - DNA, 20 bp, Artificial
  CRISPR gRNA sequence
tttgcgattttctaggccct

SEQ ID NO: 297151 - DNA, 20 bp, Artificial
  CRISPR gRNA sequence
aggcccttggacatttcctc

SEQ ID NO: 297152 - DNA, 20 bp, Artificial
  CRISPR gRNA sequence
cctctggatcccctgctgct

SEQ ID NO: 297153 - DNA, 20 bp, Artificial
  CRISPR gRNA sequence
ctggatcccctgctgctaag

SEQ ID NO: 297154 - DNA, 20 bp, Artificial
  CRISPR gRNA sequence
tggatcccctgctgctaaga

SEQ ID NO: 297155 - DNA, 20 bp, Artificial
  CRISPR gRNA sequence
atcccctgctgctaagaagg

SEQ ID NO: 297156 - DNA, 20 bp, Artificial
  CRISPR gRNA sequence
tcccctgctgctaagaaggc

SEQ ID NO: 297157 - DNA, 20 bp, Artificial
  CRISPR gRNA sequence
ccctgctgctaagaaggcag

SEQ ID NO: 297158 - DNA, 20 bp, Artificial
  CRISPR gRNA sequence
ctgctgctaagaaggcagga

SEQ ID NO: 297159 - DNA, 20 bp, Artificial
  CRISPR gRNA sequence
tgctgctaagaaggcaggag

SEQ ID NO: 297160 - DNA, 20 bp, Artificial
  CRISPR gRNA sequence
gctgctaagaaggcaggaga

SEQ ID NO: 297161 - DNA, 20 bp, Artificial
  CRISPR gRNA sequence
tgctaagaaggcaggagagg

SEQ ID NO: 297162 - DNA, 20 bp, Artificial
  CRISPR gRNA sequence
gctaagaaggcaggagaggg

SEQ ID NO: 297163 - DNA, 20 bp, Artificial
  CRISPR gRNA sequence
agaaggcaggagagggagga

SEQ ID NO: 297164 - DNA, 20 bp, Artificial
  CRISPR gRNA sequence
aaggcaggagagggaggaaa

SEQ ID NO: 297165 - DNA, 20 bp, Artificial
  CRISPR gRNA sequence
gcaggagagggaggaaagag

SEQ ID NO: 297166 - DNA, 20 bp, Artificial
  CRISPR gRNA sequence
aggagagggaggaaagagaa

SEQ ID NO: 297167 - DNA, 20 bp, Artificial
  CRISPR gRNA sequence
ggaggaaagagaagagactt

SEQ ID NO: 297168 - DNA, 20 bp, Artificial
  CRISPR gRNA sequence
ggaaagagaagagactttag

SEQ ID NO: 297169 - DNA, 20 bp, Artificial
  CRISPR gRNA sequence
agagaagagactttagcagc

SEQ ID NO: 297170 - DNA, 20 bp, Artificial
  CRISPR gRNA sequence
gagactttagcagccagatc

SEQ ID NO: 297171 - DNA, 20 bp, Artificial
  CRISPR gRNA sequence
actttagcagccagatctgg

SEQ ID NO: 297172 - DNA, 20 bp, Artificial
  CRISPR gRNA sequence
ttttctgcccacaattccat

SEQ ID NO: 297173 - DNA, 20 bp, Artificial
  CRISPR gRNA sequence
ctgcccacaattccattggc

SEQ ID NO: 297174 - DNA, 20 bp, Artificial
  CRISPR gRNA sequence
cccacaattccattggctag

SEQ ID NO: 297175 - DNA, 20 bp, Artificial
  CRISPR gRNA sequence
caattccattggctagaagc

SEQ ID NO: 297176 - DNA, 20 bp, Artificial
  CRISPR gRNA sequence
ttggctagaagccagtctca

SEQ ID NO: 297177 - DNA, 20 bp, Artificial
  CRISPR gRNA sequence
tctcatggcctgtataactg

SEQ ID NO: 297178 - DNA, 20 bp, Artificial
  CRISPR gRNA sequence
ctcatggcctgtataactgc

SEQ ID NO: 297179 - DNA, 20 bp, Artificial
  CRISPR gRNA sequence
tcatggcctgtataactgca

SEQ ID NO: 297180 - DNA, 20 bp, Artificial
  CRISPR gRNA sequence
catggcctgtataactgcag

SEQ ID NO: 297181 - DNA, 20 bp, Artificial
  CRISPR gRNA sequence
tggcctgtataactgcaggg

SEQ ID NO: 297182 - DNA, 20 bp, Artificial
  CRISPR gRNA sequence
ggcctgtataactgcagggg

SEQ ID NO: 297183 - DNA, 20 bp, Artificial
  CRISPR gRNA sequence
tgtataactgcaggggaggc

SEQ ID NO: 297184 - DNA, 20 bp, Artificial
  CRISPR gRNA sequence
gtataactgcaggggaggct

SEQ ID NO: 297185 - DNA, 20 bp, Artificial
  CRISPR gRNA sequence
tgggaaatgtgacctatcga

SEQ ID NO: 297186 - DNA, 20 bp, Artificial
  CRISPR gRNA sequence
ggaaatgtgacctatcgatg

SEQ ID NO: 297187 - DNA, 20 bp, Artificial
  CRISPR gRNA sequence
tgtgacctatcgatggagct

SEQ ID NO: 297188 - DNA, 20 bp, Artificial
  CRISPR gRNA sequence
tgacctatcgatggagctaa

SEQ ID NO: 297189 - DNA, 20 bp, Artificial
  CRISPR gRNA sequence
atcgatggagctaagagcaa

SEQ ID NO: 297190 - DNA, 20 bp, Artificial
  CRISPR gRNA sequence
tcgatggagctaagagcaaa

SEQ ID NO: 297191 - DNA, 20 bp, Artificial
  CRISPR gRNA sequence
gagctaagagcaaaaggaaa

SEQ ID NO: 297192 - DNA, 20 bp, Artificial
  CRISPR gRNA sequence
aaaaggaaatggctttgatg

SEQ ID NO: 297193 - DNA, 20 bp, Artificial
  CRISPR gRNA sequence
aaatggctttgatgaagccc

SEQ ID NO: 297194 - DNA, 20 bp, Artificial
  CRISPR gRNA sequence
ggcattgtctctgcacaccc

SEQ ID NO: 297195 - DNA, 20 bp, Artificial
  CRISPR gRNA sequence
ctctgcacacccgagaaccc

SEQ ID NO: 297196 - DNA, 20 bp, Artificial
  CRISPR gRNA sequence
tgaatcccaaactccacgtc

SEQ ID NO: 297197 - DNA, 20 bp, Artificial
  CRISPR gRNA sequence
gaatcccaaactccacgtcc

SEQ ID NO: 297198 - DNA, 20 bp, Artificial
  CRISPR gRNA sequence
tccacgtccaggtcatgttt

SEQ ID NO: 297199 - DNA, 20 bp, Artificial
  CRISPR gRNA sequence
ggtcatgttttggtgaacat

SEQ ID NO: 297200 - DNA, 20 bp, Artificial
  CRISPR gRNA sequence
ttttggtgaacatcggtttt

SEQ ID NO: 297201 - DNA, 20 bp, Artificial
  CRISPR gRNA sequence
ttcagtttccttttctaatc

SEQ ID NO: 297202 - DNA, 20 bp, Artificial
  CRISPR gRNA sequence
acctttttttttctcgactc

SEQ ID NO: 297203 - DNA, 20 bp, Artificial
  CRISPR gRNA sequence
ttttctcgactctagcacta

SEQ ID NO: 297204 - DNA, 20 bp, Artificial
  CRISPR gRNA sequence
tttctcgactctagcactat

SEQ ID NO: 297205 - DNA, 20 bp, Artificial
  CRISPR gRNA sequence
gactctagcactatgggact

SEQ ID NO: 297206 - DNA, 20 bp, Artificial
  CRISPR gRNA sequence
gagtaacattctctttgtga

SEQ ID NO: 297207 - DNA, 20 bp, Artificial
  CRISPR gRNA sequence
gtgatggccttcctgctctc

SEQ ID NO: 297208 - DNA, 20 bp, Artificial
  CRISPR gRNA sequence
tggccttcctgctctctggt

SEQ ID NO: 297209 - DNA, 20 bp, Artificial
  CRISPR gRNA sequence
gctctctggtaagaaccttt

SEQ ID NO: 297210 - DNA, 20 bp, Artificial
  CRISPR gRNA sequence
aagaacctttcagctttgtt

SEQ ID NO: 297211 - DNA, 20 bp, Artificial
  CRISPR gRNA sequence
ctttcagctttgttaagtcc

SEQ ID NO: 297212 - DNA, 20 bp, Artificial
  CRISPR gRNA sequence
gaatcctactgtctcctgat

SEQ ID NO: 297213 - DNA, 20 bp, Artificial
  CRISPR gRNA sequence
tctcctgatgagtctgacca

SEQ ID NO: 297214 - DNA, 20 bp, Artificial
  CRISPR gRNA sequence
ctgatgagtctgaccacagc

SEQ ID NO: 297215 - DNA, 20 bp, Artificial
  CRISPR gRNA sequence
gagtctgaccacagcaagcc

SEQ ID NO: 297216 - DNA, 20 bp, Artificial
  CRISPR gRNA sequence
agtctgaccacagcaagccc

SEQ ID NO: 297217 - DNA, 20 bp, Artificial
  CRISPR gRNA sequence
accacagcaagcccaggcct

SEQ ID NO: 297218 - DNA, 20 bp, Artificial
  CRISPR gRNA sequence
gcaagcccaggcctgagact

SEQ ID NO: 297219 - DNA, 20 bp, Artificial
  CRISPR gRNA sequence
agcccaggcctgagacttgg

SEQ ID NO: 297220 - DNA, 20 bp, Artificial
  CRISPR gRNA sequence
gcccaggcctgagacttggt

SEQ ID NO: 297221 - DNA, 20 bp, Artificial
  CRISPR gRNA sequence
ggttttactcactttctact

SEQ ID NO: 297222 - DNA, 20 bp, Artificial
  CRISPR gRNA sequence
ctttctactgagcattgtac

SEQ ID NO: 297223 - DNA, 20 bp, Artificial
  CRISPR gRNA sequence
gtacaagaccacatgcaaaa

SEQ ID NO: 297224 - DNA, 20 bp, Artificial
  CRISPR gRNA sequence
acatgcaaaaaagactttcc

SEQ ID NO: 297225 - DNA, 20 bp, Artificial
  CRISPR gRNA sequence
atgcaaaaaagactttcctg

SEQ ID NO: 297226 - DNA, 20 bp, Artificial
  CRISPR gRNA sequence
caaaaaagactttcctggag

SEQ ID NO: 297227 - DNA, 20 bp, Artificial
  CRISPR gRNA sequence
aaaagactttcctggagaag

SEQ ID NO: 297228 - DNA, 20 bp, Artificial
  CRISPR gRNA sequence
aaagactttcctggagaaga

SEQ ID NO: 297229 - DNA, 20 bp, Artificial
  CRISPR gRNA sequence
gactttcctggagaagaagg

SEQ ID NO: 297230 - DNA, 20 bp, Artificial
  CRISPR gRNA sequence
aagaaggaagtgttatgatt

SEQ ID NO: 297231 - DNA, 20 bp, Artificial
  CRISPR gRNA sequence
gaaggaagtgttatgattga

SEQ ID NO: 297232 - DNA, 20 bp, Artificial
  CRISPR gRNA sequence
ggaagtgttatgattgagag

SEQ ID NO: 297233 - DNA, 20 bp, Artificial
  CRISPR gRNA sequence
ttatgattgagagcagctga

SEQ ID NO: 297234 - DNA, 20 bp, Artificial
  CRISPR gRNA sequence
tgattgagagcagctgatgg

SEQ ID NO: 297235 - DNA, 20 bp, Artificial
  CRISPR gRNA sequence
gattgagagcagctgatggc

SEQ ID NO: 297236 - DNA, 20 bp, Artificial
  CRISPR gRNA sequence
tgagagcagctgatggcagg

SEQ ID NO: 297237 - DNA, 20 bp, Artificial
  CRISPR gRNA sequence
agcagctgatggcaggcagc

SEQ ID NO: 297238 - DNA, 20 bp, Artificial
  CRISPR gRNA sequence
gcagctgatggcaggcagct

SEQ ID NO: 297239 - DNA, 20 bp, Artificial
  CRISPR gRNA sequence
ctgatggcaggcagctggga

SEQ ID NO: 297240 - DNA, 20 bp, Artificial
  CRISPR gRNA sequence
gatggcaggcagctgggatg

SEQ ID NO: 297241 - DNA, 20 bp, Artificial
  CRISPR gRNA sequence
gtgtgcttcttcctcctctg

SEQ ID NO: 297242 - DNA, 20 bp, Artificial
  CRISPR gRNA sequence
cctcctctgcagtctcacat

SEQ ID NO: 297243 - DNA, 20 bp, Artificial
  CRISPR gRNA sequence
ctctgcagtctcacatcagt

SEQ ID NO: 297244 - DNA, 20 bp, Artificial
  CRISPR gRNA sequence
cagtctcacatcagtgagcc

SEQ ID NO: 297245 - DNA, 20 bp, Artificial
  CRISPR gRNA sequence
catcagtgagcctagatgct

SEQ ID NO: 297246 - DNA, 20 bp, Artificial
  CRISPR gRNA sequence
tcagtgagcctagatgctca

SEQ ID NO: 297247 - DNA, 20 bp, Artificial
  CRISPR gRNA sequence
gtgagcctagatgctcagag

SEQ ID NO: 297248 - DNA, 20 bp, Artificial
  CRISPR gRNA sequence
tgagcctagatgctcagagt

SEQ ID NO: 297249 - DNA, 20 bp, Artificial
  CRISPR gRNA sequence
gagcctagatgctcagagta

SEQ ID NO: 297250 - DNA, 20 bp, Artificial
  CRISPR gRNA sequence
cctagatgctcagagtaggg

SEQ ID NO: 297251 - DNA, 20 bp, Artificial
  CRISPR gRNA sequence
atgctcagagtagggtagcc

SEQ ID NO: 297252 - DNA, 20 bp, Artificial
  CRISPR gRNA sequence
gggtagcctggcccatccca

SEQ ID NO: 297253 - DNA, 20 bp, Artificial
  CRISPR gRNA sequence
ggtagcctggcccatcccat

SEQ ID NO: 297254 - DNA, 20 bp, Artificial
  CRISPR gRNA sequence
gtagcctggcccatcccatg

SEQ ID NO: 297255 - DNA, 20 bp, Artificial
  CRISPR gRNA sequence
cctggcccatcccatgggga

SEQ ID NO: 297256 - DNA, 20 bp, Artificial
  CRISPR gRNA sequence
ctggcccatcccatggggat

SEQ ID NO: 297257 - DNA, 20 bp, Artificial
  CRISPR gRNA sequence
tggcccatcccatggggatg

SEQ ID NO: 297258 - DNA, 20 bp, Artificial
  CRISPR gRNA sequence
ggcccatcccatggggatgg

SEQ ID NO: 297259 - DNA, 20 bp, Artificial
  CRISPR gRNA sequence
ccatcccatggggatggggg

SEQ ID NO: 297260 - DNA, 20 bp, Artificial
  CRISPR gRNA sequence
catcccatggggatggggga

SEQ ID NO: 297261 - DNA, 20 bp, Artificial
  CRISPR gRNA sequence
tgggggaaggctgctgcact

SEQ ID NO: 297262 - DNA, 20 bp, Artificial
  CRISPR gRNA sequence
gggggaaggctgctgcactg

SEQ ID NO: 297263 - DNA, 20 bp, Artificial
  CRISPR gRNA sequence
gctgctgcactgaggcccct

SEQ ID NO: 297264 - DNA, 20 bp, Artificial
  CRISPR gRNA sequence
gttccacacatattctcttc

SEQ ID NO: 297265 - DNA, 20 bp, Artificial
  CRISPR gRNA sequence
gaccctgtttctgtctttct

SEQ ID NO: 297266 - DNA, 20 bp, Artificial
  CRISPR gRNA sequence
accctgtttctgtctttctc

SEQ ID NO: 297267 - DNA, 20 bp, Artificial
  CRISPR gRNA sequence
ttctgtctttctcaggctcc

SEQ ID NO: 297268 - DNA, 20 bp, Artificial
  CRISPR gRNA sequence
tctgtctttctcaggctcct

SEQ ID NO: 297269 - DNA, 20 bp, Artificial
  CRISPR gRNA sequence
ggctcctaggaaacaactga

SEQ ID NO: 297270 - DNA, 20 bp, Artificial
  CRISPR gRNA sequence
aacaactgacagaattccaa

SEQ ID NO: 297271 - DNA, 20 bp, Artificial
  CRISPR gRNA sequence
tccaaaagtctcccttcatt

SEQ ID NO: 297272 - DNA, 20 bp, Artificial
  CRISPR gRNA sequence
caaaagtctcccttcattcg

SEQ ID NO: 297273 - DNA, 20 bp, Artificial
  CRISPR gRNA sequence
tctcccttcattcggagcac

SEQ ID NO: 297274 - DNA, 20 bp, Artificial
  CRISPR gRNA sequence
ctctctcactcccttcccta

SEQ ID NO: 297275 - DNA, 20 bp, Artificial
  CRISPR gRNA sequence
cagcccatgcacatacctca

SEQ ID NO: 297276 - DNA, 20 bp, Artificial
  CRISPR gRNA sequence
cacatacctcatggttgcca

SEQ ID NO: 297277 - DNA, 20 bp, Artificial
  CRISPR gRNA sequence
ccacggcttcctgacaacta

SEQ ID NO: 297278 - DNA, 20 bp, Artificial
  CRISPR gRNA sequence
tcctgacaactatggatgtt

SEQ ID NO: 297279 - DNA, 20 bp, Artificial
  CRISPR gRNA sequence
ggatgttcagctaattgtgt

SEQ ID NO: 297280 - DNA, 20 bp, Artificial
  CRISPR gRNA sequence
taattgtgtcagctgattta

SEQ ID NO: 297281 - DNA, 20 bp, Artificial
  CRISPR gRNA sequence
ttgtgtcagctgatttatag

SEQ ID NO: 297282 - DNA, 20 bp, Artificial
  CRISPR gRNA sequence
gtgtcagctgatttatagtg

SEQ ID NO: 297283 - DNA, 20 bp, Artificial
  CRISPR gRNA sequence
gatttatagtggagccaatg

SEQ ID NO: 297284 - DNA, 20 bp, Artificial
  CRISPR gRNA sequence
tagtggagccaatgaagctg

SEQ ID NO: 297285 - DNA, 20 bp, Artificial
  CRISPR gRNA sequence
agccaatgaagctgaagctt

SEQ ID NO: 297286 - DNA, 20 bp, Artificial
  CRISPR gRNA sequence
ccaatgaagctgaagcttca

SEQ ID NO: 297287 - DNA, 20 bp, Artificial
  CRISPR gRNA sequence
accctttctaaatccccctc

SEQ ID NO: 297288 - DNA, 20 bp, Artificial
  CRISPR gRNA sequence
atccccctcaagaccctgtg

SEQ ID NO: 297289 - DNA, 20 bp, Artificial
  CRISPR gRNA sequence
tccccctcaagaccctgtga

SEQ ID NO: 297290 - DNA, 20 bp, Artificial
  CRISPR gRNA sequence
ccccctcaagaccctgtgaa

SEQ ID NO: 297291 - DNA, 20 bp, Artificial
  CRISPR gRNA sequence
agaccctgtgaagggccccc

SEQ ID NO: 297292 - DNA, 20 bp, Artificial
  CRISPR gRNA sequence
ccctgtgaagggccccctag

SEQ ID NO: 297293 - DNA, 20 bp, Artificial
  CRISPR gRNA sequence
tgaagggccccctagcagtg

SEQ ID NO: 297294 - DNA, 20 bp, Artificial
  CRISPR gRNA sequence
tggtcacctgtcttatgctt

SEQ ID NO: 297295 - DNA, 20 bp, Artificial
  CRISPR gRNA sequence
tgctttggtaaaatttgaat

SEQ ID NO: 297296 - DNA, 20 bp, Artificial
  CRISPR gRNA sequence
ttggtaaaatttgaataagt

SEQ ID NO: 297297 - DNA, 20 bp, Artificial
  CRISPR gRNA sequence
taagatattgtaaccacaat

SEQ ID NO: 297298 - DNA, 20 bp, Artificial
  CRISPR gRNA sequence
ctccatgccattctcctgtc

SEQ ID NO: 297299 - DNA, 20 bp, Artificial
  CRISPR gRNA sequence
catgccattctcctgtctgg

SEQ ID NO: 297300 - DNA, 20 bp, Artificial
  CRISPR gRNA sequence
attctcctgtctggtggtgt

SEQ ID NO: 297301 - DNA, 20 bp, Artificial
  CRISPR gRNA sequence
ctcctgtctggtggtgttag

SEQ ID NO: 297302 - DNA, 20 bp, Artificial
  CRISPR gRNA sequence
tgtctggtggtgttagcagt

SEQ ID NO: 297303 - DNA, 20 bp, Artificial
  CRISPR gRNA sequence
gtctggtggtgttagcagtc

SEQ ID NO: 297304 - DNA, 20 bp, Artificial
  CRISPR gRNA sequence
tctggtggtgttagcagtca

SEQ ID NO: 297305 - DNA, 20 bp, Artificial
  CRISPR gRNA sequence
ctggtggtgttagcagtcag

SEQ ID NO: 297306 - DNA, 20 bp, Artificial
  CRISPR gRNA sequence
acctcccctcaaaattttaa

SEQ ID NO: 297307 - DNA, 20 bp, Artificial
  CRISPR gRNA sequence
ctcaaaattttaacagcatc

SEQ ID NO: 297308 - DNA, 20 bp, Artificial
  CRISPR gRNA sequence
gcatccagcctcacaaaact

SEQ ID NO: 297309 - DNA, 20 bp, Artificial
  CRISPR gRNA sequence
actcagatcttccctgttta

SEQ ID NO: 297310 - DNA, 20 bp, Artificial
  CRISPR gRNA sequence
cctgtttacagttccacttt

SEQ ID NO: 297311 - DNA, 20 bp, Artificial
  CRISPR gRNA sequence
tacagttccactttgagttt

SEQ ID NO: 297312 - DNA, 20 bp, Artificial
  CRISPR gRNA sequence
tcagtttcttcatctataaa

SEQ ID NO: 297313 - DNA, 20 bp, Artificial
  CRISPR gRNA sequence
cagtttcttcatctataaac

SEQ ID NO: 297314 - DNA, 20 bp, Artificial
  CRISPR gRNA sequence
gtttcttcatctataaacag

SEQ ID NO: 297315 - DNA, 20 bp, Artificial
  CRISPR gRNA sequence
cttcatctataaacaggagt

SEQ ID NO: 297316 - DNA, 20 bp, Artificial
  CRISPR gRNA sequence
ctataaacaggagttggctg

SEQ ID NO: 297317 - DNA, 20 bp, Artificial
  CRISPR gRNA sequence
ctgccatgtatcctgtgact

SEQ ID NO: 297318 - DNA, 20 bp, Artificial
  CRISPR gRNA sequence
tcctgtgactcagtgtctcg

SEQ ID NO: 297319 - DNA, 20 bp, Artificial
  CRISPR gRNA sequence
cagtgtctcgtagttactcc

SEQ ID NO: 297320 - DNA, 20 bp, Artificial
  CRISPR gRNA sequence
ctgctccttgtctccacctg

SEQ ID NO: 297321 - DNA, 20 bp, Artificial
  CRISPR gRNA sequence
tgctccttgtctccacctgc

SEQ ID NO: 297322 - DNA, 20 bp, Artificial
  CRISPR gRNA sequence
ttgtctccacctgcaggcct

SEQ ID NO: 297323 - DNA, 20 bp, Artificial
  CRISPR gRNA sequence
gtctccacctgcaggcctga

SEQ ID NO: 297324 - DNA, 20 bp, Artificial
  CRISPR gRNA sequence
tctccacctgcaggcctgag

SEQ ID NO: 297325 - DNA, 20 bp, Artificial
  CRISPR gRNA sequence
ctccacctgcaggcctgaga

SEQ ID NO: 297326 - DNA, 20 bp, Artificial
  CRISPR gRNA sequence
cacctgcaggcctgagaggg

SEQ ID NO: 297327 - DNA, 20 bp, Artificial
  CRISPR gRNA sequence
gagagggaagccaccccact

SEQ ID NO: 297328 - DNA, 20 bp, Artificial
  CRISPR gRNA sequence
gggaagccaccccactaaga

SEQ ID NO: 297329 - DNA, 20 bp, Artificial
  CRISPR gRNA sequence
ggaagccaccccactaagac

SEQ ID NO: 297330 - DNA, 20 bp, Artificial
  CRISPR gRNA sequence
gaagccaccccactaagaca

SEQ ID NO: 297331 - DNA, 20 bp, Artificial
  CRISPR gRNA sequence
agccaccccactaagacagg

SEQ ID NO: 297332 - DNA, 20 bp, Artificial
  CRISPR gRNA sequence
gccaccccactaagacaggg

SEQ ID NO: 297333 - DNA, 20 bp, Artificial
  CRISPR gRNA sequence
ctaagacagggaggtgaact

SEQ ID NO: 297334 - DNA, 20 bp, Artificial
  CRISPR gRNA sequence
agggaggtgaactgagcctg

SEQ ID NO: 297335 - DNA, 20 bp, Artificial
  CRISPR gRNA sequence
ggtgaactgagcctgaagtt

SEQ ID NO: 297336 - DNA, 20 bp, Artificial
  CRISPR gRNA sequence
ctgagcctgaagtttggcta

SEQ ID NO: 297337 - DNA, 20 bp, Artificial
  CRISPR gRNA sequence
aagtttggctacagcaccca

SEQ ID NO: 297338 - DNA, 20 bp, Artificial
  CRISPR gRNA sequence
agtttggctacagcacccac

SEQ ID NO: 297339 - DNA, 20 bp, Artificial
  CRISPR gRNA sequence
ctacagcacccacaggccac

SEQ ID NO: 297340 - DNA, 20 bp, Artificial
  CRISPR gRNA sequence
acccacaggccaccagccat

SEQ ID NO: 297341 - DNA, 20 bp, Artificial
  CRISPR gRNA sequence
agccatgagttcacctcctc

SEQ ID NO: 297342 - DNA, 20 bp, Artificial
  CRISPR gRNA sequence
atgagttcacctcctccaga

SEQ ID NO: 297343 - DNA, 20 bp, Artificial
  CRISPR gRNA sequence
tcctccagatggccacacac

SEQ ID NO: 297344 - DNA, 20 bp, Artificial
  CRISPR gRNA sequence
cctccagatggccacacacc

SEQ ID NO: 297345 - DNA, 20 bp, Artificial
  CRISPR gRNA sequence
atggccacacaccaggccct

SEQ ID NO: 297346 - DNA, 20 bp, Artificial
  CRISPR gRNA sequence
cactgtccccatgtctgctg

SEQ ID NO: 297347 - DNA, 20 bp, Artificial
  CRISPR gRNA sequence
ccatgtctgctgtggatgat

SEQ ID NO: 297348 - DNA, 20 bp, Artificial
  CRISPR gRNA sequence
catgtctgctgtggatgatg

SEQ ID NO: 297349 - DNA, 20 bp, Artificial
  CRISPR gRNA sequence
tgtctgctgtggatgatgag

SEQ ID NO: 297350 - DNA, 20 bp, Artificial
  CRISPR gRNA sequence
tgctgtggatgatgaggagt

SEQ ID NO: 297351 - DNA, 20 bp, Artificial
  CRISPR gRNA sequence
gctgtggatgatgaggagtc

SEQ ID NO: 297352 - DNA, 20 bp, Artificial
  CRISPR gRNA sequence
ctgtggatgatgaggagtca

SEQ ID NO: 297353 - DNA, 20 bp, Artificial
  CRISPR gRNA sequence
tgaggagtcagggaactaca

SEQ ID NO: 297354 - DNA, 20 bp, Artificial
  CRISPR gRNA sequence
aggagtcagggaactacaaa

SEQ ID NO: 297355 - DNA, 20 bp, Artificial
  CRISPR gRNA sequence
gtcagggaactacaaagaga

SEQ ID NO: 297356 - DNA, 20 bp, Artificial
  CRISPR gRNA sequence
actacaaagagatggtccct

SEQ ID NO: 297357 - DNA, 20 bp, Artificial
  CRISPR gRNA sequence
atggtccctcagatccatgc

SEQ ID NO: 297358 - DNA, 20 bp, Artificial
  CRISPR gRNA sequence
tccctcagatccatgctggc

SEQ ID NO: 297359 - DNA, 20 bp, Artificial
  CRISPR gRNA sequence
ccctcagatccatgctggct

SEQ ID NO: 297360 - DNA, 20 bp, Artificial
  CRISPR gRNA sequence
agatccatgctggctgggat

SEQ ID NO: 297361 - DNA, 20 bp, Artificial
  CRISPR gRNA sequence
ctggctgggataagcctttt

SEQ ID NO: 297362 - DNA, 20 bp, Artificial
  CRISPR gRNA sequence
cagatttctgtttttctgct

SEQ ID NO: 297363 - DNA, 20 bp, Artificial
  CRISPR gRNA sequence
gtttttctgcttagcacctt

SEQ ID NO: 297364 - DNA, 20 bp, Artificial
  CRISPR gRNA sequence
tgcttagcaccttgagcttg

SEQ ID NO: 297365 - DNA, 20 bp, Artificial
  CRISPR gRNA sequence
cttagcaccttgagcttgtg

SEQ ID NO: 297366 - DNA, 20 bp, Artificial
  CRISPR gRNA sequence
cttgagcttgtggagtcctt

SEQ ID NO: 297367 - DNA, 20 bp, Artificial
  CRISPR gRNA sequence
cttgtggagtccttgagtgc

SEQ ID NO: 297368 - DNA, 20 bp, Artificial
  CRISPR gRNA sequence
ttgtggagtccttgagtgca

SEQ ID NO: 297369 - DNA, 20 bp, Artificial
  CRISPR gRNA sequence
gtccttgagtgcaaggtctg

SEQ ID NO: 297370 - DNA, 20 bp, Artificial
  CRISPR gRNA sequence
tgcaaggtctgtagatgtgc

SEQ ID NO: 297371 - DNA, 20 bp, Artificial
  CRISPR gRNA sequence
gtgccagctgatcactgact

SEQ ID NO: 297372 - DNA, 20 bp, Artificial
  CRISPR gRNA sequence
tgccagctgatcactgactt

SEQ ID NO: 297373 - DNA, 20 bp, Artificial
  CRISPR gRNA sequence
atcactgacttaggtaacaa

SEQ ID NO: 297374 - DNA, 20 bp, Artificial
  CRISPR gRNA sequence
actgacttaggtaacaacag

SEQ ID NO: 297375 - DNA, 20 bp, Artificial
  CRISPR gRNA sequence
caacagcagcttccaacccc

SEQ ID NO: 297376 - DNA, 20 bp, Artificial
  CRISPR gRNA sequence
aacagcagcttccaaccccc

SEQ ID NO: 297377 - DNA, 20 bp, Artificial
  CRISPR gRNA sequence
acagcagcttccaaccccca

SEQ ID NO: 297378 - DNA, 20 bp, Artificial
  CRISPR gRNA sequence
gggcccatgacctgctacct

SEQ ID NO: 297379 - DNA, 20 bp, Artificial
  CRISPR gRNA sequence
tgacctgctaccttagctcc

SEQ ID NO: 297380 - DNA, 20 bp, Artificial
  CRISPR gRNA sequence
gacctgctaccttagctcct

SEQ ID NO: 297381 - DNA, 20 bp, Artificial
  CRISPR gRNA sequence
acctgctaccttagctcctg

SEQ ID NO: 297382 - DNA, 20 bp, Artificial
  CRISPR gRNA sequence
taccttagctcctggggatg

SEQ ID NO: 297383 - DNA, 20 bp, Artificial
  CRISPR gRNA sequence
accttagctcctggggatgt

SEQ ID NO: 297384 - DNA, 20 bp, Artificial
  CRISPR gRNA sequence
cttagctcctggggatgtgg

SEQ ID NO: 297385 - DNA, 20 bp, Artificial
  CRISPR gRNA sequence
ttagctcctggggatgtggg

SEQ ID NO: 297386 - DNA, 20 bp, Artificial
  CRISPR gRNA sequence
tgtgggaggtatgtgtgtgt

SEQ ID NO: 297387 - DNA, 20 bp, Artificial
  CRISPR gRNA sequence
tgggaggtatgtgtgtgtca

SEQ ID NO: 297388 - DNA, 20 bp, Artificial
  CRISPR gRNA sequence
ggaggtatgtgtgtgtcaga

SEQ ID NO: 297389 - DNA, 20 bp, Artificial
  CRISPR gRNA sequence
gtatgtgtgtgtcagagagc

SEQ ID NO: 297390 - DNA, 20 bp, Artificial
  CRISPR gRNA sequence
tatgtgtgtgtcagagagca

SEQ ID NO: 297391 - DNA, 20 bp, Artificial
  CRISPR gRNA sequence
tgtgtgtcagagagcaaggc

SEQ ID NO: 297392 - DNA, 20 bp, Artificial
  CRISPR gRNA sequence
gtgtcagagagcaaggcaag

SEQ ID NO: 297393 - DNA, 20 bp, Artificial
  CRISPR gRNA sequence
agagcaaggcaagaagactc

SEQ ID NO: 297394 - DNA, 20 bp, Artificial
  CRISPR gRNA sequence
agcaaggcaagaagactcta

SEQ ID NO: 297395 - DNA, 20 bp, Artificial
  CRISPR gRNA sequence
agactctagagaacattatc

SEQ ID NO: 297396 - DNA, 20 bp, Artificial
  CRISPR gRNA sequence
tctagagaacattatccagt

SEQ ID NO: 297397 - DNA, 20 bp, Artificial
  CRISPR gRNA sequence
ttttatttattttatttttt

SEQ ID NO: 297398 - DNA, 20 bp, Artificial
  CRISPR gRNA sequence
atttattttattttttgaga

SEQ ID NO: 297399 - DNA, 20 bp, Artificial
  CRISPR gRNA sequence
cagcatctttctctgtcacc

SEQ ID NO: 297400 - DNA, 20 bp, Artificial
  CRISPR gRNA sequence
agcatctttctctgtcaccc

SEQ ID NO: 297401 - DNA, 20 bp, Artificial
  CRISPR gRNA sequence
tctttctctgtcacccaggc

SEQ ID NO: 297402 - DNA, 20 bp, Artificial
  CRISPR gRNA sequence
tttctctgtcacccaggctg

SEQ ID NO: 297403 - DNA, 20 bp, Artificial
  CRISPR gRNA sequence
ctgtcacccaggctggagta

SEQ ID NO: 297404 - DNA, 20 bp, Artificial
  CRISPR gRNA sequence
tcacccaggctggagtacag

SEQ ID NO: 297405 - DNA, 20 bp, Artificial
  CRISPR gRNA sequence
caggctggagtacagtggca

SEQ ID NO: 297406 - DNA, 20 bp, Artificial
  CRISPR gRNA sequence
ggagtacagtggcacagtca

SEQ ID NO: 297407 - DNA, 20 bp, Artificial
  CRISPR gRNA sequence
ggcacagtcacagctcactg

SEQ ID NO: 297408 - DNA, 20 bp, Artificial
  CRISPR gRNA sequence
tcactgtggcctcgattacc

SEQ ID NO: 297409 - DNA, 20 bp, Artificial
  CRISPR gRNA sequence
cactgtggcctcgattacct

SEQ ID NO: 297410 - DNA, 20 bp, Artificial
  CRISPR gRNA sequence
ggcctcgattacctgggctc

SEQ ID NO: 297411 - DNA, 20 bp, Artificial
  CRISPR gRNA sequence
ctcaagcaattctcccacct

SEQ ID NO: 297412 - DNA, 20 bp, Artificial
  CRISPR gRNA sequence
tctcccacctcagcctcccc

SEQ ID NO: 297413 - DNA, 20 bp, Artificial
  CRISPR gRNA sequence
acctcagcctccccaagtgc

SEQ ID NO: 297414 - DNA, 20 bp, Artificial
  CRISPR gRNA sequence
agtgctagaattatatgcat

SEQ ID NO: 297415 - DNA, 20 bp, Artificial
  CRISPR gRNA sequence
gataaatgcatatatacaca

SEQ ID NO: 297416 - DNA, 20 bp, Artificial
  CRISPR gRNA sequence
agtcatgaatcgtttaacaa

SEQ ID NO: 297417 - DNA, 20 bp, Artificial
  CRISPR gRNA sequence
gtcatgaatcgtttaacaac

SEQ ID NO: 297418 - DNA, 20 bp, Artificial
  CRISPR gRNA sequence
tcatgaatcgtttaacaaca

SEQ ID NO: 297419 - DNA, 20 bp, Artificial
  CRISPR gRNA sequence
catgaatcgtttaacaacag

SEQ ID NO: 297420 - DNA, 20 bp, Artificial
  CRISPR gRNA sequence
taacaacaggggtacgttct

SEQ ID NO: 297421 - DNA, 20 bp, Artificial
  CRISPR gRNA sequence
cgttctgagaaacacattat

SEQ ID NO: 297422 - DNA, 20 bp, Artificial
  CRISPR gRNA sequence
gttctgagaaacacattatt

SEQ ID NO: 297423 - DNA, 20 bp, Artificial
  CRISPR gRNA sequence
ttgtcattgtataatcatca

SEQ ID NO: 297424 - DNA, 20 bp, Artificial
  CRISPR gRNA sequence
tgtcattgtataatcatcat

SEQ ID NO: 297425 - DNA, 20 bp, Artificial
  CRISPR gRNA sequence
gtcattgtataatcatcata

SEQ ID NO: 297426 - DNA, 20 bp, Artificial
  CRISPR gRNA sequence
agggtgtccttacacaaaac

SEQ ID NO: 297427 - DNA, 20 bp, Artificial
  CRISPR gRNA sequence
tgtccttacacaaaactaga

SEQ ID NO: 297428 - DNA, 20 bp, Artificial
  CRISPR gRNA sequence
ttacacaaaactagatagca

SEQ ID NO: 297429 - DNA, 20 bp, Artificial
  CRISPR gRNA sequence
agcatagcctgctccatact

SEQ ID NO: 297430 - DNA, 20 bp, Artificial
  CRISPR gRNA sequence
gcatagcctgctccatactt

SEQ ID NO: 297431 - DNA, 20 bp, Artificial
  CRISPR gRNA sequence
tgctccatacttaggctacc

SEQ ID NO: 297432 - DNA, 20 bp, Artificial
  CRISPR gRNA sequence
catacttaggctacctggca

SEQ ID NO: 297433 - DNA, 20 bp, Artificial
  CRISPR gRNA sequence
ctggcacagcctattgctcc

SEQ ID NO: 297434 - DNA, 20 bp, Artificial
  CRISPR gRNA sequence
tggcacagcctattgctcct

SEQ ID NO: 297435 - DNA, 20 bp, Artificial
  CRISPR gRNA sequence
gcctattgctcctaggctac

SEQ ID NO: 297436 - DNA, 20 bp, Artificial
  CRISPR gRNA sequence
tcctaggctacaagcctgca

SEQ ID NO: 297437 - DNA, 20 bp, Artificial
  CRISPR gRNA sequence
tgttactgtgctgaatactg

SEQ ID NO: 297438 - DNA, 20 bp, Artificial
  CRISPR gRNA sequence
gttactgtgctgaatactgt

SEQ ID NO: 297439 - DNA, 20 bp, Artificial
  CRISPR gRNA sequence
ctgtaggtgttgtaacacaa

SEQ ID NO: 297440 - DNA, 20 bp, Artificial
  CRISPR gRNA sequence
ttttgtatctgaacatatct

SEQ ID NO: 297441 - DNA, 20 bp, Artificial
  CRISPR gRNA sequence
tatctgaacatatctaagca

SEQ ID NO: 297442 - DNA, 20 bp, Artificial
  CRISPR gRNA sequence
gaacatatctaagcatagaa

SEQ ID NO: 297443 - DNA, 20 bp, Artificial
  CRISPR gRNA sequence
atctaagcatagaaaagata

SEQ ID NO: 297444 - DNA, 20 bp, Artificial
  CRISPR gRNA sequence
gaaaagatacagtaaaaata

SEQ ID NO: 297445 - DNA, 20 bp, Artificial
  CRISPR gRNA sequence
aatatggtgttataatctta

SEQ ID NO: 297446 - DNA, 20 bp, Artificial
  CRISPR gRNA sequence
atatggtgttataatcttat

SEQ ID NO: 297447 - DNA, 20 bp, Artificial
  CRISPR gRNA sequence
cattgtatatgactgaaatg

SEQ ID NO: 297448 - DNA, 20 bp, Artificial
  CRISPR gRNA sequence
tgtggctgtgcaatacatga

SEQ ID NO: 297449 - DNA, 20 bp, Artificial
  CRISPR gRNA sequence
tatatcccttactttgtgcc

SEQ ID NO: 297450 - DNA, 20 bp, Artificial
  CRISPR gRNA sequence
tttgtgcctggtactgttct

SEQ ID NO: 297451 - DNA, 20 bp, Artificial
  CRISPR gRNA sequence
tcataaatattaactcattt

SEQ ID NO: 297452 - DNA, 20 bp, Artificial
  CRISPR gRNA sequence
ctcacaataactctctgctt

SEQ ID NO: 297453 - DNA, 20 bp, Artificial
  CRISPR gRNA sequence
tcacaataactctctgcttt

SEQ ID NO: 297454 - DNA, 20 bp, Artificial
  CRISPR gRNA sequence
ttgttgttatttcccatttt

SEQ ID NO: 297455 - DNA, 20 bp, Artificial
  CRISPR gRNA sequence
ttatttcccattttaagatg

SEQ ID NO: 297456 - DNA, 20 bp, Artificial
  CRISPR gRNA sequence
attttaagatgtggacacta

SEQ ID NO: 297457 - DNA, 20 bp, Artificial
  CRISPR gRNA sequence
aagatgtggacactaaagcc

SEQ ID NO: 297458 - DNA, 20 bp, Artificial
  CRISPR gRNA sequence
gatgtggacactaaagccca

SEQ ID NO: 297459 - DNA, 20 bp, Artificial
  CRISPR gRNA sequence
tgtggacactaaagcccaga

SEQ ID NO: 297460 - DNA, 20 bp, Artificial
  CRISPR gRNA sequence
cactaaagcccagagagatg

SEQ ID NO: 297461 - DNA, 20 bp, Artificial
  CRISPR gRNA sequence
agagatgaagtaatttaccc

SEQ ID NO: 297462 - DNA, 20 bp, Artificial
  CRISPR gRNA sequence
agtaatttacccaagatcga

SEQ ID NO: 297463 - DNA, 20 bp, Artificial
  CRISPR gRNA sequence
taatttacccaagatcgaca

SEQ ID NO: 297464 - DNA, 20 bp, Artificial
  CRISPR gRNA sequence
ccaagatcgacagagctact

SEQ ID NO: 297465 - DNA, 20 bp, Artificial
  CRISPR gRNA sequence
agatcgacagagctactaag

SEQ ID NO: 297466 - DNA, 20 bp, Artificial
  CRISPR gRNA sequence
tcgacagagctactaagtgg

SEQ ID NO: 297467 - DNA, 20 bp, Artificial
  CRISPR gRNA sequence
gacagagctactaagtggca

SEQ ID NO: 297468 - DNA, 20 bp, Artificial
  CRISPR gRNA sequence
agctactaagtggcagagct

SEQ ID NO: 297469 - DNA, 20 bp, Artificial
  CRISPR gRNA sequence
gcagagcttggattcacacc

SEQ ID NO: 297470 - DNA, 20 bp, Artificial
  CRISPR gRNA sequence
tggattcacacccagcaatg

SEQ ID NO: 297471 - DNA, 20 bp, Artificial
  CRISPR gRNA sequence
cacacccagcaatgtagatt

SEQ ID NO: 297472 - DNA, 20 bp, Artificial
  CRISPR gRNA sequence
gactcttctcctaactcttg

SEQ ID NO: 297473 - DNA, 20 bp, Artificial
  CRISPR gRNA sequence
tcttgtggtaaaccatgaat

SEQ ID NO: 297474 - DNA, 20 bp, Artificial
  CRISPR gRNA sequence
tgtggtaaaccatgaataag

SEQ ID NO: 297475 - DNA, 20 bp, Artificial
  CRISPR gRNA sequence
gtaaaccatgaataagtggt

SEQ ID NO: 297476 - DNA, 20 bp, Artificial
  CRISPR gRNA sequence
aagtggtaagacttcttcca

SEQ ID NO: 297477 - DNA, 20 bp, Artificial
  CRISPR gRNA sequence
agtggtaagacttcttccat

SEQ ID NO: 297478 - DNA, 20 bp, Artificial
  CRISPR gRNA sequence
gtggtaagacttcttccatg

SEQ ID NO: 297479 - DNA, 20 bp, Artificial
  CRISPR gRNA sequence
cttcttccatggggcctgaa

SEQ ID NO: 297480 - DNA, 20 bp, Artificial
  CRISPR gRNA sequence
ccatggggcctgaacagctt

SEQ ID NO: 297481 - DNA, 20 bp, Artificial
  CRISPR gRNA sequence
tggggcctgaacagctttgg

SEQ ID NO: 297482 - DNA, 20 bp, Artificial
  CRISPR gRNA sequence
aacagctttggtggataata

SEQ ID NO: 297483 - DNA, 20 bp, Artificial
  CRISPR gRNA sequence
ctgcctcatccgtgttcatc

SEQ ID NO: 297484 - DNA, 20 bp, Artificial
  CRISPR gRNA sequence
tgcctcctccccatcacctg

SEQ ID NO: 297485 - DNA, 20 bp, Artificial
  CRISPR gRNA sequence
atcacctgcagctgacacct

SEQ ID NO: 297486 - DNA, 20 bp, Artificial
  CRISPR gRNA sequence
gctgacacctcagttgaccc

SEQ ID NO: 297487 - DNA, 20 bp, Artificial
  CRISPR gRNA sequence
tgacacctcagttgacccaa

SEQ ID NO: 297488 - DNA, 20 bp, Artificial
  CRISPR gRNA sequence
cctcagttgacccaagagct

SEQ ID NO: 297489 - DNA, 20 bp, Artificial
  CRISPR gRNA sequence
ctcagttgacccaagagctt

SEQ ID NO: 297490 - DNA, 20 bp, Artificial
  CRISPR gRNA sequence
tgacccaagagcttgggccc

SEQ ID NO: 297491 - DNA, 20 bp, Artificial
  CRISPR gRNA sequence
ggcccaagcccttctcatca

SEQ ID NO: 297492 - DNA, 20 bp, Artificial
  CRISPR gRNA sequence
gcccttctcatcaaagtgac

SEQ ID NO: 297493 - DNA, 20 bp, Artificial
  CRISPR gRNA sequence
tctcatcaaagtgaccagcc

SEQ ID NO: 297494 - DNA, 20 bp, Artificial
  CRISPR gRNA sequence
aagtgaccagcccagctctc

SEQ ID NO: 297495 - DNA, 20 bp, Artificial
  CRISPR gRNA sequence
ccagcccagctctcaagatc

SEQ ID NO: 297496 - DNA, 20 bp, Artificial
  CRISPR gRNA sequence
cagcccagctctcaagatct

SEQ ID NO: 297497 - DNA, 20 bp, Artificial
  CRISPR gRNA sequence
gcccagctctcaagatctgg

SEQ ID NO: 297498 - DNA, 20 bp, Artificial
  CRISPR gRNA sequence
ccagctctcaagatctggga

SEQ ID NO: 297499 - DNA, 20 bp, Artificial
  CRISPR gRNA sequence
gctctcaagatctgggagag

SEQ ID NO: 297500 - DNA, 20 bp, Artificial
  CRISPR gRNA sequence
ctctcaagatctgggagaga

SEQ ID NO: 297501 - DNA, 20 bp, Artificial
  CRISPR gRNA sequence
tcaagatctgggagagaagg

SEQ ID NO: 297502 - DNA, 20 bp, Artificial
  CRISPR gRNA sequence
gagaaggaagaaaaatgccc

SEQ ID NO: 297503 - DNA, 20 bp, Artificial
  CRISPR gRNA sequence
atgccctggaaacacatttc

SEQ ID NO: 297504 - DNA, 20 bp, Artificial
  CRISPR gRNA sequence
atttccagaaaacactaaac

SEQ ID NO: 297505 - DNA, 20 bp, Artificial
  CRISPR gRNA sequence
tttctgactccgcacactga

SEQ ID NO: 297506 - DNA, 20 bp, Artificial
  CRISPR gRNA sequence
tgactccgcacactgaaagt

SEQ ID NO: 297507 - DNA, 20 bp, Artificial
  CRISPR gRNA sequence
tccgcacactgaaagtgaga

SEQ ID NO: 297508 - DNA, 20 bp, Artificial
  CRISPR gRNA sequence
acactgaaagtgagaaagta

SEQ ID NO: 297509 - DNA, 20 bp, Artificial
  CRISPR gRNA sequence
gaaagtgagaaagtaaagcc

SEQ ID NO: 297510 - DNA, 20 bp, Artificial
  CRISPR gRNA sequence
cgagacactctatgaaaact

SEQ ID NO: 297511 - DNA, 20 bp, Artificial
  CRISPR gRNA sequence
cactctatgaaaactgagtt

SEQ ID NO: 297512 - DNA, 20 bp, Artificial
  CRISPR gRNA sequence
actctatgaaaactgagttc

SEQ ID NO: 297513 - DNA, 20 bp, Artificial
  CRISPR gRNA sequence
gatttgccattgacacttct

SEQ ID NO: 297514 - DNA, 20 bp, Artificial
  CRISPR gRNA sequence
ttgccattgacacttcttag

SEQ ID NO: 297515 - DNA, 20 bp, Artificial
  CRISPR gRNA sequence
gacacttcttagaagtttct

SEQ ID NO: 297516 - DNA, 20 bp, Artificial
  CRISPR gRNA sequence
ttagaagtttcttagctcct

SEQ ID NO: 297517 - DNA, 20 bp, Artificial
  CRISPR gRNA sequence
agtttcttagctcctgagaa

SEQ ID NO: 297518 - DNA, 20 bp, Artificial
  CRISPR gRNA sequence
tttcttagctcctgagaaaa

SEQ ID NO: 297519 - DNA, 20 bp, Artificial
  CRISPR gRNA sequence
aaaagagttaccaatattga

SEQ ID NO: 297520 - DNA, 20 bp, Artificial
  CRISPR gRNA sequence
ttgaaagcaacaacctcaaa

SEQ ID NO: 297521 - DNA, 20 bp, Artificial
  CRISPR gRNA sequence
acctcaaatggtaaccgttt

SEQ ID NO: 297522 - DNA, 20 bp, Artificial
  CRISPR gRNA sequence
tggtaaccgtttaagtttta

SEQ ID NO: 297523 - DNA, 20 bp, Artificial
  CRISPR gRNA sequence
taaccgtttaagttttatgg

SEQ ID NO: 297524 - DNA, 20 bp, Artificial
  CRISPR gRNA sequence
cgtttaagttttatggtggt

SEQ ID NO: 297525 - DNA, 20 bp, Artificial
  CRISPR gRNA sequence
tttaagttttatggtggtga

SEQ ID NO: 297526 - DNA, 20 bp, Artificial
  CRISPR gRNA sequence
ttttatggtggtgagagaat

SEQ ID NO: 297527 - DNA, 20 bp, Artificial
  CRISPR gRNA sequence
agaataagtgactatatttt

SEQ ID NO: 297528 - DNA, 20 bp, Artificial
  CRISPR gRNA sequence
ataagtgactatatttttgg

SEQ ID NO: 297529 - DNA, 20 bp, Artificial
  CRISPR gRNA sequence
tttttggcagtacaatttta

SEQ ID NO: 297530 - DNA, 20 bp, Artificial
  CRISPR gRNA sequence
ttggcagtacaattttaaag

SEQ ID NO: 297531 - DNA, 20 bp, Artificial
  CRISPR gRNA sequence
agtacaattttaaagtggaa

SEQ ID NO: 297532 - DNA, 20 bp, Artificial
  CRISPR gRNA sequence
caattttaaagtggaataga

SEQ ID NO: 297533 - DNA, 20 bp, Artificial
  CRISPR gRNA sequence
gaatagaaagcccatgacat

SEQ ID NO: 297534 - DNA, 20 bp, Artificial
  CRISPR gRNA sequence
gaaagcccatgacatcagat

SEQ ID NO: 297535 - DNA, 20 bp, Artificial
  CRISPR gRNA sequence
agatcagaaaataacattgc

SEQ ID NO: 297536 - DNA, 20 bp, Artificial
  CRISPR gRNA sequence
agtaattcacacacgatgaa

SEQ ID NO: 297537 - DNA, 20 bp, Artificial
  CRISPR gRNA sequence
gatgaaaagcaacaaaaaat

SEQ ID NO: 297538 - DNA, 20 bp, Artificial
  CRISPR gRNA sequence
ctatttgaattctttcttct

SEQ ID NO: 297539 - DNA, 20 bp, Artificial
  CRISPR gRNA sequence
tatttgaattctttcttctc

SEQ ID NO: 297540 - DNA, 20 bp, Artificial
  CRISPR gRNA sequence
atttgaattctttcttctca

SEQ ID NO: 297541 - DNA, 20 bp, Artificial
  CRISPR gRNA sequence
cagggcacacctctgcttac

SEQ ID NO: 297542 - DNA, 20 bp, Artificial
  CRISPR gRNA sequence
agggcacacctctgcttact

SEQ ID NO: 297543 - DNA, 20 bp, Artificial
  CRISPR gRNA sequence
cacacctctgcttactgggc

SEQ ID NO: 297544 - DNA, 20 bp, Artificial
  CRISPR gRNA sequence
ctgcttactgggctggtgaa

SEQ ID NO: 297545 - DNA, 20 bp, Artificial
  CRISPR gRNA sequence
tgggctggtgaacagtgacc

SEQ ID NO: 297546 - DNA, 20 bp, Artificial
  CRISPR gRNA sequence
ggtgaacagtgacctagcca

SEQ ID NO: 297547 - DNA, 20 bp, Artificial
  CRISPR gRNA sequence
gtgaacagtgacctagccac

SEQ ID NO: 297548 - DNA, 20 bp, Artificial
  CRISPR gRNA sequence
tgaacagtgacctagccaca

SEQ ID NO: 297549 - DNA, 20 bp, Artificial
  CRISPR gRNA sequence
cagtgacctagccacagggc

SEQ ID NO: 297550 - DNA, 20 bp, Artificial
  CRISPR gRNA sequence
agccacagggccggcttcca

SEQ ID NO: 297551 - DNA, 20 bp, Artificial
  CRISPR gRNA sequence
gccacagggccggcttccaa

SEQ ID NO: 297552 - DNA, 20 bp, Artificial
  CRISPR gRNA sequence
ccacagggccggcttccaaa

SEQ ID NO: 297553 - DNA, 20 bp, Artificial
  CRISPR gRNA sequence
acagggccggcttccaaagg

SEQ ID NO: 297554 - DNA, 20 bp, Artificial
  CRISPR gRNA sequence
ggccggcttccaaagggaga

SEQ ID NO: 297555 - DNA, 20 bp, Artificial
  CRISPR gRNA sequence
gccggcttccaaagggagaa

SEQ ID NO: 297556 - DNA, 20 bp, Artificial
  CRISPR gRNA sequence
cggcttccaaagggagaaag

SEQ ID NO: 297557 - DNA, 20 bp, Artificial
  CRISPR gRNA sequence
agggagaaaggagatgcaat

SEQ ID NO: 297558 - DNA, 20 bp, Artificial
  CRISPR gRNA sequence
cataatccaccctcaaaatg

SEQ ID NO: 297559 - DNA, 20 bp, Artificial
  CRISPR gRNA sequence
taatccaccctcaaaatgta

SEQ ID NO: 297560 - DNA, 20 bp, Artificial
  CRISPR gRNA sequence
gagctgaataattcatttca

SEQ ID NO: 297561 - DNA, 20 bp, Artificial
  CRISPR gRNA sequence
gaataattcatttcatggca

SEQ ID NO: 297562 - DNA, 20 bp, Artificial
  CRISPR gRNA sequence
ttcatttcatggcatagaaa

SEQ ID NO: 297563 - DNA, 20 bp, Artificial
  CRISPR gRNA sequence
atggcatagaaatagcaata

SEQ ID NO: 297564 - DNA, 20 bp, Artificial
  CRISPR gRNA sequence
atagaaatagcaatacagtg

SEQ ID NO: 297565 - DNA, 20 bp, Artificial
  CRISPR gRNA sequence
atattttgtgtcctctgtca

SEQ ID NO: 297566 - DNA, 20 bp, Artificial
  CRISPR gRNA sequence
tctgtcatggaaatttgaca

SEQ ID NO: 297567 - DNA, 20 bp, Artificial
  CRISPR gRNA sequence
gtcatggaaatttgacacag

SEQ ID NO: 297568 - DNA, 20 bp, Artificial
  CRISPR gRNA sequence
tatttgctgcccctgctctt

SEQ ID NO: 297569 - DNA, 20 bp, Artificial
  CRISPR gRNA sequence
atttgctgcccctgctcttg

SEQ ID NO: 297570 - DNA, 20 bp, Artificial
  CRISPR gRNA sequence
cctgctcttgaggataaaat

SEQ ID NO: 297571 - DNA, 20 bp, Artificial
  CRISPR gRNA sequence
ctcttgaggataaaattgga

SEQ ID NO: 297572 - DNA, 20 bp, Artificial
  CRISPR gRNA sequence
tcttgaggataaaattggat

SEQ ID NO: 297573 - DNA, 20 bp, Artificial
  CRISPR gRNA sequence
ttgaggataaaattggatgg

SEQ ID NO: 297574 - DNA, 20 bp, Artificial
  CRISPR gRNA sequence
ataaaattggatgggagttt

SEQ ID NO: 297575 - DNA, 20 bp, Artificial
  CRISPR gRNA sequence
atgggagtttaagactgaaa

SEQ ID NO: 297576 - DNA, 20 bp, Artificial
  CRISPR gRNA sequence
tgggagtttaagactgaaac

SEQ ID NO: 297577 - DNA, 20 bp, Artificial
  CRISPR gRNA sequence
aagactgaaacgggcacctg

SEQ ID NO: 297578 - DNA, 20 bp, Artificial
  CRISPR gRNA sequence
aacgggcacctgtggccttg

SEQ ID NO: 297579 - DNA, 20 bp, Artificial
  CRISPR gRNA sequence
cacctgtggccttgcagaat

SEQ ID NO: 297580 - DNA, 20 bp, Artificial
  CRISPR gRNA sequence
acctgtggccttgcagaatt

SEQ ID NO: 297581 - DNA, 20 bp, Artificial
  CRISPR gRNA sequence
ggccttgcagaattaggtta

SEQ ID NO: 297582 - DNA, 20 bp, Artificial
  CRISPR gRNA sequence
gtttgtgccttgtatttaca

SEQ ID NO: 297583 - DNA, 20 bp, Artificial
  CRISPR gRNA sequence
gccttgtatttacaaagcga

SEQ ID NO: 297584 - DNA, 20 bp, Artificial
  CRISPR gRNA sequence
ccttgtatttacaaagcgaa

SEQ ID NO: 297585 - DNA, 20 bp, Artificial
  CRISPR gRNA sequence
tacaaagcgaaaggaattcc

SEQ ID NO: 297586 - DNA, 20 bp, Artificial
  CRISPR gRNA sequence
ggaattcctagtgccacctg

SEQ ID NO: 297587 - DNA, 20 bp, Artificial
  CRISPR gRNA sequence
aattcctagtgccacctgca

SEQ ID NO: 297588 - DNA, 20 bp, Artificial
  CRISPR gRNA sequence
attcctagtgccacctgcag

SEQ ID NO: 297589 - DNA, 20 bp, Artificial
  CRISPR gRNA sequence
cagaggcacttctaactttc

SEQ ID NO: 297590 - DNA, 20 bp, Artificial
  CRISPR gRNA sequence
agctctgtttgccactgtcc

SEQ ID NO: 297591 - DNA, 20 bp, Artificial
  CRISPR gRNA sequence
tggcacctccatcacacttt

SEQ ID NO: 297592 - DNA, 20 bp, Artificial
  CRISPR gRNA sequence
ggcacctccatcacactttt

SEQ ID NO: 297593 - DNA, 20 bp, Artificial
  CRISPR gRNA sequence
cctccatcacacttttaggc

SEQ ID NO: 297594 - DNA, 20 bp, Artificial
  CRISPR gRNA sequence
tccatcacacttttaggctg

SEQ ID NO: 297595 - DNA, 20 bp, Artificial
  CRISPR gRNA sequence
tcacacttttaggctggagc

SEQ ID NO: 297596 - DNA, 20 bp, Artificial
  CRISPR gRNA sequence
acacttttaggctggagcca

SEQ ID NO: 297597 - DNA, 20 bp, Artificial
  CRISPR gRNA sequence
acttttaggctggagccaga

SEQ ID NO: 297598 - DNA, 20 bp, Artificial
  CRISPR gRNA sequence
cttttaggctggagccagag

SEQ ID NO: 297599 - DNA, 20 bp, Artificial
  CRISPR gRNA sequence
cagagaggtttttgaaaaat

SEQ ID NO: 297600 - DNA, 20 bp, Artificial
  CRISPR gRNA sequence
agaggtttttgaaaaatcag

SEQ ID NO: 297601 - DNA, 20 bp, Artificial
  CRISPR gRNA sequence
aaaatcagtagctcccacat

SEQ ID NO: 297602 - DNA, 20 bp, Artificial
  CRISPR gRNA sequence
aaatcagtagctcccacatc

SEQ ID NO: 297603 - DNA, 20 bp, Artificial
  CRISPR gRNA sequence
atcagtagctcccacatcag

SEQ ID NO: 297604 - DNA, 20 bp, Artificial
  CRISPR gRNA sequence
tcagtagctcccacatcagg

SEQ ID NO: 297605 - DNA, 20 bp, Artificial
  CRISPR gRNA sequence
gtagctcccacatcaggagg

SEQ ID NO: 297606 - DNA, 20 bp, Artificial
  CRISPR gRNA sequence
atcaggaggaagtatctttc

SEQ ID NO: 297607 - DNA, 20 bp, Artificial
  CRISPR gRNA sequence
aggaagtatctttccagttt

SEQ ID NO: 297608 - DNA, 20 bp, Artificial
  CRISPR gRNA sequence
tatctttccagtttgagttt

SEQ ID NO: 297609 - DNA, 20 bp, Artificial
  CRISPR gRNA sequence
ctttccagtttgagttttgg

SEQ ID NO: 297610 - DNA, 20 bp, Artificial
  CRISPR gRNA sequence
tagctgctctctttttgtct

SEQ ID NO: 297611 - DNA, 20 bp, Artificial
  CRISPR gRNA sequence
agctgctctctttttgtctg

SEQ ID NO: 297612 - DNA, 20 bp, Artificial
  CRISPR gRNA sequence
gctgctctctttttgtctga

SEQ ID NO: 297613 - DNA, 20 bp, Artificial
  CRISPR gRNA sequence
ctttttgtctgagggttctc

SEQ ID NO: 297614 - DNA, 20 bp, Artificial
  CRISPR gRNA sequence
tttttgtctgagggttctct

SEQ ID NO: 297615 - DNA, 20 bp, Artificial
  CRISPR gRNA sequence
tctgagggttctctgggtcc

SEQ ID NO: 297616 - DNA, 20 bp, Artificial
  CRISPR gRNA sequence
ctgagggttctctgggtcct

SEQ ID NO: 297617 - DNA, 20 bp, Artificial
  CRISPR gRNA sequence
tgagggttctctgggtccta

SEQ ID NO: 297618 - DNA, 20 bp, Artificial
  CRISPR gRNA sequence
tttctcttgaacaacacctc

SEQ ID NO: 297619 - DNA, 20 bp, Artificial
  CRISPR gRNA sequence
tctagttaatttcatgtacc

SEQ ID NO: 297620 - DNA, 20 bp, Artificial
  CRISPR gRNA sequence
tagttaatttcatgtacctg

SEQ ID NO: 297621 - DNA, 20 bp, Artificial
  CRISPR gRNA sequence
ttaatttcatgtacctggag

SEQ ID NO: 297622 - DNA, 20 bp, Artificial
  CRISPR gRNA sequence
atttcatgtacctggagtgg

SEQ ID NO: 297623 - DNA, 20 bp, Artificial
  CRISPR gRNA sequence
catgtacctggagtggtagt

SEQ ID NO: 297624 - DNA, 20 bp, Artificial
  CRISPR gRNA sequence
ttggaatatttcttcacttt

SEQ ID NO: 297625 - DNA, 20 bp, Artificial
  CRISPR gRNA sequence
gatttttttttttttttttt

SEQ ID NO: 297626 - DNA, 20 bp, Artificial
  CRISPR gRNA sequence
ttttttttttttttttgaga

SEQ ID NO: 297627 - DNA, 20 bp, Artificial
  CRISPR gRNA sequence
ttttttttttttttgagatg

SEQ ID NO: 297628 - DNA, 20 bp, Artificial
  CRISPR gRNA sequence
tggagtctcactctgttgcc

SEQ ID NO: 297629 - DNA, 20 bp, Artificial
  CRISPR gRNA sequence
ggagtctcactctgttgccc

SEQ ID NO: 297630 - DNA, 20 bp, Artificial
  CRISPR gRNA sequence
tcactctgttgcccaggcta

SEQ ID NO: 297631 - DNA, 20 bp, Artificial
  CRISPR gRNA sequence
ttgcccaggctaaagtgcaa

SEQ ID NO: 297632 - DNA, 20 bp, Artificial
  CRISPR gRNA sequence
aaagtgcaatggcatgatct

SEQ ID NO: 297633 - DNA, 20 bp, Artificial
  CRISPR gRNA sequence
aatggcatgatcttggctca

SEQ ID NO: 297634 - DNA, 20 bp, Artificial
  CRISPR gRNA sequence
tcacggcaacccccgcctcc

SEQ ID NO: 297635 - DNA, 20 bp, Artificial
  CRISPR gRNA sequence
cacggcaacccccgcctccc

SEQ ID NO: 297636 - DNA, 20 bp, Artificial
  CRISPR gRNA sequence
aacccccgcctcccaggttc

SEQ ID NO: 297637 - DNA, 20 bp, Artificial
  CRISPR gRNA sequence
ttcaagtgattctcttgcct

SEQ ID NO: 297638 - DNA, 20 bp, Artificial
  CRISPR gRNA sequence
ttctcttgcctcagcctccc

SEQ ID NO: 297639 - DNA, 20 bp, Artificial
  CRISPR gRNA sequence
tcttgcctcagcctcccaag

SEQ ID NO: 297640 - DNA, 20 bp, Artificial
  CRISPR gRNA sequence
gcctcagcctcccaagtagc

SEQ ID NO: 297641 - DNA, 20 bp, Artificial
  CRISPR gRNA sequence
cctcagcctcccaagtagct

SEQ ID NO: 297642 - DNA, 20 bp, Artificial
  CRISPR gRNA sequence
acaaataatttttgtatttt

SEQ ID NO: 297643 - DNA, 20 bp, Artificial
  CRISPR gRNA sequence
aataatttttgtatttttgg

SEQ ID NO: 297644 - DNA, 20 bp, Artificial
  CRISPR gRNA sequence
taatttttgtatttttggta

SEQ ID NO: 297645 - DNA, 20 bp, Artificial
  CRISPR gRNA sequence
ttttgtatttttggtagaga

SEQ ID NO: 297646 - DNA, 20 bp, Artificial
  CRISPR gRNA sequence
tttgtatttttggtagagac

SEQ ID NO: 297647 - DNA, 20 bp, Artificial
  CRISPR gRNA sequence
ttgtatttttggtagagacg

SEQ ID NO: 297648 - DNA, 20 bp, Artificial
  CRISPR gRNA sequence
gagacggggtttcaccatgt

SEQ ID NO: 297649 - DNA, 20 bp, Artificial
  CRISPR gRNA sequence
tttcaccatgttggccatgc

SEQ ID NO: 297650 - DNA, 20 bp, Artificial
  CRISPR gRNA sequence
tagtctcgaactcctgacct

SEQ ID NO: 297651 - DNA, 20 bp, Artificial
  CRISPR gRNA sequence
agtctcgaactcctgacctc

SEQ ID NO: 297652 - DNA, 20 bp, Artificial
  CRISPR gRNA sequence
ctgcccgcctcgacctccca

SEQ ID NO: 297653 - DNA, 20 bp, Artificial
  CRISPR gRNA sequence
gcctcgacctcccaaagtgc

SEQ ID NO: 297654 - DNA, 20 bp, Artificial
  CRISPR gRNA sequence
cctcgacctcccaaagtgct

SEQ ID NO: 297655 - DNA, 20 bp, Artificial
  CRISPR gRNA sequence
ctcccaaagtgctgggatta

SEQ ID NO: 297656 - DNA, 20 bp, Artificial
  CRISPR gRNA sequence
caaagtgctgggattacaga

SEQ ID NO: 297657 - DNA, 20 bp, Artificial
  CRISPR gRNA sequence
aaagtgctgggattacagac

SEQ ID NO: 297658 - DNA, 20 bp, Artificial
  CRISPR gRNA sequence
ctgggattacagacaggcat

SEQ ID NO: 297659 - DNA, 20 bp, Artificial
  CRISPR gRNA sequence
caggcatgagccactgcgcc

SEQ ID NO: 297660 - DNA, 20 bp, Artificial
  CRISPR gRNA sequence
cactgcgcccggcccacctt

SEQ ID NO: 297661 - DNA, 20 bp, Artificial
  CRISPR gRNA sequence
gcccaccttaagatttatgt

SEQ ID NO: 297662 - DNA, 20 bp, Artificial
  CRISPR gRNA sequence
ccttaagatttatgtaagat

SEQ ID NO: 297663 - DNA, 20 bp, Artificial
  CRISPR gRNA sequence
tttatgtaagattggctcaa

SEQ ID NO: 297664 - DNA, 20 bp, Artificial
  CRISPR gRNA sequence
ggctcaaaagctcattcctg

SEQ ID NO: 297665 - DNA, 20 bp, Artificial
  CRISPR gRNA sequence
caaaagctcattcctgtgga

SEQ ID NO: 297666 - DNA, 20 bp, Artificial
  CRISPR gRNA sequence
aaaagctcattcctgtggaa

SEQ ID NO: 297667 - DNA, 20 bp, Artificial
  CRISPR gRNA sequence
aggtccactgttttcctccc

SEQ ID NO: 297668 - DNA, 20 bp, Artificial
  CRISPR gRNA sequence
ttttcctcccaagatttttg

SEQ ID NO: 297669 - DNA, 20 bp, Artificial
  CRISPR gRNA sequence
gatttttgcagatatctgcg

SEQ ID NO: 297670 - DNA, 20 bp, Artificial
  CRISPR gRNA sequence
atttttgcagatatctgcgt

SEQ ID NO: 297671 - DNA, 20 bp, Artificial
  CRISPR gRNA sequence
tttgcagatatctgcgtggg

SEQ ID NO: 297672 - DNA, 20 bp, Artificial
  CRISPR gRNA sequence
ccatttcctgctgttgttga

SEQ ID NO: 297673 - DNA, 20 bp, Artificial
  CRISPR gRNA sequence
ccctcattaaaaccatcacc

SEQ ID NO: 297674 - DNA, 20 bp, Artificial
  CRISPR gRNA sequence
ctcattaaaaccatcacctg

SEQ ID NO: 297675 - DNA, 20 bp, Artificial
  CRISPR gRNA sequence
tcattaaaaccatcacctgg

SEQ ID NO: 297676 - DNA, 20 bp, Artificial
  CRISPR gRNA sequence
aaccatcacctggaggtgaa

SEQ ID NO: 297677 - DNA, 20 bp, Artificial
  CRISPR gRNA sequence
atcacctggaggtgaataga

SEQ ID NO: 297678 - DNA, 20 bp, Artificial
  CRISPR gRNA sequence
ctggaggtgaatagacagtc

SEQ ID NO: 297679 - DNA, 20 bp, Artificial
  CRISPR gRNA sequence
gtcgagacctatcattccca

SEQ ID NO: 297680 - DNA, 20 bp, Artificial
  CRISPR gRNA sequence
tcattcccaaagaattgtca

SEQ ID NO: 297681 - DNA, 20 bp, Artificial
  CRISPR gRNA sequence
attcccaaagaattgtcatg

SEQ ID NO: 297682 - DNA, 20 bp, Artificial
  CRISPR gRNA sequence
agaattgtcatggagcctaa

SEQ ID NO: 297683 - DNA, 20 bp, Artificial
  CRISPR gRNA sequence
atggagcctaatagttctat

SEQ ID NO: 297684 - DNA, 20 bp, Artificial
  CRISPR gRNA sequence
tggattcacccctttatgtt

SEQ ID NO: 297685 - DNA, 20 bp, Artificial
  CRISPR gRNA sequence
tttatgttaagccaccattt

SEQ ID NO: 297686 - DNA, 20 bp, Artificial
  CRISPR gRNA sequence
catttcagtgtttttcaaaa

SEQ ID NO: 297687 - DNA, 20 bp, Artificial
  CRISPR gRNA sequence
caaaatagatatatgttatc

SEQ ID NO: 297688 - DNA, 20 bp, Artificial
  CRISPR gRNA sequence
aatagatatatgttatctag

SEQ ID NO: 297689 - DNA, 20 bp, Artificial
  CRISPR gRNA sequence
atagatatatgttatctagt

SEQ ID NO: 297690 - DNA, 20 bp, Artificial
  CRISPR gRNA sequence
tagatatatgttatctagta

SEQ ID NO: 297691 - DNA, 20 bp, Artificial
  CRISPR gRNA sequence
gatatatgttatctagtagg

SEQ ID NO: 297692 - DNA, 20 bp, Artificial
  CRISPR gRNA sequence
ggagtatcttacccccaaat

SEQ ID NO: 297693 - DNA, 20 bp, Artificial
  CRISPR gRNA sequence
cccaaattagttgattgttt

SEQ ID NO: 297694 - DNA, 20 bp, Artificial
  CRISPR gRNA sequence
ccaaattagttgattgtttc

SEQ ID NO: 297695 - DNA, 20 bp, Artificial
  CRISPR gRNA sequence
aaattagttgattgtttcag

SEQ ID NO: 297696 - DNA, 20 bp, Artificial
  CRISPR gRNA sequence
aattagttgattgtttcagg

SEQ ID NO: 297697 - DNA, 20 bp, Artificial
  CRISPR gRNA sequence
attagttgattgtttcagga

SEQ ID NO: 297698 - DNA, 20 bp, Artificial
  CRISPR gRNA sequence
gattgtttcaggagggcttt

SEQ ID NO: 297699 - DNA, 20 bp, Artificial
  CRISPR gRNA sequence
tgtttcaggagggcttttag

SEQ ID NO: 297700 - DNA, 20 bp, Artificial
  CRISPR gRNA sequence
gtttcaggagggcttttagt

SEQ ID NO: 297701 - DNA, 20 bp, Artificial
  CRISPR gRNA sequence
ggagggcttttagtgggttc

SEQ ID NO: 297702 - DNA, 20 bp, Artificial
  CRISPR gRNA sequence
agggcttttagtgggttcca

SEQ ID NO: 297703 - DNA, 20 bp, Artificial
  CRISPR gRNA sequence
tagtgggttccagagaaaat

SEQ ID NO: 297704 - DNA, 20 bp, Artificial
  CRISPR gRNA sequence
ttccagagaaaatgagcaat

SEQ ID NO: 297705 - DNA, 20 bp, Artificial
  CRISPR gRNA sequence
gagaaaatgagcaatcagac

SEQ ID NO: 297706 - DNA, 20 bp, Artificial
  CRISPR gRNA sequence
agcaatcagacaagttgatt

SEQ ID NO: 297707 - DNA, 20 bp, Artificial
  CRISPR gRNA sequence
aatcagacaagttgatttag

SEQ ID NO: 297708 - DNA, 20 bp, Artificial
  CRISPR gRNA sequence
cagacaagttgatttagtgg

SEQ ID NO: 297709 - DNA, 20 bp, Artificial
  CRISPR gRNA sequence
caagttgatttagtggaaga

SEQ ID NO: 297710 - DNA, 20 bp, Artificial
  CRISPR gRNA sequence
agtggaagacagtcactgaa

SEQ ID NO: 297711 - DNA, 20 bp, Artificial
  CRISPR gRNA sequence
gtggaagacagtcactgaat

SEQ ID NO: 297712 - DNA, 20 bp, Artificial
  CRISPR gRNA sequence
gtcactgaataggatgtgta

SEQ ID NO: 297713 - DNA, 20 bp, Artificial
  CRISPR gRNA sequence
tcactgaataggatgtgtat

SEQ ID NO: 297714 - DNA, 20 bp, Artificial
  CRISPR gRNA sequence
cactgaataggatgtgtata

SEQ ID NO: 297715 - DNA, 20 bp, Artificial
  CRISPR gRNA sequence
aggatgtgtatagggttgtt

SEQ ID NO: 297716 - DNA, 20 bp, Artificial
  CRISPR gRNA sequence
ggatgtgtatagggttgttt

SEQ ID NO: 297717 - DNA, 20 bp, Artificial
  CRISPR gRNA sequence
atgtgtatagggttgtttgg

SEQ ID NO: 297718 - DNA, 20 bp, Artificial
  CRISPR gRNA sequence
gtatagggttgtttgggagc

SEQ ID NO: 297719 - DNA, 20 bp, Artificial
  CRISPR gRNA sequence
atagggttgtttgggagcaa

SEQ ID NO: 297720 - DNA, 20 bp, Artificial
  CRISPR gRNA sequence
tttgggagcaagagtgaaat

SEQ ID NO: 297721 - DNA, 20 bp, Artificial
  CRISPR gRNA sequence
gagcaagagtgaaattggta

SEQ ID NO: 297722 - DNA, 20 bp, Artificial
  CRISPR gRNA sequence
agagtgaaattggtatggaa

SEQ ID NO: 297723 - DNA, 20 bp, Artificial
  CRISPR gRNA sequence
agtgaaattggtatggaaca

SEQ ID NO: 297724 - DNA, 20 bp, Artificial
  CRISPR gRNA sequence
tgaaattggtatggaacaga

SEQ ID NO: 297725 - DNA, 20 bp, Artificial
  CRISPR gRNA sequence
gaaattggtatggaacagag

SEQ ID NO: 297726 - DNA, 20 bp, Artificial
  CRISPR gRNA sequence
tatggaacagagaggctccc

SEQ ID NO: 297727 - DNA, 20 bp, Artificial
  CRISPR gRNA sequence
atggaacagagaggctccca

SEQ ID NO: 297728 - DNA, 20 bp, Artificial
  CRISPR gRNA sequence
aacagagaggctcccaaggc

SEQ ID NO: 297729 - DNA, 20 bp, Artificial
  CRISPR gRNA sequence
agagaggctcccaaggcaag

SEQ ID NO: 297730 - DNA, 20 bp, Artificial
  CRISPR gRNA sequence
aggcaagcagacattttttt

SEQ ID NO: 297731 - DNA, 20 bp, Artificial
  CRISPR gRNA sequence
caagcagacattttttttgg

SEQ ID NO: 297732 - DNA, 20 bp, Artificial
  CRISPR gRNA sequence
gcagacattttttttggaag

SEQ ID NO: 297733 - DNA, 20 bp, Artificial
  CRISPR gRNA sequence
acattttttttggaagaagc

SEQ ID NO: 297734 - DNA, 20 bp, Artificial
  CRISPR gRNA sequence
tttggaagaagcaagtgttt

SEQ ID NO: 297735 - DNA, 20 bp, Artificial
  CRISPR gRNA sequence
tggaagaagcaagtgtttga

SEQ ID NO: 297736 - DNA, 20 bp, Artificial
  CRISPR gRNA sequence
agcaagtgtttgagagactg

SEQ ID NO: 297737 - DNA, 20 bp, Artificial
  CRISPR gRNA sequence
gtggcttatttttcctttgt

SEQ ID NO: 297738 - DNA, 20 bp, Artificial
  CRISPR gRNA sequence
ggcttatttttcctttgtga

SEQ ID NO: 297739 - DNA, 20 bp, Artificial
  CRISPR gRNA sequence
gcttatttttcctttgtgag

SEQ ID NO: 297740 - DNA, 20 bp, Artificial
  CRISPR gRNA sequence
cttatttttcctttgtgaga

SEQ ID NO: 297741 - DNA, 20 bp, Artificial
  CRISPR gRNA sequence
ttatttttcctttgtgagag

SEQ ID NO: 297742 - DNA, 20 bp, Artificial
  CRISPR gRNA sequence
atttttcctttgtgagaggg

SEQ ID NO: 297743 - DNA, 20 bp, Artificial
  CRISPR gRNA sequence
catttccaaaatatgtaacc

SEQ ID NO: 297744 - DNA, 20 bp, Artificial
  CRISPR gRNA sequence
gtaacctggtattttgtccc

SEQ ID NO: 297745 - DNA, 20 bp, Artificial
  CRISPR gRNA sequence
acctggtattttgtccccag

SEQ ID NO: 297746 - DNA, 20 bp, Artificial
  CRISPR gRNA sequence
ttgtccccagaagtactgtt

SEQ ID NO: 297747 - DNA, 20 bp, Artificial
  CRISPR gRNA sequence
agaagtactgttgagattta

SEQ ID NO: 297748 - DNA, 20 bp, Artificial
  CRISPR gRNA sequence
agtactgttgagatttatgg

SEQ ID NO: 297749 - DNA, 20 bp, Artificial
  CRISPR gRNA sequence
aagcaaaaaactctgtcacc

SEQ ID NO: 297750 - DNA, 20 bp, Artificial
  CRISPR gRNA sequence
agcaaaaaactctgtcaccc

SEQ ID NO: 297751 - DNA, 20 bp, Artificial
  CRISPR gRNA sequence
aaaaactctgtcacccaggc

SEQ ID NO: 297752 - DNA, 20 bp, Artificial
  CRISPR gRNA sequence
aaactctgtcacccaggcta

SEQ ID NO: 297753 - DNA, 20 bp, Artificial
  CRISPR gRNA sequence
aactctgtcacccaggctag

SEQ ID NO: 297754 - DNA, 20 bp, Artificial
  CRISPR gRNA sequence
ctctgtcacccaggctagag

SEQ ID NO: 297755 - DNA, 20 bp, Artificial
  CRISPR gRNA sequence
tcacccaggctagaggagtg

SEQ ID NO: 297756 - DNA, 20 bp, Artificial
  CRISPR gRNA sequence
cccaggctagaggagtgcag

SEQ ID NO: 297757 - DNA, 20 bp, Artificial
  CRISPR gRNA sequence
ggagtgcagtggtgctatca

SEQ ID NO: 297758 - DNA, 20 bp, Artificial
  CRISPR gRNA sequence
ggtgctatcaaagcttactg

SEQ ID NO: 297759 - DNA, 20 bp, Artificial
  CRISPR gRNA sequence
ttactgcagcctctaattcc

SEQ ID NO: 297760 - DNA, 20 bp, Artificial
  CRISPR gRNA sequence
tactgcagcctctaattccc

SEQ ID NO: 297761 - DNA, 20 bp, Artificial
  CRISPR gRNA sequence
agcctctaattcccaggctc

SEQ ID NO: 297762 - DNA, 20 bp, Artificial
  CRISPR gRNA sequence
cctctaattcccaggctcaa

SEQ ID NO: 297763 - DNA, 20 bp, Artificial
  CRISPR gRNA sequence
ctcaagagatgtttctgcct

SEQ ID NO: 297764 - DNA, 20 bp, Artificial
  CRISPR gRNA sequence
ttctgcctcagccacctgaa

SEQ ID NO: 297765 - DNA, 20 bp, Artificial
  CRISPR gRNA sequence
gcctcagccacctgaatagc

SEQ ID NO: 297766 - DNA, 20 bp, Artificial
  CRISPR gRNA sequence
acctgaatagctggcactat

SEQ ID NO: 297767 - DNA, 20 bp, Artificial
  CRISPR gRNA sequence
taagtacatgccaccatgcc

SEQ ID NO: 297768 - DNA, 20 bp, Artificial
  CRISPR gRNA sequence
tacatgccaccatgcctggc

SEQ ID NO: 297769 - DNA, 20 bp, Artificial
  CRISPR gRNA sequence
gttgttgttttgttttgctt

SEQ ID NO: 297770 - DNA, 20 bp, Artificial
  CRISPR gRNA sequence
tgttgttttgttttgcttta

SEQ ID NO: 297771 - DNA, 20 bp, Artificial
  CRISPR gRNA sequence
gttttgttttgctttagaga

SEQ ID NO: 297772 - DNA, 20 bp, Artificial
  CRISPR gRNA sequence
ttttgttttgctttagagac

SEQ ID NO: 297773 - DNA, 20 bp, Artificial
  CRISPR gRNA sequence
tttgttttgctttagagacg

SEQ ID NO: 297774 - DNA, 20 bp, Artificial
  CRISPR gRNA sequence
acggggtctcgctttgtgcc

SEQ ID NO: 297775 - DNA, 20 bp, Artificial
  CRISPR gRNA sequence
cggggtctcgctttgtgccc

SEQ ID NO: 297776 - DNA, 20 bp, Artificial
  CRISPR gRNA sequence
gtctcgctttgtgcccaggc

SEQ ID NO: 297777 - DNA, 20 bp, Artificial
  CRISPR gRNA sequence
gctggtcttgaactcctttt

SEQ ID NO: 297778 - DNA, 20 bp, Artificial
  CRISPR gRNA sequence
tttaagtgattatctcttct

SEQ ID NO: 297779 - DNA, 20 bp, Artificial
  CRISPR gRNA sequence
tatctcttctcagcttctta

SEQ ID NO: 297780 - DNA, 20 bp, Artificial
  CRISPR gRNA sequence
ttctcagcttcttaaagtcc

SEQ ID NO: 297781 - DNA, 20 bp, Artificial
  CRISPR gRNA sequence
tctcagcttcttaaagtcct

SEQ ID NO: 297782 - DNA, 20 bp, Artificial
  CRISPR gRNA sequence
ttcttaaagtcctgggatta

SEQ ID NO: 297783 - DNA, 20 bp, Artificial
  CRISPR gRNA sequence
tcttaaagtcctgggattat

SEQ ID NO: 297784 - DNA, 20 bp, Artificial
  CRISPR gRNA sequence
aagtcctgggattataggca

SEQ ID NO: 297785 - DNA, 20 bp, Artificial
  CRISPR gRNA sequence
gttacttcaaatatcttttt

SEQ ID NO: 297786 - DNA, 20 bp, Artificial
  CRISPR gRNA sequence
tacttatttaaatttttttt

SEQ ID NO: 297787 - DNA, 20 bp, Artificial
  CRISPR gRNA sequence
aattattgattttatgtcga

SEQ ID NO: 297788 - DNA, 20 bp, Artificial
  CRISPR gRNA sequence
ataaataaaaaaacaaaaac

SEQ ID NO: 297789 - DNA, 20 bp, Artificial
  CRISPR gRNA sequence
aaatcaattaatgcttacca

SEQ ID NO: 297790 - DNA, 20 bp, Artificial
  CRISPR gRNA sequence
aatcaattaatgcttaccac

SEQ ID NO: 297791 - DNA, 20 bp, Artificial
  CRISPR gRNA sequence
aattaatgcttaccacaggc

SEQ ID NO: 297792 - DNA, 20 bp, Artificial
  CRISPR gRNA sequence
aatcctcacaacaaacctat

SEQ ID NO: 297793 - DNA, 20 bp, Artificial
  CRISPR gRNA sequence
atcctcacaacaaacctatg

SEQ ID NO: 297794 - DNA, 20 bp, Artificial
  CRISPR gRNA sequence
ctcacaacaaacctatgagg

SEQ ID NO: 297795 - DNA, 20 bp, Artificial
  CRISPR gRNA sequence
tcacaacaaacctatgaggt

SEQ ID NO: 297796 - DNA, 20 bp, Artificial
  CRISPR gRNA sequence
ttattgttcctgctttttgc

SEQ ID NO: 297797 - DNA, 20 bp, Artificial
  CRISPR gRNA sequence
attgttcctgctttttgcaa

SEQ ID NO: 297798 - DNA, 20 bp, Artificial
  CRISPR gRNA sequence
ttgttcctgctttttgcaag

SEQ ID NO: 297799 - DNA, 20 bp, Artificial
  CRISPR gRNA sequence
gctttttgcaagaggaaact

SEQ ID NO: 297800 - DNA, 20 bp, Artificial
  CRISPR gRNA sequence
tgcaagaggaaactgagaca

SEQ ID NO: 297801 - DNA, 20 bp, Artificial
  CRISPR gRNA sequence
gcaagaggaaactgagacac

SEQ ID NO: 297802 - DNA, 20 bp, Artificial
  CRISPR gRNA sequence
caagaggaaactgagacaca

SEQ ID NO: 297803 - DNA, 20 bp, Artificial
  CRISPR gRNA sequence
gaggaaactgagacacaggg

SEQ ID NO: 297804 - DNA, 20 bp, Artificial
  CRISPR gRNA sequence
aactgagacacagggaagtt

SEQ ID NO: 297805 - DNA, 20 bp, Artificial
  CRISPR gRNA sequence
gaagttaagtaatttgccta

SEQ ID NO: 297806 - DNA, 20 bp, Artificial
  CRISPR gRNA sequence
gtaatttgcctatggtaaca

SEQ ID NO: 297807 - DNA, 20 bp, Artificial
  CRISPR gRNA sequence
taatttgcctatggtaacac

SEQ ID NO: 297808 - DNA, 20 bp, Artificial
  CRISPR gRNA sequence
tttgcctatggtaacacagg

SEQ ID NO: 297809 - DNA, 20 bp, Artificial
  CRISPR gRNA sequence
cctatggtaacacaggcagt

SEQ ID NO: 297810 - DNA, 20 bp, Artificial
  CRISPR gRNA sequence
atggtaacacaggcagtgag

SEQ ID NO: 297811 - DNA, 20 bp, Artificial
  CRISPR gRNA sequence
aacacaggcagtgagtagtt

SEQ ID NO: 297812 - DNA, 20 bp, Artificial
  CRISPR gRNA sequence
aggcagtgagtagttgagct

SEQ ID NO: 297813 - DNA, 20 bp, Artificial
  CRISPR gRNA sequence
gagattgaactcacgctgtc

SEQ ID NO: 297814 - DNA, 20 bp, Artificial
  CRISPR gRNA sequence
ctgtccagaatccatgctat

SEQ ID NO: 297815 - DNA, 20 bp, Artificial
  CRISPR gRNA sequence
atccatgctattagttataa

SEQ ID NO: 297816 - DNA, 20 bp, Artificial
  CRISPR gRNA sequence
tataatagtgtactgcccta

SEQ ID NO: 297817 - DNA, 20 bp, Artificial
  CRISPR gRNA sequence
ccctatagctttctgtttca

SEQ ID NO: 297818 - DNA, 20 bp, Artificial
  CRISPR gRNA sequence
ctttctgtttcacagctaca

SEQ ID NO: 297819 - DNA, 20 bp, Artificial
  CRISPR gRNA sequence
ctacatggcattactttgta

SEQ ID NO: 297820 - DNA, 20 bp, Artificial
  CRISPR gRNA sequence
taaaccatttaacttatttc

SEQ ID NO: 297821 - DNA, 20 bp, Artificial
  CRISPR gRNA sequence
tgtgcacatgtatctttttg

SEQ ID NO: 297822 - DNA, 20 bp, Artificial
  CRISPR gRNA sequence
tttttgtagaatgaattctt

SEQ ID NO: 297823 - DNA, 20 bp, Artificial
  CRISPR gRNA sequence
gaatgaattcttaagaaatt

SEQ ID NO: 297824 - DNA, 20 bp, Artificial
  CRISPR gRNA sequence
tcttaagaaattgagttgct

SEQ ID NO: 297825 - DNA, 20 bp, Artificial
  CRISPR gRNA sequence
gagttgctaagtcaatgctt

SEQ ID NO: 297826 - DNA, 20 bp, Artificial
  CRISPR gRNA sequence
attaccaactgtcctccaaa

SEQ ID NO: 297827 - DNA, 20 bp, Artificial
  CRISPR gRNA sequence
ttaccaactgtcctccaaaa

SEQ ID NO: 297828 - DNA, 20 bp, Artificial
  CRISPR gRNA sequence
ccaaaaaggttgtaccaatt

SEQ ID NO: 297829 - DNA, 20 bp, Artificial
  CRISPR gRNA sequence
gtaccaatttagaattttac

SEQ ID NO: 297830 - DNA, 20 bp, Artificial
  CRISPR gRNA sequence
ccaatttagaattttaccag

SEQ ID NO: 297831 - DNA, 20 bp, Artificial
  CRISPR gRNA sequence
aattttaccagcagtaaatt

SEQ ID NO: 297832 - DNA, 20 bp, Artificial
  CRISPR gRNA sequence
tttaccagcagtaaattcag

SEQ ID NO: 297833 - DNA, 20 bp, Artificial
  CRISPR gRNA sequence
ccagcagtaaattcagcagt

SEQ ID NO: 297834 - DNA, 20 bp, Artificial
  CRISPR gRNA sequence
cagcagtaaattcagcagtt

SEQ ID NO: 297835 - DNA, 20 bp, Artificial
  CRISPR gRNA sequence
ccattttcctaacactctcg

SEQ ID NO: 297836 - DNA, 20 bp, Artificial
  CRISPR gRNA sequence
cctaacactctcgcggacac

SEQ ID NO: 297837 - DNA, 20 bp, Artificial
  CRISPR gRNA sequence
ctaacactctcgcggacact

SEQ ID NO: 297838 - DNA, 20 bp, Artificial
  CRISPR gRNA sequence
tcgcggacactgggtattac

SEQ ID NO: 297839 - DNA, 20 bp, Artificial
  CRISPR gRNA sequence
tttaatacgtgccaatcaaa

SEQ ID NO: 297840 - DNA, 20 bp, Artificial
  CRISPR gRNA sequence
ttaatacgtgccaatcaaat

SEQ ID NO: 297841 - DNA, 20 bp, Artificial
  CRISPR gRNA sequence
gtgccaatcaaatgggcaaa

SEQ ID NO: 297842 - DNA, 20 bp, Artificial
  CRISPR gRNA sequence
aatcaaatgggcaaaaagaa

SEQ ID NO: 297843 - DNA, 20 bp, Artificial
  CRISPR gRNA sequence
aaaaagaatggtttctcact

SEQ ID NO: 297844 - DNA, 20 bp, Artificial
  CRISPR gRNA sequence
aaaagaatggtttctcactg

SEQ ID NO: 297845 - DNA, 20 bp, Artificial
  CRISPR gRNA sequence
aggtttaaattgcatttccc

SEQ ID NO: 297846 - DNA, 20 bp, Artificial
  CRISPR gRNA sequence
gcatttccctagttattctt

SEQ ID NO: 297847 - DNA, 20 bp, Artificial
  CRISPR gRNA sequence
ttcttcaacaattacttatt

SEQ ID NO: 297848 - DNA, 20 bp, Artificial
  CRISPR gRNA sequence
attgagtgcttcatatttgt

SEQ ID NO: 297849 - DNA, 20 bp, Artificial
  CRISPR gRNA sequence
ttgagtgcttcatatttgta

SEQ ID NO: 297850 - DNA, 20 bp, Artificial
  CRISPR gRNA sequence
tgagtgcttcatatttgtaa

SEQ ID NO: 297851 - DNA, 20 bp, Artificial
  CRISPR gRNA sequence
atatttgtaagggacaattg

SEQ ID NO: 297852 - DNA, 20 bp, Artificial
  CRISPR gRNA sequence
tatttgtaagggacaattgc

SEQ ID NO: 297853 - DNA, 20 bp, Artificial
  CRISPR gRNA sequence
taagggacaattgcaggtac

SEQ ID NO: 297854 - DNA, 20 bp, Artificial
  CRISPR gRNA sequence
tgcaggtactggaaatgtca

SEQ ID NO: 297855 - DNA, 20 bp, Artificial
  CRISPR gRNA sequence
ggtactggaaatgtcacagt

SEQ ID NO: 297856 - DNA, 20 bp, Artificial
  CRISPR gRNA sequence
gtactggaaatgtcacagtg

SEQ ID NO: 297857 - DNA, 20 bp, Artificial
  CRISPR gRNA sequence
ggaaatgtcacagtgaggaa

SEQ ID NO: 297858 - DNA, 20 bp, Artificial
  CRISPR gRNA sequence
cacagtgaggaaaagtgaca

SEQ ID NO: 297859 - DNA, 20 bp, Artificial
  CRISPR gRNA sequence
tgacaaagcccctgctgtca

SEQ ID NO: 297860 - DNA, 20 bp, Artificial
  CRISPR gRNA sequence
acaaagcccctgctgtcatg

SEQ ID NO: 297861 - DNA, 20 bp, Artificial
  CRISPR gRNA sequence
tgtcatggagcttattctaa

SEQ ID NO: 297862 - DNA, 20 bp, Artificial
  CRISPR gRNA sequence
gtcatggagcttattctaat

SEQ ID NO: 297863 - DNA, 20 bp, Artificial
  CRISPR gRNA sequence
catggagcttattctaatgg

SEQ ID NO: 297864 - DNA, 20 bp, Artificial
  CRISPR gRNA sequence
cttattctaatgggagatgt

SEQ ID NO: 297865 - DNA, 20 bp, Artificial
  CRISPR gRNA sequence
ttattctaatgggagatgtc

SEQ ID NO: 297866 - DNA, 20 bp, Artificial
  CRISPR gRNA sequence
aatgggagatgtcaggtgct

SEQ ID NO: 297867 - DNA, 20 bp, Artificial
  CRISPR gRNA sequence
gagatgtcaggtgctcagct

SEQ ID NO: 297868 - DNA, 20 bp, Artificial
  CRISPR gRNA sequence
tgtcaggtgctcagctgagc

SEQ ID NO: 297869 - DNA, 20 bp, Artificial
  CRISPR gRNA sequence
gtcaggtgctcagctgagct

SEQ ID NO: 297870 - DNA, 20 bp, Artificial
  CRISPR gRNA sequence
caggtgctcagctgagctgg

SEQ ID NO: 297871 - DNA, 20 bp, Artificial
  CRISPR gRNA sequence
ggtgctcagctgagctggga

SEQ ID NO: 297872 - DNA, 20 bp, Artificial
  CRISPR gRNA sequence
tgctcagctgagctgggaga

SEQ ID NO: 297873 - DNA, 20 bp, Artificial
  CRISPR gRNA sequence
ctcagctgagctgggagaga

SEQ ID NO: 297874 - DNA, 20 bp, Artificial
  CRISPR gRNA sequence
cagctgagctgggagagaga

SEQ ID NO: 297875 - DNA, 20 bp, Artificial
  CRISPR gRNA sequence
gagctgggagagagagagct

SEQ ID NO: 297876 - DNA, 20 bp, Artificial
  CRISPR gRNA sequence
gagagagagagctgagttgt

SEQ ID NO: 297877 - DNA, 20 bp, Artificial
  CRISPR gRNA sequence
agagagagagctgagttgtc

SEQ ID NO: 297878 - DNA, 20 bp, Artificial
  CRISPR gRNA sequence
agagctgagttgtcaggtgt

SEQ ID NO: 297879 - DNA, 20 bp, Artificial
  CRISPR gRNA sequence
agctgagttgtcaggtgtca

SEQ ID NO: 297880 - DNA, 20 bp, Artificial
  CRISPR gRNA sequence
gctgagttgtcaggtgtcag

SEQ ID NO: 297881 - DNA, 20 bp, Artificial
  CRISPR gRNA sequence
tgagttgtcaggtgtcagag

SEQ ID NO: 297882 - DNA, 20 bp, Artificial
  CRISPR gRNA sequence
ggtgtcagaggagccaatta

SEQ ID NO: 297883 - DNA, 20 bp, Artificial
  CRISPR gRNA sequence
gtcagaggagccaattatag

SEQ ID NO: 297884 - DNA, 20 bp, Artificial
  CRISPR gRNA sequence
gcagcaaaacaaaaataaaa

SEQ ID NO: 297885 - DNA, 20 bp, Artificial
  CRISPR gRNA sequence
aaaacaaaaataaaatagtt

SEQ ID NO: 297886 - DNA, 20 bp, Artificial
  CRISPR gRNA sequence
cttttaatctcttactacga

SEQ ID NO: 297887 - DNA, 20 bp, Artificial
  CRISPR gRNA sequence
cttactacgacggtataatc

SEQ ID NO: 297888 - DNA, 20 bp, Artificial
  CRISPR gRNA sequence
tactacgacggtataatcaa

SEQ ID NO: 297889 - DNA, 20 bp, Artificial
  CRISPR gRNA sequence
actacgacggtataatcaag

SEQ ID NO: 297890 - DNA, 20 bp, Artificial
  CRISPR gRNA sequence
gtataatcaagaggctaaaa

SEQ ID NO: 297891 - DNA, 20 bp, Artificial
  CRISPR gRNA sequence
tataatcaagaggctaaaat

SEQ ID NO: 297892 - DNA, 20 bp, Artificial
  CRISPR gRNA sequence
taatcaagaggctaaaatgg

SEQ ID NO: 297893 - DNA, 20 bp, Artificial
  CRISPR gRNA sequence
aatcaagaggctaaaatggg

SEQ ID NO: 297894 - DNA, 20 bp, Artificial
  CRISPR gRNA sequence
caagaggctaaaatgggagg

SEQ ID NO: 297895 - DNA, 20 bp, Artificial
  CRISPR gRNA sequence
aagaggctaaaatgggagga

SEQ ID NO: 297896 - DNA, 20 bp, Artificial
  CRISPR gRNA sequence
agaggctaaaatgggaggaa

SEQ ID NO: 297897 - DNA, 20 bp, Artificial
  CRISPR gRNA sequence
ggctaaaatgggaggaaggg

SEQ ID NO: 297898 - DNA, 20 bp, Artificial
  CRISPR gRNA sequence
gcctgttccatttccccaca

SEQ ID NO: 297899 - DNA, 20 bp, Artificial
  CRISPR gRNA sequence
ctgttccatttccccacata

SEQ ID NO: 297900 - DNA, 20 bp, Artificial
  CRISPR gRNA sequence
tccatttccccacatagagt

SEQ ID NO: 297901 - DNA, 20 bp, Artificial
  CRISPR gRNA sequence
cccacatagagtgagtatac

SEQ ID NO: 297902 - DNA, 20 bp, Artificial
  CRISPR gRNA sequence
atagagtgagtataccagtc

SEQ ID NO: 297903 - DNA, 20 bp, Artificial
  CRISPR gRNA sequence
tagagtgagtataccagtcg

SEQ ID NO: 297904 - DNA, 20 bp, Artificial
  CRISPR gRNA sequence
agagtgagtataccagtcga

SEQ ID NO: 297905 - DNA, 20 bp, Artificial
  CRISPR gRNA sequence
tgagtataccagtcgagggt

SEQ ID NO: 297906 - DNA, 20 bp, Artificial
  CRISPR gRNA sequence
gagtataccagtcgagggtc

SEQ ID NO: 297907 - DNA, 20 bp, Artificial
  CRISPR gRNA sequence
ccagtcgagggtcaggtaat

SEQ ID NO: 297908 - DNA, 20 bp, Artificial
  CRISPR gRNA sequence
cgagggtcaggtaatcagtg

SEQ ID NO: 297909 - DNA, 20 bp, Artificial
  CRISPR gRNA sequence
tcaggtaatcagtgcagact

SEQ ID NO: 297910 - DNA, 20 bp, Artificial
  CRISPR gRNA sequence
caggtaatcagtgcagactt

SEQ ID NO: 297911 - DNA, 20 bp, Artificial
  CRISPR gRNA sequence
aggtaatcagtgcagactta

SEQ ID NO: 297912 - DNA, 20 bp, Artificial
  CRISPR gRNA sequence
ggtaatcagtgcagacttag

SEQ ID NO: 297913 - DNA, 20 bp, Artificial
  CRISPR gRNA sequence
gtaatcagtgcagacttagg

SEQ ID NO: 297914 - DNA, 20 bp, Artificial
  CRISPR gRNA sequence
agggggtcgccttaccattg

SEQ ID NO: 297915 - DNA, 20 bp, Artificial
  CRISPR gRNA sequence
gggtcgccttaccattgaag

SEQ ID NO: 297916 - DNA, 20 bp, Artificial
  CRISPR gRNA sequence
attgaagaagccccaaatga

SEQ ID NO: 297917 - DNA, 20 bp, Artificial
  CRISPR gRNA sequence
ttgaagaagccccaaatgaa

SEQ ID NO: 297918 - DNA, 20 bp, Artificial
  CRISPR gRNA sequence
aagccccaaatgaaaggctc

SEQ ID NO: 297919 - DNA, 20 bp, Artificial
  CRISPR gRNA sequence
ccccaaatgaaaggctctag

SEQ ID NO: 297920 - DNA, 20 bp, Artificial
  CRISPR gRNA sequence
gaaaggctctagcagtttta

SEQ ID NO: 297921 - DNA, 20 bp, Artificial
  CRISPR gRNA sequence
ctctagcagttttatggacc

SEQ ID NO: 297922 - DNA, 20 bp, Artificial
  CRISPR gRNA sequence
tctagcagttttatggacct

SEQ ID NO: 297923 - DNA, 20 bp, Artificial
  CRISPR gRNA sequence
ctagcagttttatggacctg

SEQ ID NO: 297924 - DNA, 20 bp, Artificial
  CRISPR gRNA sequence
tagcagttttatggacctgg

SEQ ID NO: 297925 - DNA, 20 bp, Artificial
  CRISPR gRNA sequence
cagttttatggacctggggg

SEQ ID NO: 297926 - DNA, 20 bp, Artificial
  CRISPR gRNA sequence
gttttatggacctgggggtg

SEQ ID NO: 297927 - DNA, 20 bp, Artificial
  CRISPR gRNA sequence
ttttatggacctgggggtgg

SEQ ID NO: 297928 - DNA, 20 bp, Artificial
  CRISPR gRNA sequence
acctgggggtggaggaatcc

SEQ ID NO: 297929 - DNA, 20 bp, Artificial
  CRISPR gRNA sequence
cctgggggtggaggaatcca

SEQ ID NO: 297930 - DNA, 20 bp, Artificial
  CRISPR gRNA sequence
ctgggggtggaggaatccaa

SEQ ID NO: 297931 - DNA, 20 bp, Artificial
  CRISPR gRNA sequence
ggggtggaggaatccaaggg

SEQ ID NO: 297932 - DNA, 20 bp, Artificial
  CRISPR gRNA sequence
gggtggaggaatccaagggt

SEQ ID NO: 297933 - DNA, 20 bp, Artificial
  CRISPR gRNA sequence
ggtggaggaatccaagggtg

SEQ ID NO: 297934 - DNA, 20 bp, Artificial
  CRISPR gRNA sequence
tggaggaatccaagggtggg

SEQ ID NO: 297935 - DNA, 20 bp, Artificial
  CRISPR gRNA sequence
caagggtggggagaattcat

SEQ ID NO: 297936 - DNA, 20 bp, Artificial
  CRISPR gRNA sequence
aagggtggggagaattcatg

SEQ ID NO: 297937 - DNA, 20 bp, Artificial
  CRISPR gRNA sequence
ggagaattcatgaggaaaat

SEQ ID NO: 297938 - DNA, 20 bp, Artificial
  CRISPR gRNA sequence
gagaattcatgaggaaaatg

SEQ ID NO: 297939 - DNA, 20 bp, Artificial
  CRISPR gRNA sequence
attcatgaggaaaatgaggt

SEQ ID NO: 297940 - DNA, 20 bp, Artificial
  CRISPR gRNA sequence
tcatgaggaaaatgaggtga

SEQ ID NO: 297941 - DNA, 20 bp, Artificial
  CRISPR gRNA sequence
catgaggaaaatgaggtgag

SEQ ID NO: 297942 - DNA, 20 bp, Artificial
  CRISPR gRNA sequence
atgaggaaaatgaggtgaga

SEQ ID NO: 297943 - DNA, 20 bp, Artificial
  CRISPR gRNA sequence
ggaaaatgaggtgagagggc

SEQ ID NO: 297944 - DNA, 20 bp, Artificial
  CRISPR gRNA sequence
gaaaatgaggtgagagggct

SEQ ID NO: 297945 - DNA, 20 bp, Artificial
  CRISPR gRNA sequence
aaatgaggtgagagggctag

SEQ ID NO: 297946 - DNA, 20 bp, Artificial
  CRISPR gRNA sequence
tgaggtgagagggctaggag

SEQ ID NO: 297947 - DNA, 20 bp, Artificial
  CRISPR gRNA sequence
tgagagggctaggagtggaa

SEQ ID NO: 297948 - DNA, 20 bp, Artificial
  CRISPR gRNA sequence
gctaggagtggaaaagtaca

SEQ ID NO: 297949 - DNA, 20 bp, Artificial
  CRISPR gRNA sequence
gtggaaaagtacaaagtact

SEQ ID NO: 297950 - DNA, 20 bp, Artificial
  CRISPR gRNA sequence
aaaagtacaaagtactgagt

SEQ ID NO: 297951 - DNA, 20 bp, Artificial
  CRISPR gRNA sequence
tacaaagtactgagttagcg

SEQ ID NO: 297952 - DNA, 20 bp, Artificial
  CRISPR gRNA sequence
acaaagtactgagttagcgt

SEQ ID NO: 297953 - DNA, 20 bp, Artificial
  CRISPR gRNA sequence
caaagtactgagttagcgtg

SEQ ID NO: 297954 - DNA, 20 bp, Artificial
  CRISPR gRNA sequence
tactgagttagcgtggggaa

SEQ ID NO: 297955 - DNA, 20 bp, Artificial
  CRISPR gRNA sequence
agcgtggggaatagtgtctt

SEQ ID NO: 297956 - DNA, 20 bp, Artificial
  CRISPR gRNA sequence
gcgtggggaatagtgtcttt

SEQ ID NO: 297957 - DNA, 20 bp, Artificial
  CRISPR gRNA sequence
cgtggggaatagtgtcttta

SEQ ID NO: 297958 - DNA, 20 bp, Artificial
  CRISPR gRNA sequence
gggaatagtgtctttagggc

SEQ ID NO: 297959 - DNA, 20 bp, Artificial
  CRISPR gRNA sequence
ggaatagtgtctttagggct

SEQ ID NO: 297960 - DNA, 20 bp, Artificial
  CRISPR gRNA sequence
aatagtgtctttagggctag

SEQ ID NO: 297961 - DNA, 20 bp, Artificial
  CRISPR gRNA sequence
agtgtctttagggctaggag

SEQ ID NO: 297962 - DNA, 20 bp, Artificial
  CRISPR gRNA sequence
gctaggagtggaaaaaatac

SEQ ID NO: 297963 - DNA, 20 bp, Artificial
  CRISPR gRNA sequence
ctaggagtggaaaaaatact

SEQ ID NO: 297964 - DNA, 20 bp, Artificial
  CRISPR gRNA sequence
tggaaaaaatactaggtact

SEQ ID NO: 297965 - DNA, 20 bp, Artificial
  CRISPR gRNA sequence
aaaaatactaggtactgagt

SEQ ID NO: 297966 - DNA, 20 bp, Artificial
  CRISPR gRNA sequence
aaatactaggtactgagtca

SEQ ID NO: 297967 - DNA, 20 bp, Artificial
  CRISPR gRNA sequence
tactaggtactgagtcagag

SEQ ID NO: 297968 - DNA, 20 bp, Artificial
  CRISPR gRNA sequence
tactgagtcagagtggaaaa

SEQ ID NO: 297969 - DNA, 20 bp, Artificial
  CRISPR gRNA sequence
gagtggaaaacagtgtcttc

SEQ ID NO: 297970 - DNA, 20 bp, Artificial
  CRISPR gRNA sequence
agtggaaaacagtgtcttca

SEQ ID NO: 297971 - DNA, 20 bp, Artificial
  CRISPR gRNA sequence
ggaaaacagtgtcttcaagg

SEQ ID NO: 297972 - DNA, 20 bp, Artificial
  CRISPR gRNA sequence
gaaaacagtgtcttcaaggc

SEQ ID NO: 297973 - DNA, 20 bp, Artificial
  CRISPR gRNA sequence
aaaacagtgtcttcaaggca

SEQ ID NO: 297974 - DNA, 20 bp, Artificial
  CRISPR gRNA sequence
aacagtgtcttcaaggcagg

SEQ ID NO: 297975 - DNA, 20 bp, Artificial
  CRISPR gRNA sequence
agtgtcttcaaggcagggag

SEQ ID NO: 297976 - DNA, 20 bp, Artificial
  CRISPR gRNA sequence
cttcaaggcagggagtggaa

SEQ ID NO: 297977 - DNA, 20 bp, Artificial
  CRISPR gRNA sequence
ggcagggagtggaaaagtgc

SEQ ID NO: 297978 - DNA, 20 bp, Artificial
  CRISPR gRNA sequence
gcagggagtggaaaagtgct

SEQ ID NO: 297979 - DNA, 20 bp, Artificial
  CRISPR gRNA sequence
gtggaaaagtgctaggtact

SEQ ID NO: 297980 - DNA, 20 bp, Artificial
  CRISPR gRNA sequence
aagtgctaggtactgagtcc

SEQ ID NO: 297981 - DNA, 20 bp, Artificial
  CRISPR gRNA sequence
tgctaggtactgagtccgag

SEQ ID NO: 297982 - DNA, 20 bp, Artificial
  CRISPR gRNA sequence
ctaggtactgagtccgagtg

SEQ ID NO: 297983 - DNA, 20 bp, Artificial
  CRISPR gRNA sequence
tactgagtccgagtggagaa

SEQ ID NO: 297984 - DNA, 20 bp, Artificial
  CRISPR gRNA sequence
aaaagtgtcttctctatgat

SEQ ID NO: 297985 - DNA, 20 bp, Artificial
  CRISPR gRNA sequence
aaagtgtcttctctatgatg

SEQ ID NO: 297986 - DNA, 20 bp, Artificial
  CRISPR gRNA sequence
agtgtcttctctatgatgag

SEQ ID NO: 297987 - DNA, 20 bp, Artificial
  CRISPR gRNA sequence
gtgtcttctctatgatgagg

SEQ ID NO: 297988 - DNA, 20 bp, Artificial
  CRISPR gRNA sequence
tctctatgatgaggaggctt

SEQ ID NO: 297989 - DNA, 20 bp, Artificial
  CRISPR gRNA sequence
ctatgatgaggaggcttcag

SEQ ID NO: 297990 - DNA, 20 bp, Artificial
  CRISPR gRNA sequence
atgatgaggaggcttcagca

SEQ ID NO: 297991 - DNA, 20 bp, Artificial
  CRISPR gRNA sequence
tgatgaggaggcttcagcag

SEQ ID NO: 297992 - DNA, 20 bp, Artificial
  CRISPR gRNA sequence
ggcttcagcagaggtgcctg

SEQ ID NO: 297993 - DNA, 20 bp, Artificial
  CRISPR gRNA sequence
ggtgcctgaagacctcaccc

SEQ ID NO: 297994 - DNA, 20 bp, Artificial
  CRISPR gRNA sequence
tgcctgaagacctcacccca

SEQ ID NO: 297995 - DNA, 20 bp, Artificial
  CRISPR gRNA sequence
aagacctcaccccagagcct

SEQ ID NO: 297996 - DNA, 20 bp, Artificial
  CRISPR gRNA sequence
tcaccccagagcctcagata

SEQ ID NO: 297997 - DNA, 20 bp, Artificial
  CRISPR gRNA sequence
accccagagcctcagataaa

SEQ ID NO: 297998 - DNA, 20 bp, Artificial
  CRISPR gRNA sequence
agcctcagataaagagacct

SEQ ID NO: 297999 - DNA, 20 bp, Artificial
  CRISPR gRNA sequence
agataaagagacctaagaat

SEQ ID NO: 298000 - DNA, 20 bp, Artificial
  CRISPR gRNA sequence
gataaagagacctaagaatg

SEQ ID NO: 298001 - DNA, 20 bp, Artificial
  CRISPR gRNA sequence
ataaagagacctaagaatga

SEQ ID NO: 298002 - DNA, 20 bp, Artificial
  CRISPR gRNA sequence
gacctaagaatgagggtgcc

SEQ ID NO: 298003 - DNA, 20 bp, Artificial
  CRISPR gRNA sequence
acctaagaatgagggtgcct

SEQ ID NO: 298004 - DNA, 20 bp, Artificial
  CRISPR gRNA sequence
agaatgagggtgcctgggct

SEQ ID NO: 298005 - DNA, 20 bp, Artificial
  CRISPR gRNA sequence
ggtgcctgggctaagattgc

SEQ ID NO: 298006 - DNA, 20 bp, Artificial
  CRISPR gRNA sequence
aagattgcaagtatgtgaaa

SEQ ID NO: 298007 - DNA, 20 bp, Artificial
  CRISPR gRNA sequence
agtatgtgaaaaagcatgac

SEQ ID NO: 298008 - DNA, 20 bp, Artificial
  CRISPR gRNA sequence
atgtgaaaaagcatgactgg

SEQ ID NO: 298009 - DNA, 20 bp, Artificial
  CRISPR gRNA sequence
tgtgaaaaagcatgactggc

SEQ ID NO: 298010 - DNA, 20 bp, Artificial
  CRISPR gRNA sequence
tgaaaaagcatgactggcgg

SEQ ID NO: 298011 - DNA, 20 bp, Artificial
  CRISPR gRNA sequence
gaaaaagcatgactggcggg

SEQ ID NO: 298012 - DNA, 20 bp, Artificial
  CRISPR gRNA sequence
agcatgactggcgggaggct

SEQ ID NO: 298013 - DNA, 20 bp, Artificial
  CRISPR gRNA sequence
ggaggctgagatcttgattg

SEQ ID NO: 298014 - DNA, 20 bp, Artificial
  CRISPR gRNA sequence
atcttgattgcagccccctt

SEQ ID NO: 298015 - DNA, 20 bp, Artificial
  CRISPR gRNA sequence
cttgattgcagcccccttca

SEQ ID NO: 298016 - DNA, 20 bp, Artificial
  CRISPR gRNA sequence
ccatgcactgactgtgcacc

SEQ ID NO: 298017 - DNA, 20 bp, Artificial
  CRISPR gRNA sequence
actgtgcaccaagtctgctg

SEQ ID NO: 298018 - DNA, 20 bp, Artificial
  CRISPR gRNA sequence
tgcaccaagtctgctgtaga

SEQ ID NO: 298019 - DNA, 20 bp, Artificial
  CRISPR gRNA sequence
gcaccaagtctgctgtagaa

SEQ ID NO: 298020 - DNA, 20 bp, Artificial
  CRISPR gRNA sequence
caccaagtctgctgtagaaa

SEQ ID NO: 298021 - DNA, 20 bp, Artificial
  CRISPR gRNA sequence
tgtagaaagggcaacttcct

SEQ ID NO: 298022 - DNA, 20 bp, Artificial
  CRISPR gRNA sequence
gaaagggcaacttcctcagc

SEQ ID NO: 298023 - DNA, 20 bp, Artificial
  CRISPR gRNA sequence
aaagggcaacttcctcagca

SEQ ID NO: 298024 - DNA, 20 bp, Artificial
  CRISPR gRNA sequence
acttcctcagcaaggcttgt

SEQ ID NO: 298025 - DNA, 20 bp, Artificial
  CRISPR gRNA sequence
tcagcaaggcttgtcagatt

SEQ ID NO: 298026 - DNA, 20 bp, Artificial
  CRISPR gRNA sequence
taagcctctttaattgcctg

SEQ ID NO: 298027 - DNA, 20 bp, Artificial
  CRISPR gRNA sequence
cctctttaattgcctgtggt

SEQ ID NO: 298028 - DNA, 20 bp, Artificial
  CRISPR gRNA sequence
ctctttaattgcctgtggtc

SEQ ID NO: 298029 - DNA, 20 bp, Artificial
  CRISPR gRNA sequence
caggtctgaaaaatcacaca

SEQ ID NO: 298030 - DNA, 20 bp, Artificial
  CRISPR gRNA sequence
atcacacatagatttttaat

SEQ ID NO: 298031 - DNA, 20 bp, Artificial
  CRISPR gRNA sequence
atagatttttaatcagaacc

SEQ ID NO: 298032 - DNA, 20 bp, Artificial
  CRISPR gRNA sequence
taatcagaacccagacatct

SEQ ID NO: 298033 - DNA, 20 bp, Artificial
  CRISPR gRNA sequence
aatcagaacccagacatctc

SEQ ID NO: 298034 - DNA, 20 bp, Artificial
  CRISPR gRNA sequence
tcagaacccagacatctcag

SEQ ID NO: 298035 - DNA, 20 bp, Artificial
  CRISPR gRNA sequence
agaacccagacatctcagga

SEQ ID NO: 298036 - DNA, 20 bp, Artificial
  CRISPR gRNA sequence
cccagacatctcaggagaga

SEQ ID NO: 298037 - DNA, 20 bp, Artificial
  CRISPR gRNA sequence
gtgtcatgtcatgtcatgat

SEQ ID NO: 298038 - DNA, 20 bp, Artificial
  CRISPR gRNA sequence
ataagtaccacaataaatat

SEQ ID NO: 298039 - DNA, 20 bp, Artificial
  CRISPR gRNA sequence
gtaccacaataaatataagt

SEQ ID NO: 298040 - DNA, 20 bp, Artificial
  CRISPR gRNA sequence
caataaatataagtcagcat

SEQ ID NO: 298041 - DNA, 20 bp, Artificial
  CRISPR gRNA sequence
aataaatataagtcagcatg

SEQ ID NO: 298042 - DNA, 20 bp, Artificial
  CRISPR gRNA sequence
ataaatataagtcagcatga

SEQ ID NO: 298043 - DNA, 20 bp, Artificial
  CRISPR gRNA sequence
atataagtcagcatgaggga

SEQ ID NO: 298044 - DNA, 20 bp, Artificial
  CRISPR gRNA sequence
agcatgagggacagaatgcc

SEQ ID NO: 298045 - DNA, 20 bp, Artificial
  CRISPR gRNA sequence
gcatgagggacagaatgccc

SEQ ID NO: 298046 - DNA, 20 bp, Artificial
  CRISPR gRNA sequence
gcccaggatgctatcttcaa

SEQ ID NO: 298047 - DNA, 20 bp, Artificial
  CRISPR gRNA sequence
ggatgctatcttcaatagaa

SEQ ID NO: 298048 - DNA, 20 bp, Artificial
  CRISPR gRNA sequence
gctatcttcaatagaatggt

SEQ ID NO: 298049 - DNA, 20 bp, Artificial
  CRISPR gRNA sequence
tatcttcaatagaatggtta

SEQ ID NO: 298050 - DNA, 20 bp, Artificial
  CRISPR gRNA sequence
aatggttagagaaatctccc

SEQ ID NO: 298051 - DNA, 20 bp, Artificial
  CRISPR gRNA sequence
atggttagagaaatctccct

SEQ ID NO: 298052 - DNA, 20 bp, Artificial
  CRISPR gRNA sequence
ggttagagaaatctccctgg

SEQ ID NO: 298053 - DNA, 20 bp, Artificial
  CRISPR gRNA sequence
gttagagaaatctccctggg

SEQ ID NO: 298054 - DNA, 20 bp, Artificial
  CRISPR gRNA sequence
agagaaatctccctgggagg

SEQ ID NO: 298055 - DNA, 20 bp, Artificial
  CRISPR gRNA sequence
tgggaggtagcatttaatga

SEQ ID NO: 298056 - DNA, 20 bp, Artificial
  CRISPR gRNA sequence
tttaatgaaagacctacatg

SEQ ID NO: 298057 - DNA, 20 bp, Artificial
  CRISPR gRNA sequence
tgaaagacctacatgaagtg

SEQ ID NO: 298058 - DNA, 20 bp, Artificial
  CRISPR gRNA sequence
gaaagacctacatgaagtga

SEQ ID NO: 298059 - DNA, 20 bp, Artificial
  CRISPR gRNA sequence
aagacctacatgaagtgaag

SEQ ID NO: 298060 - DNA, 20 bp, Artificial
  CRISPR gRNA sequence
acctacatgaagtgaaggag

SEQ ID NO: 298061 - DNA, 20 bp, Artificial
  CRISPR gRNA sequence
tgaagtgaaggagaagctat

SEQ ID NO: 298062 - DNA, 20 bp, Artificial
  CRISPR gRNA sequence
ggagaagctatgagactgtc

SEQ ID NO: 298063 - DNA, 20 bp, Artificial
  CRISPR gRNA sequence
agaagctatgagactgtctg

SEQ ID NO: 298064 - DNA, 20 bp, Artificial
  CRISPR gRNA sequence
gaagctatgagactgtctgg

SEQ ID NO: 298065 - DNA, 20 bp, Artificial
  CRISPR gRNA sequence
gctatgagactgtctggagg

SEQ ID NO: 298066 - DNA, 20 bp, Artificial
  CRISPR gRNA sequence
tgtctggaggaagaaccttc

SEQ ID NO: 298067 - DNA, 20 bp, Artificial
  CRISPR gRNA sequence
tggaggaagaaccttctgga

SEQ ID NO: 298068 - DNA, 20 bp, Artificial
  CRISPR gRNA sequence
gaggaagaaccttctggaca

SEQ ID NO: 298069 - DNA, 20 bp, Artificial
  CRISPR gRNA sequence
aggaagaaccttctggacag

SEQ ID NO: 298070 - DNA, 20 bp, Artificial
  CRISPR gRNA sequence
ggaagaaccttctggacaga

SEQ ID NO: 298071 - DNA, 20 bp, Artificial
  CRISPR gRNA sequence
ctggacagagggaacaacat

SEQ ID NO: 298072 - DNA, 20 bp, Artificial
  CRISPR gRNA sequence
gacagagggaacaacatgag

SEQ ID NO: 298073 - DNA, 20 bp, Artificial
  CRISPR gRNA sequence
cagagggaacaacatgagaa

SEQ ID NO: 298074 - DNA, 20 bp, Artificial
  CRISPR gRNA sequence
agagggaacaacatgagaag

SEQ ID NO: 298075 - DNA, 20 bp, Artificial
  CRISPR gRNA sequence
acaacatgagaagaggactt

SEQ ID NO: 298076 - DNA, 20 bp, Artificial
  CRISPR gRNA sequence
catgagaagaggacttgaga

SEQ ID NO: 298077 - DNA, 20 bp, Artificial
  CRISPR gRNA sequence
tgagaagaggacttgagaca

SEQ ID NO: 298078 - DNA, 20 bp, Artificial
  CRISPR gRNA sequence
agacagagtgtgtgatcttt

SEQ ID NO: 298079 - DNA, 20 bp, Artificial
  CRISPR gRNA sequence
acagagtgtgtgatcttttg

SEQ ID NO: 298080 - DNA, 20 bp, Artificial
  CRISPR gRNA sequence
cagagtgtgtgatcttttgg

SEQ ID NO: 298081 - DNA, 20 bp, Artificial
  CRISPR gRNA sequence
tgatcttttggaggaatgtc

SEQ ID NO: 298082 - DNA, 20 bp, Artificial
  CRISPR gRNA sequence
gatcttttggaggaatgtca

SEQ ID NO: 298083 - DNA, 20 bp, Artificial
  CRISPR gRNA sequence
atcttttggaggaatgtcaa

SEQ ID NO: 298084 - DNA, 20 bp, Artificial
  CRISPR gRNA sequence
cttttggaggaatgtcaagg

SEQ ID NO: 298085 - DNA, 20 bp, Artificial
  CRISPR gRNA sequence
ttttggaggaatgtcaaggg

SEQ ID NO: 298086 - DNA, 20 bp, Artificial
  CRISPR gRNA sequence
tggaggaatgtcaagggagg

SEQ ID NO: 298087 - DNA, 20 bp, Artificial
  CRISPR gRNA sequence
gaatgtcaagggaggcagtg

SEQ ID NO: 298088 - DNA, 20 bp, Artificial
  CRISPR gRNA sequence
gtcaagggaggcagtgtggc

SEQ ID NO: 298089 - DNA, 20 bp, Artificial
  CRISPR gRNA sequence
tcaagggaggcagtgtggct

SEQ ID NO: 298090 - DNA, 20 bp, Artificial
  CRISPR gRNA sequence
caagggaggcagtgtggctg

SEQ ID NO: 298091 - DNA, 20 bp, Artificial
  CRISPR gRNA sequence
agggaggcagtgtggctggg

SEQ ID NO: 298092 - DNA, 20 bp, Artificial
  CRISPR gRNA sequence
ggaggcagtgtggctgggga

SEQ ID NO: 298093 - DNA, 20 bp, Artificial
  CRISPR gRNA sequence
gcagtgtggctggggagagt

SEQ ID NO: 298094 - DNA, 20 bp, Artificial
  CRISPR gRNA sequence
gtgtggctggggagagtaag

SEQ ID NO: 298095 - DNA, 20 bp, Artificial
  CRISPR gRNA sequence
tgtggctggggagagtaagc

SEQ ID NO: 298096 - DNA, 20 bp, Artificial
  CRISPR gRNA sequence
gtggctggggagagtaagca

SEQ ID NO: 298097 - DNA, 20 bp, Artificial
  CRISPR gRNA sequence
tggctggggagagtaagcag

SEQ ID NO: 298098 - DNA, 20 bp, Artificial
  CRISPR gRNA sequence
tggggagagtaagcagggga

SEQ ID NO: 298099 - DNA, 20 bp, Artificial
  CRISPR gRNA sequence
gggagagtaagcaggggaaa

SEQ ID NO: 298100 - DNA, 20 bp, Artificial
  CRISPR gRNA sequence
ggagagtaagcaggggaaag

SEQ ID NO: 298101 - DNA, 20 bp, Artificial
  CRISPR gRNA sequence
agcaggggaaagaggcctga

SEQ ID NO: 298102 - DNA, 20 bp, Artificial
  CRISPR gRNA sequence
gcaggggaaagaggcctgat

SEQ ID NO: 298103 - DNA, 20 bp, Artificial
  CRISPR gRNA sequence
gaaagaggcctgataggtac

SEQ ID NO: 298104 - DNA, 20 bp, Artificial
  CRISPR gRNA sequence
aaagaggcctgataggtact

SEQ ID NO: 298105 - DNA, 20 bp, Artificial
  CRISPR gRNA sequence
aagaggcctgataggtactg

SEQ ID NO: 298106 - DNA, 20 bp, Artificial
  CRISPR gRNA sequence
tactggggacccaattacat

SEQ ID NO: 298107 - DNA, 20 bp, Artificial
  CRISPR gRNA sequence
actggggacccaattacatg

SEQ ID NO: 298108 - DNA, 20 bp, Artificial
  CRISPR gRNA sequence
ccaattacatgaggtcttgt

SEQ ID NO: 298109 - DNA, 20 bp, Artificial
  CRISPR gRNA sequence
caattacatgaggtcttgta

SEQ ID NO: 298110 - DNA, 20 bp, Artificial
  CRISPR gRNA sequence
tacatgaggtcttgtaaggc

SEQ ID NO: 298111 - DNA, 20 bp, Artificial
  CRISPR gRNA sequence
acatgaggtcttgtaaggcc

SEQ ID NO: 298112 - DNA, 20 bp, Artificial
  CRISPR gRNA sequence
catgaggtcttgtaaggcca

SEQ ID NO: 298113 - DNA, 20 bp, Artificial
  CRISPR gRNA sequence
atgaggtcttgtaaggccag

SEQ ID NO: 298114 - DNA, 20 bp, Artificial
  CRISPR gRNA sequence
aggtcttgtaaggccagggg

SEQ ID NO: 298115 - DNA, 20 bp, Artificial
  CRISPR gRNA sequence
ggtcttgtaaggccagggga

SEQ ID NO: 298116 - DNA, 20 bp, Artificial
  CRISPR gRNA sequence
taaggccaggggaaggactt

SEQ ID NO: 298117 - DNA, 20 bp, Artificial
  CRISPR gRNA sequence
caggggaaggactttggatg

SEQ ID NO: 298118 - DNA, 20 bp, Artificial
  CRISPR gRNA sequence
aggactttggatgtagttct

SEQ ID NO: 298119 - DNA, 20 bp, Artificial
  CRISPR gRNA sequence
ttggatgtagttctcagtgt

SEQ ID NO: 298120 - DNA, 20 bp, Artificial
  CRISPR gRNA sequence
tggatgtagttctcagtgtg

SEQ ID NO: 298121 - DNA, 20 bp, Artificial
  CRISPR gRNA sequence
ggatgtagttctcagtgtga

SEQ ID NO: 298122 - DNA, 20 bp, Artificial
  CRISPR gRNA sequence
gatgtagttctcagtgtgag

SEQ ID NO: 298123 - DNA, 20 bp, Artificial
  CRISPR gRNA sequence
gtagttctcagtgtgagggg

SEQ ID NO: 298124 - DNA, 20 bp, Artificial
  CRISPR gRNA sequence
tagttctcagtgtgagggga

SEQ ID NO: 298125 - DNA, 20 bp, Artificial
  CRISPR gRNA sequence
agttctcagtgtgaggggaa

SEQ ID NO: 298126 - DNA, 20 bp, Artificial
  CRISPR gRNA sequence
cagtgtgaggggaagggatc

SEQ ID NO: 298127 - DNA, 20 bp, Artificial
  CRISPR gRNA sequence
agggatctggatatattttt

SEQ ID NO: 298128 - DNA, 20 bp, Artificial
  CRISPR gRNA sequence
tctggatatatttttcagtt

SEQ ID NO: 298129 - DNA, 20 bp, Artificial
  CRISPR gRNA sequence
ggatatatttttcagtttgg

SEQ ID NO: 298130 - DNA, 20 bp, Artificial
  CRISPR gRNA sequence
tatatttttcagtttggtgg

SEQ ID NO: 298131 - DNA, 20 bp, Artificial
  CRISPR gRNA sequence
atatttttcagtttggtgga

SEQ ID NO: 298132 - DNA, 20 bp, Artificial
  CRISPR gRNA sequence
ttcagtttggtggaaggcat

SEQ ID NO: 298133 - DNA, 20 bp, Artificial
  CRISPR gRNA sequence
cagtttggtggaaggcatca

SEQ ID NO: 298134 - DNA, 20 bp, Artificial
  CRISPR gRNA sequence
agtttggtggaaggcatcag

SEQ ID NO: 298135 - DNA, 20 bp, Artificial
  CRISPR gRNA sequence
aggcatcagaggcttctgaa

SEQ ID NO: 298136 - DNA, 20 bp, Artificial
  CRISPR gRNA sequence
ggcatcagaggcttctgaac

SEQ ID NO: 298137 - DNA, 20 bp, Artificial
  CRISPR gRNA sequence
catcagaggcttctgaacag

SEQ ID NO: 298138 - DNA, 20 bp, Artificial
  CRISPR gRNA sequence
atcagaggcttctgaacagg

SEQ ID NO: 298139 - DNA, 20 bp, Artificial
  CRISPR gRNA sequence
gaacaggaggattatgtgat

SEQ ID NO: 298140 - DNA, 20 bp, Artificial
  CRISPR gRNA sequence
acaggaggattatgtgattg

SEQ ID NO: 298141 - DNA, 20 bp, Artificial
  CRISPR gRNA sequence
gtgattggagctgtattttt

SEQ ID NO: 298142 - DNA, 20 bp, Artificial
  CRISPR gRNA sequence
tgattggagctgtattttta

SEQ ID NO: 298143 - DNA, 20 bp, Artificial
  CRISPR gRNA sequence
gattggagctgtatttttaa

SEQ ID NO: 298144 - DNA, 20 bp, Artificial
  CRISPR gRNA sequence
gtatttttaagggatcattt

SEQ ID NO: 298145 - DNA, 20 bp, Artificial
  CRISPR gRNA sequence
ttaagggatcattttggctt

SEQ ID NO: 298146 - DNA, 20 bp, Artificial
  CRISPR gRNA sequence
atcattttggcttgagaaac

SEQ ID NO: 298147 - DNA, 20 bp, Artificial
  CRISPR gRNA sequence
ttggcttgagaaactagacc

SEQ ID NO: 298148 - DNA, 20 bp, Artificial
  CRISPR gRNA sequence
tggcttgagaaactagaccc

SEQ ID NO: 298149 - DNA, 20 bp, Artificial
  CRISPR gRNA sequence
ggcttgagaaactagacccg

SEQ ID NO: 298150 - DNA, 20 bp, Artificial
  CRISPR gRNA sequence
gagaaactagacccggggac

SEQ ID NO: 298151 - DNA, 20 bp, Artificial
  CRISPR gRNA sequence
agaaactagacccggggaca

SEQ ID NO: 298152 - DNA, 20 bp, Artificial
  CRISPR gRNA sequence
actagacccggggacaagga

SEQ ID NO: 298153 - DNA, 20 bp, Artificial
  CRISPR gRNA sequence
tagacccggggacaaggacg

SEQ ID NO: 298154 - DNA, 20 bp, Artificial
  CRISPR gRNA sequence
acccggggacaaggacggag

SEQ ID NO: 298155 - DNA, 20 bp, Artificial
  CRISPR gRNA sequence
cccggggacaaggacggagc

SEQ ID NO: 298156 - DNA, 20 bp, Artificial
  CRISPR gRNA sequence
ggggacaaggacggagcagg

SEQ ID NO: 298157 - DNA, 20 bp, Artificial
  CRISPR gRNA sequence
caaggacggagcaggcagat

SEQ ID NO: 298158 - DNA, 20 bp, Artificial
  CRISPR gRNA sequence
gacggagcaggcagatgagt

SEQ ID NO: 298159 - DNA, 20 bp, Artificial
  CRISPR gRNA sequence
acggagcaggcagatgagtt

SEQ ID NO: 298160 - DNA, 20 bp, Artificial
  CRISPR gRNA sequence
ggagcaggcagatgagttag

SEQ ID NO: 298161 - DNA, 20 bp, Artificial
  CRISPR gRNA sequence
gagttaggagacaattacat

SEQ ID NO: 298162 - DNA, 20 bp, Artificial
  CRISPR gRNA sequence
ctacccttttcttaacatat

SEQ ID NO: 298163 - DNA, 20 bp, Artificial
  CRISPR gRNA sequence
acccttttcttaacatattg

SEQ ID NO: 298164 - DNA, 20 bp, Artificial
  CRISPR gRNA sequence
tttcttaacatattggagtt

SEQ ID NO: 298165 - DNA, 20 bp, Artificial
  CRISPR gRNA sequence
aacatattggagttcagctc

SEQ ID NO: 298166 - DNA, 20 bp, Artificial
  CRISPR gRNA sequence
ttggagttcagctctggctg

SEQ ID NO: 298167 - DNA, 20 bp, Artificial
  CRISPR gRNA sequence
gagttcagctctggctgtag

SEQ ID NO: 298168 - DNA, 20 bp, Artificial
  CRISPR gRNA sequence
agctctggctgtagtagttc

SEQ ID NO: 298169 - DNA, 20 bp, Artificial
  CRISPR gRNA sequence
gtagtagttctagatctcct

SEQ ID NO: 298170 - DNA, 20 bp, Artificial
  CRISPR gRNA sequence
tctcctcagacacacttgtg

SEQ ID NO: 298171 - DNA, 20 bp, Artificial
  CRISPR gRNA sequence
tcctcagacacacttgtgta

SEQ ID NO: 298172 - DNA, 20 bp, Artificial
  CRISPR gRNA sequence
cacttgtgtagagcctctgt

SEQ ID NO: 298173 - DNA, 20 bp, Artificial
  CRISPR gRNA sequence
acttgtgtagagcctctgtt

SEQ ID NO: 298174 - DNA, 20 bp, Artificial
  CRISPR gRNA sequence
agagcctctgttgggtattt

SEQ ID NO: 298175 - DNA, 20 bp, Artificial
  CRISPR gRNA sequence
gagcctctgttgggtatttt

SEQ ID NO: 298176 - DNA, 20 bp, Artificial
  CRISPR gRNA sequence
ggtacacaaatgattcatct

SEQ ID NO: 298177 - DNA, 20 bp, Artificial
  CRISPR gRNA sequence
aatgattcatcttggttata

SEQ ID NO: 298178 - DNA, 20 bp, Artificial
  CRISPR gRNA sequence
tcttggttatacagatgatt

SEQ ID NO: 298179 - DNA, 20 bp, Artificial
  CRISPR gRNA sequence
acagatgatttagatgattg

SEQ ID NO: 298180 - DNA, 20 bp, Artificial
  CRISPR gRNA sequence
atgatttagatgattgtaga

SEQ ID NO: 298181 - DNA, 20 bp, Artificial
  CRISPR gRNA sequence
atttagatgattgtagacag

SEQ ID NO: 298182 - DNA, 20 bp, Artificial
  CRISPR gRNA sequence
ttagatgattgtagacagaa

SEQ ID NO: 298183 - DNA, 20 bp, Artificial
  CRISPR gRNA sequence
tagatgattgtagacagaag

SEQ ID NO: 298184 - DNA, 20 bp, Artificial
  CRISPR gRNA sequence
agatgattgtagacagaaga

SEQ ID NO: 298185 - DNA, 20 bp, Artificial
  CRISPR gRNA sequence
gtagacagaagagggttgtc

SEQ ID NO: 298186 - DNA, 20 bp, Artificial
  CRISPR gRNA sequence
gagggttgtctggtcattcc

SEQ ID NO: 298187 - DNA, 20 bp, Artificial
  CRISPR gRNA sequence
gttgtctggtcattcccaga

SEQ ID NO: 298188 - DNA, 20 bp, Artificial
  CRISPR gRNA sequence
ttgtctggtcattcccagac

SEQ ID NO: 298189 - DNA, 20 bp, Artificial
  CRISPR gRNA sequence
tgtctggtcattcccagaca

SEQ ID NO: 298190 - DNA, 20 bp, Artificial
  CRISPR gRNA sequence
gtctggtcattcccagacag

SEQ ID NO: 298191 - DNA, 20 bp, Artificial
  CRISPR gRNA sequence
ctggtcattcccagacaggg

SEQ ID NO: 298192 - DNA, 20 bp, Artificial
  CRISPR gRNA sequence
cagacaggggagcattcctt

SEQ ID NO: 298193 - DNA, 20 bp, Artificial
  CRISPR gRNA sequence
caggggagcattccttgaga

SEQ ID NO: 298194 - DNA, 20 bp, Artificial
  CRISPR gRNA sequence
ggggagcattccttgagata

SEQ ID NO: 298195 - DNA, 20 bp, Artificial
  CRISPR gRNA sequence
gagcattccttgagatagag

SEQ ID NO: 298196 - DNA, 20 bp, Artificial
  CRISPR gRNA sequence
gcattccttgagatagagta

SEQ ID NO: 298197 - DNA, 20 bp, Artificial
  CRISPR gRNA sequence
cattccttgagatagagtag

SEQ ID NO: 298198 - DNA, 20 bp, Artificial
  CRISPR gRNA sequence
tccttgagatagagtagagg

SEQ ID NO: 298199 - DNA, 20 bp, Artificial
  CRISPR gRNA sequence
ccttgagatagagtagagga

SEQ ID NO: 298200 - DNA, 20 bp, Artificial
  CRISPR gRNA sequence
gatagagtagaggaaggctg

SEQ ID NO: 298201 - DNA, 20 bp, Artificial
  CRISPR gRNA sequence
atagagtagaggaaggctga

SEQ ID NO: 298202 - DNA, 20 bp, Artificial
  CRISPR gRNA sequence
tagagtagaggaaggctgaa

SEQ ID NO: 298203 - DNA, 20 bp, Artificial
  CRISPR gRNA sequence
agagtagaggaaggctgaag

SEQ ID NO: 298204 - DNA, 20 bp, Artificial
  CRISPR gRNA sequence
agtagaggaaggctgaaggg

SEQ ID NO: 298205 - DNA, 20 bp, Artificial
  CRISPR gRNA sequence
gtagaggaaggctgaagggg

SEQ ID NO: 298206 - DNA, 20 bp, Artificial
  CRISPR gRNA sequence
gaggaaggctgaaggggagg

SEQ ID NO: 298207 - DNA, 20 bp, Artificial
  CRISPR gRNA sequence
aaggctgaaggggaggaaga

SEQ ID NO: 298208 - DNA, 20 bp, Artificial
  CRISPR gRNA sequence
agacagtacctgttgctatc

SEQ ID NO: 298209 - DNA, 20 bp, Artificial
  CRISPR gRNA sequence
agtacctgttgctatctaga

SEQ ID NO: 298210 - DNA, 20 bp, Artificial
  CRISPR gRNA sequence
tacctgttgctatctagata

SEQ ID NO: 298211 - DNA, 20 bp, Artificial
  CRISPR gRNA sequence
gctatctagatagagacatc

SEQ ID NO: 298212 - DNA, 20 bp, Artificial
  CRISPR gRNA sequence
atctagatagagacatccag

SEQ ID NO: 298213 - DNA, 20 bp, Artificial
  CRISPR gRNA sequence
tctagatagagacatccagc

SEQ ID NO: 298214 - DNA, 20 bp, Artificial
  CRISPR gRNA sequence
agatagagacatccagcagg

SEQ ID NO: 298215 - DNA, 20 bp, Artificial
  CRISPR gRNA sequence
atccagcaggaagttgaata

SEQ ID NO: 298216 - DNA, 20 bp, Artificial
  CRISPR gRNA sequence
tccagcaggaagttgaatac

SEQ ID NO: 298217 - DNA, 20 bp, Artificial
  CRISPR gRNA sequence
aatacaggtatctgaaactc

SEQ ID NO: 298218 - DNA, 20 bp, Artificial
  CRISPR gRNA sequence
ggtatctgaaactctagtga

SEQ ID NO: 298219 - DNA, 20 bp, Artificial
  CRISPR gRNA sequence
tgaaactctagtgaaagtta

SEQ ID NO: 298220 - DNA, 20 bp, Artificial
  CRISPR gRNA sequence
gaaactctagtgaaagttat

SEQ ID NO: 298221 - DNA, 20 bp, Artificial
  CRISPR gRNA sequence
ctctagtgaaagttataggc

SEQ ID NO: 298222 - DNA, 20 bp, Artificial
  CRISPR gRNA sequence
gaaagttataggctggcaat

SEQ ID NO: 298223 - DNA, 20 bp, Artificial
  CRISPR gRNA sequence
ataggctggcaataagcacc

SEQ ID NO: 298224 - DNA, 20 bp, Artificial
  CRISPR gRNA sequence
taggctggcaataagcacct

SEQ ID NO: 298225 - DNA, 20 bp, Artificial
  CRISPR gRNA sequence
ggctggcaataagcacctgg

SEQ ID NO: 298226 - DNA, 20 bp, Artificial
  CRISPR gRNA sequence
aataagcacctgggagttat

SEQ ID NO: 298227 - DNA, 20 bp, Artificial
  CRISPR gRNA sequence
agttattagcttttacttga

SEQ ID NO: 298228 - DNA, 20 bp, Artificial
  CRISPR gRNA sequence
ttacttgacagttgaatccg

SEQ ID NO: 298229 - DNA, 20 bp, Artificial
  CRISPR gRNA sequence
tacttgacagttgaatccgt

SEQ ID NO: 298230 - DNA, 20 bp, Artificial
  CRISPR gRNA sequence
acttgacagttgaatccgtg

SEQ ID NO: 298231 - DNA, 20 bp, Artificial
  CRISPR gRNA sequence
gacagttgaatccgtggggc

SEQ ID NO: 298232 - DNA, 20 bp, Artificial
  CRISPR gRNA sequence
cagttgaatccgtggggcta

SEQ ID NO: 298233 - DNA, 20 bp, Artificial
  CRISPR gRNA sequence
agttgaatccgtggggctag

SEQ ID NO: 298234 - DNA, 20 bp, Artificial
  CRISPR gRNA sequence
ttgaatccgtggggctagag

SEQ ID NO: 298235 - DNA, 20 bp, Artificial
  CRISPR gRNA sequence
tggggctagaggagaaaaac

SEQ ID NO: 298236 - DNA, 20 bp, Artificial
  CRISPR gRNA sequence
ggggctagaggagaaaaacc

SEQ ID NO: 298237 - DNA, 20 bp, Artificial
  CRISPR gRNA sequence
ctagaggagaaaaaccagga

SEQ ID NO: 298238 - DNA, 20 bp, Artificial
  CRISPR gRNA sequence
ggagaaaaaccaggaaagta

SEQ ID NO: 298239 - DNA, 20 bp, Artificial
  CRISPR gRNA sequence
agaaaaaccaggaaagtatg

SEQ ID NO: 298240 - DNA, 20 bp, Artificial
  CRISPR gRNA sequence
accaggaaagtatggagaat

SEQ ID NO: 298241 - DNA, 20 bp, Artificial
  CRISPR gRNA sequence
aggaaagtatggagaataag

SEQ ID NO: 298242 - DNA, 20 bp, Artificial
  CRISPR gRNA sequence
gtatggagaataagaagacc

SEQ ID NO: 298243 - DNA, 20 bp, Artificial
  CRISPR gRNA sequence
aagaccaagaacatgcactc

SEQ ID NO: 298244 - DNA, 20 bp, Artificial
  CRISPR gRNA sequence
agaccaagaacatgcactca

SEQ ID NO: 298245 - DNA, 20 bp, Artificial
  CRISPR gRNA sequence
actcaaggttaccaaaatta

SEQ ID NO: 298246 - DNA, 20 bp, Artificial
  CRISPR gRNA sequence
tcaaggttaccaaaattaaa

SEQ ID NO: 298247 - DNA, 20 bp, Artificial
  CRISPR gRNA sequence
ccaaaattaaagagtgattt

SEQ ID NO: 298248 - DNA, 20 bp, Artificial
  CRISPR gRNA sequence
agtgatttgagaaaattaac

SEQ ID NO: 298249 - DNA, 20 bp, Artificial
  CRISPR gRNA sequence
gtgatttgagaaaattaaca

SEQ ID NO: 298250 - DNA, 20 bp, Artificial
  CRISPR gRNA sequence
gagaaaattaacaaggaaat

SEQ ID NO: 298251 - DNA, 20 bp, Artificial
  CRISPR gRNA sequence
gaaaattaacaaggaaatca

SEQ ID NO: 298252 - DNA, 20 bp, Artificial
  CRISPR gRNA sequence
ttaacaaggaaatcagagat

SEQ ID NO: 298253 - DNA, 20 bp, Artificial
  CRISPR gRNA sequence
taacaaggaaatcagagatt

SEQ ID NO: 298254 - DNA, 20 bp, Artificial
  CRISPR gRNA sequence
aaggaaatcagagattggga

SEQ ID NO: 298255 - DNA, 20 bp, Artificial
  CRISPR gRNA sequence
aatcagagattgggaaagaa

SEQ ID NO: 298256 - DNA, 20 bp, Artificial
  CRISPR gRNA sequence
tcagagattgggaaagaata

SEQ ID NO: 298257 - DNA, 20 bp, Artificial
  CRISPR gRNA sequence
aaagaatagagcatttcaat

SEQ ID NO: 298258 - DNA, 20 bp, Artificial
  CRISPR gRNA sequence
aagaatagagcatttcaatg

SEQ ID NO: 298259 - DNA, 20 bp, Artificial
  CRISPR gRNA sequence
gaatagagcatttcaatgag

SEQ ID NO: 298260 - DNA, 20 bp, Artificial
  CRISPR gRNA sequence
atagagcatttcaatgagga

SEQ ID NO: 298261 - DNA, 20 bp, Artificial
  CRISPR gRNA sequence
gccaacacttgcatttgaca

SEQ ID NO: 298262 - DNA, 20 bp, Artificial
  CRISPR gRNA sequence
aacacttgcatttgacacag

SEQ ID NO: 298263 - DNA, 20 bp, Artificial
  CRISPR gRNA sequence
atttgacacagcggtcaaat

SEQ ID NO: 298264 - DNA, 20 bp, Artificial
  CRISPR gRNA sequence
acacagcggtcaaatgagtt

SEQ ID NO: 298265 - DNA, 20 bp, Artificial
  CRISPR gRNA sequence
caaatgagttgagatctgaa

SEQ ID NO: 298266 - DNA, 20 bp, Artificial
  CRISPR gRNA sequence
aatgagttgagatctgaaaa

SEQ ID NO: 298267 - DNA, 20 bp, Artificial
  CRISPR gRNA sequence
ttgagatctgaaaagagctc

SEQ ID NO: 298268 - DNA, 20 bp, Artificial
  CRISPR gRNA sequence
tctgaaaagagctcaagcct

SEQ ID NO: 298269 - DNA, 20 bp, Artificial
  CRISPR gRNA sequence
aagagctcaagccttggcca

SEQ ID NO: 298270 - DNA, 20 bp, Artificial
  CRISPR gRNA sequence
caagccttggccatggtgtg

SEQ ID NO: 298271 - DNA, 20 bp, Artificial
  CRISPR gRNA sequence
aagtcaccaacaacctttgt

SEQ ID NO: 298272 - DNA, 20 bp, Artificial
  CRISPR gRNA sequence
agtcaccaacaacctttgtc

SEQ ID NO: 298273 - DNA, 20 bp, Artificial
  CRISPR gRNA sequence
gtcaccaacaacctttgtca

SEQ ID NO: 298274 - DNA, 20 bp, Artificial
  CRISPR gRNA sequence
caccaacaacctttgtcagg

SEQ ID NO: 298275 - DNA, 20 bp, Artificial
  CRISPR gRNA sequence
caacctttgtcagggagttt

SEQ ID NO: 298276 - DNA, 20 bp, Artificial
  CRISPR gRNA sequence
cctttgtcagggagtttcag

SEQ ID NO: 298277 - DNA, 20 bp, Artificial
  CRISPR gRNA sequence
tttgtcagggagtttcagta

SEQ ID NO: 298278 - DNA, 20 bp, Artificial
  CRISPR gRNA sequence
tgtcagggagtttcagtaga

SEQ ID NO: 298279 - DNA, 20 bp, Artificial
  CRISPR gRNA sequence
gtcagggagtttcagtagag

SEQ ID NO: 298280 - DNA, 20 bp, Artificial
  CRISPR gRNA sequence
agggagtttcagtagagagg

SEQ ID NO: 298281 - DNA, 20 bp, Artificial
  CRISPR gRNA sequence
gggagtttcagtagagaggt

SEQ ID NO: 298282 - DNA, 20 bp, Artificial
  CRISPR gRNA sequence
ggagtttcagtagagaggtg

SEQ ID NO: 298283 - DNA, 20 bp, Artificial
  CRISPR gRNA sequence
gagtttcagtagagaggtgg

SEQ ID NO: 298284 - DNA, 20 bp, Artificial
  CRISPR gRNA sequence
tttcagtagagaggtggggg

SEQ ID NO: 298285 - DNA, 20 bp, Artificial
  CRISPR gRNA sequence
ttcagtagagaggtgggggt

SEQ ID NO: 298286 - DNA, 20 bp, Artificial
  CRISPR gRNA sequence
cagtagagaggtgggggtgg

SEQ ID NO: 298287 - DNA, 20 bp, Artificial
  CRISPR gRNA sequence
agtagagaggtgggggtggg

SEQ ID NO: 298288 - DNA, 20 bp, Artificial
  CRISPR gRNA sequence
gagaggtgggggtgggaggc

SEQ ID NO: 298289 - DNA, 20 bp, Artificial
  CRISPR gRNA sequence
agaggtgggggtgggaggct

SEQ ID NO: 298290 - DNA, 20 bp, Artificial
  CRISPR gRNA sequence
ggggtgggaggctgggaata

SEQ ID NO: 298291 - DNA, 20 bp, Artificial
  CRISPR gRNA sequence
gggtgggaggctgggaataa

SEQ ID NO: 298292 - DNA, 20 bp, Artificial
  CRISPR gRNA sequence
tgggaggctgggaataaagg

SEQ ID NO: 298293 - DNA, 20 bp, Artificial
  CRISPR gRNA sequence
gcaattgctgcttactcttt

SEQ ID NO: 298294 - DNA, 20 bp, Artificial
  CRISPR gRNA sequence
caattgctgcttactctttc

SEQ ID NO: 298295 - DNA, 20 bp, Artificial
  CRISPR gRNA sequence
aattgctgcttactctttca

SEQ ID NO: 298296 - DNA, 20 bp, Artificial
  CRISPR gRNA sequence
ttgctgcttactctttcagg

SEQ ID NO: 298297 - DNA, 20 bp, Artificial
  CRISPR gRNA sequence
ctttcagggagtttgactcc

SEQ ID NO: 298298 - DNA, 20 bp, Artificial
  CRISPR gRNA sequence
tttcagggagtttgactcca

SEQ ID NO: 298299 - DNA, 20 bp, Artificial
  CRISPR gRNA sequence
ttcagggagtttgactccaa

SEQ ID NO: 298300 - DNA, 20 bp, Artificial
  CRISPR gRNA sequence
gggagtttgactccaaggga

SEQ ID NO: 298301 - DNA, 20 bp, Artificial
  CRISPR gRNA sequence
gagtttgactccaagggaaa

SEQ ID NO: 298302 - DNA, 20 bp, Artificial
  CRISPR gRNA sequence
ccaagggaaagagaaactaa

SEQ ID NO: 298303 - DNA, 20 bp, Artificial
  CRISPR gRNA sequence
agggaaagagaaactaaaag

SEQ ID NO: 298304 - DNA, 20 bp, Artificial
  CRISPR gRNA sequence
gaaagagaaactaaaagcag

SEQ ID NO: 298305 - DNA, 20 bp, Artificial
  CRISPR gRNA sequence
gaaactaaaagcagtagcac

SEQ ID NO: 298306 - DNA, 20 bp, Artificial
  CRISPR gRNA sequence
aaactaaaagcagtagcaca

SEQ ID NO: 298307 - DNA, 20 bp, Artificial
  CRISPR gRNA sequence
tagcacaaggtttgtgtttg

SEQ ID NO: 298308 - DNA, 20 bp, Artificial
  CRISPR gRNA sequence
aaggtttgtgtttgaagtaa

SEQ ID NO: 298309 - DNA, 20 bp, Artificial
  CRISPR gRNA sequence
ggtttgtgtttgaagtaatg

SEQ ID NO: 298310 - DNA, 20 bp, Artificial
  CRISPR gRNA sequence
gtttgtgtttgaagtaatgg

SEQ ID NO: 298311 - DNA, 20 bp, Artificial
  CRISPR gRNA sequence
ttgaagtaatggaggtgaac

SEQ ID NO: 298312 - DNA, 20 bp, Artificial
  CRISPR gRNA sequence
tgaagtaatggaggtgaacc

SEQ ID NO: 298313 - DNA, 20 bp, Artificial
  CRISPR gRNA sequence
atggaggtgaaccaggtgaa

SEQ ID NO: 298314 - DNA, 20 bp, Artificial
  CRISPR gRNA sequence
ggtgaaccaggtgaatagcc

SEQ ID NO: 298315 - DNA, 20 bp, Artificial
  CRISPR gRNA sequence
tgaaccaggtgaatagcctg

SEQ ID NO: 298316 - DNA, 20 bp, Artificial
  CRISPR gRNA sequence
gaaccaggtgaatagcctgg

SEQ ID NO: 298317 - DNA, 20 bp, Artificial
  CRISPR gRNA sequence
aggtgaatagcctggaggcc

SEQ ID NO: 298318 - DNA, 20 bp, Artificial
  CRISPR gRNA sequence
aatagcctggaggccgagtg

SEQ ID NO: 298319 - DNA, 20 bp, Artificial
  CRISPR gRNA sequence
gcctggaggccgagtgaagt

SEQ ID NO: 298320 - DNA, 20 bp, Artificial
  CRISPR gRNA sequence
ggaggccgagtgaagtgaga

SEQ ID NO: 298321 - DNA, 20 bp, Artificial
  CRISPR gRNA sequence
gaggccgagtgaagtgagac

SEQ ID NO: 298322 - DNA, 20 bp, Artificial
  CRISPR gRNA sequence
tgaagtgagacaggacactg

SEQ ID NO: 298323 - DNA, 20 bp, Artificial
  CRISPR gRNA sequence
gagacaggacactgcagatt

SEQ ID NO: 298324 - DNA, 20 bp, Artificial
  CRISPR gRNA sequence
ctgcagatttggaatgtcac

SEQ ID NO: 298325 - DNA, 20 bp, Artificial
  CRISPR gRNA sequence
cacaactgaataatttcctc

SEQ ID NO: 298326 - DNA, 20 bp, Artificial
  CRISPR gRNA sequence
tccagaactgctcaattgcc

SEQ ID NO: 298327 - DNA, 20 bp, Artificial
  CRISPR gRNA sequence
ctgctcaattgcccagttgt

SEQ ID NO: 298328 - DNA, 20 bp, Artificial
  CRISPR gRNA sequence
caattgcccagttgtaagaa

SEQ ID NO: 298329 - DNA, 20 bp, Artificial
  CRISPR gRNA sequence
cagttgtaagaacagatatg

SEQ ID NO: 298330 - DNA, 20 bp, Artificial
  CRISPR gRNA sequence
agaacagatatgtagaccaa

SEQ ID NO: 298331 - DNA, 20 bp, Artificial
  CRISPR gRNA sequence
acagatatgtagaccaaaag

SEQ ID NO: 298332 - DNA, 20 bp, Artificial
  CRISPR gRNA sequence
agatatgtagaccaaaagta

SEQ ID NO: 298333 - DNA, 20 bp, Artificial
  CRISPR gRNA sequence
gaccaaaagtagagtgtccc

SEQ ID NO: 298334 - DNA, 20 bp, Artificial
  CRISPR gRNA sequence
accaaaagtagagtgtcccc

SEQ ID NO: 298335 - DNA, 20 bp, Artificial
  CRISPR gRNA sequence
ccaaaagtagagtgtcccca

SEQ ID NO: 298336 - DNA, 20 bp, Artificial
  CRISPR gRNA sequence
tgtccccagggtaaatttta

SEQ ID NO: 298337 - DNA, 20 bp, Artificial
  CRISPR gRNA sequence
tccccagggtaaattttata

SEQ ID NO: 298338 - DNA, 20 bp, Artificial
  CRISPR gRNA sequence
gggtaaattttatagagaca

SEQ ID NO: 298339 - DNA, 20 bp, Artificial
  CRISPR gRNA sequence
ggtaaattttatagagacaa

SEQ ID NO: 298340 - DNA, 20 bp, Artificial
  CRISPR gRNA sequence
gtaaattttatagagacaaa

SEQ ID NO: 298341 - DNA, 20 bp, Artificial
  CRISPR gRNA sequence
taaattttatagagacaaag

SEQ ID NO: 298342 - DNA, 20 bp, Artificial
  CRISPR gRNA sequence
acaaaggggtgtgtttattg

SEQ ID NO: 298343 - DNA, 20 bp, Artificial
  CRISPR gRNA sequence
gggtgtgtttattgaagttg

SEQ ID NO: 298344 - DNA, 20 bp, Artificial
  CRISPR gRNA sequence
gtgtttattgaagttgtgga

SEQ ID NO: 298345 - DNA, 20 bp, Artificial
  CRISPR gRNA sequence
tgtttattgaagttgtggaa

SEQ ID NO: 298346 - DNA, 20 bp, Artificial
  CRISPR gRNA sequence
tgtggaaaggaataattaca

SEQ ID NO: 298347 - DNA, 20 bp, Artificial
  CRISPR gRNA sequence
ttgtccaatataataaccac

SEQ ID NO: 298348 - DNA, 20 bp, Artificial
  CRISPR gRNA sequence
tcaattaattaaaattaaat

SEQ ID NO: 298349 - DNA, 20 bp, Artificial
  CRISPR gRNA sequence
agattaaaaattcatcttct

SEQ ID NO: 298350 - DNA, 20 bp, Artificial
  CRISPR gRNA sequence
attcatcttctcagtcatac

SEQ ID NO: 298351 - DNA, 20 bp, Artificial
  CRISPR gRNA sequence
gctatgtatcaattgctcaa

SEQ ID NO: 298352 - DNA, 20 bp, Artificial
  CRISPR gRNA sequence
tatcaattgctcaatagcca

SEQ ID NO: 298353 - DNA, 20 bp, Artificial
  CRISPR gRNA sequence
atcaattgctcaatagccac

SEQ ID NO: 298354 - DNA, 20 bp, Artificial
  CRISPR gRNA sequence
tcaattgctcaatagccaca

SEQ ID NO: 298355 - DNA, 20 bp, Artificial
  CRISPR gRNA sequence
caattgctcaatagccacag

SEQ ID NO: 298356 - DNA, 20 bp, Artificial
  CRISPR gRNA sequence
tgctcaatagccacaggggc

SEQ ID NO: 298357 - DNA, 20 bp, Artificial
  CRISPR gRNA sequence
tcaatagccacaggggctgg

SEQ ID NO: 298358 - DNA, 20 bp, Artificial
  CRISPR gRNA sequence
ctggtggctatcatattgtt

SEQ ID NO: 298359 - DNA, 20 bp, Artificial
  CRISPR gRNA sequence
ggctatcatattgttcagca

SEQ ID NO: 298360 - DNA, 20 bp, Artificial
  CRISPR gRNA sequence
ctatcatattgttcagcaca

SEQ ID NO: 298361 - DNA, 20 bp, Artificial
  CRISPR gRNA sequence
catattgttcagcacagaga

SEQ ID NO: 298362 - DNA, 20 bp, Artificial
  CRISPR gRNA sequence
tattgttcagcacagagaca

SEQ ID NO: 298363 - DNA, 20 bp, Artificial
  CRISPR gRNA sequence
agagcatttccattatcact

SEQ ID NO: 298364 - DNA, 20 bp, Artificial
  CRISPR gRNA sequence
agcatttccattatcactaa

SEQ ID NO: 298365 - DNA, 20 bp, Artificial
  CRISPR gRNA sequence
attatcactaagagttcttg

SEQ ID NO: 298366 - DNA, 20 bp, Artificial
  CRISPR gRNA sequence
ttgtggaaaacactgcacta

SEQ ID NO: 298367 - DNA, 20 bp, Artificial
  CRISPR gRNA sequence
tgtggaaaacactgcactac

SEQ ID NO: 298368 - DNA, 20 bp, Artificial
  CRISPR gRNA sequence
gtggaaaacactgcactaca

SEQ ID NO: 298369 - DNA, 20 bp, Artificial
  CRISPR gRNA sequence
aaacactgcactacagggtc

SEQ ID NO: 298370 - DNA, 20 bp, Artificial
  CRISPR gRNA sequence
tgcactacagggtctggata

SEQ ID NO: 298371 - DNA, 20 bp, Artificial
  CRISPR gRNA sequence
tacagggtctggataaagct

SEQ ID NO: 298372 - DNA, 20 bp, Artificial
  CRISPR gRNA sequence
acagggtctggataaagctg

SEQ ID NO: 298373 - DNA, 20 bp, Artificial
  CRISPR gRNA sequence
ataaagctgaggtcttgatt

SEQ ID NO: 298374 - DNA, 20 bp, Artificial
  CRISPR gRNA sequence
gtcttgattaagttgaacaa

SEQ ID NO: 298375 - DNA, 20 bp, Artificial
  CRISPR gRNA sequence
attaagttgaacaacagttg

SEQ ID NO: 298376 - DNA, 20 bp, Artificial
  CRISPR gRNA sequence
aagttgaacaacagttgtag

SEQ ID NO: 298377 - DNA, 20 bp, Artificial
  CRISPR gRNA sequence
agttgaacaacagttgtaga

SEQ ID NO: 298378 - DNA, 20 bp, Artificial
  CRISPR gRNA sequence
ttgaacaacagttgtagaag

SEQ ID NO: 298379 - DNA, 20 bp, Artificial
  CRISPR gRNA sequence
acaacagttgtagaaggagt

SEQ ID NO: 298380 - DNA, 20 bp, Artificial
  CRISPR gRNA sequence
cagttgtagaaggagtaagc

SEQ ID NO: 298381 - DNA, 20 bp, Artificial
  CRISPR gRNA sequence
gttgtagaaggagtaagcaa

SEQ ID NO: 298382 - DNA, 20 bp, Artificial
  CRISPR gRNA sequence
gagtaagcaagagcaaaacc

SEQ ID NO: 298383 - DNA, 20 bp, Artificial
  CRISPR gRNA sequence
aagagcaaaacctggatgaa

SEQ ID NO: 298384 - DNA, 20 bp, Artificial
  CRISPR gRNA sequence
agagcaaaacctggatgaat

SEQ ID NO: 298385 - DNA, 20 bp, Artificial
  CRISPR gRNA sequence
agcaaaacctggatgaatag

SEQ ID NO: 298386 - DNA, 20 bp, Artificial
  CRISPR gRNA sequence
gcaaaacctggatgaatagg

SEQ ID NO: 298387 - DNA, 20 bp, Artificial
  CRISPR gRNA sequence
cctggatgaataggaggttg

SEQ ID NO: 298388 - DNA, 20 bp, Artificial
  CRISPR gRNA sequence
gatgaataggaggttgtgga

SEQ ID NO: 298389 - DNA, 20 bp, Artificial
  CRISPR gRNA sequence
tgaataggaggttgtggacg

SEQ ID NO: 298390 - DNA, 20 bp, Artificial
  CRISPR gRNA sequence
aggaggttgtggacggagat

SEQ ID NO: 298391 - DNA, 20 bp, Artificial
  CRISPR gRNA sequence
tggacggagattagtatatt

SEQ ID NO: 298392 - DNA, 20 bp, Artificial
  CRISPR gRNA sequence
gagattagtatattgagatt

SEQ ID NO: 298393 - DNA, 20 bp, Artificial
  CRISPR gRNA sequence
gtatattgagattaagattc

SEQ ID NO: 298394 - DNA, 20 bp, Artificial
  CRISPR gRNA sequence
tatattgagattaagattct

SEQ ID NO: 298395 - DNA, 20 bp, Artificial
  CRISPR gRNA sequence
atattgagattaagattcta

SEQ ID NO: 298396 - DNA, 20 bp, Artificial
  CRISPR gRNA sequence
agattaagattctagggact

SEQ ID NO: 298397 - DNA, 20 bp, Artificial
  CRISPR gRNA sequence
ttctagggactgagctgctc

SEQ ID NO: 298398 - DNA, 20 bp, Artificial
  CRISPR gRNA sequence
tctagggactgagctgctcc

SEQ ID NO: 298399 - DNA, 20 bp, Artificial
  CRISPR gRNA sequence
actgagctgctccaggtgaa

SEQ ID NO: 298400 - DNA, 20 bp, Artificial
  CRISPR gRNA sequence
ctgctccaggtgaaaagttt

SEQ ID NO: 298401 - DNA, 20 bp, Artificial
  CRISPR gRNA sequence
tgctccaggtgaaaagtttc

SEQ ID NO: 298402 - DNA, 20 bp, Artificial
  CRISPR gRNA sequence
gctccaggtgaaaagtttca

SEQ ID NO: 298403 - DNA, 20 bp, Artificial
  CRISPR gRNA sequence
aagtttcagggttatgtcat

SEQ ID NO: 298404 - DNA, 20 bp, Artificial
  CRISPR gRNA sequence
tttcagggttatgtcataag

SEQ ID NO: 298405 - DNA, 20 bp, Artificial
  CRISPR gRNA sequence
ttcagggttatgtcataaga

SEQ ID NO: 298406 - DNA, 20 bp, Artificial
  CRISPR gRNA sequence
agggttatgtcataagaagg

SEQ ID NO: 298407 - DNA, 20 bp, Artificial
  CRISPR gRNA sequence
gggttatgtcataagaaggt

SEQ ID NO: 298408 - DNA, 20 bp, Artificial
  CRISPR gRNA sequence
ggttatgtcataagaaggtg

SEQ ID NO: 298409 - DNA, 20 bp, Artificial
  CRISPR gRNA sequence
gttatgtcataagaaggtgg

SEQ ID NO: 298410 - DNA, 20 bp, Artificial
  CRISPR gRNA sequence
ttatgtcataagaaggtggg

SEQ ID NO: 298411 - DNA, 20 bp, Artificial
  CRISPR gRNA sequence
tgtcataagaaggtgggggg

SEQ ID NO: 298412 - DNA, 20 bp, Artificial
  CRISPR gRNA sequence
gtggggggcagctgctgaaa

SEQ ID NO: 298413 - DNA, 20 bp, Artificial
  CRISPR gRNA sequence
gcagctgctgaaatagtctg

SEQ ID NO: 298414 - DNA, 20 bp, Artificial
  CRISPR gRNA sequence
cagctgctgaaatagtctgc

SEQ ID NO: 298415 - DNA, 20 bp, Artificial
  CRISPR gRNA sequence
gctgaaatagtctgcgggtg

SEQ ID NO: 298416 - DNA, 20 bp, Artificial
  CRISPR gRNA sequence
agtctgcgggtgtagacctg

SEQ ID NO: 298417 - DNA, 20 bp, Artificial
  CRISPR gRNA sequence
tctgcgggtgtagacctgtg

SEQ ID NO: 298418 - DNA, 20 bp, Artificial
  CRISPR gRNA sequence
tgtagacctgtggagttgac

SEQ ID NO: 298419 - DNA, 20 bp, Artificial
  CRISPR gRNA sequence
ctgtggagttgacaagatca

SEQ ID NO: 298420 - DNA, 20 bp, Artificial
  CRISPR gRNA sequence
tgacaagatcaaagaaattt

SEQ ID NO: 298421 - DNA, 20 bp, Artificial
  CRISPR gRNA sequence
gacaagatcaaagaaatttg

SEQ ID NO: 298422 - DNA, 20 bp, Artificial
  CRISPR gRNA sequence
agatcaaagaaatttgaggc

SEQ ID NO: 298423 - DNA, 20 bp, Artificial
  CRISPR gRNA sequence
gatcaaagaaatttgaggca

SEQ ID NO: 298424 - DNA, 20 bp, Artificial
  CRISPR gRNA sequence
gaaatttgaggcaaggttgt

SEQ ID NO: 298425 - DNA, 20 bp, Artificial
  CRISPR gRNA sequence
ggttgttagactcattcatg

SEQ ID NO: 298426 - DNA, 20 bp, Artificial
  CRISPR gRNA sequence
tgttagactcattcatgaag

SEQ ID NO: 298427 - DNA, 20 bp, Artificial
  CRISPR gRNA sequence
gaagaagtcacccaaattgt

SEQ ID NO: 298428 - DNA, 20 bp, Artificial
  CRISPR gRNA sequence
aagtcacccaaattgttagc

SEQ ID NO: 298429 - DNA, 20 bp, Artificial
  CRISPR gRNA sequence
ctaatgccaaaatcctcatt

SEQ ID NO: 298430 - DNA, 20 bp, Artificial
  CRISPR gRNA sequence
tgccaaaatcctcatttagc

SEQ ID NO: 298431 - DNA, 20 bp, Artificial
  CRISPR gRNA sequence
gccaaaatcctcatttagca

SEQ ID NO: 298432 - DNA, 20 bp, Artificial
  CRISPR gRNA sequence
aaaatcctcatttagcaagg

SEQ ID NO: 298433 - DNA, 20 bp, Artificial
  CRISPR gRNA sequence
atcctcatttagcaaggtgg

SEQ ID NO: 298434 - DNA, 20 bp, Artificial
  CRISPR gRNA sequence
ttagcaaggtggtagtgact

SEQ ID NO: 298435 - DNA, 20 bp, Artificial
  CRISPR gRNA sequence
gcaaggtggtagtgacttag

SEQ ID NO: 298436 - DNA, 20 bp, Artificial
  CRISPR gRNA sequence
ggtagtgacttagtagctac

SEQ ID NO: 298437 - DNA, 20 bp, Artificial
  CRISPR gRNA sequence
acttagtagctacaagcaat

SEQ ID NO: 298438 - DNA, 20 bp, Artificial
  CRISPR gRNA sequence
agtagctacaagcaatgaga

SEQ ID NO: 298439 - DNA, 20 bp, Artificial
  CRISPR gRNA sequence
gctacaagcaatgagaaagt

SEQ ID NO: 298440 - DNA, 20 bp, Artificial
  CRISPR gRNA sequence
gagaaagtcagacacctcaa

SEQ ID NO: 298441 - DNA, 20 bp, Artificial
  CRISPR gRNA sequence
agaaagtcagacacctcaaa

SEQ ID NO: 298442 - DNA, 20 bp, Artificial
  CRISPR gRNA sequence
gaaagtcagacacctcaaaa

SEQ ID NO: 298443 - DNA, 20 bp, Artificial
  CRISPR gRNA sequence
aaagtcagacacctcaaaag

SEQ ID NO: 298444 - DNA, 20 bp, Artificial
  CRISPR gRNA sequence
gtcagacacctcaaaagggg

SEQ ID NO: 298445 - DNA, 20 bp, Artificial
  CRISPR gRNA sequence
tcagacacctcaaaagggga

SEQ ID NO: 298446 - DNA, 20 bp, Artificial
  CRISPR gRNA sequence
aaaggggaaggtgttgctca

SEQ ID NO: 298447 - DNA, 20 bp, Artificial
  CRISPR gRNA sequence
tgttgctcaaagtccccaca

SEQ ID NO: 298448 - DNA, 20 bp, Artificial
  CRISPR gRNA sequence
acaaagtgtgataaaacaaa

SEQ ID NO: 298449 - DNA, 20 bp, Artificial
  CRISPR gRNA sequence
aagtgtgataaaacaaacag

SEQ ID NO: 298450 - DNA, 20 bp, Artificial
  CRISPR gRNA sequence
gtgataaaacaaacagtagc

SEQ ID NO: 298451 - DNA, 20 bp, Artificial
  CRISPR gRNA sequence
tgataaaacaaacagtagct

SEQ ID NO: 298452 - DNA, 20 bp, Artificial
  CRISPR gRNA sequence
gataaaacaaacagtagctg

SEQ ID NO: 298453 - DNA, 20 bp, Artificial
  CRISPR gRNA sequence
aaacaaacagtagctggggc

SEQ ID NO: 298454 - DNA, 20 bp, Artificial
  CRISPR gRNA sequence
acaaacagtagctggggctg

SEQ ID NO: 298455 - DNA, 20 bp, Artificial
  CRISPR gRNA sequence
acagtagctggggctggagc

SEQ ID NO: 298456 - DNA, 20 bp, Artificial
  CRISPR gRNA sequence
gtagctggggctggagcaag

SEQ ID NO: 298457 - DNA, 20 bp, Artificial
  CRISPR gRNA sequence
ctggagcaagtggcttcctt

SEQ ID NO: 298458 - DNA, 20 bp, Artificial
  CRISPR gRNA sequence
tggagcaagtggcttccttt

SEQ ID NO: 298459 - DNA, 20 bp, Artificial
  CRISPR gRNA sequence
caagtggcttcctttgggtg

SEQ ID NO: 298460 - DNA, 20 bp, Artificial
  CRISPR gRNA sequence
tggcttcctttgggtgaagc

SEQ ID NO: 298461 - DNA, 20 bp, Artificial
  CRISPR gRNA sequence
tttcactgaaataataacct

SEQ ID NO: 298462 - DNA, 20 bp, Artificial
  CRISPR gRNA sequence
ttcactgaaataataacctc

SEQ ID NO: 298463 - DNA, 20 bp, Artificial
  CRISPR gRNA sequence
tcactgaaataataacctca

SEQ ID NO: 298464 - DNA, 20 bp, Artificial
  CRISPR gRNA sequence
aaataataacctcagggaaa

SEQ ID NO: 298465 - DNA, 20 bp, Artificial
  CRISPR gRNA sequence
cctcagggaaacagtcaatg

SEQ ID NO: 298466 - DNA, 20 bp, Artificial
  CRISPR gRNA sequence
ctcagggaaacagtcaatga

SEQ ID NO: 298467 - DNA, 20 bp, Artificial
  CRISPR gRNA sequence
tcagggaaacagtcaatgaa

SEQ ID NO: 298468 - DNA, 20 bp, Artificial
  CRISPR gRNA sequence
cagggaaacagtcaatgaag

SEQ ID NO: 298469 - DNA, 20 bp, Artificial
  CRISPR gRNA sequence
aacagtcaatgaaggggtta

SEQ ID NO: 298470 - DNA, 20 bp, Artificial
  CRISPR gRNA sequence
caatgaaggggttaaagatg

SEQ ID NO: 298471 - DNA, 20 bp, Artificial
  CRISPR gRNA sequence
aatgaaggggttaaagatgt

SEQ ID NO: 298472 - DNA, 20 bp, Artificial
  CRISPR gRNA sequence
tgaaggggttaaagatgtgg

SEQ ID NO: 298473 - DNA, 20 bp, Artificial
  CRISPR gRNA sequence
aaggggttaaagatgtggga

SEQ ID NO: 298474 - DNA, 20 bp, Artificial
  CRISPR gRNA sequence
gatgtgggagagtttccttg

SEQ ID NO: 298475 - DNA, 20 bp, Artificial
  CRISPR gRNA sequence
tgggagagtttccttgtagt

SEQ ID NO: 298476 - DNA, 20 bp, Artificial
  CRISPR gRNA sequence
agtttccttgtagtaagtaa

SEQ ID NO: 298477 - DNA, 20 bp, Artificial
  CRISPR gRNA sequence
cttgtagtaagtaatggaat

SEQ ID NO: 298478 - DNA, 20 bp, Artificial
  CRISPR gRNA sequence
ttgtagtaagtaatggaatg

SEQ ID NO: 298479 - DNA, 20 bp, Artificial
  CRISPR gRNA sequence
gtaatggaatgaggctttca

SEQ ID NO: 298480 - DNA, 20 bp, Artificial
  CRISPR gRNA sequence
taatggaatgaggctttcaa

SEQ ID NO: 298481 - DNA, 20 bp, Artificial
  CRISPR gRNA sequence
aatggaatgaggctttcaaa

SEQ ID NO: 298482 - DNA, 20 bp, Artificial
  CRISPR gRNA sequence
aatgaggctttcaaagggcc

SEQ ID NO: 298483 - DNA, 20 bp, Artificial
  CRISPR gRNA sequence
caaagggccaagtaaaactt

SEQ ID NO: 298484 - DNA, 20 bp, Artificial
  CRISPR gRNA sequence
aagggccaagtaaaactttg

SEQ ID NO: 298485 - DNA, 20 bp, Artificial
  CRISPR gRNA sequence
agggccaagtaaaactttgg

SEQ ID NO: 298486 - DNA, 20 bp, Artificial
  CRISPR gRNA sequence
gccaagtaaaactttggagg

SEQ ID NO: 298487 - DNA, 20 bp, Artificial
  CRISPR gRNA sequence
gtaaaactttggaggaagtt

SEQ ID NO: 298488 - DNA, 20 bp, Artificial
  CRISPR gRNA sequence
ctttggaggaagtttagtaa

SEQ ID NO: 298489 - DNA, 20 bp, Artificial
  CRISPR gRNA sequence
tggaggaagtttagtaaaag

SEQ ID NO: 298490 - DNA, 20 bp, Artificial
  CRISPR gRNA sequence
ggaggaagtttagtaaaaga

SEQ ID NO: 298491 - DNA, 20 bp, Artificial
  CRISPR gRNA sequence
gtaaaagaaggaattttttt

SEQ ID NO: 298492 - DNA, 20 bp, Artificial
  CRISPR gRNA sequence
agaaggaattttttttagta

SEQ ID NO: 298493 - DNA, 20 bp, Artificial
  CRISPR gRNA sequence
gaattttttttagtacagat

SEQ ID NO: 298494 - DNA, 20 bp, Artificial
  CRISPR gRNA sequence
ttttttagtacagataagca

SEQ ID NO: 298495 - DNA, 20 bp, Artificial
  CRISPR gRNA sequence
tttttagtacagataagcat

SEQ ID NO: 298496 - DNA, 20 bp, Artificial
  CRISPR gRNA sequence
cagataagcataggaacata

SEQ ID NO: 298497 - DNA, 20 bp, Artificial
  CRISPR gRNA sequence
ataagcataggaacataaag

SEQ ID NO: 298498 - DNA, 20 bp, Artificial
  CRISPR gRNA sequence
aagcataggaacataaagaa

SEQ ID NO: 298499 - DNA, 20 bp, Artificial
  CRISPR gRNA sequence
gagataattcttaaacatat

SEQ ID NO: 298500 - DNA, 20 bp, Artificial
  CRISPR gRNA sequence
aaacatataagatatgcatt

SEQ ID NO: 298501 - DNA, 20 bp, Artificial
  CRISPR gRNA sequence
aacatataagatatgcattt

SEQ ID NO: 298502 - DNA, 20 bp, Artificial
  CRISPR gRNA sequence
acatataagatatgcatttg

SEQ ID NO: 298503 - DNA, 20 bp, Artificial
  CRISPR gRNA sequence
ataagatatgcatttgggga

SEQ ID NO: 298504 - DNA, 20 bp, Artificial
  CRISPR gRNA sequence
agatatgcatttggggatag

SEQ ID NO: 298505 - DNA, 20 bp, Artificial
  CRISPR gRNA sequence
atgcatttggggatagcagc

SEQ ID NO: 298506 - DNA, 20 bp, Artificial
  CRISPR gRNA sequence
tgcatttggggatagcagcc

SEQ ID NO: 298507 - DNA, 20 bp, Artificial
  CRISPR gRNA sequence
gcatttggggatagcagcca

SEQ ID NO: 298508 - DNA, 20 bp, Artificial
  CRISPR gRNA sequence
atagcagccagggaacactg

SEQ ID NO: 298509 - DNA, 20 bp, Artificial
  CRISPR gRNA sequence
gccagggaacactgaagtcc

SEQ ID NO: 298510 - DNA, 20 bp, Artificial
  CRISPR gRNA sequence
agggaacactgaagtcccag

SEQ ID NO: 298511 - DNA, 20 bp, Artificial
  CRISPR gRNA sequence
gggaacactgaagtcccagt

SEQ ID NO: 298512 - DNA, 20 bp, Artificial
  CRISPR gRNA sequence
ggaacactgaagtcccagtg

SEQ ID NO: 298513 - DNA, 20 bp, Artificial
  CRISPR gRNA sequence
cactgaagtcccagtggggt

SEQ ID NO: 298514 - DNA, 20 bp, Artificial
  CRISPR gRNA sequence
ctgaagtcccagtggggtca

SEQ ID NO: 298515 - DNA, 20 bp, Artificial
  CRISPR gRNA sequence
agtggggtcagagacttcat

SEQ ID NO: 298516 - DNA, 20 bp, Artificial
  CRISPR gRNA sequence
gtggggtcagagacttcata

SEQ ID NO: 298517 - DNA, 20 bp, Artificial
  CRISPR gRNA sequence
ggtcagagacttcataaggc

SEQ ID NO: 298518 - DNA, 20 bp, Artificial
  CRISPR gRNA sequence
ttcataaggctagcaaatta

SEQ ID NO: 298519 - DNA, 20 bp, Artificial
  CRISPR gRNA sequence
gctagcaaattacagttttt

SEQ ID NO: 298520 - DNA, 20 bp, Artificial
  CRISPR gRNA sequence
agcaaattacagtttttgag

SEQ ID NO: 298521 - DNA, 20 bp, Artificial
  CRISPR gRNA sequence
gtttttgagtggcattccaa

SEQ ID NO: 298522 - DNA, 20 bp, Artificial
  CRISPR gRNA sequence
tttgagtggcattccaacag

SEQ ID NO: 298523 - DNA, 20 bp, Artificial
  CRISPR gRNA sequence
tgagtggcattccaacagta

SEQ ID NO: 298524 - DNA, 20 bp, Artificial
  CRISPR gRNA sequence
caacagtagagtgtattgct

SEQ ID NO: 298525 - DNA, 20 bp, Artificial
  CRISPR gRNA sequence
aacagtagagtgtattgctc

SEQ ID NO: 298526 - DNA, 20 bp, Artificial
  CRISPR gRNA sequence
agtagagtgtattgctcagg

SEQ ID NO: 298527 - DNA, 20 bp, Artificial
  CRISPR gRNA sequence
tcctttgaaacaaattcctt

SEQ ID NO: 298528 - DNA, 20 bp, Artificial
  CRISPR gRNA sequence
aattccttcagctgattacg

SEQ ID NO: 298529 - DNA, 20 bp, Artificial
  CRISPR gRNA sequence
attccttcagctgattacga

SEQ ID NO: 298530 - DNA, 20 bp, Artificial
  CRISPR gRNA sequence
cagctgattacgaaggcatc

SEQ ID NO: 298531 - DNA, 20 bp, Artificial
  CRISPR gRNA sequence
tgattacgaaggcatctagc

SEQ ID NO: 298532 - DNA, 20 bp, Artificial
  CRISPR gRNA sequence
aggcatctagctggattctt

SEQ ID NO: 298533 - DNA, 20 bp, Artificial
  CRISPR gRNA sequence
gcgacttgttcctgacatca

SEQ ID NO: 298534 - DNA, 20 bp, Artificial
  CRISPR gRNA sequence
tcatagcaacccattgtaac

SEQ ID NO: 298535 - DNA, 20 bp, Artificial
  CRISPR gRNA sequence
ttcgaccattcctcttaccc

SEQ ID NO: 298536 - DNA, 20 bp, Artificial
  CRISPR gRNA sequence
cattcctcttacccaagtgc

SEQ ID NO: 298537 - DNA, 20 bp, Artificial
  CRISPR gRNA sequence
attcctcttacccaagtgct

SEQ ID NO: 298538 - DNA, 20 bp, Artificial
  CRISPR gRNA sequence
ttcctcttacccaagtgctg

SEQ ID NO: 298539 - DNA, 20 bp, Artificial
  CRISPR gRNA sequence
ctcttacccaagtgctgggg

SEQ ID NO: 298540 - DNA, 20 bp, Artificial
  CRISPR gRNA sequence
tcttacccaagtgctgggga

SEQ ID NO: 298541 - DNA, 20 bp, Artificial
  CRISPR gRNA sequence
cttacccaagtgctggggaa

SEQ ID NO: 298542 - DNA, 20 bp, Artificial
  CRISPR gRNA sequence
tacccaagtgctggggaagg

SEQ ID NO: 298543 - DNA, 20 bp, Artificial
  CRISPR gRNA sequence
cccaagtgctggggaaggga

SEQ ID NO: 298544 - DNA, 20 bp, Artificial
  CRISPR gRNA sequence
tctcaatgcttacccaccta

SEQ ID NO: 298545 - DNA, 20 bp, Artificial
  CRISPR gRNA sequence
cttacccacctatggaatcc

SEQ ID NO: 298546 - DNA, 20 bp, Artificial
  CRISPR gRNA sequence
cccacctatggaatcccagt

SEQ ID NO: 298547 - DNA, 20 bp, Artificial
  CRISPR gRNA sequence
ctatggaatcccagtaagtc

SEQ ID NO: 298548 - DNA, 20 bp, Artificial
  CRISPR gRNA sequence
atcccagtaagtccagttgc

SEQ ID NO: 298549 - DNA, 20 bp, Artificial
  CRISPR gRNA sequence
tcccagtaagtccagttgct

SEQ ID NO: 298550 - DNA, 20 bp, Artificial
  CRISPR gRNA sequence
cagtaagtccagttgctagg

SEQ ID NO: 298551 - DNA, 20 bp, Artificial
  CRISPR gRNA sequence
gtccagttgctaggtggctt

SEQ ID NO: 298552 - DNA, 20 bp, Artificial
  CRISPR gRNA sequence
tccagttgctaggtggcttg

SEQ ID NO: 298553 - DNA, 20 bp, Artificial
  CRISPR gRNA sequence
ttgctaggtggcttgaggtc

SEQ ID NO: 298554 - DNA, 20 bp, Artificial
  CRISPR gRNA sequence
tgctaggtggcttgaggtct

SEQ ID NO: 298555 - DNA, 20 bp, Artificial
  CRISPR gRNA sequence
gctaggtggcttgaggtctg

SEQ ID NO: 298556 - DNA, 20 bp, Artificial
  CRISPR gRNA sequence
tgaggtctggggtcataaaa

SEQ ID NO: 298557 - DNA, 20 bp, Artificial
  CRISPR gRNA sequence
ggtctggggtcataaaatgg

SEQ ID NO: 298558 - DNA, 20 bp, Artificial
  CRISPR gRNA sequence
gtctggggtcataaaatgga

SEQ ID NO: 298559 - DNA, 20 bp, Artificial
  CRISPR gRNA sequence
gtcataaaatggaaggcctg

SEQ ID NO: 298560 - DNA, 20 bp, Artificial
  CRISPR gRNA sequence
atggaaggcctgaagtcatt

SEQ ID NO: 298561 - DNA, 20 bp, Artificial
  CRISPR gRNA sequence
ctgaagtcatttggtgatca

SEQ ID NO: 298562 - DNA, 20 bp, Artificial
  CRISPR gRNA sequence
atttggtgatcacagacctt

SEQ ID NO: 298563 - DNA, 20 bp, Artificial
  CRISPR gRNA sequence
tgagccaaactttccccatt

SEQ ID NO: 298564 - DNA, 20 bp, Artificial
  CRISPR gRNA sequence
ccaaactttccccatttagt

SEQ ID NO: 298565 - DNA, 20 bp, Artificial
  CRISPR gRNA sequence
aaactttccccatttagtca

SEQ ID NO: 298566 - DNA, 20 bp, Artificial
  CRISPR gRNA sequence
tttccccatttagtcagaga

SEQ ID NO: 298567 - DNA, 20 bp, Artificial
  CRISPR gRNA sequence
ttccccatttagtcagagaa

SEQ ID NO: 298568 - DNA, 20 bp, Artificial
  CRISPR gRNA sequence
catttagtcagagaaaggat

SEQ ID NO: 298569 - DNA, 20 bp, Artificial
  CRISPR gRNA sequence
ttagtcagagaaaggattag

SEQ ID NO: 298570 - DNA, 20 bp, Artificial
  CRISPR gRNA sequence
ttagcagcatcccccatgcc

SEQ ID NO: 298571 - DNA, 20 bp, Artificial
  CRISPR gRNA sequence
ccccatgcctggctctgtgt

SEQ ID NO: 298572 - DNA, 20 bp, Artificial
  CRISPR gRNA sequence
cctggctctgtgtgagatca

SEQ ID NO: 298573 - DNA, 20 bp, Artificial
  CRISPR gRNA sequence
ggctctgtgtgagatcatgg

SEQ ID NO: 298574 - DNA, 20 bp, Artificial
  CRISPR gRNA sequence
ctgtgtgagatcatggaagc

SEQ ID NO: 298575 - DNA, 20 bp, Artificial
  CRISPR gRNA sequence
tgtgagatcatggaagccag

SEQ ID NO: 298576 - DNA, 20 bp, Artificial
  CRISPR gRNA sequence
agatcatggaagccagtggt

SEQ ID NO: 298577 - DNA, 20 bp, Artificial
  CRISPR gRNA sequence
catggaagccagtggttggt

SEQ ID NO: 298578 - DNA, 20 bp, Artificial
  CRISPR gRNA sequence
atggaagccagtggttggtg

SEQ ID NO: 298579 - DNA, 20 bp, Artificial
  CRISPR gRNA sequence
cagtggttggtgaggtgcta

SEQ ID NO: 298580 - DNA, 20 bp, Artificial
  CRISPR gRNA sequence
gtggttggtgaggtgctatg

SEQ ID NO: 298581 - DNA, 20 bp, Artificial
  CRISPR gRNA sequence
tataaattgcaaaatacttt

SEQ ID NO: 298582 - DNA, 20 bp, Artificial
  CRISPR gRNA sequence
aaaatactttcagttccact

SEQ ID NO: 298583 - DNA, 20 bp, Artificial
  CRISPR gRNA sequence
actttcagttccactcagaa

SEQ ID NO: 298584 - DNA, 20 bp, Artificial
  CRISPR gRNA sequence
tccactcagaatggatttca

SEQ ID NO: 298585 - DNA, 20 bp, Artificial
  CRISPR gRNA sequence
tcaaagtgatttccacccca

SEQ ID NO: 298586 - DNA, 20 bp, Artificial
  CRISPR gRNA sequence
caaagtgatttccaccccat

SEQ ID NO: 298587 - DNA, 20 bp, Artificial
  CRISPR gRNA sequence
aaagtgatttccaccccatg

SEQ ID NO: 298588 - DNA, 20 bp, Artificial
  CRISPR gRNA sequence
agtgatttccaccccatggg

SEQ ID NO: 298589 - DNA, 20 bp, Artificial
  CRISPR gRNA sequence
gtgatttccaccccatgggg

SEQ ID NO: 298590 - DNA, 20 bp, Artificial
  CRISPR gRNA sequence
gatttccaccccatggggag

SEQ ID NO: 298591 - DNA, 20 bp, Artificial
  CRISPR gRNA sequence
tttccaccccatggggagga

SEQ ID NO: 298592 - DNA, 20 bp, Artificial
  CRISPR gRNA sequence
ttccaccccatggggaggag

SEQ ID NO: 298593 - DNA, 20 bp, Artificial
  CRISPR gRNA sequence
tccaccccatggggaggaga

SEQ ID NO: 298594 - DNA, 20 bp, Artificial
  CRISPR gRNA sequence
caccccatggggaggagagg

SEQ ID NO: 298595 - DNA, 20 bp, Artificial
  CRISPR gRNA sequence
atggggaggagagggagtct

SEQ ID NO: 298596 - DNA, 20 bp, Artificial
  CRISPR gRNA sequence
tggggaggagagggagtctg

SEQ ID NO: 298597 - DNA, 20 bp, Artificial
  CRISPR gRNA sequence
gggaggagagggagtctgag

SEQ ID NO: 298598 - DNA, 20 bp, Artificial
  CRISPR gRNA sequence
ggaggagagggagtctgagg

SEQ ID NO: 298599 - DNA, 20 bp, Artificial
  CRISPR gRNA sequence
gaggagagggagtctgagga

SEQ ID NO: 298600 - DNA, 20 bp, Artificial
  CRISPR gRNA sequence
agagggagtctgaggaggga

SEQ ID NO: 298601 - DNA, 20 bp, Artificial
  CRISPR gRNA sequence
ggagtctgaggagggatgga

SEQ ID NO: 298602 - DNA, 20 bp, Artificial
  CRISPR gRNA sequence
tcattttctgtgatccactc

SEQ ID NO: 298603 - DNA, 20 bp, Artificial
  CRISPR gRNA sequence
attttctgtgatccactctg

SEQ ID NO: 298604 - DNA, 20 bp, Artificial
  CRISPR gRNA sequence
tctgtgatccactctggaga

SEQ ID NO: 298605 - DNA, 20 bp, Artificial
  CRISPR gRNA sequence
tgtgatccactctggagaca

SEQ ID NO: 298606 - DNA, 20 bp, Artificial
  CRISPR gRNA sequence
gtgatccactctggagacag

SEQ ID NO: 298607 - DNA, 20 bp, Artificial
  CRISPR gRNA sequence
atccactctggagacagagg

SEQ ID NO: 298608 - DNA, 20 bp, Artificial
  CRISPR gRNA sequence
ccactctggagacagaggca

SEQ ID NO: 298609 - DNA, 20 bp, Artificial
  CRISPR gRNA sequence
gaggcagagattctctacaa

SEQ ID NO: 298610 - DNA, 20 bp, Artificial
  CRISPR gRNA sequence
tacaacagctgctcaaacta

SEQ ID NO: 298611 - DNA, 20 bp, Artificial
  CRISPR gRNA sequence
aactatagctcttgttaaaa

SEQ ID NO: 298612 - DNA, 20 bp, Artificial
  CRISPR gRNA sequence
ctatagctcttgttaaaatg

SEQ ID NO: 298613 - DNA, 20 bp, Artificial
  CRISPR gRNA sequence
tatagctcttgttaaaatgg

SEQ ID NO: 298614 - DNA, 20 bp, Artificial
  CRISPR gRNA sequence
ttaaaatggaggttctgaat

SEQ ID NO: 298615 - DNA, 20 bp, Artificial
  CRISPR gRNA sequence
aatggaggttctgaatcagt

SEQ ID NO: 298616 - DNA, 20 bp, Artificial
  CRISPR gRNA sequence
ggttctgaatcagtaagtct

SEQ ID NO: 298617 - DNA, 20 bp, Artificial
  CRISPR gRNA sequence
gttctgaatcagtaagtctt

SEQ ID NO: 298618 - DNA, 20 bp, Artificial
  CRISPR gRNA sequence
ctgaatcagtaagtcttggg

SEQ ID NO: 298619 - DNA, 20 bp, Artificial
  CRISPR gRNA sequence
tgaatcagtaagtcttgggt

SEQ ID NO: 298620 - DNA, 20 bp, Artificial
  CRISPR gRNA sequence
gaatcagtaagtcttgggtg

SEQ ID NO: 298621 - DNA, 20 bp, Artificial
  CRISPR gRNA sequence
cagtaagtcttgggtggggc

SEQ ID NO: 298622 - DNA, 20 bp, Artificial
  CRISPR gRNA sequence
gtaagtcttgggtggggcca

SEQ ID NO: 298623 - DNA, 20 bp, Artificial
  CRISPR gRNA sequence
gggccagagattccgtgttt

SEQ ID NO: 298624 - DNA, 20 bp, Artificial
  CRISPR gRNA sequence
agagattccgtgtttcagac

SEQ ID NO: 298625 - DNA, 20 bp, Artificial
  CRISPR gRNA sequence
acatgtgacgtgaatctcat

SEQ ID NO: 298626 - DNA, 20 bp, Artificial
  CRISPR gRNA sequence
tggtccatacatcacacttt

SEQ ID NO: 298627 - DNA, 20 bp, Artificial
  CRISPR gRNA sequence
tacatcacactttcagttgc

SEQ ID NO: 298628 - DNA, 20 bp, Artificial
  CRISPR gRNA sequence
acatcacactttcagttgct

SEQ ID NO: 298629 - DNA, 20 bp, Artificial
  CRISPR gRNA sequence
acactttcagttgctaggtg

SEQ ID NO: 298630 - DNA, 20 bp, Artificial
  CRISPR gRNA sequence
ctttcagttgctaggtgaag

SEQ ID NO: 298631 - DNA, 20 bp, Artificial
  CRISPR gRNA sequence
tttcagttgctaggtgaaga

SEQ ID NO: 298632 - DNA, 20 bp, Artificial
  CRISPR gRNA sequence
ttcagttgctaggtgaagaa

SEQ ID NO: 298633 - DNA, 20 bp, Artificial
  CRISPR gRNA sequence
cagttgctaggtgaagaagg

SEQ ID NO: 298634 - DNA, 20 bp, Artificial
  CRISPR gRNA sequence
tgaagaagggagcactcgat

SEQ ID NO: 298635 - DNA, 20 bp, Artificial
  CRISPR gRNA sequence
agaagggagcactcgatgag

SEQ ID NO: 298636 - DNA, 20 bp, Artificial
  CRISPR gRNA sequence
agggagcactcgatgagtgg

SEQ ID NO: 298637 - DNA, 20 bp, Artificial
  CRISPR gRNA sequence
ggagcactcgatgagtggaa

SEQ ID NO: 298638 - DNA, 20 bp, Artificial
  CRISPR gRNA sequence
cactcgatgagtggaagaga

SEQ ID NO: 298639 - DNA, 20 bp, Artificial
  CRISPR gRNA sequence
gagaaagccgttgtaatctt

SEQ ID NO: 298640 - DNA, 20 bp, Artificial
  CRISPR gRNA sequence
agaaagccgttgtaatcttt

SEQ ID NO: 298641 - DNA, 20 bp, Artificial
  CRISPR gRNA sequence
aaagccgttgtaatctttgg

SEQ ID NO: 298642 - DNA, 20 bp, Artificial
  CRISPR gRNA sequence
gccgttgtaatctttgggag

SEQ ID NO: 298643 - DNA, 20 bp, Artificial
  CRISPR gRNA sequence
ccgttgtaatctttgggaga

SEQ ID NO: 298644 - DNA, 20 bp, Artificial
  CRISPR gRNA sequence
cgttgtaatctttgggagaa

SEQ ID NO: 298645 - DNA, 20 bp, Artificial
  CRISPR gRNA sequence
gttgtaatctttgggagaag

SEQ ID NO: 298646 - DNA, 20 bp, Artificial
  CRISPR gRNA sequence
aatctttgggagaaggggcc

SEQ ID NO: 298647 - DNA, 20 bp, Artificial
  CRISPR gRNA sequence
atctttgggagaaggggcct

SEQ ID NO: 298648 - DNA, 20 bp, Artificial
  CRISPR gRNA sequence
ttgggagaaggggcctgggt

SEQ ID NO: 298649 - DNA, 20 bp, Artificial
  CRISPR gRNA sequence
ggagaaggggcctgggtcag

SEQ ID NO: 298650 - DNA, 20 bp, Artificial
  CRISPR gRNA sequence
agaaggggcctgggtcagcg

SEQ ID NO: 298651 - DNA, 20 bp, Artificial
  CRISPR gRNA sequence
ggggcctgggtcagcggagt

SEQ ID NO: 298652 - DNA, 20 bp, Artificial
  CRISPR gRNA sequence
ctgggtcagcggagttagac

SEQ ID NO: 298653 - DNA, 20 bp, Artificial
  CRISPR gRNA sequence
gcggagttagactggtctgt

SEQ ID NO: 298654 - DNA, 20 bp, Artificial
  CRISPR gRNA sequence
gagttagactggtctgtgag

SEQ ID NO: 298655 - DNA, 20 bp, Artificial
  CRISPR gRNA sequence
tagactggtctgtgagtgga

SEQ ID NO: 298656 - DNA, 20 bp, Artificial
  CRISPR gRNA sequence
tggtctgtgagtggacagaa

SEQ ID NO: 298657 - DNA, 20 bp, Artificial
  CRISPR gRNA sequence
ctgtgagtggacagaatgga

SEQ ID NO: 298658 - DNA, 20 bp, Artificial
  CRISPR gRNA sequence
tgtgagtggacagaatggat

SEQ ID NO: 298659 - DNA, 20 bp, Artificial
  CRISPR gRNA sequence
gagtggacagaatggatggg

SEQ ID NO: 298660 - DNA, 20 bp, Artificial
  CRISPR gRNA sequence
agtggacagaatggatggga

SEQ ID NO: 298661 - DNA, 20 bp, Artificial
  CRISPR gRNA sequence
gacagaatggatgggaagga

SEQ ID NO: 298662 - DNA, 20 bp, Artificial
  CRISPR gRNA sequence
agaatggatgggaaggaaag

SEQ ID NO: 298663 - DNA, 20 bp, Artificial
  CRISPR gRNA sequence
ggaaggaaagaagatactgt

SEQ ID NO: 298664 - DNA, 20 bp, Artificial
  CRISPR gRNA sequence
gaaggaaagaagatactgtg

SEQ ID NO: 298665 - DNA, 20 bp, Artificial
  CRISPR gRNA sequence
gaagatactgtgaggctcta

SEQ ID NO: 298666 - DNA, 20 bp, Artificial
  CRISPR gRNA sequence
tatatatatatatgtaaatc

SEQ ID NO: 298667 - DNA, 20 bp, Artificial
  CRISPR gRNA sequence
atatatatatgtaaatcaag

SEQ ID NO: 298668 - DNA, 20 bp, Artificial
  CRISPR gRNA sequence
atatatgtaaatcaagaaga

SEQ ID NO: 298669 - DNA, 20 bp, Artificial
  CRISPR gRNA sequence
tatgtaaatcaagaagacag

SEQ ID NO: 298670 - DNA, 20 bp, Artificial
  CRISPR gRNA sequence
gtaaatcaagaagacagaag

SEQ ID NO: 298671 - DNA, 20 bp, Artificial
  CRISPR gRNA sequence
caagaagacagaagcagcta

SEQ ID NO: 298672 - DNA, 20 bp, Artificial
  CRISPR gRNA sequence
gacagaagcagctaaagacg

SEQ ID NO: 298673 - DNA, 20 bp, Artificial
  CRISPR gRNA sequence
gctaaagacgaagtcatttc

SEQ ID NO: 298674 - DNA, 20 bp, Artificial
  CRISPR gRNA sequence
ctaaagacgaagtcatttcc

SEQ ID NO: 298675 - DNA, 20 bp, Artificial
  CRISPR gRNA sequence
gacgaagtcatttccaggtc

SEQ ID NO: 298676 - DNA, 20 bp, Artificial
  CRISPR gRNA sequence
gaagtcatttccaggtccag

SEQ ID NO: 298677 - DNA, 20 bp, Artificial
  CRISPR gRNA sequence
aagtcatttccaggtccaga

SEQ ID NO: 298678 - DNA, 20 bp, Artificial
  CRISPR gRNA sequence
ggtccagaaggcacaactga

SEQ ID NO: 298679 - DNA, 20 bp, Artificial
  CRISPR gRNA sequence
agaaggcacaactgacagct

SEQ ID NO: 298680 - DNA, 20 bp, Artificial
  CRISPR gRNA sequence
acataacattgactgttaat

SEQ ID NO: 298681 - DNA, 20 bp, Artificial
  CRISPR gRNA sequence
taacattgactgttaattgg

SEQ ID NO: 298682 - DNA, 20 bp, Artificial
  CRISPR gRNA sequence
agaatttttaactgtgtgtt

SEQ ID NO: 298683 - DNA, 20 bp, Artificial
  CRISPR gRNA sequence
tgtgtgtttggtttctccat

SEQ ID NO: 298684 - DNA, 20 bp, Artificial
  CRISPR gRNA sequence
gtgtgtttggtttctccatc

SEQ ID NO: 298685 - DNA, 20 bp, Artificial
  CRISPR gRNA sequence
tcctatattacatgacaatt

SEQ ID NO: 298686 - DNA, 20 bp, Artificial
  CRISPR gRNA sequence
atgacaatttagactaaaac

SEQ ID NO: 298687 - DNA, 20 bp, Artificial
  CRISPR gRNA sequence
gactaaaaccagtatttcct

SEQ ID NO: 298688 - DNA, 20 bp, Artificial
  CRISPR gRNA sequence
ctaaaaccagtatttcctca

SEQ ID NO: 298689 - DNA, 20 bp, Artificial
  CRISPR gRNA sequence
tatttcctcagagacaatgc

SEQ ID NO: 298690 - DNA, 20 bp, Artificial
  CRISPR gRNA sequence
ttcctcagagacaatgctag

SEQ ID NO: 298691 - DNA, 20 bp, Artificial
  CRISPR gRNA sequence
gacaatgctagaagctttta

SEQ ID NO: 298692 - DNA, 20 bp, Artificial
  CRISPR gRNA sequence
aatgctagaagcttttacag

SEQ ID NO: 298693 - DNA, 20 bp, Artificial
  CRISPR gRNA sequence
atgctagaagcttttacagt

SEQ ID NO: 298694 - DNA, 20 bp, Artificial
  CRISPR gRNA sequence
tgctagaagcttttacagta

SEQ ID NO: 298695 - DNA, 20 bp, Artificial
  CRISPR gRNA sequence
gctagaagcttttacagtag

SEQ ID NO: 298696 - DNA, 20 bp, Artificial
  CRISPR gRNA sequence
ctagaagcttttacagtagg

SEQ ID NO: 298697 - DNA, 20 bp, Artificial
  CRISPR gRNA sequence
gggcactcttgcattacatt

SEQ ID NO: 298698 - DNA, 20 bp, Artificial
  CRISPR gRNA sequence
gcactcttgcattacattaa

SEQ ID NO: 298699 - DNA, 20 bp, Artificial
  CRISPR gRNA sequence
cttgcattacattaagagct

SEQ ID NO: 298700 - DNA, 20 bp, Artificial
  CRISPR gRNA sequence
attacattaagagctcagca

SEQ ID NO: 298701 - DNA, 20 bp, Artificial
  CRISPR gRNA sequence
acattaagagctcagcaaag

SEQ ID NO: 298702 - DNA, 20 bp, Artificial
  CRISPR gRNA sequence
agagctcagcaaagaagatg

SEQ ID NO: 298703 - DNA, 20 bp, Artificial
  CRISPR gRNA sequence
gctcagcaaagaagatgcag

SEQ ID NO: 298704 - DNA, 20 bp, Artificial
  CRISPR gRNA sequence
caaagaagatgcagaagcct

SEQ ID NO: 298705 - DNA, 20 bp, Artificial
  CRISPR gRNA sequence
aaagaagatgcagaagcctc

SEQ ID NO: 298706 - DNA, 20 bp, Artificial
  CRISPR gRNA sequence
aagcctcaggtttgccttgt

SEQ ID NO: 298707 - DNA, 20 bp, Artificial
  CRISPR gRNA sequence
agcctcaggtttgccttgta

SEQ ID NO: 298708 - DNA, 20 bp, Artificial
  CRISPR gRNA sequence
taaacacactaaatcttcct

SEQ ID NO: 298709 - DNA, 20 bp, Artificial
  CRISPR gRNA sequence
aaacacactaaatcttcctt

SEQ ID NO: 298710 - DNA, 20 bp, Artificial
  CRISPR gRNA sequence
ttaggtctccctttcactgt

SEQ ID NO: 298711 - DNA, 20 bp, Artificial
  CRISPR gRNA sequence
taggtctccctttcactgtc

SEQ ID NO: 298712 - DNA, 20 bp, Artificial
  CRISPR gRNA sequence
aggtctccctttcactgtca

SEQ ID NO: 298713 - DNA, 20 bp, Artificial
  CRISPR gRNA sequence
tcactgtcagggtacgcata

SEQ ID NO: 298714 - DNA, 20 bp, Artificial
  CRISPR gRNA sequence
ttccttcctccctccaatac

SEQ ID NO: 298715 - DNA, 20 bp, Artificial
  CRISPR gRNA sequence
ataccggtacgcatcctcta

SEQ ID NO: 298716 - DNA, 20 bp, Artificial
  CRISPR gRNA sequence
taccggtacgcatcctctac

SEQ ID NO: 298717 - DNA, 20 bp, Artificial
  CRISPR gRNA sequence
cggtacgcatcctctacagg

SEQ ID NO: 298718 - DNA, 20 bp, Artificial
  CRISPR gRNA sequence
ggtggtgcattttatacctc

SEQ ID NO: 298719 - DNA, 20 bp, Artificial
  CRISPR gRNA sequence
tttatacctcaagtacttca

SEQ ID NO: 298720 - DNA, 20 bp, Artificial
  CRISPR gRNA sequence
ttatacctcaagtacttcac

SEQ ID NO: 298721 - DNA, 20 bp, Artificial
  CRISPR gRNA sequence
tatacctcaagtacttcaca

SEQ ID NO: 298722 - DNA, 20 bp, Artificial
  CRISPR gRNA sequence
tcaagtacttcacagggtcc

SEQ ID NO: 298723 - DNA, 20 bp, Artificial
  CRISPR gRNA sequence
gtacttcacagggtcctagt

SEQ ID NO: 298724 - DNA, 20 bp, Artificial
  CRISPR gRNA sequence
tcacagggtcctagtgagtg

SEQ ID NO: 298725 - DNA, 20 bp, Artificial
  CRISPR gRNA sequence
tcctagtgagtgtagtgaaa

SEQ ID NO: 298726 - DNA, 20 bp, Artificial
  CRISPR gRNA sequence
cctagtgagtgtagtgaaat

SEQ ID NO: 298727 - DNA, 20 bp, Artificial
  CRISPR gRNA sequence
agtgagtgtagtgaaatagg

SEQ ID NO: 298728 - DNA, 20 bp, Artificial
  CRISPR gRNA sequence
tgcctgctgtctgcttccct

SEQ ID NO: 298729 - DNA, 20 bp, Artificial
  CRISPR gRNA sequence
cctgctgtctgcttccctaa

SEQ ID NO: 298730 - DNA, 20 bp, Artificial
  CRISPR gRNA sequence
gtctgcttccctaagagttc

SEQ ID NO: 298731 - DNA, 20 bp, Artificial
  CRISPR gRNA sequence
ccttgattatgtgttctcac

SEQ ID NO: 298732 - DNA, 20 bp, Artificial
  CRISPR gRNA sequence
cttgattatgtgttctcact

SEQ ID NO: 298733 - DNA, 20 bp, Artificial
  CRISPR gRNA sequence
tcactgggccactctgtaca

SEQ ID NO: 298734 - DNA, 20 bp, Artificial
  CRISPR gRNA sequence
gggccactctgtacacagtt

SEQ ID NO: 298735 - DNA, 20 bp, Artificial
  CRISPR gRNA sequence
tgtacacagtttagtttgac

SEQ ID NO: 298736 - DNA, 20 bp, Artificial
  CRISPR gRNA sequence
gtccttctattccctctttc

SEQ ID NO: 298737 - DNA, 20 bp, Artificial
  CRISPR gRNA sequence
ccttctattccctctttcaa

SEQ ID NO: 298738 - DNA, 20 bp, Artificial
  CRISPR gRNA sequence
aatttaattactcccccact

SEQ ID NO: 298739 - DNA, 20 bp, Artificial
  CRISPR gRNA sequence
cacttagaactcttcaaatg

SEQ ID NO: 298740 - DNA, 20 bp, Artificial
  CRISPR gRNA sequence
ctgaatgatgaaattttatt

SEQ ID NO: 298741 - DNA, 20 bp, Artificial
  CRISPR gRNA sequence
cttacactaacttcctctcc

SEQ ID NO: 298742 - DNA, 20 bp, Artificial
  CRISPR gRNA sequence
ttacactaacttcctctcca

SEQ ID NO: 298743 - DNA, 20 bp, Artificial
  CRISPR gRNA sequence
cactaacttcctctccaagg

SEQ ID NO: 298744 - DNA, 20 bp, Artificial
  CRISPR gRNA sequence
gtggcatctaacttcatatt

SEQ ID NO: 298745 - DNA, 20 bp, Artificial
  CRISPR gRNA sequence
catctaacttcatattaagt

SEQ ID NO: 298746 - DNA, 20 bp, Artificial
  CRISPR gRNA sequence
acttcatattaagtaagaaa

SEQ ID NO: 298747 - DNA, 20 bp, Artificial
  CRISPR gRNA sequence
tttttttttttttttttgcc

SEQ ID NO: 298748 - DNA, 20 bp, Artificial
  CRISPR gRNA sequence
ttttttttttgccaagtctc

SEQ ID NO: 298749 - DNA, 20 bp, Artificial
  CRISPR gRNA sequence
tctcaagtaattctgtaacc

SEQ ID NO: 298750 - DNA, 20 bp, Artificial
  CRISPR gRNA sequence
agtaattctgtaacctagaa

SEQ ID NO: 298751 - DNA, 20 bp, Artificial
  CRISPR gRNA sequence
gtaattctgtaacctagaaa

SEQ ID NO: 298752 - DNA, 20 bp, Artificial
  CRISPR gRNA sequence
ccccgtgatcattcacattt

SEQ ID NO: 298753 - DNA, 20 bp, Artificial
  CRISPR gRNA sequence
cgtgatcattcacatttaag

SEQ ID NO: 298754 - DNA, 20 bp, Artificial
  CRISPR gRNA sequence
atcattcacatttaagtagt

SEQ ID NO: 298755 - DNA, 20 bp, Artificial
  CRISPR gRNA sequence
tcattcacatttaagtagtt

SEQ ID NO: 298756 - DNA, 20 bp, Artificial
  CRISPR gRNA sequence
ttcacatttaagtagttggg

SEQ ID NO: 298757 - DNA, 20 bp, Artificial
  CRISPR gRNA sequence
catccttcccacaaacccca

SEQ ID NO: 298758 - DNA, 20 bp, Artificial
  CRISPR gRNA sequence
acaaaccccaaagtgtcctc

SEQ ID NO: 298759 - DNA, 20 bp, Artificial
  CRISPR gRNA sequence
caaaccccaaagtgtcctca

SEQ ID NO: 298760 - DNA, 20 bp, Artificial
  CRISPR gRNA sequence
caaagtgtcctcaaggacta

SEQ ID NO: 298761 - DNA, 20 bp, Artificial
  CRISPR gRNA sequence
agcctttctctcaacccttc

SEQ ID NO: 298762 - DNA, 20 bp, Artificial
  CRISPR gRNA sequence
cccttccagcatgatgtcta

SEQ ID NO: 298763 - DNA, 20 bp, Artificial
  CRISPR gRNA sequence
tctatggttgtaaaattgtc

SEQ ID NO: 298764 - DNA, 20 bp, Artificial
  CRISPR gRNA sequence
ctatggttgtaaaattgtcc

SEQ ID NO: 298765 - DNA, 20 bp, Artificial
  CRISPR gRNA sequence
tatggttgtaaaattgtcca

SEQ ID NO: 298766 - DNA, 20 bp, Artificial
  CRISPR gRNA sequence
gttgtaaaattgtccagggt

SEQ ID NO: 298767 - DNA, 20 bp, Artificial
  CRISPR gRNA sequence
tgtccagggtcagtgcatac

SEQ ID NO: 298768 - DNA, 20 bp, Artificial
  CRISPR gRNA sequence
gtccagggtcagtgcatact

SEQ ID NO: 298769 - DNA, 20 bp, Artificial
  CRISPR gRNA sequence
ccagggtcagtgcatactgg

SEQ ID NO: 298770 - DNA, 20 bp, Artificial
  CRISPR gRNA sequence
gggtcagtgcatactgggag

SEQ ID NO: 298771 - DNA, 20 bp, Artificial
  CRISPR gRNA sequence
cagtgcatactgggagcagc

SEQ ID NO: 298772 - DNA, 20 bp, Artificial
  CRISPR gRNA sequence
tactgggagcagcaagtttg

SEQ ID NO: 298773 - DNA, 20 bp, Artificial
  CRISPR gRNA sequence
agcagcaagtttgtggtgcc

SEQ ID NO: 298774 - DNA, 20 bp, Artificial
  CRISPR gRNA sequence
gcagcaagtttgtggtgcct

SEQ ID NO: 298775 - DNA, 20 bp, Artificial
  CRISPR gRNA sequence
cagcaagtttgtggtgcctg

SEQ ID NO: 298776 - DNA, 20 bp, Artificial
  CRISPR gRNA sequence
gggtttccccaatactccca

SEQ ID NO: 298777 - DNA, 20 bp, Artificial
  CRISPR gRNA sequence
gcccatctatgattcatttt

SEQ ID NO: 298778 - DNA, 20 bp, Artificial
  CRISPR gRNA sequence
tttcactcatgtgccttaaa

SEQ ID NO: 298779 - DNA, 20 bp, Artificial
  CRISPR gRNA sequence
tgaccaccacaatccgaaaa

SEQ ID NO: 298780 - DNA, 20 bp, Artificial
  CRISPR gRNA sequence
aaacagccatcaaatttgcc

SEQ ID NO: 298781 - DNA, 20 bp, Artificial
  CRISPR gRNA sequence
gttctctttctgatctctga

SEQ ID NO: 298782 - DNA, 20 bp, Artificial
  CRISPR gRNA sequence
tctctttctgatctctgaaa

SEQ ID NO: 298783 - DNA, 20 bp, Artificial
  CRISPR gRNA sequence
ttctgatctctgaaagagct

SEQ ID NO: 298784 - DNA, 20 bp, Artificial
  CRISPR gRNA sequence
ctgatctctgaaagagctta

SEQ ID NO: 298785 - DNA, 20 bp, Artificial
  CRISPR gRNA sequence
gatctctgaaagagcttaga

SEQ ID NO: 298786 - DNA, 20 bp, Artificial
  CRISPR gRNA sequence
atctctgaaagagcttagag

SEQ ID NO: 298787 - DNA, 20 bp, Artificial
  CRISPR gRNA sequence
tagagaggtcactgaaaata

SEQ ID NO: 298788 - DNA, 20 bp, Artificial
  CRISPR gRNA sequence
agagaggtcactgaaaataa

SEQ ID NO: 298789 - DNA, 20 bp, Artificial
  CRISPR gRNA sequence
gtcactgaaaataaaggcct

SEQ ID NO: 298790 - DNA, 20 bp, Artificial
  CRISPR gRNA sequence
aaggccttggttcactatcg

SEQ ID NO: 298791 - DNA, 20 bp, Artificial
  CRISPR gRNA sequence
cactatcgaagtcatttcta

SEQ ID NO: 298792 - DNA, 20 bp, Artificial
  CRISPR gRNA sequence
tctaaagcatttgacatcct

SEQ ID NO: 298793 - DNA, 20 bp, Artificial
  CRISPR gRNA sequence
aaagcatttgacatccttgg

SEQ ID NO: 298794 - DNA, 20 bp, Artificial
  CRISPR gRNA sequence
tttgacatccttggaagtgc

SEQ ID NO: 298795 - DNA, 20 bp, Artificial
  CRISPR gRNA sequence
atccttggaagtgctggcca

SEQ ID NO: 298796 - DNA, 20 bp, Artificial
  CRISPR gRNA sequence
tccttggaagtgctggccat

SEQ ID NO: 298797 - DNA, 20 bp, Artificial
  CRISPR gRNA sequence
cttggaagtgctggccatgg

SEQ ID NO: 298798 - DNA, 20 bp, Artificial
  CRISPR gRNA sequence
ggaagtgctggccatgggag

SEQ ID NO: 298799 - DNA, 20 bp, Artificial
  CRISPR gRNA sequence
agtgctggccatgggagcag

SEQ ID NO: 298800 - DNA, 20 bp, Artificial
  CRISPR gRNA sequence
ggccatgggagcagcagtca

SEQ ID NO: 298801 - DNA, 20 bp, Artificial
  CRISPR gRNA sequence
gccatgggagcagcagtcat

SEQ ID NO: 298802 - DNA, 20 bp, Artificial
  CRISPR gRNA sequence
ccatgggagcagcagtcata

SEQ ID NO: 298803 - DNA, 20 bp, Artificial
  CRISPR gRNA sequence
catgggagcagcagtcatag

SEQ ID NO: 298804 - DNA, 20 bp, Artificial
  CRISPR gRNA sequence
gggagcagcagtcatagggg

SEQ ID NO: 298805 - DNA, 20 bp, Artificial
  CRISPR gRNA sequence
gtcataggggaagttctgta

SEQ ID NO: 298806 - DNA, 20 bp, Artificial
  CRISPR gRNA sequence
tcataggggaagttctgtaa

SEQ ID NO: 298807 - DNA, 20 bp, Artificial
  CRISPR gRNA sequence
cataggggaagttctgtaaa

SEQ ID NO: 298808 - DNA, 20 bp, Artificial
  CRISPR gRNA sequence
taggggaagttctgtaaagg

SEQ ID NO: 298809 - DNA, 20 bp, Artificial
  CRISPR gRNA sequence
agggagctatttgaatttca

SEQ ID NO: 298810 - DNA, 20 bp, Artificial
  CRISPR gRNA sequence
acgtgattccccaactaatg

SEQ ID NO: 298811 - DNA, 20 bp, Artificial
  CRISPR gRNA sequence
ccaactaatgaagtataata

SEQ ID NO: 298812 - DNA, 20 bp, Artificial
  CRISPR gRNA sequence
caactaatgaagtataataa

SEQ ID NO: 298813 - DNA, 20 bp, Artificial
  CRISPR gRNA sequence
aactaatgaagtataataaa

SEQ ID NO: 298814 - DNA, 20 bp, Artificial
  CRISPR gRNA sequence
actaatgaagtataataaag

SEQ ID NO: 298815 - DNA, 20 bp, Artificial
  CRISPR gRNA sequence
ctaatgaagtataataaagg

SEQ ID NO: 298816 - DNA, 20 bp, Artificial
  CRISPR gRNA sequence
taatgaagtataataaaggg

SEQ ID NO: 298817 - DNA, 20 bp, Artificial
  CRISPR gRNA sequence
ctataatttattaccattat

SEQ ID NO: 298818 - DNA, 20 bp, Artificial
  CRISPR gRNA sequence
tatcagcaatcttttcacca

SEQ ID NO: 298819 - DNA, 20 bp, Artificial
  CRISPR gRNA sequence
cagcaatcttttcaccatag

SEQ ID NO: 298820 - DNA, 20 bp, Artificial
  CRISPR gRNA sequence
tcttttcaccatagcagacc

SEQ ID NO: 298821 - DNA, 20 bp, Artificial
  CRISPR gRNA sequence
cttttcaccatagcagacca

SEQ ID NO: 298822 - DNA, 20 bp, Artificial
  CRISPR gRNA sequence
atagcagaccaaggaatatg

SEQ ID NO: 298823 - DNA, 20 bp, Artificial
  CRISPR gRNA sequence
cagaccaaggaatatgtgga

SEQ ID NO: 298824 - DNA, 20 bp, Artificial
  CRISPR gRNA sequence
agaccaaggaatatgtggat

SEQ ID NO: 298825 - DNA, 20 bp, Artificial
  CRISPR gRNA sequence
accaaggaatatgtggatgg

SEQ ID NO: 298826 - DNA, 20 bp, Artificial
  CRISPR gRNA sequence
ccaaggaatatgtggatggg

SEQ ID NO: 298827 - DNA, 20 bp, Artificial
  CRISPR gRNA sequence
caaggaatatgtggatggga

SEQ ID NO: 298828 - DNA, 20 bp, Artificial
  CRISPR gRNA sequence
aaggaatatgtggatgggag

SEQ ID NO: 298829 - DNA, 20 bp, Artificial
  CRISPR gRNA sequence
ggaatatgtggatgggaggg

SEQ ID NO: 298830 - DNA, 20 bp, Artificial
  CRISPR gRNA sequence
gaatatgtggatgggagggg

SEQ ID NO: 298831 - DNA, 20 bp, Artificial
  CRISPR gRNA sequence
aatatgtggatgggagggga

SEQ ID NO: 298832 - DNA, 20 bp, Artificial
  CRISPR gRNA sequence
atatgtggatgggaggggag

SEQ ID NO: 298833 - DNA, 20 bp, Artificial
  CRISPR gRNA sequence
gtggatgggaggggagggga

SEQ ID NO: 298834 - DNA, 20 bp, Artificial
  CRISPR gRNA sequence
ggaggggaggggaaagcttt

SEQ ID NO: 298835 - DNA, 20 bp, Artificial
  CRISPR gRNA sequence
gaggggaaagcttttggtga

SEQ ID NO: 298836 - DNA, 20 bp, Artificial
  CRISPR gRNA sequence
gaaagcttttggtgatggtg

SEQ ID NO: 298837 - DNA, 20 bp, Artificial
  CRISPR gRNA sequence
agcttttggtgatggtgtag

SEQ ID NO: 298838 - DNA, 20 bp, Artificial
  CRISPR gRNA sequence
tggtgatggtgtagaagtta

SEQ ID NO: 298839 - DNA, 20 bp, Artificial
  CRISPR gRNA sequence
agaagttatggaacctgtaa

SEQ ID NO: 298840 - DNA, 20 bp, Artificial
  CRISPR gRNA sequence
tatggaacctgtaacagcta

SEQ ID NO: 298841 - DNA, 20 bp, Artificial
  CRISPR gRNA sequence
cagtgatgaaaactaaaatt

SEQ ID NO: 298842 - DNA, 20 bp, Artificial
  CRISPR gRNA sequence
agtgatgaaaactaaaatta

SEQ ID NO: 298843 - DNA, 20 bp, Artificial
  CRISPR gRNA sequence
gaaaactaaaattaaggtta

SEQ ID NO: 298844 - DNA, 20 bp, Artificial
  CRISPR gRNA sequence
aaaactaaaattaaggttat

SEQ ID NO: 298845 - DNA, 20 bp, Artificial
  CRISPR gRNA sequence
actaaaattaaggttatagg

SEQ ID NO: 298846 - DNA, 20 bp, Artificial
  CRISPR gRNA sequence
ctaaaattaaggttatagga

SEQ ID NO: 298847 - DNA, 20 bp, Artificial
  CRISPR gRNA sequence
taaggttataggaaggtaac

SEQ ID NO: 298848 - DNA, 20 bp, Artificial
  CRISPR gRNA sequence
ggttataggaaggtaactgg

SEQ ID NO: 298849 - DNA, 20 bp, Artificial
  CRISPR gRNA sequence
gttataggaaggtaactggt

SEQ ID NO: 298850 - DNA, 20 bp, Artificial
  CRISPR gRNA sequence
gaaggtaactggtgggtgaa

SEQ ID NO: 298851 - DNA, 20 bp, Artificial
  CRISPR gRNA sequence
aaggtaactggtgggtgaat

SEQ ID NO: 298852 - DNA, 20 bp, Artificial
  CRISPR gRNA sequence
aatgggttgtctaactctac

SEQ ID NO: 298853 - DNA, 20 bp, Artificial
  CRISPR gRNA sequence
tgtcttgcaatttaaattca

SEQ ID NO: 298854 - DNA, 20 bp, Artificial
  CRISPR gRNA sequence
aatttaaattcacagaacca

SEQ ID NO: 298855 - DNA, 20 bp, Artificial
  CRISPR gRNA sequence
aattcacagaaccacagtac

SEQ ID NO: 298856 - DNA, 20 bp, Artificial
  CRISPR gRNA sequence
cacagaaccacagtactaga

SEQ ID NO: 298857 - DNA, 20 bp, Artificial
  CRISPR gRNA sequence
cacagtactagaaagaccct

SEQ ID NO: 298858 - DNA, 20 bp, Artificial
  CRISPR gRNA sequence
agaaagacccttggaacatt

SEQ ID NO: 298859 - DNA, 20 bp, Artificial
  CRISPR gRNA sequence
tagtcaaccacttcattaat

SEQ ID NO: 298860 - DNA, 20 bp, Artificial
  CRISPR gRNA sequence
aaccacttcattaatcagat

SEQ ID NO: 298861 - DNA, 20 bp, Artificial
  CRISPR gRNA sequence
accacttcattaatcagatg

SEQ ID NO: 298862 - DNA, 20 bp, Artificial
  CRISPR gRNA sequence
attaatcagatgaggaaact

SEQ ID NO: 298863 - DNA, 20 bp, Artificial
  CRISPR gRNA sequence
ttaatcagatgaggaaactg

SEQ ID NO: 298864 - DNA, 20 bp, Artificial
  CRISPR gRNA sequence
tgaggaaactgaggctcata

SEQ ID NO: 298865 - DNA, 20 bp, Artificial
  CRISPR gRNA sequence
actgaggctcataaagattg

SEQ ID NO: 298866 - DNA, 20 bp, Artificial
  CRISPR gRNA sequence
ataaagattgcagtttgtac

SEQ ID NO: 298867 - DNA, 20 bp, Artificial
  CRISPR gRNA sequence
taaagattgcagtttgtaca

SEQ ID NO: 298868 - DNA, 20 bp, Artificial
  CRISPR gRNA sequence
tttgtacaaggccacacatt

SEQ ID NO: 298869 - DNA, 20 bp, Artificial
  CRISPR gRNA sequence
tacaaggccacacatttagt

SEQ ID NO: 298870 - DNA, 20 bp, Artificial
  CRISPR gRNA sequence
aaggccacacatttagtcag

SEQ ID NO: 298871 - DNA, 20 bp, Artificial
  CRISPR gRNA sequence
cacacatttagtcagcggtg

SEQ ID NO: 298872 - DNA, 20 bp, Artificial
  CRISPR gRNA sequence
catttagtcagcggtgaagc

SEQ ID NO: 298873 - DNA, 20 bp, Artificial
  CRISPR gRNA sequence
atttagtcagcggtgaagca

SEQ ID NO: 298874 - DNA, 20 bp, Artificial
  CRISPR gRNA sequence
tcagcggtgaagcaaggaca

SEQ ID NO: 298875 - DNA, 20 bp, Artificial
  CRISPR gRNA sequence
cagcggtgaagcaaggacaa

SEQ ID NO: 298876 - DNA, 20 bp, Artificial
  CRISPR gRNA sequence
aggacaaaggtcctaatctc

SEQ ID NO: 298877 - DNA, 20 bp, Artificial
  CRISPR gRNA sequence
ggtcctaatctccagatgcc

SEQ ID NO: 298878 - DNA, 20 bp, Artificial
  CRISPR gRNA sequence
cctaatctccagatgccaag

SEQ ID NO: 298879 - DNA, 20 bp, Artificial
  CRISPR gRNA sequence
agatgccaagcagatgtgca

SEQ ID NO: 298880 - DNA, 20 bp, Artificial
  CRISPR gRNA sequence
caagcagatgtgcacagttc

SEQ ID NO: 298881 - DNA, 20 bp, Artificial
  CRISPR gRNA sequence
agcagatgtgcacagttcca

SEQ ID NO: 298882 - DNA, 20 bp, Artificial
  CRISPR gRNA sequence
gagcttaatatcttattctt

SEQ ID NO: 298883 - DNA, 20 bp, Artificial
  CRISPR gRNA sequence
tcttcagcatgattactgat

SEQ ID NO: 298884 - DNA, 20 bp, Artificial
  CRISPR gRNA sequence
cagcatgattactgataaga

SEQ ID NO: 298885 - DNA, 20 bp, Artificial
  CRISPR gRNA sequence
attactgataagatagtatc

SEQ ID NO: 298886 - DNA, 20 bp, Artificial
  CRISPR gRNA sequence
ttactgataagatagtatct

SEQ ID NO: 298887 - DNA, 20 bp, Artificial
  CRISPR gRNA sequence
tagtatctgggtattgtata

SEQ ID NO: 298888 - DNA, 20 bp, Artificial
  CRISPR gRNA sequence
gtatctgggtattgtataaa

SEQ ID NO: 298889 - DNA, 20 bp, Artificial
  CRISPR gRNA sequence
gggtattgtataaagagaaa

SEQ ID NO: 298890 - DNA, 20 bp, Artificial
  CRISPR gRNA sequence
gtattgtataaagagaaatg

SEQ ID NO: 298891 - DNA, 20 bp, Artificial
  CRISPR gRNA sequence
tattgtataaagagaaatgg

SEQ ID NO: 298892 - DNA, 20 bp, Artificial
  CRISPR gRNA sequence
taatccttaaccttcttttt

SEQ ID NO: 298893 - DNA, 20 bp, Artificial
  CRISPR gRNA sequence
aatccttaaccttctttttt

SEQ ID NO: 298894 - DNA, 20 bp, Artificial
  CRISPR gRNA sequence
ttttaggtgctgctcctctg

SEQ ID NO: 298895 - DNA, 20 bp, Artificial
  CRISPR gRNA sequence
tgctgctcctctgaagattc

SEQ ID NO: 298896 - DNA, 20 bp, Artificial
  CRISPR gRNA sequence
agattcaagcttatttcaat

SEQ ID NO: 298897 - DNA, 20 bp, Artificial
  CRISPR gRNA sequence
agcttatttcaatgagactg

SEQ ID NO: 298898 - DNA, 20 bp, Artificial
  CRISPR gRNA sequence
tttgcaaactctcaaaacca

SEQ ID NO: 298899 - DNA, 20 bp, Artificial
  CRISPR gRNA sequence
aactctcaaaaccaaagcct

SEQ ID NO: 298900 - DNA, 20 bp, Artificial
  CRISPR gRNA sequence
ctcaaaaccaaagcctgagt

SEQ ID NO: 298901 - DNA, 20 bp, Artificial
  CRISPR gRNA sequence
aaaccaaagcctgagtgagc

SEQ ID NO: 298902 - DNA, 20 bp, Artificial
  CRISPR gRNA sequence
ccaaagcctgagtgagctag

SEQ ID NO: 298903 - DNA, 20 bp, Artificial
  CRISPR gRNA sequence
tgagtgagctagtagtattt

SEQ ID NO: 298904 - DNA, 20 bp, Artificial
  CRISPR gRNA sequence
gtgagctagtagtattttgg

SEQ ID NO: 298905 - DNA, 20 bp, Artificial
  CRISPR gRNA sequence
tgagctagtagtattttggc

SEQ ID NO: 298906 - DNA, 20 bp, Artificial
  CRISPR gRNA sequence
tagtagtattttggcaggac

SEQ ID NO: 298907 - DNA, 20 bp, Artificial
  CRISPR gRNA sequence
agtagtattttggcaggacc

SEQ ID NO: 298908 - DNA, 20 bp, Artificial
  CRISPR gRNA sequence
ttggcaggaccaggaaaact

SEQ ID NO: 298909 - DNA, 20 bp, Artificial
  CRISPR gRNA sequence
aggaaaacttggttctgaat

SEQ ID NO: 298910 - DNA, 20 bp, Artificial
  CRISPR gRNA sequence
ggaaaacttggttctgaatg

SEQ ID NO: 298911 - DNA, 20 bp, Artificial
  CRISPR gRNA sequence
ggttctgaatgaggtatact

SEQ ID NO: 298912 - DNA, 20 bp, Artificial
  CRISPR gRNA sequence
gttctgaatgaggtatactt

SEQ ID NO: 298913 - DNA, 20 bp, Artificial
  CRISPR gRNA sequence
gaatgaggtatacttaggca

SEQ ID NO: 298914 - DNA, 20 bp, Artificial
  CRISPR gRNA sequence
atgaggtatacttaggcaaa

SEQ ID NO: 298915 - DNA, 20 bp, Artificial
  CRISPR gRNA sequence
ttaggcaaagagaaatttga

SEQ ID NO: 298916 - DNA, 20 bp, Artificial
  CRISPR gRNA sequence
aatttgacagtgttcattcc

SEQ ID NO: 298917 - DNA, 20 bp, Artificial
  CRISPR gRNA sequence
cagtgttcattccaagtata

SEQ ID NO: 298918 - DNA, 20 bp, Artificial
  CRISPR gRNA sequence
agtgttcattccaagtatat

SEQ ID NO: 298919 - DNA, 20 bp, Artificial
  CRISPR gRNA sequence
tccaagtatatgggccgcac

SEQ ID NO: 298920 - DNA, 20 bp, Artificial
  CRISPR gRNA sequence
gggccgcacaagttttgatt

SEQ ID NO: 298921 - DNA, 20 bp, Artificial
  CRISPR gRNA sequence
cgcacaagttttgattcgga

SEQ ID NO: 298922 - DNA, 20 bp, Artificial
  CRISPR gRNA sequence
caagttttgattcggacagt

SEQ ID NO: 298923 - DNA, 20 bp, Artificial
  CRISPR gRNA sequence
gattcggacagttggaccct

SEQ ID NO: 298924 - DNA, 20 bp, Artificial
  CRISPR gRNA sequence
ccctgagacttcacaatctt

SEQ ID NO: 298925 - DNA, 20 bp, Artificial
  CRISPR gRNA sequence
gacttcacaatcttcagatc

SEQ ID NO: 298926 - DNA, 20 bp, Artificial
  CRISPR gRNA sequence
acttcacaatcttcagatca

SEQ ID NO: 298927 - DNA, 20 bp, Artificial
  CRISPR gRNA sequence
acaatcttcagatcaaggac

SEQ ID NO: 298928 - DNA, 20 bp, Artificial
  CRISPR gRNA sequence
caatcttcagatcaaggaca

SEQ ID NO: 298929 - DNA, 20 bp, Artificial
  CRISPR gRNA sequence
aatcttcagatcaaggacaa

SEQ ID NO: 298930 - DNA, 20 bp, Artificial
  CRISPR gRNA sequence
aatgtatcatccatcacaaa

SEQ ID NO: 298931 - DNA, 20 bp, Artificial
  CRISPR gRNA sequence
catccatcacaaaaagccca

SEQ ID NO: 298932 - DNA, 20 bp, Artificial
  CRISPR gRNA sequence
atccatcacaaaaagcccac

SEQ ID NO: 298933 - DNA, 20 bp, Artificial
  CRISPR gRNA sequence
caggaatgattcgcatccac

SEQ ID NO: 298934 - DNA, 20 bp, Artificial
  CRISPR gRNA sequence
ccagatgaattctgaactgt

SEQ ID NO: 298935 - DNA, 20 bp, Artificial
  CRISPR gRNA sequence
aattctgaactgtcagtgct

SEQ ID NO: 298936 - DNA, 20 bp, Artificial
  CRISPR gRNA sequence
aactgtcagtgcttggtatg

SEQ ID NO: 298937 - DNA, 20 bp, Artificial
  CRISPR gRNA sequence
agtgcttggtatgtggtcaa

SEQ ID NO: 298938 - DNA, 20 bp, Artificial
  CRISPR gRNA sequence
tgtggtcaatggtgtgtgtt

SEQ ID NO: 298939 - DNA, 20 bp, Artificial
  CRISPR gRNA sequence
atggtgtgtgttcagattct

SEQ ID NO: 298940 - DNA, 20 bp, Artificial
  CRISPR gRNA sequence
gttcagattcttagccttct

SEQ ID NO: 298941 - DNA, 20 bp, Artificial
  CRISPR gRNA sequence
gattcttagccttctcagat

SEQ ID NO: 298942 - DNA, 20 bp, Artificial
  CRISPR gRNA sequence
tctcagatgagactgcaaat

SEQ ID NO: 298943 - DNA, 20 bp, Artificial
  CRISPR gRNA sequence
agatgagactgcaaatgagt

SEQ ID NO: 298944 - DNA, 20 bp, Artificial
  CRISPR gRNA sequence
caaatgagttagaaaaacac

SEQ ID NO: 298945 - DNA, 20 bp, Artificial
  CRISPR gRNA sequence
aatgagttagaaaaacactg

SEQ ID NO: 298946 - DNA, 20 bp, Artificial
  CRISPR gRNA sequence
atgagttagaaaaacactgg

SEQ ID NO: 298947 - DNA, 20 bp, Artificial
  CRISPR gRNA sequence
tgagttagaaaaacactgga

SEQ ID NO: 298948 - DNA, 20 bp, Artificial
  CRISPR gRNA sequence
gagttagaaaaacactggag

SEQ ID NO: 298949 - DNA, 20 bp, Artificial
  CRISPR gRNA sequence
agttagaaaaacactggagg

SEQ ID NO: 298950 - DNA, 20 bp, Artificial
  CRISPR gRNA sequence
aaaacactggagggggactt

SEQ ID NO: 298951 - DNA, 20 bp, Artificial
  CRISPR gRNA sequence
aaacactggagggggacttg

SEQ ID NO: 298952 - DNA, 20 bp, Artificial
  CRISPR gRNA sequence
aacactggagggggacttga

SEQ ID NO: 298953 - DNA, 20 bp, Artificial
  CRISPR gRNA sequence
acactggagggggacttgag

SEQ ID NO: 298954 - DNA, 20 bp, Artificial
  CRISPR gRNA sequence
ggagggggacttgaggggcc

SEQ ID NO: 298955 - DNA, 20 bp, Artificial
  CRISPR gRNA sequence
gagggggacttgaggggccc

SEQ ID NO: 298956 - DNA, 20 bp, Artificial
  CRISPR gRNA sequence
agggggacttgaggggccca

SEQ ID NO: 298957 - DNA, 20 bp, Artificial
  CRISPR gRNA sequence
gggggacttgaggggcccag

SEQ ID NO: 298958 - DNA, 20 bp, Artificial
  CRISPR gRNA sequence
acttgaggggcccaggggaa

SEQ ID NO: 298959 - DNA, 20 bp, Artificial
  CRISPR gRNA sequence
cttgaggggcccaggggaaa

SEQ ID NO: 298960 - DNA, 20 bp, Artificial
  CRISPR gRNA sequence
ttgaggggcccaggggaaaa

SEQ ID NO: 298961 - DNA, 20 bp, Artificial
  CRISPR gRNA sequence
tgaggggcccaggggaaaag

SEQ ID NO: 298962 - DNA, 20 bp, Artificial
  CRISPR gRNA sequence
gaggggcccaggggaaaagg

SEQ ID NO: 298963 - DNA, 20 bp, Artificial
  CRISPR gRNA sequence
aggggcccaggggaaaaggg

SEQ ID NO: 298964 - DNA, 20 bp, Artificial
  CRISPR gRNA sequence
caggggaaaaggggggtcta

SEQ ID NO: 298965 - DNA, 20 bp, Artificial
  CRISPR gRNA sequence
ggggaaaaggggggtctata

SEQ ID NO: 298966 - DNA, 20 bp, Artificial
  CRISPR gRNA sequence
ggaaaaggggggtctataga

SEQ ID NO: 298967 - DNA, 20 bp, Artificial
  CRISPR gRNA sequence
aaaggggggtctatagagag

SEQ ID NO: 298968 - DNA, 20 bp, Artificial
  CRISPR gRNA sequence
aaggggggtctatagagaga

SEQ ID NO: 298969 - DNA, 20 bp, Artificial
  CRISPR gRNA sequence
gggggtctatagagagaagg

SEQ ID NO: 298970 - DNA, 20 bp, Artificial
  CRISPR gRNA sequence
gggtctatagagagaaggca

SEQ ID NO: 298971 - DNA, 20 bp, Artificial
  CRISPR gRNA sequence
ggtctatagagagaaggcag

SEQ ID NO: 298972 - DNA, 20 bp, Artificial
  CRISPR gRNA sequence
tatagagagaaggcagagga

SEQ ID NO: 298973 - DNA, 20 bp, Artificial
  CRISPR gRNA sequence
aggcagaggacagccacttc

SEQ ID NO: 298974 - DNA, 20 bp, Artificial
  CRISPR gRNA sequence
ggcagaggacagccacttct

SEQ ID NO: 298975 - DNA, 20 bp, Artificial
  CRISPR gRNA sequence
agaggacagccacttctggg

SEQ ID NO: 298976 - DNA, 20 bp, Artificial
  CRISPR gRNA sequence
acttctgggaagtgcatttg

SEQ ID NO: 298977 - DNA, 20 bp, Artificial
  CRISPR gRNA sequence
cttctgggaagtgcatttga

SEQ ID NO: 298978 - DNA, 20 bp, Artificial
  CRISPR gRNA sequence
ttctgggaagtgcatttgaa

SEQ ID NO: 298979 - DNA, 20 bp, Artificial
  CRISPR gRNA sequence
ctgggaagtgcatttgaagg

SEQ ID NO: 298980 - DNA, 20 bp, Artificial
  CRISPR gRNA sequence
aagtgcatttgaagggagtg

SEQ ID NO: 298981 - DNA, 20 bp, Artificial
  CRISPR gRNA sequence
gtgcatttgaagggagtgta

SEQ ID NO: 298982 - DNA, 20 bp, Artificial
  CRISPR gRNA sequence
tttgaagggagtgtagagtc

SEQ ID NO: 298983 - DNA, 20 bp, Artificial
  CRISPR gRNA sequence
ttgaagggagtgtagagtct

SEQ ID NO: 298984 - DNA, 20 bp, Artificial
  CRISPR gRNA sequence
gaagggagtgtagagtctgg

SEQ ID NO: 298985 - DNA, 20 bp, Artificial
  CRISPR gRNA sequence
gggagtgtagagtctgggag

SEQ ID NO: 298986 - DNA, 20 bp, Artificial
  CRISPR gRNA sequence
ggagtgtagagtctgggagt

SEQ ID NO: 298987 - DNA, 20 bp, Artificial
  CRISPR gRNA sequence
gagtgtagagtctgggagta

SEQ ID NO: 298988 - DNA, 20 bp, Artificial
  CRISPR gRNA sequence
gtctgggagtagggaactga

SEQ ID NO: 298989 - DNA, 20 bp, Artificial
  CRISPR gRNA sequence
aaagtcttttgtacttttta

SEQ ID NO: 298990 - DNA, 20 bp, Artificial
  CRISPR gRNA sequence
ctttttatagtctgcttctg

SEQ ID NO: 298991 - DNA, 20 bp, Artificial
  CRISPR gRNA sequence
tttttatagtctgcttctga

SEQ ID NO: 298992 - DNA, 20 bp, Artificial
  CRISPR gRNA sequence
atagtctgcttctgaaggat

SEQ ID NO: 298993 - DNA, 20 bp, Artificial
  CRISPR gRNA sequence
ggatcagtaaaaatctgctt

SEQ ID NO: 298994 - DNA, 20 bp, Artificial
  CRISPR gRNA sequence
gatcagtaaaaatctgcttt

SEQ ID NO: 298995 - DNA, 20 bp, Artificial
  CRISPR gRNA sequence
atcagtaaaaatctgctttg

SEQ ID NO: 298996 - DNA, 20 bp, Artificial
  CRISPR gRNA sequence
aatctgctttggggaaaaaa

SEQ ID NO: 298997 - DNA, 20 bp, Artificial
  CRISPR gRNA sequence
tctgctttggggaaaaaata

SEQ ID NO: 298998 - DNA, 20 bp, Artificial
  CRISPR gRNA sequence
aaaatagagctaattgaaca

SEQ ID NO: 298999 - DNA, 20 bp, Artificial
  CRISPR gRNA sequence
ctaattgaacaaagataata

SEQ ID NO: 299000 - DNA, 20 bp, Artificial
  CRISPR gRNA sequence
ataatatggctaattaccta

SEQ ID NO: 299001 - DNA, 20 bp, Artificial
  CRISPR gRNA sequence
attacctatagtaaaaacca

SEQ ID NO: 299002 - DNA, 20 bp, Artificial
  CRISPR gRNA sequence
agtaaaaaccatggataatt

SEQ ID NO: 299003 - DNA, 20 bp, Artificial
  CRISPR gRNA sequence
tggataatttggccatcaca

SEQ ID NO: 299004 - DNA, 20 bp, Artificial
  CRISPR gRNA sequence
acaaagtttatataaccata

SEQ ID NO: 299005 - DNA, 20 bp, Artificial
  CRISPR gRNA sequence
caaagtttatataaccataa

SEQ ID NO: 299006 - DNA, 20 bp, Artificial
  CRISPR gRNA sequence
ttatataaccataaaggcct

SEQ ID NO: 299007 - DNA, 20 bp, Artificial
  CRISPR gRNA sequence
tcttacattcattttttcct

SEQ ID NO: 299008 - DNA, 20 bp, Artificial
  CRISPR gRNA sequence
cttacattcattttttcctt

SEQ ID NO: 299009 - DNA, 20 bp, Artificial
  CRISPR gRNA sequence
ttcattttttccttgggtcc

SEQ ID NO: 299010 - DNA, 20 bp, Artificial
  CRISPR gRNA sequence
tcacctactaaatctttgcc

SEQ ID NO: 299011 - DNA, 20 bp, Artificial
  CRISPR gRNA sequence
acctactaaatctttgcctg

SEQ ID NO: 299012 - DNA, 20 bp, Artificial
  CRISPR gRNA sequence
aaatctttgcctggagctcc

SEQ ID NO: 299013 - DNA, 20 bp, Artificial
  CRISPR gRNA sequence
tttgcctggagctcctagca

SEQ ID NO: 299014 - DNA, 20 bp, Artificial
  CRISPR gRNA sequence
gcctggagctcctagcaaag

SEQ ID NO: 299015 - DNA, 20 bp, Artificial
  CRISPR gRNA sequence
ggagctcctagcaaagcgga

SEQ ID NO: 299016 - DNA, 20 bp, Artificial
  CRISPR gRNA sequence
aagcggacagctgacacatt

SEQ ID NO: 299017 - DNA, 20 bp, Artificial
  CRISPR gRNA sequence
agcggacagctgacacattt

SEQ ID NO: 299018 - DNA, 20 bp, Artificial
  CRISPR gRNA sequence
acacatttgggttttccctt

SEQ ID NO: 299019 - DNA, 20 bp, Artificial
  CRISPR gRNA sequence
gttttcccttcagcctcctc

SEQ ID NO: 299020 - DNA, 20 bp, Artificial
  CRISPR gRNA sequence
ttttcccttcagcctcctct

SEQ ID NO: 299021 - DNA, 20 bp, Artificial
  CRISPR gRNA sequence
gcctcctctaggttgcttat

SEQ ID NO: 299022 - DNA, 20 bp, Artificial
  CRISPR gRNA sequence
ttgtttgctgccacaaccat

SEQ ID NO: 299023 - DNA, 20 bp, Artificial
  CRISPR gRNA sequence
tgctgccacaaccatgagcc

SEQ ID NO: 299024 - DNA, 20 bp, Artificial
  CRISPR gRNA sequence
tgccacaaccatgagcctgg

SEQ ID NO: 299025 - DNA, 20 bp, Artificial
  CRISPR gRNA sequence
acaaccatgagcctggtaga

SEQ ID NO: 299026 - DNA, 20 bp, Artificial
  CRISPR gRNA sequence
accatgagcctggtagacag

SEQ ID NO: 299027 - DNA, 20 bp, Artificial
  CRISPR gRNA sequence
ccatgagcctggtagacaga

SEQ ID NO: 299028 - DNA, 20 bp, Artificial
  CRISPR gRNA sequence
catgagcctggtagacagaa

SEQ ID NO: 299029 - DNA, 20 bp, Artificial
  CRISPR gRNA sequence
taacccacaaacttacaaac

SEQ ID NO: 299030 - DNA, 20 bp, Artificial
  CRISPR gRNA sequence
aaccagctcctctgcttcac

SEQ ID NO: 299031 - DNA, 20 bp, Artificial
  CRISPR gRNA sequence
tcctctgcttcacgagacct

SEQ ID NO: 299032 - DNA, 20 bp, Artificial
  CRISPR gRNA sequence
tctgcttcacgagaccttgg

SEQ ID NO: 299033 - DNA, 20 bp, Artificial
  CRISPR gRNA sequence
ctgcttcacgagaccttgga

SEQ ID NO: 299034 - DNA, 20 bp, Artificial
  CRISPR gRNA sequence
ggaaggcctaaatgccacta

SEQ ID NO: 299035 - DNA, 20 bp, Artificial
  CRISPR gRNA sequence
atttttttaaaactatcaca

SEQ ID NO: 299036 - DNA, 20 bp, Artificial
  CRISPR gRNA sequence
atactgttctactgattgta

SEQ ID NO: 299037 - DNA, 20 bp, Artificial
  CRISPR gRNA sequence
ctgattgtatagatcttgta

SEQ ID NO: 299038 - DNA, 20 bp, Artificial
  CRISPR gRNA sequence
gtatagatcttgtatagatt

SEQ ID NO: 299039 - DNA, 20 bp, Artificial
  CRISPR gRNA sequence
tatagatcttgtatagattt

SEQ ID NO: 299040 - DNA, 20 bp, Artificial
  CRISPR gRNA sequence
atagatttaggtaaccgcca

SEQ ID NO: 299041 - DNA, 20 bp, Artificial
  CRISPR gRNA sequence
tagatttaggtaaccgccac

SEQ ID NO: 299042 - DNA, 20 bp, Artificial
  CRISPR gRNA sequence
taggtaaccgccacaggaca

SEQ ID NO: 299043 - DNA, 20 bp, Artificial
  CRISPR gRNA sequence
ggtaaccgccacaggacata

SEQ ID NO: 299044 - DNA, 20 bp, Artificial
  CRISPR gRNA sequence
atcaccctaaaaatttccct

SEQ ID NO: 299045 - DNA, 20 bp, Artificial
  CRISPR gRNA sequence
tcaccctaaaaatttccctc

SEQ ID NO: 299046 - DNA, 20 bp, Artificial
  CRISPR gRNA sequence
tccctcaggctgtcccttca

SEQ ID NO: 299047 - DNA, 20 bp, Artificial
  CRISPR gRNA sequence
cctcaggctgtcccttcata

SEQ ID NO: 299048 - DNA, 20 bp, Artificial
  CRISPR gRNA sequence
tctgcactcataacccttgt

SEQ ID NO: 299049 - DNA, 20 bp, Artificial
  CRISPR gRNA sequence
ctgcactcataacccttgtt

SEQ ID NO: 299050 - DNA, 20 bp, Artificial
  CRISPR gRNA sequence
aacccttgttgggcatccta

SEQ ID NO: 299051 - DNA, 20 bp, Artificial
  CRISPR gRNA sequence
ctatagttttgtctttttga

SEQ ID NO: 299052 - DNA, 20 bp, Artificial
  CRISPR gRNA sequence
tctttttgacagtgtcacat

SEQ ID NO: 299053 - DNA, 20 bp, Artificial
  CRISPR gRNA sequence
ttgacagtgtcacataagtg

SEQ ID NO: 299054 - DNA, 20 bp, Artificial
  CRISPR gRNA sequence
gtcacataagtgaagccaca

SEQ ID NO: 299055 - DNA, 20 bp, Artificial
  CRISPR gRNA sequence
cacacagtatgtaacctttt

SEQ ID NO: 299056 - DNA, 20 bp, Artificial
  CRISPR gRNA sequence
agtatgtaaccttttaagcc

SEQ ID NO: 299057 - DNA, 20 bp, Artificial
  CRISPR gRNA sequence
taagcctggcttctttcgtt

SEQ ID NO: 299058 - DNA, 20 bp, Artificial
  CRISPR gRNA sequence
ctttcgtttagcgcgccttc

SEQ ID NO: 299059 - DNA, 20 bp, Artificial
  CRISPR gRNA sequence
cgcgccttcgagattcaccc

SEQ ID NO: 299060 - DNA, 20 bp, Artificial
  CRISPR gRNA sequence
cccaagttgttgcacatatc

SEQ ID NO: 299061 - DNA, 20 bp, Artificial
  CRISPR gRNA sequence
gcttgtccctttttattgct

SEQ ID NO: 299062 - DNA, 20 bp, Artificial
  CRISPR gRNA sequence
tgtccctttttattgctgag

SEQ ID NO: 299063 - DNA, 20 bp, Artificial
  CRISPR gRNA sequence
tattgtttatccattcaact

SEQ ID NO: 299064 - DNA, 20 bp, Artificial
  CRISPR gRNA sequence
ttatccattcaactcagtaa

SEQ ID NO: 299065 - DNA, 20 bp, Artificial
  CRISPR gRNA sequence
ttcaactcagtaaaagacat

SEQ ID NO: 299066 - DNA, 20 bp, Artificial
  CRISPR gRNA sequence
tcaactcagtaaaagacatt

SEQ ID NO: 299067 - DNA, 20 bp, Artificial
  CRISPR gRNA sequence
aaaagacattgggttgtttc

SEQ ID NO: 299068 - DNA, 20 bp, Artificial
  CRISPR gRNA sequence
acattgggttgtttctggtt

SEQ ID NO: 299069 - DNA, 20 bp, Artificial
  CRISPR gRNA sequence
cattgggttgtttctggttt

SEQ ID NO: 299070 - DNA, 20 bp, Artificial
  CRISPR gRNA sequence
attgggttgtttctggtttg

SEQ ID NO: 299071 - DNA, 20 bp, Artificial
  CRISPR gRNA sequence
ggtttggggctcttatgaat

SEQ ID NO: 299072 - DNA, 20 bp, Artificial
  CRISPR gRNA sequence
gtttggggctcttatgaata

SEQ ID NO: 299073 - DNA, 20 bp, Artificial
  CRISPR gRNA sequence
ctgctgtaaacgttcatgta

SEQ ID NO: 299074 - DNA, 20 bp, Artificial
  CRISPR gRNA sequence
tgctgtaaacgttcatgtac

SEQ ID NO: 299075 - DNA, 20 bp, Artificial
  CRISPR gRNA sequence
acaggtttttgtgtgaacat

SEQ ID NO: 299076 - DNA, 20 bp, Artificial
  CRISPR gRNA sequence
tttgtgtgaacataagttct

SEQ ID NO: 299077 - DNA, 20 bp, Artificial
  CRISPR gRNA sequence
aacataagttctcagttctc

SEQ ID NO: 299078 - DNA, 20 bp, Artificial
  CRISPR gRNA sequence
cataagttctcagttctcta

SEQ ID NO: 299079 - DNA, 20 bp, Artificial
  CRISPR gRNA sequence
ataagttctcagttctctag

SEQ ID NO: 299080 - DNA, 20 bp, Artificial
  CRISPR gRNA sequence
agttctctagaggaaatacc

SEQ ID NO: 299081 - DNA, 20 bp, Artificial
  CRISPR gRNA sequence
gttctctagaggaaataccc

SEQ ID NO: 299082 - DNA, 20 bp, Artificial
  CRISPR gRNA sequence
ctagaggaaatacccaggtg

SEQ ID NO: 299083 - DNA, 20 bp, Artificial
  CRISPR gRNA sequence
atacccaggtgtggtattac

SEQ ID NO: 299084 - DNA, 20 bp, Artificial
  CRISPR gRNA sequence
aggtgtggtattactggatc

SEQ ID NO: 299085 - DNA, 20 bp, Artificial
  CRISPR gRNA sequence
ggtgtggtattactggatcc

SEQ ID NO: 299086 - DNA, 20 bp, Artificial
  CRISPR gRNA sequence
aatttttgatgaaacttgaa

SEQ ID NO: 299087 - DNA, 20 bp, Artificial
  CRISPR gRNA sequence
atttttgatgaaacttgaaa

SEQ ID NO: 299088 - DNA, 20 bp, Artificial
  CRISPR gRNA sequence
tttgatgaaacttgaaaagg

SEQ ID NO: 299089 - DNA, 20 bp, Artificial
  CRISPR gRNA sequence
caacacctattctaaaacca

SEQ ID NO: 299090 - DNA, 20 bp, Artificial
  CRISPR gRNA sequence
acacctattctaaaaccata

SEQ ID NO: 299091 - DNA, 20 bp, Artificial
  CRISPR gRNA sequence
tctaaaaccatagagtaaaa

SEQ ID NO: 299092 - DNA, 20 bp, Artificial
  CRISPR gRNA sequence
aaaaccatagagtaaaacag

SEQ ID NO: 299093 - DNA, 20 bp, Artificial
  CRISPR gRNA sequence
atagagtaaaacagaagcaa

SEQ ID NO: 299094 - DNA, 20 bp, Artificial
  CRISPR gRNA sequence
aacagaagcaaaagtaaaaa

SEQ ID NO: 299095 - DNA, 20 bp, Artificial
  CRISPR gRNA sequence
aagcaaaagtaaaaatagaa

SEQ ID NO: 299096 - DNA, 20 bp, Artificial
  CRISPR gRNA sequence
gcaaaagtaaaaatagaatg

SEQ ID NO: 299097 - DNA, 20 bp, Artificial
  CRISPR gRNA sequence
aaaagtaaaaatagaatgga

SEQ ID NO: 299098 - DNA, 20 bp, Artificial
  CRISPR gRNA sequence
gaaccctgtgtgatttaaac

SEQ ID NO: 299099 - DNA, 20 bp, Artificial
  CRISPR gRNA sequence
aaccctgtgtgatttaaact

SEQ ID NO: 299100 - DNA, 20 bp, Artificial
  CRISPR gRNA sequence
gtgtgatttaaactaggctg

SEQ ID NO: 299101 - DNA, 20 bp, Artificial
  CRISPR gRNA sequence
tgtgatttaaactaggctgc

SEQ ID NO: 299102 - DNA, 20 bp, Artificial
  CRISPR gRNA sequence
gtgatttaaactaggctgca

SEQ ID NO: 299103 - DNA, 20 bp, Artificial
  CRISPR gRNA sequence
taaactaggctgcagggctt

SEQ ID NO: 299104 - DNA, 20 bp, Artificial
  CRISPR gRNA sequence
aaactaggctgcagggcttt

SEQ ID NO: 299105 - DNA, 20 bp, Artificial
  CRISPR gRNA sequence
aggctgcagggctttaggaa

SEQ ID NO: 299106 - DNA, 20 bp, Artificial
  CRISPR gRNA sequence
ggctttaggaatagttaacc

SEQ ID NO: 299107 - DNA, 20 bp, Artificial
  CRISPR gRNA sequence
aaatccgtgttttcaaaatg

SEQ ID NO: 299108 - DNA, 20 bp, Artificial
  CRISPR gRNA sequence
ccgtgttttcaaaatgtggt

SEQ ID NO: 299109 - DNA, 20 bp, Artificial
  CRISPR gRNA sequence
cgtgttttcaaaatgtggtc

SEQ ID NO: 299110 - DNA, 20 bp, Artificial
  CRISPR gRNA sequence
aaaatgtggtcaggtaccat

SEQ ID NO: 299111 - DNA, 20 bp, Artificial
  CRISPR gRNA sequence
aggtaccattggaaatgttt

SEQ ID NO: 299112 - DNA, 20 bp, Artificial
  CRISPR gRNA sequence
ggtaccattggaaatgtttt

SEQ ID NO: 299113 - DNA, 20 bp, Artificial
  CRISPR gRNA sequence
accattggaaatgttttagg

SEQ ID NO: 299114 - DNA, 20 bp, Artificial
  CRISPR gRNA sequence
ccattggaaatgttttaggt

SEQ ID NO: 299115 - DNA, 20 bp, Artificial
  CRISPR gRNA sequence
gaaatgttttaggtgggaca

SEQ ID NO: 299116 - DNA, 20 bp, Artificial
  CRISPR gRNA sequence
gttttaggtgggacacagat

SEQ ID NO: 299117 - DNA, 20 bp, Artificial
  CRISPR gRNA sequence
acacagataagcattttgaa

SEQ ID NO: 299118 - DNA, 20 bp, Artificial
  CRISPR gRNA sequence
gtatttgttttaatgtatat

SEQ ID NO: 299119 - DNA, 20 bp, Artificial
  CRISPR gRNA sequence
ttacgcaacatgtgatttca

SEQ ID NO: 299120 - DNA, 20 bp, Artificial
  CRISPR gRNA sequence
tttcacagatcttgttaatg

SEQ ID NO: 299121 - DNA, 20 bp, Artificial
  CRISPR gRNA sequence
cttgttaatgaagctaaaca

SEQ ID NO: 299122 - DNA, 20 bp, Artificial
  CRISPR gRNA sequence
taatgaagctaaacacggtc

SEQ ID NO: 299123 - DNA, 20 bp, Artificial
  CRISPR gRNA sequence
gtctggcaattcaccttcta

SEQ ID NO: 299124 - DNA, 20 bp, Artificial
  CRISPR gRNA sequence
tctggcaattcaccttctac

SEQ ID NO: 299125 - DNA, 20 bp, Artificial
  CRISPR gRNA sequence
ttcaccttctacaggccaca

SEQ ID NO: 299126 - DNA, 20 bp, Artificial
  CRISPR gRNA sequence
ctacaggccacatagactcc

SEQ ID NO: 299127 - DNA, 20 bp, Artificial
  CRISPR gRNA sequence
caggccacatagactccaag

SEQ ID NO: 299128 - DNA, 20 bp, Artificial
  CRISPR gRNA sequence
ctccaagaagactgctcaaa

SEQ ID NO: 299129 - DNA, 20 bp, Artificial
  CRISPR gRNA sequence
gctcaaatagtacactgata

SEQ ID NO: 299130 - DNA, 20 bp, Artificial
  CRISPR gRNA sequence
ctgatatagcaaaacttata

SEQ ID NO: 299131 - DNA, 20 bp, Artificial
  CRISPR gRNA sequence
taaagatgacatgcaaatga

SEQ ID NO: 299132 - DNA, 20 bp, Artificial
  CRISPR gRNA sequence
catgcaaatgacagaccttt

SEQ ID NO: 299133 - DNA, 20 bp, Artificial
  CRISPR gRNA sequence
caaatgacagaccttttagt

SEQ ID NO: 299134 - DNA, 20 bp, Artificial
  CRISPR gRNA sequence
gaatacactaaattataaat

SEQ ID NO: 299135 - DNA, 20 bp, Artificial
  CRISPR gRNA sequence
ctaaattataaattagtttg

SEQ ID NO: 299136 - DNA, 20 bp, Artificial
  CRISPR gRNA sequence
tgtagaacctgcaaactacc

SEQ ID NO: 299137 - DNA, 20 bp, Artificial
  CRISPR gRNA sequence
aaactacctagtaactataa

SEQ ID NO: 299138 - DNA, 20 bp, Artificial
  CRISPR gRNA sequence
cctagtaactataaaagaac

SEQ ID NO: 299139 - DNA, 20 bp, Artificial
  CRISPR gRNA sequence
ctagtaactataaaagaaca

SEQ ID NO: 299140 - DNA, 20 bp, Artificial
  CRISPR gRNA sequence
tagtaactataaaagaacaa

SEQ ID NO: 299141 - DNA, 20 bp, Artificial
  CRISPR gRNA sequence
gaacaagggattttttctga

SEQ ID NO: 299142 - DNA, 20 bp, Artificial
  CRISPR gRNA sequence
caagggattttttctgacag

SEQ ID NO: 299143 - DNA, 20 bp, Artificial
  CRISPR gRNA sequence
aagggattttttctgacaga

SEQ ID NO: 299144 - DNA, 20 bp, Artificial
  CRISPR gRNA sequence
ctgacagaaggcacatgaca

SEQ ID NO: 299145 - DNA, 20 bp, Artificial
  CRISPR gRNA sequence
tgacagaaggcacatgacac

SEQ ID NO: 299146 - DNA, 20 bp, Artificial
  CRISPR gRNA sequence
gaaggcacatgacacaggtc

SEQ ID NO: 299147 - DNA, 20 bp, Artificial
  CRISPR gRNA sequence
aaggcacatgacacaggtct

SEQ ID NO: 299148 - DNA, 20 bp, Artificial
  CRISPR gRNA sequence
aggcacatgacacaggtcta

SEQ ID NO: 299149 - DNA, 20 bp, Artificial
  CRISPR gRNA sequence
caggtctagggactccatgc

SEQ ID NO: 299150 - DNA, 20 bp, Artificial
  CRISPR gRNA sequence
tccatgccagtgatcctgaa

SEQ ID NO: 299151 - DNA, 20 bp, Artificial
  CRISPR gRNA sequence
tgccagtgatcctgaacagc

SEQ ID NO: 299152 - DNA, 20 bp, Artificial
  CRISPR gRNA sequence
gtgatcctgaacagccagaa

SEQ ID NO: 299153 - DNA, 20 bp, Artificial
  CRISPR gRNA sequence
tcctgaacagccagaaaagt

SEQ ID NO: 299154 - DNA, 20 bp, Artificial
  CRISPR gRNA sequence
aacagccagaaaagtgagaa

SEQ ID NO: 299155 - DNA, 20 bp, Artificial
  CRISPR gRNA sequence
ccagaaaagtgagaatggca

SEQ ID NO: 299156 - DNA, 20 bp, Artificial
  CRISPR gRNA sequence
cagaaaagtgagaatggcaa

SEQ ID NO: 299157 - DNA, 20 bp, Artificial
  CRISPR gRNA sequence
aaagtgagaatggcaaaggc

SEQ ID NO: 299158 - DNA, 20 bp, Artificial
  CRISPR gRNA sequence
agtgagaatggcaaaggcaa

SEQ ID NO: 299159 - DNA, 20 bp, Artificial
  CRISPR gRNA sequence
agagaaacactgtgtttatt

SEQ ID NO: 299160 - DNA, 20 bp, Artificial
  CRISPR gRNA sequence
tcatgtatttttccctaaaa

SEQ ID NO: 299161 - DNA, 20 bp, Artificial
  CRISPR gRNA sequence
gtatttttccctaaaatagc

SEQ ID NO: 299162 - DNA, 20 bp, Artificial
  CRISPR gRNA sequence
ttccctaaaatagctggatt

SEQ ID NO: 299163 - DNA, 20 bp, Artificial
  CRISPR gRNA sequence
gctggatttggccttcttct

SEQ ID NO: 299164 - DNA, 20 bp, Artificial
  CRISPR gRNA sequence
tggatttggccttcttctta

SEQ ID NO: 299165 - DNA, 20 bp, Artificial
  CRISPR gRNA sequence
tcttcttagagtatgttatg

SEQ ID NO: 299166 - DNA, 20 bp, Artificial
  CRISPR gRNA sequence
ttgatgctcatgccaaaaat

SEQ ID NO: 299167 - DNA, 20 bp, Artificial
  CRISPR gRNA sequence
tcacttaccacaatcctgct

SEQ ID NO: 299168 - DNA, 20 bp, Artificial
  CRISPR gRNA sequence
cacttaccacaatcctgctt

SEQ ID NO: 299169 - DNA, 20 bp, Artificial
  CRISPR gRNA sequence
aatcctgcttgggtttctga

SEQ ID NO: 299170 - DNA, 20 bp, Artificial
  CRISPR gRNA sequence
ggtttctgaaagatatgacg

SEQ ID NO: 299171 - DNA, 20 bp, Artificial
  CRISPR gRNA sequence
gtttctgaaagatatgacgc

SEQ ID NO: 299172 - DNA, 20 bp, Artificial
  CRISPR gRNA sequence
tttctgaaagatatgacgca

SEQ ID NO: 299173 - DNA, 20 bp, Artificial
  CRISPR gRNA sequence
agatatgacgcagggcatct

SEQ ID NO: 299174 - DNA, 20 bp, Artificial
  CRISPR gRNA sequence
ctcagcaccatgaactctgt

SEQ ID NO: 299175 - DNA, 20 bp, Artificial
  CRISPR gRNA sequence
ccatgaactctgtcagttcc

SEQ ID NO: 299176 - DNA, 20 bp, Artificial
  CRISPR gRNA sequence
gaactctgtcagttcctggt

SEQ ID NO: 299177 - DNA, 20 bp, Artificial
  CRISPR gRNA sequence
gtcagttcctggtgagactc

SEQ ID NO: 299178 - DNA, 20 bp, Artificial
  CRISPR gRNA sequence
tcaattccttcctgctctct

SEQ ID NO: 299179 - DNA, 20 bp, Artificial
  CRISPR gRNA sequence
tccttcctgctctcttagtc

SEQ ID NO: 299180 - DNA, 20 bp, Artificial
  CRISPR gRNA sequence
ccttcctgctctcttagtct

SEQ ID NO: 299181 - DNA, 20 bp, Artificial
  CRISPR gRNA sequence
cttcctgctctcttagtctg

SEQ ID NO: 299182 - DNA, 20 bp, Artificial
  CRISPR gRNA sequence
tcctgctctcttagtctggg

SEQ ID NO: 299183 - DNA, 20 bp, Artificial
  CRISPR gRNA sequence
gctctcttagtctggggagc

SEQ ID NO: 299184 - DNA, 20 bp, Artificial
  CRISPR gRNA sequence
gggagctggaatgtgcccca

SEQ ID NO: 299185 - DNA, 20 bp, Artificial
  CRISPR gRNA sequence
ggagctggaatgtgccccat

SEQ ID NO: 299186 - DNA, 20 bp, Artificial
  CRISPR gRNA sequence
aatgtgccccatgggacacc

SEQ ID NO: 299187 - DNA, 20 bp, Artificial
  CRISPR gRNA sequence
atgtgccccatgggacacct

SEQ ID NO: 299188 - DNA, 20 bp, Artificial
  CRISPR gRNA sequence
cccatgggacacctgggccc

SEQ ID NO: 299189 - DNA, 20 bp, Artificial
  CRISPR gRNA sequence
catgggacacctgggcccta

SEQ ID NO: 299190 - DNA, 20 bp, Artificial
  CRISPR gRNA sequence
ggacacctgggccctagagt

SEQ ID NO: 299191 - DNA, 20 bp, Artificial
  CRISPR gRNA sequence
tcagaccacttctccttcca

SEQ ID NO: 299192 - DNA, 20 bp, Artificial
  CRISPR gRNA sequence
cttccaaagactctactccc

SEQ ID NO: 299193 - DNA, 20 bp, Artificial
  CRISPR gRNA sequence
aagactctactccctggaaa

SEQ ID NO: 299194 - DNA, 20 bp, Artificial
  CRISPR gRNA sequence
actctactccctggaaacag

SEQ ID NO: 299195 - DNA, 20 bp, Artificial
  CRISPR gRNA sequence
gtggcttcattgtaaatctt

SEQ ID NO: 299196 - DNA, 20 bp, Artificial
  CRISPR gRNA sequence
aatctttggtgactcaatta

SEQ ID NO: 299197 - DNA, 20 bp, Artificial
  CRISPR gRNA sequence
attacagccctcctgtcact

SEQ ID NO: 299198 - DNA, 20 bp, Artificial
  CRISPR gRNA sequence
tacagccctcctgtcactta

SEQ ID NO: 299199 - DNA, 20 bp, Artificial
  CRISPR gRNA sequence
cagccctcctgtcacttaga

SEQ ID NO: 299200 - DNA, 20 bp, Artificial
  CRISPR gRNA sequence
tagagagcacccctttgatt

SEQ ID NO: 299201 - DNA, 20 bp, Artificial
  CRISPR gRNA sequence
agcacccctttgatttggat

SEQ ID NO: 299202 - DNA, 20 bp, Artificial
  CRISPR gRNA sequence
acccctttgatttggataag

SEQ ID NO: 299203 - DNA, 20 bp, Artificial
  CRISPR gRNA sequence
cccctttgatttggataagc

SEQ ID NO: 299204 - DNA, 20 bp, Artificial
  CRISPR gRNA sequence
ctttgatttggataagcagg

SEQ ID NO: 299205 - DNA, 20 bp, Artificial
  CRISPR gRNA sequence
gatttggataagcaggaagt

SEQ ID NO: 299206 - DNA, 20 bp, Artificial
  CRISPR gRNA sequence
ggataagcaggaagtaagca

SEQ ID NO: 299207 - DNA, 20 bp, Artificial
  CRISPR gRNA sequence
attgttgaaaaataaacatg

SEQ ID NO: 299208 - DNA, 20 bp, Artificial
  CRISPR gRNA sequence
ataaacatgaagtcattatg

SEQ ID NO: 299209 - DNA, 20 bp, Artificial
  CRISPR gRNA sequence
tcattatgtggcactcacct

SEQ ID NO: 299210 - DNA, 20 bp, Artificial
  CRISPR gRNA sequence
cattatgtggcactcacctt

SEQ ID NO: 299211 - DNA, 20 bp, Artificial
  CRISPR gRNA sequence
tgtggcactcaccttgggct

SEQ ID NO: 299212 - DNA, 20 bp, Artificial
  CRISPR gRNA sequence
gtggcactcaccttgggctg

SEQ ID NO: 299213 - DNA, 20 bp, Artificial
  CRISPR gRNA sequence
tggcactcaccttgggctga

SEQ ID NO: 299214 - DNA, 20 bp, Artificial
  CRISPR gRNA sequence
ttgggctgagggtcacattt

SEQ ID NO: 299215 - DNA, 20 bp, Artificial
  CRISPR gRNA sequence
ggtcacattttagacaccct

SEQ ID NO: 299216 - DNA, 20 bp, Artificial
  CRISPR gRNA sequence
gtcacattttagacaccctg

SEQ ID NO: 299217 - DNA, 20 bp, Artificial
  CRISPR gRNA sequence
tttagacaccctgaggctcc

SEQ ID NO: 299218 - DNA, 20 bp, Artificial
  CRISPR gRNA sequence
ttagacaccctgaggctccc

SEQ ID NO: 299219 - DNA, 20 bp, Artificial
  CRISPR gRNA sequence
gctcccaggtgtgccccaat

SEQ ID NO: 299220 - DNA, 20 bp, Artificial
  CRISPR gRNA sequence
aggtgtgccccaatgagccc

SEQ ID NO: 299221 - DNA, 20 bp, Artificial
  CRISPR gRNA sequence
gccccaatgagccccagatc

SEQ ID NO: 299222 - DNA, 20 bp, Artificial
  CRISPR gRNA sequence
tgagccccagatcaagtacc

SEQ ID NO: 299223 - DNA, 20 bp, Artificial
  CRISPR gRNA sequence
agttatttgctattccctcc

SEQ ID NO: 299224 - DNA, 20 bp, Artificial
  CRISPR gRNA sequence
ctcctagatacatctaaact

SEQ ID NO: 299225 - DNA, 20 bp, Artificial
  CRISPR gRNA sequence
ttttatctctcttctgcttt

SEQ ID NO: 299226 - DNA, 20 bp, Artificial
  CRISPR gRNA sequence
cttctgctttcagctaactt

SEQ ID NO: 299227 - DNA, 20 bp, Artificial
  CRISPR gRNA sequence
taacttcagtcaacctgaaa

SEQ ID NO: 299228 - DNA, 20 bp, Artificial
  CRISPR gRNA sequence
agtaccaatttctaatataa

SEQ ID NO: 299229 - DNA, 20 bp, Artificial
  CRISPR gRNA sequence
ttgacctgctcatctataca

SEQ ID NO: 299230 - DNA, 20 bp, Artificial
  CRISPR gRNA sequence
ctcatctatacacggttacc

SEQ ID NO: 299231 - DNA, 20 bp, Artificial
  CRISPR gRNA sequence
tacacggttacccagaacct

SEQ ID NO: 299232 - DNA, 20 bp, Artificial
  CRISPR gRNA sequence
acggttacccagaacctaag

SEQ ID NO: 299233 - DNA, 20 bp, Artificial
  CRISPR gRNA sequence
tacccagaacctaagaagat

SEQ ID NO: 299234 - DNA, 20 bp, Artificial
  CRISPR gRNA sequence
aagaagatgagtgttttgct

SEQ ID NO: 299235 - DNA, 20 bp, Artificial
  CRISPR gRNA sequence
tgagtgttttgctaagaacc

SEQ ID NO: 299236 - DNA, 20 bp, Artificial
  CRISPR gRNA sequence
gaaccaagaattcaactatc

SEQ ID NO: 299237 - DNA, 20 bp, Artificial
  CRISPR gRNA sequence
aattcaactatcgagtatga

SEQ ID NO: 299238 - DNA, 20 bp, Artificial
  CRISPR gRNA sequence
tcgagtatgatggtgttatg

SEQ ID NO: 299239 - DNA, 20 bp, Artificial
  CRISPR gRNA sequence
tggtgttatgcagaaatctc

SEQ ID NO: 299240 - DNA, 20 bp, Artificial
  CRISPR gRNA sequence
gaaatctcaagataatgtca

SEQ ID NO: 299241 - DNA, 20 bp, Artificial
  CRISPR gRNA sequence
gaactgtacgacgtttccat

SEQ ID NO: 299242 - DNA, 20 bp, Artificial
  CRISPR gRNA sequence
gtttcattccctgatgttac

SEQ ID NO: 299243 - DNA, 20 bp, Artificial
  CRISPR gRNA sequence
tatgaccatcttctgtattc

SEQ ID NO: 299244 - DNA, 20 bp, Artificial
  CRISPR gRNA sequence
tctgtattctggaaactgac

SEQ ID NO: 299245 - DNA, 20 bp, Artificial
  CRISPR gRNA sequence
ttctggaaactgacaagacg

SEQ ID NO: 299246 - DNA, 20 bp, Artificial
  CRISPR gRNA sequence
tttatcttcacctttctcta

SEQ ID NO: 299247 - DNA, 20 bp, Artificial
  CRISPR gRNA sequence
ttatcttcacctttctctat

SEQ ID NO: 299248 - DNA, 20 bp, Artificial
  CRISPR gRNA sequence
ttcacctttctctataggta

SEQ ID NO: 299249 - DNA, 20 bp, Artificial
  CRISPR gRNA sequence
tataggtaaagctgttttcc

SEQ ID NO: 299250 - DNA, 20 bp, Artificial
  CRISPR gRNA sequence
ttttccaagactatttcttt

SEQ ID NO: 299251 - DNA, 20 bp, Artificial
  CRISPR gRNA sequence
tccaagactatttctttcag

SEQ ID NO: 299252 - DNA, 20 bp, Artificial
  CRISPR gRNA sequence
ccaagactatttctttcagc

SEQ ID NO: 299253 - DNA, 20 bp, Artificial
  CRISPR gRNA sequence
ggtattatacacaaatgctt

SEQ ID NO: 299254 - DNA, 20 bp, Artificial
  CRISPR gRNA sequence
gtattatacacaaatgctta

SEQ ID NO: 299255 - DNA, 20 bp, Artificial
  CRISPR gRNA sequence
ttatacacaaatgcttaagg

SEQ ID NO: 299256 - DNA, 20 bp, Artificial
  CRISPR gRNA sequence
atccaatgtccccgacttgc

SEQ ID NO: 299257 - DNA, 20 bp, Artificial
  CRISPR gRNA sequence
tccaatgtccccgacttgct

SEQ ID NO: 299258 - DNA, 20 bp, Artificial
  CRISPR gRNA sequence
cttgctaggaaacctccaac

SEQ ID NO: 299259 - DNA, 20 bp, Artificial
  CRISPR gRNA sequence
ttgctaggaaacctccaact

SEQ ID NO: 299260 - DNA, 20 bp, Artificial
  CRISPR gRNA sequence
gggccattttatgacgctgt

SEQ ID NO: 299261 - DNA, 20 bp, Artificial
  CRISPR gRNA sequence
ggccattttatgacgctgtt

SEQ ID NO: 299262 - DNA, 20 bp, Artificial
  CRISPR gRNA sequence
cattttatgacgctgttagg

SEQ ID NO: 299263 - DNA, 20 bp, Artificial
  CRISPR gRNA sequence
attttatgacgctgttagga

SEQ ID NO: 299264 - DNA, 20 bp, Artificial
  CRISPR gRNA sequence
tgacgctgttaggaaggacc

SEQ ID NO: 299265 - DNA, 20 bp, Artificial
  CRISPR gRNA sequence
gctgttaggaaggacccaga

SEQ ID NO: 299266 - DNA, 20 bp, Artificial
  CRISPR gRNA sequence
tgttaggaaggacccagatg

SEQ ID NO: 299267 - DNA, 20 bp, Artificial
  CRISPR gRNA sequence
gttaggaaggacccagatgg

SEQ ID NO: 299268 - DNA, 20 bp, Artificial
  CRISPR gRNA sequence
ggaggtctcctgcttctcct

SEQ ID NO: 299269 - DNA, 20 bp, Artificial
  CRISPR gRNA sequence
cctgcttctcctgagtgatg

SEQ ID NO: 299270 - DNA, 20 bp, Artificial
  CRISPR gRNA sequence
ctgcttctcctgagtgatgc

SEQ ID NO: 299271 - DNA, 20 bp, Artificial
  CRISPR gRNA sequence
tgcttctcctgagtgatgca

SEQ ID NO: 299272 - DNA, 20 bp, Artificial
  CRISPR gRNA sequence
ctcctgagtgatgcagggtc

SEQ ID NO: 299273 - DNA, 20 bp, Artificial
  CRISPR gRNA sequence
tcctgagtgatgcagggtcc

SEQ ID NO: 299274 - DNA, 20 bp, Artificial
  CRISPR gRNA sequence
ctgagtgatgcagggtccag

SEQ ID NO: 299275 - DNA, 20 bp, Artificial
  CRISPR gRNA sequence
tgagtgatgcagggtccagg

SEQ ID NO: 299276 - DNA, 20 bp, Artificial
  CRISPR gRNA sequence
tgcagggtccaggaggctac

SEQ ID NO: 299277 - DNA, 20 bp, Artificial
  CRISPR gRNA sequence
acgagcctatgttgcacttg

SEQ ID NO: 299278 - DNA, 20 bp, Artificial
  CRISPR gRNA sequence
cacttgaagaaatatgcttt

SEQ ID NO: 299279 - DNA, 20 bp, Artificial
  CRISPR gRNA sequence
ttttagccctgaaactgact

SEQ ID NO: 299280 - DNA, 20 bp, Artificial
  CRISPR gRNA sequence
ctgaaactgactcagtctct

SEQ ID NO: 299281 - DNA, 20 bp, Artificial
  CRISPR gRNA sequence
tcagtctcttggtttacctt

SEQ ID NO: 299282 - DNA, 20 bp, Artificial
  CRISPR gRNA sequence
tctcttggtttacctttgga

SEQ ID NO: 299283 - DNA, 20 bp, Artificial
  CRISPR gRNA sequence
tcttggtttacctttggatg

SEQ ID NO: 299284 - DNA, 20 bp, Artificial
  CRISPR gRNA sequence
cttggtttacctttggatgg

SEQ ID NO: 299285 - DNA, 20 bp, Artificial
  CRISPR gRNA sequence
cctttggatggaggattctg

SEQ ID NO: 299286 - DNA, 20 bp, Artificial
  CRISPR gRNA sequence
gaagttttgatttaaaaata

SEQ ID NO: 299287 - DNA, 20 bp, Artificial
  CRISPR gRNA sequence
aagttttgatttaaaaatac

SEQ ID NO: 299288 - DNA, 20 bp, Artificial
  CRISPR gRNA sequence
ttaaaaatacaggattcctc

SEQ ID NO: 299289 - DNA, 20 bp, Artificial
  CRISPR gRNA sequence
taaaaatacaggattcctcc

SEQ ID NO: 299290 - DNA, 20 bp, Artificial
  CRISPR gRNA sequence
aatacaggattcctccaggc

SEQ ID NO: 299291 - DNA, 20 bp, Artificial
  CRISPR gRNA sequence
acacacaccatgcatacatg

SEQ ID NO: 299292 - DNA, 20 bp, Artificial
  CRISPR gRNA sequence
atacaaatgatatttattgt

SEQ ID NO: 299293 - DNA, 20 bp, Artificial
  CRISPR gRNA sequence
aatgatatttattgtgagta

SEQ ID NO: 299294 - DNA, 20 bp, Artificial
  CRISPR gRNA sequence
attgtgagtatagaaccatt

SEQ ID NO: 299295 - DNA, 20 bp, Artificial
  CRISPR gRNA sequence
ttgtgagtatagaaccattt

SEQ ID NO: 299296 - DNA, 20 bp, Artificial
  CRISPR gRNA sequence
agaaccatttgggacattat

SEQ ID NO: 299297 - DNA, 20 bp, Artificial
  CRISPR gRNA sequence
atttgggacattattggtca

SEQ ID NO: 299298 - DNA, 20 bp, Artificial
  CRISPR gRNA sequence
tttgggacattattggtcac

SEQ ID NO: 299299 - DNA, 20 bp, Artificial
  CRISPR gRNA sequence
tgggacattattggtcacag

SEQ ID NO: 299300 - DNA, 20 bp, Artificial
  CRISPR gRNA sequence
gtcacaggagtgaaaacaaa

SEQ ID NO: 299301 - DNA, 20 bp, Artificial
  CRISPR gRNA sequence
atgacaccccctctgccctt

SEQ ID NO: 299302 - DNA, 20 bp, Artificial
  CRISPR gRNA sequence
tgacaccccctctgcccttg

SEQ ID NO: 299303 - DNA, 20 bp, Artificial
  CRISPR gRNA sequence
tgcccttgaggaccttccaa

SEQ ID NO: 299304 - DNA, 20 bp, Artificial
  CRISPR gRNA sequence
tgaggaccttccaatagaat

SEQ ID NO: 299305 - DNA, 20 bp, Artificial
  CRISPR gRNA sequence
aatgtgcacacatgaaaaac

SEQ ID NO: 299306 - DNA, 20 bp, Artificial
  CRISPR gRNA sequence
atgaaaaactggatttttaa

SEQ ID NO: 299307 - DNA, 20 bp, Artificial
  CRISPR gRNA sequence
tgaaaaactggatttttaaa

SEQ ID NO: 299308 - DNA, 20 bp, Artificial
  CRISPR gRNA sequence
ggatttttaaaaggttgaat

SEQ ID NO: 299309 - DNA, 20 bp, Artificial
  CRISPR gRNA sequence
ggaatctaaattttattcca

SEQ ID NO: 299310 - DNA, 20 bp, Artificial
  CRISPR gRNA sequence
tctgactaaatttaaaataa

SEQ ID NO: 299311 - DNA, 20 bp, Artificial
  CRISPR gRNA sequence
aaatttaaaataaaagtgac

SEQ ID NO: 299312 - DNA, 20 bp, Artificial
  CRISPR gRNA sequence
aaataaaagtgactggtaat

SEQ ID NO: 299313 - DNA, 20 bp, Artificial
  CRISPR gRNA sequence
gtgactggtaatgagattta

SEQ ID NO: 299314 - DNA, 20 bp, Artificial
  CRISPR gRNA sequence
tgactggtaatgagatttat

SEQ ID NO: 299315 - DNA, 20 bp, Artificial
  CRISPR gRNA sequence
taatgagatttatgggcatt

SEQ ID NO: 299316 - DNA, 20 bp, Artificial
  CRISPR gRNA sequence
atgagatttatgggcattca

SEQ ID NO: 299317 - DNA, 20 bp, Artificial
  CRISPR gRNA sequence
tgagatttatgggcattcag

SEQ ID NO: 299318 - DNA, 20 bp, Artificial
  CRISPR gRNA sequence
gatttatgggcattcagagg

SEQ ID NO: 299319 - DNA, 20 bp, Artificial
  CRISPR gRNA sequence
atttatgggcattcagaggt

SEQ ID NO: 299320 - DNA, 20 bp, Artificial
  CRISPR gRNA sequence
atgggcattcagaggtaggc

SEQ ID NO: 299321 - DNA, 20 bp, Artificial
  CRISPR gRNA sequence
cagaggtaggcaagatccct

SEQ ID NO: 299322 - DNA, 20 bp, Artificial
  CRISPR gRNA sequence
agaggtaggcaagatccctg

SEQ ID NO: 299323 - DNA, 20 bp, Artificial
  CRISPR gRNA sequence
gaggtaggcaagatccctga

SEQ ID NO: 299324 - DNA, 20 bp, Artificial
  CRISPR gRNA sequence
taggcaagatccctgagggt

SEQ ID NO: 299325 - DNA, 20 bp, Artificial
  CRISPR gRNA sequence
aggcaagatccctgagggtc

SEQ ID NO: 299326 - DNA, 20 bp, Artificial
  CRISPR gRNA sequence
ggcaagatccctgagggtca

SEQ ID NO: 299327 - DNA, 20 bp, Artificial
  CRISPR gRNA sequence
gatccctgagggtcagggaa

SEQ ID NO: 299328 - DNA, 20 bp, Artificial
  CRISPR gRNA sequence
gggtcagggaatggttccta

SEQ ID NO: 299329 - DNA, 20 bp, Artificial
  CRISPR gRNA sequence
ggtcagggaatggttcctaa

SEQ ID NO: 299330 - DNA, 20 bp, Artificial
  CRISPR gRNA sequence
cagggaatggttcctaaagg

SEQ ID NO: 299331 - DNA, 20 bp, Artificial
  CRISPR gRNA sequence
agggaatggttcctaaagga

SEQ ID NO: 299332 - DNA, 20 bp, Artificial
  CRISPR gRNA sequence
gggaatggttcctaaaggaa

SEQ ID NO: 299333 - DNA, 20 bp, Artificial
  CRISPR gRNA sequence
ggaatggttcctaaaggaag

SEQ ID NO: 299334 - DNA, 20 bp, Artificial
  CRISPR gRNA sequence
taacatgtaaaataaattat

SEQ ID NO: 299335 - DNA, 20 bp, Artificial
  CRISPR gRNA sequence
aacatgtaaaataaattatt

SEQ ID NO: 299336 - DNA, 20 bp, Artificial
  CRISPR gRNA sequence
acatgtaaaataaattattg

SEQ ID NO: 299337 - DNA, 20 bp, Artificial
  CRISPR gRNA sequence
attattggggttaataaatg

SEQ ID NO: 299338 - DNA, 20 bp, Artificial
  CRISPR gRNA sequence
ttggggttaataaatgtggt

SEQ ID NO: 299339 - DNA, 20 bp, Artificial
  CRISPR gRNA sequence
tggggttaataaatgtggtg

SEQ ID NO: 299340 - DNA, 20 bp, Artificial
  CRISPR gRNA sequence
gggttaataaatgtggtgag

SEQ ID NO: 299341 - DNA, 20 bp, Artificial
  CRISPR gRNA sequence
ggttaataaatgtggtgagg

SEQ ID NO: 299342 - DNA, 20 bp, Artificial
  CRISPR gRNA sequence
gttaataaatgtggtgagga

SEQ ID NO: 299343 - DNA, 20 bp, Artificial
  CRISPR gRNA sequence
ttaataaatgtggtgaggag

SEQ ID NO: 299344 - DNA, 20 bp, Artificial
  CRISPR gRNA sequence
aataaatgtggtgaggaggg

SEQ ID NO: 299345 - DNA, 20 bp, Artificial
  CRISPR gRNA sequence
ataaatgtggtgaggagggg

SEQ ID NO: 299346 - DNA, 20 bp, Artificial
  CRISPR gRNA sequence
taaatgtggtgaggagggga

SEQ ID NO: 299347 - DNA, 20 bp, Artificial
  CRISPR gRNA sequence
gtgaggaggggagggcattc

SEQ ID NO: 299348 - DNA, 20 bp, Artificial
  CRISPR gRNA sequence
ggggagggcattctggatga

SEQ ID NO: 299349 - DNA, 20 bp, Artificial
  CRISPR gRNA sequence
gggagggcattctggatgac

SEQ ID NO: 299350 - DNA, 20 bp, Artificial
  CRISPR gRNA sequence
atgacaggttcccaaaactg

SEQ ID NO: 299351 - DNA, 20 bp, Artificial
  CRISPR gRNA sequence
caaaactgtggtgacttccg

SEQ ID NO: 299352 - DNA, 20 bp, Artificial
  CRISPR gRNA sequence
ttccgtagctgaaaaaattt

SEQ ID NO: 299353 - DNA, 20 bp, Artificial
  CRISPR gRNA sequence
gtagctgaaaaaatttgaga

SEQ ID NO: 299354 - DNA, 20 bp, Artificial
  CRISPR gRNA sequence
aaaaaatttgagacagtatc

SEQ ID NO: 299355 - DNA, 20 bp, Artificial
  CRISPR gRNA sequence
aaaaatttgagacagtatct

SEQ ID NO: 299356 - DNA, 20 bp, Artificial
  CRISPR gRNA sequence
tttgagacagtatctgggct

SEQ ID NO: 299357 - DNA, 20 bp, Artificial
  CRISPR gRNA sequence
gagacagtatctgggctaag

SEQ ID NO: 299358 - DNA, 20 bp, Artificial
  CRISPR gRNA sequence
agacagtatctgggctaagc

SEQ ID NO: 299359 - DNA, 20 bp, Artificial
  CRISPR gRNA sequence
agtatctgggctaagcaggt

SEQ ID NO: 299360 - DNA, 20 bp, Artificial
  CRISPR gRNA sequence
tatctgggctaagcaggtga

SEQ ID NO: 299361 - DNA, 20 bp, Artificial
  CRISPR gRNA sequence
atctgggctaagcaggtgag

SEQ ID NO: 299362 - DNA, 20 bp, Artificial
  CRISPR gRNA sequence
ctaagcaggtgagaggacca

SEQ ID NO: 299363 - DNA, 20 bp, Artificial
  CRISPR gRNA sequence
agcaggtgagaggaccacag

SEQ ID NO: 299364 - DNA, 20 bp, Artificial
  CRISPR gRNA sequence
gtgagaggaccacagtggat

SEQ ID NO: 299365 - DNA, 20 bp, Artificial
  CRISPR gRNA sequence
ggatcagctgtatctgacgt

SEQ ID NO: 299366 - DNA, 20 bp, Artificial
  CRISPR gRNA sequence
agctgtatctgacgtaagtg

SEQ ID NO: 299367 - DNA, 20 bp, Artificial
  CRISPR gRNA sequence
gctgtatctgacgtaagtgc

SEQ ID NO: 299368 - DNA, 20 bp, Artificial
  CRISPR gRNA sequence
tgtatctgacgtaagtgcag

SEQ ID NO: 299369 - DNA, 20 bp, Artificial
  CRISPR gRNA sequence
gtatctgacgtaagtgcagg

SEQ ID NO: 299370 - DNA, 20 bp, Artificial
  CRISPR gRNA sequence
taagtgcaggaggtatgtca

SEQ ID NO: 299371 - DNA, 20 bp, Artificial
  CRISPR gRNA sequence
tgcaggaggtatgtcaaaga

SEQ ID NO: 299372 - DNA, 20 bp, Artificial
  CRISPR gRNA sequence
aggtatgtcaaagaaagcct

SEQ ID NO: 299373 - DNA, 20 bp, Artificial
  CRISPR gRNA sequence
gtatgtcaaagaaagccttg

SEQ ID NO: 299374 - DNA, 20 bp, Artificial
  CRISPR gRNA sequence
tatgtcaaagaaagccttgg

SEQ ID NO: 299375 - DNA, 20 bp, Artificial
  CRISPR gRNA sequence
gtcaaagaaagccttggagg

SEQ ID NO: 299376 - DNA, 20 bp, Artificial
  CRISPR gRNA sequence
agaaatgcttgtgtgttcac

SEQ ID NO: 299377 - DNA, 20 bp, Artificial
  CRISPR gRNA sequence
gtgtgttcacaagtattctt

SEQ ID NO: 299378 - DNA, 20 bp, Artificial
  CRISPR gRNA sequence
tgtgttcacaagtattcttc

SEQ ID NO: 299379 - DNA, 20 bp, Artificial
  CRISPR gRNA sequence
gtgttcacaagtattcttca

SEQ ID NO: 299380 - DNA, 20 bp, Artificial
  CRISPR gRNA sequence
cacaagtattcttcagggac

SEQ ID NO: 299381 - DNA, 20 bp, Artificial
  CRISPR gRNA sequence
gtattcttcagggacaagtt

SEQ ID NO: 299382 - DNA, 20 bp, Artificial
  CRISPR gRNA sequence
ttcttcagggacaagttcag

SEQ ID NO: 299383 - DNA, 20 bp, Artificial
  CRISPR gRNA sequence
cttcagggacaagttcagtg

SEQ ID NO: 299384 - DNA, 20 bp, Artificial
  CRISPR gRNA sequence
ttcagggacaagttcagtgg

SEQ ID NO: 299385 - DNA, 20 bp, Artificial
  CRISPR gRNA sequence
gggacaagttcagtggagga

SEQ ID NO: 299386 - DNA, 20 bp, Artificial
  CRISPR gRNA sequence
ggacaagttcagtggaggaa

SEQ ID NO: 299387 - DNA, 20 bp, Artificial
  CRISPR gRNA sequence
tggaggaaaggattgaaact

SEQ ID NO: 299388 - DNA, 20 bp, Artificial
  CRISPR gRNA sequence
aggaaaggattgaaactaag

SEQ ID NO: 299389 - DNA, 20 bp, Artificial
  CRISPR gRNA sequence
aaaggattgaaactaagcag

SEQ ID NO: 299390 - DNA, 20 bp, Artificial
  CRISPR gRNA sequence
aactaagcagtagccactaa

SEQ ID NO: 299391 - DNA, 20 bp, Artificial
  CRISPR gRNA sequence
actaagcagtagccactaat

SEQ ID NO: 299392 - DNA, 20 bp, Artificial
  CRISPR gRNA sequence
taagcagtagccactaatag

SEQ ID NO: 299393 - DNA, 20 bp, Artificial
  CRISPR gRNA sequence
aataggagcctgacatttta

SEQ ID NO: 299394 - DNA, 20 bp, Artificial
  CRISPR gRNA sequence
agcctgacattttaaagtcc

SEQ ID NO: 299395 - DNA, 20 bp, Artificial
  CRISPR gRNA sequence
tttaaagtcctggctttacc

SEQ ID NO: 299396 - DNA, 20 bp, Artificial
  CRISPR gRNA sequence
ttaaagtcctggctttaccc

SEQ ID NO: 299397 - DNA, 20 bp, Artificial
  CRISPR gRNA sequence
aaagtcctggctttacccag

SEQ ID NO: 299398 - DNA, 20 bp, Artificial
  CRISPR gRNA sequence
aagtcctggctttacccagg

SEQ ID NO: 299399 - DNA, 20 bp, Artificial
  CRISPR gRNA sequence
agtcctggctttacccagga

SEQ ID NO: 299400 - DNA, 20 bp, Artificial
  CRISPR gRNA sequence
ctatatttgactcctctttt

SEQ ID NO: 299401 - DNA, 20 bp, Artificial
  CRISPR gRNA sequence
tatttgactcctcttttaag

SEQ ID NO: 299402 - DNA, 20 bp, Artificial
  CRISPR gRNA sequence
ttttaagaagctgtaactgc

SEQ ID NO: 299403 - DNA, 20 bp, Artificial
  CRISPR gRNA sequence
gtaactgcaagattccctcc

SEQ ID NO: 299404 - DNA, 20 bp, Artificial
  CRISPR gRNA sequence
caagattccctcctggaata

SEQ ID NO: 299405 - DNA, 20 bp, Artificial
  CRISPR gRNA sequence
aagattccctcctggaataa

SEQ ID NO: 299406 - DNA, 20 bp, Artificial
  CRISPR gRNA sequence
attccctcctggaataaagg

SEQ ID NO: 299407 - DNA, 20 bp, Artificial
  CRISPR gRNA sequence
tcttaccttgaccccttctc

SEQ ID NO: 299408 - DNA, 20 bp, Artificial
  CRISPR gRNA sequence
taccttgaccccttctccag

SEQ ID NO: 299409 - DNA, 20 bp, Artificial
  CRISPR gRNA sequence
cttctccagcggtgatttct

SEQ ID NO: 299410 - DNA, 20 bp, Artificial
  CRISPR gRNA sequence
atttcttggcttgccccctc

SEQ ID NO: 299411 - DNA, 20 bp, Artificial
  CRISPR gRNA sequence
caactccttgctccataccc

SEQ ID NO: 299412 - DNA, 20 bp, Artificial
  CRISPR gRNA sequence
ctttgtcacctcctttctcc

SEQ ID NO: 299413 - DNA, 20 bp, Artificial
  CRISPR gRNA sequence
tctcccagtgtcttgttgtt

SEQ ID NO: 299414 - DNA, 20 bp, Artificial
  CRISPR gRNA sequence
cttgttgttcagatataact

SEQ ID NO: 299415 - DNA, 20 bp, Artificial
  CRISPR gRNA sequence
gatataacttggtctgtgaa

SEQ ID NO: 299416 - DNA, 20 bp, Artificial
  CRISPR gRNA sequence
cttggtctgtgaacagccca

SEQ ID NO: 299417 - DNA, 20 bp, Artificial
  CRISPR gRNA sequence
ttggtctgtgaacagcccac

SEQ ID NO: 299418 - DNA, 20 bp, Artificial
  CRISPR gRNA sequence
tggtctgtgaacagcccacg

SEQ ID NO: 299419 - DNA, 20 bp, Artificial
  CRISPR gRNA sequence
ctgtgaacagcccacggggc

SEQ ID NO: 299420 - DNA, 20 bp, Artificial
  CRISPR gRNA sequence
ccatgaaccaactttacaac

SEQ ID NO: 299421 - DNA, 20 bp, Artificial
  CRISPR gRNA sequence
catgaaccaactttacaact

SEQ ID NO: 299422 - DNA, 20 bp, Artificial
  CRISPR gRNA sequence
gctactgacttcttcctatt

SEQ ID NO: 299423 - DNA, 20 bp, Artificial
  CRISPR gRNA sequence
ttcttcctattcagacactt

SEQ ID NO: 299424 - DNA, 20 bp, Artificial
  CRISPR gRNA sequence
attcagacacttcagcctct

SEQ ID NO: 299425 - DNA, 20 bp, Artificial
  CRISPR gRNA sequence
cacttcagcctctgagaatc

SEQ ID NO: 299426 - DNA, 20 bp, Artificial
  CRISPR gRNA sequence
gcctctgagaatccagtaaa

SEQ ID NO: 299427 - DNA, 20 bp, Artificial
  CRISPR gRNA sequence
tctgagaatccagtaaatgg

SEQ ID NO: 299428 - DNA, 20 bp, Artificial
  CRISPR gRNA sequence
tgagaatccagtaaatggtg

SEQ ID NO: 299429 - DNA, 20 bp, Artificial
  CRISPR gRNA sequence
ggagccaactcgtcctgtcc

SEQ ID NO: 299430 - DNA, 20 bp, Artificial
  CRISPR gRNA sequence
gcttctcctgtatcctctct

SEQ ID NO: 299431 - DNA, 20 bp, Artificial
  CRISPR gRNA sequence
ctcctgtatcctctcttggc

SEQ ID NO: 299432 - DNA, 20 bp, Artificial
  CRISPR gRNA sequence
tgtatcctctcttggccaga

SEQ ID NO: 299433 - DNA, 20 bp, Artificial
  CRISPR gRNA sequence
atcctctcttggccagatag

SEQ ID NO: 299434 - DNA, 20 bp, Artificial
  CRISPR gRNA sequence
ggccagatagaagcctctcc

SEQ ID NO: 299435 - DNA, 20 bp, Artificial
  CRISPR gRNA sequence
gcctctccaagctatgcctg

SEQ ID NO: 299436 - DNA, 20 bp, Artificial
  CRISPR gRNA sequence
tccaagctatgcctgaagtt

SEQ ID NO: 299437 - DNA, 20 bp, Artificial
  CRISPR gRNA sequence
tacctccttcaatgtgtaat

SEQ ID NO: 299438 - DNA, 20 bp, Artificial
  CRISPR gRNA sequence
caatgtgtaattagtttgat

SEQ ID NO: 299439 - DNA, 20 bp, Artificial
  CRISPR gRNA sequence
tgtgtaattagtttgattgg

SEQ ID NO: 299440 - DNA, 20 bp, Artificial
  CRISPR gRNA sequence
ttagtttgattggtggccac

SEQ ID NO: 299441 - DNA, 20 bp, Artificial
  CRISPR gRNA sequence
tttgattggtggccacaaga

SEQ ID NO: 299442 - DNA, 20 bp, Artificial
  CRISPR gRNA sequence
tggccatatatgacatgccc

SEQ ID NO: 299443 - DNA, 20 bp, Artificial
  CRISPR gRNA sequence
ggccatatatgacatgcccc

SEQ ID NO: 299444 - DNA, 20 bp, Artificial
  CRISPR gRNA sequence
gccatatatgacatgcccca

SEQ ID NO: 299445 - DNA, 20 bp, Artificial
  CRISPR gRNA sequence
tgccccagggccctctgtta

SEQ ID NO: 299446 - DNA, 20 bp, Artificial
  CRISPR gRNA sequence
gccctctgttacggctccca

SEQ ID NO: 299447 - DNA, 20 bp, Artificial
  CRISPR gRNA sequence
tcccatagtctacaaattaa

SEQ ID NO: 299448 - DNA, 20 bp, Artificial
  CRISPR gRNA sequence
cccatagtctacaaattaac

SEQ ID NO: 299449 - DNA, 20 bp, Artificial
  CRISPR gRNA sequence
ccatagtctacaaattaaca

SEQ ID NO: 299450 - DNA, 20 bp, Artificial
  CRISPR gRNA sequence
catagtctacaaattaacag

SEQ ID NO: 299451 - DNA, 20 bp, Artificial
  CRISPR gRNA sequence
ccaccactataacctcatca

SEQ ID NO: 299452 - DNA, 20 bp, Artificial
  CRISPR gRNA sequence
actgttctgccaaacttcaa

SEQ ID NO: 299453 - DNA, 20 bp, Artificial
  CRISPR gRNA sequence
ctgttctgccaaacttcaac

SEQ ID NO: 299454 - DNA, 20 bp, Artificial
  CRISPR gRNA sequence
tcaacaggtacccccatctt

SEQ ID NO: 299455 - DNA, 20 bp, Artificial
  CRISPR gRNA sequence
ccccatcttcagaaatgttt

SEQ ID NO: 299456 - DNA, 20 bp, Artificial
  CRISPR gRNA sequence
cttcagaaatgtttcagctc

SEQ ID NO: 299457 - DNA, 20 bp, Artificial
  CRISPR gRNA sequence
tgtttcagctctagctgcct

SEQ ID NO: 299458 - DNA, 20 bp, Artificial
  CRISPR gRNA sequence
gtttcagctctagctgcctc

SEQ ID NO: 299459 - DNA, 20 bp, Artificial
  CRISPR gRNA sequence
tcagctctagctgcctcagg

SEQ ID NO: 299460 - DNA, 20 bp, Artificial
  CRISPR gRNA sequence
ctctagctgcctcaggaaga

SEQ ID NO: 299461 - DNA, 20 bp, Artificial
  CRISPR gRNA sequence
tctagctgcctcaggaagat

SEQ ID NO: 299462 - DNA, 20 bp, Artificial
  CRISPR gRNA sequence
ctagctgcctcaggaagatg

SEQ ID NO: 299463 - DNA, 20 bp, Artificial
  CRISPR gRNA sequence
gaagatggggcttgcctctc

SEQ ID NO: 299464 - DNA, 20 bp, Artificial
  CRISPR gRNA sequence
aagatggggcttgcctctct

SEQ ID NO: 299465 - DNA, 20 bp, Artificial
  CRISPR gRNA sequence
ttcccattctatcgcttgat

SEQ ID NO: 299466 - DNA, 20 bp, Artificial
  CRISPR gRNA sequence
cccattctatcgcttgatca

SEQ ID NO: 299467 - DNA, 20 bp, Artificial
  CRISPR gRNA sequence
ttctatcgcttgatcagaga

SEQ ID NO: 299468 - DNA, 20 bp, Artificial
  CRISPR gRNA sequence
tctatcgcttgatcagagat

SEQ ID NO: 299469 - DNA, 20 bp, Artificial
  CRISPR gRNA sequence
tcgcttgatcagagataggt

SEQ ID NO: 299470 - DNA, 20 bp, Artificial
  CRISPR gRNA sequence
tcagagataggttagaccct

SEQ ID NO: 299471 - DNA, 20 bp, Artificial
  CRISPR gRNA sequence
gataggttagaccctgagtc

SEQ ID NO: 299472 - DNA, 20 bp, Artificial
  CRISPR gRNA sequence
ataggttagaccctgagtca

SEQ ID NO: 299473 - DNA, 20 bp, Artificial
  CRISPR gRNA sequence
taggttagaccctgagtcaa

SEQ ID NO: 299474 - DNA, 20 bp, Artificial
  CRISPR gRNA sequence
aggttagaccctgagtcaag

SEQ ID NO: 299475 - DNA, 20 bp, Artificial
  CRISPR gRNA sequence
gggccttttttgcatgttaa

SEQ ID NO: 299476 - DNA, 20 bp, Artificial
  CRISPR gRNA sequence
ggccttttttgcatgttaaa

SEQ ID NO: 299477 - DNA, 20 bp, Artificial
  CRISPR gRNA sequence
cttttttgcatgttaaaagg

SEQ ID NO: 299478 - DNA, 20 bp, Artificial
  CRISPR gRNA sequence
ttttgcatgttaaaaggtag

SEQ ID NO: 299479 - DNA, 20 bp, Artificial
  CRISPR gRNA sequence
aaaggtagcagcctccacgt

SEQ ID NO: 299480 - DNA, 20 bp, Artificial
  CRISPR gRNA sequence
gtagcagcctccacgttagt

SEQ ID NO: 299481 - DNA, 20 bp, Artificial
  CRISPR gRNA sequence
taacccctaaccccctttac

SEQ ID NO: 299482 - DNA, 20 bp, Artificial
  CRISPR gRNA sequence
aacccctaaccccctttact

SEQ ID NO: 299483 - DNA, 20 bp, Artificial
  CRISPR gRNA sequence
cccctaaccccctttactgg

SEQ ID NO: 299484 - DNA, 20 bp, Artificial
  CRISPR gRNA sequence
ctttactgggagtgccaaac

SEQ ID NO: 299485 - DNA, 20 bp, Artificial
  CRISPR gRNA sequence
tgggagtgccaaactggctc

SEQ ID NO: 299486 - DNA, 20 bp, Artificial
  CRISPR gRNA sequence
gagtgccaaactggctcaag

SEQ ID NO: 299487 - DNA, 20 bp, Artificial
  CRISPR gRNA sequence
ccaaactggctcaagtggaa

SEQ ID NO: 299488 - DNA, 20 bp, Artificial
  CRISPR gRNA sequence
ctggctcaagtggaatagac

SEQ ID NO: 299489 - DNA, 20 bp, Artificial
  CRISPR gRNA sequence
tggctcaagtggaatagact

SEQ ID NO: 299490 - DNA, 20 bp, Artificial
  CRISPR gRNA sequence
tcaagtggaatagactggga

SEQ ID NO: 299491 - DNA, 20 bp, Artificial
  CRISPR gRNA sequence
atagactgggacagactcaa

SEQ ID NO: 299492 - DNA, 20 bp, Artificial
  CRISPR gRNA sequence
tagactgggacagactcaaa

SEQ ID NO: 299493 - DNA, 20 bp, Artificial
  CRISPR gRNA sequence
agactgggacagactcaaaa

SEQ ID NO: 299494 - DNA, 20 bp, Artificial
  CRISPR gRNA sequence
gactcaaaagggattaaata

SEQ ID NO: 299495 - DNA, 20 bp, Artificial
  CRISPR gRNA sequence
ccaacaacttcttaacatcc

SEQ ID NO: 299496 - DNA, 20 bp, Artificial
  CRISPR gRNA sequence
acttcttaacatcccagaaa

SEQ ID NO: 299497 - DNA, 20 bp, Artificial
  CRISPR gRNA sequence
cttcttaacatcccagaaac

SEQ ID NO: 299498 - DNA, 20 bp, Artificial
  CRISPR gRNA sequence
ttcttaacatcccagaaaca

SEQ ID NO: 299499 - DNA, 20 bp, Artificial
  CRISPR gRNA sequence
gggcatgtgtctacaaatta

SEQ ID NO: 299500 - DNA, 20 bp, Artificial
  CRISPR gRNA sequence
tgtgtctacaaattatagct

SEQ ID NO: 299501 - DNA, 20 bp, Artificial
  CRISPR gRNA sequence
acaaattatagctaagctaa

SEQ ID NO: 299502 - DNA, 20 bp, Artificial
  CRISPR gRNA sequence
ttatagctaagctaatagat

SEQ ID NO: 299503 - DNA, 20 bp, Artificial
  CRISPR gRNA sequence
agctaagctaatagatcagc

SEQ ID NO: 299504 - DNA, 20 bp, Artificial
  CRISPR gRNA sequence
gtcctaattttcctgaaatt

SEQ ID NO: 299505 - DNA, 20 bp, Artificial
  CRISPR gRNA sequence
tcctaattttcctgaaattt

SEQ ID NO: 299506 - DNA, 20 bp, Artificial
  CRISPR gRNA sequence
attttcctgaaatttgggat

SEQ ID NO: 299507 - DNA, 20 bp, Artificial
  CRISPR gRNA sequence
tgaaatttgggattagctac

SEQ ID NO: 299508 - DNA, 20 bp, Artificial
  CRISPR gRNA sequence
tgttcccaaaaatgtcttta

SEQ ID NO: 299509 - DNA, 20 bp, Artificial
  CRISPR gRNA sequence
tcccaaaaatgtctttaaag

SEQ ID NO: 299510 - DNA, 20 bp, Artificial
  CRISPR gRNA sequence
cccaaaaatgtctttaaagt

SEQ ID NO: 299511 - DNA, 20 bp, Artificial
  CRISPR gRNA sequence
aaagtgggcgactccgttct

SEQ ID NO: 299512 - DNA, 20 bp, Artificial
  CRISPR gRNA sequence
cgttctaagttttccccaca

SEQ ID NO: 299513 - DNA, 20 bp, Artificial
  CRISPR gRNA sequence
aagcctgttttccaactccc

SEQ ID NO: 299514 - DNA, 20 bp, Artificial
  CRISPR gRNA sequence
tttccaactccccagaaact

SEQ ID NO: 299515 - DNA, 20 bp, Artificial
  CRISPR gRNA sequence
ttccaactccccagaaactt

SEQ ID NO: 299516 - DNA, 20 bp, Artificial
  CRISPR gRNA sequence
ccaactccccagaaacttag

SEQ ID NO: 299517 - DNA, 20 bp, Artificial
  CRISPR gRNA sequence
aaacttaggagttctcatgt

SEQ ID NO: 299518 - DNA, 20 bp, Artificial
  CRISPR gRNA sequence
aacttaggagttctcatgta

SEQ ID NO: 299519 - DNA, 20 bp, Artificial
  CRISPR gRNA sequence
ttaggagttctcatgtaagg

SEQ ID NO: 299520 - DNA, 20 bp, Artificial
  CRISPR gRNA sequence
ggagttctcatgtaaggaag

SEQ ID NO: 299521 - DNA, 20 bp, Artificial
  CRISPR gRNA sequence
atgtaaggaagtagttcctg

SEQ ID NO: 299522 - DNA, 20 bp, Artificial
  CRISPR gRNA sequence
tgtaaggaagtagttcctga

SEQ ID NO: 299523 - DNA, 20 bp, Artificial
  CRISPR gRNA sequence
aagtagttcctgaaggcgtg

SEQ ID NO: 299524 - DNA, 20 bp, Artificial
  CRISPR gRNA sequence
agtagttcctgaaggcgtga

SEQ ID NO: 299525 - DNA, 20 bp, Artificial
  CRISPR gRNA sequence
tgaaggcgtgaaggttcctc

SEQ ID NO: 299526 - DNA, 20 bp, Artificial
  CRISPR gRNA sequence
gaaggcgtgaaggttcctca

SEQ ID NO: 299527 - DNA, 20 bp, Artificial
  CRISPR gRNA sequence
tgaaggttcctcaaggcatg

SEQ ID NO: 299528 - DNA, 20 bp, Artificial
  CRISPR gRNA sequence
caaggcatgaagaaacatca

SEQ ID NO: 299529 - DNA, 20 bp, Artificial
  CRISPR gRNA sequence
aaggcatgaagaaacatcaa

SEQ ID NO: 299530 - DNA, 20 bp, Artificial
  CRISPR gRNA sequence
aagaaacatcaaaggttttt

SEQ ID NO: 299531 - DNA, 20 bp, Artificial
  CRISPR gRNA sequence
aaacatcaaaggtttttcag

SEQ ID NO: 299532 - DNA, 20 bp, Artificial
  CRISPR gRNA sequence
tcaaaggtttttcagtagat

SEQ ID NO: 299533 - DNA, 20 bp, Artificial
  CRISPR gRNA sequence
cagtagatgagatatgctga

SEQ ID NO: 299534 - DNA, 20 bp, Artificial
  CRISPR gRNA sequence
gagatatgctgaaagccatg

SEQ ID NO: 299535 - DNA, 20 bp, Artificial
  CRISPR gRNA sequence
gatatgctgaaagccatgca

SEQ ID NO: 299536 - DNA, 20 bp, Artificial
  CRISPR gRNA sequence
atatgctgaaagccatgcag

SEQ ID NO: 299537 - DNA, 20 bp, Artificial
  CRISPR gRNA sequence
gaggaaacctgctgtgacct

SEQ ID NO: 299538 - DNA, 20 bp, Artificial
  CRISPR gRNA sequence
gaaacctgctgtgacctcag

SEQ ID NO: 299539 - DNA, 20 bp, Artificial
  CRISPR gRNA sequence
aaacctgctgtgacctcagt

SEQ ID NO: 299540 - DNA, 20 bp, Artificial
  CRISPR gRNA sequence
taggaaaaaactaaacaaac

SEQ ID NO: 299541 - DNA, 20 bp, Artificial
  CRISPR gRNA sequence
acaaacaagcaaatgaaaac

SEQ ID NO: 299542 - DNA, 20 bp, Artificial
  CRISPR gRNA sequence
aaacaagcaaatgaaaacta

SEQ ID NO: 299543 - DNA, 20 bp, Artificial
  CRISPR gRNA sequence
aacaagcaaatgaaaactag

SEQ ID NO: 299544 - DNA, 20 bp, Artificial
  CRISPR gRNA sequence
aagcaaatgaaaactagagg

SEQ ID NO: 299545 - DNA, 20 bp, Artificial
  CRISPR gRNA sequence
agcaaatgaaaactagaggt

SEQ ID NO: 299546 - DNA, 20 bp, Artificial
  CRISPR gRNA sequence
gcaaatgaaaactagaggta

SEQ ID NO: 299547 - DNA, 20 bp, Artificial
  CRISPR gRNA sequence
caaatgaaaactagaggtag

SEQ ID NO: 299548 - DNA, 20 bp, Artificial
  CRISPR gRNA sequence
aaactagaggtaggggcctg

SEQ ID NO: 299549 - DNA, 20 bp, Artificial
  CRISPR gRNA sequence
ctagaggtaggggcctgtgg

SEQ ID NO: 299550 - DNA, 20 bp, Artificial
  CRISPR gRNA sequence
ggaagctgttccatttgtcc

SEQ ID NO: 299551 - DNA, 20 bp, Artificial
  CRISPR gRNA sequence
gctgttccatttgtccaagt

SEQ ID NO: 299552 - DNA, 20 bp, Artificial
  CRISPR gRNA sequence
tgttccatttgtccaagtga

SEQ ID NO: 299553 - DNA, 20 bp, Artificial
  CRISPR gRNA sequence
gttccatttgtccaagtgag

SEQ ID NO: 299554 - DNA, 20 bp, Artificial
  CRISPR gRNA sequence
ttgtccaagtgagaggtgtc

SEQ ID NO: 299555 - DNA, 20 bp, Artificial
  CRISPR gRNA sequence
gtccaagtgagaggtgtctg

SEQ ID NO: 299556 - DNA, 20 bp, Artificial
  CRISPR gRNA sequence
tgagaggtgtctggagatta

SEQ ID NO: 299557 - DNA, 20 bp, Artificial
  CRISPR gRNA sequence
gaggtgtctggagattatag

SEQ ID NO: 299558 - DNA, 20 bp, Artificial
  CRISPR gRNA sequence
tgtctggagattatagtgga

SEQ ID NO: 299559 - DNA, 20 bp, Artificial
  CRISPR gRNA sequence
ctggagattatagtggacag

SEQ ID NO: 299560 - DNA, 20 bp, Artificial
  CRISPR gRNA sequence
gtggacagaagaatcatcac

SEQ ID NO: 299561 - DNA, 20 bp, Artificial
  CRISPR gRNA sequence
ggacagaagaatcatcacga

SEQ ID NO: 299562 - DNA, 20 bp, Artificial
  CRISPR gRNA sequence
gacagaagaatcatcacgag

SEQ ID NO: 299563 - DNA, 20 bp, Artificial
  CRISPR gRNA sequence
aatcatcacgagaggaactt

SEQ ID NO: 299564 - DNA, 20 bp, Artificial
  CRISPR gRNA sequence
atcatcacgagaggaacttc

SEQ ID NO: 299565 - DNA, 20 bp, Artificial
  CRISPR gRNA sequence
tcatcacgagaggaacttca

SEQ ID NO: 299566 - DNA, 20 bp, Artificial
  CRISPR gRNA sequence
acgagaggaacttcagggcc

SEQ ID NO: 299567 - DNA, 20 bp, Artificial
  CRISPR gRNA sequence
cgagaggaacttcagggcct

SEQ ID NO: 299568 - DNA, 20 bp, Artificial
  CRISPR gRNA sequence
cagggcctgggaactgactg

SEQ ID NO: 299569 - DNA, 20 bp, Artificial
  CRISPR gRNA sequence
gggcctgggaactgactgca

SEQ ID NO: 299570 - DNA, 20 bp, Artificial
  CRISPR gRNA sequence
ggcctgggaactgactgcag

SEQ ID NO: 299571 - DNA, 20 bp, Artificial
  CRISPR gRNA sequence
gcctgggaactgactgcaga

SEQ ID NO: 299572 - DNA, 20 bp, Artificial
  CRISPR gRNA sequence
cctgggaactgactgcagag

SEQ ID NO: 299573 - DNA, 20 bp, Artificial
  CRISPR gRNA sequence
ctgggaactgactgcagagg

SEQ ID NO: 299574 - DNA, 20 bp, Artificial
  CRISPR gRNA sequence
tgggaactgactgcagaggg

SEQ ID NO: 299575 - DNA, 20 bp, Artificial
  CRISPR gRNA sequence
gaactgactgcagagggggg

SEQ ID NO: 299576 - DNA, 20 bp, Artificial
  CRISPR gRNA sequence
aactgactgcagaggggggc

SEQ ID NO: 299577 - DNA, 20 bp, Artificial
  CRISPR gRNA sequence
gactgcagaggggggcagga

SEQ ID NO: 299578 - DNA, 20 bp, Artificial
  CRISPR gRNA sequence
tgcagaggggggcaggatag

SEQ ID NO: 299579 - DNA, 20 bp, Artificial
  CRISPR gRNA sequence
gcagaggggggcaggatagc

SEQ ID NO: 299580 - DNA, 20 bp, Artificial
  CRISPR gRNA sequence
ggggggcaggatagcaggca

SEQ ID NO: 299581 - DNA, 20 bp, Artificial
  CRISPR gRNA sequence
ggcacaaatgactgcacgtg

SEQ ID NO: 299582 - DNA, 20 bp, Artificial
  CRISPR gRNA sequence
cacaaatgactgcacgtgca

SEQ ID NO: 299583 - DNA, 20 bp, Artificial
  CRISPR gRNA sequence
tgactgcacgtgcagagcct

SEQ ID NO: 299584 - DNA, 20 bp, Artificial
  CRISPR gRNA sequence
gcacgtgcagagcctcagca

SEQ ID NO: 299585 - DNA, 20 bp, Artificial
  CRISPR gRNA sequence
ctcagcacagacacctcacc

SEQ ID NO: 299586 - DNA, 20 bp, Artificial
  CRISPR gRNA sequence
cagacacctcacccagattc

SEQ ID NO: 299587 - DNA, 20 bp, Artificial
  CRISPR gRNA sequence
tcacccagattccagaatca

SEQ ID NO: 299588 - DNA, 20 bp, Artificial
  CRISPR gRNA sequence
cacccagattccagaatcac

SEQ ID NO: 299589 - DNA, 20 bp, Artificial
  CRISPR gRNA sequence
cagattccagaatcacgggc

SEQ ID NO: 299590 - DNA, 20 bp, Artificial
  CRISPR gRNA sequence
agattccagaatcacgggcc

SEQ ID NO: 299591 - DNA, 20 bp, Artificial
  CRISPR gRNA sequence
gaccctcttcttcctgatca

SEQ ID NO: 299592 - DNA, 20 bp, Artificial
  CRISPR gRNA sequence
ctcttcttcctgatcatggt

SEQ ID NO: 299593 - DNA, 20 bp, Artificial
  CRISPR gRNA sequence
gtgttatccccacctccatg

SEQ ID NO: 299594 - DNA, 20 bp, Artificial
  CRISPR gRNA sequence
tgttatccccacctccatga

SEQ ID NO: 299595 - DNA, 20 bp, Artificial
  CRISPR gRNA sequence
tccccacctccatgaaggca

SEQ ID NO: 299596 - DNA, 20 bp, Artificial
  CRISPR gRNA sequence
ccacctccatgaaggcatgg

SEQ ID NO: 299597 - DNA, 20 bp, Artificial
  CRISPR gRNA sequence
tccatgaaggcatggcagct

SEQ ID NO: 299598 - DNA, 20 bp, Artificial
  CRISPR gRNA sequence
gaaggcatggcagctcagtc

SEQ ID NO: 299599 - DNA, 20 bp, Artificial
  CRISPR gRNA sequence
aaggcatggcagctcagtcc

SEQ ID NO: 299600 - DNA, 20 bp, Artificial
  CRISPR gRNA sequence
ggcagctcagtccaggcatt

SEQ ID NO: 299601 - DNA, 20 bp, Artificial
  CRISPR gRNA sequence
gctcagtccaggcatttggc

SEQ ID NO: 299602 - DNA, 20 bp, Artificial
  CRISPR gRNA sequence
tcagtccaggcatttggcca

SEQ ID NO: 299603 - DNA, 20 bp, Artificial
  CRISPR gRNA sequence
cagtccaggcatttggccag

SEQ ID NO: 299604 - DNA, 20 bp, Artificial
  CRISPR gRNA sequence
caggcatttggccagaggca

SEQ ID NO: 299605 - DNA, 20 bp, Artificial
  CRISPR gRNA sequence
aggcatttggccagaggcat

SEQ ID NO: 299606 - DNA, 20 bp, Artificial
  CRISPR gRNA sequence
agaggcatgggctcgattct

SEQ ID NO: 299607 - DNA, 20 bp, Artificial
  CRISPR gRNA sequence
gaggcatgggctcgattctt

SEQ ID NO: 299608 - DNA, 20 bp, Artificial
  CRISPR gRNA sequence
tcgattcttaggtcgctgct

SEQ ID NO: 299609 - DNA, 20 bp, Artificial
  CRISPR gRNA sequence
cgattcttaggtcgctgctg

SEQ ID NO: 299610 - DNA, 20 bp, Artificial
  CRISPR gRNA sequence
taggtcgctgctgaggccct

SEQ ID NO: 299611 - DNA, 20 bp, Artificial
  CRISPR gRNA sequence
cgctgctgaggccctgagcc

SEQ ID NO: 299612 - DNA, 20 bp, Artificial
  CRISPR gRNA sequence
gctgctgaggccctgagcct

SEQ ID NO: 299613 - DNA, 20 bp, Artificial
  CRISPR gRNA sequence
cctgagcctgggactttcta

SEQ ID NO: 299614 - DNA, 20 bp, Artificial
  CRISPR gRNA sequence
ctttctatggcctcctattg

SEQ ID NO: 299615 - DNA, 20 bp, Artificial
  CRISPR gRNA sequence
tggcctcctattgtggattt

SEQ ID NO: 299616 - DNA, 20 bp, Artificial
  CRISPR gRNA sequence
ggcctcctattgtggatttc

SEQ ID NO: 299617 - DNA, 20 bp, Artificial
  CRISPR gRNA sequence
ttgtggatttcaggcttctc

SEQ ID NO: 299618 - DNA, 20 bp, Artificial
  CRISPR gRNA sequence
atttcaggcttctctggcct

SEQ ID NO: 299619 - DNA, 20 bp, Artificial
  CRISPR gRNA sequence
ttcaggcttctctggcctta

SEQ ID NO: 299620 - DNA, 20 bp, Artificial
  CRISPR gRNA sequence
cttctctggccttagagccc

SEQ ID NO: 299621 - DNA, 20 bp, Artificial
  CRISPR gRNA sequence
ttctctggccttagagccct

SEQ ID NO: 299622 - DNA, 20 bp, Artificial
  CRISPR gRNA sequence
tctctggccttagagccctg

SEQ ID NO: 299623 - DNA, 20 bp, Artificial
  CRISPR gRNA sequence
tctggccttagagccctggg

SEQ ID NO: 299624 - DNA, 20 bp, Artificial
  CRISPR gRNA sequence
tggccttagagccctgggga

SEQ ID NO: 299625 - DNA, 20 bp, Artificial
  CRISPR gRNA sequence
ggccttagagccctggggag

SEQ ID NO: 299626 - DNA, 20 bp, Artificial
  CRISPR gRNA sequence
ttagagccctggggagaggc

SEQ ID NO: 299627 - DNA, 20 bp, Artificial
  CRISPR gRNA sequence
gagccctggggagaggctgg

SEQ ID NO: 299628 - DNA, 20 bp, Artificial
  CRISPR gRNA sequence
agccctggggagaggctggc

SEQ ID NO: 299629 - DNA, 20 bp, Artificial
  CRISPR gRNA sequence
gagaggctggcaggtaaata

SEQ ID NO: 299630 - DNA, 20 bp, Artificial
  CRISPR gRNA sequence
gaggctggcaggtaaataaa

SEQ ID NO: 299631 - DNA, 20 bp, Artificial
  CRISPR gRNA sequence
gctggcaggtaaataaagag

SEQ ID NO: 299632 - DNA, 20 bp, Artificial
  CRISPR gRNA sequence
tggcaggtaaataaagagaa

SEQ ID NO: 299633 - DNA, 20 bp, Artificial
  CRISPR gRNA sequence
caggtaaataaagagaagag

SEQ ID NO: 299634 - DNA, 20 bp, Artificial
  CRISPR gRNA sequence
taaataaagagaagagcagc

SEQ ID NO: 299635 - DNA, 20 bp, Artificial
  CRISPR gRNA sequence
ataaagagaagagcagctag

SEQ ID NO: 299636 - DNA, 20 bp, Artificial
  CRISPR gRNA sequence
ccttttgtaaatgactctcc

SEQ ID NO: 299637 - DNA, 20 bp, Artificial
  CRISPR gRNA sequence
cctggctgattgaaaatttg

SEQ ID NO: 299638 - DNA, 20 bp, Artificial
  CRISPR gRNA sequence
tgaaaatttgtggtcatttg

SEQ ID NO: 299639 - DNA, 20 bp, Artificial
  CRISPR gRNA sequence
aaaatttgtggtcatttgta

SEQ ID NO: 299640 - DNA, 20 bp, Artificial
  CRISPR gRNA sequence
tgtggtcatttgtagagctt

SEQ ID NO: 299641 - DNA, 20 bp, Artificial
  CRISPR gRNA sequence
gtggtcatttgtagagcttg

SEQ ID NO: 299642 - DNA, 20 bp, Artificial
  CRISPR gRNA sequence
ttgtagagcttgaggaccct

SEQ ID NO: 299643 - DNA, 20 bp, Artificial
  CRISPR gRNA sequence
tgaggaccctcagcctcccc

SEQ ID NO: 299644 - DNA, 20 bp, Artificial
  CRISPR gRNA sequence
ctcccccagaccacattcct

SEQ ID NO: 299645 - DNA, 20 bp, Artificial
  CRISPR gRNA sequence
agaccacattccttggatta

SEQ ID NO: 299646 - DNA, 20 bp, Artificial
  CRISPR gRNA sequence
gattacagctgtacttccaa

SEQ ID NO: 299647 - DNA, 20 bp, Artificial
  CRISPR gRNA sequence
aacagttattatatgtgtga

SEQ ID NO: 299648 - DNA, 20 bp, Artificial
  CRISPR gRNA sequence
tggttttctgtctaattcta

SEQ ID NO: 299649 - DNA, 20 bp, Artificial
  CRISPR gRNA sequence
tctgtctaattctatggaaa

SEQ ID NO: 299650 - DNA, 20 bp, Artificial
  CRISPR gRNA sequence
gtctaattctatggaaatgg

SEQ ID NO: 299651 - DNA, 20 bp, Artificial
  CRISPR gRNA sequence
taattctatggaaatggaag

SEQ ID NO: 299652 - DNA, 20 bp, Artificial
  CRISPR gRNA sequence
ttctatggaaatggaagaag

SEQ ID NO: 299653 - DNA, 20 bp, Artificial
  CRISPR gRNA sequence
tatggaaatggaagaagaag

SEQ ID NO: 299654 - DNA, 20 bp, Artificial
  CRISPR gRNA sequence
ggaaatggaagaagaagaag

SEQ ID NO: 299655 - DNA, 20 bp, Artificial
  CRISPR gRNA sequence
cctcgcaactcttataaatg

SEQ ID NO: 299656 - DNA, 20 bp, Artificial
  CRISPR gRNA sequence
gcaactcttataaatgtggt

SEQ ID NO: 299657 - DNA, 20 bp, Artificial
  CRISPR gRNA sequence
ctcttataaatgtggtgagt

SEQ ID NO: 299658 - DNA, 20 bp, Artificial
  CRISPR gRNA sequence
gtgagtccttgtcctcccca

SEQ ID NO: 299659 - DNA, 20 bp, Artificial
  CRISPR gRNA sequence
ctttgcacctacttcccaat

SEQ ID NO: 299660 - DNA, 20 bp, Artificial
  CRISPR gRNA sequence
gcacctacttcccaatcggc

SEQ ID NO: 299661 - DNA, 20 bp, Artificial
  CRISPR gRNA sequence
ccaatcggctggctgccttc

SEQ ID NO: 299662 - DNA, 20 bp, Artificial
  CRISPR gRNA sequence
aatcggctggctgccttccg

SEQ ID NO: 299663 - DNA, 20 bp, Artificial
  CRISPR gRNA sequence
ggctgccttccggagcttgt

SEQ ID NO: 299664 - DNA, 20 bp, Artificial
  CRISPR gRNA sequence
ccttccggagcttgttggct

SEQ ID NO: 299665 - DNA, 20 bp, Artificial
  CRISPR gRNA sequence
cggagcttgttggctgagcc

SEQ ID NO: 299666 - DNA, 20 bp, Artificial
  CRISPR gRNA sequence
cttgttggctgagcctagac

SEQ ID NO: 299667 - DNA, 20 bp, Artificial
  CRISPR gRNA sequence
gctgagcctagactggcaaa

SEQ ID NO: 299668 - DNA, 20 bp, Artificial
  CRISPR gRNA sequence
agcctagactggcaaaaagt

SEQ ID NO: 299669 - DNA, 20 bp, Artificial
  CRISPR gRNA sequence
gcctagactggcaaaaagtc

SEQ ID NO: 299670 - DNA, 20 bp, Artificial
  CRISPR gRNA sequence
tagactggcaaaaagtcagg

SEQ ID NO: 299671 - DNA, 20 bp, Artificial
  CRISPR gRNA sequence
gcaaaaagtcaggaagttgt

SEQ ID NO: 299672 - DNA, 20 bp, Artificial
  CRISPR gRNA sequence
caaaaagtcaggaagttgtt

SEQ ID NO: 299673 - DNA, 20 bp, Artificial
  CRISPR gRNA sequence
tcaggaagttgttgggaaaa

SEQ ID NO: 299674 - DNA, 20 bp, Artificial
  CRISPR gRNA sequence
caggaagttgttgggaaaaa

SEQ ID NO: 299675 - DNA, 20 bp, Artificial
  CRISPR gRNA sequence
tgggaaaaaaggttttccct

SEQ ID NO: 299676 - DNA, 20 bp, Artificial
  CRISPR gRNA sequence
ggaaaaaaggttttcccttg

SEQ ID NO: 299677 - DNA, 20 bp, Artificial
  CRISPR gRNA sequence
aggttttcccttggagtttt

SEQ ID NO: 299678 - DNA, 20 bp, Artificial
  CRISPR gRNA sequence
cttggagttttgagcctata

SEQ ID NO: 299679 - DNA, 20 bp, Artificial
  CRISPR gRNA sequence
agttttgagcctatacagac

SEQ ID NO: 299680 - DNA, 20 bp, Artificial
  CRISPR gRNA sequence
tttgagcctatacagactgg

SEQ ID NO: 299681 - DNA, 20 bp, Artificial
  CRISPR gRNA sequence
gagcctatacagactggcag

SEQ ID NO: 299682 - DNA, 20 bp, Artificial
  CRISPR gRNA sequence
cctatacagactggcagtag

SEQ ID NO: 299683 - DNA, 20 bp, Artificial
  CRISPR gRNA sequence
gtagcagataatgctgctct

SEQ ID NO: 299684 - DNA, 20 bp, Artificial
  CRISPR gRNA sequence
aatgctgctcttggacttca

SEQ ID NO: 299685 - DNA, 20 bp, Artificial
  CRISPR gRNA sequence
ctgctcttggacttcaaaga

SEQ ID NO: 299686 - DNA, 20 bp, Artificial
  CRISPR gRNA sequence
tgctcttggacttcaaagaa

SEQ ID NO: 299687 - DNA, 20 bp, Artificial
  CRISPR gRNA sequence
aaggcgacatttctaacctc

SEQ ID NO: 299688 - DNA, 20 bp, Artificial
  CRISPR gRNA sequence
ctggtttacaaatgtacttc

SEQ ID NO: 299689 - DNA, 20 bp, Artificial
  CRISPR gRNA sequence
acaaatgtacttctggtttc

SEQ ID NO: 299690 - DNA, 20 bp, Artificial
  CRISPR gRNA sequence
caaatgtacttctggtttcc

SEQ ID NO: 299691 - DNA, 20 bp, Artificial
  CRISPR gRNA sequence
aaatgtacttctggtttcca

SEQ ID NO: 299692 - DNA, 20 bp, Artificial
  CRISPR gRNA sequence
ctttatctacctcacttcat

SEQ ID NO: 299693 - DNA, 20 bp, Artificial
  CRISPR gRNA sequence
tttatctacctcacttcatg

SEQ ID NO: 299694 - DNA, 20 bp, Artificial
  CRISPR gRNA sequence
gttactgtgacatatacata

SEQ ID NO: 299695 - DNA, 20 bp, Artificial
  CRISPR gRNA sequence
gacatatacataaagtaaaa

SEQ ID NO: 299696 - DNA, 20 bp, Artificial
  CRISPR gRNA sequence
gaaaccactcctaaatgtta

SEQ ID NO: 299697 - DNA, 20 bp, Artificial
  CRISPR gRNA sequence
ctcctaaatgttaaagattg

SEQ ID NO: 299698 - DNA, 20 bp, Artificial
  CRISPR gRNA sequence
aatgttaaagattgtggacc

SEQ ID NO: 299699 - DNA, 20 bp, Artificial
  CRISPR gRNA sequence
gttaaagattgtggacctgg

SEQ ID NO: 299700 - DNA, 20 bp, Artificial
  CRISPR gRNA sequence
ttgtggacctggtggtgttt

SEQ ID NO: 299701 - DNA, 20 bp, Artificial
  CRISPR gRNA sequence
tggacctggtggtgtttaag

SEQ ID NO: 299702 - DNA, 20 bp, Artificial
  CRISPR gRNA sequence
ggacctggtggtgtttaagc

SEQ ID NO: 299703 - DNA, 20 bp, Artificial
  CRISPR gRNA sequence
gacctggtggtgtttaagca

SEQ ID NO: 299704 - DNA, 20 bp, Artificial
  CRISPR gRNA sequence
gatatttgctaaatgaccac

SEQ ID NO: 299705 - DNA, 20 bp, Artificial
  CRISPR gRNA sequence
tgctaaatgaccacaagaat

SEQ ID NO: 299706 - DNA, 20 bp, Artificial
  CRISPR gRNA sequence
ttctcgtctctaaaaaaatc

SEQ ID NO: 299707 - DNA, 20 bp, Artificial
  CRISPR gRNA sequence
tctcgtctctaaaaaaatct

SEQ ID NO: 299708 - DNA, 20 bp, Artificial
  CRISPR gRNA sequence
atctaggtttcttatgaaat

SEQ ID NO: 299709 - DNA, 20 bp, Artificial
  CRISPR gRNA sequence
aggtttcttatgaaataagt

SEQ ID NO: 299710 - DNA, 20 bp, Artificial
  CRISPR gRNA sequence
attaactttaactaatttct

SEQ ID NO: 299711 - DNA, 20 bp, Artificial
  CRISPR gRNA sequence
taatctataactccactaat

SEQ ID NO: 299712 - DNA, 20 bp, Artificial
  CRISPR gRNA sequence
aatgattacacaaatatttt

SEQ ID NO: 299713 - DNA, 20 bp, Artificial
  CRISPR gRNA sequence
tatttttggtgcctatcttt

SEQ ID NO: 299714 - DNA, 20 bp, Artificial
  CRISPR gRNA sequence
tctatgttgttttccataat

SEQ ID NO: 299715 - DNA, 20 bp, Artificial
  CRISPR gRNA sequence
ctatgttgttttccataatt

SEQ ID NO: 299716 - DNA, 20 bp, Artificial
  CRISPR gRNA sequence
tccataattaggattatcat

SEQ ID NO: 299717 - DNA, 20 bp, Artificial
  CRISPR gRNA sequence
ccataattaggattatcata

SEQ ID NO: 299718 - DNA, 20 bp, Artificial
  CRISPR gRNA sequence
cataattaggattatcataa

SEQ ID NO: 299719 - DNA, 20 bp, Artificial
  CRISPR gRNA sequence
aagggttatttttcacaatt

SEQ ID NO: 299720 - DNA, 20 bp, Artificial
  CRISPR gRNA sequence
taattttgttatactaaatg

SEQ ID NO: 299721 - DNA, 20 bp, Artificial
  CRISPR gRNA sequence
tttgttatactaaatgtagc
